United States Patent 11,640,849 (METHODS FOR HISTOLOGICAL DIAGNOSIS AND TREATMENT OF DISEASES) - sequence listing, part 67

SEQ ID NO: 2553603 - protein, 23 aa, Entamoeba dispar
HFDSPSIFYICFSYDCKNNDSIC

SEQ ID NO: 2553604 - protein, 23 aa, Entamoeba dispar
HFKGNKKNGGFIIDFEGKMYCKH

SEQ ID NO: 2553605 - protein, 25 aa, Entamoeba dispar
HFTGYACGYYSYKWAESIDADAFEY

SEQ ID NO: 2553606 - protein, 19 aa, Entamoeba dispar
HGNALQVGRKEVYDTTYLC

SEQ ID NO: 2553607 - protein, 19 aa, Entamoeba dispar
HGPAGVSMGYTFPLSKKFF

SEQ ID NO: 2553608 - protein, 19 aa, Entamoeba dispar
HHILFKLNLQFQILNELAD

SEQ ID NO: 2553609 - protein, 19 aa, Entamoeba dispar
HIHRDEFRLLPSEDPVVML

SEQ ID NO: 2553610 - protein, 17 aa, Entamoeba dispar
HIIEVLKEKLLRVRQIK

SEQ ID NO: 2553611 - protein, 20 aa, Entamoeba dispar
HIKQKFAGIEAEISMKKIQK

SEQ ID NO: 2553612 - protein, 20 aa, Entamoeba dispar
HIKTEGVPIEYTWKEVNTFL

SEQ ID NO: 2553613 - protein, 22 aa, Entamoeba dispar
HKDKCVVIIGCTTQYFRKVWVD

SEQ ID NO: 2553614 - protein, 23 aa, Entamoeba dispar
HKKGQLLCSSFLIRYFDNLIRKS

SEQ ID NO: 2553615 - protein, 22 aa, Entamoeba dispar
HKRIEIYASIIGKEIDFMKGTV

SEQ ID NO: 2553616 - protein, 18 aa, Entamoeba dispar
HKYCQLTFDNVLTLINAN

SEQ ID NO: 2553617 - protein, 27 aa, Entamoeba dispar
HLITWKDGKKFFPLGLYFDEIIDSDLE

SEQ ID NO: 2553618 - protein, 23 aa, Entamoeba dispar
HLMCNKKLGRYCIGIIDQDVECN

SEQ ID NO: 2553619 - protein, 17 aa, Entamoeba dispar
HLSPVILKAQNKLAENQ

SEQ ID NO: 2553620 - protein, 22 aa, Entamoeba dispar
HNASDGLPEWLYYFKDVNNKWA

SEQ ID NO: 2553621 - protein, 25 aa, Entamoeba dispar
HNELKRRLPGFTVLPSIGNHDYFET

SEQ ID NO: 2553622 - protein, 35 aa, Entamoeba dispar
HNKQYYECATTFKGFRPCAPGTWCQGEQEGPYQYN

SEQ ID NO: 2553623 - protein, 22 aa, Entamoeba dispar
HPGCVNTSLWQFFPVWLQYLCW

SEQ ID NO: 2553624 - protein, 17 aa, Entamoeba dispar
HQIQIPKGKWYDYFNNS

SEQ ID NO: 2553625 - protein, 17 aa, Entamoeba dispar
HQTCGGMVRYFSYHSIE

SEQ ID NO: 2553626 - protein, 18 aa, Entamoeba dispar
HRAAIAFLAAYTGPITIY

SEQ ID NO: 2553627 - protein, 17 aa, Entamoeba dispar
HRAAIAFLASYTGPITI

SEQ ID NO: 2553628 - protein, 17 aa, Entamoeba dispar
HRKSKGSSRSSSSSRSG

SEQ ID NO: 2553629 - protein, 18 aa, Entamoeba dispar
HRVTVFPVALILAPTREL

SEQ ID NO: 2553630 - protein, 32 aa, Entamoeba dispar
HSLVSLTPILPCFICDGGLLILSRIPLKDRDQ

SEQ ID NO: 2553631 - protein, 23 aa, Entamoeba dispar
HSMGGLMFYKFLDYVGKEFADKY

SEQ ID NO: 2553632 - protein, 25 aa, Entamoeba dispar
HSMGGLMFYKFLDYVGKEFADKYID

SEQ ID NO: 2553633 - protein, 24 aa, Entamoeba dispar
HSMGGLMFYKFLDYVGKEFSDKYI

SEQ ID NO: 2553634 - protein, 26 aa, Entamoeba dispar
HSNTLLDWIRIVLAVRASKNGKEFHD

SEQ ID NO: 2553635 - protein, 17 aa, Entamoeba dispar
HSPCIGNVLVAPISLKD

SEQ ID NO: 2553636 - protein, 27 aa, Entamoeba dispar
HSQQIYPCISISFGLQIYSMNETIEIT

SEQ ID NO: 2553637 - protein, 24 aa, Entamoeba dispar
HVPKKYRIGRKWQFNKKKDSVKEL

SEQ ID NO: 2553638 - protein, 23 aa, Entamoeba dispar
HYHASWALSNWFFGRTQDWIQTH

SEQ ID NO: 2553639 - protein, 24 aa, Entamoeba dispar
IAETCTRHPVIIIPGIMASMLNAK

SEQ ID NO: 2553640 - protein, 23 aa, Entamoeba dispar
IAILKTEMDSIIFSMELYHKIQE

SEQ ID NO: 2553641 - protein, 17 aa, Entamoeba dispar
IALCGDASVGKTGIFKR

SEQ ID NO: 2553642 - protein, 27 aa, Entamoeba dispar
IARSIRGHLGLLYCTKGSYYDHQIGGD

SEQ ID NO: 2553643 - protein, 19 aa, Entamoeba dispar
IAVSAFAAPKCAQTNVANV

SEQ ID NO: 2553644 - protein, 23 aa, Entamoeba dispar
ICELKKCRILFSRKYNYLQAHKL

SEQ ID NO: 2553645 - protein, 18 aa, Entamoeba dispar
ICLCAFAEEDLFNPFIHG

SEQ ID NO: 2553646 - protein, 19 aa, Entamoeba dispar
ICNILLTIVILCYDSSQKE

SEQ ID NO: 2553647 - protein, 21 aa, Entamoeba dispar
ICSYAKLSLNQKVMQRISQSF

SEQ ID NO: 2553648 - protein, 20 aa, Entamoeba dispar
ICTQCPVGSHVGSDGKCSCG

SEQ ID NO: 2553649 - protein, 24 aa, Entamoeba dispar
IDHIPRLDAPIIDNAYIKDNVQFD

SEQ ID NO: 2553650 - protein, 23 aa, Entamoeba dispar
IDKEIFSVLSPEFRKLLQEMSDF

SEQ ID NO: 2553651 - protein, 19 aa, Entamoeba dispar
IDNACAMGASYGGYMMNWI

SEQ ID NO: 2553652 - protein, 25 aa, Entamoeba dispar
IDNKEVLDSIDWRSEGKVTPVKNQR

SEQ ID NO: 2553653 - protein, 22 aa, Entamoeba dispar
IDNRAKYALYQTILRRKGIQKT

SEQ ID NO: 2553654 - protein, 23 aa, Entamoeba dispar
IDPNWPVSIFAKCFHDLIKKFKK

SEQ ID NO: 2553655 - protein, 23 aa, Entamoeba dispar
IDRIKRKVVRKVLQLIQDLSENN

SEQ ID NO: 2553656 - protein, 22 aa, Entamoeba dispar
IDRLRPQQCIIAIKSSSLKKYP

SEQ ID NO: 2553657 - protein, 28 aa, Entamoeba dispar
IDSKEGCLCKFLWNDTKGVHYNKWDCQL

SEQ ID NO: 2553658 - protein, 24 aa, Entamoeba dispar
IDYLQKRITAVSKKYSTLVDNLNT

SEQ ID NO: 2553659 - protein, 17 aa, Entamoeba dispar
IDYPTLEYIKVRINYAI

SEQ ID NO: 2553660 - protein, 18 aa, Entamoeba dispar
IECEKGYYLNSNKECQLS

SEQ ID NO: 2553661 - protein, 28 aa, Entamoeba dispar
IEDYKGFSWIRIVLKSGSKTPTLNIYDS

SEQ ID NO: 2553662 - protein, 17 aa, Entamoeba dispar
IEGLPWPPVSGLASVLT

SEQ ID NO: 2553663 - protein, 22 aa, Entamoeba dispar
IEGYPTLALFRKGRSKKVYGGE

SEQ ID NO: 2553664 - protein, 17 aa, Entamoeba dispar
IEIIKRDILLTLGTKKR

SEQ ID NO: 2553665 - protein, 20 aa, Entamoeba dispar
IEIINEINIHCQFKLTLSDK

SEQ ID NO: 2553666 - protein, 17 aa, Entamoeba dispar
IEIKQKYIYGSYKKLTN

SEQ ID NO: 2553667 - protein, 21 aa, Entamoeba dispar
IEIPSSIKIICLNAFSNCNKL

SEQ ID NO: 2553668 - protein, 25 aa, Entamoeba dispar
IEKEWRVQRGNGFVKELNEMEYIDN

SEQ ID NO: 2553669 - protein, 27 aa, Entamoeba dispar
IELRYHCWKVPIIGDWCSTKRSNIFTI

SEQ ID NO: 2553670 - protein, 20 aa, Entamoeba dispar
IEMYKKALLSEEVKIPAENR

SEQ ID NO: 2553671 - protein, 22 aa, Entamoeba dispar
IEPMFEFLRIMRDSLLSRKEKL

SEQ ID NO: 2553672 - protein, 19 aa, Entamoeba dispar
IERKCIIKVNGYFVNIFNN

SEQ ID NO: 2553673 - protein, 20 aa, Entamoeba dispar
IERKCIIKVNGYFVNIFNNG

SEQ ID NO: 2553674 - protein, 17 aa, Entamoeba dispar
IEYILPNGIELVIEKGL

SEQ ID NO: 2553675 - protein, 22 aa, Entamoeba dispar
IFAHLFDGIAFDYIMIKTINNI

SEQ ID NO: 2553676 - protein, 25 aa, Entamoeba dispar
IFDGKDFFDSWAIFNTAGLNIELSK

SEQ ID NO: 2553677 - protein, 17 aa, Entamoeba dispar
IFFFICLTNGCQCVIYS

SEQ ID NO: 2553678 - protein, 17 aa, Entamoeba dispar
IFIFCILIGYCFSSEIK

SEQ ID NO: 2553679 - protein, 23 aa, Entamoeba dispar
IFRPCVTCGNIGGQLQTYKVRTQ

SEQ ID NO: 2553680 - protein, 22 aa, Entamoeba dispar
IGAGCAGACCAMELSKYKNLKI

SEQ ID NO: 2553681 - protein, 23 aa, Entamoeba dispar
IGCTTQYFRKVWVDPLRKRLPNT

SEQ ID NO: 2553682 - protein, 25 aa, Entamoeba dispar
IGELKKAKFPGGIKVDDKTIKRLMR

SEQ ID NO: 2553683 - protein, 17 aa, Entamoeba dispar
IGGITYLISFKSSEKER

SEQ ID NO: 2553684 - protein, 22 aa, Entamoeba dispar
IGKEIFGFSSIDSIHVPDNYEK

SEQ ID NO: 2553685 - protein, 22 aa, Entamoeba dispar
IGKEIFGFSSINSIHVPDNYEK

SEQ ID NO: 2553686 - protein, 21 aa, Entamoeba dispar
IGSIIDFKIGWIMTPSSSYST

SEQ ID NO: 2553687 - protein, 17 aa, Entamoeba dispar
IGTALSGYVQYNSSNWK

SEQ ID NO: 2553688 - protein, 21 aa, Entamoeba dispar
IGVLDGYFPVRVIKRTIENIC

SEQ ID NO: 2553689 - protein, 18 aa, Entamoeba dispar
IHGNLCLMRASSFFTNKF

SEQ ID NO: 2553690 - protein, 17 aa, Entamoeba dispar
IHIPTRLYIASTKESSS

SEQ ID NO: 2553691 - protein, 25 aa, Entamoeba dispar
IHSECYIEESFMFFSLDNTNYSRCG

SEQ ID NO: 2553692 - protein, 19 aa, Entamoeba dispar
IHSFKKKKVAMIYTNDPSG

SEQ ID NO: 2553693 - protein, 17 aa, Entamoeba dispar
IHYRFSVVQDIEGLTNL

SEQ ID NO: 2553694 - protein, 18 aa, Entamoeba dispar
IICSTQAQSCEKRKPILI

SEQ ID NO: 2553695 - protein, 21 aa, Entamoeba dispar
IIEMRGQIAVLEMKKSRIKSV

SEQ ID NO: 2553696 - protein, 18 aa, Entamoeba dispar
IIGGVYFDLYPRKGKRSG

SEQ ID NO: 2553697 - protein, 18 aa, Entamoeba dispar
IIKEINLAHGKCYNGIVD

SEQ ID NO: 2553698 - protein, 18 aa, Entamoeba dispar
IIKKRYRKQIKQLYSDMT

SEQ ID NO: 2553699 - protein, 23 aa, Entamoeba dispar
IIKNGKAPSHFPLYVTLLTNQPI

SEQ ID NO: 2553700 - protein, 18 aa, Entamoeba dispar
IIKVNGYFVNIFNNGQIH

SEQ ID NO: 2553701 - protein, 24 aa, Entamoeba dispar
IILKLKICSISKVEYEFEMYKILF

SEQ ID NO: 2553702 - protein, 24 aa, Entamoeba dispar
IIQLKEIISLALIKNKELKALSQE

SEQ ID NO: 2553703 - protein, 30 aa, Entamoeba dispar
IIREFGKKYMGFKCPHAQFTQARSAISFGS

SEQ ID NO: 2553704 - protein, 18 aa, Entamoeba dispar
IIYSCQGSFVSRCSDQDL

SEQ ID NO: 2553705 - protein, 21 aa, Entamoeba dispar
IKAIEMNAGIDLSNALQREKK

SEQ ID NO: 2553706 - protein, 20 aa, Entamoeba dispar
IKALDLEPAKARLEAKKSNS

SEQ ID NO: 2553707 - protein, 26 aa, Entamoeba dispar
IKDQGSCGTCFTFGAVAAIESRLLIS

SEQ ID NO: 2553708 - protein, 22 aa, Entamoeba dispar
IKDRKLLMCKMRTIRKNLRKIA

SEQ ID NO: 2553709 - protein, 28 aa, Entamoeba dispar
IKEDAAIVICPFSFIKCQEYINSVMKGI

SEQ ID NO: 2553710 - protein, 19 aa, Entamoeba dispar
IKERKRKIINTKLKASKII

SEQ ID NO: 2553711 - protein, 23 aa, Entamoeba dispar
IKESKKRLKIRKEMMKKKREEIL

SEQ ID NO: 2553712 - protein, 22 aa, Entamoeba dispar
IKESRLLCTPDYVAPESLRDYY

SEQ ID NO: 2553713 - protein, 17 aa, Entamoeba dispar
IKGKVSPKRAFRQIKKI

SEQ ID NO: 2553714 - protein, 18 aa, Entamoeba dispar
IKGMSKKAQKKFKETASK

SEQ ID NO: 2553715 - protein, 22 aa, Entamoeba dispar
IKGQEPRTAVPHCASVSNGACT

SEQ ID NO: 2553716 - protein, 17 aa, Entamoeba dispar
IKHMYFEISALDDKNEL

SEQ ID NO: 2553717 - protein, 21 aa, Entamoeba dispar
IKIEGLSGFMEVWDIPGSILM

SEQ ID NO: 2553718 - protein, 18 aa, Entamoeba dispar
IKIGTSFISNEYSYSHAL

SEQ ID NO: 2553719 - protein, 19 aa, Entamoeba dispar
IKIWQSWYPAEWGKCEENS

SEQ ID NO: 2553720 - protein, 21 aa, Entamoeba dispar
IKKAIYCPTTSVLDPYEFTIA

SEQ ID NO: 2553721 - protein, 17 aa, Entamoeba dispar
IKKAYRALSLKYHPDKP

SEQ ID NO: 2553722 - protein, 17 aa, Entamoeba dispar
IKKELKKEIKINKERTK

SEQ ID NO: 2553723 - protein, 22 aa, Entamoeba dispar
IKKLKKAGISKKALRKVQKKMS

SEQ ID NO: 2553724 - protein, 20 aa, Entamoeba dispar
IKMVCRSAIDGLIRKLEHQY

SEQ ID NO: 2553725 - protein, 18 aa, Entamoeba dispar
IKNLLKMRDTIVCQISRK

SEQ ID NO: 2553726 - protein, 24 aa, Entamoeba dispar
IKQIKNLRIMLAARVGVYNKSKIV

SEQ ID NO: 2553727 - protein, 17 aa, Entamoeba dispar
IKQTPIIVNIDMPSTMP

SEQ ID NO: 2553728 - protein, 18 aa, Entamoeba dispar
IKRMKVIVNIMGIKQASF

SEQ ID NO: 2553729 - protein, 22 aa, Entamoeba dispar
IKRTIENICYYRQFEVTVHSKN

SEQ ID NO: 2553730 - protein, 22 aa, Entamoeba dispar
IKSDGIGKGFALWLTTKPIVSG

SEQ ID NO: 2553731 - protein, 18 aa, Entamoeba dispar
IKSTLSYPLHGWGVTNDL

SEQ ID NO: 2553732 - protein, 17 aa, Entamoeba dispar
IKTLLRVDGEITSKGIL

SEQ ID NO: 2553733 - protein, 31 aa, Entamoeba dispar
IKTLPRREAIRLARRFDLRHRFDFAIDQEEF

SEQ ID NO: 2553734 - protein, 25 aa, Entamoeba dispar
IKTNSAGISAEFNPNNKFGASLGGK

SEQ ID NO: 2553735 - protein, 22 aa, Entamoeba dispar
IKYEEFKTLLTFNETIINVIAG

SEQ ID NO: 2553736 - protein, 21 aa, Entamoeba dispar
ILEKYPYFIVNEIKNTNNEIT

SEQ ID NO: 2553737 - protein, 17 aa, Entamoeba dispar
ILESRLSEIEDLERHVL

SEQ ID NO: 2553738 - protein, 18 aa, Entamoeba dispar
ILFMCLSIGMSSSNNPKN

SEQ ID NO: 2553739 - protein, 18 aa, Entamoeba dispar
ILHLNCPVVPTLNHAIIV

SEQ ID NO: 2553740 - protein, 19 aa, Entamoeba dispar
ILHLNCPVVPTLNHAIIVV

SEQ ID NO: 2553741 - protein, 27 aa, Entamoeba dispar
ILIQISFTYCYAEFCNIPTFSLKPLNN

SEQ ID NO: 2553742 - protein, 17 aa, Entamoeba dispar
ILIVLSYYIAAEYNVDN

SEQ ID NO: 2553743 - protein, 24 aa, Entamoeba dispar
ILKKLLHHYGPFLVSVKVSGTGFS

SEQ ID NO: 2553744 - protein, 26 aa, Entamoeba dispar
ILLPESFDSIIIFPYVCATLLSTELL

SEQ ID NO: 2553745 - protein, 18 aa, Entamoeba dispar
ILPIKKLILENGFTSLIE

SEQ ID NO: 2553746 - protein, 19 aa, Entamoeba dispar
ILQARKNYNSWVIEQQQKM

SEQ ID NO: 2553747 - protein, 18 aa, Entamoeba dispar
ILRKEARTLHKVHKYHLK

SEQ ID NO: 2553748 - protein, 18 aa, Entamoeba dispar
ILRTLPLVDQQHIIDELG

SEQ ID NO: 2553749 - protein, 17 aa, Entamoeba dispar
IMSSSAKDFINFLNEAS

SEQ ID NO: 2553750 - protein, 25 aa, Entamoeba dispar
INDLKYYLEGCVFKDILKNPPQPSF

SEQ ID NO: 2553751 - protein, 26 aa, Entamoeba dispar
INEDIKMILKRSGMNAIIIVDNEISK

SEQ ID NO: 2553752 - protein, 24 aa, Entamoeba dispar
ININTSCLYDFLVDIQKIIISTGD

SEQ ID NO: 2553753 - protein, 19 aa, Entamoeba dispar
INIPSSVIFIGKAAFSHCT

SEQ ID NO: 2553754 - protein, 20 aa, Entamoeba dispar
INIQGGFTLSFDAEVTKEIT

SEQ ID NO: 2553755 - protein, 23 aa, Entamoeba dispar
INLGYKIRLAIYKKENEKPFNLF

SEQ ID NO: 2553756 - protein, 21 aa, Entamoeba dispar
INSHVSKGFGERMRIKGSNDI

SEQ ID NO: 2553757 - protein, 23 aa, Entamoeba dispar
INTIFKTICSYSNPIVSNLNADI

SEQ ID NO: 2553758 - protein, 17 aa, Entamoeba dispar
IPDEKYTIFAMNAQRSK

SEQ ID NO: 2553759 - protein, 22 aa, Entamoeba dispar
IPECMKCGDGFYRSNKTGEYKC

SEQ ID NO: 2553760 - protein, 21 aa, Entamoeba dispar
IPGYMFGGSLNEAFFDHSNKC

SEQ ID NO: 2553761 - protein, 21 aa, Entamoeba dispar
IPINLKFSSNYGIWYLISSYE

SEQ ID NO: 2553762 - protein, 17 aa, Entamoeba dispar
IPKYCIYSSGFETAEYG

SEQ ID NO: 2553763 - protein, 21 aa, Entamoeba dispar
IPNHYFRKGNKYPLKNYEVWR

SEQ ID NO: 2553764 - protein, 23 aa, Entamoeba dispar
IPPLDIPDGIEWLASGNYKIKMV

SEQ ID NO: 2553765 - protein, 20 aa, Entamoeba dispar
IPQEHIIFISNARRLIHDDS

SEQ ID NO: 2553766 - protein, 17 aa, Entamoeba dispar
IPSSLSYCGTYRKRNPH

SEQ ID NO: 2553767 - protein, 24 aa, Entamoeba dispar
IPYIKEIFESSGYLKKMELGKKEY

SEQ ID NO: 2553768 - protein, 19 aa, Entamoeba dispar
IQIKCAITATSKEEMLQCT

SEQ ID NO: 2553769 - protein, 18 aa, Entamoeba dispar
IQLEGWVNAMAKAFNGEK

SEQ ID NO: 2553770 - protein, 17 aa, Entamoeba dispar
IQLKEKFSIEGKKLRKE

SEQ ID NO: 2553771 - protein, 17 aa, Entamoeba dispar
IQLMPPVPCTGTRAVTF

SEQ ID NO: 2553772 - protein, 17 aa, Entamoeba dispar
IQMGSTWCPTIYINGER

SEQ ID NO: 2553773 - protein, 26 aa, Entamoeba dispar
IQRNQIRPSLQRHFAELSLNTKKFDT

SEQ ID NO: 2553774 - protein, 21 aa, Entamoeba dispar
IQSVGGKVWLQLSPNECLRQL

SEQ ID NO: 2553775 - protein, 17 aa, Entamoeba dispar
IQYTKKYSFVSIPKPLP

SEQ ID NO: 2553776 - protein, 26 aa, Entamoeba dispar
IRCREGIKWSEKVLRRIAIEMREELI

SEQ ID NO: 2553777 - protein, 25 aa, Entamoeba dispar
IREFGKKYLGLKCPHAQFTEARSAI

SEQ ID NO: 2553778 - protein, 30 aa, Entamoeba dispar
IREFGKKYMGLKCPHAQFTLAKDYLVEGYL

SEQ ID NO: 2553779 - protein, 25 aa, Entamoeba dispar
IRFLIPSEHIIKINSFDSYLYERFP

SEQ ID NO: 2553780 - protein, 18 aa, Entamoeba dispar
IRGFPTVLVFNGEESKKF

SEQ ID NO: 2553781 - protein, 17 aa, Entamoeba dispar
IRKELFIQYNKLCSEGK

SEQ ID NO: 2553782 - protein, 20 aa, Entamoeba dispar
IRKLEHQYLIIVRSRNEAKK

SEQ ID NO: 2553783 - protein, 22 aa, Entamoeba dispar
IRKYDVGNGLGYMKEFKNYHFQ

SEQ ID NO: 2553784 - protein, 22 aa, Entamoeba dispar
IRLPDKYYGMFLGYAMDAYGLN

SEQ ID NO: 2553785 - protein, 19 aa, Entamoeba dispar
IRMEMRRGKEKGEENETSQ

SEQ ID NO: 2553786 - protein, 29 aa, Entamoeba dispar
IRMIGKEMKRECYVHSGMMFKKKGERLIS

SEQ ID NO: 2553787 - protein, 18 aa, Entamoeba dispar
IRNAQILMNQNWAKLLKQ

SEQ ID NO: 2553788 - protein, 30 aa, Entamoeba dispar
IRSYRLPFQIKEGWGMTRINQSLGISDGSD

SEQ ID NO: 2553789 - protein, 18 aa, Entamoeba dispar
ISDLKKRMTEIINEIKDT

SEQ ID NO: 2553790 - protein, 17 aa, Entamoeba dispar
ISFCVGEYCKEERGDDV

SEQ ID NO: 2553791 - protein, 24 aa, Entamoeba dispar
ISICSAQYLRHCMYFDEECKRISS

SEQ ID NO: 2553792 - protein, 17 aa, Entamoeba dispar
ISITWENGESLTINYKI

SEQ ID NO: 2553793 - protein, 17 aa, Entamoeba dispar
ISKFYKYLDWINLMTYD

SEQ ID NO: 2553794 - protein, 17 aa, Entamoeba dispar
ISLPVVIKEHLYFISPI

SEQ ID NO: 2553795 - protein, 26 aa, Entamoeba dispar
ISQVSMKLRIKFMINAAKGISYLHSN

SEQ ID NO: 2553796 - protein, 28 aa, Entamoeba dispar
ISRIDYPLKVCAMINCAKRELLNTNCDF

SEQ ID NO: 2553797 - protein, 18 aa, Entamoeba dispar
ISSLPSFILQRPGYQKRF

SEQ ID NO: 2553798 - protein, 18 aa, Entamoeba dispar
ISSSTVFNLLNTSKQLTI

SEQ ID NO: 2553799 - protein, 18 aa, Entamoeba dispar
ISSVPLLNLFSLGELYTK

SEQ ID NO: 2553800 - protein, 28 aa, Entamoeba dispar
ISTGSTFCKWCKHFYKKKVRSSVKIRST

SEQ ID NO: 2553801 - protein, 25 aa, Entamoeba dispar
ITFPFPLKISHHYTVLFQQYTMNHP

SEQ ID NO: 2553802 - protein, 26 aa, Entamoeba dispar
ITGKIDLSFSAPMKIVGNYMHLSTQI

SEQ ID NO: 2553803 - protein, 18 aa, Entamoeba dispar
ITQEFPLSIISLLKRKNE

SEQ ID NO: 2553804 - protein, 25 aa, Entamoeba dispar
ITQFKDVDGFFGYYPVDEPLITFID

SEQ ID NO: 2553805 - protein, 17 aa, Entamoeba dispar
ITQKGTAGSFVFTTTGI

SEQ ID NO: 2553806 - protein, 25 aa, Entamoeba dispar
ITSRDSFEIVQDWITDVCSYCPQGV

SEQ ID NO: 2553807 - protein, 17 aa, Entamoeba dispar
ITYPNQWLKYESSNQIT

SEQ ID NO: 2553808 - protein, 19 aa, Entamoeba dispar
ITYYQNFIKPFPHYHYCIL

SEQ ID NO: 2553809 - protein, 19 aa, Entamoeba dispar
IVANCPPRVIVEADVMSKC

SEQ ID NO: 2553810 - protein, 26 aa, Entamoeba dispar
IVETPSKRFGIKFVKDKTVEFELPEP

SEQ ID NO: 2553811 - protein, 22 aa, Entamoeba dispar
IVISALAAPRCTPTTVTNIVSE

SEQ ID NO: 2553812 - protein, 18 aa, Entamoeba dispar
IVIVRSFMPPTDYILLKG

SEQ ID NO: 2553813 - protein, 24 aa, Entamoeba dispar
IVKQAKWYGLHSFTYLRMTRALLD

SEQ ID NO: 2553814 - protein, 19 aa, Entamoeba dispar
IVLIFPENKTLISIKDGIQ

SEQ ID NO: 2553815 - protein, 24 aa, Entamoeba dispar
IVNKRWGDPYVEGNAIHYRFSVVQ

SEQ ID NO: 2553816 - protein, 19 aa, Entamoeba dispar
IVPTWPLKYFSNAFDSLIK

SEQ ID NO: 2553817 - protein, 27 aa, Entamoeba dispar
IVSIKEPLFRICGLAIHLDTERKYIID

SEQ ID NO: 2553818 - protein, 18 aa, Entamoeba dispar
IVSSSMRYGENVLALNPA

SEQ ID NO: 2553819 - protein, 20 aa, Entamoeba dispar
IVTEMLGYIRGCYNTQQYFK

SEQ ID NO: 2553820 - protein, 24 aa, Entamoeba dispar
IWANKILFLDMMFPQSVDKIIFMD

SEQ ID NO: 2553821 - protein, 17 aa, Entamoeba dispar
IWNREWINQFYGEDIAR

SEQ ID NO: 2553822 - protein, 18 aa, Entamoeba dispar
IYDPRTGKMRILNTLQEY

SEQ ID NO: 2553823 - protein, 19 aa, Entamoeba dispar
IYGKEGPVWKKIKEDAFWD

SEQ ID NO: 2553824 - protein, 18 aa, Entamoeba dispar
IYHGGIEPKGVIQSTDPK

SEQ ID NO: 2553825 - protein, 22 aa, Entamoeba dispar
IYIPPIRFIPNPYYYYRRPYYY

SEQ ID NO: 2553826 - protein, 17 aa, Entamoeba dispar
IYKVFHEEFSIDLKDYI

SEQ ID NO: 2553827 - protein, 27 aa, Entamoeba dispar
IYLGKLLYRLGYKGKEIYDLFIKAGDM

SEQ ID NO: 2553828 - protein, 18 aa, Entamoeba dispar
IYNCFGKCELNFTSASRY

SEQ ID NO: 2553829 - protein, 26 aa, Entamoeba dispar
IYRKKEPYQRIEFSLTIEQSNEGTTL

SEQ ID NO: 2553830 - protein, 17 aa, Entamoeba dispar
IYSAKHCTSCNKRCTVS

SEQ ID NO: 2553831 - protein, 22 aa, Entamoeba dispar
IYSNCIWDLFNIKTNERICILC

SEQ ID NO: 2553832 - protein, 18 aa, Entamoeba dispar
KAAAIRRMEKRKAAIKKQ

SEQ ID NO: 2553833 - protein, 23 aa, Entamoeba dispar
KAAKKRVKKSTKKVVRPSQKTNL

SEQ ID NO: 2553834 - protein, 19 aa, Entamoeba dispar
KAHGSSKVQLRHKIHKAQA

SEQ ID NO: 2553835 - protein, 18 aa, Entamoeba dispar
KAIAKRMKVLINRLRVKV

SEQ ID NO: 2553836 - protein, 20 aa, Entamoeba dispar
KAIRIHQLRIGMMHKKLRMI

SEQ ID NO: 2553837 - protein, 25 aa, Entamoeba dispar
KAIRKNWGGWPFEDLMKGMDYLKTN

SEQ ID NO: 2553838 - protein, 21 aa, Entamoeba dispar
KAIRVLGFKSKYNWLEDYVDI

SEQ ID NO: 2553839 - protein, 24 aa, Entamoeba dispar
KAKGMASKFKKLGKVTLKGASSVF

SEQ ID NO: 2553840 - protein, 23 aa, Entamoeba dispar
KALKGEKIILKRFGKEMKGKRCS

SEQ ID NO: 2553841 - protein, 23 aa, Entamoeba dispar
KAMKGLYKELSFIRKEGKRVQLK

SEQ ID NO: 2553842 - protein, 17 aa, Entamoeba dispar
KAMKYAKVFAMLNQVEK

SEQ ID NO: 2553843 - protein, 24 aa, Entamoeba dispar
KAQEYRKPFGSKRGRKGGFNRRGA

SEQ ID NO: 2553844 - protein, 18 aa, Entamoeba dispar
KAVEIAEDMAERKAEKLF

SEQ ID NO: 2553845 - protein, 18 aa, Entamoeba dispar
KAVNNLRKAETLKEKSIN

SEQ ID NO: 2553846 - protein, 32 aa, Entamoeba dispar
KCEKYEHCSMCSKSECFKCEKGYGLNEEGKCT

SEQ ID NO: 2553847 - protein, 30 aa, Entamoeba dispar
KCMIEECLEFEGCLECTRRECTKCNKGYEL

SEQ ID NO: 2553848 - protein, 20 aa, Entamoeba dispar
KDAREITGKLAIEEMEGCGT

SEQ ID NO: 2553849 - protein, 19 aa, Entamoeba dispar
KDDCAEFLQYFQVVVDCDY

SEQ ID NO: 2553850 - protein, 22 aa, Entamoeba dispar
KDFNFTISYSMMGSKDKVAYMV

SEQ ID NO: 2553851 - protein, 20 aa, Entamoeba dispar
KDGESINKFIINNPVNNKRC

SEQ ID NO: 2553852 - protein, 19 aa, Entamoeba dispar
KDGIDLVSPGYDWRYADRS

SEQ ID NO: 2553853 - protein, 19 aa, Entamoeba dispar
KDIISYFILRINRSSISTR

SEQ ID NO: 2553854 - protein, 28 aa, Entamoeba dispar
KDISKVWKKKWASFMDKKLLKYLSKIKC

SEQ ID NO: 2553855 - protein, 21 aa, Entamoeba dispar
KDKGDCPLCRTLTELTKKNLI

SEQ ID NO: 2553856 - protein, 20 aa, Entamoeba dispar
KDLKMQKGKIAAQCGHAAVG

SEQ ID NO: 2553857 - protein, 21 aa, Entamoeba dispar
KDLRVAVIERMDRVGGVLLQC

SEQ ID NO: 2553858 - protein, 25 aa, Entamoeba dispar
KDQGSCGSCFTFGAVAAIESRLLIS

SEQ ID NO: 2553859 - protein, 20 aa, Entamoeba dispar
KDYEGWCWPGNSVYIDFINP

SEQ ID NO: 2553860 - protein, 20 aa, Entamoeba dispar
KDYKLRIVDHKEIFPNNKDL

SEQ ID NO: 2553861 - protein, 23 aa, Entamoeba dispar
KEASKLPLWFSHYDHKANFDDYN

SEQ ID NO: 2553862 - protein, 23 aa, Entamoeba dispar
KEDIKMVQLLGGGMRVPMVLKTI

SEQ ID NO: 2553863 - protein, 17 aa, Entamoeba dispar
KEFSDKYIDNWIAMSTP

SEQ ID NO: 2553864 - protein, 18 aa, Entamoeba dispar
KEFVKALEKMAQFDKLIG

SEQ ID NO: 2553865 - protein, 22 aa, Entamoeba dispar
KEGKQKVVVVIPVATRADKVHV

SEQ ID NO: 2553866 - protein, 19 aa, Entamoeba dispar
KEIFGFSSINSIHVPDNYE

SEQ ID NO: 2553867 - protein, 26 aa, Entamoeba dispar
KEIKRRPGETMAHFLKRKERQQRKVE

SEQ ID NO: 2553868 - protein, 17 aa, Entamoeba dispar
KEILVQWEYTSKFKYSN

SEQ ID NO: 2553869 - protein, 26 aa, Entamoeba dispar
KEIMNIKYYWYFVVKNSSWISELNPC

SEQ ID NO: 2553870 - protein, 17 aa, Entamoeba dispar
KEKLEWVESQTKAIGKN

SEQ ID NO: 2553871 - protein, 23 aa, Entamoeba dispar
KEKPELQQFYLFLIQTILSREDI

SEQ ID NO: 2553872 - protein, 19 aa, Entamoeba dispar
KELKKEIKINKERTKKEYE

SEQ ID NO: 2553873 - protein, 23 aa, Entamoeba dispar
KELLTKFIGNKGVVDFKNNRYEY

SEQ ID NO: 2553874 - protein, 19 aa, Entamoeba dispar
KEPYQKIEFSLTIEQSNEG

SEQ ID NO: 2553875 - protein, 24 aa, Entamoeba dispar
KERDISLYPAFIIIRHHSQKDMIL

SEQ ID NO: 2553876 - protein, 17 aa, Entamoeba dispar
KERIRIEEVVRMLERIE

SEQ ID NO: 2553877 - protein, 17 aa, Entamoeba dispar
KESLALNMDNAELLRNI

SEQ ID NO: 2553878 - protein, 20 aa, Entamoeba dispar
KESLKLCKEMGADILEIEGA

SEQ ID NO: 2553879 - protein, 24 aa, Entamoeba dispar
KETGLKFQAVMSFHKCGGNVGDSV

SEQ ID NO: 2553880 - protein, 21 aa, Entamoeba dispar
KEVRKAIVSRAVKQNIILRKL

SEQ ID NO: 2553881 - protein, 22 aa, Entamoeba dispar
KEVRKAIVSRAVKQNIILRKLD

SEQ ID NO: 2553882 - protein, 18 aa, Entamoeba dispar
KEVYLLEGGFNELYSINP

SEQ ID NO: 2553883 - protein, 18 aa, Entamoeba dispar
KEYLNTPISITWENGESV

SEQ ID NO: 2553884 - protein, 30 aa, Entamoeba dispar
KFKGKKKEMCFKEAFDMFTSVAHTFDPLKF

SEQ ID NO: 2553885 - protein, 18 aa, Entamoeba dispar
KFLQCYSNSLPKKLPITQ

SEQ ID NO: 2553886 - protein, 32 aa, Entamoeba dispar
KFMSFGQAFYRGSDCCFLVFDVTNEQSFQSLD

SEQ ID NO: 2553887 - protein, 17 aa, Entamoeba dispar
KFNLLKQLMKEKVISSM

SEQ ID NO: 2553888 - protein, 20 aa, Entamoeba dispar
KFSPVERLRRKAIFTSNFKY

SEQ ID NO: 2553889 - protein, 24 aa, Entamoeba dispar
KFYTTEGEDIFSLVAGYIEIITLK

SEQ ID NO: 2553890 - protein, 18 aa, Entamoeba dispar
KGASEWLGNKAKDFMQNK

SEQ ID NO: 2553891 - protein, 25 aa, Entamoeba dispar
KGFFSMRWYCASKLSMAIMAQELAK

SEQ ID NO: 2553892 - protein, 23 aa, Entamoeba dispar
KGLKEYLEVYVLKDILKNPPQPS

SEQ ID NO: 2553893 - protein, 17 aa, Entamoeba dispar
KGMMKQLVVLRKQAAEI

SEQ ID NO: 2553894 - protein, 22 aa, Entamoeba dispar
KGNKKYDVKFMRVDVDKSLLKG

SEQ ID NO: 2553895 - protein, 19 aa, Entamoeba dispar
KGRCKRCENGYFISDGKCV

SEQ ID NO: 2553896 - protein, 24 aa, Entamoeba dispar
KGSCGFGSVQWSFKRRVSFAKVCL

SEQ ID NO: 2553897 - protein, 18 aa, Entamoeba dispar
KGVEASIDYKGDKLSTSS

SEQ ID NO: 2553898 - protein, 20 aa, Entamoeba dispar
KGVMDFVSQFFKFEALPEIP

SEQ ID NO: 2553899 - protein, 22 aa, Entamoeba dispar
KGYAKLKFPFVNKISYNNKSFR

SEQ ID NO: 2553900 - protein, 26 aa, Entamoeba dispar
KHANCICFYCNFVLSNYSGLWLNYYP

SEQ ID NO: 2553901 - protein, 25 aa, Entamoeba dispar
KHFRRRIPPKFIRKVRHHHCGICGC

SEQ ID NO: 2553902 - protein, 17 aa, Entamoeba dispar
KHNGVTGSNVFGIGGSV

SEQ ID NO: 2553903 - protein, 24 aa, Entamoeba dispar
KICDKSGFETLQFHVQAGPTHDKQ

SEQ ID NO: 2553904 - protein, 24 aa, Entamoeba dispar
KIDGVSSYKCGTYYRIGSVNTCAC

SEQ ID NO: 2553905 - protein, 24 aa, Entamoeba dispar
KIDNEFPLKYVINSVDGNRIVIVR

SEQ ID NO: 2553906 - protein, 18 aa, Entamoeba dispar
KIENRMRMNPDFISIADI

SEQ ID NO: 2553907 - protein, 24 aa, Entamoeba dispar
KIIKNQRLISALTFSSSFYESVQP

SEQ ID NO: 2553908 - protein, 18 aa, Entamoeba dispar
KIINTKLKASKIIKNAEM

SEQ ID NO: 2553909 - protein, 21 aa, Entamoeba dispar
KIKIWQSWYPNEWGKCEGTIE

SEQ ID NO: 2553910 - protein, 24 aa, Entamoeba dispar
KIKSDGIGKGFALWLTTKPIVSGN

SEQ ID NO: 2553911 - protein, 23 aa, Entamoeba dispar
KIKSGGVAGVMADIWWGLVETSP

SEQ ID NO: 2553912 - protein, 18 aa, Entamoeba dispar
KILETISFTLSTDGKSLR

SEQ ID NO: 2553913 - protein, 25 aa, Entamoeba dispar
KIMKKKFIEERARIKKEKNRERYQE

SEQ ID NO: 2553914 - protein, 18 aa, Entamoeba dispar
KIMKKRHLENLGLNGYGK

SEQ ID NO: 2553915 - protein, 22 aa, Entamoeba dispar
KINAPRPSYKFTDDEINSKRSL

SEQ ID NO: 2553916 - protein, 17 aa, Entamoeba dispar
KIQKSVCKTEDYKAIPM

SEQ ID NO: 2553917 - protein, 18 aa, Entamoeba dispar
KIRHGRFIITSSIMAQFA

SEQ ID NO: 2553918 - protein, 24 aa, Entamoeba dispar
KITKKLRKGICELKKCRILFSRKY

SEQ ID NO: 2553919 - protein, 23 aa, Entamoeba dispar
KIYKGEMFTDVGYWDISRAQIPL

SEQ ID NO: 2553920 - protein, 24 aa, Entamoeba dispar
KKAERLIRIADAFIQNTNDDEYQL

SEQ ID NO: 2553921 - protein, 18 aa, Entamoeba dispar
KKAGIVIDTNKKQKGNTM

SEQ ID NO: 2553922 - protein, 19 aa, Entamoeba dispar
KKAIYCPTTSVLDPYEFTI

SEQ ID NO: 2553923 - protein, 27 aa, Entamoeba dispar
KKATSSLKCSSIEFGSVLYSRENYTFS

SEQ ID NO: 2553924 - protein, 17 aa, Entamoeba dispar
KKCIKCKETYKINNKGI

SEQ ID NO: 2553925 - protein, 25 aa, Entamoeba dispar
KKCKKVEDWERFWASYKLASECYLE

SEQ ID NO: 2553926 - protein, 19 aa, Entamoeba dispar
KKENRKAIKEAKKARKVAK

SEQ ID NO: 2553927 - protein, 24 aa, Entamoeba dispar
KKEPYQKIEFSLRIESSNEGTTSI

SEQ ID NO: 2553928 - protein, 22 aa, Entamoeba dispar
KKEPYQKIEFSLTIEQSNEGTT

SEQ ID NO: 2553929 - protein, 22 aa, Entamoeba dispar
KKEPYQNIEFSLRIESSNEGTT

SEQ ID NO: 2553930 - protein, 18 aa, Entamoeba dispar
KKEQAIEFVKGMYNTALI

SEQ ID NO: 2553931 - protein, 29 aa, Entamoeba dispar
KKHITKRRGCPCIHKVPDVPCKCSSIKRN

SEQ ID NO: 2553932 - protein, 21 aa, Entamoeba dispar
KKIDLYKNVMVILDKEKKQKA

SEQ ID NO: 2553933 - protein, 17 aa, Entamoeba dispar
KKIKLQGYNGFAGGLDT

SEQ ID NO: 2553934 - protein, 20 aa, Entamoeba dispar
KKILDFCTIFSRELPHHYCF

SEQ ID NO: 2553935 - protein, 18 aa, Entamoeba dispar
KKKCDKFETIGATGRCNE

SEQ ID NO: 2553936 - protein, 19 aa, Entamoeba dispar
KKKLEAEAKKIAVAKAEKI

SEQ ID NO: 2553937 - protein, 22 aa, Entamoeba dispar
KKKLNQVLMAFSPVELKMLTLD

SEQ ID NO: 2553938 - protein, 20 aa, Entamoeba dispar
KKKVNSLLKKASKKASPKKI

SEQ ID NO: 2553939 - protein, 18 aa, Entamoeba dispar
KKLETRKVYIAKLEEVRK

SEQ ID NO: 2553940 - protein, 23 aa, Entamoeba dispar
KKLKEVKCLLKKSGVKGSLNVKK

SEQ ID NO: 2553941 - protein, 24 aa, Entamoeba dispar
KKLMKRYERQAGQLVGEEMYMKQM

SEQ ID NO: 2553942 - protein, 41 aa, Entamoeba dispar
KKLYDGLKSQCWFKALQSCGCCKECMAQKPPSCGCYKKTSG

SEQ ID NO: 2553943 - protein, 25 aa, Entamoeba dispar
KKNWRCNTCLHLGELAQIGVVEHKG

SEQ ID NO: 2553944 - protein, 24 aa, Entamoeba dispar
KKQKLSFRFKQDFGSAHVIAKVGE

SEQ ID NO: 2553945 - protein, 18 aa, Entamoeba dispar
KKRIHVVQNKLQVLNGRK

SEQ ID NO: 2553946 - protein, 17 aa, Entamoeba dispar
KKRIQILVNKIIKKTNS

SEQ ID NO: 2553947 - protein, 22 aa, Entamoeba dispar
KKSMRFAFSLVRKVLPKVTLVM

SEQ ID NO: 2553948 - protein, 21 aa, Entamoeba dispar
KKTFWLDDIELIKDPDAPDAG

SEQ ID NO: 2553949 - protein, 26 aa, Entamoeba dispar
KKTGFKGKRFEVIGKMIIKKVKGEKK

SEQ ID NO: 2553950 - protein, 26 aa, Entamoeba dispar
KKTIEKKWRAQRKALIMLERARDAKN

SEQ ID NO: 2553951 - protein, 19 aa, Entamoeba dispar
KKTLIFCAVLLFIATLQAD

SEQ ID NO: 2553952 - protein, 27 aa, Entamoeba dispar
KKTRMMKLRRKARKVLRKKQQRGNNQK

SEQ ID NO: 2553953 - protein, 34 aa, Entamoeba dispar
KKTVAYYTNWAQYRFNSIDGWTCKYTTDNIDPTI

SEQ ID NO: 2553954 - protein, 19 aa, Entamoeba dispar
KKVIKRKANKEVLNKKKTK

SEQ ID NO: 2553955 - protein, 17 aa, Entamoeba dispar
KKVVSLSDGVRCDMAHL

SEQ ID NO: 2553956 - protein, 19 aa, Entamoeba dispar
KKYDCPARPFGGNEEYDIS

SEQ ID NO: 2553957 - protein, 18 aa, Entamoeba dispar
KKYDGFSTIVVMKSMDNL

SEQ ID NO: 2553958 - protein, 17 aa, Entamoeba dispar
KKYGRRLDLCPANQRLL

SEQ ID NO: 2553959 - protein, 23 aa, Entamoeba dispar
KKYKIQLRKGLKKIIINRIKDAR

SEQ ID NO: 2553960 - protein, 20 aa, Entamoeba dispar
KKYQNIIVGYVFGHDHRSEI

SEQ ID NO: 2553961 - protein, 24 aa, Entamoeba dispar
KKYRKCKYHKVVVEESAVAPCESF

SEQ ID NO: 2553962 - protein, 17 aa, Entamoeba dispar
KKYYPKDQVELFSQLEE

SEQ ID NO: 2553963 - protein, 20 aa, Entamoeba dispar
KLAEIRRKKDVVVSTFKAEE

SEQ ID NO: 2553964 - protein, 18 aa, Entamoeba dispar
KLEVLVSCRSDIDEYRKA

SEQ ID NO: 2553965 - protein, 19 aa, Entamoeba dispar
KLFKHYRGGIYYNEECTRR

SEQ ID NO: 2553966 - protein, 17 aa, Entamoeba dispar
KLIKKLKKAGISKKALR

SEQ ID NO: 2553967 - protein, 25 aa, Entamoeba dispar
KLKDQYYRLAALKERQKMQIKANKE

SEQ ID NO: 2553968 - protein, 18 aa, Entamoeba dispar
KLNKLCTLTDDMCSLSEF

SEQ ID NO: 2553969 - protein, 19 aa, Entamoeba dispar
KLQGMVKHVIFPCPTGVTK

SEQ ID NO: 2553970 - protein, 22 aa, Entamoeba dispar
KLREVNNLQLTAPVTSRSNIKN

SEQ ID NO: 2553971 - protein, 25 aa, Entamoeba dispar
KLRTKCSGLIRYVKENHDIYVSQVA

SEQ ID NO: 2553972 - protein, 23 aa, Entamoeba dispar
KMGSKPLVKKGYKASRKSYVQPK

SEQ ID NO: 2553973 - protein, 29 aa, Entamoeba dispar
KMKLEEKRLKLAIHGKLPGQKADLISDPL

SEQ ID NO: 2553974 - protein, 20 aa, Entamoeba dispar
KMMIIEIINIKGWSNFNNIK

SEQ ID NO: 2553975 - protein, 19 aa, Entamoeba dispar
KMMLDVCQTIKGLVVAIAD

SEQ ID NO: 2553976 - protein, 17 aa, Entamoeba dispar
KMMNKLKQSSLVMKKAA

SEQ ID NO: 2553977 - protein, 19 aa, Entamoeba dispar
KMRKIELNKEIKIISIDGH

SEQ ID NO: 2553978 - protein, 25 aa, Entamoeba dispar
KMYLNPRYYYGLSFVNTPNEIINNQ

SEQ ID NO: 2553979 - protein, 17 aa, Entamoeba dispar
KNCTIEIDKDITIQQKI

SEQ ID NO: 2553980 - protein, 18 aa, Entamoeba dispar
KNCTIEIDKDITIQQKII

SEQ ID NO: 2553981 - protein, 21 aa, Entamoeba dispar
KNERKMLLDAAMKLSNEMARM

SEQ ID NO: 2553982 - protein, 19 aa, Entamoeba dispar
KNGGGYIIYSQWIEKRYHH

SEQ ID NO: 2553983 - protein, 24 aa, Entamoeba dispar
KNKERKARELKQLREKQKKLEGFN

SEQ ID NO: 2553984 - protein, 18 aa, Entamoeba dispar
KNKNGFSPLTGMTINNKI

SEQ ID NO: 2553985 - protein, 28 aa, Entamoeba dispar
KNKRIDIMQILLKYGADIDMTFKGKPIM

SEQ ID NO: 2553986 - protein, 19 aa, Entamoeba dispar
KNKTLGITKFIKGVSKATH

SEQ ID NO: 2553987 - protein, 17 aa, Entamoeba dispar
KNLKIALLEKARDVSTG

SEQ ID NO: 2553988 - protein, 22 aa, Entamoeba dispar
KNLYYFGLVIDYIHLFKDGESI

SEQ ID NO: 2553989 - protein, 18 aa, Entamoeba dispar
KNNIPFCLVSSQDNIIST

SEQ ID NO: 2553990 - protein, 30 aa, Entamoeba dispar
KNNLALVSCEVYGGGIWHTWIDRDLGISGR

SEQ ID NO: 2553991 - protein, 17 aa, Entamoeba dispar
KNNSFKKVLGKGRLIRS

SEQ ID NO: 2553992 - protein, 20 aa, Entamoeba dispar
KNRIASQAFTGFKQQRFLEY

SEQ ID NO: 2553993 - protein, 18 aa, Entamoeba dispar
KNSYSFEKVQFIFYNGNS

SEQ ID NO: 2553994 - protein, 17 aa, Entamoeba dispar
KNVSFNGGFNFENKYGQ

SEQ ID NO: 2553995 - protein, 20 aa, Entamoeba dispar
KNYYCICLNDAIANEPNADQ

SEQ ID NO: 2553996 - protein, 23 aa, Entamoeba dispar
KPDWKTGDVIFKIHTIENPNFIR

SEQ ID NO: 2553997 - protein, 18 aa, Entamoeba dispar
KPIKRSMKQVGHVSDELN

SEQ ID NO: 2553998 - protein, 19 aa, Entamoeba dispar
KPLEPTSCRIRTMKNYQIM

SEQ ID NO: 2553999 - protein, 23 aa, Entamoeba dispar
KPLHYKGSIFHRVIPGFMIQGGD

SEQ ID NO: 2554000 - protein, 25 aa, Entamoeba dispar
KPYEEIKIQLFIESVRRKVYFTTTT

SEQ ID NO: 2554001 - protein, 24 aa, Entamoeba dispar
KQCNGKACLLLIFGEEENNDLIDQ

SEQ ID NO: 2554002 - protein, 19 aa, Entamoeba dispar
KQKEEFVLRKASSSLLRTA

SEQ ID NO: 2554003 - protein, 32 aa, Entamoeba dispar
KQLIFKFKRLFKGEFKETDLITSFIYVYDYLQ

SEQ ID NO: 2554004 - protein, 17 aa, Entamoeba dispar
KQRKAVKEIKRQMRLLR

SEQ ID NO: 2554005 - protein, 25 aa, Entamoeba dispar
KQSFLKGYPSLFLFYNNYIYPEYSM

SEQ ID NO: 2554006 - protein, 17 aa, Entamoeba dispar
KQVFENYNKMKLEEKRL

SEQ ID NO: 2554007 - protein, 17 aa, Entamoeba dispar
KQVPASVDWRAEGKVTP

SEQ ID NO: 2554008 - protein, 19 aa, Entamoeba dispar
KQYRSLYGMYEYGNIKQWI

SEQ ID NO: 2554009 - protein, 19 aa, Entamoeba dispar
KQYYFKEVYLLEGGFNELY

SEQ ID NO: 2554010 - protein, 21 aa, Entamoeba dispar
KQYYGDTPIIFAMGNNDTPTP

SEQ ID NO: 2554011 - protein, 21 aa, Entamoeba dispar
KRADVIIPWGEISNNAMTADN

SEQ ID NO: 2554012 - protein, 17 aa, Entamoeba dispar
KRDLLIYGVYFSDKRKW

SEQ ID NO: 2554013 - protein, 17 aa, Entamoeba dispar
KRDLVFWAMYFKNQEMW

SEQ ID NO: 2554014 - protein, 23 aa, Entamoeba dispar
KREKLCNHCHGIGAENSHDAENC

SEQ ID NO: 2554015 - protein, 19 aa, Entamoeba dispar
KRGMLSYKLYKVNNITTSI

SEQ ID NO: 2554016 - protein, 18 aa, Entamoeba dispar
KRHNSRDLLFYGIGYNAE

SEQ ID NO: 2554017 - protein, 21 aa, Entamoeba dispar
KRKILKLCIMSSSAKDFINFL

SEQ ID NO: 2554018 - protein, 36 aa, Entamoeba dispar
KRKMKRKKDALFLCLFWFLIEVTFDIDANGILNVTA

SEQ ID NO: 2554019 - protein, 19 aa, Entamoeba dispar
KRLAKKEKIKICSKNKMSE

SEQ ID NO: 2554020 - protein, 18 aa, Entamoeba dispar
KRLETVKKINIMKKQRKN

SEQ ID NO: 2554021 - protein, 18 aa, Entamoeba dispar
KRLSNMTVQEKIAMFNQK

SEQ ID NO: 2554022 - protein, 18 aa, Entamoeba dispar
KRPFEIFTLNNNFYGNFI

SEQ ID NO: 2554023 - protein, 25 aa, Entamoeba dispar
KRPKKYVHVCIPKSNIELMGKMKKC

SEQ ID NO: 2554024 - protein, 19 aa, Entamoeba dispar
KRQRRVLKIHKKIMDIKKI

SEQ ID NO: 2554025 - protein, 17 aa, Entamoeba dispar
KRRQTCETAFIGIGNIT

SEQ ID NO: 2554026 - protein, 17 aa, Entamoeba dispar
KRTLLYKALAMHLNGVF

SEQ ID NO: 2554027 - protein, 23 aa, Entamoeba dispar
KRYFTWGSSFPHPLKLQEQLKSK

SEQ ID NO: 2554028 - protein, 31 aa, Entamoeba dispar
KSDVCYKTFALIVIKLIKLRRQMFINILKGD

SEQ ID NO: 2554029 - protein, 18 aa, Entamoeba dispar
KSEIKFNLDNPFGERIIN

SEQ ID NO: 2554030 - protein, 20 aa, Entamoeba dispar
KSGIATKVYVPLSYEDEKNT

SEQ ID NO: 2554031 - protein, 20 aa, Entamoeba dispar
KSILEKRVVVLRRIMTLNEK

SEQ ID NO: 2554032 - protein, 20 aa, Entamoeba dispar
KSKENIKEFLIPYNYSTQIN

SEQ ID NO: 2554033 - protein, 21 aa, Entamoeba dispar
KSLCLYNYSKLIMKDNSQVTS

SEQ ID NO: 2554034 - protein, 29 aa, Entamoeba dispar
KSNIELMGKMKKCLPIWKQDLPSLKRKLN

SEQ ID NO: 2554035 - protein, 25 aa, Entamoeba dispar
KSNKQVPASVDWRAEGKVTPIKDQG

SEQ ID NO: 2554036 - protein, 21 aa, Entamoeba dispar
KSPGIRQLTSFILFDSYFLNT

SEQ ID NO: 2554037 - protein, 18 aa, Entamoeba dispar
KSPYCPFMAYLTSCSIVY

SEQ ID NO: 2554038 - protein, 17 aa, Entamoeba dispar
KSQWMLNNMSLWWKDWL

SEQ ID NO: 2554039 - protein, 19 aa, Entamoeba dispar
KSRLLRFPYSTNVLTKNED

SEQ ID NO: 2554040 - protein, 23 aa, Entamoeba dispar
KSYPERLWLAIIHTMPNKISHIQ

SEQ ID NO: 2554041 - protein, 19 aa, Entamoeba dispar
KTGIFKRFIKDQFSKNEKS

SEQ ID NO: 2554042 - protein, 22 aa, Entamoeba dispar
KTIKMVKERMGIREEEFKDFKD

SEQ ID NO: 2554043 - protein, 17 aa, Entamoeba dispar
KTKEILVQWEYTSKFKY

SEQ ID NO: 2554044 - protein, 22 aa, Entamoeba dispar
KTKHWEHLCVFGSDKKTESQLV

SEQ ID NO: 2554045 - protein, 22 aa, Entamoeba dispar
KTLGKGGDFPCEYYYSNIPFKP

SEQ ID NO: 2554046 - protein, 32 aa, Entamoeba dispar
KTLLVKFFAPWCGHCKRLAPTYEEVAQAFAEN

SEQ ID NO: 2554047 - protein, 24 aa, Entamoeba dispar
KTNKWPSYSKHFYLPFSSNNLCYE

SEQ ID NO: 2554048 - protein, 24 aa, Entamoeba dispar
KTNKWPSYSKHFYLPFSSNNLCYQ

SEQ ID NO: 2554049 - protein, 22 aa, Entamoeba dispar
KTQFNHAFIIVGYDLNQPENEI

SEQ ID NO: 2554050 - protein, 18 aa, Entamoeba dispar
KTSFNLKTLFMMLTVPRR

SEQ ID NO: 2554051 - protein, 17 aa, Entamoeba dispar
KTTSVWMNKGDKSFKES

SEQ ID NO: 2554052 - protein, 31 aa, Entamoeba dispar
KTVKDFVGSLGMKWLSWVLKKSVIKKRQQQK

SEQ ID NO: 2554053 - protein, 18 aa, Entamoeba dispar
KVAYMVGIGNQFNLNQTL

SEQ ID NO: 2554054 - protein, 17 aa, Entamoeba dispar
KVFDPVKFRVASACKKI

SEQ ID NO: 2554055 - protein, 20 aa, Entamoeba dispar
KVGETDAQFARRVAKQKKLL

SEQ ID NO: 2554056 - protein, 25 aa, Entamoeba dispar
KVKLIDFGSACFENYTLYSYIQSRH

SEQ ID NO: 2554057 - protein, 20 aa, Entamoeba dispar
KVLEVCGGIDNGHIEVIEEG

SEQ ID NO: 2554058 - protein, 18 aa, Entamoeba dispar
KVLGVYEILPKISGLQRN

SEQ ID NO: 2554059 - protein, 27 aa, Entamoeba dispar
KVLINRLRVKVAIFKRKVSRCKNSPFK

SEQ ID NO: 2554060 - protein, 21 aa, Entamoeba dispar
KVMNFGKGVVGIFNKDAAKKM

SEQ ID NO: 2554061 - protein, 20 aa, Entamoeba dispar
KVNMSGPLIVADEFTTNRPL

SEQ ID NO: 2554062 - protein, 22 aa, Entamoeba dispar
KVPEHYRRMMIRQTKLESKFDE

SEQ ID NO: 2554063 - protein, 29 aa, Entamoeba dispar
KVSRCKNSPFKQVRVIRLVKKYVKKLEKA

SEQ ID NO: 2554064 - protein, 26 aa, Entamoeba dispar
KVSTLQRWIVRCMSDLLSKIDEDDIE

SEQ ID NO: 2554065 - protein, 29 aa, Entamoeba dispar
KVVCTGGIINCRYCHSLGRILKVSLRNRE

SEQ ID NO: 2554066 - protein, 17 aa, Entamoeba dispar
KVVKDLTLPPALIKSKQ

SEQ ID NO: 2554067 - protein, 26 aa, Entamoeba dispar
KVVPGRFGDACAVGYYDDTIQTTGWG

SEQ ID NO: 2554068 - protein, 20 aa, Entamoeba dispar
KVYIKGCPVKTVIVSPQCQH

SEQ ID NO: 2554069 - protein, 34 aa, Entamoeba dispar
KVYNLFAFPGTENFAGVKYPLEWVNKFGNEKTGK

SEQ ID NO: 2554070 - protein, 22 aa, Entamoeba dispar
KYGKCIKCNDTTCLNCNNKYTL

SEQ ID NO: 2554071 - protein, 17 aa, Entamoeba dispar
KYIDNWIAMSTPFLGSG

SEQ ID NO: 2554072 - protein, 18 aa, Entamoeba dispar
KYIIKAYAQIHSKIDVVK

SEQ ID NO: 2554073 - protein, 20 aa, Entamoeba dispar
KYKFGGFTIAMKQFEGTTNM

SEQ ID NO: 2554074 - protein, 18 aa, Entamoeba dispar
KYKFKFSPVERLRRKAIF

SEQ ID NO: 2554075 - protein, 19 aa, Entamoeba dispar
KYNSLMLAIEHRFYGKSVP

SEQ ID NO: 2554076 - protein, 18 aa, Entamoeba dispar
KYPQCNLNLLKQQYNEKT

SEQ ID NO: 2554077 - protein, 23 aa, Entamoeba dispar
KYQYSSPYLMIWNDMNEPSVFNG

SEQ ID NO: 2554078 - protein, 18 aa, Entamoeba dispar
KYRQIKFVVVDRDSIYDL

SEQ ID NO: 2554079 - protein, 21 aa, Entamoeba dispar
KYWIIRNSWGTAWGDAGYFLL

SEQ ID NO: 2554080 - protein, 21 aa, Entamoeba dispar
LAAKVSGIHWWYGTSSRAAEA

SEQ ID NO: 2554081 - protein, 20 aa, Entamoeba dispar
LAASYDWRYFRFDEYKHIDN

SEQ ID NO: 2554082 - protein, 19 aa, Entamoeba dispar
LAEDIYLSPYQRNRLRNVQ

SEQ ID NO: 2554083 - protein, 23 aa, Entamoeba dispar
LAEEYRLKMLFIQVDGKDIELGL

SEQ ID NO: 2554084 - protein, 19 aa, Entamoeba dispar
LAEKRKISGRGVVSKQEKK

SEQ ID NO: 2554085 - protein, 25 aa, Entamoeba dispar
LAFAWRPNPSYGLTNFKDMITTWCA

SEQ ID NO: 2554086 - protein, 20 aa, Entamoeba dispar
LAFYRKQLKQTLKVKKVLAQ

SEQ ID NO: 2554087 - protein, 18 aa, Entamoeba dispar
LAHTRLGLMYQQTNSPIG

SEQ ID NO: 2554088 - protein, 17 aa, Entamoeba dispar
LAIHLDTERKYIIDKDK

SEQ ID NO: 2554089 - protein, 31 aa, Entamoeba dispar
LAINIPKYFPFPAGYLSIFSQDIIKFIGKWE

SEQ ID NO: 2554090 - protein, 23 aa, Entamoeba dispar
LAKELRGNIAVFRSQEKYQDKLD

SEQ ID NO: 2554091 - protein, 21 aa, Entamoeba dispar
LALDICFYGPYGIPVKTPIIA

SEQ ID NO: 2554092 - protein, 17 aa, Entamoeba dispar
LAMFISFSYAEESEAEL

SEQ ID NO: 2554093 - protein, 27 aa, Entamoeba dispar
LAQCLARKHALAALVAFTNDGKFNLNS

SEQ ID NO: 2554094 - protein, 23 aa, Entamoeba dispar
LATSIPFNVCSEIKTFTISTIEG

SEQ ID NO: 2554095 - protein, 20 aa, Entamoeba dispar
LCFLIILAAILVLPLHPLFE

SEQ ID NO: 2554096 - protein, 20 aa, Entamoeba dispar
LCFTESITSFYNFSSKTLTS

SEQ ID NO: 2554097 - protein, 23 aa, Entamoeba dispar
LCIFFFIFLCHLAGIYLYGSGFL

SEQ ID NO: 2554098 - protein, 37 aa, Entamoeba dispar
LCLAFVSAMELEGDYQLDNGFDLKEENIDDNNDEYEL

SEQ ID NO: 2554099 - protein, 18 aa, Entamoeba dispar
LCLLHLISMRPFSQNLIK

SEQ ID NO: 2554100 - protein, 23 aa, Entamoeba dispar
LDAQFAAVARGFRLYNQNPNTDI

SEQ ID NO: 2554101 - protein, 17 aa, Entamoeba dispar
LDDAKRTLERIINKRLI

SEQ ID NO: 2554102 - protein, 22 aa, Entamoeba dispar
LDDFEDFYDAISPKSASVKGRM

SEQ ID NO: 2554103 - protein, 22 aa, Entamoeba dispar
LDFMGDLFKDWLSPNALEQFKK

SEQ ID NO: 2554104 - protein, 25 aa, Entamoeba dispar
LDFNHQLPIFWYFSAKHNQTAHDII

SEQ ID NO: 2554105 - protein, 22 aa, Entamoeba dispar
LDLEYKKFYPWIIIADGNGNQT

SEQ ID NO: 2554106 - protein, 20 aa, Entamoeba dispar
LDLFKKTLGPVRMVLDDAKL

SEQ ID NO: 2554107 - protein, 18 aa, Entamoeba dispar
LDLLPVREAPAVFSYSMK

SEQ ID NO: 2554108 - protein, 26 aa, Entamoeba dispar
LDLVQIKCKECFKINKISTGSTFCKW

SEQ ID NO: 2554109 - protein, 20 aa, Entamoeba dispar
LDYEVLEYLTDISISNIHSK

SEQ ID NO: 2554110 - protein, 17 aa, Entamoeba dispar
LDYQWVIESNVNKTQIL

SEQ ID NO: 2554111 - protein, 22 aa, Entamoeba dispar
LEAMKNFLENASLPPIIESTKE

SEQ ID NO: 2554112 - protein, 28 aa, Entamoeba dispar
LECKCGKTIYNPCMWPFQEGTLDCDGKP

SEQ ID NO: 2554113 - protein, 18 aa, Entamoeba dispar
LEDLKKKKLEAEAKKIAV

SEQ ID NO: 2554114 - protein, 17 aa, Entamoeba dispar
LEDPGFGHWIYKFANTT

SEQ ID NO: 2554115 - protein, 20 aa, Entamoeba dispar
LEEDRRKLLEYTDTRTVSHK

SEQ ID NO: 2554116 - protein, 18 aa, Entamoeba dispar
LEEINWKKLFKVGKAFNV

SEQ ID NO: 2554117 - protein, 17 aa, Entamoeba dispar
LEESLSFKSLTDSCNNI

SEQ ID NO: 2554118 - protein, 17 aa, Entamoeba dispar
LEFHKTEIIKAINKKNE

SEQ ID NO: 2554119 - protein, 19 aa, Entamoeba dispar
LEHCNLCYESDKCNSCDGN

SEQ ID NO: 2554120 - protein, 22 aa, Entamoeba dispar
LEHLKQVIIKRKFISYDEQEKK

SEQ ID NO: 2554121 - protein, 26 aa, Entamoeba dispar
LEHRVIIRYRHIVIKEESSYIPTTSS

SEQ ID NO: 2554122 - protein, 18 aa, Entamoeba dispar
LEKMAQFDKLIGLFKSKP

SEQ ID NO: 2554123 - protein, 20 aa, Entamoeba dispar
LEMKDIPTGTTECCSLMEDD

SEQ ID NO: 2554124 - protein, 25 aa, Entamoeba dispar
LEPTIPLILSEEGKWSEIRNYIKEC

SEQ ID NO: 2554125 - protein, 26 aa, Entamoeba dispar
LEQIVHPILRRYGGVHHRADESFNEG

SEQ ID NO: 2554126 - protein, 21 aa, Entamoeba dispar
LEQLNKVIFIRSIDEKTVQAA

SEQ ID NO: 2554127 - protein, 19 aa, Entamoeba dispar
LEQPRCIVSLSGAILSTNG

SEQ ID NO: 2554128 - protein, 18 aa, Entamoeba dispar
LESVWKLDKERGNEDNKK

SEQ ID NO: 2554129 - protein, 23 aa, Entamoeba dispar
LETNYPLIISWNAIGIELFKSLQ

SEQ ID NO: 2554130 - protein, 19 aa, Entamoeba dispar
LEVLNFRFTIHELSFQPIP

SEQ ID NO: 2554131 - protein, 22 aa, Entamoeba dispar
LEVYEKQGWFIPDKGVLKVWNF

SEQ ID NO: 2554132 - protein, 20 aa, Entamoeba dispar
LEYADNFAVIALDIPRIKDV

SEQ ID NO: 2554133 - protein, 23 aa, Entamoeba dispar
LEYIKVRINYAIKNNFSIGIWEL

SEQ ID NO: 2554134 - protein, 18 aa, Entamoeba dispar
LFDLFGAGYDWRSNDVSD

SEQ ID NO: 2554135 - protein, 20 aa, Entamoeba dispar
LFFGCMKLKNLLYVSYQLRT

SEQ ID NO: 2554136 - protein, 17 aa, Entamoeba dispar
LFIHGWGFLHLNSVQST

SEQ ID NO: 2554137 - protein, 18 aa, Entamoeba dispar
LFIQFIIKYQIIKEIYCS

SEQ ID NO: 2554138 - protein, 19 aa, Entamoeba dispar
LFIYFCLSEECSIDSNNYE

SEQ ID NO: 2554139 - protein, 23 aa, Entamoeba dispar
LFPELKQSFKGEFDFETLFSDLA

SEQ ID NO: 2554140 - protein, 19 aa, Entamoeba dispar
LFQNLNHLFILVFLLQLLH

SEQ ID NO: 2554141 - protein, 23 aa, Entamoeba dispar
LFRYKMDLDQCVVDLTLKDTCGQ

SEQ ID NO: 2554142 - protein, 17 aa, Entamoeba dispar
LGCCLASVWTPFQKKSS

SEQ ID NO: 2554143 - protein, 23 aa, Entamoeba dispar
LGFVPKLGSGFIKICQIDHIPRL

SEQ ID NO: 2554144 - protein, 17 aa, Entamoeba dispar
LGLDFKNELSGTMNFQY

SEQ ID NO: 2554145 - protein, 23 aa, Entamoeba dispar
LGLKLDPLLLRPLARSWESDYQL

SEQ ID NO: 2554146 - protein, 17 aa, Entamoeba dispar
LGLTVRETYRFNYEYNE

SEQ ID NO: 2554147 - protein, 19 aa, Entamoeba dispar
LGQMWKHIKTEGVPIEYTW

SEQ ID NO: 2554148 - protein, 17 aa, Entamoeba dispar
LGTTFSAVGIYNGEGKG

SEQ ID NO: 2554149 - protein, 18 aa, Entamoeba dispar
LGYIRGCYNTQQYFKIYK

SEQ ID NO: 2554150 - protein, 18 aa, Entamoeba dispar
LGYSRPWEKGKEPLRSLT

SEQ ID NO: 2554151 - protein, 18 aa, Entamoeba dispar
LHHAEAFGIQIQGSNKFL

SEQ ID NO: 2554152 - protein, 19 aa, Entamoeba dispar
LHIDSFVKILIKYHTTQLN

SEQ ID NO: 2554153 - protein, 21 aa, Entamoeba dispar
LHRPFEISYLLKMMSQSQIHV

SEQ ID NO: 2554154 - protein, 19 aa, Entamoeba dispar
LIADFSYVNYGIWYLISSY

SEQ ID NO: 2554155 - protein, 20 aa, Entamoeba dispar
LIATSFAFYEEDFLDDFEDD

SEQ ID NO: 2554156 - protein, 25 aa, Entamoeba dispar
LIECKTSDCYIELETDSSVTSETIN

SEQ ID NO: 2554157 - protein, 19 aa, Entamoeba dispar
LIEYHECTDEVIKFEKRLD

SEQ ID NO: 2554158 - protein, 24 aa, Entamoeba dispar
LIFKEYRGKPDLIDISSFKTQFNH

SEQ ID NO: 2554159 - protein, 19 aa, Entamoeba dispar
LIFPFVQPKYFITFYDSFI

SEQ ID NO: 2554160 - protein, 18 aa, Entamoeba dispar
LIGIFFFICLTNGCQCVI

SEQ ID NO: 2554161 - protein, 25 aa, Entamoeba dispar
LIGQFGVGFYSSFLVAENVTVISRK

SEQ ID NO: 2554162 - protein, 23 aa, Entamoeba dispar
LIKKLSGSVLPSFADKLIKTTEV

SEQ ID NO: 2554163 - protein, 17 aa, Entamoeba dispar
LIMARRMTLEGAKVLGV

SEQ ID NO: 2554164 - protein, 18 aa, Entamoeba dispar
LINEFDWRNSGIITPIKS

SEQ ID NO: 2554165 - protein, 21 aa, Entamoeba dispar
LINSCSLSFVIKSNKIELIKL

SEQ ID NO: 2554166 - protein, 19 aa, Entamoeba dispar
LIRRINLRYRFSFGTELDT

SEQ ID NO: 2554167 - protein, 30 aa, Entamoeba dispar
LIRSIIFKSGAKMAAKMAALAKKGKDISKV

SEQ ID NO: 2554168 - protein, 22 aa, Entamoeba dispar
LISDPLWKRIGLPDPSINTTNP

SEQ ID NO: 2554169 - protein, 18 aa, Entamoeba dispar
LISKCGSCINMVGPSLTE

SEQ ID NO: 2554170 - protein, 20 aa, Entamoeba dispar
LIVVNFSFAINFDQWKIKYN

SEQ ID NO: 2554171 - protein, 17 aa, Entamoeba dispar
LIYKKELTWPIKESIIY

SEQ ID NO: 2554172 - protein, 20 aa, Entamoeba dispar
LKAAGWKDGIDLVSPGYDWR

SEQ ID NO: 2554173 - protein, 18 aa, Entamoeba dispar
LKAALSQGLVDVSIDASS

SEQ ID NO: 2554174 - protein, 20 aa, Entamoeba dispar
LKAASLSFKSLDYIQEGIEW

SEQ ID NO: 2554175 - protein, 18 aa, Entamoeba dispar
LKDKYFLDTNVLKDLVKK

SEQ ID NO: 2554176 - protein, 20 aa, Entamoeba dispar
LKELIWEYDDVIFPTRSFGV

SEQ ID NO: 2554177 - protein, 23 aa, Entamoeba dispar
LKEMKTRYFLFVILWVISLGKEC

SEQ ID NO: 2554178 - protein, 24 aa, Entamoeba dispar
LKEMSLKKFKFVSLVNGTEFRQLF

SEQ ID NO: 2554179 - protein, 20 aa, Entamoeba dispar
LKERGSAIITGFGGDPNGSV

SEQ ID NO: 2554180 - protein, 19 aa, Entamoeba dispar
LKESCGIVIESITNKFNKV

SEQ ID NO: 2554181 - protein, 24 aa, Entamoeba dispar
LKGASSVFKKEWKKMQSKISKTLK

SEQ ID NO: 2554182 - protein, 24 aa, Entamoeba dispar
LKGRNELKEKLIIESNSNTIDIKD

SEQ ID NO: 2554183 - protein, 20 aa, Entamoeba dispar
LKHSTGLPVFEIYGKHAQHD

SEQ ID NO: 2554184 - protein, 19 aa, Entamoeba dispar
LKKSRLGYDKSIGESQHIN

SEQ ID NO: 2554185 - protein, 26 aa, Entamoeba dispar
LKLKEFRLRRTIAIILKQMATVLTSI

SEQ ID NO: 2554186 - protein, 26 aa, Entamoeba dispar
LKLKRLNLRECTVIKLGGVVDDLILV

SEQ ID NO: 2554187 - protein, 19 aa, Entamoeba dispar
LKLMLDFVPNHSACDAPTV

SEQ ID NO: 2554188 - protein, 19 aa, Entamoeba dispar
LKLSHEYDGLLKVKLSDLK

SEQ ID NO: 2554189 - protein, 25 aa, Entamoeba dispar
LKNFVPNSCQVHFVQYFLPSPQISF

SEQ ID NO: 2554190 - protein, 17 aa, Entamoeba dispar
LKNILSYFLQETYTFKN

SEQ ID NO: 2554191 - protein, 29 aa, Entamoeba dispar
LKNKGYGDFVIIRGWRSIGSFDSEAVNSY

SEQ ID NO: 2554192 - protein, 24 aa, Entamoeba dispar
LKNYSLVVSPLFMNASCFHCSVYY

SEQ ID NO: 2554193 - protein, 18 aa, Entamoeba dispar
LKQSLFFGCMKLKNLLYV

SEQ ID NO: 2554194 - protein, 26 aa, Entamoeba dispar
LKRQNSLRLLGKIAGSSLSYNEIMQG

SEQ ID NO: 2554195 - protein, 37 aa, Entamoeba dispar
LKSHPFRFIASLEVYYCLCLMEFLVVKVKGFDVFIKD

SEQ ID NO: 2554196 - protein, 21 aa, Entamoeba dispar
LKSPHGRFTYALESFNFGSLV

SEQ ID NO: 2554197 - protein, 18 aa, Entamoeba dispar
LKSTIRVAKFKKACAGVI

SEQ ID NO: 2554198 - protein, 22 aa, Entamoeba dispar
LKVLTLTGGLVFFELNAPIETV

SEQ ID NO: 2554199 - protein, 17 aa, Entamoeba dispar
LKYLNIRLKQTRKTIAL

SEQ ID NO: 2554200 - protein, 20 aa, Entamoeba dispar
LKYQPVMSFHKCGGNVGDTC

SEQ ID NO: 2554201 - protein, 17 aa, Entamoeba dispar
LLADRLTLFSTKPSYLK

SEQ ID NO: 2554202 - protein, 18 aa, Entamoeba dispar
LLASVPTYVKERIIHTLH

SEQ ID NO: 2554203 - protein, 18 aa, Entamoeba dispar
LLAVSFAAIVGMDVGTQF

SEQ ID NO: 2554204 - protein, 24 aa, Entamoeba dispar
LLCLWKEQLAIDIAKHYGTPYHVG

SEQ ID NO: 2554205 - protein, 23 aa, Entamoeba dispar
LLHAAKALGEFWIDDVSMEAVNP

SEQ ID NO: 2554206 - protein, 22 aa, Entamoeba dispar
LLIDYWYKEYFMSIRNKEPLLK

SEQ ID NO: 2554207 - protein, 24 aa, Entamoeba dispar
LLISVCSAFKAWVITDSHFDREYT

SEQ ID NO: 2554208 - protein, 17 aa, Entamoeba dispar
LLKKLPFIIDSPLRDIN

SEQ ID NO: 2554209 - protein, 31 aa, Entamoeba dispar
LLMPYPSSVSFQWKSSLAIALTSSIQLNVKS

SEQ ID NO: 2554210 - protein, 36 aa, Entamoeba dispar
LLNAIRLPKEIIFPAQPPIGLQVTWSGCREAEGCNV

SEQ ID NO: 2554211 - protein, 18 aa, Entamoeba dispar
LLNALKIRHGRFIITSSI

SEQ ID NO: 2554212 - protein, 19 aa, Entamoeba dispar
LLNKLNLTIELGRNDACAS

SEQ ID NO: 2554213 - protein, 19 aa, Entamoeba dispar
LLPKKSIESEEKFTPESEY

SEQ ID NO: 2554214 - protein, 25 aa, Entamoeba dispar
LLREIRRKKTAIVLYCRIEEEIKGL

SEQ ID NO: 2554215 - protein, 17 aa, Entamoeba dispar
LLSGQRLVRYCPFSVPF

SEQ ID NO: 2554216 - protein, 17 aa, Entamoeba dispar
LLSITIAETCTRHPVII

SEQ ID NO: 2554217 - protein, 18 aa, Entamoeba dispar
LLSWQRILVSMYFGQTPK

SEQ ID NO: 2554218 - protein, 18 aa, Entamoeba dispar
LLTDLGVTNNEFWGFRGQ

SEQ ID NO: 2554219 - protein, 23 aa, Entamoeba dispar
LMKNKRKPTEIVVYTDSYCYSAC

SEQ ID NO: 2554220 - protein, 21 aa, Entamoeba dispar
LMPYLALIGQDVFTWPPYASH

SEQ ID NO: 2554221 - protein, 18 aa, Entamoeba dispar
LNGACTCAYGYIQNNSTK

SEQ ID NO: 2554222 - protein, 18 aa, Entamoeba dispar
LNKFKYSPLHTALSQNEI

SEQ ID NO: 2554223 - protein, 18 aa, Entamoeba dispar
LNNFKITMCEVRVPETRS

SEQ ID NO: 2554224 - protein, 22 aa, Entamoeba dispar
LNNMSLWWKDWLSPEEIATTKK

SEQ ID NO: 2554225 - protein, 20 aa, Entamoeba dispar
LNPCALDYEVLEYLTDISIS

SEQ ID NO: 2554226 - protein, 23 aa, Entamoeba dispar
LNPRQPYGTSFLEFEAYTKALLS

SEQ ID NO: 2554227 - protein, 17 aa, Entamoeba dispar
LNRIHYVLQGLRKNLSE

SEQ ID NO: 2554228 - protein, 26 aa, Entamoeba dispar
LNSATFPSICTAWDRNGVKIKVVEVN

SEQ ID NO: 2554229 - protein, 24 aa, Entamoeba dispar
LNSEIPIVVILFTYEKNIDIIMKY

SEQ ID NO: 2554230 - protein, 18 aa, Entamoeba dispar
LNSGPVLKEHCGQKYMSD

SEQ ID NO: 2554231 - protein, 20 aa, Entamoeba dispar
LNSSEFGEGIAMVNNTLIML

SEQ ID NO: 2554232 - protein, 25 aa, Entamoeba dispar
LNSWSDGFIMNAGWLVGLSDLATEN

SEQ ID NO: 2554233 - protein, 19 aa, Entamoeba dispar
LNSWSDGFIMNAGYLSGLL

SEQ ID NO: 2554234 - protein, 18 aa, Entamoeba dispar
LNTKIALKKKVLKLQSQD

SEQ ID NO: 2554235 - protein, 26 aa, Entamoeba dispar
LNVKLKRNRLSSIYNMKKVKASDKQV

SEQ ID NO: 2554236 - protein, 17 aa, Entamoeba dispar
LPEDFKNGLDMSDGKAY

SEQ ID NO: 2554237 - protein, 18 aa, Entamoeba dispar
LPEHCPRHGSDVPLWISS

SEQ ID NO: 2554238 - protein, 34 aa, Entamoeba dispar
LPEWKTEQTKIWKNWKYILDFYEIFMKEVTMVYH

SEQ ID NO: 2554239 - protein, 30 aa, Entamoeba dispar
LPFSKRLNNEFYYLLCKDIFNVDKQRLDRR

SEQ ID NO: 2554240 - protein, 24 aa, Entamoeba dispar
LPFSRSIDVPDVWPTGKPSCISYH

SEQ ID NO: 2554241 - protein, 23 aa, Entamoeba dispar
LPINLGIIPLNFGVDLDSGIVFD

SEQ ID NO: 2554242 - protein, 18 aa, Entamoeba dispar
LPKKEAPEVKIWKKERCP

SEQ ID NO: 2554243 - protein, 17 aa, Entamoeba dispar
LPKTHIVLHKFMHELNE

SEQ ID NO: 2554244 - protein, 17 aa, Entamoeba dispar
LPLSLQYVRLELNKVLV

SEQ ID NO: 2554245 - protein, 19 aa, Entamoeba dispar
LPMNIRLGFVKDSVMHVIA

SEQ ID NO: 2554246 - protein, 17 aa, Entamoeba dispar
LPPHLQHKILFKNKIEN

SEQ ID NO: 2554247 - protein, 21 aa, Entamoeba dispar
LPPRLYPYIEYGKTVSLEQND

SEQ ID NO: 2554248 - protein, 25 aa, Entamoeba dispar
LPQEWLWCESWCNQKVKSKAKTIDL

SEQ ID NO: 2554249 - protein, 20 aa, Entamoeba dispar
LPQKFLKYKIIPLGEDVIPY

SEQ ID NO: 2554250 - protein, 20 aa, Entamoeba dispar
LPYYDNYYRVIKEFLNEQKQ

SEQ ID NO: 2554251 - protein, 18 aa, Entamoeba dispar
LQEFKKKTDIVFPIEGGE

SEQ ID NO: 2554252 - protein, 17 aa, Entamoeba dispar
LQFNFWRKHIKNNDNDD

SEQ ID NO: 2554253 - protein, 20 aa, Entamoeba dispar
LQHLISFTFSASISIPTIFR

SEQ ID NO: 2554254 - protein, 29 aa, Entamoeba dispar
LQKRMGLCPLNRLRIKRRLRVYKKEVTIA

SEQ ID NO: 2554255 - protein, 22 aa, Entamoeba dispar
LQKYGLKTAPSIAILHKNQRTS

SEQ ID NO: 2554256 - protein, 19 aa, Entamoeba dispar
LQMADWLSTLQNMRIEDVQ

SEQ ID NO: 2554257 - protein, 25 aa, Entamoeba dispar
LQTHCYRNGWEYSNKFGDNKDVDWF

SEQ ID NO: 2554258 - protein, 24 aa, Entamoeba dispar
LQTPCACSKKLLKSLHEKRKQLEE

SEQ ID NO: 2554259 - protein, 19 aa, Entamoeba dispar
LQVLHCSNLPFPSNEKEQI

SEQ ID NO: 2554260 - protein, 18 aa, Entamoeba dispar
LQYLCWPILQVVFKTPLE

SEQ ID NO: 2554261 - protein, 18 aa, Entamoeba dispar
LRDGGFFPTNYDWYTGKI

SEQ ID NO: 2554262 - protein, 18 aa, Entamoeba dispar
LRETAQKEFAEFKENLKS

SEQ ID NO: 2554263 - protein, 20 aa, Entamoeba dispar
LRIYKVYDLFYGGRRLKMSF

SEQ ID NO: 2554264 - protein, 20 aa, Entamoeba dispar
LRIYPKPLFISIHHPNTAVF

SEQ ID NO: 2554265 - protein, 17 aa, Entamoeba dispar
LRKVLVPNSQIFKPYSG

SEQ ID NO: 2554266 - protein, 25 aa, Entamoeba dispar
LRKVRKTRVELMRTLYKLVGKLSVP

SEQ ID NO: 2554267 - protein, 23 aa, Entamoeba dispar
LRLAANPTSRVQLERGIESILSE

SEQ ID NO: 2554268 - protein, 17 aa, Entamoeba dispar
LRLNFLQKELVLLKKGL

SEQ ID NO: 2554269 - protein, 25 aa, Entamoeba dispar
LRLVRGERTFIYLIGHGGEGFMKFQ

SEQ ID NO: 2554270 - protein, 17 aa, Entamoeba dispar
LRNGCYYNKKEKSLTVR

SEQ ID NO: 2554271 - protein, 25 aa, Entamoeba dispar
LRPSELKPLPFGQMDAKICDKSGFE

SEQ ID NO: 2554272 - protein, 23 aa, Entamoeba dispar
LRSYNIFLRHRFGYSERLLEEMT

SEQ ID NO: 2554273 - protein, 19 aa, Entamoeba dispar
LRTPLLFEPIVKFVDSLIF

SEQ ID NO: 2554274 - protein, 20 aa, Entamoeba dispar
LRVKGFKKGDKIGMFCETRF

SEQ ID NO: 2554275 - protein, 31 aa, Entamoeba dispar
LRYQMLPYWYSLWYYHRIDYNPVIRAMYYSF

SEQ ID NO: 2554276 - protein, 22 aa, Entamoeba dispar
LSAKLRCWDTIYVQRTSSIDTS

SEQ ID NO: 2554277 - protein, 17 aa, Entamoeba dispar
LSDNCIVGYKTYCYQCK

SEQ ID NO: 2554278 - protein, 18 aa, Entamoeba dispar
LSFAFTFDDWIRKYQYNK

SEQ ID NO: 2554279 - protein, 23 aa, Entamoeba dispar
LSFFETFRFNYNYTETIPREFLP

SEQ ID NO: 2554280 - protein, 31 aa, Entamoeba dispar
LSGKFDYKASDAWRVTGDGFISNNYGQKSNG

SEQ ID NO: 2554281 - protein, 21 aa, Entamoeba dispar
LSGSIGFFEFLALWNFMNLCN

SEQ ID NO: 2554282 - protein, 24 aa, Entamoeba dispar
  misc_feature (22)..(23): Xaa can be any naturally occurring amino acid
LSKIVPTWCKEKFYGDGNRIYXXP

SEQ ID NO: 2554283 - protein, 22 aa, Entamoeba dispar
LSKKMCDLKAKISVAKNEIKHQ

SEQ ID NO: 2554284 - protein, 19 aa, Entamoeba dispar
LSLFLTFSQALECNETNCS

SEQ ID NO: 2554285 - protein, 18 aa, Entamoeba dispar
LSNAISFDSWMAKNNQKF

SEQ ID NO: 2554286 - protein, 21 aa, Entamoeba dispar
LSPLMFKRIIDTLASVKANVL

SEQ ID NO: 2554287 - protein, 24 aa, Entamoeba dispar
LSQREVVKRIALISEEWNSENGML

SEQ ID NO: 2554288 - protein, 22 aa, Entamoeba dispar
LSRKEKLSFWGIEQATLNYLYY

SEQ ID NO: 2554289 - protein, 29 aa, Entamoeba dispar
LSSYRVGRRVIKQKGKWYRIHTNGLGNNI

SEQ ID NO: 2554290 - protein, 20 aa, Entamoeba dispar
LSTSELRDGGFFPTNYDWYT

SEQ ID NO: 2554291 - protein, 27 aa, Entamoeba dispar
LSYDSEFQLPMGFPLLQPVTYGYAHKN

SEQ ID NO: 2554292 - protein, 18 aa, Entamoeba dispar
LTELKLLVEFVPILISQI

SEQ ID NO: 2554293 - protein, 28 aa, Entamoeba dispar
LTELKVKNLQRVVSWMKKKLETRKVYIA

SEQ ID NO: 2554294 - protein, 17 aa, Entamoeba dispar
LTFLINIVFGGYCTQEG

SEQ ID NO: 2554295 - protein, 17 aa, Entamoeba dispar
LTHLYAFVANNNKLTGS

SEQ ID NO: 2554296 - protein, 19 aa, Entamoeba dispar
LTIIGHGLINLKDIQDSSV

SEQ ID NO: 2554297 - protein, 24 aa, Entamoeba dispar
LTKEGQRSLAELFHNTKQQKDEID

SEQ ID NO: 2554298 - protein, 24 aa, Entamoeba dispar
LTNEKIKQFGFYVDGVRQAVLNGS

SEQ ID NO: 2554299 - protein, 18 aa, Entamoeba dispar
LTRYRVVQLLGQGTFGQV

SEQ ID NO: 2554300 - protein, 17 aa, Entamoeba dispar
LTVRETYRFNYEYNESI

SEQ ID NO: 2554301 - protein, 20 aa, Entamoeba dispar
LTYEEILIVLSYYIAAEYNV

SEQ ID NO: 2554302 - protein, 18 aa, Entamoeba dispar
LTYSGFRAYHDYFTLNYG

SEQ ID NO: 2554303 - protein, 17 aa, Entamoeba dispar
LVACKEFDEKCNQLQRI

SEQ ID NO: 2554304 - protein, 17 aa, Entamoeba dispar
LVDDCSSGSKLTIDKNW

SEQ ID NO: 2554305 - protein, 22 aa, Entamoeba dispar
LVDIGFKLDLILYKKKYSTSIK

SEQ ID NO: 2554306 - protein, 18 aa, Entamoeba dispar
LVLVRLYAAGGINHAKRD

SEQ ID NO: 2554307 - protein, 18 aa, Entamoeba dispar
LWYKFKGDGKYVVINTCN

SEQ ID NO: 2554308 - protein, 25 aa, Entamoeba dispar
LYAPWCGHCKHLAPEFASAAKEING

SEQ ID NO: 2554309 - protein, 24 aa, Entamoeba dispar
LYDYVDLITARICHNVTLPCKDNE

SEQ ID NO: 2554310 - protein, 26 aa, Entamoeba dispar
LYFKYYCPYKPGSELKYFQITFVGEE

SEQ ID NO: 2554311 - protein, 24 aa, Entamoeba dispar
LYFYCIKCSIKIQIIKECNFILFG

SEQ ID NO: 2554312 - protein, 18 aa, Entamoeba dispar
LYKKIAIKKTLLDMSKES

SEQ ID NO: 2554313 - protein, 22 aa, Entamoeba dispar
LYLHFKTLNGINRFNQISLNRI

SEQ ID NO: 2554314 - protein, 26 aa, Entamoeba dispar
LYVYHRRLSSSFSYFAKNAKALEKIP

SEQ ID NO: 2554315 - protein, 17 aa, Entamoeba dispar
LYYGFNITQNNNINVGS

SEQ ID NO: 2554316 - protein, 22 aa, Entamoeba dispar
MAERKAEKLFKPYEEIKIQLFI

SEQ ID NO: 2554317 - protein, 22 aa, Entamoeba dispar
MAPKLLINEFELMLNAIKQNNE

SEQ ID NO: 2554318 - protein, 17 aa, Entamoeba dispar
MDKSQLLYMEDFIHIMN

SEQ ID NO: 2554319 - protein, 23 aa, Entamoeba dispar
MDPCTDCKLDGYGGHTTDIRIVC

SEQ ID NO: 2554320 - protein, 24 aa, Entamoeba dispar
MEGLDFSFVLTRARFNELNLDLFK

SEQ ID NO: 2554321 - protein, 24 aa, Entamoeba dispar
MELQKRLPGFKVFPAPGNHDYFKH

SEQ ID NO: 2554322 - protein, 18 aa, Entamoeba dispar
METRRIGPGFIQQVQSTC

SEQ ID NO: 2554323 - protein, 20 aa, Entamoeba dispar
MEYATALGFDYCAREENKGK

SEQ ID NO: 2554324 - protein, 20 aa, Entamoeba dispar
MFDMVSWATTYLLGGNTSLG

SEQ ID NO: 2554325 - protein, 19 aa, Entamoeba dispar
MFDSEVLTYSGFRAYHDYF

SEQ ID NO: 2554326 - protein, 19 aa, Entamoeba dispar
MFEGLYPFYNYKGMDMASL

SEQ ID NO: 2554327 - protein, 18 aa, Entamoeba dispar
MFYDCTSLTAISIPNSVT

SEQ ID NO: 2554328 - protein, 19 aa, Entamoeba dispar
MGASYGGYMMNWINSQNTG

SEQ ID NO: 2554329 - protein, 21 aa, Entamoeba dispar
MGGYMAYRLLDYLGNDFCNQY

SEQ ID NO: 2554330 - protein, 21 aa, Entamoeba dispar
MGSIKKKKWGFSFFHREKKDK

SEQ ID NO: 2554331 - protein, 24 aa, Entamoeba dispar
MGSIKKKKWGFSFFHREKKDKKDS

SEQ ID NO: 2554332 - protein, 17 aa, Entamoeba dispar
MHRNFKREFGIIKEKED

SEQ ID NO: 2554333 - protein, 18 aa, Entamoeba dispar
MIRRSVGKNSIMRKAAIN

SEQ ID NO: 2554334 - protein, 17 aa, Entamoeba dispar
MITHEFIKISEIVFGNG

SEQ ID NO: 2554335 - protein, 18 aa, Entamoeba dispar
MKEELAVLKERIQSEKDK

SEQ ID NO: 2554336 - protein, 21 aa, Entamoeba dispar
MKEKVISSMALFLKPSLSEGI

SEQ ID NO: 2554337 - protein, 25 aa, Entamoeba dispar
MKGSMYRWRTVGLYDLNEIQIKCAI

SEQ ID NO: 2554338 - protein, 26 aa, Entamoeba dispar
MKKQYKIKDFVPIDWYINSPYLDKEF

SEQ ID NO: 2554339 - protein, 21 aa, Entamoeba dispar
MKLSNEMARMLSAVDEQSIGN

SEQ ID NO: 2554340 - protein, 26 aa, Entamoeba dispar
MKMNNLHKFYSMFIFILIIVITNATE

SEQ ID NO: 2554341 - protein, 26 aa, Entamoeba dispar
MKSQIVSLHARKTRIIGVMKKILNKF

SEQ ID NO: 2554342 - protein, 17 aa, Entamoeba dispar
MKYTAWTNCTEKKYKII

SEQ ID NO: 2554343 - protein, 18 aa, Entamoeba dispar
MLAVCFATVKTPTTTPVV

SEQ ID NO: 2554344 - protein, 18 aa, Entamoeba dispar
MLFTSIAHPCSTYYKQLN

SEQ ID NO: 2554345 - protein, 26 aa, Entamoeba dispar
MLIGLGAKESFSFARYQATDDGSYFI

SEQ ID NO: 2554346 - protein, 23 aa, Entamoeba dispar
MLTWKEHKCHLIDPSTLEIKSTL

SEQ ID NO: 2554347 - protein, 23 aa, Entamoeba dispar
MMIKPESKLTMIFNNIKKEVEKK

SEQ ID NO: 2554348 - protein, 17 aa, Entamoeba dispar
MNCRICHNISLPCRNGE

SEQ ID NO: 2554349 - protein, 25 aa, Entamoeba dispar
MNLKRCLRTRIAMNDEIKRKEIERK

SEQ ID NO: 2554350 - protein, 25 aa, Entamoeba dispar
MNRSKIDFCSIKFLYNSSLHIYLQK

SEQ ID NO: 2554351 - protein, 18 aa, Entamoeba dispar
MNRTKGVMQRVRYPYEAE

SEQ ID NO: 2554352 - protein, 18 aa, Entamoeba dispar
MPIRGRSFITGQIDTRTT

SEQ ID NO: 2554353 - protein, 20 aa, Entamoeba dispar
MRKKAFDALKRIRMLRRNKR

SEQ ID NO: 2554354 - protein, 20 aa, Entamoeba dispar
MRLKIRKVIMKIARKKNKDE

SEQ ID NO: 2554355 - protein, 19 aa, Entamoeba dispar
MRNKAMCYECQPGYIYDTL

SEQ ID NO: 2554356 - protein, 23 aa, Entamoeba dispar
MSAWYILSVMGFYSVTPGTDQFI

SEQ ID NO: 2554357 - protein, 17 aa, Entamoeba dispar
MTFKGKPIMKMAEENGQ

SEQ ID NO: 2554358 - protein, 19 aa, Entamoeba dispar
MTKPFKFYVKPYMQNTSSE

SEQ ID NO: 2554359 - protein, 23 aa, Entamoeba dispar
MTKYWRKRLDGVDEILRELQAVE

SEQ ID NO: 2554360 - protein, 27 aa, Entamoeba dispar
MVNMTFRIMPTILMFRGNDHKPIEISS

SEQ ID NO: 2554361 - protein, 18 aa, Entamoeba dispar
MVRRKMLILEEKIKTAKI

SEQ ID NO: 2554362 - protein, 22 aa, Entamoeba dispar
MVYQMTCLKKFVFFEKLGYFPE

SEQ ID NO: 2554363 - protein, 25 aa, Entamoeba dispar
MYSDPLSNRGIVYISRRMEGNTFDF

SEQ ID NO: 2554364 - protein, 19 aa, Entamoeba dispar
MYSMIPDWIETIPTELNKD

SEQ ID NO: 2554365 - protein, 32 aa, Entamoeba dispar
MYTKSNLGKDWKYGAEVQHSFNDKWSANAQVS

SEQ ID NO: 2554366 - protein, 22 aa, Entamoeba dispar
NAEIFRPYAGFIGYAKNNMGLV

SEQ ID NO: 2554367 - protein, 23 aa, Entamoeba dispar
NAGLKFQAVMSFHKCGGNVGDSV

SEQ ID NO: 2554368 - protein, 17 aa, Entamoeba dispar
NAGYPGVVADIWDYIVS

SEQ ID NO: 2554369 - protein, 21 aa, Entamoeba dispar
NALFFDFYYSLPFKVSISNTK

SEQ ID NO: 2554370 - protein, 21 aa, Entamoeba dispar
NCINAEHYDCIQIGHEFEDGF

SEQ ID NO: 2554371 - protein, 19 aa, Entamoeba dispar
NCKWVDHIVTVVGYGTTEE

SEQ ID NO: 2554372 - protein, 18 aa, Entamoeba dispar
NCYHKLYFTYKTLTEGNH

SEQ ID NO: 2554373 - protein, 21 aa, Entamoeba dispar
NDKLWNVLDSIQFKDIPQEHI

SEQ ID NO: 2554374 - protein, 17 aa, Entamoeba dispar
NDLNGLINIATIDLSNN

SEQ ID NO: 2554375 - protein, 18 aa, Entamoeba dispar
NDNVPLFEGWKCNSLQLD

SEQ ID NO: 2554376 - protein, 25 aa, Entamoeba dispar
NDQEPFCWSESVFADVVHKNLPDRF

SEQ ID NO: 2554377 - protein, 24 aa, Entamoeba dispar
NDVKRFKQQFIYIINDKYKKPTIV

SEQ ID NO: 2554378 - protein, 18 aa, Entamoeba dispar
NDYSIGIRIQFGNFVYVT

SEQ ID NO: 2554379 - protein, 18 aa, Entamoeba dispar
NECIRRDNNTFIKMELND

SEQ ID NO: 2554380 - protein, 18 aa, Entamoeba dispar
NEEFVIALNQLRKYTEDP

SEQ ID NO: 2554381 - protein, 20 aa, Entamoeba dispar
NEILDIPIDVPEEIVNNEKV

SEQ ID NO: 2554382 - protein, 21 aa, Entamoeba dispar
NEKFPCFIEVVGIQSPGLTAS

SEQ ID NO: 2554383 - protein, 25 aa, Entamoeba dispar
NEKTLYYGSRWGVIRQLDAASMMEK

SEQ ID NO: 2554384 - protein, 26 aa, Entamoeba dispar
NEKTLYYGSRWGVIRQLDAASMMEKS

SEQ ID NO: 2554385 - protein, 25 aa, Entamoeba dispar
NELKKPREGWNWKLQILEIANSPMP

SEQ ID NO: 2554386 - protein, 20 aa, Entamoeba dispar
NEMKEYLSGEWKFYQVETTI

SEQ ID NO: 2554387 - protein, 31 aa, Entamoeba dispar; identical to SEQ ID NO: 2497460

SEQ ID NO: 2554388 - protein, 22 aa, Entamoeba dispar
NEPIPLLLIKSMKTIKNALPYP

SEQ ID NO: 2554389 - protein, 18 aa, Entamoeba dispar
NEPIQHLIYLYKSLNKGE

SEQ ID NO: 2554390 - protein, 19 aa, Entamoeba dispar
NEPLGIPIDVPEEIVNNEK

SEQ ID NO: 2554391 - protein, 25 aa, Entamoeba dispar
NFFKGKLKLKRRIKFLKLPFFRILP

SEQ ID NO: 2554392 - protein, 21 aa, Entamoeba dispar
NFKEIKVSLLRKMVNEDEQEL

SEQ ID NO: 2554393 - protein, 28 aa, Entamoeba dispar
NFKGSRPAGLCQLRWNGNGYTQNLIQGD

SEQ ID NO: 2554394 - protein, 23 aa, Entamoeba dispar
NFNYSGECAVPFKYKPNNKRDLL

SEQ ID NO: 2554395 - protein, 26 aa, Entamoeba dispar
NFPSEFPEEPVVFVFHLSITGSSNKV

SEQ ID NO: 2554396 - protein, 18 aa, Entamoeba dispar
NGAKRFGYNGGDNNEVQE

SEQ ID NO: 2554397 - protein, 21 aa, Entamoeba dispar
NGCRGCEGGSIGSALKYAQDN

SEQ ID NO: 2554398 - protein, 17 aa, Entamoeba dispar
NGCYYNKKEKSLTVRGT

SEQ ID NO: 2554399 - protein, 18 aa, Entamoeba dispar
NGESVTINYSIFKLSTSN

SEQ ID NO: 2554400 - protein, 20 aa, Entamoeba dispar
NGEYCLRADMNGWGVNPTKC

SEQ ID NO: 2554401 - protein, 33 aa, Entamoeba dispar
NGEYPFNIIHEFGKKYSALKCPHAQFTEAKDDL

SEQ ID NO: 2554402 - protein, 20 aa, Entamoeba dispar
NGGSILYVYAYTKRNGVMQE

SEQ ID NO: 2554403 - protein, 18 aa, Entamoeba dispar
NGICECTILETSAKTSFN

SEQ ID NO: 2554404 - protein, 29 aa, Entamoeba dispar
NGKGKVCKSLFMKYLRKQPNWNIKLETKV

SEQ ID NO: 2554405 - protein, 17 aa, Entamoeba dispar
NGYTRYTDCVQSEYEEY

SEQ ID NO: 2554406 - protein, 17 aa, Entamoeba dispar
NHGFSIQTIRKFVQQIL

SEQ ID NO: 2554407 - protein, 24 aa, Entamoeba dispar
NHGQCLQCAPGYFLTENYLCSQCH

SEQ ID NO: 2554408 - protein, 23 aa, Entamoeba dispar
NHIGHALLTLGILDLIKKSQSPR

SEQ ID NO: 2554409 - protein, 17 aa, Entamoeba dispar
NHRNIMVGNHVNCAIAD

SEQ ID NO: 2554410 - protein, 25 aa, Entamoeba dispar
NHWVLRPYNSIDWHTQVFNWLAKYL

SEQ ID NO: 2554411 - protein, 20 aa, Entamoeba dispar
NIDLLWSMKNIIHIQYNKQK

SEQ ID NO: 2554412 - protein, 30 aa, Entamoeba dispar
NIGFNSFFIFRCWRSLGSWDPNAKGINNNA

SEQ ID NO: 2554413 - protein, 20 aa, Entamoeba dispar
NIGRAFSFPVTVQVYSIAGT

SEQ ID NO: 2554414 - protein, 20 aa, Entamoeba dispar
NIKLYIKIAHVLRKQEQTCP

SEQ ID NO: 2554415 - protein, 17 aa, Entamoeba dispar
NINAYIMALKLFPNYYF

SEQ ID NO: 2554416 - protein, 18 aa, Entamoeba dispar
NINLPKTHIVLHKFMHEL

SEQ ID NO: 2554417 - protein, 20 aa, Entamoeba dispar
NINRRLRNSIIRASKRSERK

SEQ ID NO: 2554418 - protein, 22 aa, Entamoeba dispar
NIRRFMSLQFNFWRKHIKNNDN

SEQ ID NO: 2554419 - protein, 27 aa, Entamoeba dispar
NIYHCSCLCSLKILGLVSYLILLPTSL

SEQ ID NO: 2554420 - protein, 19 aa, Entamoeba dispar
NKACPNGIDAVWLWVNGSD

SEQ ID NO: 2554421 - protein, 19 aa, Entamoeba dispar
NKCNWCYHQFLTINGSCIQ

SEQ ID NO: 2554422 - protein, 26 aa, Entamoeba dispar
NKDEIIRFGALNAMIDIGKCDETKKI

SEQ ID NO: 2554423 - protein, 24 aa, Entamoeba dispar
NKEACGLILFVGWKGQAKARYLKS

SEQ ID NO: 2554424 - protein, 18 aa, Entamoeba dispar
NKEIKIISIDGHFEGEYT

SEQ ID NO: 2554425 - protein, 23 aa, Entamoeba dispar
NKFRKANDIVISFLHAATIVEQH

SEQ ID NO: 2554426 - protein, 26 aa, Entamoeba dispar
NKFVPEKWVVPSLKKNSMQFGSIIQK

SEQ ID NO: 2554427 - protein, 18 aa, Entamoeba dispar
NKGATLIIWMKKAPLDPG

SEQ ID NO: 2554428 - protein, 28 aa, Entamoeba dispar
NKIKSGGVAGVMADVWWGLVETSPRNYN

SEQ ID NO: 2554429 - protein, 21 aa, Entamoeba dispar
NKKELPKFIIVGNKIDQEINR

SEQ ID NO: 2554430 - protein, 18 aa, Entamoeba dispar
NKKLLLKSKVFARKARKS

SEQ ID NO: 2554431 - protein, 25 aa, Entamoeba dispar
NKNIKEQIKAGGLQRQEINRMVREN

SEQ ID NO: 2554432 - protein, 26 aa, Entamoeba dispar
NKNMLKSNHGWRSDLFNRPLDQVKMT

SEQ ID NO: 2554433 - protein, 18 aa, Entamoeba dispar
NKPGYKPSAVVMEVDEDL

SEQ ID NO: 2554434 - protein, 17 aa, Entamoeba dispar
NKQRILLETKINNEINK

SEQ ID NO: 2554435 - protein, 24 aa, Entamoeba dispar
NKQTDCKICRKLGKVAKYGIVHHE

SEQ ID NO: 2554436 - protein, 23 aa, Entamoeba dispar
NKRIEEFEKIMIHEAQLIIHKKD

SEQ ID NO: 2554437 - protein, 28 aa, Entamoeba dispar
NKTIIITPVELVFPFSTNPRIRNAQILM

SEQ ID NO: 2554438 - protein, 18 aa, Entamoeba dispar
NKTLISIKDGIQLNQDII

SEQ ID NO: 2554439 - protein, 22 aa, Entamoeba dispar
NKTLKFSNIRFKDFENKKTCKV

SEQ ID NO: 2554440 - protein, 22 aa, Entamoeba dispar
NKYEVHGYPTLKSFPKGENKKP

SEQ ID NO: 2554441 - protein, 30 aa, Entamoeba dispar
NKYPTFIQWGYKILGFFIFKSVEDGIQTAL

SEQ ID NO: 2554442 - protein, 21 aa, Entamoeba dispar
NLEFIKTTIILTDWNTSNKRE

SEQ ID NO: 2554443 - protein, 24 aa, Entamoeba dispar
NLKFSSDNKGIWYLISSYEGSINK

SEQ ID NO: 2554444 - protein, 28 aa, Entamoeba dispar
NLSELRMTKNFWIARESFSLKARALEHI

SEQ ID NO: 2554445 - protein, 28 aa, Entamoeba dispar
NMDPEPLIKCAFGSYGNILMKEAVDRPI

SEQ ID NO: 2554446 - protein, 21 aa, Entamoeba dispar
NMTIPKCKEACSLQVDQSSFN

SEQ ID NO: 2554447 - protein, 26 aa, Entamoeba dispar
NMVGASYDWRYYRYGEYKHKRNWFED

SEQ ID NO: 2554448 - protein, 18 aa, Entamoeba dispar
NMYHPALMIYQFLSELGF

SEQ ID NO: 2554449 - protein, 38 aa, Entamoeba dispar
NNDALKNSLSFYFYPEFEISDSKPFIFAPHGEGTFVNK

SEQ ID NO: 2554450 - protein, 20 aa, Entamoeba dispar
NNDYWGRHRAAIAFLAAYTG

SEQ ID NO: 2554451 - protein, 20 aa, Entamoeba dispar
NNDYWGRHRAAIAFLASYTG

SEQ ID NO: 2554452 - protein, 20 aa, Entamoeba dispar
NNFFSVCMSDFVAVNIDAPT

SEQ ID NO: 2554453 - protein, 21 aa, Entamoeba dispar
NNGKHPVVWEEVFKKGNADKS

SEQ ID NO: 2554454 - protein, 25 aa, Entamoeba dispar
NNGKWDITGDLSLSKGVQNANGKIN

SEQ ID NO: 2554455 - protein, 25 aa, Entamoeba dispar
NNILSFKLKPTWSINKNIQLNIISL

SEQ ID NO: 2554456 - protein, 22 aa, Entamoeba dispar
NNKCYRCFDGYHIHHGECEKND

SEQ ID NO: 2554457 - protein, 17 aa, Entamoeba dispar
NNKSFFDFFEIFDDDVM

SEQ ID NO: 2554458 - protein, 23 aa, Entamoeba dispar
NNYFPQICFVHKNLFYDRIGDIQ

SEQ ID NO: 2554459 - protein, 23 aa, Entamoeba dispar
NNYIANVWFYFGSRDNPFKANKV

SEQ ID NO: 2554460 - protein, 21 aa, Entamoeba dispar
NPDFWSNEPLIIFKKSGKQFF

SEQ ID NO: 2554461 - protein, 17 aa, Entamoeba dispar
NPFQFVGSNSIEYPGEY

SEQ ID NO: 2554462 - protein, 17 aa, Entamoeba dispar
NPHCLQLLEKSKIPYQD

SEQ ID NO: 2554463 - protein, 22 aa, Entamoeba dispar
NPIKKFFKWILSLFEKDKSYPV

SEQ ID NO: 2554464 - protein, 19 aa, Entamoeba dispar
NPISMILDDVFAHYYEVTD

SEQ ID NO: 2554465 - protein, 25 aa, Entamoeba dispar
NPLLKHLRLNFLLEYFPNIETIESS

SEQ ID NO: 2554466 - protein, 19 aa, Entamoeba dispar
NPLPRWGNYQRFGAYMRVV

SEQ ID NO: 2554467 - protein, 24 aa, Entamoeba dispar
NPNLKVLASIGGWNFNFYDSTKHL

SEQ ID NO: 2554468 - protein, 19 aa, Entamoeba dispar
NPQVIAAQGYIVFAPNFHG

SEQ ID NO: 2554469 - protein, 17 aa, Entamoeba dispar
NQHRVMNQIFRLKHRMF

SEQ ID NO: 2554470 - protein, 26 aa, Entamoeba dispar
NQIEHKFLMMKGVESIIAQANDDLLQ

SEQ ID NO: 2554471 - protein, 23 aa, Entamoeba dispar
NQRKCASCYAFGSVATIESLIMQ

SEQ ID NO: 2554472 - protein, 26 aa, Entamoeba dispar
NQTRLEFKLLLGFIPPFSSLNNIQNL

SEQ ID NO: 2554473 - protein, 27 aa, Entamoeba dispar
NQWLKLIIEPRIQPLLIQSDKPITIKE

SEQ ID NO: 2554474 - protein, 24 aa, Entamoeba dispar
NREASFSNALAWILLSKGYSLQLG

SEQ ID NO: 2554475 - protein, 18 aa, Entamoeba dispar
NRPLSIQVIDRLRPQQCI

SEQ ID NO: 2554476 - protein, 18 aa, Entamoeba dispar
NRSINLLVLKTFYPNLFE

SEQ ID NO: 2554477 - protein, 25 aa, Entamoeba dispar
NSATFPSICTAWDRNGVKIKVVDIS

SEQ ID NO: 2554478 - protein, 18 aa, Entamoeba dispar
NSCNISSNICSSCTSGYS

SEQ ID NO: 2554479 - protein, 17 aa, Entamoeba dispar
NSERLCIPIAENCLDGY

SEQ ID NO: 2554480 - protein, 19 aa, Entamoeba dispar
NSETCSRKPVILIPGIMSS

SEQ ID NO: 2554481 - protein, 19 aa, Entamoeba dispar
NSFDSYLYERFPKQLESFF

SEQ ID NO: 2554482 - protein, 17 aa, Entamoeba dispar
NSKERFAHIKFDNFVNI

SEQ ID NO: 2554483 - protein, 21 aa, Entamoeba dispar
NSTYFDLRFNQVTSTPIIFRL

SEQ ID NO: 2554484 - protein, 21 aa, Entamoeba dispar
NSWGNSWGEMGYARISINDLC

SEQ ID NO: 2554485 - protein, 19 aa, Entamoeba dispar
NSWGTAWGDAGYFLLARDS

SEQ ID NO: 2554486 - protein, 19 aa, Entamoeba dispar
NSWGTGWGDKGYINMVIEG

SEQ ID NO: 2554487 - protein, 25 aa, Entamoeba dispar
NTCDGKCKKGLLCALSHLTEAEYKE

SEQ ID NO: 2554488 - protein, 25 aa, Entamoeba dispar
NTGRFKCIICHDGIMDSEGSYYYMD

SEQ ID NO: 2554489 - protein, 22 aa, Entamoeba dispar
NTIFEIKRLIGRTFDDKEVQRD

SEQ ID NO: 2554490 - protein, 19 aa, Entamoeba dispar
NTMDLCVVQKVTIGTEGKI

SEQ ID NO: 2554491 - protein, 25 aa, Entamoeba dispar
NTNGIKWNTLWFDVEKDSWSSNVAT

SEQ ID NO: 2554492 - protein, 33 aa, Entamoeba dispar
NVFVKFFAPWCGHCKALAPKYIEVSKMYAGEDD

SEQ ID NO: 2554493 - protein, 25 aa, Entamoeba dispar
NVKLKRNRLSSIYNMKKVKASDKQI

SEQ ID NO: 2554494 - protein, 19 aa, Entamoeba dispar
NVLEHFDIIFLQDVIGAYS

SEQ ID NO: 2554495 - protein, 26 aa, Entamoeba dispar
NVSYELRMLKALHLYETIFRGKKNNL

SEQ ID NO: 2554496 - protein, 17 aa, Entamoeba dispar
NVVSKLKQSVQVTTDKN

SEQ ID NO: 2554497 - protein, 20 aa, Entamoeba dispar
NWQNYQFVIKQCVNLFDENS

SEQ ID NO: 2554498 - protein, 19 aa, Entamoeba dispar
NWSGYRTQFRYNRQPIDNE

SEQ ID NO: 2554499 - protein, 23 aa, Entamoeba dispar
NYKSAYGKFFLGWYQQLLLDHAN

SEQ ID NO: 2554500 - protein, 20 aa, Entamoeba dispar
NYNKECKFEGSKVIPINSYL

SEQ ID NO: 2554501 - protein, 18 aa, Entamoeba dispar
NYNQFPIVNFYREGILFS

SEQ ID NO: 2554502 - protein, 17 aa, Entamoeba dispar
NYVLGCVEGEYYKVVER

SEQ ID NO: 2554503 - protein, 20 aa, Entamoeba dispar
PALMIYQFLSELGFANAQLN

SEQ ID NO: 2554504 - protein, 17 aa, Entamoeba dispar
PARACFAAAALPKGALV

SEQ ID NO: 2554505 - protein, 18 aa, Entamoeba dispar
PCGDELVNLAKMYDNKIQ

SEQ ID NO: 2554506 - protein, 31 aa, Entamoeba dispar
PCGETRYPSYPLSRWSYCGVGEFQCNDGKSK

SEQ ID NO: 2554507 - protein, 19 aa, Entamoeba dispar
PCISTGFNEDSKWINETTF

SEQ ID NO: 2554508 - protein, 20 aa, Entamoeba dispar
PDILTTLQVVSWRQEAYQDD

SEQ ID NO: 2554509 - protein, 19 aa, Entamoeba dispar
PDNIPKPICEEFISQKSFK

SEQ ID NO: 2554510 - protein, 24 aa, Entamoeba dispar
PDNNPYTFNPCVVDEVPISSSTKS

SEQ ID NO: 2554511 - protein, 27 aa, Entamoeba dispar
PEDMCSGKLCRFRVKQVMRKCKLYEHK

SEQ ID NO: 2554512 - protein, 21 aa, Entamoeba dispar
PEDMGTKVLYYAKYESSIPSD

SEQ ID NO: 2554513 - protein, 18 aa, Entamoeba dispar
PEEAFECIDSIQTTEEFN

SEQ ID NO: 2554514 - protein, 19 aa, Entamoeba dispar
PEEISAMIIQKMAKTASDY

SEQ ID NO: 2554515 - protein, 20 aa, Entamoeba dispar
PEERMKRAAGKAWEKLKDEG

SEQ ID NO: 2554516 - protein, 17 aa, Entamoeba dispar
PEGIDFRKFGKLTYIRE

SEQ ID NO: 2554517 - protein, 22 aa, Entamoeba dispar
PEGLNIKELVMIKGCVRGCEYK

SEQ ID NO: 2554518 - protein, 18 aa, Entamoeba dispar
PELKKARHNELKFIAQVL

SEQ ID NO: 2554519 - protein, 25 aa, Entamoeba dispar
PESPWTNNFHYRWNPQVIAAQGYIV

SEQ ID NO: 2554520 - protein, 22 aa, Entamoeba dispar
PFFSKCITLLFVLLFVTVVIQV

SEQ ID NO: 2554521 - protein, 18 aa, Entamoeba dispar
PFISYGYGLSLSFFETFR

SEQ ID NO: 2554522 - protein, 25 aa, Entamoeba dispar
PGKYHVKLGKKFPVEPYDFTDAQIA

SEQ ID NO: 2554523 - protein, 19 aa, Entamoeba dispar
PHSRILKMLDYFMYYGHIC

SEQ ID NO: 2554524 - protein, 23 aa, Entamoeba dispar
PHSRILKMLDYFMYYGHICIVTE

SEQ ID NO: 2554525 - protein, 21 aa, Entamoeba dispar
PHTCYSAAMSLMAHFDSKIID

SEQ ID NO: 2554526 - protein, 17 aa, Entamoeba dispar
PIEIKWSDNSNITVSYQ

SEQ ID NO: 2554527 - protein, 19 aa, Entamoeba dispar
PIKPPSLGDGFIKVDNHYE

SEQ ID NO: 2554528 - protein, 18 aa, Entamoeba dispar
PINIVIKPKTDFTLFPHS

SEQ ID NO: 2554529 - protein, 17 aa, Entamoeba dispar
PISITWENGESVTINYS

SEQ ID NO: 2554530 - protein, 19 aa, Entamoeba dispar
PIVDGFRCVEKGIYAAGNQ

SEQ ID NO: 2554531 - protein, 19 aa, Entamoeba dispar
PKECLRQSDEFRIWENITF

SEQ ID NO: 2554532 - protein, 17 aa, Entamoeba dispar
PKGGKVKDQEKIMKKKF

SEQ ID NO: 2554533 - protein, 19 aa, Entamoeba dispar
PKKVNYCDQRRPVFLFNGM

SEQ ID NO: 2554534 - protein, 21 aa, Entamoeba dispar
PKQIQRLAADFLDNYVFITVG

SEQ ID NO: 2554535 - protein, 17 aa, Entamoeba dispar
PKSVCSRSVNGKAIQRY

SEQ ID NO: 2554536 - protein, 33 aa, Entamoeba dispar
PLEEFDRLKSKGIEYVWMMGVWQLGEYGLNLDR

SEQ ID NO: 2554537 - protein, 18 aa, Entamoeba dispar
PLFGRGGYIITERMVTEG

SEQ ID NO: 2554538 - protein, 17 aa, Entamoeba dispar
PLFKGYAKLKFPFVNKI

SEQ ID NO: 2554539 - protein, 19 aa, Entamoeba dispar
PLKLCREGKGNAGKYGDYS

SEQ ID NO: 2554540 - protein, 39 aa, Entamoeba dispar
PLNETLFPFHLHKKMKAILLTLFVLICFVSANELLEKEL

SEQ ID NO: 2554541 - protein, 23 aa, Entamoeba dispar
PLTEGRPGATIAARYDLDESRPS

SEQ ID NO: 2554542 - protein, 25 aa, Entamoeba dispar
PLYYYKVWSRDAVFASIIMMALGET

SEQ ID NO: 2554543 - protein, 23 aa, Entamoeba dispar
PMIPKYSLGYHQCRWNYMNQNDA

SEQ ID NO: 2554544 - protein, 19 aa, Entamoeba dispar
PNENSNLYASLKRDQTNNN

SEQ ID NO: 2554545 - protein, 20 aa, Entamoeba dispar
PNIRFLREIIINDISDIYIG

SEQ ID NO: 2554546 - protein, 24 aa, Entamoeba dispar
PNSELVYFYYFLPFTLYIDNNKKM

SEQ ID NO: 2554547 - protein, 20 aa, Entamoeba dispar
PNVKTAVALPEMPYGIQQSR

SEQ ID NO: 2554548 - protein, 20 aa, Entamoeba dispar
PPEGCGLTIKADECSTETGC

SEQ ID NO: 2554549 - protein, 20 aa, Entamoeba dispar
PPRVIVEADVMSKCPDFKNF

SEQ ID NO: 2554550 - protein, 17 aa, Entamoeba dispar
PQIPILLVACKEFDEKC

SEQ ID NO: 2554551 - protein, 37 aa, Entamoeba dispar
PQMSGLLMKEGYLLKRWKERFVVVKNSYLFYFVSEKS

SEQ ID NO: 2554552 - protein, 19 aa, Entamoeba dispar
PQNEPSLFILRPNEKPIEY

SEQ ID NO: 2554553 - protein, 21 aa, Entamoeba dispar
PQPGTLYAIEQMPGYYGAGDR

SEQ ID NO: 2554554 - protein, 18 aa, Entamoeba dispar
PQSKRADVIIPWGEISNN

SEQ ID NO: 2554555 - protein, 17 aa, Entamoeba dispar
PRGAAYVRQEHIEPFRV

SEQ ID NO: 2554556 - protein, 20 aa, Entamoeba dispar
PRIIVMSSLSAADWHQKEIP

SEQ ID NO: 2554557 - protein, 18 aa, Entamoeba dispar
PRKGYMGDVLRGMSEIQS

SEQ ID NO: 2554558 - protein, 20 aa, Entamoeba dispar
PRQGKDFLFFILLFVSLVTL

SEQ ID NO: 2554559 - protein, 25 aa, Entamoeba dispar
PSKCKRCKPGYIPVDFEFCKKSDGC

SEQ ID NO: 2554560 - protein, 20 aa, Entamoeba dispar
PSLFLILLFLFCVGSLSNKK

SEQ ID NO: 2554561 - protein, 18 aa, Entamoeba dispar
PSLSSLTHLYAFVANNNK

SEQ ID NO: 2554562 - protein, 25 aa, Entamoeba dispar
PSSFKIRIGIDADKGAIYIIDNGIG

SEQ ID NO: 2554563 - protein, 24 aa, Entamoeba dispar
PTRITGDVGELWVGGNDYYDYNYH

SEQ ID NO: 2554564 - protein, 19 aa, Entamoeba dispar
PVFIDKFNIHFSMTDYSLL

SEQ ID NO: 2554565 - protein, 20 aa, Entamoeba dispar
PVIADESWKLLFKTESIRLK

SEQ ID NO: 2554566 - protein, 20 aa, Entamoeba dispar
PYPAHHCYFMLTNTLNEMEE

SEQ ID NO: 2554567 - protein, 19 aa, Entamoeba dispar
PYRIEFEGDSFDSKYTVIF

SEQ ID NO: 2554568 - protein, 19 aa, Entamoeba dispar
PYSVHLMFVLLKSNEGKYY

SEQ ID NO: 2554569 - protein, 20 aa, Entamoeba dispar
PYYCGISCFLKSYNSPMVHY

SEQ ID NO: 2554570 - protein, 24 aa, Entamoeba dispar
PYYKELLVKCLIPKYRYKTRQEVG

SEQ ID NO: 2554571 - protein, 18 aa, Entamoeba dispar
QAFIKQLVQYGAKRGIIV

SEQ ID NO: 2554572 - protein, 20 aa, Entamoeba dispar
QAFTGFKQQRFLEYNAERGL

SEQ ID NO: 2554573 - protein, 25 aa, Entamoeba dispar
QAKGNSVLVVGHFPLGVAAYDCKNY

SEQ ID NO: 2554574 - protein, 22 aa, Entamoeba dispar
QAKKASDGRSVWTGNQHLKTLT

SEQ ID NO: 2554575 - protein, 19 aa, Entamoeba dispar
QAKTDIKECLKEDLKNSMN

SEQ ID NO: 2554576 - protein, 20 aa, Entamoeba dispar
QAYELLKKDATNFMNAYDAA

SEQ ID NO: 2554577 - protein, 26 aa, Entamoeba dispar
QCIVEKKISEWFARSISSALISLSTH

SEQ ID NO: 2554578 - protein, 20 aa, Entamoeba dispar
QCPHKVKGQIWINRKDLIPF

SEQ ID NO: 2554579 - protein, 25 aa, Entamoeba dispar
QDMQLYFHKNCRRYVEHEKDYSTCK

SEQ ID NO: 2554580 - protein, 18 aa, Entamoeba dispar
QDPMNWYICDDACVINEE

SEQ ID NO: 2554581 - protein, 18 aa, Entamoeba dispar
QEDKRPFEIFTLNNNFYG

SEQ ID NO: 2554582 - protein, 23 aa, Entamoeba dispar
QENCGSCYAFSSVALMETAVLLA

SEQ ID NO: 2554583 - protein, 19 aa, Entamoeba dispar
QFACIYKVFHEEFSIDLKD

SEQ ID NO: 2554584 - protein, 18 aa, Entamoeba dispar
QFEPFKWIQSSNIYSFEE

SEQ ID NO: 2554585 - protein, 22 aa, Entamoeba dispar
QFGVPLEKIRGVIITHSHSDHA

SEQ ID NO: 2554586 - protein, 24 aa, Entamoeba dispar
QFTQARSAISFGSLSDIPLTKEYL

SEQ ID NO: 2554587 - protein, 25 aa, Entamoeba dispar
QGECGGCYAMALAQVLQAHYTHLTL

SEQ ID NO: 2554588 - protein, 26 aa, Entamoeba dispar
QGNFNYKANDNWTFTGNGKANNQYGK

SEQ ID NO: 2554589 - protein, 25 aa, Entamoeba dispar
QGVGNELYYSVAHHSIFYTKCDSIC

SEQ ID NO: 2554590 - protein, 20 aa, Entamoeba dispar
QHHTRWFKIKNYENVPLLVN

SEQ ID NO: 2554591 - protein, 19 aa, Entamoeba dispar
QIEPPRFGSTYAVDTISPS

SEQ ID NO: 2554592 - protein, 19 aa, Entamoeba dispar
QIETPILHYIYDTKMSKST

SEQ ID NO: 2554593 - protein, 25 aa, Entamoeba dispar
QIIKNGKTPVCWEEVYQKGSADKKT

SEQ ID NO: 2554594 - protein, 26 aa, Entamoeba dispar
QIKNDLIFYIKVMREPSIIIVSNEII

SEQ ID NO: 2554595 - protein, 22 aa, Entamoeba dispar
QIKRELPKGAFIQHLESPKNNT

SEQ ID NO: 2554596 - protein, 25 aa, Entamoeba dispar
QILKEFGYKGSKAIPISLIDINNKI

SEQ ID NO: 2554597 - protein, 18 aa, Entamoeba dispar
QIREAEKVVEFLKVTIED

SEQ ID NO: 2554598 - protein, 19 aa, Entamoeba dispar
QIRPLSALISLLSLSFSQD

SEQ ID NO: 2554599 - protein, 22 aa, Entamoeba dispar
QKAKEDKIMFELDVRDAIEKAN

SEQ ID NO: 2554600 - protein, 23 aa, Entamoeba dispar
QKCKVCVNLAEFILRQARNGKSK

SEQ ID NO: 2554601 - protein, 23 aa, Entamoeba dispar
QKDKCIICGEGYFMSSTGICKST

SEQ ID NO: 2554602 - protein, 19 aa, Entamoeba dispar
QKEFAEFKENLKSKIQEMF

SEQ ID NO: 2554603 - protein, 23 aa, Entamoeba dispar
QKEQRQAVKIVRVYEKQQHKKEK

SEQ ID NO: 2554604 - protein, 21 aa, Entamoeba dispar
QKEQYLRNACYSQTVDGQLYI

SEQ ID NO: 2554605 - protein, 18 aa, Entamoeba dispar
QKFIPIKIVSKDEHITIT

SEQ ID NO: 2554606 - protein, 17 aa, Entamoeba dispar
QKKAAAIRRMEKRKAAI

SEQ ID NO: 2554607 - protein, 21 aa, Entamoeba dispar
QKNNFYFSWWGGNHTLNSQTM

SEQ ID NO: 2554608 - protein, 19 aa, Entamoeba dispar
QKSQCEMCTKLARVALKKK

SEQ ID NO: 2554609 - protein, 19 aa, Entamoeba dispar
QLIELKRYKKAKIACARDA

SEQ ID NO: 2554610 - protein, 30 aa, Entamoeba dispar
QLIELLFVIPKKYPIVWYFDINITEQIKSY

SEQ ID NO: 2554611 - protein, 17 aa, Entamoeba dispar
QLKISKEKLEWVESQTK

SEQ ID NO: 2554612 - protein, 22 aa, Entamoeba dispar
QLKKSRLGYDQSVGKSQRINNF

SEQ ID NO: 2554613 - protein, 20 aa, Entamoeba dispar
QLLELKRYKKAKIACARNAL

SEQ ID NO: 2554614 - protein, 26 aa, Entamoeba dispar
QLLISLKAPQAVAAMNACTLTIHWQF

SEQ ID NO: 2554615 - protein, 19 aa, Entamoeba dispar
QLLISLKAPQNVAAANACT

SEQ ID NO: 2554616 - protein, 22 aa, Entamoeba dispar
QLQKEYNKVIVHWEKAQKKRSN

SEQ ID NO: 2554617 - protein, 20 aa, Entamoeba dispar
QLSSKIVHGLSFYRDPYHKS

SEQ ID NO: 2554618 - protein, 23 aa, Entamoeba dispar
QLVGPSQKPIVCMVAGSERLNIS

SEQ ID NO: 2554619 - protein, 17 aa, Entamoeba dispar
QLVQYGAKRGIIVYPEI

SEQ ID NO: 2554620 - protein, 18 aa, Entamoeba dispar
QMFATGFADGFFSGNNIN

SEQ ID NO: 2554621 - protein, 25 aa, Entamoeba dispar
QNGIKYKFMVNRSIWVQNIGAFLSF

SEQ ID NO: 2554622 - protein, 23 aa, Entamoeba dispar
QNKEPLYAVWLVAERGRKGVANG

SEQ ID NO: 2554623 - protein, 24 aa, Entamoeba dispar
QNLPYLRFIKKLNVTITYHPASHE

SEQ ID NO: 2554624 - protein, 17 aa, Entamoeba dispar
QPVAYKLNSRMGTRQQY

SEQ ID NO: 2554625 - protein, 31 aa, Entamoeba dispar
QQAELRKQIRLRQEMLYRTKQLILRKKRIEA

SEQ ID NO: 2554626 - protein, 24 aa, Entamoeba dispar
QQSYRTTPYPGIILLSGDLAGHYQ

SEQ ID NO: 2554627 - protein, 33 aa, Entamoeba dispar
QRAVAKEIKRTCKHLRITKKVCKKIADKMRSKV

SEQ ID NO: 2554628 - protein, 20 aa, Entamoeba dispar
QRGRLIRFVGGFDAEEVVSF

SEQ ID NO: 2554629 - protein, 24 aa, Entamoeba dispar
QRIGFDVMDGCIWDKRNKILIERN

SEQ ID NO: 2554630 - protein, 22 aa, Entamoeba dispar
QRKCGVCGPLSASFSKVEDITY

SEQ ID NO: 2554631 - protein, 20 aa, Entamoeba dispar
QRLSDSFLIELRVHPKKSSQ

SEQ ID NO: 2554632 - protein, 25 aa, Entamoeba dispar
QRLVRYCPFSVPFTNEVKCILTTPY

SEQ ID NO: 2554633 - protein, 32 aa, Entamoeba dispar; identical to SEQ ID NO: 2501536

SEQ ID NO: 2554634 - protein, 19 aa, Entamoeba dispar
QRRLECFHLVIDILSEKNI

SEQ ID NO: 2554635 - protein, 18 aa, Entamoeba dispar
QSCEKRKPILILSGILAS

SEQ ID NO: 2554636 - protein, 20 aa, Entamoeba dispar
QSLDTWKNDFLSGANPTNPT

SEQ ID NO: 2554637 - protein, 25 aa, Entamoeba dispar
QSQIIRKLHMERWIQVYNYLVPHMK

SEQ ID NO: 2554638 - protein, 26 aa, Entamoeba dispar
QSVSNFPFKFCSTSGGRSKLCSSKSQ

SEQ ID NO: 2554639 - protein, 33 aa, Entamoeba dispar
QTGCGGCWSFASVCALESRYLIDYNLTVDDVGR

SEQ ID NO: 2554640 - protein, 23 aa, Entamoeba dispar
QTKKELKAKVAVAQKKAEKAKKE

SEQ ID NO: 2554641 - protein, 23 aa, Entamoeba dispar
QTLPRYFLATSVKVDQPILRFQT

SEQ ID NO: 2554642 - protein, 17 aa, Entamoeba dispar
QTLWPLKPHDDMKFGQQ

SEQ ID NO: 2554643 - protein, 20 aa, Entamoeba dispar
QVDVQFPFSKEVEGNTPSTI

SEQ ID NO: 2554644 - protein, 18 aa, Entamoeba dispar
QVFGIKMIDTCSVPNPSP

SEQ ID NO: 2554645 - protein, 18 aa, Entamoeba dispar
QVIFPKNGGGYIIYSQWI

SEQ ID NO: 2554646 - protein, 22 aa, Entamoeba dispar
QVKTMRFRTRLFSSAYNQQTET

SEQ ID NO: 2554647 - protein, 18 aa, Entamoeba dispar
QVPSYFPAIKYCKNEEIR

SEQ ID NO: 2554648 - protein, 24 aa, Entamoeba dispar
QVVSWKDRMYFVPSDEITPHHILV

SEQ ID NO: 2554649 - protein, 23 aa, Entamoeba dispar
QYVPKGIWYDWFTNTPVKNGLRT

SEQ ID NO: 2554650 - protein, 27 aa, Entamoeba dispar
RAGMGRCQGSYCTPRVMEILSKRLNIP

SEQ ID NO: 2554651 - protein, 26 aa, Entamoeba dispar
RAHSGWAIKIAEGILKRKNAFERLRK

SEQ ID NO: 2554652 - protein, 21 aa, Entamoeba dispar
RALYRKCTKKIIKILLNQNGG

SEQ ID NO: 2554653 - protein, 18 aa, Entamoeba dispar
RAQIPLLTLIAPSVVDQI

SEQ ID NO: 2554654 - protein, 32 aa, Entamoeba dispar
RAVAKEIKRTCKHLRITKKVCKKIADKMRSKV

SEQ ID NO: 2554655 - protein, 18 aa, Entamoeba dispar
RCDDKCWNNNLCALEHPR

SEQ ID NO: 2554656 - protein, 22 aa, Entamoeba dispar
RCGSCVELSGPGLKPITCMITG

SEQ ID NO: 2554657 - protein, 21 aa, Entamoeba dispar
RCSLCPDPFTECLTSKTPVPG

SEQ ID NO: 2554658 - protein, 20 aa, Entamoeba dispar
RCYYYLNSMLLNFKTDGNKT

SEQ ID NO: 2554659 - protein, 17 aa, Entamoeba dispar
RDIAAFLNRTHAVTSFK

SEQ ID NO: 2554660 - protein, 26 aa, Entamoeba dispar
RDQAQCGSCYSFGSLAAIESRLLIGG

SEQ ID NO: 2554661 - protein, 25 aa, Entamoeba dispar
RDQGNCGSCYSFSSLAVLESRLLIA

SEQ ID NO: 2554662 - protein, 25 aa, Entamoeba dispar
RDYYECSPDFNGFRHCALGTHCNGP

SEQ ID NO: 2554663 - protein, 17 aa, Entamoeba dispar
RDYYYCQASDYFSLGCM

SEQ ID NO: 2554664 - protein, 22 aa, Entamoeba dispar
REIAEISGKLIIEESIYEQTVF

SEQ ID NO: 2554665 - protein, 18 aa, Entamoeba dispar
REIEFKRRISMKKQQDLN

SEQ ID NO: 2554666 - protein, 21 aa, Entamoeba dispar
REISVKQNFIYSRKCSEQFNI

SEQ ID NO: 2554667 - protein, 25 aa, Entamoeba dispar
REKKAIALKGARLAFFQAKSAVYNL

SEQ ID NO: 2554668 - protein, 19 aa, Entamoeba dispar
RELPQHYCYFVLDELYFKI

SEQ ID NO: 2554669 - protein, 23 aa, Entamoeba dispar
REQRDSLEFATAMYTYNRGVFDT

SEQ ID NO: 2554670 - protein, 19 aa, Entamoeba dispar
RERFRLIRRINLRYRFSFG

SEQ ID NO: 2554671 - protein, 19 aa, Entamoeba dispar
RFQNIRFGRETDKSDVIEH

SEQ ID NO: 2554672 - protein, 20 aa, Entamoeba dispar
RFQSLGVAFYRGADCCALCY

SEQ ID NO: 2554673 - protein, 24 aa, Entamoeba dispar
RGNECKKRRGIARSIYDHLKSQNA

SEQ ID NO: 2554674 - protein, 18 aa, Entamoeba dispar
RGNKIYCGKRNNEGKAGY

SEQ ID NO: 2554675 - protein, 26 aa, Entamoeba dispar
RHFRIHPWRRFRIWKKHHHRRHPWRK

SEQ ID NO: 2554676 - protein, 19 aa, Entamoeba dispar
RHLWKKIKKIQEIRKEISK

SEQ ID NO: 2554677 - protein, 31 aa, Entamoeba dispar
RHRHFWHYRNWWLRRHWLRNWKRQMRRWRKQ

SEQ ID NO: 2554678 - protein, 31 aa, Entamoeba dispar
RHRHFWHYRNWWLRRHWLRNWKRQMRRWRRQ

SEQ ID NO: 2554679 - protein, 20 aa, Entamoeba dispar
RHYRAPEIVLGLPYSCAIDM

SEQ ID NO: 2554680 - protein, 19 aa, Entamoeba dispar
RICDGKADAVFLWVNGTSP

SEQ ID NO: 2554681 - protein, 21 aa, Entamoeba dispar
RIGDIQFPYCGVQLELTGANG

SEQ ID NO: 2554682 - protein, 17 aa, Entamoeba dispar
RIIKAMNIIDSKINVLK

SEQ ID NO: 2554683 - protein, 25 aa, Entamoeba dispar
RIKFLKLPFFRILPINLGIIPLNFG

SEQ ID NO: 2554684 - protein, 29 aa, Entamoeba dispar
RIKTTNLCGIGWRIGDYVYPLNMIVYANT

SEQ ID NO: 2554685 - protein, 26 aa, Entamoeba dispar
RIMRRRGRRSTLRRQAFGNFASAMQQ

SEQ ID NO: 2554686 - protein, 19 aa, Entamoeba dispar
RIQCQILSLIGDFIIDQIL

SEQ ID NO: 2554687 - protein, 28 aa, Entamoeba dispar
RISKCKGKLSPKFYMRRNKIYNMIKKEE

SEQ ID NO: 2554688 - protein, 24 aa, Entamoeba dispar
RITCSSIPFATKVMINFKEPPPQD

SEQ ID NO: 2554689 - protein, 40 aa, Entamoeba dispar
RITLKEYGKALGVTIEYCRFHWPYFMFKQVSKTRIIWANK

SEQ ID NO: 2554690 - protein, 21 aa, Entamoeba dispar
RKAFGTSLPLAAKVSGIHWWY

SEQ ID NO: 2554691 - protein, 20 aa, Entamoeba dispar
RKAINTLLFMRFLYTPLIQS

SEQ ID NO: 2554692 - protein, 21 aa, Entamoeba dispar
RKASSSLLRTAGVIRGISEAT

SEQ ID NO: 2554693 - protein, 26 aa, Entamoeba dispar
RKAVKEIKRQMRLLRETAQKEFAEFK

SEQ ID NO: 2554694 - protein, 22 aa, Entamoeba dispar
RKCNVCTASSPSNEEMIYKKVR

SEQ ID NO: 2554695 - protein, 24 aa, Entamoeba dispar
RKESKEYLKSIGIDLSKITIDDSI

SEQ ID NO: 2554696 - protein, 20 aa, Entamoeba dispar
RKFGKKKAMKIVKKMKRFEK

SEQ ID NO: 2554697 - protein, 17 aa, Entamoeba dispar
  misc_feature (14)..(15): Xaa can be any naturally occurring amino acid
RKGGFNRRGAGRFXXYY

SEQ ID NO: 2554698 - protein, 18 aa, Entamoeba dispar
RKGKELETGQIIEENRVR

SEQ ID NO: 2554699 - protein, 18 aa, Entamoeba dispar
RKGKRSGAWEEMLRVSYE

SEQ ID NO: 2554700 - protein, 27 aa, Entamoeba dispar
RKGNKYPLKNYEVWRMDDEEYFVFNKL

SEQ ID NO: 2554701 - protein, 19 aa, Entamoeba dispar
RKGVANGQGLWNIIQIFDW

SEQ ID NO: 2554702 - protein, 27 aa, Entamoeba dispar
RKIARTKRMVLAKMYKILRVLAPVEQG

SEQ ID NO: 2554703 - protein, 20 aa, Entamoeba dispar
RKLQGMVKHVIFPCPTGVTK

SEQ ID NO: 2554704 - protein, 20 aa, Entamoeba dispar
RKLTHLRSKMVVYHTKKLAL

SEQ ID NO: 2554705 - protein, 23 aa, Entamoeba dispar
RKNILIPRFIRSITRYEYIQQQL

SEQ ID NO: 2554706 - protein, 25 aa, Entamoeba dispar
RKNLRKIAMLKVKLNAQMRKGLNMI

SEQ ID NO: 2554707 - protein, 17 aa, Entamoeba dispar
RKRIRYIKKQGLNAKLN

SEQ ID NO: 2554708 - protein, 18 aa, Entamoeba dispar
RKSLGGIPIDVPEIDDNQ

SEQ ID NO: 2554709 - protein, 18 aa, Entamoeba dispar
RKSLKAKIVQVKKSAKAA

SEQ ID NO: 2554710 - protein, 21 aa, Entamoeba dispar
RKSPDFKDWKVITASITEVLK

SEQ ID NO: 2554711 - protein, 18 aa, Entamoeba dispar
RKVMAIRMEMRRGKEKGE

SEQ ID NO: 2554712 - protein, 21 aa, Entamoeba dispar
RKYPADFVVMSFYKIIGYPTG

SEQ ID NO: 2554713 - protein, 26 aa, Entamoeba dispar
RLDNILKEAIDFIGIKKEDIKMVQLL

SEQ ID NO: 2554714 - protein, 20 aa, Entamoeba dispar
RLHVNHLMLLGADEAQAVFN

SEQ ID NO: 2554715 - protein, 20 aa, Entamoeba dispar
RLLHQMAELEIEWTKKCNPL

SEQ ID NO: 2554716 - protein, 18 aa, Entamoeba dispar
RLLIISFFIIESYAFFQR

SEQ ID NO: 2554717 - protein, 20 aa, Entamoeba dispar
RLMWTQQELLDFELTVLDTL

SEQ ID NO: 2554718 - protein, 19 aa, Entamoeba dispar
RLTDKYLLDKSVKGSLKNA

SEQ ID NO: 2554719 - protein, 23 aa, Entamoeba dispar
RLYRNAKAKVRRQLQKRELEKFM

SEQ ID NO: 2554720 - protein, 17 aa, Entamoeba dispar
RMHLPPIEYFVGDQVKT

SEQ ID NO: 2554721 - protein, 18 aa, Entamoeba dispar
RMMAEAILNEKPCNAPKP

SEQ ID NO: 2554722 - protein, 21 aa, Entamoeba dispar
RMNFKRVWFDIEGQWYSDVGS

SEQ ID NO: 2554723 - protein, 20 aa, Entamoeba dispar
RMTLEGAKVLGVYEILPKIS

SEQ ID NO: 2554724 - protein, 19 aa, Entamoeba dispar
RMVKNGTNAIEFINQLHDK

SEQ ID NO: 2554725 - protein, 18 aa, Entamoeba dispar
RNATRKALAIKRNTQKKA

SEQ ID NO: 2554726 - protein, 18 aa, Entamoeba dispar
RNGVKIKVVDISGTKYFG

SEQ ID NO: 2554727 - protein, 25 aa, Entamoeba dispar
RNIEFYLLEMNRLFKRKSKADHLKI

SEQ ID NO: 2554728 - protein, 25 aa, Entamoeba dispar
RNKNIKRKKCKGIKKDKIKEIEKNE

SEQ ID NO: 2554729 - protein, 19 aa, Entamoeba dispar
RNKNVCGIYSYGTYIESIT

SEQ ID NO: 2554730 - protein, 27 aa, Entamoeba dispar
RNNGFTGFFICRAWCSPGYFDDNAPYT

SEQ ID NO: 2554731 - protein, 18 aa, Entamoeba dispar
RNPKNLYDLQAFEEKDDK

SEQ ID NO: 2554732 - protein, 22 aa, Entamoeba dispar
RNSWGDWKWGEDGYMRLYRGGN

SEQ ID NO: 2554733 - protein, 17 aa, Entamoeba dispar
RNTKCISNAHHTNVIPC

SEQ ID NO: 2554734 - protein, 19 aa, Entamoeba dispar
RNVDFEAKLNYKPNENSNL

SEQ ID NO: 2554735 - protein, 26 aa, Entamoeba dispar
RNYQRSKEILKWFDDVDESFKQIGEM

SEQ ID NO: 2554736 - protein, 24 aa, Entamoeba dispar
RPLPNRIWGCQEWFEMKGTPDEYR

SEQ ID NO: 2554737 - protein, 17 aa, Entamoeba dispar
RPVSRSRPSRSSRSRPT

SEQ ID NO: 2554738 - protein, 23 aa, Entamoeba dispar
RQGLKAQIARDILIDAHNRKINQ

SEQ ID NO: 2554739 - protein, 32 aa, Entamoeba dispar
RQIRQELLHIFKRYGVIIPVAIPVDLINEIDI

SEQ ID NO: 2554740 - protein, 19 aa, Entamoeba dispar
RQSDEFRIWENITFLYKYP

SEQ ID NO: 2554741 - protein, 22 aa, Entamoeba dispar
RQTEHKERVAAIKRTKEYLNNL

SEQ ID NO: 2554742 - protein, 18 aa, Entamoeba dispar
RQTLMFSATFPKQIQRLA

SEQ ID NO: 2554743 - protein, 21 aa, Entamoeba dispar
RRAFKSEVVKQFFKNHPDSDS

SEQ ID NO: 2554744 - protein, 17 aa, Entamoeba dispar
RRARRPSSRSSRSSSRS

SEQ ID NO: 2554745 - protein, 21 aa, Entamoeba dispar
RREAERAKRALSVQQQDRIEI

SEQ ID NO: 2554746 - protein, 19 aa, Entamoeba dispar
RRECTKCNKGYELEHGECK

SEQ ID NO: 2554747 - protein, 20 aa, Entamoeba dispar
RRLDLCPANQRLLRKRLSIN

SEQ ID NO: 2554748 - protein, 20 aa, Entamoeba dispar
RRLYRHKKVLLRDIKDKEQQ

SEQ ID NO: 2554749 - protein, 22 aa, Entamoeba dispar
RRRRSWRKWFRRHHRRPRRHYR

SEQ ID NO: 2554750 - protein, 19 aa, Entamoeba dispar
RRVSFAKVCLEVMTKDSDV

SEQ ID NO: 2554751 - protein, 23 aa, Entamoeba dispar
RRWDDLRTTLHITLKESLIGFTK

SEQ ID NO: 2554752 - protein, 24 aa, Entamoeba dispar
RSFSRRTRVGVARSLKKNVRSAKA

SEQ ID NO: 2554753 - protein, 20 aa, Entamoeba dispar
RSKEELGFFLRWLKFTRFFE

SEQ ID NO: 2554754 - protein, 25 aa, Entamoeba dispar
RTHKFRLGNDLAIPFLHGAYSVESN

SEQ ID NO: 2554755 - protein, 26 aa, Entamoeba dispar
RTPVDFYYDFMNAFNVAFKSYISDGV

SEQ ID NO: 2554756 - protein, 18 aa, Entamoeba dispar
RTRGPIVDGFRCVEKGIY

SEQ ID NO: 2554757 - protein, 23 aa, Entamoeba dispar
RVAKFKKACAGVITRKRMNYIIK

SEQ ID NO: 2554758 - protein, 20 aa, Entamoeba dispar
RVIVRSLKLSHEYDGLLKVK

SEQ ID NO: 2554759 - protein, 18 aa, Entamoeba dispar
RVRWSDWNEVFKKATSSL

SEQ ID NO: 2554760 - protein, 20 aa, Entamoeba dispar
RWLPQSALETFKRGGYYTKE

SEQ ID NO: 2554761 - protein, 18 aa, Entamoeba dispar
RWTYCGVGEFQCSDKNSL

SEQ ID NO: 2554762 - protein, 18 aa, Entamoeba dispar
RYAFKEMCYEVDDDNVRA

SEQ ID NO: 2554763 - protein, 20 aa, Entamoeba dispar
RYNYECKIIDYFCHSEYSKK

SEQ ID NO: 2554764 - protein, 20 aa, Entamoeba dispar
RYQNYCFDKHGNQKEFKTRD

SEQ ID NO: 2554765 - protein, 19 aa, Entamoeba dispar
RYVDDDCTVNNPVFISYKI

SEQ ID NO: 2554766 - protein, 20 aa, Entamoeba dispar
RYYIYPGGYLSIFSQDIIKF

SEQ ID NO: 2554767 - protein, 31 aa, Entamoeba dispar
SACSWVTKGLKEWGGAIIVGFDGDPYGKDEE

SEQ ID NO: 2554768 - protein, 19 aa, Entamoeba dispar
SAFTYDEEDLLAFDDYLED

SEQ ID NO: 2554769 - protein, 18 aa, Entamoeba dispar
SAGGCLQMADWLSTLQNM

SEQ ID NO: 2554770 - protein, 18 aa, Entamoeba dispar
SAIAERLWSKESVVDKES

SEQ ID NO: 2554771 - protein, 23 aa, Entamoeba dispar
SCASLALNFPKKWMRESVSEEVA

SEQ ID NO: 2554772 - protein, 19 aa, Entamoeba dispar
SCNQFGSLCQKCTPNQCTL

SEQ ID NO: 2554773 - protein, 19 aa, Entamoeba dispar
SCVCSAFTYDEEDLLAFDD

SEQ ID NO: 2554774 - protein, 22 aa, Entamoeba dispar
SDAPRFKWRGLMVDPSRNPLSP

SEQ ID NO: 2554775 - protein, 32 aa, Entamoeba dispar
SDEHVCLTCAKPLMVGSKCDRCKTGYYMSNGE

SEQ ID NO: 2554776 - protein, 28 aa, Entamoeba dispar
SDFDQRIALFLVEICKRKFKKDPSNNPR

SEQ ID NO: 2554777 - protein, 19 aa, Entamoeba dispar
SDIKKDYEGWCWPGNSVYI

SEQ ID NO: 2554778 - protein, 20 aa, Entamoeba dispar
SDILECINIIHLNNKKELPK

SEQ ID NO: 2554779 - protein, 23 aa, Entamoeba dispar
SDLKINHPVIISSLLSFEEVNSM

SEQ ID NO: 2554780 - protein, 21 aa, Entamoeba dispar
SDPNCLSFMTFNFNHTITYPL

SEQ ID NO: 2554781 - protein, 23 aa, Entamoeba dispar
SDQATCISCNYPGNQIEPKATKT

SEQ ID NO: 2554782 - protein, 23 aa, Entamoeba dispar
SEDISLKFKVRMLPYEFRDDEIP

SEQ ID NO: 2554783 - protein, 38 aa, Entamoeba dispar; identical to SEQ ID NO: 2503716

SEQ ID NO: 2554784 - protein, 20 aa, Entamoeba dispar
SEFIQFPIEMEITKKEEEEV

SEQ ID NO: 2554785 - protein, 18 aa, Entamoeba dispar
SEHFLLNHLLEYNKNDSS

SEQ ID NO: 2554786 - protein, 25 aa, Entamoeba dispar
SELSGPLNRKNELIAGINALLNTVP

SEQ ID NO: 2554787 - protein, 23 aa, Entamoeba dispar
SELTNFFYFLPFEINIDNDKKMY

SEQ ID NO: 2554788 - protein, 17 aa, Entamoeba dispar
SEMKSQIVSLHARKTRI

SEQ ID NO: 2554789 - protein, 26 aa, Entamoeba dispar
SENKKLFLIEKLHDFIPIENKEIETT

SEQ ID NO: 2554790 - protein, 24 aa, Entamoeba dispar
SEPFEIQIPLVFQKCPIHCSEHFL

SEQ ID NO: 2554791 - protein, 22 aa, Entamoeba dispar
SEQDFKDGLVILKELITQFKDV

SEQ ID NO: 2554792 - protein, 25 aa, Entamoeba dispar
SESCPKKAAKVEVMTEKAALLHKKA

SEQ ID NO: 2554793 - protein, 20 aa, Entamoeba dispar
SESKLIFWLMDVVPGDVITQ

SEQ ID NO: 2554794 - protein, 23 aa, Entamoeba dispar
SEVPREIREVLSVIIEIKGLLND

SEQ ID NO: 2554795 - protein, 21 aa, Entamoeba dispar
SEVSYDYILHVQTWTGQFCKT

SEQ ID NO: 2554796 - protein, 18 aa, Entamoeba dispar
SFICYEKNIFICDSTNGN

SEQ ID NO: 2554797 - protein, 18 aa, Entamoeba dispar
SFNKCFRCDNKKCIQCVD

SEQ ID NO: 2554798 - protein, 17 aa, Entamoeba dispar
SFSLKARALEHIKEKKE

SEQ ID NO: 2554799 - protein, 23 aa, Entamoeba dispar
SFSNCKFLTKMLFPLHNNIISIG

SEQ ID NO: 2554800 - protein, 20 aa, Entamoeba dispar
SGEHKICLDNSYASFSTTKT

SEQ ID NO: 2554801 - protein, 26 aa, Entamoeba dispar
SGFMEVWDIPGSILMEMDENIMREIL

SEQ ID NO: 2554802 - protein, 22 aa, Entamoeba dispar
SGLDWLPIDGQLFANVSRSIES

SEQ ID NO: 2554803 - protein, 33 aa, Entamoeba dispar
SGMTCSNRGYGWKLIWDGTIDWIIFTGECCENN

SEQ ID NO: 2554804 - protein, 18 aa, Entamoeba dispar
SGNEEVFNGIAQIDSHTL

SEQ ID NO: 2554805 - protein, 18 aa, Entamoeba dispar
SGNSLQCYIELNTTTEIK

SEQ ID NO: 2554806 - protein, 24 aa, Entamoeba dispar
SHNTWRPYYAMLRIYKHYFFPWTK

SEQ ID NO: 2554807 - protein, 23 aa, Entamoeba dispar
SHNTWRPYYAMMRIYKKYIFPFT

SEQ ID NO: 2554808 - protein, 25 aa, Entamoeba dispar
SHVYLKVVSPYLCLVMLLGDTQERD

SEQ ID NO: 2554809 - protein, 26 aa, Entamoeba dispar
SIEEFPTILFHRAHLRDRTFDEDEFD

SEQ ID NO: 2554810 - protein, 24 aa, Entamoeba dispar
SIEYPGEYLFNIKYYALNSLQIDA

SEQ ID NO: 2554811 - protein, 26 aa, Entamoeba dispar
SIFHIKSSSSLFAILSIYDNSSLHLS

SEQ ID NO: 2554812 - protein, 26 aa, Entamoeba dispar
SIFSQDIIKFIGKWENYYTFAPSSLE

SEQ ID NO: 2554813 - protein, 18 aa, Entamoeba dispar
SIGLKITGMMDVNPYFTR

SEQ ID NO: 2554814 - protein, 19 aa, Entamoeba dispar
SIGYKNCNMLIYKEKTKEC

SEQ ID NO: 2554815 - protein, 18 aa, Entamoeba dispar
SIGYKNCNMMIYKEETRE

SEQ ID NO: 2554816 - protein, 17 aa, Entamoeba dispar
SIIKKMIRRSVGKNSIM

SEQ ID NO: 2554817 - protein, 17 aa, Entamoeba dispar
SILSRGVLYSKIQPNES

SEQ ID NO: 2554818 - protein, 18 aa, Entamoeba dispar
SIMYHIATYLPWSDNNPQ

SEQ ID NO: 2554819 - protein, 17 aa, Entamoeba dispar
SIPAANLAPNYNKGQKG

SEQ ID NO: 2554820 - protein, 24 aa, Entamoeba dispar
SIPINLKFSSDISIQYLISSYEGS

SEQ ID NO: 2554821 - protein, 27 aa, Entamoeba dispar
SIPSDLFKKQCDHYRVYKTTDQSESDK

SEQ ID NO: 2554822 - protein, 22 aa, Entamoeba dispar
SIYAKAVFWLYKDSDAEVGEME

SEQ ID NO: 2554823 - protein, 21 aa, Entamoeba dispar
SKDNFKLYYGFNITQNNNINV

SEQ ID NO: 2554824 - protein, 22 aa, Entamoeba dispar
SKDWRAEGKVTPVRDQGNCGSC

SEQ ID NO: 2554825 - protein, 24 aa, Entamoeba dispar
SKESKYMLSYNWIGGMCSIEKCSI

SEQ ID NO: 2554826 - protein, 21 aa, Entamoeba dispar
SKFGESVQFFGTRLIVSAPNL

SEQ ID NO: 2554827 - protein, 22 aa, Entamoeba dispar
SKFNISVGILSYRGYGNSTGKP

SEQ ID NO: 2554828 - protein, 24 aa, Entamoeba dispar
SKFNYKGRCGDVFKYQPSNEQDLI

SEQ ID NO: 2554829 - protein, 35 aa, Entamoeba dispar
SKHVFVKFFAPWCGHCKKLAPEYIKLADAYKNKQD

SEQ ID NO: 2554830 - protein, 17 aa, Entamoeba dispar
SKICITMSLLNETTTPT

SEQ ID NO: 2554831 - protein, 17 aa, Entamoeba dispar
SKIKVLLLTNKKVKEKI

SEQ ID NO: 2554832 - protein, 20 aa, Entamoeba dispar
SKKLTRKFGKKKAMKIVKKM

SEQ ID NO: 2554833 - protein, 20 aa, Entamoeba dispar
SKKRAEFNFKIAQKRNKIAI

SEQ ID NO: 2554834 - protein, 19 aa, Entamoeba dispar
SKKVLKALIKASRTSKKKN

SEQ ID NO: 2554835 - protein, 24 aa, Entamoeba dispar
SKLDYKADKFTGSLDLKHTKDNQG

SEQ ID NO: 2554836 - protein, 18 aa, Entamoeba dispar
SKLKEMNNQFKLWKKQFQ

SEQ ID NO: 2554837 - protein, 17 aa, Entamoeba dispar
SKLKKSLAKKITKSSKN

SEQ ID NO: 2554838 - protein, 17 aa, Entamoeba dispar
SKLYHRKELPFVAEEKG

SEQ ID NO: 2554839 - protein, 19 aa, Entamoeba dispar
SKLYIKYDKSFCSDITTNF

SEQ ID NO: 2554840 - protein, 19 aa, Entamoeba dispar
SKSIYSEWEKVRNLIVEKK

SEQ ID NO: 2554841 - protein, 31 aa, Entamoeba dispar
SKYKFKFSPVERLRRKAIFTSNFKYVKEFNK

SEQ ID NO: 2554842 - protein, 17 aa, Entamoeba dispar
SKYKYNGVFPKHVPLLT

SEQ ID NO: 2554843 - protein, 28 aa, Entamoeba dispar
SLCQKCTPNQCTLCLDGIINENGICVDP

SEQ ID NO: 2554844 - protein, 18 aa, Entamoeba dispar
SLDDFWLIDNGLAIIETT

SEQ ID NO: 2554845 - protein, 19 aa, Entamoeba dispar
SLFQFPWSIADFVTQGKRR

SEQ ID NO: 2554846 - protein, 26 aa, Entamoeba dispar
SLFVSVIVFCCLLALVIGLAVGLSKN

SEQ ID NO: 2554847 - protein, 19 aa, Entamoeba dispar
SLIILGAVLVLVRLYAAGG

SEQ ID NO: 2554848 - protein, 18 aa, Entamoeba dispar
SLIILSLIKIRELYFYCI

SEQ ID NO: 2554849 - protein, 23 aa, Entamoeba dispar
SLLLYCINHPYFSELGRDKDSFY

SEQ ID NO: 2554850 - protein, 17 aa, Entamoeba dispar
SLPRIGLLLIGYGKTIN

SEQ ID NO: 2554851 - protein, 19 aa, Entamoeba dispar
SLTKCKFFNYEYDKHGTCL

SEQ ID NO: 2554852 - protein, 20 aa, Entamoeba dispar
SLWIKIKTFLKHLNLEFIKT

SEQ ID NO: 2554853 - protein, 21 aa, Entamoeba dispar
SLYDFLKRCLAYDPKERLTPD

SEQ ID NO: 2554854 - protein, 18 aa, Entamoeba dispar
SMPACCKYTTSRSEVQKV

SEQ ID NO: 2554855 - protein, 24 aa, Entamoeba dispar
SNAGPCKLPGCLSCSDDDTICYKC

SEQ ID NO: 2554856 - protein, 17 aa, Entamoeba dispar
SNCTACTLSNYYPKKGE

SEQ ID NO: 2554857 - protein, 17 aa, Entamoeba dispar
SNCTACTLSNYYPKNGE

SEQ ID NO: 2554858 - protein, 18 aa, Entamoeba dispar
SNECLKCNAEYLELKGGE

SEQ ID NO: 2554859 - protein, 18 aa, Entamoeba dispar
SNECLKCNAEYLEVKGEE

SEQ ID NO: 2554860 - protein, 19 aa, Entamoeba dispar
SNEIHGSVNYKSKDGKFDG

SEQ ID NO: 2554861 - protein, 24 aa, Entamoeba dispar
SNFKEKRNGVSLLINSISPLQQVR

SEQ ID NO: 2554862 - protein, 24 aa, Entamoeba dispar
SNGVSRSAIATGTYKINDHSTVSS

SEQ ID NO: 2554863 - protein, 25 aa, Entamoeba dispar
SNHELKRYLTFIKFNPWTYCGDMLF

SEQ ID NO: 2554864 - protein, 17 aa, Entamoeba dispar
SNIIEEWDSVTMEYINR

SEQ ID NO: 2554865 - protein, 17 aa, Entamoeba dispar
SNKQVPASVDWRAEGKV

SEQ ID NO: 2554866 - protein, 17 aa, Entamoeba dispar
SNLQHLISFTFSASISI

SEQ ID NO: 2554867 - protein, 22 aa, Entamoeba dispar
SNSKCKDSLIGHLDNEKAMKLF

SEQ ID NO: 2554868 - protein, 19 aa, Entamoeba dispar
SNWFKMLFTSIAHPCSTYY

SEQ ID NO: 2554869 - protein, 17 aa, Entamoeba dispar
SNWKISTNWLNNEKDIC

SEQ ID NO: 2554870 - protein, 21 aa, Entamoeba dispar
SNYCIHAKLLRECAYLDENCK

SEQ ID NO: 2554871 - protein, 29 aa, Entamoeba dispar
SPCGSCIKEYFGNELIRYVNVHCYKKEEK

SEQ ID NO: 2554872 - protein, 25 aa, Entamoeba dispar
SQEKCQSIAREIRSLRSSIKKTIDD

SEQ ID NO: 2554873 - protein, 18 aa, Entamoeba dispar
SQLILFPSGYSVLIDLGE

SEQ ID NO: 2554874 - protein, 25 aa, Entamoeba dispar
SQQNCGGCWAISLANLAQYLYSNLT

SEQ ID NO: 2554875 - protein, 18 aa, Entamoeba dispar
SQSPRIIVMSSLSAADWH

SEQ ID NO: 2554876 - protein, 18 aa, Entamoeba dispar
SRIPEFEKLLGQYGNDIN

SEQ ID NO: 2554877 - protein, 17 aa, Entamoeba dispar
SRLSEIEDLERHVLGKL

SEQ ID NO: 2554878 - protein, 17 aa, Entamoeba dispar
SRTSYSIPPSVTAIASD

SEQ ID NO: 2554879 - protein, 18 aa, Entamoeba dispar
SSARKAAPRRSLKSNSFS

SEQ ID NO: 2554880 - protein, 25 aa, Entamoeba dispar
SSCKANFCTENDWSFEGEIVGFADY

SEQ ID NO: 2554881 - protein, 20 aa, Entamoeba dispar
SSCNPGACYGYLNITSDEVK

SEQ ID NO: 2554882 - protein, 23 aa, Entamoeba dispar
SSDFKNFDYIFAMDNDNYYELLD

SEQ ID NO: 2554883 - protein, 27 aa, Entamoeba dispar
SSDSNIYCTFCVNGVNTLVVKSFDTRD

SEQ ID NO: 2554884 - protein, 26 aa, Entamoeba dispar
SSEWEYPPRCQWMLEFMNEQFKGWLS

SEQ ID NO: 2554885 - protein, 25 aa, Entamoeba dispar
SSGTSRSIHPLHFFLKSKDKCSNCF

SEQ ID NO: 2554886 - protein, 25 aa, Entamoeba dispar
SSKEIIKIVVIGSVKPKFMFNGINR

SEQ ID NO: 2554887 - protein, 18 aa, Entamoeba dispar
SSKILPFSIEAPVGTVNV

SEQ ID NO: 2554888 - protein, 29 aa, Entamoeba dispar
SSLLFSFFSILFFEGCCSSEIQLEVGCSH

SEQ ID NO: 2554889 - protein, 26 aa, Entamoeba dispar
SSNPALCLRTSLKLSTVAFQEKNKDL

SEQ ID NO: 2554890 - protein, 25 aa, Entamoeba dispar
SSSNSRPSTLFSFFKRFTSMQYLYF

SEQ ID NO: 2554891 - protein, 26 aa, Entamoeba dispar
SSSYGFCKEAFNFFIDVFSTYSSEQQ

SEQ ID NO: 2554892 - protein, 33 aa, Entamoeba dispar
STAIHCGKGFKSCPSGQCCSIWGYCGKTNDYCG

SEQ ID NO: 2554893 - protein, 19 aa, Entamoeba dispar
STCNTDCMNFLKSNFNHTI

SEQ ID NO: 2554894 - protein, 19 aa, Entamoeba dispar
STDYCYSCKTNIFDVVTLN

SEQ ID NO: 2554895 - protein, 20 aa, Entamoeba dispar
STKEVGEWTEFKILLTDLGV

SEQ ID NO: 2554896 - protein, 31 aa, Entamoeba dispar
STMLSFKIEIGISFPDFYSSIQLTETQTFLN

SEQ ID NO: 2554897 - protein, 25 aa, Entamoeba dispar
STNLMKRTGYRQCKSNKMLKNGKGK

SEQ ID NO: 2554898 - protein, 25 aa, Entamoeba dispar
STSMFKGKLSLLVSRVVFNEIIPSE

SEQ ID NO: 2554899 - protein, 19 aa, Entamoeba dispar
STWCPTIYINGERYCLYDS

SEQ ID NO: 2554900 - protein, 17 aa, Entamoeba dispar
STYPECCFTYWKNEEIT

SEQ ID NO: 2554901 - protein, 26 aa, Entamoeba dispar
SVAAFFRPKIAIGLLPQGKKMKSLED

SEQ ID NO: 2554902 - protein, 28 aa, Entamoeba dispar
SVKRDIPKAIDWRAEGKVTPIRDQAQCG

SEQ ID NO: 2554903 - protein, 20 aa, Entamoeba dispar
SVYLCYGYELNMYLLPHVLP

SEQ ID NO: 2554904 - protein, 18 aa, Entamoeba dispar
SVYNFAPYIKNYYIVTMG

SEQ ID NO: 2554905 - protein, 24 aa, Entamoeba dispar
SWAWQICSEYSYFQPVNESLPFSK

SEQ ID NO: 2554906 - protein, 20 aa, Entamoeba dispar
SWGNSWGEMGYARISINDLC

SEQ ID NO: 2554907 - protein, 22 aa, Entamoeba dispar
SWGTSWGDKGYILMSRNKNNQC

SEQ ID NO: 2554908 - protein, 21 aa, Entamoeba dispar
SWGTTWGMDGYILMSRNKNNQ

SEQ ID NO: 2554909 - protein, 23 aa, Entamoeba dispar
SYGGLMTKFLFDRFTGYNNYIKE

SEQ ID NO: 2554910 - protein, 17 aa, Entamoeba dispar
SYLNTKFEIEWENGEKD

SEQ ID NO: 2554911 - protein, 21 aa, Entamoeba dispar
SYLYERFPKQLESFFQYNPYQ

SEQ ID NO: 2554912 - protein, 22 aa, Entamoeba dispar
SYNLCLRAPLISNEGDDFKNVR

SEQ ID NO: 2554913 - protein, 20 aa, Entamoeba dispar
SYQGYSHVVAYARIQYKDTS

SEQ ID NO: 2554914 - protein, 20 aa, Entamoeba dispar
SYQGYSHVVGYARIQYKDTS

SEQ ID NO: 2554915 - protein, 21 aa, Entamoeba dispar
SYQMICLYSYPNRVMDMLYNT

SEQ ID NO: 2554916 - protein, 24 aa, Entamoeba dispar
SYRETFKKLGLPFVEHKEIPQVPK

SEQ ID NO: 2554917 - protein, 19 aa, Entamoeba dispar
SYSGTCPLTAFGVIFLKYN

SEQ ID NO: 2554918 - protein, 17 aa, Entamoeba dispar
TAGSFVFTTTGIIYEYN

SEQ ID NO: 2554919 - protein, 24 aa, Entamoeba dispar
TALLKKFEGFFIIPMLGNHDVYPA

SEQ ID NO: 2554920 - protein, 17 aa, Entamoeba dispar
TAPSIAILHKNQRTSYP

SEQ ID NO: 2554921 - protein, 23 aa, Entamoeba dispar
TCAKTNILQGFGMTELCGASSCM

SEQ ID NO: 2554922 - protein, 26 aa, Entamoeba dispar
TCDKCGGKGKLYGKVCHVCNGKKVEE

SEQ ID NO: 2554923 - protein, 24 aa, Entamoeba dispar
TCSSRSWCNLNRFRPVSHYNADVR

SEQ ID NO: 2554924 - protein, 21 aa, Entamoeba dispar
TDAKYTLEYTFEGADYDNSYW

SEQ ID NO: 2554925 - protein, 27 aa, Entamoeba dispar
TDDEVWFRKRMQVVNVLLPDGSTKKMM

SEQ ID NO: 2554926 - protein, 17 aa, Entamoeba dispar
TDILWVFQWHFVELQPT

SEQ ID NO: 2554927 - protein, 20 aa, Entamoeba dispar
TDPGEMMMWFNATLKVLREK

SEQ ID NO: 2554928 - protein, 28 aa, Entamoeba dispar
TEASVALTFQKEVLFWVTIPCTKNVGSC

SEQ ID NO: 2554929 - protein, 21 aa, Entamoeba dispar
TEAVIRGDIEYDRNLHQMHLT

SEQ ID NO: 2554930 - protein, 21 aa, Entamoeba dispar
  misc_feature (17)..(18): Xaa can be any naturally occurring amino acid
TEDLQAAAFDWRFISQXXAIR

SEQ ID NO: 2554931 - protein, 26 aa, Entamoeba dispar
TEGFLGNPLKGFGMWYGSGNTAKLPL

SEQ ID NO: 2554932 - protein, 25 aa, Entamoeba dispar
TEGGEINWFYSFPFLYDKILPSAVC

SEQ ID NO: 2554933 - protein, 17 aa, Entamoeba dispar
TEIKIGTSFISNEYSYS

SEQ ID NO: 2554934 - protein, 21 aa, Entamoeba dispar
TEIPNKIRIKFMLDGAKGISY

SEQ ID NO: 2554935 - protein, 17 aa, Entamoeba dispar
TFIKSAMNFARKYNLDG

SEQ ID NO: 2554936 - protein, 21 aa, Entamoeba dispar
TFPSICTAWDRNGVKIKVVDI

SEQ ID NO: 2554937 - protein, 21 aa, Entamoeba dispar
TFPSICTAWDRNGVRIKVIDI

SEQ ID NO: 2554938 - protein, 21 aa, Entamoeba dispar
TFPSICTAWDRNGVRIKVIDL

SEQ ID NO: 2554939 - protein, 26 aa, Entamoeba dispar
TGGCSLCKDGYFLNEFDCIKCPIECK

SEQ ID NO: 2554940 - protein, 17 aa, Entamoeba dispar
TGLKYYLEAYVFKDILK

SEQ ID NO: 2554941 - protein, 18 aa, Entamoeba dispar
TGMTYKLSAYIRMKDVQD

SEQ ID NO: 2554942 - protein, 17 aa, Entamoeba dispar
TGVGIPIIKRYKEKIEA

SEQ ID NO: 2554943 - protein, 26 aa, Entamoeba dispar
TGVSFMPPRFSLGFHNSKWGYNSQNI

SEQ ID NO: 2554944 - protein, 24 aa, Entamoeba dispar
THEGCKGGFILKNSWNDTVYGPSI

SEQ ID NO: 2554945 - protein, 18 aa, Entamoeba dispar
THYFKLINHCLNNSIHGN

SEQ ID NO: 2554946 - protein, 18 aa, Entamoeba dispar
TIDFGKCYYTGSVTSDYY

SEQ ID NO: 2554947 - protein, 25 aa, Entamoeba dispar
TIEGLKGLNIFEAKPAESNKCVETA

SEQ ID NO: 2554948 - protein, 18 aa, Entamoeba dispar
TIFEIKRLIGRTYDDKEV

SEQ ID NO: 2554949 - protein, 23 aa, Entamoeba dispar
TIKIPPVYVPANWNDGLETDKKC

SEQ ID NO: 2554950 - protein, 27 aa, Entamoeba dispar
TIKTLKLSKNCPLFIENELKVEKVEVP

SEQ ID NO: 2554951 - protein, 19 aa, Entamoeba dispar
TIQECIPIIKTLNKVGEKY

SEQ ID NO: 2554952 - protein, 27 aa, Entamoeba dispar
TIRFGLRSIIEYAPWINRIFLVTDGEI

SEQ ID NO: 2554953 - protein, 26 aa, Entamoeba dispar
TISEATCLFTVFPSIHILKEEKGIST

SEQ ID NO: 2554954 - protein, 17 aa, Entamoeba dispar
TIVSITFPFPLKISHHY

SEQ ID NO: 2554955 - protein, 31 aa, Entamoeba dispar
TKDCSKCGGSISCVLVRLVVFIGNTRCSKTN

SEQ ID NO: 2554956 - protein, 17 aa, Entamoeba dispar
TKECIECEKRYYLNSNK

SEQ ID NO: 2554957 - protein, 24 aa, Entamoeba dispar
TKGKLCERCFVLAKTIRSAIFERK

SEQ ID NO: 2554958 - protein, 21 aa, Entamoeba dispar
TKIPGFPVIIEDSGFITQAIP

SEQ ID NO: 2554959 - protein, 18 aa, Entamoeba dispar
TKNLKEFIEQLAVDDELW

SEQ ID NO: 2554960 - protein, 28 aa, Entamoeba dispar
TKQHPVFTRKGSDLYASVTVSLLESLTG

SEQ ID NO: 2554961 - protein, 17 aa, Entamoeba dispar
TKRLFGSGKNVHQPLPL

SEQ ID NO: 2554962 - protein, 28 aa, Entamoeba dispar
TKRRPTLRRGRRVYKRRVYRLRRYTRRY

SEQ ID NO: 2554963 - protein, 22 aa, Entamoeba dispar
TKSNKLMMVISFVTDDGKGNTG

SEQ ID NO: 2554964 - protein, 24 aa, Entamoeba dispar
TKSPLKFWLIEDFLSPEGRITLKE

SEQ ID NO: 2554965 - protein, 19 aa, Entamoeba dispar
TKYSISSLPSFILQRPGYQ

SEQ ID NO: 2554966 - protein, 19 aa, Entamoeba dispar
TLFMKEIPGLSGVEAGRIG

SEQ ID NO: 2554967 - protein, 24 aa, Entamoeba dispar
TLFNALWLRSFIKNNQRIINGRAY

SEQ ID NO: 2554968 - protein, 18 aa, Entamoeba dispar
TLGPVRMVLDDAKLDKKD

SEQ ID NO: 2554969 - protein, 19 aa, Entamoeba dispar
TLLFMRFLYTPLIQSPSLF

SEQ ID NO: 2554970 - protein, 17 aa, Entamoeba dispar
TLPRYFLATSVKVDQPI

SEQ ID NO: 2554971 - protein, 20 aa, Entamoeba dispar
TLSLSASIDYVFTDVTDEDV

SEQ ID NO: 2554972 - protein, 21 aa, Entamoeba dispar
TLTRYRVVQLLGQGTFGQVVK

SEQ ID NO: 2554973 - protein, 28 aa, Entamoeba dispar
TLWPEIPWKKITGIWRKFISHLEELGYR

SEQ ID NO: 2554974 - protein, 28 aa, Entamoeba dispar
TLYSLKVIQTFMFRYLAPLQFGIIPINI

SEQ ID NO: 2554975 - protein, 25 aa, Entamoeba dispar
TMALKPGFTLHGWWPNFVSGYPSCC

SEQ ID NO: 2554976 - protein, 28 aa, Entamoeba dispar
TMYECFGWCAAYPKSLFQFPWSIADFVT

SEQ ID NO: 2554977 - protein, 21 aa, Entamoeba dispar
TNAFFPLFVRRVNDEPKPMSH

SEQ ID NO: 2554978 - protein, 29 aa, Entamoeba dispar
TNKDIGGVIPRSLAFGVIKESQGFVKKAE

SEQ ID NO: 2554979 - protein, 17 aa, Entamoeba dispar
TNLFIQFIIKYQIIKEI

SEQ ID NO: 2554980 - protein, 23 aa, Entamoeba dispar
TNNLCDAYAFLLALLSKSCSIKV

SEQ ID NO: 2554981 - protein, 19 aa, Entamoeba dispar
TNTKCLECSFHSYINQEDC

SEQ ID NO: 2554982 - protein, 25 aa, Entamoeba dispar
TNYDWYTGKICDFVEPQYDSVGVAL

SEQ ID NO: 2554983 - protein, 18 aa, Entamoeba dispar
TNYKKSWLKGLVAKEIGV

SEQ ID NO: 2554984 - protein, 23 aa, Entamoeba dispar
TPDVCISCSSSSGFTDDCSNCKE

SEQ ID NO: 2554985 - protein, 18 aa, Entamoeba dispar
TPFYKCQDALDVQLPYTA

SEQ ID NO: 2554986 - protein, 17 aa, Entamoeba dispar
TPKLKAASLSFKSLDYI

SEQ ID NO: 2554987 - protein, 18 aa, Entamoeba dispar
TQIAIPYASTLVFEYYTK

SEQ ID NO: 2554988 - protein, 20 aa, Entamoeba dispar
TQPKILKFGILGGKNSMGLC

SEQ ID NO: 2554989 - protein, 19 aa, Entamoeba dispar
TQRIFTLALDICFYGPYGI

SEQ ID NO: 2554990 - protein, 18 aa, Entamoeba dispar
TQVIPGYMFGGSLNEAFF

SEQ ID NO: 2554991 - protein, 17 aa, Entamoeba dispar
TREKGQWMIPKRTIESY

SEQ ID NO: 2554992 - protein, 30 aa, Entamoeba dispar
TRFEWMAMALACARQGITLVTVYATLGEES

SEQ ID NO: 2554993 - protein, 17 aa, Entamoeba dispar
TRIWKKDNNDYILIVNN

SEQ ID NO: 2554994 - protein, 25 aa, Entamoeba dispar
TRLCELRGTIDFSLPEESIGNIYLD

SEQ ID NO: 2554995 - protein, 26 aa, Entamoeba dispar
TRQIKRVFETSIEFKGLLTDFYNACQ

SEQ ID NO: 2554996 - protein, 17 aa, Entamoeba dispar
TRRCIHRDLKPDNVLID

SEQ ID NO: 2554997 - protein, 25 aa, Entamoeba dispar
TRRSELYARQSWLLSELKALAKRET

SEQ ID NO: 2554998 - protein, 17 aa, Entamoeba dispar
TRTPYFPKRIRNPTLDH

SEQ ID NO: 2554999 - protein, 19 aa, Entamoeba dispar
TRYIECPKSKFIESDCSCF

SEQ ID NO: 2555000 - protein, 17 aa, Entamoeba dispar
TSCLSICFVVVLVVANF

SEQ ID NO: 2555001 - protein, 25 aa, Entamoeba dispar
TSERIESIVSFDFVNKVFNYSEVSV

SEQ ID NO: 2555002 - protein, 19 aa, Entamoeba dispar
TSLGFRFQNIRFGRETDKS

SEQ ID NO: 2555003 - protein, 23 aa, Entamoeba dispar
TSLSLYELLSWNIFESTFVPVVM

SEQ ID NO: 2555004 - protein, 27 aa, Entamoeba dispar
TSLVGVPIKLVLRKDIELAIQNKDRFI

SEQ ID NO: 2555005 - protein, 25 aa, Entamoeba dispar
TSTIGPCKLPGCLSCSDDDTICYKC

SEQ ID NO: 2555006 - protein, 25 aa, Entamoeba dispar
TSTYFRNRHVMLFCYDITKKESFNH

SEQ ID NO: 2555007 - protein, 17 aa, Entamoeba dispar
TSYSIPPSVTVIGESAF

SEQ ID NO: 2555008 - protein, 17 aa, Entamoeba dispar
TTISVTINKGMREGEII

SEQ ID NO: 2555009 - protein, 26 aa, Entamoeba dispar
TTLDKFNGIEFIDWANTKTFPLFHQV

SEQ ID NO: 2555010 - protein, 18 aa, Entamoeba dispar
TTTIKLGYSRPWEKGKEP

SEQ ID NO: 2555011 - protein, 20 aa, Entamoeba dispar
TTVSWKRYVDDDCTVNNPVF

SEQ ID NO: 2555012 - protein, 26 aa, Entamoeba dispar
TTYFRNRHCILFTYDITKRETLEHVE

SEQ ID NO: 2555013 - protein, 19 aa, Entamoeba dispar
TVETIPFLFPNGGNERWGN

SEQ ID NO: 2555014 - protein, 23 aa, Entamoeba dispar
TVSEQIPGYVFFKDFSTSLESTG

SEQ ID NO: 2555015 - protein, 17 aa, Entamoeba dispar
TVSKRCYYYLNSMLLNF

SEQ ID NO: 2555016 - protein, 21 aa, Entamoeba dispar
TVSVYEWKDGSFLETERKIFN

SEQ ID NO: 2555017 - protein, 30 aa, Entamoeba dispar
TWCREEYQQRYGFKCIYVLVESSVRQTKHL

SEQ ID NO: 2555018 - protein, 19 aa, Entamoeba dispar
TWRYGNIGRAFSFPVTVQV

SEQ ID NO: 2555019 - protein, 18 aa, Entamoeba dispar
TWTGQFCKTQCCDLPETT

SEQ ID NO: 2555020 - protein, 19 aa, Entamoeba dispar
TYRADNMVLITSYFPNKKD

SEQ ID NO: 2555021 - protein, 25 aa, Entamoeba dispar
TYTRCGLCLEITGPSLLTTTCTVVG

SEQ ID NO: 2555022 - protein, 20 aa, Entamoeba dispar
TYWLDGRHVVFGEVIEGMDV

SEQ ID NO: 2555023 - protein, 20 aa, Entamoeba dispar
VAKKVVKKAKRHDAVDEYLV

SEQ ID NO: 2555024 - protein, 21 aa, Entamoeba dispar
VCKDTRYKFKRFYDGPTKPKT

SEQ ID NO: 2555025 - protein, 27 aa, Entamoeba dispar
VDAKYKYLQLCMTLRSYGMNIYHGGIE

SEQ ID NO: 2555026 - protein, 21 aa, Entamoeba dispar
VDDAKRAFIIGNLKDMTSNAK

SEQ ID NO: 2555027 - protein, 17 aa, Entamoeba dispar
VDEFVRNIIYFRIEAIR

SEQ ID NO: 2555028 - protein, 23 aa, Entamoeba dispar
VDELTKRVEVIKSITEFLHPELN

SEQ ID NO: 2555029 - protein, 26 aa, Entamoeba dispar
VDFLSEEARNWWAGLYSFDKYKDTTE

SEQ ID NO: 2555030 - protein, 23 aa, Entamoeba dispar
VDGKLRGLASMTVFPEMTLEESA

SEQ ID NO: 2555031 - protein, 18 aa, Entamoeba dispar
VDISLTFKLNSYGLVDIS

SEQ ID NO: 2555032 - protein, 22 aa, Entamoeba dispar
VDKGTKWLAKNGDAISNTLGKV

SEQ ID NO: 2555033 - protein, 17 aa, Entamoeba dispar
VDSCLFQNLNHLFILVF

SEQ ID NO: 2555034 - protein, 19 aa, Entamoeba dispar
VDVLGDWYMNPRMIKYGNN

SEQ ID NO: 2555035 - protein, 18 aa, Entamoeba dispar
VECPCSLGNGNSNTNCVY

SEQ ID NO: 2555036 - protein, 18 aa, Entamoeba dispar
VEDIIKLFSLDMKKGTTI

SEQ ID NO: 2555037 - protein, 31 aa, Entamoeba dispar
VEIKRKKIKGKRFNSDLVRFNVFKDTMERWL

SEQ ID NO: 2555038 - protein, 44 aa, Entamoeba dispar
VEQCGKVCEPQCEYLHCFGKQCKCRMVHLEYLLSTIEKKMKRLE

SEQ ID NO: 2555039 - protein, 29 aa, Entamoeba dispar
VFAQYREKCVKKRDEFGVLRNKCDLPKKE

SEQ ID NO: 2555040 - protein, 19 aa, Entamoeba dispar
VFHEEFSIDLKDYIIEIEK

SEQ ID NO: 2555041 - protein, 19 aa, Entamoeba dispar
VGASYDWRYYRYGEYKHKR

SEQ ID NO: 2555042 - protein, 23 aa, Entamoeba dispar
VGASYDWRYYRYGEYKHKRNWFE

SEQ ID NO: 2555043 - protein, 24 aa, Entamoeba dispar
VGCRERSRFGIKVAGTRCAGVMTA

SEQ ID NO: 2555044 - protein, 22 aa, Entamoeba dispar
VGECWPLKSNWVDFLSEEARNW

SEQ ID NO: 2555045 - protein, 24 aa, Entamoeba dispar
VGQYSLKVKRVWFDIEGTWTSSAS

SEQ ID NO: 2555046 - protein, 21 aa, Entamoeba dispar
VHCPCYGLNCITKFSKEDTII

SEQ ID NO: 2555047 - protein, 23 aa, Entamoeba dispar
VHEARQLILKRFNVTSAEYTVIF

SEQ ID NO: 2555048 - protein, 17 aa, Entamoeba dispar
VIFPKYCSRVLNKETLW

SEQ ID NO: 2555049 - protein, 25 aa, Entamoeba dispar
VIGDFLFTCALEIYNTSKAFDFYNC

SEQ ID NO: 2555050 - protein, 18 aa, Entamoeba dispar
VIIEDSGFITQAIPYQEE

SEQ ID NO: 2555051 - protein, 18 aa, Entamoeba dispar
VINLEIPDEILIQRIVSR

SEQ ID NO: 2555052 - protein, 21 aa, Entamoeba dispar
VIRRFADLFVPLKCPHARFTN

SEQ ID NO: 2555053 - protein, 20 aa, Entamoeba dispar
VIVTHSFGGIAVLDLISSMS

SEQ ID NO: 2555054 - protein, 31 aa, Entamoeba dispar
VKCLYKCGMKAHLCCLGKIFSENTHTLIPTT

SEQ ID NO: 2555055 - protein, 19 aa, Entamoeba dispar
VKDQEHFFILILKNLKKEL

SEQ ID NO: 2555056 - protein, 19 aa, Entamoeba dispar
VKEELKIGDFDNIIKEQKR

SEQ ID NO: 2555057 - protein, 24 aa, Entamoeba dispar
VKFDRYEPEIGLALTEDGIKEVPI

SEQ ID NO: 2555058 - protein, 23 aa, Entamoeba dispar
VKHYSFHKICFINDNVTLVHHYI

SEQ ID NO: 2555059 - protein, 19 aa, Entamoeba dispar
VKKASLSLEKKRILLKKNR

SEQ ID NO: 2555060 - protein, 21 aa, Entamoeba dispar
VKKMFNTPVVKKYVPEKPRYY

SEQ ID NO: 2555061 - protein, 20 aa, Entamoeba dispar
VKLNAQMRKGLNMISYDNQA

SEQ ID NO: 2555062 - protein, 17 aa, Entamoeba dispar
VKLSDLKIRLAAKQKER

SEQ ID NO: 2555063 - protein, 24 aa, Entamoeba dispar
VKLTKPVPRSKIFEVMEIIHKQSP

SEQ ID NO: 2555064 - protein, 22 aa, Entamoeba dispar
VKSESSLIIAHFNSGFPLPTHL

SEQ ID NO: 2555065 - protein, 20 aa, Entamoeba dispar
VKTKGFPKVVFYHYNGMKFN

SEQ ID NO: 2555066 - protein, 26 aa, Entamoeba dispar
VKTLCQSCIFWFRLKTSLTDALGITT

SEQ ID NO: 2555067 - protein, 17 aa, Entamoeba dispar
VLDSIQFKDIPQEHIIF

SEQ ID NO: 2555068 - protein, 25 aa, Entamoeba dispar
VLEMKKSRIKSVLKTIMNKVPEHYR

SEQ ID NO: 2555069 - protein, 24 aa, Entamoeba dispar
VLPLKTGIEIFPLEDLDQDFIINR

SEQ ID NO: 2555070 - protein, 22 aa, Entamoeba dispar
VMHRMVADWLKKEFEDAKTRTG

SEQ ID NO: 2555071 - protein, 26 aa, Entamoeba dispar
VMNQIFRLKHRMFRVEEKIRRENDNT

SEQ ID NO: 2555072 - protein, 18 aa, Entamoeba dispar
VMRDCIPEYLTMNYNNKT

SEQ ID NO: 2555073 - protein, 25 aa, Entamoeba dispar
VMSKCPDFKNFGYKIAAPLFEKIGS

SEQ ID NO: 2555074 - protein, 21 aa, Entamoeba dispar
VNFYREGILFSSFDGQKKVST

SEQ ID NO: 2555075 - protein, 24 aa, Entamoeba dispar
VNGDNAWRYAAWIRKATNSYLVVV

SEQ ID NO: 2555076 - protein, 22 aa, Entamoeba dispar
VNGIEHPKWFIKYANNDIDWHL

SEQ ID NO: 2555077 - protein, 19 aa, Entamoeba dispar
VNGSDPVFRKALEENGRKG

SEQ ID NO: 2555078 - protein, 35 aa, Entamoeba dispar
VNKLCNEKSIALLGIRYGEKMPDMENLGGIDTIIS

SEQ ID NO: 2555079 - protein, 18 aa, Entamoeba dispar
VNMLFSSGVGNILLPEDI

SEQ ID NO: 2555080 - protein, 17 aa, Entamoeba dispar
VNRCVQCSFGYLNPSFK

SEQ ID NO: 2555081 - protein, 19 aa, Entamoeba dispar
VPASVDWRAEGKVTPIKDQ

SEQ ID NO: 2555082 - protein, 24 aa, Entamoeba dispar
VPEKPRYYRPTKFVTPVESNAGGF

SEQ ID NO: 2555083 - protein, 20 aa, Entamoeba dispar
VPELKKARHNELKFIAQVLA

SEQ ID NO: 2555084 - protein, 25 aa, Entamoeba dispar
VPFGFDVFLDFGVKLDLGLTGTAIV

SEQ ID NO: 2555085 - protein, 20 aa, Entamoeba dispar
VPIEYTWKEVNTFLNEDWIG

SEQ ID NO: 2555086 - protein, 20 aa, Entamoeba dispar
VPLFEGWKCNSLQLDKKKFN

SEQ ID NO: 2555087 - protein, 19 aa, Entamoeba dispar
VPLLNLFSLGELYTKPNII

SEQ ID NO: 2555088 - protein, 24 aa, Entamoeba dispar
VPNRGRIAKLLRYYSSVSGNETMS

SEQ ID NO: 2555089 - protein, 18 aa, Entamoeba dispar
VPTLISYGDLDFVVDKSQ

SEQ ID NO: 2555090 - protein, 25 aa, Entamoeba dispar
VPYWILKNCWGPSWGSNGYLYLKRN

SEQ ID NO: 2555091 - protein, 20 aa, Entamoeba dispar
VQAEQLLRSEFDDVVKNTKD

SEQ ID NO: 2555092 - protein, 22 aa, Entamoeba dispar
VQEKISRLEVELRRIEDIERHI

SEQ ID NO: 2555093 - protein, 20 aa, Entamoeba dispar
VQFYRYGVRPYVPYDRYSKN

SEQ ID NO: 2555094 - protein, 17 aa, Entamoeba dispar
VQTWTGQFCKTQCCDLP

SEQ ID NO: 2555095 - protein, 17 aa, Entamoeba dispar
VQWKFNYNATQEYNLND

SEQ ID NO: 2555096 - protein, 25 aa, Entamoeba dispar
VRAKCKTCCRVIFASDYNYETGKKF

SEQ ID NO: 2555097 - protein, 19 aa, Entamoeba dispar
VRETYRFNYEYNESIPREF

SEQ ID NO: 2555098 - protein, 20 aa, Entamoeba dispar
VRLILRRIGIELHNINKKVY

SEQ ID NO: 2555099 - protein, 25 aa, Entamoeba dispar
VRNSWGTTWGMDGYILMSRNKNNQC

SEQ ID NO: 2555100 - protein, 20 aa, Entamoeba dispar
VRSEMRRNSAELLLRKYKEK

SEQ ID NO: 2555101 - protein, 20 aa, Entamoeba dispar
VSFNGGFNFENKYGQKTSDF

SEQ ID NO: 2555102 - protein, 23 aa, Entamoeba dispar
VSFSSYPGFVFSFDDFYMTSNDL

SEQ ID NO: 2555103 - protein, 25 aa, Entamoeba dispar
VSHSMGGLMSYKLFDYLGKDFCNAY

SEQ ID NO: 2555104 - protein, 18 aa, Entamoeba dispar
VSIHPGVVVSNILNKYPT

SEQ ID NO: 2555105 - protein, 19 aa, Entamoeba dispar
VSITLCFSILVVLIVTCMV

SEQ ID NO: 2555106 - protein, 17 aa, Entamoeba dispar
VSLTLGKKAWIVTDTHF

SEQ ID NO: 2555107 - protein, 31 aa, Entamoeba dispar
VSNSLKNGLEYSGGINYNIGKNSQFSVNAGK

SEQ ID NO: 2555108 - protein, 24 aa, Entamoeba dispar
VSQVPVKFIIPWEALTPAKDQGSR

SEQ ID NO: 2555109 - protein, 24 aa, Entamoeba dispar
VSSFKFLLPCLRSITSSYHDIAHS

SEQ ID NO: 2555110 - protein, 20 aa, Entamoeba dispar
VTGSNVFGIGGSVKNNKLDL

SEQ ID NO: 2555111 - protein, 18 aa, Entamoeba dispar
VTLCLVFTQVNAVDFYDF

SEQ ID NO: 2555112 - protein, 28 aa, Entamoeba dispar
VTLWRAVPYYCYRWGMTEEELLDDVEHN

SEQ ID NO: 2555113 - protein, 17 aa, Entamoeba dispar
VTRFCAWLNYLKENKGK

SEQ ID NO: 2555114 - protein, 27 aa, Entamoeba dispar
VTSTPIIFRLCEWYSIIPEPDKHYSFS

SEQ ID NO: 2555115 - protein, 17 aa, Entamoeba dispar
VTWDFVLLVTTWPGEFC

SEQ ID NO: 2555116 - protein, 18 aa, Entamoeba dispar
VVCTACYENIQGVTTRDK

SEQ ID NO: 2555117 - protein, 26 aa, Entamoeba dispar
VVELYIKGLNKWLSYDSEFQLPMGFP

SEQ ID NO: 2555118 - protein, 25 aa, Entamoeba dispar
VVIKEHLYFISPIFFGMTVQDSLDL

SEQ ID NO: 2555119 - protein, 18 aa, Entamoeba dispar
VVMTYDYFYRGGIYNSPL

SEQ ID NO: 2555120 - protein, 21 aa, Entamoeba dispar
VYDTTYLCGILNTLGYSIDIQ

SEQ ID NO: 2555121 - protein, 24 aa, Entamoeba dispar
VYFYPCLSCGNAAGQVQSFWSSVI

SEQ ID NO: 2555122 - protein, 18 aa, Entamoeba dispar
VYKKAYKAIMEEVKNTAL

SEQ ID NO: 2555123 - protein, 23 aa, Entamoeba dispar
VYVREKWYYYGLVDNNRTNNLKI

SEQ ID NO: 2555124 - protein, 17 aa, Entamoeba dispar
WAEAFTDYYERPAKSDG

SEQ ID NO: 2555125 - protein, 25 aa, Entamoeba dispar
WASYKLASECYLEYMHLQWENKTKQ

SEQ ID NO: 2555126 - protein, 17 aa, Entamoeba dispar
WCMHCKELKPVMEQLEI

SEQ ID NO: 2555127 - protein, 31 aa, Entamoeba dispar
WCRDEYQQRYGFKCIFVFVESSAKQLEQYNE

SEQ ID NO: 2555128 - protein, 17 aa, Entamoeba dispar
WDICPELNKTLESNPVQ

SEQ ID NO: 2555129 - protein, 17 aa, Entamoeba dispar
WDYIVSSSMRYGENVLA

SEQ ID NO: 2555130 - protein, 21 aa, Entamoeba dispar
WEEYKDYLLKNGIVSMNECKP

SEQ ID NO: 2555131 - protein, 17 aa, Entamoeba dispar
WENGESLTINYKIIKLN

SEQ ID NO: 2555132 - protein, 17 aa, Entamoeba dispar
WFIPDKGVLKVWNFDWE

SEQ ID NO: 2555133 - protein, 17 aa, Entamoeba dispar
WGEDGYMRLYRGGNHCG

SEQ ID NO: 2555134 - protein, 18 aa, Entamoeba dispar
WGTLGYMVGEIWDSASNI

SEQ ID NO: 2555135 - protein, 17 aa, Entamoeba dispar
WGVWGQVLGSSYVSKEA

SEQ ID NO: 2555136 - protein, 20 aa, Entamoeba dispar
WIAYIPIKVKNKFIELINTL

SEQ ID NO: 2555137 - protein, 27 aa, Entamoeba dispar
WITDVCSYCPQGVKVMIVGNKIDLEME

SEQ ID NO: 2555138 - protein, 18 aa, Entamoeba dispar
WKDGSFLETERKIFNKGR

SEQ ID NO: 2555139 - protein, 19 aa, Entamoeba dispar
WKISTNWLNNEKDICEWYG

SEQ ID NO: 2555140 - protein, 18 aa, Entamoeba dispar
WKLISDITKLMGNRFYIK

SEQ ID NO: 2555141 - protein, 18 aa, Entamoeba dispar
WKNLEMQRKMFIRYMKSS

SEQ ID NO: 2555142 - protein, 19 aa, Entamoeba dispar
WKRFFLEDRVEVLNNLPLY

SEQ ID NO: 2555143 - protein, 24 aa, Entamoeba dispar
WLLMNLRFYWPGLKQCSFFNYEYL

SEQ ID NO: 2555144 - protein, 19 aa, Entamoeba dispar
WLPQSALETFKRGGYYTKE

SEQ ID NO: 2555145 - protein, 18 aa, Entamoeba dispar
WMIPKRTIESYDLVTDDE

SEQ ID NO: 2555146 - protein, 17 aa, Entamoeba dispar
WMLDIMIDLFKPWLSDS

SEQ ID NO: 2555147 - protein, 23 aa, Entamoeba dispar
WMYRVALPLFQPINEDIKMILKR

SEQ ID NO: 2555148 - protein, 20 aa, Entamoeba dispar
WNLELHKKYYLVRDDSSLIA

SEQ ID NO: 2555149 - protein, 17 aa, Entamoeba dispar
WRYYRYGEYKHKRNWFE

SEQ ID NO: 2555150 - protein, 18 aa, Entamoeba dispar
WSIPAANLAPNYNKGQKG

SEQ ID NO: 2555151 - protein, 17 aa, Entamoeba dispar
WSTPITLKEFEEASEEV

SEQ ID NO: 2555152 - protein, 19 aa, Entamoeba dispar
WTEFKILLTDLGVTNNEFW

SEQ ID NO: 2555153 - protein, 21 aa, Entamoeba dispar
WYLFEELGFTAGKYIERDFGL

SEQ ID NO: 2555154 - protein, 19 aa, Entamoeba dispar
WYLLEVVGNTGFIQPTHTF

SEQ ID NO: 2555155 - protein, 17 aa, Entamoeba dispar
WYQAGALQPFFRQHSSQ

SEQ ID NO: 2555156 - protein, 17 aa, Entamoeba dispar
YAFFQRKPIILIPGIMS

SEQ ID NO: 2555157 - protein, 29 aa, Entamoeba dispar
YAHLHPPELCWTTPLFKKTALYLVDALRF

SEQ ID NO: 2555158 - protein, 17 aa, Entamoeba dispar
YAKVFAMLNQVEKHIKH

SEQ ID NO: 2555159 - protein, 24 aa, Entamoeba dispar
YANNDIDWHLNWKLRTKCSGLIRY

SEQ ID NO: 2555160 - protein, 17 aa, Entamoeba dispar
YCATNGWQYPGIGEFQV

SEQ ID NO: 2555161 - protein, 19 aa, Entamoeba dispar
YCDQRRPVFLFNGMLGSTI

SEQ ID NO: 2555162 - protein, 17 aa, Entamoeba dispar
YCNSEAVLLNYRKVSSN

SEQ ID NO: 2555163 - protein, 26 aa, Entamoeba dispar
YDANYKPDNKWAFGVDGDISNKNGEK

SEQ ID NO: 2555164 - protein, 26 aa, Entamoeba dispar
YDEPKCKKFILNHAVCAVGYGSQDGK

SEQ ID NO: 2555165 - protein, 17 aa, Entamoeba dispar
YDGGFFTDHTCWWIKTT

SEQ ID NO: 2555166 - protein, 25 aa, Entamoeba dispar
YDNQARLIRCLSLEHRVIIRYRHIV

SEQ ID NO: 2555167 - protein, 18 aa, Entamoeba dispar
YDQKLRMLEVAKAVTAVN

SEQ ID NO: 2555168 - protein, 18 aa, Entamoeba dispar
YDQLMIRRWDTYWDGQFQ

SEQ ID NO: 2555169 - protein, 17 aa, Entamoeba dispar
YDRIGDIQFPYCGVQLE

SEQ ID NO: 2555170 - protein, 20 aa, Entamoeba dispar
YDSWSSDTIFEFLKEGTSPV

SEQ ID NO: 2555171 - protein, 17 aa, Entamoeba dispar
YEHAGVYIMTVLQYQNL

SEQ ID NO: 2555172 - protein, 28 aa, Entamoeba dispar
YEHLKSWKFSSEAVIFDFGKFNNGEIIK

SEQ ID NO: 2555173 - protein, 23 aa, Entamoeba dispar
YEIDGRYWLGGEVQRYDTLKFNG

SEQ ID NO: 2555174 - protein, 22 aa, Entamoeba dispar
YELPTNLFISSLHSRENKETIR

SEQ ID NO: 2555175 - protein, 25 aa, Entamoeba dispar
YEVDNNFKSFIGMISVNGEVVMEEQ

SEQ ID NO: 2555176 - protein, 22 aa, Entamoeba dispar
YEYLKHGTCIPSISHGEDGPQY

SEQ ID NO: 2555177 - protein, 17 aa, Entamoeba dispar
YFFSTSITTWFEDNELS

SEQ ID NO: 2555178 - protein, 17 aa, Entamoeba dispar
YFLATSVKVDQPILRFQ

SEQ ID NO: 2555179 - protein, 23 aa, Entamoeba dispar
YFSCFGKTLICGETIIREDQKIT

SEQ ID NO: 2555180 - protein, 25 aa, Entamoeba dispar
YFYPCISCGDPAGQVNSFWNQVVAN

SEQ ID NO: 2555181 - protein, 23 aa, Entamoeba dispar
YGANRGVIVYGEIDTPAHTASWN

SEQ ID NO: 2555182 - protein, 27 aa, Entamoeba dispar
YGCKRCKEGYYLTKDMKCLKCDDKCET

SEQ ID NO: 2555183 - protein, 17 aa, Entamoeba dispar
YGGEIGFHRVIDILEDA

SEQ ID NO: 2555184 - protein, 19 aa, Entamoeba dispar
YGLSLSFFETFRFNYNYTE

SEQ ID NO: 2555185 - protein, 26 aa, Entamoeba dispar
YGQSQFKQATCPNGLECKCGKTIYNP

SEQ ID NO: 2555186 - protein, 17 aa, Entamoeba dispar
YHIENFYTSCTHKYDEL

SEQ ID NO: 2555187 - protein, 17 aa, Entamoeba dispar
YHSSIAFQPLPPIDKSK

SEQ ID NO: 2555188 - protein, 22 aa, Entamoeba dispar
YIEFSNGCMLIECESLQQGEAH

SEQ ID NO: 2555189 - protein, 18 aa, Entamoeba dispar
YINHVKIIDFYKGGIEYD

SEQ ID NO: 2555190 - protein, 24 aa, Entamoeba dispar
YINSPYLDKEFKLFSHKWTMDSIR

SEQ ID NO: 2555191 - protein, 18 aa, Entamoeba dispar
YKEVMFIVDTCQATSLSD

SEQ ID NO: 2555192 - protein, 20 aa, Entamoeba dispar
YKIASPFNFHKVFKSYTSLL

SEQ ID NO: 2555193 - protein, 27 aa, Entamoeba dispar
YKKELTWPIKESIIYKKVLDLIEQVNA

SEQ ID NO: 2555194 - protein, 19 aa, Entamoeba dispar
YKKGWKYDQKLRMLEVAKA

SEQ ID NO: 2555195 - protein, 19 aa, Entamoeba dispar
YKMVLLVRKDLKMQKGKIA

SEQ ID NO: 2555196 - protein, 20 aa, Entamoeba dispar
YKNLKIALLEKARDVSTGAT

SEQ ID NO: 2555197 - protein, 23 aa, Entamoeba dispar
YKPDEKWDISAGASRSTEGTTWS

SEQ ID NO: 2555198 - protein, 17 aa, Entamoeba dispar
YKPSAVVMEVDEDLLKD

SEQ ID NO: 2555199 - protein, 25 aa, Entamoeba dispar
YKTGDNIIVTWSCRNYSGDKDLYIK

SEQ ID NO: 2555200 - protein, 20 aa, Entamoeba dispar
YKYNGVFPKHVPLLTVNEFL

SEQ ID NO: 2555201 - protein, 19 aa, Entamoeba dispar
YLAEKCAYIVMPMYSTDGE

SEQ ID NO: 2555202 - protein, 26 aa, Entamoeba dispar
YLDGKFTMTSSFDYWDANVIEVMDKS

SEQ ID NO: 2555203 - protein, 23 aa, Entamoeba dispar
YLPYRLDLDLCYQAKKASDGRSV

SEQ ID NO: 2555204 - protein, 23 aa, Entamoeba dispar
YLPYRLDLDLCYQAKKASDSRSV

SEQ ID NO: 2555205 - protein, 17 aa, Entamoeba dispar
YLRDEIVSFLDGTSTCK

SEQ ID NO: 2555206 - protein, 32 aa, Entamoeba dispar
YLSCIISFASAELYTFDDFELFSEIEYQVDIS

SEQ ID NO: 2555207 - protein, 18 aa, Entamoeba dispar
YLSKECSRTNKGYITCAS

SEQ ID NO: 2555208 - protein, 25 aa, Entamoeba dispar
YLVDALRFDFAFSTEYPPLFDNVTD

SEQ ID NO: 2555209 - protein, 18 aa, Entamoeba dispar
YLVPHMKKEIPINRDDNR

SEQ ID NO: 2555210 - protein, 17 aa, Entamoeba dispar
YMKPVIADESWKLLFKT

SEQ ID NO: 2555211 - protein, 24 aa, Entamoeba dispar
YMKVEMKKRYTIIAKNLKKMLPNK

SEQ ID NO: 2555212 - protein, 18 aa, Entamoeba dispar
YMTPVMKFIYTVILFLFS

SEQ ID NO: 2555213 - protein, 17 aa, Entamoeba dispar
YMWKGSCEPGQLTPEGI

SEQ ID NO: 2555214 - protein, 26 aa, Entamoeba dispar
YNAEYRPDKNFTFGISGSKENTYGQT

SEQ ID NO: 2555215 - protein, 26 aa, Entamoeba dispar
YNFDSPDAFDWPLIYKTMKRVKQRKR

SEQ ID NO: 2555216 - protein, 18 aa, Entamoeba dispar
YNIKSYCFVDENDLYVKK

SEQ ID NO: 2555217 - protein, 17 aa, Entamoeba dispar
YNITISLFSQTEECNEL

SEQ ID NO: 2555218 - protein, 18 aa, Entamoeba dispar
YNLDGICLEGLENVFYIT

SEQ ID NO: 2555219 - protein, 26 aa, Entamoeba dispar
YNLLFKMIEMLGTPPIEMLERGTKTH

SEQ ID NO: 2555220 - protein, 21 aa, Entamoeba dispar
YNNELLLPFFEGVVEKNVFNL

SEQ ID NO: 2555221 - protein, 17 aa, Entamoeba dispar
YNYHLPIQRTYINSNPA

SEQ ID NO: 2555222 - protein, 17 aa, Entamoeba dispar
YPNSLKFLQCYSNSLPK

SEQ ID NO: 2555223 - protein, 20 aa, Entamoeba dispar
YPSTCSSFNKCFRCDNKKCI

SEQ ID NO: 2555224 - protein, 27 aa, Entamoeba dispar
YPTGCKKKGYHCVFDGIKHDKYFECNE

SEQ ID NO: 2555225 - protein, 20 aa, Entamoeba dispar
YPVPIQWKTIIQHFALVINS

SEQ ID NO: 2555226 - protein, 18 aa, Entamoeba dispar
YQKIKVAAFKKAKKDAIR

SEQ ID NO: 2555227 - protein, 17 aa, Entamoeba dispar
YQNVELFIQGKDIKYEI

SEQ ID NO: 2555228 - protein, 25 aa, Entamoeba dispar
YQRYGCVKTPPKFSAQRFLDVTTTK

SEQ ID NO: 2555229 - protein, 23 aa, Entamoeba dispar
YRKKEPYQRIEFSLRIESSNEGT

SEQ ID NO: 2555230 - protein, 20 aa, Entamoeba dispar
YRNAKCKPIVKKIYKKKQPK

SEQ ID NO: 2555231 - protein, 18 aa, Entamoeba dispar
YRPNCIKNDIEYISEDIE

SEQ ID NO: 2555232 - protein, 18 aa, Entamoeba dispar
YSEESFSNFVCLNEGVYL

SEQ ID NO: 2555233 - protein, 25 aa, Entamoeba dispar
YSGLAEKALKCSQIEVINQNNIDYM

SEQ ID NO: 2555234 - protein, 21 aa, Entamoeba dispar
YSHSFIQLFNNFNIVRIAYSN

SEQ ID NO: 2555235 - protein, 23 aa, Entamoeba dispar
YSNLKKKWYFAPRKCSNKAYNKQ

SEQ ID NO: 2555236 - protein, 20 aa, Entamoeba dispar
YSPEEISAMVIKKMADTAST

SEQ ID NO: 2555237 - protein, 18 aa, Entamoeba dispar
YSSWPPYASYIIFEMYEK

SEQ ID NO: 2555238 - protein, 20 aa, Entamoeba dispar
YTDLWMKVGTSWIQVPQLSK

SEQ ID NO: 2555239 - protein, 27 aa, Entamoeba dispar
YTEAWQTSMVLNWVFQMMLPITTDVKT

SEQ ID NO: 2555240 - protein, 25 aa, Entamoeba dispar
YTFSFIPFDCCVNGATSGFGCNQIV

SEQ ID NO: 2555241 - protein, 28 aa, Entamoeba dispar
YTGMYEYWKFTGVKIKWIPNVKTAVALP

SEQ ID NO: 2555242 - protein, 22 aa, Entamoeba dispar
YTNKEIFLRELISNASDALDKL

SEQ ID NO: 2555243 - protein, 24 aa, Entamoeba dispar
YTQTKRVTVEWDYLNKTNLVDLII

SEQ ID NO: 2555244 - protein, 17 aa, Entamoeba dispar
YTRGNKIYCGKRNNEGK

SEQ ID NO: 2555245 - protein, 17 aa, Entamoeba dispar
YTVEGWRGSDYTRTHRD

SEQ ID NO: 2555246 - protein, 17 aa, Entamoeba dispar
YVCATLLSTELLNISVP

SEQ ID NO: 2555247 - protein, 17 aa, Entamoeba dispar
YVELYVVMTYDYFYRGG

SEQ ID NO: 2555248 - protein, 20 aa, Entamoeba dispar
YVKVMKRIIERGADYVEKEK

SEQ ID NO: 2555249 - protein, 26 aa, Entamoeba dispar
YVRAKCKTCCRVIFASDYNYKTKKQF

SEQ ID NO: 2555250 - protein, 18 aa, Entamoeba dispar
YVRSVFDPTHYVKKTLSI

SEQ ID NO: 2555251 - protein, 25 aa, Entamoeba dispar
YVSLSRAYRGELVFIYTDDKETMEF

SEQ ID NO: 2555252 - protein, 25 aa, Entamoeba dispar
YYAPWCGHCKALKPIYENLAKELHN

SEQ ID NO: 2555253 - protein, 25 aa, Entamoeba dispar
YYFIPYDVFKFGNSRFLNYGDDTIA

SEQ ID NO: 2555254 - protein, 23 aa, Entamoeba dispar
YYFKEIYASSLLVNELNKNKIIF

SEQ ID NO: 2555255 - protein, 23 aa, Entamoeba dispar
YYKGEFKKLFYGKSLTNINVTAT

SEQ ID NO: 2555256 - protein, 18 aa, Entamoeba dispar
YYLEAYVFKDILKNPPQP

SEQ ID NO: 2555257 - protein, 17 aa, Entamoeba dispar
YYLEAYVFKDILKNPSQ

SEQ ID NO: 2555258 - protein, 22 aa, Entamoeba dispar
YYSHCKKCQHGHISSGSVSDSL

SEQ ID NO: 2555259 - protein, 19 aa, Entamoeba dispar
YYSLTGVSFMPPRFSLGFH

SEQ ID NO: 2555260 - protein, 22 aa, Entamoeba dispar
YYYRRPYYRLSPYVRGLYLNPD

SEQ ID NO: 2555261 - protein, 20 aa, Entamoeba dispar
RFFQEWYFDLLLSHTDKVLS

SEQ ID NO: 2555262 - protein, 18 aa, Entamoeba dispar
LYYGSRWGVIRQLDAASM

SEQ ID NO: 2555263 - protein, 19 aa, Entamoeba dispar
AFTKLTWLLAQGMTPDEVR

SEQ ID NO: 2555264 - protein, 26 aa, Entamoeba dispar
ERRDMLWKKRCIRFRKTANMKQNEEL

SEQ ID NO: 2555265 - protein, 17 aa, Entamoeba dispar
FAPWCGHCNRLKPIWEN

SEQ ID NO: 2555266 - protein, 18 aa, Entamoeba dispar
GGLMFYKFLDYVGKEFAD

SEQ ID NO: 2555267 - protein, 22 aa, Entamoeba dispar
GRSWFFQTCIAYGYYQAVSEQS

SEQ ID NO: 2555268 - protein, 19 aa, Entamoeba dispar
KFEQGIDCGGGYIKLLPKK

SEQ ID NO: 2555269 - protein, 18 aa, Entamoeba dispar
KLPFPIKMHCMISSGYES

SEQ ID NO: 2555270 - protein, 19 aa, Entamoeba dispar
LYYGSRWGVIRQLDAASMM

SEQ ID NO: 2555271 - protein, 20 aa, Entamoeba dispar
PRKFKGKIFAIIESDDDMNI

SEQ ID NO: 2555272 - protein, 22 aa, Entamoeba dispar
RAKCKTCCRVIFASDYNYKTQR

SEQ ID NO: 2555273 - protein, 20 aa, Entamoeba dispar
YRMYTCYSMPKRVHDIRGGA

SEQ ID NO: 2555274 - protein, 22 aa, Entamoeba dispar
AFFRPKIAIGLLPQGKKMKSLE

SEQ ID NO: 2555275 - protein, 17 aa, Entamoeba dispar
AFGTSLPLAAKVSGIHW

SEQ ID NO: 2555276 - protein, 18 aa, Entamoeba dispar
AILLTLFVLICFVSANEL

SEQ ID NO: 2555277 - protein, 23 aa, Entamoeba dispar
AKYKYLQLCMTLRSYGMNIYHGG

SEQ ID NO: 2555278 - protein, 18 aa, Entamoeba dispar
ALEMKKDIPTIVKYMKES

SEQ ID NO: 2555279 - protein, 17 aa, Entamoeba dispar
ANCICFYCNFVLSNYSG

SEQ ID NO: 2555280 - protein, 25 aa, Entamoeba dispar
ARFVFSLPIDVCFGIASNNNGYMIV

SEQ ID NO: 2555281 - protein, 17 aa, Entamoeba dispar
ASLEVYYCLCLMEFLVV

SEQ ID NO: 2555282 - protein, 18 aa, Entamoeba dispar
ATSSLKCSSIEFGSVLYS

SEQ ID NO: 2555283 - protein, 17 aa, Entamoeba dispar
CDKSGFETLQFHVQAGP

SEQ ID NO: 2555284 - protein, 20 aa, Entamoeba dispar
CGGCYAMALAQVLQAHYTHL

SEQ ID NO: 2555285 - protein, 19 aa, Entamoeba dispar
CGSCYSFGSLAAIESRLLI

SEQ ID NO: 2555286 - protein, 18 aa, Entamoeba dispar
CILCVYTTAYSLEEDFEM

SEQ ID NO: 2555287 - protein, 17 aa, Entamoeba dispar
CLIFIILVILYIKNSTQ

SEQ ID NO: 2555288 - protein, 20 aa, Entamoeba dispar
CLLELTLALYPTGCKKKGYH

SEQ ID NO: 2555289 - protein, 18 aa, Entamoeba dispar
CLTVSFAYEDDVFVDSVD

SEQ ID NO: 2555290 - protein, 19 aa, Entamoeba dispar
CLWKEQLAIDIAKHYGTPY

SEQ ID NO: 2555291 - protein, 19 aa, Entamoeba dispar
CPHCVRFSPIYSEFAVKMQ

SEQ ID NO: 2555292 - protein, 24 aa, Entamoeba dispar
CQKCTPNQCTLCLDGIINENGICV

SEQ ID NO: 2555293 - protein, 19 aa, Entamoeba dispar
CSCLCSLKILGLVSYLILL

SEQ ID NO: 2555294 - protein, 20 aa, Entamoeba dispar
CSKSECFKCEKGYGLNEEGK

SEQ ID NO: 2555295 - protein, 18 aa, Entamoeba dispar
CVLLVLGSFASSFNNDYS

SEQ ID NO: 2555296 - protein, 27 aa, Entamoeba dispar
CWIVSFVLPSWVELKWSNEGICFLFKS

SEQ ID NO: 2555297 - protein, 18 aa, Entamoeba dispar
CYSLAFKVAKYAANLFDP

SEQ ID NO: 2555298 - protein, 18 aa, Entamoeba dispar
DAAIVICPFSFIKCQEYI

SEQ ID NO: 2555299 - protein, 24 aa, Entamoeba dispar
DANYKPDNKWAFGVDGDISNKNGE

SEQ ID NO: 2555300 - protein, 24 aa, Entamoeba dispar
DEAYCMYKKCGVCENGTTYKCGNK

SEQ ID NO: 2555301 - protein, 20 aa, Entamoeba dispar
DEIIRFGALNAMIDIGKCDE

SEQ ID NO: 2555302 - protein, 24 aa, Entamoeba dispar
DEVWFRKRMQVVNVLLPDGSTKKM

SEQ ID NO: 2555303 - protein, 24 aa, Entamoeba dispar
DFDQRIALFLVEICKRKFKKDPSN

SEQ ID NO: 2555304 - protein, 18 aa, Entamoeba dispar
DKCGGKGKLYGKVCHVCN

SEQ ID NO: 2555305 - protein, 20 aa, Entamoeba dispar
DLTLSYKPSDKFSVEGKAGY

SEQ ID NO: 2555306 - protein, 20 aa, Entamoeba dispar
DMKICKRIVKETLTFSYQYF

SEQ ID NO: 2555307 - protein, 24 aa, Entamoeba dispar
DNGEWSTKCVMAYCDDGYKFDYNN

SEQ ID NO: 2555308 - protein, 19 aa, Entamoeba dispar
DNILKEAIDFIGIKKEDIK

SEQ ID NO: 2555309 - protein, 19 aa, Entamoeba dispar
DPLLFRFLQIFKEIRELSG

SEQ ID NO: 2555310 - protein, 19 aa, Entamoeba dispar
ECLEFEGCLECTRRECTKC

SEQ ID NO: 2555311 - protein, 17 aa, Entamoeba dispar
EEARNWWAGLYSFDKYK

SEQ ID NO: 2555312 - protein, 32 aa, Entamoeba dispar
EEFCGHYMFPYCILNKHLPFWGGYVGSHFEIE

SEQ ID NO: 2555313 - protein, 21 aa, Entamoeba dispar
EFPTILFHRAHLRDRTFDEDE

SEQ ID NO: 2555314 - protein, 21 aa, Entamoeba dispar
EFYHFRHGCIMHRRMVKAQKM

SEQ ID NO: 2555315 - protein, 17 aa, Entamoeba dispar
EGCKGGFILKNSWNDTV

SEQ ID NO: 2555316 - protein, 17 aa, Entamoeba dispar
EGIKWSEKVLRRIAIEM

SEQ ID NO: 2555317 - protein, 23 aa, Entamoeba dispar
EIKRRPGETMAHFLKRKERQQRK

SEQ ID NO: 2555318 - protein, 18 aa, Entamoeba dispar
EKIFNKWCDIYHKEINTR

SEQ ID NO: 2555319 - protein, 17 aa, Entamoeba dispar
ELKKPREGWNWKLQILE

SEQ ID NO: 2555320 - protein, 18 aa, Entamoeba dispar
EPYQKIEFSLRIESSNEG

SEQ ID NO: 2555321 - protein, 22 aa, Entamoeba dispar
ERKLKVMIKRAVIARLNSAKTA

SEQ ID NO: 2555322 - protein, 17 aa, Entamoeba dispar
ESKEYLKSIGIDLSKIT

SEQ ID NO: 2555323 - protein, 18 aa, Entamoeba dispar
ETGLKFQAVMSFHKCGGN

SEQ ID NO: 2555324 - protein, 19 aa, Entamoeba dispar
ETPSKRFGIKFVKDKTVEF

SEQ ID NO: 2555325 - protein, 19 aa, Entamoeba dispar
EVVKRIALISEEWNSENGM

SEQ ID NO: 2555326 - protein, 21 aa, Entamoeba dispar
EVYYCLCLMEFLVVKVKGFDV

SEQ ID NO: 2555327 - protein, 22 aa, Entamoeba dispar
EWEYPPRCQWMLEFMNEQFKGW

SEQ ID NO: 2555328 - protein, 32 aa, Entamoeba dispar
EYGKALGVTIEYCRFHWPYFMFKQVSKTRIIW

SEQ ID NO: 2555329 - protein, 17 aa, Entamoeba dispar
FAPWCGHCKRLAPIYEE

SEQ ID NO: 2555330 - protein, 22 aa, Entamoeba dispar
FDGKDFFDSWAIFNTAGLNIEL

SEQ ID NO: 2555331 - protein, 19 aa, Entamoeba dispar
FFIFRCWRSLGSWDPNAKG

SEQ ID NO: 2555332 - protein, 18 aa, Entamoeba dispar
FFLGYPLFGATSEYNLLF

SEQ ID NO: 2555333 - protein, 17 aa, Entamoeba dispar
FGALNAMIDIGKCDETK

SEQ ID NO: 2555334 - protein, 23 aa, Entamoeba dispar
FGLRSIIEYAPWINRIFLVTDGE

SEQ ID NO: 2555335 - protein, 20 aa, Entamoeba dispar
FKIEIGISFPDFYSSIQLTE

SEQ ID NO: 2555336 - protein, 17 aa, Entamoeba dispar
FKSGAKMAAKMAALAKK

SEQ ID NO: 2555337 - protein, 18 aa, Entamoeba dispar
FLCVAFAYIPRTVSIIEL

SEQ ID NO: 2555338 - protein, 19 aa, Entamoeba dispar
FLGNPLKGFGMWYGSGNTA

SEQ ID NO: 2555339 - protein, 20 aa, Entamoeba dispar
FLQIFKEIRELSGIRPNVPK

SEQ ID NO: 2555340 - protein, 18 aa, Entamoeba dispar
FNGIEFIDWANTKTFPLF

SEQ ID NO: 2555341 - protein, 20 aa, Entamoeba dispar
FNHQLPIFWYFSAKHNQTAH

SEQ ID NO: 2555342 - protein, 18 aa, Entamoeba dispar
FPEEPVVFVFHLSITGSS

SEQ ID NO: 2555343 - protein, 17 aa, Entamoeba dispar
FPGTENFAGVKYPLEWV

SEQ ID NO: 2555344 - protein, 19 aa, Entamoeba dispar
FQLPMGFPLLQPVTYGYAH

SEQ ID NO: 2555345 - protein, 20 aa, Entamoeba dispar
FRIHPWRRFRIWKKHHHRRH

SEQ ID NO: 2555346 - protein, 17 aa, Entamoeba dispar
FRYQLVGVDVFRFRCIV

SEQ ID NO: 2555347 - protein, 17 aa, Entamoeba dispar
FSDCSLCTGEWCGSCKS

SEQ ID NO: 2555348 - protein, 18 aa, Entamoeba dispar
FVGKTCFFQRFSVGEFNA

SEQ ID NO: 2555349 - protein, 20 aa, Entamoeba dispar
FVGSLGMKWLSWVLKKSVIK

SEQ ID NO: 2555350 - protein, 21 aa, Entamoeba dispar
FWHYRNWWLRRHWLRNWKRQM

SEQ ID NO: 2555351 - protein, 20 aa, Entamoeba dispar
FYFYPEFEISDSKPFIFAPH

SEQ ID NO: 2555352 - protein, 18 aa, Entamoeba dispar
FYPCVKCGSAASQVNSFI

SEQ ID NO: 2555353 - protein, 19 aa, Entamoeba dispar
GAKESFSFARYQATDDGSY

SEQ ID NO: 2555354 - protein, 21 aa, Entamoeba dispar
GAKFPLDWICKINSLSNNKHK

SEQ ID NO: 2555355 - protein, 18 aa, Entamoeba dispar
GFDWRISSISSFQFITDT

SEQ ID NO: 2555356 - protein, 18 aa, Entamoeba dispar
GGEINWFYSFPFLYDKIL

SEQ ID NO: 2555357 - protein, 18 aa, Entamoeba dispar
GGLMFYKFLDYVGKEFSD

SEQ ID NO: 2555358 - protein, 23 aa, Entamoeba dispar
GGVIPRSLAFGVIKESQGFVKKA

SEQ ID NO: 2555359 - protein, 18 aa, Entamoeba dispar
GHCKKLAPEYIKLADAYK

SEQ ID NO: 2555360 - protein, 19 aa, Entamoeba dispar
GHCKRLAPIYEEFSNVAAT

SEQ ID NO: 2555361 - protein, 18 aa, Entamoeba dispar
GHCKRLAPTYEEVAQAFA

SEQ ID NO: 2555362 - protein, 17 aa, Entamoeba dispar
GISAEFNPNNKFGASLG

SEQ ID NO: 2555363 - protein, 24 aa, Entamoeba dispar
GKFDYKASDAWRVTGDGFISNNYG

SEQ ID NO: 2555364 - protein, 18 aa, Entamoeba dispar
GKLKLKRRIKFLKLPFFR

SEQ ID NO: 2555365 - protein, 17 aa, Entamoeba dispar
GKLSLLVSRVVFNEIIP

SEQ ID NO: 2555366 - protein, 23 aa, Entamoeba dispar
GKNSMGLCWSRSFDIDDIFNYPA

SEQ ID NO: 2555367 - protein, 24 aa, Entamoeba dispar
GNFNYKANDNWTFTGNGKANNQYG

SEQ ID NO: 2555368 - protein, 19 aa, Entamoeba dispar
GNKYPLKNYEVWRMDDEEY

SEQ ID NO: 2555369 - protein, 19 aa, Entamoeba dispar
GPQKAAAVGGRFVINKYAE

SEQ ID NO: 2555370 - protein, 18 aa, Entamoeba dispar
GRNELKEKLIIESNSNTI

SEQ ID NO: 2555371 - protein, 21 aa, Entamoeba dispar
GSCIKEYFGNELIRYVNVHCY

SEQ ID NO: 2555372 - protein, 17 aa, Entamoeba dispar
GSMLKWGCYSSSLIDKT

SEQ ID NO: 2555373 - protein, 18 aa, Entamoeba dispar
GSMYRWRTVGLYDLNEIQ

SEQ ID NO: 2555374 - protein, 23 aa, Entamoeba dispar
GYLLKRWKERFVVVKNSYLFYFV

SEQ ID NO: 2555375 - protein, 17 aa, Entamoeba dispar
HCYRNGWEYSNKFGDNK

SEQ ID NO: 2555376 - protein, 22 aa, Entamoeba dispar
HDKYFECNEFYEGIRTCPRNTK

SEQ ID NO: 2555377 - protein, 25 aa, Entamoeba dispar
HITKRRGCPCIHKVPDVPCKCSSIK

SEQ ID NO: 2555378 - protein, 18 aa, Entamoeba dispar
HLKSWKFSSEAVIFDFGK

SEQ ID NO: 2555379 - protein, 19 aa, Entamoeba dispar
HPPELCWTTPLFKKTALYL

SEQ ID NO: 2555380 - protein, 17 aa, Entamoeba dispar
IAVSAFAAPKCAQTNVA

SEQ ID NO: 2555381 - protein, 17 aa, Entamoeba dispar
ICLCAFAEEDLFNPFIH

SEQ ID NO: 2555382 - protein, 19 aa, Entamoeba dispar
IESIVSFDFVNKVFNYSEV

SEQ ID NO: 2555383 - protein, 17 aa, Entamoeba dispar
IFESSGYLKKMELGKKE

SEQ ID NO: 2555384 - protein, 18 aa, Entamoeba dispar
IFKMCRFYNISFNKLQEI

SEQ ID NO: 2555385 - protein, 19 aa, Entamoeba dispar
IIFRLCEWYSIIPEPDKHY

SEQ ID NO: 2555386 - protein, 21 aa, Entamoeba dispar
IITPVELVFPFSTNPRIRNAQ

SEQ ID NO: 2555387 - protein, 17 aa, Entamoeba dispar
IKIQLFIESVRRKVYFT

SEQ ID NO: 2555388 - protein, 20 aa, Entamoeba dispar
IKMILKRSGMNAIIIVDNEI

SEQ ID NO: 2555389 - protein, 17 aa, Entamoeba dispar
IKRKKCKGIKKDKIKEI

SEQ ID NO: 2555390 - protein, 26 aa, Entamoeba dispar
IKTTNLCGIGWRIGDYVYPLNMIVYA

SEQ ID NO: 2555391 - protein, 17 aa, Entamoeba dispar
IKYKFMVNRSIWVQNIG

SEQ ID NO: 2555392 - protein, 22 aa, Entamoeba dispar
INRLRVKVAIFKRKVSRCKNSP

SEQ ID NO: 2555393 - protein, 18 aa, Entamoeba dispar
INWFYSFPFLYDKILPSA

SEQ ID NO: 2555394 - protein, 21 aa, Entamoeba dispar
IPLARLDAGWFLRDILSFQQM

SEQ ID NO: 2555395 - protein, 19 aa, Entamoeba dispar
IPRCWRSTGSWDPYCANNC

SEQ ID NO: 2555396 - protein, 20 aa, Entamoeba dispar
IRWYQVGAFYPFFRAHAHLD

SEQ ID NO: 2555397 - protein, 24 aa, Entamoeba dispar
ISKVWKKKWASFMDKKLLKYLSKI

SEQ ID NO: 2555398 - protein, 17 aa, Entamoeba dispar
ISPKSASVKGRMKKIAK

SEQ ID NO: 2555399 - protein, 20 aa, Entamoeba dispar
IYGANPLLFCFGNFFDEFRL

SEQ ID NO: 2555400 - protein, 17 aa, Entamoeba dispar
IYNPCMWPFQEGTLDCD

SEQ ID NO: 2555401 - protein, 18 aa, Entamoeba dispar
KCGICYEVVGPKGTVRFR

SEQ ID NO: 2555402 - protein, 20 aa, Entamoeba dispar
KCGKTIYNPCMWPFQEGTLD

SEQ ID NO: 2555403 - protein, 17 aa, Entamoeba dispar
KDYKFGILYAKEGQTIE

SEQ ID NO: 2555404 - protein, 17 aa, Entamoeba dispar
KEDKIMFELDVRDAIEK

SEQ ID NO: 2555405 - protein, 20 aa, Entamoeba dispar
KEIIKIVVIGSVKPKFMFNG

SEQ ID NO: 2555406 - protein, 17 aa, Entamoeba dispar
KEMCFKEAFDMFTSVAH

SEQ ID NO: 2555407 - protein, 21 aa, Entamoeba dispar
KEQRQAVKIVRVYEKQQHKKE

SEQ ID NO: 2555408 - protein, 17 aa, Entamoeba dispar
KEVKCLLKKSGVKGSLN

SEQ ID NO: 2555409 - protein, 19 aa, Entamoeba dispar
KFDIKIVKVISYFDAQFNK

SEQ ID NO: 2555410 - protein, 18 aa, Entamoeba dispar
KGIEYVWMMGVWQLGEYG

SEQ ID NO: 2555411 - protein, 25 aa, Entamoeba dispar
KGSRPAGLCQLRWNGNGYTQNLIQG

SEQ ID NO: 2555412 - protein, 18 aa, Entamoeba dispar
KIAMLKVKLNAQMRKGLN

SEQ ID NO: 2555413 - protein, 18 aa, Entamoeba dispar
KKAECPQMVMARLAQKAH

SEQ ID NO: 2555414 - protein, 19 aa, Entamoeba dispar
KKEPYQRIEFSLTIEQSNE

SEQ ID NO: 2555415 - protein, 24 aa, Entamoeba dispar
KKIKGKRFNSDLVRFNVFKDTMER

SEQ ID NO: 2555416 - protein, 19 aa, Entamoeba dispar
KKISEWFARSISSALISLS

SEQ ID NO: 2555417 - protein, 18 aa, Entamoeba dispar
KKLARLVIRRKKYNSSEK

SEQ ID NO: 2555418 - protein, 18 aa, Entamoeba dispar
KKLFLIEKLHDFIPIENK

SEQ ID NO: 2555419 - protein, 21 aa, Entamoeba dispar
KKPREGWNWKLQILEIANSPM

SEQ ID NO: 2555420 - protein, 18 aa, Entamoeba dispar
KKSLKSKIKVASKTAKKA

SEQ ID NO: 2555421 - protein, 18 aa, Entamoeba dispar
KKYPIVWYFDINITEQIK

SEQ ID NO: 2555422 - protein, 24 aa, Entamoeba dispar
KLEEKRLKLAIHGKLPGQKADLIS

SEQ ID NO: 2555423 - protein, 20 aa, Entamoeba dispar
KLHFYWMWWFYGRDEALKLT

SEQ ID NO: 2555424 - protein, 22 aa, Entamoeba dispar
KLKEFRLRRTIAIILKQMATVL

SEQ ID NO: 2555425 - protein, 20 aa, Entamoeba dispar
KLKRNRLSSIYNMKKVKASD

SEQ ID NO: 2555426 - protein, 24 aa, Entamoeba dispar
KLRLKKRLNKMVAIAKECEKKTPN

SEQ ID NO: 2555427 - protein, 17 aa, Entamoeba dispar
KLRRKARKVLRKKQQRG

SEQ ID NO: 2555428 - protein, 18 aa, Entamoeba dispar
KNFVPNSCQVHFVQYFLP

SEQ ID NO: 2555429 - protein, 17 aa, Entamoeba dispar
KNIKRKKCKGIKKDKIK

SEQ ID NO: 2555430 - protein, 22 aa, Entamoeba dispar
KQYKIKDFVPIDWYINSPYLDK

SEQ ID NO: 2555431 - protein, 30 aa, Entamoeba dispar
KQYYECATTFKGFRPCAPGTWCQGEQEGPY

SEQ ID NO: 2555432 - protein, 18 aa, Entamoeba dispar
KRIDIMQILLKYGADIDM

SEQ ID NO: 2555433 - protein, 18 aa, Entamoeba dispar
KSSSSLFAILSIYDNSSL

SEQ ID NO: 2555434 - protein, 18 aa, Entamoeba dispar
KWVVPSLKKNSMQFGSII

SEQ ID NO: 2555435 - protein, 17 aa, Entamoeba dispar
KYYCPYKPGSELKYFQI

SEQ ID NO: 2555436 - protein, 21 aa, Entamoeba dispar
LAEKALKCSQIEVINQNNIDY

SEQ ID NO: 2555437 - protein, 24 aa, Entamoeba dispar
LAFAWRPNPSYGLTNFKDMITTWC

SEQ ID NO: 2555438 - protein, 20 aa, Entamoeba dispar
LCIFFFIFLCHLAGIYLYGS

SEQ ID NO: 2555439 - protein, 34 aa, Entamoeba dispar
LCLAFVSAMELEGDYQLDNGFDLKEENIDDNNDE

SEQ ID NO: 2555440 - protein, 18 aa, Entamoeba dispar
LCLFWFLIEVTFDIDANG

SEQ ID NO: 2555441 - protein, 18 aa, Entamoeba dispar
LDRLEINVTFALNITSNS

SEQ ID NO: 2555442 - protein, 21 aa, Entamoeba dispar
LENLKRVLVINGEHDIIIKIN

SEQ ID NO: 2555443 - protein, 18 aa, Entamoeba dispar
LFHYFKCRKQIPRLLHQM

SEQ ID NO: 2555444 - protein, 17 aa, Entamoeba dispar
LFLILLFLFCVGSLSNK

SEQ ID NO: 2555445 - protein, 22 aa, Entamoeba dispar
LFSFFSILFFEGCCSSEIQLEV

SEQ ID NO: 2555446 - protein, 20 aa, Entamoeba dispar
LFVIPKKYPIVWYFDINITE

SEQ ID NO: 2555447 - protein, 17 aa, Entamoeba dispar
LGNDLAIPFLHGAYSVE

SEQ ID NO: 2555448 - protein, 21 aa, Entamoeba dispar
LIDFGSACFENYTLYSYIQSR

SEQ ID NO: 2555449 - protein, 17 aa, Entamoeba dispar
LIIEPRIQPLLIQSDKP

SEQ ID NO: 2555450 - protein, 24 aa, Entamoeba dispar
LITWKDGKKFFPLGLYFDEIIDSD

SEQ ID NO: 2555451 - protein, 20 aa, Entamoeba dispar
LKEWGGAIIVGFDGDPYGKD

SEQ ID NO: 2555452 - protein, 23 aa, Entamoeba dispar
LKQMLRLYVRRVFVSGDFYTTLP

SEQ ID NO: 2555453 - protein, 17 aa, Entamoeba dispar
LKVIQTFMFRYLAPLQF

SEQ ID NO: 2555454 - protein, 22 aa, Entamoeba dispar
LKVKNLQRVVSWMKKKLETRKV

SEQ ID NO: 2555455 - protein, 17 aa, Entamoeba dispar
LLIRWYQVGAFYPFFRA

SEQ ID NO: 2555456 - protein, 19 aa, Entamoeba dispar
LMGKMKKCLPIWKQDLPSL

SEQ ID NO: 2555457 - protein, 25 aa, Entamoeba dispar
LMPYPSSVSFQWKSSLAIALTSSIQ

SEQ ID NO: 2555458 - protein, 17 aa, Entamoeba dispar
LNLRECTVIKLGGVVDD

SEQ ID NO: 2555459 - protein, 18 aa, Entamoeba dispar
LNYGRAFVLTSLDFHFRH

SEQ ID NO: 2555460 - protein, 21 aa, Entamoeba dispar
LQSLEWCKLPGFAKVVKDLGK

SEQ ID NO: 2555461 - protein, 18 aa, Entamoeba dispar
LRMLKALHLYETIFRGKK

SEQ ID NO: 2555462 - protein, 17 aa, Entamoeba dispar
LRTRIAMNDEIKRKEIE

SEQ ID NO: 2555463 - protein, 17 aa, Entamoeba dispar
LSFKIEIGISFPDFYSS

SEQ ID NO: 2555464 - protein, 19 aa, Entamoeba dispar
LTCAKPLMVGSKCDRCKTG

SEQ ID NO: 2555465 - protein, 25 aa, Entamoeba dispar
LTPILPCFICDGGLLILSRIPLKDR

SEQ ID NO: 2555466 - protein, 25 aa, Entamoeba dispar
LWPEIPWKKITGIWRKFISHLEELG

SEQ ID NO: 2555467 - protein, 24 aa, Entamoeba dispar
LYDGLKSQCWFKALQSCGCCKECM

SEQ ID NO: 2555468 - protein, 19 aa, Entamoeba dispar
MALACARQGITLVTVYATL

SEQ ID NO: 2555469 - protein, 17 aa, Entamoeba dispar
MFIMMGLMMLFQMFMGQ

SEQ ID NO: 2555470 - protein, 17 aa, Entamoeba dispar
MTAEFFLGYPLFGATSE

SEQ ID NO: 2555471 - protein, 24 aa, Entamoeba dispar
MYLNPRYYYGLSFVNTPNEIINNQ

SEQ ID NO: 2555472 - protein, 24 aa, Entamoeba dispar
NAEYRPDKNFTFGISGSKENTYGQ

SEQ ID NO: 2555473 - protein, 24 aa, Entamoeba dispar
NDMFKIRFSFQNGRIITPYIPIHQ

SEQ ID NO: 2555474 - protein, 20 aa, Entamoeba dispar
NECKKRRGIARSIYDHLKSQ

SEQ ID NO: 2555475 - protein, 18 aa, Entamoeba dispar
NEDIKMILKRSGMNAIII

SEQ ID NO: 2555476 - protein, 20 aa, Entamoeba dispar
NGKTPVCWEEVYQKGSADKK

SEQ ID NO: 2555477 - protein, 23 aa, Entamoeba dispar
NGKWDITGDLSLSKGVQNANGKI

SEQ ID NO: 2555478 - protein, 19 aa, Entamoeba dispar
NGLEYSGGINYNIGKNSQF

SEQ ID NO: 2555479 - protein, 23 aa, Entamoeba dispar
NILSFKLKPTWSINKNIQLNIIS

SEQ ID NO: 2555480 - protein, 25 aa, Entamoeba dispar
NKGYGDFVIIRGWRSIGSFDSEAVN

SEQ ID NO: 2555481 - protein, 20 aa, Entamoeba dispar
NLGKDWKYGAEVQHSFNDKW

SEQ ID NO: 2555482 - protein, 23 aa, Entamoeba dispar
NPALCLRTSLKLSTVAFQEKNKD

SEQ ID NO: 2555483 - protein, 18 aa, Entamoeba dispar
NQIFRLKHRMFRVEEKIR

SEQ ID NO: 2555484 - protein, 17 aa, Entamoeba dispar
NSILKFDIKIVKVISYF

SEQ ID NO: 2555485 - protein, 18 aa, Entamoeba dispar
NSLSFYFYPEFEISDSKP

SEQ ID NO: 2555486 - protein, 17 aa, Entamoeba dispar
NSNSISFRYDWRTLLAV

SEQ ID NO: 2555487 - protein, 24 aa, Entamoeba dispar
NWAQYRFNSIDGWTCKYTTDNIDP

SEQ ID NO: 2555488 - protein, 18 aa, Entamoeba dispar
NWGGWPFEDLMKGMDYLK

SEQ ID NO: 2555489 - protein, 19 aa, Entamoeba dispar
PAEMGHVWVIPKDCQIGQE

SEQ ID NO: 2555490 - protein, 17 aa, Entamoeba dispar
PDAFDWPLIYKTMKRVK

SEQ ID NO: 2555491 - protein, 17 aa, Entamoeba dispar
PESFDSIIIFPYVCATL

SEQ ID NO: 2555492 - protein, 17 aa, Entamoeba dispar
PESVDWRSIMNPAKDQG

SEQ ID NO: 2555493 - protein, 18 aa, Entamoeba dispar
PFSRSIDVPDVWPTGKPS

SEQ ID NO: 2555494 - protein, 22 aa, Entamoeba dispar
PFYYHWKIHYGLLDPITFEVQQ

SEQ ID NO: 2555495 - protein, 19 aa, Entamoeba dispar
PIECKTCFYEHCLTCADDC

SEQ ID NO: 2555496 - protein, 18 aa, Entamoeba dispar
PLFRICGLAIHLDTERKY

SEQ ID NO: 2555497 - protein, 18 aa, Entamoeba dispar
PLFRRIENLPVYTLWYFY

SEQ ID NO: 2555498 - protein, 23 aa, Entamoeba dispar
PSDLFKKQCDHYRVYKTTDQSES

SEQ ID NO: 2555499 - protein, 18 aa, Entamoeba dispar
PVDFYYDFMNAFNVAFKS

SEQ ID NO: 2555500 - protein, 18 aa, Entamoeba dispar
PVFVKFFAPWCGHCKRLA

SEQ ID NO: 2555501 - protein, 21 aa, Entamoeba dispar
PWCGHCKALAPKYIEVSKMYA

SEQ ID NO: 2555502 - protein, 19 aa, Entamoeba dispar
PYIKEIFESSGYLKKMELG

SEQ ID NO: 2555503 - protein, 20 aa, Entamoeba dispar
QCKCRMVHLEYLLSTIEKKM

SEQ ID NO: 2555504 - protein, 24 aa, Entamoeba dispar
QEGPYQYNPCVWLDQTTWFNKQNN

SEQ ID NO: 2555505 - protein, 23 aa, Entamoeba dispar
QELLHIFKRYGVIIPVAIPVDLI

SEQ ID NO: 2555506 - protein, 22 aa, Entamoeba dispar
QEPFCWSESVFADVVHKNLPDR

SEQ ID NO: 2555507 - protein, 22 aa, Entamoeba dispar
QIVHPILRRYGGVHHRADESFN

SEQ ID NO: 2555508 - protein, 18 aa, Entamoeba dispar
QKRITAVSKKYSTLVDNL

SEQ ID NO: 2555509 - protein, 17 aa, Entamoeba dispar
QMVMARLAQKAHLSPVI

SEQ ID NO: 2555510 - protein, 21 aa, Entamoeba dispar
QNCGGCWAISLANLAQYLYSN

SEQ ID NO: 2555511 - protein, 20 aa, Entamoeba dispar
RAKCKTCCRVIFASDYNYET

SEQ ID NO: 2555512 - protein, 20 aa, Entamoeba dispar
RAKCKTCCRVIFASDYNYKT

SEQ ID NO: 2555513 - protein, 20 aa, Entamoeba dispar
RDIPKAIDWRAEGKVTPIRD

SEQ ID NO: 2555514 - protein, 24 aa, Entamoeba dispar
RIDYPLKVCAMINCAKRELLNTNC

SEQ ID NO: 2555515 - protein, 20 aa, Entamoeba dispar
RIENLPVYTLWYFYQGTIPK

SEQ ID NO: 2555516 - protein, 23 aa, Entamoeba dispar
RIMRRRGRRSTLRRQAFGNFASA

SEQ ID NO: 2555517 - protein, 26 aa, Entamoeba dispar
RKKDALFLCLFWFLIEVTFDIDANGI

SEQ ID NO: 2555518 - protein, 24 aa, Entamoeba dispar
RLATAHARASIAIRGVEKIENKIF

SEQ ID NO: 2555519 - protein, 21 aa, Entamoeba dispar
RLCELRGTIDFSLPEESIGNI

SEQ ID NO: 2555520 - protein, 20 aa, Entamoeba dispar
RLNNEFYYLLCKDIFNVDKQ

SEQ ID NO: 2555521 - protein, 22 aa, Entamoeba dispar
RLPFQIKEGWGMTRINQSLGIS

SEQ ID NO: 2555522 - protein, 17 aa, Entamoeba dispar
RNMEIGKYFNILASHFS

SEQ ID NO: 2555523 - protein, 19 aa, Entamoeba dispar
RNRHCILFTYDITKRETLE

SEQ ID NO: 2555524 - protein, 17 aa, Entamoeba dispar
RQNSLRLLGKIAGSSLS

SEQ ID NO: 2555525 - protein, 17 aa, Entamoeba dispar
RSAISFGSLSDIPLTKE

SEQ ID NO: 2555526 - protein, 18 aa, Entamoeba dispar
RTQYNPCVWSFLDLPDCE

SEQ ID NO: 2555527 - protein, 21 aa, Entamoeba dispar
RYHCWKVPFIGDWCSTKRSNI

SEQ ID NO: 2555528 - protein, 19 aa, Entamoeba dispar
RYHCWKVPIIGDWCSTKRS

SEQ ID NO: 2555529 - protein, 19 aa, Entamoeba dispar
SASVKGRMKKIAKAAKKRV

SEQ ID NO: 2555530 - protein, 20 aa, Entamoeba dispar
SCGCCKECMAQKPPSCGCYK

SEQ ID NO: 2555531 - protein, 18 aa, Entamoeba dispar
SCPSGQCCSIWGYCGKTN

SEQ ID NO: 2555532 - protein, 19 aa, Entamoeba dispar
SEIPIVVILFTYEKNIDII

SEQ ID NO: 2555533 - protein, 17 aa, Entamoeba dispar
SFDSIIIFPYVCATLLS

SEQ ID NO: 2555534 - protein, 19 aa, Entamoeba dispar
SFKIRIGIDADKGAIYIID

SEQ ID NO: 2555535 - protein, 19 aa, Entamoeba dispar
SGAKMAAKMAALAKKGKDI

SEQ ID NO: 2555536 - protein, 18 aa, Entamoeba dispar
SGGVVGVMGDVWWGLVET

SEQ ID NO: 2555537 - protein, 19 aa, Entamoeba dispar
SHFDMLFHYFKCRKQIPRL

SEQ ID NO: 2555538 - protein, 26 aa, Entamoeba dispar
SISFRYDWRTLLAVIRMHLPPIEYFV

SEQ ID NO: 2555539 - protein, 23 aa, Entamoeba dispar
SKCGGSISCVLVRLVVFIGNTRC

SEQ ID NO: 2555540 - protein, 19 aa, Entamoeba dispar
SKEILKWFDDVDESFKQIG

SEQ ID NO: 2555541 - protein, 20 aa, Entamoeba dispar
SLSRAYRGELVFIYTDDKET

SEQ ID NO: 2555542 - protein, 23 aa, Entamoeba dispar
SNCLKCLNGVCIQCKDNHYLDNG

SEQ ID NO: 2555543 - protein, 23 aa, Entamoeba dispar
SNTLLDWIRIVLAVRASKNGKEF

SEQ ID NO: 2555544 - protein, 17 aa, Entamoeba dispar
SPCKMCVELGRRAKESL

SEQ ID NO: 2555545 - protein, 25 aa, Entamoeba dispar
SQQIYPCISISFGLQIYSMNETIEI

SEQ ID NO: 2555546 - protein, 18 aa, Entamoeba dispar
SSCAPVLLHKGLPSRLME

SEQ ID NO: 2555547 - protein, 21 aa, Entamoeba dispar
SSDCLAAFCAFKITEYDGTTC

SEQ ID NO: 2555548 - protein, 18 aa, Entamoeba dispar
SSIPFATKVMINFKEPPP

SEQ ID NO: 2555549 - protein, 23 aa, Entamoeba dispar
SSNSRPSTLFSFFKRFTSMQYLY

SEQ ID NO: 2555550 - protein, 18 aa, Entamoeba dispar
STFCKWCKHFYKKKVRSS

SEQ ID NO: 2555551 - protein, 17 aa, Entamoeba dispar
TCISCNYPGNQIEPKAT

SEQ ID NO: 2555552 - protein, 19 aa, Entamoeba dispar
TCLFTVFPSIHILKEEKGI

SEQ ID NO: 2555553 - protein, 20 aa, Entamoeba dispar
TDHTCWWIKTTVGIASGLLD

SEQ ID NO: 2555554 - protein, 22 aa, Entamoeba dispar
TEFKFPWKIAEFISTGKRPTII

SEQ ID NO: 2555555 - protein, 21 aa, Entamoeba dispar
TENCLKFGYASLFADPTNCSA

SEQ ID NO: 2555556 - protein, 18 aa, Entamoeba dispar
TFRIMPTILMFRGNDHKP

SEQ ID NO: 2555557 - protein, 23 aa, Entamoeba dispar
TGCKKKGYHCVFDGIKHDKYFEC

SEQ ID NO: 2555558 - protein, 24 aa, Entamoeba dispar
TGRFKCIICHDGIMDSEGSYYYMD

SEQ ID NO: 2555559 - protein, 23 aa, Entamoeba dispar
TIEIKEIPDYVGYLTDGIDDDMC

SEQ ID NO: 2555560 - protein, 27 aa, Entamoeba dispar
TLPRREAIRLARRFDLRHRFDFAIDQE

SEQ ID NO: 2555561 - protein, 22 aa, Entamoeba dispar
TNGIKWNTLWFDVEKDSWSSNV

SEQ ID NO: 2555562 - protein, 25 aa, Entamoeba dispar
TNVKIILPGGIDWSTPITLKEFEEA

SEQ ID NO: 2555563 - protein, 22 aa, Entamoeba dispar
TRLEFKLLLGFIPPFSSLNNIQ

SEQ ID NO: 2555564 - protein, 18 aa, Entamoeba dispar
TTPYPGIILLSGDLAGHY

SEQ ID NO: 2555565 - protein, 19 aa, Entamoeba dispar
TVSYRFWYHDSWRYALQSR

SEQ ID NO: 2555566 - protein, 19 aa, Entamoeba dispar
VAKELKISYFGGGTVVMAA

SEQ ID NO: 2555567 - protein, 20 aa, Entamoeba dispar
VCEPQCEYLHCFGKQCKCRM

SEQ ID NO: 2555568 - protein, 18 aa, Entamoeba dispar
VELGRRAKESLALNMDNA

SEQ ID NO: 2555569 - protein, 17 aa, Entamoeba dispar
VHVHPGFVWSKFWRYMT

SEQ ID NO: 2555570 - protein, 22 aa, Entamoeba dispar
VKLKRNRLSSIYNMKKVKASDK

SEQ ID NO: 2555571 - protein, 23 aa, Entamoeba dispar
VPGRFGDACAVGYYDDTIQTTGW

SEQ ID NO: 2555572 - protein, 19 aa, Entamoeba dispar
VPYYCYRWGMTEEELLDDV

SEQ ID NO: 2555573 - protein, 18 aa, Entamoeba dispar
VSSYKCGTYYRIGSVNTC

SEQ ID NO: 2555574 - protein, 23 aa, Entamoeba dispar
VYFERWKPIISICNKVGGNLKID

SEQ ID NO: 2555575 - protein, 19 aa, Entamoeba dispar
WCGHCKHLAPEFASAAKEI

SEQ ID NO: 2555576 - protein, 17 aa, Entamoeba dispar
WCPYRWCSYYGQKRFTV

SEQ ID NO: 2555577 - protein, 17 aa, Entamoeba dispar
WDIPGSILMEMDENIMR

SEQ ID NO: 2555578 - protein, 17 aa, Entamoeba dispar
WGDPYVEGNAIHYRFSV

SEQ ID NO: 2555579 - protein, 17 aa, Entamoeba dispar
WGTTWGMDGYILMSRNK

SEQ ID NO: 2555580 - protein, 20 aa, Entamoeba dispar
WHYRNWWLRRHWLRNWKRQM

SEQ ID NO: 2555581 - protein, 17 aa, Entamoeba dispar
WIFQWKNKYLFRGLRLT

SEQ ID NO: 2555582 - protein, 20 aa, Entamoeba dispar
WKFSSEAVIFDFGKFNNGEI

SEQ ID NO: 2555583 - protein, 21 aa, Entamoeba dispar
WKKERCPRNSDELASASPETK

SEQ ID NO: 2555584 - protein, 17 aa, Entamoeba dispar
WKVPIIGDWCSTKRSNI

SEQ ID NO: 2555585 - protein, 17 aa, Entamoeba dispar
WQTSMVLNWVFQMMLPI

SEQ ID NO: 2555586 - protein, 19 aa, Entamoeba dispar
WRCNTCLHLGELAQIGVVE

SEQ ID NO: 2555587 - protein, 21 aa, Entamoeba dispar
YEYWKFTGVKIKWIPNVKTAV

SEQ ID NO: 2555588 - protein, 19 aa, Entamoeba dispar
YGCRECLTGYYLINKECSK

SEQ ID NO: 2555589 - protein, 25 aa, Entamoeba dispar
YKCGMKAHLCCLGKIFSENTHTLIP

SEQ ID NO: 2555590 - protein, 17 aa, Entamoeba dispar
YKFGILYAKEGQTIETE

SEQ ID NO: 2555591 - protein, 20 aa, Entamoeba dispar
YKGFSWIRIVLKSGSKTPTL

SEQ ID NO: 2555592 - protein, 17 aa, Entamoeba dispar
YKPSDKFSVEGKAGYTY

SEQ ID NO: 2555593 - protein, 17 aa, Entamoeba dispar
YMGLKCPHAQFTLAKDY

SEQ ID NO: 2555594 - protein, 19 aa, Entamoeba dispar
YQMLPYWYSLWYYHRIDYN

SEQ ID NO: 2555595 - protein, 24 aa, Entamoeba dispar
YQQRYGFKCIFVFVESSAKQLEQY

SEQ ID NO: 2555596 - protein, 19 aa, Entamoeba dispar
YQQRYGFKCIYVLVESSVR

SEQ ID NO: 2555597 - protein, 20 aa, Entamoeba dispar
YREKCVKKRDEFGVLRNKCD

SEQ ID NO: 2555598 - protein, 25 aa, Entamoeba dispar
YSPFKRSCVIQSRINTITAQTKAIH

SEQ ID NO: 2555599 - protein, 20 aa, Entamoeba dispar
YVNACSFGYLVPGWNSSNKQ

SEQ ID NO: 2555600 - protein, 25 aa, Entamoeba dispar
YYDPNVACIWGWWGTLMSNHELKRY

SEQ ID NO: 2555601 - protein, 18 aa, Entamoeba dispar
YYLEGCVFKDILKNPPQP

SEQ ID NO: 2555602 - protein, 18 aa, Entamoeba dispar
YYVDPFIQFFDGFSGTLP

SEQ ID NO: 2555603 - protein, 23 aa, Entamoeba dispar
AGKISGVHWWYNDQSHAAEMTAG

SEQ ID NO: 2555604 - protein, 18 aa, Entamoeba dispar
CIYLVSSLEFVDGDCKGR

SEQ ID NO: 2555605 - protein, 23 aa, Entamoeba dispar
GETRYPSYPLSRWSYCGVGEFQC

SEQ ID NO: 2555606 - protein, 25 aa, Entamoeba dispar
GGVAGVMADVWWGLVETSPRNYNWN

SEQ ID NO: 2555607 - protein, 32 aa, Entamoeba dispar; identical to SEQ ID NO: 2518671

SEQ ID NO: 2555608 - protein, 17 aa, Entamoeba dispar
FWIKTHVNANEISCQPI

SEQ ID NO: 2555609 - protein, 23 aa, Entamoeba dispar
QHGLTAFTYLRMTRGLLDDGNAW

SEQ ID NO: 2555610 - protein, 31 aa, Entamoeba dispar
VLSQDNMYSAWNPQLLISIKAPQNVAAANAC

SEQ ID NO: 2555611 - protein, 18 aa, Entamoeba dispar
AIYCPTTSVLDPYEFTIA

SEQ ID NO: 2555612 - protein, 21 aa, Entamoeba dispar
ATCDQMFCFDLRNGCYYNKKE

SEQ ID NO: 2555613 - protein, 27 aa, Entamoeba dispar
DESKSSLFRYAAKKYSRWLPQSALETF

SEQ ID NO: 2555614 - protein, 19 aa, Entamoeba dispar
DISHLYTLIIRPNNTYVVK

SEQ ID NO: 2555615 - protein, 22 aa, Entamoeba dispar
DMTIEAAFTKLTWLLAQGMTPD

SEQ ID NO: 2555616 - protein, 20 aa, Entamoeba dispar
EFNRFEIIPMLGNHDALPEN

SEQ ID NO: 2555617 - protein, 17 aa, Entamoeba dispar
FAYIGIDVWQVKAGTIY

SEQ ID NO: 2555618 - protein, 18 aa, Entamoeba dispar
FEFAPYRMYTCYSMPKRV

SEQ ID NO: 2555619 - protein, 23 aa, Entamoeba dispar
GNELQFFEFAPYKMYTSFSIPRR

SEQ ID NO: 2555620 - protein, 35 aa, Entamoeba dispar
GRWVKKTLEWPTYKRHFYLPYRLDLDLCYQAKKAS

SEQ ID NO: 2555621 - protein, 32 aa, Entamoeba dispar
IANQKQMFKILKNKIIQLIYKLRQTQDPKQKV

SEQ ID NO: 2555622 - protein, 24 aa, Entamoeba dispar
IDLEPLDFVWSIPAANLAPNYNKG

SEQ ID NO: 2555623 - protein, 21 aa, Entamoeba dispar
IGHIMFGNFVSIVNWTFEMTE

SEQ ID NO: 2555624 - protein, 19 aa, Entamoeba dispar
ILFFSLSSAYIWEFDPNKL

SEQ ID NO: 2555625 - protein, 26 aa, Entamoeba dispar
IPTVTDGVIIIYLHPGITSTFIEAVL

SEQ ID NO: 2555626 - protein, 25 aa, Entamoeba dispar
KAEKKALLIRKMLLEKADEINEKRS

SEQ ID NO: 2555627 - protein, 25 aa, Entamoeba dispar
KFSRAGSWPIWYPHYDGKKTFSDFK

SEQ ID NO: 2555628 - protein, 34 aa, Entamoeba dispar
KRKIARIICGKKYWKKQAPKKCYDFIGGKYHDLI

SEQ ID NO: 2555629 - protein, 25 aa, Entamoeba dispar
KSEEIHHRRLYITALEENKERSQEA

SEQ ID NO: 2555630 - protein, 31 aa, Entamoeba dispar
LDIELIYEKEGLYYYLLTTEKASFNEYFNQL

SEQ ID NO: 2555631 - protein, 18 aa, Entamoeba dispar
LIDLITQYSNITIGMICG

SEQ ID NO: 2555632 - protein, 22 aa, Entamoeba dispar
LLFVTLVLSSPLLDMKIKIEQK

SEQ ID NO: 2555633 - protein, 19 aa, Entamoeba dispar
LVKFFAPWCGHCNRLKPIW

SEQ ID NO: 2555634 - protein, 26 aa, Entamoeba dispar
NACTLTIHWQFDVTLRGLRKVLTPNA

SEQ ID NO: 2555635 - protein, 21 aa, Entamoeba dispar
NTLIHELQPKLNFGLTTCGEL

SEQ ID NO: 2555636 - protein, 30 aa, Entamoeba dispar
QCLRNLGFNSFFIFRAWRSLGSFDPNAKSI

SEQ ID NO: 2555637 - protein, 35 aa, Entamoeba dispar
RERMRRKRILALKKNLKKMYLERRDMLWKKRCIRF

SEQ ID NO: 2555638 - protein, 18 aa, Entamoeba dispar
RLQKNNTFYPFLLKEIPS

SEQ ID NO: 2555639 - protein, 28 aa, Entamoeba dispar
RSTRDVRLILRRLGIELHKIQKQVFAII

SEQ ID NO: 2555640 - protein, 20 aa, Entamoeba dispar
RTHVIMNYKGKNNLIRKEIR

SEQ ID NO: 2555641 - protein, 24 aa, Entamoeba dispar
SETLPYYDFIELSPLLDSSAMTPK

SEQ ID NO: 2555642 - protein, 20 aa, Entamoeba dispar
SKKLKFERLWFDIEGKWSSS

SEQ ID NO: 2555643 - protein, 23 aa, Entamoeba dispar
SLEMTFIGNGLLNSATFPSICTA

SEQ ID NO: 2555644 - protein, 25 aa, Entamoeba dispar
SQESPTFYGLLPKKSIRPLSSNEIP

SEQ ID NO: 2555645 - protein, 19 aa, Entamoeba dispar
SSPLLDMKIKIEQKYKLIE

SEQ ID NO: 2555646 - protein, 25 aa, Entamoeba dispar
STINASTIFLLYNTTLNTGESTILS

SEQ ID NO: 2555647 - protein, 19 aa, Entamoeba dispar
TYVVVLNTVLYYTFNKLTE

SEQ ID NO: 2555648 - protein, 20 aa, Entamoeba dispar
VRAKCKTCCRVIFASDYNYK

SEQ ID NO: 2555649 - protein, 25 aa, Entamoeba dispar
YNKDKTLLIQYPIGNSRTSYSIPPS

SEQ ID NO: 2555650 - protein, 18 aa, Entamoeba dispar
YSRWLPQSALETFKRGGY

SEQ ID NO: 2555651 - protein, 17 aa, Entamoeba dispar
AAFASAKEFYQYSIVRT

SEQ ID NO: 2555652 - protein, 24 aa, Entamoeba dispar
AAGRSWFFQTCIAYGYYQAVSEQS

SEQ ID NO: 2555653 - protein, 19 aa, Entamoeba dispar
AARKAFGTSLPLAAKVSGI

SEQ ID NO: 2555654 - protein, 19 aa, Entamoeba dispar
ACEFEIFITIKCTTKIKEQ

SEQ ID NO: 2555655 - protein, 19 aa, Entamoeba dispar
ACIYCRKYFRQCAECDGMT

SEQ ID NO: 2555656 - protein, 28 aa, Entamoeba dispar
ACPNGIDAVWLWVNGSDPVFRKALEENG

SEQ ID NO: 2555657 - protein, 23 aa, Entamoeba dispar
ADGFYCVIDGIHDRDYYECSPDF

SEQ ID NO: 2555658 - protein, 25 aa, Entamoeba dispar
ADRDWKVFPDYLPPKYEAGTLNFLG

SEQ ID NO: 2555659 - protein, 26 aa, Entamoeba dispar
ADYTHPLAVHYPLIYIGNEQETFDDF

SEQ ID NO: 2555660 - protein, 23 aa, Entamoeba dispar
AEEKGFFSMRWYCASKLSMAIMA

SEQ ID NO: 2555661 - protein, 23 aa, Entamoeba dispar
AEVIRRKMLILQEQIKTAKIQNN

SEQ ID NO: 2555662 - protein, 17 aa, Entamoeba dispar
AFAFARSSMWSSMDYKG

SEQ ID NO: 2555663 - protein, 37 aa, Entamoeba dispar
AFKASDNTYYCPLTDLFLPYYFNVTKNSKDMSKITIG

SEQ ID NO: 2555664 - protein, 20 aa, Entamoeba dispar
AGKVAGIHWWYNDQSHAAEL

SEQ ID NO: 2555665 - protein, 21 aa, Entamoeba dispar
AGLNVLRILNEPTAAAMAYGL

SEQ ID NO: 2555666 - protein, 25 aa, Entamoeba dispar
AGNCYKRRHLWKKIKKIQEIRKEIS

SEQ ID NO: 2555667 - protein, 22 aa, Entamoeba dispar
AGRSWFFQTCIAYGYYQAVSEQ

SEQ ID NO: 2555668 - protein, 22 aa, Entamoeba dispar
AGVYIMTVLQYQNLVPLFNYKK

SEQ ID NO: 2555669 - protein, 19 aa, Entamoeba dispar
AHIKFDNFVNIINLSFEIA

SEQ ID NO: 2555670 - protein, 28 aa, Entamoeba dispar
AHLNVPEVVLVFGGLLLRGNRVTKTSAN

SEQ ID NO: 2555671 - protein, 18 aa, Entamoeba dispar
AIAKLAKKDKKAIAKLAK

SEQ ID NO: 2555672 - protein, 18 aa, Entamoeba dispar
AIASLKMSQLLKAKSKNE

SEQ ID NO: 2555673 - protein, 19 aa, Entamoeba dispar
AIINAMRGWMGLGSISAKE

SEQ ID NO: 2555674 - protein, 17 aa, Entamoeba dispar
AITCAFADQSAYYVKNY

SEQ ID NO: 2555675 - protein, 18 aa, Entamoeba dispar
AITIGCVGQLRNVSNDCE

SEQ ID NO: 2555676 - protein, 28 aa, Entamoeba dispar
AKALEKYWGKLLGFYVALGSNNVGESIY

SEQ ID NO: 2555677 - protein, 20 aa, Entamoeba dispar
AKCKPIVKKIYKKKQPKKRK

SEQ ID NO: 2555678 - protein, 17 aa, Entamoeba dispar
AKCKTCCRVIFASDYNY

SEQ ID NO: 2555679 - protein, 18 aa, Entamoeba dispar
AKCKTCCRVIFASDYNYE

SEQ ID NO: 2555680 - protein, 25 aa, Entamoeba dispar
AKGNGLISFTYLRMTRALLDDSTAW

SEQ ID NO: 2555681 - protein, 24 aa, Entamoeba dispar
AKLNRIHYVLQGLRKNLSELRMTK

SEQ ID NO: 2555682 - protein, 20 aa, Entamoeba dispar
AKLVAKVRKIEYQKLIKRLK

SEQ ID NO: 2555683 - protein, 19 aa, Entamoeba dispar
AKNYIYLFNGKTKFFESKN

SEQ ID NO: 2555684 - protein, 26 aa, Entamoeba dispar
AKTDPGLWYKFVHTKSIPDEKYTIFA

SEQ ID NO: 2555685 - protein, 25 aa, Entamoeba dispar
ALAKLDLRIELAKPFVLQQPKGPMV

SEQ ID NO: 2555686 - protein, 26 aa, Entamoeba dispar
ALFLCLFWFLIEVTFDIDANGILNVT

SEQ ID NO: 2555687 - protein, 18 aa, Entamoeba dispar
ALIFAKYESKGVFEGNQR

SEQ ID NO: 2555688 - protein, 17 aa, Entamoeba dispar
ALIVYDITSRDSFEIVQ

SEQ ID NO: 2555689 - protein, 23 aa, Entamoeba dispar
ALSNFLAKQYLWWTNQCKTNNTQ

SEQ ID NO: 2555690 - protein, 17 aa, Entamoeba dispar
AMKGLYKELSFIRKEGK

SEQ ID NO: 2555691 - protein, 19 aa, Entamoeba dispar
AMKLMTLYDTHSLDFISST

SEQ ID NO: 2555692 - protein, 27 aa, Entamoeba dispar
ANACTLTIHWQFDVTLRGLRKVLTPNA

SEQ ID NO: 2555693 - protein, 28 aa, Entamoeba dispar
ANACTLTIHWQFDVTLRGLRKVLTPNAE

SEQ ID NO: 2555694 - protein, 21 aa, Entamoeba dispar
ANKILFLDMMFPQSVDKIIFM

SEQ ID NO: 2555695 - protein, 28 aa, Entamoeba dispar
ANRAEYLYRFAVFLDNKKFVEANANTEL

SEQ ID NO: 2555696 - protein, 24 aa, Entamoeba dispar
APNTHLPLVLKFDKNKWKEQIKEV

SEQ ID NO: 2555697 - protein, 17 aa, Entamoeba dispar
APNYILIDGTCKYFKEV

SEQ ID NO: 2555698 - protein, 24 aa, Entamoeba dispar
AQSSGFWMPTLYRVQERLGEVAMR

SEQ ID NO: 2555699 - protein, 17 aa, Entamoeba dispar
ARDILIDAHNRKINQLK

SEQ ID NO: 2555700 - protein, 21 aa, Entamoeba dispar
ARLRNMEIGKYFNILASHFSQ

SEQ ID NO: 2555701 - protein, 20 aa, Entamoeba dispar
ARVSGKIKLFIVSSYQSNHI

SEQ ID NO: 2555702 - protein, 25 aa, Entamoeba dispar
ASDYGKFFLEFYTQLMLNHTDRVVI

SEQ ID NO: 2555703 - protein, 26 aa, Entamoeba dispar
ASFSNALAWILLSKGYSLQLGINALK

SEQ ID NO: 2555704 - protein, 20 aa, Entamoeba dispar
ASIPIPPLDIPDGIEWLASG

SEQ ID NO: 2555705 - protein, 19 aa, Entamoeba dispar
ASPFNFHKVFKSYTSLLVV

SEQ ID NO: 2555706 - protein, 21 aa, Entamoeba dispar
ASYDWRYYRYGEYKHKRNWFE

SEQ ID NO: 2555707 - protein, 23 aa, Entamoeba dispar
ATLSMVLKKYRKCKYHKVVVEES

SEQ ID NO: 2555708 - protein, 18 aa, Entamoeba dispar
ATNRQFLEDLLSAARAAG

SEQ ID NO: 2555709 - protein, 17 aa, Entamoeba dispar
ATTGRLLYFTEKKIVSL

SEQ ID NO: 2555710 - protein, 20 aa, Entamoeba dispar
AVDFYDFDLFEDSQNFEQDI

SEQ ID NO: 2555711 - protein, 25 aa, Entamoeba dispar
AVEALRRRAIFNMNAKFVAKFNKAN

SEQ ID NO: 2555712 - protein, 17 aa, Entamoeba dispar
AVGGRFVINKYAEKYNS

SEQ ID NO: 2555713 - protein, 29 aa, Entamoeba dispar
AVRASLEMTFIGNGLLNSATFPSICTAWD

SEQ ID NO: 2555714 - protein, 21 aa, Entamoeba dispar
AWRYAAWIRKATNSYLVVVNY

SEQ ID NO: 2555715 - protein, 17 aa, Entamoeba dispar
AYELLKKDATNFMNAYD

SEQ ID NO: 2555716 - protein, 18 aa, Entamoeba dispar
CADGFYFDEIKGACIPCT

SEQ ID NO: 2555717 - protein, 18 aa, Entamoeba dispar
CCFVNVNSYDVFNELSDE

SEQ ID NO: 2555718 - protein, 24 aa, Entamoeba dispar
CDQYIDKIITLNAPFIGSTKTLRT

SEQ ID NO: 2555719 - protein, 26 aa, Entamoeba dispar
CDSCAPNYILIDGTCKYFKEVVPYCA

SEQ ID NO: 2555720 - protein, 19 aa, Entamoeba dispar
CEDGYYLYNNVCHKKIKHC

SEQ ID NO: 2555721 - protein, 18 aa, Entamoeba dispar
CFFFTLSSGNIGVARFVF

SEQ ID NO: 2555722 - protein, 18 aa, Entamoeba dispar
CFGKCELNFTSASRYGLN

SEQ ID NO: 2555723 - protein, 26 aa, Entamoeba dispar
CFHCSVYYLYNLPKVVYFSKGDLKKM

SEQ ID NO: 2555724 - protein, 17 aa, Entamoeba dispar
CFMLIAQIFAEDVENTV

SEQ ID NO: 2555725 - protein, 17 aa, Entamoeba dispar
CFTLCFAQQQTQEKKPE

SEQ ID NO: 2555726 - protein, 25 aa, Entamoeba dispar
CGDPFVGKTCFFQRFSVGEFNANTK

SEQ ID NO: 2555727 - protein, 17 aa, Entamoeba dispar
CGNFNCYPPLDTVTSSL

SEQ ID NO: 2555728 - protein, 38 aa, Entamoeba dispar
CGTMFSLQYKIRLLAEILQMPAYCKLPLSVYITTHRYD

SEQ ID NO: 2555729 - protein, 18 aa, Entamoeba dispar
CHKQSFLKGYPSLFLFYN

SEQ ID NO: 2555730 - protein, 18 aa, Entamoeba dispar
CIAENFIRFPYPGLPSTD

SEQ ID NO: 2555731 - protein, 19 aa, Entamoeba dispar
CILCVYTTAYSLEEDFEMD

SEQ ID NO: 2555732 - protein, 27 aa, Entamoeba dispar
CKNSPFKQVRVIRLVKKYVKKLEKAIA

SEQ ID NO: 2555733 - protein, 22 aa, Entamoeba dispar
CKTCEEGYYLSKGKCLKGVEHC

SEQ ID NO: 2555734 - protein, 22 aa, Entamoeba dispar
CKVCVNLAEFILRQARNGKSKN

SEQ ID NO: 2555735 - protein, 31 aa, Entamoeba dispar
CLCSLKILGLVSYLILLPTSLTSLTVSCFGL

SEQ ID NO: 2555736 - protein, 25 aa, Entamoeba dispar
CLIFIILVILYIKNSTQKKLDQQLY

SEQ ID NO: 2555737 - protein, 27 aa, Entamoeba dispar
CLRNIGFNSFFIFRCWRSLGSWDPNAK

SEQ ID NO: 2555738 - protein, 24 aa, Entamoeba dispar
CLSPFIQYFKKIIFLCKDGHCSLS

SEQ ID NO: 2555739 - protein, 25 aa, Entamoeba dispar
CNAAVYRFFDLLEYLKQHGGEFDRV

SEQ ID NO: 2555740 - protein, 25 aa, Entamoeba dispar
CNAYIDQWISMSTPFLGSVRTFSAV

SEQ ID NO: 2555741 - protein, 23 aa, Entamoeba dispar
CNDKWYLLEVVGNTGFIQPTHTF

SEQ ID NO: 2555742 - protein, 17 aa, Entamoeba dispar
CNGGNFWGPKISFSKSP

SEQ ID NO: 2555743 - protein, 24 aa, Entamoeba dispar
CPAKKPIVFIPGILASILEAEVDI

SEQ ID NO: 2555744 - protein, 28 aa, Entamoeba dispar
CSSSITLLHHILFKLNLQFQILNELADR

SEQ ID NO: 2555745 - protein, 31 aa, Entamoeba dispar
CTICRDMYDGKYKFYLPTNGTCERYSEIAKK

SEQ ID NO: 2555746 - protein, 28 aa, Entamoeba dispar
CTKLTLTGTRTIKTLKLSKNCPLFIENE

SEQ ID NO: 2555747 - protein, 45 aa, Entamoeba dispar
CTQDGLFCVIDGVHNKQYYECATTFKGFRPCAPGTWCQGEQEGPY

SEQ ID NO: 2555748 - protein, 24 aa, Entamoeba dispar
CTTQYFRKVWVDPLRKRLPNTKTY

SEQ ID NO: 2555749 - protein, 17 aa, Entamoeba dispar
CVDLFNQSIPLISQCFV

SEQ ID NO: 2555750 - protein, 22 aa, Entamoeba dispar
CVLLVLGSFASSFNNDYSDFLD

SEQ ID NO: 2555751 - protein, 39 aa, Entamoeba dispar
CVNTSLWQFFPVWLQYLCWPILQVVFKTPLEGAQTCLHL

SEQ ID NO: 2555752 - protein, 24 aa, Entamoeba dispar
CVSITLCFSILVVLIVTCMVDNKS

SEQ ID NO: 2555753 - protein, 19 aa, Entamoeba dispar
CWIVSFVLPSWVELKWSNE

SEQ ID NO: 2555754 - protein, 24 aa, Entamoeba dispar
CYAKIAWCPYRWCSYYGQKRFTVD

SEQ ID NO: 2555755 - protein, 32 aa, Entamoeba dispar
CYKTFALIVIKLIKLRRQMFINILKGDYGENG

SEQ ID NO: 2555756 - protein, 21 aa, Entamoeba dispar
CYSDKFIWWGESGLGTVGIKV

SEQ ID NO: 2555757 - protein, 25 aa, Entamoeba dispar
DALKNSLSFYFYPEFEISDSKPFIF

SEQ ID NO: 2555758 - protein, 25 aa, Entamoeba dispar
DAPRFKWRGLMVDPSRNPLSPLMFK

SEQ ID NO: 2555759 - protein, 30 aa, Entamoeba dispar
DCDRSKDWFTLWLNLLDGIPYVNDCYIAYL

SEQ ID NO: 2555760 - protein, 20 aa, Entamoeba dispar
DCQCKLLFDCIPIGNRFSDG

SEQ ID NO: 2555761 - protein, 32 aa, Entamoeba dispar
DDEEYFVFNKLTILNMFSFFTDVDYKLTRVDD

SEQ ID NO: 2555762 - protein, 25 aa, Entamoeba dispar
DEIKGACILCTSPCTKCIGVMKYCE

SEQ ID NO: 2555763 - protein, 20 aa, Entamoeba dispar
DEKMYKLRLKKRLNKMVAIA

SEQ ID NO: 2555764 - protein, 18 aa, Entamoeba dispar
DELNLREYKYRELINSTR

SEQ ID NO: 2555765 - protein, 30 aa, Entamoeba dispar
DEPSTCEYVLVLQTPCACSKKLLKSLHEKR

SEQ ID NO: 2555766 - protein, 29 aa, Entamoeba dispar
DERWRRRRHHRRHSRRQSTTEDTHGDITE

SEQ ID NO: 2555767 - protein, 36 aa, Entamoeba dispar
DEVFVAYLPLAHIFELCLEFCILSFFGSIGYANART

SEQ ID NO: 2555768 - protein, 20 aa, Entamoeba dispar
DFETSFISHLPPPNVPKINA

SEQ ID NO: 2555769 - protein, 26 aa, Entamoeba dispar
DFSYVNYGIWYLISSYEGSINKITPN

SEQ ID NO: 2555770 - protein, 17 aa, Entamoeba dispar
DFTHLIMTLKVNGFVVL

SEQ ID NO: 2555771 - protein, 18 aa, Entamoeba dispar
DFTLFPHSGFIYTLSVNI

SEQ ID NO: 2555772 - protein, 24 aa, Entamoeba dispar
DGAHAHQIILNQQSKLLNKVEEST

SEQ ID NO: 2555773 - protein, 19 aa, Entamoeba dispar
DGKDYYIVKNSWGTSWGDK

SEQ ID NO: 2555774 - protein, 19 aa, Entamoeba dispar
DGKDYYIVRNSWGTTWGMD

SEQ ID NO: 2555775 - protein, 17 aa, Entamoeba dispar
DGNRIVIVRSFMPPTDY

SEQ ID NO: 2555776 - protein, 24 aa, Entamoeba dispar
DGNTLLHHLVILNQPKMIELVLNK

SEQ ID NO: 2555777 - protein, 24 aa, Entamoeba dispar
DGVAPFYYHWKIHYGLLDPITFEV

SEQ ID NO: 2555778 - protein, 18 aa, Entamoeba dispar
DGVDEILRELQAVEIRKL

SEQ ID NO: 2555779 - protein, 19 aa, Entamoeba dispar
DHKVIISEPYEHLKSWKFS

SEQ ID NO: 2555780 - protein, 20 aa, Entamoeba dispar
DIISTDLCLCDCEPASLLSL

SEQ ID NO: 2555781 - protein, 24 aa, Entamoeba dispar
DIKKIKIWQSWYPAEWGKCEENSD

SEQ ID NO: 2555782 - protein, 17 aa, Entamoeba dispar
DIKMILKRSGMNAIIIV

SEQ ID NO: 2555783 - protein, 25 aa, Entamoeba dispar
DINDPFFCSNIIIIYTPDICQLIKN

SEQ ID NO: 2555784 - protein, 22 aa, Entamoeba dispar
DKESLVMVLKQFKQIQSVDLSS

SEQ ID NO: 2555785 - protein, 26 aa, Entamoeba dispar
DKFRSEYIIHFYGAVFIPNKICMVTE

SEQ ID NO: 2555786 - protein, 26 aa, Entamoeba dispar
DKIAKGTPHLLLTKNVLNYCQSSPNE

SEQ ID NO: 2555787 - protein, 31 aa, Entamoeba dispar
DKLKKLQKRMGLCPLNRLRIKRRLRVYKKEV

SEQ ID NO: 2555788 - protein, 24 aa, Entamoeba dispar
DKYIDNWIAMSTPFLGSGKAIAAA

SEQ ID NO: 2555789 - protein, 23 aa, Entamoeba dispar
DLFCAGFDWRISSISSFQFITDT

SEQ ID NO: 2555790 - protein, 17 aa, Entamoeba dispar
DLHDVVRRLATAHARAS

SEQ ID NO: 2555791 - protein, 18 aa, Entamoeba dispar
DLIHKPGKNIFRCPFEKH

SEQ ID NO: 2555792 - protein, 21 aa, Entamoeba dispar
DLPIVLIFPENKTLISIKDGI

SEQ ID NO: 2555793 - protein, 36 aa, Entamoeba dispar
DLRFNQVTSTPIIFRLCEWYSIIPEPDKHYSFSVPT

SEQ ID NO: 2555794 - protein, 23 aa, Entamoeba dispar
DMCKYFLTTPLAKVAKRMQGIDT

SEQ ID NO: 2555795 - protein, 17 aa, Entamoeba dispar
DMRVLNEKFKNLKVIVE

SEQ ID NO: 2555796 - protein, 25 aa, Entamoeba dispar
DNEKQRILCPLPKEKCHPRIIKIDV

SEQ ID NO: 2555797 - protein, 33 aa, Entamoeba dispar
DNEQLVFHFDYPVPIQWKTIIQHFALVINSTDT

SEQ ID NO: 2555798 - protein, 22 aa, Entamoeba dispar
DNHYQFNPIFSIQFGRVSQWNT

SEQ ID NO: 2555799 - protein, 21 aa, Entamoeba dispar
DNKPFIKVTLKGDEKIYSPEE

SEQ ID NO: 2555800 - protein, 24 aa, Entamoeba dispar
DNNPYTFNPCVVDEVPISSSTKSS

SEQ ID NO: 2555801 - protein, 23 aa, Entamoeba dispar
DNVTLVHHYIVFNLFDCIEYNHN

SEQ ID NO: 2555802 - protein, 28 aa, Entamoeba dispar
DPALLDDIAFYWPSLSRCHFIEYEYDKH

SEQ ID NO: 2555803 - protein, 22 aa, Entamoeba dispar
DPISLNTWRYYGQAKIALVVDN

SEQ ID NO: 2555804 - protein, 23 aa, Entamoeba dispar
DPKFTFQWGYDQTLLNYLYYKGE

SEQ ID NO: 2555805 - protein, 20 aa, Entamoeba dispar
DQKITYVNFKQYQYDICMTE

SEQ ID NO: 2555806 - protein, 17 aa, Entamoeba dispar
DQLLFFNADDHACHPRN

SEQ ID NO: 2555807 - protein, 27 aa, Entamoeba dispar
DQNYFDPILFGYFFTANGIPIGSTLTI

SEQ ID NO: 2555808 - protein, 23 aa, Entamoeba dispar
DQRIALFLVEICKRKFKKDPSNN

SEQ ID NO: 2555809 - protein, 23 aa, Entamoeba dispar
DQRYFERMLLYSKICTNYKMVNR

SEQ ID NO: 2555810 - protein, 20 aa, Entamoeba dispar
DSALSWLEGFYDDEPKKKQM

SEQ ID NO: 2555811 - protein, 26 aa, Entamoeba dispar
DSEFQLPMGFPLLQPVTYGYAHKNAV

SEQ ID NO: 2555812 - protein, 21 aa, Entamoeba dispar
DSLNLYTDLWMKVGTSWIQVP

SEQ ID NO: 2555813 - protein, 17 aa, Entamoeba dispar
DSVGSVIFFILDNNKFV

SEQ ID NO: 2555814 - protein, 24 aa, Entamoeba dispar
DTLNKQLFIKFKTISHTKLENDSF

SEQ ID NO: 2555815 - protein, 17 aa, Entamoeba dispar
DVDEIIDFLKNDKLWNV

SEQ ID NO: 2555816 - protein, 23 aa, Entamoeba dispar
DVIYKWEPLPYSARPKFGERTQF

SEQ ID NO: 2555817 - protein, 24 aa, Entamoeba dispar
DVKKIKIWQSWYPNEWGKCEGTIE

SEQ ID NO: 2555818 - protein, 19 aa, Entamoeba dispar
DVLSSYYPKILLGFDQDYY

SEQ ID NO: 2555819 - protein, 24 aa, Entamoeba dispar
DVVNKYPLFIKEKYNPEWGDKECT

SEQ ID NO: 2555820 - protein, 17 aa, Entamoeba dispar
DWFRAWVNVDITVPWKS

SEQ ID NO: 2555821 - protein, 29 aa, Entamoeba dispar
DYANAAMNILIKHDMWKLFKANGVKADGS

SEQ ID NO: 2555822 - protein, 27 aa, Entamoeba dispar
DYLNKTNLVDLIIMKLKRYKYEIDETN

SEQ ID NO: 2555823 - protein, 17 aa, Entamoeba dispar
DYNPVIRAMYYSFPESD

SEQ ID NO: 2555824 - protein, 26 aa, Entamoeba dispar
DYNSGKYKFGGFTIAMKQFEGTTNMC

SEQ ID NO: 2555825 - protein, 17 aa, Entamoeba dispar
DYSSWPPYASYIIFEMY

SEQ ID NO: 2555826 - protein, 45 aa, Entamoeba dispar
EAIEMKYLLIDYWYKEYFMSIRNKEPLLKPLFLMYPEDEMTYNID

SEQ ID NO: 2555827 - protein, 32 aa, Entamoeba dispar
EALTGVKVVKDLTLPPALIKSKQLVVKRLEEK

SEQ ID NO: 2555828 - protein, 33 aa, Entamoeba dispar
EARKAINTLLFMRFLYTPLIQSPSLFKKIQTII

SEQ ID NO: 2555829 - protein, 20 aa, Entamoeba dispar
EARNWWAGLYSFDKYKDTTE

SEQ ID NO: 2555830 - protein, 18 aa, Entamoeba dispar
EAYVFKDILKNPPQPSFS

SEQ ID NO: 2555831 - protein, 18 aa, Entamoeba dispar
ECFHLVIDILSEKNIFVS

SEQ ID NO: 2555832 - protein, 22 aa, Entamoeba dispar
ECPQMVMARLAQKAHLSPVILK

SEQ ID NO: 2555833 - protein, 26 aa, Entamoeba dispar
ECTTSAPTLWYKFKGDGKYVVINTCN

SEQ ID NO: 2555834 - protein, 28 aa, Entamoeba dispar
EDFILPSITFILQTKLIILSSLIIQKNN

SEQ ID NO: 2555835 - protein, 20 aa, Entamoeba dispar
EDFSFNNFKDILSSNKESDK

SEQ ID NO: 2555836 - protein, 23 aa, Entamoeba dispar
EDKRPFEIFTLNNNFYGNFIDHE

SEQ ID NO: 2555837 - protein, 25 aa, Entamoeba dispar
EDLCLLHLISMRPFSQNLIKTSFGF

SEQ ID NO: 2555838 - protein, 26 aa, Entamoeba dispar
EDLGLKLDPLLLRPLARSWESDYQLM

SEQ ID NO: 2555839 - protein, 42 aa, Entamoeba dispar
EEALDAFMNLFEVSDFMLEDEGFFGDLWNGAKKIAGDAVNAV

SEQ ID NO: 2555840 - protein, 23 aa, Entamoeba dispar
EECLPGYYLEKDGENKRCTLCPD

SEQ ID NO: 2555841 - protein, 25 aa, Entamoeba dispar
EEEEYDLGFFFKPIYSAVADDDGDI

SEQ ID NO: 2555842 - protein, 20 aa, Entamoeba dispar
EEFKKFCFNRDICTIEIKEI

SEQ ID NO: 2555843 - protein, 18 aa, Entamoeba dispar
EEKNDFKYVPLSKKFRNM

SEQ ID NO: 2555844 - protein, 21 aa, Entamoeba dispar
EELNLELFKSTIAPVRKVLED

SEQ ID NO: 2555845 - protein, 22 aa, Entamoeba dispar
EENHWVLRPYNSIDWHTQVFNW

SEQ ID NO: 2555846 - protein, 21 aa, Entamoeba dispar
EEPTFKNVFNKLYRITGFESG

SEQ ID NO: 2555847 - protein, 19 aa, Entamoeba dispar
EEPVVFVFHLSITGSSNKV

SEQ ID NO: 2555848 - protein, 17 aa, Entamoeba dispar
EEQLRFQIFKNNLKNIK

SEQ ID NO: 2555849 - protein, 25 aa, Entamoeba dispar
EESKTICLLYHDYYSICTDKEDECN

SEQ ID NO: 2555850 - protein, 30 aa, Entamoeba dispar
EFCDTYIDKWIPLSAPFLGSGLAIKELLVG

SEQ ID NO: 2555851 - protein, 17 aa, Entamoeba dispar
EFELSENLPKKNPARDY

SEQ ID NO: 2555852 - protein, 29 aa, Entamoeba dispar
EFTKQIINYLPQKFLKYKIIPLGEDVIPY

SEQ ID NO: 2555853 - protein, 17 aa, Entamoeba dispar
EFVPILISQIQQLTLRK

SEQ ID NO: 2555854 - protein, 23 aa, Entamoeba dispar
EGAEKFLKWLSTSELRDGGFFPT

SEQ ID NO: 2555855 - protein, 20 aa, Entamoeba dispar
EGDLLWCNYGDYQYSKYFTE

SEQ ID NO: 2555856 - protein, 19 aa, Entamoeba dispar
EGDYTKYSSVIFLVSNYNG

SEQ ID NO: 2555857 - protein, 28 aa, Entamoeba dispar
EGENQILRKTVFDLTAYLTNLKVVSPDQ

SEQ ID NO: 2555858 - protein, 29 aa, Entamoeba dispar
EGGEINWFYSFPFLYDKILPSAVCPYTAT

SEQ ID NO: 2555859 - protein, 26 aa, Entamoeba dispar
EGGLPPFNWELFPSIQHWGTPRVYNF

SEQ ID NO: 2555860 - protein, 19 aa, Entamoeba dispar
EGIDFRKFGKLTYIREQTG

SEQ ID NO: 2555861 - protein, 25 aa, Entamoeba dispar
EGKCPLDIQAFTSLYQKLIEKLQKS

SEQ ID NO: 2555862 - protein, 23 aa, Entamoeba dispar
EGNDIVFKTIDFGKCYYTGSVTS

SEQ ID NO: 2555863 - protein, 20 aa, Entamoeba dispar
EGPIPPLYSSSLRHLDLRGT

SEQ ID NO: 2555864 - protein, 21 aa, Entamoeba dispar
EGQAKFYLMVWEDGSNTVEEV

SEQ ID NO: 2555865 - protein, 24 aa, Entamoeba dispar
EGRFEYERYLLYLTKQTNATGILI

SEQ ID NO: 2555866 - protein, 19 aa, Entamoeba dispar
EGVYQYRQLHCGSSLIDKV

SEQ ID NO: 2555867 - protein, 17 aa, Entamoeba dispar
EGYPTLALFRKGRSKKV

SEQ ID NO: 2555868 - protein, 17 aa, Entamoeba dispar
EHIEPFRVFSTTLPVEG

SEQ ID NO: 2555869 - protein, 19 aa, Entamoeba dispar
EIAILKTARALLKQMRRKG

SEQ ID NO: 2555870 - protein, 19 aa, Entamoeba dispar
EIFAKWKSMNSMTPVDAKY

SEQ ID NO: 2555871 - protein, 17 aa, Entamoeba dispar
EIIDSDLELLKDSPFNL

SEQ ID NO: 2555872 - protein, 20 aa, Entamoeba dispar
EIKALKGEKIILKRFGKEMK

SEQ ID NO: 2555873 - protein, 22 aa, Entamoeba dispar
EINQFIRKNAFYSINKLSMYNL

SEQ ID NO: 2555874 - protein, 21 aa, Entamoeba dispar
EIPNKIRIKFMLDGAKGISYL

SEQ ID NO: 2555875 - protein, 19 aa, Entamoeba dispar
EIQRKLDLNAIQRKEIDKW

SEQ ID NO: 2555876 - protein, 23 aa, Entamoeba dispar
EKCASCMEGYYLTGTECEVCTID

SEQ ID NO: 2555877 - protein, 27 aa, Entamoeba dispar
EKENLFREKSYLRRKLIELEGLAEKRK

SEQ ID NO: 2555878 - protein, 23 aa, Entamoeba dispar
EKIFNKWCDIYHKEINTRRIYIK

SEQ ID NO: 2555879 - protein, 26 aa, Entamoeba dispar
EKKLAKKIKLVKKNDAKLIKKSNKKL

SEQ ID NO: 2555880 - protein, 24 aa, Entamoeba dispar
EKLIKLIPQIDRLEKEYKVELKQV

SEQ ID NO: 2555881 - protein, 38 aa, Entamoeba dispar
EKLKQRLIIVDGHKKELLIKIKVLENRLLNYQKVRQQQ

SEQ ID NO: 2555882 - protein, 21 aa, Entamoeba dispar
EKNILVFDLGGGTFDVSLLNI

SEQ ID NO: 2555883 - protein, 25 aa, Entamoeba dispar
EKRREFYELMKRKYWKQCCNCSCCK

SEQ ID NO: 2555884 - protein, 19 aa, Entamoeba dispar
EKVISSMALFLKPSLSEGI

SEQ ID NO: 2555885 - protein, 25 aa, Entamoeba dispar
ELAEDIYLSPYQRNRLRNVQRMQRK

SEQ ID NO: 2555886 - protein, 17 aa, Entamoeba dispar
ELDYLHFYALNTEMDNF

SEQ ID NO: 2555887 - protein, 27 aa, Entamoeba dispar
ELKDIIMMIALIALLSFASATEVNLMM

SEQ ID NO: 2555888 - protein, 19 aa, Entamoeba dispar
ELKNFKIVIAIPPMSIFTE

SEQ ID NO: 2555889 - protein, 20 aa, Entamoeba dispar
ELLKDSPFNLIIGPGGMTPQ

SEQ ID NO: 2555890 - protein, 30 aa, Entamoeba dispar
ELMGKMKKCLPIWKQDLPSLKRKLNAVDQV

SEQ ID NO: 2555891 - protein, 25 aa, Entamoeba dispar
ELRMTKNFWIARESFSLKARALEHI

SEQ ID NO: 2555892 - protein, 26 aa, Entamoeba dispar
ELYEKYNYKLPFPIKMHCMISSGYES

SEQ ID NO: 2555893 - protein, 27 aa, Entamoeba dispar
ELYEKYNYKLPFPIKMHCMISSGYESI

SEQ ID NO: 2555894 - protein, 24 aa, Entamoeba dispar
EMEKLKVLFPQLKISKEKLEWVES

SEQ ID NO: 2555895 - protein, 24 aa, Entamoeba dispar
ENDNTKRLLAQKKKLLKEANQLAS

SEQ ID NO: 2555896 - protein, 32 aa, Entamoeba dispar
ENEQKRLIVQLRRLYRHKKVLLRDIKDKEQQS

SEQ ID NO: 2555897 - protein, 26 aa, Entamoeba dispar
ENGCSSCMLGYYLKDGKCQIPPNPLC

SEQ ID NO: 2555898 - protein, 22 aa, Entamoeba dispar
ENHGTLLTWQILQWNQDKTVVK

SEQ ID NO: 2555899 - protein, 23 aa, Entamoeba dispar
ENNQIESKYVYLKEYSKYIDGCG

SEQ ID NO: 2555900 - protein, 30 aa, Entamoeba dispar
ENRYKLIQRKKYLKKLIKQLTKIRKNILIP

SEQ ID NO: 2555901 - protein, 24 aa, Entamoeba dispar
EPQCEYLHCFGKQCKCRMVHLEYL

SEQ ID NO: 2555902 - protein, 18 aa, Entamoeba dispar
EPVYLTTVLLYCNSEAVL

SEQ ID NO: 2555903 - protein, 22 aa, Entamoeba dispar
EPYEHLKSWKFSSEAVIFDFGK

SEQ ID NO: 2555904 - protein, 25 aa, Entamoeba dispar
EQDLDSLLFNIPFNPQTDLNKTYEM

SEQ ID NO: 2555905 - protein, 22 aa, Entamoeba dispar
EQFNIIPKIFISDTLSFTIEYG

SEQ ID NO: 2555906 - protein, 31 aa, Entamoeba dispar
EQGKPNALFFDFYYSLPFKVSISNTKKMYLL

SEQ ID NO: 2555907 - protein, 18 aa, Entamoeba dispar
EQLIQWNNAITVYSTEGK

SEQ ID NO: 2555908 - protein, 21 aa, Entamoeba dispar
EQLKNVRELIKNKLKKVMHEH

SEQ ID NO: 2555909 - protein, 17 aa, Entamoeba dispar
EQRRKYLAMVRSRGVAP

SEQ ID NO: 2555910 - protein, 27 aa, Entamoeba dispar
EQTCPVLRLQLLNKLKSHPFRFIASLE

SEQ ID NO: 2555911 - protein, 17 aa, Entamoeba dispar
EQWKIRNQTLINEKINF

SEQ ID NO: 2555912 - protein, 19 aa, Entamoeba dispar
ERDISLYPAFIIIRHHSQK

SEQ ID NO: 2555913 - protein, 26 aa, Entamoeba dispar
ERGKCYSLAFKVAKYAANLFDPHELK

SEQ ID NO: 2555914 - protein, 26 aa, Entamoeba dispar
ERKLKKFLIVFKDCENYYDSCDCLKR

SEQ ID NO: 2555915 - protein, 22 aa, Entamoeba dispar
ERKRKIINTKLKASKIIKNAEM

SEQ ID NO: 2555916 - protein, 21 aa, Entamoeba dispar
ESAFWHCTSLTSINIPDSVTE

SEQ ID NO: 2555917 - protein, 37 aa, Entamoeba dispar
ESDMKDMSILVGIKDRKLLMCKMRTIRKNLRKIAMLK

SEQ ID NO: 2555918 - protein, 24 aa, Entamoeba dispar
ESFDSIIIFPYVCATLLSTELLNI

SEQ ID NO: 2555919 - protein, 26 aa, Entamoeba dispar
ESNIQKFPVWFKPYSFITEYQVKDIS

SEQ ID NO: 2555920 - protein, 24 aa, Entamoeba dispar
ESPKKMFPLNITQSNIRQILASNS

SEQ ID NO: 2555921 - protein, 22 aa, Entamoeba dispar
ESQFACIYKVFHEEFSIDLKDY

SEQ ID NO: 2555922 - protein, 25 aa, Entamoeba dispar
ESSNQAIFKIYRKKEPYQKIEFSLT

SEQ ID NO: 2555923 - protein, 32 aa, Entamoeba dispar
ETDRNTFYSILYRSLLFPHNITENGYYKSPFD

SEQ ID NO: 2555924 - protein, 18 aa, Entamoeba dispar
ETENNIIIELRKLIRKSI

SEQ ID NO: 2555925 - protein, 31 aa, Entamoeba dispar
ETISSTEMIYLGKLLYRLGYKGKEIYDLFIK

SEQ ID NO: 2555926 - protein, 22 aa, Entamoeba dispar
ETNYPLIISWNAIGIELFKSLQ

SEQ ID NO: 2555927 - protein, 20 aa, Entamoeba dispar
ETRECIQCEKGYYLNSNKEC

SEQ ID NO: 2555928 - protein, 22 aa, Entamoeba dispar
ETRYPSYPLSRWTYCGVGEFQC

SEQ ID NO: 2555929 - protein, 21 aa, Entamoeba dispar
ETTLNQWLVALNAVICFKPSP

SEQ ID NO: 2555930 - protein, 26 aa, Entamoeba dispar
ETTRNTIHSLLKKYKSKLLKKQNEFK

SEQ ID NO: 2555931 - protein, 18 aa, Entamoeba dispar
EVEPFWINACNPSSNGLY

SEQ ID NO: 2555932 - protein, 18 aa, Entamoeba dispar
EVHGYPTLKSFPKGENKK

SEQ ID NO: 2555933 - protein, 26 aa, Entamoeba dispar
EVQRDLHIFPFNIINQDNKPFIKVTL

SEQ ID NO: 2555934 - protein, 25 aa, Entamoeba dispar
EVVKEEVMDVLPVDVLKSEFECKAD

SEQ ID NO: 2555935 - protein, 24 aa, Entamoeba dispar
EVYEKQGWFIPDKGVLKVWNFDWE

SEQ ID NO: 2555936 - protein, 18 aa, Entamoeba dispar
EVYVLKDILKNPPQPSFS

SEQ ID NO: 2555937 - protein, 17 aa, Entamoeba dispar
EWVSAMGIPLFYDGSKQ

SEQ ID NO: 2555938 - protein, 24 aa, Entamoeba dispar
EYARYADILFDTRFNRGTLERIFN

SEQ ID NO: 2555939 - protein, 18 aa, Entamoeba dispar
EYERLWVALKNVRPLKNE

SEQ ID NO: 2555940 - protein, 19 aa, Entamoeba dispar
EYNLLFKMIEMLGTPPIEM

SEQ ID NO: 2555941 - protein, 19 aa, Entamoeba dispar
EYNLYVRCELLQLDIPECM

SEQ ID NO: 2555942 - protein, 23 aa, Entamoeba dispar
EYQKIKVAAFKKAKKDAIREKRR

SEQ ID NO: 2555943 - protein, 24 aa, Entamoeba dispar
EYQNRLFTIIKKYKSTINSFLLGH

SEQ ID NO: 2555944 - protein, 23 aa, Entamoeba dispar
EYRLKMLFIQVDGKDIELGLYGQ

SEQ ID NO: 2555945 - protein, 24 aa, Entamoeba dispar
EYSLIINHFDSPSIFYICFSYDCK

SEQ ID NO: 2555946 - protein, 33 aa, Entamoeba dispar
FAAGYIESYLTHQWIWIYWQNYLKNEYKHGIKK

SEQ ID NO: 2555947 - protein, 23 aa, Entamoeba dispar
FAFSLVRKVLPKVTLVMLTVGKV

SEQ ID NO: 2555948 - protein, 17 aa, Entamoeba dispar
FAINFDQWKIKYNIKYS

SEQ ID NO: 2555949 - protein, 38 aa, Entamoeba dispar
FAITMYECFGWCAAYPKSLFQFPWSIADFVTQGKRRSK

SEQ ID NO: 2555950 - protein, 25 aa, Entamoeba dispar
FCDKYIHRWVAMSTPFIGTTIANDI

SEQ ID NO: 2555951 - protein, 26 aa, Entamoeba dispar
FCGHYMFPYCILNKHLPFWGGYVGSH

SEQ ID NO: 2555952 - protein, 25 aa, Entamoeba dispar
FDDDDSMELLLNDFSLKSIGSAIGN

SEQ ID NO: 2555953 - protein, 18 aa, Entamoeba dispar
FDDFVPFAGWTKPTEKAK

SEQ ID NO: 2555954 - protein, 19 aa, Entamoeba dispar
FDHFLVLTPNFAIDSLQLL

SEQ ID NO: 2555955 - protein, 22 aa, Entamoeba dispar
FDKRKPIELKIQALKKLKEQKE

SEQ ID NO: 2555956 - protein, 33 aa, Entamoeba dispar
FDLAKLQQFFDISTLPIISYFMDPSKLSVYSNK

SEQ ID NO: 2555957 - protein, 20 aa, Entamoeba dispar
FDPIYIHDINNRYILWVFFN

SEQ ID NO: 2555958 - protein, 17 aa, Entamoeba dispar
FDPVKFRVASACKKIGV

SEQ ID NO: 2555959 - protein, 30 aa, Entamoeba dispar
FDQPQDNLLNPWYWIYQPASYSLNSRMGTR

SEQ ID NO: 2555960 - protein, 32 aa, Entamoeba dispar
FDQPQDNLLNPWYWIYQPVAYKLNSRMGTRQQ

SEQ ID NO: 2555961 - protein, 19 aa, Entamoeba dispar
FDRVFQRYSAIAERLWSKE

SEQ ID NO: 2555962 - protein, 26 aa, Entamoeba dispar
FDSPDAFDWPLIYKTMKRVKQRKRVQ

SEQ ID NO: 2555963 - protein, 17 aa, Entamoeba dispar
FDVDVNGILRVSAQDKK

SEQ ID NO: 2555964 - protein, 17 aa, Entamoeba dispar
FDVLWLDIEHTDDKRYF

SEQ ID NO: 2555965 - protein, 17 aa, Entamoeba dispar
FDVPPIKNKACPNGIDA

SEQ ID NO: 2555966 - protein, 17 aa, Entamoeba dispar
FEDSLWDTLKKKSQDLL

SEQ ID NO: 2555967 - protein, 20 aa, Entamoeba dispar
FEGFFIIPMLGNHDVYPANQ

SEQ ID NO: 2555968 - protein, 23 aa, Entamoeba dispar
FENVTFTFFNGNSPTRIIGGVNE

SEQ ID NO: 2555969 - protein, 19 aa, Entamoeba dispar
FFGVCNYNWYDAYFDILQE

SEQ ID NO: 2555970 - protein, 32 aa, Entamoeba dispar
FFQKYQMFIMMGLMMLFQMFMGQPGAQAPAQA

SEQ ID NO: 2555971 - protein, 28 aa, Entamoeba dispar
FFSKCITLLFVLLFVTVVIQVVSWKDRM

SEQ ID NO: 2555972 - protein, 18 aa, Entamoeba dispar
FGFVVIIYANEITTNTTN

SEQ ID NO: 2555973 - protein, 20 aa, Entamoeba dispar
FGLNSFKGEKQILVFDLGGG

SEQ ID NO: 2555974 - protein, 23 aa, Entamoeba dispar
FGSSIAIFGYWIAVSSSLGNEFN

SEQ ID NO: 2555975 - protein, 27 aa, Entamoeba dispar
FHEGFTMHGWWPNFVSGYPSCCKSPYT

SEQ ID NO: 2555976 - protein, 17 aa, Entamoeba dispar
FIAFSSSFKCETIDITI

SEQ ID NO: 2555977 - protein, 24 aa, Entamoeba dispar
FIFYSFALDYYKVLGVPRNANEKE

SEQ ID NO: 2555978 - protein, 19 aa, Entamoeba dispar
FIIFFITALSNYCQAPLPK

SEQ ID NO: 2555979 - protein, 17 aa, Entamoeba dispar
FIKYANNDIDWHLNWKL

SEQ ID NO: 2555980 - protein, 20 aa, Entamoeba dispar
FILIVYGKLPNKWAYNYPTN

SEQ ID NO: 2555981 - protein, 17 aa, Entamoeba dispar
FISFCDGEYCQKVDGND

SEQ ID NO: 2555982 - protein, 18 aa, Entamoeba dispar
FISFCNGEYCKKVEGNDT

SEQ ID NO: 2555983 - protein, 17 aa, Entamoeba dispar
FISFCNGEYCQKVDGND

SEQ ID NO: 2555984 - protein, 18 aa, Entamoeba dispar
FISHLPPPNVPKINAPRP

SEQ ID NO: 2555985 - protein, 19 aa, Entamoeba dispar
FISYGYGLSLSFFETFRFN

SEQ ID NO: 2555986 - protein, 29 aa, Entamoeba dispar
FITDRPLEEYILPPRLYPYIEYGKTVSLE

SEQ ID NO: 2555987 - protein, 18 aa, Entamoeba dispar
FIVLAFAVNHDNFRTCQQ

SEQ ID NO: 2555988 - protein, 18 aa, Entamoeba dispar
FIVLCSADLNVLTREDMV

SEQ ID NO: 2555989 - protein, 18 aa, Entamoeba dispar
FIVLNIYAITPEQEEIID

SEQ ID NO: 2555990 - protein, 19 aa, Entamoeba dispar
FIYFTISQTMYEFDNDALA

SEQ ID NO: 2555991 - protein, 36 aa, Entamoeba dispar
FKASDDTYYCPLTDLFLPYYFSVTKDSSNAITIGCV

SEQ ID NO: 2555992 - protein, 28 aa, Entamoeba dispar
FKNFDYIFAMDNDNYYELLDRCPEQYKQ

SEQ ID NO: 2555993 - protein, 24 aa, Entamoeba dispar
FKPETFGFVNFLFVFNEKTHEYTY

SEQ ID NO: 2555994 - protein, 25 aa, Entamoeba dispar
FKQVSKTRIIWANKILFLDMMFPQS

SEQ ID NO: 2555995 - protein, 18 aa, Entamoeba dispar
FKYYLELVEMIKNVGLKY

SEQ ID NO: 2555996 - protein, 26 aa, Entamoeba dispar
FLCVAFAYIPRTVSIIELFEKVYNSQ

SEQ ID NO: 2555997 - protein, 18 aa, Entamoeba dispar
FLDIRIGYEKVGRIVIGL

SEQ ID NO: 2555998 - protein, 18 aa, Entamoeba dispar
FLGNPLKGFGMWYGSGNT

SEQ ID NO: 2555999 - protein, 19 aa, Entamoeba dispar
FLIGVFALNLRDSLDDFLD

SEQ ID NO: 2556000 - protein, 20 aa, Entamoeba dispar
FLIILIINGSYCDLKKEDGF

SEQ ID NO: 2556001 - protein, 18 aa, Entamoeba dispar
FLNLVFGNVIHVTEDLFR

SEQ ID NO: 2556002 - protein, 19 aa, Entamoeba dispar
FLQTFYPLERRKSVIDIEI

SEQ ID NO: 2556003 - protein, 20 aa, Entamoeba dispar
FLSFVFASIPINATNTIQNE

SEQ ID NO: 2556004 - protein, 25 aa, Entamoeba dispar
FMNKKTRMMKLRRKARKVLRKKQQR

SEQ ID NO: 2556005 - protein, 18 aa, Entamoeba dispar
FMRKVHVPKKYRIGRKWQ

SEQ ID NO: 2556006 - protein, 25 aa, Entamoeba dispar
FNDGDDIDFALQKIYLVLGKVQQQA

SEQ ID NO: 2556007 - protein, 26 aa, Entamoeba dispar
FNKKALQKLIRRAAKKSMKKYSKKFT

SEQ ID NO: 2556008 - protein, 24 aa, Entamoeba dispar
FNLKTLFMMLTVPRRTNFLSHQNP

SEQ ID NO: 2556009 - protein, 17 aa, Entamoeba dispar
FNLLKKKCDKFETIGAT

SEQ ID NO: 2556010 - protein, 25 aa, Entamoeba dispar
FNNNIGPYNIPYTQVTPNIPVNPIV

SEQ ID NO: 2556011 - protein, 17 aa, Entamoeba dispar
FNPFFNEFISTSYSLAP

SEQ ID NO: 2556012 - protein, 20 aa, Entamoeba dispar
FNPKILIGSLLQSGSTTSTS

SEQ ID NO: 2556013 - protein, 18 aa, Entamoeba dispar
FPCFIEVVGIQSPGLTAS

SEQ ID NO: 2556014 - protein, 17 aa, Entamoeba dispar
FPFTPASVFLYLLQNHN

SEQ ID NO: 2556015 - protein, 17 aa, Entamoeba dispar
FPGNNLGLPISGDKLRP

SEQ ID NO: 2556016 - protein, 25 aa, Entamoeba dispar
FPLFHQVNMPLFRRIENLPVYTLWY

SEQ ID NO: 2556017 - protein, 18 aa, Entamoeba dispar
FPLFVRRVNDEPKPMSHT

SEQ ID NO: 2556018 - protein, 23 aa, Entamoeba dispar
FQNGYYFEIPFKDKIVSFQIVSI

SEQ ID NO: 2556019 - protein, 27 aa, Entamoeba dispar
FRGKKNNLLWTLFMKEIPGLSGVEAGR

SEQ ID NO: 2556020 - protein, 29 aa, Entamoeba dispar
FRRIENLPVYTLWYFYQGTIPKVHEDLFR

SEQ ID NO: 2556021 - protein, 19 aa, Entamoeba dispar
FSAPYDWRYYHHDEYYEKV

SEQ ID NO: 2556022 - protein, 25 aa, Entamoeba dispar
FSERKRFLQQRLSLLEKRINEIGDG

SEQ ID NO: 2556023 - protein, 25 aa, Entamoeba dispar
FSSDNKGIWYLISSYEGSINKITSK

SEQ ID NO: 2556024 - protein, 18 aa, Entamoeba dispar
FSTPLFDGYAKLEFPLVN

SEQ ID NO: 2556025 - protein, 30 aa, Entamoeba dispar
FTDNSMFYVYLRYNYECKIIDYFCHSEYSK

SEQ ID NO: 2556026 - protein, 26 aa, Entamoeba dispar
FTDNSMFYVYLRYNYKCKIGAYRCHS

SEQ ID NO: 2556027 - protein, 21 aa, Entamoeba dispar
FTFGSIGRTLLPKSYLNTKFE

SEQ ID NO: 2556028 - protein, 24 aa, Entamoeba dispar
FTGFFICRAWCSPGYFDDNAPYTL

SEQ ID NO: 2556029 - protein, 17 aa, Entamoeba dispar
FTIAMKQFEGTTNMCGV

SEQ ID NO: 2556030 - protein, 18 aa, Entamoeba dispar
FVDSKTKISKVISDALEK

SEQ ID NO: 2556031 - protein, 24 aa, Entamoeba dispar
FVDSLIFNPLKVSLFGRNLKTIII

SEQ ID NO: 2556032 - protein, 18 aa, Entamoeba dispar
FVFIIFASAIEEDEFELN

SEQ ID NO: 2556033 - protein, 17 aa, Entamoeba dispar
FVILCHADIVGMYMTAP

SEQ ID NO: 2556034 - protein, 18 aa, Entamoeba dispar
FVLLTFATEVIRVDPYIS

SEQ ID NO: 2556035 - protein, 19 aa, Entamoeba dispar
FVLVSLTLGKKAWIVTDTH

SEQ ID NO: 2556036 - protein, 23 aa, Entamoeba dispar
FVNIETNFRLELVKSPYSFKNVQ

SEQ ID NO: 2556037 - protein, 19 aa, Entamoeba dispar
FVSQFFKFEALPEIPESQL

SEQ ID NO: 2556038 - protein, 18 aa, Entamoeba dispar
FWAFPPKSQWMLNNMSLW

SEQ ID NO: 2556039 - protein, 21 aa, Entamoeba dispar
FWAWSYNIYQYPKKVILVLLP

SEQ ID NO: 2556040 - protein, 18 aa, Entamoeba dispar
FWVVWRQRAINRCLQLKQ

SEQ ID NO: 2556041 - protein, 24 aa, Entamoeba dispar
GANPLLFCFGNFFDEFRLCSDIPS

SEQ ID NO: 2556042 - protein, 20 aa, Entamoeba dispar
GAQKITQKGFLIIQKMNKKE

SEQ ID NO: 2556043 - protein, 31 aa, Entamoeba dispar
GASKIVTALLDAKLPIVLAAVHAPILSIRSQ

SEQ ID NO: 2556044 - protein, 28 aa, Entamoeba dispar
GATGTLYFKYYCPYKPGSELKYFQITFV

SEQ ID NO: 2556045 - protein, 24 aa, Entamoeba dispar
GAVTRFCAWLNYLKENKGKYDRVA

SEQ ID NO: 2556046 - protein, 28 aa, Entamoeba dispar
GCMTAEFFLGYPLFGATSEYNLLFKMIE

SEQ ID NO: 2556047 - protein, 24 aa, Entamoeba dispar
GCSLCKDGYFLNEFDCIKCPIECK

SEQ ID NO: 2556048 - protein, 19 aa, Entamoeba dispar
GCYNTQQYFKIYKTALDHG

SEQ ID NO: 2556049 - protein, 25 aa, Entamoeba dispar
GDASVGKTGIFKRFIKDQFSKNEKS

SEQ ID NO: 2556050 - protein, 20 aa, Entamoeba dispar
GDKFLKLKNFKVNCGSLAKK

SEQ ID NO: 2556051 - protein, 22 aa, Entamoeba dispar
GDPRIGFWQLGTYGHWGEWHTT

SEQ ID NO: 2556052 - protein, 25 aa, Entamoeba dispar
GDYLKFYLIQHMTYPYTKYSPELEN

SEQ ID NO: 2556053 - protein, 31 aa, Entamoeba dispar
GEDSFSNCKFLTKMLFPLHNNIISIGDYAFE

SEQ ID NO: 2556054 - protein, 24 aa, Entamoeba dispar
GEKPVFVKFFAPWCGHCKRLAPIY

SEQ ID NO: 2556055 - protein, 22 aa, Entamoeba dispar
GEKQILVFDLGGGTFDVSLLNI

SEQ ID NO: 2556056 - protein, 18 aa, Entamoeba dispar
GFALWLTTKPIVSGNNFG

SEQ ID NO: 2556057 - protein, 23 aa, Entamoeba dispar
GFPKVVFYHYNGMKFNFKNESPN

SEQ ID NO: 2556058 - protein, 18 aa, Entamoeba dispar
GFTLSNEGPFAVLTREES

SEQ ID NO: 2556059 - protein, 17 aa, Entamoeba dispar
GGFVQPLNSPYTACSRY

SEQ ID NO: 2556060 - protein, 18 aa, Entamoeba dispar
GGIWHTWIDRDLGISGRV

SEQ ID NO: 2556061 - protein, 20 aa, Entamoeba dispar
GGRFVINKYAEKYNSLMLAI

SEQ ID NO: 2556062 - protein, 26 aa, Entamoeba dispar
GGRTPVDFYYDFMNAFNVAFKSYISD

SEQ ID NO: 2556063 - protein, 25 aa, Entamoeba dispar
GGSYSGNLAAWMRQKYPNVVEGAWA

SEQ ID NO: 2556064 - protein, 27 aa, Entamoeba dispar
GGVIPRSLAFGVIKESQGFVKKAECPQ

SEQ ID NO: 2556065 - protein, 18 aa, Entamoeba dispar
GHCKKLAPEYIKLADAYK

SEQ ID NO: 2556066 - protein, 25 aa, Entamoeba dispar
GIEDYKGFSWIRIVLKSGSKTPTLN

SEQ ID NO: 2556067 - protein, 22 aa, Entamoeba dispar
GIEHPKWFIKYANNDIDWHLNW

SEQ ID NO: 2556068 - protein, 24 aa, Entamoeba dispar
GIEQATLNYLYYTNAFKKLNTTVD

SEQ ID NO: 2556069 - protein, 17 aa, Entamoeba dispar
GIEYFIIRNSWSSGWGE

SEQ ID NO: 2556070 - protein, 27 aa, Entamoeba dispar
GIKHDKYFECNEFYEGIRTCPRNTKCI

SEQ ID NO: 2556071 - protein, 31 aa, Entamoeba dispar
GISLSTPLFKGYAKLKFPFVNKISYNNKSFR

SEQ ID NO: 2556072 - protein, 25 aa, Entamoeba dispar
GISRYYNDPYFFKSKFNPAGKEVGE

SEQ ID NO: 2556073 - protein, 26 aa, Entamoeba dispar
GKAPSHFPLYVTLLTNQPISYFECKE

SEQ ID NO: 2556074 - protein, 36 aa, Entamoeba dispar
GKLKLKRRIKFLKLPFFRILPINLGIIPLNFGVDLD

SEQ ID NO: 2556075 - protein, 27 aa, Entamoeba dispar
GKLPPSFIAWNPFVDYNLLGSLWNYYT

SEQ ID NO: 2556076 - protein, 24 aa, Entamoeba dispar
GKNNNWLVLLDAAAYLSTGRLDLR

SEQ ID NO: 2556077 - protein, 18 aa, Entamoeba dispar
GKRNVDFEAKLNYKPNEN

SEQ ID NO: 2556078 - protein, 32 aa, Entamoeba dispar
GLEGIKVKCTICRNLAAFLLQKVRRDRMSPKE

SEQ ID NO: 2556079 - protein, 23 aa, Entamoeba dispar
GLETLIQLLRPYQGKYIIKHIPI

SEQ ID NO: 2556080 - protein, 17 aa, Entamoeba dispar
GLIFFNHGQFDGLKNKL

SEQ ID NO: 2556081 - protein, 18 aa, Entamoeba dispar
GLKAQIARDILIDAHNRK

SEQ ID NO: 2556082 - protein, 19 aa, Entamoeba dispar
GLKKIFDLAKLLVPTINSV

SEQ ID NO: 2556083 - protein, 24 aa, Entamoeba dispar
GLKRIKKIVLLKRHINTLKERISQ

SEQ ID NO: 2556084 - protein, 25 aa, Entamoeba dispar
GLMEGLDFSFVLTRARFNELNLDLF

SEQ ID NO: 2556085 - protein, 17 aa, Entamoeba dispar
GLVVAIADKLSLHHAEA

SEQ ID NO: 2556086 - protein, 17 aa, Entamoeba dispar
GMMHKKLRMIAIKEYKH

SEQ ID NO: 2556087 - protein, 18 aa, Entamoeba dispar
GMNALWMTPIFNSNGGSQ

SEQ ID NO: 2556088 - protein, 18 aa, Entamoeba dispar
GMNALWMTPVFNSNGGSK

SEQ ID NO: 2556089 - protein, 18 aa, Entamoeba dispar
GNCYHKLYFTYKTLTEGN

SEQ ID NO: 2556090 - protein, 19 aa, Entamoeba dispar
GNCYLIMTGSFDKLLIMET

SEQ ID NO: 2556091 - protein, 26 aa, Entamoeba dispar
GNEPIQHLIYLYKSLNKGEQAEILLT

SEQ ID NO: 2556092 - protein, 26 aa, Entamoeba dispar
GNHCGVATNAFFPLFVRRVNDEPKPM

SEQ ID NO: 2556093 - protein, 24 aa, Entamoeba dispar
GNLAAWIRQKYPNVVYAAVASSAP

SEQ ID NO: 2556094 - protein, 23 aa, Entamoeba dispar
GNTEVIGDFLFTCALEIYNTSKA

SEQ ID NO: 2556095 - protein, 27 aa, Entamoeba dispar
GPLNRKNELIAGINALLNTVPAEVKEN

SEQ ID NO: 2556096 - protein, 27 aa, Entamoeba dispar
GPYQYNPCVWLDQTTWFNKQNNNDENK

SEQ ID NO: 2556097 - protein, 24 aa, Entamoeba dispar
GQCLQCAPGYFLTENYLCSQCHSS

SEQ ID NO: 2556098 - protein, 18 aa, Entamoeba dispar
GQFILSRYDLRPNECIPS

SEQ ID NO: 2556099 - protein, 17 aa, Entamoeba dispar
GRRSALRRQAFGNFASA

SEQ ID NO: 2556100 - protein, 23 aa, Entamoeba dispar
GSAYYIELRYHCWKVPFIGDWCS

SEQ ID NO: 2556101 - protein, 24 aa, Entamoeba dispar
GSELLRRRAVFLQNSKLIQMINNQ

SEQ ID NO: 2556102 - protein, 18 aa, Entamoeba dispar
GSILYVYAYTKRNGVMQE

SEQ ID NO: 2556103 - protein, 25 aa, Entamoeba dispar
GSKDMELIRVMRLKNKILNQLDTIQ

SEQ ID NO: 2556104 - protein, 34 aa, Entamoeba dispar
GSKQLIELLFVIPKKYPIVWYFDINITEQIKSYY

SEQ ID NO: 2556105 - protein, 17 aa, Entamoeba dispar
GSYSGNLAAWIRQKYPN

SEQ ID NO: 2556106 - protein, 23 aa, Entamoeba dispar
GTDQFITGVPFFEKLEFEVNGKK

SEQ ID NO: 2556107 - protein, 20 aa, Entamoeba dispar
GTEDIVLLDTTPLTLGIETV

SEQ ID NO: 2556108 - protein, 22 aa, Entamoeba dispar
GTISFLSIASLKYGFEQQDHFG

SEQ ID NO: 2556109 - protein, 22 aa, Entamoeba dispar
GTKVLYYAKYESSIPSDLFKKQ

SEQ ID NO: 2556110 - protein, 24 aa, Entamoeba dispar
GTNNQRFVYVHPYPTSFYPEYSKT

SEQ ID NO: 2556111 - protein, 27 aa, Entamoeba dispar
GVNSIYAKAVFWLYKDSDAEVGEMEFT

SEQ ID NO: 2556112 - protein, 24 aa, Entamoeba dispar
GVTGFFVSPIYKIEEKVGILESRL

SEQ ID NO: 2556113 - protein, 26 aa, Entamoeba dispar
GVVAQLDLEYKKFYPWIIIADGNGNQ

SEQ ID NO: 2556114 - protein, 24 aa, Entamoeba dispar
GYDQSLLNYMYYSGQFNSLNITIA

SEQ ID NO: 2556115 - protein, 24 aa, Entamoeba dispar
GYDQSLLNYMYYTGQFNSLNITIA

SEQ ID NO: 2556116 - protein, 24 aa, Entamoeba dispar
GYDQTLLNYLYYKGELIDIGLGVD

SEQ ID NO: 2556117 - protein, 21 aa, Entamoeba dispar
GYFVNIFNNGQIHIGSLSLFE

SEQ ID NO: 2556118 - protein, 24 aa, Entamoeba dispar
GYGDFVIIRGWRSIGSFDSEAVNS

SEQ ID NO: 2556119 - protein, 26 aa, Entamoeba dispar
GYGKTINGVPYWILKNCWGPSWGSNG

SEQ ID NO: 2556120 - protein, 35 aa, Entamoeba dispar
GYTAQTLIFLNNKFLIVLFLLMDDNPYTGKDGKCL

SEQ ID NO: 2556121 - protein, 17 aa, Entamoeba dispar
HCTSPIYYIKGLVEKYT

SEQ ID NO: 2556122 - protein, 26 aa, Entamoeba dispar
HDINNRYILWVFFNQTLNEEYDQLFS

SEQ ID NO: 2556123 - protein, 17 aa, Entamoeba dispar
HDKIDHAILDLDAAAPA

SEQ ID NO: 2556124 - protein, 19 aa, Entamoeba dispar
HDLIHKPGKNIFRCPFEKH

SEQ ID NO: 2556125 - protein, 29 aa, Entamoeba dispar
HDRDYYECSPDFNGFRHCALGTHCNGPDN

SEQ ID NO: 2556126 - protein, 28 aa, Entamoeba dispar
HDTEEELLIRWYQVGAFYPFFRAHAHLD

SEQ ID NO: 2556127 - protein, 22 aa, Entamoeba dispar
HELKRYLTFIKFNPWTYCGDML

SEQ ID NO: 2556128 - protein, 18 aa, Entamoeba dispar
HFNSFRVLPNITKPTFHI

SEQ ID NO: 2556129 - protein, 17 aa, Entamoeba dispar
HFRHNLIMNMKKVGLRD

SEQ ID NO: 2556130 - protein, 20 aa, Entamoeba dispar
HFTGYACGYYSYKWAESIDA

SEQ ID NO: 2556131 - protein, 37 aa, Entamoeba dispar
HGTWRGYYAMLRIYKVYDLFYGGRRLKMSFSSSPGLI

SEQ ID NO: 2556132 - protein, 25 aa, Entamoeba dispar
HHRRHFRIHPWRRFRIWKKHHHRRH

SEQ ID NO: 2556133 - protein, 24 aa, Entamoeba dispar
HIHLPYGQIISNWFKMLFTSIAHP

SEQ ID NO: 2556134 - protein, 25 aa, Entamoeba dispar
HKENMNAWYLDHYLGKAKDYPKSLY

SEQ ID NO: 2556135 - protein, 24 aa, Entamoeba dispar
HKHTYALTRVLFTELNKLTYSNGT

SEQ ID NO: 2556136 - protein, 29 aa, Entamoeba dispar
HKKGQLLCSSFLIRYFDNLIRKSPDFKDW

SEQ ID NO: 2556137 - protein, 18 aa, Entamoeba dispar
HKLCKKIVRRFNHKARRV

SEQ ID NO: 2556138 - protein, 25 aa, Entamoeba dispar
HKMSKDSSWFISAEKGPSGGPRYMG

SEQ ID NO: 2556139 - protein, 28 aa, Entamoeba dispar
HKQSPIKAPINKGQILVKIPKMTDIIAC

SEQ ID NO: 2556140 - protein, 26 aa, Entamoeba dispar
HLNHQRLWIALKDLNPFNNDCTLGYL

SEQ ID NO: 2556141 - protein, 32 aa, Entamoeba dispar
HLRAKLVVFNQKKLLLLRALKRIVSAVPRKFR

SEQ ID NO: 2556142 - protein, 21 aa, Entamoeba dispar
HMERWIQVYNYLVPHMKKEIP

SEQ ID NO: 2556143 - protein, 18 aa, Entamoeba dispar
HMYFSFSSYSQPSSLKQL

SEQ ID NO: 2556144 - protein, 35 aa, Entamoeba dispar
HNTWRPYYAMLRIYKHYFFPWTKNAQPMSFASSPG

SEQ ID NO: 2556145 - protein, 18 aa, Entamoeba dispar
HPYVSHHCYFFKTDTLKE

SEQ ID NO: 2556146 - protein, 21 aa, Entamoeba dispar
HRVHRFINGRWFEKYSRKHQN

SEQ ID NO: 2556147 - protein, 24 aa, Entamoeba dispar
HRVTVFPVALILAPTRELGQQIYE

SEQ ID NO: 2556148 - protein, 23 aa, Entamoeba dispar
HSHYQSFRILPNSENPFYHVILN

SEQ ID NO: 2556149 - protein, 19 aa, Entamoeba dispar
HSMGGLMFYKFLDYVGKEF

SEQ ID NO: 2556150 - protein, 25 aa, Entamoeba dispar
HSRILKMLDYFMYYGHICIVTEMLG

SEQ ID NO: 2556151 - protein, 44 aa, Entamoeba dispar
HVHPGFVWSKFWRYMTPVMKFIYTVILFLFSRTPLQGAQTAIYC

SEQ ID NO: 2556152 - protein, 19 aa, Entamoeba dispar
IAFLKQQIRYAISKRAIKG

SEQ ID NO: 2556153 - protein, 18 aa, Entamoeba dispar
IAIYTKEDLSDQLKFNKI

SEQ ID NO: 2556154 - protein, 40 aa, Entamoeba dispar
ICELKKCRILFSRKYNYLQAHKLQIVLYKINKKLEKIHSE

SEQ ID NO: 2556155 - protein, 18 aa, Entamoeba dispar
ICFYCNFVLSNYSGLWLN

SEQ ID NO: 2556156 - protein, 21 aa, Entamoeba dispar
ICLILYVCILILYSQGMGSNW

SEQ ID NO: 2556157 - protein, 24 aa, Entamoeba dispar
ICYKCDEGLTLRGTHCYNLDSVNV

SEQ ID NO: 2556158 - protein, 20 aa, Entamoeba dispar
IDCGGGYIKLLPKKSIESEE

SEQ ID NO: 2556159 - protein, 21 aa, Entamoeba dispar
IDCGGGYIKLLPKKSIESEEK

SEQ ID NO: 2556160 - protein, 24 aa, Entamoeba dispar
IDDSYLNFVVLPVKTGNITEVFSP

SEQ ID NO: 2556161 - protein, 19 aa, Entamoeba dispar
IDELGLQKKIDLYKNVMVI

SEQ ID NO: 2556162 - protein, 30 aa, Entamoeba dispar
IDFINPKAREWWIELYSFEKYQYSSPYLMI

SEQ ID NO: 2556163 - protein, 24 aa, Entamoeba dispar
IDFYNNIILLKILQLEIKSIISSF

SEQ ID NO: 2556164 - protein, 17 aa, Entamoeba dispar
IDKGLGKASKYIGKGAS

SEQ ID NO: 2556165 - protein, 24 aa, Entamoeba dispar
IDKNGHLLLTDFGLSVVGLCNEQH

SEQ ID NO: 2556166 - protein, 26 aa, Entamoeba dispar
IDNDKKMYLIPRKSLGGIPIDVPEID

SEQ ID NO: 2556167 - protein, 22 aa, Entamoeba dispar
IDNKLYINVYWEDKIIIVDVKT

SEQ ID NO: 2556168 - protein, 26 aa, Entamoeba dispar
IDNNKKMYLNPRYYYGLSFVNTPNEI

SEQ ID NO: 2556169 - protein, 30 aa, Entamoeba dispar
IDNRAKYALYQTILRRKGIQKTIIRDTKKN

SEQ ID NO: 2556170 - protein, 23 aa, Entamoeba dispar
IEESFMFFSLDNTNYSRCGSCVE

SEQ ID NO: 2556171 - protein, 17 aa, Entamoeba dispar
IEHGPFIGMIYSNDQLR

SEQ ID NO: 2556172 - protein, 18 aa, Entamoeba dispar
IEHGPFIGMIYSNDQLRK

SEQ ID NO: 2556173 - protein, 25 aa, Entamoeba dispar
IEIIKRDILLTLGTKKREFIMKKIN

SEQ ID NO: 2556174 - protein, 20 aa, Entamoeba dispar
IEIKQKYIYGSYKKLTNVEH

SEQ ID NO: 2556175 - protein, 24 aa, Entamoeba dispar
IEKGTHIAIYYQVIEGGNNDISFV

SEQ ID NO: 2556176 - protein, 24 aa, Entamoeba dispar
IEKRYHHMMINFIKKGYAVNLYEP

SEQ ID NO: 2556177 - protein, 19 aa, Entamoeba dispar
IELENFPQLIDLNEDNFFR

SEQ ID NO: 2556178 - protein, 18 aa, Entamoeba dispar
IEMKKQIQMLMKKASQAP

SEQ ID NO: 2556179 - protein, 26 aa, Entamoeba dispar
IERKLKVMIKRAVIARLNSAKTARCV

SEQ ID NO: 2556180 - protein, 25 aa, Entamoeba dispar
IEYPGEYLFNIKYYALNSLQIDASI

SEQ ID NO: 2556181 - protein, 19 aa, Entamoeba dispar
IFFIKLTFSVEIKECIAIN

SEQ ID NO: 2556182 - protein, 18 aa, Entamoeba dispar
IFFSFIVEATKENGASKG

SEQ ID NO: 2556183 - protein, 19 aa, Entamoeba dispar
IFIFCILIGYCFSSEIKIL

SEQ ID NO: 2556184 - protein, 21 aa, Entamoeba dispar
IFIVLSFGRIDYWCDSVDNYV

SEQ ID NO: 2556185 - protein, 18 aa, Entamoeba dispar
IFKIYRKKEPYQNIEFSL

SEQ ID NO: 2556186 - protein, 20 aa, Entamoeba dispar
IFLFILYSNAESGPCVNKLV

SEQ ID NO: 2556187 - protein, 17 aa, Entamoeba dispar
IFLIIRSKEIEITNPYI

SEQ ID NO: 2556188 - protein, 20 aa, Entamoeba dispar
IFMMIIIQSFSFPLNNPIIK

SEQ ID NO: 2556189 - protein, 20 aa, Entamoeba dispar
IFSPQIIQSAPATQAPIIIQ

SEQ ID NO: 2556190 - protein, 24 aa, Entamoeba dispar
IGDVVMFEGLYPFYNYKGMDMASL

SEQ ID NO: 2556191 - protein, 19 aa, Entamoeba dispar
IGESFPWTNNSKFMYLRQN

SEQ ID NO: 2556192 - protein, 39 aa, Entamoeba dispar
IGILAYLGYLIYKKELTWPIKESIIYKKVLDLIEQVNAT

SEQ ID NO: 2556193 - protein, 23 aa, Entamoeba dispar
IGKGFALWLTTKPIVSGNNFGGK

SEQ ID NO: 2556194 - protein, 24 aa, Entamoeba dispar
IGKYGMPLHYKGSKFHRVIPGFII

SEQ ID NO: 2556195 - protein, 22 aa, Entamoeba dispar
IHCSEHFLLNHLLEYNKNDSSI

SEQ ID NO: 2556196 - protein, 25 aa, Entamoeba dispar
IHYDANYKPDNKWAFGVDGDISNKN

SEQ ID NO: 2556197 - protein, 17 aa, Entamoeba dispar
IIAIVMAHGPKVTNRVY

SEQ ID NO: 2556198 - protein, 19 aa, Entamoeba dispar
IIDFKIGWIMTPSSSYSTG

SEQ ID NO: 2556199 - protein, 18 aa, Entamoeba dispar
IIDFLKNDKLWNVLDSIQ

SEQ ID NO: 2556200 - protein, 21 aa, Entamoeba dispar
IIFLLFNFSFAQNHVAVSISN

SEQ ID NO: 2556201 - protein, 21 aa, Entamoeba dispar
IIFVVYSRPIKPPSLGDGFIK

SEQ ID NO: 2556202 - protein, 21 aa, Entamoeba dispar
IIFVVYSRPIKPPSLGDGFVK

SEQ ID NO: 2556203 - protein, 22 aa, Entamoeba dispar
IIGGVYFDLYPRKGKRSGAWEE

SEQ ID NO: 2556204 - protein, 18 aa, Entamoeba dispar
IIIDCRYPYEYEGGHVIG

SEQ ID NO: 2556205 - protein, 18 aa, Entamoeba dispar
IIIIVNGKNNFFSVCMSD

SEQ ID NO: 2556206 - protein, 24 aa, Entamoeba dispar
IIIVTLVLLYFIRPKKYNKEKEGE

SEQ ID NO: 2556207 - protein, 23 aa, Entamoeba dispar
IILFIAIFVFQCYHRNCFITLKE

SEQ ID NO: 2556208 - protein, 30 aa, Entamoeba dispar
IILNKSTMLQLIGLLMIVTVSIAVEQCGKV

SEQ ID NO: 2556209 - protein, 18 aa, Entamoeba dispar
IINNELFQLTWKNRWIKV

SEQ ID NO: 2556210 - protein, 26 aa, Entamoeba dispar
IISMNNYIANVWFYFGSRDNPFKANK

SEQ ID NO: 2556211 - protein, 22 aa, Entamoeba dispar
IISVLHLERRVNIIGDILGDAK

SEQ ID NO: 2556212 - protein, 18 aa, Entamoeba dispar
IIYCAVAEIITFNKYSNE

SEQ ID NO: 2556213 - protein, 18 aa, Entamoeba dispar
IKGACIPCTSPCTKCIGV

SEQ ID NO: 2556214 - protein, 17 aa, Entamoeba dispar
IKIWNKQLKQLNGKSLC

SEQ ID NO: 2556215 - protein, 18 aa, Entamoeba dispar
IKKARNIEFYLLEMNRLF

SEQ ID NO: 2556216 - protein, 27 aa, Entamoeba dispar
IKKNKKLIRSIIFKSGAKMAAKMAALA

SEQ ID NO: 2556217 - protein, 24 aa, Entamoeba dispar
IKKQKEEFVLRKASSSLLRTAGVI

SEQ ID NO: 2556218 - protein, 24 aa, Entamoeba dispar
IKLEKQLIELKRYKKAKIACARDA

SEQ ID NO: 2556219 - protein, 22 aa, Entamoeba dispar
IKNDLIFYIKVMREPSIIIVSN

SEQ ID NO: 2556220 - protein, 25 aa, Entamoeba dispar
IKNLSSCFLYLNDDMLLGKKLKPEH

SEQ ID NO: 2556221 - protein, 21 aa, Entamoeba dispar
IKQFGFYVDGVRQAVLNGSSS

SEQ ID NO: 2556222 - protein, 30 aa, Entamoeba dispar
IKQLTKIRKNILIPRFIRSITRYEYIQQQL

SEQ ID NO: 2556223 - protein, 29 aa, Entamoeba dispar
IKQNNYCNDYFFLNEYSKDNFKLYYGFNI

SEQ ID NO: 2556224 - protein, 17 aa, Entamoeba dispar
IKQYKNTHLLVKNIKDT

SEQ ID NO: 2556225 - protein, 19 aa, Entamoeba dispar
IKRLMRIFDIDLSGSIGFF

SEQ ID NO: 2556226 - protein, 24 aa, Entamoeba dispar
IKSSERTIWIFHGARTDGLFVGIG

SEQ ID NO: 2556227 - protein, 19 aa, Entamoeba dispar
IKTILSGKYGKTYSAGIIS

SEQ ID NO: 2556228 - protein, 18 aa, Entamoeba dispar
IKTNERICILCESGYILY

SEQ ID NO: 2556229 - protein, 19 aa, Entamoeba dispar
ILFISLTYAVSCLDNQYVS

SEQ ID NO: 2556230 - protein, 28 aa, Entamoeba dispar
ILFSDKPKRTLLYKALAMHLNGVFKFYD

SEQ ID NO: 2556231 - protein, 18 aa, Entamoeba dispar
ILHYIYDTKMSKSTLMKE

SEQ ID NO: 2556232 - protein, 19 aa, Entamoeba dispar
ILIDDIPTYLFYKMNDNTQ

SEQ ID NO: 2556233 - protein, 17 aa, Entamoeba dispar
ILIFIILCCEGKKINKY

SEQ ID NO: 2556234 - protein, 17 aa, Entamoeba dispar
ILIQISFTYCYAEFCNI

SEQ ID NO: 2556235 - protein, 20 aa, Entamoeba dispar
ILISQIQQLTLRKLVIYIYQ

SEQ ID NO: 2556236 - protein, 19 aa, Entamoeba dispar
ILKAPPQPSFSGTYYKPFD

SEQ ID NO: 2556237 - protein, 18 aa, Entamoeba dispar
ILLLVQSKDVVDTVTFEI

SEQ ID NO: 2556238 - protein, 17 aa, Entamoeba dispar
ILMIVMAVPIHICTDHL

SEQ ID NO: 2556239 - protein, 19 aa, Entamoeba dispar
ILPNRFWIGESTTPKSERK

SEQ ID NO: 2556240 - protein, 17 aa, Entamoeba dispar
ILQISNGLYNLNYTNFE

SEQ ID NO: 2556241 - protein, 18 aa, Entamoeba dispar
ILTSTQYFENYMGMYDQY

SEQ ID NO: 2556242 - protein, 17 aa, Entamoeba dispar
IMIIGMKGVTFSNDKND

SEQ ID NO: 2556243 - protein, 17 aa, Entamoeba dispar
IMSIPNHYFRKGNKYPL

SEQ ID NO: 2556244 - protein, 21 aa, Entamoeba dispar
INCRYCHSLGRILKVSLRNRE

SEQ ID NO: 2556245 - protein, 24 aa, Entamoeba dispar
INDIKRFMLLNKFKTDPLTEGRPG

SEQ ID NO: 2556246 - protein, 25 aa, Entamoeba dispar
INGIKQLNLELLKYALKELDIAAKQ

SEQ ID NO: 2556247 - protein, 19 aa, Entamoeba dispar
INKLGIAMHLILLDSLTTK

SEQ ID NO: 2556248 - protein, 18 aa, Entamoeba dispar
INKYSFPSLQLLHTTQLN

SEQ ID NO: 2556249 - protein, 18 aa, Entamoeba dispar
INLGYKIRLAIYKKENEK

SEQ ID NO: 2556250 - protein, 17 aa, Entamoeba dispar
INPAPSIDFQWFPTEKV

SEQ ID NO: 2556251 - protein, 18 aa, Entamoeba dispar
INRKDLIPFNNSACFVEY

SEQ ID NO: 2556252 - protein, 18 aa, Entamoeba dispar
INSPYLDKEFKLFSHKWT

SEQ ID NO: 2556253 - protein, 27 aa, Entamoeba dispar
INYVGHFLFNLKLLNALKIRHGRFIIT

SEQ ID NO: 2556254 - protein, 19 aa, Entamoeba dispar
IPFNNSACFVEYMKTYWNS

SEQ ID NO: 2556255 - protein, 20 aa, Entamoeba dispar
IPKVQQLLKEFFNGKEPSRG

SEQ ID NO: 2556256 - protein, 24 aa, Entamoeba dispar
IQLEKQLLELKRYKKAKIACARNA

SEQ ID NO: 2556257 - protein, 32 aa, Entamoeba dispar
IRCLSLEHRVIIRYRHIVIKEESSYIPTTSSS

SEQ ID NO: 2556258 - protein, 19 aa, Entamoeba dispar
IRDPLTFNTEQTCRKIGVC

SEQ ID NO: 2556259 - protein, 24 aa, Entamoeba dispar
IRGHLGLLYCTKGSYYDHQIGGDS

SEQ ID NO: 2556260 - protein, 20 aa, Entamoeba dispar
IRRKKTAIVLYCRIEEEIKG

SEQ ID NO: 2556261 - protein, 17 aa, Entamoeba dispar
IRRYVQETLVRAHSGWA

SEQ ID NO: 2556262 - protein, 25 aa, Entamoeba dispar
IRSIVPTWPLKYFSNAFDSLIKRLE

SEQ ID NO: 2556263 - protein, 23 aa, Entamoeba dispar
ISAEFNPNNKFGASLGGKLTKID

SEQ ID NO: 2556264 - protein, 18 aa, Entamoeba dispar
ISDIDVYFYPCVKCGSAA

SEQ ID NO: 2556265 - protein, 18 aa, Entamoeba dispar
ISELYFDQLTLTTSIVHI

SEQ ID NO: 2556266 - protein, 32 aa, Entamoeba dispar
ISFRYDWRTLLAVIRMHLPPIEYFVGDQVKTF

SEQ ID NO: 2556267 - protein, 24 aa, Entamoeba dispar
ISHSMGGLMFYKFLDYVGKEFSDK

SEQ ID NO: 2556268 - protein, 19 aa, Entamoeba dispar
ISIMYHIATYLPWSDNNPQ

SEQ ID NO: 2556269 - protein, 27 aa, Entamoeba dispar
ISIQKVHAILRGLLKLKIIDANMRITE

SEQ ID NO: 2556270 - protein, 26 aa, Entamoeba dispar
ISKDQNMVLILKKLLHHYGPFLVSVK

SEQ ID NO: 2556271 - protein, 32 aa, Entamoeba dispar
ISLPVVIKEHLYFISPIFFGMTVQDSLDLQNK

SEQ ID NO: 2556272 - protein, 24 aa, Entamoeba dispar
ISNTKKMYLLPQSLTDPFNELIPI

SEQ ID NO: 2556273 - protein, 17 aa, Entamoeba dispar
ISPKSASVKGRMKKIAK

SEQ ID NO: 2556274 - protein, 18 aa, Entamoeba dispar
ISSLPSFILQRPGYQKRF

SEQ ID NO: 2556275 - protein, 24 aa, Entamoeba dispar
ISVSNYYGIFYFGSISNPFKANKV

SEQ ID NO: 2556276 - protein, 29 aa, Entamoeba dispar
ITALFILLSHLIYQFIYPNMQRLSDSFLI

SEQ ID NO: 2556277 - protein, 26 aa, Entamoeba dispar
ITFISNGIFPLYSIFDPIYIHDINNR

SEQ ID NO: 2556278 - protein, 25 aa, Entamoeba dispar
ITLPIFAHLFDGIAFDYIMIKTINN

SEQ ID NO: 2556279 - protein, 35 aa, Entamoeba dispar
ITMKMNNLHKFYSMFIFILIIVITNATESINNTKL

SEQ ID NO: 2556280 - protein, 17 aa, Entamoeba dispar
ITPILCYHSISSSICFN

SEQ ID NO: 2556281 - protein, 20 aa, Entamoeba dispar
ITRLRREAERAKRALSVQQQ

SEQ ID NO: 2556282 - protein, 21 aa, Entamoeba dispar
ITSWEPINVNKPIWMRSDVTD

SEQ ID NO: 2556283 - protein, 25 aa, Entamoeba dispar
IVEPNIHVILMNYSIIKNQFIIERD

SEQ ID NO: 2556284 - protein, 27 aa, Entamoeba dispar
IVEPNIHVILMNYSIIKNQFIIERDSV

SEQ ID NO: 2556285 - protein, 17 aa, Entamoeba dispar
IVFLFKYNETTDTFEFY

SEQ ID NO: 2556286 - protein, 17 aa, Entamoeba dispar
IVFTNAFEMWQLTDIHL

SEQ ID NO: 2556287 - protein, 17 aa, Entamoeba dispar
IVICIRAVEINKCMYVS

SEQ ID NO: 2556288 - protein, 18 aa, Entamoeba dispar
IVISALAAPRCTPTTVTN

SEQ ID NO: 2556289 - protein, 27 aa, Entamoeba dispar
IVKDQEHFFILILKNLKKELKRAESQR

SEQ ID NO: 2556290 - protein, 18 aa, Entamoeba dispar
IVKFFSPYCPHCVRFSPI

SEQ ID NO: 2556291 - protein, 18 aa, Entamoeba dispar
IVKKIYKKKQPKKRKVVE

SEQ ID NO: 2556292 - protein, 23 aa, Entamoeba dispar
IVKNSWGTSWGDKGYILMSRNKN

SEQ ID NO: 2556293 - protein, 28 aa, Entamoeba dispar
IVKSIPRKFRARMIRRLRLEKRFNAIRD

SEQ ID NO: 2556294 - protein, 17 aa, Entamoeba dispar
IVLYCRIEEEIKGLKER

SEQ ID NO: 2556295 - protein, 29 aa, Entamoeba dispar
IVQFGDDPLLFRFLQIFKEIRELSGIRPN

SEQ ID NO: 2556296 - protein, 24 aa, Entamoeba dispar
IVRNSWGTTWGMDGYILMSRNKNN

SEQ ID NO: 2556297 - protein, 19 aa, Entamoeba dispar
IVSLSSVRYLIFDEADRML

SEQ ID NO: 2556298 - protein, 17 aa, Entamoeba dispar
IWNIINLKKIRKLVIVS

SEQ ID NO: 2556299 - protein, 25 aa, Entamoeba dispar
IYGSKYYWGNLFGSSYKYAYASSTP

SEQ ID NO: 2556300 - protein, 17 aa, Entamoeba dispar
IYNCFGKCELNFTSASR

SEQ ID NO: 2556301 - protein, 33 aa, Entamoeba dispar
IYSSHSLIILSLIKIRELYFYCIKCSIKIQIIK

SEQ ID NO: 2556302 - protein, 17 aa, Entamoeba dispar
IYTNALTVFEEYNNRSK

SEQ ID NO: 2556303 - protein, 25 aa, Entamoeba dispar
KADNDWYFDYWKSDRMKLIQRDAPN

SEQ ID NO: 2556304 - protein, 30 aa, Entamoeba dispar
KAEKKFIKKEKKLVKLQKRFAKASKSERKS

SEQ ID NO: 2556305 - protein, 48 aa, Entamoeba dispar
KAEKLFKPYEEIKIQLFIESVRRKVYFTTTTLLMNKLNGKDFTKKEAK

SEQ ID NO: 2556306 - protein, 19 aa, Entamoeba dispar
KAERLIRIADAFIQNTNDD

SEQ ID NO: 2556307 - protein, 19 aa, Entamoeba dispar
KAEYRALYRKCTKKIIKIL

SEQ ID NO: 2556308 - protein, 31 aa, Entamoeba dispar
KAKLVKGMKKLLASVPTYVKERIIHTLHIEK

SEQ ID NO: 2556309 - protein, 18 aa, Entamoeba dispar
KALGYYTSPYFGGHNFDK

SEQ ID NO: 2556310 - protein, 24 aa, Entamoeba dispar
KASGSKVLIIYTGGTIGMLKGKNG

SEQ ID NO: 2556311 - protein, 26 aa, Entamoeba dispar
KATKGSWITKVINFVINLFEKVKSYP

SEQ ID NO: 2556312 - protein, 31 aa, Entamoeba dispar
KATTNPIKKFFKWILSLFEKDKSYPVKDTKY

SEQ ID NO: 2556313 - protein, 17 aa, Entamoeba dispar
KAVKKSEAKLIKKNNKK

SEQ ID NO: 2556314 - protein, 40 aa, Entamoeba dispar
KCIYFKQEILNCQLYIEGCVLCNHGYYLSNGNCIQVNLPN

SEQ ID NO: 2556315 - protein, 17 aa, Entamoeba dispar
KCSICEDGYYLINETCI

SEQ ID NO: 2556316 - protein, 38 aa, Entamoeba dispar
KDISKVWKKKWASFMDKKLLKYLSKIKCPEKRREFYEL

SEQ ID NO: 2556317 - protein, 23 aa, Entamoeba dispar
KDKKAIAKLAKKDKKALAKIAKK

SEQ ID NO: 2556318 - protein, 17 aa, Entamoeba dispar
KDNFKLYYGFNITQNNN

SEQ ID NO: 2556319 - protein, 43 aa, Entamoeba dispar
KDPEKLKQMLRLYVRRVFVSGDFYTTLPDYLTFIRGVIDSDDI

SEQ ID NO: 2556320 - protein, 22 aa, Entamoeba dispar
KDPFSVIRRFADLFVPLKCPHA

SEQ ID NO: 2556321 - protein, 25 aa, Entamoeba dispar
KDQLRMHYHDLRLAANPTSRVQLER

SEQ ID NO: 2556322 - protein, 27 aa, Entamoeba dispar
KDVATIFWIAYIPIKVKNKFIELINTL

SEQ ID NO: 2556323 - protein, 28 aa, Entamoeba dispar
KDYLVEGYLNILPLPKEYLNTPISITWE

SEQ ID NO: 2556324 - protein, 26 aa, Entamoeba dispar
KEDLNLLKKLPFIIDSPLRDINLLES

SEQ ID NO: 2556325 - protein, 34 aa, Entamoeba dispar
KEDLSDQLKFNKINALIYSYELQKAKRDIPIQRQ

SEQ ID NO: 2556326 - protein, 21 aa, Entamoeba dispar
KEIIKKRYRKQIKQLYSDMTT

SEQ ID NO: 2556327 - protein, 17 aa, Entamoeba dispar
KEIRRRILQARKNYNSW

SEQ ID NO: 2556328 - protein, 26 aa, Entamoeba dispar
KEKAKGMASKFKKLGKVTLKGASSVF

SEQ ID NO: 2556329 - protein, 25 aa, Entamoeba dispar
KEPPNDFLRIYPKPLFISIHHPNTA

SEQ ID NO: 2556330 - protein, 25 aa, Entamoeba dispar
KESLKVIHFYVWDSAITPSGRKIVI

SEQ ID NO: 2556331 - protein, 24 aa, Entamoeba dispar
KESNEYIFPTYDATFPITMADING

SEQ ID NO: 2556332 - protein, 27 aa, Entamoeba dispar
KEVQRDLKLFPYKIINKNNKPFIEVKY

SEQ ID NO: 2556333 - protein, 18 aa, Entamoeba dispar
KEVYRKYIHLLEKEEKTV

SEQ ID NO: 2556334 - protein, 19 aa, Entamoeba dispar
KFAGKGGKLGKFASAIQKG

SEQ ID NO: 2556335 - protein, 20 aa, Entamoeba dispar
KFCVYLLTSINPGFKYHTYI

SEQ ID NO: 2556336 - protein, 20 aa, Entamoeba dispar
KFDINSFPEQLQKYGLKTAP

SEQ ID NO: 2556337 - protein, 17 aa, Entamoeba dispar
KGATLIIWMKKAPLDPG

SEQ ID NO: 2556338 - protein, 25 aa, Entamoeba dispar
KGGDFPCEYYYSNIPFKPTFNNNQR

SEQ ID NO: 2556339 - protein, 22 aa, Entamoeba dispar
KGGIVELFGWPFEDIGKECEFI

SEQ ID NO: 2556340 - protein, 23 aa, Entamoeba dispar
KGKLCERCFVLAKTIRSAIFERK

SEQ ID NO: 2556341 - protein, 20 aa, Entamoeba dispar
KGKRFEVIGKMIIKKVKGEK

SEQ ID NO: 2556342 - protein, 29 aa, Entamoeba dispar
KGKVCKSLFMKYLRKQPNWNIKLETKVLG

SEQ ID NO: 2556343 - protein, 17 aa, Entamoeba dispar
KGLNMISYDNQARLIRC

SEQ ID NO: 2556344 - protein, 21 aa, Entamoeba dispar
KGVELLRRRAIFNMNSKFVAK

SEQ ID NO: 2556345 - protein, 20 aa, Entamoeba dispar
KHFRRRIPPKFIRKVRHHHC

SEQ ID NO: 2556346 - protein, 18 aa, Entamoeba dispar
KHIPIMIEDKPRLQWRGL

SEQ ID NO: 2556347 - protein, 17 aa, Entamoeba dispar
KIALKKKVLKLQSQDAN

SEQ ID NO: 2556348 - protein, 20 aa, Entamoeba dispar
KIDHAILDLDAAAPADKPQI

SEQ ID NO: 2556349 - protein, 26 aa, Entamoeba dispar
KIDKDELYKYVYSISDPAERTKVIRT

SEQ ID NO: 2556350 - protein, 26 aa, Entamoeba dispar
KIEKFENYFIIKDYKFGILYAKEGQT

SEQ ID NO: 2556351 - protein, 22 aa, Entamoeba dispar
KIENVLDILYDDMKLAVSIADR

SEQ ID NO: 2556352 - protein, 21 aa, Entamoeba dispar
KIERETFFLMKNKTDKNSKRL

SEQ ID NO: 2556353 - protein, 17 aa, Entamoeba dispar
KIMKKLKKKKNLVFSLM

SEQ ID NO: 2556354 - protein, 18 aa, Entamoeba dispar
KIPIGFGALIHDAKYYLP

SEQ ID NO: 2556355 - protein, 25 aa, Entamoeba dispar
KIQIIKECNFILFGNGIQLFDVHSS

SEQ ID NO: 2556356 - protein, 28 aa, Entamoeba dispar
KIRVRQNTLMLRALKRKINRATIAYNAK

SEQ ID NO: 2556357 - protein, 27 aa, Entamoeba dispar
KIVKKMKRFEKKAMRKGIKKGKFNKKA

SEQ ID NO: 2556358 - protein, 19 aa, Entamoeba dispar
KKAIAKRMKVLINRLRVKV

SEQ ID NO: 2556359 - protein, 24 aa, Entamoeba dispar
KKCSCYKVKALKLKLKKLSKKMCD

SEQ ID NO: 2556360 - protein, 20 aa, Entamoeba dispar
KKDKYVYKQPKQKYYALVDN

SEQ ID NO: 2556361 - protein, 23 aa, Entamoeba dispar
KKDYEGWCWPGNSVYIDFINPKA

SEQ ID NO: 2556362 - protein, 24 aa, Entamoeba dispar
KKEAKILIREVAKKVVKKAKRHDA

SEQ ID NO: 2556363 - protein, 17 aa, Entamoeba dispar
KKEIAILKTARALLKQM

SEQ ID NO: 2556364 - protein, 24 aa, Entamoeba dispar
KKGKKIHPFFLLVAKSETDKEIIN

SEQ ID NO: 2556365 - protein, 24 aa, Entamoeba dispar
KKGKKLVVKTLKNAFNSAKKFKNN

SEQ ID NO: 2556366 - protein, 24 aa, Entamoeba dispar
KKGMRLKIRKVIMKIARKKNKDEN

SEQ ID NO: 2556367 - protein, 19 aa, Entamoeba dispar
KKHIGNDIVVLIFKEYRGK

SEQ ID NO: 2556368 - protein, 17 aa, Entamoeba dispar
KKIKTILSGKYGKTYSA

SEQ ID NO: 2556369 - protein, 23 aa, Entamoeba dispar
KKILDFCTIFSRELPHHYCFVIA

SEQ ID NO: 2556370 - protein, 20 aa, Entamoeba dispar
KKILLPLTKINVSAAVSVFE

SEQ ID NO: 2556371 - protein, 33 aa, Entamoeba dispar
KKINKLKTVAKPRTVIKPIRKPINKSVKKPINK

SEQ ID NO: 2556372 - protein, 22 aa, Entamoeba dispar
KKIVKKMFNTPVVKKYVPEKPR

SEQ ID NO: 2556373 - protein, 26 aa, Entamoeba dispar
KKLGRTNPCFIYLQRFGFMKEEDYPE

SEQ ID NO: 2556374 - protein, 23 aa, Entamoeba dispar
KKLKKEFMLKKKVMNLKRCLRTR

SEQ ID NO: 2556375 - protein, 24 aa, Entamoeba dispar
KKNIRRFMSLQFNFWRKHIKNNDN

SEQ ID NO: 2556376 - protein, 22 aa, Entamoeba dispar
KKSMKALKKSLKAKVKKAEKKA

SEQ ID NO: 2556377 - protein, 18 aa, Entamoeba dispar
KKVKNLKKALRKAHGSSK

SEQ ID NO: 2556378 - protein, 32 aa, Entamoeba dispar
KKVQVATIKQIKNLRIMLAARVGVYNKSKIVR

SEQ ID NO: 2556379 - protein, 27 aa, Entamoeba dispar
KKYAFSDFFYINHVKIIDFYKGGIEYD

SEQ ID NO: 2556380 - protein, 19 aa, Entamoeba dispar
KLEQIVHPILRRYGGVHHR

SEQ ID NO: 2556381 - protein, 20 aa, Entamoeba dispar
KLIKRLKELEMAKEEIRRIE

SEQ ID NO: 2556382 - protein, 24 aa, Entamoeba dispar
KLKEFRLRRTIAIILKQMATVLTS

SEQ ID NO: 2556383 - protein, 17 aa, Entamoeba dispar
KLKLLIKEEETKFKKED

SEQ ID NO: 2556384 - protein, 25 aa, Entamoeba dispar
KLQKKKVNSLLKKASKKASPKKIKN

SEQ ID NO: 2556385 - protein, 23 aa, Entamoeba dispar
KLRRQGKIFSPIKPYDLFPELKQ

SEQ ID NO: 2556386 - protein, 17 aa, Entamoeba dispar
KLRSKLVNNKRLIEKLY

SEQ ID NO: 2556387 - protein, 23 aa, Entamoeba dispar
KLTITPFIGISLSTPLFKGYAKL

SEQ ID NO: 2556388 - protein, 29 aa, Entamoeba dispar
KMDDELIYHYGKYTALLQKFIAIVNSQIK

SEQ ID NO: 2556389 - protein, 27 aa, Entamoeba dispar
KMVCRSAIDGLIRKLEHQYLIIVRSRN

SEQ ID NO: 2556390 - protein, 17 aa, Entamoeba dispar
KMYLIPRNEILDIPIDV

SEQ ID NO: 2556391 - protein, 18 aa, Entamoeba dispar
KNDKKAIAKLAKKDKKAI

SEQ ID NO: 2556392 - protein, 28 aa, Entamoeba dispar
KNETTRFNFVILYHPLISFMSRNYQRSK

SEQ ID NO: 2556393 - protein, 25 aa, Entamoeba dispar
KNINAYIMALKLFPNYYFYTRVDDE

SEQ ID NO: 2556394 - protein, 20 aa, Entamoeba dispar
KNKTLGITKFIKGVSKATHK

SEQ ID NO: 2556395 - protein, 24 aa, Entamoeba dispar
KNLIGQFGVGFYSSFLVAENVTVI

SEQ ID NO: 2556396 - protein, 25 aa, Entamoeba dispar
KNNKKADLTLSYKPSDKFSVEGKAG

SEQ ID NO: 2556397 - protein, 24 aa, Entamoeba dispar
KNQDQFPFVVLGNKVDTYEGSPDA

SEQ ID NO: 2556398 - protein, 18 aa, Entamoeba dispar
KNQRLISALTFSSSFYES

SEQ ID NO: 2556399 - protein, 18 aa, Entamoeba dispar
KNRWIKVYNISSLKEIRS

SEQ ID NO: 2556400 - protein, 26 aa, Entamoeba dispar
KNTKSPLKFWLIEDFLSPEGRITLKE

SEQ ID NO: 2556401 - protein, 23 aa, Entamoeba dispar
KNYMSAYYTMRQLSFGKIDLEIH

SEQ ID NO: 2556402 - protein, 26 aa, Entamoeba dispar
KPELQQFYLFLIQTILSREDIIQCLS

SEQ ID NO: 2556403 - protein, 18 aa, Entamoeba dispar
KPGYIPVDFEFCKKSDGC

SEQ ID NO: 2556404 - protein, 29 aa, Entamoeba dispar
KPNSELTNFFYFLPFEINIDNDKKMYLIP

SEQ ID NO: 2556405 - protein, 29 aa, Entamoeba dispar
KPNSELTNFFYFLPFTININNDKKMYLIP

SEQ ID NO: 2556406 - protein, 32 aa, Entamoeba dispar
KQCKCRMVHLEYLLSTIEKKMKRLEAIERTLN

SEQ ID NO: 2556407 - protein, 22 aa, Entamoeba dispar
KQELFSLGKYYKGEFKKLFYGK

SEQ ID NO: 2556408 - protein, 39 aa, Entamoeba dispar
KQIIKRKMKRKKDALFLCLFWFLIEVTFDIDANGILNVT

SEQ ID NO: 2556409 - protein, 17 aa, Entamoeba dispar
KQKGKWYRIHTNGLGNN

SEQ ID NO: 2556410 - protein, 30 aa, Entamoeba dispar
KQLESFFQYNPYQLFRFTSQDLYTFIATLD

SEQ ID NO: 2556411 - protein, 24 aa, Entamoeba dispar
KQQRKLVWKTLKNGMKKTIIELKD

SEQ ID NO: 2556412 - protein, 27 aa, Entamoeba dispar
KQSENKKLFLIEKLHDFIPIENKEIET

SEQ ID NO: 2556413 - protein, 28 aa, Entamoeba dispar
KQYKIKDFVPIDWYINSPYLDKEFKLFS

SEQ ID NO: 2556414 - protein, 20 aa, Entamoeba dispar
KRDKAILRRVTIKKNILKRK

SEQ ID NO: 2556415 - protein, 22 aa, Entamoeba dispar
KRDLVFWAMYFKNQEMWVKQRE

SEQ ID NO: 2556416 - protein, 24 aa, Entamoeba dispar
KRFKQQFIYIINDKYKKPTIVINS

SEQ ID NO: 2556417 - protein, 30 aa, Entamoeba dispar
KRKNKIIQLKEIISLALIKNKELKALSQEF

SEQ ID NO: 2556418 - protein, 23 aa, Entamoeba dispar
KRKPILILSGILASQLMIDADID

SEQ ID NO: 2556419 - protein, 23 aa, Entamoeba dispar
KRPHAVAYNFFRIKEYSSPTEMN

SEQ ID NO: 2556420 - protein, 24 aa, Entamoeba dispar
KRQTLMFSATFPKQIQRLAADFLD

SEQ ID NO: 2556421 - protein, 25 aa, Entamoeba dispar
KRREMPIMVIYLQSNVIDDAIRKVL

SEQ ID NO: 2556422 - protein, 23 aa, Entamoeba dispar
KRRGCPCIHKVPDVPCKCSSIKR

SEQ ID NO: 2556423 - protein, 22 aa, Entamoeba dispar
KSASVKGRMKKIAKAAKKRVKK

SEQ ID NO: 2556424 - protein, 17 aa, Entamoeba dispar
KSKFSVSYPFNCYSHPF

SEQ ID NO: 2556425 - protein, 25 aa, Entamoeba dispar
KSKQYKRMYNLYKLKGEVEGVSETI

SEQ ID NO: 2556426 - protein, 28 aa, Entamoeba dispar
KSNKEACGLILFVGWKGQAKARYLKSYL

SEQ ID NO: 2556427 - protein, 23 aa, Entamoeba dispar
KSPCKMCVELGRRAKESLALNMD

SEQ ID NO: 2556428 - protein, 22 aa, Entamoeba dispar
KSQCWFKALQSCGCCKECMAQK

SEQ ID NO: 2556429 - protein, 29 aa, Entamoeba dispar
KSRIKTLKKYKIQLRKGLKKIIINRIKDA

SEQ ID NO: 2556430 - protein, 17 aa, Entamoeba dispar
KSYFKYKTLKELISLNQ

SEQ ID NO: 2556431 - protein, 17 aa, Entamoeba dispar
KTGKYIIFMRTTNIIEK

SEQ ID NO: 2556432 - protein, 24 aa, Entamoeba dispar
KTIEKKWRAQRKALIMLERARDAK

SEQ ID NO: 2556433 - protein, 24 aa, Entamoeba dispar
KTIYNPCMWPFQEGTLDCDGKPGK

SEQ ID NO: 2556434 - protein, 22 aa, Entamoeba dispar
KTKKWWNLMIDKVTNLFIQFII

SEQ ID NO: 2556435 - protein, 18 aa, Entamoeba dispar
KTMRFRTRLFSSAYNQQT

SEQ ID NO: 2556436 - protein, 28 aa, Entamoeba dispar
KTQKKLIKKLKKAGISKKALRKVQKKMS

SEQ ID NO: 2556437 - protein, 29 aa, Entamoeba dispar
KTTNLCGIGWRIGDYVYPLNMIVYANTCK

SEQ ID NO: 2556438 - protein, 25 aa, Entamoeba dispar
KTTNPTKVPLWTRLQKYENETKINQ

SEQ ID NO: 2556439 - protein, 22 aa, Entamoeba dispar
KTVAYYTNWAQYRFNSIDGWTC

SEQ ID NO: 2556440 - protein, 22 aa, Entamoeba dispar
KVEKPWNEIPPLPSGDSLPQNH

SEQ ID NO: 2556441 - protein, 18 aa, Entamoeba dispar
KVHKYHLKINAKLDKTIA

SEQ ID NO: 2556442 - protein, 20 aa, Entamoeba dispar
KVLGVYEILPKISGLQRNVV

SEQ ID NO: 2556443 - protein, 17 aa, Entamoeba dispar
KVLTPNAEIFRPYAGFI

SEQ ID NO: 2556444 - protein, 18 aa, Entamoeba dispar
KVQIIDVTKLLLQKGYWA

SEQ ID NO: 2556445 - protein, 23 aa, Entamoeba dispar
KVSFSSYPGFVFSFDDFYMTSND

SEQ ID NO: 2556446 - protein, 23 aa, Entamoeba dispar
KVSTLQRWIVRCMSDLLSKIDED

SEQ ID NO: 2556447 - protein, 17 aa, Entamoeba dispar
KVTVIESMFSGCTSFPD

SEQ ID NO: 2556448 - protein, 17 aa, Entamoeba dispar
KVWSRDAVFASIIMMAL

SEQ ID NO: 2556449 - protein, 18 aa, Entamoeba dispar
KYAANLFDPHELKIKKMC

SEQ ID NO: 2556450 - protein, 17 aa, Entamoeba dispar
KYFFNTFSDKECKTLSG

SEQ ID NO: 2556451 - protein, 28 aa, Entamoeba dispar
KYHPDFVSISFYKMFGFPTGVGCLIVKK

SEQ ID NO: 2556452 - protein, 20 aa, Entamoeba dispar
KYLDMGFLPIEYDPKKIYIR

SEQ ID NO: 2556453 - protein, 19 aa, Entamoeba dispar
KYLFSILNNTNSLNQICSI

SEQ ID NO: 2556454 - protein, 23 aa, Entamoeba dispar
KYNGKFIFFSFNKIISEDQVKHM

SEQ ID NO: 2556455 - protein, 19 aa, Entamoeba dispar
KYNGVFPKHVPLLTVNEFL

SEQ ID NO: 2556456 - protein, 19 aa, Entamoeba dispar
KYPVILYTHGGPESPWTNN

SEQ ID NO: 2556457 - protein, 21 aa, Entamoeba dispar
KYRPFVLTRSYYIGSQKYGAM

SEQ ID NO: 2556458 - protein, 31 aa, Entamoeba dispar
KYYDPLAINIPKYFPFPAGYLSIFSQDIIKF

SEQ ID NO: 2556459 - protein, 25 aa, Entamoeba dispar
LAAKVSGIHWWYGTSSRAAEATAGY

SEQ ID NO: 2556460 - protein, 18 aa, Entamoeba dispar
LAFAWRPNPSYGLTNFKD

SEQ ID NO: 2556461 - protein, 17 aa, Entamoeba dispar
LAMFISFSYAEESEAEL

SEQ ID NO: 2556462 - protein, 19 aa, Entamoeba dispar
LARRFDLRHRFDFAIDQEE

SEQ ID NO: 2556463 - protein, 34 aa, Entamoeba dispar
LCANAITFDQWQSKYKFKFSPVERLRRKAIFTSN

SEQ ID NO: 2556464 - protein, 30 aa, Entamoeba dispar
LCFLIILAAILVLPLHPLFENIPEKYYYSS

SEQ ID NO: 2556465 - protein, 18 aa, Entamoeba dispar
LCGILNTLGYSIDIQRPG

SEQ ID NO: 2556466 - protein, 29 aa, Entamoeba dispar
LCGKFGINGFPTLKFFRKGTTEPIEYEGG

SEQ ID NO: 2556467 - protein, 28 aa, Entamoeba dispar
LCIFFFIFLCHLAGIYLYGSGFLIASVQ

SEQ ID NO: 2556468 - protein, 20 aa, Entamoeba dispar
LCIKFRRELPQHYCYFVLDE

SEQ ID NO: 2556469 - protein, 33 aa, Entamoeba dispar
LCLAFVSAMELEGDYQLDNGFDLKEENIDDNND

SEQ ID NO: 2556470 - protein, 24 aa, Entamoeba dispar
LCPDPFTECLTSKTPVPGKLNIKN

SEQ ID NO: 2556471 - protein, 25 aa, Entamoeba dispar
LCPDPFTECLTSKTPVPGKLNLRSS

SEQ ID NO: 2556472 - protein, 19 aa, Entamoeba dispar
LCTSCHTGFIGKDSQCLTC

SEQ ID NO: 2556473 - protein, 21 aa, Entamoeba dispar
LDAETLVKLQKLSLGCHLNGV

SEQ ID NO: 2556474 - protein, 22 aa, Entamoeba dispar
LDDFEDFYDAISPKSASVKGRM

SEQ ID NO: 2556475 - protein, 29 aa, Entamoeba dispar
LDKFRSEYIIHFYGAVFIPNKICMVTEFA

SEQ ID NO: 2556476 - protein, 19 aa, Entamoeba dispar
LDQRIVKCLYKCGMKAHLC

SEQ ID NO: 2556477 - protein, 23 aa, Entamoeba dispar
LDYIHRQQTLPRYFLATSVKVDQ

SEQ ID NO: 2556478 - protein, 24 aa, Entamoeba dispar
LEDLDDFVDMEEDWSLGGIQEKFN

SEQ ID NO: 2556479 - protein, 23 aa, Entamoeba dispar
LEHLKLHLTFYKKELEKLVHSKD

SEQ ID NO: 2556480 - protein, 19 aa, Entamoeba dispar
LEMDKLIYCTAEQALMDYV

SEQ ID NO: 2556481 - protein, 22 aa, Entamoeba dispar
LENKMRLYEAHYLIVYATEFNE

SEQ ID NO: 2556482 - protein, 17 aa, Entamoeba dispar
LERIVKRLAFKNRINRN

SEQ ID NO: 2556483 - protein, 19 aa, Entamoeba dispar
LESLFICEQMPGLMKSHDV

SEQ ID NO: 2556484 - protein, 19 aa, Entamoeba dispar
LEYDTQIAIPYASTLVFEY

SEQ ID NO: 2556485 - protein, 17 aa, Entamoeba dispar
LEYYRLKITAEKIVEAQ

SEQ ID NO: 2556486 - protein, 20 aa, Entamoeba dispar
LFCHLTIQECIPIIKTLNKV

SEQ ID NO: 2556487 - protein, 20 aa, Entamoeba dispar
LFFFLCFAKTLEQKKKLQIT

SEQ ID NO: 2556488 - protein, 21 aa, Entamoeba dispar
LFFFLCFAKTLEQKKKLQITK

SEQ ID NO: 2556489 - protein, 17 aa, Entamoeba dispar
LFFIHSNVNMKSKTITM

SEQ ID NO: 2556490 - protein, 18 aa, Entamoeba dispar
LFFITVFSEDTKQEEQKV

SEQ ID NO: 2556491 - protein, 17 aa, Entamoeba dispar
LFFNCYGSCAEDVMPHS

SEQ ID NO: 2556492 - protein, 17 aa, Entamoeba dispar
LFGIVMSESIVITIIKS

SEQ ID NO: 2556493 - protein, 18 aa, Entamoeba dispar
LFGLLLNCNGGKITKKYK

SEQ ID NO: 2556494 - protein, 18 aa, Entamoeba dispar
LFHYFKCRKQIPRLLHQM

SEQ ID NO: 2556495 - protein, 17 aa, Entamoeba dispar
LFIISSFGFNDLDLMEM

SEQ ID NO: 2556496 - protein, 20 aa, Entamoeba dispar
LFILLCVRGNEINEILNSHY

SEQ ID NO: 2556497 - protein, 19 aa, Entamoeba dispar
LFINIVSSQFLSIKSPIDE

SEQ ID NO: 2556498 - protein, 19 aa, Entamoeba dispar
LFINLVSSQFLSIKSPIDE

SEQ ID NO: 2556499 - protein, 30 aa, Entamoeba dispar
LFIVTTTVSLYYYIYQLSLSTNNYIIRNNN

SEQ ID NO: 2556500 - protein, 19 aa, Entamoeba dispar
LFIVYSLAAQGIDCAYHMK

SEQ ID NO: 2556501 - protein, 19 aa, Entamoeba dispar
LFIYFCLSEECSIDSNNYE

SEQ ID NO: 2556502 - protein, 26 aa, Entamoeba dispar
LFKKTALYLVDALRFDFAFSTEYPPL

SEQ ID NO: 2556503 - protein, 21 aa, Entamoeba dispar
LFLFFFSIKPLTDEQPNQPEE

SEQ ID NO: 2556504 - protein, 19 aa, Entamoeba dispar
LFTFVFSIDTSVFNNLRIY

SEQ ID NO: 2556505 - protein, 18 aa, Entamoeba dispar
LFVFMINAQFTTQENVQE

SEQ ID NO: 2556506 - protein, 20 aa, Entamoeba dispar
LFVITCYSYQYICVQTIEKN

SEQ ID NO: 2556507 - protein, 18 aa, Entamoeba dispar
LGCCLASVWTPFQKKSSC

SEQ ID NO: 2556508 - protein, 20 aa, Entamoeba dispar
LGDNQLYIRYTYPSIEHVRF

SEQ ID NO: 2556509 - protein, 24 aa, Entamoeba dispar
LGDYKADKLIGDKEPREAVPHCAS

SEQ ID NO: 2556510 - protein, 27 aa, Entamoeba dispar
LGGSYSGNLAAWMRQKYPNVVEGAWAS

SEQ ID NO: 2556511 - protein, 29 aa, Entamoeba dispar
LGIVPFGFDVFLDFGVKLDLGLTGTAIVE

SEQ ID NO: 2556512 - protein, 25 aa, Entamoeba dispar
LHYKGSIFHRVIPGFMIQGGDFTRF

SEQ ID NO: 2556513 - protein, 17 aa, Entamoeba dispar
LIAFSNGQMYAMVSTFG

SEQ ID NO: 2556514 - protein, 19 aa, Entamoeba dispar
LIATSFAFYEEDFLDDFED

SEQ ID NO: 2556515 - protein, 18 aa, Entamoeba dispar
LIFSAFATNVEEMKSQLI

SEQ ID NO: 2556516 - protein, 21 aa, Entamoeba dispar
LIGIFFFICLTNGCQCVIYSD

SEQ ID NO: 2556517 - protein, 23 aa, Entamoeba dispar
LIGVFLFLLKMYCNGRQNLIEKD

SEQ ID NO: 2556518 - protein, 19 aa, Entamoeba dispar
LIICINAYPYFGVSAVEKE

SEQ ID NO: 2556519 - protein, 18 aa, Entamoeba dispar
LIISMTNAEGIYSEAKSE

SEQ ID NO: 2556520 - protein, 18 aa, Entamoeba dispar
LIIVTFGKNTMDLCVVQK

SEQ ID NO: 2556521 - protein, 17 aa, Entamoeba dispar
LIIWMKKAPLDPGTNNQ

SEQ ID NO: 2556522 - protein, 30 aa, Entamoeba dispar
LIQKIKEMAPKLLINEFELMLNAIKQNNED

SEQ ID NO: 2556523 - protein, 18 aa, Entamoeba dispar
LITSFIYVYDYLQVLHCS

SEQ ID NO: 2556524 - protein, 17 aa, Entamoeba dispar
LIVAQNPECSSAYCSSC

SEQ ID NO: 2556525 - protein, 20 aa, Entamoeba dispar
LIVLLVTVDARRSNKKSSAR

SEQ ID NO: 2556526 - protein, 22 aa, Entamoeba dispar
LIVVNFSFAINFDQWKIKYNIK

SEQ ID NO: 2556527 - protein, 21 aa, Entamoeba dispar
LIYFFFIISLGQCLRKEEKVE

SEQ ID NO: 2556528 - protein, 20 aa, Entamoeba dispar
LKEVKCLLKKSGVKGSLNVK

SEQ ID NO: 2556529 - protein, 18 aa, Entamoeba dispar
LKEYLEVYVLKDILKNPP

SEQ ID NO: 2556530 - protein, 21 aa, Entamoeba dispar
LKEYTLTLTTGQKYTLEESLS

SEQ ID NO: 2556531 - protein, 19 aa, Entamoeba dispar
LKKFVFFEKLGYFPEHYDF

SEQ ID NO: 2556532 - protein, 17 aa, Entamoeba dispar
LKMILIGDSAVGKSSLM

SEQ ID NO: 2556533 - protein, 20 aa, Entamoeba dispar
LKNGAYLRGAGFRSDDIEFI

SEQ ID NO: 2556534 - protein, 22 aa, Entamoeba dispar
LKNYSLVVSPLFMNASCFHCSV

SEQ ID NO: 2556535 - protein, 27 aa, Entamoeba dispar
LKPGFTLHGWWPNFVSGYPSCCKSPYT

SEQ ID NO: 2556536 - protein, 25 aa, Entamoeba dispar
LKVKNLQRVVSWMKKKLETRKVYIA

SEQ ID NO: 2556537 - protein, 21 aa, Entamoeba dispar
LLCFAFEDNLLFKATQKKQFV

SEQ ID NO: 2556538 - protein, 18 aa, Entamoeba dispar
LLCISTHAAIHILTEKED

SEQ ID NO: 2556539 - protein, 22 aa, Entamoeba dispar
LLCLWKEQLAIDIAKHYGTPYH

SEQ ID NO: 2556540 - protein, 28 aa, Entamoeba dispar
LLEENKLFHITPKIRWTQSTSGHSPILA

SEQ ID NO: 2556541 - protein, 19 aa, Entamoeba dispar
LLFILYSNSERLCIPIAEN

SEQ ID NO: 2556542 - protein, 19 aa, Entamoeba dispar
LLFVITVSGTYNLSIVLVT

SEQ ID NO: 2556543 - protein, 18 aa, Entamoeba dispar
LLGSLWNYYTGMYEYWKF

SEQ ID NO: 2556544 - protein, 28 aa, Entamoeba dispar
LLIFPFVQPKYFITFYDSFIQVLNEGHC

SEQ ID NO: 2556545 - protein, 17 aa, Entamoeba dispar
LLILSRIPLKDRDQYIF

SEQ ID NO: 2556546 - protein, 18 aa, Entamoeba dispar
LLIQTFKKYQNIIVGYVF

SEQ ID NO: 2556547 - protein, 19 aa, Entamoeba dispar
LLLSVIADDEFYHFRHGCI

SEQ ID NO: 2556548 - protein, 23 aa, Entamoeba dispar
LLNDLFNTYIIGKQLFVGVDYSQ

SEQ ID NO: 2556549 - protein, 19 aa, Entamoeba dispar
LLQKGYWASYNSPFSKKIR

SEQ ID NO: 2556550 - protein, 26 aa, Entamoeba dispar
LLRKYKEKYLIKHSLYKNSKDKMNER

SEQ ID NO: 2556551 - protein, 25 aa, Entamoeba dispar
LLSGQRLVRYCPFSVPFTNEVKCIL

SEQ ID NO: 2556552 - protein, 18 aa, Entamoeba dispar
LLSVFTLAEDEFSIEEDF

SEQ ID NO: 2556553 - protein, 18 aa, Entamoeba dispar
LLTIAAPAGPWNIKNIEI

SEQ ID NO: 2556554 - protein, 20 aa, Entamoeba dispar
LLVFIIFFTLNVRSEFQLFG

SEQ ID NO: 2556555 - protein, 24 aa, Entamoeba dispar
LLYMEDFIHIMNLSLEKNLYYFGL

SEQ ID NO: 2556556 - protein, 18 aa, Entamoeba dispar
LMIRRWDTYWDGQFQHLF

SEQ ID NO: 2556557 - protein, 17 aa, Entamoeba dispar
LMYSDPLSNRGIVYISR

SEQ ID NO: 2556558 - protein, 32 aa, Entamoeba dispar
LNDTIHYHASWALSNWFFGRTQDWIQTHSEWV

SEQ ID NO: 2556559 - protein, 26 aa, Entamoeba dispar
LNKEDPMLLHLSYIQAHDNIVGGLYP

SEQ ID NO: 2556560 - protein, 44 aa, Entamoeba dispar
LNKPNSELVYFYYFLPFTLYIDNNKKMYLIPRNEPLGIPIDVPE

SEQ ID NO: 2556561 - protein, 32 aa, Entamoeba dispar
LNKYPTFIQWGYKILGFFIFKSVEDGIQTALH

SEQ ID NO: 2556562 - protein, 18 aa, Entamoeba dispar
LNMISYDNQARLIRCLSL

SEQ ID NO: 2556563 - protein, 17 aa, Entamoeba dispar
LNPRQPYGTSFLEFEAY

SEQ ID NO: 2556564 - protein, 25 aa, Entamoeba dispar
LNTKKNNYITLWDKYQKQINEQKEM

SEQ ID NO: 2556565 - protein, 27 aa, Entamoeba dispar
LNVQNQLLLMPYPSSVSFQWKSSLAIA

SEQ ID NO: 2556566 - protein, 25 aa, Entamoeba dispar
LPDKYYGMFLGYAMDAYGLNPGMLI

SEQ ID NO: 2556567 - protein, 27 aa, Entamoeba dispar
LPKRERFRLIRRINLRYRFSFGTELDT

SEQ ID NO: 2556568 - protein, 19 aa, Entamoeba dispar
LPLNKLVHSLYSFYKSQIL

SEQ ID NO: 2556569 - protein, 26 aa, Entamoeba dispar
LPNSENPFYHVILNPAVTTWGKINPK

SEQ ID NO: 2556570 - protein, 17 aa, Entamoeba dispar
LPTYFQINGKIKSDGIG

SEQ ID NO: 2556571 - protein, 24 aa, Entamoeba dispar
LQDKKKLKPIKKGSTGKRLSVTNA

SEQ ID NO: 2556572 - protein, 17 aa, Entamoeba dispar
LQGKLDKKYILKRQEVA

SEQ ID NO: 2556573 - protein, 22 aa, Entamoeba dispar
LQTIIIIWLLIKRNKKCTKSVS

SEQ ID NO: 2556574 - protein, 23 aa, Entamoeba dispar
LRKEIRIVRRQLFKLEERFSALQ

SEQ ID NO: 2556575 - protein, 19 aa, Entamoeba dispar
LRLKKRLNKMVAIAKECEK

SEQ ID NO: 2556576 - protein, 20 aa, Entamoeba dispar
LRLVRGERTFIYLIGHGGEG

SEQ ID NO: 2556577 - protein, 20 aa, Entamoeba dispar
LRRKAIFTSNFKYVKEFNKN

SEQ ID NO: 2556578 - protein, 17 aa, Entamoeba dispar
LRRVKRILKKKISPKQK

SEQ ID NO: 2556579 - protein, 19 aa, Entamoeba dispar
LRRVTIKKNILKRKKNSAT

SEQ ID NO: 2556580 - protein, 25 aa, Entamoeba dispar
LRSCFHFPGRYYLVQTLACEESGKG

SEQ ID NO: 2556581 - protein, 22 aa, Entamoeba dispar
LRSERKMVRVLIKSKERATKRI

SEQ ID NO: 2556582 - protein, 21 aa, Entamoeba dispar
LRSYNIFLRHRFGYSERLLEE

SEQ ID NO: 2556583 - protein, 22 aa, Entamoeba dispar
LRTTLHITLKESLIGFTKEIKH

SEQ ID NO: 2556584 - protein, 20 aa, Entamoeba dispar
LSEQQILDCAILANGCNGGT

SEQ ID NO: 2556585 - protein, 21 aa, Entamoeba dispar
LSFGKLFIYSSVTLTSQYLMI

SEQ ID NO: 2556586 - protein, 26 aa, Entamoeba dispar
LSIFLITIYLSLLLYHPNEIPFKYEI

SEQ ID NO: 2556587 - protein, 17 aa, Entamoeba dispar
LSKFRIHNFQKQHAELL

SEQ ID NO: 2556588 - protein, 18 aa, Entamoeba dispar
LSKKLTRKFGKKKAMKIV

SEQ ID NO: 2556589 - protein, 19 aa, Entamoeba dispar
LSLFITLSPSLIIPSSTLD

SEQ ID NO: 2556590 - protein, 20 aa, Entamoeba dispar
LSLFLTFSQALECNETNCST

SEQ ID NO: 2556591 - protein, 23 aa, Entamoeba dispar
LSPKFYMRRNKIYNMIKKEEEKL

SEQ ID NO: 2556592 - protein, 34 aa, Entamoeba dispar
LSQLVPYFNSVAAFFRPKIAIGLLPQGKKMKSLE

SEQ ID NO: 2556593 - protein, 25 aa, Entamoeba dispar
LSRNLPRYYIYPGGYLSIFSQDIIK

SEQ ID NO: 2556594 - protein, 25 aa, Entamoeba dispar
LSRYWLNYRHTNSGVLIYNTLKRLG

SEQ ID NO: 2556595 - protein, 24 aa, Entamoeba dispar
LSSKLDYKADKFTGSLDLKHTKDN

SEQ ID NO: 2556596 - protein, 24 aa, Entamoeba dispar
LSVMMLLILFMCLSIGMSSSNNPK

SEQ ID NO: 2556597 - protein, 21 aa, Entamoeba dispar
LSWQRILSSMYYAPSIQKLLQ

SEQ ID NO: 2556598 - protein, 17 aa, Entamoeba dispar
LTDKYLLDKSVKGSLKN

SEQ ID NO: 2556599 - protein, 20 aa, Entamoeba dispar
LTITLSLSASIDYVFTDVTD

SEQ ID NO: 2556600 - protein, 18 aa, Entamoeba dispar
LTRIDKLKKLQKRMGLCP

SEQ ID NO: 2556601 - protein, 19 aa, Entamoeba dispar
LTRVNQYVPKGIWYDWFTN

SEQ ID NO: 2556602 - protein, 18 aa, Entamoeba dispar
LTYEEILIVLSYYIAAEY

SEQ ID NO: 2556603 - protein, 18 aa, Entamoeba dispar
LVEQKQILLLAQAFNICL

SEQ ID NO: 2556604 - protein, 20 aa, Entamoeba dispar
LVFLSLLAVSFAAIVGMDVG

SEQ ID NO: 2556605 - protein, 24 aa, Entamoeba dispar
LVGKLSVPQQGRLIRYLNLEHRID

SEQ ID NO: 2556606 - protein, 19 aa, Entamoeba dispar
LVLKTFYPNLFEKDNFFDV

SEQ ID NO: 2556607 - protein, 19 aa, Entamoeba dispar
LVLQVLFGNDRKMLSTKKM

SEQ ID NO: 2556608 - protein, 21 aa, Entamoeba dispar
LVMCFVYVIGNVYQQENDVKD

SEQ ID NO: 2556609 - protein, 17 aa, Entamoeba dispar
LVQDCQCKLLFDCIPIG

SEQ ID NO: 2556610 - protein, 27 aa, Entamoeba dispar
LVSLTPILPCFICDGGLLILSRIPLKD

SEQ ID NO: 2556611 - protein, 23 aa, Entamoeba dispar
LYDECLLCNGGNKRLFNNSCQDF

SEQ ID NO: 2556612 - protein, 19 aa, Entamoeba dispar
LYFTEKKIVSLSSVRYLIF

SEQ ID NO: 2556613 - protein, 20 aa, Entamoeba dispar
LYIKLMRHKITATFVYSVIK

SEQ ID NO: 2556614 - protein, 28 aa, Entamoeba dispar
LYPFYNYKGMDMASLFDLKIFVETDDDV

SEQ ID NO: 2556615 - protein, 29 aa, Entamoeba dispar
LYSLKVIQTFMFRYLAPLQFGIIPINIPT

SEQ ID NO: 2556616 - protein, 25 aa, Entamoeba dispar
MDASRSSFLLYHGGIYNDKKCRSDK

SEQ ID NO: 2556617 - protein, 26 aa, Entamoeba dispar
MDPTKNVFVKFFAPWCGHCKALAPKY

SEQ ID NO: 2556618 - protein, 18 aa, Entamoeba dispar
MDVILYNSSIFHIKSSSS

SEQ ID NO: 2556619 - protein, 17 aa, Entamoeba dispar
MEGYYLKDSKCNVCTID

SEQ ID NO: 2556620 - protein, 20 aa, Entamoeba dispar
MFDMVSWATTYLLGGNTSLG

SEQ ID NO: 2556621 - protein, 18 aa, Entamoeba dispar
MGIPLFYDGSKQLIELLF

SEQ ID NO: 2556622 - protein, 25 aa, Entamoeba dispar
MGVNYLGHFLLTQKLLNALEKCNGR

SEQ ID NO: 2556623 - protein, 17 aa, Entamoeba dispar
MIGLGGNYKSNNGKWDI

SEQ ID NO: 2556624 - protein, 20 aa, Entamoeba dispar
MKAILLTLFVLICFVSANEL

SEQ ID NO: 2556625 - protein, 30 aa, Entamoeba dispar
MKHQVIKKLYSIIKKMIRRSVGKNSIMRKA

SEQ ID NO: 2556626 - protein, 32 aa, Entamoeba dispar
MKKERINKILNELYKKIAIKKTLLDMSKESQK

SEQ ID NO: 2556627 - protein, 26 aa, Entamoeba dispar
MKLKNLLYVSYQLRTPLLFEPIVKFV

SEQ ID NO: 2556628 - protein, 19 aa, Entamoeba dispar
MLAVCFATVKTPTTTPVVQ

SEQ ID NO: 2556629 - protein, 26 aa, Entamoeba dispar
MLDFNHQLPIFWYFSAKHNQTAHDII

SEQ ID NO: 2556630 - protein, 18 aa, Entamoeba dispar
MLNDHDFWKVFKAAGVVA

SEQ ID NO: 2556631 - protein, 18 aa, Entamoeba dispar
MLTDHDFWKVFKAAGAVA

SEQ ID NO: 2556632 - protein, 27 aa, Entamoeba dispar
MLYNTKFETPLIIWRRKEPLLETTNNQ

SEQ ID NO: 2556633 - protein, 29 aa, Entamoeba dispar
MNACTLTIHWQFDVTLRGLRKVLVPNSQI

SEQ ID NO: 2556634 - protein, 17 aa, Entamoeba dispar
MNNYKKGWKYDQKLRML

SEQ ID NO: 2556635 - protein, 23 aa, Entamoeba dispar
MPNIEIVLDVTLKDLYKGKTIEV

SEQ ID NO: 2556636 - protein, 27 aa, Entamoeba dispar
MPSYHIEHLLREIRRKKTAIVLYCRIE

SEQ ID NO: 2556637 - protein, 28 aa, Entamoeba dispar
MRQRSQLFEPSFINTIPPELTTSPMIGN

SEQ ID NO: 2556638 - protein, 24 aa, Entamoeba dispar
MSLKAKFNKQVKLQLARKAKKMAK

SEQ ID NO: 2556639 - protein, 18 aa, Entamoeba dispar
MTAIKMLTDHDFWKVFKA

SEQ ID NO: 2556640 - protein, 23 aa, Entamoeba dispar
MTKKNIMKFFKRKQYQSKKISKK

SEQ ID NO: 2556641 - protein, 20 aa, Entamoeba dispar
MTPQIIQQPAAPAQPQIIQV

SEQ ID NO: 2556642 - protein, 18 aa, Entamoeba dispar
MVLFVANAYEVDAADVEL

SEQ ID NO: 2556643 - protein, 24 aa, Entamoeba dispar
MVNMTFRIMPTILMFRGNDHKPIE

SEQ ID NO: 2556644 - protein, 31 aa, Entamoeba dispar
MVRKNPLLKHLRLNFLLEYFPNIETIESSID

SEQ ID NO: 2556645 - protein, 28 aa, Entamoeba dispar
MYMEELFDTWKRFPKILETKMWVLPDAA

SEQ ID NO: 2556646 - protein, 27 aa, Entamoeba dispar
NAAGNVRKKLYDGLKSQCWFKALQSCG

SEQ ID NO: 2556647 - protein, 25 aa, Entamoeba dispar
NAEKQIINILKIDDLMDIDLSKTMT

SEQ ID NO: 2556648 - protein, 27 aa, Entamoeba dispar
NAIIINAGYIILGLGRSNNLRLPNPDG

SEQ ID NO: 2556649 - protein, 17 aa, Entamoeba dispar
NANKRLWRDMRISEMEA

SEQ ID NO: 2556650 - protein, 31 aa, Entamoeba dispar
NATQLRLNFLQKELVLLKKGLHENAQDAIKF

SEQ ID NO: 2556651 - protein, 19 aa, Entamoeba dispar
NCLSFMTFNFNHTITYPLQ

SEQ ID NO: 2556652 - protein, 21 aa, Entamoeba dispar
NDAFLIHIPTRLYIASTKESS

SEQ ID NO: 2556653 - protein, 21 aa, Entamoeba dispar
NDFKYVPLSKKFRNMTDSERA

SEQ ID NO: 2556654 - protein, 22 aa, Entamoeba dispar
NDGFYYFKEIYASSLLVNELNK

SEQ ID NO: 2556655 - protein, 24 aa, Entamoeba dispar
NDIDKEIFSVLSPEFRKLLQEMSD

SEQ ID NO: 2556656 - protein, 25 aa, Entamoeba dispar
NDKLLSWQRILSGLYYERTAKEFVE

SEQ ID NO: 2556657 - protein, 26 aa, Entamoeba dispar
NDLNYKIAIPLLDSIINGLKLAVTKD

SEQ ID NO: 2556658 - protein, 31 aa, Entamoeba dispar
NDNEVQFYRFGGRPYVPYTPLAGSGGDNKEE

SEQ ID NO: 2556659 - protein, 25 aa, Entamoeba dispar
NDNIKQLIFKFKRLFKGEFKETDLI

SEQ ID NO: 2556660 - protein, 32 aa, Entamoeba dispar
NDNYKSAYGKFFLGWYQQLLLDHANNVLSAAK

SEQ ID NO: 2556661 - protein, 23 aa, Entamoeba dispar
NDPNAPLFVLLGGEGPASPKVLQ

SEQ ID NO: 2556662 - protein, 17 aa, Entamoeba dispar
NDVLGISGKNHKVCKMR

SEQ ID NO: 2556663 - protein, 27 aa, Entamoeba dispar
NEAERKMWYSSVFTLLYSQNPTLGTLV

SEQ ID NO: 2556664 - protein, 25 aa, Entamoeba dispar
NEETILFLQLLLEKEQLEFPIPTTY

SEQ ID NO: 2556665 - protein, 18 aa, Entamoeba dispar
NEFNGIVFLFKYNETTDT

SEQ ID NO: 2556666 - protein, 24 aa, Entamoeba dispar
NEKPFNLFEPIKMVKIGFYNVEKE

SEQ ID NO: 2556667 - protein, 23 aa, Entamoeba dispar
NEKTLYYGSRWGVIRQLDAASMM

SEQ ID NO: 2556668 - protein, 25 aa, Entamoeba dispar
NEMRKVQRRLSFLSKAQIKARKDYD

SEQ ID NO: 2556669 - protein, 20 aa, Entamoeba dispar
NERICILCESGYILYEGNCL

SEQ ID NO: 2556670 - protein, 27 aa, Entamoeba dispar
NERLCLESFMKIQLIDLSHDLPASGNQ

SEQ ID NO: 2556671 - protein, 25 aa, Entamoeba dispar
NETIVSITFPFPLKISHHYTVLFQQ

SEQ ID NO: 2556672 - protein, 19 aa, Entamoeba dispar
NEYLLTQLEYLFKELGNKF

SEQ ID NO: 2556673 - protein, 20 aa, Entamoeba dispar
NFHYRWNPQVIAAQGYIVFA

SEQ ID NO: 2556674 - protein, 22 aa, Entamoeba dispar
NFLERVLKPYFTERTKFVYYIK

SEQ ID NO: 2556675 - protein, 17 aa, Entamoeba dispar
NFNCYPPLDTVTSSLDY

SEQ ID NO: 2556676 - protein, 17 aa, Entamoeba dispar
NFNFLERVLKPYFTERT

SEQ ID NO: 2556677 - protein, 18 aa, Entamoeba dispar
NFNGQYKYKKLDANFDLN

SEQ ID NO: 2556678 - protein, 17 aa, Entamoeba dispar
NFVINLFEKVKSYPVKD

SEQ ID NO: 2556679 - protein, 29 aa, Entamoeba dispar
NFVLSNYSGLWLNYYPHKNYLFNTPNIRF

SEQ ID NO: 2556680 - protein, 19 aa, Entamoeba dispar
NFWGPKISFSKSPYYTMGF

SEQ ID NO: 2556681 - protein, 24 aa, Entamoeba dispar
NGCSSCMLGYYLKDGKCQIPPNPL

SEQ ID NO: 2556682 - protein, 23 aa, Entamoeba dispar
NGETSFIVQTFKNNIYPTYLCYH

SEQ ID NO: 2556683 - protein, 19 aa, Entamoeba dispar
NGIFNAGYPDFAYPNMFIT

SEQ ID NO: 2556684 - protein, 25 aa, Entamoeba dispar
NGKKFIAKVLLNCAGVFASQVSEML

SEQ ID NO: 2556685 - protein, 24 aa, Entamoeba dispar
NGKKFITKVLLNCAGVFASQVSEM

SEQ ID NO: 2556686 - protein, 23 aa, Entamoeba dispar
NGLEYSGGINYNIGKNSQFSVNA

SEQ ID NO: 2556687 - protein, 25 aa, Entamoeba dispar
NGQGLWNIIQIFDWTVYEEPNEEPP

SEQ ID NO: 2556688 - protein, 25 aa, Entamoeba dispar
NGQMSAWYILSVMGFYSVTPGTDQF

SEQ ID NO: 2556689 - protein, 22 aa, Entamoeba dispar
NGYFVNIFNNGQIHIGSLSLFE

SEQ ID NO: 2556690 - protein, 19 aa, Entamoeba dispar
NHCIECEYGYYLNLNTKHA

SEQ ID NO: 2556691 - protein, 22 aa, Entamoeba dispar
NHDYWLSSNWQYPPQNQWMLDF

SEQ ID NO: 2556692 - protein, 23 aa, Entamoeba dispar
NHFEKFLELLGKKIKLQGYNGFA

SEQ ID NO: 2556693 - protein, 24 aa, Entamoeba dispar
NIEFYLLEMNRLFKRKSKADHLKI

SEQ ID NO: 2556694 - protein, 17 aa, Entamoeba dispar
NIEGPIPPLYSSSLRHL

SEQ ID NO: 2556695 - protein, 18 aa, Entamoeba dispar
NIEMILIKTLGKGGDFPC

SEQ ID NO: 2556696 - protein, 33 aa, Entamoeba dispar
NIKNIEISKFYKYLDWINLMTYDLHGSWDSVTG

SEQ ID NO: 2556697 - protein, 17 aa, Entamoeba dispar
NIMLKEIPELRYIRGCY

SEQ ID NO: 2556698 - protein, 23 aa, Entamoeba dispar
NINKKVYVIIPPRSVAISGTTIN

SEQ ID NO: 2556699 - protein, 23 aa, Entamoeba dispar
NIYVKAMNSYLATLKPIVKEKKI

SEQ ID NO: 2556700 - protein, 17 aa, Entamoeba dispar
NKARVSGKIKLFIVSSY

SEQ ID NO: 2556701 - protein, 23 aa, Entamoeba dispar
NKDKTLLIQYPIGNSRTSYSIPP

SEQ ID NO: 2556702 - protein, 23 aa, Entamoeba dispar
NKENIYCLLPNYLFEQKELGKCT

SEQ ID NO: 2556703 - protein, 19 aa, Entamoeba dispar
NKIVLTRYTDEGCTIISNT

SEQ ID NO: 2556704 - protein, 20 aa, Entamoeba dispar
NKIYKQIAELKAYKKKQIQC

SEQ ID NO: 2556705 - protein, 17 aa, Entamoeba dispar
NKNVIVKFFSPYCPHCV

SEQ ID NO: 2556706 - protein, 24 aa, Entamoeba dispar
NKQYYFKEVYLLEGGFNELYSINP

SEQ ID NO: 2556707 - protein, 23 aa, Entamoeba dispar
NKRDLLIYGAYFSDKRSWIGQRQ

SEQ ID NO: 2556708 - protein, 24 aa, Entamoeba dispar
NKRDLLIYGVYFSDKRKWNKQQQT

SEQ ID NO: 2556709 - protein, 24 aa, Entamoeba dispar
NKRIDIMQILLKYGADIDMTFKGK

SEQ ID NO: 2556710 - protein, 17 aa, Entamoeba dispar
NKRLWRDMRISEMEAKM

SEQ ID NO: 2556711 - protein, 22 aa, Entamoeba dispar
NKTYFDIIDYTFKKLGISVTLH

SEQ ID NO: 2556712 - protein, 23 aa, Entamoeba dispar
NLALLKLLLQVTNVTSKASGEFY

SEQ ID NO: 2556713 - protein, 27 aa, Entamoeba dispar
NLCDAYAFLLALLSKSCSIKVSKPRHK

SEQ ID NO: 2556714 - protein, 20 aa, Entamoeba dispar
NLFIQFIIKYQIIKEIYCSL

SEQ ID NO: 2556715 - protein, 31 aa, Entamoeba dispar
NLNENNEITLFYYFLPFTTNIDNNKKMYLNP

SEQ ID NO: 2556716 - protein, 17 aa, Entamoeba dispar
NLSMLKLKKQRVKLSEE

SEQ ID NO: 2556717 - protein, 21 aa, Entamoeba dispar
NLSMVFMYPTAIMLNQDFSYF

SEQ ID NO: 2556718 - protein, 24 aa, Entamoeba dispar
NMEEYALFLPKDKTREKGQWMIPK

SEQ ID NO: 2556719 - protein, 30 aa, Entamoeba dispar
NMRSKEELGFFLRWLKFTRFFESEDTLGSF

SEQ ID NO: 2556720 - protein, 23 aa, Entamoeba dispar
NNCAVSYDYLLLVETWPGQFCHS

SEQ ID NO: 2556721 - protein, 24 aa, Entamoeba dispar
NNCAVSYDYLLLVETWPGQFCHSK

SEQ ID NO: 2556722 - protein, 24 aa, Entamoeba dispar
NNCKVTWDFVLLVTTWPGEFCKTK

SEQ ID NO: 2556723 - protein, 19 aa, Entamoeba dispar
NNDGSLLYYLSMSAPKDES

SEQ ID NO: 2556724 - protein, 24 aa, Entamoeba dispar
NNDYSDFLDDAPTPKNSKKTQKPK

SEQ ID NO: 2556725 - protein, 21 aa, Entamoeba dispar
NNELLLPFFEGVVEKNVFNLR

SEQ ID NO: 2556726 - protein, 22 aa, Entamoeba dispar
NNERQIFTTFTTGLCVRNGELS

SEQ ID NO: 2556727 - protein, 19 aa, Entamoeba dispar
NNFVITFYSKVDDILINDL

SEQ ID NO: 2556728 - protein, 21 aa, Entamoeba dispar
NNIIIELRKLIRKSIERITVI

SEQ ID NO: 2556729 - protein, 23 aa, Entamoeba dispar
NNKLFKQFLTFKSVLSWQRILSS

SEQ ID NO: 2556730 - protein, 17 aa, Entamoeba dispar
NNLVGHPVIVLGGSYSG

SEQ ID NO: 2556731 - protein, 25 aa, Entamoeba dispar
NNMYHPALMIYQFLSELGFANAQLN

SEQ ID NO: 2556732 - protein, 19 aa, Entamoeba dispar
NNQCAIASVAYFPNGAHDA

SEQ ID NO: 2556733 - protein, 22 aa, Entamoeba dispar
NNQFKLWKKQFQEKKLEFEKRF

SEQ ID NO: 2556734 - protein, 23 aa, Entamoeba dispar
NNQNDFDIHYFVNKEFLDTNDPN

SEQ ID NO: 2556735 - protein, 24 aa, Entamoeba dispar
NNQRFVYVHPYKTEWYLEYSKTNK

SEQ ID NO: 2556736 - protein, 20 aa, Entamoeba dispar
NNRKRSLSNILNKGKKKSNS

SEQ ID NO: 2556737 - protein, 18 aa, Entamoeba dispar
NPQLMTIPKGKALEFEVF

SEQ ID NO: 2556738 - protein, 22 aa, Entamoeba dispar
NPSMYYKFITLNQPLEVLNFRF

SEQ ID NO: 2556739 - protein, 26 aa, Entamoeba dispar
NPSTELLIRWYQAGALQPFFRQHSSQ

SEQ ID NO: 2556740 - protein, 25 aa, Entamoeba dispar
NQCSLCMDGFLLQNGQCVYGRSVIK

SEQ ID NO: 2556741 - protein, 23 aa, Entamoeba dispar
NQFSLSVLSINTLLYGPKLNGDD

SEQ ID NO: 2556742 - protein, 21 aa, Entamoeba dispar
NQIEHKFLMMKGVESIIAQAN

SEQ ID NO: 2556743 - protein, 19 aa, Entamoeba dispar
NQIFRLKHRMFRVEEKIRR

SEQ ID NO: 2556744 - protein, 19 aa, Entamoeba dispar
NQRFVYIYDYPFTDSRHKP

SEQ ID NO: 2556745 - protein, 27 aa, Entamoeba dispar
NQSQLYLHRPFEISYLLKMMSQSQIHV

SEQ ID NO: 2556746 - protein, 23 aa, Entamoeba dispar
NRSIWVQNIGAFLSFFNTAQKCL

SEQ ID NO: 2556747 - protein, 28 aa, Entamoeba dispar
NSCQVHFVQYFLPSPQISFIPISSTPSL

SEQ ID NO: 2556748 - protein, 20 aa, Entamoeba dispar
NSLLSWQRILVSMYFGQTPK

SEQ ID NO: 2556749 - protein, 30 aa, Entamoeba dispar
NSNENQIITLLYFSGLIHLFSERPIKVVIV

SEQ ID NO: 2556750 - protein, 28 aa, Entamoeba dispar
NSNGKYWIIRNSWGTAWGDAGYFLLARD

SEQ ID NO: 2556751 - protein, 19 aa, Entamoeba dispar
NSQWIFQFAADQFAPFLSQ

SEQ ID NO: 2556752 - protein, 24 aa, Entamoeba dispar
NSVKYNIKLIIDPIMREAQKVGKM

SEQ ID NO: 2556753 - protein, 17 aa, Entamoeba dispar
NSVTVSFIKVTQVSGKC

SEQ ID NO: 2556754 - protein, 21 aa, Entamoeba dispar
NTADLLSFAFEKWDEMTTTEE

SEQ ID NO: 2556755 - protein, 27 aa, Entamoeba dispar
NTEGDSVFRALLYIPAEGPNPFAPKDP

SEQ ID NO: 2556756 - protein, 23 aa, Entamoeba dispar
NTGFIQPTHTFGILLHAAKALGE

SEQ ID NO: 2556757 - protein, 20 aa, Entamoeba dispar
NTIFKMCRFYNISFNKLQEI

SEQ ID NO: 2556758 - protein, 23 aa, Entamoeba dispar
NTMKFIMENALFKFEMPAPLPEE

SEQ ID NO: 2556759 - protein, 24 aa, Entamoeba dispar
NTNNSQFFIEMIPTYWLDGRHVVF

SEQ ID NO: 2556760 - protein, 30 aa, Entamoeba dispar
NTPEPKSFELPEPKPFKLPEHIETTKLTIK

SEQ ID NO: 2556761 - protein, 32 aa, Entamoeba dispar
NTPVVKKYVPEKPRYYRPTKFVTPVESNAGGF

SEQ ID NO: 2556762 - protein, 33 aa, Entamoeba dispar
NTWRPYYAMMRIYKKYIFPFTKNALPMTFASSP

SEQ ID NO: 2556763 - protein, 30 aa, Entamoeba dispar
NVDLNEPWIFQWKNKYLFRGLRLTHQPSPW

SEQ ID NO: 2556764 - protein, 26 aa, Entamoeba dispar
NVFFDTPTALIYIPQRGRLIRFVGGF

SEQ ID NO: 2556765 - protein, 23 aa, Entamoeba dispar
NVKELQRVFNRIIRIKNAMRTNT

SEQ ID NO: 2556766 - protein, 18 aa, Entamoeba dispar
NVKNFFKGKLKLKRRIKF

SEQ ID NO: 2556767 - protein, 17 aa, Entamoeba dispar
NVNTHIELLPTAGQLLI

SEQ ID NO: 2556768 - protein, 18 aa, Entamoeba dispar
NWPVSIFAKCFHDLIKKF

SEQ ID NO: 2556769 - protein, 34 aa, Entamoeba dispar
NYHDVTLPITYYQNFIKPFPHYHYCILRTDIHTG

SEQ ID NO: 2556770 - protein, 29 aa, Entamoeba dispar
NYIKEWIAVSTPWKGAFLSIQALLSGLDW

SEQ ID NO: 2556771 - protein, 28 aa, Entamoeba dispar
NYKSEYGKFFLGWYHQLLLDHTNKVLSI

SEQ ID NO: 2556772 - protein, 25 aa, Entamoeba dispar
NYSSVIISVYNYYGSFYLGSTSNTF

SEQ ID NO: 2556773 - protein, 19 aa, Entamoeba dispar
NYSYYFNKNFTYSDLAFNC

SEQ ID NO: 2556774 - protein, 25 aa, Entamoeba dispar
NYVQKYVPIFSLPQEWLWCESWCNQ

SEQ ID NO: 2556775 - protein, 27 aa, Entamoeba dispar
NYYTGMYEYWKFTGVKIKWIPNVKTAV

SEQ ID NO: 2556776 - protein, 27 aa, Entamoeba dispar
PAEERLAILRRLKIEYRFNSVKEMIQD

SEQ ID NO: 2556777 - protein, 24 aa, Entamoeba dispar
PAGVSMGYTFPLSKKFFGIPEHAT

SEQ ID NO: 2556778 - protein, 20 aa, Entamoeba dispar
PAKYFVLYDLEDGSYKADVT

SEQ ID NO: 2556779 - protein, 18 aa, Entamoeba dispar
PANQRLLRKRLSINYRRL

SEQ ID NO: 2556780 - protein, 25 aa, Entamoeba dispar
PDSSQLMIYSLNKKILLPLTKINVS

SEQ ID NO: 2556781 - protein, 27 aa, Entamoeba dispar
PEQPVPHPPVIPLTPELQLNAPISNGP

SEQ ID NO: 2556782 - protein, 28 aa, Entamoeba dispar
PESQWMLDIMIDLFKPWLSDSSLETFRK

SEQ ID NO: 2556783 - protein, 21 aa, Entamoeba dispar
PEVKIWKKERCPRNSDELASA

SEQ ID NO: 2556784 - protein, 20 aa, Entamoeba dispar
PEWNLNIIPKVYLVSEKDGE

SEQ ID NO: 2556785 - protein, 17 aa, Entamoeba dispar
PFAGWTKPTEKAKDVPV

SEQ ID NO: 2556786 - protein, 29 aa, Entamoeba dispar
PFSKRLNNEFYYLLCKDIFNVDKQRLDRR

SEQ ID NO: 2556787 - protein, 23 aa, Entamoeba dispar
PGANIYYPDFPSTKGIFALAPDN

SEQ ID NO: 2556788 - protein, 30 aa, Entamoeba dispar
PGQKADLISDPLWKRIGLPDPSINTTNPNM

SEQ ID NO: 2556789 - protein, 21 aa, Entamoeba dispar
PIKPYDLFPELKQSFKGEFDF

SEQ ID NO: 2556790 - protein, 18 aa, Entamoeba dispar
PIPKELFDKMWKAKNYMS

SEQ ID NO: 2556791 - protein, 18 aa, Entamoeba dispar
PIPLLLIKSMKTIKNALP

SEQ ID NO: 2556792 - protein, 18 aa, Entamoeba dispar
PIQELPFSRSIDVPDVWP

SEQ ID NO: 2556793 - protein, 17 aa, Entamoeba dispar
PIQIILPLNGGGYVTYA

SEQ ID NO: 2556794 - protein, 17 aa, Entamoeba dispar
PKYSLGYHQCRWNYMNQ

SEQ ID NO: 2556795 - protein, 22 aa, Entamoeba dispar
PLEVLNFRFTIHELSFQPIPLS

SEQ ID NO: 2556796 - protein, 26 aa, Entamoeba dispar
PLKKNGILFFYNNSLWIKIKTFLKHL

SEQ ID NO: 2556797 - protein, 17 aa, Entamoeba dispar
PLMDVILYNSSIFHIKS

SEQ ID NO: 2556798 - protein, 20 aa, Entamoeba dispar
PLWTNYSLYAPPNISALGKF

SEQ ID NO: 2556799 - protein, 20 aa, Entamoeba dispar
PNFPLSIFAKCFHDLIKKFK

SEQ ID NO: 2556800 - protein, 17 aa, Entamoeba dispar
PNHYFRKGNKYPLKNYE

SEQ ID NO: 2556801 - protein, 23 aa, Entamoeba dispar
PPQNQWMLDFMGDLFKDWLSPNA

SEQ ID NO: 2556802 - protein, 20 aa, Entamoeba dispar
PQEHIIFISNARRLIHDDSA

SEQ ID NO: 2556803 - protein, 18 aa, Entamoeba dispar
PQELFKSYYSLTGVSFMP

SEQ ID NO: 2556804 - protein, 23 aa, Entamoeba dispar
PQEWLWCESWCNQKVKSKAKTID

SEQ ID NO: 2556805 - protein, 19 aa, Entamoeba dispar
PQLILISHRDIMNQSILPT

SEQ ID NO: 2556806 - protein, 17 aa, Entamoeba dispar
PQPSFSGTYYKPFDIDT

SEQ ID NO: 2556807 - protein, 30 aa, Entamoeba dispar
PRQGKDFLFFILLFVSLVTLVLASLCVYVG

SEQ ID NO: 2556808 - protein, 27 aa, Entamoeba dispar
PRSEYNTWRYGNIGRAFSFPVTVQVYS

SEQ ID NO: 2556809 - protein, 19 aa, Entamoeba dispar
PSEFPEEPVVFVFHLSITG

SEQ ID NO: 2556810 - protein, 21 aa, Entamoeba dispar
PSGFDLIQSIYSNCIWDLFNI

SEQ ID NO: 2556811 - protein, 34 aa, Entamoeba dispar
PSKKELKIQYTKKYSFVSIPKPLPNYTQYQQTQP

SEQ ID NO: 2556812 - protein, 29 aa, Entamoeba dispar
PSLDYIHRQQTLPRYFLATSVKVDQPILR

SEQ ID NO: 2556813 - protein, 22 aa, Entamoeba dispar
PSLFLILLFLFCVGSLSNKKRI

SEQ ID NO: 2556814 - protein, 23 aa, Entamoeba dispar
PSLSSVFIPLPDPSLDYIHRQQT

SEQ ID NO: 2556815 - protein, 19 aa, Entamoeba dispar
PSTGYAWNINYPTDTFSLS

SEQ ID NO: 2556816 - protein, 18 aa, Entamoeba dispar
PSTKIMLGMAHYGRGWTL

SEQ ID NO: 2556817 - protein, 21 aa, Entamoeba dispar
PTLKQSLFFGCMKLKNLLYVS

SEQ ID NO: 2556818 - protein, 17 aa, Entamoeba dispar
PTNPLLYSTLTPSIESN

SEQ ID NO: 2556819 - protein, 18 aa, Entamoeba dispar
PVGVTIAGGLKTAAGVLK

SEQ ID NO: 2556820 - protein, 18 aa, Entamoeba dispar
PVIKIKDYSFVFPQTEEN

SEQ ID NO: 2556821 - protein, 19 aa, Entamoeba dispar
PVITEILLQNNYLSGSIPN

SEQ ID NO: 2556822 - protein, 30 aa, Entamoeba dispar
PVNQRYIEYYYYLLKYKKNFDRVLIIDIRD

SEQ ID NO: 2556823 - protein, 25 aa, Entamoeba dispar
PVQQKKGLFGKITSFGSKIAQKGKS

SEQ ID NO: 2556824 - protein, 21 aa, Entamoeba dispar
PVVVQMNLPPPPPVTEVEEEE

SEQ ID NO: 2556825 - protein, 19 aa, Entamoeba dispar
PYFDPWPDTAQWNYFEPKT

SEQ ID NO: 2556826 - protein, 17 aa, Entamoeba dispar
PYVNACSFGYLVPGWNS

SEQ ID NO: 2556827 - protein, 17 aa, Entamoeba dispar
PYYCGISCFLKSYNSPM

SEQ ID NO: 2556828 - protein, 26 aa, Entamoeba dispar
QADSQLILFPSGYSVLIDLGENLKDY

SEQ ID NO: 2556829 - protein, 26 aa, Entamoeba dispar
QAGFTGVMGDVWWGLVETSPKNYNFK

SEQ ID NO: 2556830 - protein, 23 aa, Entamoeba dispar
QALVNYKGILPGKKVIIQGSGDI

SEQ ID NO: 2556831 - protein, 22 aa, Entamoeba dispar
QATIGLLFPHYELKLRDVPELN

SEQ ID NO: 2556832 - protein, 21 aa, Entamoeba dispar
QCGSCWTFCTTAVLEGRVNKD

SEQ ID NO: 2556833 - protein, 18 aa, Entamoeba dispar
QCSTCMEGYYLKDSKCNV

SEQ ID NO: 2556834 - protein, 17 aa, Entamoeba dispar
QDFIINRTILRSEESNQ

SEQ ID NO: 2556835 - protein, 17 aa, Entamoeba dispar
QDLLIKEKKLNNNMTQV

SEQ ID NO: 2556836 - protein, 27 aa, Entamoeba dispar
QDRNPYYLVPFLYPSQMIVLQNYFNIS

SEQ ID NO: 2556837 - protein, 18 aa, Entamoeba dispar
QEEPLWTNYSLYAPPNIS

SEQ ID NO: 2556838 - protein, 22 aa, Entamoeba dispar
QEFPLSIISLLKRKNERLKIMS

SEQ ID NO: 2556839 - protein, 24 aa, Entamoeba dispar
QEFQPTYELLIPDYTRQGYLDLAQ

SEQ ID NO: 2556840 - protein, 23 aa, Entamoeba dispar
QEKPIPNMFENMPTVAELNKERN

SEQ ID NO: 2556841 - protein, 28 aa, Entamoeba dispar
QERNLNDSLYYLYRDLKYATVAEDRARL

SEQ ID NO: 2556842 - protein, 19 aa, Entamoeba dispar
QFFGTRLIVSAPNLSIYGI

SEQ ID NO: 2556843 - protein, 19 aa, Entamoeba dispar
QFPIVNFYREGILFSSFDG

SEQ ID NO: 2556844 - protein, 21 aa, Entamoeba dispar
QGRTPLQMYKDFMSSFKSTFS

SEQ ID NO: 2556845 - protein, 23 aa, Entamoeba dispar
QHDEMIKAIKAKNLPYFVVDHLG

SEQ ID NO: 2556846 - protein, 20 aa, Entamoeba dispar
QIAIPYASTLVFEYYTKDNQ

SEQ ID NO: 2556847 - protein, 22 aa, Entamoeba dispar
QIDFDIQYFISTDYLDNNSPNA

SEQ ID NO: 2556848 - protein, 21 aa, Entamoeba dispar
QIFKPYSGFIGYAKNNMGLVV

SEQ ID NO: 2556849 - protein, 20 aa, Entamoeba dispar
QIIAVLPAEERLAILRRLKI

SEQ ID NO: 2556850 - protein, 18 aa, Entamoeba dispar
QIIKERDISLYPAFIIIR

SEQ ID NO: 2556851 - protein, 17 aa, Entamoeba dispar
QIILPLNGGGYVTYAQN

SEQ ID NO: 2556852 - protein, 19 aa, Entamoeba dispar
QIINAMRGWMGLGSISAKE

SEQ ID NO: 2556853 - protein, 18 aa, Entamoeba dispar
QILNQLKVLTLTGGLVFF

SEQ ID NO: 2556854 - protein, 20 aa, Entamoeba dispar
QIVDKLMMKVAAQPSVEAAD

SEQ ID NO: 2556855 - protein, 21 aa, Entamoeba dispar
QKEVLFWVTIPCTKNVGSCTY

SEQ ID NO: 2556856 - protein, 29 aa, Entamoeba dispar
QKKEIMNIKYYWYFVVKNSSWISELNPCA

SEQ ID NO: 2556857 - protein, 17 aa, Entamoeba dispar
QKRFYYDSWSSDTIFEF

SEQ ID NO: 2556858 - protein, 25 aa, Entamoeba dispar
QKTIIMKKYLALNKEYLIQLKKRME

SEQ ID NO: 2556859 - protein, 18 aa, Entamoeba dispar
QLQKIRALLPQLHLKMKQ

SEQ ID NO: 2556860 - protein, 24 aa, Entamoeba dispar
QLQNKLQWIKYIDTDLMIINQSSI

SEQ ID NO: 2556861 - protein, 17 aa, Entamoeba dispar
QLTLRKLVIYIYQKTDE

SEQ ID NO: 2556862 - protein, 27 aa, Entamoeba dispar
QNLNHLFILVFLLQLLHFNQLFKLIHP

SEQ ID NO: 2556863 - protein, 17 aa, Entamoeba dispar
QNLRRLTDKYLLDKSVK

SEQ ID NO: 2556864 - protein, 22 aa, Entamoeba dispar
QNQYIFIKFTITKNCPFCIDYT

SEQ ID NO: 2556865 - protein, 19 aa, Entamoeba dispar
QNTLLKHVERVKRLSKFRI

SEQ ID NO: 2556866 - protein, 29 aa, Entamoeba dispar
QPIDNEVQFYRYGVRPYVPYDRYSKNDEE

SEQ ID NO: 2556867 - protein, 21 aa, Entamoeba dispar
QPPFRKIVSIIDSLDSDERKP

SEQ ID NO: 2556868 - protein, 25 aa, Entamoeba dispar
QPSSPVVQPVPYPVPSGSASGAIAS

SEQ ID NO: 2556869 - protein, 29 aa, Entamoeba dispar
QQGIDTLFNALWLRSFIKNNQRIINGRAY

SEQ ID NO: 2556870 - protein, 23 aa, Entamoeba dispar
QQNLLIEMISFIQKSIKKRIETK

SEQ ID NO: 2556871 - protein, 25 aa, Entamoeba dispar
QQNNDVYFERWKPIISICNKVGGNL

SEQ ID NO: 2556872 - protein, 18 aa, Entamoeba dispar
QQPPIPPQSKTPPMYERV

SEQ ID NO: 2556873 - protein, 17 aa, Entamoeba dispar
QRKLKLLIKEEETKFKK

SEQ ID NO: 2556874 - protein, 17 aa, Entamoeba dispar
QRVKSQLKLIAGKDTKA

SEQ ID NO: 2556875 - protein, 17 aa, Entamoeba dispar
QRYSAIAERLWSKESVV

SEQ ID NO: 2556876 - protein, 25 aa, Entamoeba dispar
QSDNLLGLLKPLSESFRNGPKLTNE

SEQ ID NO: 2556877 - protein, 21 aa, Entamoeba dispar
QSFLKGYPSLFLFYNNYIYPE

SEQ ID NO: 2556878 - protein, 17 aa, Entamoeba dispar
QSFVLTQSFLKELTQYG

SEQ ID NO: 2556879 - protein, 18 aa, Entamoeba dispar
QSLDTWKNDFLSGANPTN

SEQ ID NO: 2556880 - protein, 19 aa, Entamoeba dispar
QSMLLTPPSFLLQAYIKAL

SEQ ID NO: 2556881 - protein, 21 aa, Entamoeba dispar
QSTLFTLKSPGIRQLTSFILF

SEQ ID NO: 2556882 - protein, 27 aa, Entamoeba dispar
QTEITIDLMYFTPYSKLNYTKCPTSAY

SEQ ID NO: 2556883 - protein, 21 aa, Entamoeba dispar
QTKELLLKVKIPIGFGALIHD

SEQ ID NO: 2556884 - protein, 26 aa, Entamoeba dispar
QTKIWKNWKYILDFYEIFMKEVTMVY

SEQ ID NO: 2556885 - protein, 21 aa, Entamoeba dispar
QTSMVLNWVFQMMLPITTDVK

SEQ ID NO: 2556886 - protein, 30 aa, Entamoeba dispar
QVDEFVRNIIYFRIEAIRKEIKALKGEKII

SEQ ID NO: 2556887 - protein, 33 aa, Entamoeba dispar; identical to SEQ ID NO: 2537659

SEQ ID NO: 2556888 - protein, 60 aa, Entamoeba dispar
QVPVPPMMYQPILPIYIPPIRFIPNPYYYYRRPYYYYRRPYYRLSPYVRGLYLNPDMFGT

SEQ ID NO: 2556889 - protein, 22 aa, Entamoeba dispar
QVSMKLRIKFMINAAKGISYLH

SEQ ID NO: 2556890 - protein, 23 aa, Entamoeba dispar
QVTFNKWKLISDITKLMGNRFYI

SEQ ID NO: 2556891 - protein, 17 aa, Entamoeba dispar
QYFKIYKTALDHGHVVN

SEQ ID NO: 2556892 - protein, 28 aa, Entamoeba dispar
QYPTIEKPFIDPPYLVPLNVVVLYDISS

SEQ ID NO: 2556893 - protein, 19 aa, Entamoeba dispar
QYTIEGLKGLNIFEAKPAE

SEQ ID NO: 2556894 - protein, 21 aa, Entamoeba dispar
QYVDQWIAISMPVMGSGVAVK

SEQ ID NO: 2556895 - protein, 24 aa, Entamoeba dispar
QYVPKGIWYDWFTNTPVKNGLRTV

SEQ ID NO: 2556896 - protein, 31 aa, Entamoeba dispar
QYVQTHEWLLMNLRFYWPGLKQCSFFNYEYL

SEQ ID NO: 2556897 - protein, 28 aa, Entamoeba dispar
RAGIQKLVTTFYAVLDRTLKQLAYAKQV

SEQ ID NO: 2556898 - protein, 19 aa, Entamoeba dispar
RALMSAIHKFGVLGIGLDT

SEQ ID NO: 2556899 - protein, 19 aa, Entamoeba dispar
RANYVRCLGLRRNFLKGTG

SEQ ID NO: 2556900 - protein, 27 aa, Entamoeba dispar
RARFNELNLDLFKKTLGPVRMVLDDAK

SEQ ID NO: 2556901 - protein, 25 aa, Entamoeba dispar
RASLEMTFIGNGLLNSATFPSICTA

SEQ ID NO: 2556902 - protein, 26 aa, Entamoeba dispar
RASLEMTFIGNGLLNSATFPSICTAW

SEQ ID NO: 2556903 - protein, 17 aa, Entamoeba dispar
RATFIKSAMNFARKYNL

SEQ ID NO: 2556904 - protein, 18 aa, Entamoeba dispar
RATTSTYFRNRHVMLFCY

SEQ ID NO: 2556905 - protein, 33 aa, Entamoeba dispar
RAVNLRYQMLPYWYSLWYYHRIDYNPVIRAMYY

SEQ ID NO: 2556906 - protein, 19 aa, Entamoeba dispar
RCEDYIFLIIRSKEIEITN

SEQ ID NO: 2556907 - protein, 22 aa, Entamoeba dispar
RDVRLILRRIGIELHNINKKVY

SEQ ID NO: 2556908 - protein, 43 aa, Entamoeba dispar
REEKRALRKIARTKRMVLAKMYKILRVLAPVEQGRLVRQLNLM

SEQ ID NO: 2556909 - protein, 20 aa, Entamoeba dispar
REERLMELQLTLKAIQQRVE

SEQ ID NO: 2556910 - protein, 25 aa, Entamoeba dispar
REKKAIALKGARLAFFQAKSAVYNL

SEQ ID NO: 2556911 - protein, 20 aa, Entamoeba dispar
RENEKFPCFIEVVGIQSPGL

SEQ ID NO: 2556912 - protein, 27 aa, Entamoeba dispar
RFGLRSIIEYAPWINRIFLVTDGEIPE

SEQ ID NO: 2556913 - protein, 28 aa, Entamoeba dispar
RFIASLEVYYCLCLMEFLVVKVKGFDVF

SEQ ID NO: 2556914 - protein, 22 aa, Entamoeba dispar
RFNRGTLERIFNREINAFLIDF

SEQ ID NO: 2556915 - protein, 21 aa, Entamoeba dispar
RGATLIIWMKKAPLDPGTNNQ

SEQ ID NO: 2556916 - protein, 20 aa, Entamoeba dispar
RGRIAKLLRYYSSVSGNETM

SEQ ID NO: 2556917 - protein, 19 aa, Entamoeba dispar
RGRRSTLRRQAFGNFASAM

SEQ ID NO: 2556918 - protein, 21 aa, Entamoeba dispar
RGYGWKLIWDGTIDWIIFTGE

SEQ ID NO: 2556919 - protein, 26 aa, Entamoeba dispar
RHMMTGTRLHSLLVTYGMGSGQQAVT

SEQ ID NO: 2556920 - protein, 19 aa, Entamoeba dispar
RHQAKAEYRALYRKCTKKI

SEQ ID NO: 2556921 - protein, 23 aa, Entamoeba dispar
RHRAAIAFLAAYTGPITIYYGDE

SEQ ID NO: 2556922 - protein, 17 aa, Entamoeba dispar
RHRAAIAFLASYTGPIT

SEQ ID NO: 2556923 - protein, 19 aa, Entamoeba dispar
RIKMMADQFKKKLPGFNVY

SEQ ID NO: 2556924 - protein, 17 aa, Entamoeba dispar
RILKKKISPKQKRQARK

SEQ ID NO: 2556925 - protein, 17 aa, Entamoeba dispar
RIMRRRGRRSTLRRQAF

SEQ ID NO: 2556926 - protein, 20 aa, Entamoeba dispar
RIRKLKRQLYDKNGKLKEIK

SEQ ID NO: 2556927 - protein, 24 aa, Entamoeba dispar
RISSKKFVISQLPIKISDAPRFKW

SEQ ID NO: 2556928 - protein, 18 aa, Entamoeba dispar
RISSLLRIKRKALRKSDE

SEQ ID NO: 2556929 - protein, 17 aa, Entamoeba dispar
RITLTTYQLISQKNGET

SEQ ID NO: 2556930 - protein, 27 aa, Entamoeba dispar
RIVSIKEPLFRICGLAIHLDTERKYII

SEQ ID NO: 2556931 - protein, 20 aa, Entamoeba dispar
RKFVQQILRALLVLSKGNIV

SEQ ID NO: 2556932 - protein, 29 aa, Entamoeba dispar
RKGNRRRVTLWRAVPYYCYRWGMTEEELL

SEQ ID NO: 2556933 - protein, 26 aa, Entamoeba dispar
RKHHQLLPTYFDPSIVKIRASAKVRT

SEQ ID NO: 2556934 - protein, 28 aa, Entamoeba dispar
RKKEGYIITLQVPSYFPAIKYCKNEEIR

SEQ ID NO: 2556935 - protein, 17 aa, Entamoeba dispar
RKKILDFGEMIKEKTIE

SEQ ID NO: 2556936 - protein, 21 aa, Entamoeba dispar
RKTRVELMRTLYKLVGKLSVP

SEQ ID NO: 2556937 - protein, 36 aa, Entamoeba dispar
RKVILFSKKERLIKKKLARLVIRRKKYNSSEKLIKL

SEQ ID NO: 2556938 - protein, 24 aa, Entamoeba dispar
RLAQKAHLSPVILKAQNKLAENQV

SEQ ID NO: 2556939 - protein, 20 aa, Entamoeba dispar
RLDAGWFLRDILSFQQMKHE

SEQ ID NO: 2556940 - protein, 22 aa, Entamoeba dispar
RLHIYSKTRKSLKIKRTKLTSQ

SEQ ID NO: 2556941 - protein, 20 aa, Entamoeba dispar
RLISALTFSSSFYESVQPSS

SEQ ID NO: 2556942 - protein, 38 aa, Entamoeba dispar
RLLIISFFIIESYAFFQRKPIILIPGIMSTILEGDGTV

SEQ ID NO: 2556943 - protein, 21 aa, Entamoeba dispar
RLPKEIIFPAQPPIGLQVTWS

SEQ ID NO: 2556944 - protein, 21 aa, Entamoeba dispar
RLQGKLDKRYVLKREEVALKN

SEQ ID NO: 2556945 - protein, 17 aa, Entamoeba dispar
RLWRDMRISEMEAKMQF

SEQ ID NO: 2556946 - protein, 19 aa, Entamoeba dispar
RMKVIVNIMGIKQASFEEE

SEQ ID NO: 2556947 - protein, 25 aa, Entamoeba dispar
RNGFGGFDPYNFFRDIRPHQKHQMP

SEQ ID NO: 2556948 - protein, 18 aa, Entamoeba dispar
RNMLDERFLIEDKLVKLD

SEQ ID NO: 2556949 - protein, 20 aa, Entamoeba dispar
RNPNGKYLFSILNNTNSLNQ

SEQ ID NO: 2556950 - protein, 29 aa, Entamoeba dispar
RNQTRLEFKLLLGFIPPFSSLNNIQNLLE

SEQ ID NO: 2556951 - protein, 25 aa, Entamoeba dispar
RQEMLYRTKQLILRKKRIEARRKSE

SEQ ID NO: 2556952 - protein, 31 aa, Entamoeba dispar
RQIRQELLHIFKRYGVIIPVAIPVDLINEID

SEQ ID NO: 2556953 - protein, 18 aa, Entamoeba dispar
RQKYPNVVEGAWASSAPV

SEQ ID NO: 2556954 - protein, 19 aa, Entamoeba dispar
RQMRRWRKQQEVKRRRVQR

SEQ ID NO: 2556955 - protein, 17 aa, Entamoeba dispar
RQMVVDRLVMLKERRKE

SEQ ID NO: 2556956 - protein, 27 aa, Entamoeba dispar
RQPYGTSFLEFEAYTKALLSEEVKIPP

SEQ ID NO: 2556957 - protein, 32 aa, Entamoeba dispar
RRELPQHYCYFVLDELYFKILQYLESGNRSDQ

SEQ ID NO: 2556958 - protein, 21 aa, Entamoeba dispar
RRFADLFVPLKCPHARFTNAQ

SEQ ID NO: 2556959 - protein, 38 aa, Entamoeba dispar
RRHRHFWHYRNWWLRRHWLRNWKRQMRRWRKQQEVKRR

SEQ ID NO: 2556960 - protein, 31 aa, Entamoeba dispar
RRHRHFWHYRNWWLRRHWLRNWKRQMRRWRR

SEQ ID NO: 2556961 - protein, 17 aa, Entamoeba dispar
RRIRLIQKKRIAKIVRK

SEQ ID NO: 2556962 - protein, 30 aa, Entamoeba dispar
RRRGKFISSVPLLNLFSLGELYTKPNIIKY

SEQ ID NO: 2556963 - protein, 26 aa, Entamoeba dispar
RRRRRRSWRKWFRRHHRRPRRHYRRR

SEQ ID NO: 2556964 - protein, 24 aa, Entamoeba dispar
RRSELYARQSWLLSELKALAKRET

SEQ ID NO: 2556965 - protein, 17 aa, Entamoeba dispar
RRTETVALLLPIGGTKI

SEQ ID NO: 2556966 - protein, 18 aa, Entamoeba dispar
RRTETVALLLPIGGTKIF

SEQ ID NO: 2556967 - protein, 23 aa, Entamoeba dispar
RSCFHFPGRYNLVQTLACEESGK

SEQ ID NO: 2556968 - protein, 28 aa, Entamoeba dispar
RSERTKMRYLKIKALKDILSKKLAAEEK

SEQ ID NO: 2556969 - protein, 28 aa, Entamoeba dispar
RSERTKMRYLKIKALKDILSKKLAAEER

SEQ ID NO: 2556970 - protein, 24 aa, Entamoeba dispar
RSYDYYTLFNPYIQNSVPILTDKR

SEQ ID NO: 2556971 - protein, 24 aa, Entamoeba dispar
RSYIHWEDSFSNCKFLTKIAISTS

SEQ ID NO: 2556972 - protein, 25 aa, Entamoeba dispar
RTDRNWTHRLLLSSYTLMDGANGND

SEQ ID NO: 2556973 - protein, 25 aa, Entamoeba dispar
RTDRNWTHRLLLSSYTLVDGANGND

SEQ ID NO: 2556974 - protein, 35 aa, Entamoeba dispar
RTIRKNLRKIAMLKVKLNAQMRKGLNMISYDNQAR

SEQ ID NO: 2556975 - protein, 19 aa, Entamoeba dispar
RTTFRLRGTQRRRYFSSSP

SEQ ID NO: 2556976 - protein, 29 aa, Entamoeba dispar
RVCKMRGYNQFEQYLNAFKASDDTYYCPL

SEQ ID NO: 2556977 - protein, 20 aa, Entamoeba dispar
RVDDLNLSMLKLKKQRVKLS

SEQ ID NO: 2556978 - protein, 21 aa, Entamoeba dispar
RVKEYCETIFLLVQSLHMNAF

SEQ ID NO: 2556979 - protein, 18 aa, Entamoeba dispar
RVKKSTKKVVRPSQKTNL

SEQ ID NO: 2556980 - protein, 18 aa, Entamoeba dispar
RVMDMLYNTKFETPLIIW

SEQ ID NO: 2556981 - protein, 23 aa, Entamoeba dispar
RVQLKLFKVVKRIQKVNQLFFRH

SEQ ID NO: 2556982 - protein, 19 aa, Entamoeba dispar
RVVVLRRIMTLNEKKLRQE

SEQ ID NO: 2556983 - protein, 22 aa, Entamoeba dispar
RVYTEIIHIIRRNTLHGGNMKR

SEQ ID NO: 2556984 - protein, 22 aa, Entamoeba dispar
SAELYTFDDFELFSEIEYQVDI

SEQ ID NO: 2556985 - protein, 35 aa, Entamoeba dispar
SALERFEIQKLKDQYYRLAALKERQKMQIKANKEI

SEQ ID NO: 2556986 - protein, 24 aa, Entamoeba dispar
SASNGFIYFINKNGEYNTSKTIKI

SEQ ID NO: 2556987 - protein, 19 aa, Entamoeba dispar
SCADGFYFDEIKGACILCT

SEQ ID NO: 2556988 - protein, 19 aa, Entamoeba dispar
SCEVYGGGIWHTWIDRDLG

SEQ ID NO: 2556989 - protein, 29 aa, Entamoeba dispar
SDAFDLCKTLITIKIPDSVPFIDISAFNY

SEQ ID NO: 2556990 - protein, 26 aa, Entamoeba dispar
SDEFRIWENITFLYKYPQCNLNLLKQ

SEQ ID NO: 2556991 - protein, 21 aa, Entamoeba dispar
SDEHVCLTCAKPLMVGSKCDR

SEQ ID NO: 2556992 - protein, 25 aa, Entamoeba dispar
SDGLPEWLYYFKDVNNKWAVPENVC

SEQ ID NO: 2556993 - protein, 25 aa, Entamoeba dispar
SDKYIDNWIAMSTPFLGSGKAIAAA

SEQ ID NO: 2556994 - protein, 25 aa, Entamoeba dispar
SDLSPLIIELLTFNDIELGDLNATL

SEQ ID NO: 2556995 - protein, 25 aa, Entamoeba dispar
SDNGNYHLPIQRTYFNSNPINLKFS

SEQ ID NO: 2556996 - protein, 27 aa, Entamoeba dispar
SDPNLKVQWWFPLVERLDAKDLQNLQS

SEQ ID NO: 2556997 - protein, 18 aa, Entamoeba dispar
SEEMGDILRTLPLVDQQH

SEQ ID NO: 2556998 - protein, 18 aa, Entamoeba dispar
SELRVLRAASRKFLDKMR

SEQ ID NO: 2556999 - protein, 25 aa, Entamoeba dispar
SEMRRNSAELLLRKYKEKYLIKHSL

SEQ ID NO: 2557000 - protein, 22 aa, Entamoeba dispar
SEPFEIQIPLVFQKCPIHCSEH

SEQ ID NO: 2557001 - protein, 24 aa, Entamoeba dispar
SESKLIFWLMDVVPGDVITQSKET

SEQ ID NO: 2557002 - protein, 24 aa, Entamoeba dispar
SFEKVQFIFYNGNSPTRIIGDVDE

SEQ ID NO: 2557003 - protein, 27 aa, Entamoeba dispar
SFFGSSYIYPYASSTPLWYPHYDHNPS

SEQ ID NO: 2557004 - protein, 27 aa, Entamoeba dispar
SFITIEQDFPILLWNNKPLNNEKHNIK

SEQ ID NO: 2557005 - protein, 26 aa, Entamoeba dispar
SFIYVYDYLQVLHCSNLPFPSNEKEQ

SEQ ID NO: 2557006 - protein, 21 aa, Entamoeba dispar
SFKKVLGKGRLIRSNIKKGLN

SEQ ID NO: 2557007 - protein, 23 aa, Entamoeba dispar
SFMPPTDYILLKGNVNVVIQPAN

SEQ ID NO: 2557008 - protein, 23 aa, Entamoeba dispar
SFNDPFLEYLQSFIPSEIVPQNN

SEQ ID NO: 2557009 - protein, 20 aa, Entamoeba dispar
SFSFALPYSEQEEKVIVDRT

SEQ ID NO: 2557010 - protein, 20 aa, Entamoeba dispar
SFTIGSCTKLTLTGTRTIKT

SEQ ID NO: 2557011 - protein, 27 aa, Entamoeba dispar
SFTSGNEFIFKSFKVTLIDNKNTIPEH

SEQ ID NO: 2557012 - protein, 26 aa, Entamoeba dispar
SGESDGMFFFNPLKNTLILTGTNELH

SEQ ID NO: 2557013 - protein, 25 aa, Entamoeba dispar
SGFRAYHDYFTLNYGRAFVLTSLDF

SEQ ID NO: 2557014 - protein, 23 aa, Entamoeba dispar
SGHLMHTLFTKQRYASLAGTNVA

SEQ ID NO: 2557015 - protein, 24 aa, Entamoeba dispar
SGKTLLVKFFAPWCGHCKRLAPTY

SEQ ID NO: 2557016 - protein, 35 aa, Entamoeba dispar
SGLLMKEGYLLKRWKERFVVVKNSYLFYFVSEKSM

SEQ ID NO: 2557017 - protein, 30 aa, Entamoeba dispar
SGNDNYYYYYHLPIQRTYINSIPINLKFSS

SEQ ID NO: 2557018 - protein, 26 aa, Entamoeba dispar
SGSAYYIELRYHCWKVPIIGDWCSTK

SEQ ID NO: 2557019 - protein, 26 aa, Entamoeba dispar
SGSIGFFEFLALWNFMNLCNETFKHF

SEQ ID NO: 2557020 - protein, 26 aa, Entamoeba dispar
SGTSSNDSWRYLFTGRITSVNTNNNS

SEQ ID NO: 2557021 - protein, 27 aa, Entamoeba dispar
SHLDSPFLKLKPYPDLIKNNLALVSCE

SEQ ID NO: 2557022 - protein, 18 aa, Entamoeba dispar
SHTLLVTGKYWNKMFELK

SEQ ID NO: 2557023 - protein, 17 aa, Entamoeba dispar
SIAIAAPAVDTGKQNGI

SEQ ID NO: 2557024 - protein, 20 aa, Entamoeba dispar
SIIELFEKVYNSQTSEYLIS

SEQ ID NO: 2557025 - protein, 24 aa, Entamoeba dispar
SIINDLKYYLEGCVFKDILKNPPQ

SEQ ID NO: 2557026 - protein, 18 aa, Entamoeba dispar
SIKVIPAPELLYCVPERV

SEQ ID NO: 2557027 - protein, 24 aa, Entamoeba dispar
SINDKIIFEFLLHKWSSEGITDDK

SEQ ID NO: 2557028 - protein, 19 aa, Entamoeba dispar
SINLLVLKTFYPNLFEKDN

SEQ ID NO: 2557029 - protein, 19 aa, Entamoeba dispar
SIRSVYNFAPYIKNYYIVT

SEQ ID NO: 2557030 - protein, 23 aa, Entamoeba dispar
SISIPTIFRLSKNIQKLIINMPD

SEQ ID NO: 2557031 - protein, 23 aa, Entamoeba dispar
SISLIKLLPPFVDSKWIIDGRNI

SEQ ID NO: 2557032 - protein, 20 aa, Entamoeba dispar
SKCILYLNDDMILGKPLKPE

SEQ ID NO: 2557033 - protein, 20 aa, Entamoeba dispar
SKDVAVLTLYPGITGKTVRS

SEQ ID NO: 2557034 - protein, 19 aa, Entamoeba dispar
SKEGCLCKFLWNDTKGVHY

SEQ ID NO: 2557035 - protein, 25 aa, Entamoeba dispar
SKGIEYVWMMGVWQLGEYGLNLDRA

SEQ ID NO: 2557036 - protein, 26 aa, Entamoeba dispar
SKKASPKKIKNLKKAEKKFIKKEKKL

SEQ ID NO: 2557037 - protein, 25 aa, Entamoeba dispar
SKKISAYDLLLNKIAIQLKVDVKDI

SEQ ID NO: 2557038 - protein, 17 aa, Entamoeba dispar
SKKLPTKIIITNSNNNS

SEQ ID NO: 2557039 - protein, 21 aa, Entamoeba dispar
SKNIKPLAKGLSGKKVPYSTI

SEQ ID NO: 2557040 - protein, 18 aa, Entamoeba dispar
SKNVLYLHFKTLNGINRF

SEQ ID NO: 2557041 - protein, 22 aa, Entamoeba dispar
SKYKNLKIALLEKARDVSTGAT

SEQ ID NO: 2557042 - protein, 23 aa, Entamoeba dispar
SKYKNLKIALLEKARDVSTGATS

SEQ ID NO: 2557043 - protein, 29 aa, Entamoeba dispar
SLEKNLYYFGLVIDYIHLFKDGESINKFI

SEQ ID NO: 2557044 - protein, 20 aa, Entamoeba dispar
SLEMDKLIYCTAEQALMDYV

SEQ ID NO: 2557045 - protein, 18 aa, Entamoeba dispar
SLEWCKLPGFAKVVKDLG

SEQ ID NO: 2557046 - protein, 25 aa, Entamoeba dispar
SLGCMVYEMLIGIPPFHSESPNQIF

SEQ ID NO: 2557047 - protein, 23 aa, Entamoeba dispar
SLIGDFIIDQILLEYADNFAVIA

SEQ ID NO: 2557048 - protein, 18 aa, Entamoeba dispar
SLIILGAVLVLVRLYAAG

SEQ ID NO: 2557049 - protein, 31 aa, Entamoeba dispar
SLKEMKTRYFLFVILWVISLGKECPAKKPIV

SEQ ID NO: 2557050 - protein, 18 aa, Entamoeba dispar
SLLILTTLSKEIKDEDGI

SEQ ID NO: 2557051 - protein, 18 aa, Entamoeba dispar
SLLLISFSLATSIPFNVC

SEQ ID NO: 2557052 - protein, 24 aa, Entamoeba dispar
SLNGIDLVIFSYTRGNKIYCGKRN

SEQ ID NO: 2557053 - protein, 27 aa, Entamoeba dispar
SMIESRKRIRYIKKQGLNAKLNRIHYV

SEQ ID NO: 2557054 - protein, 25 aa, Entamoeba dispar
SMTFYDMFFYESFGDLLDLTAVLPS

SEQ ID NO: 2557055 - protein, 27 aa, Entamoeba dispar
SNAGCFLDRLFLLKSFYSKFNISVGIL

SEQ ID NO: 2557056 - protein, 24 aa, Entamoeba dispar
SNDKKFIVWTKRSTIRKTAPIGIN

SEQ ID NO: 2557057 - protein, 17 aa, Entamoeba dispar
SNKFNFNGQYKYKKLDA

SEQ ID NO: 2557058 - protein, 29 aa, Entamoeba dispar
SNLTIQSWMYRVALPLFQPINEDIKMILK

SEQ ID NO: 2557059 - protein, 24 aa, Entamoeba dispar
SNNYPITIILPLNGGGYTDLESNF

SEQ ID NO: 2557060 - protein, 19 aa, Entamoeba dispar
SNQAIFKIYRKKEPYQNIE

SEQ ID NO: 2557061 - protein, 17 aa, Entamoeba dispar
SNRGYGWKLIWDGTIDW

SEQ ID NO: 2557062 - protein, 26 aa, Entamoeba dispar
SNYITLGFDYWDYNKARVSGKIKLFI

SEQ ID NO: 2557063 - protein, 17 aa, Entamoeba dispar
SPFNLIIGPGGMTPQTI

SEQ ID NO: 2557064 - protein, 27 aa, Entamoeba dispar
SPGIRQLTSFILFDSYFLNTDGDLLFN

SEQ ID NO: 2557065 - protein, 28 aa, Entamoeba dispar
SPHSRILKMLDYFMYYGHICIVTEMLGY

SEQ ID NO: 2557066 - protein, 25 aa, Entamoeba dispar
SPKQFNGTLLTYITPWNLYGLNLLE

SEQ ID NO: 2557067 - protein, 18 aa, Entamoeba dispar
SPSIFYICFSYDCKNNDS

SEQ ID NO: 2557068 - protein, 20 aa, Entamoeba dispar
SPYCPFMAYLTSCSIVYPEC

SEQ ID NO: 2557069 - protein, 17 aa, Entamoeba dispar
SQCHSSCKTCEGSSILC

SEQ ID NO: 2557070 - protein, 24 aa, Entamoeba dispar
SQDKPYVYGAWIALRSTIGGWIVA

SEQ ID NO: 2557071 - protein, 23 aa, Entamoeba dispar
SQIQLFPVFIDKFNIHFSMTDYS

SEQ ID NO: 2557072 - protein, 30 aa, Entamoeba dispar
SQPISLFQALQRRGIKSRLLRFPYSTNVLT

SEQ ID NO: 2557073 - protein, 24 aa, Entamoeba dispar
SQPSKIIFDKLIQTPSLGIHQLKK

SEQ ID NO: 2557074 - protein, 22 aa, Entamoeba dispar
SQQIYPCISISFGLQIYSMNET

SEQ ID NO: 2557075 - protein, 18 aa, Entamoeba dispar
SQSTCYLPRHLFTRSFKN

SEQ ID NO: 2557076 - protein, 19 aa, Entamoeba dispar
SRALPIQELPFSRSIDVPD

SEQ ID NO: 2557077 - protein, 20 aa, Entamoeba dispar
SRDLLFYGIGYNAEQWKRNK

SEQ ID NO: 2557078 - protein, 25 aa, Entamoeba dispar
SRGKRQVLLRKIKVLSRRIRRVDRS

SEQ ID NO: 2557079 - protein, 37 aa, Entamoeba dispar
SRPSTLFSFFKRFTSMQYLYFLTFNHNPQNVLHRGNC

SEQ ID NO: 2557080 - protein, 23 aa, Entamoeba dispar
SRSWCNLNRFRPVSHYNADVRSY

SEQ ID NO: 2557081 - protein, 19 aa, Entamoeba dispar
SSKPLLKFILCVFLLIITI

SEQ ID NO: 2557082 - protein, 23 aa, Entamoeba dispar
SSLAVLESRLLIAGSKYNQNNLD

SEQ ID NO: 2557083 - protein, 27 aa, Entamoeba dispar
SSLESKIKVLLLTNKKVKEKIKKEKGA

SEQ ID NO: 2557084 - protein, 26 aa, Entamoeba dispar
SSLIIAHFNSGFPLPTHLIPKDGTQR

SEQ ID NO: 2557085 - protein, 22 aa, Entamoeba dispar
SSLYHFEKHYKSMDKNHAMIKN

SEQ ID NO: 2557086 - protein, 24 aa, Entamoeba dispar
SSNQAIFKIYRKKEPYQKIEFSLT

SEQ ID NO: 2557087 - protein, 20 aa, Entamoeba dispar
SSTGYYIREFYEVQDKVSIL

SEQ ID NO: 2557088 - protein, 17 aa, Entamoeba dispar
SSWPPYASYIIFEMYEK

SEQ ID NO: 2557089 - protein, 18 aa, Entamoeba dispar
STEPLMDVILYNSSIFHI

SEQ ID NO: 2557090 - protein, 24 aa, Entamoeba dispar
STKKMQFNFTATVYDILVAIKERQ

SEQ ID NO: 2557091 - protein, 28 aa, Entamoeba dispar
STLRKKTLIFCAVLLFIATLQADTHFCL

SEQ ID NO: 2557092 - protein, 18 aa, Entamoeba dispar
STPLWYPHYDHNPSFSDF

SEQ ID NO: 2557093 - protein, 23 aa, Entamoeba dispar
STSIKLFGPINLLKAGFIDVGTS

SEQ ID NO: 2557094 - protein, 17 aa, Entamoeba dispar
STSNPHLTYAISGPTHQ

SEQ ID NO: 2557095 - protein, 24 aa, Entamoeba dispar
STTVFWMMDTLPATFLKQSKERNV

SEQ ID NO: 2557096 - protein, 17 aa, Entamoeba dispar
SVQFFGTRLIVSAPNLS

SEQ ID NO: 2557097 - protein, 24 aa, Entamoeba dispar
SVSSSRYIILKNSKINVQSITGSC

SEQ ID NO: 2557098 - protein, 21 aa, Entamoeba dispar
SVSTIGEYAFYNCVSLTSIDV

SEQ ID NO: 2557099 - protein, 27 aa, Entamoeba dispar
SVYLCYGYELNMYLLPHVLPEWKTEQT

SEQ ID NO: 2557100 - protein, 32 aa, Entamoeba dispar
SYCLGYLEAYLTHHYMYLYWTNYKANEYENGQ

SEQ ID NO: 2557101 - protein, 25 aa, Entamoeba dispar
SYCTPRVMEILSKRLNIPMTAVAKN

SEQ ID NO: 2557102 - protein, 19 aa, Entamoeba dispar
SYDWRYYRYGEYKHKRNWF

SEQ ID NO: 2557103 - protein, 32 aa, Entamoeba dispar
SYENNTYIFDYFYYYLPFNFNIESDKKVHLTP

SEQ ID NO: 2557104 - protein, 24 aa, Entamoeba dispar
SYGPAASLPLWYAHYDNWASFGDF

SEQ ID NO: 2557105 - protein, 18 aa, Entamoeba dispar
SYGVQGFPTVKLFDAQQG

SEQ ID NO: 2557106 - protein, 17 aa, Entamoeba dispar
SYKLYKVNNITTSIYVN

SEQ ID NO: 2557107 - protein, 19 aa, Entamoeba dispar
SYRTTPYPGIILLSGDLAG

SEQ ID NO: 2557108 - protein, 22 aa, Entamoeba dispar
SYSKHFYLPFSSNNLCYEAKKK

SEQ ID NO: 2557109 - protein, 24 aa, Entamoeba dispar
SYTYTNNILSFKLKPTWSINKNIQ

SEQ ID NO: 2557110 - protein, 21 aa, Entamoeba dispar
SYYYMDEMYFLETEFGYPMYE

SEQ ID NO: 2557111 - protein, 17 aa, Entamoeba dispar
TACTLSNYYPKKGEKGE

SEQ ID NO: 2557112 - protein, 23 aa, Entamoeba dispar
TAGGVMASIIPRGTHVPTKKSQI

SEQ ID NO: 2557113 - protein, 20 aa, Entamoeba dispar
TAVEALRRRAIFNMNARFVA

SEQ ID NO: 2557114 - protein, 25 aa, Entamoeba dispar
TAVYGITAPYLPKKSFYPLHNEEIT

SEQ ID NO: 2557115 - protein, 24 aa, Entamoeba dispar
TCGGMVRYFSYKNIAIHDITTECN

SEQ ID NO: 2557116 - protein, 24 aa, Entamoeba dispar
TCSDQYYEFLYNKFVDYIPRNQKE

SEQ ID NO: 2557117 - protein, 18 aa, Entamoeba dispar
TCTQCEDGYYLYNNVCHK

SEQ ID NO: 2557118 - protein, 31 aa, Entamoeba dispar
TDDEVWFRKRMQVVNVLLPDGSTKKMMLDVC

SEQ ID NO: 2557119 - protein, 24 aa, Entamoeba dispar
TDGFSMHGWWPSFSSGSMPACCKY

SEQ ID NO: 2557120 - protein, 26 aa, Entamoeba dispar
TDKVQGGFNKVMNFGKGVVGIFNKDA

SEQ ID NO: 2557121 - protein, 22 aa, Entamoeba dispar
TDPGEMMMWFNATLKVLREKGQ

SEQ ID NO: 2557122 - protein, 25 aa, Entamoeba dispar
TDVRPVYLSFVGYGKPVVISTCKSV

SEQ ID NO: 2557123 - protein, 24 aa, Entamoeba dispar
TEEYQPFPLSYLEGPYPLQHPYYC

SEQ ID NO: 2557124 - protein, 21 aa, Entamoeba dispar
TEYEVECDCLLLSVGLIPQPD

SEQ ID NO: 2557125 - protein, 29 aa, Entamoeba dispar
TFDFRATINPLPRWGNYQRFGAYMRVVEL

SEQ ID NO: 2557126 - protein, 25 aa, Entamoeba dispar
TFEIPLFENDIIVHLITFDNEKIDF

SEQ ID NO: 2557127 - protein, 17 aa, Entamoeba dispar
TFIGSAIVLTLFGTLLL

SEQ ID NO: 2557128 - protein, 19 aa, Entamoeba dispar
TFNFNHTITYPLQRQRNLD

SEQ ID NO: 2557129 - protein, 17 aa, Entamoeba dispar
TGFLFIDYRKLFVQPTF

SEQ ID NO: 2557130 - protein, 26 aa, Entamoeba dispar
TGHDSTLMPYLALIGQDVFTWPPYAS

SEQ ID NO: 2557131 - protein, 21 aa, Entamoeba dispar
TGLKYYLEAYVFKDILKNPPQ

SEQ ID NO: 2557132 - protein, 27 aa, Entamoeba dispar
TGQKLHFYWMWWFYGRDEALKLTQYNT

SEQ ID NO: 2557133 - protein, 30 aa, Entamoeba dispar
TGSLSAFNGLKGFMAISIKNNLFSGPIYMI

SEQ ID NO: 2557134 - protein, 22 aa, Entamoeba dispar
TGTKIPGFPVIIEDSGFITQAI

SEQ ID NO: 2557135 - protein, 25 aa, Entamoeba dispar
THCLSTRTPYFPKRIRNPTLDHFTI

SEQ ID NO: 2557136 - protein, 23 aa, Entamoeba dispar
THLQNLPYLRFIKKLNVTITYHP

SEQ ID NO: 2557137 - protein, 17 aa, Entamoeba dispar
TIAFSQDILIKADVNKY

SEQ ID NO: 2557138 - protein, 18 aa, Entamoeba dispar
TICYKCENGLTLKGTHCY

SEQ ID NO: 2557139 - protein, 27 aa, Entamoeba dispar
TIEYCRFHWPYFMFKQVSKTRIIWANK

SEQ ID NO: 2557140 - protein, 19 aa, Entamoeba dispar
TIGDIRKFIRAIKEFIKMV

SEQ ID NO: 2557141 - protein, 17 aa, Entamoeba dispar
TIILVGGSGVGKTCLAN

SEQ ID NO: 2557142 - protein, 17 aa, Entamoeba dispar
TIKTLPTYFQINGKIKS

SEQ ID NO: 2557143 - protein, 18 aa, Entamoeba dispar
TILIAQTLGVFDPRKPSK

SEQ ID NO: 2557144 - protein, 17 aa, Entamoeba dispar
TILISIVHGQYPTTTPQ

SEQ ID NO: 2557145 - protein, 19 aa, Entamoeba dispar
TILTFSNAYEDYSDVLDNF

SEQ ID NO: 2557146 - protein, 27 aa, Entamoeba dispar
TISFTDDCYLWYLHGVWNPITNKLENI

SEQ ID NO: 2557147 - protein, 17 aa, Entamoeba dispar
TIYTYPNQWLKYESTNQ

SEQ ID NO: 2557148 - protein, 24 aa, Entamoeba dispar
TKCNVIIQTLPITPEFFMCDEMNQ

SEQ ID NO: 2557149 - protein, 24 aa, Entamoeba dispar
TKDNHLLGKFMLEGIKRAPRGIPK

SEQ ID NO: 2557150 - protein, 22 aa, Entamoeba dispar
TKFNAKRRVLKAQMKKVKNLKK

SEQ ID NO: 2557151 - protein, 21 aa, Entamoeba dispar
TKGTLIIPTVDGTIMVGPTAD

SEQ ID NO: 2557152 - protein, 22 aa, Entamoeba dispar
TKGTLIIPTVDGTIMVGPTADN

SEQ ID NO: 2557153 - protein, 17 aa, Entamoeba dispar
TKKSQIMIIGMKGVTFS

SEQ ID NO: 2557154 - protein, 26 aa, Entamoeba dispar
TKKSVNKKLLLKSKVFARKARKSGMS

SEQ ID NO: 2557155 - protein, 27 aa, Entamoeba dispar
TKPGFTLHGWWPNFVSGYPSCCKSPYT

SEQ ID NO: 2557156 - protein, 27 aa, Entamoeba dispar
TKYCGYYFIPYDVFKFGNSRFLNYGDD

SEQ ID NO: 2557157 - protein, 17 aa, Entamoeba dispar
TLALFRKGRSKKVYGGE

SEQ ID NO: 2557158 - protein, 19 aa, Entamoeba dispar
TLFITLSYGLNITFSQRTN

SEQ ID NO: 2557159 - protein, 17 aa, Entamoeba dispar
TLIIRPNNTYVVKIDGV

SEQ ID NO: 2557160 - protein, 23 aa, Entamoeba dispar
TLKYLNIRLKQTRKTIALSKLQE

SEQ ID NO: 2557161 - protein, 24 aa, Entamoeba dispar
TLNFLGILGLKHAFNHFPNIDIIH

SEQ ID NO: 2557162 - protein, 30 aa, Entamoeba dispar
TLRNIVITLIPLYIIIESIFISIPPQLFDS

SEQ ID NO: 2557163 - protein, 26 aa, Entamoeba dispar
TLRNYKLRILRLKMADAKIRITEHQL

SEQ ID NO: 2557164 - protein, 23 aa, Entamoeba dispar
TLSGKFDYKASDAWRVTGDGFIS

SEQ ID NO: 2557165 - protein, 27 aa, Entamoeba dispar
TLVASYHPLYYYKVWSRDAVFASIIMM

SEQ ID NO: 2557166 - protein, 23 aa, Entamoeba dispar
TNDLLICQFVTKCNVIIQTLPIT

SEQ ID NO: 2557167 - protein, 24 aa, Entamoeba dispar
TNGIKWNTLWFDVEKDSWSSNVAT

SEQ ID NO: 2557168 - protein, 24 aa, Entamoeba dispar
TNGSQFFITLVPTSWLDGRHVVFG

SEQ ID NO: 2557169 - protein, 20 aa, Entamoeba dispar
TNIYQSIIYWESISIDNTDY

SEQ ID NO: 2557170 - protein, 21 aa, Entamoeba dispar
TNMCGVLVDLDYKPAGATPVS

SEQ ID NO: 2557171 - protein, 23 aa, Entamoeba dispar
TPAQPQMPTINMPAITITNTNDN

SEQ ID NO: 2557172 - protein, 17 aa, Entamoeba dispar
TPASVFLYLLQNHNSVL

SEQ ID NO: 2557173 - protein, 17 aa, Entamoeba dispar
TPLHYLCRNIQLEKNIS

SEQ ID NO: 2557174 - protein, 19 aa, Entamoeba dispar
TPSQKFIPIKIVSKDEHIT

SEQ ID NO: 2557175 - protein, 27 aa, Entamoeba dispar
TPYGYFNATLLLFQNYNVWTTLRHYNY

SEQ ID NO: 2557176 - protein, 25 aa, Entamoeba dispar
TQQSLNNFLLLGLTNISISVIQNIT

SEQ ID NO: 2557177 - protein, 17 aa, Entamoeba dispar
TQQYFKIYKTALDHGHV

SEQ ID NO: 2557178 - protein, 19 aa, Entamoeba dispar
TRECIECEKGYYLNSNKEC

SEQ ID NO: 2557179 - protein, 26 aa, Entamoeba dispar
TSINIPSSVIFIGKAAFSHCTSLTSI

SEQ ID NO: 2557180 - protein, 24 aa, Entamoeba dispar
TSKTIKIPPVYVPANWNDGLETDK

SEQ ID NO: 2557181 - protein, 19 aa, Entamoeba dispar
TSLVNGFFDPSYKIRECVM

SEQ ID NO: 2557182 - protein, 24 aa, Entamoeba dispar
TSRSIHPLHFFLKSKDKCSNCFNV

SEQ ID NO: 2557183 - protein, 33 aa, Entamoeba dispar
TSSCNKTIIITPVELVFPFSTNPRIRNAQILMN

SEQ ID NO: 2557184 - protein, 27 aa, Entamoeba dispar
TSTSSSLLFSFFSILFFEGCCSSEIQL

SEQ ID NO: 2557185 - protein, 27 aa, Entamoeba dispar
TSTYFRNRHVMLFCYDITKKESFNHVE

SEQ ID NO: 2557186 - protein, 32 aa, Entamoeba dispar
TTLNQYIHSNTLLDWIRIVLAVRASKNGKEFH

SEQ ID NO: 2557187 - protein, 26 aa, Entamoeba dispar
TTTYFRNRHCILFTYDITKRETLEHV

SEQ ID NO: 2557188 - protein, 17 aa, Entamoeba dispar
TTWAYAKNFYQYTYDQT

SEQ ID NO: 2557189 - protein, 24 aa, Entamoeba dispar
TTYIDEHLITWKDGKKFFPLGLYF

SEQ ID NO: 2557190 - protein, 18 aa, Entamoeba dispar
TVLFLNEYLGKSSDPFIS

SEQ ID NO: 2557191 - protein, 20 aa, Entamoeba dispar
TVPWKSECYINYLSGIWNNQ

SEQ ID NO: 2557192 - protein, 27 aa, Entamoeba dispar
TVSYRFWYHDSWRYALQSRPYHISALF

SEQ ID NO: 2557193 - protein, 28 aa, Entamoeba dispar
TWKDGKKFFPLGLYFDEIIDSDLELLKD

SEQ ID NO: 2557194 - protein, 28 aa, Entamoeba dispar
TYAVDTLWPEIPWKKITGIWRKFISHLE

SEQ ID NO: 2557195 - protein, 20 aa, Entamoeba dispar
TYELQNFYFLHSNKIIKRYI

SEQ ID NO: 2557196 - protein, 22 aa, Entamoeba dispar
TYGSIYFIEQKPSLLSFSYENM

SEQ ID NO: 2557197 - protein, 21 aa, Entamoeba dispar
TYPKKLWLAIIHSIPSKISHM

SEQ ID NO: 2557198 - protein, 24 aa, Entamoeba dispar
VAGVMADIWWGLVETSPRNYNWNG

SEQ ID NO: 2557199 - protein, 21 aa, Entamoeba dispar
VALTAYYYYYTQTKKTDLLLS

SEQ ID NO: 2557200 - protein, 28 aa, Entamoeba dispar
VCKMRGYNQFEQYLNAFKASDNTYYCPL

SEQ ID NO: 2557201 - protein, 31 aa, Entamoeba dispar
VCTCYDGGFFTDHTCWWIKTTVGIASGLLDT

SEQ ID NO: 2557202 - protein, 24 aa, Entamoeba dispar
VDATPLTLGIMTAGGVMASIIPRG

SEQ ID NO: 2557203 - protein, 30 aa, Entamoeba dispar
VDEIIQKFSPYYKELLVKCLIPKYRYKTRQ

SEQ ID NO: 2557204 - protein, 35 aa, Entamoeba dispar
VDFEAKLNYKPNENSNLYASLKRDQTNNNNMIGLG

SEQ ID NO: 2557205 - protein, 21 aa, Entamoeba dispar
VDGHLYYNTLIPRQILPANET

SEQ ID NO: 2557206 - protein, 28 aa, Entamoeba dispar
VDGSKHVFVKFFAPWCGHCKKLAPEYIK

SEQ ID NO: 2557207 - protein, 35 aa, Entamoeba dispar
VDHYGYYGHNGLWYLFEELGFTAGKYIERDFGLYN

SEQ ID NO: 2557208 - protein, 26 aa, Entamoeba dispar
VDIGFKLDLILYKKKYSTSIKLFGPI

SEQ ID NO: 2557209 - protein, 20 aa, Entamoeba dispar
VDQLPDYNITISLFSQTEEC

SEQ ID NO: 2557210 - protein, 21 aa, Entamoeba dispar
VDVLKSEFECKADGFYCVIDG

SEQ ID NO: 2557211 - protein, 24 aa, Entamoeba dispar
VDYDSLYSMPFKEDIRFPKQKQIF

SEQ ID NO: 2557212 - protein, 33 aa, Entamoeba dispar
VEAALLIRTNWMNWMDMIWVTTVSPEIAIARMT

SEQ ID NO: 2557213 - protein, 26 aa, Entamoeba dispar
VEAGKLLYDPYFNTNPIWNQRRERYD

SEQ ID NO: 2557214 - protein, 23 aa, Entamoeba dispar
VEDWERFWASYKLASECYLEYMH

SEQ ID NO: 2557215 - protein, 18 aa, Entamoeba dispar
VEFYFLVKATSVGATGTL

SEQ ID NO: 2557216 - protein, 20 aa, Entamoeba dispar
VEKILEKYPYFIVNEIKNTN

SEQ ID NO: 2557217 - protein, 23 aa, Entamoeba dispar
VEMKKRYTIIAKNLKKMLPNKLF

SEQ ID NO: 2557218 - protein, 24 aa, Entamoeba dispar
VEPNIHVILMNYSIIKNQFIIERD

SEQ ID NO: 2557219 - protein, 27 aa, Entamoeba dispar
VERLRRKAIFTSNFKYVKEFNKNHDFE

SEQ ID NO: 2557220 - protein, 19 aa, Entamoeba dispar
VESIERRIRLIQKKRIAKI

SEQ ID NO: 2557221 - protein, 25 aa, Entamoeba dispar
VEVLNNLPLYFTPTTFIGYKIASPF

SEQ ID NO: 2557222 - protein, 27 aa, Entamoeba dispar
VEVSRLMHLIIHSLYTNKEIFLRELIS

SEQ ID NO: 2557223 - protein, 17 aa, Entamoeba dispar
VFLLFTHQSFAQTYQGE

SEQ ID NO: 2557224 - protein, 20 aa, Entamoeba dispar
VFNGIYAEAFGDHKPARACF

SEQ ID NO: 2557225 - protein, 19 aa, Entamoeba dispar
VFNKLYRITGFESGTSYLY

SEQ ID NO: 2557226 - protein, 17 aa, Entamoeba dispar
VFVISNAIETVSNNDKQ

SEQ ID NO: 2557227 - protein, 18 aa, Entamoeba dispar
VFVISSIALISEIGHTGI

SEQ ID NO: 2557228 - protein, 22 aa, Entamoeba dispar
VGEWTEFKILLTDLGVTNNEFW

SEQ ID NO: 2557229 - protein, 20 aa, Entamoeba dispar
VGHPVIVLGGSYSGNLAAWM

SEQ ID NO: 2557230 - protein, 18 aa, Entamoeba dispar
VGNELYYSVAHHSIFYTK

SEQ ID NO: 2557231 - protein, 21 aa, Entamoeba dispar
VGSLGMKWLSWVLKKSVIKKR

SEQ ID NO: 2557232 - protein, 24 aa, Entamoeba dispar
VGTNALAIEMYKKALLSEEVKIPA

SEQ ID NO: 2557233 - protein, 17 aa, Entamoeba dispar
VHSLYSFYKSQILRQTF

SEQ ID NO: 2557234 - protein, 34 aa, Entamoeba dispar
VHYNKWDCQLYSQYLDLIAYLPNSVIQGKWNEVL

SEQ ID NO: 2557235 - protein, 21 aa, Entamoeba dispar
VIFDFGKFNNGEIIKFYTTEG

SEQ ID NO: 2557236 - protein, 17 aa, Entamoeba dispar
VIHTLAYPPPVLVKEPI

SEQ ID NO: 2557237 - protein, 23 aa, Entamoeba dispar
VILFLFFCSFAQKFSIIKKGNSI

SEQ ID NO: 2557238 - protein, 18 aa, Entamoeba dispar
VILLCIAVTGKSNKKIEK

SEQ ID NO: 2557239 - protein, 18 aa, Entamoeba dispar
VILWVISLGKECPAKKPI

SEQ ID NO: 2557240 - protein, 29 aa, Entamoeba dispar
VIVQLGYSPPIYSLLFMNIETNLELELIS

SEQ ID NO: 2557241 - protein, 25 aa, Entamoeba dispar
VKEIKRQMRLLRETAQKEFAEFKEN

SEQ ID NO: 2557242 - protein, 24 aa, Entamoeba dispar
VKKAAKILLKKYSKILARKNNHKR

SEQ ID NO: 2557243 - protein, 17 aa, Entamoeba dispar
VKKAECPQMVMARLAQK

SEQ ID NO: 2557244 - protein, 28 aa, Entamoeba dispar
VKQAKWYGLHSFTYLRMTRALLDDGTAW

SEQ ID NO: 2557245 - protein, 24 aa, Entamoeba dispar
VKQKNNFYFSWWGGNHTLNSQTMD

SEQ ID NO: 2557246 - protein, 26 aa, Entamoeba dispar
VKTLCQSCIFWFRLKTSLTDALGITT

SEQ ID NO: 2557247 - protein, 20 aa, Entamoeba dispar
VKVIGKFIGALLKFVNTFLD

SEQ ID NO: 2557248 - protein, 31 aa, Entamoeba dispar
VKVYGLNGVYIQTLWPLKPHDDMKFGQQLAS

SEQ ID NO: 2557249 - protein, 19 aa, Entamoeba dispar
VLFLVYSNAVITFPHVISA

SEQ ID NO: 2557250 - protein, 18 aa, Entamoeba dispar
VLFYIGCHCATLKETVVT

SEQ ID NO: 2557251 - protein, 28 aa, Entamoeba dispar
VLIYNTLKRLGYLDDQLLFFNADDHACH

SEQ ID NO: 2557252 - protein, 21 aa, Entamoeba dispar
VLKAQMKKVKNLKKALRKAHG

SEQ ID NO: 2557253 - protein, 19 aa, Entamoeba dispar
VLQFEWDWQHPEKGRRVRQ

SEQ ID NO: 2557254 - protein, 32 aa, Entamoeba dispar
VLSQDNMYSAWNPQLLISLKAPQNVAAANACT

SEQ ID NO: 2557255 - protein, 28 aa, Entamoeba dispar
VLTLFGTLLLADRLTLFSTKPSYLKSVF

SEQ ID NO: 2557256 - protein, 23 aa, Entamoeba dispar
VMPKITKVFLLIGKPPSITFLEE

SEQ ID NO: 2557257 - protein, 23 aa, Entamoeba dispar
VNGMYTKSNLGKDWKYGAEVQHS

SEQ ID NO: 2557258 - protein, 24 aa, Entamoeba dispar
VNKCNWCYHQFLTINGSCIQSIDA

SEQ ID NO: 2557259 - protein, 17 aa, Entamoeba dispar
VNLPIKYYFNKAEKIIK

SEQ ID NO: 2557260 - protein, 26 aa, Entamoeba dispar
VNVKNQLLLMPYPTTVNAQFGRNDCV

SEQ ID NO: 2557261 - protein, 17 aa, Entamoeba dispar
VPEDMGTKVLYYAKYES

SEQ ID NO: 2557262 - protein, 18 aa, Entamoeba dispar
VPKKTVAYYTNWAQYRFN

SEQ ID NO: 2557263 - protein, 19 aa, Entamoeba dispar
VQQNIQLNILLHECTFASD

SEQ ID NO: 2557264 - protein, 18 aa, Entamoeba dispar
VRDSLYDFLKRCLAYDPK

SEQ ID NO: 2557265 - protein, 28 aa, Entamoeba dispar
VRQLNLMNRLHVNHLMLLGADEAQAVFN

SEQ ID NO: 2557266 - protein, 26 aa, Entamoeba dispar
VSESGILDEFFLPGPKPINLIQEYLQ

SEQ ID NO: 2557267 - protein, 27 aa, Entamoeba dispar
VSKEASKLPLWFSHYDHKANFDDYNSG

SEQ ID NO: 2557268 - protein, 25 aa, Entamoeba dispar
VSLFVSVIVFCCLLALVIGLAVGLS

SEQ ID NO: 2557269 - protein, 26 aa, Entamoeba dispar
VSQVPVKFIIPWEALTPAKDQGSRST

SEQ ID NO: 2557270 - protein, 17 aa, Entamoeba dispar
VTAYLQYTNIEGPIPPL

SEQ ID NO: 2557271 - protein, 22 aa, Entamoeba dispar
VTEDLFRTILDESPLTVVGFHK

SEQ ID NO: 2557272 - protein, 25 aa, Entamoeba dispar
VTISDYFQLLLIDTTFIGIDTFKSF

SEQ ID NO: 2557273 - protein, 19 aa, Entamoeba dispar
VTLCLVFTQVNAVDFYDFD

SEQ ID NO: 2557274 - protein, 22 aa, Entamoeba dispar
VTLLNAIRLPKEIIFPAQPPIG

SEQ ID NO: 2557275 - protein, 19 aa, Entamoeba dispar
VTVSFIKVTQVSGKCNSNS

SEQ ID NO: 2557276 - protein, 17 aa, Entamoeba dispar
VVALFCHLTIQECIPII

SEQ ID NO: 2557277 - protein, 20 aa, Entamoeba dispar
VVDLQSLEWCKLPGFAKVVK

SEQ ID NO: 2557278 - protein, 20 aa, Entamoeba dispar
VVFGTSVELIIAAPKGIQKL

SEQ ID NO: 2557279 - protein, 23 aa, Entamoeba dispar
VVGVMGDVWWGLVETSPKSYNWN

SEQ ID NO: 2557280 - protein, 17 aa, Entamoeba dispar
VVICICNGQVPADLIDK

SEQ ID NO: 2557281 - protein, 18 aa, Entamoeba dispar
VVIKCHDSFYSIGNACSS

SEQ ID NO: 2557282 - protein, 22 aa, Entamoeba dispar
VYDPELYKYDSFAYIGIDVWQV

SEQ ID NO: 2557283 - protein, 18 aa, Entamoeba dispar
VYDTTYLCGILNTLGYSI

SEQ ID NO: 2557284 - protein, 17 aa, Entamoeba dispar
VYNFAPYIKNYYIVTMG

SEQ ID NO: 2557285 - protein, 26 aa, Entamoeba dispar
  misc_feature (24)..(25): Xaa can be any naturally occurring amino acid
VYSKSLLLIILSLILVRLVLTSTXXY

SEQ ID NO: 2557286 - protein, 18 aa, Entamoeba dispar
WCSEHFNIPFFETSAKNA

SEQ ID NO: 2557287 - protein, 28 aa, Entamoeba dispar
WDKKFELDWWMNVVIFPVFSKLNDAMTD

SEQ ID NO: 2557288 - protein, 18 aa, Entamoeba dispar
WDVNYYIELMKQEKYNFN

SEQ ID NO: 2557289 - protein, 19 aa, Entamoeba dispar
WEFASYQMICLYSYPNRVM

SEQ ID NO: 2557290 - protein, 17 aa, Entamoeba dispar
WLAIIHSIPSKISHMEN

SEQ ID NO: 2557291 - protein, 17 aa, Entamoeba dispar
WLEGFYDDEPKKKQMVI

SEQ ID NO: 2557292 - protein, 24 aa, Entamoeba dispar
  misc_feature (1)..(2): Xaa can be any naturally occurring amino acid
XXFLLSFILIAYAQTNITQTNGTM

SEQ ID NO: 2557293 - protein, 17 aa, Entamoeba dispar
  misc_feature (1)..(2): Xaa can be any naturally occurring amino acid
XXLLCLWKEQLAIDIAK

SEQ ID NO: 2557294 - protein, 18 aa, Entamoeba dispar
YAEKYYFKTGVCLNKQRY

SEQ ID NO: 2557295 - protein, 24 aa, Entamoeba dispar
YAQQEYLMRKKAFDALKRIRMLRR

SEQ ID NO: 2557296 - protein, 18 aa, Entamoeba dispar
YAWNINYPTDTFSLSQDT

SEQ ID NO: 2557297 - protein, 18 aa, Entamoeba dispar
YAYASSTPLWYPHYDNSP

SEQ ID NO: 2557298 - protein, 26 aa, Entamoeba dispar
YCDQRRPVFLFNGMLGSTINANLNIP

SEQ ID NO: 2557299 - protein, 24 aa, Entamoeba dispar
YDEEDLLAFDDYLEDLDDFVDMEE

SEQ ID NO: 2557300 - protein, 18 aa, Entamoeba dispar
YDFDDLPIVLIFPENKTL

SEQ ID NO: 2557301 - protein, 20 aa, Entamoeba dispar
YDMTKPFKFYVKPYMQNTSS

SEQ ID NO: 2557302 - protein, 25 aa, Entamoeba dispar
YDPNVACIWGWWGTLMSNHELKRYL

SEQ ID NO: 2557303 - protein, 30 aa, Entamoeba dispar
YDSNYHLPIQRTYFNSIPINLKFSSDISIQ

SEQ ID NO: 2557304 - protein, 22 aa, Entamoeba dispar
YEGNYVVLPLKTGIEIFPLEDL

SEQ ID NO: 2557305 - protein, 26 aa, Entamoeba dispar
YEISTRPWLYELTQKYGKSITKLRDI

SEQ ID NO: 2557306 - protein, 18 aa, Entamoeba dispar
YETIFRGKKNNLLWTLFM

SEQ ID NO: 2557307 - protein, 19 aa, Entamoeba dispar
YEYSVLSYFSGYEKQYIAT

SEQ ID NO: 2557308 - protein, 17 aa, Entamoeba dispar
YFETSFWAFPPKSQWML

SEQ ID NO: 2557309 - protein, 18 aa, Entamoeba dispar
YFNKNFTYSDLAFNCNRT

SEQ ID NO: 2557310 - protein, 20 aa, Entamoeba dispar
YFSCFGKTLICGETIIREDQ

SEQ ID NO: 2557311 - protein, 33 aa, Entamoeba dispar
YFTEESVFGGLFEIYKRLYGVSFKLNKEIKGWH

SEQ ID NO: 2557312 - protein, 21 aa, Entamoeba dispar
YGILALLEYDTQIAIPYASTL

SEQ ID NO: 2557313 - protein, 28 aa, Entamoeba dispar
YGIVEYAFSKLHNFGFRLPSGSTDGKAK

SEQ ID NO: 2557314 - protein, 28 aa, Entamoeba dispar
YHFKDIPLHFYYSFHTLILYSSSIIQNL

SEQ ID NO: 2557315 - protein, 20 aa, Entamoeba dispar
YHSDICIDSIKYQWDKGNLI

SEQ ID NO: 2557316 - protein, 18 aa, Entamoeba dispar
YIEALDKSVKLEKETRVK

SEQ ID NO: 2557317 - protein, 18 aa, Entamoeba dispar
YIIFMRTTNIIEKNPAKY

SEQ ID NO: 2557318 - protein, 27 aa, Entamoeba dispar
YITIEQDFPILLWNNKPLNNKRYDIKS

SEQ ID NO: 2557319 - protein, 17 aa, Entamoeba dispar
YITPWNLYGLNLLEKNK

SEQ ID NO: 2557320 - protein, 22 aa, Entamoeba dispar
YKAIFSAGFYLDKQMPLCNNYD

SEQ ID NO: 2557321 - protein, 21 aa, Entamoeba dispar
YKCQDALDVQLPYTALHTFSN

SEQ ID NO: 2557322 - protein, 17 aa, Entamoeba dispar
YKEETRECIQCEKGYYL

SEQ ID NO: 2557323 - protein, 18 aa, Entamoeba dispar
YKIAAPLFEKIGSIIDFK

SEQ ID NO: 2557324 - protein, 23 aa, Entamoeba dispar
YKKYTKKGLVFPPLVYPEYDDDS

SEQ ID NO: 2557325 - protein, 30 aa, Entamoeba dispar
YKRNEKEWIAQKKLLKFLKNEVKKASLSLE

SEQ ID NO: 2557326 - protein, 18 aa, Entamoeba dispar
YKTEWYLEYSKTNKWPSY

SEQ ID NO: 2557327 - protein, 25 aa, Entamoeba dispar
YKYLQLCMTLRSYGMNIYHGGIEPK

SEQ ID NO: 2557328 - protein, 22 aa, Entamoeba dispar
YLCKKKLGGVMFWSLDLDKNYV

SEQ ID NO: 2557329 - protein, 17 aa, Entamoeba dispar
YLKEKEIIKKRYRKQIK

SEQ ID NO: 2557330 - protein, 20 aa, Entamoeba dispar
YLKQFIVYGRERSRFGRFSV

SEQ ID NO: 2557331 - protein, 17 aa, Entamoeba dispar
YLLTFVSAKNTCINDKC

SEQ ID NO: 2557332 - protein, 22 aa, Entamoeba dispar
YLSCIISFASAELYTFDDFELF

SEQ ID NO: 2557333 - protein, 26 aa, Entamoeba dispar
YMAPEILNKIRYKKSADIYSFAITMY

SEQ ID NO: 2557334 - protein, 24 aa, Entamoeba dispar
YNKDKTLLIQYPIGNSRTSYSIPP

SEQ ID NO: 2557335 - protein, 26 aa, Entamoeba dispar
YNYEPQQLLEYPYQQYQMDYPEKKPK

SEQ ID NO: 2557336 - protein, 30 aa, Entamoeba dispar
YPADFVVMSFYKIIGYPTGLGALLVKNEVM

SEQ ID NO: 2557337 - protein, 18 aa, Entamoeba dispar
YPKILLGFDQDYYSHSFI

SEQ ID NO: 2557338 - protein, 18 aa, Entamoeba dispar
YPTKVYNLFAFPGTENFA

SEQ ID NO: 2557339 - protein, 25 aa, Entamoeba dispar
YQKHITINFFFIEALKRIYKDESID

SEQ ID NO: 2557340 - protein, 20 aa, Entamoeba dispar
YRETQGALIVYDITSRDSFE

SEQ ID NO: 2557341 - protein, 25 aa, Entamoeba dispar
YSFFSSLLNIVYIKSSVFNQLLENY

SEQ ID NO: 2557342 - protein, 21 aa, Entamoeba dispar
YSHSFIQLFNNFNIVRIAYSN

SEQ ID NO: 2557343 - protein, 48 aa, Entamoeba dispar
YSNSNYHLPIQRIYFNSIPINLKFSSNYGIWYLISSYEGIINQLTPNS

SEQ ID NO: 2557344 - protein, 22 aa, Entamoeba dispar
YSVHLMFVLLKSNEGKYYVRTY

SEQ ID NO: 2557345 - protein, 39 aa, Entamoeba dispar; identical to SEQ ID NO: 2403367

SEQ ID NO: 2557346 - protein, 24 aa, Entamoeba dispar
YTCNKCQEGYYWNEKECTSCPVIP

SEQ ID NO: 2557347 - protein, 24 aa, Entamoeba dispar
YTHSQLFSNFLIAKLINAEVASRE

SEQ ID NO: 2557348 - protein, 18 aa, Entamoeba dispar
YTLIIRPNNTYVVKIDGV

SEQ ID NO: 2557349 - protein, 27 aa, Entamoeba dispar
YTQKYTFFFPPFNPYYHFKDIPLHFYY

SEQ ID NO: 2557350 - protein, 30 aa, Entamoeba dispar
YTYDGYTDILWVFQWHFVELQPTGFVKLTD

SEQ ID NO: 2557351 - protein, 20 aa, Entamoeba dispar
YVKERIIHTLHIEKRFNRSE

SEQ ID NO: 2557352 - protein, 25 aa, Entamoeba dispar
YVSQVAWFMYGAMNRVMKHFDINLN

SEQ ID NO: 2557353 - protein, 23 aa, Entamoeba dispar
YVYDPELYKYDSFAYIGIDVWQV

SEQ ID NO: 2557354 - protein, 20 aa, Entamoeba dispar
YWGYDQALLSYLYTTRKLDF

SEQ ID NO: 2557355 - protein, 25 aa, Entamoeba dispar
QSEYGRFFQEWYFDLLLSHTDKVLS

SEQ ID NO: 2557356 - protein, 19 aa, Entamoeba dispar
NMYSAWNPQLLISIKAPQN

SEQ ID NO: 2557357 - protein, 19 aa, Entamoeba dispar
GKKYWKKQAPKKCYDFIGG

SEQ ID NO: 2557358 - protein, 17 aa, Entamoeba dispar
IIFVVYSRPIKPPSLGD

SEQ ID NO: 2557359 - protein, 17 aa, Entamoeba dispar
ILFFSLSSAYIWEFDPN

SEQ ID NO: 2557360 - protein, 18 aa, Entamoeba dispar
LFFFLCFAKTLEQKKKLQ

SEQ ID NO: 2557361 - protein, 19 aa, Entamoeba dispar
LLFVTLVLSSPLLDMKIKI

SEQ ID NO: 2557362 - protein, 26 aa, Entamoeba dispar
VKKTLEWPTYKRHFYLPYRLDLDLCY

SEQ ID NO: 2557363 - protein, 18 aa, Entamoeba dispar
AAYPKSLFQFPWSIADFV

SEQ ID NO: 2557364 - protein, 23 aa, Entamoeba dispar
AEYLYRFAVFLDNKKFVEANANT

SEQ ID NO: 2557365 - protein, 19 aa, Entamoeba dispar
ALFFDFYYSLPFKVSISNT

SEQ ID NO: 2557366 - protein, 24 aa, Entamoeba dispar
ALFLCLFWFLIEVTFDIDANGILN

SEQ ID NO: 2557367 - protein, 20 aa, Entamoeba dispar
ATIFWIAYIPIKVKNKFIEL

SEQ ID NO: 2557368 - protein, 18 aa, Entamoeba dispar
CDTYIDKWIPLSAPFLGS

SEQ ID NO: 2557369 - protein, 19 aa, Entamoeba dispar
CLIFIILVILYIKNSTQKK

SEQ ID NO: 2557370 - protein, 24 aa, Entamoeba dispar
CLLELTLALYPTGCKKKGYHCVFD

SEQ ID NO: 2557371 - protein, 17 aa, Entamoeba dispar
CQSCIFWFRLKTSLTDA

SEQ ID NO: 2557372 - protein, 20 aa, Entamoeba dispar
CVLLVLGSFASSFNNDYSDF

SEQ ID NO: 2557373 - protein, 19 aa, Entamoeba dispar
DFNHQLPIFWYFSAKHNQT

SEQ ID NO: 2557374 - protein, 18 aa, Entamoeba dispar
DKWIPLSAPFLGSGLAIK

SEQ ID NO: 2557375 - protein, 19 aa, Entamoeba dispar
DLISDPLWKRIGLPDPSIN

SEQ ID NO: 2557376 - protein, 17 aa, Entamoeba dispar
DPLLFRFLQIFKEIREL

SEQ ID NO: 2557377 - protein, 25 aa, Entamoeba dispar
DRNPYYLVPFLYPSQMIVLQNYFNI

SEQ ID NO: 2557378 - protein, 21 aa, Entamoeba dispar
DTLFNALWLRSFIKNNQRIIN

SEQ ID NO: 2557379 - protein, 18 aa, Entamoeba dispar
ECFGWCAAYPKSLFQFPW

SEQ ID NO: 2557380 - protein, 17 aa, Entamoeba dispar
EFYYLLCKDIFNVDKQR

SEQ ID NO: 2557381 - protein, 23 aa, Entamoeba dispar
EGFTMHGWWPNFVSGYPSCCKSP

SEQ ID NO: 2557382 - protein, 24 aa, Entamoeba dispar
EIKIQLFIESVRRKVYFTTTTLLM

SEQ ID NO: 2557383 - protein, 22 aa, Entamoeba dispar
EKFENYFIIKDYKFGILYAKEG

SEQ ID NO: 2557384 - protein, 17 aa, Entamoeba dispar
ELDWWMNVVIFPVFSKL

SEQ ID NO: 2557385 - protein, 19 aa, Entamoeba dispar
ELEGDYQLDNGFDLKEENI

SEQ ID NO: 2557386 - protein, 23 aa, Entamoeba dispar
ELKDIIMMIALIALLSFASATEV

SEQ ID NO: 2557387 - protein, 26 aa, Entamoeba dispar
EMKTRYFLFVILWVISLGKECPAKKP

SEQ ID NO: 2557388 - protein, 23 aa, Entamoeba dispar
EMKYLLIDYWYKEYFMSIRNKEP

SEQ ID NO: 2557389 - protein, 28 aa, Entamoeba dispar
ENNTYIFDYFYYYLPFNFNIESDKKVHL

SEQ ID NO: 2557390 - protein, 17 aa, Entamoeba dispar
ESDGMFFFNPLKNTLIL

SEQ ID NO: 2557391 - protein, 23 aa, Entamoeba dispar
ETTRFNFVILYHPLISFMSRNYQ

SEQ ID NO: 2557392 - protein, 18 aa, Entamoeba dispar
EYVLVLQTPCACSKKLLK

SEQ ID NO: 2557393 - protein, 18 aa, Entamoeba dispar
FFRPKIAIGLLPQGKKMK

SEQ ID NO: 2557394 - protein, 19 aa, Entamoeba dispar
FIFYSFALDYYKVLGVPRN

SEQ ID NO: 2557395 - protein, 17 aa, Entamoeba dispar
FIIFFITALSNYCQAPL

SEQ ID NO: 2557396 - protein, 17 aa, Entamoeba dispar
FIVLCSADLNVLTREDM

SEQ ID NO: 2557397 - protein, 18 aa, Entamoeba dispar
FLIILIINGSYCDLKKED

SEQ ID NO: 2557398 - protein, 17 aa, Entamoeba dispar
FLNLVFGNVIHVTEDLF

SEQ ID NO: 2557399 - protein, 18 aa, Entamoeba dispar
FMKYLRKQPNWNIKLETK

SEQ ID NO: 2557400 - protein, 19 aa, Entamoeba dispar
FMLEDEGFFGDLWNGAKKI

SEQ ID NO: 2557401 - protein, 19 aa, Entamoeba dispar
FRNRHCILFTYDITKRETL

SEQ ID NO: 2557402 - protein, 18 aa, Entamoeba dispar
FVRNIIYFRIEAIRKEIK

SEQ ID NO: 2557403 - protein, 18 aa, Entamoeba dispar
FYVYLRYNYECKIIDYFC

SEQ ID NO: 2557404 - protein, 19 aa, Entamoeba dispar
GFDVFLDFGVKLDLGLTGT

SEQ ID NO: 2557405 - protein, 19 aa, Entamoeba dispar
GFTLHGWWPNFVSGYPSCC

SEQ ID NO: 2557406 - protein, 22 aa, Entamoeba dispar
GFTLHGWWPNFVSGYPSCCKSP

SEQ ID NO: 2557407 - protein, 19 aa, Entamoeba dispar
GMFFFNPLKNTLILTGTNE

SEQ ID NO: 2557408 - protein, 25 aa, Entamoeba dispar
GNDNYYYYYHLPIQRTYINSIPINL

SEQ ID NO: 2557409 - protein, 17 aa, Entamoeba dispar
GVFLFLLKMYCNGRQNL

SEQ ID NO: 2557410 - protein, 18 aa, Entamoeba dispar
HDKYFECNEFYEGIRTCP

SEQ ID NO: 2557411 - protein, 17 aa, Entamoeba dispar
HGWWPNFVSGYPSCCKS

SEQ ID NO: 2557412 - protein, 24 aa, Entamoeba dispar
HNGLWYLFEELGFTAGKYIERDFG

SEQ ID NO: 2557413 - protein, 23 aa, Entamoeba dispar
HNKQYYECATTFKGFRPCAPGTW

SEQ ID NO: 2557414 - protein, 17 aa, Entamoeba dispar
HVFVKFFAPWCGHCKKL

SEQ ID NO: 2557415 - protein, 18 aa, Entamoeba dispar
IFIVLSFGRIDYWCDSVD

SEQ ID NO: 2557416 - protein, 18 aa, Entamoeba dispar
IFLFILYSNAESGPCVNK

SEQ ID NO: 2557417 - protein, 19 aa, Entamoeba dispar
IGILAYLGYLIYKKELTWP

SEQ ID NO: 2557418 - protein, 18 aa, Entamoeba dispar
IIFLLFNFSFAQNHVAVS

SEQ ID NO: 2557419 - protein, 29 aa, Entamoeba dispar
IILNKSTMLQLIGLLMIVTVSIAVEQCGK

SEQ ID NO: 2557420 - protein, 18 aa, Entamoeba dispar
IITLLYFSGLIHLFSERP

SEQ ID NO: 2557421 - protein, 17 aa, Entamoeba dispar
IKKEKKLVKLQKRFAKA

SEQ ID NO: 2557422 - protein, 19 aa, Entamoeba dispar
ILFSRKYNYLQAHKLQIVL

SEQ ID NO: 2557423 - protein, 20 aa, Entamoeba dispar
INIPKYFPFPAGYLSIFSQD

SEQ ID NO: 2557424 - protein, 23 aa, Entamoeba dispar
IQKVHAILRGLLKLKIIDANMRI

SEQ ID NO: 2557425 - protein, 20 aa, Entamoeba dispar
IYKVYDLFYGGRRLKMSFSS

SEQ ID NO: 2557426 - protein, 23 aa, Entamoeba dispar
KCITLLFVLLFVTVVIQVVSWKD

SEQ ID NO: 2557427 - protein, 17 aa, Entamoeba dispar
KDFVPIDWYINSPYLDK

SEQ ID NO: 2557428 - protein, 17 aa, Entamoeba dispar
KEPLLKPLFLMYPEDEM

SEQ ID NO: 2557429 - protein, 19 aa, Entamoeba dispar
KFIYTVILFLFSRTPLQGA

SEQ ID NO: 2557430 - protein, 17 aa, Entamoeba dispar
KFLTKMLFPLHNNIISI

SEQ ID NO: 2557431 - protein, 17 aa, Entamoeba dispar
KIKDFVPIDWYINSPYL

SEQ ID NO: 2557432 - protein, 24 aa, Entamoeba dispar
KNKKLIRSIIFKSGAKMAAKMAAL

SEQ ID NO: 2557433 - protein, 18 aa, Entamoeba dispar
KPYEEIKIQLFIESVRRK

SEQ ID NO: 2557434 - protein, 29 aa, Entamoeba dispar
KRKKDALFLCLFWFLIEVTFDIDANGILN

SEQ ID NO: 2557435 - protein, 18 aa, Entamoeba dispar
KRMQVVNVLLPDGSTKKM

SEQ ID NO: 2557436 - protein, 24 aa, Entamoeba dispar
KSAYGKFFLGWYQQLLLDHANNVL

SEQ ID NO: 2557437 - protein, 24 aa, Entamoeba dispar
KSEYGKFFLGWYHQLLLDHTNKVL

SEQ ID NO: 2557438 - protein, 18 aa, Entamoeba dispar
KTLIFCAVLLFIATLQAD

SEQ ID NO: 2557439 - protein, 21 aa, Entamoeba dispar
KVIQTFMFRYLAPLQFGIIPI

SEQ ID NO: 2557440 - protein, 19 aa, Entamoeba dispar
KYALYQTILRRKGIQKTII

SEQ ID NO: 2557441 - protein, 18 aa, Entamoeba dispar
LCFLIILAAILVLPLHPL

SEQ ID NO: 2557442 - protein, 24 aa, Entamoeba dispar
LCIFFFIFLCHLAGIYLYGSGFLI

SEQ ID NO: 2557443 - protein, 18 aa, Entamoeba dispar
LCLAFVSAMELEGDYQLD

SEQ ID NO: 2557444 - protein, 20 aa, Entamoeba dispar
LEAYLTHHYMYLYWTNYKAN

SEQ ID NO: 2557445 - protein, 20 aa, Entamoeba dispar
LESKIKVLLLTNKKVKEKIK

SEQ ID NO: 2557446 - protein, 18 aa, Entamoeba dispar
LFINIVSSQFLSIKSPID

SEQ ID NO: 2557447 - protein, 18 aa, Entamoeba dispar
LFINLVSSQFLSIKSPID

SEQ ID NO: 2557448 - protein, 18 aa, Entamoeba dispar
LFIVYSLAAQGIDCAYHM

SEQ ID NO: 2557449 - protein, 18 aa, Entamoeba dispar
LFIYFCLSEECSIDSNNY

SEQ ID NO: 2557450 - protein, 18 aa, Entamoeba dispar
LFLFFFSIKPLTDEQPNQ

SEQ ID NO: 2557451 - protein, 17 aa, Entamoeba dispar
LGCCLASVWTPFQKKSS

SEQ ID NO: 2557452 - protein, 18 aa, Entamoeba dispar
LGYLIYKKELTWPIKESI

SEQ ID NO: 2557453 - protein, 24 aa, Entamoeba dispar
LIELLFVIPKKYPIVWYFDINITE

SEQ ID NO: 2557454 - protein, 27 aa, Entamoeba dispar
LIFLNNKFLIVLFLLMDDNPYTGKDGK

SEQ ID NO: 2557455 - protein, 19 aa, Entamoeba dispar
LIGIFFFICLTNGCQCVIY

SEQ ID NO: 2557456 - protein, 18 aa, Entamoeba dispar
LIVLLVTVDARRSNKKSS

SEQ ID NO: 2557457 - protein, 20 aa, Entamoeba dispar
LIYFFFIISLGQCLRKEEKV

SEQ ID NO: 2557458 - protein, 17 aa, Entamoeba dispar
LIYLYKSLNKGEQAEIL

SEQ ID NO: 2557459 - protein, 30 aa, Entamoeba dispar
LKRRIKFLKLPFFRILPINLGIIPLNFGVD

SEQ ID NO: 2557460 - protein, 18 aa, Entamoeba dispar
LLCSSFLIRYFDNLIRKS

SEQ ID NO: 2557461 - protein, 17 aa, Entamoeba dispar
LLFILYSNSERLCIPIA

SEQ ID NO: 2557462 - protein, 21 aa, Entamoeba dispar
LLKHLRLNFLLEYFPNIETIE

SEQ ID NO: 2557463 - protein, 17 aa, Entamoeba dispar
LNELYKKIAIKKTLLDM

SEQ ID NO: 2557464 - protein, 26 aa, Entamoeba dispar
LRYQMLPYWYSLWYYHRIDYNPVIRA

SEQ ID NO: 2557465 - protein, 20 aa, Entamoeba dispar
LSIFLITIYLSLLLYHPNEI

SEQ ID NO: 2557466 - protein, 18 aa, Entamoeba dispar
LSLFLTFSQALECNETNC

SEQ ID NO: 2557467 - protein, 17 aa, Entamoeba dispar
LSQDNMYSAWNPQLLIS

SEQ ID NO: 2557468 - protein, 18 aa, Entamoeba dispar
LTITLSLSASIDYVFTDV

SEQ ID NO: 2557469 - protein, 24 aa, Entamoeba dispar
LVASYHPLYYYKVWSRDAVFASII

SEQ ID NO: 2557470 - protein, 17 aa, Entamoeba dispar
LVFLSLLAVSFAAIVGM

SEQ ID NO: 2557471 - protein, 19 aa, Entamoeba dispar
LVMCFVYVIGNVYQQENDV

SEQ ID NO: 2557472 - protein, 17 aa, Entamoeba dispar
LWRAVPYYCYRWGMTEE

SEQ ID NO: 2557473 - protein, 26 aa, Entamoeba dispar
MMYQPILPIYIPPIRFIPNPYYYYRR

SEQ ID NO: 2557474 - protein, 19 aa, Entamoeba dispar
MSFYKIIGYPTGLGALLVK

SEQ ID NO: 2557475 - protein, 17 aa, Entamoeba dispar
MYDGKYKFYLPTNGTCE

SEQ ID NO: 2557476 - protein, 19 aa, Entamoeba dispar
NEVQFYRYGVRPYVPYDRY

SEQ ID NO: 2557477 - protein, 20 aa, Entamoeba dispar
NKKMYLNPRYYYGLSFVNTP

SEQ ID NO: 2557478 - protein, 17 aa, Entamoeba dispar
NLALLKLLLQVTNVTSK

SEQ ID NO: 2557479 - protein, 22 aa, Entamoeba dispar
NLKVQWWFPLVERLDAKDLQNL

SEQ ID NO: 2557480 - protein, 22 aa, Entamoeba dispar
NLNDSLYYLYRDLKYATVAEDR

SEQ ID NO: 2557481 - protein, 20 aa, Entamoeba dispar
NMYSAWNPQLLISLKAPQNV

SEQ ID NO: 2557482 - protein, 25 aa, Entamoeba dispar
NNEITLFYYFLPFTTNIDNNKKMYL

SEQ ID NO: 2557483 - protein, 27 aa, Entamoeba dispar
NNLHKFYSMFIFILIIVITNATESINN

SEQ ID NO: 2557484 - protein, 27 aa, Entamoeba dispar
NQVTSTPIIFRLCEWYSIIPEPDKHYS

SEQ ID NO: 2557485 - protein, 25 aa, Entamoeba dispar
NSELTNFFYFLPFEINIDNDKKMYL

SEQ ID NO: 2557486 - protein, 25 aa, Entamoeba dispar
NSELTNFFYFLPFTININNDKKMYL

SEQ ID NO: 2557487 - protein, 23 aa, Entamoeba dispar
NTFYSILYRSLLFPHNITENGYY

SEQ ID NO: 2557488 - protein, 32 aa, Entamoeba dispar
NTSLWQFFPVWLQYLCWPILQVVFKTPLEGAQ

SEQ ID NO: 2557489 - protein, 20 aa, Entamoeba dispar
NWFYSFPFLYDKILPSAVCP

SEQ ID NO: 2557490 - protein, 19 aa, Entamoeba dispar
NYKLRILRLKMADAKIRIT

SEQ ID NO: 2557491 - protein, 23 aa, Entamoeba dispar
PKAREWWIELYSFEKYQYSSPYL

SEQ ID NO: 2557492 - protein, 20 aa, Entamoeba dispar
PLEEYILPPRLYPYIEYGKT

SEQ ID NO: 2557493 - protein, 27 aa, Entamoeba dispar
PNSELVYFYYFLPFTLYIDNNKKMYLI

SEQ ID NO: 2557494 - protein, 26 aa, Entamoeba dispar
PQDNLLNPWYWIYQPVAYKLNSRMGT

SEQ ID NO: 2557495 - protein, 20 aa, Entamoeba dispar
PSLFLILLFLFCVGSLSNKK

SEQ ID NO: 2557496 - protein, 20 aa, Entamoeba dispar
PVDFYYDFMNAFNVAFKSYI

SEQ ID NO: 2557497 - protein, 18 aa, Entamoeba dispar
PVYLSFVGYGKPVVISTC

SEQ ID NO: 2557498 - protein, 23 aa, Entamoeba dispar
PYGTSFLEFEAYTKALLSEEVKI

SEQ ID NO: 2557499 - protein, 26 aa, Entamoeba dispar
QDNMYSAWNPQLLISLKAPQAVAAMN

SEQ ID NO: 2557500 - protein, 23 aa, Entamoeba dispar
QKRLIVQLRRLYRHKKVLLRDIK

SEQ ID NO: 2557501 - protein, 21 aa, Entamoeba dispar
QLDLEYKKFYPWIIIADGNGN

SEQ ID NO: 2557502 - protein, 25 aa, Entamoeba dispar
QPQDNLLNPWYWIYQPASYSLNSRM

SEQ ID NO: 2557503 - protein, 24 aa, Entamoeba dispar
QSENKKLFLIEKLHDFIPIENKEI

SEQ ID NO: 2557504 - protein, 21 aa, Entamoeba dispar
RATINPLPRWGNYQRFGAYMR

SEQ ID NO: 2557505 - protein, 25 aa, Entamoeba dispar
RHFWHYRNWWLRRHWLRNWKRQMRR

SEQ ID NO: 2557506 - protein, 26 aa, Entamoeba dispar
RHFWHYRNWWLRRHWLRNWKRQMRRW

SEQ ID NO: 2557507 - protein, 17 aa, Entamoeba dispar
RILRLKMADAKIRITEH

SEQ ID NO: 2557508 - protein, 27 aa, Entamoeba dispar
RKAINTLLFMRFLYTPLIQSPSLFKKI

SEQ ID NO: 2557509 - protein, 18 aa, Entamoeba dispar
RLIRRINLRYRFSFGTEL

SEQ ID NO: 2557510 - protein, 22 aa, Entamoeba dispar
RMRRKRILALKKNLKKMYLERR

SEQ ID NO: 2557511 - protein, 23 aa, Entamoeba dispar
RMRRKRILALKKNLKKMYLERRD

SEQ ID NO: 2557512 - protein, 27 aa, Entamoeba dispar
RQGKDFLFFILLFVSLVTLVLASLCVY

SEQ ID NO: 2557513 - protein, 21 aa, Entamoeba dispar
RTKRMVLAKMYKILRVLAPVE

SEQ ID NO: 2557514 - protein, 30 aa, Entamoeba dispar
SDDTYYCPLTDLFLPYYFSVTKDSSNAITI

SEQ ID NO: 2557515 - protein, 30 aa, Entamoeba dispar
SDNTYYCPLTDLFLPYYFNVTKNSKDMSKI

SEQ ID NO: 2557516 - protein, 21 aa, Entamoeba dispar
SKDWFTLWLNLLDGIPYVNDC

SEQ ID NO: 2557517 - protein, 21 aa, Entamoeba dispar
SKFYKYLDWINLMTYDLHGSW

SEQ ID NO: 2557518 - protein, 17 aa, Entamoeba dispar
SLYYYIYQLSLSTNNYI

SEQ ID NO: 2557519 - protein, 23 aa, Entamoeba dispar
SSITLLHHILFKLNLQFQILNEL

SEQ ID NO: 2557520 - protein, 25 aa, Entamoeba dispar
SYLTHQWIWIYWQNYLKNEYKHGIK

SEQ ID NO: 2557521 - protein, 17 aa, Entamoeba dispar
TDILWVFQWHFVELQPT

SEQ ID NO: 2557522 - protein, 18 aa, Entamoeba dispar
TDRNTFYSILYRSLLFPH

SEQ ID NO: 2557523 - protein, 23 aa, Entamoeba dispar
TEEELLIRWYQVGAFYPFFRAHA

SEQ ID NO: 2557524 - protein, 20 aa, Entamoeba dispar
TIIITPVELVFPFSTNPRIR

SEQ ID NO: 2557525 - protein, 17 aa, Entamoeba dispar
TILTFSNAYEDYSDVLD

SEQ ID NO: 2557526 - protein, 18 aa, Entamoeba dispar
TLTIHWQFDVTLRGLRKV

SEQ ID NO: 2557527 - protein, 20 aa, Entamoeba dispar
TLWPEIPWKKITGIWRKFIS

SEQ ID NO: 2557528 - protein, 19 aa, Entamoeba dispar
TLYFKYYCPYKPGSELKYF

SEQ ID NO: 2557529 - protein, 20 aa, Entamoeba dispar
TPRVMEILSKRLNIPMTAVA

SEQ ID NO: 2557530 - protein, 23 aa, Entamoeba dispar
TSGNEFIFKSFKVTLIDNKNTIP

SEQ ID NO: 2557531 - protein, 17 aa, Entamoeba dispar
VAQLDLEYKKFYPWIII

SEQ ID NO: 2557532 - protein, 20 aa, Entamoeba dispar
VCKSLFMKYLRKQPNWNIKL

SEQ ID NO: 2557533 - protein, 17 aa, Entamoeba dispar
VIHFYVWDSAITPSGRK

SEQ ID NO: 2557534 - protein, 22 aa, Entamoeba dispar
VILFLFFCSFAQKFSIIKKGNS

SEQ ID NO: 2557535 - protein, 19 aa, Entamoeba dispar
VIPRSLAFGVIKESQGFVK

SEQ ID NO: 2557536 - protein, 17 aa, Entamoeba dispar
VITLIPLYIIIESIFIS

SEQ ID NO: 2557537 - protein, 22 aa, Entamoeba dispar
VKNQLLLMPYPTTVNAQFGRND

SEQ ID NO: 2557538 - protein, 17 aa, Entamoeba dispar
VLFLVYSNAVITFPHVI

SEQ ID NO: 2557539 - protein, 19 aa, Entamoeba dispar
VRNIIYFRIEAIRKEIKAL

SEQ ID NO: 2557540 - protein, 17 aa, Entamoeba dispar
WMNWMDMIWVTTVSPEI

SEQ ID NO: 2557541 - protein, 18 aa, Entamoeba dispar
WYHDSWRYALQSRPYHIS

SEQ ID NO: 2557542 - protein, 21 aa, Entamoeba dispar
YFRNRHVMLFCYDITKKESFN

SEQ ID NO: 2557543 - protein, 19 aa, Entamoeba dispar
YIEYYYYLLKYKKNFDRVL

SEQ ID NO: 2557544 - protein, 17 aa, Entamoeba dispar
YKFGGFTIAMKQFEGTT

SEQ ID NO: 2557545 - protein, 20 aa, Entamoeba dispar
YLSCIISFASAELYTFDDFE

SEQ ID NO: 2557546 - protein, 18 aa, Entamoeba dispar
YVPEKPRYYRPTKFVTPV

SEQ ID NO: 2557547 - protein, 20 aa, Entamoeba dispar
YYYRRPYYRLSPYVRGLYLN

SEQ ID NO: 2557548 - protein, 5 aa, Entamoeba histolytica
DFGSA

SEQ ID NO: 2557549 - protein, 9 aa, Entamoeba histolytica
TNEEGNECN

SEQ ID NO: 2557550 - protein, 5 aa, Entamoeba histolytica
GCREC

SEQ ID NO: 2557551 - protein, 5 aa, Entamoeba histolytica
GSGCG

SEQ ID NO: 2557552 - protein, 7 aa, Entamoeba histolytica
HKVTQPS

SEQ ID NO: 2557553 - protein, 15 aa, Entamoeba histolytica
IDEVKGCKGEIDKEY

SEQ ID NO: 2557554 - protein, 10 aa, Entamoeba histolytica
GDPYGKDEEF

SEQ ID NO: 2557555 - protein, 13 aa, Entamoeba histolytica
HGGYECGDNGEWS

SEQ ID NO: 2557556 - protein, 4 aa, Entamoeba histolytica
KYIK

SEQ ID NO: 2557557 - protein, 8 aa, Entamoeba histolytica
NDKKEKMK

SEQ ID NO: 2557558 - protein, 8 aa, Entamoeba histolytica
NKAQEETI

SEQ ID NO: 2557559 - protein, 15 aa, Entamoeba histolytica
SSKEENEKYSIRTNP

SEQ ID NO: 2557560 - protein, 7 aa, Entamoeba histolytica
TINGEDP

SEQ ID NO: 2557561 - protein, 6 aa, Entamoeba histolytica
HPRKPT

SEQ ID NO: 2557562 - protein, 6 aa, Entamoeba histolytica
KEVKNN

SEQ ID NO: 2557563 - protein, 20 aa, Entamoeba histolytica
KKALDENDRITRKFTSKDNN

SEQ ID NO: 2557564 - protein, 10 aa, Entamoeba histolytica
PKTCQQRRSK

SEQ ID NO: 2557565 - protein, 8 aa, Entamoeba histolytica
SKCKENCT

SEQ ID NO: 2557566 - protein, 6 aa, Entamoeba histolytica
ECNSCE

SEQ ID NO: 2557567 - protein, 6 aa, Entamoeba histolytica
ESDYTK

SEQ ID NO: 2557568 - protein, 7 aa, Entamoeba histolytica
GIGTPKY

SEQ ID NO: 2557569 - protein, 4 aa, Entamoeba histolytica
PNNP

SEQ ID NO: 2557570 - protein, 11 aa, Entamoeba histolytica
EIELQEGEEIK

SEQ ID NO: 2557571 - protein, 30 aa, Entamoeba histolytica
ETASVSNSNEKLKQGIRKPLTEEETKDIIN

SEQ ID NO: 2557572 - protein, 4 aa, Entamoeba histolytica
ETIP

SEQ ID NO: 2557573 - protein, 14 aa, Entamoeba histolytica
GHGGYECGDNGEWS

SEQ ID NO: 2557574 - protein, 26 aa, Entamoeba histolytica
IEGETEISTRLDPDEIKEEKKIGEGS

SEQ ID NO: 2557575 - protein, 11 aa, Entamoeba histolytica
KNPPQPSFSNN

SEQ ID NO: 2557576 - protein, 14 aa, Entamoeba histolytica
QVEESEDKKKEFEK

SEQ ID NO: 2557577 - protein, 11 aa, Entamoeba histolytica
REKKEREKTTT

SEQ ID NO: 2557578 - protein, 11 aa, Entamoeba histolytica
TSALDTQSEKI

SEQ ID NO: 2557579 - protein, 9 aa, Entamoeba histolytica
WQQEPKERI

SEQ ID NO: 2557580 - protein, 11 aa, Entamoeba histolytica
KEKKEREKTTT

SEQ ID NO: 2557581 - protein, 7 aa, Entamoeba histolytica
KNGGGYS

SEQ ID NO: 2557582 - protein, 6 aa, Entamoeba histolytica
NGESVS

SEQ ID NO: 2557583 - protein, 5 aa, Entamoeba histolytica
NITEI

SEQ ID NO: 2557584 - protein, 8 aa, Entamoeba histolytica
SGCGKSTT

SEQ ID NO: 2557585 - protein, 6 aa, Entamoeba histolytica
TDFGTS

SEQ ID NO: 2557586 - protein, 10 aa, Entamoeba histolytica
TKCNPKNKRL

SEQ ID NO: 2557587 - protein, 5 aa, Entamoeba histolytica
EPYKE

SEQ ID NO: 2557588 - protein, 10 aa, Entamoeba histolytica
NCEEQNTYGC

SEQ ID NO: 2557589 - protein, 6 aa, Entamoeba histolytica
PPIGGG

SEQ ID NO: 2557590 - protein, 7 aa, Entamoeba histolytica
SALSTKL

SEQ ID NO: 2557591 - protein, 4 aa, Entamoeba histolytica
APIE

SEQ ID NO: 2557592 - protein, 4 aa, Entamoeba histolytica
CNQK

SEQ ID NO: 2557593 - protein, 7 aa, Entamoeba histolytica
DDNRNEC

SEQ ID NO: 2557594 - protein, 18 aa, Entamoeba histolytica
DKYLSSNRTCQSNKELNG

SEQ ID NO: 2557595 - protein, 18 aa, Entamoeba histolytica
DKYLSSNRTCQSNNELNG

SEQ ID NO: 2557596 - protein, 8 aa, Entamoeba histolytica
DNQQLDNN

SEQ ID NO: 2557597 - protein, 14 aa, Entamoeba histolytica
EDECQNKPNDDGSI

SEQ ID NO: 2557598 - protein, 9 aa, Entamoeba histolytica
EKIKQNEHF

SEQ ID NO: 2557599 - protein, 6 aa, Entamoeba histolytica
ENCTEE

SEQ ID NO: 2557600 - protein, 5 aa, Entamoeba histolytica
FPDSE

SEQ ID NO: 2557601 - protein, 9 aa, Entamoeba histolytica
IQNPSNNDQ

SEQ ID NO: 2557602 - protein, 5 aa, Entamoeba histolytica
ITEIS

SEQ ID NO: 2557603 - protein, 6 aa, Entamoeba histolytica
KCDDNC

SEQ ID NO: 2557604 - protein, 12 aa, Entamoeba histolytica
KEIELQEGEEIK

SEQ ID NO: 2557605 - protein, 6 aa, Entamoeba histolytica
KTNSQY

SEQ ID NO: 2557606 - protein, 10 aa, Entamoeba histolytica
LDKINTKTTS

SEQ ID NO: 2557607 - protein, 5 aa, Entamoeba histolytica
NPPDE

SEQ ID NO: 2557608 - protein, 8 aa, Entamoeba histolytica
NSKKEKMK

SEQ ID NO: 2557609 - protein, 10 aa, Entamoeba histolytica
PSLQESKEFN

SEQ ID NO: 2557610 - protein, 9 aa, Entamoeba histolytica
QTTEGANNA

SEQ ID NO: 2557611 - protein, 8 aa, Entamoeba histolytica
SEQNNERN

SEQ ID NO: 2557612 - protein, 7 aa, Entamoeba histolytica
SKEELPG

SEQ ID NO: 2557613 - protein, 5 aa, Entamoeba histolytica
SLGGG

SEQ ID NO: 2557614 - protein, 11 aa, Entamoeba histolytica
TEVKESYEETI

SEQ ID NO: 2557615 - protein, 12 aa, Entamoeba histolytica
TSALDSESEKIV

SEQ ID NO: 2557616 - protein, 7 aa, Entamoeba histolytica
TTPSLNQ

SEQ ID NO: 2557617 - protein, 7 aa, Entamoeba histolytica
YYRNGKG

SEQ ID NO: 2557618 - protein, 11 aa, Entamoeba histolytica
AYNQQTETELK

SEQ ID NO: 2557619 - protein, 4 aa, Entamoeba histolytica
CNSD

SEQ ID NO: 2557620 - protein, 5 aa, Entamoeba histolytica
CTVSE

SEQ ID NO: 2557621 - protein, 18 aa, Entamoeba histolytica
DDPSLDSEHFRTKSGVEL

SEQ ID NO: 2557622 - protein, 7 aa, Entamoeba histolytica
DPYDPMK

SEQ ID NO: 2557623 - protein, 8 aa, Entamoeba histolytica
EDEKNTLQ

SEQ ID NO: 2557624 - protein, 10 aa, Entamoeba histolytica
EETKNGGVPF

SEQ ID NO: 2557625 - protein, 8 aa, Entamoeba histolytica
EFEEETKK

SEQ ID NO: 2557626 - protein, 8 aa, Entamoeba histolytica
EGKEGIEQ

SEQ ID NO: 2557627 - protein, 30 aa, Entamoeba histolytica
EGVPTPNNEVYSESDEKSQSEEISTDGSNP

SEQ ID NO: 2557628 - protein, 6 aa, Entamoeba histolytica
EQRRAE

SEQ ID NO: 2557629 - protein, 10 aa, Entamoeba histolytica
ESKGSDGKIT

SEQ ID NO: 2557630 - protein, 7 aa, Entamoeba histolytica
ETDKEYY

SEQ ID NO: 2557631 - protein, 7 aa, Entamoeba histolytica
ETTDEPI

SEQ ID NO: 2557632 - protein, 6 aa, Entamoeba histolytica
FAEQTK

SEQ ID NO: 2557633 - protein, 13 aa, Entamoeba histolytica
GSEFNAETEFDRK

SEQ ID NO: 2557634 - protein, 9 aa, Entamoeba histolytica
GTDVAKQAS

SEQ ID NO: 2557635 - protein, 15 aa, Entamoeba histolytica
HGHGGYECGDNGEWS

SEQ ID NO: 2557636 - protein, 6 aa, Entamoeba histolytica
IAEETI

SEQ ID NO: 2557637 - protein, 10 aa, Entamoeba histolytica
IGGECPTECN

SEQ ID NO: 2557638 - protein, 9 aa, Entamoeba histolytica
ISRKDQMTL

SEQ ID NO: 2557639 - protein, 7 aa, Entamoeba histolytica
KAEQGKT

SEQ ID NO: 2557640 - protein, 15 aa, Entamoeba histolytica
KANCEADQKPSSDGY

SEQ ID NO: 2557641 - protein, 9 aa, Entamoeba histolytica
KCNQNTEVD

SEQ ID NO: 2557642 - protein, 7 aa, Entamoeba histolytica
KDQKLER

SEQ ID NO: 2557643 - protein, 5 aa, Entamoeba histolytica
KESVN

SEQ ID NO: 2557644 - protein, 8 aa, Entamoeba histolytica
KGNKIRSN

SEQ ID NO: 2557645 - protein, 9 aa, Entamoeba histolytica
KNGGGYSNY

SEQ ID NO: 2557646 - protein, 9 aa, Entamoeba histolytica
KNYQDGIGP

SEQ ID NO: 2557647 - protein, 9 aa, Entamoeba histolytica
LLSGGQKQR

SEQ ID NO: 2557648 - protein, 8 aa, Entamoeba histolytica
NCKKSERN

SEQ ID NO: 2557649 - protein, 6 aa, Entamoeba histolytica
NETIPG

SEQ ID NO: 2557650 - protein, 5 aa, Entamoeba histolytica
NEYQT

SEQ ID NO: 2557651 - protein, 17 aa, Entamoeba histolytica
NYEPNGGRVTLDGKDIR

SEQ ID NO: 2557652 - protein, 5 aa, Entamoeba histolytica
PFPKS

SEQ ID NO: 2557653 - protein, 8 aa, Entamoeba histolytica
PQSNGDKY

SEQ ID NO: 2557654 - protein, 7 aa, Entamoeba histolytica
PTITPNQ

SEQ ID NO: 2557655 - protein, 15 aa, Entamoeba histolytica
QSMEEEVDQETVEND

SEQ ID NO: 2557656 - protein, 10 aa, Entamoeba histolytica
QTDRTQQLNN

SEQ ID NO: 2557657 - protein, 14 aa, Entamoeba histolytica
QVEENEDKKKEFEK

SEQ ID NO: 2557658 - protein, 8 aa, Entamoeba histolytica
RGKNAGSW

SEQ ID NO: 2557659 - protein, 9 aa, Entamoeba histolytica
SKNSTTNYL

SEQ ID NO: 2557660 - protein, 4 aa, Entamoeba histolytica
SNNY

SEQ ID NO: 2557661 - protein, 4 aa, Entamoeba histolytica
SPTD

SEQ ID NO: 2557662 - protein, 14 aa, Entamoeba histolytica
SSKEENEKYSIRTN

SEQ ID NO: 2557663 - protein, 11 aa, Entamoeba histolytica
STKNCNKVSNT

SEQ ID NO: 2557664 - protein, 7 aa, Entamoeba histolytica
TDFGSSR

SEQ ID NO: 2557665 - protein, 9 aa, Entamoeba histolytica
TERCDRDKC

SEQ ID NO: 2557666 - protein, 7 aa, Entamoeba histolytica
TGECDGT

SEQ ID NO: 2557667 - protein, 9 aa, Entamoeba histolytica
TTSIDTSAS

SEQ ID NO: 2557668 - protein, 9 aa, Entamoeba histolytica
TYATKTEAY

SEQ ID NO: 2557669 - protein, 13 aa, Entamoeba histolytica
TYSSCGGDSTGSV

SEQ ID NO: 2557670 - protein, 7 aa, Entamoeba histolytica
VCQNDNS

SEQ ID NO: 2557671 - protein, 4 aa, Entamoeba histolytica
VETG

SEQ ID NO: 2557672 - protein, 7 aa, Entamoeba histolytica
VGSGKSS

SEQ ID NO: 2557673 - protein, 10 aa, Entamoeba histolytica
VNGIKARENK

SEQ ID NO: 2557674 - protein, 7 aa, Entamoeba histolytica
YGGEYSD

SEQ ID NO: 2557675 - protein, 7 aa, Entamoeba histolytica
YNTNTTS

SEQ ID NO: 2557676 - protein, 5 aa, Entamoeba histolytica
YRGRE

SEQ ID NO: 2557677 - protein, 5 aa, Entamoeba histolytica
AEDLE

SEQ ID NO: 2557678 - protein, 7 aa, Entamoeba histolytica
AEPDFGP

SEQ ID NO: 2557679 - protein, 7 aa, Entamoeba histolytica
AERGTHQ

SEQ ID NO: 2557680 - protein, 13 aa, Entamoeba histolytica
ARNLTQEQEKEFN

SEQ ID NO: 2557681 - protein, 4 aa, Entamoeba histolytica
ASID

SEQ ID NO: 2557682 - protein, 13 aa, Entamoeba histolytica
ATCNQKDKCTTCA

SEQ ID NO: 2557683 - protein, 14 aa, Entamoeba histolytica
CESKENKNGKNEEI

SEQ ID NO: 2557684 - protein, 9 aa, Entamoeba histolytica
CKRCSKGYA

SEQ ID NO: 2557685 - protein, 11 aa, Entamoeba histolytica
CNSRKSQCGNF

SEQ ID NO: 2557686 - protein, 13 aa, Entamoeba histolytica
CTRTFTKDDEDDF

SEQ ID NO: 2557687 - protein, 10 aa, Entamoeba histolytica
DDQLENGGNL

SEQ ID NO: 2557688 - protein, 8 aa, Entamoeba histolytica
DHTSCKRC

SEQ ID NO: 2557689 - protein, 9 aa, Entamoeba histolytica
DKAAKGRTT

SEQ ID NO: 2557690 - protein, 7 aa, Entamoeba histolytica
DKNLTEV

SEQ ID NO: 2557691 - protein, 24 aa, Entamoeba histolytica
DKQKESDEIELGNNEYQEPTPIED

SEQ ID NO: 2557692 - protein, 5 aa, Entamoeba histolytica
DSNDY

SEQ ID NO: 2557693 - protein, 29 aa, Entamoeba histolytica
DTERSNANPKPRNPCETATCNQTTGETIY

SEQ ID NO: 2557694 - protein, 5 aa, Entamoeba histolytica
EECYY

SEQ ID NO: 2557695 - protein, 7 aa, Entamoeba histolytica
EEPAGGS

SEQ ID NO: 2557696 - protein, 9 aa, Entamoeba histolytica
EEPDKMGDE

SEQ ID NO: 2557697 - protein, 9 aa, Entamoeba histolytica
EKASKGRTT

SEQ ID NO: 2557698 - protein, 9 aa, Entamoeba histolytica
EKASQGRTT

SEQ ID NO: 2557699 - protein, 23 aa, Entamoeba histolytica
ELGSDNSLAHTKVSKNTISSQQY

SEQ ID NO: 2557700 - protein, 8 aa, Entamoeba histolytica
ENGENFSL

SEQ ID NO: 2557701 - protein, 8 aa, Entamoeba histolytica
ENRCQSCK

SEQ ID NO: 2557702 - protein, 4 aa, Entamoeba histolytica
EPYK

SEQ ID NO: 2557703 - protein, 5 aa, Entamoeba histolytica
EQGKH

SEQ ID NO: 2557704 - protein, 5 aa, Entamoeba histolytica
EQGTH

SEQ ID NO: 2557705 - protein, 6 aa, Entamoeba histolytica
EQGTHQ

SEQ ID NO: 2557706 - protein, 5 aa, Entamoeba histolytica
ESDYT

SEQ ID NO: 2557707 - protein, 7 aa, Entamoeba histolytica
ESGELTA

SEQ ID NO: 2557708 - protein, 4 aa, Entamoeba histolytica
ESPI

SEQ ID NO: 2557709 - protein, 22 aa, Entamoeba histolytica
EYTLNNGTCESKENKNGKNEEI

SEQ ID NO: 2557710 - protein, 4 aa, Entamoeba histolytica
FPNN

SEQ ID NO: 2557711 - protein, 9 aa, Entamoeba histolytica
FSETTSSMK

SEQ ID NO: 2557712 - protein, 5 aa, Entamoeba histolytica
GAEET

SEQ ID NO: 2557713 - protein, 25 aa, Entamoeba histolytica
GATPSKTRNQEDEGPKEANTIQTPE

SEQ ID NO: 2557714 - protein, 10 aa, Entamoeba histolytica
GCKGEIDKEY

SEQ ID NO: 2557715 - protein, 14 aa, Entamoeba histolytica
GDRGAQISGGQKQR

SEQ ID NO: 2557716 - protein, 4 aa, Entamoeba histolytica
GECD

SEQ ID NO: 2557717 - protein, 14 aa, Entamoeba histolytica
GERGTSLSGGQKQR

SEQ ID NO: 2557718 - protein, 7 aa, Entamoeba histolytica
GKSNEEF

SEQ ID NO: 2557719 - protein, 4 aa, Entamoeba histolytica
GNDW

SEQ ID NO: 2557720 - protein, 6 aa, Entamoeba histolytica
GNKTEG

SEQ ID NO: 2557721 - protein, 10 aa, Entamoeba histolytica
GRTGSGKSTM

SEQ ID NO: 2557722 - protein, 22 aa, Entamoeba histolytica
GTGDTAEYNPKDGAGDDNKDPI

SEQ ID NO: 2557723 - protein, 18 aa, Entamoeba histolytica
HENKYNNDENTQNQTYNR

SEQ ID NO: 2557724 - protein, 4 aa, Entamoeba histolytica
IEEM

SEQ ID NO: 2557725 - protein, 5 aa, Entamoeba histolytica
IESSN

SEQ ID NO: 2557726 - protein, 11 aa, Entamoeba histolytica
IETKESQRMYN

SEQ ID NO: 2557727 - protein, 10 aa, Entamoeba histolytica
IGKNSKINWN

SEQ ID NO: 2557728 - protein, 5 aa, Entamoeba histolytica
IGSSG

SEQ ID NO: 2557729 - protein, 4 aa, Entamoeba histolytica
IQNA

SEQ ID NO: 2557730 - protein, 5 aa, Entamoeba histolytica
ITEIP

SEQ ID NO: 2557731 - protein, 7 aa, Entamoeba histolytica
KDCENVT

SEQ ID NO: 2557732 - protein, 27 aa, Entamoeba histolytica
KDGIKTTTCKNTTKTTCDTNNKRIEDA

SEQ ID NO: 2557733 - protein, 8 aa, Entamoeba histolytica
KEADKEAY

SEQ ID NO: 2557734 - protein, 7 aa, Entamoeba histolytica
KETTVGC

SEQ ID NO: 2557735 - protein, 5 aa, Entamoeba histolytica
KGCTS

SEQ ID NO: 2557736 - protein, 7 aa, Entamoeba histolytica
KKIGEGS

SEQ ID NO: 2557737 - protein, 10 aa, Entamoeba histolytica
KNNSERNDSI

SEQ ID NO: 2557738 - protein, 8 aa, Entamoeba histolytica
KNPHDPIT

SEQ ID NO: 2557739 - protein, 9 aa, Entamoeba histolytica
KNPSDPITA

SEQ ID NO: 2557740 - protein, 8 aa, Entamoeba histolytica
KQCTVKPG

SEQ ID NO: 2557741 - protein, 7 aa, Entamoeba histolytica
KQGRKGC

SEQ ID NO: 2557742 - protein, 4 aa, Entamoeba histolytica
KRLD

SEQ ID NO: 2557743 - protein, 9 aa, Entamoeba histolytica
KSESCTGKI

SEQ ID NO: 2557744 - protein, 4 aa, Entamoeba histolytica
KSPN

SEQ ID NO: 2557745 - protein, 10 aa, Entamoeba histolytica
KSTPPAKRSV

SEQ ID NO: 2557746 - protein, 4 aa, Entamoeba histolytica
KTAT

SEQ ID NO: 2557747 - protein, 10 aa, Entamoeba histolytica
KVVEQGTHDE

SEQ ID NO: 2557748 - protein, 10 aa, Entamoeba histolytica
LDKASKGRTT

SEQ ID NO: 2557749 - protein, 4 aa, Entamoeba histolytica
LETL

SEQ ID NO: 2557750 - protein, 6 aa, Entamoeba histolytica
LNSETS

SEQ ID NO: 2557751 - protein, 6 aa, Entamoeba histolytica
LPEGYD

SEQ ID NO: 2557752 - protein, 9 aa, Entamoeba histolytica
LSETSTDIN

SEQ ID NO: 2557753 - protein, 4 aa, Entamoeba histolytica
LSKS

SEQ ID NO: 2557754 - protein, 9 aa, Entamoeba histolytica
NAYDGDERF

SEQ ID NO: 2557755 - protein, 8 aa, Entamoeba histolytica
NCKNSERN

SEQ ID NO: 2557756 - protein, 5 aa, Entamoeba histolytica
NDDNF

SEQ ID NO: 2557757 - protein, 17 aa, Entamoeba histolytica
NDTVNPIAETDPTSPLA

SEQ ID NO: 2557758 - protein, 8 aa, Entamoeba histolytica
NETSKTTY

SEQ ID NO: 2557759 - protein, 7 aa, Entamoeba histolytica
NKAQEET

SEQ ID NO: 2557760 - protein, 9 aa, Entamoeba histolytica
NKDPKITRS

SEQ ID NO: 2557761 - protein, 8 aa, Entamoeba histolytica
NKEERNTE

SEQ ID NO: 2557762 - protein, 13 aa, Entamoeba histolytica
NLDPTFQKSDEEM

SEQ ID NO: 2557763 - protein, 13 aa, Entamoeba histolytica
NNKCVKDKEECYY

SEQ ID NO: 2557764 - protein, 8 aa, Entamoeba histolytica
NNTCVKDK

SEQ ID NO: 2557765 - protein, 11 aa, Entamoeba histolytica
NRLEKPDGIPE

SEQ ID NO: 2557766 - protein, 12 aa, Entamoeba histolytica
NRTLAQSVGGAV

SEQ ID NO: 2557767 - protein, 4 aa, Entamoeba histolytica
NSSK

SEQ ID NO: 2557768 - protein, 4 aa, Entamoeba histolytica
NTNN

SEQ ID NO: 2557769 - protein, 22 aa, Entamoeba histolytica
NTPSASPMPLDGTVTNKDKSPL

SEQ ID NO: 2557770 - protein, 6 aa, Entamoeba histolytica
PESSYI

SEQ ID NO: 2557771 - protein, 5 aa, Entamoeba histolytica
PIGSG

SEQ ID NO: 2557772 - protein, 14 aa, Entamoeba histolytica
PKAKPKAKKECPAT

SEQ ID NO: 2557773 - protein, 4 aa, Entamoeba histolytica
PNEC

SEQ ID NO: 2557774 - protein, 16 aa, Entamoeba histolytica
PSGDPSNSPEDNKTTG

SEQ ID NO: 2557775 - protein, 7 aa, Entamoeba histolytica
PTRADNE

SEQ ID NO: 2557776 - protein, 9 aa, Entamoeba histolytica
PTTTSTGQF

SEQ ID NO: 2557777 - protein, 9 aa, Entamoeba histolytica
QEGKEAKLK

SEQ ID NO: 2557778 - protein, 11 aa, Entamoeba histolytica
QFTEAKDEFVE

SEQ ID NO: 2557779 - protein, 11 aa, Entamoeba histolytica
QLTNQKEIKRN

SEQ ID NO: 2557780 - protein, 4 aa, Entamoeba histolytica
QRIA

SEQ ID NO: 2557781 - protein, 9 aa, Entamoeba histolytica
QSNRRMGAK

SEQ ID NO: 2557782 - protein, 11 aa, Entamoeba histolytica
QTKCNPKNKRL

SEQ ID NO: 2557783 - protein, 5 aa, Entamoeba histolytica
QTTGF

SEQ ID NO: 2557784 - protein, 11 aa, Entamoeba histolytica
QVDNNKPKRKM

SEQ ID NO: 2557785 - protein, 8 aa, Entamoeba histolytica
RASESSKS

SEQ ID NO: 2557786 - protein, 5 aa, Entamoeba histolytica
REKVQ

SEQ ID NO: 2557787 - protein, 13 aa, Entamoeba histolytica
RGVPEGVEVSNEQ

SEQ ID NO: 2557788 - protein, 6 aa, Entamoeba histolytica
RIDNGK

SEQ ID NO: 2557789 - protein, 8 aa, Entamoeba histolytica
RITEETKK

SEQ ID NO: 2557790 - protein, 5 aa, Entamoeba histolytica
SCPEN

SEQ ID NO: 2557791 - protein, 6 aa, Entamoeba histolytica
SEAEYN

SEQ ID NO: 2557792 - protein, 8 aa, Entamoeba histolytica
SGELTSRI

SEQ ID NO: 2557793 - protein, 5 aa, Entamoeba histolytica
SGPDS

SEQ ID NO: 2557794 - protein, 7 aa, Entamoeba histolytica
SGWATAA

SEQ ID NO: 2557795 - protein, 20 aa, Entamoeba histolytica
SKCKENCTRCSTENECNSCE

SEQ ID NO: 2557796 - protein, 5 aa, Entamoeba histolytica
SKPLS

SEQ ID NO: 2557797 - protein, 8 aa, Entamoeba histolytica
SLNQGYAA

SEQ ID NO: 2557798 - protein, 11 aa, Entamoeba histolytica
SNEKQSSNPLK

SEQ ID NO: 2557799 - protein, 7 aa, Entamoeba histolytica
SNQSNKP

SEQ ID NO: 2557800 - protein, 25 aa, Entamoeba histolytica
SNSNEKLKQGIRKPLTEEETKDIIN

SEQ ID NO: 2557801 - protein, 12 aa, Entamoeba histolytica
SSPTQCSSCSKG

SEQ ID NO: 2557802 - protein, 6 aa, Entamoeba histolytica
SSSTYY

SEQ ID NO: 2557803 - protein, 13 aa, Entamoeba histolytica
STKQTLKQAVPDN

SEQ ID NO: 2557804 - protein, 8 aa, Entamoeba histolytica
TAGTGQVD

SEQ ID NO: 2557805 - protein, 11 aa, Entamoeba histolytica
TESWGGCGGGF

SEQ ID NO: 2557806 - protein, 9 aa, Entamoeba histolytica
TGNDEVNAT

SEQ ID NO: 2557807 - protein, 20 aa, Entamoeba histolytica
TKCNPKNKRLVKRDSKCDNE

SEQ ID NO: 2557808 - protein, 4 aa, Entamoeba histolytica
TKPL

SEQ ID NO: 2557809 - protein, 6 aa, Entamoeba histolytica
TNEEEN

SEQ ID NO: 2557810 - protein, 5 aa, Entamoeba histolytica
TNNID

SEQ ID NO: 2557811 - protein, 8 aa, Entamoeba histolytica
TPGDNTII

SEQ ID NO: 2557812 - protein, 27 aa, Entamoeba histolytica
TPTVSPLPQHVNDKSESVSEGSNNSSS

SEQ ID NO: 2557813 - protein, 5 aa, Entamoeba histolytica
TQNGE

SEQ ID NO: 2557814 - protein, 6 aa, Entamoeba histolytica
TQTDDR

SEQ ID NO: 2557815 - protein, 4 aa, Entamoeba histolytica
TRPS

SEQ ID NO: 2557816 - protein, 9 aa, Entamoeba histolytica
TSALDSESE

SEQ ID NO: 2557817 - protein, 6 aa, Entamoeba histolytica
TSSNAI

SEQ ID NO: 2557818 - protein, 9 aa, Entamoeba histolytica
TTPNSPSLI

SEQ ID NO: 2557819 - protein, 4 aa, Entamoeba histolytica
TVKD

SEQ ID NO: 2557820 - protein, 11 aa, Entamoeba histolytica
TYSPDSKGECI

SEQ ID NO: 2557821 - protein, 6 aa, Entamoeba histolytica
VDEQRI

SEQ ID NO: 2557822 - protein, 11 aa, Entamoeba histolytica
VDEYDDGSQLQ

SEQ ID NO: 2557823 - protein, 9 aa, Entamoeba histolytica
VEDSDKSIS

SEQ ID NO: 2557824 - protein, 11 aa, Entamoeba histolytica
VITQNNESESC

SEQ ID NO: 2557825 - protein, 9 aa, Entamoeba histolytica
VQQIQDGMS

SEQ ID NO: 2557826 - protein, 7 aa, Entamoeba histolytica
VSPTNEK

SEQ ID NO: 2557827 - protein, 5 aa, Entamoeba histolytica
YEETI

SEQ ID NO: 2557828 - protein, 4 aa, Entamoeba histolytica
YGSC

SEQ ID NO: 2557829 - protein, 10 aa, Entamoeba histolytica
YSDDQCTNVT

SEQ ID NO: 2557830 - protein, 5 aa, Entamoeba histolytica
YSTLK

SEQ ID NO: 2557831 - protein, 13 aa, Entamoeba histolytica
YYRNGKGCSECGE

SEQ ID NO: 2557832 - protein, 7 aa, Entamoeba histolytica
AAGGIGK

SEQ ID NO: 2557833 - protein, 16 aa, Entamoeba histolytica
AANGGNCEVTRSGETY

SEQ ID NO: 2557834 - protein, 10 aa, Entamoeba histolytica
AAPRTTDKGS

SEQ ID NO: 2557835 - protein, 7 aa, Entamoeba histolytica
AATSVRT

SEQ ID NO: 2557836 - protein, 4 aa, Entamoeba histolytica
AEEN

SEQ ID NO: 2557837 - protein, 5 aa, Entamoeba histolytica
AFNGS

SEQ ID NO: 2557838 - protein, 4 aa, Entamoeba histolytica
AGIP

SEQ ID NO: 2557839 - protein, 9 aa, Entamoeba histolytica
AHCKNVSKS

SEQ ID NO: 2557840 - protein, 29 aa, Entamoeba histolytica
AKARQKKLEKEMRKNMKESAKQHALELSA

SEQ ID NO: 2557841 - protein, 34 aa, Entamoeba histolytica
AKGEASIAETLKAEDAKKKKQENESSDSTEKPTE

SEQ ID NO: 2557842 - protein, 16 aa, Entamoeba histolytica
AKIDSSEINGNTFNDV

SEQ ID NO: 2557843 - protein, 5 aa, Entamoeba histolytica
AKKRM

SEQ ID NO: 2557844 - protein, 7 aa, Entamoeba histolytica
AKPGEVI

SEQ ID NO: 2557845 - protein, 4 aa, Entamoeba histolytica
AKYG

SEQ ID NO: 2557846 - protein, 4 aa, Entamoeba histolytica
ALGT

SEQ ID NO: 2557847 - protein, 12 aa, Entamoeba histolytica
ANIDIQTDKTIQ

SEQ ID NO: 2557848 - protein, 9 aa, Entamoeba histolytica
ANVPGKKSP

SEQ ID NO: 2557849 - protein, 14 aa, Entamoeba histolytica
ANVRPENDDEESTI

SEQ ID NO: 2557850 - protein, 17 aa, Entamoeba histolytica
APEDKTLQALTDDSSTF

SEQ ID NO: 2557851 - protein, 4 aa, Entamoeba histolytica
APTG

SEQ ID NO: 2557852 - protein, 5 aa, Entamoeba histolytica
AQQGA

SEQ ID NO: 2557853 - protein, 6 aa, Entamoeba histolytica
AQSHPP

SEQ ID NO: 2557854 - protein, 13 aa, Entamoeba histolytica
ARTNRSDNKGTIF

SEQ ID NO: 2557855 - protein, 6 aa, Entamoeba histolytica
ASAEED

SEQ ID NO: 2557856 - protein, 9 aa, Entamoeba histolytica
ASGCGKSTT

SEQ ID NO: 2557857 - protein, 9 aa, Entamoeba histolytica
ASIEDKEKI

SEQ ID NO: 2557858 - protein, 6 aa, Entamoeba histolytica
ASNQTK

SEQ ID NO: 2557859 - protein, 4 aa, Entamoeba histolytica
ASPD

SEQ ID NO: 2557860 - protein, 7 aa, Entamoeba histolytica
ASTANLG

SEQ ID NO: 2557861 - protein, 4 aa, Entamoeba histolytica
ASYA

SEQ ID NO: 2557862 - protein, 7 aa, Entamoeba histolytica
ASYPYGG

SEQ ID NO: 2557863 - protein, 6 aa, Entamoeba histolytica
ATCNQK

SEQ ID NO: 2557864 - protein, 5 aa, Entamoeba histolytica
ATDPV

SEQ ID NO: 2557865 - protein, 15 aa, Entamoeba histolytica
ATLTAQTKMKSTNSR

SEQ ID NO: 2557866 - protein, 5 aa, Entamoeba histolytica
ATNKK

SEQ ID NO: 2557867 - protein, 7 aa, Entamoeba histolytica
AVGSGTG

SEQ ID NO: 2557868 - protein, 8 aa, Entamoeba histolytica
CATCSDKD

SEQ ID NO: 2557869 - protein, 9 aa, Entamoeba histolytica
CDESEEDDC

SEQ ID NO: 2557870 - protein, 5 aa, Entamoeba histolytica
CDGGY

SEQ ID NO: 2557871 - protein, 9 aa, Entamoeba histolytica
CDSTTNNQC

SEQ ID NO: 2557872 - protein, 4 aa, Entamoeba histolytica
CEAC

SEQ ID NO: 2557873 - protein, 5 aa, Entamoeba histolytica
CEECN

SEQ ID NO: 2557874 - protein, 7 aa, Entamoeba histolytica
CEEGKYS

SEQ ID NO: 2557875 - protein, 12 aa, Entamoeba histolytica
CEENPDGEFSES

SEQ ID NO: 2557876 - protein, 8 aa, Entamoeba histolytica
CENRNTSL

SEQ ID NO: 2557877 - protein, 6 aa, Entamoeba histolytica
CETTNR

SEQ ID NO: 2557878 - protein, 4 aa, Entamoeba histolytica
CGND

SEQ ID NO: 2557879 - protein, 7 aa, Entamoeba histolytica
CGNDPNC

SEQ ID NO: 2557880 - protein, 8 aa, Entamoeba histolytica
CGTNSDVN

SEQ ID NO: 2557881 - protein, 12 aa, Entamoeba histolytica
CIPSGDKFEDGF

SEQ ID NO: 2557882 - protein, 10 aa, Entamoeba histolytica
CNNPTTCQKC

SEQ ID NO: 2557883 - protein, 5 aa, Entamoeba histolytica
CNPQF

SEQ ID NO: 2557884 - protein, 5 aa, Entamoeba histolytica
CNSDG

SEQ ID NO: 2557885 - protein, 9 aa, Entamoeba histolytica
CPTERGEGV

SEQ ID NO: 2557886 - protein, 7 aa, Entamoeba histolytica
CPTSPSP

SEQ ID NO: 2557887 - protein, 6 aa, Entamoeba histolytica
CQSCSS

SEQ ID NO: 2557888 - protein, 5 aa, Entamoeba histolytica
CSKTE

SEQ ID NO: 2557889 - protein, 7 aa, Entamoeba histolytica
CSNESYV

SEQ ID NO: 2557890 - protein, 9 aa, Entamoeba histolytica
CSPKLTTSL

SEQ ID NO: 2557891 - protein, 7 aa, Entamoeba histolytica
CSPQDKE

SEQ ID NO: 2557892 - protein, 10 aa, Entamoeba histolytica
CSVSKKEEAV

SEQ ID NO: 2557893 - protein, 8 aa, Entamoeba histolytica
CTDEDYRS

SEQ ID NO: 2557894 - protein, 4 aa, Entamoeba histolytica
CTFT

SEQ ID NO: 2557895 - protein, 11 aa, Entamoeba histolytica
CTGEGECTTCE

SEQ ID NO: 2557896 - protein, 6 aa, Entamoeba histolytica
CTKGTS

SEQ ID NO: 2557897 - protein, 11 aa, Entamoeba histolytica
CTKNPSGCKFG

SEQ ID NO: 2557898 - protein, 20 aa, Entamoeba histolytica
CTPCSDTNAGCVSPIKEGKC

SEQ ID NO: 2557899 - protein, 4 aa, Entamoeba histolytica
CTST

SEQ ID NO: 2557900 - protein, 11 aa, Entamoeba histolytica
DACDKSKQQLN

SEQ ID NO: 2557901 - protein, 6 aa, Entamoeba histolytica
DAPDIP

SEQ ID NO: 2557902 - protein, 17 aa, Entamoeba histolytica
DDSKNLPESESKRNYRK

SEQ ID NO: 2557903 - protein, 18 aa, Entamoeba histolytica
DEDAENKFGYANAASQRL

SEQ ID NO: 2557904 - protein, 6 aa, Entamoeba histolytica
DEEFEE

SEQ ID NO: 2557905 - protein, 7 aa, Entamoeba histolytica
DENTEEA

SEQ ID NO: 2557906 - protein, 4 aa, Entamoeba histolytica
DETG

SEQ ID NO: 2557907 - protein, 6 aa, Entamoeba histolytica
DFGSSR

SEQ ID NO: 2557908 - protein, 8 aa, Entamoeba histolytica
DFGSSRNI

SEQ ID NO: 2557909 - protein, 4 aa, Entamoeba histolytica
DFGT

SEQ ID NO: 2557910 - protein, 5 aa, Entamoeba histolytica
DFGTS

SEQ ID NO: 2557911 - protein, 4 aa, Entamoeba histolytica
DGDI

SEQ ID NO: 2557912 - protein, 11 aa, Entamoeba histolytica
DGIRARSSGIC

SEQ ID NO: 2557913 - protein, 8 aa, Entamoeba histolytica
DGKCNGAK

SEQ ID NO: 2557914 - protein, 39 aa, Entamoeba histolytica
DGNVSESSELDKEEDTDEKSPEENENVQPTGTPEQKPSN

SEQ ID NO: 2557915 - protein, 5 aa, Entamoeba histolytica
DIDED

SEQ ID NO: 2557916 - protein, 8 aa, Entamoeba histolytica
DINKTNIK

SEQ ID NO: 2557917 - protein, 5 aa, Entamoeba histolytica
DIPLP

SEQ ID NO: 2557918 - protein, 7 aa, Entamoeba histolytica
DIPMSES

SEQ ID NO: 2557919 - protein, 6 aa, Entamoeba histolytica
DIPNQI

SEQ ID NO: 2557920 - protein, 8 aa, Entamoeba histolytica
DIYGEDKE

SEQ ID NO: 2557921 - protein, 15 aa, Entamoeba histolytica
DKEDECNSKKLPTKI

SEQ ID NO: 2557922 - protein, 9 aa, Entamoeba histolytica
DKINTKTTS

SEQ ID NO: 2557923 - protein, 7 aa, Entamoeba histolytica
DKLTTSS

SEQ ID NO: 2557924 - protein, 8 aa, Entamoeba histolytica
DKNDNTEC

SEQ ID NO: 2557925 - protein, 7 aa, Entamoeba histolytica
DKTGTLT

SEQ ID NO: 2557926 - protein, 6 aa, Entamoeba histolytica
DKVKKS

SEQ ID NO: 2557927 - protein, 21 aa, Entamoeba histolytica
DLATKVADKSKDKNANDKIKR

SEQ ID NO: 2557928 - protein, 9 aa, Entamoeba histolytica
DLERLNNNQ

SEQ ID NO: 2557929 - protein, 6 aa, Entamoeba histolytica
DLNPTD

SEQ ID NO: 2557930 - protein, 5 aa, Entamoeba histolytica
DMKTN

SEQ ID NO: 2557931 - protein, 4 aa, Entamoeba histolytica
DNDI

SEQ ID NO: 2557932 - protein, 9 aa, Entamoeba histolytica
DNIATARSI

SEQ ID NO: 2557933 - protein, 18 aa, Entamoeba histolytica
DNNSNNDEKPNNNLGDST

SEQ ID NO: 2557934 - protein, 5 aa, Entamoeba histolytica
DNSAE

SEQ ID NO: 2557935 - protein, 4 aa, Entamoeba histolytica
DNSN

SEQ ID NO: 2557936 - protein, 13 aa, Entamoeba histolytica
DPFETTPFSASSK

SEQ ID NO: 2557937 - protein, 6 aa, Entamoeba histolytica
DPTSGE

SEQ ID NO: 2557938 - protein, 6 aa, Entamoeba histolytica
DQDALK

SEQ ID NO: 2557939 - protein, 4 aa, Entamoeba histolytica
DQNI

SEQ ID NO: 2557940 - protein, 17 aa, Entamoeba histolytica
DQTTNNCKSCNKQNGRC

SEQ ID NO: 2557941 - protein, 14 aa, Entamoeba histolytica
DQTVNEPSKTDCEE

SEQ ID NO: 2557942 - protein, 4 aa, Entamoeba histolytica
DRKH

SEQ ID NO: 2557943 - protein, 10 aa, Entamoeba histolytica
DSDHTGCSTS

SEQ ID NO: 2557944 - protein, 4 aa, Entamoeba histolytica
DSEL

SEQ ID NO: 2557945 - protein, 4 aa, Entamoeba histolytica
DSST

SEQ ID NO: 2557946 - protein, 20 aa, Entamoeba histolytica
DSTISETRDVVGENGKGDRK

SEQ ID NO: 2557947 - protein, 9 aa, Entamoeba histolytica
DSTSNTVSI

SEQ ID NO: 2557948 - protein, 8 aa, Entamoeba histolytica
DSTTEITI

SEQ ID NO: 2557949 - protein, 10 aa, Entamoeba histolytica
DTEDEKTYEE

SEQ ID NO: 2557950 - protein, 6 aa, Entamoeba histolytica
DTEGIP

SEQ ID NO: 2557951 - protein, 12 aa, Entamoeba histolytica
DTKDEKSYEETI

SEQ ID NO: 2557952 - protein, 12 aa, Entamoeba histolytica
DTNEKPDATPAL

SEQ ID NO: 2557953 - protein, 6 aa, Entamoeba histolytica
DTTPIE

SEQ ID NO: 2557954 - protein, 4 aa, Entamoeba histolytica
DTTT

SEQ ID NO: 2557955 - protein, 10 aa, Entamoeba histolytica
DVKKSKEKTY

SEQ ID NO: 2557956 - protein, 6 aa, Entamoeba histolytica
DYSKQS

SEQ ID NO: 2557957 - protein, 11 aa, Entamoeba histolytica
DYSPSYSGRGD

SEQ ID NO: 2557958 - protein, 6 aa, Entamoeba histolytica
EAKGGE

SEQ ID NO: 2557959 - protein, 7 aa, Entamoeba histolytica
EANFKEQ

SEQ ID NO: 2557960 - protein, 15 aa, Entamoeba histolytica
EAYNNDHSKYTEENQ

SEQ ID NO: 2557961 - protein, 11 aa, Entamoeba histolytica
ECGKWGETQEI

SEQ ID NO: 2557962 - protein, 4 aa, Entamoeba histolytica
ECKE

SEQ ID NO: 2557963 - protein, 5 aa, Entamoeba histolytica
ECNSC

SEQ ID NO: 2557964 - protein, 6 aa, Entamoeba histolytica
ECNSCK

SEQ ID NO: 2557965 - protein, 15 aa, Entamoeba histolytica
ECSIPETKKNIKEDR

SEQ ID NO: 2557966 - protein, 6 aa, Entamoeba histolytica
EDCMPS

SEQ ID NO: 2557967 - protein, 18 aa, Entamoeba histolytica
EDDSIPPDSTEVDIPQST

SEQ ID NO: 2557968 - protein, 7 aa, Entamoeba histolytica
EDEPETW

SEQ ID NO: 2557969 - protein, 7 aa, Entamoeba histolytica
EDFKGDT

SEQ ID NO: 2557970 - protein, 7 aa, Entamoeba histolytica
EDGSRSY

SEQ ID NO: 2557971 - protein, 15 aa, Entamoeba histolytica
EDKETIKTQSITENE

SEQ ID NO: 2557972 - protein, 9 aa, Entamoeba histolytica
EDKVKASQL

SEQ ID NO: 2557973 - protein, 8 aa, Entamoeba histolytica
EDQIRGED

SEQ ID NO: 2557974 - protein, 4 aa, Entamoeba histolytica
EDQR

SEQ ID NO: 2557975 - protein, 8 aa, Entamoeba histolytica
EDTNEQNT

SEQ ID NO: 2557976 - protein, 19 aa, Entamoeba histolytica
EEDESQQPNTFRQAPPAQS

SEQ ID NO: 2557977 - protein, 6 aa, Entamoeba histolytica
EEDTSC

SEQ ID NO: 2557978 - protein, 23 aa, Entamoeba histolytica
EEEGLNDNSTNSEEEDDDGLSAG

SEQ ID NO: 2557979 - protein, 5 aa, Entamoeba histolytica
EEKDV

SEQ ID NO: 2557980 - protein, 9 aa, Entamoeba histolytica
EEKDYFKKK

SEQ ID NO: 2557981 - protein, 4 aa, Entamoeba histolytica
EENG

SEQ ID NO: 2557982 - protein, 14 aa, Entamoeba histolytica
EENGRKGGAGRYRD

SEQ ID NO: 2557983 - protein, 6 aa, Entamoeba histolytica
EENINK

SEQ ID NO: 2557984 - protein, 4 aa, Entamoeba histolytica
EENK

SEQ ID NO: 2557985 - protein, 8 aa, Entamoeba histolytica
EENKEKYD

SEQ ID NO: 2557986 - protein, 10 aa, Entamoeba histolytica
EENNSTQTSI

SEQ ID NO: 2557987 - protein, 7 aa, Entamoeba histolytica
EENREEV

SEQ ID NO: 2557988 - protein, 7 aa, Entamoeba histolytica
EEPAGGK

SEQ ID NO: 2557989 - protein, 6 aa, Entamoeba histolytica
EEQLAN

SEQ ID NO: 2557990 - protein, 11 aa, Entamoeba histolytica
EESKDSDKITY

SEQ ID NO: 2557991 - protein, 6 aa, Entamoeba histolytica
EETGSK

SEQ ID NO: 2557992 - protein, 5 aa, Entamoeba histolytica
EFDEQ

SEQ ID NO: 2557993 - protein, 5 aa, Entamoeba histolytica
EFRKY

SEQ ID NO: 2557994 - protein, 8 aa, Entamoeba histolytica
EGNEEVKE

SEQ ID NO: 2557995 - protein, 8 aa, Entamoeba histolytica
EGNRSDED

SEQ ID NO: 2557996 - protein, 6 aa, Entamoeba histolytica
EGTYLS

SEQ ID NO: 2557997 - protein, 10 aa, Entamoeba histolytica
EGVRRNKSLQ

SEQ ID NO: 2557998 - protein, 7 aa, Entamoeba histolytica
EICNSDD

SEQ ID NO: 2557999 - protein, 7 aa, Entamoeba histolytica
EIGEQNE

SEQ ID NO: 2558000 - protein, 4 aa, Entamoeba histolytica
EIPP

SEQ ID NO: 2558001 - protein, 19 aa, Entamoeba histolytica
EITTTSPSDNEEKHKTQKE

SEQ ID NO: 2558002 - protein, 9 aa, Entamoeba histolytica
EKDGDKKRC

SEQ ID NO: 2558003 - protein, 13 aa, Entamoeba histolytica
EKGSNLSGGQRQR

SEQ ID NO: 2558004 - protein, 9 aa, Entamoeba histolytica
EKHPKSPSL

SEQ ID NO: 2558005 - protein, 9 aa, Entamoeba histolytica
EKIKQSSMS

SEQ ID NO: 2558006 - protein, 6 aa, Entamoeba histolytica
EKINEW

SEQ ID NO: 2558007 - protein, 6 aa, Entamoeba histolytica
EKKGIA

SEQ ID NO: 2558008 - protein, 5 aa, Entamoeba histolytica
EKKKF

SEQ ID NO: 2558009 - protein, 10 aa, Entamoeba histolytica
EKKKGESYLN

SEQ ID NO: 2558010 - protein, 5 aa, Entamoeba histolytica
EKLED

SEQ ID NO: 2558011 - protein, 15 aa, Entamoeba histolytica
EKSIGIPMKGSPEDN

SEQ ID NO: 2558012 - protein, 10 aa, Entamoeba histolytica
ELKNSSLEAS

SEQ ID NO: 2558013 - protein, 4 aa, Entamoeba histolytica
ELSS

SEQ ID NO: 2558014 - protein, 12 aa, Entamoeba histolytica
ENECTFNDPVSN

SEQ ID NO: 2558015 - protein, 8 aa, Entamoeba histolytica
ENEYNSEM

SEQ ID NO: 2558016 - protein, 7 aa, Entamoeba histolytica
ENGESVS

SEQ ID NO: 2558017 - protein, 9 aa, Entamoeba histolytica
ENGTCQSCS

SEQ ID NO: 2558018 - protein, 5 aa, Entamoeba histolytica
ENKGK

SEQ ID NO: 2558019 - protein, 13 aa, Entamoeba histolytica
ENKNESIIDKKDS

SEQ ID NO: 2558020 - protein, 8 aa, Entamoeba histolytica
ENKRMDTV

SEQ ID NO: 2558021 - protein, 4 aa, Entamoeba histolytica
ENNV

SEQ ID NO: 2558022 - protein, 9 aa, Entamoeba histolytica
ENPAAKRTK

SEQ ID NO: 2558023 - protein, 5 aa, Entamoeba histolytica
ENRVG

SEQ ID NO: 2558024 - protein, 7 aa, Entamoeba histolytica
ENSKISI

SEQ ID NO: 2558025 - protein, 5 aa, Entamoeba histolytica
ENTCD

SEQ ID NO: 2558026 - protein, 21 aa, Entamoeba histolytica
ENTSSKKVTYVPATDENTKAK

SEQ ID NO: 2558027 - protein, 4 aa, Entamoeba histolytica
EPSE

SEQ ID NO: 2558028 - protein, 9 aa, Entamoeba histolytica
EQFKSQNKS

SEQ ID NO: 2558029 - protein, 7 aa, Entamoeba histolytica
EQQLDNN

SEQ ID NO: 2558030 - protein, 4 aa, Entamoeba histolytica
EREP

SEQ ID NO: 2558031 - protein, 13 aa, Entamoeba histolytica
ERGANLSGGQRQR

SEQ ID NO: 2558032 - protein, 10 aa, Entamoeba histolytica
ERYESQIGEY

SEQ ID NO: 2558033 - protein, 5 aa, Entamoeba histolytica
ESEEM

SEQ ID NO: 2558034 - protein, 13 aa, Entamoeba histolytica
ESGKVDTSSLDQH

SEQ ID NO: 2558035 - protein, 6 aa, Entamoeba histolytica
ESINDP

SEQ ID NO: 2558036 - protein, 12 aa, Entamoeba histolytica
ESLPDVKPGERA

SEQ ID NO: 2558037 - protein, 10 aa, Entamoeba histolytica
ESNHEPSETC

SEQ ID NO: 2558038 - protein, 7 aa, Entamoeba histolytica
ESNNEQN

SEQ ID NO: 2558039 - protein, 4 aa, Entamoeba histolytica
ESPY

SEQ ID NO: 2558040 - protein, 15 aa, Entamoeba histolytica
ESTETIYTKTSDIEY

SEQ ID NO: 2558041 - protein, 8 aa, Entamoeba histolytica
ESTNQTTL

SEQ ID NO: 2558042 - protein, 7 aa, Entamoeba histolytica
ESTSDHS

SEQ ID NO: 2558043 - protein, 7 aa, Entamoeba histolytica
ESTSNTH

SEQ ID NO: 2558044 - protein, 10 aa, Entamoeba histolytica
ETGNGKSSLG

SEQ ID NO: 2558045 - protein, 10 aa, Entamoeba histolytica
ETGNGKSSVG

SEQ ID NO: 2558046 - protein, 4 aa, Entamoeba histolytica
ETMS

SEQ ID NO: 2558047 - protein, 20 aa, Entamoeba histolytica
ETPKEVEQPPQEKEEQDNVE

SEQ ID NO: 2558048 - protein, 8 aa, Entamoeba histolytica
ETRDQKVS

SEQ ID NO: 2558049 - protein, 7 aa, Entamoeba histolytica
ETTEELY

SEQ ID NO: 2558050 - protein, 10 aa, Entamoeba histolytica
EVKKTIKDDA

SEQ ID NO: 2558051 - protein, 9 aa, Entamoeba histolytica
EVSGTSTLT

SEQ ID NO: 2558052 - protein, 7 aa, Entamoeba histolytica
EVTEASK

SEQ ID NO: 2558053 - protein, 5 aa, Entamoeba histolytica
EYGNK

SEQ ID NO: 2558054 - protein, 4 aa, Entamoeba histolytica
EYGS

SEQ ID NO: 2558055 - protein, 22 aa, Entamoeba histolytica
EYTLNNGTCESKENKNGKNQEI

SEQ ID NO: 2558056 - protein, 7 aa, Entamoeba histolytica
FAEETKK

SEQ ID NO: 2558057 - protein, 7 aa, Entamoeba histolytica
FAEQTKK

SEQ ID NO: 2558058 - protein, 8 aa, Entamoeba histolytica
FAGPETKI

SEQ ID NO: 2558059 - protein, 11 aa, Entamoeba histolytica
FAQSSVKENDI

SEQ ID NO: 2558060 - protein, 7 aa, Entamoeba histolytica
FDDPQRW

SEQ ID NO: 2558061 - protein, 4 aa, Entamoeba histolytica
FDSE

SEQ ID NO: 2558062 - protein, 15 aa, Entamoeba histolytica
FDTRKAAKEQAESVG

SEQ ID NO: 2558063 - protein, 17 aa, Entamoeba histolytica
FERKEEKKEEKKEKKIG

SEQ ID NO: 2558064 - protein, 4 aa, Entamoeba histolytica
FGAS

SEQ ID NO: 2558065 - protein, 5 aa, Entamoeba histolytica
FGDPN

SEQ ID NO: 2558066 - protein, 5 aa, Entamoeba histolytica
FHPSG

SEQ ID NO: 2558067 - protein, 8 aa, Entamoeba histolytica
FIESSGKI

SEQ ID NO: 2558068 - protein, 30 aa, Entamoeba histolytica
FKSNSDCLNSKDGVVDQTTKHTCNKCDNNV

SEQ ID NO: 2558069 - protein, 5 aa, Entamoeba histolytica
FPETK

SEQ ID NO: 2558070 - protein, 5 aa, Entamoeba histolytica
FPTGD

SEQ ID NO: 2558071 - protein, 9 aa, Entamoeba histolytica
FSKNTNVQR

SEQ ID NO: 2558072 - protein, 6 aa, Entamoeba histolytica
FSNEER

SEQ ID NO: 2558073 - protein, 6 aa, Entamoeba histolytica
FTGSTQ

SEQ ID NO: 2558074 - protein, 18 aa, Entamoeba histolytica
GAEETQEPLSIPQNKQEM

SEQ ID NO: 2558075 - protein, 6 aa, Entamoeba histolytica
GATDIR

SEQ ID NO: 2558076 - protein, 4 aa, Entamoeba histolytica
GCRE

SEQ ID NO: 2558077 - protein, 4 aa, Entamoeba histolytica
GDEV

SEQ ID NO: 2558078 - protein, 7 aa, Entamoeba histolytica
GDNFSLG

SEQ ID NO: 2558079 - protein, 5 aa, Entamoeba histolytica
GDPDD

SEQ ID NO: 2558080 - protein, 14 aa, Entamoeba histolytica
GDRGSQLSGGQKQR

SEQ ID NO: 2558081 - protein, 6 aa, Entamoeba histolytica
GEAIAE

SEQ ID NO: 2558082 - protein, 7 aa, Entamoeba histolytica
GECGDIT

SEQ ID NO: 2558083 - protein, 6 aa, Entamoeba histolytica
GECKPC

SEQ ID NO: 2558084 - protein, 6 aa, Entamoeba histolytica
GECQGM

SEQ ID NO: 2558085 - protein, 7 aa, Entamoeba histolytica
GEGLNGD

SEQ ID NO: 2558086 - protein, 4 aa, Entamoeba histolytica
GELS

SEQ ID NO: 2558087 - protein, 7 aa, Entamoeba histolytica
GENKGDK

SEQ ID NO: 2558088 - protein, 8 aa, Entamoeba histolytica
GESPYRRA

SEQ ID NO: 2558089 - protein, 6 aa, Entamoeba histolytica
GESVSV

SEQ ID NO: 2558090 - protein, 4 aa, Entamoeba histolytica
GETI

SEQ ID NO: 2558091 - protein, 6 aa, Entamoeba histolytica
GEYTES

SEQ ID NO: 2558092 - protein, 4 aa, Entamoeba histolytica
GFNS

SEQ ID NO: 2558093 - protein, 5 aa, Entamoeba histolytica
GGDVN

SEQ ID NO: 2558094 - protein, 7 aa, Entamoeba histolytica
GGIESGV

SEQ ID NO: 2558095 - protein, 5 aa, Entamoeba histolytica
GGNQI

SEQ ID NO: 2558096 - protein, 4 aa, Entamoeba histolytica
GGST

SEQ ID NO: 2558097 - protein, 8 aa, Entamoeba histolytica
GHSGGEDF

SEQ ID NO: 2558098 - protein, 13 aa, Entamoeba histolytica
GIEGKEGKQASMA

SEQ ID NO: 2558099 - protein, 5 aa, Entamoeba histolytica
GITPP

SEQ ID NO: 2558100 - protein, 6 aa, Entamoeba histolytica
GKAGNI

SEQ ID NO: 2558101 - protein, 5 aa, Entamoeba histolytica
GKCAE

SEQ ID NO: 2558102 - protein, 7 aa, Entamoeba histolytica
GKECKSS

SEQ ID NO: 2558103 - protein, 10 aa, Entamoeba histolytica
GKETSKNNIA

SEQ ID NO: 2558104 - protein, 6 aa, Entamoeba histolytica
GKSNEA

SEQ ID NO: 2558105 - protein, 8 aa, Entamoeba histolytica
GKSNEGTV

SEQ ID NO: 2558106 - protein, 4 aa, Entamoeba histolytica
GKYG

SEQ ID NO: 2558107 - protein, 5 aa, Entamoeba histolytica
GLGNN

SEQ ID NO: 2558108 - protein, 5 aa, Entamoeba histolytica
GLTED

SEQ ID NO: 2558109 - protein, 4 aa, Entamoeba histolytica
GNER

SEQ ID NO: 2558110 - protein, 6 aa, Entamoeba histolytica
GNGTYS

SEQ ID NO: 2558111 - protein, 8 aa, Entamoeba histolytica
GNTSSSSV

SEQ ID NO: 2558112 - protein, 6 aa, Entamoeba histolytica
GNYEFN

SEQ ID NO: 2558113 - protein, 16 aa, Entamoeba histolytica
GPDNQDDTTRPILFDM

SEQ ID NO: 2558114 - protein, 5 aa, Entamoeba histolytica
GPFNK

SEQ ID NO: 2558115 - protein, 6 aa, Entamoeba histolytica
GPYEPT

SEQ ID NO: 2558116 - protein, 15 aa, Entamoeba histolytica
GQQQTSITKEDRERM

SEQ ID NO: 2558117 - protein, 7 aa, Entamoeba histolytica
GRKGNLR

SEQ ID NO: 2558118 - protein, 5 aa, Entamoeba histolytica
GRPRP

SEQ ID NO: 2558119 - protein, 7 aa, Entamoeba histolytica
GSCEKCD

SEQ ID NO: 2558120 - protein, 4 aa, Entamoeba histolytica
GSIE

SEQ ID NO: 2558121 - protein, 6 aa, Entamoeba histolytica
GSKEGF

SEQ ID NO: 2558122 - protein, 5 aa, Entamoeba histolytica
GSKKS

SEQ ID NO: 2558123 - protein, 9 aa, Entamoeba histolytica
GTEKPTDSL

SEQ ID NO: 2558124 - protein, 7 aa, Entamoeba histolytica
GTIRPGD

SEQ ID NO: 2558125 - protein, 9 aa, Entamoeba histolytica
GTIRPKESV

SEQ ID NO: 2558126 - protein, 6 aa, Entamoeba histolytica
GTQPME

SEQ ID NO: 2558127 - protein, 5 aa, Entamoeba histolytica
GTQTA

SEQ ID NO: 2558128 - protein, 14 aa, Entamoeba histolytica
GTSTSFEGKEYSMN

SEQ ID NO: 2558129 - protein, 13 aa, Entamoeba histolytica
GTTVSRSSKKAKN

SEQ ID NO: 2558130 - protein, 12 aa, Entamoeba histolytica
GVGGAVGGAVGG

SEQ ID NO: 2558131 - protein, 5 aa, Entamoeba histolytica
GVGKT

SEQ ID NO: 2558132 - protein, 5 aa, Entamoeba histolytica
GVGTP

SEQ ID NO: 2558133 - protein, 4 aa, Entamoeba histolytica
GVSR

SEQ ID NO: 2558134 - protein, 7 aa, Entamoeba histolytica
GYHRNGK

SEQ ID NO: 2558135 - protein, 15 aa, Entamoeba histolytica
GYKLSDGQCKEETAS

SEQ ID NO: 2558136 - protein, 6 aa, Entamoeba histolytica
GYYASN

SEQ ID NO: 2558137 - protein, 5 aa, Entamoeba histolytica
GYYPN

SEQ ID NO: 2558138 - protein, 5 aa, Entamoeba histolytica
GYYRN

SEQ ID NO: 2558139 - protein, 4 aa, Entamoeba histolytica
HAQF

SEQ ID NO: 2558140 - protein, 8 aa, Entamoeba histolytica
HECQENSH

SEQ ID NO: 2558141 - protein, 19 aa, Entamoeba histolytica
HENKYNDDENTQNQTYNRL

SEQ ID NO: 2558142 - protein, 5 aa, Entamoeba histolytica
HHDED

SEQ ID NO: 2558143 - protein, 9 aa, Entamoeba histolytica
HNAKGSSYR

SEQ ID NO: 2558144 - protein, 5 aa, Entamoeba histolytica
HNIPP

SEQ ID NO: 2558145 - protein, 5 aa, Entamoeba histolytica
HNLNK

SEQ ID NO: 2558146 - protein, 4 aa, Entamoeba histolytica
HNNQ

SEQ ID NO: 2558147 - protein, 10 aa, Entamoeba histolytica
HNSGEMTSRM

SEQ ID NO: 2558148 - protein, 5 aa, Entamoeba histolytica
HPHPK

SEQ ID NO: 2558149 - protein, 6 aa, Entamoeba histolytica
HPRNPT

SEQ ID NO: 2558150 - protein, 4 aa, Entamoeba histolytica
HPSM

SEQ ID NO: 2558151 - protein, 11 aa, Entamoeba histolytica
HPSSTSSISLS

SEQ ID NO: 2558152 - protein, 5 aa, Entamoeba histolytica
HSDRA

SEQ ID NO: 2558153 - protein, 9 aa, Entamoeba histolytica
HSNTNTGLG

SEQ ID NO: 2558154 - protein, 4 aa, Entamoeba histolytica
HTDA

SEQ ID NO: 2558155 - protein, 5 aa, Entamoeba histolytica
IAIEG

SEQ ID NO: 2558156 - protein, 21 aa, Entamoeba histolytica
ICPGNTPSGDTSDNNDDSASS

SEQ ID NO: 2558157 - protein, 28 aa, Entamoeba histolytica
IDTSNQEKTPVIEEKEETESMGNNDKQI

SEQ ID NO: 2558158 - protein, 9 aa, Entamoeba histolytica
IEGATQETN

SEQ ID NO: 2558159 - protein, 26 aa, Entamoeba histolytica
IEGETEISTRLDPDEIKEEKKIGEGP

SEQ ID NO: 2558160 - protein, 10 aa, Entamoeba histolytica
IELQEGEEIK

SEQ ID NO: 2558161 - protein, 9 aa, Entamoeba histolytica
IESGKEKYE

SEQ ID NO: 2558162 - protein, 13 aa, Entamoeba histolytica
IGDEIGGKTMTTI

SEQ ID NO: 2558163 - protein, 4 aa, Entamoeba histolytica
IGGA

SEQ ID NO: 2558164 - protein, 4 aa, Entamoeba histolytica
IGTP

SEQ ID NO: 2558165 - protein, 6 aa, Entamoeba histolytica
IKEDGY

SEQ ID NO: 2558166 - protein, 8 aa, Entamoeba histolytica
IKGNDNSY

SEQ ID NO: 2558167 - protein, 7 aa, Entamoeba histolytica
IKRQENI

SEQ ID NO: 2558168 - protein, 6 aa, Entamoeba histolytica
IKSENE

SEQ ID NO: 2558169 - protein, 13 aa, Entamoeba histolytica
IKSTTTSVSASVN

SEQ ID NO: 2558170 - protein, 9 aa, Entamoeba histolytica
INEPTKKIG

SEQ ID NO: 2558171 - protein, 31 aa, Entamoeba histolytica
INETREEGKIKDQNGKCNSNISNCSNESYVN

SEQ ID NO: 2558172 - protein, 8 aa, Entamoeba histolytica
INGKGNNN

SEQ ID NO: 2558173 - protein, 7 aa, Entamoeba histolytica
INGNGNN

SEQ ID NO: 2558174 - protein, 9 aa, Entamoeba histolytica
INNNSANLN

SEQ ID NO: 2558175 - protein, 4 aa, Entamoeba histolytica
INPT

SEQ ID NO: 2558176 - protein, 36 aa, Entamoeba histolytica
INSQTGESKITISTNGKLKGTKSKTVTFSPSSSSVK

SEQ ID NO: 2558177 - protein, 11 aa, Entamoeba histolytica
INTDKSKSNIK

SEQ ID NO: 2558178 - protein, 4 aa, Entamoeba histolytica
IPQT

SEQ ID NO: 2558179 - protein, 5 aa, Entamoeba histolytica
IQKES

SEQ ID NO: 2558180 - protein, 15 aa, Entamoeba histolytica
IQQPQSPTNISSSME

SEQ ID NO: 2558181 - protein, 14 aa, Entamoeba histolytica
IQSTGTKDNTNNDY

SEQ ID NO: 2558182 - protein, 9 aa, Entamoeba histolytica
IRGKSVPRY

SEQ ID NO: 2558183 - protein, 12 aa, Entamoeba histolytica
IRSDSKNNTVTC

SEQ ID NO: 2558184 - protein, 4 aa, Entamoeba histolytica
IRSE

SEQ ID NO: 2558185 - protein, 5 aa, Entamoeba histolytica
IRSSE

SEQ ID NO: 2558186 - protein, 4 aa, Entamoeba histolytica
ISDD

SEQ ID NO: 2558187 - protein, 9 aa, Entamoeba histolytica
ISEEPDPGL

SEQ ID NO: 2558188 - protein, 4 aa, Entamoeba histolytica
ISEY

SEQ ID NO: 2558189 - protein, 4 aa, Entamoeba histolytica
ISGK

SEQ ID NO: 2558190 - protein, 4 aa, Entamoeba histolytica
ISKD

SEQ ID NO: 2558191 - protein, 7 aa, Entamoeba histolytica
ISNIQDN

SEQ ID NO: 2558192 - protein, 15 aa, Entamoeba histolytica
ISNSRSRKEEGDSYQ

SEQ ID NO: 2558193 - protein, 5 aa, Entamoeba histolytica
ISSNR

SEQ ID NO: 2558194 - protein, 12 aa, Entamoeba histolytica
ISSTLPKSYGGK

SEQ ID NO: 2558195 - protein, 4 aa, Entamoeba histolytica
ISTP

SEQ ID NO: 2558196 - protein, 5 aa, Entamoeba histolytica
ITADG

SEQ ID NO: 2558197 - protein, 14 aa, Entamoeba histolytica
ITDKTYTTSTTASF

SEQ ID NO: 2558198 - protein, 6 aa, Entamoeba histolytica
ITESFN

SEQ ID NO: 2558199 - protein, 16 aa, Entamoeba histolytica
ITKSTSIDVSDSQTYT

SEQ ID NO: 2558200 - protein, 7 aa, Entamoeba histolytica
ITNSNEK

SEQ ID NO: 2558201 - protein, 31 aa, Entamoeba histolytica
ITYSDTESIEIENDEERENPKKESNEETEDN

SEQ ID NO: 2558202 - protein, 6 aa, Entamoeba histolytica
ITYSSQ

SEQ ID NO: 2558203 - protein, 5 aa, Entamoeba histolytica
KAAGL

SEQ ID NO: 2558204 - protein, 8 aa, Entamoeba histolytica
KAGRSFND

SEQ ID NO: 2558205 - protein, 15 aa, Entamoeba histolytica
KAKERSIQQDRNKMR

SEQ ID NO: 2558206 - protein, 6 aa, Entamoeba histolytica
KANNKR

SEQ ID NO: 2558207 - protein, 6 aa, Entamoeba histolytica
KAPKHI

SEQ ID NO: 2558208 - protein, 7 aa, Entamoeba histolytica
KASDNTY

SEQ ID NO: 2558209 - protein, 16 aa, Entamoeba histolytica
KAVEEIKQAETYQKAT

SEQ ID NO: 2558210 - protein, 12 aa, Entamoeba histolytica
KCDDNCKTCYGS

SEQ ID NO: 2558211 - protein, 10 aa, Entamoeba histolytica
KCDDNCTTCY

SEQ ID NO: 2558212 - protein, 10 aa, Entamoeba histolytica
KCEEQNTYGC

SEQ ID NO: 2558213 - protein, 11 aa, Entamoeba histolytica
KCKEVKNNKCS

SEQ ID NO: 2558214 - protein, 9 aa, Entamoeba histolytica
KCNDGTMQQ

SEQ ID NO: 2558215 - protein, 19 aa, Entamoeba histolytica
KCSEEEKQQAIERETFGKE

SEQ ID NO: 2558216 - protein, 7 aa, Entamoeba histolytica
KCSTKDH

SEQ ID NO: 2558217 - protein, 10 aa, Entamoeba histolytica
KCTNDNEYSE

SEQ ID NO: 2558218 - protein, 19 aa, Entamoeba histolytica
KDCEEQETGCNSEKKKIVE

SEQ ID NO: 2558219 - protein, 15 aa, Entamoeba histolytica
KDDVNPISTTDNTRA

SEQ ID NO: 2558220 - protein, 9 aa, Entamoeba histolytica
KDEKQDSVT

SEQ ID NO: 2558221 - protein, 17 aa, Entamoeba histolytica
KDGELTFEDNSEATNGY

SEQ ID NO: 2558222 - protein, 12 aa, Entamoeba histolytica
KDKTSSKSDNDI

SEQ ID NO: 2558223 - protein, 8 aa, Entamoeba histolytica
KEEDNPTL

SEQ ID NO: 2558224 - protein, 4 aa, Entamoeba histolytica
KEEI

SEQ ID NO: 2558225 - protein, 14 aa, Entamoeba histolytica
KEETESMGNTGKYI

SEQ ID NO: 2558226 - protein, 15 aa, Entamoeba histolytica
KEEYEKEKKIRKKRN

SEQ ID NO: 2558227 - protein, 10 aa, Entamoeba histolytica
KEFEEETKKI

SEQ ID NO: 2558228 - protein, 6 aa, Entamoeba histolytica
KEGIPI

SEQ ID NO: 2558229 - protein, 23 aa, Entamoeba histolytica
KEKSSEKEKDSQTKKEKDSQTKY

SEQ ID NO: 2558230 - protein, 6 aa, Entamoeba histolytica
KENEIK

SEQ ID NO: 2558231 - protein, 8 aa, Entamoeba histolytica
KENKDVYN

SEQ ID NO: 2558232 - protein, 19 aa, Entamoeba histolytica
KENKKKRIKSTTADKVGTY

SEQ ID NO: 2558233 - protein, 6 aa, Entamoeba histolytica
KENVPE

SEQ ID NO: 2558234 - protein, 134 aa, Entamoeba histolytica
KESIHENDIENEEDKKSSSNSELDENSNNQPDESSNNKPDESSNNKPNESSDNKPNESSDNKPNESSDNKPSESSNNKPNESSNNKPDESSNNKPDESSNNKPNESSDNKPNESSNNKPGSSSDNYDNLDAASS

SEQ ID NO: 2558235 - protein, 6 aa, Entamoeba histolytica
KETGYK

SEQ ID NO: 2558236 - protein, 14 aa, Entamoeba histolytica
KEVTEKSGKQNKKK

SEQ ID NO: 2558237 - protein, 11 aa, Entamoeba histolytica
KFAQDGKSENM

SEQ ID NO: 2558238 - protein, 5 aa, Entamoeba histolytica
KFKEE

SEQ ID NO: 2558239 - protein, 10 aa, Entamoeba histolytica
KGDANINIKG

SEQ ID NO: 2558240 - protein, 5 aa, Entamoeba histolytica
KGDKM

SEQ ID NO: 2558241 - protein, 5 aa, Entamoeba histolytica
KGETI

SEQ ID NO: 2558242 - protein, 7 aa, Entamoeba histolytica
KGFEELN

SEQ ID NO: 2558243 - protein, 8 aa, Entamoeba histolytica
KGIGSPKY

SEQ ID NO: 2558244 - protein, 9 aa, Entamoeba histolytica
KGLSMTDGT

SEQ ID NO: 2558245 - protein, 6 aa, Entamoeba histolytica
KGNCGE

SEQ ID NO: 2558246 - protein, 7 aa, Entamoeba histolytica
KGRNDLK

SEQ ID NO: 2558247 - protein, 8 aa, Entamoeba histolytica
KGVGTPKY

SEQ ID NO: 2558248 - protein, 13 aa, Entamoeba histolytica
KHKEQLSDSEKKN

SEQ ID NO: 2558249 - protein, 7 aa, Entamoeba histolytica
KHPRKPT

SEQ ID NO: 2558250 - protein, 27 aa, Entamoeba histolytica
KIREQENKEAEEINQHKNTDTNEDPDI

SEQ ID NO: 2558251 - protein, 8 aa, Entamoeba histolytica
KITKNGEE

SEQ ID NO: 2558252 - protein, 15 aa, Entamoeba histolytica
KKAEEGHETKPGQSH

SEQ ID NO: 2558253 - protein, 18 aa, Entamoeba histolytica
KKDKRGENMCTGKTNNCQ

SEQ ID NO: 2558254 - protein, 8 aa, Entamoeba histolytica
KKEKGNDY

SEQ ID NO: 2558255 - protein, 10 aa, Entamoeba histolytica
KKENSTGRLA

SEQ ID NO: 2558256 - protein, 7 aa, Entamoeba histolytica
KKIGEGT

SEQ ID NO: 2558257 - protein, 4 aa, Entamoeba histolytica
KKLE

SEQ ID NO: 2558258 - protein, 8 aa, Entamoeba histolytica
KKNKISGS

SEQ ID NO: 2558259 - protein, 6 aa, Entamoeba histolytica
KKNNEK

SEQ ID NO: 2558260 - protein, 17 aa, Entamoeba histolytica
KKRGEGENEKKKEQHHK

SEQ ID NO: 2558261 - protein, 7 aa, Entamoeba histolytica
KKSGFSL

SEQ ID NO: 2558262 - protein, 13 aa, Entamoeba histolytica
KKYGITGQNENHR

SEQ ID NO: 2558263 - protein, 8 aa, Entamoeba histolytica
KLDTSKYS

SEQ ID NO: 2558264 - protein, 11 aa, Entamoeba histolytica
KLPSKKSKNTL

SEQ ID NO: 2558265 - protein, 7 aa, Entamoeba histolytica
KMKESSQ

SEQ ID NO: 2558266 - protein, 6 aa, Entamoeba histolytica
KMRQGQ

SEQ ID NO: 2558267 - protein, 7 aa, Entamoeba histolytica
KNGDEVE

SEQ ID NO: 2558268 - protein, 4 aa, Entamoeba histolytica
KNKE

SEQ ID NO: 2558269 - protein, 8 aa, Entamoeba histolytica
KNKRRDKE

SEQ ID NO: 2558270 - protein, 21 aa, Entamoeba histolytica
KNLTNPNSKELKGNLQNGQEL

SEQ ID NO: 2558271 - protein, 4 aa, Entamoeba histolytica
KNNN

SEQ ID NO: 2558272 - protein, 10 aa, Entamoeba histolytica
KNNQQLDNNT

SEQ ID NO: 2558273 - protein, 5 aa, Entamoeba histolytica
KNNTL

SEQ ID NO: 2558274 - protein, 8 aa, Entamoeba histolytica
KNRIRPED

SEQ ID NO: 2558275 - protein, 4 aa, Entamoeba histolytica
KNSK

SEQ ID NO: 2558276 - protein, 5 aa, Entamoeba histolytica
KNTTE

SEQ ID NO: 2558277 - protein, 13 aa, Entamoeba histolytica
KPEKGTVKINGRN

SEQ ID NO: 2558278 - protein, 7 aa, Entamoeba histolytica
KPRKPTE

SEQ ID NO: 2558279 - protein, 8 aa, Entamoeba histolytica
KQCHTPRR

SEQ ID NO: 2558280 - protein, 6 aa, Entamoeba histolytica
KQEIDD

SEQ ID NO: 2558281 - protein, 9 aa, Entamoeba histolytica
KQENKLPTG

SEQ ID NO: 2558282 - protein, 10 aa, Entamoeba histolytica
KQFSTQTERD

SEQ ID NO: 2558283 - protein, 7 aa, Entamoeba histolytica
KQNPPDT

SEQ ID NO: 2558284 - protein, 9 aa, Entamoeba histolytica
KQTKSISTH

SEQ ID NO: 2558285 - protein, 5 aa, Entamoeba histolytica
KRKKN

SEQ ID NO: 2558286 - protein, 6 aa, Entamoeba histolytica
KRNENN

SEQ ID NO: 2558287 - protein, 10 aa, Entamoeba histolytica
KSDNDKSKCT

SEQ ID NO: 2558288 - protein, 7 aa, Entamoeba histolytica
KSDNSFD

SEQ ID NO: 2558289 - protein, 9 aa, Entamoeba histolytica
KSIKGEEPV

SEQ ID NO: 2558290 - protein, 14 aa, Entamoeba histolytica
KSLFEEQQTAPQIQ

SEQ ID NO: 2558291 - protein, 8 aa, Entamoeba histolytica
KSMKAARH

SEQ ID NO: 2558292 - protein, 6 aa, Entamoeba histolytica
KSNGKM

SEQ ID NO: 2558293 - protein, 9 aa, Entamoeba histolytica
KSNNNEKSY

SEQ ID NO: 2558294 - protein, 6 aa, Entamoeba histolytica
KSNSLT

SEQ ID NO: 2558295 - protein, 7 aa, Entamoeba histolytica
KSVDGDS

SEQ ID NO: 2558296 - protein, 21 aa, Entamoeba histolytica
KTCGTKEKDETVKKLENKPEN

SEQ ID NO: 2558297 - protein, 9 aa, Entamoeba histolytica
KTDTTTYNC

SEQ ID NO: 2558298 - protein, 7 aa, Entamoeba histolytica
KTEYSIE

SEQ ID NO: 2558299 - protein, 8 aa, Entamoeba histolytica
KTGTLTEN

SEQ ID NO: 2558300 - protein, 7 aa, Entamoeba histolytica
KTISKEE

SEQ ID NO: 2558301 - protein, 21 aa, Entamoeba histolytica
KTKCNQKNKRLVKRDSRCDKE

SEQ ID NO: 2558302 - protein, 8 aa, Entamoeba histolytica
KTKTTSID

SEQ ID NO: 2558303 - protein, 4 aa, Entamoeba histolytica
KTNE

SEQ ID NO: 2558304 - protein, 6 aa, Entamoeba histolytica
KTNTDI

SEQ ID NO: 2558305 - protein, 10 aa, Entamoeba histolytica
KTNTKNKCAS

SEQ ID NO: 2558306 - protein, 7 aa, Entamoeba histolytica
KTSDEEM

SEQ ID NO: 2558307 - protein, 6 aa, Entamoeba histolytica
KTVADT

SEQ ID NO: 2558308 - protein, 6 aa, Entamoeba histolytica
KYEDGY

SEQ ID NO: 2558309 - protein, 13 aa, Entamoeba histolytica
KYESPYERTSGVN

SEQ ID NO: 2558310 - protein, 4 aa, Entamoeba histolytica
KYGS

SEQ ID NO: 2558311 - protein, 12 aa, Entamoeba histolytica
KYIRKGRKGSLN

SEQ ID NO: 2558312 - protein, 12 aa, Entamoeba histolytica
LAADATKLNGVT

SEQ ID NO: 2558313 - protein, 16 aa, Entamoeba histolytica
LASDPTTLQGISGERV

SEQ ID NO: 2558314 - protein, 7 aa, Entamoeba histolytica
LASKETV

SEQ ID NO: 2558315 - protein, 12 aa, Entamoeba histolytica
LDFDKKSDNHYL

SEQ ID NO: 2558316 - protein, 8 aa, Entamoeba histolytica
LESSLSQD

SEQ ID NO: 2558317 - protein, 10 aa, Entamoeba histolytica
LGLPQGNREE

SEQ ID NO: 2558318 - protein, 6 aa, Entamoeba histolytica
LGNETY

SEQ ID NO: 2558319 - protein, 6 aa, Entamoeba histolytica
LGQGTF

SEQ ID NO: 2558320 - protein, 6 aa, Entamoeba histolytica
LITSGQ

SEQ ID NO: 2558321 - protein, 8 aa, Entamoeba histolytica
LKDGNEDD

SEQ ID NO: 2558322 - protein, 7 aa, Entamoeba histolytica
LKEEEVQ

SEQ ID NO: 2558323 - protein, 5 aa, Entamoeba histolytica
LKEEN

SEQ ID NO: 2558324 - protein, 6 aa, Entamoeba histolytica
LKKGDK

SEQ ID NO: 2558325 - protein, 6 aa, Entamoeba histolytica
LKKRRN

SEQ ID NO: 2558326 - protein, 22 aa, Entamoeba histolytica
LKTNNTQFQRKKNNKKNNKKNK

SEQ ID NO: 2558327 - protein, 6 aa, Entamoeba histolytica
LNETSY

SEQ ID NO: 2558328 - protein, 6 aa, Entamoeba histolytica
LNKTTY

SEQ ID NO: 2558329 - protein, 4 aa, Entamoeba histolytica
LNNG

SEQ ID NO: 2558330 - protein, 10 aa, Entamoeba histolytica
LNPCTTSDIP

SEQ ID NO: 2558331 - protein, 5 aa, Entamoeba histolytica
LNPTH

SEQ ID NO: 2558332 - protein, 10 aa, Entamoeba histolytica
LNSASIEETG

SEQ ID NO: 2558333 - protein, 6 aa, Entamoeba histolytica
LNSKGE

SEQ ID NO: 2558334 - protein, 8 aa, Entamoeba histolytica
LNSKGECI

SEQ ID NO: 2558335 - protein, 5 aa, Entamoeba histolytica
LRDEE

SEQ ID NO: 2558336 - protein, 7 aa, Entamoeba histolytica
LSDEESK

SEQ ID NO: 2558337 - protein, 6 aa, Entamoeba histolytica
LSDPGS

SEQ ID NO: 2558338 - protein, 11 aa, Entamoeba histolytica
LSKPKEVKKKE

SEQ ID NO: 2558339 - protein, 10 aa, Entamoeba histolytica
LSSDPTKLNG

SEQ ID NO: 2558340 - protein, 9 aa, Entamoeba histolytica
LSSTSDKHF

SEQ ID NO: 2558341 - protein, 30 aa, Entamoeba histolytica
LTCPADTTYRTYTYDSKTGTCKATVQPTPA

SEQ ID NO: 2558342 - protein, 4 aa, Entamoeba histolytica
LTGQ

SEQ ID NO: 2558343 - protein, 10 aa, Entamoeba histolytica
LVENDSPSHL

SEQ ID NO: 2558344 - protein, 5 aa, Entamoeba histolytica
MKKGD

SEQ ID NO: 2558345 - protein, 6 aa, Entamoeba histolytica
MKNNGA

SEQ ID NO: 2558346 - protein, 8 aa, Entamoeba histolytica
MNGPQDGT

SEQ ID NO: 2558347 - protein, 5 aa, Entamoeba histolytica
MSARS

SEQ ID NO: 2558348 - protein, 6 aa, Entamoeba histolytica
MSDDSE

SEQ ID NO: 2558349 - protein, 5 aa, Entamoeba histolytica
MSDNT

SEQ ID NO: 2558350 - protein, 9 aa, Entamoeba histolytica
MSPQASQLY

SEQ ID NO: 2558351 - protein, 9 aa, Entamoeba histolytica
MTSPDTGKI

SEQ ID NO: 2558352 - protein, 6 aa, Entamoeba histolytica
NAGPKI

SEQ ID NO: 2558353 - protein, 8 aa, Entamoeba histolytica
NAGPPEPI

SEQ ID NO: 2558354 - protein, 21 aa, Entamoeba histolytica
NAIKSSTTCSVTSNSINVSNS

SEQ ID NO: 2558355 - protein, 10 aa, Entamoeba histolytica
NAKKATKEKF

SEQ ID NO: 2558356 - protein, 9 aa, Entamoeba histolytica
NASGIEEPG

SEQ ID NO: 2558357 - protein, 6 aa, Entamoeba histolytica
NCTIGT

SEQ ID NO: 2558358 - protein, 8 aa, Entamoeba histolytica
NCTKSERN

SEQ ID NO: 2558359 - protein, 6 aa, Entamoeba histolytica
NDQLQQ

SEQ ID NO: 2558360 - protein, 5 aa, Entamoeba histolytica
NECQA

SEQ ID NO: 2558361 - protein, 7 aa, Entamoeba histolytica
NEDQQKF

SEQ ID NO: 2558362 - protein, 4 aa, Entamoeba histolytica
NEEI

SEQ ID NO: 2558363 - protein, 7 aa, Entamoeba histolytica
NEKFPLK

SEQ ID NO: 2558364 - protein, 6 aa, Entamoeba histolytica
NENENI

SEQ ID NO: 2558365 - protein, 7 aa, Entamoeba histolytica
NENNEMK

SEQ ID NO: 2558366 - protein, 4 aa, Entamoeba histolytica
NESI

SEQ ID NO: 2558367 - protein, 30 aa, Entamoeba histolytica
NETCEEGKIKDQNGKCNSNISNCSNESYVN

SEQ ID NO: 2558368 - protein, 4 aa, Entamoeba histolytica
NETI

SEQ ID NO: 2558369 - protein, 4 aa, Entamoeba histolytica
NETS

SEQ ID NO: 2558370 - protein, 4 aa, Entamoeba histolytica
NEYT

SEQ ID NO: 2558371 - protein, 4 aa, Entamoeba histolytica
NGDY

SEQ ID NO: 2558372 - protein, 7 aa, Entamoeba histolytica
NGEKKYS

SEQ ID NO: 2558373 - protein, 8 aa, Entamoeba histolytica
NGGPLETV

SEQ ID NO: 2558374 - protein, 10 aa, Entamoeba histolytica
NGHGKTETVT

SEQ ID NO: 2558375 - protein, 7 aa, Entamoeba histolytica
NGIDTDT

SEQ ID NO: 2558376 - protein, 4 aa, Entamoeba histolytica
NGIE

SEQ ID NO: 2558377 - protein, 4 aa, Entamoeba histolytica
NGKE

SEQ ID NO: 2558378 - protein, 9 aa, Entamoeba histolytica
NGLSMTDGT

SEQ ID NO: 2558379 - protein, 5 aa, Entamoeba histolytica
NGNKY

SEQ ID NO: 2558380 - protein, 7 aa, Entamoeba histolytica
NGTPAMR

SEQ ID NO: 2558381 - protein, 4 aa, Entamoeba histolytica
NGVP

SEQ ID NO: 2558382 - protein, 18 aa, Entamoeba histolytica
NGYKIENNTCVKDEEECY

SEQ ID NO: 2558383 - protein, 5 aa, Entamoeba histolytica
NHQET

SEQ ID NO: 2558384 - protein, 12 aa, Entamoeba histolytica
NIENKENITTEV

SEQ ID NO: 2558385 - protein, 4 aa, Entamoeba histolytica
NIGE

SEQ ID NO: 2558386 - protein, 7 aa, Entamoeba histolytica
NKACPNG

SEQ ID NO: 2558387 - protein, 21 aa, Entamoeba histolytica
NKCNKGSETSSKKVVKTRDNT

SEQ ID NO: 2558388 - protein, 9 aa, Entamoeba histolytica
NKEKYKQAI

SEQ ID NO: 2558389 - protein, 8 aa, Entamoeba histolytica
NKELNQNS

SEQ ID NO: 2558390 - protein, 9 aa, Entamoeba histolytica
NKESENAIE

SEQ ID NO: 2558391 - protein, 8 aa, Entamoeba histolytica
NKGFPSSH

SEQ ID NO: 2558392 - protein, 4 aa, Entamoeba histolytica
NKLT

SEQ ID NO: 2558393 - protein, 13 aa, Entamoeba histolytica
NKLTTAQKIKRGK

SEQ ID NO: 2558394 - protein, 4 aa, Entamoeba histolytica
NKRD

SEQ ID NO: 2558395 - protein, 15 aa, Entamoeba histolytica
NKTDCESKYGIRSEP

SEQ ID NO: 2558396 - protein, 4 aa, Entamoeba histolytica
NKVG

SEQ ID NO: 2558397 - protein, 5 aa, Entamoeba histolytica
NLAEE

SEQ ID NO: 2558398 - protein, 9 aa, Entamoeba histolytica
NNDCTGNEV

SEQ ID NO: 2558399 - protein, 8 aa, Entamoeba histolytica
NNDNNTLN

SEQ ID NO: 2558400 - protein, 7 aa, Entamoeba histolytica
NNECQEN

SEQ ID NO: 2558401 - protein, 9 aa, Entamoeba histolytica
NNITTTTNE

SEQ ID NO: 2558402 - protein, 10 aa, Entamoeba histolytica
NNNKECETYT

SEQ ID NO: 2558403 - protein, 12 aa, Entamoeba histolytica
NNTCVKDEEECY

SEQ ID NO: 2558404 - protein, 7 aa, Entamoeba histolytica
NPGGNKQ

SEQ ID NO: 2558405 - protein, 12 aa, Entamoeba histolytica
NPKSATLKPGTA

SEQ ID NO: 2558406 - protein, 4 aa, Entamoeba histolytica
NPLT

SEQ ID NO: 2558407 - protein, 7 aa, Entamoeba histolytica
NPPDEIK

SEQ ID NO: 2558408 - protein, 9 aa, Entamoeba histolytica
NPPKHEEEI

SEQ ID NO: 2558409 - protein, 9 aa, Entamoeba histolytica
NPPSEEEIN

SEQ ID NO: 2558410 - protein, 9 aa, Entamoeba histolytica
NPPSHSTCQ

SEQ ID NO: 2558411 - protein, 6 aa, Entamoeba histolytica
NPTPSI

SEQ ID NO: 2558412 - protein, 5 aa, Entamoeba histolytica
NQEAM

SEQ ID NO: 2558413 - protein, 4 aa, Entamoeba histolytica
NQEN

SEQ ID NO: 2558414 - protein, 10 aa, Entamoeba histolytica
NQLTPHDERP

SEQ ID NO: 2558415 - protein, 7 aa, Entamoeba histolytica
NQPSFGT

SEQ ID NO: 2558416 - protein, 4 aa, Entamoeba histolytica
NQSY

SEQ ID NO: 2558417 - protein, 13 aa, Entamoeba histolytica
NQVSSSSQQLNED

SEQ ID NO: 2558418 - protein, 9 aa, Entamoeba histolytica
NQYPSRSSK

SEQ ID NO: 2558419 - protein, 9 aa, Entamoeba histolytica
NQYSNIQTQ

SEQ ID NO: 2558420 - protein, 15 aa, Entamoeba histolytica
NRKWDEGEECDGGDG

SEQ ID NO: 2558421 - protein, 4 aa, Entamoeba histolytica
NRMD

SEQ ID NO: 2558422 - protein, 9 aa, Entamoeba histolytica
NRMGESNLS

SEQ ID NO: 2558423 - protein, 9 aa, Entamoeba histolytica
NSCKSGYYS

SEQ ID NO: 2558424 - protein, 4 aa, Entamoeba histolytica
NSDG

SEQ ID NO: 2558425 - protein, 6 aa, Entamoeba histolytica
NSISRK

SEQ ID NO: 2558426 - protein, 4 aa, Entamoeba histolytica
NSSS

SEQ ID NO: 2558427 - protein, 7 aa, Entamoeba histolytica
NSTTKYH

SEQ ID NO: 2558428 - protein, 11 aa, Entamoeba histolytica
NSVDKKLSKEV

SEQ ID NO: 2558429 - protein, 5 aa, Entamoeba histolytica
NTENK

SEQ ID NO: 2558430 - protein, 6 aa, Entamoeba histolytica
NTGVEC

SEQ ID NO: 2558431 - protein, 7 aa, Entamoeba histolytica
NTQTTIN

SEQ ID NO: 2558432 - protein, 6 aa, Entamoeba histolytica
NTSCEP

SEQ ID NO: 2558433 - protein, 5 aa, Entamoeba histolytica
NTSTI

SEQ ID NO: 2558434 - protein, 4 aa, Entamoeba histolytica
NTTT

SEQ ID NO: 2558435 - protein, 5 aa, Entamoeba histolytica
NTWNN

SEQ ID NO: 2558436 - protein, 4 aa, Entamoeba histolytica
NVDD

SEQ ID NO: 2558437 - protein, 6 aa, Entamoeba histolytica
NVTQRN

SEQ ID NO: 2558438 - protein, 9 aa, Entamoeba histolytica
NYEKTETKE

SEQ ID NO: 2558439 - protein, 10 aa, Entamoeba histolytica
NYPKERSLSE

SEQ ID NO: 2558440 - protein, 7 aa, Entamoeba histolytica
NYQSGDL

SEQ ID NO: 2558441 - protein, 5 aa, Entamoeba histolytica
NYSKN

SEQ ID NO: 2558442 - protein, 8 aa, Entamoeba histolytica
NYTQTNQG

SEQ ID NO: 2558443 - protein, 16 aa, Entamoeba histolytica
PDIDSPEESIRNTTAR

SEQ ID NO: 2558444 - protein, 5 aa, Entamoeba histolytica
PEEAD

SEQ ID NO: 2558445 - protein, 4 aa, Entamoeba histolytica
PESS

SEQ ID NO: 2558446 - protein, 5 aa, Entamoeba histolytica
PFGEE

SEQ ID NO: 2558447 - protein, 10 aa, Entamoeba histolytica
PFPKSEYPHP

SEQ ID NO: 2558448 - protein, 9 aa, Entamoeba histolytica
PGCNEGLKT

SEQ ID NO: 2558449 - protein, 13 aa, Entamoeba histolytica
PGLNDTNNFDTEN

SEQ ID NO: 2558450 - protein, 5 aa, Entamoeba histolytica
PGTTS

SEQ ID NO: 2558451 - protein, 8 aa, Entamoeba histolytica
PKEEQDSR

SEQ ID NO: 2558452 - protein, 17 aa, Entamoeba histolytica
PKEISPAETKMNSTNTR

SEQ ID NO: 2558453 - protein, 7 aa, Entamoeba histolytica
PKGVEAN

SEQ ID NO: 2558454 - protein, 5 aa, Entamoeba histolytica
PKRSY

SEQ ID NO: 2558455 - protein, 16 aa, Entamoeba histolytica
PNDKCNSKERTKHEQK

SEQ ID NO: 2558456 - protein, 7 aa, Entamoeba histolytica
PNRDSDF

SEQ ID NO: 2558457 - protein, 4 aa, Entamoeba histolytica
PPIG

SEQ ID NO: 2558458 - protein, 11 aa, Entamoeba histolytica
PPKRKKVIDKR

SEQ ID NO: 2558459 - protein, 4 aa, Entamoeba histolytica
PPLN

SEQ ID NO: 2558460 - protein, 10 aa, Entamoeba histolytica
PPNPSNGTRD

SEQ ID NO: 2558461 - protein, 7 aa, Entamoeba histolytica
PPSPFTS

SEQ ID NO: 2558462 - protein, 5 aa, Entamoeba histolytica
PRKPT

SEQ ID NO: 2558463 - protein, 6 aa, Entamoeba histolytica
PRLSDS

SEQ ID NO: 2558464 - protein, 4 aa, Entamoeba histolytica
PSHR

SEQ ID NO: 2558465 - protein, 10 aa, Entamoeba histolytica
PSNEKYEGLK

SEQ ID NO: 2558466 - protein, 4 aa, Entamoeba histolytica
PSRE

SEQ ID NO: 2558467 - protein, 4 aa, Entamoeba histolytica
PSTI

SEQ ID NO: 2558468 - protein, 4 aa, Entamoeba histolytica
PSYR

SEQ ID NO: 2558469 - protein, 7 aa, Entamoeba histolytica
PTKKPSN

SEQ ID NO: 2558470 - protein, 4 aa, Entamoeba histolytica
PTNV

SEQ ID NO: 2558471 - protein, 20 aa, Entamoeba histolytica
PTQTTGNNQRTSSNNHKQEE

SEQ ID NO: 2558472 - protein, 8 aa, Entamoeba histolytica
PTTSTCRT

SEQ ID NO: 2558473 - protein, 5 aa, Entamoeba histolytica
PVDPA

SEQ ID NO: 2558474 - protein, 26 aa, Entamoeba histolytica
PVEETKEKKRKYQEIPEDWPKEGKIE

SEQ ID NO: 2558475 - protein, 9 aa, Entamoeba histolytica
PYPPPPVDN

SEQ ID NO: 2558476 - protein, 5 aa, Entamoeba histolytica
QARNN

SEQ ID NO: 2558477 - protein, 15 aa, Entamoeba histolytica
QDNALNSINEDKPYN

SEQ ID NO: 2558478 - protein, 9 aa, Entamoeba histolytica
QDVSSKEIK

SEQ ID NO: 2558479 - protein, 9 aa, Entamoeba histolytica
QEEKEAKLK

SEQ ID NO: 2558480 - protein, 5 aa, Entamoeba histolytica
QENPY

SEQ ID NO: 2558481 - protein, 5 aa, Entamoeba histolytica
QEYKK

SEQ ID NO: 2558482 - protein, 6 aa, Entamoeba histolytica
QGHSQL

SEQ ID NO: 2558483 - protein, 4 aa, Entamoeba histolytica
QHDR

SEQ ID NO: 2558484 - protein, 14 aa, Entamoeba histolytica
QIEKSEDKKKEFEK

SEQ ID NO: 2558485 - protein, 4 aa, Entamoeba histolytica
QIKE

SEQ ID NO: 2558486 - protein, 4 aa, Entamoeba histolytica
QIKI

SEQ ID NO: 2558487 - protein, 6 aa, Entamoeba histolytica
QKLSYD

SEQ ID NO: 2558488 - protein, 6 aa, Entamoeba histolytica
QKVQKE

SEQ ID NO: 2558489 - protein, 7 aa, Entamoeba histolytica
QLDGETD

SEQ ID NO: 2558490 - protein, 9 aa, Entamoeba histolytica
QLTERTKEF

SEQ ID NO: 2558491 - protein, 17 aa, Entamoeba histolytica
QNGEEAEFYEDQKDQIN

SEQ ID NO: 2558492 - protein, 7 aa, Entamoeba histolytica
QNGIPNA

SEQ ID NO: 2558493 - protein, 4 aa, Entamoeba histolytica
QNPY

SEQ ID NO: 2558494 - protein, 8 aa, Entamoeba histolytica
QNSTDYSY

SEQ ID NO: 2558495 - protein, 7 aa, Entamoeba histolytica
QPKLTSI

SEQ ID NO: 2558496 - protein, 9 aa, Entamoeba histolytica
QQDQINNGE

SEQ ID NO: 2558497 - protein, 9 aa, Entamoeba histolytica
QRHQNESDY

SEQ ID NO: 2558498 - protein, 5 aa, Entamoeba histolytica
QRTKK

SEQ ID NO: 2558499 - protein, 9 aa, Entamoeba histolytica
QSCSTRGTY

SEQ ID NO: 2558500 - protein, 7 aa, Entamoeba histolytica
QSGCAEE

SEQ ID NO: 2558501 - protein, 4 aa, Entamoeba histolytica
QSLT

SEQ ID NO: 2558502 - protein, 15 aa, Entamoeba histolytica
QSMEEEVEQETVEND

SEQ ID NO: 2558503 - protein, 11 aa, Entamoeba histolytica
QSQKKSQCNDP

SEQ ID NO: 2558504 - protein, 11 aa, Entamoeba histolytica
QSVNTQYTITD

SEQ ID NO: 2558505 - protein, 12 aa, Entamoeba histolytica
QTADEIKNKSKD

SEQ ID NO: 2558506 - protein, 11 aa, Entamoeba histolytica
QTGLGDPSPGN

SEQ ID NO: 2558507 - protein, 7 aa, Entamoeba histolytica
QTRDESI

SEQ ID NO: 2558508 - protein, 9 aa, Entamoeba histolytica
QYGNSTTSN

SEQ ID NO: 2558509 - protein, 18 aa, Entamoeba histolytica
RAKKRKRREEEKKKRKDG

SEQ ID NO: 2558510 - protein, 4 aa, Entamoeba histolytica
RCTV

SEQ ID NO: 2558511 - protein, 14 aa, Entamoeba histolytica
RDESELSSEERKKI

SEQ ID NO: 2558512 - protein, 6 aa, Entamoeba histolytica
REEGIN

SEQ ID NO: 2558513 - protein, 7 aa, Entamoeba histolytica
REGIKPR

SEQ ID NO: 2558514 - protein, 9 aa, Entamoeba histolytica
RENSKQKDV

SEQ ID NO: 2558515 - protein, 10 aa, Entamoeba histolytica
RGKGGSKGVF

SEQ ID NO: 2558516 - protein, 8 aa, Entamoeba histolytica
RGKKTDKE

SEQ ID NO: 2558517 - protein, 13 aa, Entamoeba histolytica
RGVPKGVEVSNEQ

SEQ ID NO: 2558518 - protein, 4 aa, Entamoeba histolytica
RITT

SEQ ID NO: 2558519 - protein, 10 aa, Entamoeba histolytica
RKNNKVFDDT

SEQ ID NO: 2558520 - protein, 8 aa, Entamoeba histolytica
RKPPDQYQ

SEQ ID NO: 2558521 - protein, 19 aa, Entamoeba histolytica
RKPQQKQPQQQSSENTKKN

SEQ ID NO: 2558522 - protein, 5 aa, Entamoeba histolytica
RKRRE

SEQ ID NO: 2558523 - protein, 5 aa, Entamoeba histolytica
RKRRK

SEQ ID NO: 2558524 - protein, 13 aa, Entamoeba histolytica
RKSRKGGRKEVEK

SEQ ID NO: 2558525 - protein, 26 aa, Entamoeba histolytica
RNEESERVKENYEQPPDEWPSKGEVK

SEQ ID NO: 2558526 - protein, 10 aa, Entamoeba histolytica
RNKNNKNKKS

SEQ ID NO: 2558527 - protein, 8 aa, Entamoeba histolytica
RNNEKYQR

SEQ ID NO: 2558528 - protein, 4 aa, Entamoeba histolytica
RPGM

SEQ ID NO: 2558529 - protein, 6 aa, Entamoeba histolytica
RPHLSQ

SEQ ID NO: 2558530 - protein, 12 aa, Entamoeba histolytica
RQLTNQKEIKRN

SEQ ID NO: 2558531 - protein, 6 aa, Entamoeba histolytica
RREVPG

SEQ ID NO: 2558532 - protein, 4 aa, Entamoeba histolytica
RRKE

SEQ ID NO: 2558533 - protein, 26 aa, Entamoeba histolytica
RRRSESYSSDYSPRPRRSRWDEKPTV

SEQ ID NO: 2558534 - protein, 6 aa, Entamoeba histolytica
RSERSY

SEQ ID NO: 2558535 - protein, 4 aa, Entamoeba histolytica
RSRG

SEQ ID NO: 2558536 - protein, 4 aa, Entamoeba histolytica
RSTI

SEQ ID NO: 2558537 - protein, 8 aa, Entamoeba histolytica
RTHKFREA

SEQ ID NO: 2558538 - protein, 6 aa, Entamoeba histolytica
RTSQKL

SEQ ID NO: 2558539 - protein, 10 aa, Entamoeba histolytica
RVKDSQKETY

SEQ ID NO: 2558540 - protein, 12 aa, Entamoeba histolytica
RWGTSDDRTDYE

SEQ ID NO: 2558541 - protein, 6 aa, Entamoeba histolytica
SALPRA

SEQ ID NO: 2558542 - protein, 14 aa, Entamoeba histolytica
SAPEEEQAKKNSWH

SEQ ID NO: 2558543 - protein, 4 aa, Entamoeba histolytica
SCDD

SEQ ID NO: 2558544 - protein, 11 aa, Entamoeba histolytica
SCGTSDPSQFI

SEQ ID NO: 2558545 - protein, 5 aa, Entamoeba histolytica
SCLTT

SEQ ID NO: 2558546 - protein, 6 aa, Entamoeba histolytica
SCSQTD

SEQ ID NO: 2558547 - protein, 11 aa, Entamoeba histolytica
SDARSKTDIQT

SEQ ID NO: 2558548 - protein, 6 aa, Entamoeba histolytica
SDFERR

SEQ ID NO: 2558549 - protein, 7 aa, Entamoeba histolytica
SDFGSSR

SEQ ID NO: 2558550 - protein, 7 aa, Entamoeba histolytica
SDGSQQC

SEQ ID NO: 2558551 - protein, 10 aa, Entamoeba histolytica
SDKTGTLTEN

SEQ ID NO: 2558552 - protein, 8 aa, Entamoeba histolytica
SDNKKFTE

SEQ ID NO: 2558553 - protein, 4 aa, Entamoeba histolytica
SDRI

SEQ ID NO: 2558554 - protein, 12 aa, Entamoeba histolytica
SDTLTDDQKDTI

SEQ ID NO: 2558555 - protein, 7 aa, Entamoeba histolytica
SECSSAA

SEQ ID NO: 2558556 - protein, 6 aa, Entamoeba histolytica
SECTND

SEQ ID NO: 2558557 - protein, 10 aa, Entamoeba histolytica
SEGNSFNLNE

SEQ ID NO: 2558558 - protein, 9 aa, Entamoeba histolytica
SEKPIAEGA

SEQ ID NO: 2558559 - protein, 10 aa, Entamoeba histolytica
SEMSNISSSE

SEQ ID NO: 2558560 - protein, 5 aa, Entamoeba histolytica
SENES

SEQ ID NO: 2558561 - protein, 8 aa, Entamoeba histolytica
SENESYKK

SEQ ID NO: 2558562 - protein, 9 aa, Entamoeba histolytica
SFPTSEDDP

SEQ ID NO: 2558563 - protein, 4 aa, Entamoeba histolytica
SGDI

SEQ ID NO: 2558564 - protein, 4 aa, Entamoeba histolytica
SGIG

SEQ ID NO: 2558565 - protein, 4 aa, Entamoeba histolytica
SGTD

SEQ ID NO: 2558566 - protein, 8 aa, Entamoeba histolytica
SHETGGST

SEQ ID NO: 2558567 - protein, 12 aa, Entamoeba histolytica
SHNTSSDEFKGN

SEQ ID NO: 2558568 - protein, 24 aa, Entamoeba histolytica
SIKEQEKKKHKYSTQQSSTPNQIY

SEQ ID NO: 2558569 - protein, 9 aa, Entamoeba histolytica
SINEDKPYN

SEQ ID NO: 2558570 - protein, 6 aa, Entamoeba histolytica
SISPST

SEQ ID NO: 2558571 - protein, 5 aa, Entamoeba histolytica
SISTT

SEQ ID NO: 2558572 - protein, 6 aa, Entamoeba histolytica
SISTTL

SEQ ID NO: 2558573 - protein, 9 aa, Entamoeba histolytica
SKCKENCTT

SEQ ID NO: 2558574 - protein, 4 aa, Entamoeba histolytica
SKES

SEQ ID NO: 2558575 - protein, 6 aa, Entamoeba histolytica
SKETDC

SEQ ID NO: 2558576 - protein, 14 aa, Entamoeba histolytica
SKFNPDKELGDYED

SEQ ID NO: 2558577 - protein, 6 aa, Entamoeba histolytica
SKGAPE

SEQ ID NO: 2558578 - protein, 7 aa, Entamoeba histolytica
SKITNIP

SEQ ID NO: 2558579 - protein, 4 aa, Entamoeba histolytica
SKQP

SEQ ID NO: 2558580 - protein, 7 aa, Entamoeba histolytica
SKSTLES

SEQ ID NO: 2558581 - protein, 4 aa, Entamoeba histolytica
SKYS

SEQ ID NO: 2558582 - protein, 6 aa, Entamoeba histolytica
SLNQEN

SEQ ID NO: 2558583 - protein, 6 aa, Entamoeba histolytica
SLNQKN

SEQ ID NO: 2558584 - protein, 5 aa, Entamoeba histolytica
SLPED

SEQ ID NO: 2558585 - protein, 4 aa, Entamoeba histolytica
SLSI

SEQ ID NO: 2558586 - protein, 17 aa, Entamoeba histolytica
SLSSNITSSNQAIGNET

SEQ ID NO: 2558587 - protein, 15 aa, Entamoeba histolytica
SMQSSPAEKAYEESG

SEQ ID NO: 2558588 - protein, 13 aa, Entamoeba histolytica
SNDDSPECGSSAS

SEQ ID NO: 2558589 - protein, 4 aa, Entamoeba histolytica
SNKG

SEQ ID NO: 2558590 - protein, 8 aa, Entamoeba histolytica
SNKTNKFT

SEQ ID NO: 2558591 - protein, 12 aa, Entamoeba histolytica
SNNIPQNGYNRV

SEQ ID NO: 2558592 - protein, 7 aa, Entamoeba histolytica
SNPSKTP

SEQ ID NO: 2558593 - protein, 7 aa, Entamoeba histolytica
SNPSNTP

SEQ ID NO: 2558594 - protein, 8 aa, Entamoeba histolytica
SNTFTVDT

SEQ ID NO: 2558595 - protein, 9 aa, Entamoeba histolytica
SNTGTGATV

SEQ ID NO: 2558596 - protein, 4 aa, Entamoeba histolytica
SNTK

SEQ ID NO: 2558597 - protein, 7 aa, Entamoeba histolytica
SPDDDKI

SEQ ID NO: 2558598 - protein, 7 aa, Entamoeba histolytica
SPPGTYL

SEQ ID NO: 2558599 - protein, 9 aa, Entamoeba histolytica
SPSINQPSK

SEQ ID NO: 2558600 - protein, 11 aa, Entamoeba histolytica
SPTANGSGVPE

SEQ ID NO: 2558601 - protein, 5 aa, Entamoeba histolytica
SPTDV

SEQ ID NO: 2558602 - protein, 12 aa, Entamoeba histolytica
SPTEENKCTKCD

SEQ ID NO: 2558603 - protein, 26 aa, Entamoeba histolytica
SQNTPAKKVENINTLSTEEENKKSFP

SEQ ID NO: 2558604 - protein, 9 aa, Entamoeba histolytica
SQSNEECNR

SEQ ID NO: 2558605 - protein, 8 aa, Entamoeba histolytica
SRPKSSTL

SEQ ID NO: 2558606 - protein, 17 aa, Entamoeba histolytica
SSDEDDHGNKKKEMSSI

SEQ ID NO: 2558607 - protein, 9 aa, Entamoeba histolytica
SSDNCNNIT

SEQ ID NO: 2558608 - protein, 17 aa, Entamoeba histolytica
SSQKEIQSQTYDSARDA

SEQ ID NO: 2558609 - protein, 7 aa, Entamoeba histolytica
SSQNNLA

SEQ ID NO: 2558610 - protein, 5 aa, Entamoeba histolytica
SSQTY

SEQ ID NO: 2558611 - protein, 4 aa, Entamoeba histolytica
SSSL

SEQ ID NO: 2558612 - protein, 5 aa, Entamoeba histolytica
SSSNI

SEQ ID NO: 2558613 - protein, 6 aa, Entamoeba histolytica
SSSTKR

SEQ ID NO: 2558614 - protein, 4 aa, Entamoeba histolytica
SSTK

SEQ ID NO: 2558615 - protein, 8 aa, Entamoeba histolytica
SSTKHTAE

SEQ ID NO: 2558616 - protein, 8 aa, Entamoeba histolytica
STAKALGA

SEQ ID NO: 2558617 - protein, 7 aa, Entamoeba histolytica
STEVPVS

SEQ ID NO: 2558618 - protein, 5 aa, Entamoeba histolytica
STFSP

SEQ ID NO: 2558619 - protein, 8 aa, Entamoeba histolytica
STGKRPNI

SEQ ID NO: 2558620 - protein, 14 aa, Entamoeba histolytica
STLDSNCQSCSDKT

SEQ ID NO: 2558621 - protein, 5 aa, Entamoeba histolytica
STNTI

SEQ ID NO: 2558622 - protein, 12 aa, Entamoeba histolytica
STQINSNSREIK

SEQ ID NO: 2558623 - protein, 5 aa, Entamoeba histolytica
STQIS

SEQ ID NO: 2558624 - protein, 9 aa, Entamoeba histolytica
STSAKCGAC

SEQ ID NO: 2558625 - protein, 5 aa, Entamoeba histolytica
STTEY

SEQ ID NO: 2558626 - protein, 10 aa, Entamoeba histolytica
STTKIEEESN

SEQ ID NO: 2558627 - protein, 4 aa, Entamoeba histolytica
STTQ

SEQ ID NO: 2558628 - protein, 8 aa, Entamoeba histolytica
STYNGGST

SEQ ID NO: 2558629 - protein, 4 aa, Entamoeba histolytica
SYNH

SEQ ID NO: 2558630 - protein, 10 aa, Entamoeba histolytica
SYQNSKTKLY

SEQ ID NO: 2558631 - protein, 6 aa, Entamoeba histolytica
SYQTST

SEQ ID NO: 2558632 - protein, 4 aa, Entamoeba histolytica
SYVS

SEQ ID NO: 2558633 - protein, 10 aa, Entamoeba histolytica
TAAGKSQPAN

SEQ ID NO: 2558634 - protein, 8 aa, Entamoeba histolytica
TAETGKGI

SEQ ID NO: 2558635 - protein, 12 aa, Entamoeba histolytica
TCNNDKAKCASC

SEQ ID NO: 2558636 - protein, 6 aa, Entamoeba histolytica
TCPCSG

SEQ ID NO: 2558637 - protein, 8 aa, Entamoeba histolytica
TDFGSSRN

SEQ ID NO: 2558638 - protein, 8 aa, Entamoeba histolytica
TDGEDKRM

SEQ ID NO: 2558639 - protein, 10 aa, Entamoeba histolytica
TDKPKCSHID

SEQ ID NO: 2558640 - protein, 4 aa, Entamoeba histolytica
TDPN

SEQ ID NO: 2558641 - protein, 5 aa, Entamoeba histolytica
TDSRS

SEQ ID NO: 2558642 - protein, 10 aa, Entamoeba histolytica
TDSSVTSESI

SEQ ID NO: 2558643 - protein, 6 aa, Entamoeba histolytica
TDTNTI

SEQ ID NO: 2558644 - protein, 15 aa, Entamoeba histolytica
TDTTNCQHQTGKKWK

SEQ ID NO: 2558645 - protein, 5 aa, Entamoeba histolytica
TEHQV

SEQ ID NO: 2558646 - protein, 4 aa, Entamoeba histolytica
TELA

SEQ ID NO: 2558647 - protein, 4 aa, Entamoeba histolytica
TETF

SEQ ID NO: 2558648 - protein, 4 aa, Entamoeba histolytica
TETY

SEQ ID NO: 2558649 - protein, 9 aa, Entamoeba histolytica
TEVKESYEE

SEQ ID NO: 2558650 - protein, 10 aa, Entamoeba histolytica
TFSESNKPLV

SEQ ID NO: 2558651 - protein, 11 aa, Entamoeba histolytica
TFSSDKYQTVD

SEQ ID NO: 2558652 - protein, 4 aa, Entamoeba histolytica
TGCK

SEQ ID NO: 2558653 - protein, 17 aa, Entamoeba histolytica
TGCKTCKTSGDNSCTSC

SEQ ID NO: 2558654 - protein, 6 aa, Entamoeba histolytica
TGGQIE

SEQ ID NO: 2558655 - protein, 8 aa, Entamoeba histolytica
TGIDPTKD

SEQ ID NO: 2558656 - protein, 7 aa, Entamoeba histolytica
TGNNQQQ

SEQ ID NO: 2558657 - protein, 10 aa, Entamoeba histolytica
TGSTNPITFP

SEQ ID NO: 2558658 - protein, 8 aa, Entamoeba histolytica
TGTLTENR

SEQ ID NO: 2558659 - protein, 8 aa, Entamoeba histolytica
TGTTPKCK

SEQ ID NO: 2558660 - protein, 18 aa, Entamoeba histolytica
TGYGRNEGESSERNSVED

SEQ ID NO: 2558661 - protein, 4 aa, Entamoeba histolytica
TIPP

SEQ ID NO: 2558662 - protein, 6 aa, Entamoeba histolytica
TITETC

SEQ ID NO: 2558663 - protein, 4 aa, Entamoeba histolytica
TITK

SEQ ID NO: 2558664 - protein, 20 aa, Entamoeba histolytica
TITSPGKCPSSSSFSSQNTN

SEQ ID NO: 2558665 - protein, 21 aa, Entamoeba histolytica
TKCNPKNKRLVKRDSKCDKEI

SEQ ID NO: 2558666 - protein, 4 aa, Entamoeba histolytica
TKDG

SEQ ID NO: 2558667 - protein, 4 aa, Entamoeba histolytica
TKEY

SEQ ID NO: 2558668 - protein, 15 aa, Entamoeba histolytica
TKISNSQDNSNTISL

SEQ ID NO: 2558669 - protein, 8 aa, Entamoeba histolytica
TKKYAKAR

SEQ ID NO: 2558670 - protein, 11 aa, Entamoeba histolytica
TLENGKEYKYT

SEQ ID NO: 2558671 - protein, 11 aa, Entamoeba histolytica
TLSLETDNSFT

SEQ ID NO: 2558672 - protein, 12 aa, Entamoeba histolytica
TLSNSGKYTVPE

SEQ ID NO: 2558673 - protein, 10 aa, Entamoeba histolytica
TNGKNGAIRA

SEQ ID NO: 2558674 - protein, 7 aa, Entamoeba histolytica
TNGNIAT

SEQ ID NO: 2558675 - protein, 10 aa, Entamoeba histolytica
TNKCEENNGK

SEQ ID NO: 2558676 - protein, 7 aa, Entamoeba histolytica
TNKIPIT

SEQ ID NO: 2558677 - protein, 4 aa, Entamoeba histolytica
TNKY

SEQ ID NO: 2558678 - protein, 8 aa, Entamoeba histolytica
TNLEESWP

SEQ ID NO: 2558679 - protein, 6 aa, Entamoeba histolytica
TNNDGT

SEQ ID NO: 2558680 - protein, 5 aa, Entamoeba histolytica
TNPMS

SEQ ID NO: 2558681 - protein, 6 aa, Entamoeba histolytica
TNRISN

SEQ ID NO: 2558682 - protein, 7 aa, Entamoeba histolytica
TNRQQGW

SEQ ID NO: 2558683 - protein, 4 aa, Entamoeba histolytica
TNSQ

SEQ ID NO: 2558684 - protein, 4 aa, Entamoeba histolytica
TNVA

SEQ ID NO: 2558685 - protein, 21 aa, Entamoeba histolytica
TPDPDELARKNKKPDDSGSVT

SEQ ID NO: 2558686 - protein, 7 aa, Entamoeba histolytica
TPDPNNL

SEQ ID NO: 2558687 - protein, 4 aa, Entamoeba histolytica
TPIE

SEQ ID NO: 2558688 - protein, 4 aa, Entamoeba histolytica
TPIQ

SEQ ID NO: 2558689 - protein, 4 aa, Entamoeba histolytica
TPKI

SEQ ID NO: 2558690 - protein, 4 aa, Entamoeba histolytica
TPTK

SEQ ID NO: 2558691 - protein, 16 aa, Entamoeba histolytica
TQKEKNKFQKFNDEAE

SEQ ID NO: 2558692 - protein, 8 aa, Entamoeba histolytica
TQSATDKR

SEQ ID NO: 2558693 - protein, 5 aa, Entamoeba histolytica
TRDPN

SEQ ID NO: 2558694 - protein, 8 aa, Entamoeba histolytica
TRDSSGLS

SEQ ID NO: 2558695 - protein, 6 aa, Entamoeba histolytica
TRGNAE

SEQ ID NO: 2558696 - protein, 7 aa, Entamoeba histolytica
TRKDQMT

SEQ ID NO: 2558697 - protein, 24 aa, Entamoeba histolytica
TRTASSTQASYSVAGGIASETISN

SEQ ID NO: 2558698 - protein, 6 aa, Entamoeba histolytica
TSDKCQ

SEQ ID NO: 2558699 - protein, 7 aa, Entamoeba histolytica
TSETSNN

SEQ ID NO: 2558700 - protein, 7 aa, Entamoeba histolytica
TSFEEGL

SEQ ID NO: 2558701 - protein, 5 aa, Entamoeba histolytica
TSIDK

SEQ ID NO: 2558702 - protein, 6 aa, Entamoeba histolytica
TSKTID

SEQ ID NO: 2558703 - protein, 4 aa, Entamoeba histolytica
TSLT

SEQ ID NO: 2558704 - protein, 7 aa, Entamoeba histolytica
TSNIEYK

SEQ ID NO: 2558705 - protein, 14 aa, Entamoeba histolytica
TSSRRICGSTEDGI

SEQ ID NO: 2558706 - protein, 7 aa, Entamoeba histolytica
TSTGTNK

SEQ ID NO: 2558707 - protein, 16 aa, Entamoeba histolytica
TSTVTNEKRSIKTSGK

SEQ ID NO: 2558708 - protein, 7 aa, Entamoeba histolytica
TTANTGS

SEQ ID NO: 2558709 - protein, 10 aa, Entamoeba histolytica
TTDAASSTHI

SEQ ID NO: 2558710 - protein, 12 aa, Entamoeba histolytica
TTDCSGDEPNEQ

SEQ ID NO: 2558711 - protein, 27 aa, Entamoeba histolytica
TTDCSGDEPTEDSKDITKKADISSSTT

SEQ ID NO: 2558712 - protein, 13 aa, Entamoeba histolytica
TTDGNTICSEQSD

SEQ ID NO: 2558713 - protein, 8 aa, Entamoeba histolytica
TTEGEEGV

SEQ ID NO: 2558714 - protein, 11 aa, Entamoeba histolytica
TTFKSISGEGT

SEQ ID NO: 2558715 - protein, 10 aa, Entamoeba histolytica
TTGNDTNKIF

SEQ ID NO: 2558716 - protein, 8 aa, Entamoeba histolytica
TTHSSKDY

SEQ ID NO: 2558717 - protein, 4 aa, Entamoeba histolytica
TTKE

SEQ ID NO: 2558718 - protein, 5 aa, Entamoeba histolytica
TTKSF

SEQ ID NO: 2558719 - protein, 6 aa, Entamoeba histolytica
TTPSLN

SEQ ID NO: 2558720 - protein, 9 aa, Entamoeba histolytica
TTREISNNE

SEQ ID NO: 2558721 - protein, 4 aa, Entamoeba histolytica
TTSL

SEQ ID NO: 2558722 - protein, 7 aa, Entamoeba histolytica
TTYSDNK

SEQ ID NO: 2558723 - protein, 8 aa, Entamoeba histolytica
TVQPTKNC

SEQ ID NO: 2558724 - protein, 4 aa, Entamoeba histolytica
TVRN

SEQ ID NO: 2558725 - protein, 16 aa, Entamoeba histolytica
TYKSGTFELSSPNNIA

SEQ ID NO: 2558726 - protein, 11 aa, Entamoeba histolytica
TYSPNSKGECI

SEQ ID NO: 2558727 - protein, 6 aa, Entamoeba histolytica
TYTDKS

SEQ ID NO: 2558728 - protein, 7 aa, Entamoeba histolytica
TYTPTSK

SEQ ID NO: 2558729 - protein, 10 aa, Entamoeba histolytica
VDDQNKETAK

SEQ ID NO: 2558730 - protein, 7 aa, Entamoeba histolytica
VDGECKE

SEQ ID NO: 2558731 - protein, 5 aa, Entamoeba histolytica
VDNSF

SEQ ID NO: 2558732 - protein, 12 aa, Entamoeba histolytica
VDSNGSNVVDEK

SEQ ID NO: 2558733 - protein, 9 aa, Entamoeba histolytica
VELTDEQQH

SEQ ID NO: 2558734 - protein, 15 aa, Entamoeba histolytica
VGEKGAALSGGQKQR

SEQ ID NO: 2558735 - protein, 5 aa, Entamoeba histolytica
VGQET

SEQ ID NO: 2558736 - protein, 11 aa, Entamoeba histolytica
VGRTGSGKSTL

SEQ ID NO: 2558737 - protein, 19 aa, Entamoeba histolytica
VHTSLPPSSPVKEVKIVVE

SEQ ID NO: 2558738 - protein, 8 aa, Entamoeba histolytica
VKNNEENI

SEQ ID NO: 2558739 - protein, 15 aa, Entamoeba histolytica
VKPTNGQCPIGTSPY

SEQ ID NO: 2558740 - protein, 7 aa, Entamoeba histolytica
VKTESIE

SEQ ID NO: 2558741 - protein, 8 aa, Entamoeba histolytica
VNDDSGTY

SEQ ID NO: 2558742 - protein, 5 aa, Entamoeba histolytica
VNSGT

SEQ ID NO: 2558743 - protein, 7 aa, Entamoeba histolytica
VNSQNSC

SEQ ID NO: 2558744 - protein, 9 aa, Entamoeba histolytica
VPMESTSSQ

SEQ ID NO: 2558745 - protein, 10 aa, Entamoeba histolytica
VQDSKTYQNV

SEQ ID NO: 2558746 - protein, 11 aa, Entamoeba histolytica
VQNGNYCDSNK

SEQ ID NO: 2558747 - protein, 14 aa, Entamoeba histolytica
VSDDKKINNTKKIE

SEQ ID NO: 2558748 - protein, 7 aa, Entamoeba histolytica
VSNCTED

SEQ ID NO: 2558749 - protein, 12 aa, Entamoeba histolytica
VTGDGTNDVPAL

SEQ ID NO: 2558750 - protein, 4 aa, Entamoeba histolytica
VTSN

SEQ ID NO: 2558751 - protein, 7 aa, Entamoeba histolytica
VTTKPGK

SEQ ID NO: 2558752 - protein, 5 aa, Entamoeba histolytica
VTTPD

SEQ ID NO: 2558753 - protein, 32 aa, Entamoeba histolytica
VYSSSTSETPDANTDGDADDNKKEGVKKDTTI

SEQ ID NO: 2558754 - protein, 7 aa, Entamoeba histolytica
WERTSEE

SEQ ID NO: 2558755 - protein, 7 aa, Entamoeba histolytica
YASKTIP

SEQ ID NO: 2558756 - protein, 10 aa, Entamoeba histolytica
YAYKNEPNKI

SEQ ID NO: 2558757 - protein, 6 aa, Entamoeba histolytica
YDDEMN

SEQ ID NO: 2558758 - protein, 5 aa, Entamoeba histolytica
YEEYG

SEQ ID NO: 2558759 - protein, 9 aa, Entamoeba histolytica
YEKQEEEGI

SEQ ID NO: 2558760 - protein, 6 aa, Entamoeba histolytica
YENNEE

SEQ ID NO: 2558761 - protein, 8 aa, Entamoeba histolytica
YENSTGVQ

SEQ ID NO: 2558762 - protein, 7 aa, Entamoeba histolytica
YESIGKE

SEQ ID NO: 2558763 - protein, 9 aa, Entamoeba histolytica
YGNPQRTAG

SEQ ID NO: 2558764 - protein, 11 aa, Entamoeba histolytica
YKKENCQECGQ

SEQ ID NO: 2558765 - protein, 7 aa, Entamoeba histolytica
YKNNKEY

SEQ ID NO: 2558766 - protein, 24 aa, Entamoeba histolytica
YPNGSGCSTCASKNCGDDCNTSNG

SEQ ID NO: 2558767 - protein, 4 aa, Entamoeba histolytica
YQLE

SEQ ID NO: 2558768 - protein, 8 aa, Entamoeba histolytica
YRDSTGLI

SEQ ID NO: 2558769 - protein, 10 aa, Entamoeba histolytica
YSEEGETFND

SEQ ID NO: 2558770 - protein, 5 aa, Entamoeba histolytica
YSQPL

SEQ ID NO: 2558771 - protein, 6 aa, Entamoeba histolytica
YSSTNE

SEQ ID NO: 2558772 - protein, 7 aa, Entamoeba histolytica
YSTPTGM

SEQ ID NO: 2558773 - protein, 11 aa, Entamoeba histolytica
YTANKQREKEF

SEQ ID NO: 2558774 - protein, 4 aa, Entamoeba histolytica
YTKE

SEQ ID NO: 2558775 - protein, 11 aa, Entamoeba histolytica
YTTSPVGRKGT

SEQ ID NO: 2558776 - protein, 10 aa, Entamoeba histolytica
YVKENGECKR

SEQ ID NO: 2558777 - protein, 11 aa, Entamoeba histolytica
YVNENGECQDM

SEQ ID NO: 2558778 - protein, 18 aa, Entamoeba histolytica
YYASKDDSVYCSSSSNIN

SEQ ID NO: 2558779 - protein, 9 aa, Entamoeba histolytica
YYRDGKGCT

SEQ ID NO: 2558780 - protein, 6 aa, Entamoeba histolytica
AAAEKM

SEQ ID NO: 2558781 - protein, 11 aa, Entamoeba histolytica
AAAFKKSSTHM

SEQ ID NO: 2558782 - protein, 9 aa, Entamoeba histolytica
AAANQEGQF

SEQ ID NO: 2558783 - protein, 8 aa, Entamoeba histolytica
AAASSTHI

SEQ ID NO: 2558784 - protein, 8 aa, Entamoeba histolytica
AADNKDLN

SEQ ID NO: 2558785 - protein, 7 aa, Entamoeba histolytica
AAENPNL

SEQ ID NO: 2558786 - protein, 7 aa, Entamoeba histolytica
AAEPLTW

SEQ ID NO: 2558787 - protein, 5 aa, Entamoeba histolytica
AAEQF

SEQ ID NO: 2558788 - protein, 7 aa, Entamoeba histolytica
AAEQRNE

SEQ ID NO: 2558789 - protein, 8 aa, Entamoeba histolytica
AAETKTQL

SEQ ID NO: 2558790 - protein, 4 aa, Entamoeba histolytica
AAGA

SEQ ID NO: 2558791 - protein, 11 aa, Entamoeba histolytica
AAIRDDNKLGE

SEQ ID NO: 2558792 - protein, 13 aa, Entamoeba histolytica
AAKEYARKHGQQT

SEQ ID NO: 2558793 - protein, 9 aa, Entamoeba histolytica
AAKKECPQL

SEQ ID NO: 2558794 - protein, 6 aa, Entamoeba histolytica
AAKPGR

SEQ ID NO: 2558795 - protein, 18 aa, Entamoeba histolytica
AAKQPEETKALLDGDEKT

SEQ ID NO: 2558796 - protein, 9 aa, Entamoeba histolytica
AALDGETSL

SEQ ID NO: 2558797 - protein, 5 aa, Entamoeba histolytica
AAPYT

SEQ ID NO: 2558798 - protein, 5 aa, Entamoeba histolytica
AAQQL

SEQ ID NO: 2558799 - protein, 5 aa, Entamoeba histolytica
AASAV

SEQ ID NO: 2558800 - protein, 10 aa, Entamoeba histolytica
AASEATMSST

SEQ ID NO: 2558801 - protein, 7 aa, Entamoeba histolytica
AASTEFS

SEQ ID NO: 2558802 - protein, 4 aa, Entamoeba histolytica
AAYP

SEQ ID NO: 2558803 - protein, 11 aa, Entamoeba histolytica
ACDTEHSGSDE

SEQ ID NO: 2558804 - protein, 4 aa, Entamoeba histolytica
ACGP

SEQ ID NO: 2558805 - protein, 17 aa, Entamoeba histolytica
ACKSDKCGDSGCTECED

SEQ ID NO: 2558806 - protein, 6 aa, Entamoeba histolytica
ACREPN

SEQ ID NO: 2558807 - protein, 8 aa, Entamoeba histolytica
ACSKPSLS

SEQ ID NO: 2558808 - protein, 6 aa, Entamoeba histolytica
ACSTNS

SEQ ID NO: 2558809 - protein, 4 aa, Entamoeba histolytica
ACTK

SEQ ID NO: 2558810 - protein, 14 aa, Entamoeba histolytica
ACVDPNKCSEQDFN

SEQ ID NO: 2558811 - protein, 6 aa, Entamoeba histolytica
ADAAIG

SEQ ID NO: 2558812 - protein, 5 aa, Entamoeba histolytica
ADADT

SEQ ID NO: 2558813 - protein, 8 aa, Entamoeba histolytica
ADAKQNTM

SEQ ID NO: 2558814 - protein, 11 aa, Entamoeba histolytica
ADAPDSSTASI

SEQ ID NO: 2558815 - protein, 17 aa, Entamoeba histolytica
ADAQGAVKFDQKGKYNY

SEQ ID NO: 2558816 - protein, 9 aa, Entamoeba histolytica
ADAQQTKIG

SEQ ID NO: 2558817 - protein, 4 aa, Entamoeba histolytica
ADAY

SEQ ID NO: 2558818 - protein, 6 aa, Entamoeba histolytica
ADCNGY

SEQ ID NO: 2558819 - protein, 10 aa, Entamoeba histolytica
ADDESGNHSE

SEQ ID NO: 2558820 - protein, 5 aa, Entamoeba histolytica
ADDIP

SEQ ID NO: 2558821 - protein, 8 aa, Entamoeba histolytica
ADEDDPPV

SEQ ID NO: 2558822 - protein, 7 aa, Entamoeba histolytica
ADEDVQN

SEQ ID NO: 2558823 - protein, 14 aa, Entamoeba histolytica
ADELSEEADDTVAT

SEQ ID NO: 2558824 - protein, 9 aa, Entamoeba histolytica
ADENQKDRI

SEQ ID NO: 2558825 - protein, 10 aa, Entamoeba histolytica
ADESGCKECN

SEQ ID NO: 2558826 - protein, 8 aa, Entamoeba histolytica
ADESIEAT

SEQ ID NO: 2558827 - protein, 12 aa, Entamoeba histolytica
ADETDPNKAKLT

SEQ ID NO: 2558828 - protein, 6 aa, Entamoeba histolytica
ADFDKA

SEQ ID NO: 2558829 - protein, 6 aa, Entamoeba histolytica
ADGDSE

SEQ ID NO: 2558830 - protein, 7 aa, Entamoeba histolytica
ADGISNN

SEQ ID NO: 2558831 - protein, 7 aa, Entamoeba histolytica
ADGNGNC

SEQ ID NO: 2558832 - protein, 6 aa, Entamoeba histolytica
ADGTMW

SEQ ID NO: 2558833 - protein, 6 aa, Entamoeba histolytica
ADGVPV

SEQ ID NO: 2558834 - protein, 14 aa, Entamoeba histolytica
ADHKIEKRKCTTES

SEQ ID NO: 2558835 - protein, 10 aa, Entamoeba histolytica
ADIDGDDSLD

SEQ ID NO: 2558836 - protein, 14 aa, Entamoeba histolytica
ADKAKDDNVRAQGK

SEQ ID NO: 2558837 - protein, 5 aa, Entamoeba histolytica
ADKDD

SEQ ID NO: 2558838 - protein, 5 aa, Entamoeba histolytica
ADKDN

SEQ ID NO: 2558839 - protein, 5 aa, Entamoeba histolytica
ADKES

SEQ ID NO: 2558840 - protein, 9 aa, Entamoeba histolytica
ADKKLNKVE

SEQ ID NO: 2558841 - protein, 6 aa, Entamoeba histolytica
ADKTEG

SEQ ID NO: 2558842 - protein, 7 aa, Entamoeba histolytica
ADNNNVK

SEQ ID NO: 2558843 - protein, 5 aa, Entamoeba histolytica
ADPEN

SEQ ID NO: 2558844 - protein, 14 aa, Entamoeba histolytica
ADPYGGCEKCNGGD

SEQ ID NO: 2558845 - protein, 7 aa, Entamoeba histolytica
ADPYPDI

SEQ ID NO: 2558846 - protein, 7 aa, Entamoeba histolytica
ADQNMPQ

SEQ ID NO: 2558847 - protein, 10 aa, Entamoeba histolytica
ADRDSNGNPI

SEQ ID NO: 2558848 - protein, 8 aa, Entamoeba histolytica
ADRKTKSV

SEQ ID NO: 2558849 - protein, 8 aa, Entamoeba histolytica
ADRTCSST

SEQ ID NO: 2558850 - protein, 4 aa, Entamoeba histolytica
ADSI

SEQ ID NO: 2558851 - protein, 10 aa, Entamoeba histolytica
ADSKESSELS

SEQ ID NO: 2558852 - protein, 4 aa, Entamoeba histolytica
ADSL

SEQ ID NO: 2558853 - protein, 5 aa, Entamoeba histolytica
ADSSL

SEQ ID NO: 2558854 - protein, 10 aa, Entamoeba histolytica
ADSSTCSSSY

SEQ ID NO: 2558855 - protein, 4 aa, Entamoeba histolytica
ADTD

SEQ ID NO: 2558856 - protein, 6 aa, Entamoeba histolytica
ADTNNK

SEQ ID NO: 2558857 - protein, 5 aa, Entamoeba histolytica
ADTQD

SEQ ID NO: 2558858 - protein, 8 aa, Entamoeba histolytica
ADTSRIPD

SEQ ID NO: 2558859 - protein, 8 aa, Entamoeba histolytica
ADTSTSID

SEQ ID NO: 2558860 - protein, 5 aa, Entamoeba histolytica
ADTTV

SEQ ID NO: 2558861 - protein, 11 aa, Entamoeba histolytica
ADVKKRGTTIS

SEQ ID NO: 2558862 - protein, 6 aa, Entamoeba histolytica
ADYEEI

SEQ ID NO: 2558863 - protein, 10 aa, Entamoeba histolytica
ADYVEKEKAR

SEQ ID NO: 2558864 - protein, 5 aa, Entamoeba histolytica
AEAFG

SEQ ID NO: 2558865 - protein, 21 aa, Entamoeba histolytica
AEARKKAKERGQPTKQQKPIE

SEQ ID NO: 2558866 - protein, 6 aa, Entamoeba histolytica
AECKSV

SEQ ID NO: 2558867 - protein, 7 aa, Entamoeba histolytica
AEEHKKA

SEQ ID NO: 2558868 - protein, 16 aa, Entamoeba histolytica
AEEKEKFGGSTLGKGQ

SEQ ID NO: 2558869 - protein, 5 aa, Entamoeba histolytica
AEEKV

SEQ ID NO: 2558870 - protein, 7 aa, Entamoeba histolytica
AEENIET

SEQ ID NO: 2558871 - protein, 4 aa, Entamoeba histolytica
AEEP

SEQ ID NO: 2558872 - protein, 5 aa, Entamoeba histolytica
AEERV

SEQ ID NO: 2558873 - protein, 15 aa, Entamoeba histolytica
AEETRARKLKTKQHR

SEQ ID NO: 2558874 - protein, 81 aa, Entamoeba histolytica
AEETTEKDEDSNEENQTAESGSGSGSSSGSSSGTGSYKSGSGELGSGSQSGSNSESEQLEESKKEDDSSSGSAPESSEEDD

SEQ ID NO: 2558875 - protein, 8 aa, Entamoeba histolytica
AEEVSKKE

SEQ ID NO: 2558876 - protein, 4 aa, Entamoeba histolytica
AEGA

SEQ ID NO: 2558877 - protein, 11 aa, Entamoeba histolytica
AEGGSDGVSTK

SEQ ID NO: 2558878 - protein, 15 aa, Entamoeba histolytica
AEGKDMQNTAQKAIE

SEQ ID NO: 2558879 - protein, 9 aa, Entamoeba histolytica
AEGQSLDKR

SEQ ID NO: 2558880 - protein, 6 aa, Entamoeba histolytica
AEGSEY

SEQ ID NO: 2558881 - protein, 7 aa, Entamoeba histolytica
AEGTPTY

SEQ ID NO: 2558882 - protein, 6 aa, Entamoeba histolytica
AEGVTA

SEQ ID NO: 2558883 - protein, 14 aa, Entamoeba histolytica
AEHGESIEKAPATC

SEQ ID NO: 2558884 - protein, 5 aa, Entamoeba histolytica
AEIEE

SEQ ID NO: 2558885 - protein, 6 aa, Entamoeba histolytica
AEINAQ

SEQ ID NO: 2558886 - protein, 13 aa, Entamoeba histolytica
AEIPRTRKHRKKN

SEQ ID NO: 2558887 - protein, 28 aa, Entamoeba histolytica
AEIQEEEEKERAKKIREENAERIEKEKA

SEQ ID NO: 2558888 - protein, 8 aa, Entamoeba histolytica
AEKAGAPR

SEQ ID NO: 2558889 - protein, 4 aa, Entamoeba histolytica
AEKD

SEQ ID NO: 2558890 - protein, 14 aa, Entamoeba histolytica
AEKKISSRKSVIER

SEQ ID NO: 2558891 - protein, 51 aa, Entamoeba histolytica
AEKQEEDKEDKDNTNKTEEKKESDDNDSYSPQESEEENTSSESMKIEEASD

SEQ ID NO: 2558892 - protein, 9 aa, Entamoeba histolytica
AEKSKNRKE

SEQ ID NO: 2558893 - protein, 24 aa, Entamoeba histolytica
AEKSSYQVDEDRIEDLRKQRDKIA

SEQ ID NO: 2558894 - protein, 11 aa, Entamoeba histolytica
AELGSKDAVNK

SEQ ID NO: 2558895 - protein, 30 aa, Entamoeba histolytica
AELKEEEKENMKVEEEEIKEEEEKKEKENY

SEQ ID NO: 2558896 - protein, 4 aa, Entamoeba histolytica
AELP

SEQ ID NO: 2558897 - protein, 10 aa, Entamoeba histolytica
AEMEAQPDVD

SEQ ID NO: 2558898 - protein, 4 aa, Entamoeba histolytica
AENA

SEQ ID NO: 2558899 - protein, 8 aa, Entamoeba histolytica
AENEKEDI

SEQ ID NO: 2558900 - protein, 12 aa, Entamoeba histolytica
AENNEACGRCGN

SEQ ID NO: 2558901 - protein, 7 aa, Entamoeba histolytica
AENQQDA

SEQ ID NO: 2558902 - protein, 6 aa, Entamoeba histolytica
AENSDP

SEQ ID NO: 2558903 - protein, 8 aa, Entamoeba histolytica
AENTEESI

SEQ ID NO: 2558904 - protein, 25 aa, Entamoeba histolytica
AEPNVNPNSSESVTIKETSSSSDIE

SEQ ID NO: 2558905 - protein, 5 aa, Entamoeba histolytica
AEPSQ

SEQ ID NO: 2558906 - protein, 6 aa, Entamoeba histolytica
AEQAPI

SEQ ID NO: 2558907 - protein, 5 aa, Entamoeba histolytica
AEQGE

SEQ ID NO: 2558908 - protein, 11 aa, Entamoeba histolytica
AERIDDSSITT

SEQ ID NO: 2558909 - protein, 9 aa, Entamoeba histolytica
AERTNERDA

SEQ ID NO: 2558910 - protein, 10 aa, Entamoeba histolytica
AESAVSTKLD

SEQ ID NO: 2558911 - protein, 5 aa, Entamoeba histolytica
AESGS

SEQ ID NO: 2558912 - protein, 5 aa, Entamoeba histolytica
AESIT

SEQ ID NO: 2558913 - protein, 7 aa, Entamoeba histolytica
AESKLST

SEQ ID NO: 2558914 - protein, 10 aa, Entamoeba histolytica
AESPGGKYSN

SEQ ID NO: 2558915 - protein, 5 aa, Entamoeba histolytica
AESSS

SEQ ID NO: 2558916 - protein, 8 aa, Entamoeba histolytica
AESTLSTK

SEQ ID NO: 2558917 - protein, 10 aa, Entamoeba histolytica
AESVAKEGAL

SEQ ID NO: 2558918 - protein, 11 aa, Entamoeba histolytica
AETAPKEITTK

SEQ ID NO: 2558919 - protein, 5 aa, Entamoeba histolytica
AETED

SEQ ID NO: 2558920 - protein, 7 aa, Entamoeba histolytica
AETPSSI

SEQ ID NO: 2558921 - protein, 6 aa, Entamoeba histolytica
AETSVT

SEQ ID NO: 2558922 - protein, 8 aa, Entamoeba histolytica
AEVPDYQG

SEQ ID NO: 2558923 - protein, 5 aa, Entamoeba histolytica
AEVRT

SEQ ID NO: 2558924 - protein, 11 aa, Entamoeba histolytica
AEVRTSNLNEQ

SEQ ID NO: 2558925 - protein, 4 aa, Entamoeba histolytica
AEYK

SEQ ID NO: 2558926 - protein, 17 aa, Entamoeba histolytica
AEYVGADNEATNAATFN

SEQ ID NO: 2558927 - protein, 5 aa, Entamoeba histolytica
AFDAP

SEQ ID NO: 2558928 - protein, 21 aa, Entamoeba histolytica
AFEEEEEKKEEEKEKPKDIKQ

SEQ ID NO: 2558929 - protein, 9 aa, Entamoeba histolytica
AFEQNDPRF

SEQ ID NO: 2558930 - protein, 13 aa, Entamoeba histolytica
AFETNSDEISLTM

SEQ ID NO: 2558931 - protein, 8 aa, Entamoeba histolytica
AFNPRSPY

SEQ ID NO: 2558932 - protein, 4 aa, Entamoeba histolytica
AFNT

SEQ ID NO: 2558933 - protein, 4 aa, Entamoeba histolytica
AFPT

SEQ ID NO: 2558934 - protein, 11 aa, Entamoeba histolytica
AGAVGGLETCS

SEQ ID NO: 2558935 - protein, 10 aa, Entamoeba histolytica
AGDAFSASTI

SEQ ID NO: 2558936 - protein, 10 aa, Entamoeba histolytica
AGDDAQFNQN

SEQ ID NO: 2558937 - protein, 6 aa, Entamoeba histolytica
AGDGYS

SEQ ID NO: 2558938 - protein, 4 aa, Entamoeba histolytica
AGED

SEQ ID NO: 2558939 - protein, 5 aa, Entamoeba histolytica
AGEET

SEQ ID NO: 2558940 - protein, 19 aa, Entamoeba histolytica
AGEKLKKENEDIKEKNKQL

SEQ ID NO: 2558941 - protein, 10 aa, Entamoeba histolytica
AGEMGNNDGT

SEQ ID NO: 2558942 - protein, 12 aa, Entamoeba histolytica
AGGKDSKIKIKQ

SEQ ID NO: 2558943 - protein, 5 aa, Entamoeba histolytica
AGGKS

SEQ ID NO: 2558944 - protein, 4 aa, Entamoeba histolytica
AGGP

SEQ ID NO: 2558945 - protein, 8 aa, Entamoeba histolytica
AGGSWGPL

SEQ ID NO: 2558946 - protein, 6 aa, Entamoeba histolytica
AGGYAD

SEQ ID NO: 2558947 - protein, 8 aa, Entamoeba histolytica
AGISSEPR

SEQ ID NO: 2558948 - protein, 5 aa, Entamoeba histolytica
AGKEG

SEQ ID NO: 2558949 - protein, 7 aa, Entamoeba histolytica
AGKETQI

SEQ ID NO: 2558950 - protein, 7 aa, Entamoeba histolytica
AGKRPEL

SEQ ID NO: 2558951 - protein, 8 aa, Entamoeba histolytica
AGKSKIKI

SEQ ID NO: 2558952 - protein, 6 aa, Entamoeba histolytica
AGKTLN

SEQ ID NO: 2558953 - protein, 9 aa, Entamoeba histolytica
AGKYKKGNS

SEQ ID NO: 2558954 - protein, 10 aa, Entamoeba histolytica
AGLKENQTPY

SEQ ID NO: 2558955 - protein, 17 aa, Entamoeba histolytica
AGNAAAVGAIGGGAVGG

SEQ ID NO: 2558956 - protein, 7 aa, Entamoeba histolytica
AGNCNKG

SEQ ID NO: 2558957 - protein, 8 aa, Entamoeba histolytica
AGNDPQHD

SEQ ID NO: 2558958 - protein, 5 aa, Entamoeba histolytica
AGNEN

SEQ ID NO: 2558959 - protein, 9 aa, Entamoeba histolytica
AGNFSSDAG

SEQ ID NO: 2558960 - protein, 4 aa, Entamoeba histolytica
AGNI

SEQ ID NO: 2558961 - protein, 4 aa, Entamoeba histolytica
AGPG

SEQ ID NO: 2558962 - protein, 5 aa, Entamoeba histolytica
AGPSM

SEQ ID NO: 2558963 - protein, 5 aa, Entamoeba histolytica
AGPTG

SEQ ID NO: 2558964 - protein, 5 aa, Entamoeba histolytica
AGPTK

SEQ ID NO: 2558965 - protein, 13 aa, Entamoeba histolytica
AGQAGSPKTITGF

SEQ ID NO: 2558966 - protein, 8 aa, Entamoeba histolytica
AGQSPTAV

SEQ ID NO: 2558967 - protein, 9 aa, Entamoeba histolytica
AGRASKALE

SEQ ID NO: 2558968 - protein, 10 aa, Entamoeba histolytica
AGRDPTDSQS

SEQ ID NO: 2558969 - protein, 15 aa, Entamoeba histolytica
AGRENSVASTKSFSS

SEQ ID NO: 2558970 - protein, 7 aa, Entamoeba histolytica
AGRKETQ

SEQ ID NO: 2558971 - protein, 8 aa, Entamoeba histolytica
AGRNGLTE

SEQ ID NO: 2558972 - protein, 8 aa, Entamoeba histolytica
AGSFEQEQ

SEQ ID NO: 2558973 - protein, 6 aa, Entamoeba histolytica
AGSNKS

SEQ ID NO: 2558974 - protein, 6 aa, Entamoeba histolytica
AGTATP

SEQ ID NO: 2558975 - protein, 10 aa, Entamoeba histolytica
AGTKMTTPRA

SEQ ID NO: 2558976 - protein, 5 aa, Entamoeba histolytica
AGTMG

SEQ ID NO: 2558977 - protein, 8 aa, Entamoeba histolytica
AGTQATRA

SEQ ID NO: 2558978 - protein, 9 aa, Entamoeba histolytica
AGTRKTEMK

SEQ ID NO: 2558979 - protein, 4 aa, Entamoeba histolytica
AGTS

SEQ ID NO: 2558980 - protein, 6 aa, Entamoeba histolytica
AGTSLH

SEQ ID NO: 2558981 - protein, 8 aa, Entamoeba histolytica
AGTVGSSS

SEQ ID NO: 2558982 - protein, 11 aa, Entamoeba histolytica
AGTYSNLPQQQ

SEQ ID NO: 2558983 - protein, 5 aa, Entamoeba histolytica
AGVGQ

SEQ ID NO: 2558984 - protein, 7 aa, Entamoeba histolytica
AGVNDGN

SEQ ID NO: 2558985 - protein, 5 aa, Entamoeba histolytica
AGYEE

SEQ ID NO: 2558986 - protein, 12 aa, Entamoeba histolytica
AGYSLEKDTEAT

SEQ ID NO: 2558987 - protein, 18 aa, Entamoeba histolytica
AHDNQNENNERADKLYEE

SEQ ID NO: 2558988 - protein, 6 aa, Entamoeba histolytica
AHLGSS

SEQ ID NO: 2558989 - protein, 8 aa, Entamoeba histolytica
AHNPNGEQ

SEQ ID NO: 2558990 - protein, 6 aa, Entamoeba histolytica
AHRNDG

SEQ ID NO: 2558991 - protein, 13 aa, Entamoeba histolytica
AIDEDSKVDVASN

SEQ ID NO: 2558992 - protein, 8 aa, Entamoeba histolytica
AIDEEESR

SEQ ID NO: 2558993 - protein, 26 aa, Entamoeba histolytica
AIDTKGSITKLKSSSSLKEENTKRFS

SEQ ID NO: 2558994 - protein, 7 aa, Entamoeba histolytica
AIGGATV

SEQ ID NO: 2558995 - protein, 5 aa, Entamoeba histolytica
AIGPQ

SEQ ID NO: 2558996 - protein, 7 aa, Entamoeba histolytica
AIGQNSK

SEQ ID NO: 2558997 - protein, 8 aa, Entamoeba histolytica
AINEPNAV

SEQ ID NO: 2558998 - protein, 12 aa, Entamoeba histolytica
AINSKKSSISKA

SEQ ID NO: 2558999 - protein, 5 aa, Entamoeba histolytica
AIPEA

SEQ ID NO: 2559000 - protein, 8 aa, Entamoeba histolytica
AIPGGSNL

SEQ ID NO: 2559001 - protein, 15 aa, Entamoeba histolytica
AIPKPRSYGVFSSLF

SEQ ID NO: 2559002 - protein, 7 aa, Entamoeba histolytica
AIPSGTE

SEQ ID NO: 2559003 - protein, 9 aa, Entamoeba histolytica
AIPSSVPKE

SEQ ID NO: 2559004 - protein, 6 aa, Entamoeba histolytica
AIPTAA

SEQ ID NO: 2559005 - protein, 83 aa, Entamoeba histolytica
AIPTTTPNKVSNTTDSGNATSTKVGVTSNSNKKSLSEQVKQALDKAKGANINAKKSKAPKQPPLGNTKKPVNKKNPKVTQTTK

SEQ ID NO: 2559006 - protein, 5 aa, Entamoeba histolytica
AIQPL

SEQ ID NO: 2559007 - protein, 8 aa, Entamoeba histolytica
AIQSATKK

SEQ ID NO: 2559008 - protein, 6 aa, Entamoeba histolytica
AISDPN

SEQ ID NO: 2559009 - protein, 10 aa, Entamoeba histolytica
AIVDQEYEES

SEQ ID NO: 2559010 - protein, 10 aa, Entamoeba histolytica
AIVDQEYEET

SEQ ID NO: 2559011 - protein, 9 aa, Entamoeba histolytica
AKAQKLKKK

SEQ ID NO: 2559012 - protein, 7 aa, Entamoeba histolytica
AKAQYKE

SEQ ID NO: 2559013 - protein, 7 aa, Entamoeba histolytica
AKATPPV

SEQ ID NO: 2559014 - protein, 12 aa, Entamoeba histolytica
AKCQNGRNERIT

SEQ ID NO: 2559015 - protein, 8 aa, Entamoeba histolytica
AKDGFGKA

SEQ ID NO: 2559016 - protein, 8 aa, Entamoeba histolytica
AKDGKNTF

SEQ ID NO: 2559017 - protein, 9 aa, Entamoeba histolytica
AKDKALTIS

SEQ ID NO: 2559018 - protein, 4 aa, Entamoeba histolytica
AKDL

SEQ ID NO: 2559019 - protein, 8 aa, Entamoeba histolytica
AKDNISET

SEQ ID NO: 2559020 - protein, 8 aa, Entamoeba histolytica
AKDQDIEK

SEQ ID NO: 2559021 - protein, 9 aa, Entamoeba histolytica
AKDQDIEKE

SEQ ID NO: 2559022 - protein, 8 aa, Entamoeba histolytica
AKDTQRDV

SEQ ID NO: 2559023 - protein, 10 aa, Entamoeba histolytica
AKEDPFDRTP

SEQ ID NO: 2559024 - protein, 7 aa, Entamoeba histolytica
AKEEAEK

SEQ ID NO: 2559025 - protein, 5 aa, Entamoeba histolytica
AKEEH

SEQ ID NO: 2559026 - protein, 6 aa, Entamoeba histolytica
AKEFAV

SEQ ID NO: 2559027 - protein, 7 aa, Entamoeba histolytica
AKEFSEG

SEQ ID NO: 2559028 - protein, 5 aa, Entamoeba histolytica
AKEIS

SEQ ID NO: 2559029 - protein, 12 aa, Entamoeba histolytica
AKENEEDKELNT

SEQ ID NO: 2559030 - protein, 9 aa, Entamoeba histolytica
AKENRPSID

SEQ ID NO: 2559031 - protein, 6 aa, Entamoeba histolytica
AKEQMK

SEQ ID NO: 2559032 - protein, 6 aa, Entamoeba histolytica
AKERKK

SEQ ID NO: 2559033 - protein, 6 aa, Entamoeba histolytica
AKERTI

SEQ ID NO: 2559034 - protein, 7 aa, Entamoeba histolytica
AKESDSQ

SEQ ID NO: 2559035 - protein, 4 aa, Entamoeba histolytica
AKEV

SEQ ID NO: 2559036 - protein, 34 aa, Entamoeba histolytica
AKGEASIAETLKAEDEKKKKQENESSDSTEKPTE

SEQ ID NO: 2559037 - protein, 9 aa, Entamoeba histolytica
AKGKGAEVV

SEQ ID NO: 2559038 - protein, 15 aa, Entamoeba histolytica
AKGKSSNGSDSNFPT

SEQ ID NO: 2559039 - protein, 9 aa, Entamoeba histolytica
AKGKTKKHR

SEQ ID NO: 2559040 - protein, 5 aa, Entamoeba histolytica
AKGSY

SEQ ID NO: 2559041 - protein, 11 aa, Entamoeba histolytica
AKGYSSDGNGN

SEQ ID NO: 2559042 - protein, 16 aa, Entamoeba histolytica
AKIKTKKYEMTNDGEC

SEQ ID NO: 2559043 - protein, 6 aa, Entamoeba histolytica
AKISEY

SEQ ID NO: 2559044 - protein, 7 aa, Entamoeba histolytica
AKKERKG

SEQ ID NO: 2559045 - protein, 9 aa, Entamoeba histolytica
AKKFTETTN

SEQ ID NO: 2559046 - protein, 13 aa, Entamoeba histolytica
AKKKTEDGEYINP

SEQ ID NO: 2559047 - protein, 22 aa, Entamoeba histolytica
AKKTIEKEKRDEAQGLVPSKEI

SEQ ID NO: 2559048 - protein, 15 aa, Entamoeba histolytica
AKLQHGKIASGNGKQ

SEQ ID NO: 2559049 - protein, 8 aa, Entamoeba histolytica
AKLTASSQ

SEQ ID NO: 2559050 - protein, 7 aa, Entamoeba histolytica
AKMSDRL

SEQ ID NO: 2559051 - protein, 13 aa, Entamoeba histolytica
AKNEKEMAFELIT

SEQ ID NO: 2559052 - protein, 10 aa, Entamoeba histolytica
AKNGQLNEKD

SEQ ID NO: 2559053 - protein, 7 aa, Entamoeba histolytica
AKNNENV

SEQ ID NO: 2559054 - protein, 7 aa, Entamoeba histolytica
AKNNKCE

SEQ ID NO: 2559055 - protein, 10 aa, Entamoeba histolytica
AKNNTDKINE

SEQ ID NO: 2559056 - protein, 8 aa, Entamoeba histolytica
AKNTDPGL

SEQ ID NO: 2559057 - protein, 7 aa, Entamoeba histolytica
AKPDVLE

SEQ ID NO: 2559058 - protein, 31 aa, Entamoeba histolytica
AKPFTRKNKTKTTESSIESQSIGDISDESSI

SEQ ID NO: 2559059 - protein, 15 aa, Entamoeba histolytica
AKPGNLKIKTGEEAN

SEQ ID NO: 2559060 - protein, 7 aa, Entamoeba histolytica
AKPNEIN

SEQ ID NO: 2559061 - protein, 13 aa, Entamoeba histolytica
AKPPEELATTNDQ

SEQ ID NO: 2559062 - protein, 6 aa, Entamoeba histolytica
AKPPLT

SEQ ID NO: 2559063 - protein, 8 aa, Entamoeba histolytica
AKPQSSSN

SEQ ID NO: 2559064 - protein, 6 aa, Entamoeba histolytica
AKPTVG

SEQ ID NO: 2559065 - protein, 4 aa, Entamoeba histolytica
AKQF

SEQ ID NO: 2559066 - protein, 8 aa, Entamoeba histolytica
AKRDEYKY

SEQ ID NO: 2559067 - protein, 4 aa, Entamoeba histolytica
AKRG

SEQ ID NO: 2559068 - protein, 5 aa, Entamoeba histolytica
AKSLT

SEQ ID NO: 2559069 - protein, 20 aa, Entamoeba histolytica
AKSPLSDENRDYFKTKTEHK

SEQ ID NO: 2559070 - protein, 6 aa, Entamoeba histolytica
AKSRGY

SEQ ID NO: 2559071 - protein, 23 aa, Entamoeba histolytica
AKSTESDYALTQGRLTSQPLPKN

SEQ ID NO: 2559072 - protein, 9 aa, Entamoeba histolytica
AKSTGLNDE

SEQ ID NO: 2559073 - protein, 19 aa, Entamoeba histolytica
AKTATNETGEEEQKQEEEI

SEQ ID NO: 2559074 - protein, 7 aa, Entamoeba histolytica
AKTATSL

SEQ ID NO: 2559075 - protein, 4 aa, Entamoeba histolytica
AKTC

SEQ ID NO: 2559076 - protein, 5 aa, Entamoeba histolytica
AKTDA

SEQ ID NO: 2559077 - protein, 7 aa, Entamoeba histolytica
AKTEQLN

SEQ ID NO: 2559078 - protein, 12 aa, Entamoeba histolytica
AKTESSLKRSSY

SEQ ID NO: 2559079 - protein, 7 aa, Entamoeba histolytica
AKTGYGV

SEQ ID NO: 2559080 - protein, 5 aa, Entamoeba histolytica
AKTIT

SEQ ID NO: 2559081 - protein, 10 aa, Entamoeba histolytica
AKTKEGSTTV

SEQ ID NO: 2559082 - protein, 7 aa, Entamoeba histolytica
AKTKPTV

SEQ ID NO: 2559083 - protein, 28 aa, Entamoeba histolytica
AKTLTTSGNLTVTGNSITITESTTFGTG

SEQ ID NO: 2559084 - protein, 7 aa, Entamoeba histolytica
AKTNPLF

SEQ ID NO: 2559085 - protein, 6 aa, Entamoeba histolytica
AKTNRD

SEQ ID NO: 2559086 - protein, 5 aa, Entamoeba histolytica
AKTPQ

SEQ ID NO: 2559087 - protein, 5 aa, Entamoeba histolytica
AKTSI

SEQ ID NO: 2559088 - protein, 4 aa, Entamoeba histolytica
AKTV

SEQ ID NO: 2559089 - protein, 7 aa, Entamoeba histolytica
ALAPLNK

SEQ ID NO: 2559090 - protein, 9 aa, Entamoeba histolytica
ALENNGTAQ

SEQ ID NO: 2559091 - protein, 10 aa, Entamoeba histolytica
ALEPTEERFR

SEQ ID NO: 2559092 - protein, 5 aa, Entamoeba histolytica
ALESP

SEQ ID NO: 2559093 - protein, 6 aa, Entamoeba histolytica
ALESPY

SEQ ID NO: 2559094 - protein, 4 aa, Entamoeba histolytica
ALGD

SEQ ID NO: 2559095 - protein, 8 aa, Entamoeba histolytica
ALGGQEQW

SEQ ID NO: 2559096 - protein, 13 aa, Entamoeba histolytica
ALGKQVKGEETII

SEQ ID NO: 2559097 - protein, 7 aa, Entamoeba histolytica
ALGPVTS

SEQ ID NO: 2559098 - protein, 10 aa, Entamoeba histolytica
ALKDQDPYVR

SEQ ID NO: 2559099 - protein, 5 aa, Entamoeba histolytica
ALKRQ

SEQ ID NO: 2559100 - protein, 5 aa, Entamoeba histolytica
ALNND

SEQ ID NO: 2559101 - protein, 8 aa, Entamoeba histolytica
ALNQPSLR

SEQ ID NO: 2559102 - protein, 5 aa, Entamoeba histolytica
ALPPL

SEQ ID NO: 2559103 - protein, 4 aa, Entamoeba histolytica
ALPS

SEQ ID NO: 2559104 - protein, 13 aa, Entamoeba histolytica
ALRDSARNKDHNG

SEQ ID NO: 2559105 - protein, 8 aa, Entamoeba histolytica
ALRGPEGT

SEQ ID NO: 2559106 - protein, 10 aa, Entamoeba histolytica
ALSEHGKSEI

SEQ ID NO: 2559107 - protein, 27 aa, Entamoeba histolytica
ALSGGKKALKTVSSIDPDLSNALEEAG

SEQ ID NO: 2559108 - protein, 10 aa, Entamoeba histolytica
ALSNKGTADC

SEQ ID NO: 2559109 - protein, 4 aa, Entamoeba histolytica
ALSP

SEQ ID NO: 2559110 - protein, 6 aa, Entamoeba histolytica
ALSPSG

SEQ ID NO: 2559111 - protein, 7 aa, Entamoeba histolytica
ALSQPDN

SEQ ID NO: 2559112 - protein, 5 aa, Entamoeba histolytica
ALSVS

SEQ ID NO: 2559113 - protein, 5 aa, Entamoeba histolytica
ALYSG

SEQ ID NO: 2559114 - protein, 9 aa, Entamoeba histolytica
AMAGKENRE

SEQ ID NO: 2559115 - protein, 9 aa, Entamoeba histolytica
AMDETSQRR

SEQ ID NO: 2559116 - protein, 21 aa, Entamoeba histolytica
AMPSSSDYSVPGSPVANFSRR

SEQ ID NO: 2559117 - protein, 7 aa, Entamoeba histolytica
AMTTGGV

SEQ ID NO: 2559118 - protein, 10 aa, Entamoeba histolytica
ANAEELEQQT

SEQ ID NO: 2559119 - protein, 7 aa, Entamoeba histolytica
ANAGKKY

SEQ ID NO: 2559120 - protein, 5 aa, Entamoeba histolytica
ANANT

SEQ ID NO: 2559121 - protein, 7 aa, Entamoeba histolytica
ANAQQQK

SEQ ID NO: 2559122 - protein, 9 aa, Entamoeba histolytica
ANASKSSVG

SEQ ID NO: 2559123 - protein, 4 aa, Entamoeba histolytica
ANAT

SEQ ID NO: 2559124 - protein, 6 aa, Entamoeba histolytica
ANDCDP

SEQ ID NO: 2559125 - protein, 9 aa, Entamoeba histolytica
ANDNNDEYK

SEQ ID NO: 2559126 - protein, 5 aa, Entamoeba histolytica
ANDTY

SEQ ID NO: 2559127 - protein, 6 aa, Entamoeba histolytica
ANECPS

SEQ ID NO: 2559128 - protein, 8 aa, Entamoeba histolytica
ANEGPHGL

SEQ ID NO: 2559129 - protein, 4 aa, Entamoeba histolytica
ANEI

SEQ ID NO: 2559130 - protein, 10 aa, Entamoeba histolytica
ANEINEEKNL

SEQ ID NO: 2559131 - protein, 6 aa, Entamoeba histolytica
ANEKSP

SEQ ID NO: 2559132 - protein, 5 aa, Entamoeba histolytica
ANENM

SEQ ID NO: 2559133 - protein, 6 aa, Entamoeba histolytica
ANEQIE

SEQ ID NO: 2559134 - protein, 11 aa, Entamoeba histolytica
ANESTEREERQ

SEQ ID NO: 2559135 - protein, 6 aa, Entamoeba histolytica
ANGELS

SEQ ID NO: 2559136 - protein, 7 aa, Entamoeba histolytica
ANGENVQ

SEQ ID NO: 2559137 - protein, 5 aa, Entamoeba histolytica
ANGIE

SEQ ID NO: 2559138 - protein, 4 aa, Entamoeba histolytica
ANGK

SEQ ID NO: 2559139 - protein, 6 aa, Entamoeba histolytica
ANGKES

SEQ ID NO: 2559140 - protein, 11 aa, Entamoeba histolytica
ANGKRTNQIER

SEQ ID NO: 2559141 - protein, 14 aa, Entamoeba histolytica
ANGNELTDQISDAP

SEQ ID NO: 2559142 - protein, 9 aa, Entamoeba histolytica
ANGQTQTAY

SEQ ID NO: 2559143 - protein, 7 aa, Entamoeba histolytica
ANHATQV

SEQ ID NO: 2559144 - protein, 6 aa, Entamoeba histolytica
ANHCTE

SEQ ID NO: 2559145 - protein, 5 aa, Entamoeba histolytica
ANHEV

SEQ ID NO: 2559146 - protein, 13 aa, Entamoeba histolytica
ANITGNCQGDEPL

SEQ ID NO: 2559147 - protein, 4 aa, Entamoeba histolytica
ANKG

SEQ ID NO: 2559148 - protein, 10 aa, Entamoeba histolytica
ANKKNIDPYG

SEQ ID NO: 2559149 - protein, 10 aa, Entamoeba histolytica
ANKKQNGYKY

SEQ ID NO: 2559150 - protein, 5 aa, Entamoeba histolytica
ANKQV

SEQ ID NO: 2559151 - protein, 7 aa, Entamoeba histolytica
ANKTKKK

SEQ ID NO: 2559152 - protein, 8 aa, Entamoeba histolytica
ANNCTGQN

SEQ ID NO: 2559153 - protein, 6 aa, Entamoeba histolytica
ANNKYE

SEQ ID NO: 2559154 - protein, 5 aa, Entamoeba histolytica
ANNLE

SEQ ID NO: 2559155 - protein, 5 aa, Entamoeba histolytica
ANPLS

SEQ ID NO: 2559156 - protein, 4 aa, Entamoeba histolytica
ANPN

SEQ ID NO: 2559157 - protein, 5 aa, Entamoeba histolytica
ANPNH

SEQ ID NO: 2559158 - protein, 6 aa, Entamoeba histolytica
ANPSNY

SEQ ID NO: 2559159 - protein, 4 aa, Entamoeba histolytica
ANPY

SEQ ID NO: 2559160 - protein, 8 aa, Entamoeba histolytica
ANQAIDES

SEQ ID NO: 2559161 - protein, 9 aa, Entamoeba histolytica
ANQSPLEVT

SEQ ID NO: 2559162 - protein, 7 aa, Entamoeba histolytica
ANQYQRD

SEQ ID NO: 2559163 - protein, 17 aa, Entamoeba histolytica
ANRAHTCASSNDDDGEI

SEQ ID NO: 2559164 - protein, 4 aa, Entamoeba histolytica
ANRQ

SEQ ID NO: 2559165 - protein, 6 aa, Entamoeba histolytica
ANSDGA

SEQ ID NO: 2559166 - protein, 7 aa, Entamoeba histolytica
ANSDGTV

SEQ ID NO: 2559167 - protein, 4 aa, Entamoeba histolytica
ANSE

SEQ ID NO: 2559168 - protein, 7 aa, Entamoeba histolytica
ANSGRSE

SEQ ID NO: 2559169 - protein, 4 aa, Entamoeba histolytica
ANSI

SEQ ID NO: 2559170 - protein, 12 aa, Entamoeba histolytica
ANSIPDLKTRNK

SEQ ID NO: 2559171 - protein, 9 aa, Entamoeba histolytica
ANSIPSDLS

SEQ ID NO: 2559172 - protein, 17 aa, Entamoeba histolytica
ANSKHPGICGEDSEDVS

SEQ ID NO: 2559173 - protein, 10 aa, Entamoeba histolytica
ANSKKLIEGT

SEQ ID NO: 2559174 - protein, 9 aa, Entamoeba histolytica
ANSQEKDYA

SEQ ID NO: 2559175 - protein, 8 aa, Entamoeba histolytica
ANSRGIDP

SEQ ID NO: 2559176 - protein, 6 aa, Entamoeba histolytica
ANSSET

SEQ ID NO: 2559177 - protein, 9 aa, Entamoeba histolytica
ANSYSINDK

SEQ ID NO: 2559178 - protein, 5 aa, Entamoeba histolytica
ANTDP

SEQ ID NO: 2559179 - protein, 11 aa, Entamoeba histolytica
ANTFKKQSHEM

SEQ ID NO: 2559180 - protein, 11 aa, Entamoeba histolytica
ANTFKKQSHQM

SEQ ID NO: 2559181 - protein, 4 aa, Entamoeba histolytica
ANTN

SEQ ID NO: 2559182 - protein, 7 aa, Entamoeba histolytica
ANTPWPS

SEQ ID NO: 2559183 - protein, 9 aa, Entamoeba histolytica
ANTTESVHS

SEQ ID NO: 2559184 - protein, 5 aa, Entamoeba histolytica
ANTTK

SEQ ID NO: 2559185 - protein, 5 aa, Entamoeba histolytica
ANVGQ

SEQ ID NO: 2559186 - protein, 4 aa, Entamoeba histolytica
ANVT

SEQ ID NO: 2559187 - protein, 4 aa, Entamoeba histolytica
ANYN

SEQ ID NO: 2559188 - protein, 5 aa, Entamoeba histolytica
ANYTD

SEQ ID NO: 2559189 - protein, 11 aa, Entamoeba histolytica
APAEKKNKTHI

SEQ ID NO: 2559190 - protein, 5 aa, Entamoeba histolytica
APATS

SEQ ID NO: 2559191 - protein, 6 aa, Entamoeba histolytica
APDDDW

SEQ ID NO: 2559192 - protein, 6 aa, Entamoeba histolytica
APDEEI

SEQ ID NO: 2559193 - protein, 5 aa, Entamoeba histolytica
APDIP

SEQ ID NO: 2559194 - protein, 5 aa, Entamoeba histolytica
APDLK

SEQ ID NO: 2559195 - protein, 6 aa, Entamoeba histolytica
APEANF

SEQ ID NO: 2559196 - protein, 10 aa, Entamoeba histolytica
APEANHDEYT

SEQ ID NO: 2559197 - protein, 5 aa, Entamoeba histolytica
APECP

SEQ ID NO: 2559198 - protein, 9 aa, Entamoeba histolytica
APEGKEGKR

SEQ ID NO: 2559199 - protein, 7 aa, Entamoeba histolytica
APESLRS

SEQ ID NO: 2559200 - protein, 6 aa, Entamoeba histolytica
APFGGK

SEQ ID NO: 2559201 - protein, 11 aa, Entamoeba histolytica
APGARGDQCDS

SEQ ID NO: 2559202 - protein, 5 aa, Entamoeba histolytica
APGAY

SEQ ID NO: 2559203 - protein, 6 aa, Entamoeba histolytica
APGQYL

SEQ ID NO: 2559204 - protein, 8 aa, Entamoeba histolytica
APGSSEQL

SEQ ID NO: 2559205 - protein, 10 aa, Entamoeba histolytica
APGSSQQLTQ

SEQ ID NO: 2559206 - protein, 7 aa, Entamoeba histolytica
APGSTNH

SEQ ID NO: 2559207 - protein, 6 aa, Entamoeba histolytica
APGYYK

SEQ ID NO: 2559208 - protein, 12 aa, Entamoeba histolytica
APIVEEKKKEIS

SEQ ID NO: 2559209 - protein, 4 aa, Entamoeba histolytica
APKH

SEQ ID NO: 2559210 - protein, 16 aa, Entamoeba histolytica
APKINERATYAPLEEG

SEQ ID NO: 2559211 - protein, 7 aa, Entamoeba histolytica
APKLPEE

SEQ ID NO: 2559212 - protein, 10 aa, Entamoeba histolytica
APKPWSTNEI

SEQ ID NO: 2559213 - protein, 12 aa, Entamoeba histolytica
APKVEDDIPKEE

SEQ ID NO: 2559214 - protein, 4 aa, Entamoeba histolytica
APLG

SEQ ID NO: 2559215 - protein, 5 aa, Entamoeba histolytica
APLLG

SEQ ID NO: 2559216 - protein, 5 aa, Entamoeba histolytica
APLRQ

SEQ ID NO: 2559217 - protein, 40 aa, Entamoeba histolytica
APNDTSSSSSEDSSYTPNESSSSSNTNETSSSELQEPTTD

SEQ ID NO: 2559218 - protein, 12 aa, Entamoeba histolytica
APNFIQPKPTNV

SEQ ID NO: 2559219 - protein, 12 aa, Entamoeba histolytica
APNFTQPKPTNI

SEQ ID NO: 2559220 - protein, 6 aa, Entamoeba histolytica
APNTDI

SEQ ID NO: 2559221 - protein, 7 aa, Entamoeba histolytica
APPAEEG

SEQ ID NO: 2559222 - protein, 5 aa, Entamoeba histolytica
APPAI

SEQ ID NO: 2559223 - protein, 4 aa, Entamoeba histolytica
APPI

SEQ ID NO: 2559224 - protein, 5 aa, Entamoeba histolytica
APPLG

SEQ ID NO: 2559225 - protein, 6 aa, Entamoeba histolytica
APPPSL

SEQ ID NO: 2559226 - protein, 7 aa, Entamoeba histolytica
APPSIQS

SEQ ID NO: 2559227 - protein, 9 aa, Entamoeba histolytica
APPYDNNST

SEQ ID NO: 2559228 - protein, 6 aa, Entamoeba histolytica
APQIPS

SEQ ID NO: 2559229 - protein, 5 aa, Entamoeba histolytica
APQNA

SEQ ID NO: 2559230 - protein, 6 aa, Entamoeba histolytica
APQPTF

SEQ ID NO: 2559231 - protein, 10 aa, Entamoeba histolytica
APQPVNTTPY

SEQ ID NO: 2559232 - protein, 7 aa, Entamoeba histolytica
APRNAGE

SEQ ID NO: 2559233 - protein, 8 aa, Entamoeba histolytica
APRVDNQD

SEQ ID NO: 2559234 - protein, 5 aa, Entamoeba histolytica
APRYD

SEQ ID NO: 2559235 - protein, 8 aa, Entamoeba histolytica
APSDLNTK

SEQ ID NO: 2559236 - protein, 324 aa, Entamoeba histolytica
APSESVPQALKDNSATVSHGGSTLSGQGNEETTHGDATQALPQGVSVPPAQGDKSPSPPASAENPQASKGSEPPAKPSEEKSPQPGVSSSGEPSPAPSKQVSGGSPSPASQSGAVTPEAPASQHGPTPVEGGSVTTGGDTNQVLPKPEKPQPTETNAQTPPTTSQQEQPPSVPASTQPASGNEQTTQSTKGQNPQNSPSTQSGETSDGQKQGQPPSTSSQPSSSGDSTQQSPQSPTTQTTSSSTTNTPQTSQPQTNTNPSTVTPSKDKPNTAPNDDSQKEKPQPQQTKPEEKPQPPSQPQQNQPQQQNEKQDNKNTTTSDNSHD

SEQ ID NO: 2559237 - protein, 4 aa, Entamoeba histolytica
APSI

SEQ ID NO: 2559238 - protein, 9 aa, Entamoeba histolytica
APSNPTWQQ

SEQ ID NO: 2559239 - protein, 7 aa, Entamoeba histolytica
APSPPLE

SEQ ID NO: 2559240 - protein, 10 aa, Entamoeba histolytica
APSPSPAINS

SEQ ID NO: 2559241 - protein, 8 aa, Entamoeba histolytica
APSSSLNR

SEQ ID NO: 2559242 - protein, 16 aa, Entamoeba histolytica
APTEDGVPNMPQMDPT

SEQ ID NO: 2559243 - protein, 6 aa, Entamoeba histolytica
APTPSL

SEQ ID NO: 2559244 - protein, 8 aa, Entamoeba histolytica
APTPTFEE

SEQ ID NO: 2559245 - protein, 7 aa, Entamoeba histolytica
APTSKNL

SEQ ID NO: 2559246 - protein, 10 aa, Entamoeba histolytica
APTSSDALDR

SEQ ID NO: 2559247 - protein, 4 aa, Entamoeba histolytica
APVH

SEQ ID NO: 2559248 - protein, 9 aa, Entamoeba histolytica
APVQGEKIT

SEQ ID NO: 2559249 - protein, 6 aa, Entamoeba histolytica
APVSKG

SEQ ID NO: 2559250 - protein, 13 aa, Entamoeba histolytica
AQAKNKSQNQVKN

SEQ ID NO: 2559251 - protein, 9 aa, Entamoeba histolytica
AQAQRETIG

SEQ ID NO: 2559252 - protein, 7 aa, Entamoeba histolytica
AQCTTNG

SEQ ID NO: 2559253 - protein, 6 aa, Entamoeba histolytica
AQDETG

SEQ ID NO: 2559254 - protein, 14 aa, Entamoeba histolytica
AQDKEYKCSEHTEK

SEQ ID NO: 2559255 - protein, 6 aa, Entamoeba histolytica
AQDPLN

SEQ ID NO: 2559256 - protein, 9 aa, Entamoeba histolytica
AQDSASTSL

SEQ ID NO: 2559257 - protein, 5 aa, Entamoeba histolytica
AQELK

SEQ ID NO: 2559258 - protein, 7 aa, Entamoeba histolytica
AQENTNQ

SEQ ID NO: 2559259 - protein, 17 aa, Entamoeba histolytica
AQETNEEVQDFNEEENL

SEQ ID NO: 2559260 - protein, 12 aa, Entamoeba histolytica
AQETNPTNTNCQ

SEQ ID NO: 2559261 - protein, 8 aa, Entamoeba histolytica
AQGEGVNG

SEQ ID NO: 2559262 - protein, 8 aa, Entamoeba histolytica
AQGFQGFS

SEQ ID NO: 2559263 - protein, 10 aa, Entamoeba histolytica
AQGKYTNHRK

SEQ ID NO: 2559264 - protein, 5 aa, Entamoeba histolytica
AQIDR

SEQ ID NO: 2559265 - protein, 4 aa, Entamoeba histolytica
AQIT

SEQ ID NO: 2559266 - protein, 7 aa, Entamoeba histolytica
AQITPSG

SEQ ID NO: 2559267 - protein, 4 aa, Entamoeba histolytica
AQKG

SEQ ID NO: 2559268 - protein, 18 aa, Entamoeba histolytica
AQKPITKKDSTSSSEEGK

SEQ ID NO: 2559269 - protein, 7 aa, Entamoeba histolytica
AQKRDNF

SEQ ID NO: 2559270 - protein, 6 aa, Entamoeba histolytica
AQNCNN

SEQ ID NO: 2559271 - protein, 7 aa, Entamoeba histolytica
AQNGASA

SEQ ID NO: 2559272 - protein, 9 aa, Entamoeba histolytica
AQNSASTSL

SEQ ID NO: 2559273 - protein, 61 aa, Entamoeba histolytica
AQNSQSSQNSEMDNRSHSSSTNGASNSQPQKSTNSSSKATSSKSNENDKSNPKNKNVKSKV

SEQ ID NO: 2559274 - protein, 69 aa, Entamoeba histolytica
AQNSQSSQNSESEGGSSLSSNNNANSSSKQLSSNGQKSHPSKSHASGSAKSKSDSETSTKKKKKGKSKI

SEQ ID NO: 2559275 - protein, 7 aa, Entamoeba histolytica
AQNVPSA

SEQ ID NO: 2559276 - protein, 6 aa, Entamoeba histolytica
AQPNVT

SEQ ID NO: 2559277 - protein, 6 aa, Entamoeba histolytica
AQPRPI

SEQ ID NO: 2559278 - protein, 6 aa, Entamoeba histolytica
AQPTTH

SEQ ID NO: 2559279 - protein, 5 aa, Entamoeba histolytica
AQPVD

SEQ ID NO: 2559280 - protein, 9 aa, Entamoeba histolytica
AQQGNVKGM

SEQ ID NO: 2559281 - protein, 9 aa, Entamoeba histolytica
AQQKKEQNV

SEQ ID NO: 2559282 - protein, 5 aa, Entamoeba histolytica
AQQNA

SEQ ID NO: 2559283 - protein, 15 aa, Entamoeba histolytica
AQREEVRKHESEGTV

SEQ ID NO: 2559284 - protein, 8 aa, Entamoeba histolytica
AQSDYDGN

SEQ ID NO: 2559285 - protein, 11 aa, Entamoeba histolytica
AQSEGNTQSYA

SEQ ID NO: 2559286 - protein, 8 aa, Entamoeba histolytica
AQSNAVGK

SEQ ID NO: 2559287 - protein, 6 aa, Entamoeba histolytica
AQSNFS

SEQ ID NO: 2559288 - protein, 6 aa, Entamoeba histolytica
AQSSLS

SEQ ID NO: 2559289 - protein, 5 aa, Entamoeba histolytica
AQSTN

SEQ ID NO: 2559290 - protein, 8 aa, Entamoeba histolytica
AQTELSPK

SEQ ID NO: 2559291 - protein, 8 aa, Entamoeba histolytica
AQTKLTTR

SEQ ID NO: 2559292 - protein, 4 aa, Entamoeba histolytica
AQTT

SEQ ID NO: 2559293 - protein, 8 aa, Entamoeba histolytica
AQTTAYSR

SEQ ID NO: 2559294 - protein, 14 aa, Entamoeba histolytica
AQTTQSSLSCDTDN

SEQ ID NO: 2559295 - protein, 19 aa, Entamoeba histolytica
AQTVSSNIIGSQKEIVSSK

SEQ ID NO: 2559296 - protein, 8 aa, Entamoeba histolytica
AQVKKDDE

SEQ ID NO: 2559297 - protein, 12 aa, Entamoeba histolytica
ARDAEDLKRKEE

SEQ ID NO: 2559298 - protein, 5 aa, Entamoeba histolytica
AREGY

SEQ ID NO: 2559299 - protein, 7 aa, Entamoeba histolytica
ARESREI

SEQ ID NO: 2559300 - protein, 6 aa, Entamoeba histolytica
ARGELS

SEQ ID NO: 2559301 - protein, 6 aa, Entamoeba histolytica
ARGITT

SEQ ID NO: 2559302 - protein, 10 aa, Entamoeba histolytica
ARGPVASGVS

SEQ ID NO: 2559303 - protein, 6 aa, Entamoeba histolytica
ARHSQK

SEQ ID NO: 2559304 - protein, 7 aa, Entamoeba histolytica
ARIGNPQ

SEQ ID NO: 2559305 - protein, 8 aa, Entamoeba histolytica
ARIPHGNP

SEQ ID NO: 2559306 - protein, 10 aa, Entamoeba histolytica
ARKEFKTKEQ

SEQ ID NO: 2559307 - protein, 8 aa, Entamoeba histolytica
ARLRSENQ

SEQ ID NO: 2559308 - protein, 6 aa, Entamoeba histolytica
ARNAGG

SEQ ID NO: 2559309 - protein, 11 aa, Entamoeba histolytica
ARNEGNSEEGE

SEQ ID NO: 2559310 - protein, 13 aa, Entamoeba histolytica
ARNLTEEQTKEFN

SEQ ID NO: 2559311 - protein, 9 aa, Entamoeba histolytica
ARPAKQYPS

SEQ ID NO: 2559312 - protein, 9 aa, Entamoeba histolytica
ARRKSVKDV

SEQ ID NO: 2559313 - protein, 11 aa, Entamoeba histolytica
ARRPKKVGSVK

SEQ ID NO: 2559314 - protein, 10 aa, Entamoeba histolytica
ARSAEGKDGD

SEQ ID NO: 2559315 - protein, 20 aa, Entamoeba histolytica
ARSEGRKEIKENGGENEFNT

SEQ ID NO: 2559316 - protein, 5 aa, Entamoeba histolytica
ARSEV

SEQ ID NO: 2559317 - protein, 7 aa, Entamoeba histolytica
ARSGKPA

SEQ ID NO: 2559318 - protein, 8 aa, Entamoeba histolytica
ARSGSTSM

SEQ ID NO: 2559319 - protein, 6 aa, Entamoeba histolytica
ARSIET

SEQ ID NO: 2559320 - protein, 13 aa, Entamoeba histolytica
ARSKLSTKLDEDE

SEQ ID NO: 2559321 - protein, 4 aa, Entamoeba histolytica
ARSP

SEQ ID NO: 2559322 - protein, 7 aa, Entamoeba histolytica
ARSQTMK

SEQ ID NO: 2559323 - protein, 13 aa, Entamoeba histolytica
ARTLTEEQEKEFK

SEQ ID NO: 2559324 - protein, 6 aa, Entamoeba histolytica
ARTNPS

SEQ ID NO: 2559325 - protein, 8 aa, Entamoeba histolytica
ARTSGAAA

SEQ ID NO: 2559326 - protein, 5 aa, Entamoeba histolytica
ARTTL

SEQ ID NO: 2559327 - protein, 5 aa, Entamoeba histolytica
ARVSG

SEQ ID NO: 2559328 - protein, 7 aa, Entamoeba histolytica
ASAGRQR

SEQ ID NO: 2559329 - protein, 8 aa, Entamoeba histolytica
ASASTDID

SEQ ID NO: 2559330 - protein, 9 aa, Entamoeba histolytica
ASASTSKDQ

SEQ ID NO: 2559331 - protein, 5 aa, Entamoeba histolytica
ASATE

SEQ ID NO: 2559332 - protein, 5 aa, Entamoeba histolytica
ASCEP

SEQ ID NO: 2559333 - protein, 5 aa, Entamoeba histolytica
ASCNS

SEQ ID NO: 2559334 - protein, 55 aa, Entamoeba histolytica
ASDDEEISSSEDSSVDKEIKSPKTPKEGESTEEYIGQTSEEKSTLTKGGSTQELQ

SEQ ID NO: 2559335 - protein, 9 aa, Entamoeba histolytica
ASDKKASQL

SEQ ID NO: 2559336 - protein, 16 aa, Entamoeba histolytica
ASDKQTHLPGFSDNSD

SEQ ID NO: 2559337 - protein, 5 aa, Entamoeba histolytica
ASDLA

SEQ ID NO: 2559338 - protein, 8 aa, Entamoeba histolytica
ASEDKRVQ

SEQ ID NO: 2559339 - protein, 5 aa, Entamoeba histolytica
ASEDN

SEQ ID NO: 2559340 - protein, 6 aa, Entamoeba histolytica
ASEGGV

SEQ ID NO: 2559341 - protein, 10 aa, Entamoeba histolytica
ASEGSTSDSL

SEQ ID NO: 2559342 - protein, 10 aa, Entamoeba histolytica
ASEKEKGKYM

SEQ ID NO: 2559343 - protein, 6 aa, Entamoeba histolytica
ASENKD

SEQ ID NO: 2559344 - protein, 9 aa, Entamoeba histolytica
ASEQPYVAS

SEQ ID NO: 2559345 - protein, 6 aa, Entamoeba histolytica
ASEQVS

SEQ ID NO: 2559346 - protein, 4 aa, Entamoeba histolytica
ASET

SEQ ID NO: 2559347 - protein, 7 aa, Entamoeba histolytica
ASFSTTK

SEQ ID NO: 2559348 - protein, 9 aa, Entamoeba histolytica
ASGASSLEE

SEQ ID NO: 2559349 - protein, 8 aa, Entamoeba histolytica
ASGCGKST

SEQ ID NO: 2559350 - protein, 15 aa, Entamoeba histolytica
ASGGSCSYGPQPTTI

SEQ ID NO: 2559351 - protein, 6 aa, Entamoeba histolytica
ASGNSV

SEQ ID NO: 2559352 - protein, 8 aa, Entamoeba histolytica
ASGRYKGD

SEQ ID NO: 2559353 - protein, 8 aa, Entamoeba histolytica
ASGSNAQC

SEQ ID NO: 2559354 - protein, 14 aa, Entamoeba histolytica
ASGYKGYPECKSYT

SEQ ID NO: 2559355 - protein, 7 aa, Entamoeba histolytica
ASIAGTA

SEQ ID NO: 2559356 - protein, 4 aa, Entamoeba histolytica
ASIG

SEQ ID NO: 2559357 - protein, 5 aa, Entamoeba histolytica
ASIRP

SEQ ID NO: 2559358 - protein, 4 aa, Entamoeba histolytica
ASIS

SEQ ID NO: 2559359 - protein, 9 aa, Entamoeba histolytica
ASISDYSKQ

SEQ ID NO: 2559360 - protein, 8 aa, Entamoeba histolytica
ASISPNKL

SEQ ID NO: 2559361 - protein, 10 aa, Entamoeba histolytica
ASKAIDTEGT

SEQ ID NO: 2559362 - protein, 16 aa, Entamoeba histolytica
ASKDDSVYCSSSSNIN

SEQ ID NO: 2559363 - protein, 13 aa, Entamoeba histolytica
ASKEKDKMNVPDK

SEQ ID NO: 2559364 - protein, 13 aa, Entamoeba histolytica
ASKGDEESIEEDH

SEQ ID NO: 2559365 - protein, 8 aa, Entamoeba histolytica
ASKNNQLR

SEQ ID NO: 2559366 - protein, 7 aa, Entamoeba histolytica
ASLGPDD

SEQ ID NO: 2559367 - protein, 6 aa, Entamoeba histolytica
ASLNSY

SEQ ID NO: 2559368 - protein, 7 aa, Entamoeba histolytica
ASLPTFN

SEQ ID NO: 2559369 - protein, 5 aa, Entamoeba histolytica
ASLQQ

SEQ ID NO: 2559370 - protein, 5 aa, Entamoeba histolytica
ASLSF

SEQ ID NO: 2559371 - protein, 10 aa, Entamoeba histolytica
ASNGDLSDSH

SEQ ID NO: 2559372 - protein, 8 aa, Entamoeba histolytica
ASNGYRAG

SEQ ID NO: 2559373 - protein, 8 aa, Entamoeba histolytica
ASNLGANE

SEQ ID NO: 2559374 - protein, 5 aa, Entamoeba histolytica
ASNPI

SEQ ID NO: 2559375 - protein, 6 aa, Entamoeba histolytica
ASNPLT

SEQ ID NO: 2559376 - protein, 7 aa, Entamoeba histolytica
ASNQAGR

SEQ ID NO: 2559377 - protein, 7 aa, Entamoeba histolytica
ASNSDLK

SEQ ID NO: 2559378 - protein, 6 aa, Entamoeba histolytica
ASNSEI

SEQ ID NO: 2559379 - protein, 10 aa, Entamoeba histolytica
ASNTSTRATV

SEQ ID NO: 2559380 - protein, 8 aa, Entamoeba histolytica
ASNVKNAT

SEQ ID NO: 2559381 - protein, 10 aa, Entamoeba histolytica
ASPDDSKNEI

SEQ ID NO: 2559382 - protein, 4 aa, Entamoeba histolytica
ASPE

SEQ ID NO: 2559383 - protein, 7 aa, Entamoeba histolytica
ASPIDSS

SEQ ID NO: 2559384 - protein, 4 aa, Entamoeba histolytica
ASPK

SEQ ID NO: 2559385 - protein, 9 aa, Entamoeba histolytica
ASPKNGVER

SEQ ID NO: 2559386 - protein, 8 aa, Entamoeba histolytica
ASPNPNTI

SEQ ID NO: 2559387 - protein, 9 aa, Entamoeba histolytica
ASPSEESIM

SEQ ID NO: 2559388 - protein, 5 aa, Entamoeba histolytica
ASQAL

SEQ ID NO: 2559389 - protein, 5 aa, Entamoeba histolytica
ASQDE

SEQ ID NO: 2559390 - protein, 4 aa, Entamoeba histolytica
ASQL

SEQ ID NO: 2559391 - protein, 9 aa, Entamoeba histolytica
ASREEDAMK

SEQ ID NO: 2559392 - protein, 10 aa, Entamoeba histolytica
ASRKRKTTNI

SEQ ID NO: 2559393 - protein, 4 aa, Entamoeba histolytica
ASRS

SEQ ID NO: 2559394 - protein, 13 aa, Entamoeba histolytica
ASRSENKLKETQE

SEQ ID NO: 2559395 - protein, 6 aa, Entamoeba histolytica
ASSEIT

SEQ ID NO: 2559396 - protein, 5 aa, Entamoeba histolytica
ASSKI

SEQ ID NO: 2559397 - protein, 7 aa, Entamoeba histolytica
ASSKNFQ

SEQ ID NO: 2559398 - protein, 20 aa, Entamoeba histolytica
ASSLELSPSGCDSGTHYTRG

SEQ ID NO: 2559399 - protein, 13 aa, Entamoeba histolytica
ASSLKLSSGSLSC

SEQ ID NO: 2559400 - protein, 5 aa, Entamoeba histolytica
ASSNR

SEQ ID NO: 2559401 - protein, 5 aa, Entamoeba histolytica
ASSPM

SEQ ID NO: 2559402 - protein, 6 aa, Entamoeba histolytica
ASSSFK

SEQ ID NO: 2559403 - protein, 7 aa, Entamoeba histolytica
ASSSITN

SEQ ID NO: 2559404 - protein, 9 aa, Entamoeba histolytica
ASSSSGNAL

SEQ ID NO: 2559405 - protein, 8 aa, Entamoeba histolytica
ASSTNPVT

SEQ ID NO: 2559406 - protein, 10 aa, Entamoeba histolytica
ASSTSSKTCD

SEQ ID NO: 2559407 - protein, 12 aa, Entamoeba histolytica
ASSTSSSIPQSQ

SEQ ID NO: 2559408 - protein, 8 aa, Entamoeba histolytica
ASSVSEDV

SEQ ID NO: 2559409 - protein, 18 aa, Entamoeba histolytica
ASSYDSKDSSKNITEDNP

SEQ ID NO: 2559410 - protein, 6 aa, Entamoeba histolytica
ASSYQQ

SEQ ID NO: 2559411 - protein, 6 aa, Entamoeba histolytica
ASSYQY

SEQ ID NO: 2559412 - protein, 9 aa, Entamoeba histolytica
ASTCGTESN

SEQ ID NO: 2559413 - protein, 5 aa, Entamoeba histolytica
ASTLG

SEQ ID NO: 2559414 - protein, 14 aa, Entamoeba histolytica
ASTNPSSLLTRITQ

SEQ ID NO: 2559415 - protein, 4 aa, Entamoeba histolytica
ASTR

SEQ ID NO: 2559416 - protein, 7 aa, Entamoeba histolytica
ASTSEKY

SEQ ID NO: 2559417 - protein, 17 aa, Entamoeba histolytica
ASTTTLNASDKASYIDQ

SEQ ID NO: 2559418 - protein, 7 aa, Entamoeba histolytica
ASTYKNY

SEQ ID NO: 2559419 - protein, 6 aa, Entamoeba histolytica
ASVEND

SEQ ID NO: 2559420 - protein, 22 aa, Entamoeba histolytica
ASVRTTSTPPSLSTTPKEHERK

SEQ ID NO: 2559421 - protein, 7 aa, Entamoeba histolytica
ASVTSNP

SEQ ID NO: 2559422 - protein, 8 aa, Entamoeba histolytica
ASYDSNDG

SEQ ID NO: 2559423 - protein, 7 aa, Entamoeba histolytica
ASYQTAA

SEQ ID NO: 2559424 - protein, 8 aa, Entamoeba histolytica
ASYSTPTE

SEQ ID NO: 2559425 - protein, 13 aa, Entamoeba histolytica
ATAEELEGQTGDM

SEQ ID NO: 2559426 - protein, 4 aa, Entamoeba histolytica
ATAG

SEQ ID NO: 2559427 - protein, 18 aa, Entamoeba histolytica
ATANSSSISTNGKKIHEE

SEQ ID NO: 2559428 - protein, 10 aa, Entamoeba histolytica
ATAQGQRPSL

SEQ ID NO: 2559429 - protein, 6 aa, Entamoeba histolytica
ATASGF

SEQ ID NO: 2559430 - protein, 6 aa, Entamoeba histolytica
ATASSD

SEQ ID NO: 2559431 - protein, 6 aa, Entamoeba histolytica
ATATRQ

SEQ ID NO: 2559432 - protein, 34 aa, Entamoeba histolytica
ATAVSQNHSTNEVEIKNSNDNENKHKNDSIKRKK

SEQ ID NO: 2559433 - protein, 13 aa, Entamoeba histolytica
ATCEENPDPEVKE

SEQ ID NO: 2559434 - protein, 10 aa, Entamoeba histolytica
ATCKNSNSCL

SEQ ID NO: 2559435 - protein, 7 aa, Entamoeba histolytica
ATCNQKD

SEQ ID NO: 2559436 - protein, 9 aa, Entamoeba histolytica
ATDEQLNTS

SEQ ID NO: 2559437 - protein, 5 aa, Entamoeba histolytica
ATDFD

SEQ ID NO: 2559438 - protein, 6 aa, Entamoeba histolytica
ATDHQQ

SEQ ID NO: 2559439 - protein, 4 aa, Entamoeba histolytica
ATDK

SEQ ID NO: 2559440 - protein, 10 aa, Entamoeba histolytica
ATDKKKYERV

SEQ ID NO: 2559441 - protein, 8 aa, Entamoeba histolytica
ATDSKGIS

SEQ ID NO: 2559442 - protein, 18 aa, Entamoeba histolytica
ATDSKQVRLGSSESSSVS

SEQ ID NO: 2559443 - protein, 10 aa, Entamoeba histolytica
ATDSSAAKIE

SEQ ID NO: 2559444 - protein, 6 aa, Entamoeba histolytica
ATDSTV

SEQ ID NO: 2559445 - protein, 19 aa, Entamoeba histolytica
ATECSCESSLDSNHCTECS

SEQ ID NO: 2559446 - protein, 6 aa, Entamoeba histolytica
ATEEGK

SEQ ID NO: 2559447 - protein, 7 aa, Entamoeba histolytica
ATEEGKS

SEQ ID NO: 2559448 - protein, 10 aa, Entamoeba histolytica
ATEENGWKTS

SEQ ID NO: 2559449 - protein, 8 aa, Entamoeba histolytica
ATEKGNND

SEQ ID NO: 2559450 - protein, 6 aa, Entamoeba histolytica
ATENDV

SEQ ID NO: 2559451 - protein, 6 aa, Entamoeba histolytica
ATERVK

SEQ ID NO: 2559452 - protein, 7 aa, Entamoeba histolytica
ATESINN

SEQ ID NO: 2559453 - protein, 14 aa, Entamoeba histolytica
ATESINNQEERTKE

SEQ ID NO: 2559454 - protein, 7 aa, Entamoeba histolytica
ATESITN

SEQ ID NO: 2559455 - protein, 5 aa, Entamoeba histolytica
ATETN

SEQ ID NO: 2559456 - protein, 5 aa, Entamoeba histolytica
ATFGY

SEQ ID NO: 2559457 - protein, 16 aa, Entamoeba histolytica
ATGKSSNGSDANFPTF

SEQ ID NO: 2559458 - protein, 5 aa, Entamoeba histolytica
ATGRF

SEQ ID NO: 2559459 - protein, 4 aa, Entamoeba histolytica
ATGY

SEQ ID NO: 2559460 - protein, 13 aa, Entamoeba histolytica
ATHAGQTATTDTH

SEQ ID NO: 2559461 - protein, 11 aa, Entamoeba histolytica
ATHGSKTNINA

SEQ ID NO: 2559462 - protein, 5 aa, Entamoeba histolytica
ATIND

SEQ ID NO: 2559463 - protein, 8 aa, Entamoeba histolytica
ATKDMEYG

SEQ ID NO: 2559464 - protein, 7 aa, Entamoeba histolytica
ATKGYAK

SEQ ID NO: 2559465 - protein, 9 aa, Entamoeba histolytica
ATKHGNHQL

SEQ ID NO: 2559466 - protein, 8 aa, Entamoeba histolytica
ATKSKCEE

SEQ ID NO: 2559467 - protein, 11 aa, Entamoeba histolytica
ATKTQLSGEGQ

SEQ ID NO: 2559468 - protein, 7 aa, Entamoeba histolytica
ATMSDSQ

SEQ ID NO: 2559469 - protein, 8 aa, Entamoeba histolytica
ATNASMSS

SEQ ID NO: 2559470 - protein, 12 aa, Entamoeba histolytica
ATNGGSGSTSYR

SEQ ID NO: 2559471 - protein, 5 aa, Entamoeba histolytica
ATNGK

SEQ ID NO: 2559472 - protein, 5 aa, Entamoeba histolytica
ATNME

SEQ ID NO: 2559473 - protein, 14 aa, Entamoeba histolytica
ATNNEQWGPTTKQY

SEQ ID NO: 2559474 - protein, 6 aa, Entamoeba histolytica
ATNPKA

SEQ ID NO: 2559475 - protein, 21 aa, Entamoeba histolytica
ATNSKACGSNNLLNSNKDEYY

SEQ ID NO: 2559476 - protein, 8 aa, Entamoeba histolytica
ATNSTHNI

SEQ ID NO: 2559477 - protein, 9 aa, Entamoeba histolytica
ATNSTSNEL

SEQ ID NO: 2559478 - protein, 7 aa, Entamoeba histolytica
ATPAHEQ

SEQ ID NO: 2559479 - protein, 4 aa, Entamoeba histolytica
ATPC

SEQ ID NO: 2559480 - protein, 7 aa, Entamoeba histolytica
ATPEHPW

SEQ ID NO: 2559481 - protein, 6 aa, Entamoeba histolytica
ATPILE

SEQ ID NO: 2559482 - protein, 6 aa, Entamoeba histolytica
ATPKGE

SEQ ID NO: 2559483 - protein, 4 aa, Entamoeba histolytica
ATPL

SEQ ID NO: 2559484 - protein, 11 aa, Entamoeba histolytica
ATPNEAKGKEE

SEQ ID NO: 2559485 - protein, 5 aa, Entamoeba histolytica
ATPPV

SEQ ID NO: 2559486 - protein, 6 aa, Entamoeba histolytica
ATPSEI

SEQ ID NO: 2559487 - protein, 6 aa, Entamoeba histolytica
ATPVLD

SEQ ID NO: 2559488 - protein, 6 aa, Entamoeba histolytica
ATPYQY

SEQ ID NO: 2559489 - protein, 26 aa, Entamoeba histolytica
ATQAHGQYSYQKKQETPQQKHNTTGW

SEQ ID NO: 2559490 - protein, 6 aa, Entamoeba histolytica
ATQEVK

SEQ ID NO: 2559491 - protein, 30 aa, Entamoeba histolytica
ATQTTNSQTNPSGAGDEEKPNTSNEEEEIK

SEQ ID NO: 2559492 - protein, 4 aa, Entamoeba histolytica
ATRS

SEQ ID NO: 2559493 - protein, 6 aa, Entamoeba histolytica
ATRTEQ

SEQ ID NO: 2559494 - protein, 7 aa, Entamoeba histolytica
ATRTPVT

SEQ ID NO: 2559495 - protein, 12 aa, Entamoeba histolytica
ATRTSGCGEDSR

SEQ ID NO: 2559496 - protein, 12 aa, Entamoeba histolytica
ATRTSGCGGDSR

SEQ ID NO: 2559497 - protein, 13 aa, Entamoeba histolytica
ATSCGVSSNFGTA

SEQ ID NO: 2559498 - protein, 10 aa, Entamoeba histolytica
ATSGVDYETD

SEQ ID NO: 2559499 - protein, 7 aa, Entamoeba histolytica
ATSQTSI

SEQ ID NO: 2559500 - protein, 6 aa, Entamoeba histolytica
ATSSFE

SEQ ID NO: 2559501 - protein, 8 aa, Entamoeba histolytica
ATSSSIPD

SEQ ID NO: 2559502 - protein, 6 aa, Entamoeba histolytica
ATSVER

SEQ ID NO: 2559503 - protein, 6 aa, Entamoeba histolytica
ATTEQD

SEQ ID NO: 2559504 - protein, 4 aa, Entamoeba histolytica
ATTI

SEQ ID NO: 2559505 - protein, 8 aa, Entamoeba histolytica
ATTNTFNG

SEQ ID NO: 2559506 - protein, 8 aa, Entamoeba histolytica
ATTPFEKD

SEQ ID NO: 2559507 - protein, 4 aa, Entamoeba histolytica
ATTS

SEQ ID NO: 2559508 - protein, 19 aa, Entamoeba histolytica
ATTVEHGNSTKFVLPTEFS

SEQ ID NO: 2559509 - protein, 16 aa, Entamoeba histolytica
ATVTSDESNKVTEADG

SEQ ID NO: 2559510 - protein, 5 aa, Entamoeba histolytica
ATYQN

SEQ ID NO: 2559511 - protein, 7 aa, Entamoeba histolytica
ATYSDSG

SEQ ID NO: 2559512 - protein, 9 aa, Entamoeba histolytica
AVAGDKDNS

SEQ ID NO: 2559513 - protein, 6 aa, Entamoeba histolytica
AVDEEK

SEQ ID NO: 2559514 - protein, 6 aa, Entamoeba histolytica
AVDRPS

SEQ ID NO: 2559515 - protein, 6 aa, Entamoeba histolytica
AVEPEV

SEQ ID NO: 2559516 - protein, 10 aa, Entamoeba histolytica
AVESSKSLSI

SEQ ID NO: 2559517 - protein, 9 aa, Entamoeba histolytica
AVGDGGNDV

SEQ ID NO: 2559518 - protein, 8 aa, Entamoeba histolytica
AVGDKKSL

SEQ ID NO: 2559519 - protein, 9 aa, Entamoeba histolytica
AVGGAGKVA

SEQ ID NO: 2559520 - protein, 30 aa, Entamoeba histolytica
AVGSNEEPSSTIQNKEETKLITKNSTTQIK

SEQ ID NO: 2559521 - protein, 12 aa, Entamoeba histolytica
AVIETPDENQVS

SEQ ID NO: 2559522 - protein, 15 aa, Entamoeba histolytica
AVNQNKSAPTPLQEN

SEQ ID NO: 2559523 - protein, 15 aa, Entamoeba histolytica
AVNQNKTKPTPLQEN

SEQ ID NO: 2559524 - protein, 9 aa, Entamoeba histolytica
AVNTTNSKE

SEQ ID NO: 2559525 - protein, 6 aa, Entamoeba histolytica
AVPGTA

SEQ ID NO: 2559526 - protein, 6 aa, Entamoeba histolytica
AVPPVR

SEQ ID NO: 2559527 - protein, 5 aa, Entamoeba histolytica
AVQDG

SEQ ID NO: 2559528 - protein, 4 aa, Entamoeba histolytica
AVQE

SEQ ID NO: 2559529 - protein, 17 aa, Entamoeba histolytica
AVQEDDDLPLNANSEEM

SEQ ID NO: 2559530 - protein, 10 aa, Entamoeba histolytica
AVRAAKNTYD

SEQ ID NO: 2559531 - protein, 9 aa, Entamoeba histolytica
AVRKSSALK

SEQ ID NO: 2559532 - protein, 6 aa, Entamoeba histolytica
AVRSPS

SEQ ID NO: 2559533 - protein, 13 aa, Entamoeba histolytica
AVRTSSDNTVDSV

SEQ ID NO: 2559534 - protein, 11 aa, Entamoeba histolytica
AVSGSDSVTSE

SEQ ID NO: 2559535 - protein, 8 aa, Entamoeba histolytica
AVSRDDSY

SEQ ID NO: 2559536 - protein, 7 aa, Entamoeba histolytica
AVTGTSV

SEQ ID NO: 2559537 - protein, 15 aa, Entamoeba histolytica
AVTPDTTFDGATLPD

SEQ ID NO: 2559538 - protein, 17 aa, Entamoeba histolytica
AWKETGREEDDKIETKG

SEQ ID NO: 2559539 - protein, 7 aa, Entamoeba histolytica
AWPTQAG

SEQ ID NO: 2559540 - protein, 6 aa, Entamoeba histolytica
AYDTGA

SEQ ID NO: 2559541 - protein, 5 aa, Entamoeba histolytica
AYENQ

SEQ ID NO: 2559542 - protein, 11 aa, Entamoeba histolytica
AYEYGNDQGRE

SEQ ID NO: 2559543 - protein, 6 aa, Entamoeba histolytica
AYGAEP

SEQ ID NO: 2559544 - protein, 12 aa, Entamoeba histolytica
AYGTAKSSVGIS

SEQ ID NO: 2559545 - protein, 6 aa, Entamoeba histolytica
AYKDKQ

SEQ ID NO: 2559546 - protein, 6 aa, Entamoeba histolytica
AYKGEV

SEQ ID NO: 2559547 - protein, 5 aa, Entamoeba histolytica
AYKRT

SEQ ID NO: 2559548 - protein, 9 aa, Entamoeba histolytica
AYPADDPKF

SEQ ID NO: 2559549 - protein, 7 aa, Entamoeba histolytica
AYPAPKN

SEQ ID NO: 2559550 - protein, 16 aa, Entamoeba histolytica
AYPPILPESDDLPESL

SEQ ID NO: 2559551 - protein, 7 aa, Entamoeba histolytica
AYPTSDP

SEQ ID NO: 2559552 - protein, 12 aa, Entamoeba histolytica
AYQLKAEGKDND

SEQ ID NO: 2559553 - protein, 12 aa, Entamoeba histolytica
AYSSSDKTKNNC

SEQ ID NO: 2559554 - protein, 13 aa, Entamoeba histolytica
AYSSSSDASCPSA

SEQ ID NO: 2559555 - protein, 7 aa, Entamoeba histolytica
CAPGQCD

SEQ ID NO: 2559556 - protein, 8 aa, Entamoeba histolytica
CAQREAGL

SEQ ID NO: 2559557 - protein, 7 aa, Entamoeba histolytica
CARSNGI

SEQ ID NO: 2559558 - protein, 9 aa, Entamoeba histolytica
CASCSNEYT

SEQ ID NO: 2559559 - protein, 9 aa, Entamoeba histolytica
CASESQFDT

SEQ ID NO: 2559560 - protein, 7 aa, Entamoeba histolytica
CASSRIT

SEQ ID NO: 2559561 - protein, 9 aa, Entamoeba histolytica
CATKTVSRT

SEQ ID NO: 2559562 - protein, 11 aa, Entamoeba histolytica
CAVQGNEKYCS

SEQ ID NO: 2559563 - protein, 16 aa, Entamoeba histolytica
CCNPKAAGKCNTFQER

SEQ ID NO: 2559564 - protein, 12 aa, Entamoeba histolytica
CDASGSIPKCSG

SEQ ID NO: 2559565 - protein, 16 aa, Entamoeba histolytica
CDASQSCSKCNVSEGY

SEQ ID NO: 2559566 - protein, 9 aa, Entamoeba histolytica
CDATPLTKN

SEQ ID NO: 2559567 - protein, 10 aa, Entamoeba histolytica
CDDGTLQQCG

SEQ ID NO: 2559568 - protein, 10 aa, Entamoeba histolytica
CDECEDGYKW

SEQ ID NO: 2559569 - protein, 5 aa, Entamoeba histolytica
CDEKG

SEQ ID NO: 2559570 - protein, 8 aa, Entamoeba histolytica
CDEKTTER

SEQ ID NO: 2559571 - protein, 16 aa, Entamoeba histolytica
CDENQQSQETINEIDQ

SEQ ID NO: 2559572 - protein, 10 aa, Entamoeba histolytica
CDGDSTTSNY

SEQ ID NO: 2559573 - protein, 14 aa, Entamoeba histolytica
CDGECASPNECTSC

SEQ ID NO: 2559574 - protein, 8 aa, Entamoeba histolytica
CDGENVPC

SEQ ID NO: 2559575 - protein, 6 aa, Entamoeba histolytica
CDGGEG

SEQ ID NO: 2559576 - protein, 6 aa, Entamoeba histolytica
CDGGYG

SEQ ID NO: 2559577 - protein, 11 aa, Entamoeba histolytica
CDGNSHCGSNC

SEQ ID NO: 2559578 - protein, 6 aa, Entamoeba histolytica
CDKGKS

SEQ ID NO: 2559579 - protein, 11 aa, Entamoeba histolytica
CDNATTEDHAE

SEQ ID NO: 2559580 - protein, 11 aa, Entamoeba histolytica
CDNDEDNTVEI

SEQ ID NO: 2559581 - protein, 24 aa, Entamoeba histolytica
CDNEPLGIDQSTEVKKEETTKEEY

SEQ ID NO: 2559582 - protein, 9 aa, Entamoeba histolytica
CDNGKHNQR

SEQ ID NO: 2559583 - protein, 11 aa, Entamoeba histolytica
CDNKSTIEHGH

SEQ ID NO: 2559584 - protein, 10 aa, Entamoeba histolytica
CDNPKKDDQK

SEQ ID NO: 2559585 - protein, 11 aa, Entamoeba histolytica
CDPEYSKDDHC

SEQ ID NO: 2559586 - protein, 8 aa, Entamoeba histolytica
CDRTNGEC

SEQ ID NO: 2559587 - protein, 9 aa, Entamoeba histolytica
CDRTSGCGK

SEQ ID NO: 2559588 - protein, 5 aa, Entamoeba histolytica
CDSGA

SEQ ID NO: 2559589 - protein, 10 aa, Entamoeba histolytica
CDSNQYLNNR

SEQ ID NO: 2559590 - protein, 11 aa, Entamoeba histolytica
CDSRKSQCGNF

SEQ ID NO: 2559591 - protein, 5 aa, Entamoeba histolytica
CDSSN

SEQ ID NO: 2559592 - protein, 15 aa, Entamoeba histolytica
CDSSQCVSRETNTAQ

SEQ ID NO: 2559593 - protein, 10 aa, Entamoeba histolytica
CDSTCEDGYG

SEQ ID NO: 2559594 - protein, 6 aa, Entamoeba histolytica
CDSTEH

SEQ ID NO: 2559595 - protein, 8 aa, Entamoeba histolytica
CDSTNGNC

SEQ ID NO: 2559596 - protein, 7 aa, Entamoeba histolytica
CDSTSSI

SEQ ID NO: 2559597 - protein, 10 aa, Entamoeba histolytica
CDSTTGNKCQ

SEQ ID NO: 2559598 - protein, 4 aa, Entamoeba histolytica
CDTE

SEQ ID NO: 2559599 - protein, 15 aa, Entamoeba histolytica
CDTKSNCKTCSTDSN

SEQ ID NO: 2559600 - protein, 7 aa, Entamoeba histolytica
CDTNQSS

SEQ ID NO: 2559601 - protein, 7 aa, Entamoeba histolytica
CDTPEKK

SEQ ID NO: 2559602 - protein, 11 aa, Entamoeba histolytica
CDTSNGCTNGE

SEQ ID NO: 2559603 - protein, 16 aa, Entamoeba histolytica
CEADNTCRGGCSENYF

SEQ ID NO: 2559604 - protein, 7 aa, Entamoeba histolytica
CECSSKD

SEQ ID NO: 2559605 - protein, 8 aa, Entamoeba histolytica
CEDGNMGS

SEQ ID NO: 2559606 - protein, 9 aa, Entamoeba histolytica
CEDGTEGRH

SEQ ID NO: 2559607 - protein, 9 aa, Entamoeba histolytica
CEEAPKTRY

SEQ ID NO: 2559608 - protein, 10 aa, Entamoeba histolytica
CEEGGEGDYT

SEQ ID NO: 2559609 - protein, 8 aa, Entamoeba histolytica
CEEKNNKY

SEQ ID NO: 2559610 - protein, 8 aa, Entamoeba histolytica
CEEPTQCN

SEQ ID NO: 2559611 - protein, 9 aa, Entamoeba histolytica
CEEQNTYGC

SEQ ID NO: 2559612 - protein, 7 aa, Entamoeba histolytica
CEETAQE

SEQ ID NO: 2559613 - protein, 11 aa, Entamoeba histolytica
CEGGTSDEPLM

SEQ ID NO: 2559614 - protein, 5 aa, Entamoeba histolytica
CEGHR

SEQ ID NO: 2559615 - protein, 7 aa, Entamoeba histolytica
CEGTNTK

SEQ ID NO: 2559616 - protein, 15 aa, Entamoeba histolytica
CEHSESGCRDSCSNR

SEQ ID NO: 2559617 - protein, 7 aa, Entamoeba histolytica
CEKCTKD

SEQ ID NO: 2559618 - protein, 8 aa, Entamoeba histolytica
CEKTTPEF

SEQ ID NO: 2559619 - protein, 10 aa, Entamoeba histolytica
CELSSKKGCT

SEQ ID NO: 2559620 - protein, 7 aa, Entamoeba histolytica
CENDVTT

SEQ ID NO: 2559621 - protein, 5 aa, Entamoeba histolytica
CENGN

SEQ ID NO: 2559622 - protein, 8 aa, Entamoeba histolytica
CENGNRTR

SEQ ID NO: 2559623 - protein, 7 aa, Entamoeba histolytica
CENGYTN

SEQ ID NO: 2559624 - protein, 27 aa, Entamoeba histolytica
CENKGYGKKTCYKRDESQYYYESESSS

SEQ ID NO: 2559625 - protein, 4 aa, Entamoeba histolytica
CENN

SEQ ID NO: 2559626 - protein, 8 aa, Entamoeba histolytica
CENNEELK

SEQ ID NO: 2559627 - protein, 8 aa, Entamoeba histolytica
CENSSRSI

SEQ ID NO: 2559628 - protein, 6 aa, Entamoeba histolytica
CEQENE

SEQ ID NO: 2559629 - protein, 5 aa, Entamoeba histolytica
CESGA

SEQ ID NO: 2559630 - protein, 4 aa, Entamoeba histolytica
CESL

SEQ ID NO: 2559631 - protein, 15 aa, Entamoeba histolytica
CESSCEENKYYDGDN

SEQ ID NO: 2559632 - protein, 7 aa, Entamoeba histolytica
CESSSCS

SEQ ID NO: 2559633 - protein, 8 aa, Entamoeba histolytica
CESTNNDY

SEQ ID NO: 2559634 - protein, 6 aa, Entamoeba histolytica
CETGPN

SEQ ID NO: 2559635 - protein, 8 aa, Entamoeba histolytica
CETGYYSK

SEQ ID NO: 2559636 - protein, 4 aa, Entamoeba histolytica
CETL

SEQ ID NO: 2559637 - protein, 9 aa, Entamoeba histolytica
CEYGNPSIT

SEQ ID NO: 2559638 - protein, 12 aa, Entamoeba histolytica
CFPSNAEAIEGL

SEQ ID NO: 2559639 - protein, 5 aa, Entamoeba histolytica
CFSSR

SEQ ID NO: 2559640 - protein, 5 aa, Entamoeba histolytica
CGDGE

SEQ ID NO: 2559641 - protein, 6 aa, Entamoeba histolytica
CGDSMT

SEQ ID NO: 2559642 - protein, 6 aa, Entamoeba histolytica
CGDTQL

SEQ ID NO: 2559643 - protein, 11 aa, Entamoeba histolytica
CGEEARKADNL

SEQ ID NO: 2559644 - protein, 6 aa, Entamoeba histolytica
CGEEKR

SEQ ID NO: 2559645 - protein, 6 aa, Entamoeba histolytica
CGENDD

SEQ ID NO: 2559646 - protein, 4 aa, Entamoeba histolytica
CGEP

SEQ ID NO: 2559647 - protein, 6 aa, Entamoeba histolytica
CGETAA

SEQ ID NO: 2559648 - protein, 15 aa, Entamoeba histolytica
CGGCDSKCSNCKVTT

SEQ ID NO: 2559649 - protein, 4 aa, Entamoeba histolytica
CGGG

SEQ ID NO: 2559650 - protein, 4 aa, Entamoeba histolytica
CGKC

SEQ ID NO: 2559651 - protein, 18 aa, Entamoeba histolytica
CGNHRLDEGEECDGGTGC

SEQ ID NO: 2559652 - protein, 5 aa, Entamoeba histolytica
CGNNI

SEQ ID NO: 2559653 - protein, 8 aa, Entamoeba histolytica
CGNTQQKV

SEQ ID NO: 2559654 - protein, 5 aa, Entamoeba histolytica
CGPSN

SEQ ID NO: 2559655 - protein, 5 aa, Entamoeba histolytica
CGQTQ

SEQ ID NO: 2559656 - protein, 14 aa, Entamoeba histolytica
CGREDQKSSKYTSA

SEQ ID NO: 2559657 - protein, 10 aa, Entamoeba histolytica
CGRTGSGKSS

SEQ ID NO: 2559658 - protein, 12 aa, Entamoeba histolytica
CGSCESSNSCTN

SEQ ID NO: 2559659 - protein, 8 aa, Entamoeba histolytica
CGSEDSEF

SEQ ID NO: 2559660 - protein, 8 aa, Entamoeba histolytica
CGSETVTS

SEQ ID NO: 2559661 - protein, 7 aa, Entamoeba histolytica
CGSGNGV

SEQ ID NO: 2559662 - protein, 16 aa, Entamoeba histolytica
CGSGYQTISPKPYGSN

SEQ ID NO: 2559663 - protein, 12 aa, Entamoeba histolytica
CGSISTSSSLTI

SEQ ID NO: 2559664 - protein, 5 aa, Entamoeba histolytica
CGSLS

SEQ ID NO: 2559665 - protein, 16 aa, Entamoeba histolytica
CGTEDTSSNIKAQIEG

SEQ ID NO: 2559666 - protein, 13 aa, Entamoeba histolytica
CGTPPYGETSPML

SEQ ID NO: 2559667 - protein, 8 aa, Entamoeba histolytica
CGTVGNKG

SEQ ID NO: 2559668 - protein, 11 aa, Entamoeba histolytica
CGVRGAAQQPK

SEQ ID NO: 2559669 - protein, 12 aa, Entamoeba histolytica
CGYTGTTKEGKD

SEQ ID NO: 2559670 - protein, 9 aa, Entamoeba histolytica
CHYKDSNNQ

SEQ ID NO: 2559671 - protein, 14 aa, Entamoeba histolytica
CIPQPTTCNANNSR

SEQ ID NO: 2559672 - protein, 13 aa, Entamoeba histolytica
CIPSGDKFEDGFN

SEQ ID NO: 2559673 - protein, 9 aa, Entamoeba histolytica
CISNNGNIE

SEQ ID NO: 2559674 - protein, 6 aa, Entamoeba histolytica
CITPGT

SEQ ID NO: 2559675 - protein, 7 aa, Entamoeba histolytica
CKASGES

SEQ ID NO: 2559676 - protein, 5 aa, Entamoeba histolytica
CKDGS

SEQ ID NO: 2559677 - protein, 10 aa, Entamoeba histolytica
CKDGYQPNGL

SEQ ID NO: 2559678 - protein, 6 aa, Entamoeba histolytica
CKDNTK

SEQ ID NO: 2559679 - protein, 9 aa, Entamoeba histolytica
CKDTELSGG

SEQ ID NO: 2559680 - protein, 10 aa, Entamoeba histolytica
CKEAKNNKCS

SEQ ID NO: 2559681 - protein, 26 aa, Entamoeba histolytica
CKEEEDKKKDKKRSNDEGVKDKKQQA

SEQ ID NO: 2559682 - protein, 12 aa, Entamoeba histolytica
CKEEKTDKEQNK

SEQ ID NO: 2559683 - protein, 18 aa, Entamoeba histolytica
CKEKDKQKHHHSPEIKST

SEQ ID NO: 2559684 - protein, 6 aa, Entamoeba histolytica
CKEKRE

SEQ ID NO: 2559685 - protein, 5 aa, Entamoeba histolytica
CKENQ

SEQ ID NO: 2559686 - protein, 5 aa, Entamoeba histolytica
CKEVQ

SEQ ID NO: 2559687 - protein, 8 aa, Entamoeba histolytica
CKGESISV

SEQ ID NO: 2559688 - protein, 7 aa, Entamoeba histolytica
CKKCNSH

SEQ ID NO: 2559689 - protein, 7 aa, Entamoeba histolytica
CKKEMDQ

SEQ ID NO: 2559690 - protein, 7 aa, Entamoeba histolytica
CKKYENE

SEQ ID NO: 2559691 - protein, 5 aa, Entamoeba histolytica
CKNAG

SEQ ID NO: 2559692 - protein, 8 aa, Entamoeba histolytica
CKNEEPAL

SEQ ID NO: 2559693 - protein, 6 aa, Entamoeba histolytica
CKNQNT

SEQ ID NO: 2559694 - protein, 7 aa, Entamoeba histolytica
CKNSTAA

SEQ ID NO: 2559695 - protein, 11 aa, Entamoeba histolytica
CKNTENTGKLD

SEQ ID NO: 2559696 - protein, 12 aa, Entamoeba histolytica
CKNTENTGKLDS

SEQ ID NO: 2559697 - protein, 7 aa, Entamoeba histolytica
CKNYTDG

SEQ ID NO: 2559698 - protein, 16 aa, Entamoeba histolytica
CKPEKSGSVKTSDNLK

SEQ ID NO: 2559699 - protein, 10 aa, Entamoeba histolytica
CKPIKEDEVQ

SEQ ID NO: 2559700 - protein, 7 aa, Entamoeba histolytica
CKPPNVE

SEQ ID NO: 2559701 - protein, 18 aa, Entamoeba histolytica
CKPVSKEPKIKTSGNLKY

SEQ ID NO: 2559702 - protein, 4 aa, Entamoeba histolytica
CKRC

SEQ ID NO: 2559703 - protein, 32 aa, Entamoeba histolytica
CKRCSSVTGECTSCPNGEKTVSGKCENCSTNG

SEQ ID NO: 2559704 - protein, 10 aa, Entamoeba histolytica
CKRGNNNTCQ

SEQ ID NO: 2559705 - protein, 6 aa, Entamoeba histolytica
CKSAGS

SEQ ID NO: 2559706 - protein, 7 aa, Entamoeba histolytica
CKSINSS

SEQ ID NO: 2559707 - protein, 5 aa, Entamoeba histolytica
CKSQN

SEQ ID NO: 2559708 - protein, 8 aa, Entamoeba histolytica
CKTCEGSA

SEQ ID NO: 2559709 - protein, 7 aa, Entamoeba histolytica
CKTCSPI

SEQ ID NO: 2559710 - protein, 9 aa, Entamoeba histolytica
CKTEEEQIE

SEQ ID NO: 2559711 - protein, 6 aa, Entamoeba histolytica
CKTIND

SEQ ID NO: 2559712 - protein, 6 aa, Entamoeba histolytica
CKTNKN

SEQ ID NO: 2559713 - protein, 13 aa, Entamoeba histolytica
CKTQKKEATSTED

SEQ ID NO: 2559714 - protein, 7 aa, Entamoeba histolytica
CKTTDRY

SEQ ID NO: 2559715 - protein, 9 aa, Entamoeba histolytica
CKYNTTSKK

SEQ ID NO: 2559716 - protein, 10 aa, Entamoeba histolytica
CKYSADKKEI

SEQ ID NO: 2559717 - protein, 13 aa, Entamoeba histolytica
CLDNTGCNKIEDG

SEQ ID NO: 2559718 - protein, 10 aa, Entamoeba histolytica
CLEKKGDKCV

SEQ ID NO: 2559719 - protein, 7 aa, Entamoeba histolytica
CLPSNGG

SEQ ID NO: 2559720 - protein, 7 aa, Entamoeba histolytica
CLRGNSK

SEQ ID NO: 2559721 - protein, 7 aa, Entamoeba histolytica
CLSNDTL

SEQ ID NO: 2559722 - protein, 7 aa, Entamoeba histolytica
CNADKIN

SEQ ID NO: 2559723 - protein, 7 aa, Entamoeba histolytica
CNDGTDF

SEQ ID NO: 2559724 - protein, 10 aa, Entamoeba histolytica
CNECSEDNNC

SEQ ID NO: 2559725 - protein, 7 aa, Entamoeba histolytica
CNEKAKK

SEQ ID NO: 2559726 - protein, 9 aa, Entamoeba histolytica
CNENNETKS

SEQ ID NO: 2559727 - protein, 11 aa, Entamoeba histolytica
CNEYSKSPIGN

SEQ ID NO: 2559728 - protein, 16 aa, Entamoeba histolytica
CNGKKQKIHLESSGSY

SEQ ID NO: 2559729 - protein, 4 aa, Entamoeba histolytica
CNGN

SEQ ID NO: 2559730 - protein, 8 aa, Entamoeba histolytica
CNHNPSDQ

SEQ ID NO: 2559731 - protein, 7 aa, Entamoeba histolytica
CNKARVS

SEQ ID NO: 2559732 - protein, 6 aa, Entamoeba histolytica
CNKDTT

SEQ ID NO: 2559733 - protein, 5 aa, Entamoeba histolytica
CNKEF

SEQ ID NO: 2559734 - protein, 4 aa, Entamoeba histolytica
CNKL

SEQ ID NO: 2559735 - protein, 8 aa, Entamoeba histolytica
CNNDKNVN

SEQ ID NO: 2559736 - protein, 7 aa, Entamoeba histolytica
CNNENGR

SEQ ID NO: 2559737 - protein, 9 aa, Entamoeba histolytica
CNNGTYSNN

SEQ ID NO: 2559738 - protein, 9 aa, Entamoeba histolytica
CNNPKESSY

SEQ ID NO: 2559739 - protein, 4 aa, Entamoeba histolytica
CNNV

SEQ ID NO: 2559740 - protein, 11 aa, Entamoeba histolytica
CNPDRNGYFRD

SEQ ID NO: 2559741 - protein, 9 aa, Entamoeba histolytica
CNPKTTVNT

SEQ ID NO: 2559742 - protein, 6 aa, Entamoeba histolytica
CNPSAE

SEQ ID NO: 2559743 - protein, 6 aa, Entamoeba histolytica
CNPSTN

SEQ ID NO: 2559744 - protein, 4 aa, Entamoeba histolytica
CNQC

SEQ ID NO: 2559745 - protein, 21 aa, Entamoeba histolytica
CNQCADGYSLSTDKKSCNKFP

SEQ ID NO: 2559746 - protein, 8 aa, Entamoeba histolytica
CNQDNGHG

SEQ ID NO: 2559747 - protein, 7 aa, Entamoeba histolytica
CNQDTTK

SEQ ID NO: 2559748 - protein, 6 aa, Entamoeba histolytica
CNRESK

SEQ ID NO: 2559749 - protein, 11 aa, Entamoeba histolytica
CNSATDNSSNA

SEQ ID NO: 2559750 - protein, 12 aa, Entamoeba histolytica
CNSEETKNNNNK

SEQ ID NO: 2559751 - protein, 17 aa, Entamoeba histolytica
CNSGEYNGKIGAKSQIQ

SEQ ID NO: 2559752 - protein, 6 aa, Entamoeba histolytica
CNSNIN

SEQ ID NO: 2559753 - protein, 7 aa, Entamoeba histolytica
CNSPDNP

SEQ ID NO: 2559754 - protein, 11 aa, Entamoeba histolytica
CNSSSGDIDGN

SEQ ID NO: 2559755 - protein, 8 aa, Entamoeba histolytica
CNSTGDYD

SEQ ID NO: 2559756 - protein, 9 aa, Entamoeba histolytica
CNTCTDDQS

SEQ ID NO: 2559757 - protein, 7 aa, Entamoeba histolytica
CNTENGE

SEQ ID NO: 2559758 - protein, 14 aa, Entamoeba histolytica
CNTTRYTKDCNGCQ

SEQ ID NO: 2559759 - protein, 14 aa, Entamoeba histolytica
CNVQQGDSAELSNC

SEQ ID NO: 2559760 - protein, 15 aa, Entamoeba histolytica
CNYDKGHGTCSTRDK

SEQ ID NO: 2559761 - protein, 6 aa, Entamoeba histolytica
CNYGSW

SEQ ID NO: 2559762 - protein, 13 aa, Entamoeba histolytica
CPAGTHNPIKNTD

SEQ ID NO: 2559763 - protein, 6 aa, Entamoeba histolytica
CPARST

SEQ ID NO: 2559764 - protein, 17 aa, Entamoeba histolytica
CPASCSSCSYDSSKSKV

SEQ ID NO: 2559765 - protein, 6 aa, Entamoeba histolytica
CPASRG

SEQ ID NO: 2559766 - protein, 11 aa, Entamoeba histolytica
CPEKTDNGTRF

SEQ ID NO: 2559767 - protein, 4 aa, Entamoeba histolytica
CPEP

SEQ ID NO: 2559768 - protein, 4 aa, Entamoeba histolytica
CPHD

SEQ ID NO: 2559769 - protein, 9 aa, Entamoeba histolytica
CPHKGGDMD

SEQ ID NO: 2559770 - protein, 8 aa, Entamoeba histolytica
CPKTNQIP

SEQ ID NO: 2559771 - protein, 8 aa, Entamoeba histolytica
CPPGTYSD

SEQ ID NO: 2559772 - protein, 4 aa, Entamoeba histolytica
CPRL

SEQ ID NO: 2559773 - protein, 16 aa, Entamoeba histolytica
CPSDKEYVKNGKCAPC

SEQ ID NO: 2559774 - protein, 16 aa, Entamoeba histolytica
CPSEQEYVKSGKCAPC

SEQ ID NO: 2559775 - protein, 7 aa, Entamoeba histolytica
CPSPSTL

SEQ ID NO: 2559776 - protein, 7 aa, Entamoeba histolytica
CPSTTDL

SEQ ID NO: 2559777 - protein, 12 aa, Entamoeba histolytica
CPVGSASAVRNA

SEQ ID NO: 2559778 - protein, 11 aa, Entamoeba histolytica
CPVTGNEKCCS

SEQ ID NO: 2559779 - protein, 6 aa, Entamoeba histolytica
CQADNK

SEQ ID NO: 2559780 - protein, 9 aa, Entamoeba histolytica
CQAKDISKA

SEQ ID NO: 2559781 - protein, 4 aa, Entamoeba histolytica
CQDG

SEQ ID NO: 2559782 - protein, 6 aa, Entamoeba histolytica
CQDNTN

SEQ ID NO: 2559783 - protein, 10 aa, Entamoeba histolytica
CQELRKDGRF

SEQ ID NO: 2559784 - protein, 5 aa, Entamoeba histolytica
CQEST

SEQ ID NO: 2559785 - protein, 12 aa, Entamoeba histolytica
CQKDNGTSSCSI

SEQ ID NO: 2559786 - protein, 8 aa, Entamoeba histolytica
CQKSVDGD

SEQ ID NO: 2559787 - protein, 6 aa, Entamoeba histolytica
CQLSDS

SEQ ID NO: 2559788 - protein, 8 aa, Entamoeba histolytica
CQNPTIPE

SEQ ID NO: 2559789 - protein, 8 aa, Entamoeba histolytica
CQNTDKRE

SEQ ID NO: 2559790 - protein, 8 aa, Entamoeba histolytica
CQNTSSKN

SEQ ID NO: 2559791 - protein, 9 aa, Entamoeba histolytica
CQPKEKFTP

SEQ ID NO: 2559792 - protein, 5 aa, Entamoeba histolytica
CQPNE

SEQ ID NO: 2559793 - protein, 7 aa, Entamoeba histolytica
CQRCSSA

SEQ ID NO: 2559794 - protein, 12 aa, Entamoeba histolytica
CQSNGKLFTSNE

SEQ ID NO: 2559795 - protein, 12 aa, Entamoeba histolytica
CQTMKDKNYYDE

SEQ ID NO: 2559796 - protein, 4 aa, Entamoeba histolytica
CQYN

SEQ ID NO: 2559797 - protein, 11 aa, Entamoeba histolytica
CRDGCERCTTK

SEQ ID NO: 2559798 - protein, 10 aa, Entamoeba histolytica
CRHSNKCKSI

SEQ ID NO: 2559799 - protein, 9 aa, Entamoeba histolytica
CRKGMNKQT

SEQ ID NO: 2559800 - protein, 4 aa, Entamoeba histolytica
CRNG

SEQ ID NO: 2559801 - protein, 5 aa, Entamoeba histolytica
CRNST

SEQ ID NO: 2559802 - protein, 8 aa, Entamoeba histolytica
CRQEPVNK

SEQ ID NO: 2559803 - protein, 7 aa, Entamoeba histolytica
CRQPTVP

SEQ ID NO: 2559804 - protein, 6 aa, Entamoeba histolytica
CRSPEI

SEQ ID NO: 2559805 - protein, 6 aa, Entamoeba histolytica
CRSQEL

SEQ ID NO: 2559806 - protein, 7 aa, Entamoeba histolytica
CRSSKSS

SEQ ID NO: 2559807 - protein, 19 aa, Entamoeba histolytica
CRTENIKTNIKSNDQLKIK

SEQ ID NO: 2559808 - protein, 6 aa, Entamoeba histolytica
CRTPDV

SEQ ID NO: 2559809 - protein, 9 aa, Entamoeba histolytica
CSATENYET

SEQ ID NO: 2559810 - protein, 8 aa, Entamoeba histolytica
CSCDGESC

SEQ ID NO: 2559811 - protein, 14 aa, Entamoeba histolytica
CSDGFSGRSPYSNC

SEQ ID NO: 2559812 - protein, 21 aa, Entamoeba histolytica
CSDGQYLDTSGECKNCNTSKH

SEQ ID NO: 2559813 - protein, 12 aa, Entamoeba histolytica
CSDGYCTTTGCE

SEQ ID NO: 2559814 - protein, 7 aa, Entamoeba histolytica
CSDPTKI

SEQ ID NO: 2559815 - protein, 9 aa, Entamoeba histolytica
CSDSNNAEL

SEQ ID NO: 2559816 - protein, 7 aa, Entamoeba histolytica
CSDTSRV

SEQ ID NO: 2559817 - protein, 9 aa, Entamoeba histolytica
CSDTSSQQT

SEQ ID NO: 2559818 - protein, 4 aa, Entamoeba histolytica
CSEC

SEQ ID NO: 2559819 - protein, 8 aa, Entamoeba histolytica
CSEGTYSD

SEQ ID NO: 2559820 - protein, 10 aa, Entamoeba histolytica
CSEISSTADA

SEQ ID NO: 2559821 - protein, 6 aa, Entamoeba histolytica
CSEKNG

SEQ ID NO: 2559822 - protein, 7 aa, Entamoeba histolytica
CSEPNKI

SEQ ID NO: 2559823 - protein, 18 aa, Entamoeba histolytica
CSGCDGDCKGGSNGSGLG

SEQ ID NO: 2559824 - protein, 9 aa, Entamoeba histolytica
CSGENNPLP

SEQ ID NO: 2559825 - protein, 17 aa, Entamoeba histolytica
CSGGSYRRYAKEGSNEE

SEQ ID NO: 2559826 - protein, 12 aa, Entamoeba histolytica
CSGKRPPKLDSM

SEQ ID NO: 2559827 - protein, 7 aa, Entamoeba histolytica
CSGPSTC

SEQ ID NO: 2559828 - protein, 22 aa, Entamoeba histolytica
CSHGGSVGWQAPEAIKGERLTS

SEQ ID NO: 2559829 - protein, 9 aa, Entamoeba histolytica
CSKEENNSV

SEQ ID NO: 2559830 - protein, 11 aa, Entamoeba histolytica
CSKIDKNKPMS

SEQ ID NO: 2559831 - protein, 10 aa, Entamoeba histolytica
CSKNEKGKGV

SEQ ID NO: 2559832 - protein, 11 aa, Entamoeba histolytica
CSKPEKRGRNS

SEQ ID NO: 2559833 - protein, 10 aa, Entamoeba histolytica
CSKSTDSKCS

SEQ ID NO: 2559834 - protein, 9 aa, Entamoeba histolytica
CSNDSGTTL

SEQ ID NO: 2559835 - protein, 8 aa, Entamoeba histolytica
CSNESYVN

SEQ ID NO: 2559836 - protein, 6 aa, Entamoeba histolytica
CSNGKW

SEQ ID NO: 2559837 - protein, 21 aa, Entamoeba histolytica
CSNMNKDTIEEEIKKSKTDIL

SEQ ID NO: 2559838 - protein, 9 aa, Entamoeba histolytica
CSNPSKYSF

SEQ ID NO: 2559839 - protein, 10 aa, Entamoeba histolytica
CSNRTSEIDC

SEQ ID NO: 2559840 - protein, 11 aa, Entamoeba histolytica
CSNSDLSSDNF

SEQ ID NO: 2559841 - protein, 5 aa, Entamoeba histolytica
CSNTK

SEQ ID NO: 2559842 - protein, 4 aa, Entamoeba histolytica
CSPG

SEQ ID NO: 2559843 - protein, 14 aa, Entamoeba histolytica
CSPGCSSSCVSDGN

SEQ ID NO: 2559844 - protein, 10 aa, Entamoeba histolytica
CSPKEVSTSL

SEQ ID NO: 2559845 - protein, 7 aa, Entamoeba histolytica
CSPQDKK

SEQ ID NO: 2559846 - protein, 8 aa, Entamoeba histolytica
CSPQDKKR

SEQ ID NO: 2559847 - protein, 8 aa, Entamoeba histolytica
CSPQDKQR

SEQ ID NO: 2559848 - protein, 9 aa, Entamoeba histolytica
CSQLERADG

SEQ ID NO: 2559849 - protein, 4 aa, Entamoeba histolytica
CSSC

SEQ ID NO: 2559850 - protein, 4 aa, Entamoeba histolytica
CSSD

SEQ ID NO: 2559851 - protein, 9 aa, Entamoeba histolytica
CSSDDNNLK

SEQ ID NO: 2559852 - protein, 15 aa, Entamoeba histolytica
CSSDGSLIQRSLIYF

SEQ ID NO: 2559853 - protein, 25 aa, Entamoeba histolytica
CSSECTSQCYGESDLCDKDNKKCSD

SEQ ID NO: 2559854 - protein, 7 aa, Entamoeba histolytica
CSSGITD

SEQ ID NO: 2559855 - protein, 10 aa, Entamoeba histolytica
CSSGYENDHS

SEQ ID NO: 2559856 - protein, 12 aa, Entamoeba histolytica
CSSGYTPKGKYC

SEQ ID NO: 2559857 - protein, 11 aa, Entamoeba histolytica
CSSHTGKCECN

SEQ ID NO: 2559858 - protein, 7 aa, Entamoeba histolytica
CSSKTTM

SEQ ID NO: 2559859 - protein, 5 aa, Entamoeba histolytica
CSSNS

SEQ ID NO: 2559860 - protein, 9 aa, Entamoeba histolytica
CSSNTADVG

SEQ ID NO: 2559861 - protein, 10 aa, Entamoeba histolytica
CSSRTTEDDC

SEQ ID NO: 2559862 - protein, 11 aa, Entamoeba histolytica
CSSSDACEKCK

SEQ ID NO: 2559863 - protein, 6 aa, Entamoeba histolytica
CSSSNT

SEQ ID NO: 2559864 - protein, 5 aa, Entamoeba histolytica
CSSSQ

SEQ ID NO: 2559865 - protein, 7 aa, Entamoeba histolytica
CSSTDSK

SEQ ID NO: 2559866 - protein, 8 aa, Entamoeba histolytica
CSSTKSNC

SEQ ID NO: 2559867 - protein, 13 aa, Entamoeba histolytica
CSSTLNGKCNSCE

SEQ ID NO: 2559868 - protein, 11 aa, Entamoeba histolytica
CSSTSSGSTQF

SEQ ID NO: 2559869 - protein, 7 aa, Entamoeba histolytica
CSTCNQK

SEQ ID NO: 2559870 - protein, 8 aa, Entamoeba histolytica
CSTCSQTE

SEQ ID NO: 2559871 - protein, 4 aa, Entamoeba histolytica
CSTD

SEQ ID NO: 2559872 - protein, 7 aa, Entamoeba histolytica
CSTGTEI

SEQ ID NO: 2559873 - protein, 6 aa, Entamoeba histolytica
CSTNYR

SEQ ID NO: 2559874 - protein, 8 aa, Entamoeba histolytica
CSTSSGQC

SEQ ID NO: 2559875 - protein, 7 aa, Entamoeba histolytica
CSTTSTE

SEQ ID NO: 2559876 - protein, 6 aa, Entamoeba histolytica
CSYDSP

SEQ ID NO: 2559877 - protein, 11 aa, Entamoeba histolytica
CSYPDSSNCTI

SEQ ID NO: 2559878 - protein, 11 aa, Entamoeba histolytica
CTAPNQCGSCD

SEQ ID NO: 2559879 - protein, 12 aa, Entamoeba histolytica
CTDDIKPSSIIE

SEQ ID NO: 2559880 - protein, 11 aa, Entamoeba histolytica
CTEKTKNGCSV

SEQ ID NO: 2559881 - protein, 10 aa, Entamoeba histolytica
CTESSPKTHY

SEQ ID NO: 2559882 - protein, 4 aa, Entamoeba histolytica
CTEY

SEQ ID NO: 2559883 - protein, 7 aa, Entamoeba histolytica
CTGDTLE

SEQ ID NO: 2559884 - protein, 6 aa, Entamoeba histolytica
CTHRDN

SEQ ID NO: 2559885 - protein, 4 aa, Entamoeba histolytica
CTKA

SEQ ID NO: 2559886 - protein, 4 aa, Entamoeba histolytica
CTKC

SEQ ID NO: 2559887 - protein, 7 aa, Entamoeba histolytica
CTKCETN

SEQ ID NO: 2559888 - protein, 16 aa, Entamoeba histolytica
CTKCGNGVLDDGEECE

SEQ ID NO: 2559889 - protein, 8 aa, Entamoeba histolytica
CTKESDEC

SEQ ID NO: 2559890 - protein, 5 aa, Entamoeba histolytica
CTKGN

SEQ ID NO: 2559891 - protein, 6 aa, Entamoeba histolytica
CTNGNE

SEQ ID NO: 2559892 - protein, 11 aa, Entamoeba histolytica
CTNKESYVELP

SEQ ID NO: 2559893 - protein, 11 aa, Entamoeba histolytica
CTNTLSKTQKL

SEQ ID NO: 2559894 - protein, 7 aa, Entamoeba histolytica
CTPEEKF

SEQ ID NO: 2559895 - protein, 7 aa, Entamoeba histolytica
CTPPALN

SEQ ID NO: 2559896 - protein, 4 aa, Entamoeba histolytica
CTPS

SEQ ID NO: 2559897 - protein, 8 aa, Entamoeba histolytica
CTQEANFG

SEQ ID NO: 2559898 - protein, 12 aa, Entamoeba histolytica
CTQKSSKGCEEC

SEQ ID NO: 2559899 - protein, 5 aa, Entamoeba histolytica
CTRCT

SEQ ID NO: 2559900 - protein, 6 aa, Entamoeba histolytica
CTRDEI

SEQ ID NO: 2559901 - protein, 5 aa, Entamoeba histolytica
CTREC

SEQ ID NO: 2559902 - protein, 12 aa, Entamoeba histolytica
CTRRYKPNGNVS

SEQ ID NO: 2559903 - protein, 6 aa, Entamoeba histolytica
CTSAYS

SEQ ID NO: 2559904 - protein, 5 aa, Entamoeba histolytica
CTSCQ

SEQ ID NO: 2559905 - protein, 12 aa, Entamoeba histolytica
CTSNSKCEMNNN

SEQ ID NO: 2559906 - protein, 10 aa, Entamoeba histolytica
CTTCKKGNYL

SEQ ID NO: 2559907 - protein, 8 aa, Entamoeba histolytica
CTTCQRDA

SEQ ID NO: 2559908 - protein, 7 aa, Entamoeba histolytica
CTTFTEP

SEQ ID NO: 2559909 - protein, 5 aa, Entamoeba histolytica
CTTIT

SEQ ID NO: 2559910 - protein, 6 aa, Entamoeba histolytica
CTTQDE

SEQ ID NO: 2559911 - protein, 9 aa, Entamoeba histolytica
CTYGNDASK

SEQ ID NO: 2559912 - protein, 11 aa, Entamoeba histolytica
CTYTNSKFNEY

SEQ ID NO: 2559913 - protein, 4 aa, Entamoeba histolytica
CVER

SEQ ID NO: 2559914 - protein, 13 aa, Entamoeba histolytica
CVKPKSKNTRSFS

SEQ ID NO: 2559915 - protein, 14 aa, Entamoeba histolytica
CVKQPSASLVSPNG

SEQ ID NO: 2559916 - protein, 7 aa, Entamoeba histolytica
CVSKQQD

SEQ ID NO: 2559917 - protein, 6 aa, Entamoeba histolytica
CYGEPT

SEQ ID NO: 2559918 - protein, 4 aa, Entamoeba histolytica
CYNK

SEQ ID NO: 2559919 - protein, 6 aa, Entamoeba histolytica
CYPGDT

SEQ ID NO: 2559920 - protein, 7 aa, Entamoeba histolytica
CYPSVTS

SEQ ID NO: 2559921 - protein, 4 aa, Entamoeba histolytica
CYRN

SEQ ID NO: 2559922 - protein, 5 aa, Entamoeba histolytica
DAAEK

SEQ ID NO: 2559923 - protein, 8 aa, Entamoeba histolytica
DAASSTHI

SEQ ID NO: 2559924 - protein, 8 aa, Entamoeba histolytica
DAASSTHL

SEQ ID NO: 2559925 - protein, 4 aa, Entamoeba histolytica
DADS

SEQ ID NO: 2559926 - protein, 7 aa, Entamoeba histolytica
DAEFDRH

SEQ ID NO: 2559927 - protein, 5 aa, Entamoeba histolytica
DAELR

SEQ ID NO: 2559928 - protein, 4 aa, Entamoeba histolytica
DAEP

SEQ ID NO: 2559929 - protein, 9 aa, Entamoeba histolytica
DAEPEHPSN

SEQ ID NO: 2559930 - protein, 15 aa, Entamoeba histolytica
DAETSPDCQSYTRPS

SEQ ID NO: 2559931 - protein, 4 aa, Entamoeba histolytica
DAGD

SEQ ID NO: 2559932 - protein, 10 aa, Entamoeba histolytica
DAGKPKKAEE

SEQ ID NO: 2559933 - protein, 9 aa, Entamoeba histolytica
DAGNFQRSK

SEQ ID NO: 2559934 - protein, 7 aa, Entamoeba histolytica
DAGQSPT

SEQ ID NO: 2559935 - protein, 9 aa, Entamoeba histolytica
DAGRTQVVP

SEQ ID NO: 2559936 - protein, 6 aa, Entamoeba histolytica
DAIESV

SEQ ID NO: 2559937 - protein, 25 aa, Entamoeba histolytica
DAIKNNTKYDYEEEQKKEEESKKIQ

SEQ ID NO: 2559938 - protein, 7 aa, Entamoeba histolytica
DAITPVN

SEQ ID NO: 2559939 - protein, 11 aa, Entamoeba histolytica
DAKETEKKDYI

SEQ ID NO: 2559940 - protein, 15 aa, Entamoeba histolytica
DAKNVKQYKEAVNNA

SEQ ID NO: 2559941 - protein, 6 aa, Entamoeba histolytica
DAKRNP

SEQ ID NO: 2559942 - protein, 11 aa, Entamoeba histolytica
DAKRRKKVQND

SEQ ID NO: 2559943 - protein, 8 aa, Entamoeba histolytica
DALPNKKG

SEQ ID NO: 2559944 - protein, 9 aa, Entamoeba histolytica
DANGCTTCN

SEQ ID NO: 2559945 - protein, 12 aa, Entamoeba histolytica
DANNAESSKKCY

SEQ ID NO: 2559946 - protein, 6 aa, Entamoeba histolytica
DANPTA

SEQ ID NO: 2559947 - protein, 4 aa, Entamoeba histolytica
DANY

SEQ ID NO: 2559948 - protein, 6 aa, Entamoeba histolytica
DAPNHL

SEQ ID NO: 2559949 - protein, 7 aa, Entamoeba histolytica
DAPNHPE

SEQ ID NO: 2559950 - protein, 7 aa, Entamoeba histolytica
DAPNPRF

SEQ ID NO: 2559951 - protein, 5 aa, Entamoeba histolytica
DAPNY

SEQ ID NO: 2559952 - protein, 5 aa, Entamoeba histolytica
DAPSF

SEQ ID NO: 2559953 - protein, 20 aa, Entamoeba histolytica
DAPSRKASTSGVDESDNSNE

SEQ ID NO: 2559954 - protein, 6 aa, Entamoeba histolytica
DAQNEF

SEQ ID NO: 2559955 - protein, 15 aa, Entamoeba histolytica
DAQPSSIDNQTSSIS

SEQ ID NO: 2559956 - protein, 5 aa, Entamoeba histolytica
DAREE

SEQ ID NO: 2559957 - protein, 4 aa, Entamoeba histolytica
DARG

SEQ ID NO: 2559958 - protein, 8 aa, Entamoeba histolytica
DASESEGI

SEQ ID NO: 2559959 - protein, 9 aa, Entamoeba histolytica
DASGVEGGI

SEQ ID NO: 2559960 - protein, 4 aa, Entamoeba histolytica
DASR

SEQ ID NO: 2559961 - protein, 11 aa, Entamoeba histolytica
DASSKAKEGNA

SEQ ID NO: 2559962 - protein, 9 aa, Entamoeba histolytica
DASTGNQCK

SEQ ID NO: 2559963 - protein, 8 aa, Entamoeba histolytica
DATEYNEE

SEQ ID NO: 2559964 - protein, 17 aa, Entamoeba histolytica
DAVKNNQDTPVSKINGK

SEQ ID NO: 2559965 - protein, 4 aa, Entamoeba histolytica
DAYD

SEQ ID NO: 2559966 - protein, 8 aa, Entamoeba histolytica
DAYDNNDL

SEQ ID NO: 2559967 - protein, 7 aa, Entamoeba histolytica
DAYLPTE

SEQ ID NO: 2559968 - protein, 11 aa, Entamoeba histolytica
DAYSGNTIKRT

SEQ ID NO: 2559969 - protein, 6 aa, Entamoeba histolytica
DCGGQN

SEQ ID NO: 2559970 - protein, 9 aa, Entamoeba histolytica
DCGSGEKEY

SEQ ID NO: 2559971 - protein, 7 aa, Entamoeba histolytica
DCLPSRS

SEQ ID NO: 2559972 - protein, 5 aa, Entamoeba histolytica
DCMPS

SEQ ID NO: 2559973 - protein, 13 aa, Entamoeba histolytica
DCNPSGDKFEDGF

SEQ ID NO: 2559974 - protein, 14 aa, Entamoeba histolytica
DCNQSGNTFDGGFN

SEQ ID NO: 2559975 - protein, 7 aa, Entamoeba histolytica
DCNRETK

SEQ ID NO: 2559976 - protein, 8 aa, Entamoeba histolytica
DCNSAPAK

SEQ ID NO: 2559977 - protein, 12 aa, Entamoeba histolytica
DCSNEASASGLL

SEQ ID NO: 2559978 - protein, 6 aa, Entamoeba histolytica
DCSRTG

SEQ ID NO: 2559979 - protein, 11 aa, Entamoeba histolytica
DCSVDKPDITY

SEQ ID NO: 2559980 - protein, 5 aa, Entamoeba histolytica
DCTQE

SEQ ID NO: 2559981 - protein, 4 aa, Entamoeba histolytica
DCTV

SEQ ID NO: 2559982 - protein, 10 aa, Entamoeba histolytica
DDAPSNQTEE

SEQ ID NO: 2559983 - protein, 7 aa, Entamoeba histolytica
DDAQEGD

SEQ ID NO: 2559984 - protein, 6 aa, Entamoeba histolytica
DDCANG

SEQ ID NO: 2559985 - protein, 6 aa, Entamoeba histolytica
DDDEAL

SEQ ID NO: 2559986 - protein, 9 aa, Entamoeba histolytica
DDDELTRYG

SEQ ID NO: 2559987 - protein, 7 aa, Entamoeba histolytica
DDDQFHR

SEQ ID NO: 2559988 - protein, 21 aa, Entamoeba histolytica
DDDTKTKCIRSRTDGCGENSK

SEQ ID NO: 2559989 - protein, 8 aa, Entamoeba histolytica
DDEAITNA

SEQ ID NO: 2559990 - protein, 5 aa, Entamoeba histolytica
DDEDF

SEQ ID NO: 2559991 - protein, 11 aa, Entamoeba histolytica
DDEETKKTQGI

SEQ ID NO: 2559992 - protein, 5 aa, Entamoeba histolytica
DDEGI

SEQ ID NO: 2559993 - protein, 12 aa, Entamoeba histolytica
DDEKGNDLIVID

SEQ ID NO: 2559994 - protein, 4 aa, Entamoeba histolytica
DDEM

SEQ ID NO: 2559995 - protein, 20 aa, Entamoeba histolytica
DDEPITLKDDNSSSNFHEKQ

SEQ ID NO: 2559996 - protein, 4 aa, Entamoeba histolytica
DDES

SEQ ID NO: 2559997 - protein, 7 aa, Entamoeba histolytica
DDESITH

SEQ ID NO: 2559998 - protein, 4 aa, Entamoeba histolytica
DDET

SEQ ID NO: 2559999 - protein, 16 aa, Entamoeba histolytica
DDETEETQKQPLPEND

SEQ ID NO: 2560000 - protein, 4 aa, Entamoeba histolytica
DDEY

SEQ ID NO: 2560001 - protein, 10 aa, Entamoeba histolytica
DDGCGKTSYS

SEQ ID NO: 2560002 - protein, 6 aa, Entamoeba histolytica
DDGENF

SEQ ID NO: 2560003 - protein, 7 aa, Entamoeba histolytica
DDGSSAK

SEQ ID NO: 2560004 - protein, 7 aa, Entamoeba histolytica
DDGTNDK

SEQ ID NO: 2560005 - protein, 7 aa, Entamoeba histolytica
DDHRTNW

SEQ ID NO: 2560006 - protein, 5 aa, Entamoeba histolytica
DDHST

SEQ ID NO: 2560007 - protein, 7 aa, Entamoeba histolytica
DDIDNTV

SEQ ID NO: 2560008 - protein, 6 aa, Entamoeba histolytica
DDIPTN

SEQ ID NO: 2560009 - protein, 13 aa, Entamoeba histolytica
DDISKFDGINEQE

SEQ ID NO: 2560010 - protein, 6 aa, Entamoeba histolytica
DDISTN

SEQ ID NO: 2560011 - protein, 8 aa, Entamoeba histolytica
DDITEETI

SEQ ID NO: 2560012 - protein, 9 aa, Entamoeba histolytica
DDKDDITDW

SEQ ID NO: 2560013 - protein, 6 aa, Entamoeba histolytica
DDKGEL

SEQ ID NO: 2560014 - protein, 8 aa, Entamoeba histolytica
DDKHKGNM

SEQ ID NO: 2560015 - protein, 7 aa, Entamoeba histolytica
DDKINET

SEQ ID NO: 2560016 - protein, 32 aa, Entamoeba histolytica
DDKKETKESKPFEPVNPQQQELEKPKKEEVKM

SEQ ID NO: 2560017 - protein, 24 aa, Entamoeba histolytica
DDKKKEEQNNINECNQKSKLNEEF

SEQ ID NO: 2560018 - protein, 5 aa, Entamoeba histolytica
DDKKS

SEQ ID NO: 2560019 - protein, 10 aa, Entamoeba histolytica
DDKNGGNHQI

SEQ ID NO: 2560020 - protein, 5 aa, Entamoeba histolytica
DDLAR

SEQ ID NO: 2560021 - protein, 15 aa, Entamoeba histolytica
DDLEPNTSEDCEFEN

SEQ ID NO: 2560022 - protein, 6 aa, Entamoeba histolytica
DDLKGR

SEQ ID NO: 2560023 - protein, 5 aa, Entamoeba histolytica
DDLPG

SEQ ID NO: 2560024 - protein, 5 aa, Entamoeba histolytica
DDLRQ

SEQ ID NO: 2560025 - protein, 5 aa, Entamoeba histolytica
DDLTP

SEQ ID NO: 2560026 - protein, 5 aa, Entamoeba histolytica
DDNFG

SEQ ID NO: 2560027 - protein, 9 aa, Entamoeba histolytica
DDNNKETAK

SEQ ID NO: 2560028 - protein, 7 aa, Entamoeba histolytica
DDNNLKE

SEQ ID NO: 2560029 - protein, 8 aa, Entamoeba histolytica
DDNNPLKA

SEQ ID NO: 2560030 - protein, 5 aa, Entamoeba histolytica
DDNRT

SEQ ID NO: 2560031 - protein, 7 aa, Entamoeba histolytica
DDNRTEC

SEQ ID NO: 2560032 - protein, 24 aa, Entamoeba histolytica
DDNSGSSDSQMSGSEIKQQQRQGF

SEQ ID NO: 2560033 - protein, 5 aa, Entamoeba histolytica
DDNYA

SEQ ID NO: 2560034 - protein, 4 aa, Entamoeba histolytica
DDPF

SEQ ID NO: 2560035 - protein, 26 aa, Entamoeba histolytica
DDPNNTSYSLTSSSYPNNVNNNEPFS

SEQ ID NO: 2560036 - protein, 8 aa, Entamoeba histolytica
DDPQNKTF

SEQ ID NO: 2560037 - protein, 9 aa, Entamoeba histolytica
DDQNKETAK

SEQ ID NO: 2560038 - protein, 8 aa, Entamoeba histolytica
DDQNTSVT

SEQ ID NO: 2560039 - protein, 6 aa, Entamoeba histolytica
DDQSYS

SEQ ID NO: 2560040 - protein, 5 aa, Entamoeba histolytica
DDQTR

SEQ ID NO: 2560041 - protein, 4 aa, Entamoeba histolytica
DDRT

SEQ ID NO: 2560042 - protein, 8 aa, Entamoeba histolytica
DDSEINSS

SEQ ID NO: 2560043 - protein, 7 aa, Entamoeba histolytica
DDSETIS

SEQ ID NO: 2560044 - protein, 19 aa, Entamoeba histolytica
DDSIQESPKNATNVQQQVQ

SEQ ID NO: 2560045 - protein, 14 aa, Entamoeba histolytica
DDSLRQGNSSCVGT

SEQ ID NO: 2560046 - protein, 9 aa, Entamoeba histolytica
DDSNHTNID

SEQ ID NO: 2560047 - protein, 9 aa, Entamoeba histolytica
DDSPSGGTK

SEQ ID NO: 2560048 - protein, 10 aa, Entamoeba histolytica
DDSSKKSQEE

SEQ ID NO: 2560049 - protein, 6 aa, Entamoeba histolytica
DDSSVD

SEQ ID NO: 2560050 - protein, 7 aa, Entamoeba histolytica
DDTCEKA

SEQ ID NO: 2560051 - protein, 5 aa, Entamoeba histolytica
DDTPY

SEQ ID NO: 2560052 - protein, 10 aa, Entamoeba histolytica
DDTSNQKRPK

SEQ ID NO: 2560053 - protein, 6 aa, Entamoeba histolytica
DDVEPT

SEQ ID NO: 2560054 - protein, 5 aa, Entamoeba histolytica
DDVLT

SEQ ID NO: 2560055 - protein, 10 aa, Entamoeba histolytica
DDVSTTNSSE

SEQ ID NO: 2560056 - protein, 4 aa, Entamoeba histolytica
DDVT

SEQ ID NO: 2560057 - protein, 23 aa, Entamoeba histolytica
DDYDALSKELTQSLQEQGKLKAQ

SEQ ID NO: 2560058 - protein, 4 aa, Entamoeba histolytica
DDYP

SEQ ID NO: 2560059 - protein, 9 aa, Entamoeba histolytica
DDYQEDVSK

SEQ ID NO: 2560060 - protein, 13 aa, Entamoeba histolytica
DEAPIGSPIINDK

SEQ ID NO: 2560061 - protein, 7 aa, Entamoeba histolytica
DEDAPNH

SEQ ID NO: 2560062 - protein, 12 aa, Entamoeba histolytica
DEDDNKCSHQNN

SEQ ID NO: 2560063 - protein, 14 aa, Entamoeba histolytica
DEDESIPKKSVKQH

SEQ ID NO: 2560064 - protein, 8 aa, Entamoeba histolytica
DEDEYYDT

SEQ ID NO: 2560065 - protein, 4 aa, Entamoeba histolytica
DEDK

SEQ ID NO: 2560066 - protein, 8 aa, Entamoeba histolytica
DEDKEELE

SEQ ID NO: 2560067 - protein, 13 aa, Entamoeba histolytica
DEDNTVEIKKAPK

SEQ ID NO: 2560068 - protein, 5 aa, Entamoeba histolytica
DEDNY

SEQ ID NO: 2560069 - protein, 11 aa, Entamoeba histolytica
DEEALKDQDGI

SEQ ID NO: 2560070 - protein, 6 aa, Entamoeba histolytica
DEEGGL

SEQ ID NO: 2560071 - protein, 6 aa, Entamoeba histolytica
DEEGIS

SEQ ID NO: 2560072 - protein, 11 aa, Entamoeba histolytica
DEEGKTIGLGT

SEQ ID NO: 2560073 - protein, 10 aa, Entamoeba histolytica
DEEGNSPNAI

SEQ ID NO: 2560074 - protein, 9 aa, Entamoeba histolytica
DEEHPEGDT

SEQ ID NO: 2560075 - protein, 5 aa, Entamoeba histolytica
DEEIN

SEQ ID NO: 2560076 - protein, 4 aa, Entamoeba histolytica
DEEK

SEQ ID NO: 2560077 - protein, 12 aa, Entamoeba histolytica
DEEKNFKRQGDD

SEQ ID NO: 2560078 - protein, 11 aa, Entamoeba histolytica
DEENTNDPKRW

SEQ ID NO: 2560079 - protein, 6 aa, Entamoeba histolytica
DEENWD

SEQ ID NO: 2560080 - protein, 11 aa, Entamoeba histolytica
DEENYTNETDA

SEQ ID NO: 2560081 - protein, 8 aa, Entamoeba histolytica
DEEPNGVS

SEQ ID NO: 2560082 - protein, 5 aa, Entamoeba histolytica
DEEQG

SEQ ID NO: 2560083 - protein, 8 aa, Entamoeba histolytica
DEETGCIE

SEQ ID NO: 2560084 - protein, 8 aa, Entamoeba histolytica
DEEYRDDS

SEQ ID NO: 2560085 - protein, 13 aa, Entamoeba histolytica
DEFDPNKLTDSPK

SEQ ID NO: 2560086 - protein, 27 aa, Entamoeba histolytica
DEFEPKEYEVGDEEDEQNTTMPPEEEE

SEQ ID NO: 2560087 - protein, 25 aa, Entamoeba histolytica
DEFGQDDSSNDEEKEIIEKQKPQSI

SEQ ID NO: 2560088 - protein, 14 aa, Entamoeba histolytica
DEGCSSCDKKNGKC

SEQ ID NO: 2560089 - protein, 11 aa, Entamoeba histolytica
DEGKKIKDGTI

SEQ ID NO: 2560090 - protein, 5 aa, Entamoeba histolytica
DEGLN

SEQ ID NO: 2560091 - protein, 16 aa, Entamoeba histolytica
DEGLPKKWKQNEDLSK

SEQ ID NO: 2560092 - protein, 14 aa, Entamoeba histolytica
DEGSETEELEQKEN

SEQ ID NO: 2560093 - protein, 5 aa, Entamoeba histolytica
DEGYE

SEQ ID NO: 2560094 - protein, 13 aa, Entamoeba histolytica
DEIDENEMNIHKE

SEQ ID NO: 2560095 - protein, 9 aa, Entamoeba histolytica
DEIKGKPHN

SEQ ID NO: 2560096 - protein, 37 aa, Entamoeba histolytica
DEIKNNETKENESINIDNKKSQNSFELSTNGSSKIEE

SEQ ID NO: 2560097 - protein, 12 aa, Entamoeba histolytica
DEIPRNQSKACD

SEQ ID NO: 2560098 - protein, 13 aa, Entamoeba histolytica
DEIQEEKQIGEGS

SEQ ID NO: 2560099 - protein, 20 aa, Entamoeba histolytica
DEITDNNEEYANDSNDNINS

SEQ ID NO: 2560100 - protein, 7 aa, Entamoeba histolytica
DEKAYST

SEQ ID NO: 2560101 - protein, 6 aa, Entamoeba histolytica
DEKDKR

SEQ ID NO: 2560102 - protein, 12 aa, Entamoeba histolytica
DEKFSSQSPDEE

SEQ ID NO: 2560103 - protein, 11 aa, Entamoeba histolytica
DEKGTIAAAAT

SEQ ID NO: 2560104 - protein, 32 aa, Entamoeba histolytica
DEKGTINDQTSVPIEDTPNKSTETPDPTQNVG

SEQ ID NO: 2560105 - protein, 7 aa, Entamoeba histolytica
DEKGYRS

SEQ ID NO: 2560106 - protein, 4 aa, Entamoeba histolytica
DEKI

SEQ ID NO: 2560107 - protein, 18 aa, Entamoeba histolytica
DEKIEGAEVRNSSIPEEL

SEQ ID NO: 2560108 - protein, 5 aa, Entamoeba histolytica
DEKKG

SEQ ID NO: 2560109 - protein, 5 aa, Entamoeba histolytica
DEKKR

SEQ ID NO: 2560110 - protein, 10 aa, Entamoeba histolytica
DEKKSNNKII

SEQ ID NO: 2560111 - protein, 11 aa, Entamoeba histolytica
DEKLPQSNKIE

SEQ ID NO: 2560112 - protein, 7 aa, Entamoeba histolytica
DEKNTKT

SEQ ID NO: 2560113 - protein, 4 aa, Entamoeba histolytica
DEKP

SEQ ID NO: 2560114 - protein, 12 aa, Entamoeba histolytica
DEKSEDNDHDLF

SEQ ID NO: 2560115 - protein, 4 aa, Entamoeba histolytica
DELG

SEQ ID NO: 2560116 - protein, 30 aa, Entamoeba histolytica
DELGGNNKDEWGDDFGETPIEVGEKKPIEV

SEQ ID NO: 2560117 - protein, 9 aa, Entamoeba histolytica
DELNDHSNY

SEQ ID NO: 2560118 - protein, 5 aa, Entamoeba histolytica
DELPQ

SEQ ID NO: 2560119 - protein, 9 aa, Entamoeba histolytica
DELQDDVQQ

SEQ ID NO: 2560120 - protein, 8 aa, Entamoeba histolytica
DELQEDVQ

SEQ ID NO: 2560121 - protein, 4 aa, Entamoeba histolytica
DELR

SEQ ID NO: 2560122 - protein, 19 aa, Entamoeba histolytica
DENAPDAGQCWSSNNTNGS

SEQ ID NO: 2560123 - protein, 5 aa, Entamoeba histolytica
DENAY

SEQ ID NO: 2560124 - protein, 4 aa, Entamoeba histolytica
DENC

SEQ ID NO: 2560125 - protein, 5 aa, Entamoeba histolytica
DENCA

SEQ ID NO: 2560126 - protein, 9 aa, Entamoeba histolytica
DENCTHPDN

SEQ ID NO: 2560127 - protein, 6 aa, Entamoeba histolytica
DENDDP

SEQ ID NO: 2560128 - protein, 5 aa, Entamoeba histolytica
DENEE

SEQ ID NO: 2560129 - protein, 8 aa, Entamoeba histolytica
DENEEEYG

SEQ ID NO: 2560130 - protein, 4 aa, Entamoeba histolytica
DENN

SEQ ID NO: 2560131 - protein, 7 aa, Entamoeba histolytica
DENNGPI

SEQ ID NO: 2560132 - protein, 7 aa, Entamoeba histolytica
DENNQWN

SEQ ID NO: 2560133 - protein, 9 aa, Entamoeba histolytica
DENPSSNQL

SEQ ID NO: 2560134 - protein, 4 aa, Entamoeba histolytica
DEPE

SEQ ID NO: 2560135 - protein, 12 aa, Entamoeba histolytica
DEPLDSSKAYDA

SEQ ID NO: 2560136 - protein, 14 aa, Entamoeba histolytica
DEPMKSSLEEPATT

SEQ ID NO: 2560137 - protein, 7 aa, Entamoeba histolytica
DEPNKRM

SEQ ID NO: 2560138 - protein, 8 aa, Entamoeba histolytica
DEPSTSCV

SEQ ID NO: 2560139 - protein, 5 aa, Entamoeba histolytica
DEPTF

SEQ ID NO: 2560140 - protein, 8 aa, Entamoeba histolytica
DEPVAEGA

SEQ ID NO: 2560141 - protein, 7 aa, Entamoeba histolytica
DEPVQTT

SEQ ID NO: 2560142 - protein, 23 aa, Entamoeba histolytica
DEQIKNRNSDETENELEQAVMVD

SEQ ID NO: 2560143 - protein, 6 aa, Entamoeba histolytica
DEQKEN

SEQ ID NO: 2560144 - protein, 6 aa, Entamoeba histolytica
DEQKQQ

SEQ ID NO: 2560145 - protein, 14 aa, Entamoeba histolytica
DEQPMYDKDGQYVP

SEQ ID NO: 2560146 - protein, 7 aa, Entamoeba histolytica
DEQTEQK

SEQ ID NO: 2560147 - protein, 5 aa, Entamoeba histolytica
DERDS

SEQ ID NO: 2560148 - protein, 16 aa, Entamoeba histolytica
DERSTSPNALSETSDA

SEQ ID NO: 2560149 - protein, 4 aa, Entamoeba histolytica
DERT

SEQ ID NO: 2560150 - protein, 5 aa, Entamoeba histolytica
DERTI

SEQ ID NO: 2560151 - protein, 5 aa, Entamoeba histolytica
DESAY

SEQ ID NO: 2560152 - protein, 10 aa, Entamoeba histolytica
DESDDLPYCG

SEQ ID NO: 2560153 - protein, 6 aa, Entamoeba histolytica
DESKYT

SEQ ID NO: 2560154 - protein, 75 aa, Entamoeba histolytica
DESLSDNSSEHDDSENSLSSDSSSISESSETSSSHGSTETSSETSETQNSESNSMTNDSDDSNNNADNDNGLSGG

SEQ ID NO: 2560155 - protein, 9 aa, Entamoeba histolytica
DESNGTSIR

SEQ ID NO: 2560156 - protein, 9 aa, Entamoeba histolytica
DESNNYDKN

SEQ ID NO: 2560157 - protein, 6 aa, Entamoeba histolytica
DESNPL

SEQ ID NO: 2560158 - protein, 10 aa, Entamoeba histolytica
DESSYKNVSS

SEQ ID NO: 2560159 - protein, 4 aa, Entamoeba histolytica
DESY

SEQ ID NO: 2560160 - protein, 5 aa, Entamoeba histolytica
DESYD

SEQ ID NO: 2560161 - protein, 7 aa, Entamoeba histolytica
DETEANK

SEQ ID NO: 2560162 - protein, 6 aa, Entamoeba histolytica
DETEGQ

SEQ ID NO: 2560163 - protein, 17 aa, Entamoeba histolytica
DETETNKTEQQNHQEID

SEQ ID NO: 2560164 - protein, 12 aa, Entamoeba histolytica
DETEVEQDPREL

SEQ ID NO: 2560165 - protein, 7 aa, Entamoeba histolytica
DETMKTY

SEQ ID NO: 2560166 - protein, 7 aa, Entamoeba histolytica
DETNDVD

SEQ ID NO: 2560167 - protein, 7 aa, Entamoeba histolytica
DETNEPE

SEQ ID NO: 2560168 - protein, 5 aa, Entamoeba histolytica
DETNK

SEQ ID NO: 2560169 - protein, 8 aa, Entamoeba histolytica
DETQTNPS

SEQ ID NO: 2560170 - protein, 5 aa, Entamoeba histolytica
DETTG

SEQ ID NO: 2560171 - protein, 6 aa, Entamoeba histolytica
DETTKH

SEQ ID NO: 2560172 - protein, 6 aa, Entamoeba histolytica
DETYAG

SEQ ID NO: 2560173 - protein, 4 aa, Entamoeba histolytica
DEVN

SEQ ID NO: 2560174 - protein, 6 aa, Entamoeba histolytica
DEVSNE

SEQ ID NO: 2560175 - protein, 4 aa, Entamoeba histolytica
DEWQ

SEQ ID NO: 2560176 - protein, 5 aa, Entamoeba histolytica
DEWYS

SEQ ID NO: 2560177 - protein, 10 aa, Entamoeba histolytica
DEYGTTTEQK

SEQ ID NO: 2560178 - protein, 6 aa, Entamoeba histolytica
DEYIPP

SEQ ID NO: 2560179 - protein, 9 aa, Entamoeba histolytica
DEYKENITN

SEQ ID NO: 2560180 - protein, 7 aa, Entamoeba histolytica
DEYNNTT

SEQ ID NO: 2560181 - protein, 5 aa, Entamoeba histolytica
DEYNP

SEQ ID NO: 2560182 - protein, 9 aa, Entamoeba histolytica
DEYNTEKEI

SEQ ID NO: 2560183 - protein, 6 aa, Entamoeba histolytica
DFAIEG

SEQ ID NO: 2560184 - protein, 8 aa, Entamoeba histolytica
DFDDGECT

SEQ ID NO: 2560185 - protein, 5 aa, Entamoeba histolytica
DFDET

SEQ ID NO: 2560186 - protein, 11 aa, Entamoeba histolytica
DFDKKSDNHYL

SEQ ID NO: 2560187 - protein, 6 aa, Entamoeba histolytica
DFDPED

SEQ ID NO: 2560188 - protein, 6 aa, Entamoeba histolytica
DFEGND

SEQ ID NO: 2560189 - protein, 11 aa, Entamoeba histolytica
DFETGTASYKS

SEQ ID NO: 2560190 - protein, 13 aa, Entamoeba histolytica
DFETWNEKDKENM

SEQ ID NO: 2560191 - protein, 4 aa, Entamoeba histolytica
DFGG

SEQ ID NO: 2560192 - protein, 7 aa, Entamoeba histolytica
DFGSSRN

SEQ ID NO: 2560193 - protein, 16 aa, Entamoeba histolytica
DFGTSGVYASSSDKLN

SEQ ID NO: 2560194 - protein, 8 aa, Entamoeba histolytica
DFGTSQAY

SEQ ID NO: 2560195 - protein, 6 aa, Entamoeba histolytica
DFGTSR

SEQ ID NO: 2560196 - protein, 14 aa, Entamoeba histolytica
DFGTSRAVQEYEGN

SEQ ID NO: 2560197 - protein, 14 aa, Entamoeba histolytica
DFKGDNQKNIKEQQ

SEQ ID NO: 2560198 - protein, 9 aa, Entamoeba histolytica
DFPNEEESV

SEQ ID NO: 2560199 - protein, 11 aa, Entamoeba histolytica
DFQSSKESQKL

SEQ ID NO: 2560200 - protein, 19 aa, Entamoeba histolytica
DFSQNNAQETDPTKVYLLS

SEQ ID NO: 2560201 - protein, 7 aa, Entamoeba histolytica
DFTQPQK

SEQ ID NO: 2560202 - protein, 6 aa, Entamoeba histolytica
DFTSIS

SEQ ID NO: 2560203 - protein, 6 aa, Entamoeba histolytica
DFTTSS

SEQ ID NO: 2560204 - protein, 6 aa, Entamoeba histolytica
DGANDV

SEQ ID NO: 2560205 - protein, 18 aa, Entamoeba histolytica
DGCGNISEEVKNVEKTVP

SEQ ID NO: 2560206 - protein, 7 aa, Entamoeba histolytica
DGCNECN

SEQ ID NO: 2560207 - protein, 5 aa, Entamoeba histolytica
DGCSQ

SEQ ID NO: 2560208 - protein, 7 aa, Entamoeba histolytica
DGDAGYE

SEQ ID NO: 2560209 - protein, 14 aa, Entamoeba histolytica
DGDCKYEGDCNPTN

SEQ ID NO: 2560210 - protein, 6 aa, Entamoeba histolytica
DGDFEP

SEQ ID NO: 2560211 - protein, 5 aa, Entamoeba histolytica
DGDGI

SEQ ID NO: 2560212 - protein, 20 aa, Entamoeba histolytica
DGDLPSESIETLPKGADEEK

SEQ ID NO: 2560213 - protein, 5 aa, Entamoeba histolytica
DGDLR

SEQ ID NO: 2560214 - protein, 9 aa, Entamoeba histolytica
DGDNSESSL

SEQ ID NO: 2560215 - protein, 11 aa, Entamoeba histolytica
DGDPDGKDEEF

SEQ ID NO: 2560216 - protein, 12 aa, Entamoeba histolytica
DGDPNGKDDEFE

SEQ ID NO: 2560217 - protein, 5 aa, Entamoeba histolytica
DGDRY

SEQ ID NO: 2560218 - protein, 10 aa, Entamoeba histolytica
DGDSGNEDLS

SEQ ID NO: 2560219 - protein, 9 aa, Entamoeba histolytica
DGDSSLQLS

SEQ ID NO: 2560220 - protein, 7 aa, Entamoeba histolytica
DGDSVTC

SEQ ID NO: 2560221 - protein, 9 aa, Entamoeba histolytica
DGDSYEDLS

SEQ ID NO: 2560222 - protein, 7 aa, Entamoeba histolytica
DGEGKVG

SEQ ID NO: 2560223 - protein, 4 aa, Entamoeba histolytica
DGEI

SEQ ID NO: 2560224 - protein, 11 aa, Entamoeba histolytica
DGEMKEDKPVK

SEQ ID NO: 2560225 - protein, 7 aa, Entamoeba histolytica
DGEQNEI

SEQ ID NO: 2560226 - protein, 6 aa, Entamoeba histolytica
DGETTD

SEQ ID NO: 2560227 - protein, 7 aa, Entamoeba histolytica
DGEYQIE

SEQ ID NO: 2560228 - protein, 18 aa, Entamoeba histolytica
DGFSSNERKYNTVTVESN

SEQ ID NO: 2560229 - protein, 5 aa, Entamoeba histolytica
DGGHD

SEQ ID NO: 2560230 - protein, 21 aa, Entamoeba histolytica
DGGYYQNVSGQSSCKQCEPGY

SEQ ID NO: 2560231 - protein, 7 aa, Entamoeba histolytica
DGHSNYS

SEQ ID NO: 2560232 - protein, 9 aa, Entamoeba histolytica
DGINGCGKA

SEQ ID NO: 2560233 - protein, 5 aa, Entamoeba histolytica
DGISY

SEQ ID NO: 2560234 - protein, 9 aa, Entamoeba histolytica
DGKEFSEEF

SEQ ID NO: 2560235 - protein, 17 aa, Entamoeba histolytica
DGKKAKVEYSSNKKLGQ

SEQ ID NO: 2560236 - protein, 7 aa, Entamoeba histolytica
DGKLEQT

SEQ ID NO: 2560237 - protein, 7 aa, Entamoeba histolytica
DGKLSDN

SEQ ID NO: 2560238 - protein, 6 aa, Entamoeba histolytica
DGKPPL

SEQ ID NO: 2560239 - protein, 6 aa, Entamoeba histolytica
DGKPQY

SEQ ID NO: 2560240 - protein, 15 aa, Entamoeba histolytica
DGKQARKTGSGSPLG

SEQ ID NO: 2560241 - protein, 16 aa, Entamoeba histolytica
DGKQARKTGSGSPLGE

SEQ ID NO: 2560242 - protein, 8 aa, Entamoeba histolytica
DGKRRPKI

SEQ ID NO: 2560243 - protein, 12 aa, Entamoeba histolytica
DGKSTDENTQAQ

SEQ ID NO: 2560244 - protein, 5 aa, Entamoeba histolytica
DGKTD

SEQ ID NO: 2560245 - protein, 7 aa, Entamoeba histolytica
DGKTPRV

SEQ ID NO: 2560246 - protein, 5 aa, Entamoeba histolytica
DGKWS

SEQ ID NO: 2560247 - protein, 8 aa, Entamoeba histolytica
DGKYGQDD

SEQ ID NO: 2560248 - protein, 22 aa, Entamoeba histolytica
DGLREKGTTTLVEESEDKEVNI

SEQ ID NO: 2560249 - protein, 5 aa, Entamoeba histolytica
DGLTD

SEQ ID NO: 2560250 - protein, 10 aa, Entamoeba histolytica
DGLTSDRPDI

SEQ ID NO: 2560251 - protein, 15 aa, Entamoeba histolytica
DGNFASTDTRERPSL

SEQ ID NO: 2560252 - protein, 4 aa, Entamoeba histolytica
DGNI

SEQ ID NO: 2560253 - protein, 20 aa, Entamoeba histolytica
DGNPHDMEDEEQTKNKPFKE

SEQ ID NO: 2560254 - protein, 9 aa, Entamoeba histolytica
DGNQKFTQH

SEQ ID NO: 2560255 - protein, 39 aa, Entamoeba histolytica
DGNVSESSELDKEEDTDEKSPEENESVQPTGTPEQKPSN

SEQ ID NO: 2560256 - protein, 5 aa, Entamoeba histolytica
DGPAI

SEQ ID NO: 2560257 - protein, 14 aa, Entamoeba histolytica
DGPCTENGQCPYEC

SEQ ID NO: 2560258 - protein, 10 aa, Entamoeba histolytica
DGQCETAKIG

SEQ ID NO: 2560259 - protein, 13 aa, Entamoeba histolytica
DGQCSSNEKTNNC

SEQ ID NO: 2560260 - protein, 9 aa, Entamoeba histolytica
DGQNGSSEL

SEQ ID NO: 2560261 - protein, 41 aa, Entamoeba histolytica
DGQTINKPIHRSRSKSCGHSGSLGTIEATESKSKKKSYKIP

SEQ ID NO: 2560262 - protein, 8 aa, Entamoeba histolytica
DGQVKRRS

SEQ ID NO: 2560263 - protein, 6 aa, Entamoeba histolytica
DGRLAK

SEQ ID NO: 2560264 - protein, 7 aa, Entamoeba histolytica
DGSANIR

SEQ ID NO: 2560265 - protein, 7 aa, Entamoeba histolytica
DGSISGE

SEQ ID NO: 2560266 - protein, 6 aa, Entamoeba histolytica
DGSISM

SEQ ID NO: 2560267 - protein, 20 aa, Entamoeba histolytica
DGSIYGTYNNSNLNENKTDV

SEQ ID NO: 2560268 - protein, 5 aa, Entamoeba histolytica
DGSLD

SEQ ID NO: 2560269 - protein, 8 aa, Entamoeba histolytica
DGSSQMTL

SEQ ID NO: 2560270 - protein, 7 aa, Entamoeba histolytica
DGSTGKN

SEQ ID NO: 2560271 - protein, 5 aa, Entamoeba histolytica
DGSVK

SEQ ID NO: 2560272 - protein, 6 aa, Entamoeba histolytica
DGSYQY

SEQ ID NO: 2560273 - protein, 11 aa, Entamoeba histolytica
DGTAPHTGIGD

SEQ ID NO: 2560274 - protein, 4 aa, Entamoeba histolytica
DGTC

SEQ ID NO: 2560275 - protein, 7 aa, Entamoeba histolytica
DGTGTSF

SEQ ID NO: 2560276 - protein, 8 aa, Entamoeba histolytica
DGTISVNG

SEQ ID NO: 2560277 - protein, 10 aa, Entamoeba histolytica
DGTKRYTIEN

SEQ ID NO: 2560278 - protein, 4 aa, Entamoeba histolytica
DGTN

SEQ ID NO: 2560279 - protein, 8 aa, Entamoeba histolytica
DGTNDVGA

SEQ ID NO: 2560280 - protein, 6 aa, Entamoeba histolytica
DGTPTL

SEQ ID NO: 2560281 - protein, 9 aa, Entamoeba histolytica
DGTSKNCSS

SEQ ID NO: 2560282 - protein, 5 aa, Entamoeba histolytica
DGTVT

SEQ ID NO: 2560283 - protein, 6 aa, Entamoeba histolytica
DGTYGS

SEQ ID NO: 2560284 - protein, 9 aa, Entamoeba histolytica
DGVKKSSKL

SEQ ID NO: 2560285 - protein, 6 aa, Entamoeba histolytica
DGVNPA

SEQ ID NO: 2560286 - protein, 8 aa, Entamoeba histolytica
DGYEPTQH

SEQ ID NO: 2560287 - protein, 14 aa, Entamoeba histolytica
DGYFPTMEDDDDRY

SEQ ID NO: 2560288 - protein, 5 aa, Entamoeba histolytica
DGYGG

SEQ ID NO: 2560289 - protein, 4 aa, Entamoeba histolytica
DGYS

SEQ ID NO: 2560290 - protein, 20 aa, Entamoeba histolytica
DGYVKSEGNQIENTSSSEKL

SEQ ID NO: 2560291 - protein, 4 aa, Entamoeba histolytica
DGYY

SEQ ID NO: 2560292 - protein, 6 aa, Entamoeba histolytica
DGYYNY

SEQ ID NO: 2560293 - protein, 4 aa, Entamoeba histolytica
DHDQ

SEQ ID NO: 2560294 - protein, 8 aa, Entamoeba histolytica
DHKPLTES

SEQ ID NO: 2560295 - protein, 11 aa, Entamoeba histolytica
DHNHTTSESEC

SEQ ID NO: 2560296 - protein, 5 aa, Entamoeba histolytica
DHQET

SEQ ID NO: 2560297 - protein, 14 aa, Entamoeba histolytica
DHSSMRKSEASRFL

SEQ ID NO: 2560298 - protein, 8 aa, Entamoeba histolytica
DIAPKNLD

SEQ ID NO: 2560299 - protein, 17 aa, Entamoeba histolytica
DIASSTKPFNSDTYKAV

SEQ ID NO: 2560300 - protein, 24 aa, Entamoeba histolytica
DIDDQSSDEETEDERVERQRNEKL

SEQ ID NO: 2560301 - protein, 5 aa, Entamoeba histolytica
DIDND

SEQ ID NO: 2560302 - protein, 13 aa, Entamoeba histolytica
DIDNPQSRMDRSE

SEQ ID NO: 2560303 - protein, 9 aa, Entamoeba histolytica
DIDQTTAQT

SEQ ID NO: 2560304 - protein, 4 aa, Entamoeba histolytica
DIDT

SEQ ID NO: 2560305 - protein, 7 aa, Entamoeba histolytica
DIDTNTD

SEQ ID NO: 2560306 - protein, 11 aa, Entamoeba histolytica
DIEEDDDSNDY

SEQ ID NO: 2560307 - protein, 5 aa, Entamoeba histolytica
DIEEG

SEQ ID NO: 2560308 - protein, 7 aa, Entamoeba histolytica
DIEGESI

SEQ ID NO: 2560309 - protein, 7 aa, Entamoeba histolytica
DIENITT

SEQ ID NO: 2560310 - protein, 4 aa, Entamoeba histolytica
DIEQ

SEQ ID NO: 2560311 - protein, 7 aa, Entamoeba histolytica
DIESGRI

SEQ ID NO: 2560312 - protein, 4 aa, Entamoeba histolytica
DIGE

SEQ ID NO: 2560313 - protein, 6 aa, Entamoeba histolytica
DIGEGG

SEQ ID NO: 2560314 - protein, 13 aa, Entamoeba histolytica
DIHSGSSACQTYK

SEQ ID NO: 2560315 - protein, 4 aa, Entamoeba histolytica
DIID

SEQ ID NO: 2560316 - protein, 4 aa, Entamoeba histolytica
DIIK

SEQ ID NO: 2560317 - protein, 4 aa, Entamoeba histolytica
DIKQ

SEQ ID NO: 2560318 - protein, 6 aa, Entamoeba histolytica
DIKQRD

SEQ ID NO: 2560319 - protein, 8 aa, Entamoeba histolytica
DIKSDDSA

SEQ ID NO: 2560320 - protein, 10 aa, Entamoeba histolytica
DILPPTYKGE

SEQ ID NO: 2560321 - protein, 5 aa, Entamoeba histolytica
DINIT

SEQ ID NO: 2560322 - protein, 8 aa, Entamoeba histolytica
DINKTDIK

SEQ ID NO: 2560323 - protein, 5 aa, Entamoeba histolytica
DINNS

SEQ ID NO: 2560324 - protein, 9 aa, Entamoeba histolytica
DIPEDEESL

SEQ ID NO: 2560325 - protein, 10 aa, Entamoeba histolytica
DIPKDSPWRY

SEQ ID NO: 2560326 - protein, 27 aa, Entamoeba histolytica
DIPKGVYGKKSYKQEVQPKLYNGTDKY

SEQ ID NO: 2560327 - protein, 8 aa, Entamoeba histolytica
DIPKLSDT

SEQ ID NO: 2560328 - protein, 13 aa, Entamoeba histolytica
DIPKQPKGGFDSN

SEQ ID NO: 2560329 - protein, 8 aa, Entamoeba histolytica
DIPNTDLS

SEQ ID NO: 2560330 - protein, 12 aa, Entamoeba histolytica
DIPSGWGKYTNE

SEQ ID NO: 2560331 - protein, 26 aa, Entamoeba histolytica
DIPSSPSPSNFTPQTPSSSRSSQEEI

SEQ ID NO: 2560332 - protein, 4 aa, Entamoeba histolytica
DIPV

SEQ ID NO: 2560333 - protein, 7 aa, Entamoeba histolytica
DIQDDED

SEQ ID NO: 2560334 - protein, 5 aa, Entamoeba histolytica
DIQPN

SEQ ID NO: 2560335 - protein, 6 aa, Entamoeba histolytica
DIRKPE

SEQ ID NO: 2560336 - protein, 13 aa, Entamoeba histolytica
DIRTRRSQRQGEF

SEQ ID NO: 2560337 - protein, 6 aa, Entamoeba histolytica
DISDAS

SEQ ID NO: 2560338 - protein, 5 aa, Entamoeba histolytica
DISKE

SEQ ID NO: 2560339 - protein, 4 aa, Entamoeba histolytica
DISP

SEQ ID NO: 2560340 - protein, 5 aa, Entamoeba histolytica
DISTT

SEQ ID NO: 2560341 - protein, 14 aa, Entamoeba histolytica
DITDTTANTGNQQL

SEQ ID NO: 2560342 - protein, 9 aa, Entamoeba histolytica
DITKANSSL

SEQ ID NO: 2560343 - protein, 13 aa, Entamoeba histolytica
DITKGQKFAATNY

SEQ ID NO: 2560344 - protein, 11 aa, Entamoeba histolytica
DITNKRNITEI

SEQ ID NO: 2560345 - protein, 7 aa, Entamoeba histolytica
DITNSDI

SEQ ID NO: 2560346 - protein, 10 aa, Entamoeba histolytica
DITPSTTHNV

SEQ ID NO: 2560347 - protein, 11 aa, Entamoeba histolytica
DITRTGKRTKM

SEQ ID NO: 2560348 - protein, 5 aa, Entamoeba histolytica
DIVPS

SEQ ID NO: 2560349 - protein, 6 aa, Entamoeba histolytica
DKAAHY

SEQ ID NO: 2560350 - protein, 4 aa, Entamoeba histolytica
DKAC

SEQ ID NO: 2560351 - protein, 14 aa, Entamoeba histolytica
DKAFEQGSEEENTT

SEQ ID NO: 2560352 - protein, 9 aa, Entamoeba histolytica
DKAKETGIK

SEQ ID NO: 2560353 - protein, 13 aa, Entamoeba histolytica
DKALKDPTDPNSE

SEQ ID NO: 2560354 - protein, 8 aa, Entamoeba histolytica
DKASFSTA

SEQ ID NO: 2560355 - protein, 9 aa, Entamoeba histolytica
DKASKGRTT

SEQ ID NO: 2560356 - protein, 10 aa, Entamoeba histolytica
DKASKLNKKW

SEQ ID NO: 2560357 - protein, 22 aa, Entamoeba histolytica
DKCATCEDGYSLDAGSMSCSKT

SEQ ID NO: 2560358 - protein, 4 aa, Entamoeba histolytica
DKDE

SEQ ID NO: 2560359 - protein, 20 aa, Entamoeba histolytica
DKDENGNSILPKNGMSVKEG

SEQ ID NO: 2560360 - protein, 10 aa, Entamoeba histolytica
DKDGQEKTKE

SEQ ID NO: 2560361 - protein, 9 aa, Entamoeba histolytica
DKDKIEATG

SEQ ID NO: 2560362 - protein, 13 aa, Entamoeba histolytica
DKDNKYKLNSPDY

SEQ ID NO: 2560363 - protein, 5 aa, Entamoeba histolytica
DKDNL

SEQ ID NO: 2560364 - protein, 16 aa, Entamoeba histolytica
DKECEEPTSVENIGDI

SEQ ID NO: 2560365 - protein, 7 aa, Entamoeba histolytica
DKEEDME

SEQ ID NO: 2560366 - protein, 11 aa, Entamoeba histolytica
DKEEETEATKI

SEQ ID NO: 2560367 - protein, 29 aa, Entamoeba histolytica
DKEELNNTVEDKYDRFNRNENSYDDATLR

SEQ ID NO: 2560368 - protein, 9 aa, Entamoeba histolytica
DKEKEGTTL

SEQ ID NO: 2560369 - protein, 6 aa, Entamoeba histolytica
DKEKEI

SEQ ID NO: 2560370 - protein, 7 aa, Entamoeba histolytica
DKEKRTS

SEQ ID NO: 2560371 - protein, 7 aa, Entamoeba histolytica
DKEKTIK

SEQ ID NO: 2560372 - protein, 7 aa, Entamoeba histolytica
DKEMEEL

SEQ ID NO: 2560373 - protein, 6 aa, Entamoeba histolytica
DKESGL

SEQ ID NO: 2560374 - protein, 9 aa, Entamoeba histolytica
DKETGITKD

SEQ ID NO: 2560375 - protein, 17 aa, Entamoeba histolytica
DKETSISLKPYKEKTKI

SEQ ID NO: 2560376 - protein, 4 aa, Entamoeba histolytica
DKEV

SEQ ID NO: 2560377 - protein, 8 aa, Entamoeba histolytica
DKEVETTS

SEQ ID NO: 2560378 - protein, 6 aa, Entamoeba histolytica
DKEYAI

SEQ ID NO: 2560379 - protein, 13 aa, Entamoeba histolytica
DKFKNYNGDVPNG

SEQ ID NO: 2560380 - protein, 11 aa, Entamoeba histolytica
DKFNSKHQKTL

SEQ ID NO: 2560381 - protein, 7 aa, Entamoeba histolytica
DKGGSTF

SEQ ID NO: 2560382 - protein, 6 aa, Entamoeba histolytica
DKHQYE

SEQ ID NO: 2560383 - protein, 8 aa, Entamoeba histolytica
DKHYTSEE

SEQ ID NO: 2560384 - protein, 21 aa, Entamoeba histolytica
DKIDTVSDKVDDALKNSEAIK

SEQ ID NO: 2560385 - protein, 11 aa, Entamoeba histolytica
DKIEEKPITEE

SEQ ID NO: 2560386 - protein, 14 aa, Entamoeba histolytica
DKIEKKEENNKEIN

SEQ ID NO: 2560387 - protein, 6 aa, Entamoeba histolytica
DKIEKS

SEQ ID NO: 2560388 - protein, 26 aa, Entamoeba histolytica
DKINKTKCNPKNKRLVKRDEKCDEEV

SEQ ID NO: 2560389 - protein, 7 aa, Entamoeba histolytica
DKINNEE

SEQ ID NO: 2560390 - protein, 7 aa, Entamoeba histolytica
DKINTDT

SEQ ID NO: 2560391 - protein, 6 aa, Entamoeba histolytica
DKIPAE

SEQ ID NO: 2560392 - protein, 8 aa, Entamoeba histolytica
DKKCREKQ

SEQ ID NO: 2560393 - protein, 4 aa, Entamoeba histolytica
DKKE

SEQ ID NO: 2560394 - protein, 11 aa, Entamoeba histolytica
DKKENKDETNV

SEQ ID NO: 2560395 - protein, 7 aa, Entamoeba histolytica
DKKEYSI

SEQ ID NO: 2560396 - protein, 9 aa, Entamoeba histolytica
DKKISGSSM

SEQ ID NO: 2560397 - protein, 16 aa, Entamoeba histolytica
DKKKEYKEMQSKVPTE

SEQ ID NO: 2560398 - protein, 28 aa, Entamoeba histolytica
DKKKSSQNDKDEEQINESSEIKRQENNN

SEQ ID NO: 2560399 - protein, 6 aa, Entamoeba histolytica
DKKMDS

SEQ ID NO: 2560400 - protein, 6 aa, Entamoeba histolytica
DKKNKI

SEQ ID NO: 2560401 - protein, 5 aa, Entamoeba histolytica
DKKNY

SEQ ID NO: 2560402 - protein, 7 aa, Entamoeba histolytica
DKKQAST

SEQ ID NO: 2560403 - protein, 12 aa, Entamoeba histolytica
DKKRPSKPDNMR

SEQ ID NO: 2560404 - protein, 9 aa, Entamoeba histolytica
DKKRPVPED

SEQ ID NO: 2560405 - protein, 12 aa, Entamoeba histolytica
DKKRQESDDEQL

SEQ ID NO: 2560406 - protein, 6 aa, Entamoeba histolytica
DKKSIK

SEQ ID NO: 2560407 - protein, 10 aa, Entamoeba histolytica
DKKSNDKGKK

SEQ ID NO: 2560408 - protein, 9 aa, Entamoeba histolytica
DKKSQKGMV

SEQ ID NO: 2560409 - protein, 8 aa, Entamoeba histolytica
DKKSRAKA

SEQ ID NO: 2560410 - protein, 9 aa, Entamoeba histolytica
DKKSSGEKK

SEQ ID NO: 2560411 - protein, 7 aa, Entamoeba histolytica
DKKSTSH

SEQ ID NO: 2560412 - protein, 30 aa, Entamoeba histolytica
DKKSVSTIPESKNEEQLNTENTDTSTSEIT

SEQ ID NO: 2560413 - protein, 7 aa, Entamoeba histolytica
DKKTCIS

SEQ ID NO: 2560414 - protein, 24 aa, Entamoeba histolytica
DKKVNEGNKEIDTAEKYQRKSSKK

SEQ ID NO: 2560415 - protein, 10 aa, Entamoeba histolytica
DKLGKLDRND

SEQ ID NO: 2560416 - protein, 9 aa, Entamoeba histolytica
DKLQEGVPE

SEQ ID NO: 2560417 - protein, 9 aa, Entamoeba histolytica
DKLQPQSDL

SEQ ID NO: 2560418 - protein, 8 aa, Entamoeba histolytica
DKLQSDGN

SEQ ID NO: 2560419 - protein, 6 aa, Entamoeba histolytica
DKLQTV

SEQ ID NO: 2560420 - protein, 10 aa, Entamoeba histolytica
DKLSIKGCSP

SEQ ID NO: 2560421 - protein, 7 aa, Entamoeba histolytica
DKLSSTS

SEQ ID NO: 2560422 - protein, 8 aa, Entamoeba histolytica
DKNCDEYK

SEQ ID NO: 2560423 - protein, 11 aa, Entamoeba histolytica
DKNCDSCDQNT

SEQ ID NO: 2560424 - protein, 9 aa, Entamoeba histolytica
DKNCTHRDN

SEQ ID NO: 2560425 - protein, 4 aa, Entamoeba histolytica
DKND

SEQ ID NO: 2560426 - protein, 11 aa, Entamoeba histolytica
DKNDDNSFDGQ

SEQ ID NO: 2560427 - protein, 10 aa, Entamoeba histolytica
DKNDDNSFDK

SEQ ID NO: 2560428 - protein, 12 aa, Entamoeba histolytica
DKNDRNKITEEL

SEQ ID NO: 2560429 - protein, 7 aa, Entamoeba histolytica
DKNENDH

SEQ ID NO: 2560430 - protein, 7 aa, Entamoeba histolytica
DKNKDKE

SEQ ID NO: 2560431 - protein, 15 aa, Entamoeba histolytica
DKNKIQVNSPNNYAY

SEQ ID NO: 2560432 - protein, 8 aa, Entamoeba histolytica
DKNLNNGL

SEQ ID NO: 2560433 - protein, 12 aa, Entamoeba histolytica
DKNTATSFPLTE

SEQ ID NO: 2560434 - protein, 14 aa, Entamoeba histolytica
DKNTIDSCSSTHAR

SEQ ID NO: 2560435 - protein, 10 aa, Entamoeba histolytica
DKNTNTSWDR

SEQ ID NO: 2560436 - protein, 8 aa, Entamoeba histolytica
DKNTQKTT

SEQ ID NO: 2560437 - protein, 10 aa, Entamoeba histolytica
DKNVNEVKDY

SEQ ID NO: 2560438 - protein, 5 aa, Entamoeba histolytica
DKNYS

SEQ ID NO: 2560439 - protein, 8 aa, Entamoeba histolytica
DKPAPVRE

SEQ ID NO: 2560440 - protein, 6 aa, Entamoeba histolytica
DKPEEM

SEQ ID NO: 2560441 - protein, 8 aa, Entamoeba histolytica
DKPIKAKN

SEQ ID NO: 2560442 - protein, 21 aa, Entamoeba histolytica
DKPKNEGNETESRTVVTPPTR

SEQ ID NO: 2560443 - protein, 4 aa, Entamoeba histolytica
DKPN

SEQ ID NO: 2560444 - protein, 5 aa, Entamoeba histolytica
DKPTP

SEQ ID NO: 2560445 - protein, 4 aa, Entamoeba histolytica
DKQC

SEQ ID NO: 2560446 - protein, 11 aa, Entamoeba histolytica
DKQELSRRSKK

SEQ ID NO: 2560447 - protein, 6 aa, Entamoeba histolytica
DKQHHV

SEQ ID NO: 2560448 - protein, 9 aa, Entamoeba histolytica
DKQLGTGSL

SEQ ID NO: 2560449 - protein, 7 aa, Entamoeba histolytica
DKQLKNK

SEQ ID NO: 2560450 - protein, 11 aa, Entamoeba histolytica
DKQNEIKSYTP

SEQ ID NO: 2560451 - protein, 8 aa, Entamoeba histolytica
DKQNNNPM

SEQ ID NO: 2560452 - protein, 7 aa, Entamoeba histolytica
DKQRSKF

SEQ ID NO: 2560453 - protein, 6 aa, Entamoeba histolytica
DKQSTS

SEQ ID NO: 2560454 - protein, 8 aa, Entamoeba histolytica
DKQTEKNK

SEQ ID NO: 2560455 - protein, 9 aa, Entamoeba histolytica
DKQTNSQPF

SEQ ID NO: 2560456 - protein, 8 aa, Entamoeba histolytica
DKRDMEDL

SEQ ID NO: 2560457 - protein, 16 aa, Entamoeba histolytica
DKRERAINVGKSSGII

SEQ ID NO: 2560458 - protein, 13 aa, Entamoeba histolytica
DKRKKQSTSTDSE

SEQ ID NO: 2560459 - protein, 4 aa, Entamoeba histolytica
DKRR

SEQ ID NO: 2560460 - protein, 4 aa, Entamoeba histolytica
DKRS

SEQ ID NO: 2560461 - protein, 16 aa, Entamoeba histolytica
DKRSDEVVRNTPTFES

SEQ ID NO: 2560462 - protein, 6 aa, Entamoeba histolytica
DKRVQT

SEQ ID NO: 2560463 - protein, 5 aa, Entamoeba histolytica
DKSEL

SEQ ID NO: 2560464 - protein, 7 aa, Entamoeba histolytica
DKSGNGL

SEQ ID NO: 2560465 - protein, 9 aa, Entamoeba histolytica
DKSNENQNQ

SEQ ID NO: 2560466 - protein, 4 aa, Entamoeba histolytica
DKST

SEQ ID NO: 2560467 - protein, 5 aa, Entamoeba histolytica
DKSTI

SEQ ID NO: 2560468 - protein, 5 aa, Entamoeba histolytica
DKSYA

SEQ ID NO: 2560469 - protein, 7 aa, Entamoeba histolytica
DKSYKEM

SEQ ID NO: 2560470 - protein, 11 aa, Entamoeba histolytica
DKTDASNNNAC

SEQ ID NO: 2560471 - protein, 10 aa, Entamoeba histolytica
DKTDRDVNGV

SEQ ID NO: 2560472 - protein, 7 aa, Entamoeba histolytica
DKTDSTQ

SEQ ID NO: 2560473 - protein, 17 aa, Entamoeba histolytica
DKTETNDDSTKALIDHL

SEQ ID NO: 2560474 - protein, 8 aa, Entamoeba histolytica
DKTGEEDV

SEQ ID NO: 2560475 - protein, 8 aa, Entamoeba histolytica
DKTGTLTE

SEQ ID NO: 2560476 - protein, 9 aa, Entamoeba histolytica
DKTGTLTEN

SEQ ID NO: 2560477 - protein, 10 aa, Entamoeba histolytica
DKTGTLTENE

SEQ ID NO: 2560478 - protein, 9 aa, Entamoeba histolytica
DKTGTLTKN

SEQ ID NO: 2560479 - protein, 9 aa, Entamoeba histolytica
DKTGTLTQG

SEQ ID NO: 2560480 - protein, 9 aa, Entamoeba histolytica
DKTHCSSQS

SEQ ID NO: 2560481 - protein, 5 aa, Entamoeba histolytica
DKTIK

SEQ ID NO: 2560482 - protein, 7 aa, Entamoeba histolytica
DKTIRSH

SEQ ID NO: 2560483 - protein, 6 aa, Entamoeba histolytica
DKTIST

SEQ ID NO: 2560484 - protein, 7 aa, Entamoeba histolytica
DKTKDDN

SEQ ID NO: 2560485 - protein, 10 aa, Entamoeba histolytica
DKTNSTNPKC

SEQ ID NO: 2560486 - protein, 31 aa, Entamoeba histolytica
DKTSSKEEDSKVDETISNNKKDMSGESSKIN

SEQ ID NO: 2560487 - protein, 6 aa, Entamoeba histolytica
DKVNST

SEQ ID NO: 2560488 - protein, 10 aa, Entamoeba histolytica
DKVPKTEFGT

SEQ ID NO: 2560489 - protein, 6 aa, Entamoeba histolytica
DKVSAS

SEQ ID NO: 2560490 - protein, 6 aa, Entamoeba histolytica
DKVTNS

SEQ ID NO: 2560491 - protein, 5 aa, Entamoeba histolytica
DKYHN

SEQ ID NO: 2560492 - protein, 17 aa, Entamoeba histolytica
DKYLSSNRTCQSNNELN

SEQ ID NO: 2560493 - protein, 7 aa, Entamoeba histolytica
DKYNSHG

SEQ ID NO: 2560494 - protein, 8 aa, Entamoeba histolytica
DKYNTTGL

SEQ ID NO: 2560495 - protein, 11 aa, Entamoeba histolytica
DLAQYEKDNNE

SEQ ID NO: 2560496 - protein, 10 aa, Entamoeba histolytica
DLASKTKEND

SEQ ID NO: 2560497 - protein, 7 aa, Entamoeba histolytica
DLDETQQ

SEQ ID NO: 2560498 - protein, 8 aa, Entamoeba histolytica
DLEAQRKI

SEQ ID NO: 2560499 - protein, 8 aa, Entamoeba histolytica
DLEDETSH

SEQ ID NO: 2560500 - protein, 10 aa, Entamoeba histolytica
DLEKNKDSER

SEQ ID NO: 2560501 - protein, 5 aa, Entamoeba histolytica
DLEPN

SEQ ID NO: 2560502 - protein, 8 aa, Entamoeba histolytica
DLESSKVK

SEQ ID NO: 2560503 - protein, 7 aa, Entamoeba histolytica
DLGEDRT

SEQ ID NO: 2560504 - protein, 20 aa, Entamoeba histolytica
DLGTSDDTLTISRGDGIKDD

SEQ ID NO: 2560505 - protein, 15 aa, Entamoeba histolytica
DLKGGEKSLGDKYEE

SEQ ID NO: 2560506 - protein, 15 aa, Entamoeba histolytica
DLKGQKTCKNCGDGM

SEQ ID NO: 2560507 - protein, 12 aa, Entamoeba histolytica
DLKQSLEENNKG

SEQ ID NO: 2560508 - protein, 8 aa, Entamoeba histolytica
DLKRPKKN

SEQ ID NO: 2560509 - protein, 10 aa, Entamoeba histolytica
DLKSEKESMT

SEQ ID NO: 2560510 - protein, 6 aa, Entamoeba histolytica
DLNDAF

SEQ ID NO: 2560511 - protein, 14 aa, Entamoeba histolytica
DLNNPSSEHTPLNS

SEQ ID NO: 2560512 - protein, 58 aa, Entamoeba histolytica
DLNRTQENVTQEENESNENKIKQDEQKTEESKFRQRNEIQKRDNQECSQSNMNKNKEI

SEQ ID NO: 2560513 - protein, 6 aa, Entamoeba histolytica
DLPPHK

SEQ ID NO: 2560514 - protein, 5 aa, Entamoeba histolytica
DLPQG

SEQ ID NO: 2560515 - protein, 4 aa, Entamoeba histolytica
DLPS

SEQ ID NO: 2560516 - protein, 5 aa, Entamoeba histolytica
DLPTS

SEQ ID NO: 2560517 - protein, 4 aa, Entamoeba histolytica
DLPV

SEQ ID NO: 2560518 - protein, 5 aa, Entamoeba histolytica
DLQKN

SEQ ID NO: 2560519 - protein, 9 aa, Entamoeba histolytica
DLQSSTPVL

SEQ ID NO: 2560520 - protein, 30 aa, Entamoeba histolytica
DLSNNANSKYQKKIVGKGTTVIKPQSKDVT

SEQ ID NO: 2560521 - protein, 21 aa, Entamoeba histolytica
DLSPKNPSNLNEKYEESPEED

SEQ ID NO: 2560522 - protein, 6 aa, Entamoeba histolytica
DLSTVG

SEQ ID NO: 2560523 - protein, 5 aa, Entamoeba histolytica
DLTDD

SEQ ID NO: 2560524 - protein, 5 aa, Entamoeba histolytica
DLTEY

SEQ ID NO: 2560525 - protein, 11 aa, Entamoeba histolytica
DLTPQMPPIGE

SEQ ID NO: 2560526 - protein, 4 aa, Entamoeba histolytica
DLTS

SEQ ID NO: 2560527 - protein, 8 aa, Entamoeba histolytica
DLYGEDEE

SEQ ID NO: 2560528 - protein, 7 aa, Entamoeba histolytica
DLYPQAT

SEQ ID NO: 2560529 - protein, 8 aa, Entamoeba histolytica
DMESSGDF

SEQ ID NO: 2560530 - protein, 9 aa, Entamoeba histolytica
DMTDKQTIT

SEQ ID NO: 2560531 - protein, 6 aa, Entamoeba histolytica
DMTNSG

SEQ ID NO: 2560532 - protein, 13 aa, Entamoeba histolytica
DMTPANPNNLEEK

SEQ ID NO: 2560533 - protein, 22 aa, Entamoeba histolytica
DMTPANRNNLEEKYEVANEEGS

SEQ ID NO: 2560534 - protein, 5 aa, Entamoeba histolytica
DMYPT

SEQ ID NO: 2560535 - protein, 6 aa, Entamoeba histolytica
DNAEAL

SEQ ID NO: 2560536 - protein, 10 aa, Entamoeba histolytica
DNALKDPSSI

SEQ ID NO: 2560537 - protein, 7 aa, Entamoeba histolytica
DNANNKF

SEQ ID NO: 2560538 - protein, 7 aa, Entamoeba histolytica
DNANQKE

SEQ ID NO: 2560539 - protein, 5 aa, Entamoeba histolytica
DNARK

SEQ ID NO: 2560540 - protein, 5 aa, Entamoeba histolytica
DNCET

SEQ ID NO: 2560541 - protein, 12 aa, Entamoeba histolytica
DNCKDDNGSRLR

SEQ ID NO: 2560542 - protein, 10 aa, Entamoeba histolytica
DNCPNSNNEE

SEQ ID NO: 2560543 - protein, 5 aa, Entamoeba histolytica
DNDCE

SEQ ID NO: 2560544 - protein, 4 aa, Entamoeba histolytica
DNDG

SEQ ID NO: 2560545 - protein, 5 aa, Entamoeba histolytica
DNDMP

SEQ ID NO: 2560546 - protein, 13 aa, Entamoeba histolytica
DNDNDKFTPGVSK

SEQ ID NO: 2560547 - protein, 13 aa, Entamoeba histolytica
DNECDEPTSVENI

SEQ ID NO: 2560548 - protein, 10 aa, Entamoeba histolytica
DNECKGNSET

SEQ ID NO: 2560549 - protein, 5 aa, Entamoeba histolytica
DNECV

SEQ ID NO: 2560550 - protein, 8 aa, Entamoeba histolytica
DNEEEIKN

SEQ ID NO: 2560551 - protein, 26 aa, Entamoeba histolytica
DNEGIINETPNPISTVENENITQPQN

SEQ ID NO: 2560552 - protein, 17 aa, Entamoeba histolytica
DNEIKKDEEEEEEKHIK

SEQ ID NO: 2560553 - protein, 7 aa, Entamoeba histolytica
DNENFPL

SEQ ID NO: 2560554 - protein, 5 aa, Entamoeba histolytica
DNEPI

SEQ ID NO: 2560555 - protein, 8 aa, Entamoeba histolytica
DNEPQDGI

SEQ ID NO: 2560556 - protein, 15 aa, Entamoeba histolytica
DNEQQKYHPLPPSLE

SEQ ID NO: 2560557 - protein, 6 aa, Entamoeba histolytica
DNEQTI

SEQ ID NO: 2560558 - protein, 9 aa, Entamoeba histolytica
DNERGGDGR

SEQ ID NO: 2560559 - protein, 6 aa, Entamoeba histolytica
DNETRE

SEQ ID NO: 2560560 - protein, 6 aa, Entamoeba histolytica
DNEYSQ

SEQ ID NO: 2560561 - protein, 4 aa, Entamoeba histolytica
DNFN

SEQ ID NO: 2560562 - protein, 4 aa, Entamoeba histolytica
DNGC

SEQ ID NO: 2560563 - protein, 13 aa, Entamoeba histolytica
DNGDQMSKQYTGT

SEQ ID NO: 2560564 - protein, 6 aa, Entamoeba histolytica
DNGERY

SEQ ID NO: 2560565 - protein, 23 aa, Entamoeba histolytica
DNGKTITEEESEKETIKQTSLGA

SEQ ID NO: 2560566 - protein, 6 aa, Entamoeba histolytica
DNGQIG

SEQ ID NO: 2560567 - protein, 7 aa, Entamoeba histolytica
DNGSGAV

SEQ ID NO: 2560568 - protein, 6 aa, Entamoeba histolytica
DNHNQL

SEQ ID NO: 2560569 - protein, 8 aa, Entamoeba histolytica
DNHTRRSQ

SEQ ID NO: 2560570 - protein, 7 aa, Entamoeba histolytica
DNHYEDK

SEQ ID NO: 2560571 - protein, 9 aa, Entamoeba histolytica
DNIATGRSI

SEQ ID NO: 2560572 - protein, 7 aa, Entamoeba histolytica
DNIEKER

SEQ ID NO: 2560573 - protein, 8 aa, Entamoeba histolytica
DNIETARS

SEQ ID NO: 2560574 - protein, 9 aa, Entamoeba histolytica
DNIGSSNGM

SEQ ID NO: 2560575 - protein, 8 aa, Entamoeba histolytica
DNIPNAKD

SEQ ID NO: 2560576 - protein, 8 aa, Entamoeba histolytica
DNIPPSNG

SEQ ID NO: 2560577 - protein, 7 aa, Entamoeba histolytica
DNIPSSK

SEQ ID NO: 2560578 - protein, 6 aa, Entamoeba histolytica
DNIQTD

SEQ ID NO: 2560579 - protein, 15 aa, Entamoeba histolytica
DNISSKNKVKKPTKF

SEQ ID NO: 2560580 - protein, 13 aa, Entamoeba histolytica
DNKAQTKLTKNNI

SEQ ID NO: 2560581 - protein, 8 aa, Entamoeba histolytica
DNKDHKDL

SEQ ID NO: 2560582 - protein, 17 aa, Entamoeba histolytica
DNKEYNYSSACLMIKTV

SEQ ID NO: 2560583 - protein, 8 aa, Entamoeba histolytica
DNKIPKKI

SEQ ID NO: 2560584 - protein, 4 aa, Entamoeba histolytica
DNKK

SEQ ID NO: 2560585 - protein, 9 aa, Entamoeba histolytica
DNKKNLKGG

SEQ ID NO: 2560586 - protein, 4 aa, Entamoeba histolytica
DNKL

SEQ ID NO: 2560587 - protein, 8 aa, Entamoeba histolytica
DNKPTQLN

SEQ ID NO: 2560588 - protein, 7 aa, Entamoeba histolytica
DNKQPPI

SEQ ID NO: 2560589 - protein, 6 aa, Entamoeba histolytica
DNKRQL

SEQ ID NO: 2560590 - protein, 7 aa, Entamoeba histolytica
DNKTQLY

SEQ ID NO: 2560591 - protein, 10 aa, Entamoeba histolytica
DNKYSVNTPE

SEQ ID NO: 2560592 - protein, 5 aa, Entamoeba histolytica
DNLDD

SEQ ID NO: 2560593 - protein, 18 aa, Entamoeba histolytica
DNLDGKQARRTKSSSPLG

SEQ ID NO: 2560594 - protein, 18 aa, Entamoeba histolytica
DNLDGKQARRTSNSSPLG

SEQ ID NO: 2560595 - protein, 14 aa, Entamoeba histolytica
DNLDPTKQTSDEEM

SEQ ID NO: 2560596 - protein, 10 aa, Entamoeba histolytica
DNLDSTSTTL

SEQ ID NO: 2560597 - protein, 5 aa, Entamoeba histolytica
DNLGR

SEQ ID NO: 2560598 - protein, 4 aa, Entamoeba histolytica
DNLK

SEQ ID NO: 2560599 - protein, 16 aa, Entamoeba histolytica
DNLNENAQFSSNKGQV

SEQ ID NO: 2560600 - protein, 6 aa, Entamoeba histolytica
DNLSKG

SEQ ID NO: 2560601 - protein, 19 aa, Entamoeba histolytica
DNMSNTQNCTNRKATINYK

SEQ ID NO: 2560602 - protein, 8 aa, Entamoeba histolytica
DNNECKKC

SEQ ID NO: 2560603 - protein, 10 aa, Entamoeba histolytica
DNNEDFNNRT

SEQ ID NO: 2560604 - protein, 7 aa, Entamoeba histolytica
DNNEKPA

SEQ ID NO: 2560605 - protein, 9 aa, Entamoeba histolytica
DNNENEIND

SEQ ID NO: 2560606 - protein, 5 aa, Entamoeba histolytica
DNNEY

SEQ ID NO: 2560607 - protein, 4 aa, Entamoeba histolytica
DNNI

SEQ ID NO: 2560608 - protein, 5 aa, Entamoeba histolytica
DNNIS

SEQ ID NO: 2560609 - protein, 12 aa, Entamoeba histolytica
DNNKPTSNTTLN

SEQ ID NO: 2560610 - protein, 5 aa, Entamoeba histolytica
DNNNL

SEQ ID NO: 2560611 - protein, 7 aa, Entamoeba histolytica
DNNNNKT

SEQ ID NO: 2560612 - protein, 7 aa, Entamoeba histolytica
DNNNQEV

SEQ ID NO: 2560613 - protein, 6 aa, Entamoeba histolytica
DNNNSG

SEQ ID NO: 2560614 - protein, 5 aa, Entamoeba histolytica
DNPEV

SEQ ID NO: 2560615 - protein, 9 aa, Entamoeba histolytica
DNPIEEEKG

SEQ ID NO: 2560616 - protein, 6 aa, Entamoeba histolytica
DNPINI

SEQ ID NO: 2560617 - protein, 5 aa, Entamoeba histolytica
DNPIQ

SEQ ID NO: 2560618 - protein, 6 aa, Entamoeba histolytica
DNPLSD

SEQ ID NO: 2560619 - protein, 10 aa, Entamoeba histolytica
DNPNTPHSNC

SEQ ID NO: 2560620 - protein, 7 aa, Entamoeba histolytica
DNPSAGG

SEQ ID NO: 2560621 - protein, 5 aa, Entamoeba histolytica
DNPSE

SEQ ID NO: 2560622 - protein, 9 aa, Entamoeba histolytica
DNPSQAGYY

SEQ ID NO: 2560623 - protein, 7 aa, Entamoeba histolytica
DNPTSIY

SEQ ID NO: 2560624 - protein, 5 aa, Entamoeba histolytica
DNPYD

SEQ ID NO: 2560625 - protein, 9 aa, Entamoeba histolytica
DNQEESELF

SEQ ID NO: 2560626 - protein, 12 aa, Entamoeba histolytica
DNQHEVLSWIRN

SEQ ID NO: 2560627 - protein, 11 aa, Entamoeba histolytica
DNQNKTNYSQD

SEQ ID NO: 2560628 - protein, 16 aa, Entamoeba histolytica
DNQNYCSECEEGKYLQ

SEQ ID NO: 2560629 - protein, 7 aa, Entamoeba histolytica
DNREESL

SEQ ID NO: 2560630 - protein, 8 aa, Entamoeba histolytica
DNRGKITN

SEQ ID NO: 2560631 - protein, 4 aa, Entamoeba histolytica
DNSA

SEQ ID NO: 2560632 - protein, 15 aa, Entamoeba histolytica
DNSDGQNKDKSGTFK

SEQ ID NO: 2560633 - protein, 5 aa, Entamoeba histolytica
DNSFM

SEQ ID NO: 2560634 - protein, 8 aa, Entamoeba histolytica
DNSINTKT

SEQ ID NO: 2560635 - protein, 7 aa, Entamoeba histolytica
DNSLDFG

SEQ ID NO: 2560636 - protein, 6 aa, Entamoeba histolytica
DNSLYK

SEQ ID NO: 2560637 - protein, 6 aa, Entamoeba histolytica
DNSMES

SEQ ID NO: 2560638 - protein, 8 aa, Entamoeba histolytica
DNSNEFEQ

SEQ ID NO: 2560639 - protein, 5 aa, Entamoeba histolytica
DNSPD

SEQ ID NO: 2560640 - protein, 20 aa, Entamoeba histolytica
DNSPDKTGEKVQRLKSEGHK

SEQ ID NO: 2560641 - protein, 5 aa, Entamoeba histolytica
DNSPI

SEQ ID NO: 2560642 - protein, 7 aa, Entamoeba histolytica
DNSQILG

SEQ ID NO: 2560643 - protein, 9 aa, Entamoeba histolytica
DNSQSESPL

SEQ ID NO: 2560644 - protein, 4 aa, Entamoeba histolytica
DNSS

SEQ ID NO: 2560645 - protein, 13 aa, Entamoeba histolytica
DNSSDQNDQNNKI

SEQ ID NO: 2560646 - protein, 6 aa, Entamoeba histolytica
DNSSNQ

SEQ ID NO: 2560647 - protein, 13 aa, Entamoeba histolytica
DNSTTGRNENEII

SEQ ID NO: 2560648 - protein, 6 aa, Entamoeba histolytica
DNSYKD

SEQ ID NO: 2560649 - protein, 8 aa, Entamoeba histolytica
DNTETGIP

SEQ ID NO: 2560650 - protein, 21 aa, Entamoeba histolytica
DNTGSKKLTHVPATDSEPAKI

SEQ ID NO: 2560651 - protein, 4 aa, Entamoeba histolytica
DNTI

SEQ ID NO: 2560652 - protein, 4 aa, Entamoeba histolytica
DNTL

SEQ ID NO: 2560653 - protein, 25 aa, Entamoeba histolytica
DNTNTTVDPPFTPNSKDSIPKNRAY

SEQ ID NO: 2560654 - protein, 6 aa, Entamoeba histolytica
DNTNTY

SEQ ID NO: 2560655 - protein, 6 aa, Entamoeba histolytica
DNTQAN

SEQ ID NO: 2560656 - protein, 7 aa, Entamoeba histolytica
DNTQEIS

SEQ ID NO: 2560657 - protein, 8 aa, Entamoeba histolytica
DNVKTDTI

SEQ ID NO: 2560658 - protein, 9 aa, Entamoeba histolytica
DNVNDAKYA

SEQ ID NO: 2560659 - protein, 9 aa, Entamoeba histolytica
DNVNDANYA

SEQ ID NO: 2560660 - protein, 8 aa, Entamoeba histolytica
DNWPEAGD

SEQ ID NO: 2560661 - protein, 5 aa, Entamoeba histolytica
DNYDN

SEQ ID NO: 2560662 - protein, 10 aa, Entamoeba histolytica
DNYENKEQQH

SEQ ID NO: 2560663 - protein, 7 aa, Entamoeba histolytica
DNYSPRN

SEQ ID NO: 2560664 - protein, 14 aa, Entamoeba histolytica
DPDKPGTKRTYEGT

SEQ ID NO: 2560665 - protein, 6 aa, Entamoeba histolytica
DPEEDI

SEQ ID NO: 2560666 - protein, 4 aa, Entamoeba histolytica
DPEI

SEQ ID NO: 2560667 - protein, 9 aa, Entamoeba histolytica
DPEKTAQMR

SEQ ID NO: 2560668 - protein, 4 aa, Entamoeba histolytica
DPEL

SEQ ID NO: 2560669 - protein, 7 aa, Entamoeba histolytica
DPELPDG

SEQ ID NO: 2560670 - protein, 7 aa, Entamoeba histolytica
DPENVNA

SEQ ID NO: 2560671 - protein, 6 aa, Entamoeba histolytica
DPEQAN

SEQ ID NO: 2560672 - protein, 5 aa, Entamoeba histolytica
DPEVT

SEQ ID NO: 2560673 - protein, 11 aa, Entamoeba histolytica
DPFKRKSDKDI

SEQ ID NO: 2560674 - protein, 9 aa, Entamoeba histolytica
DPFPKNDER

SEQ ID NO: 2560675 - protein, 8 aa, Entamoeba histolytica
DPFSTTSR

SEQ ID NO: 2560676 - protein, 7 aa, Entamoeba histolytica
DPGKGNY

SEQ ID NO: 2560677 - protein, 8 aa, Entamoeba histolytica
DPGTYRDE

SEQ ID NO: 2560678 - protein, 4 aa, Entamoeba histolytica
DPHT

SEQ ID NO: 2560679 - protein, 19 aa, Entamoeba histolytica
DPIDTDNIKTNRKQDASVG

SEQ ID NO: 2560680 - protein, 10 aa, Entamoeba histolytica
DPKASKGKRY

SEQ ID NO: 2560681 - protein, 6 aa, Entamoeba histolytica
DPKDDE

SEQ ID NO: 2560682 - protein, 21 aa, Entamoeba histolytica
DPKDSSSQETSTSETTSSDIN

SEQ ID NO: 2560683 - protein, 9 aa, Entamoeba histolytica
DPKNEDKIR

SEQ ID NO: 2560684 - protein, 5 aa, Entamoeba histolytica
DPKNQ

SEQ ID NO: 2560685 - protein, 7 aa, Entamoeba histolytica
DPKQPNL

SEQ ID NO: 2560686 - protein, 8 aa, Entamoeba histolytica
DPKRKRLS

SEQ ID NO: 2560687 - protein, 13 aa, Entamoeba histolytica
DPKRYEATEPSRD

SEQ ID NO: 2560688 - protein, 18 aa, Entamoeba histolytica
DPKTISLKDEELGTGGYG

SEQ ID NO: 2560689 - protein, 4 aa, Entamoeba histolytica
DPLE

SEQ ID NO: 2560690 - protein, 6 aa, Entamoeba histolytica
DPLSRL

SEQ ID NO: 2560691 - protein, 11 aa, Entamoeba histolytica
DPNEEGDNDTR

SEQ ID NO: 2560692 - protein, 8 aa, Entamoeba histolytica
DPNEISAK

SEQ ID NO: 2560693 - protein, 8 aa, Entamoeba histolytica
DPNGGWGD

SEQ ID NO: 2560694 - protein, 26 aa, Entamoeba histolytica
DPNKISSGGKSKPSISIADGKGNKIN

SEQ ID NO: 2560695 - protein, 12 aa, Entamoeba histolytica
DPNKKEEVQKNN

SEQ ID NO: 2560696 - protein, 7 aa, Entamoeba histolytica
DPNSARW

SEQ ID NO: 2560697 - protein, 7 aa, Entamoeba histolytica
DPNTEND

SEQ ID NO: 2560698 - protein, 8 aa, Entamoeba histolytica
DPNTENFA

SEQ ID NO: 2560699 - protein, 13 aa, Entamoeba histolytica
DPNTVSNDTGSNV

SEQ ID NO: 2560700 - protein, 5 aa, Entamoeba histolytica
DPPND

SEQ ID NO: 2560701 - protein, 8 aa, Entamoeba histolytica
DPPRNESA

SEQ ID NO: 2560702 - protein, 6 aa, Entamoeba histolytica
DPPTLT

SEQ ID NO: 2560703 - protein, 14 aa, Entamoeba histolytica
DPQAAKGNSPSYRG

SEQ ID NO: 2560704 - protein, 5 aa, Entamoeba histolytica
DPQEL

SEQ ID NO: 2560705 - protein, 9 aa, Entamoeba histolytica
DPQHDLNKG

SEQ ID NO: 2560706 - protein, 7 aa, Entamoeba histolytica
DPQIPAG

SEQ ID NO: 2560707 - protein, 6 aa, Entamoeba histolytica
DPQIPS

SEQ ID NO: 2560708 - protein, 11 aa, Entamoeba histolytica
DPQNNEGACNS

SEQ ID NO: 2560709 - protein, 12 aa, Entamoeba histolytica
DPQTFEDSNYPE

SEQ ID NO: 2560710 - protein, 4 aa, Entamoeba histolytica
DPQY

SEQ ID NO: 2560711 - protein, 8 aa, Entamoeba histolytica
DPRLDKDD

SEQ ID NO: 2560712 - protein, 6 aa, Entamoeba histolytica
DPRQAL

SEQ ID NO: 2560713 - protein, 6 aa, Entamoeba histolytica
DPSFEG

SEQ ID NO: 2560714 - protein, 6 aa, Entamoeba histolytica
DPSFKY

SEQ ID NO: 2560715 - protein, 17 aa, Entamoeba histolytica
DPSITSGLEDSEKEFKS

SEQ ID NO: 2560716 - protein, 21 aa, Entamoeba histolytica
DPSLKNSGHGRKSPRTNRGGT

SEQ ID NO: 2560717 - protein, 14 aa, Entamoeba histolytica
DPSLPSISTSTPFN

SEQ ID NO: 2560718 - protein, 9 aa, Entamoeba histolytica
DPSLSTSNV

SEQ ID NO: 2560719 - protein, 9 aa, Entamoeba histolytica
DPSQDDKLN

SEQ ID NO: 2560720 - protein, 7 aa, Entamoeba histolytica
DPSRPYT

SEQ ID NO: 2560721 - protein, 13 aa, Entamoeba histolytica
DPSRVETTVNSNP

SEQ ID NO: 2560722 - protein, 5 aa, Entamoeba histolytica
DPSSK

SEQ ID NO: 2560723 - protein, 10 aa, Entamoeba histolytica
DPSTQTNTDY

SEQ ID NO: 2560724 - protein, 4 aa, Entamoeba histolytica
DPSV

SEQ ID NO: 2560725 - protein, 5 aa, Entamoeba histolytica
DPTCN

SEQ ID NO: 2560726 - protein, 4 aa, Entamoeba histolytica
DPTF

SEQ ID NO: 2560727 - protein, 8 aa, Entamoeba histolytica
DPTKRINQ

SEQ ID NO: 2560728 - protein, 4 aa, Entamoeba histolytica
DPTN

SEQ ID NO: 2560729 - protein, 10 aa, Entamoeba histolytica
DPTSNGSSLQ

SEQ ID NO: 2560730 - protein, 6 aa, Entamoeba histolytica
DPTYVP

SEQ ID NO: 2560731 - protein, 14 aa, Entamoeba histolytica
DPVGGKVTLDGNDL

SEQ ID NO: 2560732 - protein, 9 aa, Entamoeba histolytica
DPVKGKAGS

SEQ ID NO: 2560733 - protein, 10 aa, Entamoeba histolytica
DPYDGVDDGS

SEQ ID NO: 2560734 - protein, 12 aa, Entamoeba histolytica
DPYDPAKFPDSD

SEQ ID NO: 2560735 - protein, 12 aa, Entamoeba histolytica
DPYDPEKFPDSE

SEQ ID NO: 2560736 - protein, 10 aa, Entamoeba histolytica
DPYDSTEFPN

SEQ ID NO: 2560737 - protein, 7 aa, Entamoeba histolytica
DPYGITP

SEQ ID NO: 2560738 - protein, 9 aa, Entamoeba histolytica
DPYGKDEEF

SEQ ID NO: 2560739 - protein, 6 aa, Entamoeba histolytica
DPYNPM

SEQ ID NO: 2560740 - protein, 7 aa, Entamoeba histolytica
DPYPKQE

SEQ ID NO: 2560741 - protein, 7 aa, Entamoeba histolytica
DPYPNDK

SEQ ID NO: 2560742 - protein, 6 aa, Entamoeba histolytica
DQAGTC

SEQ ID NO: 2560743 - protein, 10 aa, Entamoeba histolytica
DQASMTGESV

SEQ ID NO: 2560744 - protein, 4 aa, Entamoeba histolytica
DQDE

SEQ ID NO: 2560745 - protein, 4 aa, Entamoeba histolytica
DQEI

SEQ ID NO: 2560746 - protein, 8 aa, Entamoeba histolytica
DQEQFSSE

SEQ ID NO: 2560747 - protein, 6 aa, Entamoeba histolytica
DQFKQG

SEQ ID NO: 2560748 - protein, 7 aa, Entamoeba histolytica
DQFKRGK

SEQ ID NO: 2560749 - protein, 16 aa, Entamoeba histolytica
DQGDIQFGENGERVMG

SEQ ID NO: 2560750 - protein, 28 aa, Entamoeba histolytica
DQKAEKERSSKVESKETTPVEETERPKT

SEQ ID NO: 2560751 - protein, 18 aa, Entamoeba histolytica
DQKHQAQQLEPQPPFNSL

SEQ ID NO: 2560752 - protein, 7 aa, Entamoeba histolytica
DQKNPKS

SEQ ID NO: 2560753 - protein, 7 aa, Entamoeba histolytica
DQKPSGL

SEQ ID NO: 2560754 - protein, 4 aa, Entamoeba histolytica
DQKV

SEQ ID NO: 2560755 - protein, 10 aa, Entamoeba histolytica
DQLQEDVPST

SEQ ID NO: 2560756 - protein, 5 aa, Entamoeba histolytica
DQLTN

SEQ ID NO: 2560757 - protein, 12 aa, Entamoeba histolytica
DQLTNEDELTNQ

SEQ ID NO: 2560758 - protein, 6 aa, Entamoeba histolytica
DQNGKI

SEQ ID NO: 2560759 - protein, 10 aa, Entamoeba histolytica
DQNHPLPTNT

SEQ ID NO: 2560760 - protein, 5 aa, Entamoeba histolytica
DQNID

SEQ ID NO: 2560761 - protein, 6 aa, Entamoeba histolytica
DQNTNE

SEQ ID NO: 2560762 - protein, 8 aa, Entamoeba histolytica
DQNYKECS

SEQ ID NO: 2560763 - protein, 7 aa, Entamoeba histolytica
DQQDSNF

SEQ ID NO: 2560764 - protein, 8 aa, Entamoeba histolytica
DQQGMRDK

SEQ ID NO: 2560765 - protein, 6 aa, Entamoeba histolytica
DQQNEQ

SEQ ID NO: 2560766 - protein, 6 aa, Entamoeba histolytica
DQRDSA

SEQ ID NO: 2560767 - protein, 8 aa, Entamoeba histolytica
DQSKDLKK

SEQ ID NO: 2560768 - protein, 6 aa, Entamoeba histolytica
DQSKGI

SEQ ID NO: 2560769 - protein, 8 aa, Entamoeba histolytica
DQSPEKRC

SEQ ID NO: 2560770 - protein, 40 aa, Entamoeba histolytica
DQSTPMGQPAQPMYPQPTQPMYNQAPGYAQPSPMGQPAQQ

SEQ ID NO: 2560771 - protein, 4 aa, Entamoeba histolytica
DQSY

SEQ ID NO: 2560772 - protein, 7 aa, Entamoeba histolytica
DQSYASQ

SEQ ID NO: 2560773 - protein, 8 aa, Entamoeba histolytica
DQTGLKGF

SEQ ID NO: 2560774 - protein, 6 aa, Entamoeba histolytica
DQTGVE

SEQ ID NO: 2560775 - protein, 7 aa, Entamoeba histolytica
DQTKNKY

SEQ ID NO: 2560776 - protein, 8 aa, Entamoeba histolytica
DQTPGDTV

SEQ ID NO: 2560777 - protein, 6 aa, Entamoeba histolytica
DQTQDN

SEQ ID NO: 2560778 - protein, 6 aa, Entamoeba histolytica
DQTTHS

SEQ ID NO: 2560779 - protein, 6 aa, Entamoeba histolytica
DQVPQD

SEQ ID NO: 2560780 - protein, 15 aa, Entamoeba histolytica
DRDDSSGTFPSGHCG

SEQ ID NO: 2560781 - protein, 5 aa, Entamoeba histolytica
DRDGN

SEQ ID NO: 2560782 - protein, 7 aa, Entamoeba histolytica
DRDGTAI

SEQ ID NO: 2560783 - protein, 7 aa, Entamoeba histolytica
DREGGGV

SEQ ID NO: 2560784 - protein, 6 aa, Entamoeba histolytica
DREGQD

SEQ ID NO: 2560785 - protein, 6 aa, Entamoeba histolytica
DREHRN

SEQ ID NO: 2560786 - protein, 7 aa, Entamoeba histolytica
DRENGMQ

SEQ ID NO: 2560787 - protein, 7 aa, Entamoeba histolytica
DREQSKL

SEQ ID NO: 2560788 - protein, 5 aa, Entamoeba histolytica
DRERI

SEQ ID NO: 2560789 - protein, 5 aa, Entamoeba histolytica
DRESI

SEQ ID NO: 2560790 - protein, 9 aa, Entamoeba histolytica
DRESLTPSR

SEQ ID NO: 2560791 - protein, 7 aa, Entamoeba histolytica
DRIPETN

SEQ ID NO: 2560792 - protein, 4 aa, Entamoeba histolytica
DRIT

SEQ ID NO: 2560793 - protein, 13 aa, Entamoeba histolytica
DRITRKFTSKDNN

SEQ ID NO: 2560794 - protein, 6 aa, Entamoeba histolytica
DRKREE

SEQ ID NO: 2560795 - protein, 10 aa, Entamoeba histolytica
DRLDATNAKL

SEQ ID NO: 2560796 - protein, 5 aa, Entamoeba histolytica
DRLDD

SEQ ID NO: 2560797 - protein, 7 aa, Entamoeba histolytica
DRNASNR

SEQ ID NO: 2560798 - protein, 10 aa, Entamoeba histolytica
DRNKPTGFDR

SEQ ID NO: 2560799 - protein, 7 aa, Entamoeba histolytica
DRNKQID

SEQ ID NO: 2560800 - protein, 27 aa, Entamoeba histolytica
DRNYPSNSEKTQEHSESYSMSEDYSDM

SEQ ID NO: 2560801 - protein, 4 aa, Entamoeba histolytica
DRPI

SEQ ID NO: 2560802 - protein, 5 aa, Entamoeba histolytica
DRPQF

SEQ ID NO: 2560803 - protein, 6 aa, Entamoeba histolytica
DRPSED

SEQ ID NO: 2560804 - protein, 7 aa, Entamoeba histolytica
DRQDIQR

SEQ ID NO: 2560805 - protein, 5 aa, Entamoeba histolytica
DRQNQ

SEQ ID NO: 2560806 - protein, 8 aa, Entamoeba histolytica
DRRQEVAN

SEQ ID NO: 2560807 - protein, 5 aa, Entamoeba histolytica
DRRSV

SEQ ID NO: 2560808 - protein, 8 aa, Entamoeba histolytica
DRSPHSPP

SEQ ID NO: 2560809 - protein, 9 aa, Entamoeba histolytica
DRSTGTNKI

SEQ ID NO: 2560810 - protein, 5 aa, Entamoeba histolytica
DRSWG

SEQ ID NO: 2560811 - protein, 4 aa, Entamoeba histolytica
DRTI

SEQ ID NO: 2560812 - protein, 17 aa, Entamoeba histolytica
DRTKGIGDFPDSYAYDG

SEQ ID NO: 2560813 - protein, 6 aa, Entamoeba histolytica
DRTNNS

SEQ ID NO: 2560814 - protein, 7 aa, Entamoeba histolytica
DRTSQTC

SEQ ID NO: 2560815 - protein, 5 aa, Entamoeba histolytica
DRTSS

SEQ ID NO: 2560816 - protein, 12 aa, Entamoeba histolytica
DRTTNGRGNASY

SEQ ID NO: 2560817 - protein, 10 aa, Entamoeba histolytica
DRTVAQRKGV

SEQ ID NO: 2560818 - protein, 8 aa, Entamoeba histolytica
DRVEVETS

SEQ ID NO: 2560819 - protein, 6 aa, Entamoeba histolytica
DSAQTL

SEQ ID NO: 2560820 - protein, 7 aa, Entamoeba histolytica
DSCEVPE

SEQ ID NO: 2560821 - protein, 32 aa, Entamoeba histolytica
DSCRGNDKTNYSFPSPPSVSEYSDFKSGNCGK

SEQ ID NO: 2560822 - protein, 8 aa, Entamoeba histolytica
DSCSDASP

SEQ ID NO: 2560823 - protein, 17 aa, Entamoeba histolytica
DSDDSSDDIMKPQTDDK

SEQ ID NO: 2560824 - protein, 15 aa, Entamoeba histolytica
DSDEDQTPPKEEQPE

SEQ ID NO: 2560825 - protein, 5 aa, Entamoeba histolytica
DSDEY

SEQ ID NO: 2560826 - protein, 5 aa, Entamoeba histolytica
DSDGT

SEQ ID NO: 2560827 - protein, 8 aa, Entamoeba histolytica
DSDNLTAE

SEQ ID NO: 2560828 - protein, 9 aa, Entamoeba histolytica
DSDSAEHGS

SEQ ID NO: 2560829 - protein, 7 aa, Entamoeba histolytica
DSEDEVG

SEQ ID NO: 2560830 - protein, 9 aa, Entamoeba histolytica
DSEESGYNN

SEQ ID NO: 2560831 - protein, 7 aa, Entamoeba histolytica
DSEGNVL

SEQ ID NO: 2560832 - protein, 7 aa, Entamoeba histolytica
DSEKKVN

SEQ ID NO: 2560833 - protein, 5 aa, Entamoeba histolytica
DSELE

SEQ ID NO: 2560834 - protein, 7 aa, Entamoeba histolytica
DSEMYQQ

SEQ ID NO: 2560835 - protein, 8 aa, Entamoeba histolytica
DSENQRGV

SEQ ID NO: 2560836 - protein, 5 aa, Entamoeba histolytica
DSENS

SEQ ID NO: 2560837 - protein, 7 aa, Entamoeba histolytica
DSEQDNT

SEQ ID NO: 2560838 - protein, 4 aa, Entamoeba histolytica
DSEV

SEQ ID NO: 2560839 - protein, 8 aa, Entamoeba histolytica
DSFKESDS

SEQ ID NO: 2560840 - protein, 8 aa, Entamoeba histolytica
DSFPNFPQ

SEQ ID NO: 2560841 - protein, 6 aa, Entamoeba histolytica
DSFPPE

SEQ ID NO: 2560842 - protein, 8 aa, Entamoeba histolytica
DSFPSTES

SEQ ID NO: 2560843 - protein, 8 aa, Entamoeba histolytica
DSFTGCGS

SEQ ID NO: 2560844 - protein, 6 aa, Entamoeba histolytica
DSGDCL

SEQ ID NO: 2560845 - protein, 5 aa, Entamoeba histolytica
DSGII

SEQ ID NO: 2560846 - protein, 7 aa, Entamoeba histolytica
DSGITQR

SEQ ID NO: 2560847 - protein, 7 aa, Entamoeba histolytica
DSGRRKH

SEQ ID NO: 2560848 - protein, 4 aa, Entamoeba histolytica
DSGT

SEQ ID NO: 2560849 - protein, 7 aa, Entamoeba histolytica
DSGTNDG

SEQ ID NO: 2560850 - protein, 8 aa, Entamoeba histolytica
DSHGNRNI

SEQ ID NO: 2560851 - protein, 5 aa, Entamoeba histolytica
DSHNQ

SEQ ID NO: 2560852 - protein, 5 aa, Entamoeba histolytica
DSIGC

SEQ ID NO: 2560853 - protein, 5 aa, Entamoeba histolytica
DSIKG

SEQ ID NO: 2560854 - protein, 7 aa, Entamoeba histolytica
DSIKKDG

SEQ ID NO: 2560855 - protein, 8 aa, Entamoeba histolytica
DSINRSSQ

SEQ ID NO: 2560856 - protein, 15 aa, Entamoeba histolytica
DSIPPDKSSISNSTQ

SEQ ID NO: 2560857 - protein, 10 aa, Entamoeba histolytica
DSISFSSDTP

SEQ ID NO: 2560858 - protein, 6 aa, Entamoeba histolytica
DSITSE

SEQ ID NO: 2560859 - protein, 21 aa, Entamoeba histolytica
DSKCSKCKGMNKPDPKGEKCV

SEQ ID NO: 2560860 - protein, 7 aa, Entamoeba histolytica
DSKGETL

SEQ ID NO: 2560861 - protein, 8 aa, Entamoeba histolytica
DSKHKSCS

SEQ ID NO: 2560862 - protein, 8 aa, Entamoeba histolytica
DSKHNSIR

SEQ ID NO: 2560863 - protein, 8 aa, Entamoeba histolytica
DSKNQNQV

SEQ ID NO: 2560864 - protein, 16 aa, Entamoeba histolytica
DSKQINGNVEKEESIV

SEQ ID NO: 2560865 - protein, 10 aa, Entamoeba histolytica
DSKQKAQPVE

SEQ ID NO: 2560866 - protein, 10 aa, Entamoeba histolytica
DSKQNNLQPD

SEQ ID NO: 2560867 - protein, 9 aa, Entamoeba histolytica
DSKQSKKLK

SEQ ID NO: 2560868 - protein, 7 aa, Entamoeba histolytica
DSKTSES

SEQ ID NO: 2560869 - protein, 8 aa, Entamoeba histolytica
DSLAKDLS

SEQ ID NO: 2560870 - protein, 9 aa, Entamoeba histolytica
DSLASDLTK

SEQ ID NO: 2560871 - protein, 5 aa, Entamoeba histolytica
DSLDG

SEQ ID NO: 2560872 - protein, 5 aa, Entamoeba histolytica
DSLET

SEQ ID NO: 2560873 - protein, 6 aa, Entamoeba histolytica
DSLGGS

SEQ ID NO: 2560874 - protein, 10 aa, Entamoeba histolytica
DSLKADDEST

SEQ ID NO: 2560875 - protein, 4 aa, Entamoeba histolytica
DSLN

SEQ ID NO: 2560876 - protein, 6 aa, Entamoeba histolytica
DSLNDK

SEQ ID NO: 2560877 - protein, 10 aa, Entamoeba histolytica
DSLNSYDPED

SEQ ID NO: 2560878 - protein, 16 aa, Entamoeba histolytica
DSLRKQKQVNLNEFLF

SEQ ID NO: 2560879 - protein, 10 aa, Entamoeba histolytica
DSLSEPISIP

SEQ ID NO: 2560880 - protein, 6 aa, Entamoeba histolytica
DSLTVT

SEQ ID NO: 2560881 - protein, 8 aa, Entamoeba histolytica
DSMARDDS

SEQ ID NO: 2560882 - protein, 8 aa, Entamoeba histolytica
DSMTEQQV

SEQ ID NO: 2560883 - protein, 7 aa, Entamoeba histolytica
DSNATHS

SEQ ID NO: 2560884 - protein, 5 aa, Entamoeba histolytica
DSNDP

SEQ ID NO: 2560885 - protein, 8 aa, Entamoeba histolytica
DSNDPNPI

SEQ ID NO: 2560886 - protein, 24 aa, Entamoeba histolytica
DSNINEKRDELMNKSNENNTPTQQ

SEQ ID NO: 2560887 - protein, 11 aa, Entamoeba histolytica
DSNNSLKQNGY

SEQ ID NO: 2560888 - protein, 13 aa, Entamoeba histolytica
DSNPNGIGSGYAT

SEQ ID NO: 2560889 - protein, 8 aa, Entamoeba histolytica
DSNSNVHP

SEQ ID NO: 2560890 - protein, 6 aa, Entamoeba histolytica
DSNSYD

SEQ ID NO: 2560891 - protein, 6 aa, Entamoeba histolytica
DSNSYP

SEQ ID NO: 2560892 - protein, 7 aa, Entamoeba histolytica
DSNVRSY

SEQ ID NO: 2560893 - protein, 7 aa, Entamoeba histolytica
DSPDENI

SEQ ID NO: 2560894 - protein, 14 aa, Entamoeba histolytica
DSPEKLIKDIQNKS

SEQ ID NO: 2560895 - protein, 5 aa, Entamoeba histolytica
DSPFE

SEQ ID NO: 2560896 - protein, 8 aa, Entamoeba histolytica
DSPHESRS

SEQ ID NO: 2560897 - protein, 5 aa, Entamoeba histolytica
DSPIP

SEQ ID NO: 2560898 - protein, 7 aa, Entamoeba histolytica
DSPITTA

SEQ ID NO: 2560899 - protein, 7 aa, Entamoeba histolytica
DSPLEKC

SEQ ID NO: 2560900 - protein, 7 aa, Entamoeba histolytica
DSPLGES

SEQ ID NO: 2560901 - protein, 13 aa, Entamoeba histolytica
DSPLTREKVPRTP

SEQ ID NO: 2560902 - protein, 7 aa, Entamoeba histolytica
DSPVGKS

SEQ ID NO: 2560903 - protein, 5 aa, Entamoeba histolytica
DSQCT

SEQ ID NO: 2560904 - protein, 25 aa, Entamoeba histolytica
DSQGNVIKSDDHNLKQSTKNSEQEI

SEQ ID NO: 2560905 - protein, 8 aa, Entamoeba histolytica
DSQGWKEK

SEQ ID NO: 2560906 - protein, 8 aa, Entamoeba histolytica
DSQLDQSN

SEQ ID NO: 2560907 - protein, 17 aa, Entamoeba histolytica
DSQPGEVTSQSYFSDSE

SEQ ID NO: 2560908 - protein, 12 aa, Entamoeba histolytica
DSQQPINEEIPM

SEQ ID NO: 2560909 - protein, 14 aa, Entamoeba histolytica
DSQRQATKDAGTIA

SEQ ID NO: 2560910 - protein, 9 aa, Entamoeba histolytica
DSQTKECAQ

SEQ ID NO: 2560911 - protein, 7 aa, Entamoeba histolytica
DSQTRIK

SEQ ID NO: 2560912 - protein, 12 aa, Entamoeba histolytica
DSRGKKGGNSFE

SEQ ID NO: 2560913 - protein, 8 aa, Entamoeba histolytica
DSRHRSSI

SEQ ID NO: 2560914 - protein, 8 aa, Entamoeba histolytica
DSRKEGND

SEQ ID NO: 2560915 - protein, 7 aa, Entamoeba histolytica
DSRLSRT

SEQ ID NO: 2560916 - protein, 7 aa, Entamoeba histolytica
DSRSLRG

SEQ ID NO: 2560917 - protein, 7 aa, Entamoeba histolytica
DSRYQNP

SEQ ID NO: 2560918 - protein, 10 aa, Entamoeba histolytica
DSSDQSTNQT

SEQ ID NO: 2560919 - protein, 8 aa, Entamoeba histolytica
DSSEQHQD

SEQ ID NO: 2560920 - protein, 4 aa, Entamoeba histolytica
DSSK

SEQ ID NO: 2560921 - protein, 6 aa, Entamoeba histolytica
DSSKEL

SEQ ID NO: 2560922 - protein, 7 aa, Entamoeba histolytica
DSSKSNK

SEQ ID NO: 2560923 - protein, 7 aa, Entamoeba histolytica
DSSNTEV

SEQ ID NO: 2560924 - protein, 5 aa, Entamoeba histolytica
DSSQT

SEQ ID NO: 2560925 - protein, 9 aa, Entamoeba histolytica
DSSRRTGDM

SEQ ID NO: 2560926 - protein, 13 aa, Entamoeba histolytica
DSSSIKDDHCEKC

SEQ ID NO: 2560927 - protein, 8 aa, Entamoeba histolytica
DSSSNKCS

SEQ ID NO: 2560928 - protein, 28 aa, Entamoeba histolytica
DSSSTTESEDNSNQIESTQQGTDSTPLL

SEQ ID NO: 2560929 - protein, 16 aa, Entamoeba histolytica
DSSSVEPNIRPNNENH

SEQ ID NO: 2560930 - protein, 10 aa, Entamoeba histolytica
DSSTKDQTDF

SEQ ID NO: 2560931 - protein, 5 aa, Entamoeba histolytica
DSSTL

SEQ ID NO: 2560932 - protein, 10 aa, Entamoeba histolytica
DSSVMPSQQI

SEQ ID NO: 2560933 - protein, 4 aa, Entamoeba histolytica
DSSY

SEQ ID NO: 2560934 - protein, 7 aa, Entamoeba histolytica
DSSYENP

SEQ ID NO: 2560935 - protein, 6 aa, Entamoeba histolytica
DSTAEG

SEQ ID NO: 2560936 - protein, 6 aa, Entamoeba histolytica
DSTCSE

SEQ ID NO: 2560937 - protein, 12 aa, Entamoeba histolytica
DSTCSHRDNTTR

SEQ ID NO: 2560938 - protein, 6 aa, Entamoeba histolytica
DSTFSE

SEQ ID NO: 2560939 - protein, 4 aa, Entamoeba histolytica
DSTG

SEQ ID NO: 2560940 - protein, 8 aa, Entamoeba histolytica
DSTHCTTC

SEQ ID NO: 2560941 - protein, 10 aa, Entamoeba histolytica
DSTPEETGDY

SEQ ID NO: 2560942 - protein, 6 aa, Entamoeba histolytica
DSTPIK

SEQ ID NO: 2560943 - protein, 7 aa, Entamoeba histolytica
DSTPLKE

SEQ ID NO: 2560944 - protein, 10 aa, Entamoeba histolytica
DSTPQGNETI

SEQ ID NO: 2560945 - protein, 12 aa, Entamoeba histolytica
DSTSECIKGPSN

SEQ ID NO: 2560946 - protein, 7 aa, Entamoeba histolytica
DSTSQTN

SEQ ID NO: 2560947 - protein, 4 aa, Entamoeba histolytica
DSTT

SEQ ID NO: 2560948 - protein, 6 aa, Entamoeba histolytica
DSTTIR

SEQ ID NO: 2560949 - protein, 9 aa, Entamoeba histolytica
DSTTKGIRR

SEQ ID NO: 2560950 - protein, 5 aa, Entamoeba histolytica
DSVFP

SEQ ID NO: 2560951 - protein, 5 aa, Entamoeba histolytica
DSVHQ

SEQ ID NO: 2560952 - protein, 8 aa, Entamoeba histolytica
DSVKGDGV

SEQ ID NO: 2560953 - protein, 6 aa, Entamoeba histolytica
DSVSKM

SEQ ID NO: 2560954 - protein, 11 aa, Entamoeba histolytica
DSVSSQSDCYQ

SEQ ID NO: 2560955 - protein, 7 aa, Entamoeba histolytica
DSYATDN

SEQ ID NO: 2560956 - protein, 5 aa, Entamoeba histolytica
DSYEQ

SEQ ID NO: 2560957 - protein, 4 aa, Entamoeba histolytica
DSYG

SEQ ID NO: 2560958 - protein, 25 aa, Entamoeba histolytica
DSYNKNENKSNNNKATRINKPFKEQ

SEQ ID NO: 2560959 - protein, 5 aa, Entamoeba histolytica
DSYSP

SEQ ID NO: 2560960 - protein, 8 aa, Entamoeba histolytica
DSYSTEDL

SEQ ID NO: 2560961 - protein, 6 aa, Entamoeba histolytica
DSYTSV

SEQ ID NO: 2560962 - protein, 9 aa, Entamoeba histolytica
DTAATISRQ

SEQ ID NO: 2560963 - protein, 7 aa, Entamoeba histolytica
DTAFQDG

SEQ ID NO: 2560964 - protein, 9 aa, Entamoeba histolytica
DTASPKDRI

SEQ ID NO: 2560965 - protein, 8 aa, Entamoeba histolytica
DTCEKNNS

SEQ ID NO: 2560966 - protein, 10 aa, Entamoeba histolytica
DTCETINKKT

SEQ ID NO: 2560967 - protein, 8 aa, Entamoeba histolytica
DTDDNGKL

SEQ ID NO: 2560968 - protein, 7 aa, Entamoeba histolytica
DTDEDIE

SEQ ID NO: 2560969 - protein, 6 aa, Entamoeba histolytica
DTEIQN

SEQ ID NO: 2560970 - protein, 4 aa, Entamoeba histolytica
DTEK

SEQ ID NO: 2560971 - protein, 9 aa, Entamoeba histolytica
DTEKEDTDY

SEQ ID NO: 2560972 - protein, 9 aa, Entamoeba histolytica
DTEMTENSM

SEQ ID NO: 2560973 - protein, 29 aa, Entamoeba histolytica
DTERSNIDPKPRNPCETATCDQTTGETIY

SEQ ID NO: 2560974 - protein, 5 aa, Entamoeba histolytica
DTEYE

SEQ ID NO: 2560975 - protein, 11 aa, Entamoeba histolytica
DTFAPQGDSDM

SEQ ID NO: 2560976 - protein, 5 aa, Entamoeba histolytica
DTFTN

SEQ ID NO: 2560977 - protein, 7 aa, Entamoeba histolytica
DTGASVQ

SEQ ID NO: 2560978 - protein, 6 aa, Entamoeba histolytica
DTGVGE

SEQ ID NO: 2560979 - protein, 4 aa, Entamoeba histolytica
DTGY

SEQ ID NO: 2560980 - protein, 5 aa, Entamoeba histolytica
DTIDD

SEQ ID NO: 2560981 - protein, 4 aa, Entamoeba histolytica
DTII

SEQ ID NO: 2560982 - protein, 23 aa, Entamoeba histolytica
DTINSQPTYSNIQTNEQVQQEGG

SEQ ID NO: 2560983 - protein, 7 aa, Entamoeba histolytica
DTIRTAE

SEQ ID NO: 2560984 - protein, 7 aa, Entamoeba histolytica
DTISTTM

SEQ ID NO: 2560985 - protein, 6 aa, Entamoeba histolytica
DTITSA

SEQ ID NO: 2560986 - protein, 6 aa, Entamoeba histolytica
DTKEAD

SEQ ID NO: 2560987 - protein, 26 aa, Entamoeba histolytica
DTKETQKSSSSSSSPISSISRSETQN

SEQ ID NO: 2560988 - protein, 6 aa, Entamoeba histolytica
DTKREV

SEQ ID NO: 2560989 - protein, 8 aa, Entamoeba histolytica
DTKTASTF

SEQ ID NO: 2560990 - protein, 11 aa, Entamoeba histolytica
DTKTKEGETGT

SEQ ID NO: 2560991 - protein, 22 aa, Entamoeba histolytica
DTLENGQPQKEFGRKEAETSKI

SEQ ID NO: 2560992 - protein, 7 aa, Entamoeba histolytica
DTMGQSE

SEQ ID NO: 2560993 - protein, 5 aa, Entamoeba histolytica
DTNDN

SEQ ID NO: 2560994 - protein, 4 aa, Entamoeba histolytica
DTNG

SEQ ID NO: 2560995 - protein, 7 aa, Entamoeba histolytica
DTNSFKS

SEQ ID NO: 2560996 - protein, 9 aa, Entamoeba histolytica
DTNTFKEQQ

SEQ ID NO: 2560997 - protein, 10 aa, Entamoeba histolytica
DTNTNGQQEI

SEQ ID NO: 2560998 - protein, 26 aa, Entamoeba histolytica
DTNVSNNETSQNKNENSNNDVQQHPS

SEQ ID NO: 2560999 - protein, 5 aa, Entamoeba histolytica
DTPGY

SEQ ID NO: 2561000 - protein, 5 aa, Entamoeba histolytica
DTPKI

SEQ ID NO: 2561001 - protein, 10 aa, Entamoeba histolytica
DTPNSTPYGY

SEQ ID NO: 2561002 - protein, 4 aa, Entamoeba histolytica
DTPQ

SEQ ID NO: 2561003 - protein, 12 aa, Entamoeba histolytica
DTPVSKESNESM

SEQ ID NO: 2561004 - protein, 9 aa, Entamoeba histolytica
DTQCAIDSS

SEQ ID NO: 2561005 - protein, 7 aa, Entamoeba histolytica
DTQLVPG

SEQ ID NO: 2561006 - protein, 5 aa, Entamoeba histolytica
DTQTQ

SEQ ID NO: 2561007 - protein, 9 aa, Entamoeba histolytica
DTRSFKEKT

SEQ ID NO: 2561008 - protein, 11 aa, Entamoeba histolytica
DTSDTFDKVSS

SEQ ID NO: 2561009 - protein, 6 aa, Entamoeba histolytica
DTSETF

SEQ ID NO: 2561010 - protein, 4 aa, Entamoeba histolytica
DTSF

SEQ ID NO: 2561011 - protein, 7 aa, Entamoeba histolytica
DTSFNNK

SEQ ID NO: 2561012 - protein, 4 aa, Entamoeba histolytica
DTSG

SEQ ID NO: 2561013 - protein, 10 aa, Entamoeba histolytica
DTSIKSKEPI

SEQ ID NO: 2561014 - protein, 6 aa, Entamoeba histolytica
DTSINS

SEQ ID NO: 2561015 - protein, 9 aa, Entamoeba histolytica
DTSITTSEQ

SEQ ID NO: 2561016 - protein, 4 aa, Entamoeba histolytica
DTSK

SEQ ID NO: 2561017 - protein, 8 aa, Entamoeba histolytica
DTSNLEKA

SEQ ID NO: 2561018 - protein, 27 aa, Entamoeba histolytica
DTSNQEKTPVIEEKEETESMGNNDKQI

SEQ ID NO: 2561019 - protein, 8 aa, Entamoeba histolytica
DTSPKDKI

SEQ ID NO: 2561020 - protein, 4 aa, Entamoeba histolytica
DTSS

SEQ ID NO: 2561021 - protein, 6 aa, Entamoeba histolytica
DTSSMQ

SEQ ID NO: 2561022 - protein, 5 aa, Entamoeba histolytica
DTSSN

SEQ ID NO: 2561023 - protein, 4 aa, Entamoeba histolytica
DTST

SEQ ID NO: 2561024 - protein, 10 aa, Entamoeba histolytica
DTTAASSTHI

SEQ ID NO: 2561025 - protein, 5 aa, Entamoeba histolytica
DTTCT

SEQ ID NO: 2561026 - protein, 10 aa, Entamoeba histolytica
DTTDLQYPDL

SEQ ID NO: 2561027 - protein, 5 aa, Entamoeba histolytica
DTTFT

SEQ ID NO: 2561028 - protein, 8 aa, Entamoeba histolytica
DTTGKSPK

SEQ ID NO: 2561029 - protein, 8 aa, Entamoeba histolytica
DTTGKSST

SEQ ID NO: 2561030 - protein, 8 aa, Entamoeba histolytica
DTTHATDS

SEQ ID NO: 2561031 - protein, 8 aa, Entamoeba histolytica
DTTKEKEE

SEQ ID NO: 2561032 - protein, 8 aa, Entamoeba histolytica
DTTKVSGN

SEQ ID NO: 2561033 - protein, 7 aa, Entamoeba histolytica
DTTPQIT

SEQ ID NO: 2561034 - protein, 20 aa, Entamoeba histolytica
DTTPSTEQLHPAKEQKEKVQ

SEQ ID NO: 2561035 - protein, 5 aa, Entamoeba histolytica
DTTRE

SEQ ID NO: 2561036 - protein, 8 aa, Entamoeba histolytica
DTVQPITP

SEQ ID NO: 2561037 - protein, 18 aa, Entamoeba histolytica
DTYLSSNRTCQSNNELNG

SEQ ID NO: 2561038 - protein, 7 aa, Entamoeba histolytica
DVDPNDM

SEQ ID NO: 2561039 - protein, 11 aa, Entamoeba histolytica
DVESQNNVETL

SEQ ID NO: 2561040 - protein, 9 aa, Entamoeba histolytica
DVGQSPSVV

SEQ ID NO: 2561041 - protein, 4 aa, Entamoeba histolytica
DVIG

SEQ ID NO: 2561042 - protein, 10 aa, Entamoeba histolytica
DVKQEEGEVK

SEQ ID NO: 2561043 - protein, 8 aa, Entamoeba histolytica
DVKTDTVE

SEQ ID NO: 2561044 - protein, 13 aa, Entamoeba histolytica
DVKTQNETQEKKK

SEQ ID NO: 2561045 - protein, 7 aa, Entamoeba histolytica
DVNEKKK

SEQ ID NO: 2561046 - protein, 5 aa, Entamoeba histolytica
DVPDN

SEQ ID NO: 2561047 - protein, 6 aa, Entamoeba histolytica
DVPDPA

SEQ ID NO: 2561048 - protein, 8 aa, Entamoeba histolytica
DVPEKNRN

SEQ ID NO: 2561049 - protein, 7 aa, Entamoeba histolytica
DVPKEKK

SEQ ID NO: 2561050 - protein, 14 aa, Entamoeba histolytica
DVPPPQRPKPPTGI

SEQ ID NO: 2561051 - protein, 10 aa, Entamoeba histolytica
DVRKEKKSLA

SEQ ID NO: 2561052 - protein, 9 aa, Entamoeba histolytica
DVSAEEVQN

SEQ ID NO: 2561053 - protein, 12 aa, Entamoeba histolytica
DVSNDTAHNISD

SEQ ID NO: 2561054 - protein, 11 aa, Entamoeba histolytica
DVSNRKKTNGF

SEQ ID NO: 2561055 - protein, 7 aa, Entamoeba histolytica
DVSPEEN

SEQ ID NO: 2561056 - protein, 10 aa, Entamoeba histolytica
DVSSTSDNDI

SEQ ID NO: 2561057 - protein, 9 aa, Entamoeba histolytica
DVSTGPSLD

SEQ ID NO: 2561058 - protein, 7 aa, Entamoeba histolytica
DVSVEKT

SEQ ID NO: 2561059 - protein, 11 aa, Entamoeba histolytica
DVTNKYAEGMS

SEQ ID NO: 2561060 - protein, 8 aa, Entamoeba histolytica
DVTNNLKD

SEQ ID NO: 2561061 - protein, 8 aa, Entamoeba histolytica
DVTSFDGK

SEQ ID NO: 2561062 - protein, 15 aa, Entamoeba histolytica
DVYKNRKKKDPKIRD

SEQ ID NO: 2561063 - protein, 10 aa, Entamoeba histolytica
DWDEEEYGDE

SEQ ID NO: 2561064 - protein, 5 aa, Entamoeba histolytica
DWEKT

SEQ ID NO: 2561065 - protein, 14 aa, Entamoeba histolytica
DWGNEPKEQEDVQE

SEQ ID NO: 2561066 - protein, 6 aa, Entamoeba histolytica
DYAKAS

SEQ ID NO: 2561067 - protein, 6 aa, Entamoeba histolytica
DYANMT

SEQ ID NO: 2561068 - protein, 13 aa, Entamoeba histolytica
DYASETDCDAQNE

SEQ ID NO: 2561069 - protein, 25 aa, Entamoeba histolytica
DYCNKSNSGNNKEENSEKNIQTTCN

SEQ ID NO: 2561070 - protein, 5 aa, Entamoeba histolytica
DYCTG

SEQ ID NO: 2561071 - protein, 18 aa, Entamoeba histolytica
DYDNEESHGDEVVIADDE

SEQ ID NO: 2561072 - protein, 14 aa, Entamoeba histolytica
DYDRDKSDTKEENM

SEQ ID NO: 2561073 - protein, 7 aa, Entamoeba histolytica
DYEDVQN

SEQ ID NO: 2561074 - protein, 20 aa, Entamoeba histolytica
DYESAEAQIDRKENYEDDRE

SEQ ID NO: 2561075 - protein, 8 aa, Entamoeba histolytica
DYESGNDS

SEQ ID NO: 2561076 - protein, 7 aa, Entamoeba histolytica
DYGGSSL

SEQ ID NO: 2561077 - protein, 6 aa, Entamoeba histolytica
DYGTTT

SEQ ID NO: 2561078 - protein, 10 aa, Entamoeba histolytica
DYKDTNKTLS

SEQ ID NO: 2561079 - protein, 8 aa, Entamoeba histolytica
DYKPSQKM

SEQ ID NO: 2561080 - protein, 10 aa, Entamoeba histolytica
DYLKGTQTVE

SEQ ID NO: 2561081 - protein, 4 aa, Entamoeba histolytica
DYLP

SEQ ID NO: 2561082 - protein, 11 aa, Entamoeba histolytica
DYNTKPTDLNE

SEQ ID NO: 2561083 - protein, 6 aa, Entamoeba histolytica
DYPEAH

SEQ ID NO: 2561084 - protein, 4 aa, Entamoeba histolytica
DYPH

SEQ ID NO: 2561085 - protein, 12 aa, Entamoeba histolytica
DYPPFPNTVSPQ

SEQ ID NO: 2561086 - protein, 7 aa, Entamoeba histolytica
DYPQFEG

SEQ ID NO: 2561087 - protein, 25 aa, Entamoeba histolytica
DYPYIDGSGSTSTSCSPRGDQNPNV

SEQ ID NO: 2561088 - protein, 12 aa, Entamoeba histolytica
DYRNNNSHNEQT

SEQ ID NO: 2561089 - protein, 10 aa, Entamoeba histolytica
DYSDGGKGIE

SEQ ID NO: 2561090 - protein, 6 aa, Entamoeba histolytica
DYSGSS

SEQ ID NO: 2561091 - protein, 5 aa, Entamoeba histolytica
DYSSL

SEQ ID NO: 2561092 - protein, 11 aa, Entamoeba histolytica
DYSSSYSGRGD

SEQ ID NO: 2561093 - protein, 6 aa, Entamoeba histolytica
DYSTQQ

SEQ ID NO: 2561094 - protein, 4 aa, Entamoeba histolytica
DYTA

SEQ ID NO: 2561095 - protein, 9 aa, Entamoeba histolytica
DYTDGDPKC

SEQ ID NO: 2561096 - protein, 4 aa, Entamoeba histolytica
DYTE

SEQ ID NO: 2561097 - protein, 6 aa, Entamoeba histolytica
DYTGPI

SEQ ID NO: 2561098 - protein, 8 aa, Entamoeba histolytica
EAASSTHI

SEQ ID NO: 2561099 - protein, 4 aa, Entamoeba histolytica
EACP

SEQ ID NO: 2561100 - protein, 16 aa, Entamoeba histolytica
EAEAEKEQIDPNGDKP

SEQ ID NO: 2561101 - protein, 19 aa, Entamoeba histolytica
EAEIKSKQEKISEDDINED

SEQ ID NO: 2561102 - protein, 9 aa, Entamoeba histolytica
EAEKQYEEA

SEQ ID NO: 2561103 - protein, 4 aa, Entamoeba histolytica
EAEY

SEQ ID NO: 2561104 - protein, 10 aa, Entamoeba histolytica
EAFPGHESKN

SEQ ID NO: 2561105 - protein, 9 aa, Entamoeba histolytica
EAGPHPNSE

SEQ ID NO: 2561106 - protein, 6 aa, Entamoeba histolytica
EAIEGG

SEQ ID NO: 2561107 - protein, 6 aa, Entamoeba histolytica
EAIKNG

SEQ ID NO: 2561108 - protein, 4 aa, Entamoeba histolytica
EAIP

SEQ ID NO: 2561109 - protein, 70 aa, Entamoeba histolytica
EAKDESTDSSQQSESSENSSSQQSESSENSSSQQPEPQPPEDSSSQQSQSSEESSSQQTSSSSSNSTNDK

SEQ ID NO: 2561110 - protein, 11 aa, Entamoeba histolytica
EAKEKDEPNVD

SEQ ID NO: 2561111 - protein, 8 aa, Entamoeba histolytica
EAKESLKR

SEQ ID NO: 2561112 - protein, 8 aa, Entamoeba histolytica
EAKGISKM

SEQ ID NO: 2561113 - protein, 8 aa, Entamoeba histolytica
EAKKGFEP

SEQ ID NO: 2561114 - protein, 8 aa, Entamoeba histolytica
EAKNGTID

SEQ ID NO: 2561115 - protein, 5 aa, Entamoeba histolytica
EAKNI

SEQ ID NO: 2561116 - protein, 8 aa, Entamoeba histolytica
EAKRPNDE

SEQ ID NO: 2561117 - protein, 9 aa, Entamoeba histolytica
EAKRVGNTK

SEQ ID NO: 2561118 - protein, 19 aa, Entamoeba histolytica
EAKSIKNPPNCQPREKTNV

SEQ ID NO: 2561119 - protein, 7 aa, Entamoeba histolytica
EAKTNKF

SEQ ID NO: 2561120 - protein, 4 aa, Entamoeba histolytica
EALK

SEQ ID NO: 2561121 - protein, 6 aa, Entamoeba histolytica
EALNKT

SEQ ID NO: 2561122 - protein, 5 aa, Entamoeba histolytica
EALQK

SEQ ID NO: 2561123 - protein, 15 aa, Entamoeba histolytica
EANHPELDANTYTDK

SEQ ID NO: 2561124 - protein, 6 aa, Entamoeba histolytica
EANKFQ

SEQ ID NO: 2561125 - protein, 83 aa, Entamoeba histolytica
EANKTDSGEQEMSYSEENDKQQETKKYNKSNDSIQSSASSISEGNSENEESSSEQEDESKEIIAPPSSGPLSKNKQKKRAKIR

SEQ ID NO: 2561126 - protein, 7 aa, Entamoeba histolytica
EANSNKF

SEQ ID NO: 2561127 - protein, 9 aa, Entamoeba histolytica
EAPEGEEDF

SEQ ID NO: 2561128 - protein, 18 aa, Entamoeba histolytica
EAPGCKECDDEQHYPNST

SEQ ID NO: 2561129 - protein, 31 aa, Entamoeba histolytica
EAPIKDSSCSTPKRNKRATKSQICSAVDPTF

SEQ ID NO: 2561130 - protein, 171 aa, Entamoeba histolytica
  misc_feature (121)..(154): Xaa can be any naturally occurring amino acid
EAPSEGAKDSTRASEPAGTTAVSAGTTVTVPQGNAATTGDAAVSSLKGNEVTPPVPPVEGTSSSAIPPKQVTAPNGQPEGVAPTPVEGSSKTTGTEATSSGQSAGGSATGGSGAIPSAGSXXXXXXXXXXXXXXXXXXXXXXXXXXXXXXXXXXPHKLHPHHHKQQTNHNH

SEQ ID NO: 2561131 - protein, 5 aa, Entamoeba histolytica
EAPSL

SEQ ID NO: 2561132 - protein, 15 aa, Entamoeba histolytica
EAPSVESKLIIDDLE

SEQ ID NO: 2561133 - protein, 9 aa, Entamoeba histolytica
EAQNIQSTP

SEQ ID NO: 2561134 - protein, 10 aa, Entamoeba histolytica
EAQNQYENAG

SEQ ID NO: 2561135 - protein, 15 aa, Entamoeba histolytica
EAQPQDMITLHISRV

SEQ ID NO: 2561136 - protein, 5 aa, Entamoeba histolytica
EAQTI

SEQ ID NO: 2561137 - protein, 13 aa, Entamoeba histolytica
EAQTKLSNEKNNK

SEQ ID NO: 2561138 - protein, 11 aa, Entamoeba histolytica
EARKLGEKGQR

SEQ ID NO: 2561139 - protein, 9 aa, Entamoeba histolytica
EARLQDQSN

SEQ ID NO: 2561140 - protein, 21 aa, Entamoeba histolytica
EARPKKEGDKINYQSQSPDEV

SEQ ID NO: 2561141 - protein, 7 aa, Entamoeba histolytica
EASDAHP

SEQ ID NO: 2561142 - protein, 4 aa, Entamoeba histolytica
EASF

SEQ ID NO: 2561143 - protein, 16 aa, Entamoeba histolytica
EASFKERDGGNNNGRT

SEQ ID NO: 2561144 - protein, 8 aa, Entamoeba histolytica
EASKTNEE

SEQ ID NO: 2561145 - protein, 12 aa, Entamoeba histolytica
EASSTPKYTLSD

SEQ ID NO: 2561146 - protein, 6 aa, Entamoeba histolytica
EASTKT

SEQ ID NO: 2561147 - protein, 8 aa, Entamoeba histolytica
EATGSESD

SEQ ID NO: 2561148 - protein, 6 aa, Entamoeba histolytica
EATIRR

SEQ ID NO: 2561149 - protein, 17 aa, Entamoeba histolytica
EATMSNDVENIQEKQKQ

SEQ ID NO: 2561150 - protein, 8 aa, Entamoeba histolytica
EATNSTNL

SEQ ID NO: 2561151 - protein, 4 aa, Entamoeba histolytica
EAVD

SEQ ID NO: 2561152 - protein, 6 aa, Entamoeba histolytica
EAVSTT

SEQ ID NO: 2561153 - protein, 5 aa, Entamoeba histolytica
EAYDK

SEQ ID NO: 2561154 - protein, 6 aa, Entamoeba histolytica
EAYKDD

SEQ ID NO: 2561155 - protein, 8 aa, Entamoeba histolytica
ECDEDPDE

SEQ ID NO: 2561156 - protein, 7 aa, Entamoeba histolytica
ECDGGIN

SEQ ID NO: 2561157 - protein, 11 aa, Entamoeba histolytica
ECDGGKGCGSN

SEQ ID NO: 2561158 - protein, 9 aa, Entamoeba histolytica
ECDGGSGCE

SEQ ID NO: 2561159 - protein, 18 aa, Entamoeba histolytica
ECDGSNAVKIQGSDTMTQ

SEQ ID NO: 2561160 - protein, 9 aa, Entamoeba histolytica
ECDPTLPNR

SEQ ID NO: 2561161 - protein, 7 aa, Entamoeba histolytica
ECDSTEH

SEQ ID NO: 2561162 - protein, 11 aa, Entamoeba histolytica
ECDTSIKNGTV

SEQ ID NO: 2561163 - protein, 10 aa, Entamoeba histolytica
ECEEQNTYGC

SEQ ID NO: 2561164 - protein, 4 aa, Entamoeba histolytica
ECGD

SEQ ID NO: 2561165 - protein, 16 aa, Entamoeba histolytica
ECGNGELDEGEECDSV

SEQ ID NO: 2561166 - protein, 10 aa, Entamoeba histolytica
ECGPTGVSSE

SEQ ID NO: 2561167 - protein, 4 aa, Entamoeba histolytica
ECGS

SEQ ID NO: 2561168 - protein, 8 aa, Entamoeba histolytica
ECGTNKDY

SEQ ID NO: 2561169 - protein, 8 aa, Entamoeba histolytica
ECIEKTTT

SEQ ID NO: 2561170 - protein, 10 aa, Entamoeba histolytica
ECKEGYGYDD

SEQ ID NO: 2561171 - protein, 18 aa, Entamoeba histolytica
ECKNGNLGSGDECIQNSE

SEQ ID NO: 2561172 - protein, 5 aa, Entamoeba histolytica
ECLSG

SEQ ID NO: 2561173 - protein, 5 aa, Entamoeba histolytica
ECNDN

SEQ ID NO: 2561174 - protein, 9 aa, Entamoeba histolytica
ECNGDKGYF

SEQ ID NO: 2561175 - protein, 5 aa, Entamoeba histolytica
ECNKK

SEQ ID NO: 2561176 - protein, 6 aa, Entamoeba histolytica
ECNNGG

SEQ ID NO: 2561177 - protein, 6 aa, Entamoeba histolytica
ECNNKT

SEQ ID NO: 2561178 - protein, 21 aa, Entamoeba histolytica
ECNPTNSTIKPTNGEPIKNYS

SEQ ID NO: 2561179 - protein, 16 aa, Entamoeba histolytica
ECNTTKGYTEDCQGCQ

SEQ ID NO: 2561180 - protein, 8 aa, Entamoeba histolytica
ECPDSTTD

SEQ ID NO: 2561181 - protein, 8 aa, Entamoeba histolytica
ECPGTATG

SEQ ID NO: 2561182 - protein, 12 aa, Entamoeba histolytica
ECPKDPCGTNEA

SEQ ID NO: 2561183 - protein, 23 aa, Entamoeba histolytica
ECPKDPCGTNEAGISSQITNGEV

SEQ ID NO: 2561184 - protein, 10 aa, Entamoeba histolytica
ECPKNCSSCY

SEQ ID NO: 2561185 - protein, 6 aa, Entamoeba histolytica
ECQGTY

SEQ ID NO: 2561186 - protein, 11 aa, Entamoeba histolytica
ECQKEDHTEPT

SEQ ID NO: 2561187 - protein, 6 aa, Entamoeba histolytica
ECQNGS

SEQ ID NO: 2561188 - protein, 5 aa, Entamoeba histolytica
ECREC

SEQ ID NO: 2561189 - protein, 7 aa, Entamoeba histolytica
ECRPKTE

SEQ ID NO: 2561190 - protein, 4 aa, Entamoeba histolytica
ECSR

SEQ ID NO: 2561191 - protein, 12 aa, Entamoeba histolytica
ECSRNNKGDISC

SEQ ID NO: 2561192 - protein, 9 aa, Entamoeba histolytica
ECTDSNTIN

SEQ ID NO: 2561193 - protein, 27 aa, Entamoeba histolytica
ECTNPLPKISQPSIKEENQIENTPIPN

SEQ ID NO: 2561194 - protein, 5 aa, Entamoeba histolytica
ECTSC

SEQ ID NO: 2561195 - protein, 25 aa, Entamoeba histolytica
ECTSTECKTCDNGYDLKDANTEVPG

SEQ ID NO: 2561196 - protein, 9 aa, Entamoeba histolytica
ECTTNNSSL

SEQ ID NO: 2561197 - protein, 8 aa, Entamoeba histolytica
EDADEQTI

SEQ ID NO: 2561198 - protein, 9 aa, Entamoeba histolytica
EDAEMGELP

SEQ ID NO: 2561199 - protein, 10 aa, Entamoeba histolytica
EDATSGKQES

SEQ ID NO: 2561200 - protein, 35 aa, Entamoeba histolytica
EDATSNTSNISTHTSSSSSDEKGKKSGNTGTPPSI

SEQ ID NO: 2561201 - protein, 7 aa, Entamoeba histolytica
EDCLPSR

SEQ ID NO: 2561202 - protein, 8 aa, Entamoeba histolytica
EDDAAEKS

SEQ ID NO: 2561203 - protein, 14 aa, Entamoeba histolytica
EDDDDEKDTNNTDY

SEQ ID NO: 2561204 - protein, 21 aa, Entamoeba histolytica
EDDEPMTLKDDNSSSNFHEKQ

SEQ ID NO: 2561205 - protein, 9 aa, Entamoeba histolytica
EDDGNIKSN

SEQ ID NO: 2561206 - protein, 5 aa, Entamoeba histolytica
EDDIE

SEQ ID NO: 2561207 - protein, 8 aa, Entamoeba histolytica
EDDKKNYI

SEQ ID NO: 2561208 - protein, 6 aa, Entamoeba histolytica
EDDRKT

SEQ ID NO: 2561209 - protein, 7 aa, Entamoeba histolytica
EDDSLKE

SEQ ID NO: 2561210 - protein, 4 aa, Entamoeba histolytica
EDEA

SEQ ID NO: 2561211 - protein, 7 aa, Entamoeba histolytica
EDEAELH

SEQ ID NO: 2561212 - protein, 8 aa, Entamoeba histolytica
EDEDKGTF

SEQ ID NO: 2561213 - protein, 17 aa, Entamoeba histolytica
EDEEAPPSKESVDTSTC

SEQ ID NO: 2561214 - protein, 6 aa, Entamoeba histolytica
EDEEKS

SEQ ID NO: 2561215 - protein, 8 aa, Entamoeba histolytica
EDEFHDSS

SEQ ID NO: 2561216 - protein, 13 aa, Entamoeba histolytica
EDEGELEEEKKLD

SEQ ID NO: 2561217 - protein, 9 aa, Entamoeba histolytica
EDEISKKKF

SEQ ID NO: 2561218 - protein, 5 aa, Entamoeba histolytica
EDEKQ

SEQ ID NO: 2561219 - protein, 5 aa, Entamoeba histolytica
EDEKT

SEQ ID NO: 2561220 - protein, 6 aa, Entamoeba histolytica
EDELQE

SEQ ID NO: 2561221 - protein, 8 aa, Entamoeba histolytica
EDENYASA

SEQ ID NO: 2561222 - protein, 6 aa, Entamoeba histolytica
EDEPKK

SEQ ID NO: 2561223 - protein, 6 aa, Entamoeba histolytica
EDESGY

SEQ ID NO: 2561224 - protein, 11 aa, Entamoeba histolytica
EDETGSDGVSI

SEQ ID NO: 2561225 - protein, 15 aa, Entamoeba histolytica
EDETTTKGSQSPLTN

SEQ ID NO: 2561226 - protein, 15 aa, Entamoeba histolytica
EDFKEFNTKEVSPDL

SEQ ID NO: 2561227 - protein, 11 aa, Entamoeba histolytica
EDGGGRGTANA

SEQ ID NO: 2561228 - protein, 12 aa, Entamoeba histolytica
EDGGGSGTAGAH

SEQ ID NO: 2561229 - protein, 14 aa, Entamoeba histolytica
EDGGMGKGKTDDGE

SEQ ID NO: 2561230 - protein, 4 aa, Entamoeba histolytica
EDGK

SEQ ID NO: 2561231 - protein, 6 aa, Entamoeba histolytica
EDGKNW

SEQ ID NO: 2561232 - protein, 11 aa, Entamoeba histolytica
EDGKVKDPQGW

SEQ ID NO: 2561233 - protein, 6 aa, Entamoeba histolytica
EDGNSF

SEQ ID NO: 2561234 - protein, 8 aa, Entamoeba histolytica
EDGPIPDP

SEQ ID NO: 2561235 - protein, 5 aa, Entamoeba histolytica
EDGQL

SEQ ID NO: 2561236 - protein, 8 aa, Entamoeba histolytica
EDGSQEFE

SEQ ID NO: 2561237 - protein, 36 aa, Entamoeba histolytica
EDGTNAPINNKVNNSNEDQDNINQRPAQHYETSEET

SEQ ID NO: 2561238 - protein, 8 aa, Entamoeba histolytica
EDGWGSPN

SEQ ID NO: 2561239 - protein, 7 aa, Entamoeba histolytica
EDGYGGE

SEQ ID NO: 2561240 - protein, 13 aa, Entamoeba histolytica
EDHSSLKDLNGFN

SEQ ID NO: 2561241 - protein, 6 aa, Entamoeba histolytica
EDIKHS

SEQ ID NO: 2561242 - protein, 4 aa, Entamoeba histolytica
EDIN

SEQ ID NO: 2561243 - protein, 5 aa, Entamoeba histolytica
EDIPK

SEQ ID NO: 2561244 - protein, 8 aa, Entamoeba histolytica
EDIPTDER

SEQ ID NO: 2561245 - protein, 4 aa, Entamoeba histolytica
EDIS

SEQ ID NO: 2561246 - protein, 9 aa, Entamoeba histolytica
EDITKESDL

SEQ ID NO: 2561247 - protein, 7 aa, Entamoeba histolytica
EDKGSDI

SEQ ID NO: 2561248 - protein, 7 aa, Entamoeba histolytica
EDKIGCD

SEQ ID NO: 2561249 - protein, 6 aa, Entamoeba histolytica
EDKINT

SEQ ID NO: 2561250 - protein, 10 aa, Entamoeba histolytica
EDKKITQPKR

SEQ ID NO: 2561251 - protein, 12 aa, Entamoeba histolytica
EDKLQDGVPETI

SEQ ID NO: 2561252 - protein, 11 aa, Entamoeba histolytica
EDKLQSGVTEA

SEQ ID NO: 2561253 - protein, 5 aa, Entamoeba histolytica
EDKLS

SEQ ID NO: 2561254 - protein, 9 aa, Entamoeba histolytica
EDKTKENND

SEQ ID NO: 2561255 - protein, 7 aa, Entamoeba histolytica
EDKTPYE

SEQ ID NO: 2561256 - protein, 14 aa, Entamoeba histolytica
EDKTRGLQKEKVEL

SEQ ID NO: 2561257 - protein, 7 aa, Entamoeba histolytica
EDKWEEE

SEQ ID NO: 2561258 - protein, 4 aa, Entamoeba histolytica
EDLD

SEQ ID NO: 2561259 - protein, 21 aa, Entamoeba histolytica
EDMKNKKGKVKGKNSGLNEEL

SEQ ID NO: 2561260 - protein, 6 aa, Entamoeba histolytica
EDMSSN

SEQ ID NO: 2561261 - protein, 12 aa, Entamoeba histolytica
EDNASIDRQNQA

SEQ ID NO: 2561262 - protein, 4 aa, Entamoeba histolytica
EDNC

SEQ ID NO: 2561263 - protein, 9 aa, Entamoeba histolytica
EDNDPNQVN

SEQ ID NO: 2561264 - protein, 6 aa, Entamoeba histolytica
EDNEKY

SEQ ID NO: 2561265 - protein, 7 aa, Entamoeba histolytica
EDNENTC

SEQ ID NO: 2561266 - protein, 6 aa, Entamoeba histolytica
EDNFNG

SEQ ID NO: 2561267 - protein, 9 aa, Entamoeba histolytica
EDNKQTQFK

SEQ ID NO: 2561268 - protein, 7 aa, Entamoeba histolytica
EDNLTNQ

SEQ ID NO: 2561269 - protein, 6 aa, Entamoeba histolytica
EDNPYY

SEQ ID NO: 2561270 - protein, 6 aa, Entamoeba histolytica
EDNQQE

SEQ ID NO: 2561271 - protein, 9 aa, Entamoeba histolytica
EDNTSKEIA

SEQ ID NO: 2561272 - protein, 8 aa, Entamoeba histolytica
EDPHEAAE

SEQ ID NO: 2561273 - protein, 7 aa, Entamoeba histolytica
EDPKPTY

SEQ ID NO: 2561274 - protein, 5 aa, Entamoeba histolytica
EDPKV

SEQ ID NO: 2561275 - protein, 8 aa, Entamoeba histolytica
EDPNLRPK

SEQ ID NO: 2561276 - protein, 4 aa, Entamoeba histolytica
EDPQ

SEQ ID NO: 2561277 - protein, 11 aa, Entamoeba histolytica
EDPRNITSPTK

SEQ ID NO: 2561278 - protein, 4 aa, Entamoeba histolytica
EDPT

SEQ ID NO: 2561279 - protein, 4 aa, Entamoeba histolytica
EDPY

SEQ ID NO: 2561280 - protein, 10 aa, Entamoeba histolytica
EDQKKSEDFG

SEQ ID NO: 2561281 - protein, 8 aa, Entamoeba histolytica
EDQTESCG

SEQ ID NO: 2561282 - protein, 7 aa, Entamoeba histolytica
EDRLNGK

SEQ ID NO: 2561283 - protein, 8 aa, Entamoeba histolytica
EDRRKERM

SEQ ID NO: 2561284 - protein, 7 aa, Entamoeba histolytica
EDSAVAN

SEQ ID NO: 2561285 - protein, 7 aa, Entamoeba histolytica
EDSDEKE

SEQ ID NO: 2561286 - protein, 8 aa, Entamoeba histolytica
EDSENDPL

SEQ ID NO: 2561287 - protein, 18 aa, Entamoeba histolytica
EDSGNKGVIAQNNESESY

SEQ ID NO: 2561288 - protein, 7 aa, Entamoeba histolytica
EDSKPIQ

SEQ ID NO: 2561289 - protein, 11 aa, Entamoeba histolytica
EDSKQNNLQPD

SEQ ID NO: 2561290 - protein, 4 aa, Entamoeba histolytica
EDSR

SEQ ID NO: 2561291 - protein, 7 aa, Entamoeba histolytica
EDSREQT

SEQ ID NO: 2561292 - protein, 6 aa, Entamoeba histolytica
EDSSNK

SEQ ID NO: 2561293 - protein, 19 aa, Entamoeba histolytica
EDSSNKGVIPQNNESESYV

SEQ ID NO: 2561294 - protein, 12 aa, Entamoeba histolytica
EDSTYESASNSV

SEQ ID NO: 2561295 - protein, 5 aa, Entamoeba histolytica
EDTIK

SEQ ID NO: 2561296 - protein, 5 aa, Entamoeba histolytica
EDTQG

SEQ ID NO: 2561297 - protein, 9 aa, Entamoeba histolytica
EDTQSNSLK

SEQ ID NO: 2561298 - protein, 6 aa, Entamoeba histolytica
EDVAKG

SEQ ID NO: 2561299 - protein, 10 aa, Entamoeba histolytica
EDVKKYKTSI

SEQ ID NO: 2561300 - protein, 6 aa, Entamoeba histolytica
EDVVSE

SEQ ID NO: 2561301 - protein, 8 aa, Entamoeba histolytica
EDYELRQA

SEQ ID NO: 2561302 - protein, 4 aa, Entamoeba histolytica
EDYG

SEQ ID NO: 2561303 - protein, 7 aa, Entamoeba histolytica
EDYIKEK

SEQ ID NO: 2561304 - protein, 5 aa, Entamoeba histolytica
EDYLG

SEQ ID NO: 2561305 - protein, 6 aa, Entamoeba histolytica
EDYPGK

SEQ ID NO: 2561306 - protein, 11 aa, Entamoeba histolytica
EDYSSVTSIQD

SEQ ID NO: 2561307 - protein, 8 aa, Entamoeba histolytica
EEADESGS

SEQ ID NO: 2561308 - protein, 6 aa, Entamoeba histolytica
EEAERK

SEQ ID NO: 2561309 - protein, 5 aa, Entamoeba histolytica
EEAKE

SEQ ID NO: 2561310 - protein, 5 aa, Entamoeba histolytica
EEAPT

SEQ ID NO: 2561311 - protein, 4 aa, Entamoeba histolytica
EEAT

SEQ ID NO: 2561312 - protein, 9 aa, Entamoeba histolytica
EEATKTNPI

SEQ ID NO: 2561313 - protein, 11 aa, Entamoeba histolytica
EEATSKEVCSK

SEQ ID NO: 2561314 - protein, 7 aa, Entamoeba histolytica
EEAYAGA

SEQ ID NO: 2561315 - protein, 9 aa, Entamoeba histolytica
EECDGGIGC

SEQ ID NO: 2561316 - protein, 7 aa, Entamoeba histolytica
EECDGGM

SEQ ID NO: 2561317 - protein, 10 aa, Entamoeba histolytica
EECDGGSNCR

SEQ ID NO: 2561318 - protein, 7 aa, Entamoeba histolytica
EECDGGY

SEQ ID NO: 2561319 - protein, 13 aa, Entamoeba histolytica
EECDGIKGCGSDC

SEQ ID NO: 2561320 - protein, 11 aa, Entamoeba histolytica
EECDGSDGCNN

SEQ ID NO: 2561321 - protein, 10 aa, Entamoeba histolytica
EECDPSNNIT

SEQ ID NO: 2561322 - protein, 10 aa, Entamoeba histolytica
EECDSVEGCG

SEQ ID NO: 2561323 - protein, 18 aa, Entamoeba histolytica
EEDDENLNKEIDTLSEQN

SEQ ID NO: 2561324 - protein, 11 aa, Entamoeba histolytica
EEDEEVNNNSE

SEQ ID NO: 2561325 - protein, 14 aa, Entamoeba histolytica
EEDETSSSLSEGDT

SEQ ID NO: 2561326 - protein, 5 aa, Entamoeba histolytica
EEDGK

SEQ ID NO: 2561327 - protein, 12 aa, Entamoeba histolytica
EEDGTKSDSYKC

SEQ ID NO: 2561328 - protein, 32 aa, Entamoeba histolytica
EEDMNQEEMSDDDENQENDDDDRKERETDMNI

SEQ ID NO: 2561329 - protein, 7 aa, Entamoeba histolytica
EEDNDQE

SEQ ID NO: 2561330 - protein, 10 aa, Entamoeba histolytica
EEDPNTKETR

SEQ ID NO: 2561331 - protein, 4 aa, Entamoeba histolytica
EEDQ

SEQ ID NO: 2561332 - protein, 16 aa, Entamoeba histolytica
EEDREWAQKEMETAME

SEQ ID NO: 2561333 - protein, 4 aa, Entamoeba histolytica
EEDS

SEQ ID NO: 2561334 - protein, 9 aa, Entamoeba histolytica
EEDSTRQKE

SEQ ID NO: 2561335 - protein, 9 aa, Entamoeba histolytica
EEDVETDID

SEQ ID NO: 2561336 - protein, 10 aa, Entamoeba histolytica
EEEDIEMKQP

SEQ ID NO: 2561337 - protein, 11 aa, Entamoeba histolytica
EEEEEKPKEEE

SEQ ID NO: 2561338 - protein, 5 aa, Entamoeba histolytica
EEEEG

SEQ ID NO: 2561339 - protein, 5 aa, Entamoeba histolytica
EEEFE

SEQ ID NO: 2561340 - protein, 29 aa, Entamoeba histolytica
EEEGEIEEEDTIPLEEKEEDSSISRVRIH

SEQ ID NO: 2561341 - protein, 5 aa, Entamoeba histolytica
EEEGI

SEQ ID NO: 2561342 - protein, 25 aa, Entamoeba histolytica
EEEGSNDIQQSTTNEKKGWFNSADG

SEQ ID NO: 2561343 - protein, 4 aa, Entamoeba histolytica
EEEK

SEQ ID NO: 2561344 - protein, 9 aa, Entamoeba histolytica
EEEKDSLCS

SEQ ID NO: 2561345 - protein, 7 aa, Entamoeba histolytica
EEEKSEW

SEQ ID NO: 2561346 - protein, 5 aa, Entamoeba histolytica
EEELA

SEQ ID NO: 2561347 - protein, 6 aa, Entamoeba histolytica
EEEMEE

SEQ ID NO: 2561348 - protein, 6 aa, Entamoeba histolytica
EEEMND

SEQ ID NO: 2561349 - protein, 6 aa, Entamoeba histolytica
EEEMRK

SEQ ID NO: 2561350 - protein, 5 aa, Entamoeba histolytica
EEENE

SEQ ID NO: 2561351 - protein, 12 aa, Entamoeba histolytica
EEENTNNTLTQR

SEQ ID NO: 2561352 - protein, 17 aa, Entamoeba histolytica
EEEPQQIEKKEEKEMEE

SEQ ID NO: 2561353 - protein, 7 aa, Entamoeba histolytica
EEEPTKI

SEQ ID NO: 2561354 - protein, 7 aa, Entamoeba histolytica
EEEQNKC

SEQ ID NO: 2561355 - protein, 6 aa, Entamoeba histolytica
EEERTS

SEQ ID NO: 2561356 - protein, 11 aa, Entamoeba histolytica
EEESCKRDQIR

SEQ ID NO: 2561357 - protein, 5 aa, Entamoeba histolytica
EEESN

SEQ ID NO: 2561358 - protein, 5 aa, Entamoeba histolytica
EEESP

SEQ ID NO: 2561359 - protein, 9 aa, Entamoeba histolytica
EEESSSKYS

SEQ ID NO: 2561360 - protein, 14 aa, Entamoeba histolytica
EEETKEENKRNEQY

SEQ ID NO: 2561361 - protein, 13 aa, Entamoeba histolytica
EEETVEQQESTSI

SEQ ID NO: 2561362 - protein, 5 aa, Entamoeba histolytica
EEFDG

SEQ ID NO: 2561363 - protein, 18 aa, Entamoeba histolytica
EEFDTKNEVKEKKVKKNK

SEQ ID NO: 2561364 - protein, 10 aa, Entamoeba histolytica
EEFKSQSISP

SEQ ID NO: 2561365 - protein, 4 aa, Entamoeba histolytica
EEFT

SEQ ID NO: 2561366 - protein, 6 aa, Entamoeba histolytica
EEFTNN

SEQ ID NO: 2561367 - protein, 5 aa, Entamoeba histolytica
EEGEE

SEQ ID NO: 2561368 - protein, 19 aa, Entamoeba histolytica
EEGEEHTQINDKKEHNDIN

SEQ ID NO: 2561369 - protein, 45 aa, Entamoeba histolytica
EEGEEVDIEDDKKEEEIENKPNDKKEEEIENKSTEAKDVQNKDTT

SEQ ID NO: 2561370 - protein, 11 aa, Entamoeba histolytica
EEGENKTKISV

SEQ ID NO: 2561371 - protein, 5 aa, Entamoeba histolytica
EEGGI

SEQ ID NO: 2561372 - protein, 4 aa, Entamoeba histolytica
EEGH

SEQ ID NO: 2561373 - protein, 4 aa, Entamoeba histolytica
EEGI

SEQ ID NO: 2561374 - protein, 5 aa, Entamoeba histolytica
EEGKE

SEQ ID NO: 2561375 - protein, 8 aa, Entamoeba histolytica
EEGKEFTE

SEQ ID NO: 2561376 - protein, 7 aa, Entamoeba histolytica
EEGKNYS

SEQ ID NO: 2561377 - protein, 5 aa, Entamoeba histolytica
EEGLT

SEQ ID NO: 2561378 - protein, 8 aa, Entamoeba histolytica
EEGNEEPK

SEQ ID NO: 2561379 - protein, 12 aa, Entamoeba histolytica
EEGNHGGSTLQE

SEQ ID NO: 2561380 - protein, 7 aa, Entamoeba histolytica
EEGNKKE

SEQ ID NO: 2561381 - protein, 9 aa, Entamoeba histolytica
EEGNNEEYK

SEQ ID NO: 2561382 - protein, 8 aa, Entamoeba histolytica
EEGNNPDN

SEQ ID NO: 2561383 - protein, 5 aa, Entamoeba histolytica
EEGPL

SEQ ID NO: 2561384 - protein, 8 aa, Entamoeba histolytica
EEGSKQTE

SEQ ID NO: 2561385 - protein, 7 aa, Entamoeba histolytica
EEGWNKS

SEQ ID NO: 2561386 - protein, 11 aa, Entamoeba histolytica
EEHKSEPEKRW

SEQ ID NO: 2561387 - protein, 4 aa, Entamoeba histolytica
EEHN

SEQ ID NO: 2561388 - protein, 13 aa, Entamoeba histolytica
EEHRGEDELLQND

SEQ ID NO: 2561389 - protein, 17 aa, Entamoeba histolytica
EEIEDIKNKNNKEYQDY

SEQ ID NO: 2561390 - protein, 7 aa, Entamoeba histolytica
EEIHESN

SEQ ID NO: 2561391 - protein, 6 aa, Entamoeba histolytica
EEIKAR

SEQ ID NO: 2561392 - protein, 8 aa, Entamoeba histolytica
EEIKEDNE

SEQ ID NO: 2561393 - protein, 9 aa, Entamoeba histolytica
EEIKEKENK

SEQ ID NO: 2561394 - protein, 20 aa, Entamoeba histolytica
EEIKEKKTLDPKRKISSQEA

SEQ ID NO: 2561395 - protein, 7 aa, Entamoeba histolytica
EEIKETA

SEQ ID NO: 2561396 - protein, 5 aa, Entamoeba histolytica
EEIKG

SEQ ID NO: 2561397 - protein, 10 aa, Entamoeba histolytica
EEIKSNKEDA

SEQ ID NO: 2561398 - protein, 11 aa, Entamoeba histolytica
EEIKTRTYDES

SEQ ID NO: 2561399 - protein, 11 aa, Entamoeba histolytica
EEINKKQSYYD

SEQ ID NO: 2561400 - protein, 6 aa, Entamoeba histolytica
EEIPDG

SEQ ID NO: 2561401 - protein, 13 aa, Entamoeba histolytica
EEIPRTQKQRKKN

SEQ ID NO: 2561402 - protein, 8 aa, Entamoeba histolytica
EEIQDAPN

SEQ ID NO: 2561403 - protein, 5 aa, Entamoeba histolytica
EEIQN

SEQ ID NO: 2561404 - protein, 28 aa, Entamoeba histolytica
EEIQNHSSQNENSNSDFPISPEDDDNEV

SEQ ID NO: 2561405 - protein, 13 aa, Entamoeba histolytica
EEIQRTQKQRKKN

SEQ ID NO: 2561406 - protein, 4 aa, Entamoeba histolytica
EEIV

SEQ ID NO: 2561407 - protein, 8 aa, Entamoeba histolytica
EEKAKPFQ

SEQ ID NO: 2561408 - protein, 4 aa, Entamoeba histolytica
EEKE

SEQ ID NO: 2561409 - protein, 10 aa, Entamoeba histolytica
EEKEAKLKFD

SEQ ID NO: 2561410 - protein, 10 aa, Entamoeba histolytica
EEKEEEKNLT

SEQ ID NO: 2561411 - protein, 13 aa, Entamoeba histolytica
EEKEEKGKTLRET

SEQ ID NO: 2561412 - protein, 16 aa, Entamoeba histolytica
EEKEETLLQNEDKSFT

SEQ ID NO: 2561413 - protein, 7 aa, Entamoeba histolytica
EEKEGRL

SEQ ID NO: 2561414 - protein, 5 aa, Entamoeba histolytica
EEKGD

SEQ ID NO: 2561415 - protein, 8 aa, Entamoeba histolytica
EEKKNNSA

SEQ ID NO: 2561416 - protein, 8 aa, Entamoeba histolytica
EEKNDRSG

SEQ ID NO: 2561417 - protein, 16 aa, Entamoeba histolytica
EEKNQIVSTSTLSKSI

SEQ ID NO: 2561418 - protein, 17 aa, Entamoeba histolytica
EEKPEEVFEEDSDDIVD

SEQ ID NO: 2561419 - protein, 11 aa, Entamoeba histolytica
EEKQARKEKEA

SEQ ID NO: 2561420 - protein, 9 aa, Entamoeba histolytica
EEKQDGDSV

SEQ ID NO: 2561421 - protein, 8 aa, Entamoeba histolytica
EEKRSVGG

SEQ ID NO: 2561422 - protein, 9 aa, Entamoeba histolytica
EEKTKQIVS

SEQ ID NO: 2561423 - protein, 6 aa, Entamoeba histolytica
EELENE

SEQ ID NO: 2561424 - protein, 6 aa, Entamoeba histolytica
EELEQE

SEQ ID NO: 2561425 - protein, 7 aa, Entamoeba histolytica
EELGQTN

SEQ ID NO: 2561426 - protein, 11 aa, Entamoeba histolytica
EELIDSGNNDI

SEQ ID NO: 2561427 - protein, 11 aa, Entamoeba histolytica
EELKANQNSEF

SEQ ID NO: 2561428 - protein, 8 aa, Entamoeba histolytica
EELKEENQ

SEQ ID NO: 2561429 - protein, 13 aa, Entamoeba histolytica
EELNQNKISDNKY

SEQ ID NO: 2561430 - protein, 17 aa, Entamoeba histolytica
EELPKGKKLEALKQNTN

SEQ ID NO: 2561431 - protein, 13 aa, Entamoeba histolytica
EELPKKSKQKEEN

SEQ ID NO: 2561432 - protein, 5 aa, Entamoeba histolytica
EELSK

SEQ ID NO: 2561433 - protein, 4 aa, Entamoeba histolytica
EEMK

SEQ ID NO: 2561434 - protein, 5 aa, Entamoeba histolytica
EEMSP

SEQ ID NO: 2561435 - protein, 4 aa, Entamoeba histolytica
EENE

SEQ ID NO: 2561436 - protein, 5 aa, Entamoeba histolytica
EENED

SEQ ID NO: 2561437 - protein, 9 aa, Entamoeba histolytica
EENENKENI

SEQ ID NO: 2561438 - protein, 9 aa, Entamoeba histolytica
EENENNSLE

SEQ ID NO: 2561439 - protein, 15 aa, Entamoeba histolytica
EENGQRGGDGRYRDY

SEQ ID NO: 2561440 - protein, 5 aa, Entamoeba histolytica
EENHN

SEQ ID NO: 2561441 - protein, 14 aa, Entamoeba histolytica
EENKRKNNVTNNGV

SEQ ID NO: 2561442 - protein, 50 aa, Entamoeba histolytica
EENKTKQNEEENEEENKEENKEENKEENKEENKEENKEENKTTTSSSQIH

SEQ ID NO: 2561443 - protein, 9 aa, Entamoeba histolytica
EENNEKNEA

SEQ ID NO: 2561444 - protein, 7 aa, Entamoeba histolytica
EENPPEN

SEQ ID NO: 2561445 - protein, 9 aa, Entamoeba histolytica
EENQNNQAN

SEQ ID NO: 2561446 - protein, 5 aa, Entamoeba histolytica
EENRM

SEQ ID NO: 2561447 - protein, 10 aa, Entamoeba histolytica
EENSSGIKDK

SEQ ID NO: 2561448 - protein, 10 aa, Entamoeba histolytica
EENTGGIKDK

SEQ ID NO: 2561449 - protein, 16 aa, Entamoeba histolytica
EENTGYYYSNGECKQC

SEQ ID NO: 2561450 - protein, 9 aa, Entamoeba histolytica
EENTQALER

SEQ ID NO: 2561451 - protein, 6 aa, Entamoeba histolytica
EENVKP

SEQ ID NO: 2561452 - protein, 7 aa, Entamoeba histolytica
EENYSNT

SEQ ID NO: 2561453 - protein, 5 aa, Entamoeba histolytica
EENYY

SEQ ID NO: 2561454 - protein, 9 aa, Entamoeba histolytica
EEPDKMSDE

SEQ ID NO: 2561455 - protein, 8 aa, Entamoeba histolytica
EEPDNMKT

SEQ ID NO: 2561456 - protein, 8 aa, Entamoeba histolytica
EEPDRMSD

SEQ ID NO: 2561457 - protein, 10 aa, Entamoeba histolytica
EEPENGTIDQ

SEQ ID NO: 2561458 - protein, 4 aa, Entamoeba histolytica
EEPF

SEQ ID NO: 2561459 - protein, 12 aa, Entamoeba histolytica
EEPGTSAELDKN

SEQ ID NO: 2561460 - protein, 38 aa, Entamoeba histolytica
EEPINESSSDNINNSLNPSANHSISSNSSNKPLDQLII

SEQ ID NO: 2561461 - protein, 10 aa, Entamoeba histolytica
EEPLKGSSFA

SEQ ID NO: 2561462 - protein, 7 aa, Entamoeba histolytica
EEPMTTS

SEQ ID NO: 2561463 - protein, 6 aa, Entamoeba histolytica
EEPNFS

SEQ ID NO: 2561464 - protein, 7 aa, Entamoeba histolytica
EEPTNGL

SEQ ID NO: 2561465 - protein, 6 aa, Entamoeba histolytica
EEPTNS

SEQ ID NO: 2561466 - protein, 5 aa, Entamoeba histolytica
EEPYK

SEQ ID NO: 2561467 - protein, 6 aa, Entamoeba histolytica
EEPYKD

SEQ ID NO: 2561468 - protein, 22 aa, Entamoeba histolytica
EEQASYDDTIPDVSETDLPSQS

SEQ ID NO: 2561469 - protein, 7 aa, Entamoeba histolytica
EEQDEPL

SEQ ID NO: 2561470 - protein, 4 aa, Entamoeba histolytica
EEQE

SEQ ID NO: 2561471 - protein, 5 aa, Entamoeba histolytica
EEQIP

SEQ ID NO: 2561472 - protein, 7 aa, Entamoeba histolytica
EEQKSTW

SEQ ID NO: 2561473 - protein, 9 aa, Entamoeba histolytica
EEQNPNIEL

SEQ ID NO: 2561474 - protein, 7 aa, Entamoeba histolytica
EEQNTYG

SEQ ID NO: 2561475 - protein, 23 aa, Entamoeba histolytica
EEQPKEENGDDVKIQENDDDDEI

SEQ ID NO: 2561476 - protein, 22 aa, Entamoeba histolytica
EEQPPFEESISDVDEKSLPSQN

SEQ ID NO: 2561477 - protein, 20 aa, Entamoeba histolytica
EEQPQEPTSEEEQEQTEFGK

SEQ ID NO: 2561478 - protein, 12 aa, Entamoeba histolytica
EEQQTTLENFER

SEQ ID NO: 2561479 - protein, 8 aa, Entamoeba histolytica
EEQRANLN

SEQ ID NO: 2561480 - protein, 4 aa, Entamoeba histolytica
EEQS

SEQ ID NO: 2561481 - protein, 6 aa, Entamoeba histolytica
EEQTDE

SEQ ID NO: 2561482 - protein, 11 aa, Entamoeba histolytica
EERDRKGLYAK

SEQ ID NO: 2561483 - protein, 7 aa, Entamoeba histolytica
EERESVE

SEQ ID NO: 2561484 - protein, 6 aa, Entamoeba histolytica
EERKRS

SEQ ID NO: 2561485 - protein, 5 aa, Entamoeba histolytica
EERNY

SEQ ID NO: 2561486 - protein, 9 aa, Entamoeba histolytica
EERTPTRDY

SEQ ID NO: 2561487 - protein, 5 aa, Entamoeba histolytica
EESCS

SEQ ID NO: 2561488 - protein, 6 aa, Entamoeba histolytica
EESDEE

SEQ ID NO: 2561489 - protein, 4 aa, Entamoeba histolytica
EESG

SEQ ID NO: 2561490 - protein, 6 aa, Entamoeba histolytica
EESGND

SEQ ID NO: 2561491 - protein, 13 aa, Entamoeba histolytica
EESIEKKNTDNTL

SEQ ID NO: 2561492 - protein, 22 aa, Entamoeba histolytica
EESKQKRSASFTPTQKDKNEDL

SEQ ID NO: 2561493 - protein, 14 aa, Entamoeba histolytica
EESLGNAGAIAEAT

SEQ ID NO: 2561494 - protein, 6 aa, Entamoeba histolytica
EESLMK

SEQ ID NO: 2561495 - protein, 7 aa, Entamoeba histolytica
EESNKIS

SEQ ID NO: 2561496 - protein, 6 aa, Entamoeba histolytica
EESNVN

SEQ ID NO: 2561497 - protein, 23 aa, Entamoeba histolytica
EESQEQTKKVSTKKKQTSSSNYS

SEQ ID NO: 2561498 - protein, 9 aa, Entamoeba histolytica
EESSFNNEK

SEQ ID NO: 2561499 - protein, 8 aa, Entamoeba histolytica
EESTEAFE

SEQ ID NO: 2561500 - protein, 5 aa, Entamoeba histolytica
EESTI

SEQ ID NO: 2561501 - protein, 6 aa, Entamoeba histolytica
EESTPF

SEQ ID NO: 2561502 - protein, 14 aa, Entamoeba histolytica
EESWERVKKDGKKW

SEQ ID NO: 2561503 - protein, 6 aa, Entamoeba histolytica
EESYSG

SEQ ID NO: 2561504 - protein, 18 aa, Entamoeba histolytica
EETDETTQDNIPGYKSES

SEQ ID NO: 2561505 - protein, 6 aa, Entamoeba histolytica
EETESK

SEQ ID NO: 2561506 - protein, 8 aa, Entamoeba histolytica
EETGQRKD

SEQ ID NO: 2561507 - protein, 17 aa, Entamoeba histolytica
EETKEHYKEEKDRNQNV

SEQ ID NO: 2561508 - protein, 5 aa, Entamoeba histolytica
EETLP

SEQ ID NO: 2561509 - protein, 4 aa, Entamoeba histolytica
EETN

SEQ ID NO: 2561510 - protein, 9 aa, Entamoeba histolytica
EETNEYVQS

SEQ ID NO: 2561511 - protein, 7 aa, Entamoeba histolytica
EETNNIN

SEQ ID NO: 2561512 - protein, 11 aa, Entamoeba histolytica
EETNQQNPNII

SEQ ID NO: 2561513 - protein, 25 aa, Entamoeba histolytica
EETNSTSVSSQPKGYTQKKHYSNNG

SEQ ID NO: 2561514 - protein, 5 aa, Entamoeba histolytica
EETPK

SEQ ID NO: 2561515 - protein, 16 aa, Entamoeba histolytica
EETQPVEKKDEVSKEF

SEQ ID NO: 2561516 - protein, 5 aa, Entamoeba histolytica
EETSA

SEQ ID NO: 2561517 - protein, 13 aa, Entamoeba histolytica
EETTICNSTTSLQ

SEQ ID NO: 2561518 - protein, 10 aa, Entamoeba histolytica
EETTKEIKEN

SEQ ID NO: 2561519 - protein, 7 aa, Entamoeba histolytica
EETVKKN

SEQ ID NO: 2561520 - protein, 7 aa, Entamoeba histolytica
EETYEKT

SEQ ID NO: 2561521 - protein, 10 aa, Entamoeba histolytica
EEVDEKNQPI

SEQ ID NO: 2561522 - protein, 12 aa, Entamoeba histolytica
EEVDKKKKENPI

SEQ ID NO: 2561523 - protein, 9 aa, Entamoeba histolytica
EEVKQNDSI

SEQ ID NO: 2561524 - protein, 13 aa, Entamoeba histolytica
EEVKRQQEKQKKY

SEQ ID NO: 2561525 - protein, 4 aa, Entamoeba histolytica
EEVN

SEQ ID NO: 2561526 - protein, 6 aa, Entamoeba histolytica
EEVNSE

SEQ ID NO: 2561527 - protein, 8 aa, Entamoeba histolytica
EEVREAKR

SEQ ID NO: 2561528 - protein, 11 aa, Entamoeba histolytica
EEVRNTKDKAQ

SEQ ID NO: 2561529 - protein, 14 aa, Entamoeba histolytica
EEWDPEIQYPASKL

SEQ ID NO: 2561530 - protein, 6 aa, Entamoeba histolytica
EEYESN

SEQ ID NO: 2561531 - protein, 4 aa, Entamoeba histolytica
EEYL

SEQ ID NO: 2561532 - protein, 9 aa, Entamoeba histolytica
EEYNPRIDP

SEQ ID NO: 2561533 - protein, 6 aa, Entamoeba histolytica
EEYSAQ

SEQ ID NO: 2561534 - protein, 5 aa, Entamoeba histolytica
EEYSG

SEQ ID NO: 2561535 - protein, 6 aa, Entamoeba histolytica
EEYSQN

SEQ ID NO: 2561536 - protein, 12 aa, Entamoeba histolytica
EEYSVEERKARD

SEQ ID NO: 2561537 - protein, 8 aa, Entamoeba histolytica
EEYTPKDD

SEQ ID NO: 2561538 - protein, 11 aa, Entamoeba histolytica
EFAKKEAKQLE

SEQ ID NO: 2561539 - protein, 10 aa, Entamoeba histolytica
EFASKTRSYT

SEQ ID NO: 2561540 - protein, 5 aa, Entamoeba histolytica
EFATE

SEQ ID NO: 2561541 - protein, 5 aa, Entamoeba histolytica
EFDEA

SEQ ID NO: 2561542 - protein, 7 aa, Entamoeba histolytica
EFDEPSY

SEQ ID NO: 2561543 - protein, 8 aa, Entamoeba histolytica
EFEEEPKK

SEQ ID NO: 2561544 - protein, 7 aa, Entamoeba histolytica
EFEEETK

SEQ ID NO: 2561545 - protein, 8 aa, Entamoeba histolytica
EFEEETNK

SEQ ID NO: 2561546 - protein, 8 aa, Entamoeba histolytica
EFEETHSP

SEQ ID NO: 2561547 - protein, 4 aa, Entamoeba histolytica
EFEK

SEQ ID NO: 2561548 - protein, 9 aa, Entamoeba histolytica
EFEKENMGE

SEQ ID NO: 2561549 - protein, 11 aa, Entamoeba histolytica
EFERARGRREA

SEQ ID NO: 2561550 - protein, 10 aa, Entamoeba histolytica
EFETDNDVTV

SEQ ID NO: 2561551 - protein, 5 aa, Entamoeba histolytica
EFETQ

SEQ ID NO: 2561552 - protein, 4 aa, Entamoeba histolytica
EFGE

SEQ ID NO: 2561553 - protein, 8 aa, Entamoeba histolytica
EFKEQKDE

SEQ ID NO: 2561554 - protein, 6 aa, Entamoeba histolytica
EFKGNS

SEQ ID NO: 2561555 - protein, 8 aa, Entamoeba histolytica
EFKNTKMS

SEQ ID NO: 2561556 - protein, 15 aa, Entamoeba histolytica
EFKRNEEGKLKKTPF

SEQ ID NO: 2561557 - protein, 15 aa, Entamoeba histolytica
EFKRNEVGNLQRTKK

SEQ ID NO: 2561558 - protein, 5 aa, Entamoeba histolytica
EFNDN

SEQ ID NO: 2561559 - protein, 5 aa, Entamoeba histolytica
EFNPM

SEQ ID NO: 2561560 - protein, 8 aa, Entamoeba histolytica
EFNTSGGV

SEQ ID NO: 2561561 - protein, 4 aa, Entamoeba histolytica
EFNY

SEQ ID NO: 2561562 - protein, 9 aa, Entamoeba histolytica
EFPKTKPNQ

SEQ ID NO: 2561563 - protein, 5 aa, Entamoeba histolytica
EFPPL

SEQ ID NO: 2561564 - protein, 8 aa, Entamoeba histolytica
EFPPTEEQ

SEQ ID NO: 2561565 - protein, 4 aa, Entamoeba histolytica
EFPV

SEQ ID NO: 2561566 - protein, 11 aa, Entamoeba histolytica
EFQPGGETDLD

SEQ ID NO: 2561567 - protein, 10 aa, Entamoeba histolytica
EFQQSGCAEE

SEQ ID NO: 2561568 - protein, 8 aa, Entamoeba histolytica
EFQTEAPE

SEQ ID NO: 2561569 - protein, 8 aa, Entamoeba histolytica
EFQTEAPN

SEQ ID NO: 2561570 - protein, 10 aa, Entamoeba histolytica
EFRDSKGEAE

SEQ ID NO: 2561571 - protein, 9 aa, Entamoeba histolytica
EFSEKRNVT

SEQ ID NO: 2561572 - protein, 10 aa, Entamoeba histolytica
EFSEKTGKYY

SEQ ID NO: 2561573 - protein, 29 aa, Entamoeba histolytica
EFSSTTPFSPIESPDTLAPESLSSTHGVT

SEQ ID NO: 2561574 - protein, 13 aa, Entamoeba histolytica
EFTESKENKEGEF

SEQ ID NO: 2561575 - protein, 5 aa, Entamoeba histolytica
EFTNY

SEQ ID NO: 2561576 - protein, 11 aa, Entamoeba histolytica
EFTPDKGNIRA

SEQ ID NO: 2561577 - protein, 4 aa, Entamoeba histolytica
EFTS

SEQ ID NO: 2561578 - protein, 10 aa, Entamoeba histolytica
EFTTPTGEYL

SEQ ID NO: 2561579 - protein, 15 aa, Entamoeba histolytica
EGAAAQQAKKRGSAY

SEQ ID NO: 2561580 - protein, 8 aa, Entamoeba histolytica
EGALQNNT

SEQ ID NO: 2561581 - protein, 7 aa, Entamoeba histolytica
EGARKYA

SEQ ID NO: 2561582 - protein, 14 aa, Entamoeba histolytica
EGARNKAKHLKNPL

SEQ ID NO: 2561583 - protein, 8 aa, Entamoeba histolytica
EGATTGHS

SEQ ID NO: 2561584 - protein, 7 aa, Entamoeba histolytica
EGCENGT

SEQ ID NO: 2561585 - protein, 11 aa, Entamoeba histolytica
EGCQPSCGTCS

SEQ ID NO: 2561586 - protein, 6 aa, Entamoeba histolytica
EGDCDD

SEQ ID NO: 2561587 - protein, 14 aa, Entamoeba histolytica
EGDEEIDEKEEEIV

SEQ ID NO: 2561588 - protein, 6 aa, Entamoeba histolytica
EGDEIE

SEQ ID NO: 2561589 - protein, 8 aa, Entamoeba histolytica
EGDPEGDV

SEQ ID NO: 2561590 - protein, 10 aa, Entamoeba histolytica
EGDPEKENSF

SEQ ID NO: 2561591 - protein, 7 aa, Entamoeba histolytica
EGDPELS

SEQ ID NO: 2561592 - protein, 21 aa, Entamoeba histolytica
EGDPNGKIEEFDAGNSPTAVV

SEQ ID NO: 2561593 - protein, 9 aa, Entamoeba histolytica
EGECSNSEG

SEQ ID NO: 2561594 - protein, 4 aa, Entamoeba histolytica
EGED

SEQ ID NO: 2561595 - protein, 19 aa, Entamoeba histolytica
EGEEVEESKEESKEEEKIN

SEQ ID NO: 2561596 - protein, 70 aa, Entamoeba histolytica
EGEKKMNGSDISSNSTPSVPSSVQEQSVPSEEQQTDPLQQNSQNDSIHNPSQPEKNQPVALSSSSSSSSS

SEQ ID NO: 2561597 - protein, 5 aa, Entamoeba histolytica
EGENE

SEQ ID NO: 2561598 - protein, 6 aa, Entamoeba histolytica
EGENNS

SEQ ID NO: 2561599 - protein, 9 aa, Entamoeba histolytica
EGESKSGIK

SEQ ID NO: 2561600 - protein, 5 aa, Entamoeba histolytica
EGEVK

SEQ ID NO: 2561601 - protein, 4 aa, Entamoeba histolytica
EGEY

SEQ ID NO: 2561602 - protein, 13 aa, Entamoeba histolytica
EGFDKERAAGTYR

SEQ ID NO: 2561603 - protein, 5 aa, Entamoeba histolytica
EGFGS

SEQ ID NO: 2561604 - protein, 6 aa, Entamoeba histolytica
EGFQAE

SEQ ID NO: 2561605 - protein, 8 aa, Entamoeba histolytica
EGGEYKNK

SEQ ID NO: 2561606 - protein, 6 aa, Entamoeba histolytica
EGGKKM

SEQ ID NO: 2561607 - protein, 6 aa, Entamoeba histolytica
EGGNND

SEQ ID NO: 2561608 - protein, 6 aa, Entamoeba histolytica
EGGSQG

SEQ ID NO: 2561609 - protein, 7 aa, Entamoeba histolytica
EGHDKRM

SEQ ID NO: 2561610 - protein, 4 aa, Entamoeba histolytica
EGID

SEQ ID NO: 2561611 - protein, 10 aa, Entamoeba histolytica
EGIEKDIEES

SEQ ID NO: 2561612 - protein, 5 aa, Entamoeba histolytica
EGIIN

SEQ ID NO: 2561613 - protein, 5 aa, Entamoeba histolytica
EGIQK

SEQ ID NO: 2561614 - protein, 5 aa, Entamoeba histolytica
EGIQS

SEQ ID NO: 2561615 - protein, 8 aa, Entamoeba histolytica
EGKANTKR

SEQ ID NO: 2561616 - protein, 7 aa, Entamoeba histolytica
EGKCKEC

SEQ ID NO: 2561617 - protein, 8 aa, Entamoeba histolytica
EGKDDPVA

SEQ ID NO: 2561618 - protein, 8 aa, Entamoeba histolytica
EGKEAKLK

SEQ ID NO: 2561619 - protein, 5 aa, Entamoeba histolytica
EGKEI

SEQ ID NO: 2561620 - protein, 8 aa, Entamoeba histolytica
EGKERKEI

SEQ ID NO: 2561621 - protein, 9 aa, Entamoeba histolytica
EGKGADIEQ

SEQ ID NO: 2561622 - protein, 5 aa, Entamoeba histolytica
EGKNF

SEQ ID NO: 2561623 - protein, 9 aa, Entamoeba histolytica
EGKRPRKED

SEQ ID NO: 2561624 - protein, 9 aa, Entamoeba histolytica
EGKRPSFKK

SEQ ID NO: 2561625 - protein, 5 aa, Entamoeba histolytica
EGKSI

SEQ ID NO: 2561626 - protein, 4 aa, Entamoeba histolytica
EGKY

SEQ ID NO: 2561627 - protein, 18 aa, Entamoeba histolytica
EGLKKRSEMGMENESATK

SEQ ID NO: 2561628 - protein, 9 aa, Entamoeba histolytica
EGLKPLSEA

SEQ ID NO: 2561629 - protein, 16 aa, Entamoeba histolytica
EGLKSETKETESLSPE

SEQ ID NO: 2561630 - protein, 5 aa, Entamoeba histolytica
EGLKT

SEQ ID NO: 2561631 - protein, 21 aa, Entamoeba histolytica
EGLPDDESTVAKFGDASMASP

SEQ ID NO: 2561632 - protein, 6 aa, Entamoeba histolytica
EGLREE

SEQ ID NO: 2561633 - protein, 14 aa, Entamoeba histolytica
EGLSSGLANSTESY

SEQ ID NO: 2561634 - protein, 10 aa, Entamoeba histolytica
EGLSSNPLGF

SEQ ID NO: 2561635 - protein, 7 aa, Entamoeba histolytica
EGNEVER

SEQ ID NO: 2561636 - protein, 6 aa, Entamoeba histolytica
EGNGKG

SEQ ID NO: 2561637 - protein, 10 aa, Entamoeba histolytica
EGNGTSEDGM

SEQ ID NO: 2561638 - protein, 9 aa, Entamoeba histolytica
EGNIKTDYP

SEQ ID NO: 2561639 - protein, 9 aa, Entamoeba histolytica
EGNLTEDEF

SEQ ID NO: 2561640 - protein, 38 aa, Entamoeba histolytica
EGNSISSVEGSSSCKTCPKNQVANLQKTSNEISNSDHT

SEQ ID NO: 2561641 - protein, 7 aa, Entamoeba histolytica
EGNTVPA

SEQ ID NO: 2561642 - protein, 6 aa, Entamoeba histolytica
EGNYRN

SEQ ID NO: 2561643 - protein, 4 aa, Entamoeba histolytica
EGPC

SEQ ID NO: 2561644 - protein, 8 aa, Entamoeba histolytica
EGPDGAAI

SEQ ID NO: 2561645 - protein, 8 aa, Entamoeba histolytica
EGPDRLPV

SEQ ID NO: 2561646 - protein, 5 aa, Entamoeba histolytica
EGPLH

SEQ ID NO: 2561647 - protein, 38 aa, Entamoeba histolytica
EGQENSEDQKEKTSSELFEGSPKTKPTQVESDQKSDVE

SEQ ID NO: 2561648 - protein, 4 aa, Entamoeba histolytica
EGQK

SEQ ID NO: 2561649 - protein, 8 aa, Entamoeba histolytica
EGQNEPIP

SEQ ID NO: 2561650 - protein, 7 aa, Entamoeba histolytica
EGQSNSV

SEQ ID NO: 2561651 - protein, 4 aa, Entamoeba histolytica
EGQT

SEQ ID NO: 2561652 - protein, 9 aa, Entamoeba histolytica
EGQTLRNEN

SEQ ID NO: 2561653 - protein, 13 aa, Entamoeba histolytica
EGQYVKNGECAPC

SEQ ID NO: 2561654 - protein, 13 aa, Entamoeba histolytica
EGRGCSGNPTART

SEQ ID NO: 2561655 - protein, 6 aa, Entamoeba histolytica
EGRKEK

SEQ ID NO: 2561656 - protein, 4 aa, Entamoeba histolytica
EGRN

SEQ ID NO: 2561657 - protein, 9 aa, Entamoeba histolytica
EGRSNGKQC

SEQ ID NO: 2561658 - protein, 4 aa, Entamoeba histolytica
EGRY

SEQ ID NO: 2561659 - protein, 6 aa, Entamoeba histolytica
EGSANT

SEQ ID NO: 2561660 - protein, 11 aa, Entamoeba histolytica
EGSCKREEEDG

SEQ ID NO: 2561661 - protein, 6 aa, Entamoeba histolytica
EGSDTY

SEQ ID NO: 2561662 - protein, 7 aa, Entamoeba histolytica
EGSFGKE

SEQ ID NO: 2561663 - protein, 6 aa, Entamoeba histolytica
EGSIGT

SEQ ID NO: 2561664 - protein, 4 aa, Entamoeba histolytica
EGSK

SEQ ID NO: 2561665 - protein, 6 aa, Entamoeba histolytica
EGSKRR

SEQ ID NO: 2561666 - protein, 4 aa, Entamoeba histolytica
EGSN

SEQ ID NO: 2561667 - protein, 21 aa, Entamoeba histolytica
EGSSTCSGNKESETHNFDSQE

SEQ ID NO: 2561668 - protein, 9 aa, Entamoeba histolytica
EGSTKEKRE

SEQ ID NO: 2561669 - protein, 9 aa, Entamoeba histolytica
EGSVGGKLE

SEQ ID NO: 2561670 - protein, 8 aa, Entamoeba histolytica
EGSYFETQ

SEQ ID NO: 2561671 - protein, 5 aa, Entamoeba histolytica
EGTAK

SEQ ID NO: 2561672 - protein, 6 aa, Entamoeba histolytica
EGTANS

SEQ ID NO: 2561673 - protein, 8 aa, Entamoeba histolytica
EGTEEAHT

SEQ ID NO: 2561674 - protein, 7 aa, Entamoeba histolytica
EGTFQGK

SEQ ID NO: 2561675 - protein, 5 aa, Entamoeba histolytica
EGTFV

SEQ ID NO: 2561676 - protein, 6 aa, Entamoeba histolytica
EGTGSE

SEQ ID NO: 2561677 - protein, 9 aa, Entamoeba histolytica
EGTRVKPQK

SEQ ID NO: 2561678 - protein, 11 aa, Entamoeba histolytica
EGTSTEDNKIE

SEQ ID NO: 2561679 - protein, 13 aa, Entamoeba histolytica
EGTSTEDNKIECQ

SEQ ID NO: 2561680 - protein, 16 aa, Entamoeba histolytica
EGTSTYYTSYTENGAC

SEQ ID NO: 2561681 - protein, 7 aa, Entamoeba histolytica
EGTVKPC

SEQ ID NO: 2561682 - protein, 14 aa, Entamoeba histolytica
EGTVNQNRGGVGHN

SEQ ID NO: 2561683 - protein, 4 aa, Entamoeba histolytica
EGVG

SEQ ID NO: 2561684 - protein, 7 aa, Entamoeba histolytica
EGVPNDS

SEQ ID NO: 2561685 - protein, 10 aa, Entamoeba histolytica
EGYAEKDGVC

SEQ ID NO: 2561686 - protein, 7 aa, Entamoeba histolytica
EGYEQDI

SEQ ID NO: 2561687 - protein, 7 aa, Entamoeba histolytica
EGYGGSD

SEQ ID NO: 2561688 - protein, 8 aa, Entamoeba histolytica
EGYLSEQS

SEQ ID NO: 2561689 - protein, 9 aa, Entamoeba histolytica
EGYNADGKG

SEQ ID NO: 2561690 - protein, 5 aa, Entamoeba histolytica
EGYQD

SEQ ID NO: 2561691 - protein, 5 aa, Entamoeba histolytica
EGYQL

SEQ ID NO: 2561692 - protein, 6 aa, Entamoeba histolytica
EGYQNA

SEQ ID NO: 2561693 - protein, 4 aa, Entamoeba histolytica
EGYR

SEQ ID NO: 2561694 - protein, 7 aa, Entamoeba histolytica
EGYRNVN

SEQ ID NO: 2561695 - protein, 8 aa, Entamoeba histolytica
EGYSDSKC

SEQ ID NO: 2561696 - protein, 9 aa, Entamoeba histolytica
EGYSGGALK

SEQ ID NO: 2561697 - protein, 7 aa, Entamoeba histolytica
EHAQEPI

SEQ ID NO: 2561698 - protein, 12 aa, Entamoeba histolytica
EHEESIKTENAS

SEQ ID NO: 2561699 - protein, 7 aa, Entamoeba histolytica
EHETQRE

SEQ ID NO: 2561700 - protein, 8 aa, Entamoeba histolytica
EHGKTGGY

SEQ ID NO: 2561701 - protein, 4 aa, Entamoeba histolytica
EHGR

SEQ ID NO: 2561702 - protein, 6 aa, Entamoeba histolytica
EHIETQ

SEQ ID NO: 2561703 - protein, 14 aa, Entamoeba histolytica
EHKRSQPSLAPPQQ

SEQ ID NO: 2561704 - protein, 8 aa, Entamoeba histolytica
EHKRTQES

SEQ ID NO: 2561705 - protein, 9 aa, Entamoeba histolytica
EHKTAKSKQ

SEQ ID NO: 2561706 - protein, 6 aa, Entamoeba histolytica
EHPEQV

SEQ ID NO: 2561707 - protein, 5 aa, Entamoeba histolytica
EHPQV

SEQ ID NO: 2561708 - protein, 6 aa, Entamoeba histolytica
EHQNNT

SEQ ID NO: 2561709 - protein, 6 aa, Entamoeba histolytica
EHQPAN

SEQ ID NO: 2561710 - protein, 10 aa, Entamoeba histolytica
EHQSPSSSGV

SEQ ID NO: 2561711 - protein, 7 aa, Entamoeba histolytica
EHRERGR

SEQ ID NO: 2561712 - protein, 29 aa, Entamoeba histolytica
EHSDSGDYNYSSFSPDEETLCDASKKNGV

SEQ ID NO: 2561713 - protein, 4 aa, Entamoeba histolytica
EHYE

SEQ ID NO: 2561714 - protein, 15 aa, Entamoeba histolytica
EHYRPGSLKSPEQGI

SEQ ID NO: 2561715 - protein, 20 aa, Entamoeba histolytica
EIAEDKKEESTEKRIEEDEI

SEQ ID NO: 2561716 - protein, 7 aa, Entamoeba histolytica
EIASQKA

SEQ ID NO: 2561717 - protein, 7 aa, Entamoeba histolytica
EIDNNNK

SEQ ID NO: 2561718 - protein, 8 aa, Entamoeba histolytica
EIDPGDTI

SEQ ID NO: 2561719 - protein, 5 aa, Entamoeba histolytica
EIDTG

SEQ ID NO: 2561720 - protein, 6 aa, Entamoeba histolytica
EIEAPD

SEQ ID NO: 2561721 - protein, 6 aa, Entamoeba histolytica
EIEEEQ

SEQ ID NO: 2561722 - protein, 8 aa, Entamoeba histolytica
EIEEEQEI

SEQ ID NO: 2561723 - protein, 9 aa, Entamoeba histolytica
EIEEPPKNH

SEQ ID NO: 2561724 - protein, 21 aa, Entamoeba histolytica
EIEERKKKKVVEKEEEAPNYE

SEQ ID NO: 2561725 - protein, 5 aa, Entamoeba histolytica
EIEGP

SEQ ID NO: 2561726 - protein, 19 aa, Entamoeba histolytica
EIEKESEKIRRNKKIESEN

SEQ ID NO: 2561727 - protein, 14 aa, Entamoeba histolytica
EIELQEGEKIKVNE

SEQ ID NO: 2561728 - protein, 6 aa, Entamoeba histolytica
EIENNG

SEQ ID NO: 2561729 - protein, 7 aa, Entamoeba histolytica
EIERDER

SEQ ID NO: 2561730 - protein, 14 aa, Entamoeba histolytica
EIERYEKASEESME

SEQ ID NO: 2561731 - protein, 9 aa, Entamoeba histolytica
EIETNSNYL

SEQ ID NO: 2561732 - protein, 7 aa, Entamoeba histolytica
EIGETSE

SEQ ID NO: 2561733 - protein, 7 aa, Entamoeba histolytica
EIGEYDS

SEQ ID NO: 2561734 - protein, 8 aa, Entamoeba histolytica
EIGKDDTG

SEQ ID NO: 2561735 - protein, 14 aa, Entamoeba histolytica
EIGKEKLSKIEGKV

SEQ ID NO: 2561736 - protein, 6 aa, Entamoeba histolytica
EIGKNE

SEQ ID NO: 2561737 - protein, 4 aa, Entamoeba histolytica
EIGR

SEQ ID NO: 2561738 - protein, 23 aa, Entamoeba histolytica
EIGSDNSLAHTKVSKSAISSQQY

SEQ ID NO: 2561739 - protein, 9 aa, Entamoeba histolytica
EIGTSGNGY

SEQ ID NO: 2561740 - protein, 8 aa, Entamoeba histolytica
EIHPSDNT

SEQ ID NO: 2561741 - protein, 31 aa, Entamoeba histolytica
EIKEEESIKEENEEEESSKEEKKKMEEEEID

SEQ ID NO: 2561742 - protein, 9 aa, Entamoeba histolytica
EIKENNENI

SEQ ID NO: 2561743 - protein, 10 aa, Entamoeba histolytica
EIKEQYISDD

SEQ ID NO: 2561744 - protein, 12 aa, Entamoeba histolytica
EIKGKENKKGEW

SEQ ID NO: 2561745 - protein, 11 aa, Entamoeba histolytica
EIKKNQKGWKK

SEQ ID NO: 2561746 - protein, 11 aa, Entamoeba histolytica
EIKNDDDEFEK

SEQ ID NO: 2561747 - protein, 16 aa, Entamoeba histolytica
EIKQESSDPSTSEETI

SEQ ID NO: 2561748 - protein, 15 aa, Entamoeba histolytica
EIKRSVQASNISSND

SEQ ID NO: 2561749 - protein, 10 aa, Entamoeba histolytica
EIKSEELTTQ

SEQ ID NO: 2561750 - protein, 8 aa, Entamoeba histolytica
EIKSGDDD

SEQ ID NO: 2561751 - protein, 8 aa, Entamoeba histolytica
EILPGGRK

SEQ ID NO: 2561752 - protein, 5 aa, Entamoeba histolytica
EILSD

SEQ ID NO: 2561753 - protein, 4 aa, Entamoeba histolytica
EIND

SEQ ID NO: 2561754 - protein, 7 aa, Entamoeba histolytica
EINDEKI

SEQ ID NO: 2561755 - protein, 6 aa, Entamoeba histolytica
EINEDE

SEQ ID NO: 2561756 - protein, 5 aa, Entamoeba histolytica
EINEE

SEQ ID NO: 2561757 - protein, 15 aa, Entamoeba histolytica
EINETEPDNKTIKEL

SEQ ID NO: 2561758 - protein, 9 aa, Entamoeba histolytica
EINETTSNK

SEQ ID NO: 2561759 - protein, 8 aa, Entamoeba histolytica
EINGTNEN

SEQ ID NO: 2561760 - protein, 4 aa, Entamoeba histolytica
EINN

SEQ ID NO: 2561761 - protein, 13 aa, Entamoeba histolytica
EINPFDSSSSSSD

SEQ ID NO: 2561762 - protein, 5 aa, Entamoeba histolytica
EINPQ

SEQ ID NO: 2561763 - protein, 19 aa, Entamoeba histolytica
EINSTDSQISGSQQSKAFH

SEQ ID NO: 2561764 - protein, 5 aa, Entamoeba histolytica
EINTP

SEQ ID NO: 2561765 - protein, 6 aa, Entamoeba histolytica
EINTTN

SEQ ID NO: 2561766 - protein, 5 aa, Entamoeba histolytica
EIPAD

SEQ ID NO: 2561767 - protein, 5 aa, Entamoeba histolytica
EIPAE

SEQ ID NO: 2561768 - protein, 8 aa, Entamoeba histolytica
EIPEDETE

SEQ ID NO: 2561769 - protein, 17 aa, Entamoeba histolytica
EIQEKNDEEKETRKNKI

SEQ ID NO: 2561770 - protein, 4 aa, Entamoeba histolytica
EIQS

SEQ ID NO: 2561771 - protein, 7 aa, Entamoeba histolytica
EIQTSLK

SEQ ID NO: 2561772 - protein, 9 aa, Entamoeba histolytica
EIRETPSRK

SEQ ID NO: 2561773 - protein, 7 aa, Entamoeba histolytica
EIRTPGN

SEQ ID NO: 2561774 - protein, 5 aa, Entamoeba histolytica
EIRTV

SEQ ID NO: 2561775 - protein, 5 aa, Entamoeba histolytica
EISET

SEQ ID NO: 2561776 - protein, 9 aa, Entamoeba histolytica
EISKQNEKL

SEQ ID NO: 2561777 - protein, 7 aa, Entamoeba histolytica
EISYNSR

SEQ ID NO: 2561778 - protein, 9 aa, Entamoeba histolytica
EITDKEVNE

SEQ ID NO: 2561779 - protein, 5 aa, Entamoeba histolytica
EITGT

SEQ ID NO: 2561780 - protein, 8 aa, Entamoeba histolytica
EITKDRPR

SEQ ID NO: 2561781 - protein, 29 aa, Entamoeba histolytica
EITQYEKKDKKVKTGSLIPPSKKKKKLST

SEQ ID NO: 2561782 - protein, 5 aa, Entamoeba histolytica
EITSE

SEQ ID NO: 2561783 - protein, 11 aa, Entamoeba histolytica
EITSRTDSFTD

SEQ ID NO: 2561784 - protein, 5 aa, Entamoeba histolytica
EIVRT

SEQ ID NO: 2561785 - protein, 9 aa, Entamoeba histolytica
EIVTTSKSC

SEQ ID NO: 2561786 - protein, 10 aa, Entamoeba histolytica
EKAERREENY

SEQ ID NO: 2561787 - protein, 7 aa, Entamoeba histolytica
EKANFDT

SEQ ID NO: 2561788 - protein, 4 aa, Entamoeba histolytica
EKAQ

SEQ ID NO: 2561789 - protein, 4 aa, Entamoeba histolytica
EKAS

SEQ ID NO: 2561790 - protein, 8 aa, Entamoeba histolytica
EKASASDC

SEQ ID NO: 2561791 - protein, 12 aa, Entamoeba histolytica
EKASSHDTCESA

SEQ ID NO: 2561792 - protein, 11 aa, Entamoeba histolytica
EKATDKDGHPL

SEQ ID NO: 2561793 - protein, 4 aa, Entamoeba histolytica
EKAY

SEQ ID NO: 2561794 - protein, 18 aa, Entamoeba histolytica
EKCDTTKHIKSDCSDCED

SEQ ID NO: 2561795 - protein, 6 aa, Entamoeba histolytica
EKCKAS

SEQ ID NO: 2561796 - protein, 7 aa, Entamoeba histolytica
EKCNGGD

SEQ ID NO: 2561797 - protein, 14 aa, Entamoeba histolytica
EKCNGSGRVSETTE

SEQ ID NO: 2561798 - protein, 8 aa, Entamoeba histolytica
EKCPTQKP

SEQ ID NO: 2561799 - protein, 9 aa, Entamoeba histolytica
EKCSEGCKS

SEQ ID NO: 2561800 - protein, 8 aa, Entamoeba histolytica
EKCSPECG

SEQ ID NO: 2561801 - protein, 8 aa, Entamoeba histolytica
EKCTRGVD

SEQ ID NO: 2561802 - protein, 9 aa, Entamoeba histolytica
EKDAVHRQT

SEQ ID NO: 2561803 - protein, 5 aa, Entamoeba histolytica
EKDEL

SEQ ID NO: 2561804 - protein, 8 aa, Entamoeba histolytica
EKDGNNGI

SEQ ID NO: 2561805 - protein, 18 aa, Entamoeba histolytica
EKDITGPNQRSDNTSPID

SEQ ID NO: 2561806 - protein, 6 aa, Entamoeba histolytica
EKDITQ

SEQ ID NO: 2561807 - protein, 22 aa, Entamoeba histolytica
EKDKDSLDKVNDNLDTSDKTLK

SEQ ID NO: 2561808 - protein, 15 aa, Entamoeba histolytica
EKDKFSKPMTKQNKK

SEQ ID NO: 2561809 - protein, 11 aa, Entamoeba histolytica
EKDNDPENSTS

SEQ ID NO: 2561810 - protein, 6 aa, Entamoeba histolytica
EKDNKY

SEQ ID NO: 2561811 - protein, 10 aa, Entamoeba histolytica
EKDNPDNESL

SEQ ID NO: 2561812 - protein, 6 aa, Entamoeba histolytica
EKDSEY

SEQ ID NO: 2561813 - protein, 5 aa, Entamoeba histolytica
EKEAE

SEQ ID NO: 2561814 - protein, 4 aa, Entamoeba histolytica
EKEE

SEQ ID NO: 2561815 - protein, 6 aa, Entamoeba histolytica
EKEEEI

SEQ ID NO: 2561816 - protein, 20 aa, Entamoeba histolytica
EKEEESKQETTETETIKSKQ

SEQ ID NO: 2561817 - protein, 10 aa, Entamoeba histolytica
EKEEHEKAEI

SEQ ID NO: 2561818 - protein, 19 aa, Entamoeba histolytica
EKEEYEKLKTEIDKKKKYP

SEQ ID NO: 2561819 - protein, 6 aa, Entamoeba histolytica
EKEFKN

SEQ ID NO: 2561820 - protein, 9 aa, Entamoeba histolytica
EKEFSERYS

SEQ ID NO: 2561821 - protein, 15 aa, Entamoeba histolytica
EKEGAEEWKKKYSEQ

SEQ ID NO: 2561822 - protein, 29 aa, Entamoeba histolytica
EKEGETINEQKIPTKENNNIKNKTEKSHS

SEQ ID NO: 2561823 - protein, 9 aa, Entamoeba histolytica
EKEGKVDET

SEQ ID NO: 2561824 - protein, 6 aa, Entamoeba histolytica
EKEIHA

SEQ ID NO: 2561825 - protein, 12 aa, Entamoeba histolytica
EKEINKSKQGIP

SEQ ID NO: 2561826 - protein, 6 aa, Entamoeba histolytica
EKEISL

SEQ ID NO: 2561827 - protein, 15 aa, Entamoeba histolytica
EKEKKETHSYSQAAG

SEQ ID NO: 2561828 - protein, 9 aa, Entamoeba histolytica
EKEKQAGEI

SEQ ID NO: 2561829 - protein, 7 aa, Entamoeba histolytica
EKENALK

SEQ ID NO: 2561830 - protein, 7 aa, Entamoeba histolytica
EKENDIK

SEQ ID NO: 2561831 - protein, 6 aa, Entamoeba histolytica
EKENEH

SEQ ID NO: 2561832 - protein, 8 aa, Entamoeba histolytica
EKENSEIK

SEQ ID NO: 2561833 - protein, 10 aa, Entamoeba histolytica
EKENTEIVSS

SEQ ID NO: 2561834 - protein, 34 aa, Entamoeba histolytica
EKEPENNSENAPQTGVTEFTSKTEEDNSEEEPFI

SEQ ID NO: 2561835 - protein, 15 aa, Entamoeba histolytica
EKEPLNEGNKKIKTI

SEQ ID NO: 2561836 - protein, 7 aa, Entamoeba histolytica
EKEPTKF

SEQ ID NO: 2561837 - protein, 19 aa, Entamoeba histolytica
EKEQQGETNKQQNEEEEHQ

SEQ ID NO: 2561838 - protein, 4 aa, Entamoeba histolytica
EKER

SEQ ID NO: 2561839 - protein, 8 aa, Entamoeba histolytica
EKETENNI

SEQ ID NO: 2561840 - protein, 11 aa, Entamoeba histolytica
EKETQKKNPSL

SEQ ID NO: 2561841 - protein, 10 aa, Entamoeba histolytica
EKETSGSGEM

SEQ ID NO: 2561842 - protein, 6 aa, Entamoeba histolytica
EKETVG

SEQ ID NO: 2561843 - protein, 7 aa, Entamoeba histolytica
EKEVGYE

SEQ ID NO: 2561844 - protein, 6 aa, Entamoeba histolytica
EKEYSK

SEQ ID NO: 2561845 - protein, 9 aa, Entamoeba histolytica
EKFEKRSED

SEQ ID NO: 2561846 - protein, 4 aa, Entamoeba histolytica
EKFG

SEQ ID NO: 2561847 - protein, 5 aa, Entamoeba histolytica
EKFGG

SEQ ID NO: 2561848 - protein, 17 aa, Entamoeba histolytica
EKGCTKCEDGYSETSDR

SEQ ID NO: 2561849 - protein, 7 aa, Entamoeba histolytica
EKGEEKF

SEQ ID NO: 2561850 - protein, 8 aa, Entamoeba histolytica
EKGGKGNI

SEQ ID NO: 2561851 - protein, 10 aa, Entamoeba histolytica
EKGGYSDENV

SEQ ID NO: 2561852 - protein, 10 aa, Entamoeba histolytica
EKGHTTENYY

SEQ ID NO: 2561853 - protein, 4 aa, Entamoeba histolytica
EKGI

SEQ ID NO: 2561854 - protein, 6 aa, Entamoeba histolytica
EKGINK

SEQ ID NO: 2561855 - protein, 8 aa, Entamoeba histolytica
EKGITSEC

SEQ ID NO: 2561856 - protein, 11 aa, Entamoeba histolytica
EKGKKEKEEFK

SEQ ID NO: 2561857 - protein, 8 aa, Entamoeba histolytica
EKGMNKQT

SEQ ID NO: 2561858 - protein, 8 aa, Entamoeba histolytica
EKGNETLD

SEQ ID NO: 2561859 - protein, 8 aa, Entamoeba histolytica
EKGPFGSS

SEQ ID NO: 2561860 - protein, 8 aa, Entamoeba histolytica
EKGSTISI

SEQ ID NO: 2561861 - protein, 5 aa, Entamoeba histolytica
EKGYS

SEQ ID NO: 2561862 - protein, 4 aa, Entamoeba histolytica
EKHE

SEQ ID NO: 2561863 - protein, 9 aa, Entamoeba histolytica
EKHKGDYDL

SEQ ID NO: 2561864 - protein, 8 aa, Entamoeba histolytica
EKHPRDPT

SEQ ID NO: 2561865 - protein, 5 aa, Entamoeba histolytica
EKHYD

SEQ ID NO: 2561866 - protein, 5 aa, Entamoeba histolytica
EKIDR

SEQ ID NO: 2561867 - protein, 14 aa, Entamoeba histolytica
EKIKNNTLHSGDDV

SEQ ID NO: 2561868 - protein, 12 aa, Entamoeba histolytica
EKIKQQIRRIKS

SEQ ID NO: 2561869 - protein, 7 aa, Entamoeba histolytica
EKIKSSK

SEQ ID NO: 2561870 - protein, 6 aa, Entamoeba histolytica
EKINAK

SEQ ID NO: 2561871 - protein, 12 aa, Entamoeba histolytica
EKINETSSASYV

SEQ ID NO: 2561872 - protein, 18 aa, Entamoeba histolytica
EKINSNTVPNTIEGNYTN

SEQ ID NO: 2561873 - protein, 5 aa, Entamoeba histolytica
EKIQL

SEQ ID NO: 2561874 - protein, 9 aa, Entamoeba histolytica
EKKAEESNL

SEQ ID NO: 2561875 - protein, 10 aa, Entamoeba histolytica
EKKDEGYYCS

SEQ ID NO: 2561876 - protein, 13 aa, Entamoeba histolytica
EKKEEEKEPLLYS

SEQ ID NO: 2561877 - protein, 8 aa, Entamoeba histolytica
EKKEETGR

SEQ ID NO: 2561878 - protein, 5 aa, Entamoeba histolytica
EKKGG

SEQ ID NO: 2561879 - protein, 7 aa, Entamoeba histolytica
EKKGPII

SEQ ID NO: 2561880 - protein, 5 aa, Entamoeba histolytica
EKKIE

SEQ ID NO: 2561881 - protein, 7 aa, Entamoeba histolytica
EKKIGTT

SEQ ID NO: 2561882 - protein, 11 aa, Entamoeba histolytica
EKKKDDNKDGP

SEQ ID NO: 2561883 - protein, 18 aa, Entamoeba histolytica
EKKKEGEEKQDEKEMKNK

SEQ ID NO: 2561884 - protein, 10 aa, Entamoeba histolytica
EKKPGSDSLQ

SEQ ID NO: 2561885 - protein, 8 aa, Entamoeba histolytica
EKKPRLKE

SEQ ID NO: 2561886 - protein, 8 aa, Entamoeba histolytica
EKKRQEQI

SEQ ID NO: 2561887 - protein, 5 aa, Entamoeba histolytica
EKKSF

SEQ ID NO: 2561888 - protein, 8 aa, Entamoeba histolytica
EKKTYKEC

SEQ ID NO: 2561889 - protein, 9 aa, Entamoeba histolytica
EKLEEYGRS

SEQ ID NO: 2561890 - protein, 5 aa, Entamoeba histolytica
EKLKE

SEQ ID NO: 2561891 - protein, 7 aa, Entamoeba histolytica
EKLPDET

SEQ ID NO: 2561892 - protein, 8 aa, Entamoeba histolytica
EKLPPGNS

SEQ ID NO: 2561893 - protein, 4 aa, Entamoeba histolytica
EKLS

SEQ ID NO: 2561894 - protein, 23 aa, Entamoeba histolytica
EKLSKRIKNKRKTVNKELLKVYL

SEQ ID NO: 2561895 - protein, 4 aa, Entamoeba histolytica
EKME

SEQ ID NO: 2561896 - protein, 6 aa, Entamoeba histolytica
EKMPDK

SEQ ID NO: 2561897 - protein, 10 aa, Entamoeba histolytica
EKNAKTFKPS

SEQ ID NO: 2561898 - protein, 13 aa, Entamoeba histolytica
EKNDGTEKNPDKC

SEQ ID NO: 2561899 - protein, 4 aa, Entamoeba histolytica
EKNE

SEQ ID NO: 2561900 - protein, 6 aa, Entamoeba histolytica
EKNFAE

SEQ ID NO: 2561901 - protein, 6 aa, Entamoeba histolytica
EKNFRP

SEQ ID NO: 2561902 - protein, 10 aa, Entamoeba histolytica
EKNGRQRTTR

SEQ ID NO: 2561903 - protein, 4 aa, Entamoeba histolytica
EKNI

SEQ ID NO: 2561904 - protein, 8 aa, Entamoeba histolytica
EKNKEEEF

SEQ ID NO: 2561905 - protein, 8 aa, Entamoeba histolytica
EKNKIDKM

SEQ ID NO: 2561906 - protein, 13 aa, Entamoeba histolytica
EKNKKEKNLKEDK

SEQ ID NO: 2561907 - protein, 7 aa, Entamoeba histolytica
EKNKKKI

SEQ ID NO: 2561908 - protein, 8 aa, Entamoeba histolytica
EKNNENYQ

SEQ ID NO: 2561909 - protein, 7 aa, Entamoeba histolytica
EKNNPEV

SEQ ID NO: 2561910 - protein, 6 aa, Entamoeba histolytica
EKNNSL

SEQ ID NO: 2561911 - protein, 6 aa, Entamoeba histolytica
EKNNTH

SEQ ID NO: 2561912 - protein, 6 aa, Entamoeba histolytica
EKNQEK

SEQ ID NO: 2561913 - protein, 7 aa, Entamoeba histolytica
EKNSQED

SEQ ID NO: 2561914 - protein, 7 aa, Entamoeba histolytica
EKNSQYI

SEQ ID NO: 2561915 - protein, 5 aa, Entamoeba histolytica
EKNYA

SEQ ID NO: 2561916 - protein, 8 aa, Entamoeba histolytica
EKNYKEQE

SEQ ID NO: 2561917 - protein, 5 aa, Entamoeba histolytica
EKPCT

SEQ ID NO: 2561918 - protein, 11 aa, Entamoeba histolytica
EKPGKQSKMTT

SEQ ID NO: 2561919 - protein, 4 aa, Entamoeba histolytica
EKPH

SEQ ID NO: 2561920 - protein, 65 aa, Entamoeba histolytica
EKPIPTPLNNKEENKVKEEEKEVINKNNDNVSDSDSSQSEDSEDFNKQKNKEEMSESEEWSESDS

SEQ ID NO: 2561921 - protein, 4 aa, Entamoeba histolytica
EKPN

SEQ ID NO: 2561922 - protein, 8 aa, Entamoeba histolytica
EKPNDIPE

SEQ ID NO: 2561923 - protein, 15 aa, Entamoeba histolytica
EKPPTKREEKQNQQV

SEQ ID NO: 2561924 - protein, 6 aa, Entamoeba histolytica
EKPQIQ

SEQ ID NO: 2561925 - protein, 7 aa, Entamoeba histolytica
EKPSHAR

SEQ ID NO: 2561926 - protein, 6 aa, Entamoeba histolytica
EKPTKV

SEQ ID NO: 2561927 - protein, 11 aa, Entamoeba histolytica
EKQAYENDDRF

SEQ ID NO: 2561928 - protein, 8 aa, Entamoeba histolytica
EKQPHSKI

SEQ ID NO: 2561929 - protein, 8 aa, Entamoeba histolytica
EKQRKKFN

SEQ ID NO: 2561930 - protein, 6 aa, Entamoeba histolytica
EKRGIE

SEQ ID NO: 2561931 - protein, 12 aa, Entamoeba histolytica
EKRLEEKKEDVI

SEQ ID NO: 2561932 - protein, 16 aa, Entamoeba histolytica
EKRNDKDDILGDENSN

SEQ ID NO: 2561933 - protein, 6 aa, Entamoeba histolytica
EKRNDY

SEQ ID NO: 2561934 - protein, 4 aa, Entamoeba histolytica
EKRP

SEQ ID NO: 2561935 - protein, 8 aa, Entamoeba histolytica
EKRQELNE

SEQ ID NO: 2561936 - protein, 7 aa, Entamoeba histolytica
EKRQITT

SEQ ID NO: 2561937 - protein, 6 aa, Entamoeba histolytica
EKSAKI

SEQ ID NO: 2561938 - protein, 9 aa, Entamoeba histolytica
EKSDDEVAT

SEQ ID NO: 2561939 - protein, 8 aa, Entamoeba histolytica
EKSEELKK

SEQ ID NO: 2561940 - protein, 5 aa, Entamoeba histolytica
EKSIE

SEQ ID NO: 2561941 - protein, 6 aa, Entamoeba histolytica
EKSKDY

SEQ ID NO: 2561942 - protein, 5 aa, Entamoeba histolytica
EKSKP

SEQ ID NO: 2561943 - protein, 8 aa, Entamoeba histolytica
EKSLRTSS

SEQ ID NO: 2561944 - protein, 14 aa, Entamoeba histolytica
EKSNDNGKKTFDDK

SEQ ID NO: 2561945 - protein, 9 aa, Entamoeba histolytica
EKSNGGANV

SEQ ID NO: 2561946 - protein, 18 aa, Entamoeba histolytica
EKSPDTETPSIINESSQK

SEQ ID NO: 2561947 - protein, 8 aa, Entamoeba histolytica
EKSQEDIP

SEQ ID NO: 2561948 - protein, 29 aa, Entamoeba histolytica
EKSQNPPTPPPEDSSAEDNDDNNNEQHHG

SEQ ID NO: 2561949 - protein, 10 aa, Entamoeba histolytica
EKSSSCQKCN

SEQ ID NO: 2561950 - protein, 7 aa, Entamoeba histolytica
EKSTGSL

SEQ ID NO: 2561951 - protein, 9 aa, Entamoeba histolytica
EKTARNQNI

SEQ ID NO: 2561952 - protein, 27 aa, Entamoeba histolytica
EKTEHSEDEVDDDDEVESSESNGEKKI

SEQ ID NO: 2561953 - protein, 8 aa, Entamoeba histolytica
EKTEPRIE

SEQ ID NO: 2561954 - protein, 16 aa, Entamoeba histolytica
EKTETTHNKTKSTTTV

SEQ ID NO: 2561955 - protein, 6 aa, Entamoeba histolytica
EKTGNI

SEQ ID NO: 2561956 - protein, 21 aa, Entamoeba histolytica
EKTHVEDNKKEQQEESINEPE

SEQ ID NO: 2561957 - protein, 5 aa, Entamoeba histolytica
EKTIE

SEQ ID NO: 2561958 - protein, 7 aa, Entamoeba histolytica
EKTITKT

SEQ ID NO: 2561959 - protein, 4 aa, Entamoeba histolytica
EKTK

SEQ ID NO: 2561960 - protein, 8 aa, Entamoeba histolytica
EKTKEKFN

SEQ ID NO: 2561961 - protein, 5 aa, Entamoeba histolytica
EKTNH

SEQ ID NO: 2561962 - protein, 7 aa, Entamoeba histolytica
EKTNSYC

SEQ ID NO: 2561963 - protein, 9 aa, Entamoeba histolytica
EKTQQDTHV

SEQ ID NO: 2561964 - protein, 8 aa, Entamoeba histolytica
EKTSKGEI

SEQ ID NO: 2561965 - protein, 10 aa, Entamoeba histolytica
EKTSLSKKEL

SEQ ID NO: 2561966 - protein, 14 aa, Entamoeba histolytica
EKTWKEPKKDFRTV

SEQ ID NO: 2561967 - protein, 20 aa, Entamoeba histolytica
EKTYSQAKTTKTKSKVKPSI

SEQ ID NO: 2561968 - protein, 6 aa, Entamoeba histolytica
EKTYTT

SEQ ID NO: 2561969 - protein, 12 aa, Entamoeba histolytica
EKVASQGSVSDD

SEQ ID NO: 2561970 - protein, 4 aa, Entamoeba histolytica
EKVD

SEQ ID NO: 2561971 - protein, 13 aa, Entamoeba histolytica
EKVDNCKTKNNVD

SEQ ID NO: 2561972 - protein, 11 aa, Entamoeba histolytica
EKVKQKGKKGF

SEQ ID NO: 2561973 - protein, 5 aa, Entamoeba histolytica
EKVKV

SEQ ID NO: 2561974 - protein, 6 aa, Entamoeba histolytica
EKVNSS

SEQ ID NO: 2561975 - protein, 8 aa, Entamoeba histolytica
EKVTEEEF

SEQ ID NO: 2561976 - protein, 17 aa, Entamoeba histolytica
EKYETSPSNKVKNNYTE

SEQ ID NO: 2561977 - protein, 4 aa, Entamoeba histolytica
EKYG

SEQ ID NO: 2561978 - protein, 7 aa, Entamoeba histolytica
EKYGGDD

SEQ ID NO: 2561979 - protein, 5 aa, Entamoeba histolytica
EKYIN

SEQ ID NO: 2561980 - protein, 5 aa, Entamoeba histolytica
EKYKI

SEQ ID NO: 2561981 - protein, 12 aa, Entamoeba histolytica
EKYKSPSPDEEA

SEQ ID NO: 2561982 - protein, 4 aa, Entamoeba histolytica
ELDE

SEQ ID NO: 2561983 - protein, 7 aa, Entamoeba histolytica
ELDETSK

SEQ ID NO: 2561984 - protein, 10 aa, Entamoeba histolytica
ELDGESNLKQ

SEQ ID NO: 2561985 - protein, 13 aa, Entamoeba histolytica
ELDGLKEKNDDEL

SEQ ID NO: 2561986 - protein, 5 aa, Entamoeba histolytica
ELDKR

SEQ ID NO: 2561987 - protein, 5 aa, Entamoeba histolytica
ELDQN

SEQ ID NO: 2561988 - protein, 7 aa, Entamoeba histolytica
ELDQNSM

SEQ ID NO: 2561989 - protein, 7 aa, Entamoeba histolytica
ELDSNSY

SEQ ID NO: 2561990 - protein, 10 aa, Entamoeba histolytica
ELEEKNYGND

SEQ ID NO: 2561991 - protein, 15 aa, Entamoeba histolytica
ELEEQDTSSHDDGLF

SEQ ID NO: 2561992 - protein, 16 aa, Entamoeba histolytica
ELEGEDTTSSDDGIFE

SEQ ID NO: 2561993 - protein, 9 aa, Entamoeba histolytica
ELEKGVKES

SEQ ID NO: 2561994 - protein, 5 aa, Entamoeba histolytica
ELEKK

SEQ ID NO: 2561995 - protein, 10 aa, Entamoeba histolytica
ELEQNQNTRN

SEQ ID NO: 2561996 - protein, 9 aa, Entamoeba histolytica
ELEQTGDDY

SEQ ID NO: 2561997 - protein, 5 aa, Entamoeba histolytica
ELERS

SEQ ID NO: 2561998 - protein, 6 aa, Entamoeba histolytica
ELGEDN

SEQ ID NO: 2561999 - protein, 6 aa, Entamoeba histolytica
ELGHTK

SEQ ID NO: 2562000 - protein, 23 aa, Entamoeba histolytica
ELGNDNSLAHTKVSKNTISSQQY

SEQ ID NO: 2562001 - protein, 7 aa, Entamoeba histolytica
ELGNPVS

SEQ ID NO: 2562002 - protein, 12 aa, Entamoeba histolytica
ELGSDNSLAHTK

SEQ ID NO: 2562003 - protein, 23 aa, Entamoeba histolytica
ELGSDNSLAHTKVSKSAISSQQY

SEQ ID NO: 2562004 - protein, 14 aa, Entamoeba histolytica
ELIGSNDNACGTQS

SEQ ID NO: 2562005 - protein, 15 aa, Entamoeba histolytica
ELIKASRTNREKKSF

SEQ ID NO: 2562006 - protein, 5 aa, Entamoeba histolytica
ELIPG

SEQ ID NO: 2562007 - protein, 5 aa, Entamoeba histolytica
ELIPN

SEQ ID NO: 2562008 - protein, 6 aa, Entamoeba histolytica
ELKEDK

SEQ ID NO: 2562009 - protein, 5 aa, Entamoeba histolytica
ELKEE

SEQ ID NO: 2562010 - protein, 12 aa, Entamoeba histolytica
ELKEEKKLGEGS

SEQ ID NO: 2562011 - protein, 12 aa, Entamoeba histolytica
ELKEEKQIGEGS

SEQ ID NO: 2562012 - protein, 5 aa, Entamoeba histolytica
ELKEK

SEQ ID NO: 2562013 - protein, 15 aa, Entamoeba histolytica
ELKGSTAKEQCTEEN

SEQ ID NO: 2562014 - protein, 11 aa, Entamoeba histolytica
ELKKDPSGMPD

SEQ ID NO: 2562015 - protein, 9 aa, Entamoeba histolytica
ELKKEEIQN

SEQ ID NO: 2562016 - protein, 6 aa, Entamoeba histolytica
ELKKEF

SEQ ID NO: 2562017 - protein, 6 aa, Entamoeba histolytica
ELKNAT

SEQ ID NO: 2562018 - protein, 10 aa, Entamoeba histolytica
ELKNQSQDPQ

SEQ ID NO: 2562019 - protein, 12 aa, Entamoeba histolytica
ELKPESKGEKGI

SEQ ID NO: 2562020 - protein, 18 aa, Entamoeba histolytica
ELKRQREVLEDDNRKLDR

SEQ ID NO: 2562021 - protein, 12 aa, Entamoeba histolytica
ELLSEDDTQTLN

SEQ ID NO: 2562022 - protein, 12 aa, Entamoeba histolytica
ELNKKRAEKQEL

SEQ ID NO: 2562023 - protein, 4 aa, Entamoeba histolytica
ELNN

SEQ ID NO: 2562024 - protein, 52 aa, Entamoeba histolytica
ELNNSKSVSSDESEEQPKSSNETNEIKNVTKEEKNEKNNSSEKKKQPKPTYT

SEQ ID NO: 2562025 - protein, 4 aa, Entamoeba histolytica
ELNS

SEQ ID NO: 2562026 - protein, 10 aa, Entamoeba histolytica
ELNTTTSFSG

SEQ ID NO: 2562027 - protein, 6 aa, Entamoeba histolytica
ELNVTS

SEQ ID NO: 2562028 - protein, 9 aa, Entamoeba histolytica
ELPDIEDDE

SEQ ID NO: 2562029 - protein, 6 aa, Entamoeba histolytica
ELPETS

SEQ ID NO: 2562030 - protein, 8 aa, Entamoeba histolytica
ELPHETST

SEQ ID NO: 2562031 - protein, 4 aa, Entamoeba histolytica
ELPK

SEQ ID NO: 2562032 - protein, 9 aa, Entamoeba histolytica
ELPKAKNRD

SEQ ID NO: 2562033 - protein, 5 aa, Entamoeba histolytica
ELPKT

SEQ ID NO: 2562034 - protein, 8 aa, Entamoeba histolytica
ELPNRKSE

SEQ ID NO: 2562035 - protein, 8 aa, Entamoeba histolytica
ELPPQQQL

SEQ ID NO: 2562036 - protein, 5 aa, Entamoeba histolytica
ELPSL

SEQ ID NO: 2562037 - protein, 4 aa, Entamoeba histolytica
ELPT

SEQ ID NO: 2562038 - protein, 5 aa, Entamoeba histolytica
ELQKG

SEQ ID NO: 2562039 - protein, 13 aa, Entamoeba histolytica
ELQNENDIKKECT

SEQ ID NO: 2562040 - protein, 9 aa, Entamoeba histolytica
ELQNSGNLT

SEQ ID NO: 2562041 - protein, 18 aa, Entamoeba histolytica
ELQPLPPPQLQSNTTFTS

SEQ ID NO: 2562042 - protein, 10 aa, Entamoeba histolytica
ELRNSNLEAS

SEQ ID NO: 2562043 - protein, 9 aa, Entamoeba histolytica
ELRNSTLEA

SEQ ID NO: 2562044 - protein, 9 aa, Entamoeba histolytica
ELSEDTHYE

SEQ ID NO: 2562045 - protein, 5 aa, Entamoeba histolytica
ELSEQ

SEQ ID NO: 2562046 - protein, 11 aa, Entamoeba histolytica
ELSKPGKNPNN

SEQ ID NO: 2562047 - protein, 6 aa, Entamoeba histolytica
ELSNGI

SEQ ID NO: 2562048 - protein, 15 aa, Entamoeba histolytica
ELSNGKDGDCYAQRG

SEQ ID NO: 2562049 - protein, 17 aa, Entamoeba histolytica
ELSNSINSDKINQEGKK

SEQ ID NO: 2562050 - protein, 15 aa, Entamoeba histolytica
ELSTNKKDPSLDSLS

SEQ ID NO: 2562051 - protein, 8 aa, Entamoeba histolytica
ELTASTNN

SEQ ID NO: 2562052 - protein, 9 aa, Entamoeba histolytica
ELTDGKSVI

SEQ ID NO: 2562053 - protein, 6 aa, Entamoeba histolytica
ELTGKE

SEQ ID NO: 2562054 - protein, 8 aa, Entamoeba histolytica
ELTGNTQN

SEQ ID NO: 2562055 - protein, 12 aa, Entamoeba histolytica
ELTKTPTTLSPI

SEQ ID NO: 2562056 - protein, 8 aa, Entamoeba histolytica
ELTNETQQ

SEQ ID NO: 2562057 - protein, 9 aa, Entamoeba histolytica
ELTNKTSKY

SEQ ID NO: 2562058 - protein, 5 aa, Entamoeba histolytica
ELTPG

SEQ ID NO: 2562059 - protein, 5 aa, Entamoeba histolytica
ELTQY

SEQ ID NO: 2562060 - protein, 7 aa, Entamoeba histolytica
ELTTDNS

SEQ ID NO: 2562061 - protein, 15 aa, Entamoeba histolytica
ELTTTEDNVTNPQSL

SEQ ID NO: 2562062 - protein, 5 aa, Entamoeba histolytica
ELYAN

SEQ ID NO: 2562063 - protein, 4 aa, Entamoeba histolytica
EMAP

SEQ ID NO: 2562064 - protein, 12 aa, Entamoeba histolytica
EMAPDGAISNET

SEQ ID NO: 2562065 - protein, 45 aa, Entamoeba histolytica
EMDENKEESHVTDQNDENQAPSPTNEPEETNEIKEHPQPVEQEES

SEQ ID NO: 2562066 - protein, 11 aa, Entamoeba histolytica
EMEKNKTNPSI

SEQ ID NO: 2562067 - protein, 14 aa, Entamoeba histolytica
EMENDSESSESINE

SEQ ID NO: 2562068 - protein, 5 aa, Entamoeba histolytica
EMGDD

SEQ ID NO: 2562069 - protein, 29 aa, Entamoeba histolytica
EMGEEKKGKAKAPSVSKEAKKAEQEKKRK

SEQ ID NO: 2562070 - protein, 22 aa, Entamoeba histolytica
EMKEEEEKRKVDKEEKKRVQND

SEQ ID NO: 2562071 - protein, 16 aa, Entamoeba histolytica
EMKEQQQIDCSKQQKE

SEQ ID NO: 2562072 - protein, 4 aa, Entamoeba histolytica
EMLK

SEQ ID NO: 2562073 - protein, 5 aa, Entamoeba histolytica
EMNPD

SEQ ID NO: 2562074 - protein, 13 aa, Entamoeba histolytica
EMQPYKTNEYHPI

SEQ ID NO: 2562075 - protein, 12 aa, Entamoeba histolytica
EMRGSDENTFNT

SEQ ID NO: 2562076 - protein, 19 aa, Entamoeba histolytica
EMSPKKSEKEKKVKTVDTN

SEQ ID NO: 2562077 - protein, 6 aa, Entamoeba histolytica
EMSSEG

SEQ ID NO: 2562078 - protein, 5 aa, Entamoeba histolytica
EMTER

SEQ ID NO: 2562079 - protein, 11 aa, Entamoeba histolytica
ENAEEARGDKV

SEQ ID NO: 2562080 - protein, 12 aa, Entamoeba histolytica
ENAEIQQQKQKE

SEQ ID NO: 2562081 - protein, 11 aa, Entamoeba histolytica
ENAGGEGRSEQ

SEQ ID NO: 2562082 - protein, 12 aa, Entamoeba histolytica
ENANENNAGGKY

SEQ ID NO: 2562083 - protein, 13 aa, Entamoeba histolytica
ENANEVQSTVQQL

SEQ ID NO: 2562084 - protein, 6 aa, Entamoeba histolytica
ENASNI

SEQ ID NO: 2562085 - protein, 10 aa, Entamoeba histolytica
ENCGTEGCVS

SEQ ID NO: 2562086 - protein, 16 aa, Entamoeba histolytica
ENCNSTKEYTKQINEE

SEQ ID NO: 2562087 - protein, 6 aa, Entamoeba histolytica
ENCQAE

SEQ ID NO: 2562088 - protein, 6 aa, Entamoeba histolytica
ENCQNA

SEQ ID NO: 2562089 - protein, 8 aa, Entamoeba histolytica
ENCTHPDN

SEQ ID NO: 2562090 - protein, 11 aa, Entamoeba histolytica
ENCYYKKEGNK

SEQ ID NO: 2562091 - protein, 7 aa, Entamoeba histolytica
ENDDNTV

SEQ ID NO: 2562092 - protein, 7 aa, Entamoeba histolytica
ENDDQLP

SEQ ID NO: 2562093 - protein, 5 aa, Entamoeba histolytica
ENDEK

SEQ ID NO: 2562094 - protein, 9 aa, Entamoeba histolytica
ENDENDGGN

SEQ ID NO: 2562095 - protein, 10 aa, Entamoeba histolytica
ENDENEKNKY

SEQ ID NO: 2562096 - protein, 7 aa, Entamoeba histolytica
ENDEVEG

SEQ ID NO: 2562097 - protein, 11 aa, Entamoeba histolytica
ENDFNINENSG

SEQ ID NO: 2562098 - protein, 7 aa, Entamoeba histolytica
ENDGGNQ

SEQ ID NO: 2562099 - protein, 7 aa, Entamoeba histolytica
ENDHKEM

SEQ ID NO: 2562100 - protein, 5 aa, Entamoeba histolytica
ENDKE

SEQ ID NO: 2562101 - protein, 8 aa, Entamoeba histolytica
ENDKEIDA

SEQ ID NO: 2562102 - protein, 18 aa, Entamoeba histolytica
ENDKENKNQQELKERKKA

SEQ ID NO: 2562103 - protein, 7 aa, Entamoeba histolytica
ENDKVGR

SEQ ID NO: 2562104 - protein, 4 aa, Entamoeba histolytica
ENDN

SEQ ID NO: 2562105 - protein, 5 aa, Entamoeba histolytica
ENDPI

SEQ ID NO: 2562106 - protein, 14 aa, Entamoeba histolytica
ENDQQSSIDETTNS

SEQ ID NO: 2562107 - protein, 5 aa, Entamoeba histolytica
ENDSQ

SEQ ID NO: 2562108 - protein, 4 aa, Entamoeba histolytica
ENDT

SEQ ID NO: 2562109 - protein, 10 aa, Entamoeba histolytica
ENDVRTRQFS

SEQ ID NO: 2562110 - protein, 11 aa, Entamoeba histolytica
ENECPKDDYSS

SEQ ID NO: 2562111 - protein, 19 aa, Entamoeba histolytica
ENEDNEIDKYYNQGNDYNS

SEQ ID NO: 2562112 - protein, 6 aa, Entamoeba histolytica
ENEECK

SEQ ID NO: 2562113 - protein, 6 aa, Entamoeba histolytica
ENEELD

SEQ ID NO: 2562114 - protein, 7 aa, Entamoeba histolytica
ENEENKE

SEQ ID NO: 2562115 - protein, 5 aa, Entamoeba histolytica
ENEES

SEQ ID NO: 2562116 - protein, 7 aa, Entamoeba histolytica
ENEETTK

SEQ ID NO: 2562117 - protein, 7 aa, Entamoeba histolytica
ENEGTHS

SEQ ID NO: 2562118 - protein, 6 aa, Entamoeba histolytica
ENEINK

SEQ ID NO: 2562119 - protein, 17 aa, Entamoeba histolytica
ENEKIDEETKENNSSKR

SEQ ID NO: 2562120 - protein, 5 aa, Entamoeba histolytica
ENEKK

SEQ ID NO: 2562121 - protein, 9 aa, Entamoeba histolytica
ENEKPDNDF

SEQ ID NO: 2562122 - protein, 24 aa, Entamoeba histolytica
ENEKVDNSETLPPLNSDSSDIEEN

SEQ ID NO: 2562123 - protein, 7 aa, Entamoeba histolytica
ENEKVTQ

SEQ ID NO: 2562124 - protein, 10 aa, Entamoeba histolytica
ENELKTTQLS

SEQ ID NO: 2562125 - protein, 5 aa, Entamoeba histolytica
ENEMK

SEQ ID NO: 2562126 - protein, 9 aa, Entamoeba histolytica
ENENSSIKT

SEQ ID NO: 2562127 - protein, 8 aa, Entamoeba histolytica
ENEPERYE

SEQ ID NO: 2562128 - protein, 6 aa, Entamoeba histolytica
ENEPFR

SEQ ID NO: 2562129 - protein, 17 aa, Entamoeba histolytica
ENEQEIKEAKERSEYAK

SEQ ID NO: 2562130 - protein, 5 aa, Entamoeba histolytica
ENEQV

SEQ ID NO: 2562131 - protein, 5 aa, Entamoeba histolytica
ENESE

SEQ ID NO: 2562132 - protein, 9 aa, Entamoeba histolytica
ENESKQYNY

SEQ ID NO: 2562133 - protein, 18 aa, Entamoeba histolytica
ENESTKSEITTTNSIETT

SEQ ID NO: 2562134 - protein, 5 aa, Entamoeba histolytica
ENETV

SEQ ID NO: 2562135 - protein, 11 aa, Entamoeba histolytica
ENEVKNQKNMY

SEQ ID NO: 2562136 - protein, 8 aa, Entamoeba histolytica
ENEYTKPI

SEQ ID NO: 2562137 - protein, 10 aa, Entamoeba histolytica
ENFASNITKE

SEQ ID NO: 2562138 - protein, 7 aa, Entamoeba histolytica
ENFPGAD

SEQ ID NO: 2562139 - protein, 16 aa, Entamoeba histolytica
ENFSKEGGSIKITTEE

SEQ ID NO: 2562140 - protein, 17 aa, Entamoeba histolytica
ENFTGKTPEEIKKNEIQ

SEQ ID NO: 2562141 - protein, 5 aa, Entamoeba histolytica
ENGAS

SEQ ID NO: 2562142 - protein, 4 aa, Entamoeba histolytica
ENGC

SEQ ID NO: 2562143 - protein, 9 aa, Entamoeba histolytica
ENGCNPKNK

SEQ ID NO: 2562144 - protein, 6 aa, Entamoeba histolytica
ENGEKD

SEQ ID NO: 2562145 - protein, 7 aa, Entamoeba histolytica
ENGELPS

SEQ ID NO: 2562146 - protein, 5 aa, Entamoeba histolytica
ENGER

SEQ ID NO: 2562147 - protein, 7 aa, Entamoeba histolytica
ENGESVN

SEQ ID NO: 2562148 - protein, 4 aa, Entamoeba histolytica
ENGH

SEQ ID NO: 2562149 - protein, 5 aa, Entamoeba histolytica
ENGIE

SEQ ID NO: 2562150 - protein, 13 aa, Entamoeba histolytica
ENGIETSDYPNQI

SEQ ID NO: 2562151 - protein, 6 aa, Entamoeba histolytica
ENGKEI

SEQ ID NO: 2562152 - protein, 6 aa, Entamoeba histolytica
ENGLTD

SEQ ID NO: 2562153 - protein, 7 aa, Entamoeba histolytica
ENGNEII

SEQ ID NO: 2562154 - protein, 10 aa, Entamoeba histolytica
ENGNHSHQQS

SEQ ID NO: 2562155 - protein, 25 aa, Entamoeba histolytica
ENGNKIDSTIYKNSDCSEATNKYTL

SEQ ID NO: 2562156 - protein, 7 aa, Entamoeba histolytica
ENGSHFG

SEQ ID NO: 2562157 - protein, 8 aa, Entamoeba histolytica
ENGTEGTI

SEQ ID NO: 2562158 - protein, 8 aa, Entamoeba histolytica
ENGTEGTV

SEQ ID NO: 2562159 - protein, 7 aa, Entamoeba histolytica
ENIEQNE

SEQ ID NO: 2562160 - protein, 15 aa, Entamoeba histolytica
ENIGSDSSEVNQEPS

SEQ ID NO: 2562161 - protein, 5 aa, Entamoeba histolytica
ENIKE

SEQ ID NO: 2562162 - protein, 4 aa, Entamoeba histolytica
ENIN

SEQ ID NO: 2562163 - protein, 6 aa, Entamoeba histolytica
ENIPES

SEQ ID NO: 2562164 - protein, 5 aa, Entamoeba histolytica
ENIPQ

SEQ ID NO: 2562165 - protein, 5 aa, Entamoeba histolytica
ENISD

SEQ ID NO: 2562166 - protein, 10 aa, Entamoeba histolytica
ENISSKARCG

SEQ ID NO: 2562167 - protein, 4 aa, Entamoeba histolytica
ENIT

SEQ ID NO: 2562168 - protein, 5 aa, Entamoeba histolytica
ENITE

SEQ ID NO: 2562169 - protein, 10 aa, Entamoeba histolytica
ENKDKIHSNI

SEQ ID NO: 2562170 - protein, 6 aa, Entamoeba histolytica
ENKEEK

SEQ ID NO: 2562171 - protein, 6 aa, Entamoeba histolytica
ENKEEV

SEQ ID NO: 2562172 - protein, 13 aa, Entamoeba histolytica
ENKEIEERVEGTY

SEQ ID NO: 2562173 - protein, 7 aa, Entamoeba histolytica
ENKENGS

SEQ ID NO: 2562174 - protein, 8 aa, Entamoeba histolytica
ENKFNSTG

SEQ ID NO: 2562175 - protein, 8 aa, Entamoeba histolytica
ENKGKYDR

SEQ ID NO: 2562176 - protein, 4 aa, Entamoeba histolytica
ENKI

SEQ ID NO: 2562177 - protein, 12 aa, Entamoeba histolytica
ENKISSSENPVS

SEQ ID NO: 2562178 - protein, 7 aa, Entamoeba histolytica
ENKNDFL

SEQ ID NO: 2562179 - protein, 7 aa, Entamoeba histolytica
ENKNKYN

SEQ ID NO: 2562180 - protein, 7 aa, Entamoeba histolytica
ENKQFPK

SEQ ID NO: 2562181 - protein, 4 aa, Entamoeba histolytica
ENKR

SEQ ID NO: 2562182 - protein, 10 aa, Entamoeba histolytica
ENKTKQDNKS

SEQ ID NO: 2562183 - protein, 4 aa, Entamoeba histolytica
ENKW

SEQ ID NO: 2562184 - protein, 7 aa, Entamoeba histolytica
ENKWKEQ

SEQ ID NO: 2562185 - protein, 7 aa, Entamoeba histolytica
ENMQNSS

SEQ ID NO: 2562186 - protein, 10 aa, Entamoeba histolytica
ENNEENKGQI

SEQ ID NO: 2562187 - protein, 7 aa, Entamoeba histolytica
ENNEENS

SEQ ID NO: 2562188 - protein, 9 aa, Entamoeba histolytica
ENNEKNGEI

SEQ ID NO: 2562189 - protein, 6 aa, Entamoeba histolytica
ENNENY

SEQ ID NO: 2562190 - protein, 5 aa, Entamoeba histolytica
ENNEV

SEQ ID NO: 2562191 - protein, 6 aa, Entamoeba histolytica
ENNGRY

SEQ ID NO: 2562192 - protein, 7 aa, Entamoeba histolytica
ENNGSPE

SEQ ID NO: 2562193 - protein, 4 aa, Entamoeba histolytica
ENNH

SEQ ID NO: 2562194 - protein, 10 aa, Entamoeba histolytica
ENNKAKNQLK

SEQ ID NO: 2562195 - protein, 8 aa, Entamoeba histolytica
ENNKQLDI

SEQ ID NO: 2562196 - protein, 10 aa, Entamoeba histolytica
ENNNKKGELD

SEQ ID NO: 2562197 - protein, 6 aa, Entamoeba histolytica
ENNQQE

SEQ ID NO: 2562198 - protein, 8 aa, Entamoeba histolytica
ENNQTDEL

SEQ ID NO: 2562199 - protein, 18 aa, Entamoeba histolytica
ENNQTIKINQKRKSISSV

SEQ ID NO: 2562200 - protein, 17 aa, Entamoeba histolytica
ENNQTNEEQNEKPQENV

SEQ ID NO: 2562201 - protein, 8 aa, Entamoeba histolytica
ENNRDQNY

SEQ ID NO: 2562202 - protein, 10 aa, Entamoeba histolytica
ENNSEKEEEL

SEQ ID NO: 2562203 - protein, 7 aa, Entamoeba histolytica
ENNSGSK

SEQ ID NO: 2562204 - protein, 7 aa, Entamoeba histolytica
ENNSLSK

SEQ ID NO: 2562205 - protein, 5 aa, Entamoeba histolytica
ENNTN

SEQ ID NO: 2562206 - protein, 11 aa, Entamoeba histolytica
ENPFEEEMTPE

SEQ ID NO: 2562207 - protein, 7 aa, Entamoeba histolytica
ENPIAEG

SEQ ID NO: 2562208 - protein, 22 aa, Entamoeba histolytica
ENPSMKAKKIDDFTRNLNVLEV

SEQ ID NO: 2562209 - protein, 5 aa, Entamoeba histolytica
ENPTY

SEQ ID NO: 2562210 - protein, 4 aa, Entamoeba histolytica
ENPY

SEQ ID NO: 2562211 - protein, 7 aa, Entamoeba histolytica
ENQESPL

SEQ ID NO: 2562212 - protein, 7 aa, Entamoeba histolytica
ENQNYQE

SEQ ID NO: 2562213 - protein, 21 aa, Entamoeba histolytica
ENQVTIEPTNQENKNEFVDPL

SEQ ID NO: 2562214 - protein, 14 aa, Entamoeba histolytica
ENRDDFEPTNAKYV

SEQ ID NO: 2562215 - protein, 7 aa, Entamoeba histolytica
ENREGPM

SEQ ID NO: 2562216 - protein, 7 aa, Entamoeba histolytica
ENRGLSP

SEQ ID NO: 2562217 - protein, 8 aa, Entamoeba histolytica
ENRKQQVK

SEQ ID NO: 2562218 - protein, 13 aa, Entamoeba histolytica
ENRNRQTGDATNL

SEQ ID NO: 2562219 - protein, 8 aa, Entamoeba histolytica
ENSEFNQR

SEQ ID NO: 2562220 - protein, 7 aa, Entamoeba histolytica
ENSGKTV

SEQ ID NO: 2562221 - protein, 6 aa, Entamoeba histolytica
ENSGVE

SEQ ID NO: 2562222 - protein, 6 aa, Entamoeba histolytica
ENSHPN

SEQ ID NO: 2562223 - protein, 10 aa, Entamoeba histolytica
ENSIPQTLSK

SEQ ID NO: 2562224 - protein, 5 aa, Entamoeba histolytica
ENSIQ

SEQ ID NO: 2562225 - protein, 8 aa, Entamoeba histolytica
ENSIQTEL

SEQ ID NO: 2562226 - protein, 16 aa, Entamoeba histolytica
ENSKDELEVTSGTKCN

SEQ ID NO: 2562227 - protein, 14 aa, Entamoeba histolytica
ENSKIRKSSANLEK

SEQ ID NO: 2562228 - protein, 9 aa, Entamoeba histolytica
ENSKRKSYV

SEQ ID NO: 2562229 - protein, 10 aa, Entamoeba histolytica
ENSKTNSITE

SEQ ID NO: 2562230 - protein, 4 aa, Entamoeba histolytica
ENSL

SEQ ID NO: 2562231 - protein, 11 aa, Entamoeba histolytica
ENSLANLSPEA

SEQ ID NO: 2562232 - protein, 8 aa, Entamoeba histolytica
ENSNADSS

SEQ ID NO: 2562233 - protein, 7 aa, Entamoeba histolytica
ENSNSPL

SEQ ID NO: 2562234 - protein, 6 aa, Entamoeba histolytica
ENSRCT

SEQ ID NO: 2562235 - protein, 7 aa, Entamoeba histolytica
ENSTIDD

SEQ ID NO: 2562236 - protein, 8 aa, Entamoeba histolytica
ENSTSNFN

SEQ ID NO: 2562237 - protein, 7 aa, Entamoeba histolytica
ENSTTSL

SEQ ID NO: 2562238 - protein, 6 aa, Entamoeba histolytica
ENTKPI

SEQ ID NO: 2562239 - protein, 8 aa, Entamoeba histolytica
ENTPNKSI

SEQ ID NO: 2562240 - protein, 9 aa, Entamoeba histolytica
ENTQALERA

SEQ ID NO: 2562241 - protein, 9 aa, Entamoeba histolytica
ENTQFNDTE

SEQ ID NO: 2562242 - protein, 20 aa, Entamoeba histolytica
ENTSSKKVTYVPAKNNAPAQ

SEQ ID NO: 2562243 - protein, 4 aa, Entamoeba histolytica
ENTV

SEQ ID NO: 2562244 - protein, 9 aa, Entamoeba histolytica
ENTVSNEIS

SEQ ID NO: 2562245 - protein, 6 aa, Entamoeba histolytica
ENVDGT

SEQ ID NO: 2562246 - protein, 10 aa, Entamoeba histolytica
ENVDKRNGLN

SEQ ID NO: 2562247 - protein, 25 aa, Entamoeba histolytica
ENVEKDNEIITEKENNNNQNQEIMK

SEQ ID NO: 2562248 - protein, 5 aa, Entamoeba histolytica
ENVTN

SEQ ID NO: 2562249 - protein, 5 aa, Entamoeba histolytica
ENYAE

SEQ ID NO: 2562250 - protein, 9 aa, Entamoeba histolytica
ENYPGSPYT

SEQ ID NO: 2562251 - protein, 7 aa, Entamoeba histolytica
ENYSPSE

SEQ ID NO: 2562252 - protein, 5 aa, Entamoeba histolytica
ENYYT

SEQ ID NO: 2562253 - protein, 9 aa, Entamoeba histolytica
EPAPNGTDP

SEQ ID NO: 2562254 - protein, 9 aa, Entamoeba histolytica
EPASPDSPV

SEQ ID NO: 2562255 - protein, 15 aa, Entamoeba histolytica
EPCKGYDNSRSENEI

SEQ ID NO: 2562256 - protein, 10 aa, Entamoeba histolytica
EPDPNHIGSC

SEQ ID NO: 2562257 - protein, 5 aa, Entamoeba histolytica
EPEHC

SEQ ID NO: 2562258 - protein, 14 aa, Entamoeba histolytica
EPFKSIKDKKTATK

SEQ ID NO: 2562259 - protein, 6 aa, Entamoeba histolytica
EPFPKQ

SEQ ID NO: 2562260 - protein, 7 aa, Entamoeba histolytica
EPGVGKT

SEQ ID NO: 2562261 - protein, 5 aa, Entamoeba histolytica
EPIQN

SEQ ID NO: 2562262 - protein, 15 aa, Entamoeba histolytica
EPIQNNTTLLESIEF

SEQ ID NO: 2562263 - protein, 4 aa, Entamoeba histolytica
EPIS

SEQ ID NO: 2562264 - protein, 10 aa, Entamoeba histolytica
EPKEKEEEFE

SEQ ID NO: 2562265 - protein, 5 aa, Entamoeba histolytica
EPKER

SEQ ID NO: 2562266 - protein, 7 aa, Entamoeba histolytica
EPKERLP

SEQ ID NO: 2562267 - protein, 5 aa, Entamoeba histolytica
EPKQH

SEQ ID NO: 2562268 - protein, 8 aa, Entamoeba histolytica
EPKTPMHN

SEQ ID NO: 2562269 - protein, 6 aa, Entamoeba histolytica
EPLATN

SEQ ID NO: 2562270 - protein, 6 aa, Entamoeba histolytica
EPLNTY

SEQ ID NO: 2562271 - protein, 12 aa, Entamoeba histolytica
EPMNKEENTVDT

SEQ ID NO: 2562272 - protein, 11 aa, Entamoeba histolytica
EPNDKFKQYSP

SEQ ID NO: 2562273 - protein, 10 aa, Entamoeba histolytica
EPNDNLPTEP

SEQ ID NO: 2562274 - protein, 4 aa, Entamoeba histolytica
EPNE

SEQ ID NO: 2562275 - protein, 17 aa, Entamoeba histolytica
EPNENKVTTTAENQAGY

SEQ ID NO: 2562276 - protein, 9 aa, Entamoeba histolytica
EPNGGSATV

SEQ ID NO: 2562277 - protein, 4 aa, Entamoeba histolytica
EPNI

SEQ ID NO: 2562278 - protein, 5 aa, Entamoeba histolytica
EPNTI

SEQ ID NO: 2562279 - protein, 5 aa, Entamoeba histolytica
EPPEV

SEQ ID NO: 2562280 - protein, 5 aa, Entamoeba histolytica
EPPGI

SEQ ID NO: 2562281 - protein, 9 aa, Entamoeba histolytica
EPPINSKCS

SEQ ID NO: 2562282 - protein, 8 aa, Entamoeba histolytica
EPPKEINR

SEQ ID NO: 2562283 - protein, 9 aa, Entamoeba histolytica
EPPKGTLAY

SEQ ID NO: 2562284 - protein, 10 aa, Entamoeba histolytica
EPPKLHKKEQ

SEQ ID NO: 2562285 - protein, 8 aa, Entamoeba histolytica
EPPKNPIL

SEQ ID NO: 2562286 - protein, 6 aa, Entamoeba histolytica
EPPNDK

SEQ ID NO: 2562287 - protein, 10 aa, Entamoeba histolytica
EPPPDDPTTS

SEQ ID NO: 2562288 - protein, 7 aa, Entamoeba histolytica
EPPPHYD

SEQ ID NO: 2562289 - protein, 6 aa, Entamoeba histolytica
EPPRYT

SEQ ID NO: 2562290 - protein, 20 aa, Entamoeba histolytica
EPPTNISSSMEDNPLNNIRG

SEQ ID NO: 2562291 - protein, 8 aa, Entamoeba histolytica
EPQDNVNQ

SEQ ID NO: 2562292 - protein, 11 aa, Entamoeba histolytica
EPQINVPQSKN

SEQ ID NO: 2562293 - protein, 5 aa, Entamoeba histolytica
EPQVA

SEQ ID NO: 2562294 - protein, 33 aa, Entamoeba histolytica
EPSEDNSKNEKENEETQPLVPSEEVKESTEVIN

SEQ ID NO: 2562295 - protein, 8 aa, Entamoeba histolytica
EPSFSGSS

SEQ ID NO: 2562296 - protein, 8 aa, Entamoeba histolytica
EPSGTQID

SEQ ID NO: 2562297 - protein, 11 aa, Entamoeba histolytica
EPSKKSLLGSS

SEQ ID NO: 2562298 - protein, 8 aa, Entamoeba histolytica
EPSNSTLY

SEQ ID NO: 2562299 - protein, 8 aa, Entamoeba histolytica
EPSYSLES

SEQ ID NO: 2562300 - protein, 5 aa, Entamoeba histolytica
EPTAA

SEQ ID NO: 2562301 - protein, 5 aa, Entamoeba histolytica
EPTEP

SEQ ID NO: 2562302 - protein, 9 aa, Entamoeba histolytica
EPTISKDNK

SEQ ID NO: 2562303 - protein, 26 aa, Entamoeba histolytica
EPTRPDPTEPKEPNTIPDKSIEAKKN

SEQ ID NO: 2562304 - protein, 6 aa, Entamoeba histolytica
EPTSGE

SEQ ID NO: 2562305 - protein, 7 aa, Entamoeba histolytica
EPTSTMK

SEQ ID NO: 2562306 - protein, 6 aa, Entamoeba histolytica
EPTTGL

SEQ ID NO: 2562307 - protein, 11 aa, Entamoeba histolytica
EPTTGMDPVSR

SEQ ID NO: 2562308 - protein, 5 aa, Entamoeba histolytica
EPTYE

SEQ ID NO: 2562309 - protein, 10 aa, Entamoeba histolytica
EPVDNPIPHN

SEQ ID NO: 2562310 - protein, 14 aa, Entamoeba histolytica
EPVDTPNGKVTTRA

SEQ ID NO: 2562311 - protein, 24 aa, Entamoeba histolytica
EPVEQKEEILNQPQEIQQPNYNND

SEQ ID NO: 2562312 - protein, 6 aa, Entamoeba histolytica
EPVGPF

SEQ ID NO: 2562313 - protein, 4 aa, Entamoeba histolytica
EPVK

SEQ ID NO: 2562314 - protein, 5 aa, Entamoeba histolytica
EPVKT

SEQ ID NO: 2562315 - protein, 8 aa, Entamoeba histolytica
EPVSTPIE

SEQ ID NO: 2562316 - protein, 7 aa, Entamoeba histolytica
EPYDPMK

SEQ ID NO: 2562317 - protein, 5 aa, Entamoeba histolytica
EPYKD

SEQ ID NO: 2562318 - protein, 6 aa, Entamoeba histolytica
EPYSEC

SEQ ID NO: 2562319 - protein, 4 aa, Entamoeba histolytica
EPYY

SEQ ID NO: 2562320 - protein, 10 aa, Entamoeba histolytica
EQAAVQEGTF

SEQ ID NO: 2562321 - protein, 8 aa, Entamoeba histolytica
EQADCTRL

SEQ ID NO: 2562322 - protein, 9 aa, Entamoeba histolytica
EQAKEYTTE

SEQ ID NO: 2562323 - protein, 10 aa, Entamoeba histolytica
EQAKPNNDTL

SEQ ID NO: 2562324 - protein, 8 aa, Entamoeba histolytica
EQASSNDF

SEQ ID NO: 2562325 - protein, 4 aa, Entamoeba histolytica
EQAY

SEQ ID NO: 2562326 - protein, 12 aa, Entamoeba histolytica
EQCDGSNGCGKD

SEQ ID NO: 2562327 - protein, 7 aa, Entamoeba histolytica
EQCKNEE

SEQ ID NO: 2562328 - protein, 4 aa, Entamoeba histolytica
EQCN

SEQ ID NO: 2562329 - protein, 8 aa, Entamoeba histolytica
EQDQLSDA

SEQ ID NO: 2562330 - protein, 7 aa, Entamoeba histolytica
EQDTRKR

SEQ ID NO: 2562331 - protein, 17 aa, Entamoeba histolytica
EQEDNTQETKKESHISI

SEQ ID NO: 2562332 - protein, 13 aa, Entamoeba histolytica
EQEELDENGIIVN

SEQ ID NO: 2562333 - protein, 5 aa, Entamoeba histolytica
EQEGI

SEQ ID NO: 2562334 - protein, 5 aa, Entamoeba histolytica
EQEGT

SEQ ID NO: 2562335 - protein, 5 aa, Entamoeba histolytica
EQEKE

SEQ ID NO: 2562336 - protein, 5 aa, Entamoeba histolytica
EQELD

SEQ ID NO: 2562337 - protein, 9 aa, Entamoeba histolytica
EQENENEKD

SEQ ID NO: 2562338 - protein, 5 aa, Entamoeba histolytica
EQETR

SEQ ID NO: 2562339 - protein, 8 aa, Entamoeba histolytica
EQFEEGFG

SEQ ID NO: 2562340 - protein, 17 aa, Entamoeba histolytica
EQFKGKEVGITKENMTN

SEQ ID NO: 2562341 - protein, 6 aa, Entamoeba histolytica
EQFNSG

SEQ ID NO: 2562342 - protein, 5 aa, Entamoeba histolytica
EQGGI

SEQ ID NO: 2562343 - protein, 6 aa, Entamoeba histolytica
EQGKHQ

SEQ ID NO: 2562344 - protein, 5 aa, Entamoeba histolytica
EQGST

SEQ ID NO: 2562345 - protein, 30 aa, Entamoeba histolytica
EQHQVNKEEKVTSPEENGVPGTIKTPISNE

SEQ ID NO: 2562346 - protein, 12 aa, Entamoeba histolytica
EQIDNTPLSQED

SEQ ID NO: 2562347 - protein, 6 aa, Entamoeba histolytica
EQINTK

SEQ ID NO: 2562348 - protein, 13 aa, Entamoeba histolytica
EQIPRTQNQRKKN

SEQ ID NO: 2562349 - protein, 5 aa, Entamoeba histolytica
EQISN

SEQ ID NO: 2562350 - protein, 7 aa, Entamoeba histolytica
EQKCSHP

SEQ ID NO: 2562351 - protein, 29 aa, Entamoeba histolytica
EQKDNNNENDQTSIKIDRSSSSSSEESFQ

SEQ ID NO: 2562352 - protein, 4 aa, Entamoeba histolytica
EQKE

SEQ ID NO: 2562353 - protein, 8 aa, Entamoeba histolytica
EQKEEGTF

SEQ ID NO: 2562354 - protein, 40 aa, Entamoeba histolytica
EQKEETPEEDQTEKVTELQPESLPGNQQIKTRNDISSKAE

SEQ ID NO: 2562355 - protein, 10 aa, Entamoeba histolytica
EQKEGRQQNN

SEQ ID NO: 2562356 - protein, 7 aa, Entamoeba histolytica
EQKEPTL

SEQ ID NO: 2562357 - protein, 8 aa, Entamoeba histolytica
EQKKSLPQ

SEQ ID NO: 2562358 - protein, 10 aa, Entamoeba histolytica
EQKKTEEEIQ

SEQ ID NO: 2562359 - protein, 5 aa, Entamoeba histolytica
EQKLQ

SEQ ID NO: 2562360 - protein, 6 aa, Entamoeba histolytica
EQKNGQ

SEQ ID NO: 2562361 - protein, 7 aa, Entamoeba histolytica
EQKNIEK

SEQ ID NO: 2562362 - protein, 6 aa, Entamoeba histolytica
EQKNQV

SEQ ID NO: 2562363 - protein, 9 aa, Entamoeba histolytica
EQKQIEAKK

SEQ ID NO: 2562364 - protein, 21 aa, Entamoeba histolytica
EQKRNNKSVTHEQTVKDTPVK

SEQ ID NO: 2562365 - protein, 21 aa, Entamoeba histolytica
EQLNKEADEKHRLKNRNISQS

SEQ ID NO: 2562366 - protein, 10 aa, Entamoeba histolytica
EQLSKQNDLT

SEQ ID NO: 2562367 - protein, 17 aa, Entamoeba histolytica
EQLSNTPVFDNEGDKYS

SEQ ID NO: 2562368 - protein, 6 aa, Entamoeba histolytica
EQNAVY

SEQ ID NO: 2562369 - protein, 11 aa, Entamoeba histolytica
EQNDEKENGVV

SEQ ID NO: 2562370 - protein, 11 aa, Entamoeba histolytica
EQNENSMDDGG

SEQ ID NO: 2562371 - protein, 5 aa, Entamoeba histolytica
EQNEQ

SEQ ID NO: 2562372 - protein, 10 aa, Entamoeba histolytica
EQNERKISSS

SEQ ID NO: 2562373 - protein, 20 aa, Entamoeba histolytica
EQNGVSFGKRKTKQAKKTVQ

SEQ ID NO: 2562374 - protein, 8 aa, Entamoeba histolytica
EQNIESED

SEQ ID NO: 2562375 - protein, 9 aa, Entamoeba histolytica
EQNKNQNWK

SEQ ID NO: 2562376 - protein, 13 aa, Entamoeba histolytica
EQNNTLAKSSLNY

SEQ ID NO: 2562377 - protein, 5 aa, Entamoeba histolytica
EQNPM

SEQ ID NO: 2562378 - protein, 8 aa, Entamoeba histolytica
EQNPQYKE

SEQ ID NO: 2562379 - protein, 7 aa, Entamoeba histolytica
EQPEDTT

SEQ ID NO: 2562380 - protein, 14 aa, Entamoeba histolytica
EQPEEGILVDEQIS

SEQ ID NO: 2562381 - protein, 5 aa, Entamoeba histolytica
EQPKN

SEQ ID NO: 2562382 - protein, 8 aa, Entamoeba histolytica
EQPPVGAG

SEQ ID NO: 2562383 - protein, 9 aa, Entamoeba histolytica
EQPSNRPDF

SEQ ID NO: 2562384 - protein, 9 aa, Entamoeba histolytica
EQPSSCDRN

SEQ ID NO: 2562385 - protein, 7 aa, Entamoeba histolytica
EQPTNKI

SEQ ID NO: 2562386 - protein, 6 aa, Entamoeba histolytica
EQPTNP

SEQ ID NO: 2562387 - protein, 6 aa, Entamoeba histolytica
EQQEQI

SEQ ID NO: 2562388 - protein, 16 aa, Entamoeba histolytica
EQQGNEFERCQPTSSL

SEQ ID NO: 2562389 - protein, 8 aa, Entamoeba histolytica
EQQLKNKT

SEQ ID NO: 2562390 - protein, 21 aa, Entamoeba histolytica
EQQLSKNKVENKENKSDEEEV

SEQ ID NO: 2562391 - protein, 5 aa, Entamoeba histolytica
EQQLT

SEQ ID NO: 2562392 - protein, 6 aa, Entamoeba histolytica
EQQNKV

SEQ ID NO: 2562393 - protein, 9 aa, Entamoeba histolytica
EQQPSQFTQ

SEQ ID NO: 2562394 - protein, 8 aa, Entamoeba histolytica
EQQSHSFN

SEQ ID NO: 2562395 - protein, 7 aa, Entamoeba histolytica
EQRAENN

SEQ ID NO: 2562396 - protein, 6 aa, Entamoeba histolytica
EQRCSV

SEQ ID NO: 2562397 - protein, 6 aa, Entamoeba histolytica
EQRCTV

SEQ ID NO: 2562398 - protein, 10 aa, Entamoeba histolytica
EQRDGVEDYN

SEQ ID NO: 2562399 - protein, 12 aa, Entamoeba histolytica
EQRNDPNPTNAI

SEQ ID NO: 2562400 - protein, 33 aa, Entamoeba histolytica
EQSDNIISKTPEEIEQNINSQKENIQNKEQNEF

SEQ ID NO: 2562401 - protein, 8 aa, Entamoeba histolytica
EQSEAQRI

SEQ ID NO: 2562402 - protein, 14 aa, Entamoeba histolytica
EQSEGINSPRSTIE

SEQ ID NO: 2562403 - protein, 25 aa, Entamoeba histolytica
EQSEKKRSFELKPKEINKKEVQQPI

SEQ ID NO: 2562404 - protein, 7 aa, Entamoeba histolytica
EQSESEE

SEQ ID NO: 2562405 - protein, 9 aa, Entamoeba histolytica
EQSNISSSE

SEQ ID NO: 2562406 - protein, 8 aa, Entamoeba histolytica
EQSNTDQK

SEQ ID NO: 2562407 - protein, 6 aa, Entamoeba histolytica
EQSTLL

SEQ ID NO: 2562408 - protein, 4 aa, Entamoeba histolytica
EQSY

SEQ ID NO: 2562409 - protein, 11 aa, Entamoeba histolytica
EQTASHARLGE

SEQ ID NO: 2562410 - protein, 10 aa, Entamoeba histolytica
EQTEMNNKQI

SEQ ID NO: 2562411 - protein, 20 aa, Entamoeba histolytica
EQTEQLKAGNEQEGATDKLN

SEQ ID NO: 2562412 - protein, 9 aa, Entamoeba histolytica
EQTNNTQKI

SEQ ID NO: 2562413 - protein, 6 aa, Entamoeba histolytica
EQTPIK

SEQ ID NO: 2562414 - protein, 7 aa, Entamoeba histolytica
EQTPTSI

SEQ ID NO: 2562415 - protein, 5 aa, Entamoeba histolytica
EQTTL

SEQ ID NO: 2562416 - protein, 12 aa, Entamoeba histolytica
EQTTMKEYKNKY

SEQ ID NO: 2562417 - protein, 15 aa, Entamoeba histolytica
EQTTSQTIKNTGRQA

SEQ ID NO: 2562418 - protein, 7 aa, Entamoeba histolytica
EQVKKTD

SEQ ID NO: 2562419 - protein, 5 aa, Entamoeba histolytica
EQYAN

SEQ ID NO: 2562420 - protein, 4 aa, Entamoeba histolytica
EQYE

SEQ ID NO: 2562421 - protein, 7 aa, Entamoeba histolytica
EQYPQGI

SEQ ID NO: 2562422 - protein, 6 aa, Entamoeba histolytica
EQYRRT

SEQ ID NO: 2562423 - protein, 4 aa, Entamoeba histolytica
EQYS

SEQ ID NO: 2562424 - protein, 7 aa, Entamoeba histolytica
EQYSTSA

SEQ ID NO: 2562425 - protein, 10 aa, Entamoeba histolytica
ERAKDRDELP

SEQ ID NO: 2562426 - protein, 4 aa, Entamoeba histolytica
ERAQ

SEQ ID NO: 2562427 - protein, 4 aa, Entamoeba histolytica
ERAS

SEQ ID NO: 2562428 - protein, 8 aa, Entamoeba histolytica
ERASSGFD

SEQ ID NO: 2562429 - protein, 5 aa, Entamoeba histolytica
ERCIE

SEQ ID NO: 2562430 - protein, 10 aa, Entamoeba histolytica
ERCKSEGKAY

SEQ ID NO: 2562431 - protein, 34 aa, Entamoeba histolytica
ERDDNLHNETTSFPLNSSSNIVQEEKDKDNIKEL

SEQ ID NO: 2562432 - protein, 16 aa, Entamoeba histolytica
ERDKSLDLNNTKLGEE

SEQ ID NO: 2562433 - protein, 9 aa, Entamoeba histolytica
ERDPRTTKQ

SEQ ID NO: 2562434 - protein, 13 aa, Entamoeba histolytica
EREERMKKVVKAL

SEQ ID NO: 2562435 - protein, 5 aa, Entamoeba histolytica
EREGL

SEQ ID NO: 2562436 - protein, 9 aa, Entamoeba histolytica
ERENTSNTI

SEQ ID NO: 2562437 - protein, 7 aa, Entamoeba histolytica
EREQIPN

SEQ ID NO: 2562438 - protein, 4 aa, Entamoeba histolytica
ERET

SEQ ID NO: 2562439 - protein, 8 aa, Entamoeba histolytica
ERETTVKR

SEQ ID NO: 2562440 - protein, 7 aa, Entamoeba histolytica
EREVPEN

SEQ ID NO: 2562441 - protein, 6 aa, Entamoeba histolytica
EREYTT

SEQ ID NO: 2562442 - protein, 4 aa, Entamoeba histolytica
ERFS

SEQ ID NO: 2562443 - protein, 11 aa, Entamoeba histolytica
ERGNKANDTYD

SEQ ID NO: 2562444 - protein, 7 aa, Entamoeba histolytica
ERGQPTD

SEQ ID NO: 2562445 - protein, 9 aa, Entamoeba histolytica
ERHQERSYE

SEQ ID NO: 2562446 - protein, 16 aa, Entamoeba histolytica
ERIKKNKEQNINNQND

SEQ ID NO: 2562447 - protein, 4 aa, Entamoeba histolytica
ERIS

SEQ ID NO: 2562448 - protein, 7 aa, Entamoeba histolytica
ERITNGT

SEQ ID NO: 2562449 - protein, 9 aa, Entamoeba histolytica
ERKDENNNI

SEQ ID NO: 2562450 - protein, 25 aa, Entamoeba histolytica
ERKLRSKKMESNTQPLIPQQNHKKY

SEQ ID NO: 2562451 - protein, 10 aa, Entamoeba histolytica
ERLGSQSCQA

SEQ ID NO: 2562452 - protein, 12 aa, Entamoeba histolytica
ERLNGKGSVEDK

SEQ ID NO: 2562453 - protein, 7 aa, Entamoeba histolytica
ERNGKIN

SEQ ID NO: 2562454 - protein, 26 aa, Entamoeba histolytica
ERNNGCTKCGNGVVDENEECDPSNKT

SEQ ID NO: 2562455 - protein, 14 aa, Entamoeba histolytica
ERPDKTVPLSNKVD

SEQ ID NO: 2562456 - protein, 36 aa, Entamoeba histolytica
ERPKKKKKQNQEDNEKEMDDELNTENISDSETKQIG

SEQ ID NO: 2562457 - protein, 11 aa, Entamoeba histolytica
ERPKTKKIEEG

SEQ ID NO: 2562458 - protein, 9 aa, Entamoeba histolytica
ERPNNEASQ

SEQ ID NO: 2562459 - protein, 11 aa, Entamoeba histolytica
ERPRKKASTTR

SEQ ID NO: 2562460 - protein, 11 aa, Entamoeba histolytica
ERRKMSGSNKN

SEQ ID NO: 2562461 - protein, 8 aa, Entamoeba histolytica
ERRNKAER

SEQ ID NO: 2562462 - protein, 21 aa, Entamoeba histolytica
ERRQTKKVNKFKERLAKSKEQ

SEQ ID NO: 2562463 - protein, 4 aa, Entamoeba histolytica
ERSK

SEQ ID NO: 2562464 - protein, 40 aa, Entamoeba histolytica
ERSKRRGIRNGIRKEKSEEGNERKRIKQENDEYKPNCSEY

SEQ ID NO: 2562465 - protein, 6 aa, Entamoeba histolytica
ERSSEF

SEQ ID NO: 2562466 - protein, 5 aa, Entamoeba histolytica
ERSTH

SEQ ID NO: 2562467 - protein, 12 aa, Entamoeba histolytica
ERSYYSSFPPSI

SEQ ID NO: 2562468 - protein, 7 aa, Entamoeba histolytica
ERTISPS

SEQ ID NO: 2562469 - protein, 10 aa, Entamoeba histolytica
ERTKKNKKRN

SEQ ID NO: 2562470 - protein, 8 aa, Entamoeba histolytica
ERTNSVTI

SEQ ID NO: 2562471 - protein, 6 aa, Entamoeba histolytica
ERTQSS

SEQ ID NO: 2562472 - protein, 8 aa, Entamoeba histolytica
ERTSEEII

SEQ ID NO: 2562473 - protein, 9 aa, Entamoeba histolytica
ERTTLDGKK

SEQ ID NO: 2562474 - protein, 5 aa, Entamoeba histolytica
ERVPA

SEQ ID NO: 2562475 - protein, 6 aa, Entamoeba histolytica
ERYGGD

SEQ ID NO: 2562476 - protein, 9 aa, Entamoeba histolytica
ERYIPEEGK

SEQ ID NO: 2562477 - protein, 7 aa, Entamoeba histolytica
ERYSNGP

SEQ ID NO: 2562478 - protein, 18 aa, Entamoeba histolytica
ERYSNSRITKNGLIDSNK

SEQ ID NO: 2562479 - protein, 10 aa, Entamoeba histolytica
ESAEGLGRSV

SEQ ID NO: 2562480 - protein, 7 aa, Entamoeba histolytica
ESAFSGC

SEQ ID NO: 2562481 - protein, 6 aa, Entamoeba histolytica
ESAKSI

SEQ ID NO: 2562482 - protein, 8 aa, Entamoeba histolytica
ESASSEEL

SEQ ID NO: 2562483 - protein, 10 aa, Entamoeba histolytica
ESCNSTTNKC

SEQ ID NO: 2562484 - protein, 8 aa, Entamoeba histolytica
ESDDPGVV

SEQ ID NO: 2562485 - protein, 6 aa, Entamoeba histolytica
ESDDQY

SEQ ID NO: 2562486 - protein, 8 aa, Entamoeba histolytica
ESDHECPN

SEQ ID NO: 2562487 - protein, 10 aa, Entamoeba histolytica
ESDLETRSKS

SEQ ID NO: 2562488 - protein, 17 aa, Entamoeba histolytica
ESDMTGEPVAVKKSEKD

SEQ ID NO: 2562489 - protein, 10 aa, Entamoeba histolytica
ESDNCDTNCY

SEQ ID NO: 2562490 - protein, 9 aa, Entamoeba histolytica
ESDNPDLRD

SEQ ID NO: 2562491 - protein, 8 aa, Entamoeba histolytica
ESDQQTAR

SEQ ID NO: 2562492 - protein, 4 aa, Entamoeba histolytica
ESDS

SEQ ID NO: 2562493 - protein, 4 aa, Entamoeba histolytica
ESDV

SEQ ID NO: 2562494 - protein, 13 aa, Entamoeba histolytica
ESDVKSCQEYTTQ

SEQ ID NO: 2562495 - protein, 7 aa, Entamoeba histolytica
ESDYTKH

SEQ ID NO: 2562496 - protein, 10 aa, Entamoeba histolytica
ESEDDERKEE

SEQ ID NO: 2562497 - protein, 10 aa, Entamoeba histolytica
ESEDSPVDAS

SEQ ID NO: 2562498 - protein, 9 aa, Entamoeba histolytica
ESEDSSDFG

SEQ ID NO: 2562499 - protein, 5 aa, Entamoeba histolytica
ESEDT

SEQ ID NO: 2562500 - protein, 9 aa, Entamoeba histolytica
ESEEEKRKQ

SEQ ID NO: 2562501 - protein, 9 aa, Entamoeba histolytica
ESEEGSSKK

SEQ ID NO: 2562502 - protein, 12 aa, Entamoeba histolytica
ESEKENDGRYTH

SEQ ID NO: 2562503 - protein, 7 aa, Entamoeba histolytica
ESEKGGR

SEQ ID NO: 2562504 - protein, 23 aa, Entamoeba histolytica
ESEKINEQQRSCITPKNKNQSQI

SEQ ID NO: 2562505 - protein, 11 aa, Entamoeba histolytica
ESEMKNAPNKQ

SEQ ID NO: 2562506 - protein, 10 aa, Entamoeba histolytica
ESEQKAKSVG

SEQ ID NO: 2562507 - protein, 7 aa, Entamoeba histolytica
ESEQLSR

SEQ ID NO: 2562508 - protein, 6 aa, Entamoeba histolytica
ESETER

SEQ ID NO: 2562509 - protein, 13 aa, Entamoeba histolytica
ESETSDLSLLVND

SEQ ID NO: 2562510 - protein, 273 aa, Entamoeba histolytica
ESETVPSVKEPTKEKEETPATSTPNETEEQKTVSENSKKLSSKISTPTESKQPPPEKEAKPLEIPPTHEENTQNQPHQDEQKEPQIPKTSQLQEGDNVPTQQKGESSSQQKGADENEKNTSDQAEGQQKNTGEEKPSQDEEHSLSNNPKTEGTQTEQGQQQGGLVPPRIQEETPSQKEKHEKDEKTQNQEQPHQPQEGKNQPEDEKSKKDNDSNKPDNTNQNNQQPNNTPEDEKKNNQKDGNQEIDNKTASTSDSSESKTDDDINKRNLDGTS

SEQ ID NO: 2562511 - protein, 7 aa, Entamoeba histolytica
ESEYEEE

SEQ ID NO: 2562512 - protein, 6 aa, Entamoeba histolytica
ESFCPG

SEQ ID NO: 2562513 - protein, 10 aa, Entamoeba histolytica
ESFDNSKYQP

SEQ ID NO: 2562514 - protein, 5 aa, Entamoeba histolytica
ESFET

SEQ ID NO: 2562515 - protein, 13 aa, Entamoeba histolytica
ESFSDKNQMYNNE

SEQ ID NO: 2562516 - protein, 9 aa, Entamoeba histolytica
ESGDSSKYH

SEQ ID NO: 2562517 - protein, 13 aa, Entamoeba histolytica
ESGEDYIKDEENG

SEQ ID NO: 2562518 - protein, 6 aa, Entamoeba histolytica
ESGELT

SEQ ID NO: 2562519 - protein, 12 aa, Entamoeba histolytica
ESGETEESEMKD

SEQ ID NO: 2562520 - protein, 5 aa, Entamoeba histolytica
ESGEY

SEQ ID NO: 2562521 - protein, 10 aa, Entamoeba histolytica
ESGNGKSSVG

SEQ ID NO: 2562522 - protein, 5 aa, Entamoeba histolytica
ESGRE

SEQ ID NO: 2562523 - protein, 8 aa, Entamoeba histolytica
ESGSIEMT

SEQ ID NO: 2562524 - protein, 11 aa, Entamoeba histolytica
ESGSPFEGECT

SEQ ID NO: 2562525 - protein, 8 aa, Entamoeba histolytica
ESGTGSGC

SEQ ID NO: 2562526 - protein, 9 aa, Entamoeba histolytica
ESHDEEEDI

SEQ ID NO: 2562527 - protein, 5 aa, Entamoeba histolytica
ESHNG

SEQ ID NO: 2562528 - protein, 7 aa, Entamoeba histolytica
ESHSPSC

SEQ ID NO: 2562529 - protein, 8 aa, Entamoeba histolytica
ESIGRQKG

SEQ ID NO: 2562530 - protein, 19 aa, Entamoeba histolytica
ESINGKEVKQSNDSKSKKL

SEQ ID NO: 2562531 - protein, 5 aa, Entamoeba histolytica
ESIQP

SEQ ID NO: 2562532 - protein, 8 aa, Entamoeba histolytica
ESITSSPK

SEQ ID NO: 2562533 - protein, 6 aa, Entamoeba histolytica
ESIWNS

SEQ ID NO: 2562534 - protein, 4 aa, Entamoeba histolytica
ESKE

SEQ ID NO: 2562535 - protein, 6 aa, Entamoeba histolytica
ESKEGI

SEQ ID NO: 2562536 - protein, 6 aa, Entamoeba histolytica
ESKEIE

SEQ ID NO: 2562537 - protein, 4 aa, Entamoeba histolytica
ESKF

SEQ ID NO: 2562538 - protein, 8 aa, Entamoeba histolytica
ESKKSLSP

SEQ ID NO: 2562539 - protein, 4 aa, Entamoeba histolytica
ESKL

SEQ ID NO: 2562540 - protein, 8 aa, Entamoeba histolytica
ESKNETIE

SEQ ID NO: 2562541 - protein, 17 aa, Entamoeba histolytica
ESKNNGECTCTDNNEFE

SEQ ID NO: 2562542 - protein, 9 aa, Entamoeba histolytica
ESKNSKKIV

SEQ ID NO: 2562543 - protein, 5 aa, Entamoeba histolytica
ESKPL

SEQ ID NO: 2562544 - protein, 14 aa, Entamoeba histolytica
ESKPNKNSSDYIDG

SEQ ID NO: 2562545 - protein, 11 aa, Entamoeba histolytica
ESKPSNSLSKS

SEQ ID NO: 2562546 - protein, 30 aa, Entamoeba histolytica
ESKQTSSTSPHPHPDDDDDDDDDDDDDNNF

SEQ ID NO: 2562547 - protein, 80 aa, Entamoeba histolytica
ESKSGPIPDNVAAENVNSVSDENDKNELQDRKAPENANHSPHSGSDISEEEQKINNNAEDNTIKEVNSELSTEEEHDTIG

SEQ ID NO: 2562548 - protein, 7 aa, Entamoeba histolytica
ESKSTLN

SEQ ID NO: 2562549 - protein, 9 aa, Entamoeba histolytica
ESKTPISLE

SEQ ID NO: 2562550 - protein, 7 aa, Entamoeba histolytica
ESKTPNI

SEQ ID NO: 2562551 - protein, 7 aa, Entamoeba histolytica
ESKTPYS

SEQ ID NO: 2562552 - protein, 5 aa, Entamoeba histolytica
ESKTY

SEQ ID NO: 2562553 - protein, 4 aa, Entamoeba histolytica
ESKV

SEQ ID NO: 2562554 - protein, 14 aa, Entamoeba histolytica
ESKYQRIKEQKISS

SEQ ID NO: 2562555 - protein, 12 aa, Entamoeba histolytica
ESKYSIKRDSTS

SEQ ID NO: 2562556 - protein, 5 aa, Entamoeba histolytica
ESLPS

SEQ ID NO: 2562557 - protein, 4 aa, Entamoeba histolytica
ESLT

SEQ ID NO: 2562558 - protein, 6 aa, Entamoeba histolytica
ESLTST

SEQ ID NO: 2562559 - protein, 7 aa, Entamoeba histolytica
ESNEGNI

SEQ ID NO: 2562560 - protein, 5 aa, Entamoeba histolytica
ESNFP

SEQ ID NO: 2562561 - protein, 4 aa, Entamoeba histolytica
ESNN

SEQ ID NO: 2562562 - protein, 9 aa, Entamoeba histolytica
ESNNLTTEL

SEQ ID NO: 2562563 - protein, 11 aa, Entamoeba histolytica
ESNNSDNPNEE

SEQ ID NO: 2562564 - protein, 4 aa, Entamoeba histolytica
ESNP

SEQ ID NO: 2562565 - protein, 5 aa, Entamoeba histolytica
ESNQT

SEQ ID NO: 2562566 - protein, 7 aa, Entamoeba histolytica
ESNQYNL

SEQ ID NO: 2562567 - protein, 9 aa, Entamoeba histolytica
ESNSTYSGK

SEQ ID NO: 2562568 - protein, 6 aa, Entamoeba histolytica
ESNTEV

SEQ ID NO: 2562569 - protein, 29 aa, Entamoeba histolytica
ESNTIHRKPARPIRPSQSMVSDTDSSESI

SEQ ID NO: 2562570 - protein, 5 aa, Entamoeba histolytica
ESNYK

SEQ ID NO: 2562571 - protein, 8 aa, Entamoeba histolytica
ESNYRVGT

SEQ ID NO: 2562572 - protein, 11 aa, Entamoeba histolytica
ESPFEEEMTPE

SEQ ID NO: 2562573 - protein, 33 aa, Entamoeba histolytica
ESPFKGSSKNVSNHTDLKPPMTKKTKKNEKTDL

SEQ ID NO: 2562574 - protein, 12 aa, Entamoeba histolytica
ESPIKQEKEIDI

SEQ ID NO: 2562575 - protein, 5 aa, Entamoeba histolytica
ESPIS

SEQ ID NO: 2562576 - protein, 9 aa, Entamoeba histolytica
ESPKSNAFK

SEQ ID NO: 2562577 - protein, 4 aa, Entamoeba histolytica
ESPL

SEQ ID NO: 2562578 - protein, 10 aa, Entamoeba histolytica
ESPPSIDQDQ

SEQ ID NO: 2562579 - protein, 7 aa, Entamoeba histolytica
ESPTDGV

SEQ ID NO: 2562580 - protein, 10 aa, Entamoeba histolytica
ESPTGSETVS

SEQ ID NO: 2562581 - protein, 7 aa, Entamoeba histolytica
ESPYPSG

SEQ ID NO: 2562582 - protein, 10 aa, Entamoeba histolytica
ESQEKPGKRY

SEQ ID NO: 2562583 - protein, 14 aa, Entamoeba histolytica
ESQGNGKCSVKSGE

SEQ ID NO: 2562584 - protein, 8 aa, Entamoeba histolytica
ESQGTSGQ

SEQ ID NO: 2562585 - protein, 10 aa, Entamoeba histolytica
ESQIGKSQSY

SEQ ID NO: 2562586 - protein, 5 aa, Entamoeba histolytica
ESQKN

SEQ ID NO: 2562587 - protein, 7 aa, Entamoeba histolytica
ESQSPSL

SEQ ID NO: 2562588 - protein, 8 aa, Entamoeba histolytica
ESQYGDCS

SEQ ID NO: 2562589 - protein, 6 aa, Entamoeba histolytica
ESRAST

SEQ ID NO: 2562590 - protein, 13 aa, Entamoeba histolytica
ESRKQQEKEEKIG

SEQ ID NO: 2562591 - protein, 19 aa, Entamoeba histolytica
ESRNIRGFTSRGTTSESKC

SEQ ID NO: 2562592 - protein, 14 aa, Entamoeba histolytica
ESRRMEKEGNPKLA

SEQ ID NO: 2562593 - protein, 5 aa, Entamoeba histolytica
ESRRR

SEQ ID NO: 2562594 - protein, 14 aa, Entamoeba histolytica
ESSATEANATNRHG

SEQ ID NO: 2562595 - protein, 7 aa, Entamoeba histolytica
ESSENNT

SEQ ID NO: 2562596 - protein, 6 aa, Entamoeba histolytica
ESSEQS

SEQ ID NO: 2562597 - protein, 4 aa, Entamoeba histolytica
ESSF

SEQ ID NO: 2562598 - protein, 12 aa, Entamoeba histolytica
ESSIKTLKSNSI

SEQ ID NO: 2562599 - protein, 7 aa, Entamoeba histolytica
ESSIQST

SEQ ID NO: 2562600 - protein, 11 aa, Entamoeba histolytica
ESSKAVDTEGT

SEQ ID NO: 2562601 - protein, 9 aa, Entamoeba histolytica
ESSKEGNYI

SEQ ID NO: 2562602 - protein, 16 aa, Entamoeba histolytica
ESSKFQPDISKRDPNN

SEQ ID NO: 2562603 - protein, 7 aa, Entamoeba histolytica
ESSKQYE

SEQ ID NO: 2562604 - protein, 16 aa, Entamoeba histolytica
ESSKVNGKLTDFGSSR

SEQ ID NO: 2562605 - protein, 8 aa, Entamoeba histolytica
ESSLSTKL

SEQ ID NO: 2562606 - protein, 6 aa, Entamoeba histolytica
ESSNFN

SEQ ID NO: 2562607 - protein, 6 aa, Entamoeba histolytica
ESSNVS

SEQ ID NO: 2562608 - protein, 16 aa, Entamoeba histolytica
ESSSCSGNKKSETFNL

SEQ ID NO: 2562609 - protein, 16 aa, Entamoeba histolytica
ESSSCSRNKKSETFNL

SEQ ID NO: 2562610 - protein, 9 aa, Entamoeba histolytica
ESSSLEPSQ

SEQ ID NO: 2562611 - protein, 9 aa, Entamoeba histolytica
ESSSSESLF

SEQ ID NO: 2562612 - protein, 14 aa, Entamoeba histolytica
ESSTMPSYKKETSS

SEQ ID NO: 2562613 - protein, 7 aa, Entamoeba histolytica
ESSWTGA

SEQ ID NO: 2562614 - protein, 29 aa, Entamoeba histolytica
ESTDTNTQNKINTSLHEKSTEDSKENKEI

SEQ ID NO: 2562615 - protein, 4 aa, Entamoeba histolytica
ESTE

SEQ ID NO: 2562616 - protein, 13 aa, Entamoeba histolytica
ESTEEEKDEQMNN

SEQ ID NO: 2562617 - protein, 6 aa, Entamoeba histolytica
ESTEER

SEQ ID NO: 2562618 - protein, 12 aa, Entamoeba histolytica
ESTIKNTKHQCE

SEQ ID NO: 2562619 - protein, 5 aa, Entamoeba histolytica
ESTIR

SEQ ID NO: 2562620 - protein, 6 aa, Entamoeba histolytica
ESTNDM

SEQ ID NO: 2562621 - protein, 8 aa, Entamoeba histolytica
ESTNGDGQ

SEQ ID NO: 2562622 - protein, 8 aa, Entamoeba histolytica
ESTNGTCH

SEQ ID NO: 2562623 - protein, 7 aa, Entamoeba histolytica
ESTNQTT

SEQ ID NO: 2562624 - protein, 10 aa, Entamoeba histolytica
ESTPLTSNNP

SEQ ID NO: 2562625 - protein, 5 aa, Entamoeba histolytica
ESTRI

SEQ ID NO: 2562626 - protein, 11 aa, Entamoeba histolytica
ESTRTDRETSK

SEQ ID NO: 2562627 - protein, 4 aa, Entamoeba histolytica
ESTT

SEQ ID NO: 2562628 - protein, 10 aa, Entamoeba histolytica
ESTVHASSEI

SEQ ID NO: 2562629 - protein, 12 aa, Entamoeba histolytica
ESVEFERDGDKI

SEQ ID NO: 2562630 - protein, 5 aa, Entamoeba histolytica
ESVKT

SEQ ID NO: 2562631 - protein, 5 aa, Entamoeba histolytica
ESVNS

SEQ ID NO: 2562632 - protein, 6 aa, Entamoeba histolytica
ESVPSF

SEQ ID NO: 2562633 - protein, 16 aa, Entamoeba histolytica
ESVRNNDLKTGKNGLE

SEQ ID NO: 2562634 - protein, 11 aa, Entamoeba histolytica
ESVSNCKPNVK

SEQ ID NO: 2562635 - protein, 5 aa, Entamoeba histolytica
ESVTV

SEQ ID NO: 2562636 - protein, 11 aa, Entamoeba histolytica
ESWTQDDQKLL

SEQ ID NO: 2562637 - protein, 10 aa, Entamoeba histolytica
ESYDKTPVIN

SEQ ID NO: 2562638 - protein, 7 aa, Entamoeba histolytica
ESYSSPS

SEQ ID NO: 2562639 - protein, 5 aa, Entamoeba histolytica
ETAKD

SEQ ID NO: 2562640 - protein, 20 aa, Entamoeba histolytica
ETCDSNGRCNKCNSDKFRIS

SEQ ID NO: 2562641 - protein, 16 aa, Entamoeba histolytica
ETCEEGKIKDQNGKCN

SEQ ID NO: 2562642 - protein, 29 aa, Entamoeba histolytica
ETCEEGKIKDQNGKCNSNISNCSNESYVN

SEQ ID NO: 2562643 - protein, 16 aa, Entamoeba histolytica
ETCEERKIKDQNGKCN

SEQ ID NO: 2562644 - protein, 15 aa, Entamoeba histolytica
ETCESRENEINPKTL

SEQ ID NO: 2562645 - protein, 18 aa, Entamoeba histolytica
ETCESRERRGVNSSTFSE

SEQ ID NO: 2562646 - protein, 5 aa, Entamoeba histolytica
ETCSS

SEQ ID NO: 2562647 - protein, 16 aa, Entamoeba histolytica
ETDDSSYVTYDATTPL

SEQ ID NO: 2562648 - protein, 7 aa, Entamoeba histolytica
ETDEKDE

SEQ ID NO: 2562649 - protein, 7 aa, Entamoeba histolytica
ETDIPKD

SEQ ID NO: 2562650 - protein, 4 aa, Entamoeba histolytica
ETDQ

SEQ ID NO: 2562651 - protein, 6 aa, Entamoeba histolytica
ETEDES

SEQ ID NO: 2562652 - protein, 10 aa, Entamoeba histolytica
ETEDVKNNSV

SEQ ID NO: 2562653 - protein, 10 aa, Entamoeba histolytica
ETEECDGGDG

SEQ ID NO: 2562654 - protein, 6 aa, Entamoeba histolytica
ETEEIE

SEQ ID NO: 2562655 - protein, 8 aa, Entamoeba histolytica
ETEEVGGS

SEQ ID NO: 2562656 - protein, 6 aa, Entamoeba histolytica
ETEIQQ

SEQ ID NO: 2562657 - protein, 4 aa, Entamoeba histolytica
ETEN

SEQ ID NO: 2562658 - protein, 5 aa, Entamoeba histolytica
ETENV

SEQ ID NO: 2562659 - protein, 4 aa, Entamoeba histolytica
ETEP

SEQ ID NO: 2562660 - protein, 5 aa, Entamoeba histolytica
ETEQL

SEQ ID NO: 2562661 - protein, 5 aa, Entamoeba histolytica
ETERI

SEQ ID NO: 2562662 - protein, 8 aa, Entamoeba histolytica
ETERTKRL

SEQ ID NO: 2562663 - protein, 14 aa, Entamoeba histolytica
ETESTEFKRDGDKI

SEQ ID NO: 2562664 - protein, 4 aa, Entamoeba histolytica
ETFD

SEQ ID NO: 2562665 - protein, 4 aa, Entamoeba histolytica
ETFK

SEQ ID NO: 2562666 - protein, 4 aa, Entamoeba histolytica
ETGE

SEQ ID NO: 2562667 - protein, 4 aa, Entamoeba histolytica
ETGF

SEQ ID NO: 2562668 - protein, 4 aa, Entamoeba histolytica
ETGI

SEQ ID NO: 2562669 - protein, 4 aa, Entamoeba histolytica
ETGN

SEQ ID NO: 2562670 - protein, 12 aa, Entamoeba histolytica
ETGNGKSSLGNS

SEQ ID NO: 2562671 - protein, 11 aa, Entamoeba histolytica
ETGTGKSSAGN

SEQ ID NO: 2562672 - protein, 10 aa, Entamoeba histolytica
ETGTGKSSLG

SEQ ID NO: 2562673 - protein, 12 aa, Entamoeba histolytica
ETGTGKSSLGNS

SEQ ID NO: 2562674 - protein, 255 aa, Entamoeba histolytica
ETGVDEKLTTDKGAEEPTSSTQSTKEASSKDEQEVPKETQETKGSDVDSTTGEKQPKDIPTKESQKPEETTSAETTKQQTESQESSTPKVPQGENSEKTKQQQKDHNPSSQGEENQKQDKKQSETQTPSTQGGNQQKEESEKTQENGDNKNNEIPKTQDDAKDKQDEQQNENQKQQESKDKQEKQEDKQEKKDNDSQQKNNNNQQTNNNPEDEKTHEPNKNENKESDTKQSNNDESETDNSTDNDINNQKNIDGT

SEQ ID NO: 2562675 - protein, 11 aa, Entamoeba histolytica
ETGYNGSKYTE

SEQ ID NO: 2562676 - protein, 13 aa, Entamoeba histolytica
ETGYTVDKSETKC

SEQ ID NO: 2562677 - protein, 9 aa, Entamoeba histolytica
ETHDETRND

SEQ ID NO: 2562678 - protein, 6 aa, Entamoeba histolytica
ETHLPE

SEQ ID NO: 2562679 - protein, 15 aa, Entamoeba histolytica
ETHNSNVKTKTMDSY

SEQ ID NO: 2562680 - protein, 6 aa, Entamoeba histolytica
ETIAKE

SEQ ID NO: 2562681 - protein, 6 aa, Entamoeba histolytica
ETIERP

SEQ ID NO: 2562682 - protein, 6 aa, Entamoeba histolytica
ETIESE

SEQ ID NO: 2562683 - protein, 6 aa, Entamoeba histolytica
ETIESG

SEQ ID NO: 2562684 - protein, 6 aa, Entamoeba histolytica
ETIKKG

SEQ ID NO: 2562685 - protein, 11 aa, Entamoeba histolytica
ETIPEDQSGPC

SEQ ID NO: 2562686 - protein, 6 aa, Entamoeba histolytica
ETIRSS

SEQ ID NO: 2562687 - protein, 19 aa, Entamoeba histolytica
ETKDSCSSLDKDQESQGIY

SEQ ID NO: 2562688 - protein, 4 aa, Entamoeba histolytica
ETKE

SEQ ID NO: 2562689 - protein, 8 aa, Entamoeba histolytica
ETKENEEG

SEQ ID NO: 2562690 - protein, 10 aa, Entamoeba histolytica
ETKNESFQTE

SEQ ID NO: 2562691 - protein, 6 aa, Entamoeba histolytica
ETKNFS

SEQ ID NO: 2562692 - protein, 16 aa, Entamoeba histolytica
ETKQILNGKDATLKRS

SEQ ID NO: 2562693 - protein, 15 aa, Entamoeba histolytica
ETKSSNENICAKPKQ

SEQ ID NO: 2562694 - protein, 6 aa, Entamoeba histolytica
ETKTMN

SEQ ID NO: 2562695 - protein, 11 aa, Entamoeba histolytica
ETKVKKGKTEV

SEQ ID NO: 2562696 - protein, 11 aa, Entamoeba histolytica
ETKVSGKTLKG

SEQ ID NO: 2562697 - protein, 8 aa, Entamoeba histolytica
ETLKTKPR

SEQ ID NO: 2562698 - protein, 7 aa, Entamoeba histolytica
ETLNGTN

SEQ ID NO: 2562699 - protein, 6 aa, Entamoeba histolytica
ETLSNE

SEQ ID NO: 2562700 - protein, 11 aa, Entamoeba histolytica
ETLTSCDTKGV

SEQ ID NO: 2562701 - protein, 11 aa, Entamoeba histolytica
ETLTSSPSQYF

SEQ ID NO: 2562702 - protein, 4 aa, Entamoeba histolytica
ETMD

SEQ ID NO: 2562703 - protein, 5 aa, Entamoeba histolytica
ETMGD

SEQ ID NO: 2562704 - protein, 5 aa, Entamoeba histolytica
ETMGP

SEQ ID NO: 2562705 - protein, 7 aa, Entamoeba histolytica
ETMPPGL

SEQ ID NO: 2562706 - protein, 7 aa, Entamoeba histolytica
ETNDVNN

SEQ ID NO: 2562707 - protein, 6 aa, Entamoeba histolytica
ETNEPT

SEQ ID NO: 2562708 - protein, 51 aa, Entamoeba histolytica
ETNESIHSRQNEKLESYQSQQEKDSRSESDDSLPAPKTQASNTSKSEEQIE

SEQ ID NO: 2562709 - protein, 6 aa, Entamoeba histolytica
ETNGCN

SEQ ID NO: 2562710 - protein, 20 aa, Entamoeba histolytica
ETNGEYNEALENQYNEYYED

SEQ ID NO: 2562711 - protein, 4 aa, Entamoeba histolytica
ETNI

SEQ ID NO: 2562712 - protein, 7 aa, Entamoeba histolytica
ETNKSIP

SEQ ID NO: 2562713 - protein, 6 aa, Entamoeba histolytica
ETNLSR

SEQ ID NO: 2562714 - protein, 5 aa, Entamoeba histolytica
ETNPY

SEQ ID NO: 2562715 - protein, 4 aa, Entamoeba histolytica
ETNY

SEQ ID NO: 2562716 - protein, 6 aa, Entamoeba histolytica
ETNYSK

SEQ ID NO: 2562717 - protein, 5 aa, Entamoeba histolytica
ETPDL

SEQ ID NO: 2562718 - protein, 6 aa, Entamoeba histolytica
ETPETD

SEQ ID NO: 2562719 - protein, 4 aa, Entamoeba histolytica
ETPH

SEQ ID NO: 2562720 - protein, 5 aa, Entamoeba histolytica
ETPKQ

SEQ ID NO: 2562721 - protein, 4 aa, Entamoeba histolytica
ETPL

SEQ ID NO: 2562722 - protein, 10 aa, Entamoeba histolytica
ETPLKSEKDM

SEQ ID NO: 2562723 - protein, 16 aa, Entamoeba histolytica
ETPNISHPQDDTVDNE

SEQ ID NO: 2562724 - protein, 6 aa, Entamoeba histolytica
ETPPHS

SEQ ID NO: 2562725 - protein, 4 aa, Entamoeba histolytica
ETPR

SEQ ID NO: 2562726 - protein, 4 aa, Entamoeba histolytica
ETPT

SEQ ID NO: 2562727 - protein, 4 aa, Entamoeba histolytica
ETPY

SEQ ID NO: 2562728 - protein, 6 aa, Entamoeba histolytica
ETQNKD

SEQ ID NO: 2562729 - protein, 12 aa, Entamoeba histolytica
ETQPLSSITENQ

SEQ ID NO: 2562730 - protein, 6 aa, Entamoeba histolytica
ETQSYY

SEQ ID NO: 2562731 - protein, 13 aa, Entamoeba histolytica
ETRDHPLRLLCCC

SEQ ID NO: 2562732 - protein, 7 aa, Entamoeba histolytica
ETRPDIA

SEQ ID NO: 2562733 - protein, 6 aa, Entamoeba histolytica
ETRTAA

SEQ ID NO: 2562734 - protein, 10 aa, Entamoeba histolytica
ETRVKSPKVE

SEQ ID NO: 2562735 - protein, 10 aa, Entamoeba histolytica
ETSDRNGSER

SEQ ID NO: 2562736 - protein, 18 aa, Entamoeba histolytica
ETSEANAADDLAASLLDS

SEQ ID NO: 2562737 - protein, 5 aa, Entamoeba histolytica
ETSIT

SEQ ID NO: 2562738 - protein, 6 aa, Entamoeba histolytica
ETSKKI

SEQ ID NO: 2562739 - protein, 9 aa, Entamoeba histolytica
ETSNGKCSK

SEQ ID NO: 2562740 - protein, 10 aa, Entamoeba histolytica
ETSNGKCSKC

SEQ ID NO: 2562741 - protein, 17 aa, Entamoeba histolytica
ETSPISDIAGKKSSTYI

SEQ ID NO: 2562742 - protein, 4 aa, Entamoeba histolytica
ETSS

SEQ ID NO: 2562743 - protein, 17 aa, Entamoeba histolytica
ETSSFKSNYPKKTDKYN

SEQ ID NO: 2562744 - protein, 20 aa, Entamoeba histolytica
ETSSTEENIITESTNKRRRT

SEQ ID NO: 2562745 - protein, 11 aa, Entamoeba histolytica
ETSTCSSCNSG

SEQ ID NO: 2562746 - protein, 11 aa, Entamoeba histolytica
ETSTCTSCNSG

SEQ ID NO: 2562747 - protein, 8 aa, Entamoeba histolytica
ETSTRATP

SEQ ID NO: 2562748 - protein, 10 aa, Entamoeba histolytica
ETTGKRTQQL

SEQ ID NO: 2562749 - protein, 8 aa, Entamoeba histolytica
ETTGMGTS

SEQ ID NO: 2562750 - protein, 36 aa, Entamoeba histolytica
ETTHESTTSSFSSTSSVSSQTHPNGNSNEENKKGLQ

SEQ ID NO: 2562751 - protein, 9 aa, Entamoeba histolytica
ETTKEDTLL

SEQ ID NO: 2562752 - protein, 13 aa, Entamoeba histolytica
ETTKEESEQYVHL

SEQ ID NO: 2562753 - protein, 8 aa, Entamoeba histolytica
ETTKGNKE

SEQ ID NO: 2562754 - protein, 5 aa, Entamoeba histolytica
ETTKP

SEQ ID NO: 2562755 - protein, 10 aa, Entamoeba histolytica
ETTSQNLQEL

SEQ ID NO: 2562756 - protein, 10 aa, Entamoeba histolytica
ETTSRDQWNN

SEQ ID NO: 2562757 - protein, 5 aa, Entamoeba histolytica
ETTSS

SEQ ID NO: 2562758 - protein, 14 aa, Entamoeba histolytica
ETTTPTNKISLGPP

SEQ ID NO: 2562759 - protein, 175 aa, Entamoeba histolytica
ETTTSSQGAKEGVTSGNTATVSQGSAATVSSQGDKSLSQPVEGNSSPVTPKPASQTSQTPEADSQPSSPTPPTSPSSPQTSSTPTTNQPSQPQTNSASSTSTPQSQPENNNPQPPQTKPEEQPQQPSSQSQQNQPQQQNEKKDNKNTTTSDISHDKTVVSSDDTSDNHNNLDGAS

SEQ ID NO: 2562760 - protein, 342 aa, Entamoeba histolytica
ETVHKESQSAEVSGGEESSKKSHESETSQKTQSNSQSPSTTITSPTKSEQSTTQTSESGTKEQQKVNEGTTSTLNGEGKGHNEQSQEGVGKNSLDGTSATGTGVSGQETTSGKEKNDATQTGEPPTETQEGTTTVNKKPEATKSTNGGNTESGKNGSEKNGQGQNADEKTKEEPKSNDGKDSTTTSGKDGQSTSGKEEGTSGQPSGKGGESTSNESGKENEGESVGPNGQKPPANQNDGKDTQTGGQGKDGNAGTTTNGKDEKENKPDTQPPTGGQDGKSNDKTQKPDDTKNNHDPKTPITPEEKPNNNTNTTSTKSENKTDDSSNNKNDDQHEHNNLDNTS

SEQ ID NO: 2562761 - protein, 6 aa, Entamoeba histolytica
ETVSTT

SEQ ID NO: 2562762 - protein, 8 aa, Entamoeba histolytica
ETYDDDDE

SEQ ID NO: 2562763 - protein, 7 aa, Entamoeba histolytica
ETYDPRI

SEQ ID NO: 2562764 - protein, 13 aa, Entamoeba histolytica
ETYETIAASPNRA

SEQ ID NO: 2562765 - protein, 7 aa, Entamoeba histolytica
ETYNRLQ

SEQ ID NO: 2562766 - protein, 8 aa, Entamoeba histolytica
EVANEEGS

SEQ ID NO: 2562767 - protein, 12 aa, Entamoeba histolytica
EVAQNKTAIDEF

SEQ ID NO: 2562768 - protein, 9 aa, Entamoeba histolytica
EVDDSTKHN

SEQ ID NO: 2562769 - protein, 18 aa, Entamoeba histolytica
EVDEDDDFSNNESETLKA

SEQ ID NO: 2562770 - protein, 8 aa, Entamoeba histolytica
EVDEDTKT

SEQ ID NO: 2562771 - protein, 9 aa, Entamoeba histolytica
EVDEPNPDL

SEQ ID NO: 2562772 - protein, 5 aa, Entamoeba histolytica
EVDKD

SEQ ID NO: 2562773 - protein, 31 aa, Entamoeba histolytica
EVDKEEKPRRIKPFTTGDYPGSDQKAEDRAA

SEQ ID NO: 2562774 - protein, 11 aa, Entamoeba histolytica
EVDSSLSSHEK

SEQ ID NO: 2562775 - protein, 10 aa, Entamoeba histolytica
EVDTTETNNG

SEQ ID NO: 2562776 - protein, 6 aa, Entamoeba histolytica
EVEDEI

SEQ ID NO: 2562777 - protein, 4 aa, Entamoeba histolytica
EVGD

SEQ ID NO: 2562778 - protein, 5 aa, Entamoeba histolytica
EVGDK

SEQ ID NO: 2562779 - protein, 8 aa, Entamoeba histolytica
EVGERSET

SEQ ID NO: 2562780 - protein, 11 aa, Entamoeba histolytica
EVGPSTKQDYG

SEQ ID NO: 2562781 - protein, 12 aa, Entamoeba histolytica
EVKEEEKIGEGG

SEQ ID NO: 2562782 - protein, 13 aa, Entamoeba histolytica
EVKGCKGEIDKEY

SEQ ID NO: 2562783 - protein, 6 aa, Entamoeba histolytica
EVKGGE

SEQ ID NO: 2562784 - protein, 6 aa, Entamoeba histolytica
EVKGNV

SEQ ID NO: 2562785 - protein, 6 aa, Entamoeba histolytica
EVKNAM

SEQ ID NO: 2562786 - protein, 74 aa, Entamoeba histolytica
EVKQSTKSEEISKDIETPKPSKEEDKNIPKEDETLTKEDENIPKEDETLTKEDENIPKEDKTLNKEGSTNIQTE

SEQ ID NO: 2562787 - protein, 10 aa, Entamoeba histolytica
EVKSAKTRES

SEQ ID NO: 2562788 - protein, 8 aa, Entamoeba histolytica
EVKTPEQI

SEQ ID NO: 2562789 - protein, 13 aa, Entamoeba histolytica
EVLGNTKGSEGYN

SEQ ID NO: 2562790 - protein, 8 aa, Entamoeba histolytica
EVNDGETY

SEQ ID NO: 2562791 - protein, 6 aa, Entamoeba histolytica
EVNEGV

SEQ ID NO: 2562792 - protein, 8 aa, Entamoeba histolytica
EVNGGPGA

SEQ ID NO: 2562793 - protein, 11 aa, Entamoeba histolytica
EVNNSNDPQLI

SEQ ID NO: 2562794 - protein, 12 aa, Entamoeba histolytica
EVPDDKDEITDC

SEQ ID NO: 2562795 - protein, 6 aa, Entamoeba histolytica
EVPEPK

SEQ ID NO: 2562796 - protein, 6 aa, Entamoeba histolytica
EVPPTT

SEQ ID NO: 2562797 - protein, 5 aa, Entamoeba histolytica
EVPVS

SEQ ID NO: 2562798 - protein, 10 aa, Entamoeba histolytica
EVQNEGELTT

SEQ ID NO: 2562799 - protein, 12 aa, Entamoeba histolytica
EVSINNTNTIAR

SEQ ID NO: 2562800 - protein, 9 aa, Entamoeba histolytica
EVSKEPTSQ

SEQ ID NO: 2562801 - protein, 7 aa, Entamoeba histolytica
EVSLNST

SEQ ID NO: 2562802 - protein, 19 aa, Entamoeba histolytica
EVSNSYSKVDGEENVSDVI

SEQ ID NO: 2562803 - protein, 4 aa, Entamoeba histolytica
EVSP

SEQ ID NO: 2562804 - protein, 6 aa, Entamoeba histolytica
EVSQLD

SEQ ID NO: 2562805 - protein, 8 aa, Entamoeba histolytica
EVSSNGTY

SEQ ID NO: 2562806 - protein, 15 aa, Entamoeba histolytica
EVSSSPELNFYVPKF

SEQ ID NO: 2562807 - protein, 11 aa, Entamoeba histolytica
EVSTNEEQQTL

SEQ ID NO: 2562808 - protein, 13 aa, Entamoeba histolytica
EVTEKSGKQNKKK

SEQ ID NO: 2562809 - protein, 13 aa, Entamoeba histolytica
EVTETSEKPDNRR

SEQ ID NO: 2562810 - protein, 13 aa, Entamoeba histolytica
EVTETSENPDKKK

SEQ ID NO: 2562811 - protein, 9 aa, Entamoeba histolytica
EVTKGLKEW

SEQ ID NO: 2562812 - protein, 13 aa, Entamoeba histolytica
EVTPNQHCAGSYG

SEQ ID NO: 2562813 - protein, 9 aa, Entamoeba histolytica
EVTSNNPSM

SEQ ID NO: 2562814 - protein, 4 aa, Entamoeba histolytica
EVYT

SEQ ID NO: 2562815 - protein, 8 aa, Entamoeba histolytica
EWDDANNT

SEQ ID NO: 2562816 - protein, 4 aa, Entamoeba histolytica
EWNA

SEQ ID NO: 2562817 - protein, 11 aa, Entamoeba histolytica
EWSNSGSVTCS

SEQ ID NO: 2562818 - protein, 12 aa, Entamoeba histolytica
EYAQPSIKTPTI

SEQ ID NO: 2562819 - protein, 10 aa, Entamoeba histolytica
EYDEKNERHY

SEQ ID NO: 2562820 - protein, 7 aa, Entamoeba histolytica
EYEEESA

SEQ ID NO: 2562821 - protein, 8 aa, Entamoeba histolytica
EYEKDNDI

SEQ ID NO: 2562822 - protein, 11 aa, Entamoeba histolytica
EYELEGKDPVY

SEQ ID NO: 2562823 - protein, 5 aa, Entamoeba histolytica
EYERQ

SEQ ID NO: 2562824 - protein, 4 aa, Entamoeba histolytica
EYET

SEQ ID NO: 2562825 - protein, 12 aa, Entamoeba histolytica
EYGDAENKQQKK

SEQ ID NO: 2562826 - protein, 10 aa, Entamoeba histolytica
EYGGSKSDKK

SEQ ID NO: 2562827 - protein, 8 aa, Entamoeba histolytica
EYGPYGEF

SEQ ID NO: 2562828 - protein, 5 aa, Entamoeba histolytica
EYGSI

SEQ ID NO: 2562829 - protein, 18 aa, Entamoeba histolytica
EYHRTASGQSKRTKKTWG

SEQ ID NO: 2562830 - protein, 14 aa, Entamoeba histolytica
EYISQKKKEIDDSW

SEQ ID NO: 2562831 - protein, 10 aa, Entamoeba histolytica
EYKDQEKEED

SEQ ID NO: 2562832 - protein, 8 aa, Entamoeba histolytica
EYKGNDNG

SEQ ID NO: 2562833 - protein, 9 aa, Entamoeba histolytica
EYKKGKSLK

SEQ ID NO: 2562834 - protein, 4 aa, Entamoeba histolytica
EYKN

SEQ ID NO: 2562835 - protein, 4 aa, Entamoeba histolytica
EYND

SEQ ID NO: 2562836 - protein, 9 aa, Entamoeba histolytica
EYNPTPRRT

SEQ ID NO: 2562837 - protein, 10 aa, Entamoeba histolytica
EYNQKDETRR

SEQ ID NO: 2562838 - protein, 8 aa, Entamoeba histolytica
EYNRSREG

SEQ ID NO: 2562839 - protein, 5 aa, Entamoeba histolytica
EYNTN

SEQ ID NO: 2562840 - protein, 4 aa, Entamoeba histolytica
EYPA

SEQ ID NO: 2562841 - protein, 4 aa, Entamoeba histolytica
EYPG

SEQ ID NO: 2562842 - protein, 6 aa, Entamoeba histolytica
EYPQKP

SEQ ID NO: 2562843 - protein, 8 aa, Entamoeba histolytica
EYPSSLPS

SEQ ID NO: 2562844 - protein, 19 aa, Entamoeba histolytica
EYQEYATEQLKKKNQNDEK

SEQ ID NO: 2562845 - protein, 6 aa, Entamoeba histolytica
EYQTEY

SEQ ID NO: 2562846 - protein, 5 aa, Entamoeba histolytica
EYRGY

SEQ ID NO: 2562847 - protein, 4 aa, Entamoeba histolytica
EYRR

SEQ ID NO: 2562848 - protein, 5 aa, Entamoeba histolytica
EYRSK

SEQ ID NO: 2562849 - protein, 5 aa, Entamoeba histolytica
EYSGD

SEQ ID NO: 2562850 - protein, 7 aa, Entamoeba histolytica
EYSGRYT

SEQ ID NO: 2562851 - protein, 9 aa, Entamoeba histolytica
EYSKSYDGY

SEQ ID NO: 2562852 - protein, 5 aa, Entamoeba histolytica
EYSND

SEQ ID NO: 2562853 - protein, 6 aa, Entamoeba histolytica
EYSSSY

SEQ ID NO: 2562854 - protein, 9 aa, Entamoeba histolytica
EYSTPPPHS

SEQ ID NO: 2562855 - protein, 10 aa, Entamoeba histolytica
EYTANGTTQY

SEQ ID NO: 2562856 - protein, 10 aa, Entamoeba histolytica
EYTGSQIDTV

SEQ ID NO: 2562857 - protein, 22 aa, Entamoeba histolytica
EYTLNNGKCESKENKNGKNEEI

SEQ ID NO: 2562858 - protein, 22 aa, Entamoeba histolytica
EYTLNNGKCGSKENKNGKNEEI

SEQ ID NO: 2562859 - protein, 23 aa, Entamoeba histolytica
EYTLNNGTCVSKKQNQNGKNQEI

SEQ ID NO: 2562860 - protein, 13 aa, Entamoeba histolytica
EYTTPVKETNRGF

SEQ ID NO: 2562861 - protein, 7 aa, Entamoeba histolytica
EYWSQNE

SEQ ID NO: 2562862 - protein, 7 aa, Entamoeba histolytica
EYYSKED

SEQ ID NO: 2562863 - protein, 8 aa, Entamoeba histolytica
FADKTGVD

SEQ ID NO: 2562864 - protein, 4 aa, Entamoeba histolytica
FAEE

SEQ ID NO: 2562865 - protein, 12 aa, Entamoeba histolytica
FAENEAQKNEGI

SEQ ID NO: 2562866 - protein, 4 aa, Entamoeba histolytica
FAEQ

SEQ ID NO: 2562867 - protein, 7 aa, Entamoeba histolytica
FAESEDT

SEQ ID NO: 2562868 - protein, 7 aa, Entamoeba histolytica
FAESPRQ

SEQ ID NO: 2562869 - protein, 10 aa, Entamoeba histolytica
FAKDDKSETM

SEQ ID NO: 2562870 - protein, 10 aa, Entamoeba histolytica
FAKSEKESYK

SEQ ID NO: 2562871 - protein, 9 aa, Entamoeba histolytica
FAPNGTFTK

SEQ ID NO: 2562872 - protein, 10 aa, Entamoeba histolytica
FAQDGKSETM

SEQ ID NO: 2562873 - protein, 5 aa, Entamoeba histolytica
FASEG

SEQ ID NO: 2562874 - protein, 11 aa, Entamoeba histolytica
FDAGNSPTPVI

SEQ ID NO: 2562875 - protein, 5 aa, Entamoeba histolytica
FDASA

SEQ ID NO: 2562876 - protein, 15 aa, Entamoeba histolytica
FDDEHSKNSSCNDQH

SEQ ID NO: 2562877 - protein, 5 aa, Entamoeba histolytica
FDDES

SEQ ID NO: 2562878 - protein, 8 aa, Entamoeba histolytica
FDDKTGIG

SEQ ID NO: 2562879 - protein, 8 aa, Entamoeba histolytica
FDDTETQE

SEQ ID NO: 2562880 - protein, 10 aa, Entamoeba histolytica
FDDTKKPREF

SEQ ID NO: 2562881 - protein, 11 aa, Entamoeba histolytica
FDDTSSFTIEN

SEQ ID NO: 2562882 - protein, 10 aa, Entamoeba histolytica
FDDVTNPKKI

SEQ ID NO: 2562883 - protein, 11 aa, Entamoeba histolytica
FDEAGHDNNEL

SEQ ID NO: 2562884 - protein, 13 aa, Entamoeba histolytica
FDEDIEQPSPSLS

SEQ ID NO: 2562885 - protein, 18 aa, Entamoeba histolytica
FDEEEQKLVKQNSKEENS

SEQ ID NO: 2562886 - protein, 7 aa, Entamoeba histolytica
FDENDIA

SEQ ID NO: 2562887 - protein, 4 aa, Entamoeba histolytica
FDEQ

SEQ ID NO: 2562888 - protein, 6 aa, Entamoeba histolytica
FDESQN

SEQ ID NO: 2562889 - protein, 7 aa, Entamoeba histolytica
FDGARDA

SEQ ID NO: 2562890 - protein, 7 aa, Entamoeba histolytica
FDGKAYD

SEQ ID NO: 2562891 - protein, 12 aa, Entamoeba histolytica
FDGSEYGECGEN

SEQ ID NO: 2562892 - protein, 14 aa, Entamoeba histolytica
FDGTESNSPSKQYK

SEQ ID NO: 2562893 - protein, 10 aa, Entamoeba histolytica
FDKNSTDHYL

SEQ ID NO: 2562894 - protein, 4 aa, Entamoeba histolytica
FDKS

SEQ ID NO: 2562895 - protein, 17 aa, Entamoeba histolytica
FDNENNNENDENISQNN

SEQ ID NO: 2562896 - protein, 9 aa, Entamoeba histolytica
FDNETKNMI

SEQ ID NO: 2562897 - protein, 10 aa, Entamoeba histolytica
FDNWTQEDQL

SEQ ID NO: 2562898 - protein, 10 aa, Entamoeba histolytica
FDPAKDGYTR

SEQ ID NO: 2562899 - protein, 4 aa, Entamoeba histolytica
FDPE

SEQ ID NO: 2562900 - protein, 12 aa, Entamoeba histolytica
FDPNSKYSKEEI

SEQ ID NO: 2562901 - protein, 7 aa, Entamoeba histolytica
FDPPKYL

SEQ ID NO: 2562902 - protein, 5 aa, Entamoeba histolytica
FDPRC

SEQ ID NO: 2562903 - protein, 9 aa, Entamoeba histolytica
FDPSDAKKI

SEQ ID NO: 2562904 - protein, 5 aa, Entamoeba histolytica
FDPST

SEQ ID NO: 2562905 - protein, 4 aa, Entamoeba histolytica
FDPT

SEQ ID NO: 2562906 - protein, 11 aa, Entamoeba histolytica
FDQSENLREKK

SEQ ID NO: 2562907 - protein, 6 aa, Entamoeba histolytica
FDSDRK

SEQ ID NO: 2562908 - protein, 9 aa, Entamoeba histolytica
FDSEGTEKV

SEQ ID NO: 2562909 - protein, 11 aa, Entamoeba histolytica
FDSKEDITKEK

SEQ ID NO: 2562910 - protein, 10 aa, Entamoeba histolytica
FDSQCDNNTC

SEQ ID NO: 2562911 - protein, 8 aa, Entamoeba histolytica
FDSQNEGR

SEQ ID NO: 2562912 - protein, 4 aa, Entamoeba histolytica
FDSS

SEQ ID NO: 2562913 - protein, 8 aa, Entamoeba histolytica
FDSSNSQF

SEQ ID NO: 2562914 - protein, 4 aa, Entamoeba histolytica
FDTE

SEQ ID NO: 2562915 - protein, 10 aa, Entamoeba histolytica
FDTPDKTKDI

SEQ ID NO: 2562916 - protein, 7 aa, Entamoeba histolytica
FDTPQNL

SEQ ID NO: 2562917 - protein, 7 aa, Entamoeba histolytica
FDTQKAK

SEQ ID NO: 2562918 - protein, 6 aa, Entamoeba histolytica
FDTSDK

SEQ ID NO: 2562919 - protein, 8 aa, Entamoeba histolytica
FDTSDKVS

SEQ ID NO: 2562920 - protein, 10 aa, Entamoeba histolytica
FDTSSFGDIP

SEQ ID NO: 2562921 - protein, 6 aa, Entamoeba histolytica
FDVNGD

SEQ ID NO: 2562922 - protein, 4 aa, Entamoeba histolytica
FDYS

SEQ ID NO: 2562923 - protein, 6 aa, Entamoeba histolytica
FEAGTL

SEQ ID NO: 2562924 - protein, 8 aa, Entamoeba histolytica
FEATNKQL

SEQ ID NO: 2562925 - protein, 5 aa, Entamoeba histolytica
FEDGF

SEQ ID NO: 2562926 - protein, 7 aa, Entamoeba histolytica
FEEDNNE

SEQ ID NO: 2562927 - protein, 9 aa, Entamoeba histolytica
FEEERKRRN

SEQ ID NO: 2562928 - protein, 6 aa, Entamoeba histolytica
FEEETQ

SEQ ID NO: 2562929 - protein, 25 aa, Entamoeba histolytica
FEEGNERKRIKQENDEYKPNCSEYN

SEQ ID NO: 2562930 - protein, 4 aa, Entamoeba histolytica
FEEN

SEQ ID NO: 2562931 - protein, 8 aa, Entamoeba histolytica
FEENEEKD

SEQ ID NO: 2562932 - protein, 8 aa, Entamoeba histolytica
FEESRDGF

SEQ ID NO: 2562933 - protein, 5 aa, Entamoeba histolytica
FEEWN

SEQ ID NO: 2562934 - protein, 12 aa, Entamoeba histolytica
FEEWTSTDQETM

SEQ ID NO: 2562935 - protein, 4 aa, Entamoeba histolytica
FEGG

SEQ ID NO: 2562936 - protein, 10 aa, Entamoeba histolytica
FEKDEPTLLG

SEQ ID NO: 2562937 - protein, 5 aa, Entamoeba histolytica
FEKDP

SEQ ID NO: 2562938 - protein, 11 aa, Entamoeba histolytica
FEKGNGSINTK

SEQ ID NO: 2562939 - protein, 8 aa, Entamoeba histolytica
FEKNEERT

SEQ ID NO: 2562940 - protein, 4 aa, Entamoeba histolytica
FEND

SEQ ID NO: 2562941 - protein, 11 aa, Entamoeba histolytica
FENESQQEKFT

SEQ ID NO: 2562942 - protein, 5 aa, Entamoeba histolytica
FENGK

SEQ ID NO: 2562943 - protein, 20 aa, Entamoeba histolytica
FENPYEPTCADAKTVSFPGT

SEQ ID NO: 2562944 - protein, 7 aa, Entamoeba histolytica
FEPGSVD

SEQ ID NO: 2562945 - protein, 6 aa, Entamoeba histolytica
FEPSTS

SEQ ID NO: 2562946 - protein, 8 aa, Entamoeba histolytica
FEQNQDKK

SEQ ID NO: 2562947 - protein, 7 aa, Entamoeba histolytica
FEQTPTL

SEQ ID NO: 2562948 - protein, 18 aa, Entamoeba histolytica
FERKEEKKEEEKKEKKIG

SEQ ID NO: 2562949 - protein, 32 aa, Entamoeba histolytica
FERSKRSGIRIEESEEENERKRIKQENDEYEP

SEQ ID NO: 2562950 - protein, 5 aa, Entamoeba histolytica
FERTH

SEQ ID NO: 2562951 - protein, 12 aa, Entamoeba histolytica
FESDPQVQADRR

SEQ ID NO: 2562952 - protein, 11 aa, Entamoeba histolytica
FESESDNNDCS

SEQ ID NO: 2562953 - protein, 6 aa, Entamoeba histolytica
FETLPN

SEQ ID NO: 2562954 - protein, 5 aa, Entamoeba histolytica
FETWT

SEQ ID NO: 2562955 - protein, 13 aa, Entamoeba histolytica
FGDEDKKESSIPL

SEQ ID NO: 2562956 - protein, 6 aa, Entamoeba histolytica
FGDGND

SEQ ID NO: 2562957 - protein, 18 aa, Entamoeba histolytica
FGENSKKFTTEKKDTQMN

SEQ ID NO: 2562958 - protein, 11 aa, Entamoeba histolytica
FGEPGKSEIQF

SEQ ID NO: 2562959 - protein, 10 aa, Entamoeba histolytica
FGGDPNGNID

SEQ ID NO: 2562960 - protein, 23 aa, Entamoeba histolytica
FGGEEDPTQQSTRFESDTKTQKF

SEQ ID NO: 2562961 - protein, 5 aa, Entamoeba histolytica
FGGNN

SEQ ID NO: 2562962 - protein, 4 aa, Entamoeba histolytica
FGGT

SEQ ID NO: 2562963 - protein, 15 aa, Entamoeba histolytica
FGGTTLSIGDGANDC

SEQ ID NO: 2562964 - protein, 8 aa, Entamoeba histolytica
FGKENEQQ

SEQ ID NO: 2562965 - protein, 9 aa, Entamoeba histolytica
FGKPGSNQM

SEQ ID NO: 2562966 - protein, 4 aa, Entamoeba histolytica
FGLS

SEQ ID NO: 2562967 - protein, 9 aa, Entamoeba histolytica
FGNEQGKGH

SEQ ID NO: 2562968 - protein, 6 aa, Entamoeba histolytica
FGNKTW

SEQ ID NO: 2562969 - protein, 16 aa, Entamoeba histolytica
FGNMGSKTFSKSNDSY

SEQ ID NO: 2562970 - protein, 19 aa, Entamoeba histolytica
FGNSPVPRKKSPGEETTEL

SEQ ID NO: 2562971 - protein, 10 aa, Entamoeba histolytica
FGNSSNSTNI

SEQ ID NO: 2562972 - protein, 8 aa, Entamoeba histolytica
FGNTSSSS

SEQ ID NO: 2562973 - protein, 4 aa, Entamoeba histolytica
FGNV

SEQ ID NO: 2562974 - protein, 9 aa, Entamoeba histolytica
FGPMSSNIN

SEQ ID NO: 2562975 - protein, 4 aa, Entamoeba histolytica
FGQT

SEQ ID NO: 2562976 - protein, 13 aa, Entamoeba histolytica
FGREGISAKGITE

SEQ ID NO: 2562977 - protein, 6 aa, Entamoeba histolytica
FGRETA

SEQ ID NO: 2562978 - protein, 5 aa, Entamoeba histolytica
FGSAR

SEQ ID NO: 2562979 - protein, 6 aa, Entamoeba histolytica
FGSARS

SEQ ID NO: 2562980 - protein, 5 aa, Entamoeba histolytica
FGSKE

SEQ ID NO: 2562981 - protein, 19 aa, Entamoeba histolytica
FGSSNEEKEEVADVEEESE

SEQ ID NO: 2562982 - protein, 4 aa, Entamoeba histolytica
FGSY

SEQ ID NO: 2562983 - protein, 11 aa, Entamoeba histolytica
FGTDETAKTIN

SEQ ID NO: 2562984 - protein, 4 aa, Entamoeba histolytica
FGTS

SEQ ID NO: 2562985 - protein, 5 aa, Entamoeba histolytica
FGTSR

SEQ ID NO: 2562986 - protein, 19 aa, Entamoeba histolytica
FGTSRFTKRKNNDKGLGTP

SEQ ID NO: 2562987 - protein, 5 aa, Entamoeba histolytica
FGYPT

SEQ ID NO: 2562988 - protein, 10 aa, Entamoeba histolytica
FIDPGQPSSF

SEQ ID NO: 2562989 - protein, 6 aa, Entamoeba histolytica
FIESSG

SEQ ID NO: 2562990 - protein, 6 aa, Entamoeba histolytica
FIESSQ

SEQ ID NO: 2562991 - protein, 6 aa, Entamoeba histolytica
FIESSS

SEQ ID NO: 2562992 - protein, 9 aa, Entamoeba histolytica
FIPNTSKTY

SEQ ID NO: 2562993 - protein, 5 aa, Entamoeba histolytica
FKAGP

SEQ ID NO: 2562994 - protein, 4 aa, Entamoeba histolytica
FKDR

SEQ ID NO: 2562995 - protein, 8 aa, Entamoeba histolytica
FKEDGKQT

SEQ ID NO: 2562996 - protein, 10 aa, Entamoeba histolytica
FKEEEQQDND

SEQ ID NO: 2562997 - protein, 7 aa, Entamoeba histolytica
FKEENKK

SEQ ID NO: 2562998 - protein, 4 aa, Entamoeba histolytica
FKEK

SEQ ID NO: 2562999 - protein, 8 aa, Entamoeba histolytica
FKESYQKF

SEQ ID NO: 2563000 - protein, 13 aa, Entamoeba histolytica
FKETIQRTTISDQ

SEQ ID NO: 2563001 - protein, 6 aa, Entamoeba histolytica
FKGEDH

SEQ ID NO: 2563002 - protein, 16 aa, Entamoeba histolytica
FKGEGDDDDNCSHRDD

SEQ ID NO: 2563003 - protein, 16 aa, Entamoeba histolytica
FKGEGDNDDNCSHRDD

SEQ ID NO: 2563004 - protein, 9 aa, Entamoeba histolytica
FKGEIDKEY

SEQ ID NO: 2563005 - protein, 6 aa, Entamoeba histolytica
FKGSQA

SEQ ID NO: 2563006 - protein, 5 aa, Entamoeba histolytica
FKIPN

SEQ ID NO: 2563007 - protein, 10 aa, Entamoeba histolytica
FKKDENGNCV

SEQ ID NO: 2563008 - protein, 6 aa, Entamoeba histolytica
FKKGDK

SEQ ID NO: 2563009 - protein, 5 aa, Entamoeba histolytica
FKKNG

SEQ ID NO: 2563010 - protein, 11 aa, Entamoeba histolytica
FKKTQNKTPMK

SEQ ID NO: 2563011 - protein, 6 aa, Entamoeba histolytica
FKNEEN

SEQ ID NO: 2563012 - protein, 44 aa, Entamoeba histolytica
FKNKTNKVESSNQIDKIQQESISQTSKLIEKKDKVDEESKKQKA

SEQ ID NO: 2563013 - protein, 9 aa, Entamoeba histolytica
FKNSKSDNI

SEQ ID NO: 2563014 - protein, 4 aa, Entamoeba histolytica
FKPE

SEQ ID NO: 2563015 - protein, 9 aa, Entamoeba histolytica
FKPKPTDIL

SEQ ID NO: 2563016 - protein, 10 aa, Entamoeba histolytica
FKPTDSEPQF

SEQ ID NO: 2563017 - protein, 8 aa, Entamoeba histolytica
FKRGDTPL

SEQ ID NO: 2563018 - protein, 10 aa, Entamoeba histolytica
FKRNDSLQPI

SEQ ID NO: 2563019 - protein, 13 aa, Entamoeba histolytica
FKRNQDSQQLEEQ

SEQ ID NO: 2563020 - protein, 8 aa, Entamoeba histolytica
FKSETEKL

SEQ ID NO: 2563021 - protein, 18 aa, Entamoeba histolytica
FKSKDKEERENQNRRNEY

SEQ ID NO: 2563022 - protein, 7 aa, Entamoeba histolytica
FKTEETK

SEQ ID NO: 2563023 - protein, 6 aa, Entamoeba histolytica
FKTNNN

SEQ ID NO: 2563024 - protein, 8 aa, Entamoeba histolytica
FKTPSDPI

SEQ ID NO: 2563025 - protein, 7 aa, Entamoeba histolytica
FKTPTAI

SEQ ID NO: 2563026 - protein, 7 aa, Entamoeba histolytica
FKTSEGV

SEQ ID NO: 2563027 - protein, 7 aa, Entamoeba histolytica
FKYTQER

SEQ ID NO: 2563028 - protein, 5 aa, Entamoeba histolytica
FLSDG

SEQ ID NO: 2563029 - protein, 17 aa, Entamoeba histolytica
FLSTNNAKCKIKKNQEE

SEQ ID NO: 2563030 - protein, 4 aa, Entamoeba histolytica
FNAS

SEQ ID NO: 2563031 - protein, 4 aa, Entamoeba histolytica
FNDN

SEQ ID NO: 2563032 - protein, 4 aa, Entamoeba histolytica
FNDR

SEQ ID NO: 2563033 - protein, 8 aa, Entamoeba histolytica
FNDSPSNF

SEQ ID NO: 2563034 - protein, 12 aa, Entamoeba histolytica
FNDWSQSDQLQM

SEQ ID NO: 2563035 - protein, 12 aa, Entamoeba histolytica
FNDWTQDNQRQM

SEQ ID NO: 2563036 - protein, 15 aa, Entamoeba histolytica
FNEEEINKQCDDNEK

SEQ ID NO: 2563037 - protein, 7 aa, Entamoeba histolytica
FNEGGKV

SEQ ID NO: 2563038 - protein, 6 aa, Entamoeba histolytica
FNEGSS

SEQ ID NO: 2563039 - protein, 12 aa, Entamoeba histolytica
FNEQNKEETERL

SEQ ID NO: 2563040 - protein, 6 aa, Entamoeba histolytica
FNETDV

SEQ ID NO: 2563041 - protein, 4 aa, Entamoeba histolytica
FNGG

SEQ ID NO: 2563042 - protein, 31 aa, Entamoeba histolytica
FNHEEEKTPDISHEIDNNQNNIIKEEQKQDF

SEQ ID NO: 2563043 - protein, 13 aa, Entamoeba histolytica
FNKHNRSRATEKE

SEQ ID NO: 2563044 - protein, 9 aa, Entamoeba histolytica
FNKKDKKQF

SEQ ID NO: 2563045 - protein, 15 aa, Entamoeba histolytica
FNNDKNESLCRPKSD

SEQ ID NO: 2563046 - protein, 8 aa, Entamoeba histolytica
FNNEKTLE

SEQ ID NO: 2563047 - protein, 7 aa, Entamoeba histolytica
FNNESSV

SEQ ID NO: 2563048 - protein, 7 aa, Entamoeba histolytica
FNPEEIR

SEQ ID NO: 2563049 - protein, 11 aa, Entamoeba histolytica
FNPESLSSLGT

SEQ ID NO: 2563050 - protein, 6 aa, Entamoeba histolytica
FNPQSK

SEQ ID NO: 2563051 - protein, 4 aa, Entamoeba histolytica
FNPS

SEQ ID NO: 2563052 - protein, 9 aa, Entamoeba histolytica
FNPSQGQYG

SEQ ID NO: 2563053 - protein, 4 aa, Entamoeba histolytica
FNQD

SEQ ID NO: 2563054 - protein, 13 aa, Entamoeba histolytica
FNRPEESKNTFTE

SEQ ID NO: 2563055 - protein, 4 aa, Entamoeba histolytica
FNRT

SEQ ID NO: 2563056 - protein, 7 aa, Entamoeba histolytica
FNSAAES

SEQ ID NO: 2563057 - protein, 11 aa, Entamoeba histolytica
FNSEDGCSSCA

SEQ ID NO: 2563058 - protein, 5 aa, Entamoeba histolytica
FNSKE

SEQ ID NO: 2563059 - protein, 9 aa, Entamoeba histolytica
FNSKEQHSN

SEQ ID NO: 2563060 - protein, 19 aa, Entamoeba histolytica
FNSKNAPKFADKEKISHTE

SEQ ID NO: 2563061 - protein, 15 aa, Entamoeba histolytica
FNSNGDKIKVNQETR

SEQ ID NO: 2563062 - protein, 4 aa, Entamoeba histolytica
FNSQ

SEQ ID NO: 2563063 - protein, 8 aa, Entamoeba histolytica
FNTAPNGY

SEQ ID NO: 2563064 - protein, 9 aa, Entamoeba histolytica
FNTDNNKNF

SEQ ID NO: 2563065 - protein, 9 aa, Entamoeba histolytica
FNTKQVSSE

SEQ ID NO: 2563066 - protein, 5 aa, Entamoeba histolytica
FNTNS

SEQ ID NO: 2563067 - protein, 6 aa, Entamoeba histolytica
FNTNTK

SEQ ID NO: 2563068 - protein, 7 aa, Entamoeba histolytica
FNTSDSV

SEQ ID NO: 2563069 - protein, 7 aa, Entamoeba histolytica
FNTSSDI

SEQ ID NO: 2563070 - protein, 8 aa, Entamoeba histolytica
FNTTQENP

SEQ ID NO: 2563071 - protein, 5 aa, Entamoeba histolytica
FPDGE

SEQ ID NO: 2563072 - protein, 8 aa, Entamoeba histolytica
FPECSTNS

SEQ ID NO: 2563073 - protein, 7 aa, Entamoeba histolytica
FPEDETY

SEQ ID NO: 2563074 - protein, 20 aa, Entamoeba histolytica
FPELSPTTPFKKTQNKAPLK

SEQ ID NO: 2563075 - protein, 4 aa, Entamoeba histolytica
FPFP

SEQ ID NO: 2563076 - protein, 4 aa, Entamoeba histolytica
FPIS

SEQ ID NO: 2563077 - protein, 4 aa, Entamoeba histolytica
FPKE

SEQ ID NO: 2563078 - protein, 6 aa, Entamoeba histolytica
FPKNEL

SEQ ID NO: 2563079 - protein, 5 aa, Entamoeba histolytica
FPKPS

SEQ ID NO: 2563080 - protein, 6 aa, Entamoeba histolytica
FPKPTF

SEQ ID NO: 2563081 - protein, 4 aa, Entamoeba histolytica
FPKT

SEQ ID NO: 2563082 - protein, 9 aa, Entamoeba histolytica
FPNEEESVE

SEQ ID NO: 2563083 - protein, 11 aa, Entamoeba histolytica
FPNKFQERPEP

SEQ ID NO: 2563084 - protein, 5 aa, Entamoeba histolytica
FPNNK

SEQ ID NO: 2563085 - protein, 14 aa, Entamoeba histolytica
FPPAKKDKNTEPLM

SEQ ID NO: 2563086 - protein, 12 aa, Entamoeba histolytica
FPPKSSSQIYDE

SEQ ID NO: 2563087 - protein, 15 aa, Entamoeba histolytica
FPPSVSLTKDGTNVN

SEQ ID NO: 2563088 - protein, 6 aa, Entamoeba histolytica
FPRNTS

SEQ ID NO: 2563089 - protein, 6 aa, Entamoeba histolytica
FPSEYE

SEQ ID NO: 2563090 - protein, 8 aa, Entamoeba histolytica
FPSGHSSA

SEQ ID NO: 2563091 - protein, 9 aa, Entamoeba histolytica
FPSHSRTPQ

SEQ ID NO: 2563092 - protein, 5 aa, Entamoeba histolytica
FPSSV

SEQ ID NO: 2563093 - protein, 7 aa, Entamoeba histolytica
FPSTTSA

SEQ ID NO: 2563094 - protein, 4 aa, Entamoeba histolytica
FPSY

SEQ ID NO: 2563095 - protein, 5 aa, Entamoeba histolytica
FPTDT

SEQ ID NO: 2563096 - protein, 25 aa, Entamoeba histolytica
FPTEQQQEKKKENETKIEVNKNEQK

SEQ ID NO: 2563097 - protein, 7 aa, Entamoeba histolytica
FPTKGQD

SEQ ID NO: 2563098 - protein, 6 aa, Entamoeba histolytica
FPTPSF

SEQ ID NO: 2563099 - protein, 8 aa, Entamoeba histolytica
FPTPTSEQ

SEQ ID NO: 2563100 - protein, 5 aa, Entamoeba histolytica
FQAPQ

SEQ ID NO: 2563101 - protein, 6 aa, Entamoeba histolytica
FQDDKP

SEQ ID NO: 2563102 - protein, 6 aa, Entamoeba histolytica
FQEEGK

SEQ ID NO: 2563103 - protein, 5 aa, Entamoeba histolytica
FQEIP

SEQ ID NO: 2563104 - protein, 4 aa, Entamoeba histolytica
FQGN

SEQ ID NO: 2563105 - protein, 10 aa, Entamoeba histolytica
FQGRASNNSF

SEQ ID NO: 2563106 - protein, 7 aa, Entamoeba histolytica
FQPETNK

SEQ ID NO: 2563107 - protein, 4 aa, Entamoeba histolytica
FQPN

SEQ ID NO: 2563108 - protein, 8 aa, Entamoeba histolytica
FQPTDNKT

SEQ ID NO: 2563109 - protein, 8 aa, Entamoeba histolytica
FQPTNKAE

SEQ ID NO: 2563110 - protein, 6 aa, Entamoeba histolytica
FQQTAR

SEQ ID NO: 2563111 - protein, 14 aa, Entamoeba histolytica
FQSLANKKNSVPSI

SEQ ID NO: 2563112 - protein, 13 aa, Entamoeba histolytica
FQTENELKGYSGI

SEQ ID NO: 2563113 - protein, 7 aa, Entamoeba histolytica
FRDGESS

SEQ ID NO: 2563114 - protein, 9 aa, Entamoeba histolytica
FRDKGGADF

SEQ ID NO: 2563115 - protein, 12 aa, Entamoeba histolytica
FREQEDKEAEQG

SEQ ID NO: 2563116 - protein, 13 aa, Entamoeba histolytica
FRGGYGEAAQETS

SEQ ID NO: 2563117 - protein, 5 aa, Entamoeba histolytica
FRGNT

SEQ ID NO: 2563118 - protein, 9 aa, Entamoeba histolytica
FRKASTDLK

SEQ ID NO: 2563119 - protein, 9 aa, Entamoeba histolytica
FRKQEDKEV

SEQ ID NO: 2563120 - protein, 11 aa, Entamoeba histolytica
FRREPKTKGEM

SEQ ID NO: 2563121 - protein, 22 aa, Entamoeba histolytica
FRSNSFSETASDVWSSPTCPCT

SEQ ID NO: 2563122 - protein, 4 aa, Entamoeba histolytica
FRSP

SEQ ID NO: 2563123 - protein, 9 aa, Entamoeba histolytica
FSARQNEQV

SEQ ID NO: 2563124 - protein, 9 aa, Entamoeba histolytica
FSCTSSTKI

SEQ ID NO: 2563125 - protein, 13 aa, Entamoeba histolytica
FSDEDRENSTKTL

SEQ ID NO: 2563126 - protein, 15 aa, Entamoeba histolytica
FSDSQEALGKSTLTE

SEQ ID NO: 2563127 - protein, 5 aa, Entamoeba histolytica
FSDSS

SEQ ID NO: 2563128 - protein, 5 aa, Entamoeba histolytica
FSEEI

SEQ ID NO: 2563129 - protein, 10 aa, Entamoeba histolytica
FSEKGKNSEM

SEQ ID NO: 2563130 - protein, 7 aa, Entamoeba histolytica
FSENEYE

SEQ ID NO: 2563131 - protein, 11 aa, Entamoeba histolytica
FSEQQSLGEQL

SEQ ID NO: 2563132 - protein, 8 aa, Entamoeba histolytica
FSESNNYK

SEQ ID NO: 2563133 - protein, 11 aa, Entamoeba histolytica
FSGDTSTQEAM

SEQ ID NO: 2563134 - protein, 29 aa, Entamoeba histolytica
FSGKQGVPSTTATTTKSKAKGSGKQSNVK

SEQ ID NO: 2563135 - protein, 5 aa, Entamoeba histolytica
FSGKY

SEQ ID NO: 2563136 - protein, 11 aa, Entamoeba histolytica
FSGNKQNQYRP

SEQ ID NO: 2563137 - protein, 5 aa, Entamoeba histolytica
FSGQS

SEQ ID NO: 2563138 - protein, 8 aa, Entamoeba histolytica
FSGRKMSK

SEQ ID NO: 2563139 - protein, 10 aa, Entamoeba histolytica
FSGTKKGETI

SEQ ID NO: 2563140 - protein, 6 aa, Entamoeba histolytica
FSGTTS

SEQ ID NO: 2563141 - protein, 26 aa, Entamoeba histolytica
FSKNGDNLKGKVYTEADCKGNSIEGE

SEQ ID NO: 2563142 - protein, 11 aa, Entamoeba histolytica
FSKSNGTGVFG

SEQ ID NO: 2563143 - protein, 7 aa, Entamoeba histolytica
FSKTTSA

SEQ ID NO: 2563144 - protein, 12 aa, Entamoeba histolytica
FSNGKGGSAQRM

SEQ ID NO: 2563145 - protein, 9 aa, Entamoeba histolytica
FSNGKNDYH

SEQ ID NO: 2563146 - protein, 8 aa, Entamoeba histolytica
FSNPDSSD

SEQ ID NO: 2563147 - protein, 9 aa, Entamoeba histolytica
FSNPNSSDR

SEQ ID NO: 2563148 - protein, 5 aa, Entamoeba histolytica
FSNTN

SEQ ID NO: 2563149 - protein, 7 aa, Entamoeba histolytica
FSPDQYS

SEQ ID NO: 2563150 - protein, 9 aa, Entamoeba histolytica
FSPSPSYAT

SEQ ID NO: 2563151 - protein, 7 aa, Entamoeba histolytica
FSQEDEI

SEQ ID NO: 2563152 - protein, 23 aa, Entamoeba histolytica
FSRPRSFTKHSRGNTKNLPSLNP

SEQ ID NO: 2563153 - protein, 12 aa, Entamoeba histolytica
FSRSKQYDTFPS

SEQ ID NO: 2563154 - protein, 12 aa, Entamoeba histolytica
FSRTPNSPMPDF

SEQ ID NO: 2563155 - protein, 8 aa, Entamoeba histolytica
FSSDAQTC

SEQ ID NO: 2563156 - protein, 6 aa, Entamoeba histolytica
FSSDEE

SEQ ID NO: 2563157 - protein, 30 aa, Entamoeba histolytica
FSSDESQETQEQEEVQNEEIQQNEQEQNER

SEQ ID NO: 2563158 - protein, 5 aa, Entamoeba histolytica
FSSET

SEQ ID NO: 2563159 - protein, 11 aa, Entamoeba histolytica
FSSGGSYTISN

SEQ ID NO: 2563160 - protein, 5 aa, Entamoeba histolytica
FSSGR

SEQ ID NO: 2563161 - protein, 7 aa, Entamoeba histolytica
FSSKQPM

SEQ ID NO: 2563162 - protein, 5 aa, Entamoeba histolytica
FSSNT

SEQ ID NO: 2563163 - protein, 8 aa, Entamoeba histolytica
FSSSKKKN

SEQ ID NO: 2563164 - protein, 5 aa, Entamoeba histolytica
FSSTD

SEQ ID NO: 2563165 - protein, 15 aa, Entamoeba histolytica
FSSTSAVQITNSEPI

SEQ ID NO: 2563166 - protein, 12 aa, Entamoeba histolytica
FSSTTKLDGNTL

SEQ ID NO: 2563167 - protein, 8 aa, Entamoeba histolytica
FSTDTEQY

SEQ ID NO: 2563168 - protein, 5 aa, Entamoeba histolytica
FSTEL

SEQ ID NO: 2563169 - protein, 6 aa, Entamoeba histolytica
FSTITD

SEQ ID NO: 2563170 - protein, 4 aa, Entamoeba histolytica
FSTQ

SEQ ID NO: 2563171 - protein, 10 aa, Entamoeba histolytica
FSTSFKQQEM

SEQ ID NO: 2563172 - protein, 5 aa, Entamoeba histolytica
FSTST

SEQ ID NO: 2563173 - protein, 4 aa, Entamoeba histolytica
FSWP

SEQ ID NO: 2563174 - protein, 4 aa, Entamoeba histolytica
FSYD

SEQ ID NO: 2563175 - protein, 10 aa, Entamoeba histolytica
FSYQDTYNEV

SEQ ID NO: 2563176 - protein, 11 aa, Entamoeba histolytica
FTDTGSSSECT

SEQ ID NO: 2563177 - protein, 5 aa, Entamoeba histolytica
FTDTN

SEQ ID NO: 2563178 - protein, 10 aa, Entamoeba histolytica
FTEAKGDFVE

SEQ ID NO: 2563179 - protein, 4 aa, Entamoeba histolytica
FTEE

SEQ ID NO: 2563180 - protein, 14 aa, Entamoeba histolytica
FTEEENKRKKSELR

SEQ ID NO: 2563181 - protein, 5 aa, Entamoeba histolytica
FTGGE

SEQ ID NO: 2563182 - protein, 8 aa, Entamoeba histolytica
FTHPSSDL

SEQ ID NO: 2563183 - protein, 5 aa, Entamoeba histolytica
FTKGN

SEQ ID NO: 2563184 - protein, 5 aa, Entamoeba histolytica
FTKSQ

SEQ ID NO: 2563185 - protein, 11 aa, Entamoeba histolytica
FTLTDNNPSTW

SEQ ID NO: 2563186 - protein, 17 aa, Entamoeba histolytica
FTNGSGEGQCHYGEPGC

SEQ ID NO: 2563187 - protein, 10 aa, Entamoeba histolytica
FTNKNVPYNT

SEQ ID NO: 2563188 - protein, 8 aa, Entamoeba histolytica
FTNNGERY

SEQ ID NO: 2563189 - protein, 4 aa, Entamoeba histolytica
FTPK

SEQ ID NO: 2563190 - protein, 5 aa, Entamoeba histolytica
FTPPQ

SEQ ID NO: 2563191 - protein, 5 aa, Entamoeba histolytica
FTPPV

SEQ ID NO: 2563192 - protein, 5 aa, Entamoeba histolytica
FTQDN

SEQ ID NO: 2563193 - protein, 6 aa, Entamoeba histolytica
FTQERK

SEQ ID NO: 2563194 - protein, 10 aa, Entamoeba histolytica
FTQSTDGSAH

SEQ ID NO: 2563195 - protein, 15 aa, Entamoeba histolytica
FTQTKDKCNPHAPSY

SEQ ID NO: 2563196 - protein, 5 aa, Entamoeba histolytica
FTRSE

SEQ ID NO: 2563197 - protein, 4 aa, Entamoeba histolytica
FTRT

SEQ ID NO: 2563198 - protein, 8 aa, Entamoeba histolytica
FTSDESND

SEQ ID NO: 2563199 - protein, 12 aa, Entamoeba histolytica
FTSEEKTSCNTG

SEQ ID NO: 2563200 - protein, 8 aa, Entamoeba histolytica
FTSPDSKK

SEQ ID NO: 2563201 - protein, 11 aa, Entamoeba histolytica
FTSPQQPQNEI

SEQ ID NO: 2563202 - protein, 10 aa, Entamoeba histolytica
FTTAAPYSKN

SEQ ID NO: 2563203 - protein, 8 aa, Entamoeba histolytica
FTTEPQKY

SEQ ID NO: 2563204 - protein, 6 aa, Entamoeba histolytica
FTTETQ

SEQ ID NO: 2563205 - protein, 9 aa, Entamoeba histolytica
FTTNGNPTT

SEQ ID NO: 2563206 - protein, 6 aa, Entamoeba histolytica
FTTPDD

SEQ ID NO: 2563207 - protein, 5 aa, Entamoeba histolytica
FTTTN

SEQ ID NO: 2563208 - protein, 6 aa, Entamoeba histolytica
FTTTQP

SEQ ID NO: 2563209 - protein, 4 aa, Entamoeba histolytica
FTVS

SEQ ID NO: 2563210 - protein, 48 aa, Entamoeba histolytica; identical to SEQ ID NO: 2364104

SEQ ID NO: 2563211 - protein, 38 aa, Entamoeba histolytica
FYQNSQKSSSCKPCSSSCSTCSKSTGECQSCKKGYGLS

SEQ ID NO: 2563212 - protein, 6 aa, Entamoeba histolytica
FYSDGT

SEQ ID NO: 2563213 - protein, 13 aa, Entamoeba histolytica
GAAVGDNPNAEKI

SEQ ID NO: 2563214 - protein, 4 aa, Entamoeba histolytica
GACN

SEQ ID NO: 2563215 - protein, 8 aa, Entamoeba histolytica
GAEPDIDT

SEQ ID NO: 2563216 - protein, 9 aa, Entamoeba histolytica
GAEQNGEVA

SEQ ID NO: 2563217 - protein, 7 aa, Entamoeba histolytica
GAETPEK

SEQ ID NO: 2563218 - protein, 9 aa, Entamoeba histolytica
GAGSVNEAL

SEQ ID NO: 2563219 - protein, 9 aa, Entamoeba histolytica
GAIPKTSTT

SEQ ID NO: 2563220 - protein, 6 aa, Entamoeba histolytica
GAITTC

SEQ ID NO: 2563221 - protein, 5 aa, Entamoeba histolytica
GAIYN

SEQ ID NO: 2563222 - protein, 6 aa, Entamoeba histolytica
GAKKGI

SEQ ID NO: 2563223 - protein, 33 aa, Entamoeba histolytica
GAKRFGYNGGDKNEVKEDCTCTSVDGKWDKDDC

SEQ ID NO: 2563224 - protein, 8 aa, Entamoeba histolytica
GAKTKTQK

SEQ ID NO: 2563225 - protein, 5 aa, Entamoeba histolytica
GALDN

SEQ ID NO: 2563226 - protein, 25 aa, Entamoeba histolytica
GALKNSIKHSGNSQFKYTSDDNNVK

SEQ ID NO: 2563227 - protein, 6 aa, Entamoeba histolytica
GANDTQ

SEQ ID NO: 2563228 - protein, 4 aa, Entamoeba histolytica
GANG

SEQ ID NO: 2563229 - protein, 7 aa, Entamoeba histolytica
GANGGTN

SEQ ID NO: 2563230 - protein, 8 aa, Entamoeba histolytica
GANPEKVT

SEQ ID NO: 2563231 - protein, 11 aa, Entamoeba histolytica
GAPEELKKTCP

SEQ ID NO: 2563232 - protein, 5 aa, Entamoeba histolytica
GAPLY

SEQ ID NO: 2563233 - protein, 9 aa, Entamoeba histolytica
GAPNESESI

SEQ ID NO: 2563234 - protein, 5 aa, Entamoeba histolytica
GAQSD

SEQ ID NO: 2563235 - protein, 9 aa, Entamoeba histolytica
GAQSSGKST

SEQ ID NO: 2563236 - protein, 4 aa, Entamoeba histolytica
GARS

SEQ ID NO: 2563237 - protein, 14 aa, Entamoeba histolytica
GARSKWSCDEEKES

SEQ ID NO: 2563238 - protein, 7 aa, Entamoeba histolytica
GARTTVE

SEQ ID NO: 2563239 - protein, 10 aa, Entamoeba histolytica
GASEGVGKSF

SEQ ID NO: 2563240 - protein, 37 aa, Entamoeba histolytica
GASGTNKRCSLAETGSLSKRRSESLSPDEGGERLASK

SEQ ID NO: 2563241 - protein, 8 aa, Entamoeba histolytica
GASQGEMN

SEQ ID NO: 2563242 - protein, 10 aa, Entamoeba histolytica
GASRNDKTTQ

SEQ ID NO: 2563243 - protein, 4 aa, Entamoeba histolytica
GAVG

SEQ ID NO: 2563244 - protein, 8 aa, Entamoeba histolytica
GAVPDVTN

SEQ ID NO: 2563245 - protein, 4 aa, Entamoeba histolytica
GAYD

SEQ ID NO: 2563246 - protein, 7 aa, Entamoeba histolytica
GAYGTEP

SEQ ID NO: 2563247 - protein, 7 aa, Entamoeba histolytica
GCAKPTK

SEQ ID NO: 2563248 - protein, 6 aa, Entamoeba histolytica
GCDGPN

SEQ ID NO: 2563249 - protein, 5 aa, Entamoeba histolytica
GCETS

SEQ ID NO: 2563250 - protein, 10 aa, Entamoeba histolytica
GCGDEGRTRA

SEQ ID NO: 2563251 - protein, 9 aa, Entamoeba histolytica
GCGDRENRV

SEQ ID NO: 2563252 - protein, 5 aa, Entamoeba histolytica
GCGNA

SEQ ID NO: 2563253 - protein, 13 aa, Entamoeba histolytica
GCGQSQNDDPEGV

SEQ ID NO: 2563254 - protein, 7 aa, Entamoeba histolytica
GCGSSSN

SEQ ID NO: 2563255 - protein, 18 aa, Entamoeba histolytica
GCKDCQPGYYKNTTGKSC

SEQ ID NO: 2563256 - protein, 7 aa, Entamoeba histolytica
GCKKCEN

SEQ ID NO: 2563257 - protein, 5 aa, Entamoeba histolytica
GCNEN

SEQ ID NO: 2563258 - protein, 10 aa, Entamoeba histolytica
GCNEPAKTKY

SEQ ID NO: 2563259 - protein, 6 aa, Entamoeba histolytica
GCNKPD

SEQ ID NO: 2563260 - protein, 8 aa, Entamoeba histolytica
GCPCDGSQ

SEQ ID NO: 2563261 - protein, 11 aa, Entamoeba histolytica
GCPCNTNPTFG

SEQ ID NO: 2563262 - protein, 11 aa, Entamoeba histolytica
GCSNDPKGQAK

SEQ ID NO: 2563263 - protein, 7 aa, Entamoeba histolytica
GCTECGN

SEQ ID NO: 2563264 - protein, 12 aa, Entamoeba histolytica
GCTQGSYCPGND

SEQ ID NO: 2563265 - protein, 7 aa, Entamoeba histolytica
GCYTPDE

SEQ ID NO: 2563266 - protein, 9 aa, Entamoeba histolytica
GDAKAEQKE

SEQ ID NO: 2563267 - protein, 13 aa, Entamoeba histolytica
GDAPIAEATEGCG

SEQ ID NO: 2563268 - protein, 7 aa, Entamoeba histolytica
GDAYTNG

SEQ ID NO: 2563269 - protein, 8 aa, Entamoeba histolytica
GDDEGGDS

SEQ ID NO: 2563270 - protein, 29 aa, Entamoeba histolytica
GDDGKRVDKGIKYDTSSIQVPENDCQSSG

SEQ ID NO: 2563271 - protein, 9 aa, Entamoeba histolytica
GDDGKWSTE

SEQ ID NO: 2563272 - protein, 18 aa, Entamoeba histolytica
GDDIPKEDVKDIDGEIQE

SEQ ID NO: 2563273 - protein, 5 aa, Entamoeba histolytica
GDDNV

SEQ ID NO: 2563274 - protein, 4 aa, Entamoeba histolytica
GDDP

SEQ ID NO: 2563275 - protein, 7 aa, Entamoeba histolytica
GDDVKEM

SEQ ID NO: 2563276 - protein, 15 aa, Entamoeba histolytica
GDECTFGSNGFSQEE

SEQ ID NO: 2563277 - protein, 14 aa, Entamoeba histolytica
GDEEMKKKFSSAMK

SEQ ID NO: 2563278 - protein, 6 aa, Entamoeba histolytica
GDEGCR

SEQ ID NO: 2563279 - protein, 31 aa, Entamoeba histolytica
GDEIVKQENDGLDHQDEMTEGDNLEEGYDDT

SEQ ID NO: 2563280 - protein, 4 aa, Entamoeba histolytica
GDEL

SEQ ID NO: 2563281 - protein, 7 aa, Entamoeba histolytica
GDENQTR

SEQ ID NO: 2563282 - protein, 15 aa, Entamoeba histolytica
GDENTTPLQPIPTTS

SEQ ID NO: 2563283 - protein, 7 aa, Entamoeba histolytica
GDEPNWK

SEQ ID NO: 2563284 - protein, 7 aa, Entamoeba histolytica
GDETIAN

SEQ ID NO: 2563285 - protein, 6 aa, Entamoeba histolytica
GDGAND

SEQ ID NO: 2563286 - protein, 4 aa, Entamoeba histolytica
GDGC

SEQ ID NO: 2563287 - protein, 7 aa, Entamoeba histolytica
GDGGNDI

SEQ ID NO: 2563288 - protein, 6 aa, Entamoeba histolytica
GDGKAD

SEQ ID NO: 2563289 - protein, 6 aa, Entamoeba histolytica
GDGNDI

SEQ ID NO: 2563290 - protein, 6 aa, Entamoeba histolytica
GDGNQI

SEQ ID NO: 2563291 - protein, 4 aa, Entamoeba histolytica
GDGR

SEQ ID NO: 2563292 - protein, 5 aa, Entamoeba histolytica
GDGRR

SEQ ID NO: 2563293 - protein, 14 aa, Entamoeba histolytica
GDGVNDAPAIKSSN

SEQ ID NO: 2563294 - protein, 6 aa, Entamoeba histolytica
GDGYCN

SEQ ID NO: 2563295 - protein, 10 aa, Entamoeba histolytica
GDHPKTAGAI

SEQ ID NO: 2563296 - protein, 19 aa, Entamoeba histolytica
GDIEMSEEVKNKTEQPVEN

SEQ ID NO: 2563297 - protein, 9 aa, Entamoeba histolytica
GDIENEESS

SEQ ID NO: 2563298 - protein, 5 aa, Entamoeba histolytica
GDINS

SEQ ID NO: 2563299 - protein, 8 aa, Entamoeba histolytica
GDIQTSEN

SEQ ID NO: 2563300 - protein, 19 aa, Entamoeba histolytica
GDISVSEKTSLLTGQQETI

SEQ ID NO: 2563301 - protein, 6 aa, Entamoeba histolytica
GDITSE

SEQ ID NO: 2563302 - protein, 9 aa, Entamoeba histolytica
GDKEETGIA

SEQ ID NO: 2563303 - protein, 5 aa, Entamoeba histolytica
GDKIQ

SEQ ID NO: 2563304 - protein, 9 aa, Entamoeba histolytica
GDKKETAFN

SEQ ID NO: 2563305 - protein, 8 aa, Entamoeba histolytica
GDKSFKES

SEQ ID NO: 2563306 - protein, 7 aa, Entamoeba histolytica
GDKSKCN

SEQ ID NO: 2563307 - protein, 16 aa, Entamoeba histolytica
GDKSKEGFSPIGNDNK

SEQ ID NO: 2563308 - protein, 8 aa, Entamoeba histolytica
GDKYLDNG

SEQ ID NO: 2563309 - protein, 8 aa, Entamoeba histolytica
GDLDGSQD

SEQ ID NO: 2563310 - protein, 8 aa, Entamoeba histolytica
GDMPDVDD

SEQ ID NO: 2563311 - protein, 5 aa, Entamoeba histolytica
GDMST

SEQ ID NO: 2563312 - protein, 5 aa, Entamoeba histolytica
GDNEE

SEQ ID NO: 2563313 - protein, 5 aa, Entamoeba histolytica
GDNGG

SEQ ID NO: 2563314 - protein, 7 aa, Entamoeba histolytica
GDNIPTD

SEQ ID NO: 2563315 - protein, 5 aa, Entamoeba histolytica
GDNKG

SEQ ID NO: 2563316 - protein, 8 aa, Entamoeba histolytica
GDNNTNTS

SEQ ID NO: 2563317 - protein, 5 aa, Entamoeba histolytica
GDPDK

SEQ ID NO: 2563318 - protein, 9 aa, Entamoeba histolytica
GDPEGEKEL

SEQ ID NO: 2563319 - protein, 9 aa, Entamoeba histolytica
GDPYGKDEE

SEQ ID NO: 2563320 - protein, 25 aa, Entamoeba histolytica
GDQITATEEKCKNEEKQRKMENEYL

SEQ ID NO: 2563321 - protein, 10 aa, Entamoeba histolytica
GDQNDKIKET

SEQ ID NO: 2563322 - protein, 8 aa, Entamoeba histolytica
GDREGGAV

SEQ ID NO: 2563323 - protein, 8 aa, Entamoeba histolytica
GDRSELDD

SEQ ID NO: 2563324 - protein, 5 aa, Entamoeba histolytica
GDSDL

SEQ ID NO: 2563325 - protein, 5 aa, Entamoeba histolytica
GDSIG

SEQ ID NO: 2563326 - protein, 12 aa, Entamoeba histolytica
GDSISSLDKTTV

SEQ ID NO: 2563327 - protein, 8 aa, Entamoeba histolytica
GDSISVTG

SEQ ID NO: 2563328 - protein, 8 aa, Entamoeba histolytica
GDSKEKKL

SEQ ID NO: 2563329 - protein, 8 aa, Entamoeba histolytica
GDSTNGSS

SEQ ID NO: 2563330 - protein, 8 aa, Entamoeba histolytica
GDTKEDKI

SEQ ID NO: 2563331 - protein, 5 aa, Entamoeba histolytica
GDTNK

SEQ ID NO: 2563332 - protein, 11 aa, Entamoeba histolytica
GDTSKSPVSGS

SEQ ID NO: 2563333 - protein, 23 aa, Entamoeba histolytica
GDTTKSQTRDVDVQSGEGDRSDV

SEQ ID NO: 2563334 - protein, 9 aa, Entamoeba histolytica
GDVEKDRDL

SEQ ID NO: 2563335 - protein, 6 aa, Entamoeba histolytica
GDVPSN

SEQ ID NO: 2563336 - protein, 13 aa, Entamoeba histolytica
GDVQNFLNEHKYQ

SEQ ID NO: 2563337 - protein, 9 aa, Entamoeba histolytica
GDYHSSSKS

SEQ ID NO: 2563338 - protein, 10 aa, Entamoeba histolytica
GDYKNEDQCY

SEQ ID NO: 2563339 - protein, 5 aa, Entamoeba histolytica
GDYPK

SEQ ID NO: 2563340 - protein, 5 aa, Entamoeba histolytica
GDYQK

SEQ ID NO: 2563341 - protein, 4 aa, Entamoeba histolytica
GDYS

SEQ ID NO: 2563342 - protein, 9 aa, Entamoeba histolytica
GDYSEKGSV

SEQ ID NO: 2563343 - protein, 4 aa, Entamoeba histolytica
GEAC

SEQ ID NO: 2563344 - protein, 15 aa, Entamoeba histolytica
GECGKPFKYKPNNKR

SEQ ID NO: 2563345 - protein, 5 aa, Entamoeba histolytica
GECIN

SEQ ID NO: 2563346 - protein, 8 aa, Entamoeba histolytica
GECKKGQV

SEQ ID NO: 2563347 - protein, 9 aa, Entamoeba histolytica
GECQAPDEY

SEQ ID NO: 2563348 - protein, 12 aa, Entamoeba histolytica
GECSTKTKQCTS

SEQ ID NO: 2563349 - protein, 4 aa, Entamoeba histolytica
GECY

SEQ ID NO: 2563350 - protein, 16 aa, Entamoeba histolytica
GEDCDPSVSPDPLCDS

SEQ ID NO: 2563351 - protein, 4 aa, Entamoeba histolytica
GEDF

SEQ ID NO: 2563352 - protein, 6 aa, Entamoeba histolytica
GEDGTI

SEQ ID NO: 2563353 - protein, 4 aa, Entamoeba histolytica
GEDM

SEQ ID NO: 2563354 - protein, 7 aa, Entamoeba histolytica
GEDNKGY

SEQ ID NO: 2563355 - protein, 4 aa, Entamoeba histolytica
GEDP

SEQ ID NO: 2563356 - protein, 10 aa, Entamoeba histolytica
GEDQKDRDAD

SEQ ID NO: 2563357 - protein, 10 aa, Entamoeba histolytica
GEDQSKLYNV

SEQ ID NO: 2563358 - protein, 27 aa, Entamoeba histolytica
GEECDGGEGCTEECTCDRSKNYEYSNS

SEQ ID NO: 2563359 - protein, 11 aa, Entamoeba histolytica
GEECDGGTNCD

SEQ ID NO: 2563360 - protein, 13 aa, Entamoeba histolytica
GEEDIKKLNSEKG

SEQ ID NO: 2563361 - protein, 4 aa, Entamoeba histolytica
GEEL

SEQ ID NO: 2563362 - protein, 12 aa, Entamoeba histolytica
GEENDRDETEQK

SEQ ID NO: 2563363 - protein, 11 aa, Entamoeba histolytica
GEENGHDSVGV

SEQ ID NO: 2563364 - protein, 6 aa, Entamoeba histolytica
GEEQAD

SEQ ID NO: 2563365 - protein, 18 aa, Entamoeba histolytica
GEESTDTINVGNGGKSKL

SEQ ID NO: 2563366 - protein, 7 aa, Entamoeba histolytica
GEEVEGE

SEQ ID NO: 2563367 - protein, 4 aa, Entamoeba histolytica
GEEY

SEQ ID NO: 2563368 - protein, 4 aa, Entamoeba histolytica
GEFN

SEQ ID NO: 2563369 - protein, 4 aa, Entamoeba histolytica
GEGC

SEQ ID NO: 2563370 - protein, 6 aa, Entamoeba histolytica
GEGDRS

SEQ ID NO: 2563371 - protein, 7 aa, Entamoeba histolytica
GEGDRSG

SEQ ID NO: 2563372 - protein, 8 aa, Entamoeba histolytica
GEGELEKG

SEQ ID NO: 2563373 - protein, 10 aa, Entamoeba histolytica
GEGKPSSTLN

SEQ ID NO: 2563374 - protein, 13 aa, Entamoeba histolytica
GEGKPVEGDCPER

SEQ ID NO: 2563375 - protein, 4 aa, Entamoeba histolytica
GEGM

SEQ ID NO: 2563376 - protein, 4 aa, Entamoeba histolytica
GEGS

SEQ ID NO: 2563377 - protein, 5 aa, Entamoeba histolytica
GEGTY

SEQ ID NO: 2563378 - protein, 9 aa, Entamoeba histolytica
GEHGELDEG

SEQ ID NO: 2563379 - protein, 15 aa, Entamoeba histolytica
GEHQNIPNNSQTGIH

SEQ ID NO: 2563380 - protein, 6 aa, Entamoeba histolytica
GEHSKK

SEQ ID NO: 2563381 - protein, 5 aa, Entamoeba histolytica
GEIAS

SEQ ID NO: 2563382 - protein, 8 aa, Entamoeba histolytica
GEIETSVK

SEQ ID NO: 2563383 - protein, 6 aa, Entamoeba histolytica
GEIKTG

SEQ ID NO: 2563384 - protein, 8 aa, Entamoeba histolytica
GEINEPPK

SEQ ID NO: 2563385 - protein, 5 aa, Entamoeba histolytica
GEITS

SEQ ID NO: 2563386 - protein, 8 aa, Entamoeba histolytica
GEKELRGD

SEQ ID NO: 2563387 - protein, 14 aa, Entamoeba histolytica
GEKETKKYQYQTSE

SEQ ID NO: 2563388 - protein, 5 aa, Entamoeba histolytica
GEKMD

SEQ ID NO: 2563389 - protein, 11 aa, Entamoeba histolytica
GEKREKGKENC

SEQ ID NO: 2563390 - protein, 9 aa, Entamoeba histolytica
GEKSYKENA

SEQ ID NO: 2563391 - protein, 6 aa, Entamoeba histolytica
GEKTGF

SEQ ID NO: 2563392 - protein, 13 aa, Entamoeba histolytica
GELDNEEDGLSGG

SEQ ID NO: 2563393 - protein, 9 aa, Entamoeba histolytica
GELNGGPDV

SEQ ID NO: 2563394 - protein, 7 aa, Entamoeba histolytica
GELQLSN

SEQ ID NO: 2563395 - protein, 7 aa, Entamoeba histolytica
GELSSKN

SEQ ID NO: 2563396 - protein, 4 aa, Entamoeba histolytica
GEMG

SEQ ID NO: 2563397 - protein, 8 aa, Entamoeba histolytica
GENDQPHL

SEQ ID NO: 2563398 - protein, 4 aa, Entamoeba histolytica
GENG

SEQ ID NO: 2563399 - protein, 9 aa, Entamoeba histolytica
GEPKEIQSK

SEQ ID NO: 2563400 - protein, 10 aa, Entamoeba histolytica
GEPYRKNITE

SEQ ID NO: 2563401 - protein, 7 aa, Entamoeba histolytica
GEQLRGV

SEQ ID NO: 2563402 - protein, 4 aa, Entamoeba histolytica
GERA

SEQ ID NO: 2563403 - protein, 6 aa, Entamoeba histolytica
GEREKD

SEQ ID NO: 2563404 - protein, 14 aa, Entamoeba histolytica
GERGAALSGGQKQR

SEQ ID NO: 2563405 - protein, 5 aa, Entamoeba histolytica
GERHE

SEQ ID NO: 2563406 - protein, 6 aa, Entamoeba histolytica
GERNKG

SEQ ID NO: 2563407 - protein, 17 aa, Entamoeba histolytica
GESEKTKVCGYSNQDGF

SEQ ID NO: 2563408 - protein, 20 aa, Entamoeba histolytica
GESEPENELSYDDKFKTNKF

SEQ ID NO: 2563409 - protein, 4 aa, Entamoeba histolytica
GESF

SEQ ID NO: 2563410 - protein, 7 aa, Entamoeba histolytica
GESFPQE

SEQ ID NO: 2563411 - protein, 5 aa, Entamoeba histolytica
GESIS

SEQ ID NO: 2563412 - protein, 10 aa, Entamoeba histolytica
GESKEEFNYE

SEQ ID NO: 2563413 - protein, 9 aa, Entamoeba histolytica
GESKLTGGV

SEQ ID NO: 2563414 - protein, 16 aa, Entamoeba histolytica
GESKPIENKKEEVNMS

SEQ ID NO: 2563415 - protein, 5 aa, Entamoeba histolytica
GESLT

SEQ ID NO: 2563416 - protein, 9 aa, Entamoeba histolytica
GESNSHEKA

SEQ ID NO: 2563417 - protein, 9 aa, Entamoeba histolytica
GESPDSSYL

SEQ ID NO: 2563418 - protein, 7 aa, Entamoeba histolytica
GESPQWS

SEQ ID NO: 2563419 - protein, 8 aa, Entamoeba histolytica
GESTLKGK

SEQ ID NO: 2563420 - protein, 6 aa, Entamoeba histolytica
GESTYD

SEQ ID NO: 2563421 - protein, 7 aa, Entamoeba histolytica
GESVAVT

SEQ ID NO: 2563422 - protein, 7 aa, Entamoeba histolytica
GETDRTE

SEQ ID NO: 2563423 - protein, 24 aa, Entamoeba histolytica
GETEISTRLDPDEIKEEKKIGEGS

SEQ ID NO: 2563424 - protein, 24 aa, Entamoeba histolytica
GETEISTRLDPDEIKEEKKIGEGT

SEQ ID NO: 2563425 - protein, 7 aa, Entamoeba histolytica
GETEITT

SEQ ID NO: 2563426 - protein, 7 aa, Entamoeba histolytica
GETEKDV

SEQ ID NO: 2563427 - protein, 334 aa, Entamoeba histolytica
GETGVDEKLTTDKGAEEPTAGTTGDQKVSNPKEELQESNIESGTPSKKNEQAINGKESTATSVGQESKQTIAEGGSSITKEDKGTGSGITGQPETGDKKTESTETKTDAQRVTEAEGTDSKVSGVGKTNDNEGPEKAKQETEEKDGKAADSHDNGNTNPVTNTENTGNVDKGDTKKDETVDHNKTGKGEVSTKDSGTGSSEQSQQGEKPGSADNNEQENKGTDGSNTSGKEGQNGSAGENGKDDKGSTEQSPNNGQKEQPNKDGPTGEDKKDDGKGDSEENGKDSKGTDEQKDGMNNQNGQKDKGNKETDNKTTSSSDSSESKSDDDLNNHKNI

SEQ ID NO: 2563428 - protein, 226 aa, Entamoeba histolytica
GETGVDEKLTTDKGAEEPTSTQSTKEAVPTSEQAVPKETQETKGSDVDSTTGEKQPKDITTEETTSAETTKQQTESQKSSTPKAPQSENSDKTKQQQKDHNPSSQGEENKKQKDKKQSETQTPSTQGGNQQKEKSEKTQENGDNKNNEIPKTQDDAKDKQEKKDNDSQQKNNNNQQTNNNPEDEKTHEPNKNENKESDTKQSNNDESETDNSTDNDINNQKSIDGT

SEQ ID NO: 2563429 - protein, 7 aa, Entamoeba histolytica
GETKSIN

SEQ ID NO: 2563430 - protein, 4 aa, Entamoeba histolytica
GETN

SEQ ID NO: 2563431 - protein, 5 aa, Entamoeba histolytica
GETST

SEQ ID NO: 2563432 - protein, 10 aa, Entamoeba histolytica
GETSYSSTLS

SEQ ID NO: 2563433 - protein, 9 aa, Entamoeba histolytica
GETTSKDIN

SEQ ID NO: 2563434 - protein, 5 aa, Entamoeba histolytica
GEVIE

SEQ ID NO: 2563435 - protein, 7 aa, Entamoeba histolytica
GEVNNLN

SEQ ID NO: 2563436 - protein, 5 aa, Entamoeba histolytica
GEYIS

SEQ ID NO: 2563437 - protein, 4 aa, Entamoeba histolytica
GEYN

SEQ ID NO: 2563438 - protein, 21 aa, Entamoeba histolytica
GEYPLSSSIASEDAKPHNRGR

SEQ ID NO: 2563439 - protein, 10 aa, Entamoeba histolytica
GEYQDEEGTI

SEQ ID NO: 2563440 - protein, 88 aa, Entamoeba histolytica
GFAPNAKGQCIKSPDDSSYSDDSSNSNNSDDSSNSNNSDGSNNSSNSNNSDGSNNSSNSNNSDGSNNSNSSTTSSAGSNDSSDEKSNT

SEQ ID NO: 2563441 - protein, 6 aa, Entamoeba histolytica
GFDRET

SEQ ID NO: 2563442 - protein, 11 aa, Entamoeba histolytica
GFEEGSSTSIT

SEQ ID NO: 2563443 - protein, 5 aa, Entamoeba histolytica
GFEKP

SEQ ID NO: 2563444 - protein, 8 aa, Entamoeba histolytica
GFETEDNV

SEQ ID NO: 2563445 - protein, 4 aa, Entamoeba histolytica
GFKG

SEQ ID NO: 2563446 - protein, 4 aa, Entamoeba histolytica
GFNA

SEQ ID NO: 2563447 - protein, 6 aa, Entamoeba histolytica
GFNGSS

SEQ ID NO: 2563448 - protein, 7 aa, Entamoeba histolytica
GFNNAKY

SEQ ID NO: 2563449 - protein, 5 aa, Entamoeba histolytica
GFNNE

SEQ ID NO: 2563450 - protein, 5 aa, Entamoeba histolytica
GFPEK

SEQ ID NO: 2563451 - protein, 5 aa, Entamoeba histolytica
GFPER

SEQ ID NO: 2563452 - protein, 4 aa, Entamoeba histolytica
GFPK

SEQ ID NO: 2563453 - protein, 8 aa, Entamoeba histolytica
GFPKDKRE

SEQ ID NO: 2563454 - protein, 5 aa, Entamoeba histolytica
GFPST

SEQ ID NO: 2563455 - protein, 6 aa, Entamoeba histolytica
GFPTHS

SEQ ID NO: 2563456 - protein, 6 aa, Entamoeba histolytica
GFQGDV

SEQ ID NO: 2563457 - protein, 14 aa, Entamoeba histolytica
GFQIKTKRSKESIE

SEQ ID NO: 2563458 - protein, 10 aa, Entamoeba histolytica
GFQKNKNPHT

SEQ ID NO: 2563459 - protein, 7 aa, Entamoeba histolytica
GFSEEPI

SEQ ID NO: 2563460 - protein, 7 aa, Entamoeba histolytica
GFSGNDN

SEQ ID NO: 2563461 - protein, 9 aa, Entamoeba histolytica
GFTSNGKGN

SEQ ID NO: 2563462 - protein, 7 aa, Entamoeba histolytica
GGAARKI

SEQ ID NO: 2563463 - protein, 15 aa, Entamoeba histolytica
GGDEKLTPRAQQEAT

SEQ ID NO: 2563464 - protein, 12 aa, Entamoeba histolytica
GGDPENNEFDIG

SEQ ID NO: 2563465 - protein, 9 aa, Entamoeba histolytica
GGDSGALKP

SEQ ID NO: 2563466 - protein, 11 aa, Entamoeba histolytica
GGDWDRRNRRR

SEQ ID NO: 2563467 - protein, 6 aa, Entamoeba histolytica
GGEDQS

SEQ ID NO: 2563468 - protein, 7 aa, Entamoeba histolytica
GGEQTSP

SEQ ID NO: 2563469 - protein, 6 aa, Entamoeba histolytica
GGFNTQ

SEQ ID NO: 2563470 - protein, 5 aa, Entamoeba histolytica
GGFRH

SEQ ID NO: 2563471 - protein, 4 aa, Entamoeba histolytica
GGFS

SEQ ID NO: 2563472 - protein, 5 aa, Entamoeba histolytica
GGGDT

SEQ ID NO: 2563473 - protein, 4 aa, Entamoeba histolytica
GGGY

SEQ ID NO: 2563474 - protein, 7 aa, Entamoeba histolytica
GGGYADL

SEQ ID NO: 2563475 - protein, 10 aa, Entamoeba histolytica
GGGYGDLESN

SEQ ID NO: 2563476 - protein, 9 aa, Entamoeba histolytica
GGGYTDLES

SEQ ID NO: 2563477 - protein, 10 aa, Entamoeba histolytica
GGHSKYVNSP

SEQ ID NO: 2563478 - protein, 4 aa, Entamoeba histolytica
GGHT

SEQ ID NO: 2563479 - protein, 7 aa, Entamoeba histolytica
GGIEGND

SEQ ID NO: 2563480 - protein, 11 aa, Entamoeba histolytica
GGKCTQKNDKI

SEQ ID NO: 2563481 - protein, 7 aa, Entamoeba histolytica
GGKFDRA

SEQ ID NO: 2563482 - protein, 9 aa, Entamoeba histolytica
GGKGCGKST

SEQ ID NO: 2563483 - protein, 10 aa, Entamoeba histolytica
GGKGSTQYQD

SEQ ID NO: 2563484 - protein, 4 aa, Entamoeba histolytica
GGKI

SEQ ID NO: 2563485 - protein, 9 aa, Entamoeba histolytica
GGKIGEKGG

SEQ ID NO: 2563486 - protein, 4 aa, Entamoeba histolytica
GGKM

SEQ ID NO: 2563487 - protein, 9 aa, Entamoeba histolytica
GGKNPYSKL

SEQ ID NO: 2563488 - protein, 4 aa, Entamoeba histolytica
GGKP

SEQ ID NO: 2563489 - protein, 7 aa, Entamoeba histolytica
GGKPIKY

SEQ ID NO: 2563490 - protein, 4 aa, Entamoeba histolytica
GGLS

SEQ ID NO: 2563491 - protein, 7 aa, Entamoeba histolytica
GGMTPET

SEQ ID NO: 2563492 - protein, 6 aa, Entamoeba histolytica
GGNLQV

SEQ ID NO: 2563493 - protein, 5 aa, Entamoeba histolytica
GGPIK

SEQ ID NO: 2563494 - protein, 5 aa, Entamoeba histolytica
GGQCY

SEQ ID NO: 2563495 - protein, 11 aa, Entamoeba histolytica
GGQPRKEKDLA

SEQ ID NO: 2563496 - protein, 11 aa, Entamoeba histolytica
GGQPRKEKELA

SEQ ID NO: 2563497 - protein, 6 aa, Entamoeba histolytica
GGRGIY

SEQ ID NO: 2563498 - protein, 5 aa, Entamoeba histolytica
GGRSD

SEQ ID NO: 2563499 - protein, 6 aa, Entamoeba histolytica
GGSEPL

SEQ ID NO: 2563500 - protein, 7 aa, Entamoeba histolytica
GGSEPLN

SEQ ID NO: 2563501 - protein, 9 aa, Entamoeba histolytica
GGSGAGKST

SEQ ID NO: 2563502 - protein, 7 aa, Entamoeba histolytica
GGSIPTQ

SEQ ID NO: 2563503 - protein, 6 aa, Entamoeba histolytica
GGSKQL

SEQ ID NO: 2563504 - protein, 4 aa, Entamoeba histolytica
GGSN

SEQ ID NO: 2563505 - protein, 12 aa, Entamoeba histolytica
GGSNLSGGQKQR

SEQ ID NO: 2563506 - protein, 15 aa, Entamoeba histolytica
GGSRYDSKKKSLYVG

SEQ ID NO: 2563507 - protein, 7 aa, Entamoeba histolytica
GGSSGIG

SEQ ID NO: 2563508 - protein, 24 aa, Entamoeba histolytica
GGTEISTRLDPDEIKEEKKIGEGT

SEQ ID NO: 2563509 - protein, 13 aa, Entamoeba histolytica
GGTTLATKYNDGS

SEQ ID NO: 2563510 - protein, 7 aa, Entamoeba histolytica
GGVQEAT

SEQ ID NO: 2563511 - protein, 9 aa, Entamoeba histolytica
GGVRENGIN

SEQ ID NO: 2563512 - protein, 6 aa, Entamoeba histolytica
GGYECD

SEQ ID NO: 2563513 - protein, 17 aa, Entamoeba histolytica
GGYEKDGNELPVNEESR

SEQ ID NO: 2563514 - protein, 4 aa, Entamoeba histolytica
GGYK

SEQ ID NO: 2563515 - protein, 7 aa, Entamoeba histolytica
GGYQVDE

SEQ ID NO: 2563516 - protein, 12 aa, Entamoeba histolytica
GGYSKTLNGSYA

SEQ ID NO: 2563517 - protein, 6 aa, Entamoeba histolytica
GHASFE

SEQ ID NO: 2563518 - protein, 6 aa, Entamoeba histolytica
GHELRQ

SEQ ID NO: 2563519 - protein, 7 aa, Entamoeba histolytica
GHFQPNP

SEQ ID NO: 2563520 - protein, 4 aa, Entamoeba histolytica
GHGE

SEQ ID NO: 2563521 - protein, 15 aa, Entamoeba histolytica
GHGRSSGIPNKPKTF

SEQ ID NO: 2563522 - protein, 10 aa, Entamoeba histolytica
GHGRSSGTRG

SEQ ID NO: 2563523 - protein, 4 aa, Entamoeba histolytica
GHGS

SEQ ID NO: 2563524 - protein, 7 aa, Entamoeba histolytica
GHKSQYV

SEQ ID NO: 2563525 - protein, 8 aa, Entamoeba histolytica
GHRNQGLS

SEQ ID NO: 2563526 - protein, 10 aa, Entamoeba histolytica
GHRRPQNNLP

SEQ ID NO: 2563527 - protein, 5 aa, Entamoeba histolytica
GHSTN

SEQ ID NO: 2563528 - protein, 6 aa, Entamoeba histolytica
GHTHDG

SEQ ID NO: 2563529 - protein, 7 aa, Entamoeba histolytica
GHTSSMN

SEQ ID NO: 2563530 - protein, 10 aa, Entamoeba histolytica
GHYQDKEGEY

SEQ ID NO: 2563531 - protein, 22 aa, Entamoeba histolytica
GICDESYSKRQEQFGKNRTPDP

SEQ ID NO: 2563532 - protein, 8 aa, Entamoeba histolytica
GICSTASG

SEQ ID NO: 2563533 - protein, 8 aa, Entamoeba histolytica
GIDGGSRV

SEQ ID NO: 2563534 - protein, 5 aa, Entamoeba histolytica
GIEDS

SEQ ID NO: 2563535 - protein, 15 aa, Entamoeba histolytica
GIEEDSTESSDENIN

SEQ ID NO: 2563536 - protein, 11 aa, Entamoeba histolytica
GIEEESNWNEG

SEQ ID NO: 2563537 - protein, 10 aa, Entamoeba histolytica
GIEEKENEIR

SEQ ID NO: 2563538 - protein, 7 aa, Entamoeba histolytica
GIEVTTG

SEQ ID NO: 2563539 - protein, 10 aa, Entamoeba histolytica
GIGGDDGGMY

SEQ ID NO: 2563540 - protein, 7 aa, Entamoeba histolytica
GIGSPTY

SEQ ID NO: 2563541 - protein, 5 aa, Entamoeba histolytica
GIGTP

SEQ ID NO: 2563542 - protein, 7 aa, Entamoeba histolytica
GIGTPAY

SEQ ID NO: 2563543 - protein, 11 aa, Entamoeba histolytica
GIGTPAYTAPE

SEQ ID NO: 2563544 - protein, 13 aa, Entamoeba histolytica
GIGTPKNEQIDSN

SEQ ID NO: 2563545 - protein, 7 aa, Entamoeba histolytica
GIGTPTY

SEQ ID NO: 2563546 - protein, 13 aa, Entamoeba histolytica
GIGTQPEGKQPTN

SEQ ID NO: 2563547 - protein, 8 aa, Entamoeba histolytica
GIKAKGKS

SEQ ID NO: 2563548 - protein, 8 aa, Entamoeba histolytica
GIKTSDSD

SEQ ID NO: 2563549 - protein, 9 aa, Entamoeba histolytica
GILSKSDIK

SEQ ID NO: 2563550 - protein, 11 aa, Entamoeba histolytica
GINEKTAKRRL

SEQ ID NO: 2563551 - protein, 7 aa, Entamoeba histolytica
GINENTY

SEQ ID NO: 2563552 - protein, 10 aa, Entamoeba histolytica
GINNKEITSA

SEQ ID NO: 2563553 - protein, 10 aa, Entamoeba histolytica
GINNSTEGGY

SEQ ID NO: 2563554 - protein, 6 aa, Entamoeba histolytica
GINSSS

SEQ ID NO: 2563555 - protein, 27 aa, Entamoeba histolytica
GIPEKEIKQEKENNVIKSPRSPRTSAY

SEQ ID NO: 2563556 - protein, 20 aa, Entamoeba histolytica
GIPEKEVKQENNANKSPRSS

SEQ ID NO: 2563557 - protein, 7 aa, Entamoeba histolytica
GIPIEKG

SEQ ID NO: 2563558 - protein, 4 aa, Entamoeba histolytica
GIPK

SEQ ID NO: 2563559 - protein, 13 aa, Entamoeba histolytica
GIPKSNDGCSKEV

SEQ ID NO: 2563560 - protein, 10 aa, Entamoeba histolytica
GIPNQVRGSI

SEQ ID NO: 2563561 - protein, 10 aa, Entamoeba histolytica
GIPNRSTQTI

SEQ ID NO: 2563562 - protein, 5 aa, Entamoeba histolytica
GIPPA

SEQ ID NO: 2563563 - protein, 10 aa, Entamoeba histolytica
GIPQSKTPFT

SEQ ID NO: 2563564 - protein, 14 aa, Entamoeba histolytica
GIPRSNQTKYKPFN

SEQ ID NO: 2563565 - protein, 5 aa, Entamoeba histolytica
GIPVN

SEQ ID NO: 2563566 - protein, 6 aa, Entamoeba histolytica
GIQENQ

SEQ ID NO: 2563567 - protein, 10 aa, Entamoeba histolytica
GIQSQSNISL

SEQ ID NO: 2563568 - protein, 5 aa, Entamoeba histolytica
GIRQR

SEQ ID NO: 2563569 - protein, 8 aa, Entamoeba histolytica
GISISSDN

SEQ ID NO: 2563570 - protein, 13 aa, Entamoeba histolytica
GISNEGGMSTPFT

SEQ ID NO: 2563571 - protein, 9 aa, Entamoeba histolytica
GISNKQSKC

SEQ ID NO: 2563572 - protein, 12 aa, Entamoeba histolytica
GISNKRRNATMG

SEQ ID NO: 2563573 - protein, 9 aa, Entamoeba histolytica
GISPPGTFL

SEQ ID NO: 2563574 - protein, 8 aa, Entamoeba histolytica
GISPRGYV

SEQ ID NO: 2563575 - protein, 5 aa, Entamoeba histolytica
GISSS

SEQ ID NO: 2563576 - protein, 15 aa, Entamoeba histolytica
GISYSTGSLVTSSPE

SEQ ID NO: 2563577 - protein, 8 aa, Entamoeba histolytica
GITGESWT

SEQ ID NO: 2563578 - protein, 5 aa, Entamoeba histolytica
GITPK

SEQ ID NO: 2563579 - protein, 7 aa, Entamoeba histolytica
GITSGIN

SEQ ID NO: 2563580 - protein, 4 aa, Entamoeba histolytica
GITT

SEQ ID NO: 2563581 - protein, 12 aa, Entamoeba histolytica
GITTNERIKKRY

SEQ ID NO: 2563582 - protein, 19 aa, Entamoeba histolytica
GIVSDDSGDSELDSEDYND

SEQ ID NO: 2563583 - protein, 13 aa, Entamoeba histolytica
GIYDNGEECDEKG

SEQ ID NO: 2563584 - protein, 8 aa, Entamoeba histolytica
GKAAPKEF

SEQ ID NO: 2563585 - protein, 8 aa, Entamoeba histolytica
GKAAPQEF

SEQ ID NO: 2563586 - protein, 4 aa, Entamoeba histolytica
GKAF

SEQ ID NO: 2563587 - protein, 6 aa, Entamoeba histolytica
GKAITV

SEQ ID NO: 2563588 - protein, 6 aa, Entamoeba histolytica
GKATTP

SEQ ID NO: 2563589 - protein, 4 aa, Entamoeba histolytica
GKAV

SEQ ID NO: 2563590 - protein, 8 aa, Entamoeba histolytica
GKAVGAAK

SEQ ID NO: 2563591 - protein, 4 aa, Entamoeba histolytica
GKCE

SEQ ID NO: 2563592 - protein, 9 aa, Entamoeba histolytica
GKCNPCSNI

SEQ ID NO: 2563593 - protein, 6 aa, Entamoeba histolytica
GKCNSC

SEQ ID NO: 2563594 - protein, 11 aa, Entamoeba histolytica
GKCQPNGDNSY

SEQ ID NO: 2563595 - protein, 13 aa, Entamoeba histolytica
GKCQPNKKIKASK

SEQ ID NO: 2563596 - protein, 21 aa, Entamoeba histolytica
GKCSPNLNDGFKTSAKTECQK

SEQ ID NO: 2563597 - protein, 6 aa, Entamoeba histolytica
GKCSTQ

SEQ ID NO: 2563598 - protein, 12 aa, Entamoeba histolytica
GKDECLEGTGCN

SEQ ID NO: 2563599 - protein, 4 aa, Entamoeba histolytica
GKDG

SEQ ID NO: 2563600 - protein, 6 aa, Entamoeba histolytica
GKDGEH

SEQ ID NO: 2563601 - protein, 8 aa, Entamoeba histolytica
GKDKEECN

SEQ ID NO: 2563602 - protein, 5 aa, Entamoeba histolytica
GKDLV

SEQ ID NO: 2563603 - protein, 5 aa, Entamoeba histolytica
GKDPF

SEQ ID NO: 2563604 - protein, 4 aa, Entamoeba histolytica
GKDR

SEQ ID NO: 2563605 - protein, 7 aa, Entamoeba histolytica
GKDTAKV

SEQ ID NO: 2563606 - protein, 10 aa, Entamoeba histolytica
GKDYQEAPYN

SEQ ID NO: 2563607 - protein, 6 aa, Entamoeba histolytica
GKEDGR

SEQ ID NO: 2563608 - protein, 8 aa, Entamoeba histolytica
GKEETTSL

SEQ ID NO: 2563609 - protein, 12 aa, Entamoeba histolytica
GKEGNQAARASD

SEQ ID NO: 2563610 - protein, 13 aa, Entamoeba histolytica
GKEGSQAARSADY

SEQ ID NO: 2563611 - protein, 18 aa, Entamoeba histolytica
GKEIKQLTGRKYRKRYSQ

SEQ ID NO: 2563612 - protein, 11 aa, Entamoeba histolytica
GKEKETGDVQQ

SEQ ID NO: 2563613 - protein, 5 aa, Entamoeba histolytica
GKENN

SEQ ID NO: 2563614 - protein, 7 aa, Entamoeba histolytica
GKENPKY

SEQ ID NO: 2563615 - protein, 17 aa, Entamoeba histolytica
GKEPTKVSLSSNNEEFN

SEQ ID NO: 2563616 - protein, 5 aa, Entamoeba histolytica
GKESN

SEQ ID NO: 2563617 - protein, 14 aa, Entamoeba histolytica
GKETKIEMSKEEPV

SEQ ID NO: 2563618 - protein, 16 aa, Entamoeba histolytica
GKETRSSMNRNGQRNV

SEQ ID NO: 2563619 - protein, 4 aa, Entamoeba histolytica
GKEV

SEQ ID NO: 2563620 - protein, 8 aa, Entamoeba histolytica
GKFSSDSS

SEQ ID NO: 2563621 - protein, 11 aa, Entamoeba histolytica
GKGASKDCSAG

SEQ ID NO: 2563622 - protein, 11 aa, Entamoeba histolytica
GKGGSDNVKAG

SEQ ID NO: 2563623 - protein, 11 aa, Entamoeba histolytica
GKGGSKGVSAG

SEQ ID NO: 2563624 - protein, 4 aa, Entamoeba histolytica
GKGI

SEQ ID NO: 2563625 - protein, 6 aa, Entamoeba histolytica
GKGKQD

SEQ ID NO: 2563626 - protein, 7 aa, Entamoeba histolytica
GKGKYTQ

SEQ ID NO: 2563627 - protein, 12 aa, Entamoeba histolytica
GKGLLEKRKQEV

SEQ ID NO: 2563628 - protein, 6 aa, Entamoeba histolytica
GKGMEE

SEQ ID NO: 2563629 - protein, 5 aa, Entamoeba histolytica
GKGSF

SEQ ID NO: 2563630 - protein, 6 aa, Entamoeba histolytica
GKGTKK

SEQ ID NO: 2563631 - protein, 12 aa, Entamoeba histolytica
GKHDEDDETKAC

SEQ ID NO: 2563632 - protein, 8 aa, Entamoeba histolytica
GKHKKTET

SEQ ID NO: 2563633 - protein, 8 aa, Entamoeba histolytica
GKIADKTN

SEQ ID NO: 2563634 - protein, 6 aa, Entamoeba histolytica
GKIDAK

SEQ ID NO: 2563635 - protein, 20 aa, Entamoeba histolytica
GKIDEGEECDPSVEGYDDSQ

SEQ ID NO: 2563636 - protein, 5 aa, Entamoeba histolytica
GKIDS

SEQ ID NO: 2563637 - protein, 8 aa, Entamoeba histolytica
GKKEDGTQ

SEQ ID NO: 2563638 - protein, 7 aa, Entamoeba histolytica
GKKEEKL

SEQ ID NO: 2563639 - protein, 14 aa, Entamoeba histolytica
GKKEYEESEEEEEL

SEQ ID NO: 2563640 - protein, 13 aa, Entamoeba histolytica
GKKKNENVKDENI

SEQ ID NO: 2563641 - protein, 8 aa, Entamoeba histolytica
GKKLNTQL

SEQ ID NO: 2563642 - protein, 9 aa, Entamoeba histolytica
GKKNKVSGL

SEQ ID NO: 2563643 - protein, 10 aa, Entamoeba histolytica
GKKQGGSVKT

SEQ ID NO: 2563644 - protein, 10 aa, Entamoeba histolytica
GKKQTTTYQA

SEQ ID NO: 2563645 - protein, 17 aa, Entamoeba histolytica
GKKTPMEKKEESSSDQF

SEQ ID NO: 2563646 - protein, 10 aa, Entamoeba histolytica
GKKYSERAEQ

SEQ ID NO: 2563647 - protein, 22 aa, Entamoeba histolytica
GKLDKDEECDPSVEGYNDSRCT

SEQ ID NO: 2563648 - protein, 8 aa, Entamoeba histolytica
GKLDYGED

SEQ ID NO: 2563649 - protein, 20 aa, Entamoeba histolytica
GKLGPKDECSQGSDGCTETC

SEQ ID NO: 2563650 - protein, 6 aa, Entamoeba histolytica
GKLNEI

SEQ ID NO: 2563651 - protein, 5 aa, Entamoeba histolytica
GKLQE

SEQ ID NO: 2563652 - protein, 6 aa, Entamoeba histolytica
GKLTTK

SEQ ID NO: 2563653 - protein, 4 aa, Entamoeba histolytica
GKME

SEQ ID NO: 2563654 - protein, 6 aa, Entamoeba histolytica
GKNEEA

SEQ ID NO: 2563655 - protein, 7 aa, Entamoeba histolytica
GKNGPIE

SEQ ID NO: 2563656 - protein, 5 aa, Entamoeba histolytica
GKNIE

SEQ ID NO: 2563657 - protein, 7 aa, Entamoeba histolytica
GKNIENI

SEQ ID NO: 2563658 - protein, 13 aa, Entamoeba histolytica
GKNPQLVNTESRS

SEQ ID NO: 2563659 - protein, 6 aa, Entamoeba histolytica
GKNSKC

SEQ ID NO: 2563660 - protein, 8 aa, Entamoeba histolytica
GKNVSKED

SEQ ID NO: 2563661 - protein, 9 aa, Entamoeba histolytica
GKPITTPQT

SEQ ID NO: 2563662 - protein, 6 aa, Entamoeba histolytica
GKPLNQ

SEQ ID NO: 2563663 - protein, 7 aa, Entamoeba histolytica
GKPRPNY

SEQ ID NO: 2563664 - protein, 6 aa, Entamoeba histolytica
GKPTDA

SEQ ID NO: 2563665 - protein, 5 aa, Entamoeba histolytica
GKPTL

SEQ ID NO: 2563666 - protein, 9 aa, Entamoeba histolytica
GKPVSTKAD

SEQ ID NO: 2563667 - protein, 5 aa, Entamoeba histolytica
GKPVT

SEQ ID NO: 2563668 - protein, 8 aa, Entamoeba histolytica
GKPYSSEQ

SEQ ID NO: 2563669 - protein, 8 aa, Entamoeba histolytica
GKQKERLE

SEQ ID NO: 2563670 - protein, 7 aa, Entamoeba histolytica
GKQPQQL

SEQ ID NO: 2563671 - protein, 12 aa, Entamoeba histolytica
GKQTRKKGTSKN

SEQ ID NO: 2563672 - protein, 10 aa, Entamoeba histolytica
GKRDNEGNAG

SEQ ID NO: 2563673 - protein, 6 aa, Entamoeba histolytica
GKRIEL

SEQ ID NO: 2563674 - protein, 9 aa, Entamoeba histolytica
GKRKDNNVV

SEQ ID NO: 2563675 - protein, 16 aa, Entamoeba histolytica
GKRKKSGEKKVNPVRV

SEQ ID NO: 2563676 - protein, 9 aa, Entamoeba histolytica
GKRLEQPPI

SEQ ID NO: 2563677 - protein, 9 aa, Entamoeba histolytica
GKRMPQTKD

SEQ ID NO: 2563678 - protein, 20 aa, Entamoeba histolytica
GKRSSNGQTCDTKCDESCKS

SEQ ID NO: 2563679 - protein, 6 aa, Entamoeba histolytica
GKRTPI

SEQ ID NO: 2563680 - protein, 6 aa, Entamoeba histolytica
GKRVEI

SEQ ID NO: 2563681 - protein, 5 aa, Entamoeba histolytica
GKRVK

SEQ ID NO: 2563682 - protein, 9 aa, Entamoeba histolytica
GKSNTISLG

SEQ ID NO: 2563683 - protein, 4 aa, Entamoeba histolytica
GKSP

SEQ ID NO: 2563684 - protein, 6 aa, Entamoeba histolytica
GKSPRL

SEQ ID NO: 2563685 - protein, 7 aa, Entamoeba histolytica
GKSSDPF

SEQ ID NO: 2563686 - protein, 5 aa, Entamoeba histolytica
GKSVS

SEQ ID NO: 2563687 - protein, 11 aa, Entamoeba histolytica
GKTAAQRTSRL

SEQ ID NO: 2563688 - protein, 12 aa, Entamoeba histolytica
GKTECAPPSCGN

SEQ ID NO: 2563689 - protein, 19 aa, Entamoeba histolytica
GKTKESLNQDKPRPTPLQE

SEQ ID NO: 2563690 - protein, 8 aa, Entamoeba histolytica
GKTKNGWG

SEQ ID NO: 2563691 - protein, 21 aa, Entamoeba histolytica
GKTNHSDSSPSTPKKSMFEEE

SEQ ID NO: 2563692 - protein, 5 aa, Entamoeba histolytica
GKTQI

SEQ ID NO: 2563693 - protein, 8 aa, Entamoeba histolytica
GKTTDGKQ

SEQ ID NO: 2563694 - protein, 5 aa, Entamoeba histolytica
GKTTI

SEQ ID NO: 2563695 - protein, 7 aa, Entamoeba histolytica
GKTTYEN

SEQ ID NO: 2563696 - protein, 6 aa, Entamoeba histolytica
GKTYNN

SEQ ID NO: 2563697 - protein, 8 aa, Entamoeba histolytica
GKTYPLRG

SEQ ID NO: 2563698 - protein, 24 aa, Entamoeba histolytica
GKVHDSPNPETREVVGENGEGERS

SEQ ID NO: 2563699 - protein, 6 aa, Entamoeba histolytica
GKVISP

SEQ ID NO: 2563700 - protein, 9 aa, Entamoeba histolytica
GKVNKDVKP

SEQ ID NO: 2563701 - protein, 5 aa, Entamoeba histolytica
GKVPS

SEQ ID NO: 2563702 - protein, 6 aa, Entamoeba histolytica
GKVQGG

SEQ ID NO: 2563703 - protein, 7 aa, Entamoeba histolytica
GKVTGTN

SEQ ID NO: 2563704 - protein, 5 aa, Entamoeba histolytica
GKVVE

SEQ ID NO: 2563705 - protein, 9 aa, Entamoeba histolytica
GKWEETQEI

SEQ ID NO: 2563706 - protein, 7 aa, Entamoeba histolytica
GKYDDSY

SEQ ID NO: 2563707 - protein, 7 aa, Entamoeba histolytica
GKYLNEG

SEQ ID NO: 2563708 - protein, 4 aa, Entamoeba histolytica
GKYQ

SEQ ID NO: 2563709 - protein, 9 aa, Entamoeba histolytica
GKYQFSGDK

SEQ ID NO: 2563710 - protein, 9 aa, Entamoeba histolytica
GLDEESARK

SEQ ID NO: 2563711 - protein, 13 aa, Entamoeba histolytica
GLDEKDETNMSSA

SEQ ID NO: 2563712 - protein, 8 aa, Entamoeba histolytica
GLDGNNEM

SEQ ID NO: 2563713 - protein, 9 aa, Entamoeba histolytica
GLDKKENKK

SEQ ID NO: 2563714 - protein, 4 aa, Entamoeba histolytica
GLDM

SEQ ID NO: 2563715 - protein, 7 aa, Entamoeba histolytica
GLDNETG

SEQ ID NO: 2563716 - protein, 4 aa, Entamoeba histolytica
GLES

SEQ ID NO: 2563717 - protein, 10 aa, Entamoeba histolytica
GLGKPERAHH

SEQ ID NO: 2563718 - protein, 4 aa, Entamoeba histolytica
GLGQ

SEQ ID NO: 2563719 - protein, 7 aa, Entamoeba histolytica
GLKNPNR

SEQ ID NO: 2563720 - protein, 10 aa, Entamoeba histolytica
GLNEGEYSFN

SEQ ID NO: 2563721 - protein, 7 aa, Entamoeba histolytica
GLNQSGE

SEQ ID NO: 2563722 - protein, 9 aa, Entamoeba histolytica
GLPSAYKQL

SEQ ID NO: 2563723 - protein, 7 aa, Entamoeba histolytica
GLREKGN

SEQ ID NO: 2563724 - protein, 9 aa, Entamoeba histolytica
GLRRERDRA

SEQ ID NO: 2563725 - protein, 9 aa, Entamoeba histolytica
GLSDPYYNP

SEQ ID NO: 2563726 - protein, 10 aa, Entamoeba histolytica
GLSEGSRTVA

SEQ ID NO: 2563727 - protein, 10 aa, Entamoeba histolytica
GLSGVEAGKI

SEQ ID NO: 2563728 - protein, 9 aa, Entamoeba histolytica
GLSKNSTAY

SEQ ID NO: 2563729 - protein, 7 aa, Entamoeba histolytica
GLSPGMK

SEQ ID NO: 2563730 - protein, 9 aa, Entamoeba histolytica
GLTGELSDT

SEQ ID NO: 2563731 - protein, 11 aa, Entamoeba histolytica
GLTKDKQRVRY

SEQ ID NO: 2563732 - protein, 4 aa, Entamoeba histolytica
GLTQ

SEQ ID NO: 2563733 - protein, 5 aa, Entamoeba histolytica
GLTQQ

SEQ ID NO: 2563734 - protein, 12 aa, Entamoeba histolytica
GLTSSSCETSSS

SEQ ID NO: 2563735 - protein, 7 aa, Entamoeba histolytica
GLTTSQG

SEQ ID NO: 2563736 - protein, 4 aa, Entamoeba histolytica
GMER

SEQ ID NO: 2563737 - protein, 10 aa, Entamoeba histolytica
GMKDGETTWE

SEQ ID NO: 2563738 - protein, 8 aa, Entamoeba histolytica
GMKEDNKP

SEQ ID NO: 2563739 - protein, 12 aa, Entamoeba histolytica
GMNDGSEETTFS

SEQ ID NO: 2563740 - protein, 13 aa, Entamoeba histolytica
GMNNQGNTLSTTL

SEQ ID NO: 2563741 - protein, 6 aa, Entamoeba histolytica
GMSPDT

SEQ ID NO: 2563742 - protein, 13 aa, Entamoeba histolytica
GMYQDEKGQKECK

SEQ ID NO: 2563743 - protein, 10 aa, Entamoeba histolytica
GMYSPSSENI

SEQ ID NO: 2563744 - protein, 9 aa, Entamoeba histolytica
GNACTQPVP

SEQ ID NO: 2563745 - protein, 7 aa, Entamoeba histolytica
GNAHGGH

SEQ ID NO: 2563746 - protein, 5 aa, Entamoeba histolytica
GNASS

SEQ ID NO: 2563747 - protein, 8 aa, Entamoeba histolytica
GNATEKKS

SEQ ID NO: 2563748 - protein, 6 aa, Entamoeba histolytica
GNATQE

SEQ ID NO: 2563749 - protein, 4 aa, Entamoeba histolytica
GNCQ

SEQ ID NO: 2563750 - protein, 12 aa, Entamoeba histolytica
GNCRCDASTSYQ

SEQ ID NO: 2563751 - protein, 7 aa, Entamoeba histolytica
GNDLKTY

SEQ ID NO: 2563752 - protein, 9 aa, Entamoeba histolytica
GNDNEATTV

SEQ ID NO: 2563753 - protein, 5 aa, Entamoeba histolytica
GNDNN

SEQ ID NO: 2563754 - protein, 9 aa, Entamoeba histolytica
GNDNNDNNY

SEQ ID NO: 2563755 - protein, 5 aa, Entamoeba histolytica
GNDPC

SEQ ID NO: 2563756 - protein, 4 aa, Entamoeba histolytica
GNDQ

SEQ ID NO: 2563757 - protein, 25 aa, Entamoeba histolytica
GNDTRLARNRKQSGNVKRGKTEDEV

SEQ ID NO: 2563758 - protein, 5 aa, Entamoeba histolytica
GNDTV

SEQ ID NO: 2563759 - protein, 10 aa, Entamoeba histolytica
GNECTKESDV

SEQ ID NO: 2563760 - protein, 4 aa, Entamoeba histolytica
GNEE

SEQ ID NO: 2563761 - protein, 7 aa, Entamoeba histolytica
GNEEEIR

SEQ ID NO: 2563762 - protein, 9 aa, Entamoeba histolytica
GNEGECKQC

SEQ ID NO: 2563763 - protein, 13 aa, Entamoeba histolytica
GNEHTGLKSPHGR

SEQ ID NO: 2563764 - protein, 8 aa, Entamoeba histolytica
GNEKSKIQ

SEQ ID NO: 2563765 - protein, 4 aa, Entamoeba histolytica
GNEL

SEQ ID NO: 2563766 - protein, 7 aa, Entamoeba histolytica
GNELDGP

SEQ ID NO: 2563767 - protein, 8 aa, Entamoeba histolytica
GNENGNEE

SEQ ID NO: 2563768 - protein, 19 aa, Entamoeba histolytica
GNENKSIKKENLLSEESKI

SEQ ID NO: 2563769 - protein, 6 aa, Entamoeba histolytica
GNENTL

SEQ ID NO: 2563770 - protein, 17 aa, Entamoeba histolytica
GNEREEEKYEFSDRIKK

SEQ ID NO: 2563771 - protein, 4 aa, Entamoeba histolytica
GNET

SEQ ID NO: 2563772 - protein, 6 aa, Entamoeba histolytica
GNETQY

SEQ ID NO: 2563773 - protein, 8 aa, Entamoeba histolytica
GNFNPEKK

SEQ ID NO: 2563774 - protein, 6 aa, Entamoeba histolytica
GNGDRI

SEQ ID NO: 2563775 - protein, 17 aa, Entamoeba histolytica
GNGEIDEGEDCDGGDGC

SEQ ID NO: 2563776 - protein, 6 aa, Entamoeba histolytica
GNGEYV

SEQ ID NO: 2563777 - protein, 7 aa, Entamoeba histolytica
GNGGFGL

SEQ ID NO: 2563778 - protein, 5 aa, Entamoeba histolytica
GNGKE

SEQ ID NO: 2563779 - protein, 10 aa, Entamoeba histolytica
GNGKKKITKE

SEQ ID NO: 2563780 - protein, 11 aa, Entamoeba histolytica
GNGKLDEGEIC

SEQ ID NO: 2563781 - protein, 9 aa, Entamoeba histolytica
GNGLENNSI

SEQ ID NO: 2563782 - protein, 12 aa, Entamoeba histolytica
GNGNKTLKGKSH

SEQ ID NO: 2563783 - protein, 16 aa, Entamoeba histolytica
GNGRFDAGEECDGGKG

SEQ ID NO: 2563784 - protein, 16 aa, Entamoeba histolytica
GNGRIDSGEECDGGDG

SEQ ID NO: 2563785 - protein, 9 aa, Entamoeba histolytica
GNGSGSLAT

SEQ ID NO: 2563786 - protein, 17 aa, Entamoeba histolytica
GNGSSSSAASKKDDDYQ

SEQ ID NO: 2563787 - protein, 4 aa, Entamoeba histolytica
GNGV

SEQ ID NO: 2563788 - protein, 7 aa, Entamoeba histolytica
GNGVAGL

SEQ ID NO: 2563789 - protein, 10 aa, Entamoeba histolytica
GNGYQGNPIQ

SEQ ID NO: 2563790 - protein, 4 aa, Entamoeba histolytica
GNHD

SEQ ID NO: 2563791 - protein, 7 aa, Entamoeba histolytica
GNHDSDG

SEQ ID NO: 2563792 - protein, 6 aa, Entamoeba histolytica
GNHEDP

SEQ ID NO: 2563793 - protein, 7 aa, Entamoeba histolytica
GNHETYD

SEQ ID NO: 2563794 - protein, 4 aa, Entamoeba histolytica
GNIE

SEQ ID NO: 2563795 - protein, 7 aa, Entamoeba histolytica
GNIKPET

SEQ ID NO: 2563796 - protein, 4 aa, Entamoeba histolytica
GNIP

SEQ ID NO: 2563797 - protein, 7 aa, Entamoeba histolytica
GNIRGGQ

SEQ ID NO: 2563798 - protein, 9 aa, Entamoeba histolytica
GNISEEIEP

SEQ ID NO: 2563799 - protein, 6 aa, Entamoeba histolytica
GNKENT

SEQ ID NO: 2563800 - protein, 8 aa, Entamoeba histolytica
GNKERKEV

SEQ ID NO: 2563801 - protein, 15 aa, Entamoeba histolytica
GNKKWDEGEECDGGY

SEQ ID NO: 2563802 - protein, 9 aa, Entamoeba histolytica
GNKRVNNNY

SEQ ID NO: 2563803 - protein, 7 aa, Entamoeba histolytica
GNKSKMS

SEQ ID NO: 2563804 - protein, 9 aa, Entamoeba histolytica
GNKTSPTKI

SEQ ID NO: 2563805 - protein, 4 aa, Entamoeba histolytica
GNLC

SEQ ID NO: 2563806 - protein, 8 aa, Entamoeba histolytica
GNLTGNRN

SEQ ID NO: 2563807 - protein, 9 aa, Entamoeba histolytica
GNNDEGDFE

SEQ ID NO: 2563808 - protein, 7 aa, Entamoeba histolytica
GNNGSFC

SEQ ID NO: 2563809 - protein, 7 aa, Entamoeba histolytica
GNNGVKG

SEQ ID NO: 2563810 - protein, 4 aa, Entamoeba histolytica
GNNI

SEQ ID NO: 2563811 - protein, 9 aa, Entamoeba histolytica
GNNLNRPGI

SEQ ID NO: 2563812 - protein, 9 aa, Entamoeba histolytica
GNNSNSETK

SEQ ID NO: 2563813 - protein, 7 aa, Entamoeba histolytica
GNNSSSY

SEQ ID NO: 2563814 - protein, 8 aa, Entamoeba histolytica
GNNTIKDE

SEQ ID NO: 2563815 - protein, 5 aa, Entamoeba histolytica
GNNVN

SEQ ID NO: 2563816 - protein, 106 aa, Entamoeba histolytica
GNPEFDESSHEDSESSYTTSESSSSYSSESDESSYSSESDDEEFPIQQEQEKISPLNPVNSDKTIQSQNKGSDTNNTTKEEEEVNKSEKEKVKKLEEEQLKKAQEV

SEQ ID NO: 2563817 - protein, 28 aa, Entamoeba histolytica
GNPNKETIDQDLKEDEEEETKKKEKLLN

SEQ ID NO: 2563818 - protein, 7 aa, Entamoeba histolytica
GNPPYYD

SEQ ID NO: 2563819 - protein, 4 aa, Entamoeba histolytica
GNPR

SEQ ID NO: 2563820 - protein, 4 aa, Entamoeba histolytica
GNPY

SEQ ID NO: 2563821 - protein, 8 aa, Entamoeba histolytica
GNQFSESK

SEQ ID NO: 2563822 - protein, 7 aa, Entamoeba histolytica
GNQNGKE

SEQ ID NO: 2563823 - protein, 25 aa, Entamoeba histolytica
GNQRFTQNDIETALGKEEAEKNEGV

SEQ ID NO: 2563824 - protein, 15 aa, Entamoeba histolytica
GNQTPPVNSNKQALQ

SEQ ID NO: 2563825 - protein, 14 aa, Entamoeba histolytica
GNRNETLSNGIHTS

SEQ ID NO: 2563826 - protein, 8 aa, Entamoeba histolytica
GNRPKIPD

SEQ ID NO: 2563827 - protein, 9 aa, Entamoeba histolytica
GNRPKTTGI

SEQ ID NO: 2563828 - protein, 5 aa, Entamoeba histolytica
GNSEM

SEQ ID NO: 2563829 - protein, 7 aa, Entamoeba histolytica
GNSGDPQ

SEQ ID NO: 2563830 - protein, 6 aa, Entamoeba histolytica
GNSGKY

SEQ ID NO: 2563831 - protein, 4 aa, Entamoeba histolytica
GNSK

SEQ ID NO: 2563832 - protein, 9 aa, Entamoeba histolytica
GNSNSYSSI

SEQ ID NO: 2563833 - protein, 5 aa, Entamoeba histolytica
GNSQD

SEQ ID NO: 2563834 - protein, 5 aa, Entamoeba histolytica
GNSRK

SEQ ID NO: 2563835 - protein, 7 aa, Entamoeba histolytica
GNSSNYN

SEQ ID NO: 2563836 - protein, 5 aa, Entamoeba histolytica
GNSVT

SEQ ID NO: 2563837 - protein, 6 aa, Entamoeba histolytica
GNTEDV

SEQ ID NO: 2563838 - protein, 13 aa, Entamoeba histolytica
GNTEDVKKALEQA

SEQ ID NO: 2563839 - protein, 5 aa, Entamoeba histolytica
GNTEK

SEQ ID NO: 2563840 - protein, 4 aa, Entamoeba histolytica
GNTR

SEQ ID NO: 2563841 - protein, 6 aa, Entamoeba histolytica
GNTSLG

SEQ ID NO: 2563842 - protein, 7 aa, Entamoeba histolytica
GNTSSAS

SEQ ID NO: 2563843 - protein, 21 aa, Entamoeba histolytica
GNTTKSETEKAKVENGEEDRS

SEQ ID NO: 2563844 - protein, 8 aa, Entamoeba histolytica
GNTYEFQQ

SEQ ID NO: 2563845 - protein, 15 aa, Entamoeba histolytica
GNVPQEQLTPEQIQQ

SEQ ID NO: 2563846 - protein, 5 aa, Entamoeba histolytica
GNVQS

SEQ ID NO: 2563847 - protein, 7 aa, Entamoeba histolytica
GNVSPSN

SEQ ID NO: 2563848 - protein, 15 aa, Entamoeba histolytica
GNWGISNPGEETNNV

SEQ ID NO: 2563849 - protein, 5 aa, Entamoeba histolytica
GNWQS

SEQ ID NO: 2563850 - protein, 6 aa, Entamoeba histolytica
GNYINK

SEQ ID NO: 2563851 - protein, 4 aa, Entamoeba histolytica
GNYN

SEQ ID NO: 2563852 - protein, 10 aa, Entamoeba histolytica
GNYSNPSERF

SEQ ID NO: 2563853 - protein, 4 aa, Entamoeba histolytica
GNYT

SEQ ID NO: 2563854 - protein, 16 aa, Entamoeba histolytica
GNYTGENRKKCNNETY

SEQ ID NO: 2563855 - protein, 5 aa, Entamoeba histolytica
GNYYG

SEQ ID NO: 2563856 - protein, 6 aa, Entamoeba histolytica
GNYYGR

SEQ ID NO: 2563857 - protein, 4 aa, Entamoeba histolytica
GPAL

SEQ ID NO: 2563858 - protein, 6 aa, Entamoeba histolytica
GPDTQI

SEQ ID NO: 2563859 - protein, 12 aa, Entamoeba histolytica
GPENQEDTNKAL

SEQ ID NO: 2563860 - protein, 5 aa, Entamoeba histolytica
GPETH

SEQ ID NO: 2563861 - protein, 5 aa, Entamoeba histolytica
GPEYE

SEQ ID NO: 2563862 - protein, 13 aa, Entamoeba histolytica
GPFESTENNSRTM

SEQ ID NO: 2563863 - protein, 4 aa, Entamoeba histolytica
GPFG

SEQ ID NO: 2563864 - protein, 9 aa, Entamoeba histolytica
GPGQMSATQ

SEQ ID NO: 2563865 - protein, 5 aa, Entamoeba histolytica
GPIDL

SEQ ID NO: 2563866 - protein, 5 aa, Entamoeba histolytica
GPIDS

SEQ ID NO: 2563867 - protein, 9 aa, Entamoeba histolytica
GPIEGGTNV

SEQ ID NO: 2563868 - protein, 5 aa, Entamoeba histolytica
GPING

SEQ ID NO: 2563869 - protein, 10 aa, Entamoeba histolytica
GPITVTSNDI

SEQ ID NO: 2563870 - protein, 6 aa, Entamoeba histolytica
GPKGTV

SEQ ID NO: 2563871 - protein, 14 aa, Entamoeba histolytica
GPKISEQNPDYQAE

SEQ ID NO: 2563872 - protein, 6 aa, Entamoeba histolytica
GPKRST

SEQ ID NO: 2563873 - protein, 10 aa, Entamoeba histolytica
GPKSSHINKQ

SEQ ID NO: 2563874 - protein, 5 aa, Entamoeba histolytica
GPLRE

SEQ ID NO: 2563875 - protein, 7 aa, Entamoeba histolytica
GPNTTTY

SEQ ID NO: 2563876 - protein, 6 aa, Entamoeba histolytica
GPPFAT

SEQ ID NO: 2563877 - protein, 9 aa, Entamoeba histolytica
GPQNSGKST

SEQ ID NO: 2563878 - protein, 4 aa, Entamoeba histolytica
GPRG

SEQ ID NO: 2563879 - protein, 8 aa, Entamoeba histolytica
GPRKSGKS

SEQ ID NO: 2563880 - protein, 13 aa, Entamoeba histolytica
GPSADDEDPRDGL

SEQ ID NO: 2563881 - protein, 9 aa, Entamoeba histolytica
GPSATGKSR

SEQ ID NO: 2563882 - protein, 8 aa, Entamoeba histolytica
GPSGCGKS

SEQ ID NO: 2563883 - protein, 5 aa, Entamoeba histolytica
GPSGT

SEQ ID NO: 2563884 - protein, 5 aa, Entamoeba histolytica
GPSIK

SEQ ID NO: 2563885 - protein, 4 aa, Entamoeba histolytica
GPSK

SEQ ID NO: 2563886 - protein, 5 aa, Entamoeba histolytica
GPSLE

SEQ ID NO: 2563887 - protein, 6 aa, Entamoeba histolytica
GPSQNP

SEQ ID NO: 2563888 - protein, 7 aa, Entamoeba histolytica
GPSSFSY

SEQ ID NO: 2563889 - protein, 4 aa, Entamoeba histolytica
GPTF

SEQ ID NO: 2563890 - protein, 16 aa, Entamoeba histolytica
GPTKQGVRQNIPDSSA

SEQ ID NO: 2563891 - protein, 4 aa, Entamoeba histolytica
GPTV

SEQ ID NO: 2563892 - protein, 5 aa, Entamoeba histolytica
GPVGD

SEQ ID NO: 2563893 - protein, 5 aa, Entamoeba histolytica
GPVTS

SEQ ID NO: 2563894 - protein, 11 aa, Entamoeba histolytica
GPYSSKIGSKQ

SEQ ID NO: 2563895 - protein, 5 aa, Entamoeba histolytica
GQAYY

SEQ ID NO: 2563896 - protein, 6 aa, Entamoeba histolytica
GQCESC

SEQ ID NO: 2563897 - protein, 10 aa, Entamoeba histolytica
GQCPYTSGRQ

SEQ ID NO: 2563898 - protein, 8 aa, Entamoeba histolytica
GQDESPQH

SEQ ID NO: 2563899 - protein, 12 aa, Entamoeba histolytica
GQDLNKQKSAVE

SEQ ID NO: 2563900 - protein, 12 aa, Entamoeba histolytica
GQDSSYTKTTVS

SEQ ID NO: 2563901 - protein, 5 aa, Entamoeba histolytica
GQEEK

SEQ ID NO: 2563902 - protein, 15 aa, Entamoeba histolytica
GQEESCEEDPNKVDL

SEQ ID NO: 2563903 - protein, 4 aa, Entamoeba histolytica
GQEH

SEQ ID NO: 2563904 - protein, 4 aa, Entamoeba histolytica
GQEI

SEQ ID NO: 2563905 - protein, 14 aa, Entamoeba histolytica
GQEYDRFSGANRAK

SEQ ID NO: 2563906 - protein, 12 aa, Entamoeba histolytica
GQFEEYSNNQCT

SEQ ID NO: 2563907 - protein, 4 aa, Entamoeba histolytica
GQFS

SEQ ID NO: 2563908 - protein, 4 aa, Entamoeba histolytica
GQGK

SEQ ID NO: 2563909 - protein, 6 aa, Entamoeba histolytica
GQGKQD

SEQ ID NO: 2563910 - protein, 5 aa, Entamoeba histolytica
GQGRM

SEQ ID NO: 2563911 - protein, 5 aa, Entamoeba histolytica
GQGTF

SEQ ID NO: 2563912 - protein, 15 aa, Entamoeba histolytica
GQIDQGEECDGGNGC

SEQ ID NO: 2563913 - protein, 18 aa, Entamoeba histolytica
GQKEVKTEGWQNEANGGK

SEQ ID NO: 2563914 - protein, 10 aa, Entamoeba histolytica
GQKSSSGTAI

SEQ ID NO: 2563915 - protein, 17 aa, Entamoeba histolytica
GQKTKHKEIGVKEGTQL

SEQ ID NO: 2563916 - protein, 9 aa, Entamoeba histolytica
GQLSDISSK

SEQ ID NO: 2563917 - protein, 9 aa, Entamoeba histolytica
GQLTETASA

SEQ ID NO: 2563918 - protein, 14 aa, Entamoeba histolytica
GQMNEKQKQEFSEE

SEQ ID NO: 2563919 - protein, 5 aa, Entamoeba histolytica
GQMPS

SEQ ID NO: 2563920 - protein, 9 aa, Entamoeba histolytica
GQNAGEIEE

SEQ ID NO: 2563921 - protein, 4 aa, Entamoeba histolytica
GQNH

SEQ ID NO: 2563922 - protein, 7 aa, Entamoeba histolytica
GQNKSNS

SEQ ID NO: 2563923 - protein, 11 aa, Entamoeba histolytica
GQNKTSTTDTF

SEQ ID NO: 2563924 - protein, 5 aa, Entamoeba histolytica
GQPFE

SEQ ID NO: 2563925 - protein, 10 aa, Entamoeba histolytica
GQPTQPVQQQ

SEQ ID NO: 2563926 - protein, 5 aa, Entamoeba histolytica
GQRCP

SEQ ID NO: 2563927 - protein, 7 aa, Entamoeba histolytica
GQRDAFD

SEQ ID NO: 2563928 - protein, 15 aa, Entamoeba histolytica
GQRGAQISGGQKQRI

SEQ ID NO: 2563929 - protein, 5 aa, Entamoeba histolytica
GQRLE

SEQ ID NO: 2563930 - protein, 15 aa, Entamoeba histolytica
GQRVDPTTLVPKFIK

SEQ ID NO: 2563931 - protein, 12 aa, Entamoeba histolytica
GQSCDGNRTSHE

SEQ ID NO: 2563932 - protein, 4 aa, Entamoeba histolytica
GQSI

SEQ ID NO: 2563933 - protein, 5 aa, Entamoeba histolytica
GQSSL

SEQ ID NO: 2563934 - protein, 23 aa, Entamoeba histolytica
GQTEPQPDSSCKITTGSTDVQIS

SEQ ID NO: 2563935 - protein, 10 aa, Entamoeba histolytica
GQTLLSGSSD

SEQ ID NO: 2563936 - protein, 9 aa, Entamoeba histolytica
GQTPEVNET

SEQ ID NO: 2563937 - protein, 14 aa, Entamoeba histolytica
GQTPYIPSIDSSKT

SEQ ID NO: 2563938 - protein, 10 aa, Entamoeba histolytica
GQTSDVASKG

SEQ ID NO: 2563939 - protein, 9 aa, Entamoeba histolytica
GQTSTIIPR

SEQ ID NO: 2563940 - protein, 41 aa, Entamoeba histolytica
GQTVEKKSPKETPVVSSKKEEKKEKKSKSSSSSSSSSSDEK

SEQ ID NO: 2563941 - protein, 14 aa, Entamoeba histolytica
GRATVKGGMGINSS

SEQ ID NO: 2563942 - protein, 9 aa, Entamoeba histolytica
GRCQKNEEL

SEQ ID NO: 2563943 - protein, 4 aa, Entamoeba histolytica
GRDE

SEQ ID NO: 2563944 - protein, 10 aa, Entamoeba histolytica
GRDKISCEDN

SEQ ID NO: 2563945 - protein, 8 aa, Entamoeba histolytica
GRDVGSPA

SEQ ID NO: 2563946 - protein, 5 aa, Entamoeba histolytica
GRDVQ

SEQ ID NO: 2563947 - protein, 18 aa, Entamoeba histolytica
GRDYTAPPTASDREKCER

SEQ ID NO: 2563948 - protein, 5 aa, Entamoeba histolytica
GREEE

SEQ ID NO: 2563949 - protein, 12 aa, Entamoeba histolytica
GREENDYTNGHI

SEQ ID NO: 2563950 - protein, 9 aa, Entamoeba histolytica
GREKSMSER

SEQ ID NO: 2563951 - protein, 6 aa, Entamoeba histolytica
GRESSY

SEQ ID NO: 2563952 - protein, 8 aa, Entamoeba histolytica
GRGSGIGV

SEQ ID NO: 2563953 - protein, 6 aa, Entamoeba histolytica
GRGTGI

SEQ ID NO: 2563954 - protein, 8 aa, Entamoeba histolytica
GRIKPKES

SEQ ID NO: 2563955 - protein, 4 aa, Entamoeba histolytica
GRIR

SEQ ID NO: 2563956 - protein, 5 aa, Entamoeba histolytica
GRIVG

SEQ ID NO: 2563957 - protein, 8 aa, Entamoeba histolytica
GRKGSLNV

SEQ ID NO: 2563958 - protein, 5 aa, Entamoeba histolytica
GRLND

SEQ ID NO: 2563959 - protein, 24 aa, Entamoeba histolytica
GRNRSNLMTSSENNTNTGRGTEDD

SEQ ID NO: 2563960 - protein, 7 aa, Entamoeba histolytica
GRPFDKS

SEQ ID NO: 2563961 - protein, 6 aa, Entamoeba histolytica
GRPRPN

SEQ ID NO: 2563962 - protein, 7 aa, Entamoeba histolytica
GRRIEQE

SEQ ID NO: 2563963 - protein, 8 aa, Entamoeba histolytica
GRSARDKK

SEQ ID NO: 2563964 - protein, 11 aa, Entamoeba histolytica
GRSERQIAAAS

SEQ ID NO: 2563965 - protein, 7 aa, Entamoeba histolytica
GRSETLS

SEQ ID NO: 2563966 - protein, 13 aa, Entamoeba histolytica
GRSGTEPVPVDEE

SEQ ID NO: 2563967 - protein, 15 aa, Entamoeba histolytica
GRSKKNIVNEEVPSQ

SEQ ID NO: 2563968 - protein, 6 aa, Entamoeba histolytica
GRSNER

SEQ ID NO: 2563969 - protein, 5 aa, Entamoeba histolytica
GRSPR

SEQ ID NO: 2563970 - protein, 25 aa, Entamoeba histolytica
GRSPSLQTPQTGFQRGSRRGDENKD

SEQ ID NO: 2563971 - protein, 7 aa, Entamoeba histolytica
GRSRTTH

SEQ ID NO: 2563972 - protein, 10 aa, Entamoeba histolytica
GRSSGKPKTY

SEQ ID NO: 2563973 - protein, 6 aa, Entamoeba histolytica
GRSTLV

SEQ ID NO: 2563974 - protein, 9 aa, Entamoeba histolytica
GRTGAGKSS

SEQ ID NO: 2563975 - protein, 9 aa, Entamoeba histolytica
GRTPLPKSY

SEQ ID NO: 2563976 - protein, 7 aa, Entamoeba histolytica
GRYGASN

SEQ ID NO: 2563977 - protein, 15 aa, Entamoeba histolytica
GSAFAGNSSVIKGES

SEQ ID NO: 2563978 - protein, 18 aa, Entamoeba histolytica
GSAFGEKAQENKTECGEY

SEQ ID NO: 2563979 - protein, 7 aa, Entamoeba histolytica
GSANGIA

SEQ ID NO: 2563980 - protein, 8 aa, Entamoeba histolytica
GSAPAYEI

SEQ ID NO: 2563981 - protein, 10 aa, Entamoeba histolytica
GSAPTGSGKT

SEQ ID NO: 2563982 - protein, 7 aa, Entamoeba histolytica
GSATLSG

SEQ ID NO: 2563983 - protein, 7 aa, Entamoeba histolytica
GSATSME

SEQ ID NO: 2563984 - protein, 7 aa, Entamoeba histolytica
GSATTVK

SEQ ID NO: 2563985 - protein, 9 aa, Entamoeba histolytica
GSCDPQNKC

SEQ ID NO: 2563986 - protein, 7 aa, Entamoeba histolytica
GSCENTE

SEQ ID NO: 2563987 - protein, 9 aa, Entamoeba histolytica
GSCENTEPD

SEQ ID NO: 2563988 - protein, 7 aa, Entamoeba histolytica
GSCNKDE

SEQ ID NO: 2563989 - protein, 10 aa, Entamoeba histolytica
GSCNTHEHTP

SEQ ID NO: 2563990 - protein, 9 aa, Entamoeba histolytica
GSCSKCSES

SEQ ID NO: 2563991 - protein, 8 aa, Entamoeba histolytica
GSCTSSTY

SEQ ID NO: 2563992 - protein, 7 aa, Entamoeba histolytica
GSCTTSS

SEQ ID NO: 2563993 - protein, 10 aa, Entamoeba histolytica
GSDEENGLST

SEQ ID NO: 2563994 - protein, 13 aa, Entamoeba histolytica
GSDESSNKNQSKR

SEQ ID NO: 2563995 - protein, 10 aa, Entamoeba histolytica
GSDGSIREDD

SEQ ID NO: 2563996 - protein, 27 aa, Entamoeba histolytica
GSDMNQIQQQPKEEEVNIKPSENTEKY

SEQ ID NO: 2563997 - protein, 8 aa, Entamoeba histolytica
GSDPLKSN

SEQ ID NO: 2563998 - protein, 14 aa, Entamoeba histolytica
GSDPTGLTRGNDIG

SEQ ID NO: 2563999 - protein, 4 aa, Entamoeba histolytica
GSDT

SEQ ID NO: 2564000 - protein, 7 aa, Entamoeba histolytica
GSDTIRK

SEQ ID NO: 2564001 - protein, 4 aa, Entamoeba histolytica
GSDV

SEQ ID NO: 2564002 - protein, 7 aa, Entamoeba histolytica
GSDVYSS

SEQ ID NO: 2564003 - protein, 8 aa, Entamoeba histolytica
GSDYGTPV

SEQ ID NO: 2564004 - protein, 8 aa, Entamoeba histolytica
GSEEHDNY

SEQ ID NO: 2564005 - protein, 11 aa, Entamoeba histolytica
GSEGDFNEGSV

SEQ ID NO: 2564006 - protein, 8 aa, Entamoeba histolytica
GSEGSKCT

SEQ ID NO: 2564007 - protein, 7 aa, Entamoeba histolytica
GSEIDTS

SEQ ID NO: 2564008 - protein, 6 aa, Entamoeba histolytica
GSEIGQ

SEQ ID NO: 2564009 - protein, 5 aa, Entamoeba histolytica
GSELR

SEQ ID NO: 2564010 - protein, 5 aa, Entamoeba histolytica
GSEST

SEQ ID NO: 2564011 - protein, 5 aa, Entamoeba histolytica
GSETK

SEQ ID NO: 2564012 - protein, 13 aa, Entamoeba histolytica
GSFEDSDSEEDNY

SEQ ID NO: 2564013 - protein, 5 aa, Entamoeba histolytica
GSFGY

SEQ ID NO: 2564014 - protein, 8 aa, Entamoeba histolytica
GSFLPKEK

SEQ ID NO: 2564015 - protein, 18 aa, Entamoeba histolytica
GSFQPQMGQSKCESCSDG

SEQ ID NO: 2564016 - protein, 7 aa, Entamoeba histolytica
GSGAAHS

SEQ ID NO: 2564017 - protein, 8 aa, Entamoeba histolytica
GSGFDDGN

SEQ ID NO: 2564018 - protein, 9 aa, Entamoeba histolytica
GSGNEITEK

SEQ ID NO: 2564019 - protein, 6 aa, Entamoeba histolytica
GSGNIP

SEQ ID NO: 2564020 - protein, 4 aa, Entamoeba histolytica
GSGQ

SEQ ID NO: 2564021 - protein, 5 aa, Entamoeba histolytica
GSGSC

SEQ ID NO: 2564022 - protein, 7 aa, Entamoeba histolytica
GSGSYGD

SEQ ID NO: 2564023 - protein, 11 aa, Entamoeba histolytica
GSGTDLTKQSA

SEQ ID NO: 2564024 - protein, 6 aa, Entamoeba histolytica
GSGTIT

SEQ ID NO: 2564025 - protein, 7 aa, Entamoeba histolytica
GSGYKSS

SEQ ID NO: 2564026 - protein, 22 aa, Entamoeba histolytica
GSHVGTEETPANDSRTEHAILA

SEQ ID NO: 2564027 - protein, 5 aa, Entamoeba histolytica
GSIDG

SEQ ID NO: 2564028 - protein, 6 aa, Entamoeba histolytica
GSIEPQ

SEQ ID NO: 2564029 - protein, 5 aa, Entamoeba histolytica
GSIET

SEQ ID NO: 2564030 - protein, 5 aa, Entamoeba histolytica
GSIGC

SEQ ID NO: 2564031 - protein, 4 aa, Entamoeba histolytica
GSIN

SEQ ID NO: 2564032 - protein, 5 aa, Entamoeba histolytica
GSINT

SEQ ID NO: 2564033 - protein, 13 aa, Entamoeba histolytica
GSIPQQTPNDQTL

SEQ ID NO: 2564034 - protein, 5 aa, Entamoeba histolytica
GSISG

SEQ ID NO: 2564035 - protein, 10 aa, Entamoeba histolytica
GSISGNGEFV

SEQ ID NO: 2564036 - protein, 4 aa, Entamoeba histolytica
GSIT

SEQ ID NO: 2564037 - protein, 7 aa, Entamoeba histolytica
GSKAEKA

SEQ ID NO: 2564038 - protein, 8 aa, Entamoeba histolytica
GSKDNNNK

SEQ ID NO: 2564039 - protein, 17 aa, Entamoeba histolytica
GSKEKNIQQNQKTKLES

SEQ ID NO: 2564040 - protein, 18 aa, Entamoeba histolytica
GSKEKNIQQNQKTQPESI

SEQ ID NO: 2564041 - protein, 14 aa, Entamoeba histolytica
GSKESFKSIENKEE

SEQ ID NO: 2564042 - protein, 8 aa, Entamoeba histolytica
GSKGYYKS

SEQ ID NO: 2564043 - protein, 10 aa, Entamoeba histolytica
GSKKKPPTIE

SEQ ID NO: 2564044 - protein, 11 aa, Entamoeba histolytica
GSKNNEPPLIK

SEQ ID NO: 2564045 - protein, 22 aa, Entamoeba histolytica
GSKPKTKDEKKKEKKEENEIEE

SEQ ID NO: 2564046 - protein, 8 aa, Entamoeba histolytica
GSKPQGNW

SEQ ID NO: 2564047 - protein, 12 aa, Entamoeba histolytica
GSKQAAQLNQQI

SEQ ID NO: 2564048 - protein, 9 aa, Entamoeba histolytica
GSKSKSGVL

SEQ ID NO: 2564049 - protein, 6 aa, Entamoeba histolytica
GSLKDS

SEQ ID NO: 2564050 - protein, 6 aa, Entamoeba histolytica
GSLNPN

SEQ ID NO: 2564051 - protein, 8 aa, Entamoeba histolytica
GSLPQTKG

SEQ ID NO: 2564052 - protein, 9 aa, Entamoeba histolytica
GSLSNTKLS

SEQ ID NO: 2564053 - protein, 5 aa, Entamoeba histolytica
GSLSQ

SEQ ID NO: 2564054 - protein, 7 aa, Entamoeba histolytica
GSLTEEN

SEQ ID NO: 2564055 - protein, 6 aa, Entamoeba histolytica
GSLTTG

SEQ ID NO: 2564056 - protein, 8 aa, Entamoeba histolytica
GSMGGSVS

SEQ ID NO: 2564057 - protein, 4 aa, Entamoeba histolytica
GSMN

SEQ ID NO: 2564058 - protein, 7 aa, Entamoeba histolytica
GSNDEDL

SEQ ID NO: 2564059 - protein, 9 aa, Entamoeba histolytica
GSNEIEDNQ

SEQ ID NO: 2564060 - protein, 7 aa, Entamoeba histolytica
GSNEMSK

SEQ ID NO: 2564061 - protein, 10 aa, Entamoeba histolytica
GSNNNDTFSE

SEQ ID NO: 2564062 - protein, 5 aa, Entamoeba histolytica
GSNNR

SEQ ID NO: 2564063 - protein, 6 aa, Entamoeba histolytica
GSNQLR

SEQ ID NO: 2564064 - protein, 16 aa, Entamoeba histolytica
GSNSNGCGTLASYDAQ

SEQ ID NO: 2564065 - protein, 4 aa, Entamoeba histolytica
GSNT

SEQ ID NO: 2564066 - protein, 16 aa, Entamoeba histolytica
GSPDIPELGMKQVDHD

SEQ ID NO: 2564067 - protein, 14 aa, Entamoeba histolytica
GSPKVTKDKSETYL

SEQ ID NO: 2564068 - protein, 7 aa, Entamoeba histolytica
GSPVEAN

SEQ ID NO: 2564069 - protein, 13 aa, Entamoeba histolytica
GSQDPSQCSNNAT

SEQ ID NO: 2564070 - protein, 14 aa, Entamoeba histolytica
GSQEVEENNTVATR

SEQ ID NO: 2564071 - protein, 4 aa, Entamoeba histolytica
GSQL

SEQ ID NO: 2564072 - protein, 5 aa, Entamoeba histolytica
GSQSF

SEQ ID NO: 2564073 - protein, 5 aa, Entamoeba histolytica
GSRQI

SEQ ID NO: 2564074 - protein, 5 aa, Entamoeba histolytica
GSRSI

SEQ ID NO: 2564075 - protein, 4 aa, Entamoeba histolytica
GSSG

SEQ ID NO: 2564076 - protein, 7 aa, Entamoeba histolytica
GSSGGIS

SEQ ID NO: 2564077 - protein, 10 aa, Entamoeba histolytica
GSSIDSQETC

SEQ ID NO: 2564078 - protein, 5 aa, Entamoeba histolytica
GSSIN

SEQ ID NO: 2564079 - protein, 7 aa, Entamoeba histolytica
GSSIRSS

SEQ ID NO: 2564080 - protein, 7 aa, Entamoeba histolytica
GSSLHST

SEQ ID NO: 2564081 - protein, 7 aa, Entamoeba histolytica
GSSLSED

SEQ ID NO: 2564082 - protein, 6 aa, Entamoeba histolytica
GSSNII

SEQ ID NO: 2564083 - protein, 23 aa, Entamoeba histolytica
GSSQSRDTVITKEKTDSQQQETH

SEQ ID NO: 2564084 - protein, 14 aa, Entamoeba histolytica
GSSSCSRNNEEQTF

SEQ ID NO: 2564085 - protein, 8 aa, Entamoeba histolytica
GSSSKIEN

SEQ ID NO: 2564086 - protein, 6 aa, Entamoeba histolytica
GSSSYT

SEQ ID NO: 2564087 - protein, 12 aa, Entamoeba histolytica
GSSTDLTKEGSH

SEQ ID NO: 2564088 - protein, 8 aa, Entamoeba histolytica
GSSTHRLS

SEQ ID NO: 2564089 - protein, 9 aa, Entamoeba histolytica
GSSTKPDNN

SEQ ID NO: 2564090 - protein, 12 aa, Entamoeba histolytica
GSSYSQCPSPYQ

SEQ ID NO: 2564091 - protein, 4 aa, Entamoeba histolytica
GSTL

SEQ ID NO: 2564092 - protein, 7 aa, Entamoeba histolytica
GSTNQEE

SEQ ID NO: 2564093 - protein, 4 aa, Entamoeba histolytica
GSTQ

SEQ ID NO: 2564094 - protein, 8 aa, Entamoeba histolytica
GSTSQELD

SEQ ID NO: 2564095 - protein, 8 aa, Entamoeba histolytica
GSTSTESL

SEQ ID NO: 2564096 - protein, 4 aa, Entamoeba histolytica
GSTV

SEQ ID NO: 2564097 - protein, 10 aa, Entamoeba histolytica
GSVPQNKRTE

SEQ ID NO: 2564098 - protein, 6 aa, Entamoeba histolytica
GSVPVD

SEQ ID NO: 2564099 - protein, 6 aa, Entamoeba histolytica
GSVTTI

SEQ ID NO: 2564100 - protein, 10 aa, Entamoeba histolytica
GSYESSEEVE

SEQ ID NO: 2564101 - protein, 7 aa, Entamoeba histolytica
GSYLNTK

SEQ ID NO: 2564102 - protein, 7 aa, Entamoeba histolytica
GSYNDCS

SEQ ID NO: 2564103 - protein, 5 aa, Entamoeba histolytica
GSYQS

SEQ ID NO: 2564104 - protein, 9 aa, Entamoeba histolytica
GSYSDEITT

SEQ ID NO: 2564105 - protein, 10 aa, Entamoeba histolytica
GSYSKGETSV

SEQ ID NO: 2564106 - protein, 6 aa, Entamoeba histolytica
GTAGIT

SEQ ID NO: 2564107 - protein, 8 aa, Entamoeba histolytica
GTANGRKV

SEQ ID NO: 2564108 - protein, 4 aa, Entamoeba histolytica
GTAS

SEQ ID NO: 2564109 - protein, 6 aa, Entamoeba histolytica
GTASSY

SEQ ID NO: 2564110 - protein, 7 aa, Entamoeba histolytica
GTCEECN

SEQ ID NO: 2564111 - protein, 8 aa, Entamoeba histolytica
GTCSEYQP

SEQ ID NO: 2564112 - protein, 8 aa, Entamoeba histolytica
GTCTASDY

SEQ ID NO: 2564113 - protein, 16 aa, Entamoeba histolytica
GTCVSKESVSCKQVSK

SEQ ID NO: 2564114 - protein, 18 aa, Entamoeba histolytica
GTCVSKESVSCKQVSKST

SEQ ID NO: 2564115 - protein, 15 aa, Entamoeba histolytica
GTDGSAREDDYSFER

SEQ ID NO: 2564116 - protein, 6 aa, Entamoeba histolytica
GTDNSN

SEQ ID NO: 2564117 - protein, 11 aa, Entamoeba histolytica
GTDQSNRTKEE

SEQ ID NO: 2564118 - protein, 4 aa, Entamoeba histolytica
GTDS

SEQ ID NO: 2564119 - protein, 7 aa, Entamoeba histolytica
GTDSAFS

SEQ ID NO: 2564120 - protein, 8 aa, Entamoeba histolytica
GTDVAKQA

SEQ ID NO: 2564121 - protein, 4 aa, Entamoeba histolytica
GTDY

SEQ ID NO: 2564122 - protein, 15 aa, Entamoeba histolytica
GTECPPCNNESDKDK

SEQ ID NO: 2564123 - protein, 18 aa, Entamoeba histolytica
GTEENKKFVESGEKESNE

SEQ ID NO: 2564124 - protein, 9 aa, Entamoeba histolytica
GTEESSVDV

SEQ ID NO: 2564125 - protein, 4 aa, Entamoeba histolytica
GTEI

SEQ ID NO: 2564126 - protein, 7 aa, Entamoeba histolytica
GTEIPKD

SEQ ID NO: 2564127 - protein, 9 aa, Entamoeba histolytica
GTEKPTPSL

SEQ ID NO: 2564128 - protein, 9 aa, Entamoeba histolytica
GTEKPTTDL

SEQ ID NO: 2564129 - protein, 5 aa, Entamoeba histolytica
GTEPM

SEQ ID NO: 2564130 - protein, 6 aa, Entamoeba histolytica
GTEQTL

SEQ ID NO: 2564131 - protein, 14 aa, Entamoeba histolytica
GTESINNTEERNEE

SEQ ID NO: 2564132 - protein, 15 aa, Entamoeba histolytica
GTEWGDKGTAKLSAD

SEQ ID NO: 2564133 - protein, 4 aa, Entamoeba histolytica
GTFT

SEQ ID NO: 2564134 - protein, 7 aa, Entamoeba histolytica
GTGATPS

SEQ ID NO: 2564135 - protein, 7 aa, Entamoeba histolytica
GTGDGYQ

SEQ ID NO: 2564136 - protein, 5 aa, Entamoeba histolytica
GTGES

SEQ ID NO: 2564137 - protein, 8 aa, Entamoeba histolytica
GTGHTLPE

SEQ ID NO: 2564138 - protein, 4 aa, Entamoeba histolytica
GTGI

SEQ ID NO: 2564139 - protein, 47 aa, Entamoeba histolytica; identical to SEQ ID NO: 2365065

SEQ ID NO: 2564140 - protein, 7 aa, Entamoeba histolytica
GTGTGVS

SEQ ID NO: 2564141 - protein, 6 aa, Entamoeba histolytica
GTHATQ

SEQ ID NO: 2564142 - protein, 7 aa, Entamoeba histolytica
GTHQEKV

SEQ ID NO: 2564143 - protein, 8 aa, Entamoeba histolytica
GTIAPGTQ

SEQ ID NO: 2564144 - protein, 17 aa, Entamoeba histolytica
GTIGKEAGIGHEARDSG

SEQ ID NO: 2564145 - protein, 6 aa, Entamoeba histolytica
GTINNP

SEQ ID NO: 2564146 - protein, 6 aa, Entamoeba histolytica
GTIPLE

SEQ ID NO: 2564147 - protein, 6 aa, Entamoeba histolytica
GTISGD

SEQ ID NO: 2564148 - protein, 5 aa, Entamoeba histolytica
GTKCQ

SEQ ID NO: 2564149 - protein, 8 aa, Entamoeba histolytica
GTKEKQPI

SEQ ID NO: 2564150 - protein, 5 aa, Entamoeba histolytica
GTKKS

SEQ ID NO: 2564151 - protein, 8 aa, Entamoeba histolytica
GTKSINNT

SEQ ID NO: 2564152 - protein, 7 aa, Entamoeba histolytica
GTKTENY

SEQ ID NO: 2564153 - protein, 7 aa, Entamoeba histolytica
GTLEFNP

SEQ ID NO: 2564154 - protein, 5 aa, Entamoeba histolytica
GTLNT

SEQ ID NO: 2564155 - protein, 10 aa, Entamoeba histolytica
GTLSSNLRVD

SEQ ID NO: 2564156 - protein, 11 aa, Entamoeba histolytica
GTNDESVTMEG

SEQ ID NO: 2564157 - protein, 13 aa, Entamoeba histolytica
GTNECPQANGISY

SEQ ID NO: 2564158 - protein, 5 aa, Entamoeba histolytica
GTNEL

SEQ ID NO: 2564159 - protein, 5 aa, Entamoeba histolytica
GTNGS

SEQ ID NO: 2564160 - protein, 6 aa, Entamoeba histolytica
GTNNCQ

SEQ ID NO: 2564161 - protein, 5 aa, Entamoeba histolytica
GTNPL

SEQ ID NO: 2564162 - protein, 8 aa, Entamoeba histolytica
GTNRGIGY

SEQ ID NO: 2564163 - protein, 8 aa, Entamoeba histolytica
GTNSFGDG

SEQ ID NO: 2564164 - protein, 13 aa, Entamoeba histolytica
GTNSSKRACGTYG

SEQ ID NO: 2564165 - protein, 7 aa, Entamoeba histolytica
GTNSVSD

SEQ ID NO: 2564166 - protein, 8 aa, Entamoeba histolytica
GTNYSSGN

SEQ ID NO: 2564167 - protein, 14 aa, Entamoeba histolytica
GTPATDSSVSNYNS

SEQ ID NO: 2564168 - protein, 7 aa, Entamoeba histolytica
GTPSAYR

SEQ ID NO: 2564169 - protein, 16 aa, Entamoeba histolytica
GTQKKTQEKSTTLVEQ

SEQ ID NO: 2564170 - protein, 10 aa, Entamoeba histolytica
GTQKVQASLK

SEQ ID NO: 2564171 - protein, 4 aa, Entamoeba histolytica
GTQL

SEQ ID NO: 2564172 - protein, 7 aa, Entamoeba histolytica
GTQNNSS

SEQ ID NO: 2564173 - protein, 7 aa, Entamoeba histolytica
GTQPPQC

SEQ ID NO: 2564174 - protein, 4 aa, Entamoeba histolytica
GTQR

SEQ ID NO: 2564175 - protein, 10 aa, Entamoeba histolytica
GTRAKPEKVV

SEQ ID NO: 2564176 - protein, 4 aa, Entamoeba histolytica
GTRE

SEQ ID NO: 2564177 - protein, 4 aa, Entamoeba histolytica
GTSD

SEQ ID NO: 2564178 - protein, 4 aa, Entamoeba histolytica
GTSI

SEQ ID NO: 2564179 - protein, 6 aa, Entamoeba histolytica
GTSIQG

SEQ ID NO: 2564180 - protein, 5 aa, Entamoeba histolytica
GTSIT

SEQ ID NO: 2564181 - protein, 5 aa, Entamoeba histolytica
GTSKE

SEQ ID NO: 2564182 - protein, 4 aa, Entamoeba histolytica
GTSL

SEQ ID NO: 2564183 - protein, 8 aa, Entamoeba histolytica
GTSLSGRT

SEQ ID NO: 2564184 - protein, 5 aa, Entamoeba histolytica
GTSQA

SEQ ID NO: 2564185 - protein, 22 aa, Entamoeba histolytica
GTSRFTKKNNKNSEDKGLGTPI

SEQ ID NO: 2564186 - protein, 21 aa, Entamoeba histolytica
GTSRFTKKNNTNSGDKGLGTP

SEQ ID NO: 2564187 - protein, 20 aa, Entamoeba histolytica
GTSRFTKKTNNLTDKGLGTP

SEQ ID NO: 2564188 - protein, 21 aa, Entamoeba histolytica
GTSRFTKSSYSNEDKGLGTPI

SEQ ID NO: 2564189 - protein, 22 aa, Entamoeba histolytica
GTSRITEKNKIDGNDNKGLGTP

SEQ ID NO: 2564190 - protein, 20 aa, Entamoeba histolytica
GTSRMNKKSNKRTDKGLGTP

SEQ ID NO: 2564191 - protein, 13 aa, Entamoeba histolytica
GTSSSQSITNGSI

SEQ ID NO: 2564192 - protein, 5 aa, Entamoeba histolytica
GTSTN

SEQ ID NO: 2564193 - protein, 6 aa, Entamoeba histolytica
GTSTNM

SEQ ID NO: 2564194 - protein, 7 aa, Entamoeba histolytica
GTSYRQY

SEQ ID NO: 2564195 - protein, 7 aa, Entamoeba histolytica
GTTASDV

SEQ ID NO: 2564196 - protein, 8 aa, Entamoeba histolytica
GTTDGKEI

SEQ ID NO: 2564197 - protein, 6 aa, Entamoeba histolytica
GTTEIE

SEQ ID NO: 2564198 - protein, 7 aa, Entamoeba histolytica
GTTENGT

SEQ ID NO: 2564199 - protein, 6 aa, Entamoeba histolytica
GTTFPT

SEQ ID NO: 2564200 - protein, 5 aa, Entamoeba histolytica
GTTKC

SEQ ID NO: 2564201 - protein, 12 aa, Entamoeba histolytica
GTTKCSPPTCNN

SEQ ID NO: 2564202 - protein, 4 aa, Entamoeba histolytica
GTTQ

SEQ ID NO: 2564203 - protein, 5 aa, Entamoeba histolytica
GTTSD

SEQ ID NO: 2564204 - protein, 7 aa, Entamoeba histolytica
GTTTNTF

SEQ ID NO: 2564205 - protein, 4 aa, Entamoeba histolytica
GTTV

SEQ ID NO: 2564206 - protein, 21 aa, Entamoeba histolytica
GTTYPNPKVIKEDSDKKEYEW

SEQ ID NO: 2564207 - protein, 26 aa, Entamoeba histolytica
GTVDIQDKGRMGMGKNAASWSRSVNK

SEQ ID NO: 2564208 - protein, 10 aa, Entamoeba histolytica
GTVDSRPSFK

SEQ ID NO: 2564209 - protein, 16 aa, Entamoeba histolytica
GTVGKEAGVGHEARNS

SEQ ID NO: 2564210 - protein, 8 aa, Entamoeba histolytica
GTVHPSES

SEQ ID NO: 2564211 - protein, 6 aa, Entamoeba histolytica
GTVQPE

SEQ ID NO: 2564212 - protein, 9 aa, Entamoeba histolytica
GTYADYDGI

SEQ ID NO: 2564213 - protein, 29 aa, Entamoeba histolytica
GTYANQIKQEACQKCSSTCSECDKSSGNC

SEQ ID NO: 2564214 - protein, 5 aa, Entamoeba histolytica
GTYEG

SEQ ID NO: 2564215 - protein, 4 aa, Entamoeba histolytica
GTYP

SEQ ID NO: 2564216 - protein, 12 aa, Entamoeba histolytica
GTYQEYEGGQEC

SEQ ID NO: 2564217 - protein, 12 aa, Entamoeba histolytica
GTYQNETGSTYC

SEQ ID NO: 2564218 - protein, 6 aa, Entamoeba histolytica
GTYQNM

SEQ ID NO: 2564219 - protein, 12 aa, Entamoeba histolytica
GTYQRDDNNEDH

SEQ ID NO: 2564220 - protein, 4 aa, Entamoeba histolytica
GTYS

SEQ ID NO: 2564221 - protein, 9 aa, Entamoeba histolytica
GTYSEKYKG

SEQ ID NO: 2564222 - protein, 10 aa, Entamoeba histolytica
GVAENNRCTG

SEQ ID NO: 2564223 - protein, 9 aa, Entamoeba histolytica
GVDGNPQEL

SEQ ID NO: 2564224 - protein, 6 aa, Entamoeba histolytica
GVDSSE

SEQ ID NO: 2564225 - protein, 7 aa, Entamoeba histolytica
GVECNEE

SEQ ID NO: 2564226 - protein, 10 aa, Entamoeba histolytica
GVEKGVGSLS

SEQ ID NO: 2564227 - protein, 5 aa, Entamoeba histolytica
GVGGN

SEQ ID NO: 2564228 - protein, 10 aa, Entamoeba histolytica
GVGKRSDDCM

SEQ ID NO: 2564229 - protein, 4 aa, Entamoeba histolytica
GVGS

SEQ ID NO: 2564230 - protein, 7 aa, Entamoeba histolytica
GVGTPSF

SEQ ID NO: 2564231 - protein, 5 aa, Entamoeba histolytica
GVIAR

SEQ ID NO: 2564232 - protein, 10 aa, Entamoeba histolytica
GVISKNNKSE

SEQ ID NO: 2564233 - protein, 7 aa, Entamoeba histolytica
GVKDVNK

SEQ ID NO: 2564234 - protein, 9 aa, Entamoeba histolytica
GVKENKPTW

SEQ ID NO: 2564235 - protein, 8 aa, Entamoeba histolytica
GVKNGDVQ

SEQ ID NO: 2564236 - protein, 4 aa, Entamoeba histolytica
GVKS

SEQ ID NO: 2564237 - protein, 5 aa, Entamoeba histolytica
GVKSD

SEQ ID NO: 2564238 - protein, 6 aa, Entamoeba histolytica
GVNEDD

SEQ ID NO: 2564239 - protein, 7 aa, Entamoeba histolytica
GVNENED

SEQ ID NO: 2564240 - protein, 6 aa, Entamoeba histolytica
GVNESH

SEQ ID NO: 2564241 - protein, 6 aa, Entamoeba histolytica
GVNPST

SEQ ID NO: 2564242 - protein, 4 aa, Entamoeba histolytica
GVNR

SEQ ID NO: 2564243 - protein, 4 aa, Entamoeba histolytica
GVPI

SEQ ID NO: 2564244 - protein, 6 aa, Entamoeba histolytica
GVRGTQ

SEQ ID NO: 2564245 - protein, 22 aa, Entamoeba histolytica
GVRIDESEMTGESASVKKSEDN

SEQ ID NO: 2564246 - protein, 4 aa, Entamoeba histolytica
GVSI

SEQ ID NO: 2564247 - protein, 4 aa, Entamoeba histolytica
GVSP

SEQ ID NO: 2564248 - protein, 37 aa, Entamoeba histolytica
GVSTRDKDNECACKKDTPEYKEGLNAEDKKKSCAQLN

SEQ ID NO: 2564249 - protein, 15 aa, Entamoeba histolytica
GVTEEGNHGGSTLQE

SEQ ID NO: 2564250 - protein, 11 aa, Entamoeba histolytica
GVTESKAFKQE

SEQ ID NO: 2564251 - protein, 8 aa, Entamoeba histolytica
GVTNGQCE

SEQ ID NO: 2564252 - protein, 11 aa, Entamoeba histolytica
GVTQKGYDTIA

SEQ ID NO: 2564253 - protein, 4 aa, Entamoeba histolytica
GVTR

SEQ ID NO: 2564254 - protein, 11 aa, Entamoeba histolytica
GVTTRNKENEC

SEQ ID NO: 2564255 - protein, 9 aa, Entamoeba histolytica
GVVGSKSQI

SEQ ID NO: 2564256 - protein, 8 aa, Entamoeba histolytica
GWGDGDNY

SEQ ID NO: 2564257 - protein, 8 aa, Entamoeba histolytica
GWKNDNCP

SEQ ID NO: 2564258 - protein, 12 aa, Entamoeba histolytica
GWSRKSKFSFEQ

SEQ ID NO: 2564259 - protein, 7 aa, Entamoeba histolytica
GWTEEER

SEQ ID NO: 2564260 - protein, 21 aa, Entamoeba histolytica
GWTTAEVQSPKHSSFLLETKT

SEQ ID NO: 2564261 - protein, 20 aa, Entamoeba histolytica
GYCTTQNTPPLSTRKNGMEC

SEQ ID NO: 2564262 - protein, 6 aa, Entamoeba histolytica
GYDVDD

SEQ ID NO: 2564263 - protein, 11 aa, Entamoeba histolytica
GYECGDDNKWT

SEQ ID NO: 2564264 - protein, 6 aa, Entamoeba histolytica
GYEEFK

SEQ ID NO: 2564265 - protein, 8 aa, Entamoeba histolytica
GYEEGDTS

SEQ ID NO: 2564266 - protein, 11 aa, Entamoeba histolytica
GYEKESSTGRC

SEQ ID NO: 2564267 - protein, 12 aa, Entamoeba histolytica
GYEKEYKENLRR

SEQ ID NO: 2564268 - protein, 10 aa, Entamoeba histolytica
GYESAKTEFT

SEQ ID NO: 2564269 - protein, 12 aa, Entamoeba histolytica
GYETKSSSVQTK

SEQ ID NO: 2564270 - protein, 7 aa, Entamoeba histolytica
GYGDPLK

SEQ ID NO: 2564271 - protein, 4 aa, Entamoeba histolytica
GYGF

SEQ ID NO: 2564272 - protein, 5 aa, Entamoeba histolytica
GYGGD

SEQ ID NO: 2564273 - protein, 8 aa, Entamoeba histolytica
GYGLKEDK

SEQ ID NO: 2564274 - protein, 4 aa, Entamoeba histolytica
GYGQ

SEQ ID NO: 2564275 - protein, 13 aa, Entamoeba histolytica
GYHSSSNRCKTCS

SEQ ID NO: 2564276 - protein, 19 aa, Entamoeba histolytica
GYKEGPNAEDKKKSCAQLN

SEQ ID NO: 2564277 - protein, 13 aa, Entamoeba histolytica
GYKTDSSDKTRCV

SEQ ID NO: 2564278 - protein, 8 aa, Entamoeba histolytica
GYKTTDSD

SEQ ID NO: 2564279 - protein, 4 aa, Entamoeba histolytica
GYLP

SEQ ID NO: 2564280 - protein, 9 aa, Entamoeba histolytica
GYNPNDKNC

SEQ ID NO: 2564281 - protein, 13 aa, Entamoeba histolytica
GYNSKGIKTESTI

SEQ ID NO: 2564282 - protein, 5 aa, Entamoeba histolytica
GYQSN

SEQ ID NO: 2564283 - protein, 6 aa, Entamoeba histolytica
GYRITQ

SEQ ID NO: 2564284 - protein, 8 aa, Entamoeba histolytica
GYRPPLDK

SEQ ID NO: 2564285 - protein, 9 aa, Entamoeba histolytica
GYSAYKTTG

SEQ ID NO: 2564286 - protein, 5 aa, Entamoeba histolytica
GYSDG

SEQ ID NO: 2564287 - protein, 5 aa, Entamoeba histolytica
GYSEE

SEQ ID NO: 2564288 - protein, 6 aa, Entamoeba histolytica
GYSFGG

SEQ ID NO: 2564289 - protein, 8 aa, Entamoeba histolytica
GYSNDTSC

SEQ ID NO: 2564290 - protein, 4 aa, Entamoeba histolytica
GYSP

SEQ ID NO: 2564291 - protein, 5 aa, Entamoeba histolytica
GYSPR

SEQ ID NO: 2564292 - protein, 4 aa, Entamoeba histolytica
GYSR

SEQ ID NO: 2564293 - protein, 8 aa, Entamoeba histolytica
GYSSQSTT

SEQ ID NO: 2564294 - protein, 4 aa, Entamoeba histolytica
GYTA

SEQ ID NO: 2564295 - protein, 9 aa, Entamoeba histolytica
GYTANGNGT

SEQ ID NO: 2564296 - protein, 4 aa, Entamoeba histolytica
GYTG

SEQ ID NO: 2564297 - protein, 5 aa, Entamoeba histolytica
GYTGP

SEQ ID NO: 2564298 - protein, 4 aa, Entamoeba histolytica
GYTK

SEQ ID NO: 2564299 - protein, 17 aa, Entamoeba histolytica
GYTKSTSPCSLNTQQTG

SEQ ID NO: 2564300 - protein, 9 aa, Entamoeba histolytica
GYTPNEKQT

SEQ ID NO: 2564301 - protein, 5 aa, Entamoeba histolytica
GYTQS

SEQ ID NO: 2564302 - protein, 11 aa, Entamoeba histolytica
GYTTDKEIPQG

SEQ ID NO: 2564303 - protein, 5 aa, Entamoeba histolytica
GYVDE

SEQ ID NO: 2564304 - protein, 19 aa, Entamoeba histolytica
GYYDKTKKRITTKSTGCSP

SEQ ID NO: 2564305 - protein, 15 aa, Entamoeba histolytica
GYYKAEDGKNCNKCD

SEQ ID NO: 2564306 - protein, 10 aa, Entamoeba histolytica
GYYPDGDCKK

SEQ ID NO: 2564307 - protein, 7 aa, Entamoeba histolytica
GYYPSGK

SEQ ID NO: 2564308 - protein, 15 aa, Entamoeba histolytica
GYYTSSNTELSKKAE

SEQ ID NO: 2564309 - protein, 4 aa, Entamoeba histolytica
HADT

SEQ ID NO: 2564310 - protein, 4 aa, Entamoeba histolytica
HAKT

SEQ ID NO: 2564311 - protein, 6 aa, Entamoeba histolytica
HASSNT

SEQ ID NO: 2564312 - protein, 8 aa, Entamoeba histolytica
HATPSKTT

SEQ ID NO: 2564313 - protein, 5 aa, Entamoeba histolytica
HCDNE

SEQ ID NO: 2564314 - protein, 7 aa, Entamoeba histolytica
HCEKAEN

SEQ ID NO: 2564315 - protein, 5 aa, Entamoeba histolytica
HCERC

SEQ ID NO: 2564316 - protein, 11 aa, Entamoeba histolytica
HCESSSNNVCT

SEQ ID NO: 2564317 - protein, 13 aa, Entamoeba histolytica
HCSGPSSTECTTC

SEQ ID NO: 2564318 - protein, 5 aa, Entamoeba histolytica
HCSNG

SEQ ID NO: 2564319 - protein, 8 aa, Entamoeba histolytica
HDEESEYK

SEQ ID NO: 2564320 - protein, 6 aa, Entamoeba histolytica
HDETPY

SEQ ID NO: 2564321 - protein, 10 aa, Entamoeba histolytica
HDGGIEDGTY

SEQ ID NO: 2564322 - protein, 4 aa, Entamoeba histolytica
HDGY

SEQ ID NO: 2564323 - protein, 5 aa, Entamoeba histolytica
HDNFD

SEQ ID NO: 2564324 - protein, 15 aa, Entamoeba histolytica
HDNSVSLQSSSRQEY

SEQ ID NO: 2564325 - protein, 12 aa, Entamoeba histolytica
HDNTCNEPDGID

SEQ ID NO: 2564326 - protein, 19 aa, Entamoeba histolytica
HDNTQNENGIIPPRKKNYV

SEQ ID NO: 2564327 - protein, 8 aa, Entamoeba histolytica
HDPKQRPV

SEQ ID NO: 2564328 - protein, 37 aa, Entamoeba histolytica
HDPTDEKEESSEAEESSEAEESSEEDDDEKEESSEEE

SEQ ID NO: 2564329 - protein, 4 aa, Entamoeba histolytica
HDQN

SEQ ID NO: 2564330 - protein, 24 aa, Entamoeba histolytica
HDSRCSQCERGYEISNNGTSCDEK

SEQ ID NO: 2564331 - protein, 13 aa, Entamoeba histolytica
HDTKDAPSENDYS

SEQ ID NO: 2564332 - protein, 18 aa, Entamoeba histolytica
HDTPNKPKGKSKRDQKRQ

SEQ ID NO: 2564333 - protein, 8 aa, Entamoeba histolytica
HDTSDPQD

SEQ ID NO: 2564334 - protein, 7 aa, Entamoeba histolytica
HEEESFR

SEQ ID NO: 2564335 - protein, 30 aa, Entamoeba histolytica
HEEGKTDTNKFELNEKKEECITQQETKQNF

SEQ ID NO: 2564336 - protein, 17 aa, Entamoeba histolytica
HEGRKSCRKAKVDAQAE

SEQ ID NO: 2564337 - protein, 6 aa, Entamoeba histolytica
HEKKGI

SEQ ID NO: 2564338 - protein, 6 aa, Entamoeba histolytica
HEKPED

SEQ ID NO: 2564339 - protein, 6 aa, Entamoeba histolytica
HENFPS

SEQ ID NO: 2564340 - protein, 8 aa, Entamoeba histolytica
HENKESTL

SEQ ID NO: 2564341 - protein, 19 aa, Entamoeba histolytica
HENKYHDDENTQNQTYNRL

SEQ ID NO: 2564342 - protein, 17 aa, Entamoeba histolytica
HENKYNDDENTQHQTYN

SEQ ID NO: 2564343 - protein, 6 aa, Entamoeba histolytica
HENNIP

SEQ ID NO: 2564344 - protein, 6 aa, Entamoeba histolytica
HENTFT

SEQ ID NO: 2564345 - protein, 13 aa, Entamoeba histolytica
HEPNKDGSGCETT

SEQ ID NO: 2564346 - protein, 6 aa, Entamoeba histolytica
HEPPKD

SEQ ID NO: 2564347 - protein, 10 aa, Entamoeba histolytica
HEQGNDNGGL

SEQ ID NO: 2564348 - protein, 6 aa, Entamoeba histolytica
HEQGSY

SEQ ID NO: 2564349 - protein, 9 aa, Entamoeba histolytica
HEQKQEHQN

SEQ ID NO: 2564350 - protein, 10 aa, Entamoeba histolytica
HERKTEPEEI

SEQ ID NO: 2564351 - protein, 5 aa, Entamoeba histolytica
HERSI

SEQ ID NO: 2564352 - protein, 5 aa, Entamoeba histolytica
HERTV

SEQ ID NO: 2564353 - protein, 5 aa, Entamoeba histolytica
HETAI

SEQ ID NO: 2564354 - protein, 7 aa, Entamoeba histolytica
HETDGDV

SEQ ID NO: 2564355 - protein, 11 aa, Entamoeba histolytica
HETDGSSYKPY

SEQ ID NO: 2564356 - protein, 7 aa, Entamoeba histolytica
HETRKKE

SEQ ID NO: 2564357 - protein, 8 aa, Entamoeba histolytica
HETTSPVI

SEQ ID NO: 2564358 - protein, 4 aa, Entamoeba histolytica
HFDK

SEQ ID NO: 2564359 - protein, 5 aa, Entamoeba histolytica
HFGDN

SEQ ID NO: 2564360 - protein, 8 aa, Entamoeba histolytica
HFKENNTS

SEQ ID NO: 2564361 - protein, 9 aa, Entamoeba histolytica
HGDEKQMEE

SEQ ID NO: 2564362 - protein, 5 aa, Entamoeba histolytica
HGEPF

SEQ ID NO: 2564363 - protein, 6 aa, Entamoeba histolytica
HGGGPI

SEQ ID NO: 2564364 - protein, 14 aa, Entamoeba histolytica
HGIDENKAKRHSEI

SEQ ID NO: 2564365 - protein, 11 aa, Entamoeba histolytica
HGIKSSSACTI

SEQ ID NO: 2564366 - protein, 14 aa, Entamoeba histolytica
HGISENEVTENSTR

SEQ ID NO: 2564367 - protein, 6 aa, Entamoeba histolytica
HGKKKT

SEQ ID NO: 2564368 - protein, 7 aa, Entamoeba histolytica
HGNARTC

SEQ ID NO: 2564369 - protein, 4 aa, Entamoeba histolytica
HGNL

SEQ ID NO: 2564370 - protein, 9 aa, Entamoeba histolytica
HGNQFGKSA

SEQ ID NO: 2564371 - protein, 7 aa, Entamoeba histolytica
HGRCTEN

SEQ ID NO: 2564372 - protein, 11 aa, Entamoeba histolytica
HGRSSGEPKGW

SEQ ID NO: 2564373 - protein, 14 aa, Entamoeba histolytica
HGSNTKCTYNPSSE

SEQ ID NO: 2564374 - protein, 4 aa, Entamoeba histolytica
HGTG

SEQ ID NO: 2564375 - protein, 8 aa, Entamoeba histolytica
HGYQQTCE

SEQ ID NO: 2564376 - protein, 6 aa, Entamoeba histolytica
HHHEDT

SEQ ID NO: 2564377 - protein, 4 aa, Entamoeba histolytica
HIPS

SEQ ID NO: 2564378 - protein, 10 aa, Entamoeba histolytica
HIQPPQPKYK

SEQ ID NO: 2564379 - protein, 6 aa, Entamoeba histolytica
HISDNR

SEQ ID NO: 2564380 - protein, 16 aa, Entamoeba histolytica
HISPSHPSRSTPYASL

SEQ ID NO: 2564381 - protein, 4 aa, Entamoeba histolytica
HITD

SEQ ID NO: 2564382 - protein, 8 aa, Entamoeba histolytica
HKARNKKT

SEQ ID NO: 2564383 - protein, 11 aa, Entamoeba histolytica
HKATQKSSAVS

SEQ ID NO: 2564384 - protein, 4 aa, Entamoeba histolytica
HKCS

SEQ ID NO: 2564385 - protein, 6 aa, Entamoeba histolytica
HKDGSI

SEQ ID NO: 2564386 - protein, 30 aa, Entamoeba histolytica
HKDQEKAPLVENEQQTINDFKNNQNPNDLI

SEQ ID NO: 2564387 - protein, 16 aa, Entamoeba histolytica
HKDTVDEELSHTDAQR

SEQ ID NO: 2564388 - protein, 7 aa, Entamoeba histolytica
HKECNEN

SEQ ID NO: 2564389 - protein, 10 aa, Entamoeba histolytica
HKEESFHKTN

SEQ ID NO: 2564390 - protein, 12 aa, Entamoeba histolytica
HKEFDKDVSNKR

SEQ ID NO: 2564391 - protein, 7 aa, Entamoeba histolytica
HKETPKE

SEQ ID NO: 2564392 - protein, 8 aa, Entamoeba histolytica
HKGKHNIS

SEQ ID NO: 2564393 - protein, 13 aa, Entamoeba histolytica
HKHPEEEKEEGKG

SEQ ID NO: 2564394 - protein, 15 aa, Entamoeba histolytica
HKKEVSEQHKSQVVM

SEQ ID NO: 2564395 - protein, 22 aa, Entamoeba histolytica
HKKIESPDISQNEETKRLIDSQ

SEQ ID NO: 2564396 - protein, 11 aa, Entamoeba histolytica
HKKNTTKSIKP

SEQ ID NO: 2564397 - protein, 10 aa, Entamoeba histolytica
HKKQKLSRKK

SEQ ID NO: 2564398 - protein, 8 aa, Entamoeba histolytica
HKLGEKSR

SEQ ID NO: 2564399 - protein, 12 aa, Entamoeba histolytica
HKPECADIPPKK

SEQ ID NO: 2564400 - protein, 7 aa, Entamoeba histolytica
HKSEQNI

SEQ ID NO: 2564401 - protein, 9 aa, Entamoeba histolytica
HKSERSIGP

SEQ ID NO: 2564402 - protein, 9 aa, Entamoeba histolytica
HKSESSIPN

SEQ ID NO: 2564403 - protein, 4 aa, Entamoeba histolytica
HKTE

SEQ ID NO: 2564404 - protein, 18 aa, Entamoeba histolytica
HKTGETSSKKVVKTSENK

SEQ ID NO: 2564405 - protein, 7 aa, Entamoeba histolytica
HKTSEKV

SEQ ID NO: 2564406 - protein, 8 aa, Entamoeba histolytica
HKVKRNNQ

SEQ ID NO: 2564407 - protein, 7 aa, Entamoeba histolytica
HKVSQPS

SEQ ID NO: 2564408 - protein, 15 aa, Entamoeba histolytica
HKVSQPSKTNRNKIY

SEQ ID NO: 2564409 - protein, 7 aa, Entamoeba histolytica
HKYKENE

SEQ ID NO: 2564410 - protein, 4 aa, Entamoeba histolytica
HKYS

SEQ ID NO: 2564411 - protein, 12 aa, Entamoeba histolytica
HKYSKDKKPGHK

SEQ ID NO: 2564412 - protein, 7 aa, Entamoeba histolytica
HLDDENK

SEQ ID NO: 2564413 - protein, 13 aa, Entamoeba histolytica
HLDDNTTTSFLHE

SEQ ID NO: 2564414 - protein, 9 aa, Entamoeba histolytica
HLDESNKTL

SEQ ID NO: 2564415 - protein, 5 aa, Entamoeba histolytica
HLPQY

SEQ ID NO: 2564416 - protein, 5 aa, Entamoeba histolytica
HMETG

SEQ ID NO: 2564417 - protein, 8 aa, Entamoeba histolytica
HMQRTSEE

SEQ ID NO: 2564418 - protein, 6 aa, Entamoeba histolytica
HNGDGV

SEQ ID NO: 2564419 - protein, 6 aa, Entamoeba histolytica
HNHTKR

SEQ ID NO: 2564420 - protein, 7 aa, Entamoeba histolytica
HNKITQY

SEQ ID NO: 2564421 - protein, 4 aa, Entamoeba histolytica
HNKK

SEQ ID NO: 2564422 - protein, 8 aa, Entamoeba histolytica
HNNAQGLR

SEQ ID NO: 2564423 - protein, 11 aa, Entamoeba histolytica
HNNHQNPNSMN

SEQ ID NO: 2564424 - protein, 9 aa, Entamoeba histolytica
HNPKLGDAS

SEQ ID NO: 2564425 - protein, 14 aa, Entamoeba histolytica
HNQQSHDQQSLYED

SEQ ID NO: 2564426 - protein, 6 aa, Entamoeba histolytica
HNSKED

SEQ ID NO: 2564427 - protein, 4 aa, Entamoeba histolytica
HNTY

SEQ ID NO: 2564428 - protein, 7 aa, Entamoeba histolytica
HPAQADQ

SEQ ID NO: 2564429 - protein, 9 aa, Entamoeba histolytica
HPASQRGIT

SEQ ID NO: 2564430 - protein, 19 aa, Entamoeba histolytica
HPATVKEEEESEEEKERAF

SEQ ID NO: 2564431 - protein, 5 aa, Entamoeba histolytica
HPCSE

SEQ ID NO: 2564432 - protein, 15 aa, Entamoeba histolytica
HPDKSKEEDAAEKFQ

SEQ ID NO: 2564433 - protein, 13 aa, Entamoeba histolytica
HPDKTRDPNAEDK

SEQ ID NO: 2564434 - protein, 14 aa, Entamoeba histolytica
HPDTHPGDSQYAKI

SEQ ID NO: 2564435 - protein, 5 aa, Entamoeba histolytica
HPDVG

SEQ ID NO: 2564436 - protein, 7 aa, Entamoeba histolytica
HPEPGTI

SEQ ID NO: 2564437 - protein, 26 aa, Entamoeba histolytica
HPEQSQGHEVQQSQEPDGHDNDQSDK

SEQ ID NO: 2564438 - protein, 4 aa, Entamoeba histolytica
HPGE

SEQ ID NO: 2564439 - protein, 6 aa, Entamoeba histolytica
HPHETR

SEQ ID NO: 2564440 - protein, 7 aa, Entamoeba histolytica
HPHTSSG

SEQ ID NO: 2564441 - protein, 5 aa, Entamoeba histolytica
HPIQT

SEQ ID NO: 2564442 - protein, 8 aa, Entamoeba histolytica
HPKDRERE

SEQ ID NO: 2564443 - protein, 5 aa, Entamoeba histolytica
HPMKQ

SEQ ID NO: 2564444 - protein, 11 aa, Entamoeba histolytica
HPNAIPPTYIP

SEQ ID NO: 2564445 - protein, 4 aa, Entamoeba histolytica
HPNP

SEQ ID NO: 2564446 - protein, 9 aa, Entamoeba histolytica
HPNSVSDPM

SEQ ID NO: 2564447 - protein, 5 aa, Entamoeba histolytica
HPNVD

SEQ ID NO: 2564448 - protein, 13 aa, Entamoeba histolytica
HPPDGLETDREKV

SEQ ID NO: 2564449 - protein, 4 aa, Entamoeba histolytica
HPPG

SEQ ID NO: 2564450 - protein, 6 aa, Entamoeba histolytica
HPQPKV

SEQ ID NO: 2564451 - protein, 12 aa, Entamoeba histolytica
HPQQYRPNHSNE

SEQ ID NO: 2564452 - protein, 16 aa, Entamoeba histolytica
HPSEKEEGSTNASNKE

SEQ ID NO: 2564453 - protein, 18 aa, Entamoeba histolytica
HPSGEKTVAEEMNYKSTE

SEQ ID NO: 2564454 - protein, 6 aa, Entamoeba histolytica
HPSSPL

SEQ ID NO: 2564455 - protein, 4 aa, Entamoeba histolytica
HPTG

SEQ ID NO: 2564456 - protein, 5 aa, Entamoeba histolytica
HPTSS

SEQ ID NO: 2564457 - protein, 10 aa, Entamoeba histolytica
HQCDDNGEIG

SEQ ID NO: 2564458 - protein, 11 aa, Entamoeba histolytica
HQCEDNGEIGN

SEQ ID NO: 2564459 - protein, 20 aa, Entamoeba histolytica
HQDEFSAEGSVGSRSESPTI

SEQ ID NO: 2564460 - protein, 10 aa, Entamoeba histolytica
HQEDTELAEQ

SEQ ID NO: 2564461 - protein, 6 aa, Entamoeba histolytica
HQEGYD

SEQ ID NO: 2564462 - protein, 19 aa, Entamoeba histolytica
HQFEDGNEENIDIDPKGAK

SEQ ID NO: 2564463 - protein, 6 aa, Entamoeba histolytica
HQGEES

SEQ ID NO: 2564464 - protein, 15 aa, Entamoeba histolytica
HQKDQKIDKEIKNLK

SEQ ID NO: 2564465 - protein, 6 aa, Entamoeba histolytica
HQKELD

SEQ ID NO: 2564466 - protein, 5 aa, Entamoeba histolytica
HQMTS

SEQ ID NO: 2564467 - protein, 5 aa, Entamoeba histolytica
HQPVP

SEQ ID NO: 2564468 - protein, 13 aa, Entamoeba histolytica
HQQPLNESVNENG

SEQ ID NO: 2564469 - protein, 8 aa, Entamoeba histolytica
HQQQTNHN

SEQ ID NO: 2564470 - protein, 5 aa, Entamoeba histolytica
HQSDY

SEQ ID NO: 2564471 - protein, 6 aa, Entamoeba histolytica
HQSGDT

SEQ ID NO: 2564472 - protein, 12 aa, Entamoeba histolytica
HQSQGEETREKH

SEQ ID NO: 2564473 - protein, 16 aa, Entamoeba histolytica
HQTAELTPLSECTKGR

SEQ ID NO: 2564474 - protein, 5 aa, Entamoeba histolytica
HQTEI

SEQ ID NO: 2564475 - protein, 5 aa, Entamoeba histolytica
HQTNI

SEQ ID NO: 2564476 - protein, 5 aa, Entamoeba histolytica
HQTTE

SEQ ID NO: 2564477 - protein, 20 aa, Entamoeba histolytica
HRCEPCPAGTYSNTTTATSC

SEQ ID NO: 2564478 - protein, 5 aa, Entamoeba histolytica
HRDAN

SEQ ID NO: 2564479 - protein, 5 aa, Entamoeba histolytica
HRDLK

SEQ ID NO: 2564480 - protein, 12 aa, Entamoeba histolytica
HRDTSDQEENTI

SEQ ID NO: 2564481 - protein, 12 aa, Entamoeba histolytica
HREDEDAQIDED

SEQ ID NO: 2564482 - protein, 4 aa, Entamoeba histolytica
HRKK

SEQ ID NO: 2564483 - protein, 11 aa, Entamoeba histolytica
HRKVSKRCSQE

SEQ ID NO: 2564484 - protein, 22 aa, Entamoeba histolytica
HRPANENGQVVTTPQIKRELPK

SEQ ID NO: 2564485 - protein, 7 aa, Entamoeba histolytica
HRSGGNV

SEQ ID NO: 2564486 - protein, 9 aa, Entamoeba histolytica
HRSSTESMT

SEQ ID NO: 2564487 - protein, 22 aa, Entamoeba histolytica
HRTTTSLSSYSRRTSSNAKQFL

SEQ ID NO: 2564488 - protein, 8 aa, Entamoeba histolytica
HSCNNNGN

SEQ ID NO: 2564489 - protein, 7 aa, Entamoeba histolytica
HSCSSTS

SEQ ID NO: 2564490 - protein, 7 aa, Entamoeba histolytica
HSDGSSW

SEQ ID NO: 2564491 - protein, 6 aa, Entamoeba histolytica
HSDGSV

SEQ ID NO: 2564492 - protein, 7 aa, Entamoeba histolytica
HSDSSSV

SEQ ID NO: 2564493 - protein, 4 aa, Entamoeba histolytica
HSEK

SEQ ID NO: 2564494 - protein, 13 aa, Entamoeba histolytica
HSEKEEEATSEEE

SEQ ID NO: 2564495 - protein, 7 aa, Entamoeba histolytica
HSEQTQL

SEQ ID NO: 2564496 - protein, 4 aa, Entamoeba histolytica
HSFN

SEQ ID NO: 2564497 - protein, 8 aa, Entamoeba histolytica
HSFPSGHT

SEQ ID NO: 2564498 - protein, 5 aa, Entamoeba histolytica
HSGPL

SEQ ID NO: 2564499 - protein, 42 aa, Entamoeba histolytica
HSHGHSHGHSHEHSHGHSHKHSHEGYQRHESHEEEMKENDVK

SEQ ID NO: 2564500 - protein, 6 aa, Entamoeba histolytica
HSHSTK

SEQ ID NO: 2564501 - protein, 6 aa, Entamoeba histolytica
HSKDQN

SEQ ID NO: 2564502 - protein, 18 aa, Entamoeba histolytica
HSKGSRLKIGKNRNGSII

SEQ ID NO: 2564503 - protein, 6 aa, Entamoeba histolytica
HSLDEK

SEQ ID NO: 2564504 - protein, 7 aa, Entamoeba histolytica
HSNDSSV

SEQ ID NO: 2564505 - protein, 9 aa, Entamoeba histolytica
HSNEKEEGF

SEQ ID NO: 2564506 - protein, 8 aa, Entamoeba histolytica
HSNETNQS

SEQ ID NO: 2564507 - protein, 15 aa, Entamoeba histolytica
HSNIQKQYESLQQVT

SEQ ID NO: 2564508 - protein, 6 aa, Entamoeba histolytica
HSPASS

SEQ ID NO: 2564509 - protein, 7 aa, Entamoeba histolytica
HSPNLPS

SEQ ID NO: 2564510 - protein, 5 aa, Entamoeba histolytica
HSPNV

SEQ ID NO: 2564511 - protein, 7 aa, Entamoeba histolytica
HSPRNSS

SEQ ID NO: 2564512 - protein, 6 aa, Entamoeba histolytica
HSPSDL

SEQ ID NO: 2564513 - protein, 6 aa, Entamoeba histolytica
HSPSKI

SEQ ID NO: 2564514 - protein, 10 aa, Entamoeba histolytica
HSQEPQRGWD

SEQ ID NO: 2564515 - protein, 7 aa, Entamoeba histolytica
HSQKSMQ

SEQ ID NO: 2564516 - protein, 4 aa, Entamoeba histolytica
HSQP

SEQ ID NO: 2564517 - protein, 24 aa, Entamoeba histolytica
HSQPSTPSQKSSRKLFSFGKKEEK

SEQ ID NO: 2564518 - protein, 12 aa, Entamoeba histolytica
HSRKRSKSSPID

SEQ ID NO: 2564519 - protein, 14 aa, Entamoeba histolytica
HSSHLSQRSSLHNA

SEQ ID NO: 2564520 - protein, 4 aa, Entamoeba histolytica
HSSN

SEQ ID NO: 2564521 - protein, 7 aa, Entamoeba histolytica
HSSNNYG

SEQ ID NO: 2564522 - protein, 6 aa, Entamoeba histolytica
HSSSDL

SEQ ID NO: 2564523 - protein, 7 aa, Entamoeba histolytica
HSTCDNS

SEQ ID NO: 2564524 - protein, 5 aa, Entamoeba histolytica
HSTDE

SEQ ID NO: 2564525 - protein, 5 aa, Entamoeba histolytica
HSTIG

SEQ ID NO: 2564526 - protein, 5 aa, Entamoeba histolytica
HSTLT

SEQ ID NO: 2564527 - protein, 11 aa, Entamoeba histolytica
HSTNGNTKLPS

SEQ ID NO: 2564528 - protein, 7 aa, Entamoeba histolytica
HSTNSQA

SEQ ID NO: 2564529 - protein, 6 aa, Entamoeba histolytica
HSTSRC

SEQ ID NO: 2564530 - protein, 18 aa, Entamoeba histolytica
HTADKTDKGYSASSADEE

SEQ ID NO: 2564531 - protein, 9 aa, Entamoeba histolytica
HTATTQEHR

SEQ ID NO: 2564532 - protein, 5 aa, Entamoeba histolytica
HTDEE

SEQ ID NO: 2564533 - protein, 7 aa, Entamoeba histolytica
HTEEKYN

SEQ ID NO: 2564534 - protein, 10 aa, Entamoeba histolytica
HTEESKSSLL

SEQ ID NO: 2564535 - protein, 4 aa, Entamoeba histolytica
HTEK

SEQ ID NO: 2564536 - protein, 14 aa, Entamoeba histolytica
HTEPTKSGSRKHSA

SEQ ID NO: 2564537 - protein, 12 aa, Entamoeba histolytica
HTINTKGGNNQN

SEQ ID NO: 2564538 - protein, 8 aa, Entamoeba histolytica
HTKEDRGL

SEQ ID NO: 2564539 - protein, 14 aa, Entamoeba histolytica
HTLQRDGTKSICQS

SEQ ID NO: 2564540 - protein, 4 aa, Entamoeba histolytica
HTNR

SEQ ID NO: 2564541 - protein, 8 aa, Entamoeba histolytica
HTNYEQEE

SEQ ID NO: 2564542 - protein, 5 aa, Entamoeba histolytica
HTQSN

SEQ ID NO: 2564543 - protein, 9 aa, Entamoeba histolytica
HTSAEEAST

SEQ ID NO: 2564544 - protein, 6 aa, Entamoeba histolytica
HTTGAN

SEQ ID NO: 2564545 - protein, 6 aa, Entamoeba histolytica
HTTPKV

SEQ ID NO: 2564546 - protein, 6 aa, Entamoeba histolytica
HTTPQE

SEQ ID NO: 2564547 - protein, 9 aa, Entamoeba histolytica
HTTTTQNNW

SEQ ID NO: 2564548 - protein, 11 aa, Entamoeba histolytica
HVDSNGKCSCG

SEQ ID NO: 2564549 - protein, 5 aa, Entamoeba histolytica
HYDRP

SEQ ID NO: 2564550 - protein, 5 aa, Entamoeba histolytica
HYEET

SEQ ID NO: 2564551 - protein, 10 aa, Entamoeba histolytica
HYGGGRNNAA

SEQ ID NO: 2564552 - protein, 5 aa, Entamoeba histolytica
HYNQS

SEQ ID NO: 2564553 - protein, 10 aa, Entamoeba histolytica
HYPDPTKSSC

SEQ ID NO: 2564554 - protein, 5 aa, Entamoeba histolytica
HYPNE

SEQ ID NO: 2564555 - protein, 11 aa, Entamoeba histolytica
HYTEDDPSYPF

SEQ ID NO: 2564556 - protein, 6 aa, Entamoeba histolytica
IAATNQ

SEQ ID NO: 2564557 - protein, 5 aa, Entamoeba histolytica
IADGT

SEQ ID NO: 2564558 - protein, 4 aa, Entamoeba histolytica
IADM

SEQ ID NO: 2564559 - protein, 9 aa, Entamoeba histolytica
IADNQNSAK

SEQ ID NO: 2564560 - protein, 7 aa, Entamoeba histolytica
IADSGLE

SEQ ID NO: 2564561 - protein, 23 aa, Entamoeba histolytica
IAEDKQKDKEKWNRLDKQTQNDI

SEQ ID NO: 2564562 - protein, 15 aa, Entamoeba histolytica
IAEESSKCSNAETIT

SEQ ID NO: 2564563 - protein, 5 aa, Entamoeba histolytica
IAEKS

SEQ ID NO: 2564564 - protein, 4 aa, Entamoeba histolytica
IAEN

SEQ ID NO: 2564565 - protein, 10 aa, Entamoeba histolytica
IAEQNKNNYS

SEQ ID NO: 2564566 - protein, 12 aa, Entamoeba histolytica
IAESETVAVNTS

SEQ ID NO: 2564567 - protein, 13 aa, Entamoeba histolytica
IAETTDCSSLSEV

SEQ ID NO: 2564568 - protein, 4 aa, Entamoeba histolytica
IAGG

SEQ ID NO: 2564569 - protein, 8 aa, Entamoeba histolytica
IAHDGRPK

SEQ ID NO: 2564570 - protein, 7 aa, Entamoeba histolytica
IAITPSG

SEQ ID NO: 2564571 - protein, 10 aa, Entamoeba histolytica
IANDQSSAKC

SEQ ID NO: 2564572 - protein, 9 aa, Entamoeba histolytica
IANNERNPS

SEQ ID NO: 2564573 - protein, 8 aa, Entamoeba histolytica
IAPTTGTP

SEQ ID NO: 2564574 - protein, 6 aa, Entamoeba histolytica
IATEEQ

SEQ ID NO: 2564575 - protein, 6 aa, Entamoeba histolytica
IATSCK

SEQ ID NO: 2564576 - protein, 4 aa, Entamoeba histolytica
IAYT

SEQ ID NO: 2564577 - protein, 21 aa, Entamoeba histolytica
ICDESYSKRQEQFGKNRTPDA

SEQ ID NO: 2564578 - protein, 5 aa, Entamoeba histolytica
ICGDK

SEQ ID NO: 2564579 - protein, 5 aa, Entamoeba histolytica
ICNSD

SEQ ID NO: 2564580 - protein, 13 aa, Entamoeba histolytica
ICNTEPSKVPGSV

SEQ ID NO: 2564581 - protein, 12 aa, Entamoeba histolytica
ICSGSGDNEECS

SEQ ID NO: 2564582 - protein, 7 aa, Entamoeba histolytica
ICSSNSM

SEQ ID NO: 2564583 - protein, 9 aa, Entamoeba histolytica
IDASSQPTT

SEQ ID NO: 2564584 - protein, 9 aa, Entamoeba histolytica
IDDDDTSCD

SEQ ID NO: 2564585 - protein, 6 aa, Entamoeba histolytica
IDDEPK

SEQ ID NO: 2564586 - protein, 13 aa, Entamoeba histolytica
IDDNSETMSIDEL

SEQ ID NO: 2564587 - protein, 5 aa, Entamoeba histolytica
IDDPA

SEQ ID NO: 2564588 - protein, 9 aa, Entamoeba histolytica
IDDPYEAPL

SEQ ID NO: 2564589 - protein, 4 aa, Entamoeba histolytica
IDEA

SEQ ID NO: 2564590 - protein, 17 aa, Entamoeba histolytica
IDEAEDDVSYQETKDLA

SEQ ID NO: 2564591 - protein, 14 aa, Entamoeba histolytica
IDEELNSSNECTTL

SEQ ID NO: 2564592 - protein, 6 aa, Entamoeba histolytica
IDEGKS

SEQ ID NO: 2564593 - protein, 6 aa, Entamoeba histolytica
IDEKTP

SEQ ID NO: 2564594 - protein, 4 aa, Entamoeba histolytica
IDEN

SEQ ID NO: 2564595 - protein, 9 aa, Entamoeba histolytica
IDENDKETN

SEQ ID NO: 2564596 - protein, 6 aa, Entamoeba histolytica
IDENTN

SEQ ID NO: 2564597 - protein, 5 aa, Entamoeba histolytica
IDEQE

SEQ ID NO: 2564598 - protein, 5 aa, Entamoeba histolytica
IDERS

SEQ ID NO: 2564599 - protein, 5 aa, Entamoeba histolytica
IDESK

SEQ ID NO: 2564600 - protein, 8 aa, Entamoeba histolytica
IDESQSNL

SEQ ID NO: 2564601 - protein, 19 aa, Entamoeba histolytica
IDESQVQIEPNPAFDVPAN

SEQ ID NO: 2564602 - protein, 9 aa, Entamoeba histolytica
IDETSPKEN

SEQ ID NO: 2564603 - protein, 5 aa, Entamoeba histolytica
IDEVP

SEQ ID NO: 2564604 - protein, 14 aa, Entamoeba histolytica
IDFGDKRPEIDEPI

SEQ ID NO: 2564605 - protein, 8 aa, Entamoeba histolytica
IDGDGKND

SEQ ID NO: 2564606 - protein, 11 aa, Entamoeba histolytica
IDGDSYSNPYK

SEQ ID NO: 2564607 - protein, 6 aa, Entamoeba histolytica
IDGEKK

SEQ ID NO: 2564608 - protein, 8 aa, Entamoeba histolytica
IDGEVTPK

SEQ ID NO: 2564609 - protein, 6 aa, Entamoeba histolytica
IDGKDV

SEQ ID NO: 2564610 - protein, 16 aa, Entamoeba histolytica
IDGNSDIKIPQTQKDH

SEQ ID NO: 2564611 - protein, 28 aa, Entamoeba histolytica
IDINQTEQNINNPLKDKDMSSNKHSTNL

SEQ ID NO: 2564612 - protein, 6 aa, Entamoeba histolytica
IDKDSQ

SEQ ID NO: 2564613 - protein, 13 aa, Entamoeba histolytica
IDKENNSSKNEIH

SEQ ID NO: 2564614 - protein, 9 aa, Entamoeba histolytica
IDKERRNES

SEQ ID NO: 2564615 - protein, 9 aa, Entamoeba histolytica
IDKETDNTL

SEQ ID NO: 2564616 - protein, 11 aa, Entamoeba histolytica
IDKKNQDKHIE

SEQ ID NO: 2564617 - protein, 8 aa, Entamoeba histolytica
IDKKRSTR

SEQ ID NO: 2564618 - protein, 7 aa, Entamoeba histolytica
IDKNKSE

SEQ ID NO: 2564619 - protein, 6 aa, Entamoeba histolytica
IDKSGI

SEQ ID NO: 2564620 - protein, 28 aa, Entamoeba histolytica
IDKSVSSKSSGGQGSKRRVNKILSRRFD

SEQ ID NO: 2564621 - protein, 6 aa, Entamoeba histolytica
IDKTDG

SEQ ID NO: 2564622 - protein, 8 aa, Entamoeba histolytica
IDKTTEKM

SEQ ID NO: 2564623 - protein, 14 aa, Entamoeba histolytica
IDNEGYSNRTDSKT

SEQ ID NO: 2564624 - protein, 8 aa, Entamoeba histolytica
IDNGPNSE

SEQ ID NO: 2564625 - protein, 17 aa, Entamoeba histolytica
IDNGTKCQECAENQAPY

SEQ ID NO: 2564626 - protein, 9 aa, Entamoeba histolytica
IDNKESHTY

SEQ ID NO: 2564627 - protein, 13 aa, Entamoeba histolytica
IDNKGNKQDFKNK

SEQ ID NO: 2564628 - protein, 5 aa, Entamoeba histolytica
IDNKT

SEQ ID NO: 2564629 - protein, 12 aa, Entamoeba histolytica
IDNQKEETTADH

SEQ ID NO: 2564630 - protein, 7 aa, Entamoeba histolytica
IDNSNQV

SEQ ID NO: 2564631 - protein, 7 aa, Entamoeba histolytica
IDNTDNI

SEQ ID NO: 2564632 - protein, 4 aa, Entamoeba histolytica
IDPQ

SEQ ID NO: 2564633 - protein, 6 aa, Entamoeba histolytica
IDPQKD

SEQ ID NO: 2564634 - protein, 6 aa, Entamoeba histolytica
IDPQQT

SEQ ID NO: 2564635 - protein, 8 aa, Entamoeba histolytica
IDPSSTSI

SEQ ID NO: 2564636 - protein, 6 aa, Entamoeba histolytica
IDPTNY

SEQ ID NO: 2564637 - protein, 12 aa, Entamoeba histolytica
IDQNEECDGGKG

SEQ ID NO: 2564638 - protein, 5 aa, Entamoeba histolytica
IDQTR

SEQ ID NO: 2564639 - protein, 8 aa, Entamoeba histolytica
IDREITSG

SEQ ID NO: 2564640 - protein, 13 aa, Entamoeba histolytica
IDRISGPEETTSS

SEQ ID NO: 2564641 - protein, 9 aa, Entamoeba histolytica
IDRPDQGYT

SEQ ID NO: 2564642 - protein, 32 aa, Entamoeba histolytica; identical to SEQ ID NO: 2365576

SEQ ID NO: 2564643 - protein, 12 aa, Entamoeba histolytica
IDSGKEPKATQM

SEQ ID NO: 2564644 - protein, 7 aa, Entamoeba histolytica
IDSHPPQ

SEQ ID NO: 2564645 - protein, 8 aa, Entamoeba histolytica
IDSKKKKF

SEQ ID NO: 2564646 - protein, 7 aa, Entamoeba histolytica
IDSNERM

SEQ ID NO: 2564647 - protein, 15 aa, Entamoeba histolytica
IDSNSTDDSSSQVVD

SEQ ID NO: 2564648 - protein, 8 aa, Entamoeba histolytica
IDSSCGEF

SEQ ID NO: 2564649 - protein, 6 aa, Entamoeba histolytica
IDSSKL

SEQ ID NO: 2564650 - protein, 8 aa, Entamoeba histolytica
IDSSNNNR

SEQ ID NO: 2564651 - protein, 22 aa, Entamoeba histolytica
IDSVSFEEKDCNEEYTSTNGNK

SEQ ID NO: 2564652 - protein, 4 aa, Entamoeba histolytica
IDSY

SEQ ID NO: 2564653 - protein, 4 aa, Entamoeba histolytica
IDTE

SEQ ID NO: 2564654 - protein, 18 aa, Entamoeba histolytica
IDTETKKEDKKKKEHHHQ

SEQ ID NO: 2564655 - protein, 6 aa, Entamoeba histolytica
IDTGGD

SEQ ID NO: 2564656 - protein, 12 aa, Entamoeba histolytica
IDTNHTKPDSYK

SEQ ID NO: 2564657 - protein, 6 aa, Entamoeba histolytica
IDTPKN

SEQ ID NO: 2564658 - protein, 9 aa, Entamoeba histolytica
IDTSGEPLL

SEQ ID NO: 2564659 - protein, 28 aa, Entamoeba histolytica
IDTSNQEKAPVIEEKEETESMGNNDKQI

SEQ ID NO: 2564660 - protein, 23 aa, Entamoeba histolytica
IDVPSEIENNKNNYVKSINGDDP

SEQ ID NO: 2564661 - protein, 6 aa, Entamoeba histolytica
IDVQKE

SEQ ID NO: 2564662 - protein, 16 aa, Entamoeba histolytica
IDYERTNPNTYQPPET

SEQ ID NO: 2564663 - protein, 6 aa, Entamoeba histolytica
IEDAAT

SEQ ID NO: 2564664 - protein, 11 aa, Entamoeba histolytica
IEDATSSSKEI

SEQ ID NO: 2564665 - protein, 14 aa, Entamoeba histolytica
IEDDTLKHSKITSK

SEQ ID NO: 2564666 - protein, 8 aa, Entamoeba histolytica
IEDEENKQ

SEQ ID NO: 2564667 - protein, 10 aa, Entamoeba histolytica
IEDEIEEDAT

SEQ ID NO: 2564668 - protein, 7 aa, Entamoeba histolytica
IEDHTKD

SEQ ID NO: 2564669 - protein, 11 aa, Entamoeba histolytica
IEDKLQDGVPE

SEQ ID NO: 2564670 - protein, 9 aa, Entamoeba histolytica
IEDQSSTYI

SEQ ID NO: 2564671 - protein, 6 aa, Entamoeba histolytica
IEDRRT

SEQ ID NO: 2564672 - protein, 6 aa, Entamoeba histolytica
IEEAEP

SEQ ID NO: 2564673 - protein, 10 aa, Entamoeba histolytica
IEEDGKKSIK

SEQ ID NO: 2564674 - protein, 8 aa, Entamoeba histolytica
IEEEEGKT

SEQ ID NO: 2564675 - protein, 15 aa, Entamoeba histolytica
IEEEERKEELPSRIE

SEQ ID NO: 2564676 - protein, 10 aa, Entamoeba histolytica
IEEEGGEKRI

SEQ ID NO: 2564677 - protein, 5 aa, Entamoeba histolytica
IEEEK

SEQ ID NO: 2564678 - protein, 18 aa, Entamoeba histolytica
IEEENNKEETSSIDSNEI

SEQ ID NO: 2564679 - protein, 11 aa, Entamoeba histolytica
IEEKDQKTSDI

SEQ ID NO: 2564680 - protein, 17 aa, Entamoeba histolytica
IEEKETEEEKKDNGIIE

SEQ ID NO: 2564681 - protein, 5 aa, Entamoeba histolytica
IEEPQ

SEQ ID NO: 2564682 - protein, 14 aa, Entamoeba histolytica
IEEQKKKRRTSLPN

SEQ ID NO: 2564683 - protein, 11 aa, Entamoeba histolytica
IEEQNSTNPVI

SEQ ID NO: 2564684 - protein, 5 aa, Entamoeba histolytica
IEERG

SEQ ID NO: 2564685 - protein, 9 aa, Entamoeba histolytica
IEESKKPTF

SEQ ID NO: 2564686 - protein, 7 aa, Entamoeba histolytica
IEESSTS

SEQ ID NO: 2564687 - protein, 13 aa, Entamoeba histolytica
IEESTQNTETKDI

SEQ ID NO: 2564688 - protein, 15 aa, Entamoeba histolytica
IEETKEKQIKRIKPR

SEQ ID NO: 2564689 - protein, 10 aa, Entamoeba histolytica
IEETKQSEDV

SEQ ID NO: 2564690 - protein, 5 aa, Entamoeba histolytica
IEETP

SEQ ID NO: 2564691 - protein, 25 aa, Entamoeba histolytica
IEEVKSPERVGKKERRVKTKESKIN

SEQ ID NO: 2564692 - protein, 13 aa, Entamoeba histolytica
IEEYEKSKETKKI

SEQ ID NO: 2564693 - protein, 6 aa, Entamoeba histolytica
IEEYQK

SEQ ID NO: 2564694 - protein, 26 aa, Entamoeba histolytica
IEGETEISTRLDPDEIKEEKKIGEGT

SEQ ID NO: 2564695 - protein, 8 aa, Entamoeba histolytica
IEGKEKKY

SEQ ID NO: 2564696 - protein, 12 aa, Entamoeba histolytica
IEGKLENQGINQ

SEQ ID NO: 2564697 - protein, 4 aa, Entamoeba histolytica
IEGR

SEQ ID NO: 2564698 - protein, 8 aa, Entamoeba histolytica
IEHQENME

SEQ ID NO: 2564699 - protein, 4 aa, Entamoeba histolytica
IEIS

SEQ ID NO: 2564700 - protein, 8 aa, Entamoeba histolytica
IEKDTTTI

SEQ ID NO: 2564701 - protein, 6 aa, Entamoeba histolytica
IEKEDS

SEQ ID NO: 2564702 - protein, 10 aa, Entamoeba histolytica
IEKEKKENKI

SEQ ID NO: 2564703 - protein, 8 aa, Entamoeba histolytica
IEKEVPPV

SEQ ID NO: 2564704 - protein, 8 aa, Entamoeba histolytica
IEKKDKEW

SEQ ID NO: 2564705 - protein, 6 aa, Entamoeba histolytica
IEKKEH

SEQ ID NO: 2564706 - protein, 21 aa, Entamoeba histolytica
IEKKKSLSNVSNEKEYDEKEE

SEQ ID NO: 2564707 - protein, 8 aa, Entamoeba histolytica
IEKKNIEN

SEQ ID NO: 2564708 - protein, 9 aa, Entamoeba histolytica
IEKPEGTNR

SEQ ID NO: 2564709 - protein, 5 aa, Entamoeba histolytica
IEKQE

SEQ ID NO: 2564710 - protein, 7 aa, Entamoeba histolytica
IEKSSGK

SEQ ID NO: 2564711 - protein, 8 aa, Entamoeba histolytica
IEKSSLPS

SEQ ID NO: 2564712 - protein, 21 aa, Entamoeba histolytica
IELNKQTSYLNPESHKCTDGK

SEQ ID NO: 2564713 - protein, 21 aa, Entamoeba histolytica
IELNKQTSYLNPESHKCTDGN

SEQ ID NO: 2564714 - protein, 6 aa, Entamoeba histolytica
IELSSE

SEQ ID NO: 2564715 - protein, 16 aa, Entamoeba histolytica
IENDIKKKREIDSNEV

SEQ ID NO: 2564716 - protein, 24 aa, Entamoeba histolytica
IENERNDKQLPQVQGIKEKKDKEL

SEQ ID NO: 2564717 - protein, 9 aa, Entamoeba histolytica
IENERRSST

SEQ ID NO: 2564718 - protein, 7 aa, Entamoeba histolytica
IENGTRN

SEQ ID NO: 2564719 - protein, 6 aa, Entamoeba histolytica
IENKSS

SEQ ID NO: 2564720 - protein, 7 aa, Entamoeba histolytica
IENKTNN

SEQ ID NO: 2564721 - protein, 4 aa, Entamoeba histolytica
IENN

SEQ ID NO: 2564722 - protein, 4 aa, Entamoeba histolytica
IENS

SEQ ID NO: 2564723 - protein, 13 aa, Entamoeba histolytica
IENTEEKQQPITQ

SEQ ID NO: 2564724 - protein, 5 aa, Entamoeba histolytica
IENTT

SEQ ID NO: 2564725 - protein, 6 aa, Entamoeba histolytica
IEPEYT

SEQ ID NO: 2564726 - protein, 8 aa, Entamoeba histolytica
IEPNGLSS

SEQ ID NO: 2564727 - protein, 6 aa, Entamoeba histolytica
IEPNQE

SEQ ID NO: 2564728 - protein, 13 aa, Entamoeba histolytica
IEPPLSDEKRQQL

SEQ ID NO: 2564729 - protein, 22 aa, Entamoeba histolytica
IEPPTKKNEQKDDHPSTQQPSI

SEQ ID NO: 2564730 - protein, 10 aa, Entamoeba histolytica
IEQEPENEKI

SEQ ID NO: 2564731 - protein, 6 aa, Entamoeba histolytica
IEQEQK

SEQ ID NO: 2564732 - protein, 8 aa, Entamoeba histolytica
IEQGEEDL

SEQ ID NO: 2564733 - protein, 8 aa, Entamoeba histolytica
IEQNIQKK

SEQ ID NO: 2564734 - protein, 14 aa, Entamoeba histolytica
IEQPKKQLPSLPQK

SEQ ID NO: 2564735 - protein, 5 aa, Entamoeba histolytica
IEQQT

SEQ ID NO: 2564736 - protein, 7 aa, Entamoeba histolytica
IEQRPQL

SEQ ID NO: 2564737 - protein, 4 aa, Entamoeba histolytica
IEQS

SEQ ID NO: 2564738 - protein, 8 aa, Entamoeba histolytica
IEQTNSNY

SEQ ID NO: 2564739 - protein, 5 aa, Entamoeba histolytica
IERSA

SEQ ID NO: 2564740 - protein, 7 aa, Entamoeba histolytica
IESDNKE

SEQ ID NO: 2564741 - protein, 21 aa, Entamoeba histolytica
IESENKEGYNNKKIKEKESPI

SEQ ID NO: 2564742 - protein, 4 aa, Entamoeba histolytica
IESK

SEQ ID NO: 2564743 - protein, 14 aa, Entamoeba histolytica
IESKEQAKEQNKQE

SEQ ID NO: 2564744 - protein, 12 aa, Entamoeba histolytica
IESKSNDKDNIG

SEQ ID NO: 2564745 - protein, 10 aa, Entamoeba histolytica
IESKSSQYNI

SEQ ID NO: 2564746 - protein, 20 aa, Entamoeba histolytica
IESNETVDINEASSNKKKAM

SEQ ID NO: 2564747 - protein, 7 aa, Entamoeba histolytica
IESNQNK

SEQ ID NO: 2564748 - protein, 8 aa, Entamoeba histolytica
IESNYQEK

SEQ ID NO: 2564749 - protein, 10 aa, Entamoeba histolytica
IESPSKNTEE

SEQ ID NO: 2564750 - protein, 5 aa, Entamoeba histolytica
IESSE

SEQ ID NO: 2564751 - protein, 6 aa, Entamoeba histolytica
IESSGN

SEQ ID NO: 2564752 - protein, 6 aa, Entamoeba histolytica
IESSNP

SEQ ID NO: 2564753 - protein, 6 aa, Entamoeba histolytica
IESSTT

SEQ ID NO: 2564754 - protein, 4 aa, Entamoeba histolytica
IESY

SEQ ID NO: 2564755 - protein, 4 aa, Entamoeba histolytica
IETE

SEQ ID NO: 2564756 - protein, 6 aa, Entamoeba histolytica
IETKSI

SEQ ID NO: 2564757 - protein, 4 aa, Entamoeba histolytica
IETL

SEQ ID NO: 2564758 - protein, 4 aa, Entamoeba histolytica
IETN

SEQ ID NO: 2564759 - protein, 17 aa, Entamoeba histolytica
IETNKNSLKEKSNERNQ

SEQ ID NO: 2564760 - protein, 6 aa, Entamoeba histolytica
IETPKY

SEQ ID NO: 2564761 - protein, 7 aa, Entamoeba histolytica
IETPRSK

SEQ ID NO: 2564762 - protein, 43 aa, Entamoeba histolytica
IETPSNFSKAITPSRLPSRPTSRISQNSVKQISKSSTPSQLST

SEQ ID NO: 2564763 - protein, 9 aa, Entamoeba histolytica
IETRGSSIE

SEQ ID NO: 2564764 - protein, 7 aa, Entamoeba histolytica
IETSLSE

SEQ ID NO: 2564765 - protein, 21 aa, Entamoeba histolytica
IETSNKPEEQEREEEPKEQNR

SEQ ID NO: 2564766 - protein, 6 aa, Entamoeba histolytica
IETTNE

SEQ ID NO: 2564767 - protein, 5 aa, Entamoeba histolytica
IETVG

SEQ ID NO: 2564768 - protein, 4 aa, Entamoeba histolytica
IETY

SEQ ID NO: 2564769 - protein, 12 aa, Entamoeba histolytica
IEVEGQTFTEEE

SEQ ID NO: 2564770 - protein, 5 aa, Entamoeba histolytica
IFGGT

SEQ ID NO: 2564771 - protein, 8 aa, Entamoeba histolytica
IFNSRGDE

SEQ ID NO: 2564772 - protein, 5 aa, Entamoeba histolytica
IFSDE

SEQ ID NO: 2564773 - protein, 8 aa, Entamoeba histolytica
IGDGANDV

SEQ ID NO: 2564774 - protein, 9 aa, Entamoeba histolytica
IGDGEEEHE

SEQ ID NO: 2564775 - protein, 8 aa, Entamoeba histolytica
IGDGGNDV

SEQ ID NO: 2564776 - protein, 9 aa, Entamoeba histolytica
IGDGGNDVS

SEQ ID NO: 2564777 - protein, 4 aa, Entamoeba histolytica
IGDY

SEQ ID NO: 2564778 - protein, 9 aa, Entamoeba histolytica
IGEDQNGNC

SEQ ID NO: 2564779 - protein, 7 aa, Entamoeba histolytica
IGEETKA

SEQ ID NO: 2564780 - protein, 7 aa, Entamoeba histolytica
IGEGSFG

SEQ ID NO: 2564781 - protein, 5 aa, Entamoeba histolytica
IGEGT

SEQ ID NO: 2564782 - protein, 7 aa, Entamoeba histolytica
IGEGTSG

SEQ ID NO: 2564783 - protein, 7 aa, Entamoeba histolytica
IGEGTYS

SEQ ID NO: 2564784 - protein, 12 aa, Entamoeba histolytica
IGENNKKPSTKQ

SEQ ID NO: 2564785 - protein, 8 aa, Entamoeba histolytica
IGESLQTK

SEQ ID NO: 2564786 - protein, 6 aa, Entamoeba histolytica
IGETQK

SEQ ID NO: 2564787 - protein, 15 aa, Entamoeba histolytica
IGGDSTKGGSDFPHT

SEQ ID NO: 2564788 - protein, 8 aa, Entamoeba histolytica
IGGECQSE

SEQ ID NO: 2564789 - protein, 10 aa, Entamoeba histolytica
IGGKEPREAV

SEQ ID NO: 2564790 - protein, 10 aa, Entamoeba histolytica
IGGNDGGDVP

SEQ ID NO: 2564791 - protein, 6 aa, Entamoeba histolytica
IGGNKT

SEQ ID NO: 2564792 - protein, 6 aa, Entamoeba histolytica
IGGSIK

SEQ ID NO: 2564793 - protein, 6 aa, Entamoeba histolytica
IGHPET

SEQ ID NO: 2564794 - protein, 5 aa, Entamoeba histolytica
IGIGT

SEQ ID NO: 2564795 - protein, 7 aa, Entamoeba histolytica
IGKDEKK

SEQ ID NO: 2564796 - protein, 9 aa, Entamoeba histolytica
IGKEEEKVG

SEQ ID NO: 2564797 - protein, 9 aa, Entamoeba histolytica
IGKKQEAIG

SEQ ID NO: 2564798 - protein, 4 aa, Entamoeba histolytica
IGKL

SEQ ID NO: 2564799 - protein, 12 aa, Entamoeba histolytica
IGKNGKKVTAST

SEQ ID NO: 2564800 - protein, 5 aa, Entamoeba histolytica
IGKNS

SEQ ID NO: 2564801 - protein, 6 aa, Entamoeba histolytica
IGKPKV

SEQ ID NO: 2564802 - protein, 8 aa, Entamoeba histolytica
IGKSGQLF

SEQ ID NO: 2564803 - protein, 8 aa, Entamoeba histolytica
IGNDTKKK

SEQ ID NO: 2564804 - protein, 11 aa, Entamoeba histolytica
IGNEQRTTSLT

SEQ ID NO: 2564805 - protein, 4 aa, Entamoeba histolytica
IGNG

SEQ ID NO: 2564806 - protein, 11 aa, Entamoeba histolytica
IGNGNDELNNS

SEQ ID NO: 2564807 - protein, 11 aa, Entamoeba histolytica
IGNKDEQKKRL

SEQ ID NO: 2564808 - protein, 6 aa, Entamoeba histolytica
IGNKTE

SEQ ID NO: 2564809 - protein, 8 aa, Entamoeba histolytica
IGNNGEIK

SEQ ID NO: 2564810 - protein, 4 aa, Entamoeba histolytica
IGNS

SEQ ID NO: 2564811 - protein, 6 aa, Entamoeba histolytica
IGNYPN

SEQ ID NO: 2564812 - protein, 8 aa, Entamoeba histolytica
IGPNTVND

SEQ ID NO: 2564813 - protein, 6 aa, Entamoeba histolytica
IGPPQM

SEQ ID NO: 2564814 - protein, 5 aa, Entamoeba histolytica
IGQAK

SEQ ID NO: 2564815 - protein, 10 aa, Entamoeba histolytica
IGQSQSLEHE

SEQ ID NO: 2564816 - protein, 9 aa, Entamoeba histolytica
IGSENLKTK

SEQ ID NO: 2564817 - protein, 8 aa, Entamoeba histolytica
IGSLSSQT

SEQ ID NO: 2564818 - protein, 11 aa, Entamoeba histolytica
IGSNTEGRGCA

SEQ ID NO: 2564819 - protein, 5 aa, Entamoeba histolytica
IGSNV

SEQ ID NO: 2564820 - protein, 6 aa, Entamoeba histolytica
IGSPDI

SEQ ID NO: 2564821 - protein, 13 aa, Entamoeba histolytica
IGSPESTKPNISN

SEQ ID NO: 2564822 - protein, 5 aa, Entamoeba histolytica
IGSYG

SEQ ID NO: 2564823 - protein, 7 aa, Entamoeba histolytica
IGTDQNE

SEQ ID NO: 2564824 - protein, 6 aa, Entamoeba histolytica
IGTPKY

SEQ ID NO: 2564825 - protein, 6 aa, Entamoeba histolytica
IGTPTY

SEQ ID NO: 2564826 - protein, 7 aa, Entamoeba histolytica
IGTSSFK

SEQ ID NO: 2564827 - protein, 6 aa, Entamoeba histolytica
IGTSYE

SEQ ID NO: 2564828 - protein, 4 aa, Entamoeba histolytica
IGTT

SEQ ID NO: 2564829 - protein, 5 aa, Entamoeba histolytica
IGTTG

SEQ ID NO: 2564830 - protein, 13 aa, Entamoeba histolytica
IGVEGKEGKQAAL

SEQ ID NO: 2564831 - protein, 7 aa, Entamoeba histolytica
IGVGASG

SEQ ID NO: 2564832 - protein, 8 aa, Entamoeba histolytica
IGVTQPRR

SEQ ID NO: 2564833 - protein, 4 aa, Entamoeba histolytica
IHAK

SEQ ID NO: 2564834 - protein, 6 aa, Entamoeba histolytica
IHGNIK

SEQ ID NO: 2564835 - protein, 9 aa, Entamoeba histolytica
IHNSDPAKR

SEQ ID NO: 2564836 - protein, 7 aa, Entamoeba histolytica
IHPTNSK

SEQ ID NO: 2564837 - protein, 4 aa, Entamoeba histolytica
IHQN

SEQ ID NO: 2564838 - protein, 11 aa, Entamoeba histolytica
IHSPKNYEITS

SEQ ID NO: 2564839 - protein, 7 aa, Entamoeba histolytica
IHTESNG

SEQ ID NO: 2564840 - protein, 6 aa, Entamoeba histolytica
IHYSNK

SEQ ID NO: 2564841 - protein, 12 aa, Entamoeba histolytica
IIEEQKKQEEIV

SEQ ID NO: 2564842 - protein, 10 aa, Entamoeba histolytica
IIEPNSELQV

SEQ ID NO: 2564843 - protein, 15 aa, Entamoeba histolytica
IINNENEKNDNQNQT

SEQ ID NO: 2564844 - protein, 54 aa, Entamoeba histolytica
IINNPNPSYGYSNETTQPSNYVPYQSPQYYQQTPVSLPSYNQTFTSSEPKYEQE

SEQ ID NO: 2564845 - protein, 14 aa, Entamoeba histolytica
IIPPTQNQQESQAD

SEQ ID NO: 2564846 - protein, 6 aa, Entamoeba histolytica
IIQPQD

SEQ ID NO: 2564847 - protein, 9 aa, Entamoeba histolytica
IIRNTPNSE

SEQ ID NO: 2564848 - protein, 17 aa, Entamoeba histolytica
IISNSTVSSVDSSLTSS

SEQ ID NO: 2564849 - protein, 8 aa, Entamoeba histolytica
IISTTGNV

SEQ ID NO: 2564850 - protein, 25 aa, Entamoeba histolytica
IITDSSKSEVTNTNSSESSVTSNEN

SEQ ID NO: 2564851 - protein, 6 aa, Entamoeba histolytica
IITEEE

SEQ ID NO: 2564852 - protein, 9 aa, Entamoeba histolytica
IKADRNGAL

SEQ ID NO: 2564853 - protein, 9 aa, Entamoeba histolytica
IKAKESGNV

SEQ ID NO: 2564854 - protein, 9 aa, Entamoeba histolytica
IKDQKDKLK

SEQ ID NO: 2564855 - protein, 6 aa, Entamoeba histolytica
IKDQQK

SEQ ID NO: 2564856 - protein, 10 aa, Entamoeba histolytica
IKDQTKVSKI

SEQ ID NO: 2564857 - protein, 9 aa, Entamoeba histolytica
IKDSPNLYP

SEQ ID NO: 2564858 - protein, 6 aa, Entamoeba histolytica
IKDSTM

SEQ ID NO: 2564859 - protein, 8 aa, Entamoeba histolytica
IKDTYTSE

SEQ ID NO: 2564860 - protein, 29 aa, Entamoeba histolytica
IKEDEEDEMDEDVDAEKKMTLDESNKKPM

SEQ ID NO: 2564861 - protein, 12 aa, Entamoeba histolytica
IKEDKTDEIENE

SEQ ID NO: 2564862 - protein, 10 aa, Entamoeba histolytica
IKEEDNTSIK

SEQ ID NO: 2564863 - protein, 6 aa, Entamoeba histolytica
IKEEEY

SEQ ID NO: 2564864 - protein, 9 aa, Entamoeba histolytica
IKEEGDNYN

SEQ ID NO: 2564865 - protein, 29 aa, Entamoeba histolytica
IKEEKTSSVGKNSNEQSSQIKEEQPMAVD

SEQ ID NO: 2564866 - protein, 5 aa, Entamoeba histolytica
IKEFN

SEQ ID NO: 2564867 - protein, 6 aa, Entamoeba histolytica
IKEGGL

SEQ ID NO: 2564868 - protein, 6 aa, Entamoeba histolytica
IKEHTG

SEQ ID NO: 2564869 - protein, 9 aa, Entamoeba histolytica
IKEIKGGKV

SEQ ID NO: 2564870 - protein, 11 aa, Entamoeba histolytica
IKEKEPEKVRK

SEQ ID NO: 2564871 - protein, 56 aa, Entamoeba histolytica
IKEKTSKEVKEETSLNHEKGIKDTEDNIKEKKGTKQKSETKKENKKTHKKEERKKT

SEQ ID NO: 2564872 - protein, 4 aa, Entamoeba histolytica
IKEL

SEQ ID NO: 2564873 - protein, 8 aa, Entamoeba histolytica
IKENKGIE

SEQ ID NO: 2564874 - protein, 22 aa, Entamoeba histolytica
IKENNQNSEETIKNDEDKVTEL

SEQ ID NO: 2564875 - protein, 12 aa, Entamoeba histolytica
IKENNTEDSINE

SEQ ID NO: 2564876 - protein, 7 aa, Entamoeba histolytica
IKENTAF

SEQ ID NO: 2564877 - protein, 22 aa, Entamoeba histolytica
IKEQKETNIETSKDDSSSVTTY

SEQ ID NO: 2564878 - protein, 20 aa, Entamoeba histolytica
IKESFTSSEDTSSTEINDSF

SEQ ID NO: 2564879 - protein, 4 aa, Entamoeba histolytica
IKET

SEQ ID NO: 2564880 - protein, 8 aa, Entamoeba histolytica
IKETKQSL

SEQ ID NO: 2564881 - protein, 26 aa, Entamoeba histolytica
IKGETEISTRLDPDEIKEEKKIGEGS

SEQ ID NO: 2564882 - protein, 13 aa, Entamoeba histolytica
IKGGVNNNEESKS

SEQ ID NO: 2564883 - protein, 9 aa, Entamoeba histolytica
IKGKGNNNI

SEQ ID NO: 2564884 - protein, 7 aa, Entamoeba histolytica
IKGKTSI

SEQ ID NO: 2564885 - protein, 7 aa, Entamoeba histolytica
IKGSGTI

SEQ ID NO: 2564886 - protein, 21 aa, Entamoeba histolytica
IKHDENVSCSYKEDTTKCEAY

SEQ ID NO: 2564887 - protein, 4 aa, Entamoeba histolytica
IKIK

SEQ ID NO: 2564888 - protein, 17 aa, Entamoeba histolytica
IKIPNSGIDPISNEEKR

SEQ ID NO: 2564889 - protein, 7 aa, Entamoeba histolytica
IKKDNPE

SEQ ID NO: 2564890 - protein, 6 aa, Entamoeba histolytica
IKKDSG

SEQ ID NO: 2564891 - protein, 9 aa, Entamoeba histolytica
IKKEEEEIK

SEQ ID NO: 2564892 - protein, 14 aa, Entamoeba histolytica
IKKEEFEKTNKQLQ

SEQ ID NO: 2564893 - protein, 11 aa, Entamoeba histolytica
IKKEEIELENK

SEQ ID NO: 2564894 - protein, 10 aa, Entamoeba histolytica
IKKEKEEKKM

SEQ ID NO: 2564895 - protein, 33 aa, Entamoeba histolytica
IKKEKEELKGNKEDPLSKETVTTNENNNKDDVE

SEQ ID NO: 2564896 - protein, 20 aa, Entamoeba histolytica
IKKEKEKEREQERNNYKNSI

SEQ ID NO: 2564897 - protein, 7 aa, Entamoeba histolytica
IKKENPE

SEQ ID NO: 2564898 - protein, 17 aa, Entamoeba histolytica
IKKESNETIKQLKESGH

SEQ ID NO: 2564899 - protein, 7 aa, Entamoeba histolytica
IKKIEKA

SEQ ID NO: 2564900 - protein, 7 aa, Entamoeba histolytica
IKKNGEK

SEQ ID NO: 2564901 - protein, 10 aa, Entamoeba histolytica
IKKNNEAEKL

SEQ ID NO: 2564902 - protein, 10 aa, Entamoeba histolytica
IKLDENEDNY

SEQ ID NO: 2564903 - protein, 13 aa, Entamoeba histolytica
IKNGEKNKYIRDD

SEQ ID NO: 2564904 - protein, 4 aa, Entamoeba histolytica
IKNH

SEQ ID NO: 2564905 - protein, 7 aa, Entamoeba histolytica
IKNKDSI

SEQ ID NO: 2564906 - protein, 11 aa, Entamoeba histolytica
IKNKEISKEDI

SEQ ID NO: 2564907 - protein, 14 aa, Entamoeba histolytica
IKNNSNAQIGSGPY

SEQ ID NO: 2564908 - protein, 5 aa, Entamoeba histolytica
IKNPK

SEQ ID NO: 2564909 - protein, 5 aa, Entamoeba histolytica
IKNSE

SEQ ID NO: 2564910 - protein, 5 aa, Entamoeba histolytica
IKNSI

SEQ ID NO: 2564911 - protein, 9 aa, Entamoeba histolytica
IKPEEKKKV

SEQ ID NO: 2564912 - protein, 7 aa, Entamoeba histolytica
IKPEFGE

SEQ ID NO: 2564913 - protein, 6 aa, Entamoeba histolytica
IKPEKN

SEQ ID NO: 2564914 - protein, 7 aa, Entamoeba histolytica
IKPEPFG

SEQ ID NO: 2564915 - protein, 6 aa, Entamoeba histolytica
IKPKIT

SEQ ID NO: 2564916 - protein, 22 aa, Entamoeba histolytica
IKPLNKKQPPALPKKDSLIKPS

SEQ ID NO: 2564917 - protein, 12 aa, Entamoeba histolytica
IKPLSNSAPQFQ

SEQ ID NO: 2564918 - protein, 8 aa, Entamoeba histolytica
IKPNDKTS

SEQ ID NO: 2564919 - protein, 285 aa, Entamoeba histolytica
IKPPIPKAEESPSEPGKVTTPSGGEPNTITPGAPATVSTSTESSQSQKGVETTKGPSPQADSTHAGGESAQTSPTKDTPPGQEKSKEQTLDGAGSSQTQTSQSGSTGQPTQPLPTGAQQPSVPQTQDTVPNQSGSSQSTDTASTQKTNSNSAPQPQSKDEVQKPTGSSESTTGSAPNTTPGKEKSPSGESVPNSQTTPSSGMSGQTNTVPNQAETTPSVPTPSDKSQNGSPSSPDATPEESNKASDNSTDKKSPELSNKNETTNGTESDKMNKPDDDVNETTNLN

SEQ ID NO: 2564920 - protein, 9 aa, Entamoeba histolytica
IKPQPLKAH

SEQ ID NO: 2564921 - protein, 5 aa, Entamoeba histolytica
IKPRH

SEQ ID NO: 2564922 - protein, 7 aa, Entamoeba histolytica
IKPRKKE

SEQ ID NO: 2564923 - protein, 6 aa, Entamoeba histolytica
IKPSEE

SEQ ID NO: 2564924 - protein, 7 aa, Entamoeba histolytica
IKPSGPV

SEQ ID NO: 2564925 - protein, 14 aa, Entamoeba histolytica
IKPSSIESFSPKSI

SEQ ID NO: 2564926 - protein, 9 aa, Entamoeba histolytica
IKPTKEVDS

SEQ ID NO: 2564927 - protein, 4 aa, Entamoeba histolytica
IKQE

SEQ ID NO: 2564928 - protein, 7 aa, Entamoeba histolytica
IKQEIDD

SEQ ID NO: 2564929 - protein, 11 aa, Entamoeba histolytica
IKQEKEMEEDE

SEQ ID NO: 2564930 - protein, 4 aa, Entamoeba histolytica
IKQK

SEQ ID NO: 2564931 - protein, 7 aa, Entamoeba histolytica
IKQKQDL

SEQ ID NO: 2564932 - protein, 8 aa, Entamoeba histolytica
IKQKVTPT

SEQ ID NO: 2564933 - protein, 5 aa, Entamoeba histolytica
IKQPR

SEQ ID NO: 2564934 - protein, 8 aa, Entamoeba histolytica
IKQSDDQL

SEQ ID NO: 2564935 - protein, 8 aa, Entamoeba histolytica
IKQTEHSV

SEQ ID NO: 2564936 - protein, 6 aa, Entamoeba histolytica
IKQTNF

SEQ ID NO: 2564937 - protein, 17 aa, Entamoeba histolytica
IKREEKTPYDLQSRDGM

SEQ ID NO: 2564938 - protein, 11 aa, Entamoeba histolytica
IKRRSLSNSLS

SEQ ID NO: 2564939 - protein, 24 aa, Entamoeba histolytica
IKRTSSAGSEPDWSDSDSVTMTQS

SEQ ID NO: 2564940 - protein, 5 aa, Entamoeba histolytica
IKSDN

SEQ ID NO: 2564941 - protein, 11 aa, Entamoeba histolytica
IKSEESQEMSR

SEQ ID NO: 2564942 - protein, 9 aa, Entamoeba histolytica
IKSETSNQL

SEQ ID NO: 2564943 - protein, 15 aa, Entamoeba histolytica
IKSLKNESVDKSKKY

SEQ ID NO: 2564944 - protein, 8 aa, Entamoeba histolytica
IKSMPGQR

SEQ ID NO: 2564945 - protein, 13 aa, Entamoeba histolytica
IKSNKDLDLPSQK

SEQ ID NO: 2564946 - protein, 16 aa, Entamoeba histolytica
IKSNKNVTKNNEASTH

SEQ ID NO: 2564947 - protein, 9 aa, Entamoeba histolytica
IKSNTSEYC

SEQ ID NO: 2564948 - protein, 7 aa, Entamoeba histolytica
IKSPINQ

SEQ ID NO: 2564949 - protein, 7 aa, Entamoeba histolytica
IKSQESI

SEQ ID NO: 2564950 - protein, 8 aa, Entamoeba histolytica
IKSSEHHV

SEQ ID NO: 2564951 - protein, 8 aa, Entamoeba histolytica
IKSSNSIK

SEQ ID NO: 2564952 - protein, 9 aa, Entamoeba histolytica
IKSSSDSRF

SEQ ID NO: 2564953 - protein, 8 aa, Entamoeba histolytica
IKSTHLKN

SEQ ID NO: 2564954 - protein, 5 aa, Entamoeba histolytica
IKSTT

SEQ ID NO: 2564955 - protein, 6 aa, Entamoeba histolytica
IKTEEQ

SEQ ID NO: 2564956 - protein, 9 aa, Entamoeba histolytica
IKTEKKKTF

SEQ ID NO: 2564957 - protein, 11 aa, Entamoeba histolytica
IKTEKKKTFKE

SEQ ID NO: 2564958 - protein, 10 aa, Entamoeba histolytica
IKTEKSGKVL

SEQ ID NO: 2564959 - protein, 9 aa, Entamoeba histolytica
IKTENENIQ

SEQ ID NO: 2564960 - protein, 6 aa, Entamoeba histolytica
IKTENQ

SEQ ID NO: 2564961 - protein, 6 aa, Entamoeba histolytica
IKTNTT

SEQ ID NO: 2564962 - protein, 5 aa, Entamoeba histolytica
IKTPT

SEQ ID NO: 2564963 - protein, 4 aa, Entamoeba histolytica
IKTQ

SEQ ID NO: 2564964 - protein, 6 aa, Entamoeba histolytica
IKTQDE

SEQ ID NO: 2564965 - protein, 5 aa, Entamoeba histolytica
IKTQN

SEQ ID NO: 2564966 - protein, 7 aa, Entamoeba histolytica
IKTSIED

SEQ ID NO: 2564967 - protein, 7 aa, Entamoeba histolytica
IKTSKEK

SEQ ID NO: 2564968 - protein, 8 aa, Entamoeba histolytica
IKTSNETK

SEQ ID NO: 2564969 - protein, 28 aa, Entamoeba histolytica
IKTTTSENQTPRNGKQKEVRSKEDIIPE

SEQ ID NO: 2564970 - protein, 6 aa, Entamoeba histolytica
IKYNGN

SEQ ID NO: 2564971 - protein, 4 aa, Entamoeba histolytica
ILEK

SEQ ID NO: 2564972 - protein, 6 aa, Entamoeba histolytica
ILSSSN

SEQ ID NO: 2564973 - protein, 19 aa, Entamoeba histolytica
ILTSDGQCTTSNNCETFTN

SEQ ID NO: 2564974 - protein, 9 aa, Entamoeba histolytica
INAGEQGTV

SEQ ID NO: 2564975 - protein, 7 aa, Entamoeba histolytica
INAKDGS

SEQ ID NO: 2564976 - protein, 7 aa, Entamoeba histolytica
INAKTEP

SEQ ID NO: 2564977 - protein, 8 aa, Entamoeba histolytica
INAPQNTY

SEQ ID NO: 2564978 - protein, 12 aa, Entamoeba histolytica
INCTEENNDFDK

SEQ ID NO: 2564979 - protein, 4 aa, Entamoeba histolytica
INDE

SEQ ID NO: 2564980 - protein, 10 aa, Entamoeba histolytica
INDKSDEKKC

SEQ ID NO: 2564981 - protein, 10 aa, Entamoeba histolytica
INDKSDEKNC

SEQ ID NO: 2564982 - protein, 16 aa, Entamoeba histolytica
INDNDFKEAIDKANKK

SEQ ID NO: 2564983 - protein, 6 aa, Entamoeba histolytica
INDNFD

SEQ ID NO: 2564984 - protein, 9 aa, Entamoeba histolytica
INDNRSGYS

SEQ ID NO: 2564985 - protein, 9 aa, Entamoeba histolytica
INDPESEKC

SEQ ID NO: 2564986 - protein, 6 aa, Entamoeba histolytica
INDPFQ

SEQ ID NO: 2564987 - protein, 6 aa, Entamoeba histolytica
INDPNE

SEQ ID NO: 2564988 - protein, 4 aa, Entamoeba histolytica
INDQ

SEQ ID NO: 2564989 - protein, 22 aa, Entamoeba histolytica
INDQTITSKEFKSLTKDEFNKY

SEQ ID NO: 2564990 - protein, 12 aa, Entamoeba histolytica
INDTTKPKQQTY

SEQ ID NO: 2564991 - protein, 9 aa, Entamoeba histolytica
INDTTKQTL

SEQ ID NO: 2564992 - protein, 9 aa, Entamoeba histolytica
INEDDQLKE

SEQ ID NO: 2564993 - protein, 5 aa, Entamoeba histolytica
INEDE

SEQ ID NO: 2564994 - protein, 7 aa, Entamoeba histolytica
INEDYKN

SEQ ID NO: 2564995 - protein, 8 aa, Entamoeba histolytica
INEEDNIS

SEQ ID NO: 2564996 - protein, 9 aa, Entamoeba histolytica
INEEDVSYQ

SEQ ID NO: 2564997 - protein, 12 aa, Entamoeba histolytica
INEEEEDNHNHL

SEQ ID NO: 2564998 - protein, 8 aa, Entamoeba histolytica
INEGPNHG

SEQ ID NO: 2564999 - protein, 11 aa, Entamoeba histolytica
INEKTKPKIAK

SEQ ID NO: 2565000 - protein, 6 aa, Entamoeba histolytica
INEKTP

SEQ ID NO: 2565001 - protein, 16 aa, Entamoeba histolytica
INELKKNQNKSSSSDE

SEQ ID NO: 2565002 - protein, 9 aa, Entamoeba histolytica
INELSEEKE

SEQ ID NO: 2565003 - protein, 11 aa, Entamoeba histolytica
INENNSSIIEP

SEQ ID NO: 2565004 - protein, 11 aa, Entamoeba histolytica
INENNTDNEYK

SEQ ID NO: 2565005 - protein, 28 aa, Entamoeba histolytica
INEPKPDEHDYSQLPKDEEGVEMKDQQH

SEQ ID NO: 2565006 - protein, 9 aa, Entamoeba histolytica
INEQKIQPT

SEQ ID NO: 2565007 - protein, 17 aa, Entamoeba histolytica
INERSLSQSGKHIKAKT

SEQ ID NO: 2565008 - protein, 8 aa, Entamoeba histolytica
INESKSNI

SEQ ID NO: 2565009 - protein, 8 aa, Entamoeba histolytica
INESNKPF

SEQ ID NO: 2565010 - protein, 26 aa, Entamoeba histolytica
INETENTSEISEETLTNQKNMENQLQ

SEQ ID NO: 2565011 - protein, 10 aa, Entamoeba histolytica
INETGKMESL

SEQ ID NO: 2565012 - protein, 18 aa, Entamoeba histolytica
INETREEGKIKDQNGKCN

SEQ ID NO: 2565013 - protein, 5 aa, Entamoeba histolytica
INGDM

SEQ ID NO: 2565014 - protein, 8 aa, Entamoeba histolytica
INGEGSKK

SEQ ID NO: 2565015 - protein, 7 aa, Entamoeba histolytica
INGENKL

SEQ ID NO: 2565016 - protein, 12 aa, Entamoeba histolytica
INGENRDVDEQT

SEQ ID NO: 2565017 - protein, 9 aa, Entamoeba histolytica
INGESPSIS

SEQ ID NO: 2565018 - protein, 9 aa, Entamoeba histolytica
INGGSPINK

SEQ ID NO: 2565019 - protein, 9 aa, Entamoeba histolytica
INGKGNNNI

SEQ ID NO: 2565020 - protein, 7 aa, Entamoeba histolytica
INGKSKI

SEQ ID NO: 2565021 - protein, 8 aa, Entamoeba histolytica
INGKTGVS

SEQ ID NO: 2565022 - protein, 4 aa, Entamoeba histolytica
INGN

SEQ ID NO: 2565023 - protein, 6 aa, Entamoeba histolytica
INGNEG

SEQ ID NO: 2565024 - protein, 11 aa, Entamoeba histolytica
INGNFPNQQPF

SEQ ID NO: 2565025 - protein, 7 aa, Entamoeba histolytica
INGNGSN

SEQ ID NO: 2565026 - protein, 6 aa, Entamoeba histolytica
INGNTI

SEQ ID NO: 2565027 - protein, 9 aa, Entamoeba histolytica
INGNTNLPS

SEQ ID NO: 2565028 - protein, 7 aa, Entamoeba histolytica
INHPQPP

SEQ ID NO: 2565029 - protein, 4 aa, Entamoeba histolytica
INKE

SEQ ID NO: 2565030 - protein, 8 aa, Entamoeba histolytica
INKEDHSS

SEQ ID NO: 2565031 - protein, 13 aa, Entamoeba histolytica
INKEEQDTSKIYE

SEQ ID NO: 2565032 - protein, 7 aa, Entamoeba histolytica
INKEGEI

SEQ ID NO: 2565033 - protein, 11 aa, Entamoeba histolytica
INKGNLPESIY

SEQ ID NO: 2565034 - protein, 4 aa, Entamoeba histolytica
INKI

SEQ ID NO: 2565035 - protein, 9 aa, Entamoeba histolytica
INKNESSCL

SEQ ID NO: 2565036 - protein, 9 aa, Entamoeba histolytica
INKNGNSRI

SEQ ID NO: 2565037 - protein, 4 aa, Entamoeba histolytica
INKP

SEQ ID NO: 2565038 - protein, 7 aa, Entamoeba histolytica
INKPTDI

SEQ ID NO: 2565039 - protein, 8 aa, Entamoeba histolytica
INKPTNPS

SEQ ID NO: 2565040 - protein, 5 aa, Entamoeba histolytica
INKRN

SEQ ID NO: 2565041 - protein, 13 aa, Entamoeba histolytica
INNAASESNTGSM

SEQ ID NO: 2565042 - protein, 22 aa, Entamoeba histolytica
INNCTGKELSIKGESVTITDSK

SEQ ID NO: 2565043 - protein, 4 aa, Entamoeba histolytica
INNK

SEQ ID NO: 2565044 - protein, 6 aa, Entamoeba histolytica
INNPPK

SEQ ID NO: 2565045 - protein, 12 aa, Entamoeba histolytica
INNTNEAKERIE

SEQ ID NO: 2565046 - protein, 7 aa, Entamoeba histolytica
INNTQPL

SEQ ID NO: 2565047 - protein, 8 aa, Entamoeba histolytica
INNTSNTD

SEQ ID NO: 2565048 - protein, 9 aa, Entamoeba histolytica
INPKEGYNT

SEQ ID NO: 2565049 - protein, 10 aa, Entamoeba histolytica
INPKHRNNKI

SEQ ID NO: 2565050 - protein, 7 aa, Entamoeba histolytica
INPKSSY

SEQ ID NO: 2565051 - protein, 4 aa, Entamoeba histolytica
INPN

SEQ ID NO: 2565052 - protein, 11 aa, Entamoeba histolytica
INPNVSDTTMY

SEQ ID NO: 2565053 - protein, 7 aa, Entamoeba histolytica
INPQGTV

SEQ ID NO: 2565054 - protein, 7 aa, Entamoeba histolytica
INPQPNY

SEQ ID NO: 2565055 - protein, 6 aa, Entamoeba histolytica
INPQQT

SEQ ID NO: 2565056 - protein, 6 aa, Entamoeba histolytica
INPSEI

SEQ ID NO: 2565057 - protein, 7 aa, Entamoeba histolytica
INPSPNQ

SEQ ID NO: 2565058 - protein, 6 aa, Entamoeba histolytica
INPTAK

SEQ ID NO: 2565059 - protein, 4 aa, Entamoeba histolytica
INQN

SEQ ID NO: 2565060 - protein, 5 aa, Entamoeba histolytica
INQNE

SEQ ID NO: 2565061 - protein, 8 aa, Entamoeba histolytica
INQNNGTV

SEQ ID NO: 2565062 - protein, 10 aa, Entamoeba histolytica
INQPSSSTNF

SEQ ID NO: 2565063 - protein, 4 aa, Entamoeba histolytica
INQQ

SEQ ID NO: 2565064 - protein, 9 aa, Entamoeba histolytica
INQQDDGGL

SEQ ID NO: 2565065 - protein, 10 aa, Entamoeba histolytica
INQQENSTLN

SEQ ID NO: 2565066 - protein, 5 aa, Entamoeba histolytica
INQSE

SEQ ID NO: 2565067 - protein, 8 aa, Entamoeba histolytica
INQTSDGS

SEQ ID NO: 2565068 - protein, 7 aa, Entamoeba histolytica
INRDEPI

SEQ ID NO: 2565069 - protein, 5 aa, Entamoeba histolytica
INRPT

SEQ ID NO: 2565070 - protein, 6 aa, Entamoeba histolytica
INRTGG

SEQ ID NO: 2565071 - protein, 8 aa, Entamoeba histolytica
INSADLEK

SEQ ID NO: 2565072 - protein, 7 aa, Entamoeba histolytica
INSELNY

SEQ ID NO: 2565073 - protein, 9 aa, Entamoeba histolytica
INSENIKSY

SEQ ID NO: 2565074 - protein, 14 aa, Entamoeba histolytica
INSGEIKENLNDGI

SEQ ID NO: 2565075 - protein, 8 aa, Entamoeba histolytica
INSGKEEV

SEQ ID NO: 2565076 - protein, 7 aa, Entamoeba histolytica
INSGKTP

SEQ ID NO: 2565077 - protein, 9 aa, Entamoeba histolytica
INSNDNKEW

SEQ ID NO: 2565078 - protein, 8 aa, Entamoeba histolytica
INSNEDGE

SEQ ID NO: 2565079 - protein, 8 aa, Entamoeba histolytica
INSNETNK

SEQ ID NO: 2565080 - protein, 7 aa, Entamoeba histolytica
INSPTGY

SEQ ID NO: 2565081 - protein, 13 aa, Entamoeba histolytica
INSQNLQERKIGT

SEQ ID NO: 2565082 - protein, 9 aa, Entamoeba histolytica
INSTETKTS

SEQ ID NO: 2565083 - protein, 10 aa, Entamoeba histolytica
INSTQPDSLK

SEQ ID NO: 2565084 - protein, 4 aa, Entamoeba histolytica
INTA

SEQ ID NO: 2565085 - protein, 11 aa, Entamoeba histolytica
INTKANGLSNQ

SEQ ID NO: 2565086 - protein, 12 aa, Entamoeba histolytica
INTPPSKEAKYE

SEQ ID NO: 2565087 - protein, 6 aa, Entamoeba histolytica
INTPQY

SEQ ID NO: 2565088 - protein, 10 aa, Entamoeba histolytica
INTQKPTGDI

SEQ ID NO: 2565089 - protein, 6 aa, Entamoeba histolytica
INTTNK

SEQ ID NO: 2565090 - protein, 9 aa, Entamoeba histolytica
INTTTPNKF

SEQ ID NO: 2565091 - protein, 4 aa, Entamoeba histolytica
INVE

SEQ ID NO: 2565092 - protein, 13 aa, Entamoeba histolytica
INYNSEADGKVDR

SEQ ID NO: 2565093 - protein, 9 aa, Entamoeba histolytica
INYPKQEVQ

SEQ ID NO: 2565094 - protein, 5 aa, Entamoeba histolytica
IPATC

SEQ ID NO: 2565095 - protein, 5 aa, Entamoeba histolytica
IPDDE

SEQ ID NO: 2565096 - protein, 8 aa, Entamoeba histolytica
IPDDRPDF

SEQ ID NO: 2565097 - protein, 13 aa, Entamoeba histolytica
IPDDSSPSESTLS

SEQ ID NO: 2565098 - protein, 11 aa, Entamoeba histolytica
IPDPDNPGSCM

SEQ ID NO: 2565099 - protein, 8 aa, Entamoeba histolytica
IPDPNDPM

SEQ ID NO: 2565100 - protein, 4 aa, Entamoeba histolytica
IPDS

SEQ ID NO: 2565101 - protein, 11 aa, Entamoeba histolytica
IPDYQKESIGH

SEQ ID NO: 2565102 - protein, 5 aa, Entamoeba histolytica
IPEEK

SEQ ID NO: 2565103 - protein, 8 aa, Entamoeba histolytica
IPEGSEKI

SEQ ID NO: 2565104 - protein, 24 aa, Entamoeba histolytica
IPENENNENINQEQDEIDDQLVAQ

SEQ ID NO: 2565105 - protein, 8 aa, Entamoeba histolytica
IPENGSSL

SEQ ID NO: 2565106 - protein, 15 aa, Entamoeba histolytica
IPEQQPKKENNDCQG

SEQ ID NO: 2565107 - protein, 9 aa, Entamoeba histolytica
IPESVSSFN

SEQ ID NO: 2565108 - protein, 5 aa, Entamoeba histolytica
IPFDN

SEQ ID NO: 2565109 - protein, 12 aa, Entamoeba histolytica
IPGSKLPKLPTH

SEQ ID NO: 2565110 - protein, 36 aa, Entamoeba histolytica
IPGSSKSKPKTITPKPECNKTKTIKISTHAKESISA

SEQ ID NO: 2565111 - protein, 5 aa, Entamoeba histolytica
IPGTS

SEQ ID NO: 2565112 - protein, 20 aa, Entamoeba histolytica
IPIEDNDSNSHSRKSFDLSS

SEQ ID NO: 2565113 - protein, 12 aa, Entamoeba histolytica
IPISTKPDSEYA

SEQ ID NO: 2565114 - protein, 4 aa, Entamoeba histolytica
IPKD

SEQ ID NO: 2565115 - protein, 11 aa, Entamoeba histolytica
IPKEGKVTISA

SEQ ID NO: 2565116 - protein, 10 aa, Entamoeba histolytica
IPKGSKTGDI

SEQ ID NO: 2565117 - protein, 14 aa, Entamoeba histolytica
IPKKKKLKKSHPVP

SEQ ID NO: 2565118 - protein, 9 aa, Entamoeba histolytica
IPKKNNYPT

SEQ ID NO: 2565119 - protein, 10 aa, Entamoeba histolytica
IPKKPQNDDI

SEQ ID NO: 2565120 - protein, 5 aa, Entamoeba histolytica
IPKPE

SEQ ID NO: 2565121 - protein, 8 aa, Entamoeba histolytica
IPKQDKLK

SEQ ID NO: 2565122 - protein, 8 aa, Entamoeba histolytica
IPNEERAE

SEQ ID NO: 2565123 - protein, 5 aa, Entamoeba histolytica
IPNEG

SEQ ID NO: 2565124 - protein, 13 aa, Entamoeba histolytica
IPNEQSSSSSIPL

SEQ ID NO: 2565125 - protein, 6 aa, Entamoeba histolytica
IPNNKQ

SEQ ID NO: 2565126 - protein, 5 aa, Entamoeba histolytica
IPNNN

SEQ ID NO: 2565127 - protein, 17 aa, Entamoeba histolytica
IPNSLQPKCDGRKNINK

SEQ ID NO: 2565128 - protein, 9 aa, Entamoeba histolytica
IPNTLGDKN

SEQ ID NO: 2565129 - protein, 8 aa, Entamoeba histolytica
IPPAPTRT

SEQ ID NO: 2565130 - protein, 6 aa, Entamoeba histolytica
IPPEYI

SEQ ID NO: 2565131 - protein, 38 aa, Entamoeba histolytica
IPPKNENNDGENEIKEVDSVKEEHKNEELEITNSENEK

SEQ ID NO: 2565132 - protein, 13 aa, Entamoeba histolytica
IPPKNNVNDTSPL

SEQ ID NO: 2565133 - protein, 4 aa, Entamoeba histolytica
IPPL

SEQ ID NO: 2565134 - protein, 6 aa, Entamoeba histolytica
IPPQPI

SEQ ID NO: 2565135 - protein, 5 aa, Entamoeba histolytica
IPPRD

SEQ ID NO: 2565136 - protein, 4 aa, Entamoeba histolytica
IPPS

SEQ ID NO: 2565137 - protein, 5 aa, Entamoeba histolytica
IPPSI

SEQ ID NO: 2565138 - protein, 7 aa, Entamoeba histolytica
IPPSKST

SEQ ID NO: 2565139 - protein, 6 aa, Entamoeba histolytica
IPPTYT

SEQ ID NO: 2565140 - protein, 5 aa, Entamoeba histolytica
IPQGE

SEQ ID NO: 2565141 - protein, 4 aa, Entamoeba histolytica
IPQR

SEQ ID NO: 2565142 - protein, 4 aa, Entamoeba histolytica
IPRP

SEQ ID NO: 2565143 - protein, 6 aa, Entamoeba histolytica
IPRSKE

SEQ ID NO: 2565144 - protein, 8 aa, Entamoeba histolytica
IPRTKRKD

SEQ ID NO: 2565145 - protein, 8 aa, Entamoeba histolytica
IPSDTSKL

SEQ ID NO: 2565146 - protein, 8 aa, Entamoeba histolytica
IPSEESSS

SEQ ID NO: 2565147 - protein, 10 aa, Entamoeba histolytica
IPSEHPENHK

SEQ ID NO: 2565148 - protein, 7 aa, Entamoeba histolytica
IPSESLP

SEQ ID NO: 2565149 - protein, 7 aa, Entamoeba histolytica
IPSGKGI

SEQ ID NO: 2565150 - protein, 4 aa, Entamoeba histolytica
IPSI

SEQ ID NO: 2565151 - protein, 5 aa, Entamoeba histolytica
IPSKL

SEQ ID NO: 2565152 - protein, 6 aa, Entamoeba histolytica
IPSNAG

SEQ ID NO: 2565153 - protein, 6 aa, Entamoeba histolytica
IPSPNH

SEQ ID NO: 2565154 - protein, 5 aa, Entamoeba histolytica
IPSQI

SEQ ID NO: 2565155 - protein, 12 aa, Entamoeba histolytica
IPSQLTQPIQPQ

SEQ ID NO: 2565156 - protein, 5 aa, Entamoeba histolytica
IPSQT

SEQ ID NO: 2565157 - protein, 43 aa, Entamoeba histolytica
IPSSDSSSSSSPSASSTQPSTSSSAPNPSGESSNNTEDNNGTK

SEQ ID NO: 2565158 - protein, 15 aa, Entamoeba histolytica
IPSSPTKETNKQNNL

SEQ ID NO: 2565159 - protein, 11 aa, Entamoeba histolytica
IPSSSFSMNET

SEQ ID NO: 2565160 - protein, 9 aa, Entamoeba histolytica
IPSSSHPED

SEQ ID NO: 2565161 - protein, 6 aa, Entamoeba histolytica
IPSSVT

SEQ ID NO: 2565162 - protein, 5 aa, Entamoeba histolytica
IPTDY

SEQ ID NO: 2565163 - protein, 10 aa, Entamoeba histolytica
IPTNKQENHQ

SEQ ID NO: 2565164 - protein, 15 aa, Entamoeba histolytica
IPTPESHSQSINEYL

SEQ ID NO: 2565165 - protein, 5 aa, Entamoeba histolytica
IPTSH

SEQ ID NO: 2565166 - protein, 5 aa, Entamoeba histolytica
IPTSI

SEQ ID NO: 2565167 - protein, 6 aa, Entamoeba histolytica
IPTSQV

SEQ ID NO: 2565168 - protein, 4 aa, Entamoeba histolytica
IPTT

SEQ ID NO: 2565169 - protein, 18 aa, Entamoeba histolytica
IPTTASQPDGTTPNPSFA

SEQ ID NO: 2565170 - protein, 10 aa, Entamoeba histolytica
IPTTSNEYLK

SEQ ID NO: 2565171 - protein, 7 aa, Entamoeba histolytica
IPVKTNS

SEQ ID NO: 2565172 - protein, 8 aa, Entamoeba histolytica
IPYKEDPN

SEQ ID NO: 2565173 - protein, 4 aa, Entamoeba histolytica
IPYS

SEQ ID NO: 2565174 - protein, 4 aa, Entamoeba histolytica
IQAD

SEQ ID NO: 2565175 - protein, 7 aa, Entamoeba histolytica
IQAPPKA

SEQ ID NO: 2565176 - protein, 9 aa, Entamoeba histolytica
IQDDEADKV

SEQ ID NO: 2565177 - protein, 14 aa, Entamoeba histolytica
IQDENGSTKDIPVS

SEQ ID NO: 2565178 - protein, 11 aa, Entamoeba histolytica
IQDEPQQEITQ

SEQ ID NO: 2565179 - protein, 12 aa, Entamoeba histolytica
IQDPAKESKSHY

SEQ ID NO: 2565180 - protein, 4 aa, Entamoeba histolytica
IQEK

SEQ ID NO: 2565181 - protein, 12 aa, Entamoeba histolytica
IQEQDGKISNTP

SEQ ID NO: 2565182 - protein, 7 aa, Entamoeba histolytica
IQERYPT

SEQ ID NO: 2565183 - protein, 14 aa, Entamoeba histolytica
IQETDKDQDNHTKS

SEQ ID NO: 2565184 - protein, 8 aa, Entamoeba histolytica
IQETRDDI

SEQ ID NO: 2565185 - protein, 4 aa, Entamoeba histolytica
IQGD

SEQ ID NO: 2565186 - protein, 4 aa, Entamoeba histolytica
IQGE

SEQ ID NO: 2565187 - protein, 5 aa, Entamoeba histolytica
IQGQP

SEQ ID NO: 2565188 - protein, 6 aa, Entamoeba histolytica
IQGRNP

SEQ ID NO: 2565189 - protein, 13 aa, Entamoeba histolytica
IQHTSNKKADRDS

SEQ ID NO: 2565190 - protein, 5 aa, Entamoeba histolytica
IQIGG

SEQ ID NO: 2565191 - protein, 4 aa, Entamoeba histolytica
IQIT

SEQ ID NO: 2565192 - protein, 9 aa, Entamoeba histolytica
IQKDKDGAV

SEQ ID NO: 2565193 - protein, 21 aa, Entamoeba histolytica
IQKKERKVKEVKKNTPKITDE

SEQ ID NO: 2565194 - protein, 12 aa, Entamoeba histolytica
IQKLQKKNNNQM

SEQ ID NO: 2565195 - protein, 15 aa, Entamoeba histolytica
IQKRKEELQSNAGLQ

SEQ ID NO: 2565196 - protein, 5 aa, Entamoeba histolytica
IQKSH

SEQ ID NO: 2565197 - protein, 9 aa, Entamoeba histolytica
IQKSSPNEN

SEQ ID NO: 2565198 - protein, 8 aa, Entamoeba histolytica
IQKSSQIT

SEQ ID NO: 2565199 - protein, 9 aa, Entamoeba histolytica
IQKSSQITL

SEQ ID NO: 2565200 - protein, 17 aa, Entamoeba histolytica
IQNDSNNTILQKNSTSK

SEQ ID NO: 2565201 - protein, 9 aa, Entamoeba histolytica
IQNGKTKEF

SEQ ID NO: 2565202 - protein, 11 aa, Entamoeba histolytica
IQNNPKESDTF

SEQ ID NO: 2565203 - protein, 10 aa, Entamoeba histolytica
IQNNQQDTTY

SEQ ID NO: 2565204 - protein, 6 aa, Entamoeba histolytica
IQNQTE

SEQ ID NO: 2565205 - protein, 9 aa, Entamoeba histolytica
IQNSSSFSP

SEQ ID NO: 2565206 - protein, 12 aa, Entamoeba histolytica
IQPATEQEVKSI

SEQ ID NO: 2565207 - protein, 9 aa, Entamoeba histolytica
IQPKAPSNV

SEQ ID NO: 2565208 - protein, 8 aa, Entamoeba histolytica
IQPKEESN

SEQ ID NO: 2565209 - protein, 7 aa, Entamoeba histolytica
IQPNEST

SEQ ID NO: 2565210 - protein, 4 aa, Entamoeba histolytica
IQPT

SEQ ID NO: 2565211 - protein, 10 aa, Entamoeba histolytica
IQQEEEENKN

SEQ ID NO: 2565212 - protein, 5 aa, Entamoeba histolytica
IQQEK

SEQ ID NO: 2565213 - protein, 7 aa, Entamoeba histolytica
IQQPYAP

SEQ ID NO: 2565214 - protein, 11 aa, Entamoeba histolytica
IQSGNKISGYT

SEQ ID NO: 2565215 - protein, 4 aa, Entamoeba histolytica
IQSI

SEQ ID NO: 2565216 - protein, 10 aa, Entamoeba histolytica
IQSNNKPDSI

SEQ ID NO: 2565217 - protein, 16 aa, Entamoeba histolytica
IQSSGNVLNANDDFER

SEQ ID NO: 2565218 - protein, 10 aa, Entamoeba histolytica
IQSSSDNEIE

SEQ ID NO: 2565219 - protein, 9 aa, Entamoeba histolytica
IQSSTDDIN

SEQ ID NO: 2565220 - protein, 9 aa, Entamoeba histolytica
IQSTENDDT

SEQ ID NO: 2565221 - protein, 6 aa, Entamoeba histolytica
IQTAQT

SEQ ID NO: 2565222 - protein, 14 aa, Entamoeba histolytica
IQTASSSLPGSLKE

SEQ ID NO: 2565223 - protein, 9 aa, Entamoeba histolytica
IQTEENKKR

SEQ ID NO: 2565224 - protein, 5 aa, Entamoeba histolytica
IQTEI

SEQ ID NO: 2565225 - protein, 7 aa, Entamoeba histolytica
IQTERDG

SEQ ID NO: 2565226 - protein, 6 aa, Entamoeba histolytica
IQTGAY

SEQ ID NO: 2565227 - protein, 6 aa, Entamoeba histolytica
IQTQET

SEQ ID NO: 2565228 - protein, 16 aa, Entamoeba histolytica
IQTRDEIKKENNNLKS

SEQ ID NO: 2565229 - protein, 7 aa, Entamoeba histolytica
IQTSERI

SEQ ID NO: 2565230 - protein, 9 aa, Entamoeba histolytica
IQTSNSSST

SEQ ID NO: 2565231 - protein, 23 aa, Entamoeba histolytica
IQTSNTVPYKPLSSEISYGASSS

SEQ ID NO: 2565232 - protein, 10 aa, Entamoeba histolytica
IRAGERPQFK

SEQ ID NO: 2565233 - protein, 11 aa, Entamoeba histolytica
IRDGTAPNELL

SEQ ID NO: 2565234 - protein, 5 aa, Entamoeba histolytica
IRDTE

SEQ ID NO: 2565235 - protein, 6 aa, Entamoeba histolytica
IREEDS

SEQ ID NO: 2565236 - protein, 7 aa, Entamoeba histolytica
IRGKNQS

SEQ ID NO: 2565237 - protein, 4 aa, Entamoeba histolytica
IRGR

SEQ ID NO: 2565238 - protein, 8 aa, Entamoeba histolytica
IRKDNSEN

SEQ ID NO: 2565239 - protein, 10 aa, Entamoeba histolytica
IRKENDTIPV

SEQ ID NO: 2565240 - protein, 8 aa, Entamoeba histolytica
IRKNEDIS

SEQ ID NO: 2565241 - protein, 8 aa, Entamoeba histolytica
IRKRNSEK

SEQ ID NO: 2565242 - protein, 8 aa, Entamoeba histolytica
IRKRNSET

SEQ ID NO: 2565243 - protein, 5 aa, Entamoeba histolytica
IRKSS

SEQ ID NO: 2565244 - protein, 20 aa, Entamoeba histolytica
IRNGGNEEDVVKSNDNVPKI

SEQ ID NO: 2565245 - protein, 8 aa, Entamoeba histolytica
IRNKSGNK

SEQ ID NO: 2565246 - protein, 5 aa, Entamoeba histolytica
IRNTK

SEQ ID NO: 2565247 - protein, 5 aa, Entamoeba histolytica
IRPDK

SEQ ID NO: 2565248 - protein, 6 aa, Entamoeba histolytica
IRPTTL

SEQ ID NO: 2565249 - protein, 287 aa, Entamoeba histolytica
IRQENGEHSLKQTVEKEQEQQDLTHKTQDQDQKSRSEAVTQPTAKDQTVQSLPVSSTGVTDSTKSASGSSTVNTPTDSPVKTTTNPSKDNTAESTEGQQESEGLGSDTKTSTQQKVPNTSPSGINIPNEQNPQGQTGLSGTGVKNEQNPEGQSGTNEQNSKGQSGITNEQNPQGQSKQKGAKTPSTNGKQETEQTNKQGKEKEQETSGTNDGQHDTTKEKDDNRTNESDENNKPKTPNGQEEGKNTTDNKTPNTPTNKPESKSENKNDDKTNNSEDEDSNSNKNIDG

SEQ ID NO: 2565250 - protein, 287 aa, Entamoeba histolytica
IRQENGQHSQKQTVEKEQEQQDLTHKTQDQDQKSRSEAVTQPTAKDQPVQSLPVSSTGVTDSTKSVSGSSTVNTPTDSPVKTTTNPSKDNTAESTEGQQESEGLGSDTKTSTQQKVPNTSPSGINIPNEQNPQGQTELSGTGVKNEQNPEGQSGTNEQNSKGQSGITNEQNPQGQSEQKGAKTPSTNGKQETEQTNKQGKEKEQETSGTNDGQHDTTKEKDDNGTNESDENNKPKTPNGQEEGKNTTDNKTPNTPTNKPESKSENKNDDKTNNSEDEDSNSNKNIDG

SEQ ID NO: 2565251 - protein, 8 aa, Entamoeba histolytica
IRQENNDI

SEQ ID NO: 2565252 - protein, 11 aa, Entamoeba histolytica
IRQPDNTYLTT

SEQ ID NO: 2565253 - protein, 5 aa, Entamoeba histolytica
IRREH

SEQ ID NO: 2565254 - protein, 9 aa, Entamoeba histolytica
IRRGNGGKY

SEQ ID NO: 2565255 - protein, 4 aa, Entamoeba histolytica
IRSL

SEQ ID NO: 2565256 - protein, 12 aa, Entamoeba histolytica
IRSNNQSELNDD

SEQ ID NO: 2565257 - protein, 7 aa, Entamoeba histolytica
IRSPKNS

SEQ ID NO: 2565258 - protein, 6 aa, Entamoeba histolytica
IRTDPS

SEQ ID NO: 2565259 - protein, 5 aa, Entamoeba histolytica
IRTKI

SEQ ID NO: 2565260 - protein, 4 aa, Entamoeba histolytica
IRTN

SEQ ID NO: 2565261 - protein, 15 aa, Entamoeba histolytica
IRTPSTGLNETTGFQ

SEQ ID NO: 2565262 - protein, 25 aa, Entamoeba histolytica
IRYEEKEETKTKKETKSDITYEKKT

SEQ ID NO: 2565263 - protein, 18 aa, Entamoeba histolytica
ISAASSFADIDGDDELNE

SEQ ID NO: 2565264 - protein, 4 aa, Entamoeba histolytica
ISAP

SEQ ID NO: 2565265 - protein, 9 aa, Entamoeba histolytica
ISAQSSSQL

SEQ ID NO: 2565266 - protein, 21 aa, Entamoeba histolytica
ISATSKNLKHGTVTSEDIENA

SEQ ID NO: 2565267 - protein, 7 aa, Entamoeba histolytica
ISDASGN

SEQ ID NO: 2565268 - protein, 15 aa, Entamoeba histolytica
ISDDSSKSSKYYDNS

SEQ ID NO: 2565269 - protein, 9 aa, Entamoeba histolytica
ISDKGHEMK

SEQ ID NO: 2565270 - protein, 12 aa, Entamoeba histolytica
ISDNHNNLDGTS

SEQ ID NO: 2565271 - protein, 14 aa, Entamoeba histolytica
ISDNHNNLDGTSGG

SEQ ID NO: 2565272 - protein, 6 aa, Entamoeba histolytica
ISDNRQ

SEQ ID NO: 2565273 - protein, 5 aa, Entamoeba histolytica
ISDTP

SEQ ID NO: 2565274 - protein, 4 aa, Entamoeba histolytica
ISEE

SEQ ID NO: 2565275 - protein, 7 aa, Entamoeba histolytica
ISEESQI

SEQ ID NO: 2565276 - protein, 10 aa, Entamoeba histolytica
ISEKDEREDL

SEQ ID NO: 2565277 - protein, 10 aa, Entamoeba histolytica
ISENKTTKFN

SEQ ID NO: 2565278 - protein, 7 aa, Entamoeba histolytica
ISEPNDP

SEQ ID NO: 2565279 - protein, 9 aa, Entamoeba histolytica
ISEPSKQVY

SEQ ID NO: 2565280 - protein, 6 aa, Entamoeba histolytica
ISEPTD

SEQ ID NO: 2565281 - protein, 7 aa, Entamoeba histolytica
ISEPTDF

SEQ ID NO: 2565282 - protein, 6 aa, Entamoeba histolytica
ISEQRH

SEQ ID NO: 2565283 - protein, 20 aa, Entamoeba histolytica
ISERNRLNKELTQGIGTPTY

SEQ ID NO: 2565284 - protein, 6 aa, Entamoeba histolytica
ISERSL

SEQ ID NO: 2565285 - protein, 20 aa, Entamoeba histolytica
ISERSLSAKELSQGIGTPTY

SEQ ID NO: 2565286 - protein, 9 aa, Entamoeba histolytica
ISESADSCD

SEQ ID NO: 2565287 - protein, 7 aa, Entamoeba histolytica
ISETEIA

SEQ ID NO: 2565288 - protein, 33 aa, Entamoeba histolytica
ISETKKVSSITPSLKEEKKQKKSKSSDERRTEY

SEQ ID NO: 2565289 - protein, 8 aa, Entamoeba histolytica
ISETSAIN

SEQ ID NO: 2565290 - protein, 6 aa, Entamoeba histolytica
ISFNGG

SEQ ID NO: 2565291 - protein, 18 aa, Entamoeba histolytica
ISFPSATTIETHNNTIQQ

SEQ ID NO: 2565292 - protein, 4 aa, Entamoeba histolytica
ISGE

SEQ ID NO: 2565293 - protein, 7 aa, Entamoeba histolytica
ISGEEGL

SEQ ID NO: 2565294 - protein, 19 aa, Entamoeba histolytica
ISGKEEKEKKEEKSDSMDT

SEQ ID NO: 2565295 - protein, 11 aa, Entamoeba histolytica
ISGKPASSGEI

SEQ ID NO: 2565296 - protein, 8 aa, Entamoeba histolytica
ISGPTERP

SEQ ID NO: 2565297 - protein, 5 aa, Entamoeba histolytica
ISGRE

SEQ ID NO: 2565298 - protein, 11 aa, Entamoeba histolytica
ISGSEDKNCDR

SEQ ID NO: 2565299 - protein, 24 aa, Entamoeba histolytica
ISGSESETVSESGRNETASVGGRE

SEQ ID NO: 2565300 - protein, 8 aa, Entamoeba histolytica
ISGSFNNE

SEQ ID NO: 2565301 - protein, 6 aa, Entamoeba histolytica
ISHPTE

SEQ ID NO: 2565302 - protein, 13 aa, Entamoeba histolytica
ISHQQSTSTEDGI

SEQ ID NO: 2565303 - protein, 8 aa, Entamoeba histolytica
ISHSENDF

SEQ ID NO: 2565304 - protein, 7 aa, Entamoeba histolytica
ISIKDTK

SEQ ID NO: 2565305 - protein, 10 aa, Entamoeba histolytica
ISKERVKRRF

SEQ ID NO: 2565306 - protein, 16 aa, Entamoeba histolytica
ISKESDFIGEKESLKA

SEQ ID NO: 2565307 - protein, 12 aa, Entamoeba histolytica
ISKGKRPNIPDT

SEQ ID NO: 2565308 - protein, 10 aa, Entamoeba histolytica
ISKGSEGCMK

SEQ ID NO: 2565309 - protein, 8 aa, Entamoeba histolytica
ISKHDNNE

SEQ ID NO: 2565310 - protein, 9 aa, Entamoeba histolytica
ISKNENTTT

SEQ ID NO: 2565311 - protein, 8 aa, Entamoeba histolytica
ISKPSSIQ

SEQ ID NO: 2565312 - protein, 8 aa, Entamoeba histolytica
ISKTTNVS

SEQ ID NO: 2565313 - protein, 10 aa, Entamoeba histolytica
ISKYSGSEKL

SEQ ID NO: 2565314 - protein, 8 aa, Entamoeba histolytica
ISLNSPTP

SEQ ID NO: 2565315 - protein, 8 aa, Entamoeba histolytica
ISNAEEKI

SEQ ID NO: 2565316 - protein, 14 aa, Entamoeba histolytica
ISNATDYNSPLRKK

SEQ ID NO: 2565317 - protein, 14 aa, Entamoeba histolytica
ISNDDEYGITAYTQ

SEQ ID NO: 2565318 - protein, 18 aa, Entamoeba histolytica
ISNDLREKLSDAKDNEEF

SEQ ID NO: 2565319 - protein, 7 aa, Entamoeba histolytica
ISNDNTS

SEQ ID NO: 2565320 - protein, 14 aa, Entamoeba histolytica
ISNEKTANENTNKF

SEQ ID NO: 2565321 - protein, 9 aa, Entamoeba histolytica
ISNEPSEKF

SEQ ID NO: 2565322 - protein, 8 aa, Entamoeba histolytica
ISNNLKPD

SEQ ID NO: 2565323 - protein, 9 aa, Entamoeba histolytica
ISNQNGKQR

SEQ ID NO: 2565324 - protein, 10 aa, Entamoeba histolytica
ISNREGSKEC

SEQ ID NO: 2565325 - protein, 7 aa, Entamoeba histolytica
ISNSKKE

SEQ ID NO: 2565326 - protein, 6 aa, Entamoeba histolytica
ISNSQL

SEQ ID NO: 2565327 - protein, 19 aa, Entamoeba histolytica
ISNSSSSSYCDQTKGTFCP

SEQ ID NO: 2565328 - protein, 7 aa, Entamoeba histolytica
ISNTKKI

SEQ ID NO: 2565329 - protein, 18 aa, Entamoeba histolytica
ISNTNQQHKKISNDKALK

SEQ ID NO: 2565330 - protein, 16 aa, Entamoeba histolytica
ISPDQALKIAKVLNQT

SEQ ID NO: 2565331 - protein, 11 aa, Entamoeba histolytica
ISPDQTSNGVR

SEQ ID NO: 2565332 - protein, 8 aa, Entamoeba histolytica
ISPESSAQ

SEQ ID NO: 2565333 - protein, 10 aa, Entamoeba histolytica
ISPEVSEETP

SEQ ID NO: 2565334 - protein, 6 aa, Entamoeba histolytica
ISPGAE

SEQ ID NO: 2565335 - protein, 12 aa, Entamoeba histolytica
ISPNSKTPRISQ

SEQ ID NO: 2565336 - protein, 8 aa, Entamoeba histolytica
ISPPETDE

SEQ ID NO: 2565337 - protein, 4 aa, Entamoeba histolytica
ISPS

SEQ ID NO: 2565338 - protein, 5 aa, Entamoeba histolytica
ISPSG

SEQ ID NO: 2565339 - protein, 14 aa, Entamoeba histolytica
ISPSLNGNGPKGFG

SEQ ID NO: 2565340 - protein, 14 aa, Entamoeba histolytica
ISPTDQPIQQFQPT

SEQ ID NO: 2565341 - protein, 5 aa, Entamoeba histolytica
ISPWT

SEQ ID NO: 2565342 - protein, 8 aa, Entamoeba histolytica
ISQDATSL

SEQ ID NO: 2565343 - protein, 7 aa, Entamoeba histolytica
ISQEKNI

SEQ ID NO: 2565344 - protein, 12 aa, Entamoeba histolytica
ISQKEEKEIELR

SEQ ID NO: 2565345 - protein, 12 aa, Entamoeba histolytica
ISQKERRSTAPI

SEQ ID NO: 2565346 - protein, 10 aa, Entamoeba histolytica
ISQNEEENYE

SEQ ID NO: 2565347 - protein, 5 aa, Entamoeba histolytica
ISQPN

SEQ ID NO: 2565348 - protein, 6 aa, Entamoeba histolytica
ISQQDQ

SEQ ID NO: 2565349 - protein, 21 aa, Entamoeba histolytica
ISQQPRYTAEFSKQGTSSLSA

SEQ ID NO: 2565350 - protein, 9 aa, Entamoeba histolytica
ISQSKSTEI

SEQ ID NO: 2565351 - protein, 8 aa, Entamoeba histolytica
ISQTTHGS

SEQ ID NO: 2565352 - protein, 4 aa, Entamoeba histolytica
ISRD

SEQ ID NO: 2565353 - protein, 10 aa, Entamoeba histolytica
ISRESTAGDA

SEQ ID NO: 2565354 - protein, 7 aa, Entamoeba histolytica
ISRNAGQ

SEQ ID NO: 2565355 - protein, 12 aa, Entamoeba histolytica
ISRRSDFGDNVP

SEQ ID NO: 2565356 - protein, 5 aa, Entamoeba histolytica
ISSDC

SEQ ID NO: 2565357 - protein, 11 aa, Entamoeba histolytica
ISSDDSSASLS

SEQ ID NO: 2565358 - protein, 35 aa, Entamoeba histolytica
ISSEPKKSKNSKPKEKVSESLEEKNREKEQQEYNQ

SEQ ID NO: 2565359 - protein, 15 aa, Entamoeba histolytica
ISSKEDNEKYSIRTN

SEQ ID NO: 2565360 - protein, 10 aa, Entamoeba histolytica
ISSNKEKEPI

SEQ ID NO: 2565361 - protein, 10 aa, Entamoeba histolytica
ISSNKTNNIS

SEQ ID NO: 2565362 - protein, 9 aa, Entamoeba histolytica
ISSNPQPIQ

SEQ ID NO: 2565363 - protein, 9 aa, Entamoeba histolytica
ISSPENNVM

SEQ ID NO: 2565364 - protein, 8 aa, Entamoeba histolytica
ISSPENNW

SEQ ID NO: 2565365 - protein, 15 aa, Entamoeba histolytica
ISSPNSESHVTQEEP

SEQ ID NO: 2565366 - protein, 11 aa, Entamoeba histolytica
ISSQKNPTQSL

SEQ ID NO: 2565367 - protein, 11 aa, Entamoeba histolytica
ISSSDEPKELM

SEQ ID NO: 2565368 - protein, 5 aa, Entamoeba histolytica
ISSSE

SEQ ID NO: 2565369 - protein, 6 aa, Entamoeba histolytica
ISSSEQ

SEQ ID NO: 2565370 - protein, 8 aa, Entamoeba histolytica
ISSSNSFD

SEQ ID NO: 2565371 - protein, 11 aa, Entamoeba histolytica
ISSSSKTVPEF

SEQ ID NO: 2565372 - protein, 17 aa, Entamoeba histolytica
ISSTSIKNENKSLKQSI

SEQ ID NO: 2565373 - protein, 4 aa, Entamoeba histolytica
ISTA

SEQ ID NO: 2565374 - protein, 7 aa, Entamoeba histolytica
ISTEMDS

SEQ ID NO: 2565375 - protein, 5 aa, Entamoeba histolytica
ISTFG

SEQ ID NO: 2565376 - protein, 4 aa, Entamoeba histolytica
ISTG

SEQ ID NO: 2565377 - protein, 5 aa, Entamoeba histolytica
ISTGN

SEQ ID NO: 2565378 - protein, 10 aa, Entamoeba histolytica
ISTNDKNTKV

SEQ ID NO: 2565379 - protein, 24 aa, Entamoeba histolytica
ISTNEEVEIKKRNEGHNNNINQQE

SEQ ID NO: 2565380 - protein, 5 aa, Entamoeba histolytica
ISTPK

SEQ ID NO: 2565381 - protein, 7 aa, Entamoeba histolytica
ISTQISN

SEQ ID NO: 2565382 - protein, 11 aa, Entamoeba histolytica
ISTQSVPSNIE

SEQ ID NO: 2565383 - protein, 6 aa, Entamoeba histolytica
ISTRTA

SEQ ID NO: 2565384 - protein, 34 aa, Entamoeba histolytica
ISTSKSDKSNKSQRSGRSSVSSLSNQNSTSSEEV

SEQ ID NO: 2565385 - protein, 11 aa, Entamoeba histolytica
ISTTDESISEF

SEQ ID NO: 2565386 - protein, 8 aa, Entamoeba histolytica
ISTTGSTL

SEQ ID NO: 2565387 - protein, 22 aa, Entamoeba histolytica
ISTTSISVSSSAVSRPTIAASS

SEQ ID NO: 2565388 - protein, 7 aa, Entamoeba histolytica
ISTYPNP

SEQ ID NO: 2565389 - protein, 6 aa, Entamoeba histolytica
ISTYSE

SEQ ID NO: 2565390 - protein, 16 aa, Entamoeba histolytica
ISYNTEKSLSLTGQPF

SEQ ID NO: 2565391 - protein, 7 aa, Entamoeba histolytica
ITASEGC

SEQ ID NO: 2565392 - protein, 8 aa, Entamoeba histolytica
ITDDSNRV

SEQ ID NO: 2565393 - protein, 6 aa, Entamoeba histolytica
ITDGSV

SEQ ID NO: 2565394 - protein, 69 aa, Entamoeba histolytica
ITDKSKSDSNNKNHSGTTKTDSQIKTSSNSNQNTINTNTSTSNTTSKTQLEESKESYVSDTDSTSSNIE

SEQ ID NO: 2565395 - protein, 10 aa, Entamoeba histolytica
ITDNGKSGKC

SEQ ID NO: 2565396 - protein, 16 aa, Entamoeba histolytica
ITDNNGKTYPALPEGN

SEQ ID NO: 2565397 - protein, 18 aa, Entamoeba histolytica
ITDNSQVETSDSYSIDPN

SEQ ID NO: 2565398 - protein, 9 aa, Entamoeba histolytica
ITDPPASFS

SEQ ID NO: 2565399 - protein, 7 aa, Entamoeba histolytica
ITDQVTS

SEQ ID NO: 2565400 - protein, 9 aa, Entamoeba histolytica
ITDSQLGSV

SEQ ID NO: 2565401 - protein, 7 aa, Entamoeba histolytica
ITDSRTK

SEQ ID NO: 2565402 - protein, 12 aa, Entamoeba histolytica
ITDSSSTSVPEL

SEQ ID NO: 2565403 - protein, 17 aa, Entamoeba histolytica
ITEAKIDEDTVESLSIS

SEQ ID NO: 2565404 - protein, 16 aa, Entamoeba histolytica
ITEGQAQECIEDNDNL

SEQ ID NO: 2565405 - protein, 4 aa, Entamoeba histolytica
ITEL

SEQ ID NO: 2565406 - protein, 6 aa, Entamoeba histolytica
ITENTR

SEQ ID NO: 2565407 - protein, 13 aa, Entamoeba histolytica
ITERGKSHELEGT

SEQ ID NO: 2565408 - protein, 11 aa, Entamoeba histolytica
ITERINEENPF

SEQ ID NO: 2565409 - protein, 9 aa, Entamoeba histolytica
ITESKGKWS

SEQ ID NO: 2565410 - protein, 19 aa, Entamoeba histolytica
ITESNKQDSLINSNKDKGF

SEQ ID NO: 2565411 - protein, 15 aa, Entamoeba histolytica
ITESYKNLPDKEQAR

SEQ ID NO: 2565412 - protein, 5 aa, Entamoeba histolytica
ITGGQ

SEQ ID NO: 2565413 - protein, 13 aa, Entamoeba histolytica
ITGKEGMSAARAA

SEQ ID NO: 2565414 - protein, 5 aa, Entamoeba histolytica
ITGSC

SEQ ID NO: 2565415 - protein, 8 aa, Entamoeba histolytica
ITGTTTTD

SEQ ID NO: 2565416 - protein, 7 aa, Entamoeba histolytica
ITGTVTS

SEQ ID NO: 2565417 - protein, 5 aa, Entamoeba histolytica
ITHPD

SEQ ID NO: 2565418 - protein, 7 aa, Entamoeba histolytica
ITHSRSQ

SEQ ID NO: 2565419 - protein, 5 aa, Entamoeba histolytica
ITIKT

SEQ ID NO: 2565420 - protein, 5 aa, Entamoeba histolytica
ITISG

SEQ ID NO: 2565421 - protein, 4 aa, Entamoeba histolytica
ITKD

SEQ ID NO: 2565422 - protein, 9 aa, Entamoeba histolytica
ITKDGDGNT

SEQ ID NO: 2565423 - protein, 11 aa, Entamoeba histolytica
ITKEEAKKDKC

SEQ ID NO: 2565424 - protein, 5 aa, Entamoeba histolytica
ITKEN

SEQ ID NO: 2565425 - protein, 9 aa, Entamoeba histolytica
ITKKHGEPS

SEQ ID NO: 2565426 - protein, 9 aa, Entamoeba histolytica
ITKNPESSA

SEQ ID NO: 2565427 - protein, 7 aa, Entamoeba histolytica
ITKQESL

SEQ ID NO: 2565428 - protein, 9 aa, Entamoeba histolytica
ITKQQSSSD

SEQ ID NO: 2565429 - protein, 10 aa, Entamoeba histolytica
ITKSSQSPLT

SEQ ID NO: 2565430 - protein, 10 aa, Entamoeba histolytica
ITKTQDSIKE

SEQ ID NO: 2565431 - protein, 7 aa, Entamoeba histolytica
ITNEKEE

SEQ ID NO: 2565432 - protein, 22 aa, Entamoeba histolytica
ITNENAEYVGADNEATNAATFN

SEQ ID NO: 2565433 - protein, 16 aa, Entamoeba histolytica
ITNENGETVQVKRSTK

SEQ ID NO: 2565434 - protein, 9 aa, Entamoeba histolytica
ITNENTSSK

SEQ ID NO: 2565435 - protein, 13 aa, Entamoeba histolytica
ITNESYDDHTLSP

SEQ ID NO: 2565436 - protein, 12 aa, Entamoeba histolytica
ITNKENNKSSAF

SEQ ID NO: 2565437 - protein, 4 aa, Entamoeba histolytica
ITNN

SEQ ID NO: 2565438 - protein, 11 aa, Entamoeba histolytica
ITNNNKNEQYN

SEQ ID NO: 2565439 - protein, 9 aa, Entamoeba histolytica
ITNNSTVNK

SEQ ID NO: 2565440 - protein, 16 aa, Entamoeba histolytica
ITNPKSFDLSKSTTTF

SEQ ID NO: 2565441 - protein, 10 aa, Entamoeba histolytica
ITNREQGDKD

SEQ ID NO: 2565442 - protein, 7 aa, Entamoeba histolytica
ITNSPTM

SEQ ID NO: 2565443 - protein, 11 aa, Entamoeba histolytica
ITNTKETTDEE

SEQ ID NO: 2565444 - protein, 7 aa, Entamoeba histolytica
ITNTTNN

SEQ ID NO: 2565445 - protein, 4 aa, Entamoeba histolytica
ITNV

SEQ ID NO: 2565446 - protein, 5 aa, Entamoeba histolytica
ITPNE

SEQ ID NO: 2565447 - protein, 15 aa, Entamoeba histolytica
ITPPQSISPQTLSGI

SEQ ID NO: 2565448 - protein, 9 aa, Entamoeba histolytica
ITPQTNVPT

SEQ ID NO: 2565449 - protein, 6 aa, Entamoeba histolytica
ITPTPS

SEQ ID NO: 2565450 - protein, 5 aa, Entamoeba histolytica
ITPTT

SEQ ID NO: 2565451 - protein, 9 aa, Entamoeba histolytica
ITPVKGQLA

SEQ ID NO: 2565452 - protein, 6 aa, Entamoeba histolytica
ITQDDR

SEQ ID NO: 2565453 - protein, 7 aa, Entamoeba histolytica
ITQNEDI

SEQ ID NO: 2565454 - protein, 8 aa, Entamoeba histolytica
ITQPEQSI

SEQ ID NO: 2565455 - protein, 22 aa, Entamoeba histolytica
ITQYDDSGCTLPNSKKQIETFE

SEQ ID NO: 2565456 - protein, 5 aa, Entamoeba histolytica
ITRKT

SEQ ID NO: 2565457 - protein, 14 aa, Entamoeba histolytica
ITRPTSKSSNDRMG

SEQ ID NO: 2565458 - protein, 10 aa, Entamoeba histolytica
ITRSGSKSRL

SEQ ID NO: 2565459 - protein, 7 aa, Entamoeba histolytica
ITSASNL

SEQ ID NO: 2565460 - protein, 8 aa, Entamoeba histolytica
ITSEEGGY

SEQ ID NO: 2565461 - protein, 5 aa, Entamoeba histolytica
ITSET

SEQ ID NO: 2565462 - protein, 6 aa, Entamoeba histolytica
ITSGSG

SEQ ID NO: 2565463 - protein, 6 aa, Entamoeba histolytica
ITSGVT

SEQ ID NO: 2565464 - protein, 10 aa, Entamoeba histolytica
ITSKDDSFTD

SEQ ID NO: 2565465 - protein, 14 aa, Entamoeba histolytica
ITSKPSLKKEQPKK

SEQ ID NO: 2565466 - protein, 9 aa, Entamoeba histolytica
ITSNNPRVS

SEQ ID NO: 2565467 - protein, 4 aa, Entamoeba histolytica
ITSP

SEQ ID NO: 2565468 - protein, 7 aa, Entamoeba histolytica
ITSPPSN

SEQ ID NO: 2565469 - protein, 12 aa, Entamoeba histolytica
ITSPQPQSPSLF

SEQ ID NO: 2565470 - protein, 13 aa, Entamoeba histolytica
ITSPTTNPKLSQS

SEQ ID NO: 2565471 - protein, 4 aa, Entamoeba histolytica
ITSQ

SEQ ID NO: 2565472 - protein, 6 aa, Entamoeba histolytica
ITSRKG

SEQ ID NO: 2565473 - protein, 9 aa, Entamoeba histolytica
ITSRTDKLP

SEQ ID NO: 2565474 - protein, 4 aa, Entamoeba histolytica
ITSS

SEQ ID NO: 2565475 - protein, 7 aa, Entamoeba histolytica
ITSSSSS

SEQ ID NO: 2565476 - protein, 8 aa, Entamoeba histolytica
ITTEKKKT

SEQ ID NO: 2565477 - protein, 4 aa, Entamoeba histolytica
ITTG

SEQ ID NO: 2565478 - protein, 9 aa, Entamoeba histolytica
ITTGKRPNI

SEQ ID NO: 2565479 - protein, 6 aa, Entamoeba histolytica
ITTGNR

SEQ ID NO: 2565480 - protein, 7 aa, Entamoeba histolytica
ITTGQSK

SEQ ID NO: 2565481 - protein, 5 aa, Entamoeba histolytica
ITTKI

SEQ ID NO: 2565482 - protein, 19 aa, Entamoeba histolytica
ITTKRKEEILPNSNIKSPV

SEQ ID NO: 2565483 - protein, 7 aa, Entamoeba histolytica
ITTKRNI

SEQ ID NO: 2565484 - protein, 18 aa, Entamoeba histolytica
ITTNDEQEEDYNGLLIND

SEQ ID NO: 2565485 - protein, 5 aa, Entamoeba histolytica
ITTNE

SEQ ID NO: 2565486 - protein, 37 aa, Entamoeba histolytica
ITTNENTETKEIPEEIENNKVNSQSNSNELISSPPIE

SEQ ID NO: 2565487 - protein, 5 aa, Entamoeba histolytica
ITTNN

SEQ ID NO: 2565488 - protein, 6 aa, Entamoeba histolytica
ITTNTH

SEQ ID NO: 2565489 - protein, 8 aa, Entamoeba histolytica
ITTPSGVT

SEQ ID NO: 2565490 - protein, 12 aa, Entamoeba histolytica
ITTQQERSTFST

SEQ ID NO: 2565491 - protein, 10 aa, Entamoeba histolytica
ITTQTKSAYF

SEQ ID NO: 2565492 - protein, 7 aa, Entamoeba histolytica
ITTTPNL

SEQ ID NO: 2565493 - protein, 18 aa, Entamoeba histolytica
ITTTSSASPWKEGCQPTC

SEQ ID NO: 2565494 - protein, 12 aa, Entamoeba histolytica
ITVTNDNKQLKD

SEQ ID NO: 2565495 - protein, 29 aa, Entamoeba histolytica
ITYSDTESIETENDEETENKKKESDVEKT

SEQ ID NO: 2565496 - protein, 5 aa, Entamoeba histolytica
IVKQP

SEQ ID NO: 2565497 - protein, 12 aa, Entamoeba histolytica
IVNNPEDEERTH

SEQ ID NO: 2565498 - protein, 17 aa, Entamoeba histolytica
IVSGNNFGGKFTESSEG

SEQ ID NO: 2565499 - protein, 5 aa, Entamoeba histolytica
IWTEK

SEQ ID NO: 2565500 - protein, 9 aa, Entamoeba histolytica
IYKNDRKND

SEQ ID NO: 2565501 - protein, 5 aa, Entamoeba histolytica
IYSKT

SEQ ID NO: 2565502 - protein, 12 aa, Entamoeba histolytica
IYSTSSCSTQLE

SEQ ID NO: 2565503 - protein, 8 aa, Entamoeba histolytica
KAAAGRTS

SEQ ID NO: 2565504 - protein, 6 aa, Entamoeba histolytica
KAAPPA

SEQ ID NO: 2565505 - protein, 25 aa, Entamoeba histolytica
KAASETKNNNSSKLESLSKATNDAL

SEQ ID NO: 2565506 - protein, 4 aa, Entamoeba histolytica
KACT

SEQ ID NO: 2565507 - protein, 5 aa, Entamoeba histolytica
KACYY

SEQ ID NO: 2565508 - protein, 7 aa, Entamoeba histolytica
KADEEKG

SEQ ID NO: 2565509 - protein, 7 aa, Entamoeba histolytica
KADENNG

SEQ ID NO: 2565510 - protein, 11 aa, Entamoeba histolytica
KADIGSSSTEP

SEQ ID NO: 2565511 - protein, 9 aa, Entamoeba histolytica
KADISSSTT

SEQ ID NO: 2565512 - protein, 11 aa, Entamoeba histolytica
KADISSSTTGT

SEQ ID NO: 2565513 - protein, 7 aa, Entamoeba histolytica
KADNQTL

SEQ ID NO: 2565514 - protein, 7 aa, Entamoeba histolytica
KAEESLK

SEQ ID NO: 2565515 - protein, 6 aa, Entamoeba histolytica
KAEGLE

SEQ ID NO: 2565516 - protein, 8 aa, Entamoeba histolytica
KAENPDIQ

SEQ ID NO: 2565517 - protein, 13 aa, Entamoeba histolytica
KAEREQNQIHGST

SEQ ID NO: 2565518 - protein, 301 aa, Entamoeba histolytica
KAEVSTTEPASQKESKSHISEEASTQQGQQKEGNGNTETTKKNTETSVSGGGSKLENKETTKENGGNTQPGSGGAGSVSSGTDGISVEHKEKSEEEKVVAKETSATSGSGEKGNGGASNVPSTSATGSDEKSAGDTEAKGSGKSQTTDNGPNEDQGSKGTASNGSGSTQAGGDKGTSGGNSENTQHNGKDEQTDQSGSKKDKGDNGTAGKDSSKEQPGNGEDSKGEGEKNENNITDKNEEDTGKGGEKPQAGKDESKEHIGDKGKDGNKESDGSQTEDKTSSSSESNSEDGSNKNNNFDAT

SEQ ID NO: 2565519 - protein, 4 aa, Entamoeba histolytica
KAFA

SEQ ID NO: 2565520 - protein, 13 aa, Entamoeba histolytica
KAFDDNKCTTGEG

SEQ ID NO: 2565521 - protein, 7 aa, Entamoeba histolytica
KAFPKSD

SEQ ID NO: 2565522 - protein, 5 aa, Entamoeba histolytica
KAGGV

SEQ ID NO: 2565523 - protein, 7 aa, Entamoeba histolytica
KAGQTRV

SEQ ID NO: 2565524 - protein, 7 aa, Entamoeba histolytica
KAGRTFN

SEQ ID NO: 2565525 - protein, 9 aa, Entamoeba histolytica
KAIEAAKNT

SEQ ID NO: 2565526 - protein, 9 aa, Entamoeba histolytica
KAIQDNRQK

SEQ ID NO: 2565527 - protein, 11 aa, Entamoeba histolytica
KAIVDQEYEET

SEQ ID NO: 2565528 - protein, 36 aa, Entamoeba histolytica
KAKDETTQQKDETTQQNVNSPNQINTTKTSSSEEQA

SEQ ID NO: 2565529 - protein, 10 aa, Entamoeba histolytica
KAKEAKTEQE

SEQ ID NO: 2565530 - protein, 31 aa, Entamoeba histolytica
KAKEEQQKEENKEESSLNKNDELSEETKEKS

SEQ ID NO: 2565531 - protein, 9 aa, Entamoeba histolytica
KAKEKTKPK

SEQ ID NO: 2565532 - protein, 16 aa, Entamoeba histolytica
KAKKAQEKETEVIETT

SEQ ID NO: 2565533 - protein, 14 aa, Entamoeba histolytica
KAKQETTIKEAKQA

SEQ ID NO: 2565534 - protein, 7 aa, Entamoeba histolytica
KAKSAIT

SEQ ID NO: 2565535 - protein, 15 aa, Entamoeba histolytica
KAKSAITSGSLSNLP

SEQ ID NO: 2565536 - protein, 6 aa, Entamoeba histolytica
KAKSAR

SEQ ID NO: 2565537 - protein, 10 aa, Entamoeba histolytica
KAKSLKDCEP

SEQ ID NO: 2565538 - protein, 40 aa, Entamoeba histolytica
KAKSLTTSGNLTVTGNSITITESTTFGTGKISGNNVDFTT

SEQ ID NO: 2565539 - protein, 8 aa, Entamoeba histolytica
KALEEAHQ

SEQ ID NO: 2565540 - protein, 5 aa, Entamoeba histolytica
KALGE

SEQ ID NO: 2565541 - protein, 7 aa, Entamoeba histolytica
KALPGSD

SEQ ID NO: 2565542 - protein, 6 aa, Entamoeba histolytica
KALPNN

SEQ ID NO: 2565543 - protein, 23 aa, Entamoeba histolytica
KALSAIKPKTVNDNDSVSSTDSR

SEQ ID NO: 2565544 - protein, 7 aa, Entamoeba histolytica
KALSEEY

SEQ ID NO: 2565545 - protein, 11 aa, Entamoeba histolytica
KALVDKEYEQN

SEQ ID NO: 2565546 - protein, 6 aa, Entamoeba histolytica
KAMEND

SEQ ID NO: 2565547 - protein, 9 aa, Entamoeba histolytica
KANDSLRQA

SEQ ID NO: 2565548 - protein, 18 aa, Entamoeba histolytica
KANESSTTMDDLVIPFYL

SEQ ID NO: 2565549 - protein, 7 aa, Entamoeba histolytica
KANEYGM

SEQ ID NO: 2565550 - protein, 5 aa, Entamoeba histolytica
KANHC

SEQ ID NO: 2565551 - protein, 13 aa, Entamoeba histolytica
KANKAQGDSPADF

SEQ ID NO: 2565552 - protein, 11 aa, Entamoeba histolytica
KANSNQTECDH

SEQ ID NO: 2565553 - protein, 8 aa, Entamoeba histolytica
KANTTLDA

SEQ ID NO: 2565554 - protein, 6 aa, Entamoeba histolytica
KANYNG

SEQ ID NO: 2565555 - protein, 11 aa, Entamoeba histolytica
KAPECACPTGT

SEQ ID NO: 2565556 - protein, 5 aa, Entamoeba histolytica
KAPEF

SEQ ID NO: 2565557 - protein, 6 aa, Entamoeba histolytica
KAPITG

SEQ ID NO: 2565558 - protein, 5 aa, Entamoeba histolytica
KAPKI

SEQ ID NO: 2565559 - protein, 5 aa, Entamoeba histolytica
KAPKT

SEQ ID NO: 2565560 - protein, 11 aa, Entamoeba histolytica
KAPPKDETTDS

SEQ ID NO: 2565561 - protein, 8 aa, Entamoeba histolytica
KAPPQPSF

SEQ ID NO: 2565562 - protein, 22 aa, Entamoeba histolytica
KAPSPRKHRKKKEPSDKDALGE

SEQ ID NO: 2565563 - protein, 6 aa, Entamoeba histolytica
KAPTSL

SEQ ID NO: 2565564 - protein, 8 aa, Entamoeba histolytica
KAPYALSS

SEQ ID NO: 2565565 - protein, 7 aa, Entamoeba histolytica
KAQAGGF

SEQ ID NO: 2565566 - protein, 4 aa, Entamoeba histolytica
KAQE

SEQ ID NO: 2565567 - protein, 6 aa, Entamoeba histolytica
KAQEKS

SEQ ID NO: 2565568 - protein, 6 aa, Entamoeba histolytica
KAQEPI

SEQ ID NO: 2565569 - protein, 4 aa, Entamoeba histolytica
KAQM

SEQ ID NO: 2565570 - protein, 7 aa, Entamoeba histolytica
KAQPGNN

SEQ ID NO: 2565571 - protein, 7 aa, Entamoeba histolytica
KARGLKK

SEQ ID NO: 2565572 - protein, 5 aa, Entamoeba histolytica
KASAY

SEQ ID NO: 2565573 - protein, 8 aa, Entamoeba histolytica
KASESGED

SEQ ID NO: 2565574 - protein, 7 aa, Entamoeba histolytica
KASFNDK

SEQ ID NO: 2565575 - protein, 8 aa, Entamoeba histolytica
KASGEHDK

SEQ ID NO: 2565576 - protein, 9 aa, Entamoeba histolytica
KASGNKEIK

SEQ ID NO: 2565577 - protein, 9 aa, Entamoeba histolytica
KASKNEKVN

SEQ ID NO: 2565578 - protein, 6 aa, Entamoeba histolytica
KASMNT

SEQ ID NO: 2565579 - protein, 6 aa, Entamoeba histolytica
KASNNT

SEQ ID NO: 2565580 - protein, 4 aa, Entamoeba histolytica
KASS

SEQ ID NO: 2565581 - protein, 6 aa, Entamoeba histolytica
KASVNS

SEQ ID NO: 2565582 - protein, 6 aa, Entamoeba histolytica
KATEEM

SEQ ID NO: 2565583 - protein, 7 aa, Entamoeba histolytica
KATEITA

SEQ ID NO: 2565584 - protein, 10 aa, Entamoeba histolytica
KATGPLSQVE

SEQ ID NO: 2565585 - protein, 11 aa, Entamoeba histolytica
KATKPNPVDLP

SEQ ID NO: 2565586 - protein, 12 aa, Entamoeba histolytica
KATNEVEKEKAI

SEQ ID NO: 2565587 - protein, 6 aa, Entamoeba histolytica
KATNIQ

SEQ ID NO: 2565588 - protein, 13 aa, Entamoeba histolytica
KATTRTIRENDPN

SEQ ID NO: 2565589 - protein, 5 aa, Entamoeba histolytica
KATVR

SEQ ID NO: 2565590 - protein, 11 aa, Entamoeba histolytica
KAVVQDKQSDP

SEQ ID NO: 2565591 - protein, 16 aa, Entamoeba histolytica
KAYPIKYSDKSQAPKL

SEQ ID NO: 2565592 - protein, 9 aa, Entamoeba histolytica
KCDDNCTTC

SEQ ID NO: 2565593 - protein, 9 aa, Entamoeba histolytica
KCDPSSSTI

SEQ ID NO: 2565594 - protein, 12 aa, Entamoeba histolytica
KCDSKCKECTSN

SEQ ID NO: 2565595 - protein, 9 aa, Entamoeba histolytica
KCDSTLNTC

SEQ ID NO: 2565596 - protein, 24 aa, Entamoeba histolytica
KCDTNEKEMKDLEEKCKTNKKIGE

SEQ ID NO: 2565597 - protein, 11 aa, Entamoeba histolytica
KCEAKKFKKSL

SEQ ID NO: 2565598 - protein, 9 aa, Entamoeba histolytica
KCEEQNTYG

SEQ ID NO: 2565599 - protein, 9 aa, Entamoeba histolytica
KCESSDGIK

SEQ ID NO: 2565600 - protein, 6 aa, Entamoeba histolytica
KCETCN

SEQ ID NO: 2565601 - protein, 10 aa, Entamoeba histolytica
KCGDDGKWSN

SEQ ID NO: 2565602 - protein, 11 aa, Entamoeba histolytica
KCGENDDGTCK

SEQ ID NO: 2565603 - protein, 8 aa, Entamoeba histolytica
KCGGKGVV

SEQ ID NO: 2565604 - protein, 9 aa, Entamoeba histolytica
KCGNDNKWT

SEQ ID NO: 2565605 - protein, 19 aa, Entamoeba histolytica
KCGNGKLEEEEECDSGDGC

SEQ ID NO: 2565606 - protein, 13 aa, Entamoeba histolytica
KCINQNNEQGNNS

SEQ ID NO: 2565607 - protein, 16 aa, Entamoeba histolytica
KCKEGSFLSDDGKCYS

SEQ ID NO: 2565608 - protein, 8 aa, Entamoeba histolytica
KCKEVKNN

SEQ ID NO: 2565609 - protein, 11 aa, Entamoeba histolytica
KCKRSGTIGSD

SEQ ID NO: 2565610 - protein, 8 aa, Entamoeba histolytica
KCLDQQNS

SEQ ID NO: 2565611 - protein, 14 aa, Entamoeba histolytica
KCNDKNGEVECQDS

SEQ ID NO: 2565612 - protein, 14 aa, Entamoeba histolytica
KCNDNNGEVECQDS

SEQ ID NO: 2565613 - protein, 5 aa, Entamoeba histolytica
KCNGA

SEQ ID NO: 2565614 - protein, 8 aa, Entamoeba histolytica
KCNGDETC

SEQ ID NO: 2565615 - protein, 8 aa, Entamoeba histolytica
KCNPKNKR

SEQ ID NO: 2565616 - protein, 6 aa, Entamoeba histolytica
KCPTLP

SEQ ID NO: 2565617 - protein, 6 aa, Entamoeba histolytica
KCPTSS

SEQ ID NO: 2565618 - protein, 5 aa, Entamoeba histolytica
KCPTT

SEQ ID NO: 2565619 - protein, 7 aa, Entamoeba histolytica
KCQEKRK

SEQ ID NO: 2565620 - protein, 5 aa, Entamoeba histolytica
KCQNC

SEQ ID NO: 2565621 - protein, 6 aa, Entamoeba histolytica
KCQRCS

SEQ ID NO: 2565622 - protein, 7 aa, Entamoeba histolytica
KCQSCDD

SEQ ID NO: 2565623 - protein, 10 aa, Entamoeba histolytica
KCRGGPPLRS

SEQ ID NO: 2565624 - protein, 7 aa, Entamoeba histolytica
KCRSNDE

SEQ ID NO: 2565625 - protein, 17 aa, Entamoeba histolytica
KCSKEKYDDSKDETRGC

SEQ ID NO: 2565626 - protein, 8 aa, Entamoeba histolytica
KCSKGYYK

SEQ ID NO: 2565627 - protein, 6 aa, Entamoeba histolytica
KCSKKD

SEQ ID NO: 2565628 - protein, 7 aa, Entamoeba histolytica
KCSLETC

SEQ ID NO: 2565629 - protein, 8 aa, Entamoeba histolytica
KCSNEKMA

SEQ ID NO: 2565630 - protein, 15 aa, Entamoeba histolytica
KCSPNTQYLSKEDNK

SEQ ID NO: 2565631 - protein, 9 aa, Entamoeba histolytica
KCSPTNDCD

SEQ ID NO: 2565632 - protein, 12 aa, Entamoeba histolytica
KCSSSCSTCVGT

SEQ ID NO: 2565633 - protein, 5 aa, Entamoeba histolytica
KCSTA

SEQ ID NO: 2565634 - protein, 4 aa, Entamoeba histolytica
KCTA

SEQ ID NO: 2565635 - protein, 6 aa, Entamoeba histolytica
KCTSCR

SEQ ID NO: 2565636 - protein, 7 aa, Entamoeba histolytica
KCTSRQD

SEQ ID NO: 2565637 - protein, 11 aa, Entamoeba histolytica
KDAASPEDQER

SEQ ID NO: 2565638 - protein, 7 aa, Entamoeba histolytica
KDAEGKQ

SEQ ID NO: 2565639 - protein, 7 aa, Entamoeba histolytica
KDAFSPP

SEQ ID NO: 2565640 - protein, 11 aa, Entamoeba histolytica
KDASSKSDNDI

SEQ ID NO: 2565641 - protein, 13 aa, Entamoeba histolytica
KDASTSQRGGIKQ

SEQ ID NO: 2565642 - protein, 6 aa, Entamoeba histolytica
KDCESL

SEQ ID NO: 2565643 - protein, 4 aa, Entamoeba histolytica
KDCG

SEQ ID NO: 2565644 - protein, 8 aa, Entamoeba histolytica
KDCKADKI

SEQ ID NO: 2565645 - protein, 11 aa, Entamoeba histolytica
KDDDPNQIPIN

SEQ ID NO: 2565646 - protein, 8 aa, Entamoeba histolytica
KDDDSTHL

SEQ ID NO: 2565647 - protein, 6 aa, Entamoeba histolytica
KDDERT

SEQ ID NO: 2565648 - protein, 7 aa, Entamoeba histolytica
KDDGSTL

SEQ ID NO: 2565649 - protein, 9 aa, Entamoeba histolytica
KDDKSNENL

SEQ ID NO: 2565650 - protein, 7 aa, Entamoeba histolytica
KDDNGDI

SEQ ID NO: 2565651 - protein, 8 aa, Entamoeba histolytica
KDDRITET

SEQ ID NO: 2565652 - protein, 7 aa, Entamoeba histolytica
KDDRYNQ

SEQ ID NO: 2565653 - protein, 4 aa, Entamoeba histolytica
KDDS

SEQ ID NO: 2565654 - protein, 5 aa, Entamoeba histolytica
KDDTI

SEQ ID NO: 2565655 - protein, 33 aa, Entamoeba histolytica
KDDTSLSTQNSMKSKSINSHSHNNSSSISIEKS

SEQ ID NO: 2565656 - protein, 5 aa, Entamoeba histolytica
KDDVP

SEQ ID NO: 2565657 - protein, 6 aa, Entamoeba histolytica
KDDYNC

SEQ ID NO: 2565658 - protein, 6 aa, Entamoeba histolytica
KDECSN

SEQ ID NO: 2565659 - protein, 5 aa, Entamoeba histolytica
KDEDA

SEQ ID NO: 2565660 - protein, 8 aa, Entamoeba histolytica
KDEETYTF

SEQ ID NO: 2565661 - protein, 5 aa, Entamoeba histolytica
KDEEV

SEQ ID NO: 2565662 - protein, 6 aa, Entamoeba histolytica
KDEGEY

SEQ ID NO: 2565663 - protein, 11 aa, Entamoeba histolytica
KDEIKKERRKE

SEQ ID NO: 2565664 - protein, 6 aa, Entamoeba histolytica
KDEKDV

SEQ ID NO: 2565665 - protein, 9 aa, Entamoeba histolytica
KDEKSEINK

SEQ ID NO: 2565666 - protein, 8 aa, Entamoeba histolytica
KDENQRRP

SEQ ID NO: 2565667 - protein, 18 aa, Entamoeba histolytica
KDEQEDDREETEDEQEEE

SEQ ID NO: 2565668 - protein, 6 aa, Entamoeba histolytica
KDERVP

SEQ ID NO: 2565669 - protein, 7 aa, Entamoeba histolytica
KDERYST

SEQ ID NO: 2565670 - protein, 8 aa, Entamoeba histolytica
KDESISSK

SEQ ID NO: 2565671 - protein, 7 aa, Entamoeba histolytica
KDESKIK

SEQ ID NO: 2565672 - protein, 5 aa, Entamoeba histolytica
KDETH

SEQ ID NO: 2565673 - protein, 8 aa, Entamoeba histolytica
KDETVNAK

SEQ ID NO: 2565674 - protein, 8 aa, Entamoeba histolytica
KDEVNEQM

SEQ ID NO: 2565675 - protein, 125 aa, Entamoeba histolytica
KDFPEESPSGRKSDEKRLSSQSSEKLSSNSTSSQTKSDSSSEKSEHDKDERDQEKPQEKVESKEESKEESKEESKEESKEESKEKDTAKEQEITESKEEKKEEIKDTVETTKEKKEQEKEAITEE

SEQ ID NO: 2565676 - protein, 6 aa, Entamoeba histolytica
KDGAQY

SEQ ID NO: 2565677 - protein, 8 aa, Entamoeba histolytica
KDGEKGQY

SEQ ID NO: 2565678 - protein, 12 aa, Entamoeba histolytica
KDGEKPKIRENL

SEQ ID NO: 2565679 - protein, 10 aa, Entamoeba histolytica
KDGETPTEEE

SEQ ID NO: 2565680 - protein, 6 aa, Entamoeba histolytica
KDGETV

SEQ ID NO: 2565681 - protein, 9 aa, Entamoeba histolytica
KDGIAKATS

SEQ ID NO: 2565682 - protein, 5 aa, Entamoeba histolytica
KDGIK

SEQ ID NO: 2565683 - protein, 27 aa, Entamoeba histolytica
KDGIKTTTCKDTGKTTCDTNNKRIEDA

SEQ ID NO: 2565684 - protein, 9 aa, Entamoeba histolytica
KDGKGDPRI

SEQ ID NO: 2565685 - protein, 7 aa, Entamoeba histolytica
KDGNGDI

SEQ ID NO: 2565686 - protein, 7 aa, Entamoeba histolytica
KDGNQFE

SEQ ID NO: 2565687 - protein, 6 aa, Entamoeba histolytica
KDGSMY

SEQ ID NO: 2565688 - protein, 30 aa, Entamoeba histolytica
KDGSNEDDEQGRSDDNFEDENEIKEDKTLP

SEQ ID NO: 2565689 - protein, 6 aa, Entamoeba histolytica
KDGTAY

SEQ ID NO: 2565690 - protein, 18 aa, Entamoeba histolytica
KDGTCKSCNKESTNESEN

SEQ ID NO: 2565691 - protein, 8 aa, Entamoeba histolytica
KDGYEQTT

SEQ ID NO: 2565692 - protein, 6 aa, Entamoeba histolytica
KDHNKG

SEQ ID NO: 2565693 - protein, 17 aa, Entamoeba histolytica
KDIAGAEVRNSTLPEEL

SEQ ID NO: 2565694 - protein, 7 aa, Entamoeba histolytica
KDIGEDT

SEQ ID NO: 2565695 - protein, 4 aa, Entamoeba histolytica
KDIK

SEQ ID NO: 2565696 - protein, 21 aa, Entamoeba histolytica
KDIKSYQDRNKERKSKEKSTI

SEQ ID NO: 2565697 - protein, 6 aa, Entamoeba histolytica
KDINKT

SEQ ID NO: 2565698 - protein, 10 aa, Entamoeba histolytica
KDINSNEDGM

SEQ ID NO: 2565699 - protein, 4 aa, Entamoeba histolytica
KDIP

SEQ ID NO: 2565700 - protein, 4 aa, Entamoeba histolytica
KDIS

SEQ ID NO: 2565701 - protein, 4 aa, Entamoeba histolytica
KDIT

SEQ ID NO: 2565702 - protein, 6 aa, Entamoeba histolytica
KDKEIK

SEQ ID NO: 2565703 - protein, 7 aa, Entamoeba histolytica
KDKESIE

SEQ ID NO: 2565704 - protein, 9 aa, Entamoeba histolytica
KDKGGCEMT

SEQ ID NO: 2565705 - protein, 8 aa, Entamoeba histolytica
KDKGLGTP

SEQ ID NO: 2565706 - protein, 5 aa, Entamoeba histolytica
KDKID

SEQ ID NO: 2565707 - protein, 10 aa, Entamoeba histolytica
KDKKPEVDQV

SEQ ID NO: 2565708 - protein, 16 aa, Entamoeba histolytica
KDKKTFNTQQTTENNL

SEQ ID NO: 2565709 - protein, 8 aa, Entamoeba histolytica
KDKNNPNV

SEQ ID NO: 2565710 - protein, 7 aa, Entamoeba histolytica
KDKNPIL

SEQ ID NO: 2565711 - protein, 15 aa, Entamoeba histolytica
KDKPYRKAPCGNGGY

SEQ ID NO: 2565712 - protein, 6 aa, Entamoeba histolytica
KDKRNE

SEQ ID NO: 2565713 - protein, 8 aa, Entamoeba histolytica
KDKSAAEI

SEQ ID NO: 2565714 - protein, 6 aa, Entamoeba histolytica
KDKTID

SEQ ID NO: 2565715 - protein, 5 aa, Entamoeba histolytica
KDLDN

SEQ ID NO: 2565716 - protein, 23 aa, Entamoeba histolytica
KDLEKETEKTRAKHKRSEEWKKT

SEQ ID NO: 2565717 - protein, 4 aa, Entamoeba histolytica
KDLL

SEQ ID NO: 2565718 - protein, 6 aa, Entamoeba histolytica
KDNAQR

SEQ ID NO: 2565719 - protein, 7 aa, Entamoeba histolytica
KDNEDSN

SEQ ID NO: 2565720 - protein, 8 aa, Entamoeba histolytica
KDNETYKT

SEQ ID NO: 2565721 - protein, 10 aa, Entamoeba histolytica
KDNHSDPKAF

SEQ ID NO: 2565722 - protein, 5 aa, Entamoeba histolytica
KDNIK

SEQ ID NO: 2565723 - protein, 12 aa, Entamoeba histolytica
KDNKDLDLPSQR

SEQ ID NO: 2565724 - protein, 12 aa, Entamoeba histolytica
KDNNDNQNHCTQ

SEQ ID NO: 2565725 - protein, 13 aa, Entamoeba histolytica
KDNNTNENPTGRV

SEQ ID NO: 2565726 - protein, 8 aa, Entamoeba histolytica
KDNNTTEK

SEQ ID NO: 2565727 - protein, 5 aa, Entamoeba histolytica
KDNSD

SEQ ID NO: 2565728 - protein, 9 aa, Entamoeba histolytica
KDNSSSQSC

SEQ ID NO: 2565729 - protein, 6 aa, Entamoeba histolytica
KDNTSK

SEQ ID NO: 2565730 - protein, 5 aa, Entamoeba histolytica
KDNVD

SEQ ID NO: 2565731 - protein, 11 aa, Entamoeba histolytica
KDNWKSSLARK

SEQ ID NO: 2565732 - protein, 5 aa, Entamoeba histolytica
KDPDI

SEQ ID NO: 2565733 - protein, 7 aa, Entamoeba histolytica
KDPDPSY

SEQ ID NO: 2565734 - protein, 5 aa, Entamoeba histolytica
KDPGN

SEQ ID NO: 2565735 - protein, 22 aa, Entamoeba histolytica
KDPKKRPKINEVEEKLLKLEET

SEQ ID NO: 2565736 - protein, 16 aa, Entamoeba histolytica
KDPMRKRRASTATYED

SEQ ID NO: 2565737 - protein, 12 aa, Entamoeba histolytica
KDPNAPDAGKCY

SEQ ID NO: 2565738 - protein, 8 aa, Entamoeba histolytica
KDPNSISK

SEQ ID NO: 2565739 - protein, 6 aa, Entamoeba histolytica
KDPQYV

SEQ ID NO: 2565740 - protein, 6 aa, Entamoeba histolytica
KDPSTL

SEQ ID NO: 2565741 - protein, 7 aa, Entamoeba histolytica
KDPTNNY

SEQ ID NO: 2565742 - protein, 10 aa, Entamoeba histolytica
KDPTPWEDAT

SEQ ID NO: 2565743 - protein, 9 aa, Entamoeba histolytica
KDPTTNEVK

SEQ ID NO: 2565744 - protein, 7 aa, Entamoeba histolytica
KDPYDSI

SEQ ID NO: 2565745 - protein, 9 aa, Entamoeba histolytica
KDPYGAERG

SEQ ID NO: 2565746 - protein, 5 aa, Entamoeba histolytica
KDPYV

SEQ ID NO: 2565747 - protein, 5 aa, Entamoeba histolytica
KDQAG

SEQ ID NO: 2565748 - protein, 15 aa, Entamoeba histolytica
KDQIKKEYPTEKETS

SEQ ID NO: 2565749 - protein, 8 aa, Entamoeba histolytica
KDQINNKT

SEQ ID NO: 2565750 - protein, 25 aa, Entamoeba histolytica
KDQKRSENGQGQDNYYQPFNQENND

SEQ ID NO: 2565751 - protein, 5 aa, Entamoeba histolytica
KDQTL

SEQ ID NO: 2565752 - protein, 5 aa, Entamoeba histolytica
KDQVT

SEQ ID NO: 2565753 - protein, 5 aa, Entamoeba histolytica
KDRAN

SEQ ID NO: 2565754 - protein, 11 aa, Entamoeba histolytica
KDRDVKNDCEC

SEQ ID NO: 2565755 - protein, 4 aa, Entamoeba histolytica
KDRI

SEQ ID NO: 2565756 - protein, 9 aa, Entamoeba histolytica
KDRSHGDES

SEQ ID NO: 2565757 - protein, 6 aa, Entamoeba histolytica
KDRSYN

SEQ ID NO: 2565758 - protein, 5 aa, Entamoeba histolytica
KDRTG

SEQ ID NO: 2565759 - protein, 7 aa, Entamoeba histolytica
KDSALTR

SEQ ID NO: 2565760 - protein, 5 aa, Entamoeba histolytica
KDSAN

SEQ ID NO: 2565761 - protein, 5 aa, Entamoeba histolytica
KDSEL

SEQ ID NO: 2565762 - protein, 7 aa, Entamoeba histolytica
KDSGLTR

SEQ ID NO: 2565763 - protein, 9 aa, Entamoeba histolytica
KDSKGCNNV

SEQ ID NO: 2565764 - protein, 9 aa, Entamoeba histolytica
KDSKINKNE

SEQ ID NO: 2565765 - protein, 5 aa, Entamoeba histolytica
KDSLT

SEQ ID NO: 2565766 - protein, 4 aa, Entamoeba histolytica
KDSN

SEQ ID NO: 2565767 - protein, 7 aa, Entamoeba histolytica
KDSNNEH

SEQ ID NO: 2565768 - protein, 7 aa, Entamoeba histolytica
KDSNYRK

SEQ ID NO: 2565769 - protein, 8 aa, Entamoeba histolytica
KDSSAETV

SEQ ID NO: 2565770 - protein, 7 aa, Entamoeba histolytica
KDSSSIT

SEQ ID NO: 2565771 - protein, 7 aa, Entamoeba histolytica
KDSSTEI

SEQ ID NO: 2565772 - protein, 8 aa, Entamoeba histolytica
KDSSTEYR

SEQ ID NO: 2565773 - protein, 5 aa, Entamoeba histolytica
KDSSV

SEQ ID NO: 2565774 - protein, 4 aa, Entamoeba histolytica
KDST

SEQ ID NO: 2565775 - protein, 9 aa, Entamoeba histolytica
KDSTLDKNG

SEQ ID NO: 2565776 - protein, 6 aa, Entamoeba histolytica
KDSYSF

SEQ ID NO: 2565777 - protein, 6 aa, Entamoeba histolytica
KDTEKC

SEQ ID NO: 2565778 - protein, 5 aa, Entamoeba histolytica
KDTFN

SEQ ID NO: 2565779 - protein, 7 aa, Entamoeba histolytica
KDTKGDV

SEQ ID NO: 2565780 - protein, 6 aa, Entamoeba histolytica
KDTQKR

SEQ ID NO: 2565781 - protein, 6 aa, Entamoeba histolytica
KDTTCT

SEQ ID NO: 2565782 - protein, 7 aa, Entamoeba histolytica
KDTTNVP

SEQ ID NO: 2565783 - protein, 16 aa, Entamoeba histolytica
KDVDKFNERGVSNDYV

SEQ ID NO: 2565784 - protein, 10 aa, Entamoeba histolytica
KDVGSSGGQY

SEQ ID NO: 2565785 - protein, 24 aa, Entamoeba histolytica
KDVKSSSSESSDDDDNLEKKSLLS

SEQ ID NO: 2565786 - protein, 4 aa, Entamoeba histolytica
KDVR

SEQ ID NO: 2565787 - protein, 10 aa, Entamoeba histolytica
KDYEDSNNLT

SEQ ID NO: 2565788 - protein, 12 aa, Entamoeba histolytica
KDYERNDKSTRI

SEQ ID NO: 2565789 - protein, 9 aa, Entamoeba histolytica
KDYEYNRER

SEQ ID NO: 2565790 - protein, 4 aa, Entamoeba histolytica
KDYI

SEQ ID NO: 2565791 - protein, 5 aa, Entamoeba histolytica
KDYNK

SEQ ID NO: 2565792 - protein, 6 aa, Entamoeba histolytica
KDYSNL

SEQ ID NO: 2565793 - protein, 8 aa, Entamoeba histolytica
KDYSSEYN

SEQ ID NO: 2565794 - protein, 5 aa, Entamoeba histolytica
KDYTS

SEQ ID NO: 2565795 - protein, 4 aa, Entamoeba histolytica
KDYW

SEQ ID NO: 2565796 - protein, 20 aa, Entamoeba histolytica
KEAAGPDYKIPEEDAEFKPT

SEQ ID NO: 2565797 - protein, 15 aa, Entamoeba histolytica
KEADDGCGKSSKSSI

SEQ ID NO: 2565798 - protein, 5 aa, Entamoeba histolytica
KEAEK

SEQ ID NO: 2565799 - protein, 7 aa, Entamoeba histolytica
KEAEQFA

SEQ ID NO: 2565800 - protein, 6 aa, Entamoeba histolytica
KEAGAI

SEQ ID NO: 2565801 - protein, 7 aa, Entamoeba histolytica
KEAGLEE

SEQ ID NO: 2565802 - protein, 5 aa, Entamoeba histolytica
KEAKD

SEQ ID NO: 2565803 - protein, 9 aa, Entamoeba histolytica
KEANESPLM

SEQ ID NO: 2565804 - protein, 4 aa, Entamoeba histolytica
KEAP

SEQ ID NO: 2565805 - protein, 25 aa, Entamoeba histolytica
KEAPTNSMKNSESKTVQTKDNDDWG

SEQ ID NO: 2565806 - protein, 10 aa, Entamoeba histolytica
KEARKEGKTE

SEQ ID NO: 2565807 - protein, 7 aa, Entamoeba histolytica
KEASEHY

SEQ ID NO: 2565808 - protein, 10 aa, Entamoeba histolytica
KEASETEGIS

SEQ ID NO: 2565809 - protein, 8 aa, Entamoeba histolytica
KEAVTPSI

SEQ ID NO: 2565810 - protein, 8 aa, Entamoeba histolytica
KEAYKKRG

SEQ ID NO: 2565811 - protein, 15 aa, Entamoeba histolytica
KECASTTEELTIQIS

SEQ ID NO: 2565812 - protein, 6 aa, Entamoeba histolytica
KECDQQ

SEQ ID NO: 2565813 - protein, 6 aa, Entamoeba histolytica
KECNCR

SEQ ID NO: 2565814 - protein, 4 aa, Entamoeba histolytica
KECQ

SEQ ID NO: 2565815 - protein, 10 aa, Entamoeba histolytica
KECSTSFGKN

SEQ ID NO: 2565816 - protein, 8 aa, Entamoeba histolytica
KECTSKGT

SEQ ID NO: 2565817 - protein, 10 aa, Entamoeba histolytica
KEDCDNGTNC

SEQ ID NO: 2565818 - protein, 15 aa, Entamoeba histolytica
KEDDELPKTFKEPSP

SEQ ID NO: 2565819 - protein, 9 aa, Entamoeba histolytica
KEDDTGKLT

SEQ ID NO: 2565820 - protein, 11 aa, Entamoeba histolytica
KEDEDTKQENA

SEQ ID NO: 2565821 - protein, 15 aa, Entamoeba histolytica
KEDEVSSSSDEVESK

SEQ ID NO: 2565822 - protein, 14 aa, Entamoeba histolytica
KEDFASKKRLSVDQ

SEQ ID NO: 2565823 - protein, 8 aa, Entamoeba histolytica
KEDGGNVL

SEQ ID NO: 2565824 - protein, 14 aa, Entamoeba histolytica
KEDKPPSINDDKKY

SEQ ID NO: 2565825 - protein, 8 aa, Entamoeba histolytica
KEDKSIQS

SEQ ID NO: 2565826 - protein, 32 aa, Entamoeba histolytica
KEDPQPDDSSSVPPTPSSSTDDKDDDSHHSTP

SEQ ID NO: 2565827 - protein, 13 aa, Entamoeba histolytica
KEDQLPKYEVEES

SEQ ID NO: 2565828 - protein, 7 aa, Entamoeba histolytica
KEDSPKT

SEQ ID NO: 2565829 - protein, 9 aa, Entamoeba histolytica
KEDTDKYSL

SEQ ID NO: 2565830 - protein, 9 aa, Entamoeba histolytica
KEDTKQEDA

SEQ ID NO: 2565831 - protein, 4 aa, Entamoeba histolytica
KEDY

SEQ ID NO: 2565832 - protein, 9 aa, Entamoeba histolytica
KEEAKEECT

SEQ ID NO: 2565833 - protein, 10 aa, Entamoeba histolytica
KEEAQKNKNE

SEQ ID NO: 2565834 - protein, 9 aa, Entamoeba histolytica
KEECDGGVN

SEQ ID NO: 2565835 - protein, 6 aa, Entamoeba histolytica
KEECDN

SEQ ID NO: 2565836 - protein, 9 aa, Entamoeba histolytica
KEECNSKND

SEQ ID NO: 2565837 - protein, 6 aa, Entamoeba histolytica
KEECQS

SEQ ID NO: 2565838 - protein, 19 aa, Entamoeba histolytica
KEEDEVENNSEKKKAPGID

SEQ ID NO: 2565839 - protein, 5 aa, Entamoeba histolytica
KEEDI

SEQ ID NO: 2565840 - protein, 5 aa, Entamoeba histolytica
KEEDQ

SEQ ID NO: 2565841 - protein, 10 aa, Entamoeba histolytica
KEEECDGGEG

SEQ ID NO: 2565842 - protein, 17 aa, Entamoeba histolytica
KEEEEIEKEHKETNPNI

SEQ ID NO: 2565843 - protein, 8 aa, Entamoeba histolytica
KEEEGFDA

SEQ ID NO: 2565844 - protein, 8 aa, Entamoeba histolytica
KEEEKELR

SEQ ID NO: 2565845 - protein, 11 aa, Entamoeba histolytica
KEEEKVEKIRK

SEQ ID NO: 2565846 - protein, 9 aa, Entamoeba histolytica
KEEERKDMN

SEQ ID NO: 2565847 - protein, 7 aa, Entamoeba histolytica
KEEERQK

SEQ ID NO: 2565848 - protein, 19 aa, Entamoeba histolytica
KEEESESSTLSSSSNNSED

SEQ ID NO: 2565849 - protein, 17 aa, Entamoeba histolytica
KEEEVKEKENKINKQKK

SEQ ID NO: 2565850 - protein, 5 aa, Entamoeba histolytica
KEEFN

SEQ ID NO: 2565851 - protein, 4 aa, Entamoeba histolytica
KEEG

SEQ ID NO: 2565852 - protein, 6 aa, Entamoeba histolytica
KEEGIS

SEQ ID NO: 2565853 - protein, 5 aa, Entamoeba histolytica
KEEIP

SEQ ID NO: 2565854 - protein, 11 aa, Entamoeba histolytica
KEEIPNNYTGI

SEQ ID NO: 2565855 - protein, 8 aa, Entamoeba histolytica
KEEKPTNI

SEQ ID NO: 2565856 - protein, 13 aa, Entamoeba histolytica
KEELTNGKKIGQI

SEQ ID NO: 2565857 - protein, 11 aa, Entamoeba histolytica
KEENDNDFPEL

SEQ ID NO: 2565858 - protein, 6 aa, Entamoeba histolytica
KEENEI

SEQ ID NO: 2565859 - protein, 5 aa, Entamoeba histolytica
KEENK

SEQ ID NO: 2565860 - protein, 10 aa, Entamoeba histolytica
KEEQEKHPEQ

SEQ ID NO: 2565861 - protein, 11 aa, Entamoeba histolytica
KEEQKKRKDEI

SEQ ID NO: 2565862 - protein, 16 aa, Entamoeba histolytica
KEEQKRYQSNKVENNK

SEQ ID NO: 2565863 - protein, 13 aa, Entamoeba histolytica
KEEQKTKDQLPNQ

SEQ ID NO: 2565864 - protein, 36 aa, Entamoeba histolytica
KEERENKEGSKESPHSSSPSTELSPCATPSEKPQSP

SEQ ID NO: 2565865 - protein, 21 aa, Entamoeba histolytica
KEERISTKKNALERAEKYQTK

SEQ ID NO: 2565866 - protein, 5 aa, Entamoeba histolytica
KEERS

SEQ ID NO: 2565867 - protein, 5 aa, Entamoeba histolytica
KEESE

SEQ ID NO: 2565868 - protein, 11 aa, Entamoeba histolytica
KEESSTLESSD

SEQ ID NO: 2565869 - protein, 5 aa, Entamoeba histolytica
KEEST

SEQ ID NO: 2565870 - protein, 7 aa, Entamoeba histolytica
KEESTTI

SEQ ID NO: 2565871 - protein, 19 aa, Entamoeba histolytica
KEETKTNKNISKSKTQPPV

SEQ ID NO: 2565872 - protein, 5 aa, Entamoeba histolytica
KEETV

SEQ ID NO: 2565873 - protein, 7 aa, Entamoeba histolytica
KEETVKK

SEQ ID NO: 2565874 - protein, 12 aa, Entamoeba histolytica
KEEVEEDTKKEG

SEQ ID NO: 2565875 - protein, 5 aa, Entamoeba histolytica
KEEVS

SEQ ID NO: 2565876 - protein, 6 aa, Entamoeba histolytica
KEFEGR

SEQ ID NO: 2565877 - protein, 19 aa, Entamoeba histolytica
KEFESKDKPDVGSKPMPTR

SEQ ID NO: 2565878 - protein, 6 aa, Entamoeba histolytica
KEFNAN

SEQ ID NO: 2565879 - protein, 6 aa, Entamoeba histolytica
KEFNYQ

SEQ ID NO: 2565880 - protein, 12 aa, Entamoeba histolytica
KEFPGEPRKPPF

SEQ ID NO: 2565881 - protein, 5 aa, Entamoeba histolytica
KEFQR

SEQ ID NO: 2565882 - protein, 4 aa, Entamoeba histolytica
KEFS

SEQ ID NO: 2565883 - protein, 6 aa, Entamoeba histolytica
KEGAQV

SEQ ID NO: 2565884 - protein, 10 aa, Entamoeba histolytica
KEGATPSEEE

SEQ ID NO: 2565885 - protein, 4 aa, Entamoeba histolytica
KEGC

SEQ ID NO: 2565886 - protein, 17 aa, Entamoeba histolytica
KEGCDKTGCIDSNSASL

SEQ ID NO: 2565887 - protein, 12 aa, Entamoeba histolytica
KEGCVSTAPLRQ

SEQ ID NO: 2565888 - protein, 4 aa, Entamoeba histolytica
KEGD

SEQ ID NO: 2565889 - protein, 17 aa, Entamoeba histolytica
KEGEEKKPEKKPEKGIS

SEQ ID NO: 2565890 - protein, 8 aa, Entamoeba histolytica
KEGEENFK

SEQ ID NO: 2565891 - protein, 9 aa, Entamoeba histolytica
KEGETLSKD

SEQ ID NO: 2565892 - protein, 9 aa, Entamoeba histolytica
KEGETLSKE

SEQ ID NO: 2565893 - protein, 7 aa, Entamoeba histolytica
KEGGIDY

SEQ ID NO: 2565894 - protein, 9 aa, Entamoeba histolytica
KEGGQPIKL

SEQ ID NO: 2565895 - protein, 5 aa, Entamoeba histolytica
KEGKF

SEQ ID NO: 2565896 - protein, 6 aa, Entamoeba histolytica
KEGKKI

SEQ ID NO: 2565897 - protein, 7 aa, Entamoeba histolytica
KEGKNKY

SEQ ID NO: 2565898 - protein, 6 aa, Entamoeba histolytica
KEGKRY

SEQ ID NO: 2565899 - protein, 10 aa, Entamoeba histolytica
KEGKTPSEEE

SEQ ID NO: 2565900 - protein, 5 aa, Entamoeba histolytica
KEGLD

SEQ ID NO: 2565901 - protein, 6 aa, Entamoeba histolytica
KEGMKG

SEQ ID NO: 2565902 - protein, 4 aa, Entamoeba histolytica
KEGQ

SEQ ID NO: 2565903 - protein, 4 aa, Entamoeba histolytica
KEGR

SEQ ID NO: 2565904 - protein, 7 aa, Entamoeba histolytica
KEGRTKL

SEQ ID NO: 2565905 - protein, 13 aa, Entamoeba histolytica
KEGTFINSGNNIK

SEQ ID NO: 2565906 - protein, 14 aa, Entamoeba histolytica
KEGTFINSGNNINT

SEQ ID NO: 2565907 - protein, 7 aa, Entamoeba histolytica
KEGTKDI

SEQ ID NO: 2565908 - protein, 8 aa, Entamoeba histolytica
KEGTNDKF

SEQ ID NO: 2565909 - protein, 12 aa, Entamoeba histolytica
KEGTQAAQTSDY

SEQ ID NO: 2565910 - protein, 12 aa, Entamoeba histolytica
KEGTQAARASDY

SEQ ID NO: 2565911 - protein, 8 aa, Entamoeba histolytica
KEGTTMDS

SEQ ID NO: 2565912 - protein, 10 aa, Entamoeba histolytica
KEGTVTPDTV

SEQ ID NO: 2565913 - protein, 7 aa, Entamoeba histolytica
KEGYEDK

SEQ ID NO: 2565914 - protein, 8 aa, Entamoeba histolytica
KEGYGGDN

SEQ ID NO: 2565915 - protein, 6 aa, Entamoeba histolytica
KEGYSY

SEQ ID NO: 2565916 - protein, 7 aa, Entamoeba histolytica
KEGYYQD

SEQ ID NO: 2565917 - protein, 8 aa, Entamoeba histolytica
KEHCQRCT

SEQ ID NO: 2565918 - protein, 5 aa, Entamoeba histolytica
KEHQN

SEQ ID NO: 2565919 - protein, 21 aa, Entamoeba histolytica
KEHSEISRRKRNKLRTAAEEY

SEQ ID NO: 2565920 - protein, 4 aa, Entamoeba histolytica
KEHV

SEQ ID NO: 2565921 - protein, 9 aa, Entamoeba histolytica
KEHYDESTH

SEQ ID NO: 2565922 - protein, 7 aa, Entamoeba histolytica
KEIATEY

SEQ ID NO: 2565923 - protein, 4 aa, Entamoeba histolytica
KEID

SEQ ID NO: 2565924 - protein, 5 aa, Entamoeba histolytica
KEIDI

SEQ ID NO: 2565925 - protein, 5 aa, Entamoeba histolytica
KEIDK

SEQ ID NO: 2565926 - protein, 12 aa, Entamoeba histolytica
KEIDMTKEDQNI

SEQ ID NO: 2565927 - protein, 7 aa, Entamoeba histolytica
KEIDNNK

SEQ ID NO: 2565928 - protein, 9 aa, Entamoeba histolytica
KEIDNRRQR

SEQ ID NO: 2565929 - protein, 6 aa, Entamoeba histolytica
KEIEEE

SEQ ID NO: 2565930 - protein, 14 aa, Entamoeba histolytica
KEIEKKKEQEKIQR

SEQ ID NO: 2565931 - protein, 18 aa, Entamoeba histolytica
KEIENTHTKNLQSQCKQQ

SEQ ID NO: 2565932 - protein, 6 aa, Entamoeba histolytica
KEIGHG

SEQ ID NO: 2565933 - protein, 11 aa, Entamoeba histolytica
KEIGKKRDDEI

SEQ ID NO: 2565934 - protein, 10 aa, Entamoeba histolytica
KEIKEENTKR

SEQ ID NO: 2565935 - protein, 12 aa, Entamoeba histolytica
KEIKLNKEGYHD

SEQ ID NO: 2565936 - protein, 21 aa, Entamoeba histolytica
KEIKNDFDTSLNKKEISINEQ

SEQ ID NO: 2565937 - protein, 9 aa, Entamoeba histolytica
KEINQTNPN

SEQ ID NO: 2565938 - protein, 8 aa, Entamoeba histolytica
KEINSSGP

SEQ ID NO: 2565939 - protein, 6 aa, Entamoeba histolytica
KEIPAD

SEQ ID NO: 2565940 - protein, 13 aa, Entamoeba histolytica
KEIPTSIPEDKKE

SEQ ID NO: 2565941 - protein, 7 aa, Entamoeba histolytica
KEIQSVG

SEQ ID NO: 2565942 - protein, 4 aa, Entamoeba histolytica
KEIR

SEQ ID NO: 2565943 - protein, 10 aa, Entamoeba histolytica
KEISEAAKKA

SEQ ID NO: 2565944 - protein, 9 aa, Entamoeba histolytica
KEISQEQYN

SEQ ID NO: 2565945 - protein, 12 aa, Entamoeba histolytica
KEITYSPPYGQI

SEQ ID NO: 2565946 - protein, 7 aa, Entamoeba histolytica
KEKATSL

SEQ ID NO: 2565947 - protein, 7 aa, Entamoeba histolytica
KEKEEKQ

SEQ ID NO: 2565948 - protein, 13 aa, Entamoeba histolytica
KEKEETKPRRSSF

SEQ ID NO: 2565949 - protein, 7 aa, Entamoeba histolytica
KEKEIKE

SEQ ID NO: 2565950 - protein, 29 aa, Entamoeba histolytica
KEKEKDKKKKIRKDKDKVVPNEPTSLPED

SEQ ID NO: 2565951 - protein, 10 aa, Entamoeba histolytica
KEKENKKIDE

SEQ ID NO: 2565952 - protein, 7 aa, Entamoeba histolytica
KEKEQKE

SEQ ID NO: 2565953 - protein, 9 aa, Entamoeba histolytica
KEKEYQSKI

SEQ ID NO: 2565954 - protein, 4 aa, Entamoeba histolytica
KEKF

SEQ ID NO: 2565955 - protein, 7 aa, Entamoeba histolytica
KEKGEEN

SEQ ID NO: 2565956 - protein, 10 aa, Entamoeba histolytica
KEKKAEKQAL

SEQ ID NO: 2565957 - protein, 27 aa, Entamoeba histolytica
KEKKDGKKIKIPTLKTKGKDKEENCNE

SEQ ID NO: 2565958 - protein, 10 aa, Entamoeba histolytica
KEKKDNERYT

SEQ ID NO: 2565959 - protein, 10 aa, Entamoeba histolytica
KEKKEREKTT

SEQ ID NO: 2565960 - protein, 9 aa, Entamoeba histolytica
KEKKNETRN

SEQ ID NO: 2565961 - protein, 10 aa, Entamoeba histolytica
KEKKQASNPI

SEQ ID NO: 2565962 - protein, 8 aa, Entamoeba histolytica
KEKKRNGV

SEQ ID NO: 2565963 - protein, 9 aa, Entamoeba histolytica
KEKKSNQVG

SEQ ID NO: 2565964 - protein, 11 aa, Entamoeba histolytica
KEKLNKKKQEF

SEQ ID NO: 2565965 - protein, 8 aa, Entamoeba histolytica
KEKLNKKS

SEQ ID NO: 2565966 - protein, 7 aa, Entamoeba histolytica
KEKNGME

SEQ ID NO: 2565967 - protein, 9 aa, Entamoeba histolytica
KEKNKCNKC

SEQ ID NO: 2565968 - protein, 9 aa, Entamoeba histolytica
KEKPNDGVS

SEQ ID NO: 2565969 - protein, 8 aa, Entamoeba histolytica
KEKPRKIS

SEQ ID NO: 2565970 - protein, 8 aa, Entamoeba histolytica
KEKPYGTI

SEQ ID NO: 2565971 - protein, 5 aa, Entamoeba histolytica
KEKQT

SEQ ID NO: 2565972 - protein, 7 aa, Entamoeba histolytica
KEKRPTA

SEQ ID NO: 2565973 - protein, 9 aa, Entamoeba histolytica
KEKRRELEQ

SEQ ID NO: 2565974 - protein, 16 aa, Entamoeba histolytica
KEKRSKEEIKEDNNNI

SEQ ID NO: 2565975 - protein, 9 aa, Entamoeba histolytica
KEKSEESNN

SEQ ID NO: 2565976 - protein, 10 aa, Entamoeba histolytica
KEKSKSKSWL

SEQ ID NO: 2565977 - protein, 6 aa, Entamoeba histolytica
KEKSQD

SEQ ID NO: 2565978 - protein, 23 aa, Entamoeba histolytica
KEKSSEKEKYSQTKKEKDSQTKY

SEQ ID NO: 2565979 - protein, 9 aa, Entamoeba histolytica
KEKSSQTKY

SEQ ID NO: 2565980 - protein, 6 aa, Entamoeba histolytica
KEKTNQ

SEQ ID NO: 2565981 - protein, 7 aa, Entamoeba histolytica
KEKTSLT

SEQ ID NO: 2565982 - protein, 11 aa, Entamoeba histolytica
KEKVGVDKKRV

SEQ ID NO: 2565983 - protein, 9 aa, Entamoeba histolytica
KEKYKKSAD

SEQ ID NO: 2565984 - protein, 9 aa, Entamoeba histolytica
KEKYNPNRT

SEQ ID NO: 2565985 - protein, 7 aa, Entamoeba histolytica
KELEDSA

SEQ ID NO: 2565986 - protein, 6 aa, Entamoeba histolytica
KELGDF

SEQ ID NO: 2565987 - protein, 9 aa, Entamoeba histolytica
KELKEKSNI

SEQ ID NO: 2565988 - protein, 15 aa, Entamoeba histolytica
KELNEKDNRSEHDKQ

SEQ ID NO: 2565989 - protein, 7 aa, Entamoeba histolytica
KELNENS

SEQ ID NO: 2565990 - protein, 5 aa, Entamoeba histolytica
KELNG

SEQ ID NO: 2565991 - protein, 20 aa, Entamoeba histolytica
KELQGTSKTHSDSLKPNDEI

SEQ ID NO: 2565992 - protein, 6 aa, Entamoeba histolytica
KELRDK

SEQ ID NO: 2565993 - protein, 7 aa, Entamoeba histolytica
KELSEEM

SEQ ID NO: 2565994 - protein, 6 aa, Entamoeba histolytica
KELTPQ

SEQ ID NO: 2565995 - protein, 19 aa, Entamoeba histolytica
KEMAERDKSQIKARDEYRK

SEQ ID NO: 2565996 - protein, 5 aa, Entamoeba histolytica
KEMQQ

SEQ ID NO: 2565997 - protein, 7 aa, Entamoeba histolytica
KENDDET

SEQ ID NO: 2565998 - protein, 5 aa, Entamoeba histolytica
KENDK

SEQ ID NO: 2565999 - protein, 16 aa, Entamoeba histolytica
KENEAKYNITNNETIT

SEQ ID NO: 2566000 - protein, 7 aa, Entamoeba histolytica
KENEEVT

SEQ ID NO: 2566001 - protein, 6 aa, Entamoeba histolytica
KENESI

SEQ ID NO: 2566002 - protein, 11 aa, Entamoeba histolytica
KENESLRASEA

SEQ ID NO: 2566003 - protein, 11 aa, Entamoeba histolytica
KENETEGEQCT

SEQ ID NO: 2566004 - protein, 11 aa, Entamoeba histolytica
KENIGKYPSNP

SEQ ID NO: 2566005 - protein, 7 aa, Entamoeba histolytica
KENIQPK

SEQ ID NO: 2566006 - protein, 7 aa, Entamoeba histolytica
KENKPLN

SEQ ID NO: 2566007 - protein, 12 aa, Entamoeba histolytica
KENKTDDDTEDK

SEQ ID NO: 2566008 - protein, 11 aa, Entamoeba histolytica
KENNSGKTIKY

SEQ ID NO: 2566009 - protein, 7 aa, Entamoeba histolytica
KENPERK

SEQ ID NO: 2566010 - protein, 7 aa, Entamoeba histolytica
KENPPTY

SEQ ID NO: 2566011 - protein, 4 aa, Entamoeba histolytica
KENR

SEQ ID NO: 2566012 - protein, 7 aa, Entamoeba histolytica
KENRKRL

SEQ ID NO: 2566013 - protein, 5 aa, Entamoeba histolytica
KENRN

SEQ ID NO: 2566014 - protein, 5 aa, Entamoeba histolytica
KENSI

SEQ ID NO: 2566015 - protein, 12 aa, Entamoeba histolytica
KENSINKQWPSH

SEQ ID NO: 2566016 - protein, 10 aa, Entamoeba histolytica
KENSNQDSGI

SEQ ID NO: 2566017 - protein, 10 aa, Entamoeba histolytica
KENSSDFSSG

SEQ ID NO: 2566018 - protein, 6 aa, Entamoeba histolytica
KENTAE

SEQ ID NO: 2566019 - protein, 7 aa, Entamoeba histolytica
KENTNQI

SEQ ID NO: 2566020 - protein, 8 aa, Entamoeba histolytica
KENTQIQS

SEQ ID NO: 2566021 - protein, 9 aa, Entamoeba histolytica
KENTQTYAG

SEQ ID NO: 2566022 - protein, 6 aa, Entamoeba histolytica
KENTSI

SEQ ID NO: 2566023 - protein, 6 aa, Entamoeba histolytica
KENTSK

SEQ ID NO: 2566024 - protein, 6 aa, Entamoeba histolytica
KENTTI

SEQ ID NO: 2566025 - protein, 6 aa, Entamoeba histolytica
KENVSK

SEQ ID NO: 2566026 - protein, 4 aa, Entamoeba histolytica
KEPE

SEQ ID NO: 2566027 - protein, 9 aa, Entamoeba histolytica
KEPGRYEDV

SEQ ID NO: 2566028 - protein, 6 aa, Entamoeba histolytica
KEPKLH

SEQ ID NO: 2566029 - protein, 9 aa, Entamoeba histolytica
KEPNEQNRE

SEQ ID NO: 2566030 - protein, 6 aa, Entamoeba histolytica
KEPNHP

SEQ ID NO: 2566031 - protein, 4 aa, Entamoeba histolytica
KEPS

SEQ ID NO: 2566032 - protein, 4 aa, Entamoeba histolytica
KEPT

SEQ ID NO: 2566033 - protein, 5 aa, Entamoeba histolytica
KEPTE

SEQ ID NO: 2566034 - protein, 7 aa, Entamoeba histolytica
KEPYTIT

SEQ ID NO: 2566035 - protein, 7 aa, Entamoeba histolytica
KEQDETV

SEQ ID NO: 2566036 - protein, 8 aa, Entamoeba histolytica
KEQDRMKR

SEQ ID NO: 2566037 - protein, 4 aa, Entamoeba histolytica
KEQE

SEQ ID NO: 2566038 - protein, 14 aa, Entamoeba histolytica
KEQERKLKETIQEP

SEQ ID NO: 2566039 - protein, 6 aa, Entamoeba histolytica
KEQIDK

SEQ ID NO: 2566040 - protein, 10 aa, Entamoeba histolytica
KEQKDGNNSS

SEQ ID NO: 2566041 - protein, 33 aa, Entamoeba histolytica
KEQKETKTQKEIEQEIEKDVESYKKSIHTNQNK

SEQ ID NO: 2566042 - protein, 6 aa, Entamoeba histolytica
KEQKGT

SEQ ID NO: 2566043 - protein, 5 aa, Entamoeba histolytica
KEQKM

SEQ ID NO: 2566044 - protein, 28 aa, Entamoeba histolytica
KEQLPQQDNQSQKSEQNDNTPEVIITES

SEQ ID NO: 2566045 - protein, 7 aa, Entamoeba histolytica
KEQPCDE

SEQ ID NO: 2566046 - protein, 5 aa, Entamoeba histolytica
KEQQT

SEQ ID NO: 2566047 - protein, 6 aa, Entamoeba histolytica
KEQQTS

SEQ ID NO: 2566048 - protein, 5 aa, Entamoeba histolytica
KEQQY

SEQ ID NO: 2566049 - protein, 6 aa, Entamoeba histolytica
KEQRCI

SEQ ID NO: 2566050 - protein, 5 aa, Entamoeba histolytica
KEQVK

SEQ ID NO: 2566051 - protein, 4 aa, Entamoeba histolytica
KERD

SEQ ID NO: 2566052 - protein, 7 aa, Entamoeba histolytica
KEREEKE

SEQ ID NO: 2566053 - protein, 10 aa, Entamoeba histolytica
KEREKEIKPF

SEQ ID NO: 2566054 - protein, 6 aa, Entamoeba histolytica
KERELE

SEQ ID NO: 2566055 - protein, 8 aa, Entamoeba histolytica
KEREQNEL

SEQ ID NO: 2566056 - protein, 7 aa, Entamoeba histolytica
KERFKNR

SEQ ID NO: 2566057 - protein, 9 aa, Entamoeba histolytica
KERGSQKKC

SEQ ID NO: 2566058 - protein, 9 aa, Entamoeba histolytica
KERGSQTEY

SEQ ID NO: 2566059 - protein, 7 aa, Entamoeba histolytica
KERGWEL

SEQ ID NO: 2566060 - protein, 12 aa, Entamoeba histolytica
KERIDKKRRNRA

SEQ ID NO: 2566061 - protein, 9 aa, Entamoeba histolytica
KERIGTPGY

SEQ ID NO: 2566062 - protein, 7 aa, Entamoeba histolytica
KERKEED

SEQ ID NO: 2566063 - protein, 13 aa, Entamoeba histolytica
KERKLGRTSANAL

SEQ ID NO: 2566064 - protein, 8 aa, Entamoeba histolytica
KERKTPAH

SEQ ID NO: 2566065 - protein, 13 aa, Entamoeba histolytica
KERLGARTTPLEY

SEQ ID NO: 2566066 - protein, 5 aa, Entamoeba histolytica
KERNE

SEQ ID NO: 2566067 - protein, 18 aa, Entamoeba histolytica
KERQDQLSDLRSKKREGM

SEQ ID NO: 2566068 - protein, 7 aa, Entamoeba histolytica
KERTHEE

SEQ ID NO: 2566069 - protein, 5 aa, Entamoeba histolytica
KERYP

SEQ ID NO: 2566070 - protein, 5 aa, Entamoeba histolytica
KERYS

SEQ ID NO: 2566071 - protein, 14 aa, Entamoeba histolytica
KESCNEDSDGIKTY

SEQ ID NO: 2566072 - protein, 8 aa, Entamoeba histolytica
KESDCQDF

SEQ ID NO: 2566073 - protein, 8 aa, Entamoeba histolytica
KESDCQGF

SEQ ID NO: 2566074 - protein, 5 aa, Entamoeba histolytica
KESEK

SEQ ID NO: 2566075 - protein, 8 aa, Entamoeba histolytica
KESEKPRV

SEQ ID NO: 2566076 - protein, 8 aa, Entamoeba histolytica
KESERERI

SEQ ID NO: 2566077 - protein, 8 aa, Entamoeba histolytica
KESETCKK

SEQ ID NO: 2566078 - protein, 142 aa, Entamoeba histolytica
KESIHENDIENEEDKKSSSNSELDENSNNQPDESSNNKPNESSDNKPNESSDNKPDESSNNKPNESSNNKPDESSNNKPDESSNNKPNESSDNKPNESSDNKPNESSDNKPNESSNNKPDESSNNKPGSSSDNYDNLDAASS

SEQ ID NO: 2566079 - protein, 150 aa, Entamoeba histolytica
KESIHENDIENEEDKKSSSNSELDENSNNQPDESSNNKPNESSDNKPNESSDNKPNESSDNKPDESSNNKPNESSNNKPDESSNNKPDESSNNKPNESSDNKPNESSDNKPNESSDNKPNESSNNKPDESSNNKPGSSSDNYDNLDAASS

SEQ ID NO: 2566080 - protein, 182 aa, Entamoeba histolytica
KESIHENDIENEEDKKSSSNSELDENSNNQPDESSNNKPNESSDNKPNESSDNKPNESSDNKPSESSDNKPSESSDNKPSESSDNKPSESSDNKPDESSNNKPNESSNNKPDESSNNKPDESSNNKPNESSDNKPNESSDNKPNESSNNKPDESSNNKPDESSNNKPGSSSDNYDNLDAASS

SEQ ID NO: 2566081 - protein, 6 aa, Entamoeba histolytica
KESIPK

SEQ ID NO: 2566082 - protein, 19 aa, Entamoeba histolytica
KESKTTLTEKDKEQFEQEV

SEQ ID NO: 2566083 - protein, 13 aa, Entamoeba histolytica
KESLEDKTELKPS

SEQ ID NO: 2566084 - protein, 7 aa, Entamoeba histolytica
KESNHCT

SEQ ID NO: 2566085 - protein, 8 aa, Entamoeba histolytica
KESRSESP

SEQ ID NO: 2566086 - protein, 5 aa, Entamoeba histolytica
KESSF

SEQ ID NO: 2566087 - protein, 6 aa, Entamoeba histolytica
KESSLE

SEQ ID NO: 2566088 - protein, 9 aa, Entamoeba histolytica
KESSNKKIG

SEQ ID NO: 2566089 - protein, 8 aa, Entamoeba histolytica
KESTSPRF

SEQ ID NO: 2566090 - protein, 4 aa, Entamoeba histolytica
KESV

SEQ ID NO: 2566091 - protein, 33 aa, Entamoeba histolytica
KESVKEVEKGYTPEEFEEVNEKKYQRPKGKVKF

SEQ ID NO: 2566092 - protein, 17 aa, Entamoeba histolytica
KESVSDGSLSVKESVTS

SEQ ID NO: 2566093 - protein, 7 aa, Entamoeba histolytica
KESYSTN

SEQ ID NO: 2566094 - protein, 6 aa, Entamoeba histolytica
KETAET

SEQ ID NO: 2566095 - protein, 7 aa, Entamoeba histolytica
KETEKEL

SEQ ID NO: 2566096 - protein, 5 aa, Entamoeba histolytica
KETEL

SEQ ID NO: 2566097 - protein, 8 aa, Entamoeba histolytica
KETEQDNI

SEQ ID NO: 2566098 - protein, 15 aa, Entamoeba histolytica
KETEVISKDQDVQEL

SEQ ID NO: 2566099 - protein, 7 aa, Entamoeba histolytica
KETGCSD

SEQ ID NO: 2566100 - protein, 6 aa, Entamoeba histolytica
KETGKC

SEQ ID NO: 2566101 - protein, 5 aa, Entamoeba histolytica
KETIT

SEQ ID NO: 2566102 - protein, 9 aa, Entamoeba histolytica
KETKKGYSS

SEQ ID NO: 2566103 - protein, 9 aa, Entamoeba histolytica
KETKLNNSY

SEQ ID NO: 2566104 - protein, 8 aa, Entamoeba histolytica
KETKNNKL

SEQ ID NO: 2566105 - protein, 19 aa, Entamoeba histolytica
KETKSVMRKEKRRKKRSYI

SEQ ID NO: 2566106 - protein, 5 aa, Entamoeba histolytica
KETNV

SEQ ID NO: 2566107 - protein, 9 aa, Entamoeba histolytica
KETPLRKRD

SEQ ID NO: 2566108 - protein, 16 aa, Entamoeba histolytica
KETPSETAKEGSENTY

SEQ ID NO: 2566109 - protein, 6 aa, Entamoeba histolytica
KETQDI

SEQ ID NO: 2566110 - protein, 4 aa, Entamoeba histolytica
KETR

SEQ ID NO: 2566111 - protein, 7 aa, Entamoeba histolytica
KETSLTL

SEQ ID NO: 2566112 - protein, 5 aa, Entamoeba histolytica
KETWT

SEQ ID NO: 2566113 - protein, 27 aa, Entamoeba histolytica
KETYKKKMEKERKDSITPNKASSISVN

SEQ ID NO: 2566114 - protein, 15 aa, Entamoeba histolytica
KEVATSLNQQVDEQD

SEQ ID NO: 2566115 - protein, 7 aa, Entamoeba histolytica
KEVDEKI

SEQ ID NO: 2566116 - protein, 7 aa, Entamoeba histolytica
KEVEDNI

SEQ ID NO: 2566117 - protein, 8 aa, Entamoeba histolytica
KEVEGSWE

SEQ ID NO: 2566118 - protein, 12 aa, Entamoeba histolytica
KEVFDTTPALPQ

SEQ ID NO: 2566119 - protein, 6 aa, Entamoeba histolytica
KEVHQT

SEQ ID NO: 2566120 - protein, 6 aa, Entamoeba histolytica
KEVKKN

SEQ ID NO: 2566121 - protein, 9 aa, Entamoeba histolytica
KEVKKNKCS

SEQ ID NO: 2566122 - protein, 10 aa, Entamoeba histolytica
KEVKNTLDNL

SEQ ID NO: 2566123 - protein, 13 aa, Entamoeba histolytica
KEVNTSSHSGNDK

SEQ ID NO: 2566124 - protein, 6 aa, Entamoeba histolytica
KEVTKT

SEQ ID NO: 2566125 - protein, 23 aa, Entamoeba histolytica
KEWFDSDEDEQQEGEDEEERKKK

SEQ ID NO: 2566126 - protein, 9 aa, Entamoeba histolytica
KEWKKGEVI

SEQ ID NO: 2566127 - protein, 8 aa, Entamoeba histolytica
KEYEAETK

SEQ ID NO: 2566128 - protein, 6 aa, Entamoeba histolytica
KEYEGI

SEQ ID NO: 2566129 - protein, 15 aa, Entamoeba histolytica
KEYELNSKKYNGGAL

SEQ ID NO: 2566130 - protein, 6 aa, Entamoeba histolytica
KEYGEK

SEQ ID NO: 2566131 - protein, 20 aa, Entamoeba histolytica
KEYGSAGCLTKSKANEKHEY

SEQ ID NO: 2566132 - protein, 5 aa, Entamoeba histolytica
KEYKD

SEQ ID NO: 2566133 - protein, 5 aa, Entamoeba histolytica
KEYKE

SEQ ID NO: 2566134 - protein, 9 aa, Entamoeba histolytica
KEYKTKGDD

SEQ ID NO: 2566135 - protein, 12 aa, Entamoeba histolytica
KEYNEFKTKYEK

SEQ ID NO: 2566136 - protein, 10 aa, Entamoeba histolytica
KEYNGETDGI

SEQ ID NO: 2566137 - protein, 14 aa, Entamoeba histolytica
KEYRSYSGCESCKG

SEQ ID NO: 2566138 - protein, 7 aa, Entamoeba histolytica
KEYSDQK

SEQ ID NO: 2566139 - protein, 9 aa, Entamoeba histolytica
KEYSRNNTI

SEQ ID NO: 2566140 - protein, 47 aa, Entamoeba histolytica
KEYVSGKRAPYSKETDIELGDTELPPEQQNKEQEEDDDEKEEIPTIV

SEQ ID NO: 2566141 - protein, 29 aa, Entamoeba histolytica
KEYVSGKRAPYSKETDIELNEDQNSLPPQ

SEQ ID NO: 2566142 - protein, 9 aa, Entamoeba histolytica
KFDNGKAEG

SEQ ID NO: 2566143 - protein, 9 aa, Entamoeba histolytica
KFDPKNKDT

SEQ ID NO: 2566144 - protein, 4 aa, Entamoeba histolytica
KFDY

SEQ ID NO: 2566145 - protein, 8 aa, Entamoeba histolytica
KFEDYGKK

SEQ ID NO: 2566146 - protein, 6 aa, Entamoeba histolytica
KFEGDE

SEQ ID NO: 2566147 - protein, 7 aa, Entamoeba histolytica
KFETTKA

SEQ ID NO: 2566148 - protein, 6 aa, Entamoeba histolytica
KFEYPN

SEQ ID NO: 2566149 - protein, 7 aa, Entamoeba histolytica
KFFDQED

SEQ ID NO: 2566150 - protein, 10 aa, Entamoeba histolytica
KFGCNPENEI

SEQ ID NO: 2566151 - protein, 6 aa, Entamoeba histolytica
KFGHRP

SEQ ID NO: 2566152 - protein, 11 aa, Entamoeba histolytica
KFIEDKSKKKI

SEQ ID NO: 2566153 - protein, 8 aa, Entamoeba histolytica
KFIPPDED

SEQ ID NO: 2566154 - protein, 25 aa, Entamoeba histolytica
KFKASDAAKSVTQETSGCYGEDDRS

SEQ ID NO: 2566155 - protein, 5 aa, Entamoeba histolytica
KFKEV

SEQ ID NO: 2566156 - protein, 15 aa, Entamoeba histolytica
KFKGDNTKKGIKNYE

SEQ ID NO: 2566157 - protein, 12 aa, Entamoeba histolytica
KFKTNEEEVNEL

SEQ ID NO: 2566158 - protein, 5 aa, Entamoeba histolytica
KFNDK

SEQ ID NO: 2566159 - protein, 5 aa, Entamoeba histolytica
KFNDT

SEQ ID NO: 2566160 - protein, 10 aa, Entamoeba histolytica
KFNENNESFR

SEQ ID NO: 2566161 - protein, 6 aa, Entamoeba histolytica
KFNTPD

SEQ ID NO: 2566162 - protein, 9 aa, Entamoeba histolytica
KFNTTQELN

SEQ ID NO: 2566163 - protein, 5 aa, Entamoeba histolytica
KFPQN

SEQ ID NO: 2566164 - protein, 6 aa, Entamoeba histolytica
KFPSNI

SEQ ID NO: 2566165 - protein, 4 aa, Entamoeba histolytica
KFQE

SEQ ID NO: 2566166 - protein, 5 aa, Entamoeba histolytica
KFQEA

SEQ ID NO: 2566167 - protein, 7 aa, Entamoeba histolytica
KFQGRND

SEQ ID NO: 2566168 - protein, 14 aa, Entamoeba histolytica
KFREEKEKNIKQDG

SEQ ID NO: 2566169 - protein, 10 aa, Entamoeba histolytica
KFREQEDKEV

SEQ ID NO: 2566170 - protein, 13 aa, Entamoeba histolytica
KFREQEDKEVENI

SEQ ID NO: 2566171 - protein, 7 aa, Entamoeba histolytica
KFRPPRS

SEQ ID NO: 2566172 - protein, 11 aa, Entamoeba histolytica
KFSNKQTNTTI

SEQ ID NO: 2566173 - protein, 4 aa, Entamoeba histolytica
KFSP

SEQ ID NO: 2566174 - protein, 7 aa, Entamoeba histolytica
KFTNKTD

SEQ ID NO: 2566175 - protein, 5 aa, Entamoeba histolytica
KGAIS

SEQ ID NO: 2566176 - protein, 8 aa, Entamoeba histolytica
KGANGVKN

SEQ ID NO: 2566177 - protein, 12 aa, Entamoeba histolytica
KGCERKGKEIVQ

SEQ ID NO: 2566178 - protein, 8 aa, Entamoeba histolytica
KGCKPISC

SEQ ID NO: 2566179 - protein, 10 aa, Entamoeba histolytica
KGCPEPGSHH

SEQ ID NO: 2566180 - protein, 8 aa, Entamoeba histolytica
KGCRDDCT

SEQ ID NO: 2566181 - protein, 8 aa, Entamoeba histolytica
KGCSYGSW

SEQ ID NO: 2566182 - protein, 13 aa, Entamoeba histolytica
KGDDLRKDEGAEI

SEQ ID NO: 2566183 - protein, 7 aa, Entamoeba histolytica
KGDEIKS

SEQ ID NO: 2566184 - protein, 13 aa, Entamoeba histolytica
KGDNNPVDDRGLY

SEQ ID NO: 2566185 - protein, 7 aa, Entamoeba histolytica
KGDQETK

SEQ ID NO: 2566186 - protein, 9 aa, Entamoeba histolytica
KGDQITATE

SEQ ID NO: 2566187 - protein, 5 aa, Entamoeba histolytica
KGEAF

SEQ ID NO: 2566188 - protein, 4 aa, Entamoeba histolytica
KGEC

SEQ ID NO: 2566189 - protein, 4 aa, Entamoeba histolytica
KGEE

SEQ ID NO: 2566190 - protein, 11 aa, Entamoeba histolytica
KGEECDGGEGC

SEQ ID NO: 2566191 - protein, 8 aa, Entamoeba histolytica
KGEECKEP

SEQ ID NO: 2566192 - protein, 13 aa, Entamoeba histolytica
KGEEGDEINFYLI

SEQ ID NO: 2566193 - protein, 8 aa, Entamoeba histolytica
KGEEQEES

SEQ ID NO: 2566194 - protein, 6 aa, Entamoeba histolytica
KGEGDI

SEQ ID NO: 2566195 - protein, 6 aa, Entamoeba histolytica
KGEGEV

SEQ ID NO: 2566196 - protein, 8 aa, Entamoeba histolytica
KGEGTHLT

SEQ ID NO: 2566197 - protein, 9 aa, Entamoeba histolytica
KGEKEEEIE

SEQ ID NO: 2566198 - protein, 7 aa, Entamoeba histolytica
KGEKEPL

SEQ ID NO: 2566199 - protein, 9 aa, Entamoeba histolytica
KGEKSEEEK

SEQ ID NO: 2566200 - protein, 20 aa, Entamoeba histolytica
KGELVGTQCGNGYYNNTNNE

SEQ ID NO: 2566201 - protein, 5 aa, Entamoeba histolytica
KGENF

SEQ ID NO: 2566202 - protein, 9 aa, Entamoeba histolytica
KGEQPKYGI

SEQ ID NO: 2566203 - protein, 5 aa, Entamoeba histolytica
KGEQQ

SEQ ID NO: 2566204 - protein, 8 aa, Entamoeba histolytica
KGETELKR

SEQ ID NO: 2566205 - protein, 5 aa, Entamoeba histolytica
KGETL

SEQ ID NO: 2566206 - protein, 9 aa, Entamoeba histolytica
KGETRSCKT

SEQ ID NO: 2566207 - protein, 9 aa, Entamoeba histolytica
KGETSQREN

SEQ ID NO: 2566208 - protein, 13 aa, Entamoeba histolytica
KGFANKENKDEII

SEQ ID NO: 2566209 - protein, 6 aa, Entamoeba histolytica
KGFEEL

SEQ ID NO: 2566210 - protein, 8 aa, Entamoeba histolytica
KGFGGSAK

SEQ ID NO: 2566211 - protein, 5 aa, Entamoeba histolytica
KGFNS

SEQ ID NO: 2566212 - protein, 17 aa, Entamoeba histolytica
KGGDEEQSSEDKNDPYN

SEQ ID NO: 2566213 - protein, 8 aa, Entamoeba histolytica
KGGEDEEL

SEQ ID NO: 2566214 - protein, 6 aa, Entamoeba histolytica
KGGEGF

SEQ ID NO: 2566215 - protein, 7 aa, Entamoeba histolytica
KGGESHK

SEQ ID NO: 2566216 - protein, 4 aa, Entamoeba histolytica
KGGK

SEQ ID NO: 2566217 - protein, 5 aa, Entamoeba histolytica
KGGKM

SEQ ID NO: 2566218 - protein, 7 aa, Entamoeba histolytica
KGGSVRL

SEQ ID NO: 2566219 - protein, 7 aa, Entamoeba histolytica
KGGVDNI

SEQ ID NO: 2566220 - protein, 19 aa, Entamoeba histolytica
KGGYQTSSEGSSTTTPSTL

SEQ ID NO: 2566221 - protein, 6 aa, Entamoeba histolytica
KGHLPT

SEQ ID NO: 2566222 - protein, 7 aa, Entamoeba histolytica
KGIESNP

SEQ ID NO: 2566223 - protein, 17 aa, Entamoeba histolytica
KGINPDKPRNLAKAVTV

SEQ ID NO: 2566224 - protein, 10 aa, Entamoeba histolytica
KGINSGERDE

SEQ ID NO: 2566225 - protein, 8 aa, Entamoeba histolytica
KGIPSSDI

SEQ ID NO: 2566226 - protein, 4 aa, Entamoeba histolytica
KGKA

SEQ ID NO: 2566227 - protein, 8 aa, Entamoeba histolytica
KGKDTCEE

SEQ ID NO: 2566228 - protein, 6 aa, Entamoeba histolytica
KGKEPL

SEQ ID NO: 2566229 - protein, 8 aa, Entamoeba histolytica
KGKEVKNN

SEQ ID NO: 2566230 - protein, 7 aa, Entamoeba histolytica
KGKFSSR

SEQ ID NO: 2566231 - protein, 5 aa, Entamoeba histolytica
KGKGC

SEQ ID NO: 2566232 - protein, 9 aa, Entamoeba histolytica
KGKKGEEEA

SEQ ID NO: 2566233 - protein, 6 aa, Entamoeba histolytica
KGKKPI

SEQ ID NO: 2566234 - protein, 5 aa, Entamoeba histolytica
KGKKY

SEQ ID NO: 2566235 - protein, 7 aa, Entamoeba histolytica
KGKPDND

SEQ ID NO: 2566236 - protein, 5 aa, Entamoeba histolytica
KGKQF

SEQ ID NO: 2566237 - protein, 7 aa, Entamoeba histolytica
KGKQIEY

SEQ ID NO: 2566238 - protein, 8 aa, Entamoeba histolytica
KGKQYESR

SEQ ID NO: 2566239 - protein, 9 aa, Entamoeba histolytica
KGKSAIETI

SEQ ID NO: 2566240 - protein, 9 aa, Entamoeba histolytica
KGKSDDRIR

SEQ ID NO: 2566241 - protein, 7 aa, Entamoeba histolytica
KGKYDKE

SEQ ID NO: 2566242 - protein, 7 aa, Entamoeba histolytica
KGLGLKK

SEQ ID NO: 2566243 - protein, 9 aa, Entamoeba histolytica
KGLGMKDGT

SEQ ID NO: 2566244 - protein, 6 aa, Entamoeba histolytica
KGLGTV

SEQ ID NO: 2566245 - protein, 13 aa, Entamoeba histolytica
KGLPRKWEPTDDV

SEQ ID NO: 2566246 - protein, 12 aa, Entamoeba histolytica
KGMDPSTAGTAL

SEQ ID NO: 2566247 - protein, 10 aa, Entamoeba histolytica
KGMKNDEKKE

SEQ ID NO: 2566248 - protein, 6 aa, Entamoeba histolytica
KGMSKK

SEQ ID NO: 2566249 - protein, 7 aa, Entamoeba histolytica
KGNDEIA

SEQ ID NO: 2566250 - protein, 7 aa, Entamoeba histolytica
KGNEEPE

SEQ ID NO: 2566251 - protein, 6 aa, Entamoeba histolytica
KGNENK

SEQ ID NO: 2566252 - protein, 6 aa, Entamoeba histolytica
KGNEQC

SEQ ID NO: 2566253 - protein, 8 aa, Entamoeba histolytica
KGNETKAI

SEQ ID NO: 2566254 - protein, 4 aa, Entamoeba histolytica
KGNG

SEQ ID NO: 2566255 - protein, 5 aa, Entamoeba histolytica
KGNGE

SEQ ID NO: 2566256 - protein, 19 aa, Entamoeba histolytica
KGNGLETEIAEGGSNFSIG

SEQ ID NO: 2566257 - protein, 5 aa, Entamoeba histolytica
KGNHE

SEQ ID NO: 2566258 - protein, 9 aa, Entamoeba histolytica
KGNHEGHDA

SEQ ID NO: 2566259 - protein, 6 aa, Entamoeba histolytica
KGNHLY

SEQ ID NO: 2566260 - protein, 15 aa, Entamoeba histolytica
KGNHSKSIKIENGGS

SEQ ID NO: 2566261 - protein, 5 aa, Entamoeba histolytica
KGNKE

SEQ ID NO: 2566262 - protein, 6 aa, Entamoeba histolytica
KGNKPI

SEQ ID NO: 2566263 - protein, 6 aa, Entamoeba histolytica
KGNKQG

SEQ ID NO: 2566264 - protein, 8 aa, Entamoeba histolytica
KGNNAVEI

SEQ ID NO: 2566265 - protein, 11 aa, Entamoeba histolytica
KGNNGKDDQYS

SEQ ID NO: 2566266 - protein, 6 aa, Entamoeba histolytica
KGNNNK

SEQ ID NO: 2566267 - protein, 11 aa, Entamoeba histolytica
KGNPERKQEHP

SEQ ID NO: 2566268 - protein, 9 aa, Entamoeba histolytica
KGNRKSEVP

SEQ ID NO: 2566269 - protein, 7 aa, Entamoeba histolytica
KGNRLNI

SEQ ID NO: 2566270 - protein, 6 aa, Entamoeba histolytica
KGNYTS

SEQ ID NO: 2566271 - protein, 7 aa, Entamoeba histolytica
KGPINVE

SEQ ID NO: 2566272 - protein, 4 aa, Entamoeba histolytica
KGPL

SEQ ID NO: 2566273 - protein, 4 aa, Entamoeba histolytica
KGQE

SEQ ID NO: 2566274 - protein, 8 aa, Entamoeba histolytica
KGQKKIAE

SEQ ID NO: 2566275 - protein, 14 aa, Entamoeba histolytica
KGQRRERPDNIPEP

SEQ ID NO: 2566276 - protein, 6 aa, Entamoeba histolytica
KGQRVP

SEQ ID NO: 2566277 - protein, 9 aa, Entamoeba histolytica
KGQSETDFA

SEQ ID NO: 2566278 - protein, 127 aa, Entamoeba histolytica
KGQSGITNEQNPQGQSKQKGAKTPSTNGKQETEQTNKQGKEKEQETSGTNDGQHDTTKEKDDNGTNESDENNKPKTPNGQEEGKNTTDNKTPNTPTNKPESKSENKNDDKTNNSEDEDSNSNKNIDG

SEQ ID NO: 2566279 - protein, 10 aa, Entamoeba histolytica
KGQSIKENRN

SEQ ID NO: 2566280 - protein, 10 aa, Entamoeba histolytica
KGQSIKESRN

SEQ ID NO: 2566281 - protein, 15 aa, Entamoeba histolytica
KGQSVETKEAESQYE

SEQ ID NO: 2566282 - protein, 4 aa, Entamoeba histolytica
KGRD

SEQ ID NO: 2566283 - protein, 5 aa, Entamoeba histolytica
KGRFN

SEQ ID NO: 2566284 - protein, 8 aa, Entamoeba histolytica
KGSEPEIA

SEQ ID NO: 2566285 - protein, 8 aa, Entamoeba histolytica
KGSERREE

SEQ ID NO: 2566286 - protein, 11 aa, Entamoeba histolytica
KGSKDNRKHFD

SEQ ID NO: 2566287 - protein, 10 aa, Entamoeba histolytica
KGSKEGEYQT

SEQ ID NO: 2566288 - protein, 6 aa, Entamoeba histolytica
KGSLEL

SEQ ID NO: 2566289 - protein, 15 aa, Entamoeba histolytica
KGSNTNTIKQTDYNK

SEQ ID NO: 2566290 - protein, 14 aa, Entamoeba histolytica
KGSQLVNEKRGEKV

SEQ ID NO: 2566291 - protein, 7 aa, Entamoeba histolytica
KGSSPLN

SEQ ID NO: 2566292 - protein, 8 aa, Entamoeba histolytica
KGSSSSRV

SEQ ID NO: 2566293 - protein, 7 aa, Entamoeba histolytica
KGSSTLS

SEQ ID NO: 2566294 - protein, 8 aa, Entamoeba histolytica
KGSSVDAK

SEQ ID NO: 2566295 - protein, 10 aa, Entamoeba histolytica
KGSVRRPSFS

SEQ ID NO: 2566296 - protein, 17 aa, Entamoeba histolytica
KGSYDSDEGKFGGKEQG

SEQ ID NO: 2566297 - protein, 7 aa, Entamoeba histolytica
KGSYKGI

SEQ ID NO: 2566298 - protein, 9 aa, Entamoeba histolytica
KGTDSPNDL

SEQ ID NO: 2566299 - protein, 13 aa, Entamoeba histolytica
KGTEKSGKQNKKR

SEQ ID NO: 2566300 - protein, 6 aa, Entamoeba histolytica
KGTFSQ

SEQ ID NO: 2566301 - protein, 8 aa, Entamoeba histolytica
KGTFTPET

SEQ ID NO: 2566302 - protein, 16 aa, Entamoeba histolytica
KGTGCEECESGYTYSR

SEQ ID NO: 2566303 - protein, 8 aa, Entamoeba histolytica
KGTIKALD

SEQ ID NO: 2566304 - protein, 6 aa, Entamoeba histolytica
KGTIKN

SEQ ID NO: 2566305 - protein, 23 aa, Entamoeba histolytica
KGTNSEDSSETSIASVSNQISKR

SEQ ID NO: 2566306 - protein, 7 aa, Entamoeba histolytica
KGTPKQL

SEQ ID NO: 2566307 - protein, 6 aa, Entamoeba histolytica
KGTSSA

SEQ ID NO: 2566308 - protein, 16 aa, Entamoeba histolytica
KGTTEPIEYEGGRTVE

SEQ ID NO: 2566309 - protein, 7 aa, Entamoeba histolytica
KGTVTNN

SEQ ID NO: 2566310 - protein, 14 aa, Entamoeba histolytica
KGVCGNGKRHRFEE

SEQ ID NO: 2566311 - protein, 9 aa, Entamoeba histolytica
KGVGTPSYM

SEQ ID NO: 2566312 - protein, 10 aa, Entamoeba histolytica
KGVPKDSSKG

SEQ ID NO: 2566313 - protein, 9 aa, Entamoeba histolytica
KGVREGTEN

SEQ ID NO: 2566314 - protein, 8 aa, Entamoeba histolytica
KGVSGHPN

SEQ ID NO: 2566315 - protein, 5 aa, Entamoeba histolytica
KGVSM

SEQ ID NO: 2566316 - protein, 7 aa, Entamoeba histolytica
KGYRDDC

SEQ ID NO: 2566317 - protein, 13 aa, Entamoeba histolytica
KGYSFDSLNSNKC

SEQ ID NO: 2566318 - protein, 10 aa, Entamoeba histolytica
KGYTDGEANT

SEQ ID NO: 2566319 - protein, 9 aa, Entamoeba histolytica
KGYTPDKKG

SEQ ID NO: 2566320 - protein, 10 aa, Entamoeba histolytica
KGYTPDKKGN

SEQ ID NO: 2566321 - protein, 6 aa, Entamoeba histolytica
KGYTTY

SEQ ID NO: 2566322 - protein, 6 aa, Entamoeba histolytica
KGYYPR

SEQ ID NO: 2566323 - protein, 9 aa, Entamoeba histolytica
KGYYSNKGD

SEQ ID NO: 2566324 - protein, 10 aa, Entamoeba histolytica
KHDDSSKCSN

SEQ ID NO: 2566325 - protein, 7 aa, Entamoeba histolytica
KHDNDLY

SEQ ID NO: 2566326 - protein, 20 aa, Entamoeba histolytica
KHEKEKEKKNSKEDQVIEEE

SEQ ID NO: 2566327 - protein, 5 aa, Entamoeba histolytica
KHELP

SEQ ID NO: 2566328 - protein, 5 aa, Entamoeba histolytica
KHENR

SEQ ID NO: 2566329 - protein, 11 aa, Entamoeba histolytica
KHENTRPENAI

SEQ ID NO: 2566330 - protein, 5 aa, Entamoeba histolytica
KHFTA

SEQ ID NO: 2566331 - protein, 7 aa, Entamoeba histolytica
KHGEPSV

SEQ ID NO: 2566332 - protein, 8 aa, Entamoeba histolytica
KHIPQGMQ

SEQ ID NO: 2566333 - protein, 13 aa, Entamoeba histolytica
KHIPTSIDKASDC

SEQ ID NO: 2566334 - protein, 11 aa, Entamoeba histolytica
KHKDVDKLSEQ

SEQ ID NO: 2566335 - protein, 11 aa, Entamoeba histolytica
KHKPSDRPTFK

SEQ ID NO: 2566336 - protein, 4 aa, Entamoeba histolytica
KHKY

SEQ ID NO: 2566337 - protein, 11 aa, Entamoeba histolytica
KHNENSFNGIN

SEQ ID NO: 2566338 - protein, 6 aa, Entamoeba histolytica
KHNHQE

SEQ ID NO: 2566339 - protein, 13 aa, Entamoeba histolytica
KHNKSSYNTLPDT

SEQ ID NO: 2566340 - protein, 8 aa, Entamoeba histolytica
KHNNDRDI

SEQ ID NO: 2566341 - protein, 10 aa, Entamoeba histolytica
KHNPKDRPHF

SEQ ID NO: 2566342 - protein, 6 aa, Entamoeba histolytica
KHNPNK

SEQ ID NO: 2566343 - protein, 11 aa, Entamoeba histolytica
KHNPSERPTFK

SEQ ID NO: 2566344 - protein, 4 aa, Entamoeba histolytica
KHPE

SEQ ID NO: 2566345 - protein, 15 aa, Entamoeba histolytica
KHPENELSSKSVTHS

SEQ ID NO: 2566346 - protein, 10 aa, Entamoeba histolytica
KHPKSTTTEL

SEQ ID NO: 2566347 - protein, 6 aa, Entamoeba histolytica
KHPNEE

SEQ ID NO: 2566348 - protein, 6 aa, Entamoeba histolytica
KHPNTL

SEQ ID NO: 2566349 - protein, 7 aa, Entamoeba histolytica
KHPRNPT

SEQ ID NO: 2566350 - protein, 13 aa, Entamoeba histolytica
KHPYGNSLERQNN

SEQ ID NO: 2566351 - protein, 5 aa, Entamoeba histolytica
KHQNL

SEQ ID NO: 2566352 - protein, 5 aa, Entamoeba histolytica
KHQQN

SEQ ID NO: 2566353 - protein, 14 aa, Entamoeba histolytica
KHQYSDNLCSSGDS

SEQ ID NO: 2566354 - protein, 12 aa, Entamoeba histolytica
KHSFGPYKSYGT

SEQ ID NO: 2566355 - protein, 17 aa, Entamoeba histolytica
KHSIDQSKRKVIHLKTI

SEQ ID NO: 2566356 - protein, 8 aa, Entamoeba histolytica
KHSKPNEH

SEQ ID NO: 2566357 - protein, 13 aa, Entamoeba histolytica
KHSNDANTLNSLP

SEQ ID NO: 2566358 - protein, 7 aa, Entamoeba histolytica
KHSPQIL

SEQ ID NO: 2566359 - protein, 9 aa, Entamoeba histolytica
KHSSDCRRY

SEQ ID NO: 2566360 - protein, 4 aa, Entamoeba histolytica
KHTL

SEQ ID NO: 2566361 - protein, 8 aa, Entamoeba histolytica
KHTPPMHP

SEQ ID NO: 2566362 - protein, 13 aa, Entamoeba histolytica
KIDAEENDKLVKE

SEQ ID NO: 2566363 - protein, 10 aa, Entamoeba histolytica
KIDEDGKDVG

SEQ ID NO: 2566364 - protein, 13 aa, Entamoeba histolytica
KIDEKETIPEDES

SEQ ID NO: 2566365 - protein, 18 aa, Entamoeba histolytica
KIDNEENKEINIQQPSEI

SEQ ID NO: 2566366 - protein, 6 aa, Entamoeba histolytica
KIDPQS

SEQ ID NO: 2566367 - protein, 7 aa, Entamoeba histolytica
KIEDNAS

SEQ ID NO: 2566368 - protein, 6 aa, Entamoeba histolytica
KIEEDH

SEQ ID NO: 2566369 - protein, 10 aa, Entamoeba histolytica
KIEESKRIKE

SEQ ID NO: 2566370 - protein, 12 aa, Entamoeba histolytica
KIEKEEDRKQRI

SEQ ID NO: 2566371 - protein, 9 aa, Entamoeba histolytica
KIEKEEPIG

SEQ ID NO: 2566372 - protein, 21 aa, Entamoeba histolytica
KIENDEKEKEHKFTENETYQN

SEQ ID NO: 2566373 - protein, 4 aa, Entamoeba histolytica
KIEP

SEQ ID NO: 2566374 - protein, 8 aa, Entamoeba histolytica
KIEPTNLS

SEQ ID NO: 2566375 - protein, 17 aa, Entamoeba histolytica
KIEQGVEYTKEKGETLL

SEQ ID NO: 2566376 - protein, 11 aa, Entamoeba histolytica
KIETSKSEILG

SEQ ID NO: 2566377 - protein, 5 aa, Entamoeba histolytica
KIEVP

SEQ ID NO: 2566378 - protein, 11 aa, Entamoeba histolytica
KIGDIKSGDDT

SEQ ID NO: 2566379 - protein, 30 aa, Entamoeba histolytica
KIGERGKKVADLEKQADTMKQASSDLSASA

SEQ ID NO: 2566380 - protein, 7 aa, Entamoeba histolytica
KIGGYDS

SEQ ID NO: 2566381 - protein, 5 aa, Entamoeba histolytica
KIGNP

SEQ ID NO: 2566382 - protein, 11 aa, Entamoeba histolytica
KIGSKCDECKT

SEQ ID NO: 2566383 - protein, 5 aa, Entamoeba histolytica
KIGTE

SEQ ID NO: 2566384 - protein, 7 aa, Entamoeba histolytica
KIKAEED

SEQ ID NO: 2566385 - protein, 6 aa, Entamoeba histolytica
KIKGNN

SEQ ID NO: 2566386 - protein, 6 aa, Entamoeba histolytica
KIKKVG

SEQ ID NO: 2566387 - protein, 13 aa, Entamoeba histolytica
KIKNEGKRHISEI

SEQ ID NO: 2566388 - protein, 51 aa, Entamoeba histolytica
KIKQEKEERNIKKKALNSKSQDATKPKMEDDEHSKLKKKKRRFSEEETQNL

SEQ ID NO: 2566389 - protein, 7 aa, Entamoeba histolytica
KIKQKNK

SEQ ID NO: 2566390 - protein, 5 aa, Entamoeba histolytica
KIKRG

SEQ ID NO: 2566391 - protein, 9 aa, Entamoeba histolytica
KIKSDGIGK

SEQ ID NO: 2566392 - protein, 6 aa, Entamoeba histolytica
KIKTNG

SEQ ID NO: 2566393 - protein, 12 aa, Entamoeba histolytica
KILDEEKEEGIN

SEQ ID NO: 2566394 - protein, 14 aa, Entamoeba histolytica
KINDTSKKNEERVG

SEQ ID NO: 2566395 - protein, 10 aa, Entamoeba histolytica
KINENEINTK

SEQ ID NO: 2566396 - protein, 9 aa, Entamoeba histolytica
KINEPSESP

SEQ ID NO: 2566397 - protein, 5 aa, Entamoeba histolytica
KINGE

SEQ ID NO: 2566398 - protein, 8 aa, Entamoeba histolytica
KINGKYPY

SEQ ID NO: 2566399 - protein, 10 aa, Entamoeba histolytica
KINGNNVGVK

SEQ ID NO: 2566400 - protein, 12 aa, Entamoeba histolytica
KINNTVTPQNHK

SEQ ID NO: 2566401 - protein, 7 aa, Entamoeba histolytica
KINPDDT

SEQ ID NO: 2566402 - protein, 7 aa, Entamoeba histolytica
KINSNNR

SEQ ID NO: 2566403 - protein, 8 aa, Entamoeba histolytica
KINTKTTS

SEQ ID NO: 2566404 - protein, 8 aa, Entamoeba histolytica
KINTQTTS

SEQ ID NO: 2566405 - protein, 10 aa, Entamoeba histolytica
KIPGRAPPSV

SEQ ID NO: 2566406 - protein, 4 aa, Entamoeba histolytica
KIPK

SEQ ID NO: 2566407 - protein, 17 aa, Entamoeba histolytica
KIPKRKEYKTKEPETQE

SEQ ID NO: 2566408 - protein, 5 aa, Entamoeba histolytica
KIPPI

SEQ ID NO: 2566409 - protein, 6 aa, Entamoeba histolytica
KIPTDY

SEQ ID NO: 2566410 - protein, 6 aa, Entamoeba histolytica
KIPTNI

SEQ ID NO: 2566411 - protein, 6 aa, Entamoeba histolytica
KIQGNE

SEQ ID NO: 2566412 - protein, 5 aa, Entamoeba histolytica
KIQIQ

SEQ ID NO: 2566413 - protein, 10 aa, Entamoeba histolytica
KIQKRDMSAS

SEQ ID NO: 2566414 - protein, 42 aa, Entamoeba histolytica
KIQNNNRNNDKNKKVDIQQESSSKKPCSTNSHQQKKAGEHQY

SEQ ID NO: 2566415 - protein, 15 aa, Entamoeba histolytica
KIQPPQSPTNISNSM

SEQ ID NO: 2566416 - protein, 26 aa, Entamoeba histolytica
KIQPPQSPTNISNSMEDNPLNNDIGS

SEQ ID NO: 2566417 - protein, 25 aa, Entamoeba histolytica
KIQPPQSPTNISNSMEDNPLNNIRG

SEQ ID NO: 2566418 - protein, 9 aa, Entamoeba histolytica
KIQQTQPKN

SEQ ID NO: 2566419 - protein, 8 aa, Entamoeba histolytica
KIQRSKHE

SEQ ID NO: 2566420 - protein, 8 aa, Entamoeba histolytica
KIRKRKDK

SEQ ID NO: 2566421 - protein, 5 aa, Entamoeba histolytica
KIRSN

SEQ ID NO: 2566422 - protein, 18 aa, Entamoeba histolytica
KIRSSDEQCDQVDNCDEN

SEQ ID NO: 2566423 - protein, 7 aa, Entamoeba histolytica
KISGPRE

SEQ ID NO: 2566424 - protein, 5 aa, Entamoeba histolytica
KISIN

SEQ ID NO: 2566425 - protein, 6 aa, Entamoeba histolytica
KISSFD

SEQ ID NO: 2566426 - protein, 23 aa, Entamoeba histolytica
KISTVGDNTSNNGTISIKSNSNL

SEQ ID NO: 2566427 - protein, 8 aa, Entamoeba histolytica
KITDKKEV

SEQ ID NO: 2566428 - protein, 5 aa, Entamoeba histolytica
KITDN

SEQ ID NO: 2566429 - protein, 7 aa, Entamoeba histolytica
KITEASN

SEQ ID NO: 2566430 - protein, 7 aa, Entamoeba histolytica
KITEEEK

SEQ ID NO: 2566431 - protein, 8 aa, Entamoeba histolytica
KITENKND

SEQ ID NO: 2566432 - protein, 7 aa, Entamoeba histolytica
KITGSSM

SEQ ID NO: 2566433 - protein, 4 aa, Entamoeba histolytica
KITI

SEQ ID NO: 2566434 - protein, 8 aa, Entamoeba histolytica
KITPEKIK

SEQ ID NO: 2566435 - protein, 4 aa, Entamoeba histolytica
KITS

SEQ ID NO: 2566436 - protein, 5 aa, Entamoeba histolytica
KITSD

SEQ ID NO: 2566437 - protein, 4 aa, Entamoeba histolytica
KITT

SEQ ID NO: 2566438 - protein, 8 aa, Entamoeba histolytica
KIVNNSNK

SEQ ID NO: 2566439 - protein, 14 aa, Entamoeba histolytica
KIVQSGYGLDNSET

SEQ ID NO: 2566440 - protein, 5 aa, Entamoeba histolytica
KIYEE

SEQ ID NO: 2566441 - protein, 4 aa, Entamoeba histolytica
KIYS

SEQ ID NO: 2566442 - protein, 10 aa, Entamoeba histolytica
KIYSPTMTGS

SEQ ID NO: 2566443 - protein, 27 aa, Entamoeba histolytica
KKAEMEKKKKNIEMSENDRKKLIKMYL

SEQ ID NO: 2566444 - protein, 5 aa, Entamoeba histolytica
KKAHS

SEQ ID NO: 2566445 - protein, 23 aa, Entamoeba histolytica
KKAKEKKKEKKSKMSPLQNQGSI

SEQ ID NO: 2566446 - protein, 12 aa, Entamoeba histolytica
KKAKSNKDNEEK

SEQ ID NO: 2566447 - protein, 19 aa, Entamoeba histolytica
KKALDENDRITRKFTSKDN

SEQ ID NO: 2566448 - protein, 7 aa, Entamoeba histolytica
KKALKEI

SEQ ID NO: 2566449 - protein, 14 aa, Entamoeba histolytica
KKALRDEQQKPYAD

SEQ ID NO: 2566450 - protein, 7 aa, Entamoeba histolytica
KKANQTK

SEQ ID NO: 2566451 - protein, 6 aa, Entamoeba histolytica
KKAPKH

SEQ ID NO: 2566452 - protein, 14 aa, Entamoeba histolytica
KKAPSYKKLPDRKA

SEQ ID NO: 2566453 - protein, 4 aa, Entamoeba histolytica
KKAQ

SEQ ID NO: 2566454 - protein, 7 aa, Entamoeba histolytica
KKAQEKI

SEQ ID NO: 2566455 - protein, 7 aa, Entamoeba histolytica
KKAQSIV

SEQ ID NO: 2566456 - protein, 9 aa, Entamoeba histolytica
KKASGEGYS

SEQ ID NO: 2566457 - protein, 8 aa, Entamoeba histolytica
KKASKRLT

SEQ ID NO: 2566458 - protein, 6 aa, Entamoeba histolytica
KKASLD

SEQ ID NO: 2566459 - protein, 8 aa, Entamoeba histolytica
KKASTTIY

SEQ ID NO: 2566460 - protein, 14 aa, Entamoeba histolytica
KKATSNQISEAKKR

SEQ ID NO: 2566461 - protein, 7 aa, Entamoeba histolytica
KKAYSYQ

SEQ ID NO: 2566462 - protein, 13 aa, Entamoeba histolytica
KKCNGKKDGECSK

SEQ ID NO: 2566463 - protein, 5 aa, Entamoeba histolytica
KKCPP

SEQ ID NO: 2566464 - protein, 10 aa, Entamoeba histolytica
KKCSEKTLNS

SEQ ID NO: 2566465 - protein, 7 aa, Entamoeba histolytica
KKCSFKD

SEQ ID NO: 2566466 - protein, 7 aa, Entamoeba histolytica
KKCSSEN

SEQ ID NO: 2566467 - protein, 9 aa, Entamoeba histolytica
KKCTKYPDH

SEQ ID NO: 2566468 - protein, 7 aa, Entamoeba histolytica
KKDAQQV

SEQ ID NO: 2566469 - protein, 11 aa, Entamoeba histolytica
KKDDAKNKRIT

SEQ ID NO: 2566470 - protein, 9 aa, Entamoeba histolytica
KKDDYETQQ

SEQ ID NO: 2566471 - protein, 30 aa, Entamoeba histolytica
KKDEKRMSEEADDKFRKTKKRFNDVPKNDK

SEQ ID NO: 2566472 - protein, 11 aa, Entamoeba histolytica
KKDERFNPKNT

SEQ ID NO: 2566473 - protein, 13 aa, Entamoeba histolytica
KKDFGKGSIKTPY

SEQ ID NO: 2566474 - protein, 4 aa, Entamoeba histolytica
KKDG

SEQ ID NO: 2566475 - protein, 4 aa, Entamoeba histolytica
KKDI

SEQ ID NO: 2566476 - protein, 9 aa, Entamoeba histolytica
KKDKKEDIE

SEQ ID NO: 2566477 - protein, 17 aa, Entamoeba histolytica
KKDKQKRKEKKKQNKMK

SEQ ID NO: 2566478 - protein, 18 aa, Entamoeba histolytica
KKDKRGKEMCTGKTNNCQ

SEQ ID NO: 2566479 - protein, 4 aa, Entamoeba histolytica
KKDL

SEQ ID NO: 2566480 - protein, 14 aa, Entamoeba histolytica
KKDNNRIYDIDSLR

SEQ ID NO: 2566481 - protein, 7 aa, Entamoeba histolytica
KKDPNDV

SEQ ID NO: 2566482 - protein, 8 aa, Entamoeba histolytica
KKDPQSEV

SEQ ID NO: 2566483 - protein, 7 aa, Entamoeba histolytica
KKDQEID

SEQ ID NO: 2566484 - protein, 8 aa, Entamoeba histolytica
KKDSIPPA

SEQ ID NO: 2566485 - protein, 159 aa, Entamoeba histolytica
KKDSNSELDENSNNQPDESSNNKPNESSDNKPSESSDNKPSESSDNKPSESSDNKPSESSNNKPNESSNNKPNESSDNKPNESSDNKPNESSDNKPNESSNNKPNESSNNKPNESSNNKPDESSNNKPNESSDNKPNESSNNKPGSSSDNYDNLDAASS

SEQ ID NO: 2566486 - protein, 33 aa, Entamoeba histolytica
KKDYDKYSREAEKRKQIEENQRVKAAQERKEFE

SEQ ID NO: 2566487 - protein, 7 aa, Entamoeba histolytica
KKEAYRQ

SEQ ID NO: 2566488 - protein, 16 aa, Entamoeba histolytica
KKECSSNIDTEPPDYY

SEQ ID NO: 2566489 - protein, 5 aa, Entamoeba histolytica
KKEDI

SEQ ID NO: 2566490 - protein, 7 aa, Entamoeba histolytica
KKEDLSD

SEQ ID NO: 2566491 - protein, 7 aa, Entamoeba histolytica
KKEDNQH

SEQ ID NO: 2566492 - protein, 9 aa, Entamoeba histolytica
KKEDQLSKR

SEQ ID NO: 2566493 - protein, 7 aa, Entamoeba histolytica
KKEDYQR

SEQ ID NO: 2566494 - protein, 16 aa, Entamoeba histolytica
KKEEELKQKLKKENDK

SEQ ID NO: 2566495 - protein, 43 aa, Entamoeba histolytica
KKEEERKRDEENKKKEDDKKKDDDKKTEEERKKEEIKKKEEEF

SEQ ID NO: 2566496 - protein, 10 aa, Entamoeba histolytica
KKEEGNDDII

SEQ ID NO: 2566497 - protein, 9 aa, Entamoeba histolytica
KKEEKMPEK

SEQ ID NO: 2566498 - protein, 8 aa, Entamoeba histolytica
KKEGEGLK

SEQ ID NO: 2566499 - protein, 10 aa, Entamoeba histolytica
KKEGKNQKLK

SEQ ID NO: 2566500 - protein, 5 aa, Entamoeba histolytica
KKEGL

SEQ ID NO: 2566501 - protein, 12 aa, Entamoeba histolytica
KKEGTEYKSATT

SEQ ID NO: 2566502 - protein, 8 aa, Entamoeba histolytica
KKEIEEIG

SEQ ID NO: 2566503 - protein, 15 aa, Entamoeba histolytica
KKEIMSSVNGTSTFE

SEQ ID NO: 2566504 - protein, 37 aa, Entamoeba histolytica
KKEISENLKNTQPQSQSKLPLSNEQPTSFNTTTIRPK

SEQ ID NO: 2566505 - protein, 21 aa, Entamoeba histolytica
KKEITEKEKTQKGPKKMNEEN

SEQ ID NO: 2566506 - protein, 7 aa, Entamoeba histolytica
KKEKEEL

SEQ ID NO: 2566507 - protein, 8 aa, Entamoeba histolytica
KKEKGYKR

SEQ ID NO: 2566508 - protein, 30 aa, Entamoeba histolytica
KKEKKITPRKKRLTSEKPLIKKSDTPENWD

SEQ ID NO: 2566509 - protein, 7 aa, Entamoeba histolytica
KKEKKKM

SEQ ID NO: 2566510 - protein, 7 aa, Entamoeba histolytica
KKEKKKR

SEQ ID NO: 2566511 - protein, 9 aa, Entamoeba histolytica
KKEKNINKI

SEQ ID NO: 2566512 - protein, 8 aa, Entamoeba histolytica
KKEKRSTI

SEQ ID NO: 2566513 - protein, 6 aa, Entamoeba histolytica
KKEKYE

SEQ ID NO: 2566514 - protein, 6 aa, Entamoeba histolytica
KKENNS

SEQ ID NO: 2566515 - protein, 8 aa, Entamoeba histolytica
KKENPDLI

SEQ ID NO: 2566516 - protein, 7 aa, Entamoeba histolytica
KKENPEM

SEQ ID NO: 2566517 - protein, 8 aa, Entamoeba histolytica
KKEPKTTL

SEQ ID NO: 2566518 - protein, 6 aa, Entamoeba histolytica
KKEPYQ

SEQ ID NO: 2566519 - protein, 7 aa, Entamoeba histolytica
KKEPYQR

SEQ ID NO: 2566520 - protein, 6 aa, Entamoeba histolytica
KKEQCA

SEQ ID NO: 2566521 - protein, 10 aa, Entamoeba histolytica
KKEQKRHSRR

SEQ ID NO: 2566522 - protein, 9 aa, Entamoeba histolytica
KKEQTTNLQ

SEQ ID NO: 2566523 - protein, 7 aa, Entamoeba histolytica
KKEREQR

SEQ ID NO: 2566524 - protein, 9 aa, Entamoeba histolytica
KKESEANIH

SEQ ID NO: 2566525 - protein, 8 aa, Entamoeba histolytica
KKESEDII

SEQ ID NO: 2566526 - protein, 8 aa, Entamoeba histolytica
KKESINGK

SEQ ID NO: 2566527 - protein, 6 aa, Entamoeba histolytica
KKESKY

SEQ ID NO: 2566528 - protein, 8 aa, Entamoeba histolytica
KKESLDEE

SEQ ID NO: 2566529 - protein, 10 aa, Entamoeba histolytica
KKESLSSDNI

SEQ ID NO: 2566530 - protein, 6 aa, Entamoeba histolytica
KKESLT

SEQ ID NO: 2566531 - protein, 20 aa, Entamoeba histolytica
KKESQIKKEESLSGEESENI

SEQ ID NO: 2566532 - protein, 10 aa, Entamoeba histolytica
KKESSKRINK

SEQ ID NO: 2566533 - protein, 6 aa, Entamoeba histolytica
KKESTL

SEQ ID NO: 2566534 - protein, 6 aa, Entamoeba histolytica
KKETFG

SEQ ID NO: 2566535 - protein, 7 aa, Entamoeba histolytica
KKETIQK

SEQ ID NO: 2566536 - protein, 6 aa, Entamoeba histolytica
KKETLK

SEQ ID NO: 2566537 - protein, 7 aa, Entamoeba histolytica
KKETTNI

SEQ ID NO: 2566538 - protein, 7 aa, Entamoeba histolytica
KKETTQN

SEQ ID NO: 2566539 - protein, 6 aa, Entamoeba histolytica
KKEVKK

SEQ ID NO: 2566540 - protein, 15 aa, Entamoeba histolytica
KKEVPNTTKKLSDYS

SEQ ID NO: 2566541 - protein, 6 aa, Entamoeba histolytica
KKEYSI

SEQ ID NO: 2566542 - protein, 11 aa, Entamoeba histolytica
KKEYTGDPNGT

SEQ ID NO: 2566543 - protein, 14 aa, Entamoeba histolytica
KKEYTGQPEGTPYY

SEQ ID NO: 2566544 - protein, 6 aa, Entamoeba histolytica
KKFAEK

SEQ ID NO: 2566545 - protein, 8 aa, Entamoeba histolytica
KKFDGDPR

SEQ ID NO: 2566546 - protein, 8 aa, Entamoeba histolytica
KKFDQKTL

SEQ ID NO: 2566547 - protein, 7 aa, Entamoeba histolytica
KKFPTGD

SEQ ID NO: 2566548 - protein, 7 aa, Entamoeba histolytica
KKFPTSD

SEQ ID NO: 2566549 - protein, 7 aa, Entamoeba histolytica
KKGCSTK

SEQ ID NO: 2566550 - protein, 9 aa, Entamoeba histolytica
KKGDEKEKD

SEQ ID NO: 2566551 - protein, 11 aa, Entamoeba histolytica
KKGEKEKEQFK

SEQ ID NO: 2566552 - protein, 6 aa, Entamoeba histolytica
KKGETI

SEQ ID NO: 2566553 - protein, 6 aa, Entamoeba histolytica
KKGETV

SEQ ID NO: 2566554 - protein, 6 aa, Entamoeba histolytica
KKGGDY

SEQ ID NO: 2566555 - protein, 13 aa, Entamoeba histolytica
KKGGLTTTEGSSY

SEQ ID NO: 2566556 - protein, 9 aa, Entamoeba histolytica
KKGIDNKTQ

SEQ ID NO: 2566557 - protein, 7 aa, Entamoeba histolytica
KKGISQS

SEQ ID NO: 2566558 - protein, 8 aa, Entamoeba histolytica
KKGITPAS

SEQ ID NO: 2566559 - protein, 7 aa, Entamoeba histolytica
KKGKDKA

SEQ ID NO: 2566560 - protein, 6 aa, Entamoeba histolytica
KKGKGM

SEQ ID NO: 2566561 - protein, 8 aa, Entamoeba histolytica
KKGKKEGM

SEQ ID NO: 2566562 - protein, 44 aa, Entamoeba histolytica
KKGMGNDTLSNVNDSMPSNNPVSQVDENEQKPKSQSVSHSSSDE

SEQ ID NO: 2566563 - protein, 4 aa, Entamoeba histolytica
KKGN

SEQ ID NO: 2566564 - protein, 7 aa, Entamoeba histolytica
KKGNKIR

SEQ ID NO: 2566565 - protein, 8 aa, Entamoeba histolytica
KKGNLNGC

SEQ ID NO: 2566566 - protein, 7 aa, Entamoeba histolytica
KKGNPDL

SEQ ID NO: 2566567 - protein, 6 aa, Entamoeba histolytica
KKGNQE

SEQ ID NO: 2566568 - protein, 20 aa, Entamoeba histolytica
KKGPRELDEEDSSHQRGCVI

SEQ ID NO: 2566569 - protein, 5 aa, Entamoeba histolytica
KKGQT

SEQ ID NO: 2566570 - protein, 6 aa, Entamoeba histolytica
KKGQTV

SEQ ID NO: 2566571 - protein, 10 aa, Entamoeba histolytica
KKGSESCPKG

SEQ ID NO: 2566572 - protein, 8 aa, Entamoeba histolytica
KKGSGYND

SEQ ID NO: 2566573 - protein, 7 aa, Entamoeba histolytica
KKGSYSD

SEQ ID NO: 2566574 - protein, 8 aa, Entamoeba histolytica
KKGTPVEK

SEQ ID NO: 2566575 - protein, 5 aa, Entamoeba histolytica
KKGYG

SEQ ID NO: 2566576 - protein, 12 aa, Entamoeba histolytica
KKHKTKDHGKET

SEQ ID NO: 2566577 - protein, 6 aa, Entamoeba histolytica
KKHLTQ

SEQ ID NO: 2566578 - protein, 6 aa, Entamoeba histolytica
KKHQDI

SEQ ID NO: 2566579 - protein, 10 aa, Entamoeba histolytica
KKIDRAEEQE

SEQ ID NO: 2566580 - protein, 5 aa, Entamoeba histolytica
KKIEG

SEQ ID NO: 2566581 - protein, 8 aa, Entamoeba histolytica
KKIEGTEY

SEQ ID NO: 2566582 - protein, 8 aa, Entamoeba histolytica
KKIEGTSC

SEQ ID NO: 2566583 - protein, 12 aa, Entamoeba histolytica
KKIEKKDDEKII

SEQ ID NO: 2566584 - protein, 8 aa, Entamoeba histolytica
KKIEQSDD

SEQ ID NO: 2566585 - protein, 4 aa, Entamoeba histolytica
KKIG

SEQ ID NO: 2566586 - protein, 4 aa, Entamoeba histolytica
KKII

SEQ ID NO: 2566587 - protein, 12 aa, Entamoeba histolytica
KKIKNDAETKGT

SEQ ID NO: 2566588 - protein, 11 aa, Entamoeba histolytica
KKINDKTLTNN

SEQ ID NO: 2566589 - protein, 9 aa, Entamoeba histolytica
KKINNNNGV

SEQ ID NO: 2566590 - protein, 20 aa, Entamoeba histolytica
KKINSSNKKEEEKSEKSEIE

SEQ ID NO: 2566591 - protein, 58 aa, Entamoeba histolytica
KKIQGSDASSSTSVPSSAQEPSTNSTSTPTDDKPSSSSEQKTSNESKKKSESTNQEEL

SEQ ID NO: 2566592 - protein, 12 aa, Entamoeba histolytica
KKIQTAQRRFEK

SEQ ID NO: 2566593 - protein, 5 aa, Entamoeba histolytica
KKIRF

SEQ ID NO: 2566594 - protein, 6 aa, Entamoeba histolytica
KKISNA

SEQ ID NO: 2566595 - protein, 5 aa, Entamoeba histolytica
KKITG

SEQ ID NO: 2566596 - protein, 7 aa, Entamoeba histolytica
KKITNQK

SEQ ID NO: 2566597 - protein, 29 aa, Entamoeba histolytica
KKKCSSKSSEECDKSDKTRKEKEGQITNK

SEQ ID NO: 2566598 - protein, 10 aa, Entamoeba histolytica
KKKDDNKEGP

SEQ ID NO: 2566599 - protein, 12 aa, Entamoeba histolytica
KKKEAESHFLNM

SEQ ID NO: 2566600 - protein, 21 aa, Entamoeba histolytica
KKKEEENKKLEGDEDDDPLER

SEQ ID NO: 2566601 - protein, 9 aa, Entamoeba histolytica
KKKEESEIS

SEQ ID NO: 2566602 - protein, 11 aa, Entamoeba histolytica
KKKEGEPERGY

SEQ ID NO: 2566603 - protein, 9 aa, Entamoeba histolytica
KKKESIERG

SEQ ID NO: 2566604 - protein, 8 aa, Entamoeba histolytica
KKKGEGSF

SEQ ID NO: 2566605 - protein, 5 aa, Entamoeba histolytica
KKKGL

SEQ ID NO: 2566606 - protein, 10 aa, Entamoeba histolytica
KKKGSAGWDD

SEQ ID NO: 2566607 - protein, 17 aa, Entamoeba histolytica
KKKGSKGDSKEKEEEEI

SEQ ID NO: 2566608 - protein, 11 aa, Entamoeba histolytica
KKKGSSSKMTH

SEQ ID NO: 2566609 - protein, 6 aa, Entamoeba histolytica
KKKHPS

SEQ ID NO: 2566610 - protein, 51 aa, Entamoeba histolytica
KKKIKSKEEPQIQETTQKTYKQETEIVNKKNKQDNIYPEDNETSLEERIND

SEQ ID NO: 2566611 - protein, 15 aa, Entamoeba histolytica
KKKKDHVTSKSEVRS

SEQ ID NO: 2566612 - protein, 80 aa, Entamoeba histolytica
KKKKEEEKMNSSEHPLNSTHDQIQSTPNANNPISSPTNDLEIKKEKKPIQSSGNWRQKSEEAKKLQQEKEEKERKLKEEK

SEQ ID NO: 2566613 - protein, 6 aa, Entamoeba histolytica
KKKKPQ

SEQ ID NO: 2566614 - protein, 8 aa, Entamoeba histolytica
KKKLNIES

SEQ ID NO: 2566615 - protein, 12 aa, Entamoeba histolytica
KKKNFFTPFNKL

SEQ ID NO: 2566616 - protein, 9 aa, Entamoeba histolytica
KKKNGKISI

SEQ ID NO: 2566617 - protein, 15 aa, Entamoeba histolytica
KKKNNNEDKGLGTPI

SEQ ID NO: 2566618 - protein, 8 aa, Entamoeba histolytica
KKKPEKQF

SEQ ID NO: 2566619 - protein, 8 aa, Entamoeba histolytica
KKKPYCTH

SEQ ID NO: 2566620 - protein, 9 aa, Entamoeba histolytica
KKKSIKQED

SEQ ID NO: 2566621 - protein, 9 aa, Entamoeba histolytica
KKKSNGEIE

SEQ ID NO: 2566622 - protein, 6 aa, Entamoeba histolytica
KKKTYP

SEQ ID NO: 2566623 - protein, 9 aa, Entamoeba histolytica
KKKVIPKKT

SEQ ID NO: 2566624 - protein, 8 aa, Entamoeba histolytica
KKLDENGN

SEQ ID NO: 2566625 - protein, 5 aa, Entamoeba histolytica
KKLDK

SEQ ID NO: 2566626 - protein, 5 aa, Entamoeba histolytica
KKLEE

SEQ ID NO: 2566627 - protein, 13 aa, Entamoeba histolytica
KKLEEEEKELNNK

SEQ ID NO: 2566628 - protein, 12 aa, Entamoeba histolytica
KKLEERKAKITE

SEQ ID NO: 2566629 - protein, 7 aa, Entamoeba histolytica
KKLGEGA

SEQ ID NO: 2566630 - protein, 14 aa, Entamoeba histolytica
KKLNGQKLTNEKSI

SEQ ID NO: 2566631 - protein, 4 aa, Entamoeba histolytica
KKLP

SEQ ID NO: 2566632 - protein, 7 aa, Entamoeba histolytica
KKLPDTK

SEQ ID NO: 2566633 - protein, 7 aa, Entamoeba histolytica
KKLPKEA

SEQ ID NO: 2566634 - protein, 7 aa, Entamoeba histolytica
KKLSKHM

SEQ ID NO: 2566635 - protein, 6 aa, Entamoeba histolytica
KKLSQT

SEQ ID NO: 2566636 - protein, 12 aa, Entamoeba histolytica
KKLTNNSTTTNG

SEQ ID NO: 2566637 - protein, 5 aa, Entamoeba histolytica
KKMSD

SEQ ID NO: 2566638 - protein, 7 aa, Entamoeba histolytica
KKMSVSK

SEQ ID NO: 2566639 - protein, 9 aa, Entamoeba histolytica
KKNDKKKYR

SEQ ID NO: 2566640 - protein, 7 aa, Entamoeba histolytica
KKNDYQD

SEQ ID NO: 2566641 - protein, 8 aa, Entamoeba histolytica
KKNEDFGY

SEQ ID NO: 2566642 - protein, 5 aa, Entamoeba histolytica
KKNEN

SEQ ID NO: 2566643 - protein, 13 aa, Entamoeba histolytica
KKNENKTEEEKDI

SEQ ID NO: 2566644 - protein, 8 aa, Entamoeba histolytica
KKNERFKE

SEQ ID NO: 2566645 - protein, 9 aa, Entamoeba histolytica
KKNGGKRHS

SEQ ID NO: 2566646 - protein, 9 aa, Entamoeba histolytica
KKNGHRAPS

SEQ ID NO: 2566647 - protein, 8 aa, Entamoeba histolytica
KKNHEEAL

SEQ ID NO: 2566648 - protein, 6 aa, Entamoeba histolytica
KKNHKV

SEQ ID NO: 2566649 - protein, 8 aa, Entamoeba histolytica
KKNIEEVT

SEQ ID NO: 2566650 - protein, 9 aa, Entamoeba histolytica
KKNIENGKK

SEQ ID NO: 2566651 - protein, 6 aa, Entamoeba histolytica
KKNISL

SEQ ID NO: 2566652 - protein, 8 aa, Entamoeba histolytica
KKNISPSL

SEQ ID NO: 2566653 - protein, 7 aa, Entamoeba histolytica
KKNKDKI

SEQ ID NO: 2566654 - protein, 16 aa, Entamoeba histolytica
KKNKKFPGNKVSTTKY

SEQ ID NO: 2566655 - protein, 18 aa, Entamoeba histolytica
KKNKTGYTKFDPERYQRT

SEQ ID NO: 2566656 - protein, 6 aa, Entamoeba histolytica
KKNNIK

SEQ ID NO: 2566657 - protein, 4 aa, Entamoeba histolytica
KKNP

SEQ ID NO: 2566658 - protein, 5 aa, Entamoeba histolytica
KKNPK

SEQ ID NO: 2566659 - protein, 8 aa, Entamoeba histolytica
KKNPKEIK

SEQ ID NO: 2566660 - protein, 8 aa, Entamoeba histolytica
KKNPNYTF

SEQ ID NO: 2566661 - protein, 8 aa, Entamoeba histolytica
KKNPTEVK

SEQ ID NO: 2566662 - protein, 6 aa, Entamoeba histolytica
KKNPTL

SEQ ID NO: 2566663 - protein, 8 aa, Entamoeba histolytica
KKNQPYKN

SEQ ID NO: 2566664 - protein, 4 aa, Entamoeba histolytica
KKNR

SEQ ID NO: 2566665 - protein, 13 aa, Entamoeba histolytica
KKNRITTTTTTTT

SEQ ID NO: 2566666 - protein, 12 aa, Entamoeba histolytica
KKNTERETDEEC

SEQ ID NO: 2566667 - protein, 28 aa, Entamoeba histolytica
KKNYSPVDESTKYYDDQDSNGIELTNGP

SEQ ID NO: 2566668 - protein, 5 aa, Entamoeba histolytica
KKPAD

SEQ ID NO: 2566669 - protein, 7 aa, Entamoeba histolytica
KKPAEYS

SEQ ID NO: 2566670 - protein, 7 aa, Entamoeba histolytica
KKPEQPR

SEQ ID NO: 2566671 - protein, 230 aa, Entamoeba histolytica
KKPESVVSTTEQGTSGTDSHTDTEATQTSQGATQTLPTSGKPEVPEPSVASGKNSEKPPQPTSQDGVTGQPSSVGSSQTQDGKLHKPESTKPEGTSSEPPTQSSPSSDSSPAQNPASEKPKEDTPKSDSHPTQPSTSQDTKQTSQNTNQPVSKPESSPSLTPNPTPNTSPQQDSQQSKPAPAETTNPTPNTPAKSDQSPDSNPAPSNNPQHEPPSNNQQNNQQNETVSPH

SEQ ID NO: 2566672 - protein, 14 aa, Entamoeba histolytica
KKPIKSDIKRRPLT

SEQ ID NO: 2566673 - protein, 5 aa, Entamoeba histolytica
KKPLI

SEQ ID NO: 2566674 - protein, 9 aa, Entamoeba histolytica
KKPLKDRNA

SEQ ID NO: 2566675 - protein, 13 aa, Entamoeba histolytica
KKPNEEPPTEQQI

SEQ ID NO: 2566676 - protein, 7 aa, Entamoeba histolytica
KKPNSEF

SEQ ID NO: 2566677 - protein, 6 aa, Entamoeba histolytica
KKPPKH

SEQ ID NO: 2566678 - protein, 7 aa, Entamoeba histolytica
KKPRKKT

SEQ ID NO: 2566679 - protein, 29 aa, Entamoeba histolytica
KKPSRQETVETKPKEVSTGSPATKETTKS

SEQ ID NO: 2566680 - protein, 6 aa, Entamoeba histolytica
KKPYNP

SEQ ID NO: 2566681 - protein, 7 aa, Entamoeba histolytica
KKPYNPI

SEQ ID NO: 2566682 - protein, 9 aa, Entamoeba histolytica
KKQAALPST

SEQ ID NO: 2566683 - protein, 7 aa, Entamoeba histolytica
KKQDGNL

SEQ ID NO: 2566684 - protein, 8 aa, Entamoeba histolytica
KKQHSETL

SEQ ID NO: 2566685 - protein, 8 aa, Entamoeba histolytica
KKQLGNEE

SEQ ID NO: 2566686 - protein, 7 aa, Entamoeba histolytica
KKQNEEI

SEQ ID NO: 2566687 - protein, 9 aa, Entamoeba histolytica
KKQNNVTEC

SEQ ID NO: 2566688 - protein, 12 aa, Entamoeba histolytica
KKQPKNTRNSGN

SEQ ID NO: 2566689 - protein, 7 aa, Entamoeba histolytica
KKQRTEV

SEQ ID NO: 2566690 - protein, 16 aa, Entamoeba histolytica
KKQRVKIPTNNKNGMT

SEQ ID NO: 2566691 - protein, 7 aa, Entamoeba histolytica
KKQTAMR

SEQ ID NO: 2566692 - protein, 8 aa, Entamoeba histolytica
KKQTAMRR

SEQ ID NO: 2566693 - protein, 6 aa, Entamoeba histolytica
KKRFEK

SEQ ID NO: 2566694 - protein, 7 aa, Entamoeba histolytica
KKRGVQH

SEQ ID NO: 2566695 - protein, 5 aa, Entamoeba histolytica
KKRME

SEQ ID NO: 2566696 - protein, 8 aa, Entamoeba histolytica
KKRPEQSH

SEQ ID NO: 2566697 - protein, 5 aa, Entamoeba histolytica
KKRPN

SEQ ID NO: 2566698 - protein, 6 aa, Entamoeba histolytica
KKRPSI

SEQ ID NO: 2566699 - protein, 38 aa, Entamoeba histolytica
KKRQAKRVSISSDPHVNESNSTIPQENKEYKTASINET

SEQ ID NO: 2566700 - protein, 6 aa, Entamoeba histolytica
KKRSDE

SEQ ID NO: 2566701 - protein, 14 aa, Entamoeba histolytica
KKRSNEYPQYKPNK

SEQ ID NO: 2566702 - protein, 9 aa, Entamoeba histolytica
KKRTRSDTD

SEQ ID NO: 2566703 - protein, 9 aa, Entamoeba histolytica
KKSADTGAE

SEQ ID NO: 2566704 - protein, 5 aa, Entamoeba histolytica
KKSDC

SEQ ID NO: 2566705 - protein, 5 aa, Entamoeba histolytica
KKSDK

SEQ ID NO: 2566706 - protein, 8 aa, Entamoeba histolytica
KKSESKGI

SEQ ID NO: 2566707 - protein, 8 aa, Entamoeba histolytica
KKSEVGET

SEQ ID NO: 2566708 - protein, 7 aa, Entamoeba histolytica
KKSFPSL

SEQ ID NO: 2566709 - protein, 10 aa, Entamoeba histolytica
KKSGKEEIKD

SEQ ID NO: 2566710 - protein, 6 aa, Entamoeba histolytica
KKSHTL

SEQ ID NO: 2566711 - protein, 5 aa, Entamoeba histolytica
KKSID

SEQ ID NO: 2566712 - protein, 24 aa, Entamoeba histolytica
KKSIPSTPGEVKRKQKRENGGNEV

SEQ ID NO: 2566713 - protein, 8 aa, Entamoeba histolytica
KKSIRRAT

SEQ ID NO: 2566714 - protein, 4 aa, Entamoeba histolytica
KKSK

SEQ ID NO: 2566715 - protein, 5 aa, Entamoeba histolytica
KKSKK

SEQ ID NO: 2566716 - protein, 14 aa, Entamoeba histolytica
KKSKKVHKKTYDKK

SEQ ID NO: 2566717 - protein, 8 aa, Entamoeba histolytica
KKSKYTCD

SEQ ID NO: 2566718 - protein, 8 aa, Entamoeba histolytica
KKSLEDKM

SEQ ID NO: 2566719 - protein, 8 aa, Entamoeba histolytica
KKSLEVDN

SEQ ID NO: 2566720 - protein, 6 aa, Entamoeba histolytica
KKSNDK

SEQ ID NO: 2566721 - protein, 11 aa, Entamoeba histolytica
KKSPWKELRGK

SEQ ID NO: 2566722 - protein, 6 aa, Entamoeba histolytica
KKSQAI

SEQ ID NO: 2566723 - protein, 14 aa, Entamoeba histolytica
KKSQSRQSNSSKTI

SEQ ID NO: 2566724 - protein, 4 aa, Entamoeba histolytica
KKSS

SEQ ID NO: 2566725 - protein, 10 aa, Entamoeba histolytica
KKSSDLSQIN

SEQ ID NO: 2566726 - protein, 9 aa, Entamoeba histolytica
KKSSKKDIA

SEQ ID NO: 2566727 - protein, 6 aa, Entamoeba histolytica
KKSTCK

SEQ ID NO: 2566728 - protein, 12 aa, Entamoeba histolytica
KKSTLSQKVLVI

SEQ ID NO: 2566729 - protein, 11 aa, Entamoeba histolytica
KKSTSFSLTGA

SEQ ID NO: 2566730 - protein, 5 aa, Entamoeba histolytica
KKSTV

SEQ ID NO: 2566731 - protein, 5 aa, Entamoeba histolytica
KKSVT

SEQ ID NO: 2566732 - protein, 13 aa, Entamoeba histolytica
KKTAEDQSAVDSI

SEQ ID NO: 2566733 - protein, 30 aa, Entamoeba histolytica
KKTCGNGQRDSILDSKGHEIGEECDGGKNC

SEQ ID NO: 2566734 - protein, 7 aa, Entamoeba histolytica
KKTDDDC

SEQ ID NO: 2566735 - protein, 8 aa, Entamoeba histolytica
KKTEQKPI

SEQ ID NO: 2566736 - protein, 4 aa, Entamoeba histolytica
KKTK

SEQ ID NO: 2566737 - protein, 5 aa, Entamoeba histolytica
KKTKQ

SEQ ID NO: 2566738 - protein, 18 aa, Entamoeba histolytica
KKTKSTKELLGNDKSING

SEQ ID NO: 2566739 - protein, 7 aa, Entamoeba histolytica
KKTKTIS

SEQ ID NO: 2566740 - protein, 33 aa, Entamoeba histolytica
KKTNEYSKVGNNESWDDDFGNGKNENSDEGFSG

SEQ ID NO: 2566741 - protein, 15 aa, Entamoeba histolytica
KKTNKNEDKGLGTPI

SEQ ID NO: 2566742 - protein, 7 aa, Entamoeba histolytica
KKTNKTR

SEQ ID NO: 2566743 - protein, 10 aa, Entamoeba histolytica
KKTNSETVVT

SEQ ID NO: 2566744 - protein, 7 aa, Entamoeba histolytica
KKTQAKQ

SEQ ID NO: 2566745 - protein, 10 aa, Entamoeba histolytica
KKTQEELRTS

SEQ ID NO: 2566746 - protein, 7 aa, Entamoeba histolytica
KKTQSQL

SEQ ID NO: 2566747 - protein, 8 aa, Entamoeba histolytica
KKTQTNII

SEQ ID NO: 2566748 - protein, 34 aa, Entamoeba histolytica
KKTSDKSKSDSHNKNHSESTKTNTKSKDISSSEI

SEQ ID NO: 2566749 - protein, 60 aa, Entamoeba histolytica
KKTSDKSKSDSHNKNHSGTTKTNTKSKDISSTEIKSTTNTTNGTDENNDSAISSQSIDKS

SEQ ID NO: 2566750 - protein, 32 aa, Entamoeba histolytica
KKTSDKSKSDSNNKNNSSSTKTNTKSKDISSI

SEQ ID NO: 2566751 - protein, 7 aa, Entamoeba histolytica
KKTSSVK

SEQ ID NO: 2566752 - protein, 4 aa, Entamoeba histolytica
KKTV

SEQ ID NO: 2566753 - protein, 16 aa, Entamoeba histolytica
KKTVSTKEESTFSKHD

SEQ ID NO: 2566754 - protein, 4 aa, Entamoeba histolytica
KKTY

SEQ ID NO: 2566755 - protein, 6 aa, Entamoeba histolytica
KKTYGR

SEQ ID NO: 2566756 - protein, 8 aa, Entamoeba histolytica
KKVGEGSF

SEQ ID NO: 2566757 - protein, 6 aa, Entamoeba histolytica
KKVGRP

SEQ ID NO: 2566758 - protein, 10 aa, Entamoeba histolytica
KKVQKTDRYS

SEQ ID NO: 2566759 - protein, 18 aa, Entamoeba histolytica
KKVRKSRSLMSVDRKKVL

SEQ ID NO: 2566760 - protein, 7 aa, Entamoeba histolytica
KKVSDEI

SEQ ID NO: 2566761 - protein, 5 aa, Entamoeba histolytica
KKVSH

SEQ ID NO: 2566762 - protein, 6 aa, Entamoeba histolytica
KKYEKG

SEQ ID NO: 2566763 - protein, 8 aa, Entamoeba histolytica
KKYEKPAD

SEQ ID NO: 2566764 - protein, 7 aa, Entamoeba histolytica
KKYESES

SEQ ID NO: 2566765 - protein, 7 aa, Entamoeba histolytica
KKYKTAA

SEQ ID NO: 2566766 - protein, 6 aa, Entamoeba histolytica
KKYLGE

SEQ ID NO: 2566767 - protein, 21 aa, Entamoeba histolytica
KKYNKEKEGEWVGENKQGETR

SEQ ID NO: 2566768 - protein, 7 aa, Entamoeba histolytica
KKYRTGW

SEQ ID NO: 2566769 - protein, 9 aa, Entamoeba histolytica
KKYSITGST

SEQ ID NO: 2566770 - protein, 15 aa, Entamoeba histolytica
KKYTLEGKLNNNSLE

SEQ ID NO: 2566771 - protein, 12 aa, Entamoeba histolytica
KLAEEEKEIRNE

SEQ ID NO: 2566772 - protein, 10 aa, Entamoeba histolytica
KLDDNQKQIV

SEQ ID NO: 2566773 - protein, 10 aa, Entamoeba histolytica
KLDGAKDEMG

SEQ ID NO: 2566774 - protein, 8 aa, Entamoeba histolytica
KLDNIESN

SEQ ID NO: 2566775 - protein, 10 aa, Entamoeba histolytica
KLDNSSPSSK

SEQ ID NO: 2566776 - protein, 20 aa, Entamoeba histolytica
KLDPSTSSFSNSTTKGSIGW

SEQ ID NO: 2566777 - protein, 7 aa, Entamoeba histolytica
KLDQPTE

SEQ ID NO: 2566778 - protein, 20 aa, Entamoeba histolytica
KLEDNATDLSPIDCSTAPAK

SEQ ID NO: 2566779 - protein, 5 aa, Entamoeba histolytica
KLEEK

SEQ ID NO: 2566780 - protein, 5 aa, Entamoeba histolytica
KLEER

SEQ ID NO: 2566781 - protein, 11 aa, Entamoeba histolytica
KLERGNNEEIA

SEQ ID NO: 2566782 - protein, 12 aa, Entamoeba histolytica
KLFGEPAERNGI

SEQ ID NO: 2566783 - protein, 5 aa, Entamoeba histolytica
KLGEY

SEQ ID NO: 2566784 - protein, 12 aa, Entamoeba histolytica
KLGGLESKAEEL

SEQ ID NO: 2566785 - protein, 22 aa, Entamoeba histolytica
KLGGYENKKKREKLEKDQATIK

SEQ ID NO: 2566786 - protein, 7 aa, Entamoeba histolytica
KLGKTKR

SEQ ID NO: 2566787 - protein, 7 aa, Entamoeba histolytica
KLGRNTC

SEQ ID NO: 2566788 - protein, 9 aa, Entamoeba histolytica
KLINTSDKT

SEQ ID NO: 2566789 - protein, 6 aa, Entamoeba histolytica
KLKAGS

SEQ ID NO: 2566790 - protein, 6 aa, Entamoeba histolytica
KLKDGN

SEQ ID NO: 2566791 - protein, 16 aa, Entamoeba histolytica
KLKEDKKKNKKEKEDI

SEQ ID NO: 2566792 - protein, 10 aa, Entamoeba histolytica
KLKEDNSPVL

SEQ ID NO: 2566793 - protein, 15 aa, Entamoeba histolytica
KLKEEKQQADDERNL

SEQ ID NO: 2566794 - protein, 6 aa, Entamoeba histolytica
KLKEGD

SEQ ID NO: 2566795 - protein, 5 aa, Entamoeba histolytica
KLKHS

SEQ ID NO: 2566796 - protein, 12 aa, Entamoeba histolytica
KLKKKKAKKGFT

SEQ ID NO: 2566797 - protein, 12 aa, Entamoeba histolytica
KLKQKSNKDKQN

SEQ ID NO: 2566798 - protein, 10 aa, Entamoeba histolytica
KLLTSESEGI

SEQ ID NO: 2566799 - protein, 9 aa, Entamoeba histolytica
KLNEQHKSK

SEQ ID NO: 2566800 - protein, 5 aa, Entamoeba histolytica
KLNER

SEQ ID NO: 2566801 - protein, 10 aa, Entamoeba histolytica
KLNGQTKEQF

SEQ ID NO: 2566802 - protein, 4 aa, Entamoeba histolytica
KLNK

SEQ ID NO: 2566803 - protein, 7 aa, Entamoeba histolytica
KLNKETH

SEQ ID NO: 2566804 - protein, 7 aa, Entamoeba histolytica
KLNKQQK

SEQ ID NO: 2566805 - protein, 9 aa, Entamoeba histolytica
KLNQDSPAS

SEQ ID NO: 2566806 - protein, 8 aa, Entamoeba histolytica
KLNTNGEI

SEQ ID NO: 2566807 - protein, 6 aa, Entamoeba histolytica
KLPHPN

SEQ ID NO: 2566808 - protein, 6 aa, Entamoeba histolytica
KLPNDY

SEQ ID NO: 2566809 - protein, 5 aa, Entamoeba histolytica
KLPPI

SEQ ID NO: 2566810 - protein, 4 aa, Entamoeba histolytica
KLPQ

SEQ ID NO: 2566811 - protein, 8 aa, Entamoeba histolytica
KLPTKLTS

SEQ ID NO: 2566812 - protein, 8 aa, Entamoeba histolytica
KLPTKRSK

SEQ ID NO: 2566813 - protein, 6 aa, Entamoeba histolytica
KLPWKG

SEQ ID NO: 2566814 - protein, 9 aa, Entamoeba histolytica
KLQEEHKVT

SEQ ID NO: 2566815 - protein, 8 aa, Entamoeba histolytica
KLQESTLK

SEQ ID NO: 2566816 - protein, 4 aa, Entamoeba histolytica
KLQS

SEQ ID NO: 2566817 - protein, 7 aa, Entamoeba histolytica
KLQTVDT

SEQ ID NO: 2566818 - protein, 7 aa, Entamoeba histolytica
KLRKVSD

SEQ ID NO: 2566819 - protein, 14 aa, Entamoeba histolytica
KLSDNRLSCEEKSM

SEQ ID NO: 2566820 - protein, 8 aa, Entamoeba histolytica
KLSENDTI

SEQ ID NO: 2566821 - protein, 8 aa, Entamoeba histolytica
KLSENTRN

SEQ ID NO: 2566822 - protein, 31 aa, Entamoeba histolytica
KLSKKEKEKLEKAKEEEQRKKEEEKQRRREE

SEQ ID NO: 2566823 - protein, 8 aa, Entamoeba histolytica
KLSKKKKE

SEQ ID NO: 2566824 - protein, 9 aa, Entamoeba histolytica
KLSNESASI

SEQ ID NO: 2566825 - protein, 16 aa, Entamoeba histolytica
KLSPTDSPQDNNNLKK

SEQ ID NO: 2566826 - protein, 6 aa, Entamoeba histolytica
KLSQGP

SEQ ID NO: 2566827 - protein, 6 aa, Entamoeba histolytica
KLSQKQ

SEQ ID NO: 2566828 - protein, 6 aa, Entamoeba histolytica
KLSRDR

SEQ ID NO: 2566829 - protein, 9 aa, Entamoeba histolytica
KLSRKRPSH

SEQ ID NO: 2566830 - protein, 4 aa, Entamoeba histolytica
KLSS

SEQ ID NO: 2566831 - protein, 7 aa, Entamoeba histolytica
KLSSSDK

SEQ ID NO: 2566832 - protein, 19 aa, Entamoeba histolytica
KLTDAQNDLKKGSKDQQLS

SEQ ID NO: 2566833 - protein, 9 aa, Entamoeba histolytica
KLTDFGSAR

SEQ ID NO: 2566834 - protein, 18 aa, Entamoeba histolytica
KLTGTTQSMSCGSSVEKV

SEQ ID NO: 2566835 - protein, 8 aa, Entamoeba histolytica
KLTKNNNR

SEQ ID NO: 2566836 - protein, 10 aa, Entamoeba histolytica
KLTKPKNDPY

SEQ ID NO: 2566837 - protein, 32 aa, Entamoeba histolytica
KLTNNSTTTNGEVNYSEKTGLLSQEKEEIPTK

SEQ ID NO: 2566838 - protein, 10 aa, Entamoeba histolytica
KLTNPTNTFS

SEQ ID NO: 2566839 - protein, 6 aa, Entamoeba histolytica
KLTQSN

SEQ ID NO: 2566840 - protein, 189 aa, Entamoeba histolytica
KLTTDKGAEEPTSSTQSTKQAVPTSEQAVPKETQETKGSDKANSQAHQKHHNQKIQTKQQQKDHNPSSQGEEIQKQDKKQSETQTPSTQGGNQQKEESEKTQENGDNKNNEIPKTQDDAKDKQEKKDNDSQQKNNNNQQTNNNPEDEKTHEPNKNENKESDTKQSNNDESETDNSTDNDINNQKNIDGT

SEQ ID NO: 2566841 - protein, 19 aa, Entamoeba histolytica
KLTYQPNGIPKSYNYNQPI

SEQ ID NO: 2566842 - protein, 11 aa, Entamoeba histolytica
KMDEDECQQCE

SEQ ID NO: 2566843 - protein, 4 aa, Entamoeba histolytica
KMEP

SEQ ID NO: 2566844 - protein, 5 aa, Entamoeba histolytica
KMETA

SEQ ID NO: 2566845 - protein, 5 aa, Entamoeba histolytica
KMGDE

SEQ ID NO: 2566846 - protein, 8 aa, Entamoeba histolytica
KMGEYSKK

SEQ ID NO: 2566847 - protein, 12 aa, Entamoeba histolytica
KMKQAEKEIEIR

SEQ ID NO: 2566848 - protein, 10 aa, Entamoeba histolytica
KMKRKYKKQE

SEQ ID NO: 2566849 - protein, 11 aa, Entamoeba histolytica
KMNEKERQTTL

SEQ ID NO: 2566850 - protein, 4 aa, Entamoeba histolytica
KMPT

SEQ ID NO: 2566851 - protein, 10 aa, Entamoeba histolytica
KMSGEENDSL

SEQ ID NO: 2566852 - protein, 8 aa, Entamoeba histolytica
KMSKDTKI

SEQ ID NO: 2566853 - protein, 10 aa, Entamoeba histolytica
KMSKPKEYTN

SEQ ID NO: 2566854 - protein, 7 aa, Entamoeba histolytica
KMSNPTI

SEQ ID NO: 2566855 - protein, 6 aa, Entamoeba histolytica
KMSNRT

SEQ ID NO: 2566856 - protein, 8 aa, Entamoeba histolytica
KMSQEEYQ

SEQ ID NO: 2566857 - protein, 20 aa, Entamoeba histolytica
KMTSNLEKAEDLEEKTNEMV

SEQ ID NO: 2566858 - protein, 7 aa, Entamoeba histolytica
KNAIQNR

SEQ ID NO: 2566859 - protein, 5 aa, Entamoeba histolytica
KNAKS

SEQ ID NO: 2566860 - protein, 12 aa, Entamoeba histolytica
KNAKSKMTPSTI

SEQ ID NO: 2566861 - protein, 29 aa, Entamoeba histolytica
KNALDCDENTYNHYSPKDFDNGLSMTDGT

SEQ ID NO: 2566862 - protein, 7 aa, Entamoeba histolytica
KNAQDLQ

SEQ ID NO: 2566863 - protein, 8 aa, Entamoeba histolytica
KNAVKSES

SEQ ID NO: 2566864 - protein, 6 aa, Entamoeba histolytica
KNCKNH

SEQ ID NO: 2566865 - protein, 13 aa, Entamoeba histolytica
KNCPIHGSGEEKR

SEQ ID NO: 2566866 - protein, 9 aa, Entamoeba histolytica
KNCTTSEYD

SEQ ID NO: 2566867 - protein, 7 aa, Entamoeba histolytica
KNDDVQS

SEQ ID NO: 2566868 - protein, 8 aa, Entamoeba histolytica
KNDETARE

SEQ ID NO: 2566869 - protein, 10 aa, Entamoeba histolytica
KNDFNINENS

SEQ ID NO: 2566870 - protein, 11 aa, Entamoeba histolytica
KNDFSINKNSE

SEQ ID NO: 2566871 - protein, 13 aa, Entamoeba histolytica
KNDGKSKKWRQTW

SEQ ID NO: 2566872 - protein, 11 aa, Entamoeba histolytica
KNDKCEDKIDN

SEQ ID NO: 2566873 - protein, 7 aa, Entamoeba histolytica
KNDNKTL

SEQ ID NO: 2566874 - protein, 5 aa, Entamoeba histolytica
KNDNL

SEQ ID NO: 2566875 - protein, 7 aa, Entamoeba histolytica
KNDPKHY

SEQ ID NO: 2566876 - protein, 5 aa, Entamoeba histolytica
KNDPT

SEQ ID NO: 2566877 - protein, 4 aa, Entamoeba histolytica
KNDQ

SEQ ID NO: 2566878 - protein, 6 aa, Entamoeba histolytica
KNDSHS

SEQ ID NO: 2566879 - protein, 6 aa, Entamoeba histolytica
KNEAQI

SEQ ID NO: 2566880 - protein, 10 aa, Entamoeba histolytica
KNECDSNNKR

SEQ ID NO: 2566881 - protein, 7 aa, Entamoeba histolytica
KNEDGDA

SEQ ID NO: 2566882 - protein, 8 aa, Entamoeba histolytica
KNEDGDAV

SEQ ID NO: 2566883 - protein, 7 aa, Entamoeba histolytica
KNEDPKV

SEQ ID NO: 2566884 - protein, 10 aa, Entamoeba histolytica
KNENISKKRT

SEQ ID NO: 2566885 - protein, 5 aa, Entamoeba histolytica
KNENL

SEQ ID NO: 2566886 - protein, 5 aa, Entamoeba histolytica
KNEPK

SEQ ID NO: 2566887 - protein, 14 aa, Entamoeba histolytica
KNEPNNKMGASEGA

SEQ ID NO: 2566888 - protein, 10 aa, Entamoeba histolytica
KNESDAECTT

SEQ ID NO: 2566889 - protein, 6 aa, Entamoeba histolytica
KNESEG

SEQ ID NO: 2566890 - protein, 17 aa, Entamoeba histolytica
KNESEISETTGKITASS

SEQ ID NO: 2566891 - protein, 7 aa, Entamoeba histolytica
KNESIIQ

SEQ ID NO: 2566892 - protein, 9 aa, Entamoeba histolytica
KNESKEECG

SEQ ID NO: 2566893 - protein, 11 aa, Entamoeba histolytica
KNETDELEKNI

SEQ ID NO: 2566894 - protein, 6 aa, Entamoeba histolytica
KNETKY

SEQ ID NO: 2566895 - protein, 7 aa, Entamoeba histolytica
KNETMSK

SEQ ID NO: 2566896 - protein, 11 aa, Entamoeba histolytica
KNETNSSDCED

SEQ ID NO: 2566897 - protein, 7 aa, Entamoeba histolytica
KNETSDV

SEQ ID NO: 2566898 - protein, 14 aa, Entamoeba histolytica
KNETSETISKKENK

SEQ ID NO: 2566899 - protein, 6 aa, Entamoeba histolytica
KNETST

SEQ ID NO: 2566900 - protein, 6 aa, Entamoeba histolytica
KNETSV

SEQ ID NO: 2566901 - protein, 24 aa, Entamoeba histolytica
KNETTNGTENNVNKTNDDLNNHNL

SEQ ID NO: 2566902 - protein, 5 aa, Entamoeba histolytica
KNETV

SEQ ID NO: 2566903 - protein, 6 aa, Entamoeba histolytica
KNEVQH

SEQ ID NO: 2566904 - protein, 5 aa, Entamoeba histolytica
KNEYS

SEQ ID NO: 2566905 - protein, 13 aa, Entamoeba histolytica
KNFDEDGSQPIEL

SEQ ID NO: 2566906 - protein, 7 aa, Entamoeba histolytica
KNFGDDS

SEQ ID NO: 2566907 - protein, 14 aa, Entamoeba histolytica
KNFGSKASPVPITD

SEQ ID NO: 2566908 - protein, 11 aa, Entamoeba histolytica
KNFGTKKKDIP

SEQ ID NO: 2566909 - protein, 6 aa, Entamoeba histolytica
KNFPTT

SEQ ID NO: 2566910 - protein, 4 aa, Entamoeba histolytica
KNFS

SEQ ID NO: 2566911 - protein, 4 aa, Entamoeba histolytica
KNFT

SEQ ID NO: 2566912 - protein, 7 aa, Entamoeba histolytica
KNFYTTT

SEQ ID NO: 2566913 - protein, 8 aa, Entamoeba histolytica
KNGANGRF

SEQ ID NO: 2566914 - protein, 21 aa, Entamoeba histolytica
KNGCKKCEKGYSPKDNGMCSK

SEQ ID NO: 2566915 - protein, 29 aa, Entamoeba histolytica
KNGDDYEERDYYSTNCTKSEYSTNDNGDK

SEQ ID NO: 2566916 - protein, 5 aa, Entamoeba histolytica
KNGEE

SEQ ID NO: 2566917 - protein, 6 aa, Entamoeba histolytica
KNGGGL

SEQ ID NO: 2566918 - protein, 8 aa, Entamoeba histolytica
KNGGGNAI

SEQ ID NO: 2566919 - protein, 10 aa, Entamoeba histolytica
KNGGGSGNYS

SEQ ID NO: 2566920 - protein, 8 aa, Entamoeba histolytica
KNGGNSEL

SEQ ID NO: 2566921 - protein, 21 aa, Entamoeba histolytica
KNGHSESEKCDCTRTHNKYSE

SEQ ID NO: 2566922 - protein, 4 aa, Entamoeba histolytica
KNGM

SEQ ID NO: 2566923 - protein, 6 aa, Entamoeba histolytica
KNGNGW

SEQ ID NO: 2566924 - protein, 16 aa, Entamoeba histolytica
KNGNNGIVSTGKYNNQ

SEQ ID NO: 2566925 - protein, 6 aa, Entamoeba histolytica
KNGNNQ

SEQ ID NO: 2566926 - protein, 10 aa, Entamoeba histolytica
KNGNSKYNQQ

SEQ ID NO: 2566927 - protein, 6 aa, Entamoeba histolytica
KNGQID

SEQ ID NO: 2566928 - protein, 8 aa, Entamoeba histolytica
KNGSEEAV

SEQ ID NO: 2566929 - protein, 5 aa, Entamoeba histolytica
KNGTC

SEQ ID NO: 2566930 - protein, 10 aa, Entamoeba histolytica
KNGTCGEGEY

SEQ ID NO: 2566931 - protein, 14 aa, Entamoeba histolytica
KNGYNELRGNEEEL

SEQ ID NO: 2566932 - protein, 12 aa, Entamoeba histolytica
KNGYTRDCTGCQ

SEQ ID NO: 2566933 - protein, 30 aa, Entamoeba histolytica; identical to SEQ ID NO: 2367924

SEQ ID NO: 2566934 - protein, 7 aa, Entamoeba histolytica
KNIDDER

SEQ ID NO: 2566935 - protein, 4 aa, Entamoeba histolytica
KNIG

SEQ ID NO: 2566936 - protein, 4 aa, Entamoeba histolytica
KNII

SEQ ID NO: 2566937 - protein, 6 aa, Entamoeba histolytica
KNIKDK

SEQ ID NO: 2566938 - protein, 7 aa, Entamoeba histolytica
KNIKDNT

SEQ ID NO: 2566939 - protein, 7 aa, Entamoeba histolytica
KNIKPRE

SEQ ID NO: 2566940 - protein, 7 aa, Entamoeba histolytica
KNINNER

SEQ ID NO: 2566941 - protein, 12 aa, Entamoeba histolytica
KNINNNKIDEEL

SEQ ID NO: 2566942 - protein, 4 aa, Entamoeba histolytica
KNIP

SEQ ID NO: 2566943 - protein, 5 aa, Entamoeba histolytica
KNITD

SEQ ID NO: 2566944 - protein, 9 aa, Entamoeba histolytica
KNKAGNAHD

SEQ ID NO: 2566945 - protein, 5 aa, Entamoeba histolytica
KNKCN

SEQ ID NO: 2566946 - protein, 7 aa, Entamoeba histolytica
KNKDFND

SEQ ID NO: 2566947 - protein, 8 aa, Entamoeba histolytica
KNKDPEIG

SEQ ID NO: 2566948 - protein, 8 aa, Entamoeba histolytica
KNKDTNYS

SEQ ID NO: 2566949 - protein, 11 aa, Entamoeba histolytica
KNKEERNISLG

SEQ ID NO: 2566950 - protein, 8 aa, Entamoeba histolytica
KNKEEYKH

SEQ ID NO: 2566951 - protein, 9 aa, Entamoeba histolytica
KNKESDDKI

SEQ ID NO: 2566952 - protein, 7 aa, Entamoeba histolytica
KNKFRDD

SEQ ID NO: 2566953 - protein, 13 aa, Entamoeba histolytica
KNKKEIAKTQRER

SEQ ID NO: 2566954 - protein, 8 aa, Entamoeba histolytica
KNKKGIEN

SEQ ID NO: 2566955 - protein, 31 aa, Entamoeba histolytica
KNKKSKENDNEINLTKSKVAPALPEKNTENV

SEQ ID NO: 2566956 - protein, 11 aa, Entamoeba histolytica
KNKLDIEKEEV

SEQ ID NO: 2566957 - protein, 7 aa, Entamoeba histolytica
KNKNEKL

SEQ ID NO: 2566958 - protein, 14 aa, Entamoeba histolytica
KNKNHPTKNEQSTI

SEQ ID NO: 2566959 - protein, 6 aa, Entamoeba histolytica
KNKNND

SEQ ID NO: 2566960 - protein, 9 aa, Entamoeba histolytica
KNKNTNVSM

SEQ ID NO: 2566961 - protein, 6 aa, Entamoeba histolytica
KNKPNY

SEQ ID NO: 2566962 - protein, 6 aa, Entamoeba histolytica
KNKRYS

SEQ ID NO: 2566963 - protein, 6 aa, Entamoeba histolytica
KNKSEI

SEQ ID NO: 2566964 - protein, 7 aa, Entamoeba histolytica
KNKSGNK

SEQ ID NO: 2566965 - protein, 8 aa, Entamoeba histolytica
KNKSTKVA

SEQ ID NO: 2566966 - protein, 6 aa, Entamoeba histolytica
KNKTSS

SEQ ID NO: 2566967 - protein, 7 aa, Entamoeba histolytica
KNKTTWG

SEQ ID NO: 2566968 - protein, 6 aa, Entamoeba histolytica
KNKVNE

SEQ ID NO: 2566969 - protein, 4 aa, Entamoeba histolytica
KNLE

SEQ ID NO: 2566970 - protein, 5 aa, Entamoeba histolytica
KNLEE

SEQ ID NO: 2566971 - protein, 7 aa, Entamoeba histolytica
KNLEGKT

SEQ ID NO: 2566972 - protein, 18 aa, Entamoeba histolytica
KNLIETKKEEGEEYKEED

SEQ ID NO: 2566973 - protein, 10 aa, Entamoeba histolytica
KNLPPINLGN

SEQ ID NO: 2566974 - protein, 6 aa, Entamoeba histolytica
KNLVEK

SEQ ID NO: 2566975 - protein, 10 aa, Entamoeba histolytica
KNNDGNFVAN

SEQ ID NO: 2566976 - protein, 5 aa, Entamoeba histolytica
KNNDL

SEQ ID NO: 2566977 - protein, 6 aa, Entamoeba histolytica
KNNDLN

SEQ ID NO: 2566978 - protein, 14 aa, Entamoeba histolytica
KNNDSVSHPSIQRE

SEQ ID NO: 2566979 - protein, 11 aa, Entamoeba histolytica
KNNEKPKYVDG

SEQ ID NO: 2566980 - protein, 6 aa, Entamoeba histolytica
KNNESI

SEQ ID NO: 2566981 - protein, 7 aa, Entamoeba histolytica
KNNFEST

SEQ ID NO: 2566982 - protein, 7 aa, Entamoeba histolytica
KNNGEKI

SEQ ID NO: 2566983 - protein, 8 aa, Entamoeba histolytica
KNNGVNTT

SEQ ID NO: 2566984 - protein, 4 aa, Entamoeba histolytica
KNNK

SEQ ID NO: 2566985 - protein, 11 aa, Entamoeba histolytica
KNNKIKEIDYT

SEQ ID NO: 2566986 - protein, 11 aa, Entamoeba histolytica
KNNKKPEISNE

SEQ ID NO: 2566987 - protein, 6 aa, Entamoeba histolytica
KNNKNK

SEQ ID NO: 2566988 - protein, 16 aa, Entamoeba histolytica
KNNKNNKVGWKNKKGF

SEQ ID NO: 2566989 - protein, 5 aa, Entamoeba histolytica
KNNNE

SEQ ID NO: 2566990 - protein, 13 aa, Entamoeba histolytica
KNNNEECEIEDKN

SEQ ID NO: 2566991 - protein, 7 aa, Entamoeba histolytica
KNNNITK

SEQ ID NO: 2566992 - protein, 5 aa, Entamoeba histolytica
KNNNK

SEQ ID NO: 2566993 - protein, 7 aa, Entamoeba histolytica
KNNNNFD

SEQ ID NO: 2566994 - protein, 9 aa, Entamoeba histolytica
KNNNQSSQV

SEQ ID NO: 2566995 - protein, 9 aa, Entamoeba histolytica
KNNNTCTQC

SEQ ID NO: 2566996 - protein, 6 aa, Entamoeba histolytica
KNNPVE

SEQ ID NO: 2566997 - protein, 14 aa, Entamoeba histolytica
KNNQDIENKQREIT

SEQ ID NO: 2566998 - protein, 11 aa, Entamoeba histolytica
KNNQNDNEIGI

SEQ ID NO: 2566999 - protein, 7 aa, Entamoeba histolytica
KNNQNFY

SEQ ID NO: 2567000 - protein, 9 aa, Entamoeba histolytica
KNNQRLDNN

SEQ ID NO: 2567001 - protein, 8 aa, Entamoeba histolytica
KNNRDNKI

SEQ ID NO: 2567002 - protein, 15 aa, Entamoeba histolytica
KNNSCDNENKGLGTP

SEQ ID NO: 2567003 - protein, 23 aa, Entamoeba histolytica
KNNSNDSINSHENTSYHSNEPHE

SEQ ID NO: 2567004 - protein, 8 aa, Entamoeba histolytica
KNNTCESL

SEQ ID NO: 2567005 - protein, 5 aa, Entamoeba histolytica
KNPEA

SEQ ID NO: 2567006 - protein, 6 aa, Entamoeba histolytica
KNPEQC

SEQ ID NO: 2567007 - protein, 9 aa, Entamoeba histolytica
KNPKTKLTQ

SEQ ID NO: 2567008 - protein, 9 aa, Entamoeba histolytica
KNPPNQIGT

SEQ ID NO: 2567009 - protein, 11 aa, Entamoeba histolytica
KNPPQPKGYET

SEQ ID NO: 2567010 - protein, 9 aa, Entamoeba histolytica
KNPPQPSFD

SEQ ID NO: 2567011 - protein, 10 aa, Entamoeba histolytica
KNPPQPSFDA

SEQ ID NO: 2567012 - protein, 11 aa, Entamoeba histolytica
KNPPQPSFSDD

SEQ ID NO: 2567013 - protein, 11 aa, Entamoeba histolytica
KNPPQPSFSND

SEQ ID NO: 2567014 - protein, 10 aa, Entamoeba histolytica
KNPPQPSIDS

SEQ ID NO: 2567015 - protein, 7 aa, Entamoeba histolytica
KNPRNPT

SEQ ID NO: 2567016 - protein, 8 aa, Entamoeba histolytica
KNPRNPTD

SEQ ID NO: 2567017 - protein, 11 aa, Entamoeba histolytica
KNPSFEEGNGI

SEQ ID NO: 2567018 - protein, 7 aa, Entamoeba histolytica
KNPSLGE

SEQ ID NO: 2567019 - protein, 10 aa, Entamoeba histolytica
KNPSQEQQLK

SEQ ID NO: 2567020 - protein, 6 aa, Entamoeba histolytica
KNPYDP

SEQ ID NO: 2567021 - protein, 10 aa, Entamoeba histolytica
KNQGKLGNGW

SEQ ID NO: 2567022 - protein, 7 aa, Entamoeba histolytica
KNQHSNA

SEQ ID NO: 2567023 - protein, 7 aa, Entamoeba histolytica
KNQISTI

SEQ ID NO: 2567024 - protein, 6 aa, Entamoeba histolytica
KNQNIE

SEQ ID NO: 2567025 - protein, 5 aa, Entamoeba histolytica
KNQPQ

SEQ ID NO: 2567026 - protein, 6 aa, Entamoeba histolytica
KNQPTS

SEQ ID NO: 2567027 - protein, 8 aa, Entamoeba histolytica
KNQPVSPL

SEQ ID NO: 2567028 - protein, 7 aa, Entamoeba histolytica
KNQQNTC

SEQ ID NO: 2567029 - protein, 11 aa, Entamoeba histolytica
KNQQPLEPTKY

SEQ ID NO: 2567030 - protein, 7 aa, Entamoeba histolytica
KNQRLAN

SEQ ID NO: 2567031 - protein, 5 aa, Entamoeba histolytica
KNQTS

SEQ ID NO: 2567032 - protein, 4 aa, Entamoeba histolytica
KNQV

SEQ ID NO: 2567033 - protein, 14 aa, Entamoeba histolytica
KNQVGDRKILIPFI

SEQ ID NO: 2567034 - protein, 5 aa, Entamoeba histolytica
KNQYS

SEQ ID NO: 2567035 - protein, 10 aa, Entamoeba histolytica
KNRERSFSDP

SEQ ID NO: 2567036 - protein, 8 aa, Entamoeba histolytica
KNREVATL

SEQ ID NO: 2567037 - protein, 4 aa, Entamoeba histolytica
KNRP

SEQ ID NO: 2567038 - protein, 5 aa, Entamoeba histolytica
KNRSN

SEQ ID NO: 2567039 - protein, 4 aa, Entamoeba histolytica
KNSE

SEQ ID NO: 2567040 - protein, 5 aa, Entamoeba histolytica
KNSGK

SEQ ID NO: 2567041 - protein, 6 aa, Entamoeba histolytica
KNSITS

SEQ ID NO: 2567042 - protein, 7 aa, Entamoeba histolytica
KNSKQSL

SEQ ID NO: 2567043 - protein, 10 aa, Entamoeba histolytica
KNSKSKYKEY

SEQ ID NO: 2567044 - protein, 7 aa, Entamoeba histolytica
KNSKTNV

SEQ ID NO: 2567045 - protein, 5 aa, Entamoeba histolytica
KNSMD

SEQ ID NO: 2567046 - protein, 9 aa, Entamoeba histolytica
KNSNEKDKI

SEQ ID NO: 2567047 - protein, 9 aa, Entamoeba histolytica
KNSNNQVNE

SEQ ID NO: 2567048 - protein, 4 aa, Entamoeba histolytica
KNSP

SEQ ID NO: 2567049 - protein, 7 aa, Entamoeba histolytica
KNSPKIT

SEQ ID NO: 2567050 - protein, 9 aa, Entamoeba histolytica
KNSPTKHTA

SEQ ID NO: 2567051 - protein, 7 aa, Entamoeba histolytica
KNSRCTQ

SEQ ID NO: 2567052 - protein, 7 aa, Entamoeba histolytica
KNSSLQG

SEQ ID NO: 2567053 - protein, 4 aa, Entamoeba histolytica
KNST

SEQ ID NO: 2567054 - protein, 25 aa, Entamoeba histolytica
KNSTETISQQTKECPPLPKRDHPTQ

SEQ ID NO: 2567055 - protein, 4 aa, Entamoeba histolytica
KNSV

SEQ ID NO: 2567056 - protein, 7 aa, Entamoeba histolytica
KNSWRKK

SEQ ID NO: 2567057 - protein, 8 aa, Entamoeba histolytica
KNTAKQGV

SEQ ID NO: 2567058 - protein, 10 aa, Entamoeba histolytica
KNTDNNLSQF

SEQ ID NO: 2567059 - protein, 8 aa, Entamoeba histolytica
KNTEESFK

SEQ ID NO: 2567060 - protein, 7 aa, Entamoeba histolytica
KNTFETQ

SEQ ID NO: 2567061 - protein, 9 aa, Entamoeba histolytica
KNTGETPVG

SEQ ID NO: 2567062 - protein, 12 aa, Entamoeba histolytica
KNTGTEAKTLKQ

SEQ ID NO: 2567063 - protein, 11 aa, Entamoeba histolytica
KNTKGERAEFT

SEQ ID NO: 2567064 - protein, 5 aa, Entamoeba histolytica
KNTLQ

SEQ ID NO: 2567065 - protein, 9 aa, Entamoeba histolytica
KNTPNQQQV

SEQ ID NO: 2567066 - protein, 19 aa, Entamoeba histolytica
KNTQEVPPIKTDVYLLDDS

SEQ ID NO: 2567067 - protein, 6 aa, Entamoeba histolytica
KNTRHH

SEQ ID NO: 2567068 - protein, 4 aa, Entamoeba histolytica
KNTS

SEQ ID NO: 2567069 - protein, 8 aa, Entamoeba histolytica
KNTSKNKI

SEQ ID NO: 2567070 - protein, 9 aa, Entamoeba histolytica
KNTTSNDND

SEQ ID NO: 2567071 - protein, 5 aa, Entamoeba histolytica
KNVKE

SEQ ID NO: 2567072 - protein, 10 aa, Entamoeba histolytica
KNVPENYEEH

SEQ ID NO: 2567073 - protein, 7 aa, Entamoeba histolytica
KNVPQGN

SEQ ID NO: 2567074 - protein, 5 aa, Entamoeba histolytica
KNYNN

SEQ ID NO: 2567075 - protein, 7 aa, Entamoeba histolytica
KNYPKAW

SEQ ID NO: 2567076 - protein, 7 aa, Entamoeba histolytica
KNYSESN

SEQ ID NO: 2567077 - protein, 5 aa, Entamoeba histolytica
KNYSS

SEQ ID NO: 2567078 - protein, 7 aa, Entamoeba histolytica
KNYSSPS

SEQ ID NO: 2567079 - protein, 5 aa, Entamoeba histolytica
KNYTL

SEQ ID NO: 2567080 - protein, 8 aa, Entamoeba histolytica
KNYTTSAD

SEQ ID NO: 2567081 - protein, 7 aa, Entamoeba histolytica
KNYYPGK

SEQ ID NO: 2567082 - protein, 6 aa, Entamoeba histolytica
KPAKKA

SEQ ID NO: 2567083 - protein, 7 aa, Entamoeba histolytica
KPCKTKK

SEQ ID NO: 2567084 - protein, 21 aa, Entamoeba histolytica
KPDKCSSCDTKRYKKDCTECQ

SEQ ID NO: 2567085 - protein, 7 aa, Entamoeba histolytica
KPDQYIG

SEQ ID NO: 2567086 - protein, 59 aa, Entamoeba histolytica
KPDRNEKKEIKEEKNEDIEKVEETEKKVKSNKTTKKSKEQKRNERNEKKAEKLRKEEEI

SEQ ID NO: 2567087 - protein, 5 aa, Entamoeba histolytica
KPDYE

SEQ ID NO: 2567088 - protein, 8 aa, Entamoeba histolytica
KPEDFDKT

SEQ ID NO: 2567089 - protein, 5 aa, Entamoeba histolytica
KPELN

SEQ ID NO: 2567090 - protein, 7 aa, Entamoeba histolytica
KPELPPQ

SEQ ID NO: 2567091 - protein, 7 aa, Entamoeba histolytica
KPENETI

SEQ ID NO: 2567092 - protein, 9 aa, Entamoeba histolytica
KPENLSNEN

SEQ ID NO: 2567093 - protein, 6 aa, Entamoeba histolytica
KPENPR

SEQ ID NO: 2567094 - protein, 7 aa, Entamoeba histolytica
KPERSHH

SEQ ID NO: 2567095 - protein, 8 aa, Entamoeba histolytica
KPESCQSE

SEQ ID NO: 2567096 - protein, 5 aa, Entamoeba histolytica
KPEWD

SEQ ID NO: 2567097 - protein, 7 aa, Entamoeba histolytica
KPFEEAC

SEQ ID NO: 2567098 - protein, 4 aa, Entamoeba histolytica
KPFG

SEQ ID NO: 2567099 - protein, 6 aa, Entamoeba histolytica
KPFGKY

SEQ ID NO: 2567100 - protein, 6 aa, Entamoeba histolytica
KPFGRK

SEQ ID NO: 2567101 - protein, 4 aa, Entamoeba histolytica
KPFK

SEQ ID NO: 2567102 - protein, 8 aa, Entamoeba histolytica
KPFKRTDS

SEQ ID NO: 2567103 - protein, 19 aa, Entamoeba histolytica
KPFLNKQDSEIMAELQQLL

SEQ ID NO: 2567104 - protein, 6 aa, Entamoeba histolytica
KPFPPP

SEQ ID NO: 2567105 - protein, 5 aa, Entamoeba histolytica
KPFSE

SEQ ID NO: 2567106 - protein, 7 aa, Entamoeba histolytica
KPFSSNN

SEQ ID NO: 2567107 - protein, 5 aa, Entamoeba histolytica
KPGQA

SEQ ID NO: 2567108 - protein, 6 aa, Entamoeba histolytica
KPGTTR

SEQ ID NO: 2567109 - protein, 4 aa, Entamoeba histolytica
KPHP

SEQ ID NO: 2567110 - protein, 7 aa, Entamoeba histolytica
KPHPTRK

SEQ ID NO: 2567111 - protein, 7 aa, Entamoeba histolytica
KPHSSEK

SEQ ID NO: 2567112 - protein, 5 aa, Entamoeba histolytica
KPIEA

SEQ ID NO: 2567113 - protein, 14 aa, Entamoeba histolytica
KPIEEQKKVEVPKT

SEQ ID NO: 2567114 - protein, 17 aa, Entamoeba histolytica
KPIGALTPERAENTLER

SEQ ID NO: 2567115 - protein, 5 aa, Entamoeba histolytica
KPIGS

SEQ ID NO: 2567116 - protein, 5 aa, Entamoeba histolytica
KPIKE

SEQ ID NO: 2567117 - protein, 7 aa, Entamoeba histolytica
KPIKSEQ

SEQ ID NO: 2567118 - protein, 6 aa, Entamoeba histolytica
KPINTQ

SEQ ID NO: 2567119 - protein, 6 aa, Entamoeba histolytica
KPIPNS

SEQ ID NO: 2567120 - protein, 5 aa, Entamoeba histolytica
KPKDQ

SEQ ID NO: 2567121 - protein, 12 aa, Entamoeba histolytica
KPKEFTKSYPQF

SEQ ID NO: 2567122 - protein, 25 aa, Entamoeba histolytica
KPKFSNAKKPRASEVVKQKKEQKKA

SEQ ID NO: 2567123 - protein, 11 aa, Entamoeba histolytica
KPKKHKTKTLT

SEQ ID NO: 2567124 - protein, 7 aa, Entamoeba histolytica
KPKNGWD

SEQ ID NO: 2567125 - protein, 9 aa, Entamoeba histolytica
KPKNRPTFN

SEQ ID NO: 2567126 - protein, 9 aa, Entamoeba histolytica
KPKNTTEVN

SEQ ID NO: 2567127 - protein, 17 aa, Entamoeba histolytica
KPKRNNNWDVTKDDQEY

SEQ ID NO: 2567128 - protein, 11 aa, Entamoeba histolytica
KPKRSNAKELH

SEQ ID NO: 2567129 - protein, 16 aa, Entamoeba histolytica
KPKTETDEQQQIRKER

SEQ ID NO: 2567130 - protein, 7 aa, Entamoeba histolytica
KPLNTDE

SEQ ID NO: 2567131 - protein, 7 aa, Entamoeba histolytica
KPLPKEK

SEQ ID NO: 2567132 - protein, 8 aa, Entamoeba histolytica
KPLPPLPT

SEQ ID NO: 2567133 - protein, 5 aa, Entamoeba histolytica
KPLPR

SEQ ID NO: 2567134 - protein, 4 aa, Entamoeba histolytica
KPLS

SEQ ID NO: 2567135 - protein, 6 aa, Entamoeba histolytica
KPLSDN

SEQ ID NO: 2567136 - protein, 6 aa, Entamoeba histolytica
KPLSQR

SEQ ID NO: 2567137 - protein, 4 aa, Entamoeba histolytica
KPLT

SEQ ID NO: 2567138 - protein, 10 aa, Entamoeba histolytica
KPLTKTKTIP

SEQ ID NO: 2567139 - protein, 5 aa, Entamoeba histolytica
KPLTY

SEQ ID NO: 2567140 - protein, 5 aa, Entamoeba histolytica
KPMKT

SEQ ID NO: 2567141 - protein, 8 aa, Entamoeba histolytica
KPMRSNKQ

SEQ ID NO: 2567142 - protein, 5 aa, Entamoeba histolytica
KPMTS

SEQ ID NO: 2567143 - protein, 5 aa, Entamoeba histolytica
KPNDS

SEQ ID NO: 2567144 - protein, 6 aa, Entamoeba histolytica
KPNEKV

SEQ ID NO: 2567145 - protein, 11 aa, Entamoeba histolytica
KPNGDPKDVGS

SEQ ID NO: 2567146 - protein, 12 aa, Entamoeba histolytica
KPNISYEGLTQS

SEQ ID NO: 2567147 - protein, 9 aa, Entamoeba histolytica
KPNKGSKPI

SEQ ID NO: 2567148 - protein, 8 aa, Entamoeba histolytica
KPNKQGNA

SEQ ID NO: 2567149 - protein, 8 aa, Entamoeba histolytica
KPNPEERM

SEQ ID NO: 2567150 - protein, 8 aa, Entamoeba histolytica
KPNPIKYP

SEQ ID NO: 2567151 - protein, 13 aa, Entamoeba histolytica
KPNPISQIENNPF

SEQ ID NO: 2567152 - protein, 19 aa, Entamoeba histolytica
KPNSKEKGSSETKQQNSLN

SEQ ID NO: 2567153 - protein, 5 aa, Entamoeba histolytica
KPNSL

SEQ ID NO: 2567154 - protein, 5 aa, Entamoeba histolytica
KPNSY

SEQ ID NO: 2567155 - protein, 11 aa, Entamoeba histolytica
KPNTGKTTTPI

SEQ ID NO: 2567156 - protein, 11 aa, Entamoeba histolytica
KPNTGRTTNPV

SEQ ID NO: 2567157 - protein, 8 aa, Entamoeba histolytica
KPNYESNK

SEQ ID NO: 2567158 - protein, 6 aa, Entamoeba histolytica
KPPECV

SEQ ID NO: 2567159 - protein, 12 aa, Entamoeba histolytica
KPPYSSDEFPNA

SEQ ID NO: 2567160 - protein, 8 aa, Entamoeba histolytica
KPQDDLPS

SEQ ID NO: 2567161 - protein, 12 aa, Entamoeba histolytica
KPQENNEDVNYA

SEQ ID NO: 2567162 - protein, 5 aa, Entamoeba histolytica
KPQQI

SEQ ID NO: 2567163 - protein, 8 aa, Entamoeba histolytica
KPQQIPSS

SEQ ID NO: 2567164 - protein, 6 aa, Entamoeba histolytica
KPQRYE

SEQ ID NO: 2567165 - protein, 7 aa, Entamoeba histolytica
KPQYRNE

SEQ ID NO: 2567166 - protein, 14 aa, Entamoeba histolytica
KPRARSGGKKGGYS

SEQ ID NO: 2567167 - protein, 4 aa, Entamoeba histolytica
KPRI

SEQ ID NO: 2567168 - protein, 8 aa, Entamoeba histolytica
KPRKNAKL

SEQ ID NO: 2567169 - protein, 11 aa, Entamoeba histolytica
KPRKPVKQTEI

SEQ ID NO: 2567170 - protein, 9 aa, Entamoeba histolytica
KPRNQENPS

SEQ ID NO: 2567171 - protein, 7 aa, Entamoeba histolytica
KPRPART

SEQ ID NO: 2567172 - protein, 18 aa, Entamoeba histolytica
KPRSSHSQNRDNNNNNDA

SEQ ID NO: 2567173 - protein, 5 aa, Entamoeba histolytica
KPRTF

SEQ ID NO: 2567174 - protein, 8 aa, Entamoeba histolytica
KPRTSSMS

SEQ ID NO: 2567175 - protein, 14 aa, Entamoeba histolytica
KPRYKNDETNPKKV

SEQ ID NO: 2567176 - protein, 15 aa, Entamoeba histolytica
KPSDISSNPQTPANQ

SEQ ID NO: 2567177 - protein, 25 aa, Entamoeba histolytica
KPSDYGYTSYDEDISNVDCSDSSHT

SEQ ID NO: 2567178 - protein, 8 aa, Entamoeba histolytica
KPSEANPL

SEQ ID NO: 2567179 - protein, 6 aa, Entamoeba histolytica
KPSIDC

SEQ ID NO: 2567180 - protein, 6 aa, Entamoeba histolytica
KPSIDN

SEQ ID NO: 2567181 - protein, 6 aa, Entamoeba histolytica
KPSIRS

SEQ ID NO: 2567182 - protein, 20 aa, Entamoeba histolytica
KPSPEPFYEEAPNQDFADMQ

SEQ ID NO: 2567183 - protein, 6 aa, Entamoeba histolytica
KPSPIH

SEQ ID NO: 2567184 - protein, 6 aa, Entamoeba histolytica
KPSSFP

SEQ ID NO: 2567185 - protein, 12 aa, Entamoeba histolytica
KPSYTLTPKNAA

SEQ ID NO: 2567186 - protein, 6 aa, Entamoeba histolytica
KPSYTT

SEQ ID NO: 2567187 - protein, 9 aa, Entamoeba histolytica
KPTADGTFT

SEQ ID NO: 2567188 - protein, 4 aa, Entamoeba histolytica
KPTI

SEQ ID NO: 2567189 - protein, 5 aa, Entamoeba histolytica
KPTKE

SEQ ID NO: 2567190 - protein, 12 aa, Entamoeba histolytica
KPTLPPKHDTFI

SEQ ID NO: 2567191 - protein, 5 aa, Entamoeba histolytica
KPTLR

SEQ ID NO: 2567192 - protein, 6 aa, Entamoeba histolytica
KPTNTQ

SEQ ID NO: 2567193 - protein, 7 aa, Entamoeba histolytica
KPTSPFT

SEQ ID NO: 2567194 - protein, 9 aa, Entamoeba histolytica
KPTTEGSNR

SEQ ID NO: 2567195 - protein, 6 aa, Entamoeba histolytica
KPTTGI

SEQ ID NO: 2567196 - protein, 6 aa, Entamoeba histolytica
KPTTHT

SEQ ID NO: 2567197 - protein, 7 aa, Entamoeba histolytica
KPTTIKY

SEQ ID NO: 2567198 - protein, 5 aa, Entamoeba histolytica
KPTTN

SEQ ID NO: 2567199 - protein, 17 aa, Entamoeba histolytica
KPTTNLKNNERNVNKQE

SEQ ID NO: 2567200 - protein, 10 aa, Entamoeba histolytica
KPTTPPSPSF

SEQ ID NO: 2567201 - protein, 4 aa, Entamoeba histolytica
KPTV

SEQ ID NO: 2567202 - protein, 4 aa, Entamoeba histolytica
KPVD

SEQ ID NO: 2567203 - protein, 6 aa, Entamoeba histolytica
KPVDSN

SEQ ID NO: 2567204 - protein, 6 aa, Entamoeba histolytica
KPYGDV

SEQ ID NO: 2567205 - protein, 5 aa, Entamoeba histolytica
KPYIQ

SEQ ID NO: 2567206 - protein, 4 aa, Entamoeba histolytica
KPYK

SEQ ID NO: 2567207 - protein, 5 aa, Entamoeba histolytica
KPYNF

SEQ ID NO: 2567208 - protein, 6 aa, Entamoeba histolytica
KPYPGI

SEQ ID NO: 2567209 - protein, 7 aa, Entamoeba histolytica
KPYSPFE

SEQ ID NO: 2567210 - protein, 15 aa, Entamoeba histolytica
KQAGVSSESKLENEV

SEQ ID NO: 2567211 - protein, 7 aa, Entamoeba histolytica
KQAISNA

SEQ ID NO: 2567212 - protein, 13 aa, Entamoeba histolytica
KQALRKSKREEML

SEQ ID NO: 2567213 - protein, 6 aa, Entamoeba histolytica
KQCDKQ

SEQ ID NO: 2567214 - protein, 7 aa, Entamoeba histolytica
KQCGDYQ

SEQ ID NO: 2567215 - protein, 21 aa, Entamoeba histolytica
KQCKQENDSIKKDIESNPIHQ

SEQ ID NO: 2567216 - protein, 7 aa, Entamoeba histolytica
KQCNETR

SEQ ID NO: 2567217 - protein, 6 aa, Entamoeba histolytica
KQCSEF

SEQ ID NO: 2567218 - protein, 8 aa, Entamoeba histolytica
KQDDLENE

SEQ ID NO: 2567219 - protein, 13 aa, Entamoeba histolytica
KQDEQLNKLGENL

SEQ ID NO: 2567220 - protein, 6 aa, Entamoeba histolytica
KQDIDD

SEQ ID NO: 2567221 - protein, 5 aa, Entamoeba histolytica
KQDIP

SEQ ID NO: 2567222 - protein, 4 aa, Entamoeba histolytica
KQDS

SEQ ID NO: 2567223 - protein, 7 aa, Entamoeba histolytica
KQDSTEL

SEQ ID NO: 2567224 - protein, 9 aa, Entamoeba histolytica
KQEDDSNFT

SEQ ID NO: 2567225 - protein, 7 aa, Entamoeba histolytica
KQEEGKW

SEQ ID NO: 2567226 - protein, 7 aa, Entamoeba histolytica
KQEIEDE

SEQ ID NO: 2567227 - protein, 6 aa, Entamoeba histolytica
KQEIGT

SEQ ID NO: 2567228 - protein, 8 aa, Entamoeba histolytica
KQEKNRLE

SEQ ID NO: 2567229 - protein, 4 aa, Entamoeba histolytica
KQEN

SEQ ID NO: 2567230 - protein, 7 aa, Entamoeba histolytica
KQENGGF

SEQ ID NO: 2567231 - protein, 7 aa, Entamoeba histolytica
KQENGKC

SEQ ID NO: 2567232 - protein, 12 aa, Entamoeba histolytica
KQENGQLNITGN

SEQ ID NO: 2567233 - protein, 6 aa, Entamoeba histolytica
KQEPKY

SEQ ID NO: 2567234 - protein, 6 aa, Entamoeba histolytica
KQESER

SEQ ID NO: 2567235 - protein, 7 aa, Entamoeba histolytica
KQETGHT

SEQ ID NO: 2567236 - protein, 9 aa, Entamoeba histolytica
KQETKDSFN

SEQ ID NO: 2567237 - protein, 91 aa, Entamoeba histolytica
KQGKEKEQETSGTNDGQHDTTKEKDDNGTNESDENNKPKTPNGQEEGKNTTDNKTPNTPTNKPESKSENKNDDKTNNSEDEDLNNHKNIDG

SEQ ID NO: 2567238 - protein, 5 aa, Entamoeba histolytica
KQGKL

SEQ ID NO: 2567239 - protein, 8 aa, Entamoeba histolytica
KQGLTGQK

SEQ ID NO: 2567240 - protein, 6 aa, Entamoeba histolytica
KQGNDK

SEQ ID NO: 2567241 - protein, 18 aa, Entamoeba histolytica
KQGTEDLKQAHEYAKQSS

SEQ ID NO: 2567242 - protein, 8 aa, Entamoeba histolytica
KQGTNTSN

SEQ ID NO: 2567243 - protein, 8 aa, Entamoeba histolytica
KQGVSDKN

SEQ ID NO: 2567244 - protein, 12 aa, Entamoeba histolytica
KQHQSFKKSQET

SEQ ID NO: 2567245 - protein, 16 aa, Entamoeba histolytica
KQIDGNKCTSVNEDNC

SEQ ID NO: 2567246 - protein, 7 aa, Entamoeba histolytica
KQIGKGS

SEQ ID NO: 2567247 - protein, 7 aa, Entamoeba histolytica
KQIGTNC

SEQ ID NO: 2567248 - protein, 8 aa, Entamoeba histolytica
KQIPKTVN

SEQ ID NO: 2567249 - protein, 13 aa, Entamoeba histolytica
KQIPQKQKTEHSL

SEQ ID NO: 2567250 - protein, 11 aa, Entamoeba histolytica
KQIQSQPLNTS

SEQ ID NO: 2567251 - protein, 5 aa, Entamoeba histolytica
KQISH

SEQ ID NO: 2567252 - protein, 8 aa, Entamoeba histolytica
KQISRNSD

SEQ ID NO: 2567253 - protein, 9 aa, Entamoeba histolytica
KQKENTKTA

SEQ ID NO: 2567254 - protein, 6 aa, Entamoeba histolytica
KQKENY

SEQ ID NO: 2567255 - protein, 8 aa, Entamoeba histolytica
KQKEPFNN

SEQ ID NO: 2567256 - protein, 9 aa, Entamoeba histolytica
KQKEVFDSN

SEQ ID NO: 2567257 - protein, 8 aa, Entamoeba histolytica
KQKGTSAE

SEQ ID NO: 2567258 - protein, 9 aa, Entamoeba histolytica
KQKIKEESI

SEQ ID NO: 2567259 - protein, 8 aa, Entamoeba histolytica
KQKIPDTS

SEQ ID NO: 2567260 - protein, 10 aa, Entamoeba histolytica
KQKKENQTEI

SEQ ID NO: 2567261 - protein, 9 aa, Entamoeba histolytica
KQKKGSLNE

SEQ ID NO: 2567262 - protein, 8 aa, Entamoeba histolytica
KQKKQALV

SEQ ID NO: 2567263 - protein, 5 aa, Entamoeba histolytica
KQKKS

SEQ ID NO: 2567264 - protein, 8 aa, Entamoeba histolytica
KQKNEASI

SEQ ID NO: 2567265 - protein, 12 aa, Entamoeba histolytica
KQKNEINETKEE

SEQ ID NO: 2567266 - protein, 8 aa, Entamoeba histolytica
KQKPLTEK

SEQ ID NO: 2567267 - protein, 5 aa, Entamoeba histolytica
KQKSL

SEQ ID NO: 2567268 - protein, 18 aa, Entamoeba histolytica
KQKSSSELPEISSTPEIP

SEQ ID NO: 2567269 - protein, 5 aa, Entamoeba histolytica
KQKTV

SEQ ID NO: 2567270 - protein, 8 aa, Entamoeba histolytica
KQKTVGSK

SEQ ID NO: 2567271 - protein, 6 aa, Entamoeba histolytica
KQKYRA

SEQ ID NO: 2567272 - protein, 10 aa, Entamoeba histolytica
KQKYSKENNK

SEQ ID NO: 2567273 - protein, 13 aa, Entamoeba histolytica
KQLEKGKKIKEQL

SEQ ID NO: 2567274 - protein, 19 aa, Entamoeba histolytica
KQLPNSNSKTQKLLNDDET

SEQ ID NO: 2567275 - protein, 11 aa, Entamoeba histolytica
KQLSGKELKNE

SEQ ID NO: 2567276 - protein, 7 aa, Entamoeba histolytica
KQLSKQN

SEQ ID NO: 2567277 - protein, 17 aa, Entamoeba histolytica
KQLTDTLKYDDMIIITI

SEQ ID NO: 2567278 - protein, 15 aa, Entamoeba histolytica
KQLTSDVAAAERAVS

SEQ ID NO: 2567279 - protein, 5 aa, Entamoeba histolytica
KQMTP

SEQ ID NO: 2567280 - protein, 9 aa, Entamoeba histolytica
KQNGTSSKK

SEQ ID NO: 2567281 - protein, 7 aa, Entamoeba histolytica
KQNKKID

SEQ ID NO: 2567282 - protein, 8 aa, Entamoeba histolytica
KQNPISTS

SEQ ID NO: 2567283 - protein, 5 aa, Entamoeba histolytica
KQNPL

SEQ ID NO: 2567284 - protein, 9 aa, Entamoeba histolytica
KQNPSERYN

SEQ ID NO: 2567285 - protein, 17 aa, Entamoeba histolytica
KQNSTKMKKKEDVQQIN

SEQ ID NO: 2567286 - protein, 7 aa, Entamoeba histolytica
KQNVEQS

SEQ ID NO: 2567287 - protein, 4 aa, Entamoeba histolytica
KQPA

SEQ ID NO: 2567288 - protein, 5 aa, Entamoeba histolytica
KQPHS

SEQ ID NO: 2567289 - protein, 7 aa, Entamoeba histolytica
KQPNESK

SEQ ID NO: 2567290 - protein, 8 aa, Entamoeba histolytica
KQPPLGDG

SEQ ID NO: 2567291 - protein, 9 aa, Entamoeba histolytica
KQPPVGQGS

SEQ ID NO: 2567292 - protein, 7 aa, Entamoeba histolytica
KQPSQLI

SEQ ID NO: 2567293 - protein, 6 aa, Entamoeba histolytica
KQPSVM

SEQ ID NO: 2567294 - protein, 6 aa, Entamoeba histolytica
KQPTPF

SEQ ID NO: 2567295 - protein, 4 aa, Entamoeba histolytica
KQQE

SEQ ID NO: 2567296 - protein, 13 aa, Entamoeba histolytica
KQQINDSEQQKKE

SEQ ID NO: 2567297 - protein, 4 aa, Entamoeba histolytica
KQQK

SEQ ID NO: 2567298 - protein, 45 aa, Entamoeba histolytica
KQQKSGETTPSPRSQKPVPQPPVNRYPQKQTPAVPSLPQKPPKLS

SEQ ID NO: 2567299 - protein, 11 aa, Entamoeba histolytica
KQQRTHPESRP

SEQ ID NO: 2567300 - protein, 6 aa, Entamoeba histolytica
KQQSEI

SEQ ID NO: 2567301 - protein, 8 aa, Entamoeba histolytica
KQQSGPLN

SEQ ID NO: 2567302 - protein, 13 aa, Entamoeba histolytica
KQRAANGIPEKQR

SEQ ID NO: 2567303 - protein, 6 aa, Entamoeba histolytica
KQRCSV

SEQ ID NO: 2567304 - protein, 98 aa, Entamoeba histolytica
KQREEEAKKKAEEEAKKKAEEEARKKAEEEAKKKAEEEARKKAEEEAKKKAEEEARKKAEEEARKKAEEAKKKAEEEARKKAEEARKKAEEESQKDEL

SEQ ID NO: 2567305 - protein, 4 aa, Entamoeba histolytica
KQRL

SEQ ID NO: 2567306 - protein, 8 aa, Entamoeba histolytica
KQRNGNEE

SEQ ID NO: 2567307 - protein, 8 aa, Entamoeba histolytica
KQRQFTEE

SEQ ID NO: 2567308 - protein, 20 aa, Entamoeba histolytica
KQRRDDSRIEIKQKSEKDEI

SEQ ID NO: 2567309 - protein, 9 aa, Entamoeba histolytica
KQRTFQQTT

SEQ ID NO: 2567310 - protein, 12 aa, Entamoeba histolytica
KQSGINSTEIKE

SEQ ID NO: 2567311 - protein, 6 aa, Entamoeba histolytica
KQSHPS

SEQ ID NO: 2567312 - protein, 11 aa, Entamoeba histolytica
KQSNHGEDGHK

SEQ ID NO: 2567313 - protein, 7 aa, Entamoeba histolytica
KQSNTEK

SEQ ID NO: 2567314 - protein, 4 aa, Entamoeba histolytica
KQSV

SEQ ID NO: 2567315 - protein, 8 aa, Entamoeba histolytica
KQTDDETL

SEQ ID NO: 2567316 - protein, 7 aa, Entamoeba histolytica
KQTDFRT

SEQ ID NO: 2567317 - protein, 33 aa, Entamoeba histolytica
KQTDSNSSVQSNRVNNINTSQIETDTQKIPPNK

SEQ ID NO: 2567318 - protein, 7 aa, Entamoeba histolytica
KQTDSYE

SEQ ID NO: 2567319 - protein, 6 aa, Entamoeba histolytica
KQTEFN

SEQ ID NO: 2567320 - protein, 8 aa, Entamoeba histolytica
KQTEIESS

SEQ ID NO: 2567321 - protein, 5 aa, Entamoeba histolytica
KQTKK

SEQ ID NO: 2567322 - protein, 8 aa, Entamoeba histolytica
KQTKTNNT

SEQ ID NO: 2567323 - protein, 8 aa, Entamoeba histolytica
KQTNPNYQ

SEQ ID NO: 2567324 - protein, 13 aa, Entamoeba histolytica
KQTPFGPKWKKGD

SEQ ID NO: 2567325 - protein, 8 aa, Entamoeba histolytica
KQTPSSYP

SEQ ID NO: 2567326 - protein, 7 aa, Entamoeba histolytica
KQTPTDI

SEQ ID NO: 2567327 - protein, 5 aa, Entamoeba histolytica
KQTQK

SEQ ID NO: 2567328 - protein, 8 aa, Entamoeba histolytica
KQTTNTNE

SEQ ID NO: 2567329 - protein, 8 aa, Entamoeba histolytica
KQTTSTKT

SEQ ID NO: 2567330 - protein, 9 aa, Entamoeba histolytica
KQVENKESS

SEQ ID NO: 2567331 - protein, 9 aa, Entamoeba histolytica
KQVKLGGSL

SEQ ID NO: 2567332 - protein, 4 aa, Entamoeba histolytica
KQVP

SEQ ID NO: 2567333 - protein, 8 aa, Entamoeba histolytica
KQWQDGEL

SEQ ID NO: 2567334 - protein, 6 aa, Entamoeba histolytica
KQYDGT

SEQ ID NO: 2567335 - protein, 7 aa, Entamoeba histolytica
KQYEKEN

SEQ ID NO: 2567336 - protein, 6 aa, Entamoeba histolytica
KQYKQR

SEQ ID NO: 2567337 - protein, 6 aa, Entamoeba histolytica
KQYNRD

SEQ ID NO: 2567338 - protein, 6 aa, Entamoeba histolytica
KQYPSE

SEQ ID NO: 2567339 - protein, 11 aa, Entamoeba histolytica
KQYVDGSETDI

SEQ ID NO: 2567340 - protein, 7 aa, Entamoeba histolytica
KRAANLK

SEQ ID NO: 2567341 - protein, 56 aa, Entamoeba histolytica
KRALDEKAIKEGKKPKFNTKDTDEHKTKEIQENIEKHENSIEENIKPNDNQLVNER

SEQ ID NO: 2567342 - protein, 7 aa, Entamoeba histolytica
KRASNLD

SEQ ID NO: 2567343 - protein, 6 aa, Entamoeba histolytica
KRCEDK

SEQ ID NO: 2567344 - protein, 11 aa, Entamoeba histolytica
KRDAPIAEQKE

SEQ ID NO: 2567345 - protein, 7 aa, Entamoeba histolytica
KRDNEID

SEQ ID NO: 2567346 - protein, 6 aa, Entamoeba histolytica
KRDPTK

SEQ ID NO: 2567347 - protein, 6 aa, Entamoeba histolytica
KRDPTL

SEQ ID NO: 2567348 - protein, 4 aa, Entamoeba histolytica
KRDT

SEQ ID NO: 2567349 - protein, 7 aa, Entamoeba histolytica
KREDLNE

SEQ ID NO: 2567350 - protein, 6 aa, Entamoeba histolytica
KREEVF

SEQ ID NO: 2567351 - protein, 18 aa, Entamoeba histolytica
KREEWSQPIDSPEKLNEG

SEQ ID NO: 2567352 - protein, 9 aa, Entamoeba histolytica
KREKAKTVN

SEQ ID NO: 2567353 - protein, 7 aa, Entamoeba histolytica
KRENPDL

SEQ ID NO: 2567354 - protein, 73 aa, Entamoeba histolytica
KRENPDLIPQNSQSSQNSESDNKSRSSSTNGSSSQKNSHTSLNTQKNTPSGSGKSGSSNNSDSKKKKGKSKVS

SEQ ID NO: 2567355 - protein, 9 aa, Entamoeba histolytica
KREQDETQA

SEQ ID NO: 2567356 - protein, 6 aa, Entamoeba histolytica
KRESDQ

SEQ ID NO: 2567357 - protein, 15 aa, Entamoeba histolytica
KRETAVKGSNKSIKF

SEQ ID NO: 2567358 - protein, 7 aa, Entamoeba histolytica
KREWENG

SEQ ID NO: 2567359 - protein, 16 aa, Entamoeba histolytica
KRFTQDQVNELLNQCT

SEQ ID NO: 2567360 - protein, 15 aa, Entamoeba histolytica
KRGDVEPSAQVNEIS

SEQ ID NO: 2567361 - protein, 6 aa, Entamoeba histolytica
KRGIPG

SEQ ID NO: 2567362 - protein, 8 aa, Entamoeba histolytica
KRGNETKQ

SEQ ID NO: 2567363 - protein, 8 aa, Entamoeba histolytica
KRGTSTHC

SEQ ID NO: 2567364 - protein, 7 aa, Entamoeba histolytica
KRHSEEM

SEQ ID NO: 2567365 - protein, 7 aa, Entamoeba histolytica
KRHVGND

SEQ ID NO: 2567366 - protein, 5 aa, Entamoeba histolytica
KRIEN

SEQ ID NO: 2567367 - protein, 7 aa, Entamoeba histolytica
KRINKRG

SEQ ID NO: 2567368 - protein, 5 aa, Entamoeba histolytica
KRKAT

SEQ ID NO: 2567369 - protein, 7 aa, Entamoeba histolytica
KRKDYRK

SEQ ID NO: 2567370 - protein, 11 aa, Entamoeba histolytica
KRKEQQKMNQK

SEQ ID NO: 2567371 - protein, 6 aa, Entamoeba histolytica
KRKGFD

SEQ ID NO: 2567372 - protein, 8 aa, Entamoeba histolytica
KRKKDNIK

SEQ ID NO: 2567373 - protein, 8 aa, Entamoeba histolytica
KRKKSTKF

SEQ ID NO: 2567374 - protein, 10 aa, Entamoeba histolytica
KRKKYIDKRN

SEQ ID NO: 2567375 - protein, 12 aa, Entamoeba histolytica
KRKNEEKKSKKI

SEQ ID NO: 2567376 - protein, 15 aa, Entamoeba histolytica
KRLEESNDEGEQKVI

SEQ ID NO: 2567377 - protein, 10 aa, Entamoeba histolytica
KRLEKPEGME

SEQ ID NO: 2567378 - protein, 14 aa, Entamoeba histolytica
KRLERKEPKVIENT

SEQ ID NO: 2567379 - protein, 8 aa, Entamoeba histolytica
KRLPQVEP

SEQ ID NO: 2567380 - protein, 8 aa, Entamoeba histolytica
KRLRKPNR

SEQ ID NO: 2567381 - protein, 10 aa, Entamoeba histolytica
KRLSKGTEIN

SEQ ID NO: 2567382 - protein, 4 aa, Entamoeba histolytica
KRME

SEQ ID NO: 2567383 - protein, 9 aa, Entamoeba histolytica
KRNDSQTVT

SEQ ID NO: 2567384 - protein, 8 aa, Entamoeba histolytica
KRNEDINY

SEQ ID NO: 2567385 - protein, 17 aa, Entamoeba histolytica
KRNEEKEQVKSFEGQTR

SEQ ID NO: 2567386 - protein, 8 aa, Entamoeba histolytica
KRNEGTIQ

SEQ ID NO: 2567387 - protein, 7 aa, Entamoeba histolytica
KRNELGP

SEQ ID NO: 2567388 - protein, 4 aa, Entamoeba histolytica
KRNG

SEQ ID NO: 2567389 - protein, 15 aa, Entamoeba histolytica
KRNGNLQRLLNEIVH

SEQ ID NO: 2567390 - protein, 9 aa, Entamoeba histolytica
KRNITEGNE

SEQ ID NO: 2567391 - protein, 16 aa, Entamoeba histolytica
KRNNRESANHNDYGNE

SEQ ID NO: 2567392 - protein, 6 aa, Entamoeba histolytica
KRNNYR

SEQ ID NO: 2567393 - protein, 13 aa, Entamoeba histolytica
KRNPEHKKETEKQ

SEQ ID NO: 2567394 - protein, 4 aa, Entamoeba histolytica
KRNQ

SEQ ID NO: 2567395 - protein, 7 aa, Entamoeba histolytica
KRNQLNN

SEQ ID NO: 2567396 - protein, 16 aa, Entamoeba histolytica
KRNQWDRTISNSNEQM

SEQ ID NO: 2567397 - protein, 8 aa, Entamoeba histolytica
KRNSENIT

SEQ ID NO: 2567398 - protein, 6 aa, Entamoeba histolytica
KRNSSK

SEQ ID NO: 2567399 - protein, 4 aa, Entamoeba histolytica
KRNV

SEQ ID NO: 2567400 - protein, 7 aa, Entamoeba histolytica
KRPYSKL

SEQ ID NO: 2567401 - protein, 57 aa, Entamoeba histolytica
KRQAKRADPTAGYHEYTPDQSKNVSTPQPSTASESRQKGDDLTNANSSNTQQIEMEP

SEQ ID NO: 2567402 - protein, 26 aa, Entamoeba histolytica
KRQAKRAEPTSLRENNEGPSPIETTK

SEQ ID NO: 2567403 - protein, 7 aa, Entamoeba histolytica
KRQESYS

SEQ ID NO: 2567404 - protein, 7 aa, Entamoeba histolytica
KRQSPTI

SEQ ID NO: 2567405 - protein, 8 aa, Entamoeba histolytica
KRQSSGMV

SEQ ID NO: 2567406 - protein, 4 aa, Entamoeba histolytica
KRRG

SEQ ID NO: 2567407 - protein, 4 aa, Entamoeba histolytica
KRRN

SEQ ID NO: 2567408 - protein, 31 aa, Entamoeba histolytica
KRRQAKRVDPTKDYHQEDNKKNTGCSMEITP

SEQ ID NO: 2567409 - protein, 14 aa, Entamoeba histolytica
KRRTARQDSALEKE

SEQ ID NO: 2567410 - protein, 14 aa, Entamoeba histolytica
KRSIQKTKTPPKLQ

SEQ ID NO: 2567411 - protein, 9 aa, Entamoeba histolytica
KRSKDCDSK

SEQ ID NO: 2567412 - protein, 6 aa, Entamoeba histolytica
KRSNDI

SEQ ID NO: 2567413 - protein, 8 aa, Entamoeba histolytica
KRSNNPLS

SEQ ID NO: 2567414 - protein, 25 aa, Entamoeba histolytica
KRSNSPSGGSSDNEGSVQELSSTPE

SEQ ID NO: 2567415 - protein, 25 aa, Entamoeba histolytica
KRSNSSSGRSSDNEGSIVESSKKIE

SEQ ID NO: 2567416 - protein, 6 aa, Entamoeba histolytica
KRSRNY

SEQ ID NO: 2567417 - protein, 7 aa, Entamoeba histolytica
KRSTIME

SEQ ID NO: 2567418 - protein, 8 aa, Entamoeba histolytica
KRTATKSM

SEQ ID NO: 2567419 - protein, 8 aa, Entamoeba histolytica
KRTDNEDE

SEQ ID NO: 2567420 - protein, 7 aa, Entamoeba histolytica
KRTGLGN

SEQ ID NO: 2567421 - protein, 6 aa, Entamoeba histolytica
KRTGTV

SEQ ID NO: 2567422 - protein, 5 aa, Entamoeba histolytica
KRTKF

SEQ ID NO: 2567423 - protein, 9 aa, Entamoeba histolytica
KRTNKRSHC

SEQ ID NO: 2567424 - protein, 6 aa, Entamoeba histolytica
KRTTAV

SEQ ID NO: 2567425 - protein, 8 aa, Entamoeba histolytica
KRVDNKPL

SEQ ID NO: 2567426 - protein, 6 aa, Entamoeba histolytica
KRVGED

SEQ ID NO: 2567427 - protein, 5 aa, Entamoeba histolytica
KRVRE

SEQ ID NO: 2567428 - protein, 8 aa, Entamoeba histolytica
KRWTPNKH

SEQ ID NO: 2567429 - protein, 9 aa, Entamoeba histolytica
KRYKTNQTC

SEQ ID NO: 2567430 - protein, 7 aa, Entamoeba histolytica
KRYPYRG

SEQ ID NO: 2567431 - protein, 7 aa, Entamoeba histolytica
KSAAKKM

SEQ ID NO: 2567432 - protein, 7 aa, Entamoeba histolytica
KSAGPEL

SEQ ID NO: 2567433 - protein, 4 aa, Entamoeba histolytica
KSAI

SEQ ID NO: 2567434 - protein, 7 aa, Entamoeba histolytica
KSAKKVE

SEQ ID NO: 2567435 - protein, 7 aa, Entamoeba histolytica
KSANGLS

SEQ ID NO: 2567436 - protein, 6 aa, Entamoeba histolytica
KSAPKM

SEQ ID NO: 2567437 - protein, 10 aa, Entamoeba histolytica
KSAQSQSPDI

SEQ ID NO: 2567438 - protein, 9 aa, Entamoeba histolytica
KSARSNYSK

SEQ ID NO: 2567439 - protein, 8 aa, Entamoeba histolytica
KSASSSVE

SEQ ID NO: 2567440 - protein, 8 aa, Entamoeba histolytica
KSAYTSSD

SEQ ID NO: 2567441 - protein, 5 aa, Entamoeba histolytica
KSCNE

SEQ ID NO: 2567442 - protein, 16 aa, Entamoeba histolytica
KSCQTCNSTIDPKTGN

SEQ ID NO: 2567443 - protein, 13 aa, Entamoeba histolytica
KSDDFSSSENLDE

SEQ ID NO: 2567444 - protein, 7 aa, Entamoeba histolytica
KSDDGRY

SEQ ID NO: 2567445 - protein, 6 aa, Entamoeba histolytica
KSDDTA

SEQ ID NO: 2567446 - protein, 34 aa, Entamoeba histolytica; identical to SEQ ID NO: 2368454

SEQ ID NO: 2567447 - protein, 12 aa, Entamoeba histolytica
KSDKMKKEKLES

SEQ ID NO: 2567448 - protein, 10 aa, Entamoeba histolytica
KSDKNASVSG

SEQ ID NO: 2567449 - protein, 16 aa, Entamoeba histolytica
KSDNKKVYNSISEELT

SEQ ID NO: 2567450 - protein, 38 aa, Entamoeba histolytica
KSDPQPIPKTTPTTPQNNLPSPQSNTTSVSPSQTPKQH

SEQ ID NO: 2567451 - protein, 7 aa, Entamoeba histolytica
KSDSDIH

SEQ ID NO: 2567452 - protein, 6 aa, Entamoeba histolytica
KSDSML

SEQ ID NO: 2567453 - protein, 5 aa, Entamoeba histolytica
KSDSR

SEQ ID NO: 2567454 - protein, 10 aa, Entamoeba histolytica
KSDSSCRSQN

SEQ ID NO: 2567455 - protein, 7 aa, Entamoeba histolytica
KSDSYLD

SEQ ID NO: 2567456 - protein, 5 aa, Entamoeba histolytica
KSDYL

SEQ ID NO: 2567457 - protein, 5 aa, Entamoeba histolytica
KSDYN

SEQ ID NO: 2567458 - protein, 4 aa, Entamoeba histolytica
KSED

SEQ ID NO: 2567459 - protein, 8 aa, Entamoeba histolytica
KSEDCNNK

SEQ ID NO: 2567460 - protein, 7 aa, Entamoeba histolytica
KSEETDG

SEQ ID NO: 2567461 - protein, 6 aa, Entamoeba histolytica
KSEEYQ

SEQ ID NO: 2567462 - protein, 11 aa, Entamoeba histolytica
KSEHCEKASNS

SEQ ID NO: 2567463 - protein, 9 aa, Entamoeba histolytica
KSEKDIKKK

SEQ ID NO: 2567464 - protein, 9 aa, Entamoeba histolytica
KSEKNNERD

SEQ ID NO: 2567465 - protein, 5 aa, Entamoeba histolytica
KSELN

SEQ ID NO: 2567466 - protein, 8 aa, Entamoeba histolytica
KSELPKEH

SEQ ID NO: 2567467 - protein, 12 aa, Entamoeba histolytica
KSELQTNGALKG

SEQ ID NO: 2567468 - protein, 5 aa, Entamoeba histolytica
KSELR

SEQ ID NO: 2567469 - protein, 10 aa, Entamoeba histolytica
KSEMEEKGKN

SEQ ID NO: 2567470 - protein, 5 aa, Entamoeba histolytica
KSENE

SEQ ID NO: 2567471 - protein, 7 aa, Entamoeba histolytica
KSENELK

SEQ ID NO: 2567472 - protein, 4 aa, Entamoeba histolytica
KSES

SEQ ID NO: 2567473 - protein, 61 aa, Entamoeba histolytica
KSESSLSKQKKEEAKQKEIKQKKEEAKQKKLSKKEAKKESLSEKIKRKNAKVSSSSSSSDS

SEQ ID NO: 2567474 - protein, 9 aa, Entamoeba histolytica
KSETETPEV

SEQ ID NO: 2567475 - protein, 6 aa, Entamoeba histolytica
KSETGS

SEQ ID NO: 2567476 - protein, 6 aa, Entamoeba histolytica
KSEVQL

SEQ ID NO: 2567477 - protein, 6 aa, Entamoeba histolytica
KSEYSL

SEQ ID NO: 2567478 - protein, 11 aa, Entamoeba histolytica
KSFDENNKEEI

SEQ ID NO: 2567479 - protein, 6 aa, Entamoeba histolytica
KSFGYS

SEQ ID NO: 2567480 - protein, 4 aa, Entamoeba histolytica
KSFL

SEQ ID NO: 2567481 - protein, 6 aa, Entamoeba histolytica
KSFNTS

SEQ ID NO: 2567482 - protein, 13 aa, Entamoeba histolytica
KSFNYTGKEEKNL

SEQ ID NO: 2567483 - protein, 5 aa, Entamoeba histolytica
KSFQG

SEQ ID NO: 2567484 - protein, 24 aa, Entamoeba histolytica
KSFTPGSSNNSPSSERSGWEKGEE

SEQ ID NO: 2567485 - protein, 5 aa, Entamoeba histolytica
KSGAA

SEQ ID NO: 2567486 - protein, 10 aa, Entamoeba histolytica
KSGCADGDNV

SEQ ID NO: 2567487 - protein, 5 aa, Entamoeba histolytica
KSGDF

SEQ ID NO: 2567488 - protein, 7 aa, Entamoeba histolytica
KSGDSIC

SEQ ID NO: 2567489 - protein, 9 aa, Entamoeba histolytica
KSGKQEGSC

SEQ ID NO: 2567490 - protein, 13 aa, Entamoeba histolytica
KSGLGKDIKDIGT

SEQ ID NO: 2567491 - protein, 13 aa, Entamoeba histolytica
KSGLTKGKLERVE

SEQ ID NO: 2567492 - protein, 5 aa, Entamoeba histolytica
KSGNI

SEQ ID NO: 2567493 - protein, 14 aa, Entamoeba histolytica
KSGSGGTCDCGSSI

SEQ ID NO: 2567494 - protein, 8 aa, Entamoeba histolytica
KSGSLPNY

SEQ ID NO: 2567495 - protein, 7 aa, Entamoeba histolytica
KSGSPIK

SEQ ID NO: 2567496 - protein, 4 aa, Entamoeba histolytica
KSGV

SEQ ID NO: 2567497 - protein, 9 aa, Entamoeba histolytica
KSGYYKNST

SEQ ID NO: 2567498 - protein, 28 aa, Entamoeba histolytica
KSHEEETQSIQSMTNEVSTYAQSAASKV

SEQ ID NO: 2567499 - protein, 9 aa, Entamoeba histolytica
KSHGTPGSA

SEQ ID NO: 2567500 - protein, 6 aa, Entamoeba histolytica
KSHNLQ

SEQ ID NO: 2567501 - protein, 8 aa, Entamoeba histolytica
KSHSNKSD

SEQ ID NO: 2567502 - protein, 10 aa, Entamoeba histolytica
KSHSPISKRI

SEQ ID NO: 2567503 - protein, 7 aa, Entamoeba histolytica
KSHSTNN

SEQ ID NO: 2567504 - protein, 6 aa, Entamoeba histolytica
KSHTTQ

SEQ ID NO: 2567505 - protein, 6 aa, Entamoeba histolytica
KSIESN

SEQ ID NO: 2567506 - protein, 5 aa, Entamoeba histolytica
KSIGL

SEQ ID NO: 2567507 - protein, 7 aa, Entamoeba histolytica
KSIGSTI

SEQ ID NO: 2567508 - protein, 7 aa, Entamoeba histolytica
KSIKSNR

SEQ ID NO: 2567509 - protein, 9 aa, Entamoeba histolytica
KSINSFPST

SEQ ID NO: 2567510 - protein, 51 aa, Entamoeba histolytica
KSIQKKNQEIRNVTTSEKKELIKSSEHLNKTQTKEHPTKEIPKENNEIHSN

SEQ ID NO: 2567511 - protein, 6 aa, Entamoeba histolytica
KSIREE

SEQ ID NO: 2567512 - protein, 6 aa, Entamoeba histolytica
KSISEM

SEQ ID NO: 2567513 - protein, 7 aa, Entamoeba histolytica
KSITDEK

SEQ ID NO: 2567514 - protein, 8 aa, Entamoeba histolytica
KSKDENSV

SEQ ID NO: 2567515 - protein, 5 aa, Entamoeba histolytica
KSKDL

SEQ ID NO: 2567516 - protein, 8 aa, Entamoeba histolytica
KSKDNKQQ

SEQ ID NO: 2567517 - protein, 7 aa, Entamoeba histolytica
KSKDQDD

SEQ ID NO: 2567518 - protein, 21 aa, Entamoeba histolytica
KSKERKRNNRVNANRNDYGNE

SEQ ID NO: 2567519 - protein, 7 aa, Entamoeba histolytica
KSKETIH

SEQ ID NO: 2567520 - protein, 4 aa, Entamoeba histolytica
KSKF

SEQ ID NO: 2567521 - protein, 6 aa, Entamoeba histolytica
KSKGTE

SEQ ID NO: 2567522 - protein, 9 aa, Entamoeba histolytica
KSKHCSKPQ

SEQ ID NO: 2567523 - protein, 8 aa, Entamoeba histolytica
KSKKEEEE

SEQ ID NO: 2567524 - protein, 7 aa, Entamoeba histolytica
KSKLPEK

SEQ ID NO: 2567525 - protein, 14 aa, Entamoeba histolytica
KSKNGDSSSSTPKK

SEQ ID NO: 2567526 - protein, 7 aa, Entamoeba histolytica
KSKNLTS

SEQ ID NO: 2567527 - protein, 6 aa, Entamoeba histolytica
KSKNNK

SEQ ID NO: 2567528 - protein, 5 aa, Entamoeba histolytica
KSKPL

SEQ ID NO: 2567529 - protein, 8 aa, Entamoeba histolytica
KSKPQKWS

SEQ ID NO: 2567530 - protein, 13 aa, Entamoeba histolytica
KSKQENKTQTTQL

SEQ ID NO: 2567531 - protein, 7 aa, Entamoeba histolytica
KSKRKSI

SEQ ID NO: 2567532 - protein, 9 aa, Entamoeba histolytica
KSKSFESQI

SEQ ID NO: 2567533 - protein, 6 aa, Entamoeba histolytica
KSKSVA

SEQ ID NO: 2567534 - protein, 10 aa, Entamoeba histolytica
KSKSYCPTTT

SEQ ID NO: 2567535 - protein, 8 aa, Entamoeba histolytica
KSKSYDPF

SEQ ID NO: 2567536 - protein, 7 aa, Entamoeba histolytica
KSKTTKI

SEQ ID NO: 2567537 - protein, 8 aa, Entamoeba histolytica
KSKVGSET

SEQ ID NO: 2567538 - protein, 5 aa, Entamoeba histolytica
KSKVN

SEQ ID NO: 2567539 - protein, 8 aa, Entamoeba histolytica
KSKYTPQS

SEQ ID NO: 2567540 - protein, 17 aa, Entamoeba histolytica
KSKYTSIGEETYPTIIT

SEQ ID NO: 2567541 - protein, 11 aa, Entamoeba histolytica
KSLDDTNNKIN

SEQ ID NO: 2567542 - protein, 8 aa, Entamoeba histolytica
KSLDPQSD

SEQ ID NO: 2567543 - protein, 9 aa, Entamoeba histolytica
KSLDTSTQP

SEQ ID NO: 2567544 - protein, 7 aa, Entamoeba histolytica
KSLGGKT

SEQ ID NO: 2567545 - protein, 10 aa, Entamoeba histolytica
KSLNENNTEF

SEQ ID NO: 2567546 - protein, 17 aa, Entamoeba histolytica
KSLSEIGCSNPKSLKNS

SEQ ID NO: 2567547 - protein, 28 aa, Entamoeba histolytica
KSLSLPSQSTLYQNSSNPLSFQEQSSPV

SEQ ID NO: 2567548 - protein, 9 aa, Entamoeba histolytica
KSLSSTAQN

SEQ ID NO: 2567549 - protein, 9 aa, Entamoeba histolytica
KSLSTTPHG

SEQ ID NO: 2567550 - protein, 4 aa, Entamoeba histolytica
KSLT

SEQ ID NO: 2567551 - protein, 10 aa, Entamoeba histolytica
KSMEIKNDTD

SEQ ID NO: 2567552 - protein, 7 aa, Entamoeba histolytica
KSMNGSS

SEQ ID NO: 2567553 - protein, 15 aa, Entamoeba histolytica
KSMPGVQKLQKKKNK

SEQ ID NO: 2567554 - protein, 5 aa, Entamoeba histolytica
KSNCT

SEQ ID NO: 2567555 - protein, 7 aa, Entamoeba histolytica
KSNDSVT

SEQ ID NO: 2567556 - protein, 5 aa, Entamoeba histolytica
KSNEA

SEQ ID NO: 2567557 - protein, 6 aa, Entamoeba histolytica
KSNEEF

SEQ ID NO: 2567558 - protein, 7 aa, Entamoeba histolytica
KSNEGTV

SEQ ID NO: 2567559 - protein, 7 aa, Entamoeba histolytica
KSNGNEV

SEQ ID NO: 2567560 - protein, 5 aa, Entamoeba histolytica
KSNGS

SEQ ID NO: 2567561 - protein, 9 aa, Entamoeba histolytica
KSNKLKPSH

SEQ ID NO: 2567562 - protein, 6 aa, Entamoeba histolytica
KSNKTE

SEQ ID NO: 2567563 - protein, 4 aa, Entamoeba histolytica
KSNL

SEQ ID NO: 2567564 - protein, 6 aa, Entamoeba histolytica
KSNMVS

SEQ ID NO: 2567565 - protein, 8 aa, Entamoeba histolytica
KSNNDQEI

SEQ ID NO: 2567566 - protein, 18 aa, Entamoeba histolytica
KSNNKEEIAQSMNGRQAA

SEQ ID NO: 2567567 - protein, 6 aa, Entamoeba histolytica
KSNNQI

SEQ ID NO: 2567568 - protein, 8 aa, Entamoeba histolytica
KSNPPTSL

SEQ ID NO: 2567569 - protein, 8 aa, Entamoeba histolytica
KSNQTSST

SEQ ID NO: 2567570 - protein, 8 aa, Entamoeba histolytica
KSNRAEDL

SEQ ID NO: 2567571 - protein, 7 aa, Entamoeba histolytica
KSNSDAF

SEQ ID NO: 2567572 - protein, 7 aa, Entamoeba histolytica
KSNSKRL

SEQ ID NO: 2567573 - protein, 5 aa, Entamoeba histolytica
KSNSL

SEQ ID NO: 2567574 - protein, 6 aa, Entamoeba histolytica
KSNTCD

SEQ ID NO: 2567575 - protein, 6 aa, Entamoeba histolytica
KSNTDD

SEQ ID NO: 2567576 - protein, 6 aa, Entamoeba histolytica
KSNTQL

SEQ ID NO: 2567577 - protein, 7 aa, Entamoeba histolytica
KSNYDLP

SEQ ID NO: 2567578 - protein, 6 aa, Entamoeba histolytica
KSPCSS

SEQ ID NO: 2567579 - protein, 11 aa, Entamoeba histolytica
KSPDPPNAGCS

SEQ ID NO: 2567580 - protein, 5 aa, Entamoeba histolytica
KSPEI

SEQ ID NO: 2567581 - protein, 6 aa, Entamoeba histolytica
KSPFIN

SEQ ID NO: 2567582 - protein, 11 aa, Entamoeba histolytica
KSPGDKDSDSY

SEQ ID NO: 2567583 - protein, 9 aa, Entamoeba histolytica
KSPGIEKTK

SEQ ID NO: 2567584 - protein, 21 aa, Entamoeba histolytica
KSPHAQFTNSKSSNLDNSFTQ

SEQ ID NO: 2567585 - protein, 7 aa, Entamoeba histolytica
KSPHELS

SEQ ID NO: 2567586 - protein, 6 aa, Entamoeba histolytica
KSPKIR

SEQ ID NO: 2567587 - protein, 6 aa, Entamoeba histolytica
KSPNTN

SEQ ID NO: 2567588 - protein, 7 aa, Entamoeba histolytica
KSPPPDM

SEQ ID NO: 2567589 - protein, 9 aa, Entamoeba histolytica
KSPPQPSFN

SEQ ID NO: 2567590 - protein, 9 aa, Entamoeba histolytica
KSPSEEEDI

SEQ ID NO: 2567591 - protein, 8 aa, Entamoeba histolytica
KSPVGQHG

SEQ ID NO: 2567592 - protein, 13 aa, Entamoeba histolytica
KSPYPRESFPDTE

SEQ ID NO: 2567593 - protein, 7 aa, Entamoeba histolytica
KSQCTNI

SEQ ID NO: 2567594 - protein, 6 aa, Entamoeba histolytica
KSQCTQ

SEQ ID NO: 2567595 - protein, 7 aa, Entamoeba histolytica
KSQDRRE

SEQ ID NO: 2567596 - protein, 13 aa, Entamoeba histolytica
KSQEPFPLEDEEK

SEQ ID NO: 2567597 - protein, 8 aa, Entamoeba histolytica
KSQGANSI

SEQ ID NO: 2567598 - protein, 8 aa, Entamoeba histolytica
KSQQDSNK

SEQ ID NO: 2567599 - protein, 6 aa, Entamoeba histolytica
KSQQPP

SEQ ID NO: 2567600 - protein, 5 aa, Entamoeba histolytica
KSQRE

SEQ ID NO: 2567601 - protein, 12 aa, Entamoeba histolytica
KSQSDSSKTHHS

SEQ ID NO: 2567602 - protein, 6 aa, Entamoeba histolytica
KSQSPR

SEQ ID NO: 2567603 - protein, 5 aa, Entamoeba histolytica
KSQTL

SEQ ID NO: 2567604 - protein, 6 aa, Entamoeba histolytica
KSQYGT

SEQ ID NO: 2567605 - protein, 5 aa, Entamoeba histolytica
KSRNK

SEQ ID NO: 2567606 - protein, 14 aa, Entamoeba histolytica
KSRNMTQEQEKEFS

SEQ ID NO: 2567607 - protein, 12 aa, Entamoeba histolytica
KSRSDGCGTNSK

SEQ ID NO: 2567608 - protein, 9 aa, Entamoeba histolytica
KSRSSGGCG

SEQ ID NO: 2567609 - protein, 15 aa, Entamoeba histolytica
KSRSYLQKASQTEKL

SEQ ID NO: 2567610 - protein, 9 aa, Entamoeba histolytica
KSRVGSLAR

SEQ ID NO: 2567611 - protein, 13 aa, Entamoeba histolytica
KSSDYCTKTEGIG

SEQ ID NO: 2567612 - protein, 14 aa, Entamoeba histolytica
KSSENVSGVPSDSI

SEQ ID NO: 2567613 - protein, 21 aa, Entamoeba histolytica
KSSFTEDNYNKLQQSKGTIDS

SEQ ID NO: 2567614 - protein, 4 aa, Entamoeba histolytica
KSSG

SEQ ID NO: 2567615 - protein, 8 aa, Entamoeba histolytica
KSSGISKV

SEQ ID NO: 2567616 - protein, 7 aa, Entamoeba histolytica
KSSGYSL

SEQ ID NO: 2567617 - protein, 8 aa, Entamoeba histolytica
KSSINQLT

SEQ ID NO: 2567618 - protein, 7 aa, Entamoeba histolytica
KSSITSN

SEQ ID NO: 2567619 - protein, 9 aa, Entamoeba histolytica
KSSKPNVST

SEQ ID NO: 2567620 - protein, 7 aa, Entamoeba histolytica
KSSLPNS

SEQ ID NO: 2567621 - protein, 25 aa, Entamoeba histolytica
KSSMSKSEINDEINDSSVSSDMAKD

SEQ ID NO: 2567622 - protein, 4 aa, Entamoeba histolytica
KSSN

SEQ ID NO: 2567623 - protein, 8 aa, Entamoeba histolytica
KSSNGNPN

SEQ ID NO: 2567624 - protein, 5 aa, Entamoeba histolytica
KSSNN

SEQ ID NO: 2567625 - protein, 7 aa, Entamoeba histolytica
KSSNNEL

SEQ ID NO: 2567626 - protein, 14 aa, Entamoeba histolytica
KSSNQTACTSKDAY

SEQ ID NO: 2567627 - protein, 8 aa, Entamoeba histolytica
KSSPDPYN

SEQ ID NO: 2567628 - protein, 54 aa, Entamoeba histolytica
KSSPENLSINSSNSSSEEESEVSEEESEVSEEESEVSEEESEVSEEEKNPPPSV

SEQ ID NO: 2567629 - protein, 16 aa, Entamoeba histolytica
KSSPIQVHKNVLFINY

SEQ ID NO: 2567630 - protein, 12 aa, Entamoeba histolytica
KSSPQKYRGKNT

SEQ ID NO: 2567631 - protein, 5 aa, Entamoeba histolytica
KSSQN

SEQ ID NO: 2567632 - protein, 6 aa, Entamoeba histolytica
KSSRSF

SEQ ID NO: 2567633 - protein, 7 aa, Entamoeba histolytica
KSSSFKN

SEQ ID NO: 2567634 - protein, 8 aa, Entamoeba histolytica
KSSSGNAM

SEQ ID NO: 2567635 - protein, 9 aa, Entamoeba histolytica
KSSSKNQRS

SEQ ID NO: 2567636 - protein, 8 aa, Entamoeba histolytica
KSSSLNTN

SEQ ID NO: 2567637 - protein, 9 aa, Entamoeba histolytica
KSSSPIQQS

SEQ ID NO: 2567638 - protein, 5 aa, Entamoeba histolytica
KSSSS

SEQ ID NO: 2567639 - protein, 9 aa, Entamoeba histolytica
KSSSTPELC

SEQ ID NO: 2567640 - protein, 15 aa, Entamoeba histolytica
KSSTLLSKTDNTNVC

SEQ ID NO: 2567641 - protein, 8 aa, Entamoeba histolytica
KSSTSPED

SEQ ID NO: 2567642 - protein, 6 aa, Entamoeba histolytica
KSSVED

SEQ ID NO: 2567643 - protein, 12 aa, Entamoeba histolytica
KSSYKQEKIKSQ

SEQ ID NO: 2567644 - protein, 8 aa, Entamoeba histolytica
KSSYSNNV

SEQ ID NO: 2567645 - protein, 6 aa, Entamoeba histolytica
KSTAIT

SEQ ID NO: 2567646 - protein, 6 aa, Entamoeba histolytica
KSTFKQ

SEQ ID NO: 2567647 - protein, 4 aa, Entamoeba histolytica
KSTI

SEQ ID NO: 2567648 - protein, 18 aa, Entamoeba histolytica
KSTKEDFDKEEDEIDPEI

SEQ ID NO: 2567649 - protein, 7 aa, Entamoeba histolytica
KSTPDYS

SEQ ID NO: 2567650 - protein, 9 aa, Entamoeba histolytica
KSTPTDEKI

SEQ ID NO: 2567651 - protein, 9 aa, Entamoeba histolytica
KSTPTQRQE

SEQ ID NO: 2567652 - protein, 7 aa, Entamoeba histolytica
KSTQPLI

SEQ ID NO: 2567653 - protein, 7 aa, Entamoeba histolytica
KSTQPSK

SEQ ID NO: 2567654 - protein, 13 aa, Entamoeba histolytica
KSTRVELENTGYE

SEQ ID NO: 2567655 - protein, 8 aa, Entamoeba histolytica
KSTSQNNV

SEQ ID NO: 2567656 - protein, 6 aa, Entamoeba histolytica
KSTSSL

SEQ ID NO: 2567657 - protein, 7 aa, Entamoeba histolytica
KSTSTSL

SEQ ID NO: 2567658 - protein, 9 aa, Entamoeba histolytica
KSTTEGSNR

SEQ ID NO: 2567659 - protein, 12 aa, Entamoeba histolytica
KSTTFARSGVNG

SEQ ID NO: 2567660 - protein, 8 aa, Entamoeba histolytica
KSTTNKQL

SEQ ID NO: 2567661 - protein, 7 aa, Entamoeba histolytica
KSTTQGF

SEQ ID NO: 2567662 - protein, 6 aa, Entamoeba histolytica
KSTTTV

SEQ ID NO: 2567663 - protein, 7 aa, Entamoeba histolytica
KSTTVSK

SEQ ID NO: 2567664 - protein, 7 aa, Entamoeba histolytica
KSTTYLN

SEQ ID NO: 2567665 - protein, 7 aa, Entamoeba histolytica
KSVDDDP

SEQ ID NO: 2567666 - protein, 14 aa, Entamoeba histolytica
KSVEASKKWYGNGI

SEQ ID NO: 2567667 - protein, 5 aa, Entamoeba histolytica
KSVET

SEQ ID NO: 2567668 - protein, 8 aa, Entamoeba histolytica
KSVGTPAY

SEQ ID NO: 2567669 - protein, 10 aa, Entamoeba histolytica
KSVKAESTAI

SEQ ID NO: 2567670 - protein, 5 aa, Entamoeba histolytica
KSVKK

SEQ ID NO: 2567671 - protein, 5 aa, Entamoeba histolytica
KSVKR

SEQ ID NO: 2567672 - protein, 5 aa, Entamoeba histolytica
KSVKT

SEQ ID NO: 2567673 - protein, 8 aa, Entamoeba histolytica
KSVPNNQF

SEQ ID NO: 2567674 - protein, 6 aa, Entamoeba histolytica
KSVSPS

SEQ ID NO: 2567675 - protein, 16 aa, Entamoeba histolytica
KSVSQTTDKIANTNEE

SEQ ID NO: 2567676 - protein, 4 aa, Entamoeba histolytica
KSVV

SEQ ID NO: 2567677 - protein, 4 aa, Entamoeba histolytica
KSYL

SEQ ID NO: 2567678 - protein, 7 aa, Entamoeba histolytica
KTAEEAK

SEQ ID NO: 2567679 - protein, 13 aa, Entamoeba histolytica
KTAGEAKWTTESR

SEQ ID NO: 2567680 - protein, 11 aa, Entamoeba histolytica
KTAIPRRNYKS

SEQ ID NO: 2567681 - protein, 14 aa, Entamoeba histolytica
KTAKDESKAIKPYH

SEQ ID NO: 2567682 - protein, 10 aa, Entamoeba histolytica
KTANRTECEN

SEQ ID NO: 2567683 - protein, 6 aa, Entamoeba histolytica
KTAQGE

SEQ ID NO: 2567684 - protein, 8 aa, Entamoeba histolytica
KTAQRRLE

SEQ ID NO: 2567685 - protein, 7 aa, Entamoeba histolytica
KTASHDR

SEQ ID NO: 2567686 - protein, 7 aa, Entamoeba histolytica
KTCEDYA

SEQ ID NO: 2567687 - protein, 16 aa, Entamoeba histolytica
KTCEEGKIKDQNGKCN

SEQ ID NO: 2567688 - protein, 22 aa, Entamoeba histolytica
KTCEEGKIKDQNGKCNSNISNC

SEQ ID NO: 2567689 - protein, 28 aa, Entamoeba histolytica
KTCEEGKIKDQNGKCNSNISNCSNESYV

SEQ ID NO: 2567690 - protein, 14 aa, Entamoeba histolytica
KTCEQREKYVNPKT

SEQ ID NO: 2567691 - protein, 59 aa, Entamoeba histolytica
KTCPPPPPPPCRGKDCEGPHHPDCDGDDCPKPEPTPDPTPDPDVPVPQECNATANFSRI

SEQ ID NO: 2567692 - protein, 7 aa, Entamoeba histolytica
KTCQGAG

SEQ ID NO: 2567693 - protein, 8 aa, Entamoeba histolytica
KTCQQRRS

SEQ ID NO: 2567694 - protein, 7 aa, Entamoeba histolytica
KTCQSCS

SEQ ID NO: 2567695 - protein, 8 aa, Entamoeba histolytica
KTDETDET

SEQ ID NO: 2567696 - protein, 4 aa, Entamoeba histolytica
KTDF

SEQ ID NO: 2567697 - protein, 5 aa, Entamoeba histolytica
KTDKK

SEQ ID NO: 2567698 - protein, 5 aa, Entamoeba histolytica
KTDNN

SEQ ID NO: 2567699 - protein, 27 aa, Entamoeba histolytica
KTDNSKDKEDGSKGKSVERKKKQVKGL

SEQ ID NO: 2567700 - protein, 5 aa, Entamoeba histolytica
KTDPA

SEQ ID NO: 2567701 - protein, 10 aa, Entamoeba histolytica
KTDSETTENI

SEQ ID NO: 2567702 - protein, 8 aa, Entamoeba histolytica
KTDVPKET

SEQ ID NO: 2567703 - protein, 8 aa, Entamoeba histolytica
KTEDMTPN

SEQ ID NO: 2567704 - protein, 14 aa, Entamoeba histolytica
KTEEAISEFEEETK

SEQ ID NO: 2567705 - protein, 7 aa, Entamoeba histolytica
KTEEGIS

SEQ ID NO: 2567706 - protein, 11 aa, Entamoeba histolytica
KTEEKERNTTP

SEQ ID NO: 2567707 - protein, 13 aa, Entamoeba histolytica
KTEEKNPSAVASK

SEQ ID NO: 2567708 - protein, 10 aa, Entamoeba histolytica
KTEEQPNKSV

SEQ ID NO: 2567709 - protein, 4 aa, Entamoeba histolytica
KTEH

SEQ ID NO: 2567710 - protein, 8 aa, Entamoeba histolytica
KTEKECDS

SEQ ID NO: 2567711 - protein, 8 aa, Entamoeba histolytica
KTEKGQNY

SEQ ID NO: 2567712 - protein, 5 aa, Entamoeba histolytica
KTEKK

SEQ ID NO: 2567713 - protein, 9 aa, Entamoeba histolytica
KTEKPTRVN

SEQ ID NO: 2567714 - protein, 13 aa, Entamoeba histolytica
KTENDNQNKELQE

SEQ ID NO: 2567715 - protein, 9 aa, Entamoeba histolytica
KTENTTESQ

SEQ ID NO: 2567716 - protein, 8 aa, Entamoeba histolytica
KTEPSSSY

SEQ ID NO: 2567717 - protein, 7 aa, Entamoeba histolytica
KTEQGEY

SEQ ID NO: 2567718 - protein, 7 aa, Entamoeba histolytica
KTERTNI

SEQ ID NO: 2567719 - protein, 8 aa, Entamoeba histolytica
KTESSTEL

SEQ ID NO: 2567720 - protein, 15 aa, Entamoeba histolytica
KTETEMTTKIDPDEL

SEQ ID NO: 2567721 - protein, 6 aa, Entamoeba histolytica
KTEVDS

SEQ ID NO: 2567722 - protein, 15 aa, Entamoeba histolytica
KTEVSGAWDEAVPST

SEQ ID NO: 2567723 - protein, 6 aa, Entamoeba histolytica
KTEWNE

SEQ ID NO: 2567724 - protein, 10 aa, Entamoeba histolytica
KTEYQDPNES

SEQ ID NO: 2567725 - protein, 17 aa, Entamoeba histolytica
KTFGGDEKGIDLAKTDS

SEQ ID NO: 2567726 - protein, 4 aa, Entamoeba histolytica
KTFP

SEQ ID NO: 2567727 - protein, 10 aa, Entamoeba histolytica
KTGDLEKDTD

SEQ ID NO: 2567728 - protein, 17 aa, Entamoeba histolytica
KTGESSSKKVFKTSENK

SEQ ID NO: 2567729 - protein, 7 aa, Entamoeba histolytica
KTGGLTR

SEQ ID NO: 2567730 - protein, 6 aa, Entamoeba histolytica
KTGIQN

SEQ ID NO: 2567731 - protein, 6 aa, Entamoeba histolytica
KTGKNQ

SEQ ID NO: 2567732 - protein, 5 aa, Entamoeba histolytica
KTGLQ

SEQ ID NO: 2567733 - protein, 9 aa, Entamoeba histolytica
KTGNNEYIQ

SEQ ID NO: 2567734 - protein, 9 aa, Entamoeba histolytica
KTGSHSQYY

SEQ ID NO: 2567735 - protein, 6 aa, Entamoeba histolytica
KTGTEV

SEQ ID NO: 2567736 - protein, 5 aa, Entamoeba histolytica
KTGTF

SEQ ID NO: 2567737 - protein, 6 aa, Entamoeba histolytica
KTGTLT

SEQ ID NO: 2567738 - protein, 8 aa, Entamoeba histolytica
KTGTLTKN

SEQ ID NO: 2567739 - protein, 9 aa, Entamoeba histolytica
KTGTLTKNE

SEQ ID NO: 2567740 - protein, 10 aa, Entamoeba histolytica
KTGTLTSDEV

SEQ ID NO: 2567741 - protein, 7 aa, Entamoeba histolytica
KTHPQVN

SEQ ID NO: 2567742 - protein, 7 aa, Entamoeba histolytica
KTHQNGL

SEQ ID NO: 2567743 - protein, 7 aa, Entamoeba histolytica
KTHSSIP

SEQ ID NO: 2567744 - protein, 39 aa, Entamoeba histolytica
KTIEYTKKGANKVKETGAKIKDKAIEYTKKGAQKAKETI

SEQ ID NO: 2567745 - protein, 6 aa, Entamoeba histolytica
KTIGLS

SEQ ID NO: 2567746 - protein, 14 aa, Entamoeba histolytica
KTIGSGEGDSPTYY

SEQ ID NO: 2567747 - protein, 5 aa, Entamoeba histolytica
KTIKE

SEQ ID NO: 2567748 - protein, 8 aa, Entamoeba histolytica
KTINGEDP

SEQ ID NO: 2567749 - protein, 5 aa, Entamoeba histolytica
KTIRN

SEQ ID NO: 2567750 - protein, 13 aa, Entamoeba histolytica
KTISTETQSISGT

SEQ ID NO: 2567751 - protein, 6 aa, Entamoeba histolytica
KTISYG

SEQ ID NO: 2567752 - protein, 4 aa, Entamoeba histolytica
KTIT

SEQ ID NO: 2567753 - protein, 4 aa, Entamoeba histolytica
KTIY

SEQ ID NO: 2567754 - protein, 11 aa, Entamoeba histolytica
KTKCNPKNKRL

SEQ ID NO: 2567755 - protein, 21 aa, Entamoeba histolytica
KTKCNPKNKRLVKRDEKCDEE

SEQ ID NO: 2567756 - protein, 40 aa, Entamoeba histolytica
KTKCNPKNKRLVKRDEKCDEEINKKHGHGGYECGDNGEWS

SEQ ID NO: 2567757 - protein, 21 aa, Entamoeba histolytica
KTKCNPKNKRLVKRDSRCDKE

SEQ ID NO: 2567758 - protein, 23 aa, Entamoeba histolytica
KTKDDKLKKETKEQGSGYTMFHD

SEQ ID NO: 2567759 - protein, 7 aa, Entamoeba histolytica
KTKDSID

SEQ ID NO: 2567760 - protein, 4 aa, Entamoeba histolytica
KTKE

SEQ ID NO: 2567761 - protein, 19 aa, Entamoeba histolytica
KTKEDKYQPPLEEDIPQPK

SEQ ID NO: 2567762 - protein, 31 aa, Entamoeba histolytica; identical to SEQ ID NO: 2368743

SEQ ID NO: 2567763 - protein, 27 aa, Entamoeba histolytica
KTKEETEKKFNKEIEELKQTNREISKK

SEQ ID NO: 2567764 - protein, 8 aa, Entamoeba histolytica
KTKEHDGY

SEQ ID NO: 2567765 - protein, 19 aa, Entamoeba histolytica
KTKEIDSDIDDLKNEYGNL

SEQ ID NO: 2567766 - protein, 7 aa, Entamoeba histolytica
KTKENVK

SEQ ID NO: 2567767 - protein, 4 aa, Entamoeba histolytica
KTKI

SEQ ID NO: 2567768 - protein, 6 aa, Entamoeba histolytica
KTKIVN

SEQ ID NO: 2567769 - protein, 8 aa, Entamoeba histolytica
KTKKPESL

SEQ ID NO: 2567770 - protein, 4 aa, Entamoeba histolytica
KTKL

SEQ ID NO: 2567771 - protein, 7 aa, Entamoeba histolytica
KTKLPQA

SEQ ID NO: 2567772 - protein, 5 aa, Entamoeba histolytica
KTKNG

SEQ ID NO: 2567773 - protein, 12 aa, Entamoeba histolytica
KTKPNHNLTESD

SEQ ID NO: 2567774 - protein, 5 aa, Entamoeba histolytica
KTKRI

SEQ ID NO: 2567775 - protein, 6 aa, Entamoeba histolytica
KTKSEI

SEQ ID NO: 2567776 - protein, 5 aa, Entamoeba histolytica
KTKTK

SEQ ID NO: 2567777 - protein, 8 aa, Entamoeba histolytica
KTKTKYSI

SEQ ID NO: 2567778 - protein, 9 aa, Entamoeba histolytica
KTKTPFSGP

SEQ ID NO: 2567779 - protein, 8 aa, Entamoeba histolytica
KTKTPNGC

SEQ ID NO: 2567780 - protein, 9 aa, Entamoeba histolytica
KTKVSNPIR

SEQ ID NO: 2567781 - protein, 10 aa, Entamoeba histolytica
KTKYIRDGTT

SEQ ID NO: 2567782 - protein, 6 aa, Entamoeba histolytica
KTLGGY

SEQ ID NO: 2567783 - protein, 16 aa, Entamoeba histolytica
KTLKKGWSKMDEEEIP

SEQ ID NO: 2567784 - protein, 5 aa, Entamoeba histolytica
KTLND

SEQ ID NO: 2567785 - protein, 12 aa, Entamoeba histolytica
KTLNKSSKRYKR

SEQ ID NO: 2567786 - protein, 7 aa, Entamoeba histolytica
KTLPEEY

SEQ ID NO: 2567787 - protein, 6 aa, Entamoeba histolytica
KTLPGS

SEQ ID NO: 2567788 - protein, 8 aa, Entamoeba histolytica
KTLQPSDH

SEQ ID NO: 2567789 - protein, 7 aa, Entamoeba histolytica
KTLTGVE

SEQ ID NO: 2567790 - protein, 8 aa, Entamoeba histolytica
KTLYSPDE

SEQ ID NO: 2567791 - protein, 5 aa, Entamoeba histolytica
KTMEE

SEQ ID NO: 2567792 - protein, 9 aa, Entamoeba histolytica
KTMSSLRKS

SEQ ID NO: 2567793 - protein, 7 aa, Entamoeba histolytica
KTNAEYQ

SEQ ID NO: 2567794 - protein, 5 aa, Entamoeba histolytica
KTNAG

SEQ ID NO: 2567795 - protein, 7 aa, Entamoeba histolytica
KTNDDFT

SEQ ID NO: 2567796 - protein, 8 aa, Entamoeba histolytica
KTNDEDTL

SEQ ID NO: 2567797 - protein, 8 aa, Entamoeba histolytica
KTNDIDEM

SEQ ID NO: 2567798 - protein, 10 aa, Entamoeba histolytica
KTNEDLQQKL

SEQ ID NO: 2567799 - protein, 9 aa, Entamoeba histolytica
KTNEEKEEA

SEQ ID NO: 2567800 - protein, 8 aa, Entamoeba histolytica
KTNEIRNT

SEQ ID NO: 2567801 - protein, 22 aa, Entamoeba histolytica
KTNEKGLVNKENKVDEKKEELL

SEQ ID NO: 2567802 - protein, 6 aa, Entamoeba histolytica
KTNEYP

SEQ ID NO: 2567803 - protein, 16 aa, Entamoeba histolytica
KTNFDESADIHDVTKD

SEQ ID NO: 2567804 - protein, 5 aa, Entamoeba histolytica
KTNGA

SEQ ID NO: 2567805 - protein, 8 aa, Entamoeba histolytica
KTNKTIAP

SEQ ID NO: 2567806 - protein, 4 aa, Entamoeba histolytica
KTNL

SEQ ID NO: 2567807 - protein, 8 aa, Entamoeba histolytica
KTNNGMKK

SEQ ID NO: 2567808 - protein, 9 aa, Entamoeba histolytica
KTNNKSLKE

SEQ ID NO: 2567809 - protein, 9 aa, Entamoeba histolytica
KTNPRKEEL

SEQ ID NO: 2567810 - protein, 5 aa, Entamoeba histolytica
KTNPT

SEQ ID NO: 2567811 - protein, 6 aa, Entamoeba histolytica
KTNPTF

SEQ ID NO: 2567812 - protein, 9 aa, Entamoeba histolytica
KTNQDSEMC

SEQ ID NO: 2567813 - protein, 7 aa, Entamoeba histolytica
KTNQKSI

SEQ ID NO: 2567814 - protein, 9 aa, Entamoeba histolytica
KTNQQEMEQ

SEQ ID NO: 2567815 - protein, 5 aa, Entamoeba histolytica
KTNQS

SEQ ID NO: 2567816 - protein, 5 aa, Entamoeba histolytica
KTNSQ

SEQ ID NO: 2567817 - protein, 5 aa, Entamoeba histolytica
KTNTL

SEQ ID NO: 2567818 - protein, 7 aa, Entamoeba histolytica
KTPCGSG

SEQ ID NO: 2567819 - protein, 6 aa, Entamoeba histolytica
KTPDNS

SEQ ID NO: 2567820 - protein, 7 aa, Entamoeba histolytica
KTPEEIE

SEQ ID NO: 2567821 - protein, 6 aa, Entamoeba histolytica
KTPEEN

SEQ ID NO: 2567822 - protein, 5 aa, Entamoeba histolytica
KTPGI

SEQ ID NO: 2567823 - protein, 7 aa, Entamoeba histolytica
KTPIAQR

SEQ ID NO: 2567824 - protein, 8 aa, Entamoeba histolytica
KTPKGETK

SEQ ID NO: 2567825 - protein, 17 aa, Entamoeba histolytica
KTPKKRHNKKKEDRLQE

SEQ ID NO: 2567826 - protein, 4 aa, Entamoeba histolytica
KTPL

SEQ ID NO: 2567827 - protein, 6 aa, Entamoeba histolytica
KTPMDE

SEQ ID NO: 2567828 - protein, 7 aa, Entamoeba histolytica
KTPSKRG

SEQ ID NO: 2567829 - protein, 7 aa, Entamoeba histolytica
KTQASYM

SEQ ID NO: 2567830 - protein, 11 aa, Entamoeba histolytica
KTQCSGTNSTI

SEQ ID NO: 2567831 - protein, 9 aa, Entamoeba histolytica
KTQEKSELT

SEQ ID NO: 2567832 - protein, 8 aa, Entamoeba histolytica
KTQGRQTY

SEQ ID NO: 2567833 - protein, 6 aa, Entamoeba histolytica
KTQKAA

SEQ ID NO: 2567834 - protein, 5 aa, Entamoeba histolytica
KTQND

SEQ ID NO: 2567835 - protein, 5 aa, Entamoeba histolytica
KTQNR

SEQ ID NO: 2567836 - protein, 5 aa, Entamoeba histolytica
KTQPA

SEQ ID NO: 2567837 - protein, 10 aa, Entamoeba histolytica
KTQQDNATRA

SEQ ID NO: 2567838 - protein, 9 aa, Entamoeba histolytica
KTQREKDIK

SEQ ID NO: 2567839 - protein, 10 aa, Entamoeba histolytica
KTQSKVSGTG

SEQ ID NO: 2567840 - protein, 6 aa, Entamoeba histolytica
KTQTGI

SEQ ID NO: 2567841 - protein, 8 aa, Entamoeba histolytica
KTQTQQEN

SEQ ID NO: 2567842 - protein, 6 aa, Entamoeba histolytica
KTREMG

SEQ ID NO: 2567843 - protein, 5 aa, Entamoeba histolytica
KTRII

SEQ ID NO: 2567844 - protein, 6 aa, Entamoeba histolytica
KTRLQN

SEQ ID NO: 2567845 - protein, 9 aa, Entamoeba histolytica
KTRNGAQMK

SEQ ID NO: 2567846 - protein, 5 aa, Entamoeba histolytica
KTRSV

SEQ ID NO: 2567847 - protein, 5 aa, Entamoeba histolytica
KTRTN

SEQ ID NO: 2567848 - protein, 8 aa, Entamoeba histolytica
KTSCNNAE

SEQ ID NO: 2567849 - protein, 6 aa, Entamoeba histolytica
KTSDYT

SEQ ID NO: 2567850 - protein, 8 aa, Entamoeba histolytica
KTSGHSAN

SEQ ID NO: 2567851 - protein, 8 aa, Entamoeba histolytica
KTSGIPPS

SEQ ID NO: 2567852 - protein, 7 aa, Entamoeba histolytica
KTSKDEY

SEQ ID NO: 2567853 - protein, 7 aa, Entamoeba histolytica
KTSKEVV

SEQ ID NO: 2567854 - protein, 9 aa, Entamoeba histolytica
KTSLTSSNL

SEQ ID NO: 2567855 - protein, 6 aa, Entamoeba histolytica
KTSNCL

SEQ ID NO: 2567856 - protein, 8 aa, Entamoeba histolytica
KTSNKSEL

SEQ ID NO: 2567857 - protein, 8 aa, Entamoeba histolytica
KTSNSINR

SEQ ID NO: 2567858 - protein, 10 aa, Entamoeba histolytica
KTSSKYYAPE

SEQ ID NO: 2567859 - protein, 7 aa, Entamoeba histolytica
KTSSSSG

SEQ ID NO: 2567860 - protein, 7 aa, Entamoeba histolytica
KTSSSTQ

SEQ ID NO: 2567861 - protein, 6 aa, Entamoeba histolytica
KTSTLR

SEQ ID NO: 2567862 - protein, 8 aa, Entamoeba histolytica
KTSTQPAS

SEQ ID NO: 2567863 - protein, 5 aa, Entamoeba histolytica
KTSYQ

SEQ ID NO: 2567864 - protein, 7 aa, Entamoeba histolytica
KTTEKEN

SEQ ID NO: 2567865 - protein, 10 aa, Entamoeba histolytica
KTTEKENSDI

SEQ ID NO: 2567866 - protein, 10 aa, Entamoeba histolytica
KTTEKENTDI

SEQ ID NO: 2567867 - protein, 9 aa, Entamoeba histolytica
KTTETGNPT

SEQ ID NO: 2567868 - protein, 5 aa, Entamoeba histolytica
KTTIQ

SEQ ID NO: 2567869 - protein, 5 aa, Entamoeba histolytica
KTTKI

SEQ ID NO: 2567870 - protein, 7 aa, Entamoeba histolytica
KTTNNDY

SEQ ID NO: 2567871 - protein, 7 aa, Entamoeba histolytica
KTTNTSL

SEQ ID NO: 2567872 - protein, 6 aa, Entamoeba histolytica
KTTQVS

SEQ ID NO: 2567873 - protein, 8 aa, Entamoeba histolytica
KTTRGTTR

SEQ ID NO: 2567874 - protein, 6 aa, Entamoeba histolytica
KTTSEI

SEQ ID NO: 2567875 - protein, 8 aa, Entamoeba histolytica
KTTSSSTL

SEQ ID NO: 2567876 - protein, 6 aa, Entamoeba histolytica
KTVDKT

SEQ ID NO: 2567877 - protein, 6 aa, Entamoeba histolytica
KTVGSK

SEQ ID NO: 2567878 - protein, 10 aa, Entamoeba histolytica
KTVKEKKERK

SEQ ID NO: 2567879 - protein, 6 aa, Entamoeba histolytica
KTVSEA

SEQ ID NO: 2567880 - protein, 8 aa, Entamoeba histolytica
KTVTVTKD

SEQ ID NO: 2567881 - protein, 6 aa, Entamoeba histolytica
KTYLSN

SEQ ID NO: 2567882 - protein, 5 aa, Entamoeba histolytica
KTYNG

SEQ ID NO: 2567883 - protein, 8 aa, Entamoeba histolytica
KTYQSTYR

SEQ ID NO: 2567884 - protein, 7 aa, Entamoeba histolytica
KTYSGSN

SEQ ID NO: 2567885 - protein, 5 aa, Entamoeba histolytica
KTYTG

SEQ ID NO: 2567886 - protein, 4 aa, Entamoeba histolytica
KVAA

SEQ ID NO: 2567887 - protein, 6 aa, Entamoeba histolytica
KVAPDD

SEQ ID NO: 2567888 - protein, 7 aa, Entamoeba histolytica
KVAPTMS

SEQ ID NO: 2567889 - protein, 6 aa, Entamoeba histolytica
KVCKKD

SEQ ID NO: 2567890 - protein, 7 aa, Entamoeba histolytica
KVDDGTV

SEQ ID NO: 2567891 - protein, 15 aa, Entamoeba histolytica
KVDHTDSRIVSTRKK

SEQ ID NO: 2567892 - protein, 24 aa, Entamoeba histolytica
KVDNRTSHKSKSTCTFNEQTRNAT

SEQ ID NO: 2567893 - protein, 8 aa, Entamoeba histolytica
KVDNSPKL

SEQ ID NO: 2567894 - protein, 6 aa, Entamoeba histolytica
KVDQLT

SEQ ID NO: 2567895 - protein, 8 aa, Entamoeba histolytica
KVEAPETH

SEQ ID NO: 2567896 - protein, 6 aa, Entamoeba histolytica
KVEGNQ

SEQ ID NO: 2567897 - protein, 21 aa, Entamoeba histolytica
KVEGTDQKVQDVKTKRINKKG

SEQ ID NO: 2567898 - protein, 10 aa, Entamoeba histolytica
KVEKEEIERR

SEQ ID NO: 2567899 - protein, 5 aa, Entamoeba histolytica
KVENA

SEQ ID NO: 2567900 - protein, 11 aa, Entamoeba histolytica
KVEPRKITEQT

SEQ ID NO: 2567901 - protein, 10 aa, Entamoeba histolytica
KVESTETNNG

SEQ ID NO: 2567902 - protein, 5 aa, Entamoeba histolytica
KVETA

SEQ ID NO: 2567903 - protein, 6 aa, Entamoeba histolytica
KVETAI

SEQ ID NO: 2567904 - protein, 6 aa, Entamoeba histolytica
KVETAT

SEQ ID NO: 2567905 - protein, 4 aa, Entamoeba histolytica
KVGK

SEQ ID NO: 2567906 - protein, 8 aa, Entamoeba histolytica
KVGKTHNY

SEQ ID NO: 2567907 - protein, 6 aa, Entamoeba histolytica
KVKEEV

SEQ ID NO: 2567908 - protein, 16 aa, Entamoeba histolytica
KVKEKGFKNDEDKKKS

SEQ ID NO: 2567909 - protein, 5 aa, Entamoeba histolytica
KVKEN

SEQ ID NO: 2567910 - protein, 12 aa, Entamoeba histolytica
KVKENDSYTSIT

SEQ ID NO: 2567911 - protein, 7 aa, Entamoeba histolytica
KVKETVK

SEQ ID NO: 2567912 - protein, 7 aa, Entamoeba histolytica
KVKPPKV

SEQ ID NO: 2567913 - protein, 5 aa, Entamoeba histolytica
KVKQG

SEQ ID NO: 2567914 - protein, 12 aa, Entamoeba histolytica
KVKTGAKEPEFQ

SEQ ID NO: 2567915 - protein, 6 aa, Entamoeba histolytica
KVKTSK

SEQ ID NO: 2567916 - protein, 29 aa, Entamoeba histolytica
KVNGDDSGSSMSSSSSSELSNSTGSSPRR

SEQ ID NO: 2567917 - protein, 6 aa, Entamoeba histolytica
KVNGEH

SEQ ID NO: 2567918 - protein, 14 aa, Entamoeba histolytica
KVNKEIKSSKDKRE

SEQ ID NO: 2567919 - protein, 8 aa, Entamoeba histolytica
KVNPDRRF

SEQ ID NO: 2567920 - protein, 7 aa, Entamoeba histolytica
KVNPESK

SEQ ID NO: 2567921 - protein, 7 aa, Entamoeba histolytica
KVNQETK

SEQ ID NO: 2567922 - protein, 7 aa, Entamoeba histolytica
KVPASKP

SEQ ID NO: 2567923 - protein, 9 aa, Entamoeba histolytica
KVPCPSSLG

SEQ ID NO: 2567924 - protein, 8 aa, Entamoeba histolytica
KVPEKCDG

SEQ ID NO: 2567925 - protein, 4 aa, Entamoeba histolytica
KVPG

SEQ ID NO: 2567926 - protein, 4 aa, Entamoeba histolytica
KVPI

SEQ ID NO: 2567927 - protein, 5 aa, Entamoeba histolytica
KVPNS

SEQ ID NO: 2567928 - protein, 4 aa, Entamoeba histolytica
KVPS

SEQ ID NO: 2567929 - protein, 6 aa, Entamoeba histolytica
KVPVQS

SEQ ID NO: 2567930 - protein, 7 aa, Entamoeba histolytica
KVPYSDE

SEQ ID NO: 2567931 - protein, 12 aa, Entamoeba histolytica
KVQCGNEPGAIT

SEQ ID NO: 2567932 - protein, 7 aa, Entamoeba histolytica
KVQQGNN

SEQ ID NO: 2567933 - protein, 10 aa, Entamoeba histolytica
KVQYSTKTGI

SEQ ID NO: 2567934 - protein, 6 aa, Entamoeba histolytica
KVRGYG

SEQ ID NO: 2567935 - protein, 6 aa, Entamoeba histolytica
KVSGSA

SEQ ID NO: 2567936 - protein, 14 aa, Entamoeba histolytica
KVSGSSVTLPNQPI

SEQ ID NO: 2567937 - protein, 18 aa, Entamoeba histolytica
KVSKKKELTDEELFAIEF

SEQ ID NO: 2567938 - protein, 5 aa, Entamoeba histolytica
KVSNF

SEQ ID NO: 2567939 - protein, 6 aa, Entamoeba histolytica
KVSQPS

SEQ ID NO: 2567940 - protein, 11 aa, Entamoeba histolytica
KVSQPSSENWD

SEQ ID NO: 2567941 - protein, 8 aa, Entamoeba histolytica
KVSSGNVS

SEQ ID NO: 2567942 - protein, 11 aa, Entamoeba histolytica
KVSSSSQQLNE

SEQ ID NO: 2567943 - protein, 21 aa, Entamoeba histolytica
KVTEIGKISSELNKKIDKTMP

SEQ ID NO: 2567944 - protein, 9 aa, Entamoeba histolytica
KVTETTSGS

SEQ ID NO: 2567945 - protein, 9 aa, Entamoeba histolytica
KVTGKEGNC

SEQ ID NO: 2567946 - protein, 13 aa, Entamoeba histolytica
KVTKTEKESIESN

SEQ ID NO: 2567947 - protein, 15 aa, Entamoeba histolytica
KVTMKEGVDEVKAQA

SEQ ID NO: 2567948 - protein, 8 aa, Entamoeba histolytica
KVTQPSVD

SEQ ID NO: 2567949 - protein, 8 aa, Entamoeba histolytica
KVTSENEH

SEQ ID NO: 2567950 - protein, 6 aa, Entamoeba histolytica
KVVNSK

SEQ ID NO: 2567951 - protein, 7 aa, Entamoeba histolytica
KWGEYDD

SEQ ID NO: 2567952 - protein, 12 aa, Entamoeba histolytica
KWNNKKVRKERV

SEQ ID NO: 2567953 - protein, 8 aa, Entamoeba histolytica
KWPKQNGY

SEQ ID NO: 2567954 - protein, 11 aa, Entamoeba histolytica
KWSNRRDGAAE

SEQ ID NO: 2567955 - protein, 8 aa, Entamoeba histolytica
KYAPQVTR

SEQ ID NO: 2567956 - protein, 5 aa, Entamoeba histolytica
KYDDS

SEQ ID NO: 2567957 - protein, 7 aa, Entamoeba histolytica
KYDEGDI

SEQ ID NO: 2567958 - protein, 4 aa, Entamoeba histolytica
KYDG

SEQ ID NO: 2567959 - protein, 10 aa, Entamoeba histolytica
KYDGKTDTLI

SEQ ID NO: 2567960 - protein, 5 aa, Entamoeba histolytica
KYDGN

SEQ ID NO: 2567961 - protein, 13 aa, Entamoeba histolytica
KYDGQKPRGCEPS

SEQ ID NO: 2567962 - protein, 10 aa, Entamoeba histolytica
KYDKELETQR

SEQ ID NO: 2567963 - protein, 9 aa, Entamoeba histolytica
KYDKSPNSV

SEQ ID NO: 2567964 - protein, 4 aa, Entamoeba histolytica
KYDL

SEQ ID NO: 2567965 - protein, 8 aa, Entamoeba histolytica
KYDNSDCK

SEQ ID NO: 2567966 - protein, 5 aa, Entamoeba histolytica
KYDPI

SEQ ID NO: 2567967 - protein, 6 aa, Entamoeba histolytica
KYDTET

SEQ ID NO: 2567968 - protein, 5 aa, Entamoeba histolytica
KYDTL

SEQ ID NO: 2567969 - protein, 20 aa, Entamoeba histolytica
KYEASMKEKWEKESQSKRPS

SEQ ID NO: 2567970 - protein, 6 aa, Entamoeba histolytica
KYEHQE

SEQ ID NO: 2567971 - protein, 4 aa, Entamoeba histolytica
KYEK

SEQ ID NO: 2567972 - protein, 5 aa, Entamoeba histolytica
KYENE

SEQ ID NO: 2567973 - protein, 8 aa, Entamoeba histolytica
KYEPENKG

SEQ ID NO: 2567974 - protein, 5 aa, Entamoeba histolytica
KYFDG

SEQ ID NO: 2567975 - protein, 12 aa, Entamoeba histolytica
KYGDNFTATTIQ

SEQ ID NO: 2567976 - protein, 6 aa, Entamoeba histolytica
KYGEKS

SEQ ID NO: 2567977 - protein, 17 aa, Entamoeba histolytica
KYGNDLTAQAESGKMDP

SEQ ID NO: 2567978 - protein, 12 aa, Entamoeba histolytica
KYGSEEELKRNP

SEQ ID NO: 2567979 - protein, 5 aa, Entamoeba histolytica
KYGSI

SEQ ID NO: 2567980 - protein, 6 aa, Entamoeba histolytica
KYGSSG

SEQ ID NO: 2567981 - protein, 5 aa, Entamoeba histolytica
KYGSV

SEQ ID NO: 2567982 - protein, 5 aa, Entamoeba histolytica
KYGTP

SEQ ID NO: 2567983 - protein, 7 aa, Entamoeba histolytica
KYGTPES

SEQ ID NO: 2567984 - protein, 9 aa, Entamoeba histolytica
KYGTSSTQG

SEQ ID NO: 2567985 - protein, 7 aa, Entamoeba histolytica
KYHKQDN

SEQ ID NO: 2567986 - protein, 5 aa, Entamoeba histolytica
KYIKD

SEQ ID NO: 2567987 - protein, 10 aa, Entamoeba histolytica
KYIPESKAGI

SEQ ID NO: 2567988 - protein, 5 aa, Entamoeba histolytica
KYISS

SEQ ID NO: 2567989 - protein, 4 aa, Entamoeba histolytica
KYKE

SEQ ID NO: 2567990 - protein, 6 aa, Entamoeba histolytica
KYKEKI

SEQ ID NO: 2567991 - protein, 5 aa, Entamoeba histolytica
KYKEL

SEQ ID NO: 2567992 - protein, 9 aa, Entamoeba histolytica
KYKGKSNWN

SEQ ID NO: 2567993 - protein, 7 aa, Entamoeba histolytica
KYKGTFP

SEQ ID NO: 2567994 - protein, 9 aa, Entamoeba histolytica
KYKKEGKKY

SEQ ID NO: 2567995 - protein, 7 aa, Entamoeba histolytica
KYKKMSE

SEQ ID NO: 2567996 - protein, 8 aa, Entamoeba histolytica
KYKKRYQK

SEQ ID NO: 2567997 - protein, 5 aa, Entamoeba histolytica
KYKMP

SEQ ID NO: 2567998 - protein, 5 aa, Entamoeba histolytica
KYKMS

SEQ ID NO: 2567999 - protein, 4 aa, Entamoeba histolytica
KYKN

SEQ ID NO: 2568000 - protein, 23 aa, Entamoeba histolytica
KYKNTSKYSETKGIEKEKEVLSK

SEQ ID NO: 2568001 - protein, 8 aa, Entamoeba histolytica
KYKQPEKC

SEQ ID NO: 2568002 - protein, 10 aa, Entamoeba histolytica
KYKRNKEYDD

SEQ ID NO: 2568003 - protein, 12 aa, Entamoeba histolytica
KYKTNKCTTCSS

SEQ ID NO: 2568004 - protein, 9 aa, Entamoeba histolytica
KYKTSNGPI

SEQ ID NO: 2568005 - protein, 9 aa, Entamoeba histolytica
KYLNDDKTR

SEQ ID NO: 2568006 - protein, 7 aa, Entamoeba histolytica
KYLNPTT

SEQ ID NO: 2568007 - protein, 12 aa, Entamoeba histolytica
KYNDTWNEDNAR

SEQ ID NO: 2568008 - protein, 4 aa, Entamoeba histolytica
KYNE

SEQ ID NO: 2568009 - protein, 5 aa, Entamoeba histolytica
KYNEK

SEQ ID NO: 2568010 - protein, 6 aa, Entamoeba histolytica
KYNETT

SEQ ID NO: 2568011 - protein, 30 aa, Entamoeba histolytica
KYNGQECRTEKINVGNNKYTTDKDKDIQAV

SEQ ID NO: 2568012 - protein, 31 aa, Entamoeba histolytica
KYNGQECRTEKINVGNNKYTTDKDKDIQEVQ

SEQ ID NO: 2568013 - protein, 5 aa, Entamoeba histolytica
KYNNL

SEQ ID NO: 2568014 - protein, 5 aa, Entamoeba histolytica
KYNNS

SEQ ID NO: 2568015 - protein, 4 aa, Entamoeba histolytica
KYNP

SEQ ID NO: 2568016 - protein, 5 aa, Entamoeba histolytica
KYNQE

SEQ ID NO: 2568017 - protein, 10 aa, Entamoeba histolytica
KYNQSPLPRE

SEQ ID NO: 2568018 - protein, 19 aa, Entamoeba histolytica
KYNSPSSHIENKTPVQSPK

SEQ ID NO: 2568019 - protein, 5 aa, Entamoeba histolytica
KYNTD

SEQ ID NO: 2568020 - protein, 5 aa, Entamoeba histolytica
KYNYE

SEQ ID NO: 2568021 - protein, 7 aa, Entamoeba histolytica
KYPIQTQ

SEQ ID NO: 2568022 - protein, 6 aa, Entamoeba histolytica
KYPNIN

SEQ ID NO: 2568023 - protein, 6 aa, Entamoeba histolytica
KYPPYQ

SEQ ID NO: 2568024 - protein, 9 aa, Entamoeba histolytica
KYPSRSHTS

SEQ ID NO: 2568025 - protein, 5 aa, Entamoeba histolytica
KYPTS

SEQ ID NO: 2568026 - protein, 7 aa, Entamoeba histolytica
KYPTSDD

SEQ ID NO: 2568027 - protein, 19 aa, Entamoeba histolytica
KYQKKESNQQVETESNPVA

SEQ ID NO: 2568028 - protein, 13 aa, Entamoeba histolytica
KYQNKHNKSSFGT

SEQ ID NO: 2568029 - protein, 4 aa, Entamoeba histolytica
KYQQ

SEQ ID NO: 2568030 - protein, 10 aa, Entamoeba histolytica
KYQTNEGEKG

SEQ ID NO: 2568031 - protein, 6 aa, Entamoeba histolytica
KYRGST

SEQ ID NO: 2568032 - protein, 7 aa, Entamoeba histolytica
KYRLNGG

SEQ ID NO: 2568033 - protein, 8 aa, Entamoeba histolytica
KYSEKGNI

SEQ ID NO: 2568034 - protein, 5 aa, Entamoeba histolytica
KYSKA

SEQ ID NO: 2568035 - protein, 10 aa, Entamoeba histolytica
KYSNKNKGRI

SEQ ID NO: 2568036 - protein, 9 aa, Entamoeba histolytica
KYSQELSRT

SEQ ID NO: 2568037 - protein, 12 aa, Entamoeba histolytica
KYSQNKKQDSNT

SEQ ID NO: 2568038 - protein, 6 aa, Entamoeba histolytica
KYSSKK

SEQ ID NO: 2568039 - protein, 10 aa, Entamoeba histolytica
KYSSNGEDEL

SEQ ID NO: 2568040 - protein, 9 aa, Entamoeba histolytica
KYSTKPKNY

SEQ ID NO: 2568041 - protein, 29 aa, Entamoeba histolytica
KYSTQEPFTDNNGNGFKYAGGSKSRSGNL

SEQ ID NO: 2568042 - protein, 7 aa, Entamoeba histolytica
KYSVEDG

SEQ ID NO: 2568043 - protein, 12 aa, Entamoeba histolytica
KYTESEIPNDPF

SEQ ID NO: 2568044 - protein, 7 aa, Entamoeba histolytica
KYTGDCQ

SEQ ID NO: 2568045 - protein, 20 aa, Entamoeba histolytica
KYTKQSLNSSKPINKNSTLD

SEQ ID NO: 2568046 - protein, 8 aa, Entamoeba histolytica
KYTKSTKV

SEQ ID NO: 2568047 - protein, 5 aa, Entamoeba histolytica
KYTPH

SEQ ID NO: 2568048 - protein, 6 aa, Entamoeba histolytica
KYVGSS

SEQ ID NO: 2568049 - protein, 4 aa, Entamoeba histolytica
KYVS

SEQ ID NO: 2568050 - protein, 5 aa, Entamoeba histolytica
KYYDS

SEQ ID NO: 2568051 - protein, 7 aa, Entamoeba histolytica
KYYGNGE

SEQ ID NO: 2568052 - protein, 5 aa, Entamoeba histolytica
KYYNA

SEQ ID NO: 2568053 - protein, 12 aa, Entamoeba histolytica
LAATAAGQAAVQ

SEQ ID NO: 2568054 - protein, 4 aa, Entamoeba histolytica
LAEN

SEQ ID NO: 2568055 - protein, 13 aa, Entamoeba histolytica
LAENRNPKGITFD

SEQ ID NO: 2568056 - protein, 6 aa, Entamoeba histolytica
LAEPNE

SEQ ID NO: 2568057 - protein, 5 aa, Entamoeba histolytica
LAEQG

SEQ ID NO: 2568058 - protein, 9 aa, Entamoeba histolytica
LAEQIKPND

SEQ ID NO: 2568059 - protein, 7 aa, Entamoeba histolytica
LAEREPF

SEQ ID NO: 2568060 - protein, 11 aa, Entamoeba histolytica
LAGGGNKLSDL

SEQ ID NO: 2568061 - protein, 6 aa, Entamoeba histolytica
LAIESN

SEQ ID NO: 2568062 - protein, 18 aa, Entamoeba histolytica
LAKEEKKSSRKKLNGKRR

SEQ ID NO: 2568063 - protein, 15 aa, Entamoeba histolytica
LAKEQTTTKTLQNEI

SEQ ID NO: 2568064 - protein, 11 aa, Entamoeba histolytica
LAKNSSKPKIK

SEQ ID NO: 2568065 - protein, 6 aa, Entamoeba histolytica
LAPAGS

SEQ ID NO: 2568066 - protein, 7 aa, Entamoeba histolytica
LAPGDKQ

SEQ ID NO: 2568067 - protein, 5 aa, Entamoeba histolytica
LAQKE

SEQ ID NO: 2568068 - protein, 4 aa, Entamoeba histolytica
LARE

SEQ ID NO: 2568069 - protein, 8 aa, Entamoeba histolytica
LARKTNKT

SEQ ID NO: 2568070 - protein, 8 aa, Entamoeba histolytica
LARNTGKT

SEQ ID NO: 2568071 - protein, 16 aa, Entamoeba histolytica
LARTNDGENKEEYNNA

SEQ ID NO: 2568072 - protein, 8 aa, Entamoeba histolytica
LASGEENA

SEQ ID NO: 2568073 - protein, 8 aa, Entamoeba histolytica
LASGKDNA

SEQ ID NO: 2568074 - protein, 7 aa, Entamoeba histolytica
LASHTAG

SEQ ID NO: 2568075 - protein, 21 aa, Entamoeba histolytica
LASKNGDAKLYKQKQTELKNE

SEQ ID NO: 2568076 - protein, 10 aa, Entamoeba histolytica
LASKSGSTTL

SEQ ID NO: 2568077 - protein, 6 aa, Entamoeba histolytica
LASKYY

SEQ ID NO: 2568078 - protein, 12 aa, Entamoeba histolytica
LASRTGLGEETY

SEQ ID NO: 2568079 - protein, 9 aa, Entamoeba histolytica
LASTPLPKD

SEQ ID NO: 2568080 - protein, 33 aa, Entamoeba histolytica; identical to SEQ ID NO: 2369089

SEQ ID NO: 2568081 - protein, 10 aa, Entamoeba histolytica
LATKNNDEKL

SEQ ID NO: 2568082 - protein, 27 aa, Entamoeba histolytica
LATLKSSIKDKDRCGEISSIKDSSIAD

SEQ ID NO: 2568083 - protein, 11 aa, Entamoeba histolytica
LATPTLKATGR

SEQ ID NO: 2568084 - protein, 27 aa, Entamoeba histolytica
LCGNGKKDEGEECENISGDNYTDPNCD

SEQ ID NO: 2568085 - protein, 12 aa, Entamoeba histolytica
LDAKGMGDNKPV

SEQ ID NO: 2568086 - protein, 8 aa, Entamoeba histolytica
LDAKKTGS

SEQ ID NO: 2568087 - protein, 7 aa, Entamoeba histolytica
LDASQKI

SEQ ID NO: 2568088 - protein, 8 aa, Entamoeba histolytica
LDDNTNSF

SEQ ID NO: 2568089 - protein, 11 aa, Entamoeba histolytica
LDEARKQELIK

SEQ ID NO: 2568090 - protein, 13 aa, Entamoeba histolytica
LDEEKSESENRQS

SEQ ID NO: 2568091 - protein, 4 aa, Entamoeba histolytica
LDEG

SEQ ID NO: 2568092 - protein, 6 aa, Entamoeba histolytica
LDENGC

SEQ ID NO: 2568093 - protein, 17 aa, Entamoeba histolytica
LDENKVASFDGDTTKQT

SEQ ID NO: 2568094 - protein, 7 aa, Entamoeba histolytica
LDEQEHK

SEQ ID NO: 2568095 - protein, 5 aa, Entamoeba histolytica
LDERT

SEQ ID NO: 2568096 - protein, 19 aa, Entamoeba histolytica
LDESDMTGESVAVKKSEKS

SEQ ID NO: 2568097 - protein, 5 aa, Entamoeba histolytica
LDETT

SEQ ID NO: 2568098 - protein, 28 aa, Entamoeba histolytica
LDGDNQYEESDDDSISDIHSDDEGVKKI

SEQ ID NO: 2568099 - protein, 6 aa, Entamoeba histolytica
LDGETN

SEQ ID NO: 2568100 - protein, 7 aa, Entamoeba histolytica
LDGETNL

SEQ ID NO: 2568101 - protein, 7 aa, Entamoeba histolytica
LDGNCNE

SEQ ID NO: 2568102 - protein, 8 aa, Entamoeba histolytica
LDGYDTSD

SEQ ID NO: 2568103 - protein, 4 aa, Entamoeba histolytica
LDLE

SEQ ID NO: 2568104 - protein, 10 aa, Entamoeba histolytica
LDNEKRQSIQ

SEQ ID NO: 2568105 - protein, 12 aa, Entamoeba histolytica
LDNGSKNTEKLK

SEQ ID NO: 2568106 - protein, 4 aa, Entamoeba histolytica
LDNK

SEQ ID NO: 2568107 - protein, 20 aa, Entamoeba histolytica
LDNNGIDDKTDKNEQKEKKT

SEQ ID NO: 2568108 - protein, 23 aa, Entamoeba histolytica
LDNSTVNQHQNESSKIEKGYNLS

SEQ ID NO: 2568109 - protein, 4 aa, Entamoeba histolytica
LDNT

SEQ ID NO: 2568110 - protein, 9 aa, Entamoeba histolytica
LDNTKETSI

SEQ ID NO: 2568111 - protein, 9 aa, Entamoeba histolytica
LDNTSNPQI

SEQ ID NO: 2568112 - protein, 11 aa, Entamoeba histolytica
LDNTYEKNEPS

SEQ ID NO: 2568113 - protein, 6 aa, Entamoeba histolytica
LDPDEI

SEQ ID NO: 2568114 - protein, 6 aa, Entamoeba histolytica
LDPDNE

SEQ ID NO: 2568115 - protein, 12 aa, Entamoeba histolytica
LDPGEECDGGLG

SEQ ID NO: 2568116 - protein, 5 aa, Entamoeba histolytica
LDPGL

SEQ ID NO: 2568117 - protein, 6 aa, Entamoeba histolytica
LDPNIN

SEQ ID NO: 2568118 - protein, 9 aa, Entamoeba histolytica
LDPSAKSFP

SEQ ID NO: 2568119 - protein, 7 aa, Entamoeba histolytica
LDPYEKH

SEQ ID NO: 2568120 - protein, 11 aa, Entamoeba histolytica
LDQARPKETHK

SEQ ID NO: 2568121 - protein, 5 aa, Entamoeba histolytica
LDQGN

SEQ ID NO: 2568122 - protein, 9 aa, Entamoeba histolytica
LDSEEGIYG

SEQ ID NO: 2568123 - protein, 6 aa, Entamoeba histolytica
LDSEGS

SEQ ID NO: 2568124 - protein, 26 aa, Entamoeba histolytica
LDSITIGNKQRTESPKEAVLSTEKGQ

SEQ ID NO: 2568125 - protein, 4 aa, Entamoeba histolytica
LDSL

SEQ ID NO: 2568126 - protein, 8 aa, Entamoeba histolytica
LDSPYTSI

SEQ ID NO: 2568127 - protein, 10 aa, Entamoeba histolytica
LDSTSTSARR

SEQ ID NO: 2568128 - protein, 5 aa, Entamoeba histolytica
LDTEQ

SEQ ID NO: 2568129 - protein, 14 aa, Entamoeba histolytica
LDTGDDQTDTYENG

SEQ ID NO: 2568130 - protein, 4 aa, Entamoeba histolytica
LDTP

SEQ ID NO: 2568131 - protein, 7 aa, Entamoeba histolytica
LDTTETS

SEQ ID NO: 2568132 - protein, 43 aa, Entamoeba histolytica
LDVGSTDGEYKKGLVEGKKGKSKKVEEEEEDPIKDIKNAATGI

SEQ ID NO: 2568133 - protein, 4 aa, Entamoeba histolytica
LEAC

SEQ ID NO: 2568134 - protein, 21 aa, Entamoeba histolytica
LEAEIKKKEDAKEMAKAELTR

SEQ ID NO: 2568135 - protein, 5 aa, Entamoeba histolytica
LEANE

SEQ ID NO: 2568136 - protein, 11 aa, Entamoeba histolytica
LEDGGHKQKRY

SEQ ID NO: 2568137 - protein, 9 aa, Entamoeba histolytica
LEDGNNDID

SEQ ID NO: 2568138 - protein, 6 aa, Entamoeba histolytica
LEDGSC

SEQ ID NO: 2568139 - protein, 11 aa, Entamoeba histolytica
LEDGSERKNVD

SEQ ID NO: 2568140 - protein, 6 aa, Entamoeba histolytica
LEDNNQ

SEQ ID NO: 2568141 - protein, 5 aa, Entamoeba histolytica
LEDQD

SEQ ID NO: 2568142 - protein, 16 aa, Entamoeba histolytica
LEDQTDDKKNQSIKED

SEQ ID NO: 2568143 - protein, 9 aa, Entamoeba histolytica
LEDTQEEEF

SEQ ID NO: 2568144 - protein, 8 aa, Entamoeba histolytica
LEDTTIPT

SEQ ID NO: 2568145 - protein, 9 aa, Entamoeba histolytica
LEDVSKSEH

SEQ ID NO: 2568146 - protein, 6 aa, Entamoeba histolytica
LEEANK

SEQ ID NO: 2568147 - protein, 26 aa, Entamoeba histolytica
LEEANKRLNENDHLTEENKKEETQNI

SEQ ID NO: 2568148 - protein, 4 aa, Entamoeba histolytica
LEEE

SEQ ID NO: 2568149 - protein, 7 aa, Entamoeba histolytica
LEEGCQT

SEQ ID NO: 2568150 - protein, 9 aa, Entamoeba histolytica
LEELTGKKV

SEQ ID NO: 2568151 - protein, 8 aa, Entamoeba histolytica
LEENENET

SEQ ID NO: 2568152 - protein, 11 aa, Entamoeba histolytica
LEENNENTNID

SEQ ID NO: 2568153 - protein, 19 aa, Entamoeba histolytica
LEESDSSSESMDEEAQNEL

SEQ ID NO: 2568154 - protein, 4 aa, Entamoeba histolytica
LEET

SEQ ID NO: 2568155 - protein, 8 aa, Entamoeba histolytica
LEETEEKD

SEQ ID NO: 2568156 - protein, 5 aa, Entamoeba histolytica
LEFTK

SEQ ID NO: 2568157 - protein, 9 aa, Entamoeba histolytica
LEGIQDAPN

SEQ ID NO: 2568158 - protein, 21 aa, Entamoeba histolytica
LEGKKNIEKEFEEAKKRIEEL

SEQ ID NO: 2568159 - protein, 7 aa, Entamoeba histolytica
LEKEPEK

SEQ ID NO: 2568160 - protein, 13 aa, Entamoeba histolytica
LEKEQTKRSNEVK

SEQ ID NO: 2568161 - protein, 12 aa, Entamoeba histolytica
LEKEQTKRTNEI

SEQ ID NO: 2568162 - protein, 4 aa, Entamoeba histolytica
LEKG

SEQ ID NO: 2568163 - protein, 6 aa, Entamoeba histolytica
LEKGQT

SEQ ID NO: 2568164 - protein, 7 aa, Entamoeba histolytica
LEKHPNV

SEQ ID NO: 2568165 - protein, 4 aa, Entamoeba histolytica
LEKN

SEQ ID NO: 2568166 - protein, 10 aa, Entamoeba histolytica
LEKPEGMSES

SEQ ID NO: 2568167 - protein, 10 aa, Entamoeba histolytica
LEKPKESNDI

SEQ ID NO: 2568168 - protein, 7 aa, Entamoeba histolytica
LEKSEGE

SEQ ID NO: 2568169 - protein, 17 aa, Entamoeba histolytica
LEKSSEPEDKDKQDEKQ

SEQ ID NO: 2568170 - protein, 8 aa, Entamoeba histolytica
LELTTNNL

SEQ ID NO: 2568171 - protein, 10 aa, Entamoeba histolytica
LENATPSEIN

SEQ ID NO: 2568172 - protein, 20 aa, Entamoeba histolytica
LENENQESKVQEEKEETIKV

SEQ ID NO: 2568173 - protein, 55 aa, Entamoeba histolytica
LENGGQNEEGYNKGKSDKNSVLESSTTSSGKHETSSADKGKAEAQKPRSTTTPVV

SEQ ID NO: 2568174 - protein, 18 aa, Entamoeba histolytica
LENHDRTDSSDDSHEQHE

SEQ ID NO: 2568175 - protein, 6 aa, Entamoeba histolytica
LENKER

SEQ ID NO: 2568176 - protein, 8 aa, Entamoeba histolytica
LENQTGVQ

SEQ ID NO: 2568177 - protein, 4 aa, Entamoeba histolytica
LEPI

SEQ ID NO: 2568178 - protein, 4 aa, Entamoeba histolytica
LEPN

SEQ ID NO: 2568179 - protein, 6 aa, Entamoeba histolytica
LEPNDK

SEQ ID NO: 2568180 - protein, 6 aa, Entamoeba histolytica
LEPSKV

SEQ ID NO: 2568181 - protein, 18 aa, Entamoeba histolytica
LEQESQQIESPSRDDVRS

SEQ ID NO: 2568182 - protein, 17 aa, Entamoeba histolytica
LEQNEEIGKHENTPRGG

SEQ ID NO: 2568183 - protein, 5 aa, Entamoeba histolytica
LEQRQ

SEQ ID NO: 2568184 - protein, 9 aa, Entamoeba histolytica
LEQSHPSPI

SEQ ID NO: 2568185 - protein, 10 aa, Entamoeba histolytica
LEQSKGETVI

SEQ ID NO: 2568186 - protein, 8 aa, Entamoeba histolytica
LEQTYETS

SEQ ID NO: 2568187 - protein, 7 aa, Entamoeba histolytica
LERKSNV

SEQ ID NO: 2568188 - protein, 8 aa, Entamoeba histolytica
LERNENVG

SEQ ID NO: 2568189 - protein, 10 aa, Entamoeba histolytica
LESDTRRKRK

SEQ ID NO: 2568190 - protein, 6 aa, Entamoeba histolytica
LESIET

SEQ ID NO: 2568191 - protein, 4 aa, Entamoeba histolytica
LESK

SEQ ID NO: 2568192 - protein, 5 aa, Entamoeba histolytica
LESKN

SEQ ID NO: 2568193 - protein, 17 aa, Entamoeba histolytica
LESNNCKLKSTKESVKY

SEQ ID NO: 2568194 - protein, 19 aa, Entamoeba histolytica
LESQNQEESKRSRNELQKE

SEQ ID NO: 2568195 - protein, 8 aa, Entamoeba histolytica
LESSDGNL

SEQ ID NO: 2568196 - protein, 18 aa, Entamoeba histolytica
LESSEEDFSEDNIPEQIY

SEQ ID NO: 2568197 - protein, 12 aa, Entamoeba histolytica
LESSEKGTITNP

SEQ ID NO: 2568198 - protein, 7 aa, Entamoeba histolytica
LETDPSP

SEQ ID NO: 2568199 - protein, 12 aa, Entamoeba histolytica
LETDREKVDRKF

SEQ ID NO: 2568200 - protein, 49 aa, Entamoeba histolytica
LETEQYNEQGNKDDNKREDNMVDSTRTTQHKHENKYHDDENTQNQTYNR

SEQ ID NO: 2568201 - protein, 7 aa, Entamoeba histolytica
LETSKSY

SEQ ID NO: 2568202 - protein, 5 aa, Entamoeba histolytica
LETTN

SEQ ID NO: 2568203 - protein, 13 aa, Entamoeba histolytica
LFDPTKYAGYAEQ

SEQ ID NO: 2568204 - protein, 9 aa, Entamoeba histolytica
LGAETSAIE

SEQ ID NO: 2568205 - protein, 5 aa, Entamoeba histolytica
LGANS

SEQ ID NO: 2568206 - protein, 10 aa, Entamoeba histolytica
LGASDDDGSA

SEQ ID NO: 2568207 - protein, 6 aa, Entamoeba histolytica
LGASTS

SEQ ID NO: 2568208 - protein, 11 aa, Entamoeba histolytica
LGDGSNYLPPP

SEQ ID NO: 2568209 - protein, 4 aa, Entamoeba histolytica
LGDM

SEQ ID NO: 2568210 - protein, 6 aa, Entamoeba histolytica
LGDPNF

SEQ ID NO: 2568211 - protein, 24 aa, Entamoeba histolytica
LGEEFSSDDEDDIQINTQPANTKS

SEQ ID NO: 2568212 - protein, 5 aa, Entamoeba histolytica
LGEES

SEQ ID NO: 2568213 - protein, 6 aa, Entamoeba histolytica
LGEGGF

SEQ ID NO: 2568214 - protein, 5 aa, Entamoeba histolytica
LGEGS

SEQ ID NO: 2568215 - protein, 8 aa, Entamoeba histolytica
LGENESFQ

SEQ ID NO: 2568216 - protein, 11 aa, Entamoeba histolytica
LGENKENNQID

SEQ ID NO: 2568217 - protein, 4 aa, Entamoeba histolytica
LGET

SEQ ID NO: 2568218 - protein, 8 aa, Entamoeba histolytica
LGETVGAD

SEQ ID NO: 2568219 - protein, 9 aa, Entamoeba histolytica
LGGKNPAIV

SEQ ID NO: 2568220 - protein, 8 aa, Entamoeba histolytica
LGGNSSLG

SEQ ID NO: 2568221 - protein, 12 aa, Entamoeba histolytica
LGGSASDYSKQK

SEQ ID NO: 2568222 - protein, 6 aa, Entamoeba histolytica
LGGSQA

SEQ ID NO: 2568223 - protein, 11 aa, Entamoeba histolytica
LGGSSNSSFSL

SEQ ID NO: 2568224 - protein, 6 aa, Entamoeba histolytica
LGGTEG

SEQ ID NO: 2568225 - protein, 9 aa, Entamoeba histolytica
LGHENRNTS

SEQ ID NO: 2568226 - protein, 6 aa, Entamoeba histolytica
LGHETE

SEQ ID NO: 2568227 - protein, 6 aa, Entamoeba histolytica
LGHGST

SEQ ID NO: 2568228 - protein, 6 aa, Entamoeba histolytica
LGKDKR

SEQ ID NO: 2568229 - protein, 15 aa, Entamoeba histolytica
LGKGEDDYNKFDELT

SEQ ID NO: 2568230 - protein, 10 aa, Entamoeba histolytica
LGKREVTDEE

SEQ ID NO: 2568231 - protein, 9 aa, Entamoeba histolytica
LGNDGNDAL

SEQ ID NO: 2568232 - protein, 8 aa, Entamoeba histolytica
LGNEPYDD

SEQ ID NO: 2568233 - protein, 7 aa, Entamoeba histolytica
LGPFSSQ

SEQ ID NO: 2568234 - protein, 23 aa, Entamoeba histolytica
LGPGKGLGTDFRPTGSTISFSQD

SEQ ID NO: 2568235 - protein, 7 aa, Entamoeba histolytica
LGPNQAI

SEQ ID NO: 2568236 - protein, 5 aa, Entamoeba histolytica
LGPSQ

SEQ ID NO: 2568237 - protein, 9 aa, Entamoeba histolytica
LGPSTTSMP

SEQ ID NO: 2568238 - protein, 20 aa, Entamoeba histolytica
LGQDDKRESRYYQSLQTEDR

SEQ ID NO: 2568239 - protein, 9 aa, Entamoeba histolytica
LGQNSSNNI

SEQ ID NO: 2568240 - protein, 11 aa, Entamoeba histolytica
LGQPKSHSKHQ

SEQ ID NO: 2568241 - protein, 14 aa, Entamoeba histolytica
LGQPNEYSTHNKPV

SEQ ID NO: 2568242 - protein, 13 aa, Entamoeba histolytica
LGQQTSKKTPGSI

SEQ ID NO: 2568243 - protein, 4 aa, Entamoeba histolytica
LGRL

SEQ ID NO: 2568244 - protein, 7 aa, Entamoeba histolytica
LGRPSPV

SEQ ID NO: 2568245 - protein, 6 aa, Entamoeba histolytica
LGRTDS

SEQ ID NO: 2568246 - protein, 4 aa, Entamoeba histolytica
LGSA

SEQ ID NO: 2568247 - protein, 6 aa, Entamoeba histolytica
LGSAGY

SEQ ID NO: 2568248 - protein, 12 aa, Entamoeba histolytica
LGSDSSEEVKVT

SEQ ID NO: 2568249 - protein, 7 aa, Entamoeba histolytica
LGSEETK

SEQ ID NO: 2568250 - protein, 9 aa, Entamoeba histolytica
LGSSDDSMK

SEQ ID NO: 2568251 - protein, 10 aa, Entamoeba histolytica
LGSSKDPCSF

SEQ ID NO: 2568252 - protein, 10 aa, Entamoeba histolytica
LGTEKPTKEL

SEQ ID NO: 2568253 - protein, 9 aa, Entamoeba histolytica
LGTKATTTL

SEQ ID NO: 2568254 - protein, 5 aa, Entamoeba histolytica
LGTNG

SEQ ID NO: 2568255 - protein, 13 aa, Entamoeba histolytica
LGTNTNTKEFKES

SEQ ID NO: 2568256 - protein, 6 aa, Entamoeba histolytica
LGTSES

SEQ ID NO: 2568257 - protein, 8 aa, Entamoeba histolytica
LGTSGNNH

SEQ ID NO: 2568258 - protein, 8 aa, Entamoeba histolytica
LGVSPVKE

SEQ ID NO: 2568259 - protein, 13 aa, Entamoeba histolytica
LGYKGGVCDGDNI

SEQ ID NO: 2568260 - protein, 12 aa, Entamoeba histolytica
LGYSDDPETILT

SEQ ID NO: 2568261 - protein, 4 aa, Entamoeba histolytica
LHAD

SEQ ID NO: 2568262 - protein, 13 aa, Entamoeba histolytica
LHDKQPPSLPPKQ

SEQ ID NO: 2568263 - protein, 11 aa, Entamoeba histolytica
LHKKGIQDNTL

SEQ ID NO: 2568264 - protein, 19 aa, Entamoeba histolytica
LHNNEEDISSFDEQEMDTL

SEQ ID NO: 2568265 - protein, 6 aa, Entamoeba histolytica
LHPGNQ

SEQ ID NO: 2568266 - protein, 9 aa, Entamoeba histolytica
LHQQAGSKN

SEQ ID NO: 2568267 - protein, 5 aa, Entamoeba histolytica
LHQTQ

SEQ ID NO: 2568268 - protein, 7 aa, Entamoeba histolytica
LHSNSSS

SEQ ID NO: 2568269 - protein, 11 aa, Entamoeba histolytica
LHSSKQKVKRR

SEQ ID NO: 2568270 - protein, 5 aa, Entamoeba histolytica
LIDEE

SEQ ID NO: 2568271 - protein, 4 aa, Entamoeba histolytica
LIDG

SEQ ID NO: 2568272 - protein, 5 aa, Entamoeba histolytica
LIDGN

SEQ ID NO: 2568273 - protein, 16 aa, Entamoeba histolytica
LIGEGSDTILDTPNSK

SEQ ID NO: 2568274 - protein, 7 aa, Entamoeba histolytica
LINDSDT

SEQ ID NO: 2568275 - protein, 8 aa, Entamoeba histolytica
LINEDSTK

SEQ ID NO: 2568276 - protein, 6 aa, Entamoeba histolytica
LINPKN

SEQ ID NO: 2568277 - protein, 9 aa, Entamoeba histolytica
LIRDQPEKN

SEQ ID NO: 2568278 - protein, 7 aa, Entamoeba histolytica
LITPPPG

SEQ ID NO: 2568279 - protein, 6 aa, Entamoeba histolytica
LKANSN

SEQ ID NO: 2568280 - protein, 7 aa, Entamoeba histolytica
LKDDPFK

SEQ ID NO: 2568281 - protein, 4 aa, Entamoeba histolytica
LKDE

SEQ ID NO: 2568282 - protein, 9 aa, Entamoeba histolytica
LKDGRTRRS

SEQ ID NO: 2568283 - protein, 10 aa, Entamoeba histolytica
LKDKLNQKSY

SEQ ID NO: 2568284 - protein, 18 aa, Entamoeba histolytica
LKDKNRFEEVGKNADDKI

SEQ ID NO: 2568285 - protein, 15 aa, Entamoeba histolytica
LKDKPQKKKQSFCVM

SEQ ID NO: 2568286 - protein, 7 aa, Entamoeba histolytica
LKDKQNI

SEQ ID NO: 2568287 - protein, 5 aa, Entamoeba histolytica
LKDKT

SEQ ID NO: 2568288 - protein, 10 aa, Entamoeba histolytica
LKDPTDPLSE

SEQ ID NO: 2568289 - protein, 4 aa, Entamoeba histolytica
LKDS

SEQ ID NO: 2568290 - protein, 7 aa, Entamoeba histolytica
LKDSDNY

SEQ ID NO: 2568291 - protein, 6 aa, Entamoeba histolytica
LKDYEN

SEQ ID NO: 2568292 - protein, 9 aa, Entamoeba histolytica
LKEANEETL

SEQ ID NO: 2568293 - protein, 10 aa, Entamoeba histolytica
LKEDMNKKKN

SEQ ID NO: 2568294 - protein, 29 aa, Entamoeba histolytica
LKEEEEEENEVDLSNNDNNIIQSNSPPQI

SEQ ID NO: 2568295 - protein, 7 aa, Entamoeba histolytica
LKEETCK

SEQ ID NO: 2568296 - protein, 13 aa, Entamoeba histolytica
LKEEVSKSENDIK

SEQ ID NO: 2568297 - protein, 7 aa, Entamoeba histolytica
LKEKERI

SEQ ID NO: 2568298 - protein, 10 aa, Entamoeba histolytica
LKEKTDSISE

SEQ ID NO: 2568299 - protein, 8 aa, Entamoeba histolytica
LKEKYEKD

SEQ ID NO: 2568300 - protein, 5 aa, Entamoeba histolytica
LKEME

SEQ ID NO: 2568301 - protein, 19 aa, Entamoeba histolytica
LKENNEEEVEINPTWNVHE

SEQ ID NO: 2568302 - protein, 13 aa, Entamoeba histolytica
LKENWEKEALSKH

SEQ ID NO: 2568303 - protein, 9 aa, Entamoeba histolytica
LKEPGKPQI

SEQ ID NO: 2568304 - protein, 11 aa, Entamoeba histolytica
LKEPKRGNEVI

SEQ ID NO: 2568305 - protein, 6 aa, Entamoeba histolytica
LKEQGG

SEQ ID NO: 2568306 - protein, 11 aa, Entamoeba histolytica
LKEQPPQSRDH

SEQ ID NO: 2568307 - protein, 7 aa, Entamoeba histolytica
LKERGSA

SEQ ID NO: 2568308 - protein, 16 aa, Entamoeba histolytica
LKERTDNIGAKQEFDK

SEQ ID NO: 2568309 - protein, 14 aa, Entamoeba histolytica
LKESQSSEKALTEF

SEQ ID NO: 2568310 - protein, 7 aa, Entamoeba histolytica
LKESSQL

SEQ ID NO: 2568311 - protein, 12 aa, Entamoeba histolytica
LKETKKEIYEEP

SEQ ID NO: 2568312 - protein, 321 aa, Entamoeba histolytica
LKGEVTTQITDEVPKSSQPTVQKEQRSEEDTNTKEVGSTLNPKNNPEDSETGKSLNTNTENKVDKGVNEPAKGGEVKTENNAETETNKQSETTDKGLNPESSTTGQEETTPKQTNAGSTGKGEDPVPKSEGEVPSTKPGSSDSEKGQESNKNGQGDSGVNEQGKEGSGTGAESKEKGEINDKGKEEKATNEKDGGNTKDKEGKEQGNSVTDDGHSNKNGESNKEKDGNSGETGQKEESGKNGVAGQDEKNGSNKTKEEKQDSKNNDKNDDKKKAEDEKSNEQKDGNQETDNGNKITSSSDSSDNKSDDDINNHKNLDGATS

SEQ ID NO: 2568313 - protein, 10 aa, Entamoeba histolytica
LKGRNEDTEL

SEQ ID NO: 2568314 - protein, 60 aa, Entamoeba histolytica
LKHARSRRGTISREGSFNSSDSKKKGSSTISSEEDSTDSTVKTNEGSEEGGNSDNNEGIC

SEQ ID NO: 2568315 - protein, 6 aa, Entamoeba histolytica
LKHTET

SEQ ID NO: 2568316 - protein, 11 aa, Entamoeba histolytica
LKKAKAKKGFT

SEQ ID NO: 2568317 - protein, 15 aa, Entamoeba histolytica
LKKEKSEKELQKKEN

SEQ ID NO: 2568318 - protein, 15 aa, Entamoeba histolytica
LKKENKENKEVKEEM

SEQ ID NO: 2568319 - protein, 11 aa, Entamoeba histolytica
LKKETSIPNTT

SEQ ID NO: 2568320 - protein, 19 aa, Entamoeba histolytica
LKKHKQTILDGKSEPSSRQ

SEQ ID NO: 2568321 - protein, 10 aa, Entamoeba histolytica
LKKKDNYITQ

SEQ ID NO: 2568322 - protein, 12 aa, Entamoeba histolytica
LKKQQDSLLKKI

SEQ ID NO: 2568323 - protein, 7 aa, Entamoeba histolytica
LKKSTIA

SEQ ID NO: 2568324 - protein, 4 aa, Entamoeba histolytica
LKKY

SEQ ID NO: 2568325 - protein, 4 aa, Entamoeba histolytica
LKLE

SEQ ID NO: 2568326 - protein, 23 aa, Entamoeba histolytica
LKNDERKSLDNDSFDMKGTPTLE

SEQ ID NO: 2568327 - protein, 13 aa, Entamoeba histolytica
LKNEDEEQPISLI

SEQ ID NO: 2568328 - protein, 7 aa, Entamoeba histolytica
LKNENTI

SEQ ID NO: 2568329 - protein, 7 aa, Entamoeba histolytica
LKNGSYS

SEQ ID NO: 2568330 - protein, 21 aa, Entamoeba histolytica
LKNNPTVDITKGDPIICDLLN

SEQ ID NO: 2568331 - protein, 15 aa, Entamoeba histolytica
LKNPEFTKLGEEATP

SEQ ID NO: 2568332 - protein, 9 aa, Entamoeba histolytica
LKNPTKHSP

SEQ ID NO: 2568333 - protein, 11 aa, Entamoeba histolytica
LKNQRYNSSTN

SEQ ID NO: 2568334 - protein, 7 aa, Entamoeba histolytica
LKNYPDP

SEQ ID NO: 2568335 - protein, 6 aa, Entamoeba histolytica
LKPEEF

SEQ ID NO: 2568336 - protein, 4 aa, Entamoeba histolytica
LKPG

SEQ ID NO: 2568337 - protein, 7 aa, Entamoeba histolytica
LKPNSSS

SEQ ID NO: 2568338 - protein, 5 aa, Entamoeba histolytica
LKPSY

SEQ ID NO: 2568339 - protein, 16 aa, Entamoeba histolytica
LKQEGKTIDDITNSPK

SEQ ID NO: 2568340 - protein, 9 aa, Entamoeba histolytica
LKQSESSIR

SEQ ID NO: 2568341 - protein, 5 aa, Entamoeba histolytica
LKQSL

SEQ ID NO: 2568342 - protein, 11 aa, Entamoeba histolytica
LKQSSKGKFDL

SEQ ID NO: 2568343 - protein, 8 aa, Entamoeba histolytica
LKQTETSI

SEQ ID NO: 2568344 - protein, 19 aa, Entamoeba histolytica
LKRENEELQKRKGNEMRNE

SEQ ID NO: 2568345 - protein, 14 aa, Entamoeba histolytica
LKRSEEAKKKELEE

SEQ ID NO: 2568346 - protein, 6 aa, Entamoeba histolytica
LKRTTE

SEQ ID NO: 2568347 - protein, 12 aa, Entamoeba histolytica
LKRVKKKVKKKN

SEQ ID NO: 2568348 - protein, 8 aa, Entamoeba histolytica
LKSAPGTF

SEQ ID NO: 2568349 - protein, 9 aa, Entamoeba histolytica
LKSAPRNTG

SEQ ID NO: 2568350 - protein, 14 aa, Entamoeba histolytica
LKSDSQRSERYKKL

SEQ ID NO: 2568351 - protein, 4 aa, Entamoeba histolytica
LKSE

SEQ ID NO: 2568352 - protein, 246 aa, Entamoeba histolytica
LKSEEPEKVTSTVPQPASPKAPEAAESPSVAQVPKENSVSTEGKESAAGNTDASQKEQATEGTQQTHTTDTQPTATQQGANTQQAQSAGASPTEQTSTDTTKQQQAQSSPGTTTNTPTGQEQPAVKPQQPETTNNDPKPQPSQNPQKETQPSKQEEQGEKPKPEIKEPEKQKEQKDTDQKSSKDEKPQPPKNNENNEPNKEDGKNNQQKPEDGNKVTDNKATSSSDSSSESKTDDSFDSHKNLNGT

SEQ ID NO: 2568353 - protein, 10 aa, Entamoeba histolytica
LKSEKDMKKK

SEQ ID NO: 2568354 - protein, 7 aa, Entamoeba histolytica
LKSGEAM

SEQ ID NO: 2568355 - protein, 12 aa, Entamoeba histolytica
LKSGGSKKELKE

SEQ ID NO: 2568356 - protein, 6 aa, Entamoeba histolytica
LKSHSD

SEQ ID NO: 2568357 - protein, 7 aa, Entamoeba histolytica
LKSKFGT

SEQ ID NO: 2568358 - protein, 6 aa, Entamoeba histolytica
LKSNDS

SEQ ID NO: 2568359 - protein, 6 aa, Entamoeba histolytica
LKSNEV

SEQ ID NO: 2568360 - protein, 7 aa, Entamoeba histolytica
LKSNPEN

SEQ ID NO: 2568361 - protein, 12 aa, Entamoeba histolytica
LKSPDDKEAIES

SEQ ID NO: 2568362 - protein, 18 aa, Entamoeba histolytica
LKSSNENIKSVSCGSSNR

SEQ ID NO: 2568363 - protein, 8 aa, Entamoeba histolytica
LKSTSKSY

SEQ ID NO: 2568364 - protein, 15 aa, Entamoeba histolytica
LKSYNDKFENSDVSN

SEQ ID NO: 2568365 - protein, 18 aa, Entamoeba histolytica
LKTEDERYKDETQNNENV

SEQ ID NO: 2568366 - protein, 8 aa, Entamoeba histolytica
LKTNNEIS

SEQ ID NO: 2568367 - protein, 15 aa, Entamoeba histolytica
LKTNSYAPGSNEDPM

SEQ ID NO: 2568368 - protein, 8 aa, Entamoeba histolytica
LKTNTNET

SEQ ID NO: 2568369 - protein, 19 aa, Entamoeba histolytica
LKTPKKKHEIKKEDRLQEL

SEQ ID NO: 2568370 - protein, 18 aa, Entamoeba histolytica
LKTPRNKTPRNTLTPRKS

SEQ ID NO: 2568371 - protein, 8 aa, Entamoeba histolytica
LKTQGVSD

SEQ ID NO: 2568372 - protein, 16 aa, Entamoeba histolytica
LKTSTGCEECDTGYTL

SEQ ID NO: 2568373 - protein, 7 aa, Entamoeba histolytica
LKTTDTI

SEQ ID NO: 2568374 - protein, 12 aa, Entamoeba histolytica
LKVGSKCDGCKT

SEQ ID NO: 2568375 - protein, 8 aa, Entamoeba histolytica
LKVKQTKE

SEQ ID NO: 2568376 - protein, 10 aa, Entamoeba histolytica
LLAPPKPQRI

SEQ ID NO: 2568377 - protein, 7 aa, Entamoeba histolytica
LLNNPSS

SEQ ID NO: 2568378 - protein, 11 aa, Entamoeba histolytica
LLTTKQKKLNS

SEQ ID NO: 2568379 - protein, 6 aa, Entamoeba histolytica
LNADEA

SEQ ID NO: 2568380 - protein, 5 aa, Entamoeba histolytica
LNAEY

SEQ ID NO: 2568381 - protein, 6 aa, Entamoeba histolytica
LNAPDN

SEQ ID NO: 2568382 - protein, 10 aa, Entamoeba histolytica
LNASSNELTI

SEQ ID NO: 2568383 - protein, 5 aa, Entamoeba histolytica
LNATE

SEQ ID NO: 2568384 - protein, 5 aa, Entamoeba histolytica
LNDER

SEQ ID NO: 2568385 - protein, 5 aa, Entamoeba histolytica
LNDIS

SEQ ID NO: 2568386 - protein, 12 aa, Entamoeba histolytica
LNDKENPKNGEY

SEQ ID NO: 2568387 - protein, 5 aa, Entamoeba histolytica
LNDPS

SEQ ID NO: 2568388 - protein, 7 aa, Entamoeba histolytica
LNDTDQS

SEQ ID NO: 2568389 - protein, 11 aa, Entamoeba histolytica
LNEDNNTIDSV

SEQ ID NO: 2568390 - protein, 10 aa, Entamoeba histolytica
LNEEKQVEEF

SEQ ID NO: 2568391 - protein, 6 aa, Entamoeba histolytica
LNEEND

SEQ ID NO: 2568392 - protein, 12 aa, Entamoeba histolytica
LNEENKSKYSER

SEQ ID NO: 2568393 - protein, 15 aa, Entamoeba histolytica
LNEENNTKEDDSVST

SEQ ID NO: 2568394 - protein, 14 aa, Entamoeba histolytica
LNEESKTHIKQRII

SEQ ID NO: 2568395 - protein, 7 aa, Entamoeba histolytica
LNEGDMK

SEQ ID NO: 2568396 - protein, 21 aa, Entamoeba histolytica
LNEKDNQKQQQQKNPEKHEED

SEQ ID NO: 2568397 - protein, 7 aa, Entamoeba histolytica
LNEKNAE

SEQ ID NO: 2568398 - protein, 6 aa, Entamoeba histolytica
LNEKPY

SEQ ID NO: 2568399 - protein, 6 aa, Entamoeba histolytica
LNEKTR

SEQ ID NO: 2568400 - protein, 6 aa, Entamoeba histolytica
LNELNK

SEQ ID NO: 2568401 - protein, 6 aa, Entamoeba histolytica
LNENSF

SEQ ID NO: 2568402 - protein, 5 aa, Entamoeba histolytica
LNENT

SEQ ID NO: 2568403 - protein, 8 aa, Entamoeba histolytica
LNEQKNPR

SEQ ID NO: 2568404 - protein, 8 aa, Entamoeba histolytica
LNETNAKL

SEQ ID NO: 2568405 - protein, 6 aa, Entamoeba histolytica
LNETRF

SEQ ID NO: 2568406 - protein, 5 aa, Entamoeba histolytica
LNETY

SEQ ID NO: 2568407 - protein, 9 aa, Entamoeba histolytica
LNGEEDSVD

SEQ ID NO: 2568408 - protein, 8 aa, Entamoeba histolytica
LNGETLSK

SEQ ID NO: 2568409 - protein, 6 aa, Entamoeba histolytica
LNGKGI

SEQ ID NO: 2568410 - protein, 9 aa, Entamoeba histolytica
LNGNDYSPL

SEQ ID NO: 2568411 - protein, 5 aa, Entamoeba histolytica
LNHQS

SEQ ID NO: 2568412 - protein, 12 aa, Entamoeba histolytica
LNIASSEVGRVK

SEQ ID NO: 2568413 - protein, 4 aa, Entamoeba histolytica
LNIP

SEQ ID NO: 2568414 - protein, 11 aa, Entamoeba histolytica
LNIRTGSTFEA

SEQ ID NO: 2568415 - protein, 7 aa, Entamoeba histolytica
LNITGSG

SEQ ID NO: 2568416 - protein, 11 aa, Entamoeba histolytica
LNKAENENRIA

SEQ ID NO: 2568417 - protein, 7 aa, Entamoeba histolytica
LNKDGSC

SEQ ID NO: 2568418 - protein, 13 aa, Entamoeba histolytica
LNKDKTGCGKNNY

SEQ ID NO: 2568419 - protein, 7 aa, Entamoeba histolytica
LNKEPLK

SEQ ID NO: 2568420 - protein, 5 aa, Entamoeba histolytica
LNKEY

SEQ ID NO: 2568421 - protein, 10 aa, Entamoeba histolytica
LNKNSPRGKV

SEQ ID NO: 2568422 - protein, 8 aa, Entamoeba histolytica
LNKQSEHH

SEQ ID NO: 2568423 - protein, 14 aa, Entamoeba histolytica
LNNDSSSNDYKSTD

SEQ ID NO: 2568424 - protein, 7 aa, Entamoeba histolytica
LNNGTSD

SEQ ID NO: 2568425 - protein, 40 aa, Entamoeba histolytica
LNNNENEEEGTNLKEQNITGENTEEKKDREVIKEKTPDAV

SEQ ID NO: 2568426 - protein, 5 aa, Entamoeba histolytica
LNNNG

SEQ ID NO: 2568427 - protein, 6 aa, Entamoeba histolytica
LNNNGW

SEQ ID NO: 2568428 - protein, 6 aa, Entamoeba histolytica
LNNNKG

SEQ ID NO: 2568429 - protein, 8 aa, Entamoeba histolytica
LNNSEPPR

SEQ ID NO: 2568430 - protein, 4 aa, Entamoeba histolytica
LNNT

SEQ ID NO: 2568431 - protein, 7 aa, Entamoeba histolytica
LNNTNKV

SEQ ID NO: 2568432 - protein, 9 aa, Entamoeba histolytica
LNPETEERN

SEQ ID NO: 2568433 - protein, 5 aa, Entamoeba histolytica
LNPGE

SEQ ID NO: 2568434 - protein, 17 aa, Entamoeba histolytica
LNPLESPSHLNETSNEL

SEQ ID NO: 2568435 - protein, 11 aa, Entamoeba histolytica
LNPPKGMSATN

SEQ ID NO: 2568436 - protein, 5 aa, Entamoeba histolytica
LNPTN

SEQ ID NO: 2568437 - protein, 5 aa, Entamoeba histolytica
LNQCK

SEQ ID NO: 2568438 - protein, 5 aa, Entamoeba histolytica
LNQGD

SEQ ID NO: 2568439 - protein, 10 aa, Entamoeba histolytica
LNQPNQKVEV

SEQ ID NO: 2568440 - protein, 15 aa, Entamoeba histolytica
LNQTPPKLKKSNIDT

SEQ ID NO: 2568441 - protein, 4 aa, Entamoeba histolytica
LNSC

SEQ ID NO: 2568442 - protein, 16 aa, Entamoeba histolytica
LNSDGITVSTKGAGEW

SEQ ID NO: 2568443 - protein, 7 aa, Entamoeba histolytica
LNSDKGM

SEQ ID NO: 2568444 - protein, 9 aa, Entamoeba histolytica
LNSDSTNTL

SEQ ID NO: 2568445 - protein, 15 aa, Entamoeba histolytica
LNSKNAAPAKAAYEQ

SEQ ID NO: 2568446 - protein, 10 aa, Entamoeba histolytica
LNSLEKDAEV

SEQ ID NO: 2568447 - protein, 8 aa, Entamoeba histolytica
LNSPKENL

SEQ ID NO: 2568448 - protein, 6 aa, Entamoeba histolytica
LNSPQS

SEQ ID NO: 2568449 - protein, 7 aa, Entamoeba histolytica
LNSQDDL

SEQ ID NO: 2568450 - protein, 6 aa, Entamoeba histolytica
LNSQRY

SEQ ID NO: 2568451 - protein, 11 aa, Entamoeba histolytica
LNSSDNQAGVV

SEQ ID NO: 2568452 - protein, 6 aa, Entamoeba histolytica
LNSSRE

SEQ ID NO: 2568453 - protein, 4 aa, Entamoeba histolytica
LNTE

SEQ ID NO: 2568454 - protein, 5 aa, Entamoeba histolytica
LNTEE

SEQ ID NO: 2568455 - protein, 9 aa, Entamoeba histolytica
LNTGEQDMT

SEQ ID NO: 2568456 - protein, 14 aa, Entamoeba histolytica
LNTHGNASPSFTDL

SEQ ID NO: 2568457 - protein, 12 aa, Entamoeba histolytica
LNTKEHNNEDVH

SEQ ID NO: 2568458 - protein, 11 aa, Entamoeba histolytica
LNTKSQRASEC

SEQ ID NO: 2568459 - protein, 15 aa, Entamoeba histolytica
LNTLSKDTKNNQTLP

SEQ ID NO: 2568460 - protein, 11 aa, Entamoeba histolytica
LNTNENQDTKF

SEQ ID NO: 2568461 - protein, 4 aa, Entamoeba histolytica
LNTQ

SEQ ID NO: 2568462 - protein, 7 aa, Entamoeba histolytica
LNTQGDI

SEQ ID NO: 2568463 - protein, 9 aa, Entamoeba histolytica
LNTQINKQS

SEQ ID NO: 2568464 - protein, 4 aa, Entamoeba histolytica
LNTS

SEQ ID NO: 2568465 - protein, 4 aa, Entamoeba histolytica
LNTW

SEQ ID NO: 2568466 - protein, 11 aa, Entamoeba histolytica
LNYGSGYVSTP

SEQ ID NO: 2568467 - protein, 7 aa, Entamoeba histolytica
LNYPPEI

SEQ ID NO: 2568468 - protein, 13 aa, Entamoeba histolytica
LPADASKCAYPAA

SEQ ID NO: 2568469 - protein, 8 aa, Entamoeba histolytica
LPAGQENT

SEQ ID NO: 2568470 - protein, 14 aa, Entamoeba histolytica
LPAIPQSSLRKSYN

SEQ ID NO: 2568471 - protein, 5 aa, Entamoeba histolytica
LPAPT

SEQ ID NO: 2568472 - protein, 12 aa, Entamoeba histolytica
LPATSNKECKYA

SEQ ID NO: 2568473 - protein, 8 aa, Entamoeba histolytica
LPDKIDNL

SEQ ID NO: 2568474 - protein, 5 aa, Entamoeba histolytica
LPDNR

SEQ ID NO: 2568475 - protein, 12 aa, Entamoeba histolytica
LPDPNGKSTNYL

SEQ ID NO: 2568476 - protein, 9 aa, Entamoeba histolytica
LPDPNQSNE

SEQ ID NO: 2568477 - protein, 12 aa, Entamoeba histolytica
LPDSYESNIDQG

SEQ ID NO: 2568478 - protein, 9 aa, Entamoeba histolytica
LPDTEECNN

SEQ ID NO: 2568479 - protein, 5 aa, Entamoeba histolytica
LPDTY

SEQ ID NO: 2568480 - protein, 12 aa, Entamoeba histolytica
LPEDQVSCPNDR

SEQ ID NO: 2568481 - protein, 10 aa, Entamoeba histolytica
LPENESSTSL

SEQ ID NO: 2568482 - protein, 5 aa, Entamoeba histolytica
LPEQK

SEQ ID NO: 2568483 - protein, 11 aa, Entamoeba histolytica
LPEQSSSMSPR

SEQ ID NO: 2568484 - protein, 6 aa, Entamoeba histolytica
LPETTV

SEQ ID NO: 2568485 - protein, 5 aa, Entamoeba histolytica
LPGAD

SEQ ID NO: 2568486 - protein, 14 aa, Entamoeba histolytica
LPGCSDCSQTEKAC

SEQ ID NO: 2568487 - protein, 8 aa, Entamoeba histolytica
LPGESSSY

SEQ ID NO: 2568488 - protein, 6 aa, Entamoeba histolytica
LPGGTC

SEQ ID NO: 2568489 - protein, 4 aa, Entamoeba histolytica
LPHD

SEQ ID NO: 2568490 - protein, 13 aa, Entamoeba histolytica
LPIDKNSKVDTNS

SEQ ID NO: 2568491 - protein, 11 aa, Entamoeba histolytica
LPIRQSKDDIL

SEQ ID NO: 2568492 - protein, 6 aa, Entamoeba histolytica
LPKEIR

SEQ ID NO: 2568493 - protein, 9 aa, Entamoeba histolytica
LPKEYKGSC

SEQ ID NO: 2568494 - protein, 4 aa, Entamoeba histolytica
LPKK

SEQ ID NO: 2568495 - protein, 9 aa, Entamoeba histolytica
LPKKGGRMI

SEQ ID NO: 2568496 - protein, 10 aa, Entamoeba histolytica
LPKPSVSLSR

SEQ ID NO: 2568497 - protein, 5 aa, Entamoeba histolytica
LPKTL

SEQ ID NO: 2568498 - protein, 11 aa, Entamoeba histolytica
LPNAKKAKRTI

SEQ ID NO: 2568499 - protein, 6 aa, Entamoeba histolytica
LPNDEN

SEQ ID NO: 2568500 - protein, 7 aa, Entamoeba histolytica
LPNEIPE

SEQ ID NO: 2568501 - protein, 5 aa, Entamoeba histolytica
LPNEY

SEQ ID NO: 2568502 - protein, 8 aa, Entamoeba histolytica
LPNNKSSL

SEQ ID NO: 2568503 - protein, 6 aa, Entamoeba histolytica
LPNNPI

SEQ ID NO: 2568504 - protein, 6 aa, Entamoeba histolytica
LPPAER

SEQ ID NO: 2568505 - protein, 21 aa, Entamoeba histolytica
LPPAERQKCSSNIDTEPPDYY

SEQ ID NO: 2568506 - protein, 10 aa, Entamoeba histolytica
LPPEGTSRIG

SEQ ID NO: 2568507 - protein, 5 aa, Entamoeba histolytica
LPPEQ

SEQ ID NO: 2568508 - protein, 13 aa, Entamoeba histolytica
LPPGTETRDVSQN

SEQ ID NO: 2568509 - protein, 5 aa, Entamoeba histolytica
LPPHL

SEQ ID NO: 2568510 - protein, 5 aa, Entamoeba histolytica
LPPIE

SEQ ID NO: 2568511 - protein, 19 aa, Entamoeba histolytica
LPPKKIEKDKIKKEQYKED

SEQ ID NO: 2568512 - protein, 7 aa, Entamoeba histolytica
LPPLSTN

SEQ ID NO: 2568513 - protein, 16 aa, Entamoeba histolytica
LPPNTHVKATQEYNST

SEQ ID NO: 2568514 - protein, 6 aa, Entamoeba histolytica
LPPSEL

SEQ ID NO: 2568515 - protein, 6 aa, Entamoeba histolytica
LPPTPL

SEQ ID NO: 2568516 - protein, 6 aa, Entamoeba histolytica
LPQGAL

SEQ ID NO: 2568517 - protein, 5 aa, Entamoeba histolytica
LPQGI

SEQ ID NO: 2568518 - protein, 4 aa, Entamoeba histolytica
LPQI

SEQ ID NO: 2568519 - protein, 8 aa, Entamoeba histolytica
LPQPSDMS

SEQ ID NO: 2568520 - protein, 6 aa, Entamoeba histolytica
LPQPTN

SEQ ID NO: 2568521 - protein, 12 aa, Entamoeba histolytica
LPRATRRGDENR

SEQ ID NO: 2568522 - protein, 11 aa, Entamoeba histolytica
LPSCERAANEN

SEQ ID NO: 2568523 - protein, 11 aa, Entamoeba histolytica
LPSCERTANGN

SEQ ID NO: 2568524 - protein, 5 aa, Entamoeba histolytica
LPSDG

SEQ ID NO: 2568525 - protein, 11 aa, Entamoeba histolytica
LPSDTPKKEPI

SEQ ID NO: 2568526 - protein, 11 aa, Entamoeba histolytica
LPSEKEKKEAE

SEQ ID NO: 2568527 - protein, 8 aa, Entamoeba histolytica
LPSEVQQG

SEQ ID NO: 2568528 - protein, 13 aa, Entamoeba histolytica
LPSGATISGTGSL

SEQ ID NO: 2568529 - protein, 10 aa, Entamoeba histolytica
LPSKKDSLSH

SEQ ID NO: 2568530 - protein, 6 aa, Entamoeba histolytica
LPSKTQ

SEQ ID NO: 2568531 - protein, 11 aa, Entamoeba histolytica
LPSLKKNKDIH

SEQ ID NO: 2568532 - protein, 4 aa, Entamoeba histolytica
LPSP

SEQ ID NO: 2568533 - protein, 5 aa, Entamoeba histolytica
LPSPT

SEQ ID NO: 2568534 - protein, 6 aa, Entamoeba histolytica
LPSPVN

SEQ ID NO: 2568535 - protein, 6 aa, Entamoeba histolytica
LPSSET

SEQ ID NO: 2568536 - protein, 7 aa, Entamoeba histolytica
LPSTLKQ

SEQ ID NO: 2568537 - protein, 9 aa, Entamoeba histolytica
LPTEQQKHG

SEQ ID NO: 2568538 - protein, 11 aa, Entamoeba histolytica
LPTKTPRDKAI

SEQ ID NO: 2568539 - protein, 6 aa, Entamoeba histolytica
LPTPIN

SEQ ID NO: 2568540 - protein, 10 aa, Entamoeba histolytica
LPVETEPQTA

SEQ ID NO: 2568541 - protein, 10 aa, Entamoeba histolytica
LPYNGNDEEH

SEQ ID NO: 2568542 - protein, 14 aa, Entamoeba histolytica
LQAETSTKNSTHEQ

SEQ ID NO: 2568543 - protein, 8 aa, Entamoeba histolytica
LQEENTKS

SEQ ID NO: 2568544 - protein, 4 aa, Entamoeba histolytica
LQEK

SEQ ID NO: 2568545 - protein, 11 aa, Entamoeba histolytica
LQEKEKKGSGI

SEQ ID NO: 2568546 - protein, 7 aa, Entamoeba histolytica
LQEKKQL

SEQ ID NO: 2568547 - protein, 8 aa, Entamoeba histolytica
LQEKYGTS

SEQ ID NO: 2568548 - protein, 11 aa, Entamoeba histolytica
LQENEDEKRKV

SEQ ID NO: 2568549 - protein, 9 aa, Entamoeba histolytica
LQENHKKVD

SEQ ID NO: 2568550 - protein, 10 aa, Entamoeba histolytica
LQEPDVDNSD

SEQ ID NO: 2568551 - protein, 6 aa, Entamoeba histolytica
LQESTN

SEQ ID NO: 2568552 - protein, 5 aa, Entamoeba histolytica
LQGKN

SEQ ID NO: 2568553 - protein, 9 aa, Entamoeba histolytica
LQKDGKHQK

SEQ ID NO: 2568554 - protein, 23 aa, Entamoeba histolytica
LQKKESQNKNKQEQEEKRIRSIE

SEQ ID NO: 2568555 - protein, 12 aa, Entamoeba histolytica
LQKQGSNTNGVN

SEQ ID NO: 2568556 - protein, 8 aa, Entamoeba histolytica
LQNNNQGV

SEQ ID NO: 2568557 - protein, 22 aa, Entamoeba histolytica
LQNPENCQERFNSSDPNSTELG

SEQ ID NO: 2568558 - protein, 5 aa, Entamoeba histolytica
LQNYE

SEQ ID NO: 2568559 - protein, 6 aa, Entamoeba histolytica
LQNYET

SEQ ID NO: 2568560 - protein, 9 aa, Entamoeba histolytica
LQPEPENEK

SEQ ID NO: 2568561 - protein, 11 aa, Entamoeba histolytica
LQPKNDDPDAD

SEQ ID NO: 2568562 - protein, 14 aa, Entamoeba histolytica
LQPQDRTSAPNSEY

SEQ ID NO: 2568563 - protein, 12 aa, Entamoeba histolytica
LQPRGNDGFKPK

SEQ ID NO: 2568564 - protein, 6 aa, Entamoeba histolytica
LQPSTQ

SEQ ID NO: 2568565 - protein, 6 aa, Entamoeba histolytica
LQPTNK

SEQ ID NO: 2568566 - protein, 12 aa, Entamoeba histolytica
LQPTQPLQHPHK

SEQ ID NO: 2568567 - protein, 9 aa, Entamoeba histolytica
LQPVGNKKQ

SEQ ID NO: 2568568 - protein, 6 aa, Entamoeba histolytica
LQQGEA

SEQ ID NO: 2568569 - protein, 11 aa, Entamoeba histolytica
LQQGQNKLKIE

SEQ ID NO: 2568570 - protein, 5 aa, Entamoeba histolytica
LQQKT

SEQ ID NO: 2568571 - protein, 9 aa, Entamoeba histolytica
LQQQNTNQE

SEQ ID NO: 2568572 - protein, 17 aa, Entamoeba histolytica
LQQSSSSSSSSDSTSSS

SEQ ID NO: 2568573 - protein, 12 aa, Entamoeba histolytica
LQQYTKEYEDAI

SEQ ID NO: 2568574 - protein, 7 aa, Entamoeba histolytica
LQRKQKD

SEQ ID NO: 2568575 - protein, 6 aa, Entamoeba histolytica
LQRRQI

SEQ ID NO: 2568576 - protein, 8 aa, Entamoeba histolytica
LQSDGSCG

SEQ ID NO: 2568577 - protein, 4 aa, Entamoeba histolytica
LQSG

SEQ ID NO: 2568578 - protein, 8 aa, Entamoeba histolytica
LQSNPSTN

SEQ ID NO: 2568579 - protein, 8 aa, Entamoeba histolytica
LQSPQGKN

SEQ ID NO: 2568580 - protein, 11 aa, Entamoeba histolytica
LQSPQQSNTLS

SEQ ID NO: 2568581 - protein, 5 aa, Entamoeba histolytica
LQSQS

SEQ ID NO: 2568582 - protein, 11 aa, Entamoeba histolytica
LQSRDDPSITA

SEQ ID NO: 2568583 - protein, 4 aa, Entamoeba histolytica
LQSS

SEQ ID NO: 2568584 - protein, 11 aa, Entamoeba histolytica
LQSSSYCPKLS

SEQ ID NO: 2568585 - protein, 26 aa, Entamoeba histolytica
LQTATTNITTESHTDQHSKDSFSNIK

SEQ ID NO: 2568586 - protein, 10 aa, Entamoeba histolytica
LQTEKTVNEK

SEQ ID NO: 2568587 - protein, 33 aa, Entamoeba histolytica
LQTESSISSPHKDNVLNSPRSDTATENQQQQPN

SEQ ID NO: 2568588 - protein, 8 aa, Entamoeba histolytica
LQTGEQEK

SEQ ID NO: 2568589 - protein, 6 aa, Entamoeba histolytica
LQTLPD

SEQ ID NO: 2568590 - protein, 6 aa, Entamoeba histolytica
LQTNPT

SEQ ID NO: 2568591 - protein, 17 aa, Entamoeba histolytica
LQTRTSYDSEKERYTSK

SEQ ID NO: 2568592 - protein, 18 aa, Entamoeba histolytica
LQTRTSYGSEKERYTNKV

SEQ ID NO: 2568593 - protein, 5 aa, Entamoeba histolytica
LRASD

SEQ ID NO: 2568594 - protein, 4 aa, Entamoeba histolytica
LRDG

SEQ ID NO: 2568595 - protein, 7 aa, Entamoeba histolytica
LRDGDGY

SEQ ID NO: 2568596 - protein, 4 aa, Entamoeba histolytica
LRDQ

SEQ ID NO: 2568597 - protein, 5 aa, Entamoeba histolytica
LRDRR

SEQ ID NO: 2568598 - protein, 4 aa, Entamoeba histolytica
LREG

SEQ ID NO: 2568599 - protein, 6 aa, Entamoeba histolytica
LREKAR

SEQ ID NO: 2568600 - protein, 5 aa, Entamoeba histolytica
LREPK

SEQ ID NO: 2568601 - protein, 9 aa, Entamoeba histolytica
LREPTSSIG

SEQ ID NO: 2568602 - protein, 12 aa, Entamoeba histolytica
LRFGSEKAPVEI

SEQ ID NO: 2568603 - protein, 15 aa, Entamoeba histolytica
LRGDNTSSSTTLPKT

SEQ ID NO: 2568604 - protein, 12 aa, Entamoeba histolytica
LRGETPTNTPAL

SEQ ID NO: 2568605 - protein, 4 aa, Entamoeba histolytica
LRGN

SEQ ID NO: 2568606 - protein, 21 aa, Entamoeba histolytica
LRIDESEMTGESASVKKSEDN

SEQ ID NO: 2568607 - protein, 5 aa, Entamoeba histolytica
LRKEK

SEQ ID NO: 2568608 - protein, 6 aa, Entamoeba histolytica
LRKGKL

SEQ ID NO: 2568609 - protein, 18 aa, Entamoeba histolytica
LRKKNVNKDQSKSQLTST

SEQ ID NO: 2568610 - protein, 8 aa, Entamoeba histolytica
LRKKQQNK

SEQ ID NO: 2568611 - protein, 9 aa, Entamoeba histolytica
LRKNAKRQL

SEQ ID NO: 2568612 - protein, 13 aa, Entamoeba histolytica
LRKQKSDSQKSMT

SEQ ID NO: 2568613 - protein, 13 aa, Entamoeba histolytica
LRKQNSDSQKSMT

SEQ ID NO: 2568614 - protein, 20 aa, Entamoeba histolytica
LRNKQKEDDLYAEPFIDPDN

SEQ ID NO: 2568615 - protein, 5 aa, Entamoeba histolytica
LRPDA

SEQ ID NO: 2568616 - protein, 6 aa, Entamoeba histolytica
LRPPND

SEQ ID NO: 2568617 - protein, 7 aa, Entamoeba histolytica
LRSEGQN

SEQ ID NO: 2568618 - protein, 5 aa, Entamoeba histolytica
LRSKN

SEQ ID NO: 2568619 - protein, 18 aa, Entamoeba histolytica
LRSRSNKQLKGDPISTYS

SEQ ID NO: 2568620 - protein, 20 aa, Entamoeba histolytica
LRTEARELQREGARYGPFTD

SEQ ID NO: 2568621 - protein, 6 aa, Entamoeba histolytica
LRTEKE

SEQ ID NO: 2568622 - protein, 8 aa, Entamoeba histolytica
LRTQPEYS

SEQ ID NO: 2568623 - protein, 9 aa, Entamoeba histolytica
LSAASGKIG

SEQ ID NO: 2568624 - protein, 8 aa, Entamoeba histolytica
LSASGQFK

SEQ ID NO: 2568625 - protein, 9 aa, Entamoeba histolytica
LSASPTYNV

SEQ ID NO: 2568626 - protein, 7 aa, Entamoeba histolytica
LSASSSS

SEQ ID NO: 2568627 - protein, 9 aa, Entamoeba histolytica
LSDEHSDDL

SEQ ID NO: 2568628 - protein, 15 aa, Entamoeba histolytica
LSDFGTSRDVSSSNV

SEQ ID NO: 2568629 - protein, 7 aa, Entamoeba histolytica
LSDGKGK

SEQ ID NO: 2568630 - protein, 15 aa, Entamoeba histolytica
LSDGTTKKEQCDGGV

SEQ ID NO: 2568631 - protein, 5 aa, Entamoeba histolytica
LSDNW

SEQ ID NO: 2568632 - protein, 10 aa, Entamoeba histolytica
LSDPSPKDIT

SEQ ID NO: 2568633 - protein, 6 aa, Entamoeba histolytica
LSDSTT

SEQ ID NO: 2568634 - protein, 8 aa, Entamoeba histolytica
LSDTQTSN

SEQ ID NO: 2568635 - protein, 5 aa, Entamoeba histolytica
LSEAN

SEQ ID NO: 2568636 - protein, 12 aa, Entamoeba histolytica
LSEEGENDEDIK

SEQ ID NO: 2568637 - protein, 6 aa, Entamoeba histolytica
LSEEKY

SEQ ID NO: 2568638 - protein, 13 aa, Entamoeba histolytica
LSEHQKDSINNPL

SEQ ID NO: 2568639 - protein, 9 aa, Entamoeba histolytica
LSEITNEQN

SEQ ID NO: 2568640 - protein, 12 aa, Entamoeba histolytica
LSENDEACGRCP

SEQ ID NO: 2568641 - protein, 6 aa, Entamoeba histolytica
LSENET

SEQ ID NO: 2568642 - protein, 85 aa, Entamoeba histolytica
LSEPALANSQSASQASGISTPTGSAVTTQEGNSPAQSGLAPAENPASTSPKGNEPPAKVEGNSLQSKQVSGDTPEGGSSTTHSEI

SEQ ID NO: 2568643 - protein, 92 aa, Entamoeba histolytica
LSEPALANSQSASQASGISTPTGSAVTTQEGNSPAQSGLAPAENPASTSPKGNEPPAKVEGNSPQSGVSAPQSKQVSGDTPEGGSSTTHSEI

SEQ ID NO: 2568644 - protein, 92 aa, Entamoeba histolytica
LSEPAPANSQSASQASGISTPTGSAVTTQEGNSPAQSGLAPAENPASTSPKGNEPPAKVEGNSPQSGVSAPQSKQVSGDTPEGGSSTTHSEI

SEQ ID NO: 2568645 - protein, 5 aa, Entamoeba histolytica
LSEQQ

SEQ ID NO: 2568646 - protein, 17 aa, Entamoeba histolytica
LSESEENEEAMPSVAPN

SEQ ID NO: 2568647 - protein, 6 aa, Entamoeba histolytica
LSESHI

SEQ ID NO: 2568648 - protein, 9 aa, Entamoeba histolytica
LSESLGSPS

SEQ ID NO: 2568649 - protein, 6 aa, Entamoeba histolytica
LSETIE

SEQ ID NO: 2568650 - protein, 5 aa, Entamoeba histolytica
LSETV

SEQ ID NO: 2568651 - protein, 6 aa, Entamoeba histolytica
LSFNPN

SEQ ID NO: 2568652 - protein, 4 aa, Entamoeba histolytica
LSFS

SEQ ID NO: 2568653 - protein, 7 aa, Entamoeba histolytica
LSGDSVE

SEQ ID NO: 2568654 - protein, 6 aa, Entamoeba histolytica
LSGFNT

SEQ ID NO: 2568655 - protein, 9 aa, Entamoeba histolytica
LSGKKTRSI

SEQ ID NO: 2568656 - protein, 8 aa, Entamoeba histolytica
LSGPYDEN

SEQ ID NO: 2568657 - protein, 5 aa, Entamoeba histolytica
LSGSE

SEQ ID NO: 2568658 - protein, 14 aa, Entamoeba histolytica
LSGTECKRKDTFEK

SEQ ID NO: 2568659 - protein, 12 aa, Entamoeba histolytica
LSGTESRDFNQD

SEQ ID NO: 2568660 - protein, 12 aa, Entamoeba histolytica
LSKAEAQKNEGV

SEQ ID NO: 2568661 - protein, 18 aa, Entamoeba histolytica
LSKEKQKRINAKRNGYND

SEQ ID NO: 2568662 - protein, 15 aa, Entamoeba histolytica
LSKKPKDDEDEYYDG

SEQ ID NO: 2568663 - protein, 6 aa, Entamoeba histolytica
LSKNPI

SEQ ID NO: 2568664 - protein, 11 aa, Entamoeba histolytica
LSKNTISSQQY

SEQ ID NO: 2568665 - protein, 8 aa, Entamoeba histolytica
LSKQGTKM

SEQ ID NO: 2568666 - protein, 11 aa, Entamoeba histolytica
LSKQSNKSVQI

SEQ ID NO: 2568667 - protein, 4 aa, Entamoeba histolytica
LSKR

SEQ ID NO: 2568668 - protein, 7 aa, Entamoeba histolytica
LSKSNKL

SEQ ID NO: 2568669 - protein, 6 aa, Entamoeba histolytica
LSKTSY

SEQ ID NO: 2568670 - protein, 4 aa, Entamoeba histolytica
LSLT

SEQ ID NO: 2568671 - protein, 13 aa, Entamoeba histolytica
LSMNSSSNETINR

SEQ ID NO: 2568672 - protein, 26 aa, Entamoeba histolytica
LSNEKEVVDEEGNGQTEPIGTAGIPG

SEQ ID NO: 2568673 - protein, 10 aa, Entamoeba histolytica
LSNENQKYFN

SEQ ID NO: 2568674 - protein, 7 aa, Entamoeba histolytica
LSNEQTT

SEQ ID NO: 2568675 - protein, 6 aa, Entamoeba histolytica
LSNGLG

SEQ ID NO: 2568676 - protein, 16 aa, Entamoeba histolytica
LSNKNEIELQEGEEIK

SEQ ID NO: 2568677 - protein, 7 aa, Entamoeba histolytica
LSNKQQL

SEQ ID NO: 2568678 - protein, 5 aa, Entamoeba histolytica
LSNQE

SEQ ID NO: 2568679 - protein, 7 aa, Entamoeba histolytica
LSNQQSC

SEQ ID NO: 2568680 - protein, 12 aa, Entamoeba histolytica
LSNSISPKMATS

SEQ ID NO: 2568681 - protein, 18 aa, Entamoeba histolytica
LSNTIKKISSKKSSSSVK

SEQ ID NO: 2568682 - protein, 6 aa, Entamoeba histolytica
LSNTQE

SEQ ID NO: 2568683 - protein, 6 aa, Entamoeba histolytica
LSNYST

SEQ ID NO: 2568684 - protein, 4 aa, Entamoeba histolytica
LSPA

SEQ ID NO: 2568685 - protein, 7 aa, Entamoeba histolytica
LSPATRA

SEQ ID NO: 2568686 - protein, 9 aa, Entamoeba histolytica
LSPEPKTPL

SEQ ID NO: 2568687 - protein, 7 aa, Entamoeba histolytica
LSPETSN

SEQ ID NO: 2568688 - protein, 12 aa, Entamoeba histolytica
LSPGTVQAQNEV

SEQ ID NO: 2568689 - protein, 6 aa, Entamoeba histolytica
LSPKGF

SEQ ID NO: 2568690 - protein, 5 aa, Entamoeba histolytica
LSPRK

SEQ ID NO: 2568691 - protein, 15 aa, Entamoeba histolytica
LSPRKEENKEMNDKK

SEQ ID NO: 2568692 - protein, 7 aa, Entamoeba histolytica
LSPRRTV

SEQ ID NO: 2568693 - protein, 6 aa, Entamoeba histolytica
LSPSGE

SEQ ID NO: 2568694 - protein, 8 aa, Entamoeba histolytica
LSPSNNIR

SEQ ID NO: 2568695 - protein, 7 aa, Entamoeba histolytica
LSPSTDI

SEQ ID NO: 2568696 - protein, 7 aa, Entamoeba histolytica
LSPTGRF

SEQ ID NO: 2568697 - protein, 7 aa, Entamoeba histolytica
LSPTGRY

SEQ ID NO: 2568698 - protein, 4 aa, Entamoeba histolytica
LSPV

SEQ ID NO: 2568699 - protein, 4 aa, Entamoeba histolytica
LSPY

SEQ ID NO: 2568700 - protein, 6 aa, Entamoeba histolytica
LSPYDD

SEQ ID NO: 2568701 - protein, 8 aa, Entamoeba histolytica
LSPYDPPL

SEQ ID NO: 2568702 - protein, 26 aa, Entamoeba histolytica
LSQDSKKVDKMKTKPSHRQTISEHSQ

SEQ ID NO: 2568703 - protein, 9 aa, Entamoeba histolytica
LSQETWSET

SEQ ID NO: 2568704 - protein, 11 aa, Entamoeba histolytica
LSQGIGTPTYM

SEQ ID NO: 2568705 - protein, 10 aa, Entamoeba histolytica
LSQKSRRPTY

SEQ ID NO: 2568706 - protein, 4 aa, Entamoeba histolytica
LSQS

SEQ ID NO: 2568707 - protein, 6 aa, Entamoeba histolytica
LSQTNE

SEQ ID NO: 2568708 - protein, 5 aa, Entamoeba histolytica
LSRFT

SEQ ID NO: 2568709 - protein, 12 aa, Entamoeba histolytica
LSRKSTKTDSIE

SEQ ID NO: 2568710 - protein, 10 aa, Entamoeba histolytica
LSRNENNRYL

SEQ ID NO: 2568711 - protein, 5 aa, Entamoeba histolytica
LSRRH

SEQ ID NO: 2568712 - protein, 13 aa, Entamoeba histolytica
LSRRRGEKSGEII

SEQ ID NO: 2568713 - protein, 14 aa, Entamoeba histolytica
LSRSQTSLSLSTPK

SEQ ID NO: 2568714 - protein, 8 aa, Entamoeba histolytica
LSRTNAYS

SEQ ID NO: 2568715 - protein, 11 aa, Entamoeba histolytica
LSSAKPSGSAN

SEQ ID NO: 2568716 - protein, 7 aa, Entamoeba histolytica
LSSDSVA

SEQ ID NO: 2568717 - protein, 9 aa, Entamoeba histolytica
LSSDYKDQF

SEQ ID NO: 2568718 - protein, 7 aa, Entamoeba histolytica
LSSEEKQ

SEQ ID NO: 2568719 - protein, 7 aa, Entamoeba histolytica
LSSESEK

SEQ ID NO: 2568720 - protein, 10 aa, Entamoeba histolytica
LSSGESISGQ

SEQ ID NO: 2568721 - protein, 33 aa, Entamoeba histolytica
LSSHSSANLNGRDGSQRRENSKELNNTNQNYNN

SEQ ID NO: 2568722 - protein, 4 aa, Entamoeba histolytica
LSSK

SEQ ID NO: 2568723 - protein, 8 aa, Entamoeba histolytica
LSSKDSNF

SEQ ID NO: 2568724 - protein, 8 aa, Entamoeba histolytica
LSSKECNT

SEQ ID NO: 2568725 - protein, 8 aa, Entamoeba histolytica
LSSNNEYK

SEQ ID NO: 2568726 - protein, 8 aa, Entamoeba histolytica
LSSNNKYK

SEQ ID NO: 2568727 - protein, 5 aa, Entamoeba histolytica
LSSPN

SEQ ID NO: 2568728 - protein, 6 aa, Entamoeba histolytica
LSSPNS

SEQ ID NO: 2568729 - protein, 7 aa, Entamoeba histolytica
LSSSGNA

SEQ ID NO: 2568730 - protein, 8 aa, Entamoeba histolytica
LSSSNDDG

SEQ ID NO: 2568731 - protein, 4 aa, Entamoeba histolytica
LSST

SEQ ID NO: 2568732 - protein, 14 aa, Entamoeba histolytica
LSSVNSPLQTDLNP

SEQ ID NO: 2568733 - protein, 12 aa, Entamoeba histolytica
LSSYGKSHLENS

SEQ ID NO: 2568734 - protein, 10 aa, Entamoeba histolytica
LSTDDSIELN

SEQ ID NO: 2568735 - protein, 4 aa, Entamoeba histolytica
LSTE

SEQ ID NO: 2568736 - protein, 9 aa, Entamoeba histolytica
LSTGPKGGN

SEQ ID NO: 2568737 - protein, 9 aa, Entamoeba histolytica
LSTKENRTQ

SEQ ID NO: 2568738 - protein, 9 aa, Entamoeba histolytica
LSTKNKKFF

SEQ ID NO: 2568739 - protein, 7 aa, Entamoeba histolytica
LSTKTSS

SEQ ID NO: 2568740 - protein, 13 aa, Entamoeba histolytica
LSTNDDSVQGCGS

SEQ ID NO: 2568741 - protein, 8 aa, Entamoeba histolytica
LSTPQQKQ

SEQ ID NO: 2568742 - protein, 4 aa, Entamoeba histolytica
LSTR

SEQ ID NO: 2568743 - protein, 8 aa, Entamoeba histolytica
LSTSKPLA

SEQ ID NO: 2568744 - protein, 13 aa, Entamoeba histolytica
LSTTITEKTQCTS

SEQ ID NO: 2568745 - protein, 6 aa, Entamoeba histolytica
LSVEQQ

SEQ ID NO: 2568746 - protein, 15 aa, Entamoeba histolytica
LSVPKSDVEQDVKRN

SEQ ID NO: 2568747 - protein, 6 aa, Entamoeba histolytica
LSYADD

SEQ ID NO: 2568748 - protein, 4 aa, Entamoeba histolytica
LSYE

SEQ ID NO: 2568749 - protein, 11 aa, Entamoeba histolytica
LSYKCPGNTQC

SEQ ID NO: 2568750 - protein, 14 aa, Entamoeba histolytica
LSYRDSTSSTTISL

SEQ ID NO: 2568751 - protein, 22 aa, Entamoeba histolytica
LTATSLKQKSGTLTVNANSNSL

SEQ ID NO: 2568752 - protein, 7 aa, Entamoeba histolytica
LTDDPNT

SEQ ID NO: 2568753 - protein, 6 aa, Entamoeba histolytica
LTDEEV

SEQ ID NO: 2568754 - protein, 8 aa, Entamoeba histolytica
LTDEQANS

SEQ ID NO: 2568755 - protein, 5 aa, Entamoeba histolytica
LTDES

SEQ ID NO: 2568756 - protein, 8 aa, Entamoeba histolytica
LTDFGSAR

SEQ ID NO: 2568757 - protein, 10 aa, Entamoeba histolytica
LTDISYDSNQ

SEQ ID NO: 2568758 - protein, 15 aa, Entamoeba histolytica
LTDKGEIKVKSKDIQ

SEQ ID NO: 2568759 - protein, 11 aa, Entamoeba histolytica
LTDNDSKDISA

SEQ ID NO: 2568760 - protein, 7 aa, Entamoeba histolytica
LTDPFNE

SEQ ID NO: 2568761 - protein, 10 aa, Entamoeba histolytica
LTDPKKHGEM

SEQ ID NO: 2568762 - protein, 6 aa, Entamoeba histolytica
LTDRPD

SEQ ID NO: 2568763 - protein, 5 aa, Entamoeba histolytica
LTDSG

SEQ ID NO: 2568764 - protein, 7 aa, Entamoeba histolytica
LTDSPNI

SEQ ID NO: 2568765 - protein, 10 aa, Entamoeba histolytica
LTDSPNVQTE

SEQ ID NO: 2568766 - protein, 4 aa, Entamoeba histolytica
LTEE

SEQ ID NO: 2568767 - protein, 10 aa, Entamoeba histolytica
LTEEHEEEEG

SEQ ID NO: 2568768 - protein, 5 aa, Entamoeba histolytica
LTEGQ

SEQ ID NO: 2568769 - protein, 6 aa, Entamoeba histolytica
LTEGST

SEQ ID NO: 2568770 - protein, 6 aa, Entamoeba histolytica
LTEGTQ

SEQ ID NO: 2568771 - protein, 4 aa, Entamoeba histolytica
LTEK

SEQ ID NO: 2568772 - protein, 7 aa, Entamoeba histolytica
LTEKNSI

SEQ ID NO: 2568773 - protein, 92 aa, Entamoeba histolytica
LTEPAPANSQSASQASGISTPTGSAVTTQEGNSPAQSGLAPAENPASTSPKGNEPPAKVEGNSPQSGVSAPQSKQVSGDTPEGGSSTTHSEI

SEQ ID NO: 2568774 - protein, 8 aa, Entamoeba histolytica
LTERKTTH

SEQ ID NO: 2568775 - protein, 18 aa, Entamoeba histolytica
LTEYGKQRRIYQEGSVEA

SEQ ID NO: 2568776 - protein, 5 aa, Entamoeba histolytica
LTFEN

SEQ ID NO: 2568777 - protein, 5 aa, Entamoeba histolytica
LTFTG

SEQ ID NO: 2568778 - protein, 9 aa, Entamoeba histolytica
LTGESTPHM

SEQ ID NO: 2568779 - protein, 6 aa, Entamoeba histolytica
LTGKRT

SEQ ID NO: 2568780 - protein, 6 aa, Entamoeba histolytica
LTGPES

SEQ ID NO: 2568781 - protein, 4 aa, Entamoeba histolytica
LTGT

SEQ ID NO: 2568782 - protein, 6 aa, Entamoeba histolytica
LTGTRT

SEQ ID NO: 2568783 - protein, 14 aa, Entamoeba histolytica
LTHKKEKVGGLKPS

SEQ ID NO: 2568784 - protein, 11 aa, Entamoeba histolytica
LTHSKKDVSYD

SEQ ID NO: 2568785 - protein, 6 aa, Entamoeba histolytica
LTHYKS

SEQ ID NO: 2568786 - protein, 12 aa, Entamoeba histolytica
LTIKDDNKTTIS

SEQ ID NO: 2568787 - protein, 10 aa, Entamoeba histolytica
LTIPKGKNMT

SEQ ID NO: 2568788 - protein, 5 aa, Entamoeba histolytica
LTKEN

SEQ ID NO: 2568789 - protein, 10 aa, Entamoeba histolytica
LTKPNGQSSC

SEQ ID NO: 2568790 - protein, 4 aa, Entamoeba histolytica
LTKR

SEQ ID NO: 2568791 - protein, 12 aa, Entamoeba histolytica
LTLTPDKQEMSI

SEQ ID NO: 2568792 - protein, 19 aa, Entamoeba histolytica
LTNEKLEKKREEKEIKKPL

SEQ ID NO: 2568793 - protein, 8 aa, Entamoeba histolytica
LTNGELRQ

SEQ ID NO: 2568794 - protein, 5 aa, Entamoeba histolytica
LTNKT

SEQ ID NO: 2568795 - protein, 12 aa, Entamoeba histolytica
LTNPPPPPPPLM

SEQ ID NO: 2568796 - protein, 17 aa, Entamoeba histolytica
LTNSPCPMSPRKRTLNR

SEQ ID NO: 2568797 - protein, 8 aa, Entamoeba histolytica
LTNTDDIP

SEQ ID NO: 2568798 - protein, 9 aa, Entamoeba histolytica
LTNVTSLSD

SEQ ID NO: 2568799 - protein, 14 aa, Entamoeba histolytica
LTPDLSDKSGRITS

SEQ ID NO: 2568800 - protein, 4 aa, Entamoeba histolytica
LTPE

SEQ ID NO: 2568801 - protein, 10 aa, Entamoeba histolytica
LTPEQFSSQN

SEQ ID NO: 2568802 - protein, 11 aa, Entamoeba histolytica
LTPGQKYTLGE

SEQ ID NO: 2568803 - protein, 6 aa, Entamoeba histolytica
LTPKGN

SEQ ID NO: 2568804 - protein, 9 aa, Entamoeba histolytica
LTPKITTEY

SEQ ID NO: 2568805 - protein, 6 aa, Entamoeba histolytica
LTPPPL

SEQ ID NO: 2568806 - protein, 5 aa, Entamoeba histolytica
LTPQT

SEQ ID NO: 2568807 - protein, 7 aa, Entamoeba histolytica
LTPSSTE

SEQ ID NO: 2568808 - protein, 5 aa, Entamoeba histolytica
LTPYE

SEQ ID NO: 2568809 - protein, 5 aa, Entamoeba histolytica
LTPYT

SEQ ID NO: 2568810 - protein, 11 aa, Entamoeba histolytica
LTQDDNEIEVN

SEQ ID NO: 2568811 - protein, 5 aa, Entamoeba histolytica
LTQEK

SEQ ID NO: 2568812 - protein, 9 aa, Entamoeba histolytica
LTQPGSDMG

SEQ ID NO: 2568813 - protein, 5 aa, Entamoeba histolytica
LTQQR

SEQ ID NO: 2568814 - protein, 6 aa, Entamoeba histolytica
LTQRGK

SEQ ID NO: 2568815 - protein, 14 aa, Entamoeba histolytica
LTQTEEDKKKFEKA

SEQ ID NO: 2568816 - protein, 8 aa, Entamoeba histolytica
LTQTTPES

SEQ ID NO: 2568817 - protein, 7 aa, Entamoeba histolytica
LTREPKT

SEQ ID NO: 2568818 - protein, 7 aa, Entamoeba histolytica
LTRGSSS

SEQ ID NO: 2568819 - protein, 4 aa, Entamoeba histolytica
LTSA

SEQ ID NO: 2568820 - protein, 9 aa, Entamoeba histolytica
LTSAKGTLS

SEQ ID NO: 2568821 - protein, 9 aa, Entamoeba histolytica
LTSATNVNT

SEQ ID NO: 2568822 - protein, 9 aa, Entamoeba histolytica
LTSDEEERF

SEQ ID NO: 2568823 - protein, 4 aa, Entamoeba histolytica
LTSE

SEQ ID NO: 2568824 - protein, 9 aa, Entamoeba histolytica
LTSEGRPIT

SEQ ID NO: 2568825 - protein, 11 aa, Entamoeba histolytica
LTSITSSSSMS

SEQ ID NO: 2568826 - protein, 4 aa, Entamoeba histolytica
LTSK

SEQ ID NO: 2568827 - protein, 7 aa, Entamoeba histolytica
LTSKQSI

SEQ ID NO: 2568828 - protein, 12 aa, Entamoeba histolytica
LTSLSNNSFEKC

SEQ ID NO: 2568829 - protein, 4 aa, Entamoeba histolytica
LTSN

SEQ ID NO: 2568830 - protein, 5 aa, Entamoeba histolytica
LTSND

SEQ ID NO: 2568831 - protein, 6 aa, Entamoeba histolytica
LTSNNG

SEQ ID NO: 2568832 - protein, 8 aa, Entamoeba histolytica
LTSPSITI

SEQ ID NO: 2568833 - protein, 8 aa, Entamoeba histolytica
LTSQSMQR

SEQ ID NO: 2568834 - protein, 18 aa, Entamoeba histolytica
LTSQTNDNDISLEWNVRE

SEQ ID NO: 2568835 - protein, 44 aa, Entamoeba histolytica
LTSSNETNNSETLKTDHQSSMNTQNSGDEKCKKVDELKEELNQV

SEQ ID NO: 2568836 - protein, 15 aa, Entamoeba histolytica
LTSSRSPSPSLTRNS

SEQ ID NO: 2568837 - protein, 9 aa, Entamoeba histolytica
LTSTDGPCK

SEQ ID NO: 2568838 - protein, 8 aa, Entamoeba histolytica
LTSTNSFQ

SEQ ID NO: 2568839 - protein, 6 aa, Entamoeba histolytica
LTTEES

SEQ ID NO: 2568840 - protein, 10 aa, Entamoeba histolytica
LTTENSQEQI

SEQ ID NO: 2568841 - protein, 23 aa, Entamoeba histolytica
LTTKEATGSLTKNPCTAETRNGN

SEQ ID NO: 2568842 - protein, 6 aa, Entamoeba histolytica
LTTNGV

SEQ ID NO: 2568843 - protein, 8 aa, Entamoeba histolytica
LTTNKSSD

SEQ ID NO: 2568844 - protein, 6 aa, Entamoeba histolytica
LTTNSS

SEQ ID NO: 2568845 - protein, 28 aa, Entamoeba histolytica
LTTNTTTNTVEDQGESIEASASSQMVDN

SEQ ID NO: 2568846 - protein, 9 aa, Entamoeba histolytica
LTTQPDPNF

SEQ ID NO: 2568847 - protein, 4 aa, Entamoeba histolytica
LTTS

SEQ ID NO: 2568848 - protein, 10 aa, Entamoeba histolytica
LTTSGSIELN

SEQ ID NO: 2568849 - protein, 8 aa, Entamoeba histolytica
LTTSTPNI

SEQ ID NO: 2568850 - protein, 13 aa, Entamoeba histolytica
LTYNSKGKKNTVV

SEQ ID NO: 2568851 - protein, 11 aa, Entamoeba histolytica
LTYNTERGNGF

SEQ ID NO: 2568852 - protein, 8 aa, Entamoeba histolytica
LVESSQQT

SEQ ID NO: 2568853 - protein, 5 aa, Entamoeba histolytica
LVKQP

SEQ ID NO: 2568854 - protein, 5 aa, Entamoeba histolytica
LVQNT

SEQ ID NO: 2568855 - protein, 4 aa, Entamoeba histolytica
LVTT

SEQ ID NO: 2568856 - protein, 10 aa, Entamoeba histolytica
LYDPTDNSCS

SEQ ID NO: 2568857 - protein, 6 aa, Entamoeba histolytica
LYKQQQ

SEQ ID NO: 2568858 - protein, 5 aa, Entamoeba histolytica
LYKTD

SEQ ID NO: 2568859 - protein, 4 aa, Entamoeba histolytica
LYNK

SEQ ID NO: 2568860 - protein, 6 aa, Entamoeba histolytica
LYPAED

SEQ ID NO: 2568861 - protein, 6 aa, Entamoeba histolytica
LYPSNS

SEQ ID NO: 2568862 - protein, 11 aa, Entamoeba histolytica
LYQGESPLKDI

SEQ ID NO: 2568863 - protein, 13 aa, Entamoeba histolytica
LYSKTKQNTCQKE

SEQ ID NO: 2568864 - protein, 12 aa, Entamoeba histolytica
LYSQSNQKEESV

SEQ ID NO: 2568865 - protein, 5 aa, Entamoeba histolytica
LYYGG

SEQ ID NO: 2568866 - protein, 17 aa, Entamoeba histolytica
MAKDAEKDAILYLSSKI

SEQ ID NO: 2568867 - protein, 13 aa, Entamoeba histolytica
MAKTTNGSFLGSS

SEQ ID NO: 2568868 - protein, 7 aa, Entamoeba histolytica
MDDETLK

SEQ ID NO: 2568869 - protein, 50 aa, Entamoeba histolytica
MDDSSGSTDEDEVARDNGEEVAYKSKISKKISYNSEGESKDELSKEDIKN

SEQ ID NO: 2568870 - protein, 7 aa, Entamoeba histolytica
MDETTED

SEQ ID NO: 2568871 - protein, 10 aa, Entamoeba histolytica
MDGKSKINLG

SEQ ID NO: 2568872 - protein, 8 aa, Entamoeba histolytica
MDKDNNYI

SEQ ID NO: 2568873 - protein, 10 aa, Entamoeba histolytica
MDKEKPKEKH

SEQ ID NO: 2568874 - protein, 7 aa, Entamoeba histolytica
MDKESTL

SEQ ID NO: 2568875 - protein, 10 aa, Entamoeba histolytica
MDNEVSNDKI

SEQ ID NO: 2568876 - protein, 5 aa, Entamoeba histolytica
MDPNE

SEQ ID NO: 2568877 - protein, 7 aa, Entamoeba histolytica
MDQNDKD

SEQ ID NO: 2568878 - protein, 21 aa, Entamoeba histolytica
MDRERSGMGDVNTGRPTVNGL

SEQ ID NO: 2568879 - protein, 13 aa, Entamoeba histolytica
MEDEVEDKENIQV

SEQ ID NO: 2568880 - protein, 5 aa, Entamoeba histolytica
MEDKE

SEQ ID NO: 2568881 - protein, 15 aa, Entamoeba histolytica
MEEEKSKTKKQQNEE

SEQ ID NO: 2568882 - protein, 6 aa, Entamoeba histolytica
MEEKEF

SEQ ID NO: 2568883 - protein, 8 aa, Entamoeba histolytica
MEKDTNAT

SEQ ID NO: 2568884 - protein, 11 aa, Entamoeba histolytica
MEKEGNIDSFT

SEQ ID NO: 2568885 - protein, 8 aa, Entamoeba histolytica
MEKSKNVT

SEQ ID NO: 2568886 - protein, 10 aa, Entamoeba histolytica
MEKTSKSVTY

SEQ ID NO: 2568887 - protein, 37 aa, Entamoeba histolytica
MENADIKKQNEQIDRAGQDADAMATDVSNTNAQLQEA

SEQ ID NO: 2568888 - protein, 9 aa, Entamoeba histolytica
MENDGTCTT

SEQ ID NO: 2568889 - protein, 10 aa, Entamoeba histolytica
MENESTNSKY

SEQ ID NO: 2568890 - protein, 14 aa, Entamoeba histolytica
MENETKIKKSTFGS

SEQ ID NO: 2568891 - protein, 4 aa, Entamoeba histolytica
MENI

SEQ ID NO: 2568892 - protein, 6 aa, Entamoeba histolytica
MEPGFK

SEQ ID NO: 2568893 - protein, 6 aa, Entamoeba histolytica
MEQENK

SEQ ID NO: 2568894 - protein, 8 aa, Entamoeba histolytica
MESDNDNN

SEQ ID NO: 2568895 - protein, 4 aa, Entamoeba histolytica
MESN

SEQ ID NO: 2568896 - protein, 21 aa, Entamoeba histolytica
METSESVKEEDYDADIAKNGI

SEQ ID NO: 2568897 - protein, 4 aa, Entamoeba histolytica
MFPS

SEQ ID NO: 2568898 - protein, 10 aa, Entamoeba histolytica
MGATPPRQSE

SEQ ID NO: 2568899 - protein, 10 aa, Entamoeba histolytica
MGDDEEAMEE

SEQ ID NO: 2568900 - protein, 10 aa, Entamoeba histolytica
MGGEKDYING

SEQ ID NO: 2568901 - protein, 17 aa, Entamoeba histolytica
MGGTNEKTRTGHLTATS

SEQ ID NO: 2568902 - protein, 14 aa, Entamoeba histolytica
MGKNELTASQQQSI

SEQ ID NO: 2568903 - protein, 7 aa, Entamoeba histolytica
MGNGGKM

SEQ ID NO: 2568904 - protein, 5 aa, Entamoeba histolytica
MGSGG

SEQ ID NO: 2568905 - protein, 5 aa, Entamoeba histolytica
MGSPL

SEQ ID NO: 2568906 - protein, 20 aa, Entamoeba histolytica
MIEKETGKTNQQLKKEFKLL

SEQ ID NO: 2568907 - protein, 15 aa, Entamoeba histolytica
MKASIPDVELQVITN

SEQ ID NO: 2568908 - protein, 13 aa, Entamoeba histolytica
MKEKQGTTTKKRR

SEQ ID NO: 2568909 - protein, 4 aa, Entamoeba histolytica
MKEN

SEQ ID NO: 2568910 - protein, 14 aa, Entamoeba histolytica
MKENKETGSTRKNE

SEQ ID NO: 2568911 - protein, 6 aa, Entamoeba histolytica
MKERGN

SEQ ID NO: 2568912 - protein, 7 aa, Entamoeba histolytica
MKESPKQ

SEQ ID NO: 2568913 - protein, 14 aa, Entamoeba histolytica
MKGSDYTTSSSFDK

SEQ ID NO: 2568914 - protein, 8 aa, Entamoeba histolytica
MKHPRKPT

SEQ ID NO: 2568915 - protein, 15 aa, Entamoeba histolytica
MKKDIKANTRNKIKE

SEQ ID NO: 2568916 - protein, 13 aa, Entamoeba histolytica
MKKEDNKEGKENN

SEQ ID NO: 2568917 - protein, 8 aa, Entamoeba histolytica
MKKEQREL

SEQ ID NO: 2568918 - protein, 7 aa, Entamoeba histolytica
MKKKDVK

SEQ ID NO: 2568919 - protein, 7 aa, Entamoeba histolytica
MKKSNPT

SEQ ID NO: 2568920 - protein, 8 aa, Entamoeba histolytica
MKKTPGQY

SEQ ID NO: 2568921 - protein, 12 aa, Entamoeba histolytica
MKNDQARKRVST

SEQ ID NO: 2568922 - protein, 15 aa, Entamoeba histolytica
MKNNKKSDNDKWEDE

SEQ ID NO: 2568923 - protein, 9 aa, Entamoeba histolytica
MKNPRKPTE

SEQ ID NO: 2568924 - protein, 4 aa, Entamoeba histolytica
MKNT

SEQ ID NO: 2568925 - protein, 8 aa, Entamoeba histolytica
MKNTKKEG

SEQ ID NO: 2568926 - protein, 57 aa, Entamoeba histolytica
MKQEKKNTKETDNTDIDTQTNQSEEEIKSEEENVISEEESESDNERIGSEDNDNNEN

SEQ ID NO: 2568927 - protein, 16 aa, Entamoeba histolytica
MKQQPNNVSFTVNSCD

SEQ ID NO: 2568928 - protein, 10 aa, Entamoeba histolytica
MKRESKSFEA

SEQ ID NO: 2568929 - protein, 6 aa, Entamoeba histolytica
MKRGEV

SEQ ID NO: 2568930 - protein, 7 aa, Entamoeba histolytica
MKSDGTL

SEQ ID NO: 2568931 - protein, 16 aa, Entamoeba histolytica
MKSSKNLEEKGLGTPI

SEQ ID NO: 2568932 - protein, 4 aa, Entamoeba histolytica
MKTA

SEQ ID NO: 2568933 - protein, 8 aa, Entamoeba histolytica
MKTESNKC

SEQ ID NO: 2568934 - protein, 8 aa, Entamoeba histolytica
MKTGASSN

SEQ ID NO: 2568935 - protein, 7 aa, Entamoeba histolytica
MKTGIPP

SEQ ID NO: 2568936 - protein, 12 aa, Entamoeba histolytica
MNEGKRDNYLLI

SEQ ID NO: 2568937 - protein, 4 aa, Entamoeba histolytica
MNEK

SEQ ID NO: 2568938 - protein, 5 aa, Entamoeba histolytica
MNERE

SEQ ID NO: 2568939 - protein, 5 aa, Entamoeba histolytica
MNESK

SEQ ID NO: 2568940 - protein, 5 aa, Entamoeba histolytica
MNGKS

SEQ ID NO: 2568941 - protein, 20 aa, Entamoeba histolytica
MNGNEKQETGSDEDPIGTPN

SEQ ID NO: 2568942 - protein, 5 aa, Entamoeba histolytica
MNKDE

SEQ ID NO: 2568943 - protein, 7 aa, Entamoeba histolytica
MNKEENR

SEQ ID NO: 2568944 - protein, 11 aa, Entamoeba histolytica
MNKEKEANDVK

SEQ ID NO: 2568945 - protein, 7 aa, Entamoeba histolytica
MNNPSNI

SEQ ID NO: 2568946 - protein, 6 aa, Entamoeba histolytica
MNPIPT

SEQ ID NO: 2568947 - protein, 5 aa, Entamoeba histolytica
MNQEN

SEQ ID NO: 2568948 - protein, 4 aa, Entamoeba histolytica
MNQT

SEQ ID NO: 2568949 - protein, 5 aa, Entamoeba histolytica
MNSNT

SEQ ID NO: 2568950 - protein, 6 aa, Entamoeba histolytica
MNTKDS

SEQ ID NO: 2568951 - protein, 31 aa, Entamoeba histolytica
MNYSTRKDIKNNRNIKRDEKKKEDKENEKHF

SEQ ID NO: 2568952 - protein, 9 aa, Entamoeba histolytica
MPEQNSNEI

SEQ ID NO: 2568953 - protein, 5 aa, Entamoeba histolytica
MPEVP

SEQ ID NO: 2568954 - protein, 5 aa, Entamoeba histolytica
MPKQS

SEQ ID NO: 2568955 - protein, 4 aa, Entamoeba histolytica
MPLN

SEQ ID NO: 2568956 - protein, 5 aa, Entamoeba histolytica
MPNKK

SEQ ID NO: 2568957 - protein, 11 aa, Entamoeba histolytica
MPNTNKLNSSD

SEQ ID NO: 2568958 - protein, 12 aa, Entamoeba histolytica
MPNTPSSTEDSS

SEQ ID NO: 2568959 - protein, 14 aa, Entamoeba histolytica
MPPCASASGSTSRI

SEQ ID NO: 2568960 - protein, 8 aa, Entamoeba histolytica
MPSENDYS

SEQ ID NO: 2568961 - protein, 16 aa, Entamoeba histolytica
MPTERDKDGSMIEKGR

SEQ ID NO: 2568962 - protein, 14 aa, Entamoeba histolytica
MPTGMTDERPNHSR

SEQ ID NO: 2568963 - protein, 13 aa, Entamoeba histolytica
MQARRTKSSSALG

SEQ ID NO: 2568964 - protein, 5 aa, Entamoeba histolytica
MQKGK

SEQ ID NO: 2568965 - protein, 7 aa, Entamoeba histolytica
MQNTNTG

SEQ ID NO: 2568966 - protein, 5 aa, Entamoeba histolytica
MRESN

SEQ ID NO: 2568967 - protein, 11 aa, Entamoeba histolytica
MRLSGTDKQMN

SEQ ID NO: 2568968 - protein, 10 aa, Entamoeba histolytica
MRNKGNKSKI

SEQ ID NO: 2568969 - protein, 6 aa, Entamoeba histolytica
MRQSND

SEQ ID NO: 2568970 - protein, 11 aa, Entamoeba histolytica
MSEGNPEARER

SEQ ID NO: 2568971 - protein, 6 aa, Entamoeba histolytica
MSEPSN

SEQ ID NO: 2568972 - protein, 9 aa, Entamoeba histolytica
MSGDNERNS

SEQ ID NO: 2568973 - protein, 8 aa, Entamoeba histolytica
MSGGESPL

SEQ ID NO: 2568974 - protein, 7 aa, Entamoeba histolytica
MSGGGLI

SEQ ID NO: 2568975 - protein, 8 aa, Entamoeba histolytica
MSGTSTTD

SEQ ID NO: 2568976 - protein, 4 aa, Entamoeba histolytica
MSKA

SEQ ID NO: 2568977 - protein, 15 aa, Entamoeba histolytica
MSKKCSSPFLKQNNG

SEQ ID NO: 2568978 - protein, 5 aa, Entamoeba histolytica
MSLTD

SEQ ID NO: 2568979 - protein, 4 aa, Entamoeba histolytica
MSMQ

SEQ ID NO: 2568980 - protein, 4 aa, Entamoeba histolytica
MSNG

SEQ ID NO: 2568981 - protein, 5 aa, Entamoeba histolytica
MSNQK

SEQ ID NO: 2568982 - protein, 4 aa, Entamoeba histolytica
MSQQ

SEQ ID NO: 2568983 - protein, 8 aa, Entamoeba histolytica
MSQTTSNQ

SEQ ID NO: 2568984 - protein, 28 aa, Entamoeba histolytica
MSRSSADVGRSSMDTVRTSTSLDGSDIY

SEQ ID NO: 2568985 - protein, 8 aa, Entamoeba histolytica
MSSKAGKN

SEQ ID NO: 2568986 - protein, 29 aa, Entamoeba histolytica
MSSPNQSNEISLPSPSRITNNPEQLSESN

SEQ ID NO: 2568987 - protein, 19 aa, Entamoeba histolytica
MSSPSSTCVRGKDDSQEYV

SEQ ID NO: 2568988 - protein, 4 aa, Entamoeba histolytica
MSSV

SEQ ID NO: 2568989 - protein, 4 aa, Entamoeba histolytica
MTDD

SEQ ID NO: 2568990 - protein, 4 aa, Entamoeba histolytica
MTED

SEQ ID NO: 2568991 - protein, 6 aa, Entamoeba histolytica
MTEGKD

SEQ ID NO: 2568992 - protein, 11 aa, Entamoeba histolytica
MTETDKPSDLT

SEQ ID NO: 2568993 - protein, 5 aa, Entamoeba histolytica
MTGKH

SEQ ID NO: 2568994 - protein, 6 aa, Entamoeba histolytica
MTHNSD

SEQ ID NO: 2568995 - protein, 9 aa, Entamoeba histolytica
MTNKQSSLK

SEQ ID NO: 2568996 - protein, 5 aa, Entamoeba histolytica
MTPEE

SEQ ID NO: 2568997 - protein, 27 aa, Entamoeba histolytica
MTPEERRKYEEKQRNKLVKRKQVKVRM

SEQ ID NO: 2568998 - protein, 5 aa, Entamoeba histolytica
MTQLD

SEQ ID NO: 2568999 - protein, 4 aa, Entamoeba histolytica
MTRN

SEQ ID NO: 2569000 - protein, 4 aa, Entamoeba histolytica
MTSD

SEQ ID NO: 2569001 - protein, 22 aa, Entamoeba histolytica
MTSRSDNTNFDSVARDIMETFL

SEQ ID NO: 2569002 - protein, 4 aa, Entamoeba histolytica
MTSS

SEQ ID NO: 2569003 - protein, 8 aa, Entamoeba histolytica
MTSSKDYW

SEQ ID NO: 2569004 - protein, 6 aa, Entamoeba histolytica
MTTGGV

SEQ ID NO: 2569005 - protein, 10 aa, Entamoeba histolytica
MVQSDDDDNV

SEQ ID NO: 2569006 - protein, 6 aa, Entamoeba histolytica
MYKTKG

SEQ ID NO: 2569007 - protein, 34 aa, Entamoeba histolytica
MYPPPQQPGMYPPPVQPGMYPPPQQPGMYPPPVQ

SEQ ID NO: 2569008 - protein, 4 aa, Entamoeba histolytica
MYYE

SEQ ID NO: 2569009 - protein, 7 aa, Entamoeba histolytica
NAADEQL

SEQ ID NO: 2569010 - protein, 11 aa, Entamoeba histolytica
NAASSAMTDRD

SEQ ID NO: 2569011 - protein, 23 aa, Entamoeba histolytica
NAATENSLLNPTNPYAATKAGAE

SEQ ID NO: 2569012 - protein, 23 aa, Entamoeba histolytica
NAATENSLLNPTNPYSATKAGAE

SEQ ID NO: 2569013 - protein, 8 aa, Entamoeba histolytica
NACDRNQH

SEQ ID NO: 2569014 - protein, 8 aa, Entamoeba histolytica
NACQDNKS

SEQ ID NO: 2569015 - protein, 12 aa, Entamoeba histolytica
NACSSKSEDEKI

SEQ ID NO: 2569016 - protein, 14 aa, Entamoeba histolytica
NADGIRKRKPYDLP

SEQ ID NO: 2569017 - protein, 13 aa, Entamoeba histolytica
NADRELKQTQYSD

SEQ ID NO: 2569018 - protein, 6 aa, Entamoeba histolytica
NADSGE

SEQ ID NO: 2569019 - protein, 6 aa, Entamoeba histolytica
NADTNI

SEQ ID NO: 2569020 - protein, 5 aa, Entamoeba histolytica
NADVK

SEQ ID NO: 2569021 - protein, 42 aa, Entamoeba histolytica
NAEKKHTSNNTSVNDTNTPTNKRTDNDTSSKTKQKKSKKKID

SEQ ID NO: 2569022 - protein, 10 aa, Entamoeba histolytica
NAENEERLAG

SEQ ID NO: 2569023 - protein, 16 aa, Entamoeba histolytica
NAEPSNGFCSRTQKTE

SEQ ID NO: 2569024 - protein, 6 aa, Entamoeba histolytica
NAEQDA

SEQ ID NO: 2569025 - protein, 6 aa, Entamoeba histolytica
NAERLS

SEQ ID NO: 2569026 - protein, 13 aa, Entamoeba histolytica
NAESERKRRPYDM

SEQ ID NO: 2569027 - protein, 4 aa, Entamoeba histolytica
NAET

SEQ ID NO: 2569028 - protein, 10 aa, Entamoeba histolytica
NAEVSYETTT

SEQ ID NO: 2569029 - protein, 9 aa, Entamoeba histolytica
NAFKDENNK

SEQ ID NO: 2569030 - protein, 6 aa, Entamoeba histolytica
NAFTKG

SEQ ID NO: 2569031 - protein, 5 aa, Entamoeba histolytica
NAGCS

SEQ ID NO: 2569032 - protein, 27 aa, Entamoeba histolytica
NAGDTCKQAECTKYNDNGCGKGSTGST

SEQ ID NO: 2569033 - protein, 24 aa, Entamoeba histolytica
NAGKSVEEIKEQHKDIQQPQEEIS

SEQ ID NO: 2569034 - protein, 8 aa, Entamoeba histolytica
NAGKYGKV

SEQ ID NO: 2569035 - protein, 8 aa, Entamoeba histolytica
NAGNSPLS

SEQ ID NO: 2569036 - protein, 14 aa, Entamoeba histolytica
NAGSPDATSDLDRG

SEQ ID NO: 2569037 - protein, 5 aa, Entamoeba histolytica
NAHTS

SEQ ID NO: 2569038 - protein, 9 aa, Entamoeba histolytica
NAIDTQATT

SEQ ID NO: 2569039 - protein, 13 aa, Entamoeba histolytica
NAIQSNSVCNKNK

SEQ ID NO: 2569040 - protein, 12 aa, Entamoeba histolytica
NAISKNGKYGVD

SEQ ID NO: 2569041 - protein, 13 aa, Entamoeba histolytica
NAITNRKRRPYDY

SEQ ID NO: 2569042 - protein, 26 aa, Entamoeba histolytica
NAITTTNENAEYVGADNEATNAAIFN

SEQ ID NO: 2569043 - protein, 26 aa, Entamoeba histolytica
NAITTTNENAEYVGADNEATNAATYN

SEQ ID NO: 2569044 - protein, 10 aa, Entamoeba histolytica
NAKGNERVTG

SEQ ID NO: 2569045 - protein, 8 aa, Entamoeba histolytica
NAKNRTGK

SEQ ID NO: 2569046 - protein, 4 aa, Entamoeba histolytica
NAKS

SEQ ID NO: 2569047 - protein, 6 aa, Entamoeba histolytica
NAKSSI

SEQ ID NO: 2569048 - protein, 7 aa, Entamoeba histolytica
NAKVGAS

SEQ ID NO: 2569049 - protein, 5 aa, Entamoeba histolytica
NALDF

SEQ ID NO: 2569050 - protein, 11 aa, Entamoeba histolytica
NALGKKGEIKR

SEQ ID NO: 2569051 - protein, 10 aa, Entamoeba histolytica
NALNSAQRSV

SEQ ID NO: 2569052 - protein, 8 aa, Entamoeba histolytica
NAMSKQRA

SEQ ID NO: 2569053 - protein, 6 aa, Entamoeba histolytica
NANENV

SEQ ID NO: 2569054 - protein, 7 aa, Entamoeba histolytica
NANFPLK

SEQ ID NO: 2569055 - protein, 11 aa, Entamoeba histolytica
NANKFTSDRSS

SEQ ID NO: 2569056 - protein, 5 aa, Entamoeba histolytica
NANTA

SEQ ID NO: 2569057 - protein, 6 aa, Entamoeba histolytica
NANTQY

SEQ ID NO: 2569058 - protein, 7 aa, Entamoeba histolytica
NAPATVK

SEQ ID NO: 2569059 - protein, 14 aa, Entamoeba histolytica
NAPDEIENKEEFTT

SEQ ID NO: 2569060 - protein, 8 aa, Entamoeba histolytica
NAPEAQRV

SEQ ID NO: 2569061 - protein, 13 aa, Entamoeba histolytica
NAPEPATQSEQPP

SEQ ID NO: 2569062 - protein, 7 aa, Entamoeba histolytica
NAPGNVA

SEQ ID NO: 2569063 - protein, 26 aa, Entamoeba histolytica
NAPKMNEDSDETEDENEIIKKEDKKR

SEQ ID NO: 2569064 - protein, 12 aa, Entamoeba histolytica
NAPRSKYRPKPI

SEQ ID NO: 2569065 - protein, 6 aa, Entamoeba histolytica
NAPSCV

SEQ ID NO: 2569066 - protein, 5 aa, Entamoeba histolytica
NAPSH

SEQ ID NO: 2569067 - protein, 10 aa, Entamoeba histolytica
NAPTTISTPL

SEQ ID NO: 2569068 - protein, 7 aa, Entamoeba histolytica
NAQDSSQ

SEQ ID NO: 2569069 - protein, 6 aa, Entamoeba histolytica
NAQQFN

SEQ ID NO: 2569070 - protein, 5 aa, Entamoeba histolytica
NAREL

SEQ ID NO: 2569071 - protein, 6 aa, Entamoeba histolytica
NARKKK

SEQ ID NO: 2569072 - protein, 7 aa, Entamoeba histolytica
NARSPIR

SEQ ID NO: 2569073 - protein, 7 aa, Entamoeba histolytica
NARTIPN

SEQ ID NO: 2569074 - protein, 7 aa, Entamoeba histolytica
NASASVS

SEQ ID NO: 2569075 - protein, 11 aa, Entamoeba histolytica
NASDTKQLEEF

SEQ ID NO: 2569076 - protein, 4 aa, Entamoeba histolytica
NASG

SEQ ID NO: 2569077 - protein, 13 aa, Entamoeba histolytica
NASGLSEEKKSAM

SEQ ID NO: 2569078 - protein, 8 aa, Entamoeba histolytica
NASGPGLV

SEQ ID NO: 2569079 - protein, 6 aa, Entamoeba histolytica
NASKNH

SEQ ID NO: 2569080 - protein, 9 aa, Entamoeba histolytica
NASNDSSPI

SEQ ID NO: 2569081 - protein, 6 aa, Entamoeba histolytica
NATDDP

SEQ ID NO: 2569082 - protein, 6 aa, Entamoeba histolytica
NATDGV

SEQ ID NO: 2569083 - protein, 8 aa, Entamoeba histolytica
NATENRSS

SEQ ID NO: 2569084 - protein, 7 aa, Entamoeba histolytica
NATEQLQ

SEQ ID NO: 2569085 - protein, 31 aa, Entamoeba histolytica
NATFTKNTTDSIKSTINTTITQQKNTSFQKI

SEQ ID NO: 2569086 - protein, 5 aa, Entamoeba histolytica
NATKD

SEQ ID NO: 2569087 - protein, 8 aa, Entamoeba histolytica
NATNENKI

SEQ ID NO: 2569088 - protein, 8 aa, Entamoeba histolytica
NATTTPEI

SEQ ID NO: 2569089 - protein, 23 aa, Entamoeba histolytica
NATYDKCTAPTGFSPSDTAPVYT

SEQ ID NO: 2569090 - protein, 7 aa, Entamoeba histolytica
NAVSGDA

SEQ ID NO: 2569091 - protein, 4 aa, Entamoeba histolytica
NAYP

SEQ ID NO: 2569092 - protein, 13 aa, Entamoeba histolytica
NCAEVSSNTCGND

SEQ ID NO: 2569093 - protein, 7 aa, Entamoeba histolytica
NCDDSSK

SEQ ID NO: 2569094 - protein, 12 aa, Entamoeba histolytica
NCDKEEEPGKEE

SEQ ID NO: 2569095 - protein, 8 aa, Entamoeba histolytica
NCDQTTLD

SEQ ID NO: 2569096 - protein, 11 aa, Entamoeba histolytica
NCDSRNGRCTS

SEQ ID NO: 2569097 - protein, 6 aa, Entamoeba histolytica
NCENGT

SEQ ID NO: 2569098 - protein, 9 aa, Entamoeba histolytica
NCERKNAHG

SEQ ID NO: 2569099 - protein, 7 aa, Entamoeba histolytica
NCETNTQ

SEQ ID NO: 2569100 - protein, 9 aa, Entamoeba histolytica
NCKEANNSK

SEQ ID NO: 2569101 - protein, 9 aa, Entamoeba histolytica
NCKECNNNE

SEQ ID NO: 2569102 - protein, 8 aa, Entamoeba histolytica
NCKEQTGY

SEQ ID NO: 2569103 - protein, 20 aa, Entamoeba histolytica
NCKKVADNCSKYDQSGCKEC

SEQ ID NO: 2569104 - protein, 7 aa, Entamoeba histolytica
NCKVTDQ

SEQ ID NO: 2569105 - protein, 11 aa, Entamoeba histolytica
NCLSPTEITEG

SEQ ID NO: 2569106 - protein, 10 aa, Entamoeba histolytica
NCNGQTQGNG

SEQ ID NO: 2569107 - protein, 10 aa, Entamoeba histolytica
NCNKNEGKKL

SEQ ID NO: 2569108 - protein, 14 aa, Entamoeba histolytica
NCNSASGNGNCLPQ

SEQ ID NO: 2569109 - protein, 12 aa, Entamoeba histolytica
NCNSKTNNGVCS

SEQ ID NO: 2569110 - protein, 11 aa, Entamoeba histolytica
NCPCSEAGSEI

SEQ ID NO: 2569111 - protein, 11 aa, Entamoeba histolytica
NCPDDPCGTND

SEQ ID NO: 2569112 - protein, 6 aa, Entamoeba histolytica
NCPENQ

SEQ ID NO: 2569113 - protein, 4 aa, Entamoeba histolytica
NCPV

SEQ ID NO: 2569114 - protein, 19 aa, Entamoeba histolytica
NCQDKNEKIEKKCKEYAEE

SEQ ID NO: 2569115 - protein, 4 aa, Entamoeba histolytica
NCSG

SEQ ID NO: 2569116 - protein, 6 aa, Entamoeba histolytica
NCSKYD

SEQ ID NO: 2569117 - protein, 8 aa, Entamoeba histolytica
NCSSSELN

SEQ ID NO: 2569118 - protein, 7 aa, Entamoeba histolytica
NCSSSTN

SEQ ID NO: 2569119 - protein, 12 aa, Entamoeba histolytica
NCTESGCEDGYG

SEQ ID NO: 2569120 - protein, 7 aa, Entamoeba histolytica
NCTKCSN

SEQ ID NO: 2569121 - protein, 5 aa, Entamoeba histolytica
NCTQC

SEQ ID NO: 2569122 - protein, 8 aa, Entamoeba histolytica
NCTQCGNN

SEQ ID NO: 2569123 - protein, 8 aa, Entamoeba histolytica
NCTSCTSQ

SEQ ID NO: 2569124 - protein, 13 aa, Entamoeba histolytica
NCTSSNSKSEICE

SEQ ID NO: 2569125 - protein, 9 aa, Entamoeba histolytica
NDAKNDQRR

SEQ ID NO: 2569126 - protein, 8 aa, Entamoeba histolytica
NDANQLYQ

SEQ ID NO: 2569127 - protein, 9 aa, Entamoeba histolytica
NDASEGGKD

SEQ ID NO: 2569128 - protein, 7 aa, Entamoeba histolytica
NDCSGAR

SEQ ID NO: 2569129 - protein, 6 aa, Entamoeba histolytica
NDCYEG

SEQ ID NO: 2569130 - protein, 4 aa, Entamoeba histolytica
NDDE

SEQ ID NO: 2569131 - protein, 5 aa, Entamoeba histolytica
NDDLS

SEQ ID NO: 2569132 - protein, 5 aa, Entamoeba histolytica
NDDNV

SEQ ID NO: 2569133 - protein, 5 aa, Entamoeba histolytica
NDDPE

SEQ ID NO: 2569134 - protein, 10 aa, Entamoeba histolytica
NDDSDSLNDE

SEQ ID NO: 2569135 - protein, 4 aa, Entamoeba histolytica
NDDT

SEQ ID NO: 2569136 - protein, 4 aa, Entamoeba histolytica
NDEC

SEQ ID NO: 2569137 - protein, 4 aa, Entamoeba histolytica
NDED

SEQ ID NO: 2569138 - protein, 16 aa, Entamoeba histolytica
NDEEITNDKSTSKRKW

SEQ ID NO: 2569139 - protein, 4 aa, Entamoeba histolytica
NDEK

SEQ ID NO: 2569140 - protein, 8 aa, Entamoeba histolytica
NDENNQKY

SEQ ID NO: 2569141 - protein, 8 aa, Entamoeba histolytica
NDEPEGGV

SEQ ID NO: 2569142 - protein, 4 aa, Entamoeba histolytica
NDEQ

SEQ ID NO: 2569143 - protein, 15 aa, Entamoeba histolytica
NDEQEENQEMSDSEQ

SEQ ID NO: 2569144 - protein, 4 aa, Entamoeba histolytica
NDES

SEQ ID NO: 2569145 - protein, 5 aa, Entamoeba histolytica
NDESS

SEQ ID NO: 2569146 - protein, 5 aa, Entamoeba histolytica
NDESW

SEQ ID NO: 2569147 - protein, 7 aa, Entamoeba histolytica
NDETEIE

SEQ ID NO: 2569148 - protein, 6 aa, Entamoeba histolytica
NDFDNH

SEQ ID NO: 2569149 - protein, 4 aa, Entamoeba histolytica
NDFK

SEQ ID NO: 2569150 - protein, 10 aa, Entamoeba histolytica
NDFPDKPEYI

SEQ ID NO: 2569151 - protein, 7 aa, Entamoeba histolytica
NDFSEDI

SEQ ID NO: 2569152 - protein, 4 aa, Entamoeba histolytica
NDGD

SEQ ID NO: 2569153 - protein, 10 aa, Entamoeba histolytica
NDGEELNEEK

SEQ ID NO: 2569154 - protein, 5 aa, Entamoeba histolytica
NDGEV

SEQ ID NO: 2569155 - protein, 7 aa, Entamoeba histolytica
NDGKSPL

SEQ ID NO: 2569156 - protein, 9 aa, Entamoeba histolytica
NDGNDQAKI

SEQ ID NO: 2569157 - protein, 12 aa, Entamoeba histolytica
NDGNKTITSDST

SEQ ID NO: 2569158 - protein, 13 aa, Entamoeba histolytica
NDGSYFDSTTRTC

SEQ ID NO: 2569159 - protein, 5 aa, Entamoeba histolytica
NDGTC

SEQ ID NO: 2569160 - protein, 6 aa, Entamoeba histolytica
NDGTSL

SEQ ID NO: 2569161 - protein, 5 aa, Entamoeba histolytica
NDHCK

SEQ ID NO: 2569162 - protein, 7 aa, Entamoeba histolytica
NDHEKTQ

SEQ ID NO: 2569163 - protein, 4 aa, Entamoeba histolytica
NDHP

SEQ ID NO: 2569164 - protein, 5 aa, Entamoeba histolytica
NDHSN

SEQ ID NO: 2569165 - protein, 4 aa, Entamoeba histolytica
NDHT

SEQ ID NO: 2569166 - protein, 25 aa, Entamoeba histolytica
NDIASGITKISKSDVTCSSTGKSAS

SEQ ID NO: 2569167 - protein, 7 aa, Entamoeba histolytica
NDIDEDT

SEQ ID NO: 2569168 - protein, 4 aa, Entamoeba histolytica
NDIG

SEQ ID NO: 2569169 - protein, 6 aa, Entamoeba histolytica
NDIKRQ

SEQ ID NO: 2569170 - protein, 11 aa, Entamoeba histolytica
NDISDTNPEGS

SEQ ID NO: 2569171 - protein, 5 aa, Entamoeba histolytica
NDITD

SEQ ID NO: 2569172 - protein, 7 aa, Entamoeba histolytica
NDKEKSI

SEQ ID NO: 2569173 - protein, 7 aa, Entamoeba histolytica
NDKEKWL

SEQ ID NO: 2569174 - protein, 7 aa, Entamoeba histolytica
NDKGEMK

SEQ ID NO: 2569175 - protein, 5 aa, Entamoeba histolytica
NDKKE

SEQ ID NO: 2569176 - protein, 7 aa, Entamoeba histolytica
NDKKGYD

SEQ ID NO: 2569177 - protein, 7 aa, Entamoeba histolytica
NDKNAIE

SEQ ID NO: 2569178 - protein, 16 aa, Entamoeba histolytica
NDKNEINNKRISENIQ

SEQ ID NO: 2569179 - protein, 9 aa, Entamoeba histolytica
NDKNRKNLS

SEQ ID NO: 2569180 - protein, 8 aa, Entamoeba histolytica
NDKNTDRL

SEQ ID NO: 2569181 - protein, 11 aa, Entamoeba histolytica
NDKQPNEEYEM

SEQ ID NO: 2569182 - protein, 5 aa, Entamoeba histolytica
NDKQR

SEQ ID NO: 2569183 - protein, 55 aa, Entamoeba histolytica
NDKSKSDSHRDQSASTKTETRSKEPSSERVSTTNTTEESIEASVSSQVPETGVEN

SEQ ID NO: 2569184 - protein, 10 aa, Entamoeba histolytica
NDKTQRIKDV

SEQ ID NO: 2569185 - protein, 8 aa, Entamoeba histolytica
NDKYGGDD

SEQ ID NO: 2569186 - protein, 11 aa, Entamoeba histolytica
NDKYKRRTKES

SEQ ID NO: 2569187 - protein, 15 aa, Entamoeba histolytica
NDKYTINTNGGNNQN

SEQ ID NO: 2569188 - protein, 7 aa, Entamoeba histolytica
NDLGASS

SEQ ID NO: 2569189 - protein, 11 aa, Entamoeba histolytica
NDLGENIEKEM

SEQ ID NO: 2569190 - protein, 8 aa, Entamoeba histolytica
NDLGNDYA

SEQ ID NO: 2569191 - protein, 6 aa, Entamoeba histolytica
NDLKTQ

SEQ ID NO: 2569192 - protein, 5 aa, Entamoeba histolytica
NDLPD

SEQ ID NO: 2569193 - protein, 5 aa, Entamoeba histolytica
NDLQI

SEQ ID NO: 2569194 - protein, 5 aa, Entamoeba histolytica
NDLQK

SEQ ID NO: 2569195 - protein, 22 aa, Entamoeba histolytica
NDLTAKVADKSKDKNANDKIKR

SEQ ID NO: 2569196 - protein, 6 aa, Entamoeba histolytica
NDMPNQ

SEQ ID NO: 2569197 - protein, 7 aa, Entamoeba histolytica
NDNALSP

SEQ ID NO: 2569198 - protein, 7 aa, Entamoeba histolytica
NDNDFRS

SEQ ID NO: 2569199 - protein, 6 aa, Entamoeba histolytica
NDNGHR

SEQ ID NO: 2569200 - protein, 7 aa, Entamoeba histolytica
NDNIHSP

SEQ ID NO: 2569201 - protein, 9 aa, Entamoeba histolytica
NDNKSTTEF

SEQ ID NO: 2569202 - protein, 11 aa, Entamoeba histolytica
NDNLPNGINAS

SEQ ID NO: 2569203 - protein, 4 aa, Entamoeba histolytica
NDNN

SEQ ID NO: 2569204 - protein, 9 aa, Entamoeba histolytica
NDNNVNENT

SEQ ID NO: 2569205 - protein, 12 aa, Entamoeba histolytica
NDNQPQPTQKSQ

SEQ ID NO: 2569206 - protein, 8 aa, Entamoeba histolytica
NDNSFRSS

SEQ ID NO: 2569207 - protein, 8 aa, Entamoeba histolytica
NDNSMNEY

SEQ ID NO: 2569208 - protein, 10 aa, Entamoeba histolytica
NDNTNYQNGS

SEQ ID NO: 2569209 - protein, 7 aa, Entamoeba histolytica
NDNTWSS

SEQ ID NO: 2569210 - protein, 7 aa, Entamoeba histolytica
NDNVNEA

SEQ ID NO: 2569211 - protein, 5 aa, Entamoeba histolytica
NDPLG

SEQ ID NO: 2569212 - protein, 9 aa, Entamoeba histolytica
NDPLQTPNI

SEQ ID NO: 2569213 - protein, 8 aa, Entamoeba histolytica
NDPQMTNE

SEQ ID NO: 2569214 - protein, 5 aa, Entamoeba histolytica
NDPSK

SEQ ID NO: 2569215 - protein, 9 aa, Entamoeba histolytica
NDPYGITPA

SEQ ID NO: 2569216 - protein, 4 aa, Entamoeba histolytica
NDQD

SEQ ID NO: 2569217 - protein, 5 aa, Entamoeba histolytica
NDQDI

SEQ ID NO: 2569218 - protein, 7 aa, Entamoeba histolytica
NDQINKS

SEQ ID NO: 2569219 - protein, 10 aa, Entamoeba histolytica
NDQKLEENPE

SEQ ID NO: 2569220 - protein, 4 aa, Entamoeba histolytica
NDQL

SEQ ID NO: 2569221 - protein, 27 aa, Entamoeba histolytica
NDQLKESPSKYKRKNNKSKKPIKKRNI

SEQ ID NO: 2569222 - protein, 11 aa, Entamoeba histolytica
NDQMPQYERSI

SEQ ID NO: 2569223 - protein, 7 aa, Entamoeba histolytica
NDQQKKK

SEQ ID NO: 2569224 - protein, 5 aa, Entamoeba histolytica
NDQTT

SEQ ID NO: 2569225 - protein, 6 aa, Entamoeba histolytica
NDRKGL

SEQ ID NO: 2569226 - protein, 4 aa, Entamoeba histolytica
NDRM

SEQ ID NO: 2569227 - protein, 6 aa, Entamoeba histolytica
NDRNDY

SEQ ID NO: 2569228 - protein, 24 aa, Entamoeba histolytica
NDRRMKREKPYNKRRKQVTSPEDI

SEQ ID NO: 2569229 - protein, 7 aa, Entamoeba histolytica
NDSDFRN

SEQ ID NO: 2569230 - protein, 18 aa, Entamoeba histolytica
NDSFERKTERSSSLSPRV

SEQ ID NO: 2569231 - protein, 7 aa, Entamoeba histolytica
NDSGAVQ

SEQ ID NO: 2569232 - protein, 5 aa, Entamoeba histolytica
NDSKN

SEQ ID NO: 2569233 - protein, 12 aa, Entamoeba histolytica
NDSNQDSVSSIN

SEQ ID NO: 2569234 - protein, 6 aa, Entamoeba histolytica
NDSPET

SEQ ID NO: 2569235 - protein, 9 aa, Entamoeba histolytica
NDSQTINGT

SEQ ID NO: 2569236 - protein, 15 aa, Entamoeba histolytica
NDSQYTLSNTEKTSV

SEQ ID NO: 2569237 - protein, 7 aa, Entamoeba histolytica
NDSRDPQ

SEQ ID NO: 2569238 - protein, 5 aa, Entamoeba histolytica
NDSSH

SEQ ID NO: 2569239 - protein, 8 aa, Entamoeba histolytica
NDSSPHGA

SEQ ID NO: 2569240 - protein, 12 aa, Entamoeba histolytica
NDSSSSGSFSFS

SEQ ID NO: 2569241 - protein, 8 aa, Entamoeba histolytica
NDSTNIKS

SEQ ID NO: 2569242 - protein, 10 aa, Entamoeba histolytica
NDSTPQQPQV

SEQ ID NO: 2569243 - protein, 13 aa, Entamoeba histolytica
NDSTSKCYSLGDS

SEQ ID NO: 2569244 - protein, 6 aa, Entamoeba histolytica
NDTCQP

SEQ ID NO: 2569245 - protein, 16 aa, Entamoeba histolytica
NDTLSKTLEKGDFEEY

SEQ ID NO: 2569246 - protein, 7 aa, Entamoeba histolytica
NDTNKIR

SEQ ID NO: 2569247 - protein, 24 aa, Entamoeba histolytica
NDTNNDRKQEKEHNEYDNIKEELK

SEQ ID NO: 2569248 - protein, 11 aa, Entamoeba histolytica
NDTNSDYQTTT

SEQ ID NO: 2569249 - protein, 11 aa, Entamoeba histolytica
NDTRGCNGGGY

SEQ ID NO: 2569250 - protein, 8 aa, Entamoeba histolytica
NDVKGKDV

SEQ ID NO: 2569251 - protein, 8 aa, Entamoeba histolytica
NDVKNDTI

SEQ ID NO: 2569252 - protein, 9 aa, Entamoeba histolytica
NDVNLNEQS

SEQ ID NO: 2569253 - protein, 8 aa, Entamoeba histolytica
NDVSDGRI

SEQ ID NO: 2569254 - protein, 10 aa, Entamoeba histolytica
NDVSSTSNYQ

SEQ ID NO: 2569255 - protein, 10 aa, Entamoeba histolytica
NDVSTKEWER

SEQ ID NO: 2569256 - protein, 6 aa, Entamoeba histolytica
NDVSTT

SEQ ID NO: 2569257 - protein, 10 aa, Entamoeba histolytica
NDVTSDINQT

SEQ ID NO: 2569258 - protein, 6 aa, Entamoeba histolytica
NDYGQK

SEQ ID NO: 2569259 - protein, 6 aa, Entamoeba histolytica
NDYKNK

SEQ ID NO: 2569260 - protein, 5 aa, Entamoeba histolytica
NDYLP

SEQ ID NO: 2569261 - protein, 5 aa, Entamoeba histolytica
NDYST

SEQ ID NO: 2569262 - protein, 9 aa, Entamoeba histolytica
NEAEALEQK

SEQ ID NO: 2569263 - protein, 9 aa, Entamoeba histolytica
NEAEENENN

SEQ ID NO: 2569264 - protein, 5 aa, Entamoeba histolytica
NEAEN

SEQ ID NO: 2569265 - protein, 7 aa, Entamoeba histolytica
NEAKEKF

SEQ ID NO: 2569266 - protein, 26 aa, Entamoeba histolytica
NEATKRFDEKENQRKKKKGKKEKGEA

SEQ ID NO: 2569267 - protein, 7 aa, Entamoeba histolytica
NECEYSP

SEQ ID NO: 2569268 - protein, 18 aa, Entamoeba histolytica
NECGYGTTVTSSGKGSKY

SEQ ID NO: 2569269 - protein, 11 aa, Entamoeba histolytica
NECSDDQYSEK

SEQ ID NO: 2569270 - protein, 9 aa, Entamoeba histolytica
NEDELEDSP

SEQ ID NO: 2569271 - protein, 6 aa, Entamoeba histolytica
NEDENV

SEQ ID NO: 2569272 - protein, 7 aa, Entamoeba histolytica
NEDGSSQ

SEQ ID NO: 2569273 - protein, 16 aa, Entamoeba histolytica
NEDGTCKECNQNFGPK

SEQ ID NO: 2569274 - protein, 8 aa, Entamoeba histolytica
NEDKIEEG

SEQ ID NO: 2569275 - protein, 5 aa, Entamoeba histolytica
NEDPK

SEQ ID NO: 2569276 - protein, 4 aa, Entamoeba histolytica
NEDQ

SEQ ID NO: 2569277 - protein, 5 aa, Entamoeba histolytica
NEDRT

SEQ ID NO: 2569278 - protein, 12 aa, Entamoeba histolytica
NEEDETKLSIGT

SEQ ID NO: 2569279 - protein, 5 aa, Entamoeba histolytica
NEEDI

SEQ ID NO: 2569280 - protein, 8 aa, Entamoeba histolytica
NEEDPLRP

SEQ ID NO: 2569281 - protein, 10 aa, Entamoeba histolytica
NEEDTFRPKG

SEQ ID NO: 2569282 - protein, 7 aa, Entamoeba histolytica
NEEDYIP

SEQ ID NO: 2569283 - protein, 15 aa, Entamoeba histolytica
NEEEEGYVTERRKQL

SEQ ID NO: 2569284 - protein, 6 aa, Entamoeba histolytica
NEEEQQ

SEQ ID NO: 2569285 - protein, 4 aa, Entamoeba histolytica
NEEG

SEQ ID NO: 2569286 - protein, 6 aa, Entamoeba histolytica
NEEGGL

SEQ ID NO: 2569287 - protein, 6 aa, Entamoeba histolytica
NEEINS

SEQ ID NO: 2569288 - protein, 4 aa, Entamoeba histolytica
NEEK

SEQ ID NO: 2569289 - protein, 15 aa, Entamoeba histolytica
NEEKCTGCDNCERKK

SEQ ID NO: 2569290 - protein, 9 aa, Entamoeba histolytica
NEELETAEK

SEQ ID NO: 2569291 - protein, 4 aa, Entamoeba histolytica
NEEN

SEQ ID NO: 2569292 - protein, 26 aa, Entamoeba histolytica
NEENQIEGQQLNEENQIEGQQLNEND

SEQ ID NO: 2569293 - protein, 9 aa, Entamoeba histolytica
NEENVEGGK

SEQ ID NO: 2569294 - protein, 8 aa, Entamoeba histolytica
NEEQNGYE

SEQ ID NO: 2569295 - protein, 8 aa, Entamoeba histolytica
NEEQNTKF

SEQ ID NO: 2569296 - protein, 5 aa, Entamoeba histolytica
NEESF

SEQ ID NO: 2569297 - protein, 8 aa, Entamoeba histolytica
NEESNENR

SEQ ID NO: 2569298 - protein, 10 aa, Entamoeba histolytica
NEESPEYNES

SEQ ID NO: 2569299 - protein, 24 aa, Entamoeba histolytica
NEESTNSSSSSLLKEEKKEEIQEQ

SEQ ID NO: 2569300 - protein, 6 aa, Entamoeba histolytica
NEESYK

SEQ ID NO: 2569301 - protein, 5 aa, Entamoeba histolytica
NEETQ

SEQ ID NO: 2569302 - protein, 4 aa, Entamoeba histolytica
NEEV

SEQ ID NO: 2569303 - protein, 16 aa, Entamoeba histolytica
NEEYNEEIEKEEEEIG

SEQ ID NO: 2569304 - protein, 4 aa, Entamoeba histolytica
NEFT

SEQ ID NO: 2569305 - protein, 7 aa, Entamoeba histolytica
NEGCSQT

SEQ ID NO: 2569306 - protein, 6 aa, Entamoeba histolytica
NEGDTQ

SEQ ID NO: 2569307 - protein, 10 aa, Entamoeba histolytica
NEGEKKDIEK

SEQ ID NO: 2569308 - protein, 10 aa, Entamoeba histolytica
NEGGDADIEG

SEQ ID NO: 2569309 - protein, 6 aa, Entamoeba histolytica
NEGIRR

SEQ ID NO: 2569310 - protein, 4 aa, Entamoeba histolytica
NEGL

SEQ ID NO: 2569311 - protein, 8 aa, Entamoeba histolytica
NEGNEIDL

SEQ ID NO: 2569312 - protein, 8 aa, Entamoeba histolytica
NEGNYYSK

SEQ ID NO: 2569313 - protein, 7 aa, Entamoeba histolytica
NEGRSPP

SEQ ID NO: 2569314 - protein, 6 aa, Entamoeba histolytica
NEGSFD

SEQ ID NO: 2569315 - protein, 4 aa, Entamoeba histolytica
NEHE

SEQ ID NO: 2569316 - protein, 10 aa, Entamoeba histolytica
NEHETDDVEI

SEQ ID NO: 2569317 - protein, 6 aa, Entamoeba histolytica
NEHKPK

SEQ ID NO: 2569318 - protein, 5 aa, Entamoeba histolytica
NEHPE

SEQ ID NO: 2569319 - protein, 21 aa, Entamoeba histolytica
NEHQEDTLSTTHNKNDICVEL

SEQ ID NO: 2569320 - protein, 8 aa, Entamoeba histolytica
NEHRTKQQ

SEQ ID NO: 2569321 - protein, 10 aa, Entamoeba histolytica
NEHSNEDSCK

SEQ ID NO: 2569322 - protein, 7 aa, Entamoeba histolytica
NEIASSI

SEQ ID NO: 2569323 - protein, 4 aa, Entamoeba histolytica
NEID

SEQ ID NO: 2569324 - protein, 5 aa, Entamoeba histolytica
NEIDA

SEQ ID NO: 2569325 - protein, 4 aa, Entamoeba histolytica
NEIE

SEQ ID NO: 2569326 - protein, 7 aa, Entamoeba histolytica
NEIGGDF

SEQ ID NO: 2569327 - protein, 5 aa, Entamoeba histolytica
NEINE

SEQ ID NO: 2569328 - protein, 6 aa, Entamoeba histolytica
NEIPSS

SEQ ID NO: 2569329 - protein, 6 aa, Entamoeba histolytica
NEIQEY

SEQ ID NO: 2569330 - protein, 4 aa, Entamoeba histolytica
NEIS

SEQ ID NO: 2569331 - protein, 11 aa, Entamoeba histolytica
NEISKEKTNSI

SEQ ID NO: 2569332 - protein, 5 aa, Entamoeba histolytica
NEISN

SEQ ID NO: 2569333 - protein, 5 aa, Entamoeba histolytica
NEITN

SEQ ID NO: 2569334 - protein, 11 aa, Entamoeba histolytica
NEITPETENFY

SEQ ID NO: 2569335 - protein, 10 aa, Entamoeba histolytica
NEIYDSSNSF

SEQ ID NO: 2569336 - protein, 6 aa, Entamoeba histolytica
NEKEEK

SEQ ID NO: 2569337 - protein, 8 aa, Entamoeba histolytica
NEKEGEGS

SEQ ID NO: 2569338 - protein, 9 aa, Entamoeba histolytica
NEKGKRGKG

SEQ ID NO: 2569339 - protein, 10 aa, Entamoeba histolytica
NEKGKYYSPN

SEQ ID NO: 2569340 - protein, 5 aa, Entamoeba histolytica
NEKGS

SEQ ID NO: 2569341 - protein, 6 aa, Entamoeba histolytica
NEKIAK

SEQ ID NO: 2569342 - protein, 8 aa, Entamoeba histolytica
NEKIPDHK

SEQ ID NO: 2569343 - protein, 11 aa, Entamoeba histolytica
NEKKDIEIETD

SEQ ID NO: 2569344 - protein, 7 aa, Entamoeba histolytica
NEKLQDS

SEQ ID NO: 2569345 - protein, 7 aa, Entamoeba histolytica
NEKNERM

SEQ ID NO: 2569346 - protein, 6 aa, Entamoeba histolytica
NEKNNV

SEQ ID NO: 2569347 - protein, 6 aa, Entamoeba histolytica
NEKPHL

SEQ ID NO: 2569348 - protein, 7 aa, Entamoeba histolytica
NEKPVGS

SEQ ID NO: 2569349 - protein, 4 aa, Entamoeba histolytica
NEKQ

SEQ ID NO: 2569350 - protein, 9 aa, Entamoeba histolytica
NEKQNPSKI

SEQ ID NO: 2569351 - protein, 13 aa, Entamoeba histolytica
NEKQQQFCFEMMI

SEQ ID NO: 2569352 - protein, 6 aa, Entamoeba histolytica
NEKQSW

SEQ ID NO: 2569353 - protein, 5 aa, Entamoeba histolytica
NEKQT

SEQ ID NO: 2569354 - protein, 8 aa, Entamoeba histolytica
NEKSSLVT

SEQ ID NO: 2569355 - protein, 8 aa, Entamoeba histolytica
NEKTNKKW

SEQ ID NO: 2569356 - protein, 6 aa, Entamoeba histolytica
NEKVGS

SEQ ID NO: 2569357 - protein, 5 aa, Entamoeba histolytica
NEKVN

SEQ ID NO: 2569358 - protein, 6 aa, Entamoeba histolytica
NELDNE

SEQ ID NO: 2569359 - protein, 5 aa, Entamoeba histolytica
NELEY

SEQ ID NO: 2569360 - protein, 4 aa, Entamoeba histolytica
NELK

SEQ ID NO: 2569361 - protein, 6 aa, Entamoeba histolytica
NELKEE

SEQ ID NO: 2569362 - protein, 5 aa, Entamoeba histolytica
NELKG

SEQ ID NO: 2569363 - protein, 49 aa, Entamoeba histolytica
NELKSDKEELNQKNIENNEEKDNDNEIEERQEKDNNKRKRPNEEEKERI

SEQ ID NO: 2569364 - protein, 4 aa, Entamoeba histolytica
NELN

SEQ ID NO: 2569365 - protein, 8 aa, Entamoeba histolytica
NELPGSKE

SEQ ID NO: 2569366 - protein, 15 aa, Entamoeba histolytica
NELTQSKKEKINDLL

SEQ ID NO: 2569367 - protein, 5 aa, Entamoeba histolytica
NEMEG

SEQ ID NO: 2569368 - protein, 26 aa, Entamoeba histolytica
NEMTESQQPEKQPANETTDSQQQEIQ

SEQ ID NO: 2569369 - protein, 12 aa, Entamoeba histolytica
NENALSPSQCKQ

SEQ ID NO: 2569370 - protein, 4 aa, Entamoeba histolytica
NENC

SEQ ID NO: 2569371 - protein, 10 aa, Entamoeba histolytica
NENCTTCSRT

SEQ ID NO: 2569372 - protein, 11 aa, Entamoeba histolytica
NENDFNINENS

SEQ ID NO: 2569373 - protein, 7 aa, Entamoeba histolytica
NENDNAI

SEQ ID NO: 2569374 - protein, 8 aa, Entamoeba histolytica
NENDPLVQ

SEQ ID NO: 2569375 - protein, 8 aa, Entamoeba histolytica
NENESYSQ

SEQ ID NO: 2569376 - protein, 15 aa, Entamoeba histolytica
NENETSYKQSQSCRN

SEQ ID NO: 2569377 - protein, 7 aa, Entamoeba histolytica
NENFPLK

SEQ ID NO: 2569378 - protein, 5 aa, Entamoeba histolytica
NENGQ

SEQ ID NO: 2569379 - protein, 12 aa, Entamoeba histolytica
NENGQLNQNKHN

SEQ ID NO: 2569380 - protein, 8 aa, Entamoeba histolytica
NENGRGME

SEQ ID NO: 2569381 - protein, 7 aa, Entamoeba histolytica
NENIDRN

SEQ ID NO: 2569382 - protein, 5 aa, Entamoeba histolytica
NENIN

SEQ ID NO: 2569383 - protein, 7 aa, Entamoeba histolytica
NENISNI

SEQ ID NO: 2569384 - protein, 7 aa, Entamoeba histolytica
NENKESC

SEQ ID NO: 2569385 - protein, 7 aa, Entamoeba histolytica
NENNTRI

SEQ ID NO: 2569386 - protein, 7 aa, Entamoeba histolytica
NENNTSK

SEQ ID NO: 2569387 - protein, 6 aa, Entamoeba histolytica
NENRMN

SEQ ID NO: 2569388 - protein, 6 aa, Entamoeba histolytica
NENTEE

SEQ ID NO: 2569389 - protein, 7 aa, Entamoeba histolytica
NEPAKTR

SEQ ID NO: 2569390 - protein, 6 aa, Entamoeba histolytica
NEPGKY

SEQ ID NO: 2569391 - protein, 11 aa, Entamoeba histolytica
NEPIPKENDEL

SEQ ID NO: 2569392 - protein, 49 aa, Entamoeba histolytica
NEPKQEDSLQVPQPLEHTEELTQEIPREMSTEKEEMTEELTQQNQVITD

SEQ ID NO: 2569393 - protein, 20 aa, Entamoeba histolytica
NEPLKSEKSEESCDNEISAE

SEQ ID NO: 2569394 - protein, 4 aa, Entamoeba histolytica
NEPS

SEQ ID NO: 2569395 - protein, 5 aa, Entamoeba histolytica
NEPSM

SEQ ID NO: 2569396 - protein, 7 aa, Entamoeba histolytica
NEQEERR

SEQ ID NO: 2569397 - protein, 8 aa, Entamoeba histolytica
NEQETHQH

SEQ ID NO: 2569398 - protein, 14 aa, Entamoeba histolytica
NEQGLSDSDKHWSS

SEQ ID NO: 2569399 - protein, 39 aa, Entamoeba histolytica
NEQINDTPETKAEQASNRIKERKQNNINKEKQRENERIE

SEQ ID NO: 2569400 - protein, 9 aa, Entamoeba histolytica
NEQKELEGV

SEQ ID NO: 2569401 - protein, 6 aa, Entamoeba histolytica
NEQKTK

SEQ ID NO: 2569402 - protein, 14 aa, Entamoeba histolytica
NEQLSKNGQTKEPV

SEQ ID NO: 2569403 - protein, 5 aa, Entamoeba histolytica
NEQPH

SEQ ID NO: 2569404 - protein, 18 aa, Entamoeba histolytica
NEQPNELEVDNTKVSQEV

SEQ ID NO: 2569405 - protein, 8 aa, Entamoeba histolytica
NEQRLDNN

SEQ ID NO: 2569406 - protein, 7 aa, Entamoeba histolytica
NEQSLQE

SEQ ID NO: 2569407 - protein, 7 aa, Entamoeba histolytica
NEQTDKY

SEQ ID NO: 2569408 - protein, 4 aa, Entamoeba histolytica
NEQY

SEQ ID NO: 2569409 - protein, 7 aa, Entamoeba histolytica
NERARLK

SEQ ID NO: 2569410 - protein, 5 aa, Entamoeba histolytica
NERAW

SEQ ID NO: 2569411 - protein, 6 aa, Entamoeba histolytica
NERDVP

SEQ ID NO: 2569412 - protein, 5 aa, Entamoeba histolytica
NERER

SEQ ID NO: 2569413 - protein, 9 aa, Entamoeba histolytica
NERGSQKKC

SEQ ID NO: 2569414 - protein, 5 aa, Entamoeba histolytica
NERKS

SEQ ID NO: 2569415 - protein, 9 aa, Entamoeba histolytica
NERLEDKQK

SEQ ID NO: 2569416 - protein, 8 aa, Entamoeba histolytica
NERSEARH

SEQ ID NO: 2569417 - protein, 6 aa, Entamoeba histolytica
NERSNL

SEQ ID NO: 2569418 - protein, 4 aa, Entamoeba histolytica
NERT

SEQ ID NO: 2569419 - protein, 35 aa, Entamoeba histolytica
NESAEANESSSNIESSNDSSNESQSLNSRQSEESL

SEQ ID NO: 2569420 - protein, 5 aa, Entamoeba histolytica
NESGF

SEQ ID NO: 2569421 - protein, 25 aa, Entamoeba histolytica
NESGKKNSTESVEYQSKTSTTSKEV

SEQ ID NO: 2569422 - protein, 14 aa, Entamoeba histolytica
NESISSVNNEASDG

SEQ ID NO: 2569423 - protein, 4 aa, Entamoeba histolytica
NESL

SEQ ID NO: 2569424 - protein, 5 aa, Entamoeba histolytica
NESNG

SEQ ID NO: 2569425 - protein, 5 aa, Entamoeba histolytica
NESPF

SEQ ID NO: 2569426 - protein, 7 aa, Entamoeba histolytica
NESPSNC

SEQ ID NO: 2569427 - protein, 4 aa, Entamoeba histolytica
NESQ

SEQ ID NO: 2569428 - protein, 13 aa, Entamoeba histolytica
NESQEQHNNSQEL

SEQ ID NO: 2569429 - protein, 8 aa, Entamoeba histolytica
NESRSQRS

SEQ ID NO: 2569430 - protein, 16 aa, Entamoeba histolytica
NESTKSSEGNDELKPE

SEQ ID NO: 2569431 - protein, 7 aa, Entamoeba histolytica
NESTPNS

SEQ ID NO: 2569432 - protein, 4 aa, Entamoeba histolytica
NETA

SEQ ID NO: 2569433 - protein, 23 aa, Entamoeba histolytica
NETCEEGKIKDQNGKCNSNISNC

SEQ ID NO: 2569434 - protein, 6 aa, Entamoeba histolytica
NETDTS

SEQ ID NO: 2569435 - protein, 5 aa, Entamoeba histolytica
NETEF

SEQ ID NO: 2569436 - protein, 10 aa, Entamoeba histolytica
NETEKEKYEY

SEQ ID NO: 2569437 - protein, 45 aa, Entamoeba histolytica
NETEYQQTSINSQKNVLPDNESQNIQETSIQDPELNNSVQEFPQK

SEQ ID NO: 2569438 - protein, 8 aa, Entamoeba histolytica
NETIKEKT

SEQ ID NO: 2569439 - protein, 6 aa, Entamoeba histolytica
NETIQT

SEQ ID NO: 2569440 - protein, 7 aa, Entamoeba histolytica
NETKDYA

SEQ ID NO: 2569441 - protein, 7 aa, Entamoeba histolytica
NETKEIQ

SEQ ID NO: 2569442 - protein, 13 aa, Entamoeba histolytica
NETKQLQNAKGIK

SEQ ID NO: 2569443 - protein, 4 aa, Entamoeba histolytica
NETL

SEQ ID NO: 2569444 - protein, 16 aa, Entamoeba histolytica
NETLSKTLEKGDFEEY

SEQ ID NO: 2569445 - protein, 5 aa, Entamoeba histolytica
NETME

SEQ ID NO: 2569446 - protein, 7 aa, Entamoeba histolytica
NETNEDI

SEQ ID NO: 2569447 - protein, 6 aa, Entamoeba histolytica
NETNHQ

SEQ ID NO: 2569448 - protein, 8 aa, Entamoeba histolytica
NETNKNEL

SEQ ID NO: 2569449 - protein, 10 aa, Entamoeba histolytica
NETNNPNNSI

SEQ ID NO: 2569450 - protein, 11 aa, Entamoeba histolytica
NETQRKSISNL

SEQ ID NO: 2569451 - protein, 5 aa, Entamoeba histolytica
NETSL

SEQ ID NO: 2569452 - protein, 5 aa, Entamoeba histolytica
NETST

SEQ ID NO: 2569453 - protein, 8 aa, Entamoeba histolytica
NETTGECE

SEQ ID NO: 2569454 - protein, 4 aa, Entamoeba histolytica
NETV

SEQ ID NO: 2569455 - protein, 9 aa, Entamoeba histolytica
NEVKKKVNT

SEQ ID NO: 2569456 - protein, 7 aa, Entamoeba histolytica
NEVNGKI

SEQ ID NO: 2569457 - protein, 6 aa, Entamoeba histolytica
NEVPQS

SEQ ID NO: 2569458 - protein, 5 aa, Entamoeba histolytica
NEVTN

SEQ ID NO: 2569459 - protein, 7 aa, Entamoeba histolytica
NEWTENN

SEQ ID NO: 2569460 - protein, 7 aa, Entamoeba histolytica
NEYATSS

SEQ ID NO: 2569461 - protein, 4 aa, Entamoeba histolytica
NEYD

SEQ ID NO: 2569462 - protein, 6 aa, Entamoeba histolytica
NEYDQQ

SEQ ID NO: 2569463 - protein, 4 aa, Entamoeba histolytica
NEYE

SEQ ID NO: 2569464 - protein, 7 aa, Entamoeba histolytica
NEYNDDD

SEQ ID NO: 2569465 - protein, 4 aa, Entamoeba histolytica
NFAG

SEQ ID NO: 2569466 - protein, 6 aa, Entamoeba histolytica
NFESGD

SEQ ID NO: 2569467 - protein, 4 aa, Entamoeba histolytica
NFET

SEQ ID NO: 2569468 - protein, 12 aa, Entamoeba histolytica
NFGGEKKSVQQV

SEQ ID NO: 2569469 - protein, 11 aa, Entamoeba histolytica
NFGGTEDAFTG

SEQ ID NO: 2569470 - protein, 11 aa, Entamoeba histolytica
NFGNDSENIRQ

SEQ ID NO: 2569471 - protein, 12 aa, Entamoeba histolytica
NFGNEENEDNSN

SEQ ID NO: 2569472 - protein, 6 aa, Entamoeba histolytica
NFGPNT

SEQ ID NO: 2569473 - protein, 8 aa, Entamoeba histolytica
NFGTEDNL

SEQ ID NO: 2569474 - protein, 7 aa, Entamoeba histolytica
NFHGNTP

SEQ ID NO: 2569475 - protein, 4 aa, Entamoeba histolytica
NFKK

SEQ ID NO: 2569476 - protein, 10 aa, Entamoeba histolytica
NFKKKDEKVR

SEQ ID NO: 2569477 - protein, 8 aa, Entamoeba histolytica
NFKNEGEI

SEQ ID NO: 2569478 - protein, 4 aa, Entamoeba histolytica
NFKT

SEQ ID NO: 2569479 - protein, 6 aa, Entamoeba histolytica
NFNEPY

SEQ ID NO: 2569480 - protein, 7 aa, Entamoeba histolytica
NFPKASD

SEQ ID NO: 2569481 - protein, 9 aa, Entamoeba histolytica
NFPNGETAF

SEQ ID NO: 2569482 - protein, 4 aa, Entamoeba histolytica
NFPV

SEQ ID NO: 2569483 - protein, 11 aa, Entamoeba histolytica
NFTSDSSDYLS

SEQ ID NO: 2569484 - protein, 5 aa, Entamoeba histolytica
NFTSI

SEQ ID NO: 2569485 - protein, 4 aa, Entamoeba histolytica
NGAE

SEQ ID NO: 2569486 - protein, 5 aa, Entamoeba histolytica
NGAEQ

SEQ ID NO: 2569487 - protein, 6 aa, Entamoeba histolytica
NGAEVA

SEQ ID NO: 2569488 - protein, 7 aa, Entamoeba histolytica
NGAGKST

SEQ ID NO: 2569489 - protein, 6 aa, Entamoeba histolytica
NGAPDV

SEQ ID NO: 2569490 - protein, 12 aa, Entamoeba histolytica
NGAQNQKVDRHT

SEQ ID NO: 2569491 - protein, 14 aa, Entamoeba histolytica
NGASGAGKSPNYND

SEQ ID NO: 2569492 - protein, 5 aa, Entamoeba histolytica
NGATL

SEQ ID NO: 2569493 - protein, 7 aa, Entamoeba histolytica
NGATPFD

SEQ ID NO: 2569494 - protein, 7 aa, Entamoeba histolytica
NGAVPAT

SEQ ID NO: 2569495 - protein, 6 aa, Entamoeba histolytica
NGCEEQ

SEQ ID NO: 2569496 - protein, 12 aa, Entamoeba histolytica
NGCHNNSGSARA

SEQ ID NO: 2569497 - protein, 19 aa, Entamoeba histolytica
NGCPNSLSSDQSPITSPGL

SEQ ID NO: 2569498 - protein, 5 aa, Entamoeba histolytica
NGCTK

SEQ ID NO: 2569499 - protein, 4 aa, Entamoeba histolytica
NGDC

SEQ ID NO: 2569500 - protein, 7 aa, Entamoeba histolytica
NGDCKKK

SEQ ID NO: 2569501 - protein, 5 aa, Entamoeba histolytica
NGDCR

SEQ ID NO: 2569502 - protein, 5 aa, Entamoeba histolytica
NGDDA

SEQ ID NO: 2569503 - protein, 7 aa, Entamoeba histolytica
NGDPCYN

SEQ ID NO: 2569504 - protein, 22 aa, Entamoeba histolytica
NGDPNGKDEEFEVGQSPTGVDD

SEQ ID NO: 2569505 - protein, 7 aa, Entamoeba histolytica
NGDQTTN

SEQ ID NO: 2569506 - protein, 7 aa, Entamoeba histolytica
NGDSKSI

SEQ ID NO: 2569507 - protein, 10 aa, Entamoeba histolytica
NGEDEDENQL

SEQ ID NO: 2569508 - protein, 5 aa, Entamoeba histolytica
NGEEE

SEQ ID NO: 2569509 - protein, 5 aa, Entamoeba histolytica
NGEEL

SEQ ID NO: 2569510 - protein, 6 aa, Entamoeba histolytica
NGEELP

SEQ ID NO: 2569511 - protein, 5 aa, Entamoeba histolytica
NGEEN

SEQ ID NO: 2569512 - protein, 8 aa, Entamoeba histolytica
NGEESENI

SEQ ID NO: 2569513 - protein, 13 aa, Entamoeba histolytica
NGEFNPETEECDG

SEQ ID NO: 2569514 - protein, 8 aa, Entamoeba histolytica
NGEGELQN

SEQ ID NO: 2569515 - protein, 18 aa, Entamoeba histolytica
NGEGNTLDAGDSHSYESE

SEQ ID NO: 2569516 - protein, 18 aa, Entamoeba histolytica
NGEKEAYKRIKEEERKDA

SEQ ID NO: 2569517 - protein, 8 aa, Entamoeba histolytica
NGEKGESL

SEQ ID NO: 2569518 - protein, 7 aa, Entamoeba histolytica
NGEPLGD

SEQ ID NO: 2569519 - protein, 6 aa, Entamoeba histolytica
NGEPPL

SEQ ID NO: 2569520 - protein, 4 aa, Entamoeba histolytica
NGER

SEQ ID NO: 2569521 - protein, 6 aa, Entamoeba histolytica
NGESVN

SEQ ID NO: 2569522 - protein, 6 aa, Entamoeba histolytica
NGETCD

SEQ ID NO: 2569523 - protein, 7 aa, Entamoeba histolytica
NGEVPQT

SEQ ID NO: 2569524 - protein, 4 aa, Entamoeba histolytica
NGFS

SEQ ID NO: 2569525 - protein, 7 aa, Entamoeba histolytica
NGFSVRG

SEQ ID NO: 2569526 - protein, 7 aa, Entamoeba histolytica
NGGEKNM

SEQ ID NO: 2569527 - protein, 5 aa, Entamoeba histolytica
NGGES

SEQ ID NO: 2569528 - protein, 8 aa, Entamoeba histolytica
NGGFGIGN

SEQ ID NO: 2569529 - protein, 7 aa, Entamoeba histolytica
NGGGGIN

SEQ ID NO: 2569530 - protein, 10 aa, Entamoeba histolytica
NGGGSGDLVS

SEQ ID NO: 2569531 - protein, 5 aa, Entamoeba histolytica
NGGGY

SEQ ID NO: 2569532 - protein, 6 aa, Entamoeba histolytica
NGGGYS

SEQ ID NO: 2569533 - protein, 10 aa, Entamoeba histolytica
NGGIENNRES

SEQ ID NO: 2569534 - protein, 15 aa, Entamoeba histolytica
NGGMAKDEECLRGSE

SEQ ID NO: 2569535 - protein, 14 aa, Entamoeba histolytica
NGGNPSEKYVSSKS

SEQ ID NO: 2569536 - protein, 6 aa, Entamoeba histolytica
NGGSQI

SEQ ID NO: 2569537 - protein, 6 aa, Entamoeba histolytica
NGGSTE

SEQ ID NO: 2569538 - protein, 7 aa, Entamoeba histolytica
NGGTSKY

SEQ ID NO: 2569539 - protein, 17 aa, Entamoeba histolytica
NGGVEIQRANEGGKTFA

SEQ ID NO: 2569540 - protein, 5 aa, Entamoeba histolytica
NGGVS

SEQ ID NO: 2569541 - protein, 6 aa, Entamoeba histolytica
NGGVTN

SEQ ID NO: 2569542 - protein, 5 aa, Entamoeba histolytica
NGHFP

SEQ ID NO: 2569543 - protein, 20 aa, Entamoeba histolytica
NGHKLENNTCVKDEEKECYY

SEQ ID NO: 2569544 - protein, 4 aa, Entamoeba histolytica
NGHS

SEQ ID NO: 2569545 - protein, 12 aa, Entamoeba histolytica
NGHTECKKYSEG

SEQ ID NO: 2569546 - protein, 11 aa, Entamoeba histolytica
NGIDDSHLQGD

SEQ ID NO: 2569547 - protein, 4 aa, Entamoeba histolytica
NGIK

SEQ ID NO: 2569548 - protein, 6 aa, Entamoeba histolytica
NGINKS

SEQ ID NO: 2569549 - protein, 5 aa, Entamoeba histolytica
NGIPA

SEQ ID NO: 2569550 - protein, 9 aa, Entamoeba histolytica
NGIPNNNKL

SEQ ID NO: 2569551 - protein, 4 aa, Entamoeba histolytica
NGKC

SEQ ID NO: 2569552 - protein, 5 aa, Entamoeba histolytica
NGKDN

SEQ ID NO: 2569553 - protein, 8 aa, Entamoeba histolytica
NGKDRGGA

SEQ ID NO: 2569554 - protein, 6 aa, Entamoeba histolytica
NGKEIR

SEQ ID NO: 2569555 - protein, 13 aa, Entamoeba histolytica
NGKENIKTQHKNV

SEQ ID NO: 2569556 - protein, 24 aa, Entamoeba histolytica
NGKESDTSSSNNEKCKCKNGVDTC

SEQ ID NO: 2569557 - protein, 5 aa, Entamoeba histolytica
NGKEV

SEQ ID NO: 2569558 - protein, 21 aa, Entamoeba histolytica
NGKIDDSEECDLSAQEDSHCA

SEQ ID NO: 2569559 - protein, 17 aa, Entamoeba histolytica
NGKINKVDNTVSTAKKG

SEQ ID NO: 2569560 - protein, 6 aa, Entamoeba histolytica
NGKKLD

SEQ ID NO: 2569561 - protein, 6 aa, Entamoeba histolytica
NGKKLH

SEQ ID NO: 2569562 - protein, 10 aa, Entamoeba histolytica
NGKLDEGEEC

SEQ ID NO: 2569563 - protein, 23 aa, Entamoeba histolytica
NGKLDKDEDCDPTIEGNNDTQCT

SEQ ID NO: 2569564 - protein, 8 aa, Entamoeba histolytica
NGKNDEAR

SEQ ID NO: 2569565 - protein, 5 aa, Entamoeba histolytica
NGKQD

SEQ ID NO: 2569566 - protein, 11 aa, Entamoeba histolytica
NGKRKEQCDGG

SEQ ID NO: 2569567 - protein, 8 aa, Entamoeba histolytica
NGKSELPI

SEQ ID NO: 2569568 - protein, 15 aa, Entamoeba histolytica
NGKSRSIRKEKESNL

SEQ ID NO: 2569569 - protein, 8 aa, Entamoeba histolytica
NGKTSGMV

SEQ ID NO: 2569570 - protein, 12 aa, Entamoeba histolytica
NGLASAYKNGKA

SEQ ID NO: 2569571 - protein, 5 aa, Entamoeba histolytica
NGLNK

SEQ ID NO: 2569572 - protein, 8 aa, Entamoeba histolytica
NGLPSATN

SEQ ID NO: 2569573 - protein, 6 aa, Entamoeba histolytica
NGLSQY

SEQ ID NO: 2569574 - protein, 15 aa, Entamoeba histolytica
NGMRDEGEDCDGGEY

SEQ ID NO: 2569575 - protein, 7 aa, Entamoeba histolytica
NGNCQEC

SEQ ID NO: 2569576 - protein, 5 aa, Entamoeba histolytica
NGNDI

SEQ ID NO: 2569577 - protein, 8 aa, Entamoeba histolytica
NGNDNGIT

SEQ ID NO: 2569578 - protein, 8 aa, Entamoeba histolytica
NGNDTTEL

SEQ ID NO: 2569579 - protein, 8 aa, Entamoeba histolytica
NGNHEGHE

SEQ ID NO: 2569580 - protein, 8 aa, Entamoeba histolytica
NGNNGVSE

SEQ ID NO: 2569581 - protein, 7 aa, Entamoeba histolytica
NGNNINQ

SEQ ID NO: 2569582 - protein, 6 aa, Entamoeba histolytica
NGNQTV

SEQ ID NO: 2569583 - protein, 11 aa, Entamoeba histolytica
NGNSPSKITGD

SEQ ID NO: 2569584 - protein, 9 aa, Entamoeba histolytica
NGNTTVNGD

SEQ ID NO: 2569585 - protein, 9 aa, Entamoeba histolytica
NGNVTPSNF

SEQ ID NO: 2569586 - protein, 5 aa, Entamoeba histolytica
NGPKL

SEQ ID NO: 2569587 - protein, 10 aa, Entamoeba histolytica
NGQKQNKYDT

SEQ ID NO: 2569588 - protein, 8 aa, Entamoeba histolytica
NGQPFDES

SEQ ID NO: 2569589 - protein, 8 aa, Entamoeba histolytica
NGQSDNVN

SEQ ID NO: 2569590 - protein, 8 aa, Entamoeba histolytica
NGQTVSTR

SEQ ID NO: 2569591 - protein, 4 aa, Entamoeba histolytica
NGRA

SEQ ID NO: 2569592 - protein, 17 aa, Entamoeba histolytica
NGRIEEGEECDNTTSCN

SEQ ID NO: 2569593 - protein, 18 aa, Entamoeba histolytica
NGRIGNDEECKQGTEGCT

SEQ ID NO: 2569594 - protein, 13 aa, Entamoeba histolytica
NGRSSTLKTSASL

SEQ ID NO: 2569595 - protein, 21 aa, Entamoeba histolytica
NGSCKTCEEAYDENCSDCDGI

SEQ ID NO: 2569596 - protein, 8 aa, Entamoeba histolytica
NGSDTNDN

SEQ ID NO: 2569597 - protein, 5 aa, Entamoeba histolytica
NGSFQ

SEQ ID NO: 2569598 - protein, 6 aa, Entamoeba histolytica
NGSGTI

SEQ ID NO: 2569599 - protein, 8 aa, Entamoeba histolytica
NGSIRPNE

SEQ ID NO: 2569600 - protein, 5 aa, Entamoeba histolytica
NGSNF

SEQ ID NO: 2569601 - protein, 19 aa, Entamoeba histolytica
NGSSQNDDSSNSNDNKEHS

SEQ ID NO: 2569602 - protein, 7 aa, Entamoeba histolytica
NGSSTKI

SEQ ID NO: 2569603 - protein, 5 aa, Entamoeba histolytica
NGSTD

SEQ ID NO: 2569604 - protein, 6 aa, Entamoeba histolytica
NGSYQF

SEQ ID NO: 2569605 - protein, 4 aa, Entamoeba histolytica
NGTC

SEQ ID NO: 2569606 - protein, 13 aa, Entamoeba histolytica
NGTCSSPKGKNCY

SEQ ID NO: 2569607 - protein, 6 aa, Entamoeba histolytica
NGTCTE

SEQ ID NO: 2569608 - protein, 11 aa, Entamoeba histolytica
NGTDSKCEECN

SEQ ID NO: 2569609 - protein, 4 aa, Entamoeba histolytica
NGTI

SEQ ID NO: 2569610 - protein, 9 aa, Entamoeba histolytica
NGTKETDYS

SEQ ID NO: 2569611 - protein, 41 aa, Entamoeba histolytica
NGTKLDKSNKSQRSFRSSFSSVSNQNSTSSDEVSVKPSKAK

SEQ ID NO: 2569612 - protein, 6 aa, Entamoeba histolytica
NGTNED

SEQ ID NO: 2569613 - protein, 5 aa, Entamoeba histolytica
NGTSC

SEQ ID NO: 2569614 - protein, 16 aa, Entamoeba histolytica
NGTSYCSSTKKTDNCQ

SEQ ID NO: 2569615 - protein, 7 aa, Entamoeba histolytica
NGTTTLD

SEQ ID NO: 2569616 - protein, 10 aa, Entamoeba histolytica
NGTYAEREGM

SEQ ID NO: 2569617 - protein, 4 aa, Entamoeba histolytica
NGVD

SEQ ID NO: 2569618 - protein, 4 aa, Entamoeba histolytica
NGVN

SEQ ID NO: 2569619 - protein, 5 aa, Entamoeba histolytica
NGVSK

SEQ ID NO: 2569620 - protein, 8 aa, Entamoeba histolytica
NGYEGGWG

SEQ ID NO: 2569621 - protein, 13 aa, Entamoeba histolytica
NGYESSQNNDNIH

SEQ ID NO: 2569622 - protein, 6 aa, Entamoeba histolytica
NGYESV

SEQ ID NO: 2569623 - protein, 20 aa, Entamoeba histolytica
NGYKIENNTCVKDKEKECYY

SEQ ID NO: 2569624 - protein, 16 aa, Entamoeba histolytica
NGYSLNSNNKCQKNSR

SEQ ID NO: 2569625 - protein, 14 aa, Entamoeba histolytica
NGYTSQNDPTTGNV

SEQ ID NO: 2569626 - protein, 5 aa, Entamoeba histolytica
NGYTT

SEQ ID NO: 2569627 - protein, 5 aa, Entamoeba histolytica
NGYYR

SEQ ID NO: 2569628 - protein, 8 aa, Entamoeba histolytica
NHDTNVKT

SEQ ID NO: 2569629 - protein, 12 aa, Entamoeba histolytica
NHDVDGVYGRNN

SEQ ID NO: 2569630 - protein, 7 aa, Entamoeba histolytica
NHGGKQI

SEQ ID NO: 2569631 - protein, 6 aa, Entamoeba histolytica
NHGPEK

SEQ ID NO: 2569632 - protein, 11 aa, Entamoeba histolytica
NHHGSKHSNSW

SEQ ID NO: 2569633 - protein, 5 aa, Entamoeba histolytica
NHHQR

SEQ ID NO: 2569634 - protein, 11 aa, Entamoeba histolytica
NHKEKRDIGYE

SEQ ID NO: 2569635 - protein, 12 aa, Entamoeba histolytica
NHKEKRDIGYET

SEQ ID NO: 2569636 - protein, 17 aa, Entamoeba histolytica
NHKKNNEDIPDEEMAEM

SEQ ID NO: 2569637 - protein, 11 aa, Entamoeba histolytica
NHKPSDRPTFK

SEQ ID NO: 2569638 - protein, 16 aa, Entamoeba histolytica
NHLKGEPTNSIDSKYE

SEQ ID NO: 2569639 - protein, 7 aa, Entamoeba histolytica
NHMENNK

SEQ ID NO: 2569640 - protein, 7 aa, Entamoeba histolytica
NHNGLGY

SEQ ID NO: 2569641 - protein, 4 aa, Entamoeba histolytica
NHNS

SEQ ID NO: 2569642 - protein, 4 aa, Entamoeba histolytica
NHNT

SEQ ID NO: 2569643 - protein, 9 aa, Entamoeba histolytica
NHNTRSKGV

SEQ ID NO: 2569644 - protein, 4 aa, Entamoeba histolytica
NHPN

SEQ ID NO: 2569645 - protein, 6 aa, Entamoeba histolytica
NHPRSP

SEQ ID NO: 2569646 - protein, 4 aa, Entamoeba histolytica
NHQE

SEQ ID NO: 2569647 - protein, 12 aa, Entamoeba histolytica
NHSQINKQEYVD

SEQ ID NO: 2569648 - protein, 4 aa, Entamoeba histolytica
NHSR

SEQ ID NO: 2569649 - protein, 22 aa, Entamoeba histolytica
NHSVPQRRSTVASTSDAAKKAQ

SEQ ID NO: 2569650 - protein, 8 aa, Entamoeba histolytica
NHTSKETK

SEQ ID NO: 2569651 - protein, 8 aa, Entamoeba histolytica
NHVYGESR

SEQ ID NO: 2569652 - protein, 6 aa, Entamoeba histolytica
NIAANE

SEQ ID NO: 2569653 - protein, 6 aa, Entamoeba histolytica
NIAERQ

SEQ ID NO: 2569654 - protein, 6 aa, Entamoeba histolytica
NIATGQ

SEQ ID NO: 2569655 - protein, 6 aa, Entamoeba histolytica
NIDGHE

SEQ ID NO: 2569656 - protein, 10 aa, Entamoeba histolytica
NIDGTETPVV

SEQ ID NO: 2569657 - protein, 7 aa, Entamoeba histolytica
NIDKTNT

SEQ ID NO: 2569658 - protein, 5 aa, Entamoeba histolytica
NIEDG

SEQ ID NO: 2569659 - protein, 4 aa, Entamoeba histolytica
NIEE

SEQ ID NO: 2569660 - protein, 7 aa, Entamoeba histolytica
NIEEQKH

SEQ ID NO: 2569661 - protein, 14 aa, Entamoeba histolytica
NIEPTSGINIGRDS

SEQ ID NO: 2569662 - protein, 7 aa, Entamoeba histolytica
NIERPKN

SEQ ID NO: 2569663 - protein, 6 aa, Entamoeba histolytica
NIESGK

SEQ ID NO: 2569664 - protein, 9 aa, Entamoeba histolytica
NIESKYSLT

SEQ ID NO: 2569665 - protein, 5 aa, Entamoeba histolytica
NIESS

SEQ ID NO: 2569666 - protein, 5 aa, Entamoeba histolytica
NIGAE

SEQ ID NO: 2569667 - protein, 12 aa, Entamoeba histolytica
NIGDKNKWSGLS

SEQ ID NO: 2569668 - protein, 18 aa, Entamoeba histolytica
NIGDTNCSVNNAKPNGIS

SEQ ID NO: 2569669 - protein, 8 aa, Entamoeba histolytica
NIGERPSF

SEQ ID NO: 2569670 - protein, 5 aa, Entamoeba histolytica
NIGEV

SEQ ID NO: 2569671 - protein, 7 aa, Entamoeba histolytica
NIGNDEY

SEQ ID NO: 2569672 - protein, 4 aa, Entamoeba histolytica
NIGR

SEQ ID NO: 2569673 - protein, 5 aa, Entamoeba histolytica
NIGTH

SEQ ID NO: 2569674 - protein, 5 aa, Entamoeba histolytica
NIKKE

SEQ ID NO: 2569675 - protein, 9 aa, Entamoeba histolytica
NIKKELKEM

SEQ ID NO: 2569676 - protein, 8 aa, Entamoeba histolytica
NIKLEDTR

SEQ ID NO: 2569677 - protein, 9 aa, Entamoeba histolytica
NIKTAQGYD

SEQ ID NO: 2569678 - protein, 7 aa, Entamoeba histolytica
NIKTEIE

SEQ ID NO: 2569679 - protein, 10 aa, Entamoeba histolytica
NILNEEKTKC

SEQ ID NO: 2569680 - protein, 32 aa, Entamoeba histolytica
NILNNSSNKISSDGNGNVKNNNKRAVNNNSIG

SEQ ID NO: 2569681 - protein, 4 aa, Entamoeba histolytica
NILS

SEQ ID NO: 2569682 - protein, 11 aa, Entamoeba histolytica
NINEDNKVTRK

SEQ ID NO: 2569683 - protein, 5 aa, Entamoeba histolytica
NINWK

SEQ ID NO: 2569684 - protein, 30 aa, Entamoeba histolytica
NIPDGKIQAKVSDRLNKVTNTQRFSTPSVH

SEQ ID NO: 2569685 - protein, 8 aa, Entamoeba histolytica
NIPKGSFE

SEQ ID NO: 2569686 - protein, 11 aa, Entamoeba histolytica
NIPPNNSISIT

SEQ ID NO: 2569687 - protein, 6 aa, Entamoeba histolytica
NIPSSV

SEQ ID NO: 2569688 - protein, 4 aa, Entamoeba histolytica
NIPT

SEQ ID NO: 2569689 - protein, 13 aa, Entamoeba histolytica
NIPTQKKSVIGNN

SEQ ID NO: 2569690 - protein, 14 aa, Entamoeba histolytica
NIQEDEQQEEKHSS

SEQ ID NO: 2569691 - protein, 6 aa, Entamoeba histolytica
NIQGDE

SEQ ID NO: 2569692 - protein, 8 aa, Entamoeba histolytica
NIQGYERE

SEQ ID NO: 2569693 - protein, 16 aa, Entamoeba histolytica
NIQHPEGTCQSDPYKH

SEQ ID NO: 2569694 - protein, 12 aa, Entamoeba histolytica
NIQKDTTQQFNT

SEQ ID NO: 2569695 - protein, 9 aa, Entamoeba histolytica
NIRRNEKCK

SEQ ID NO: 2569696 - protein, 12 aa, Entamoeba histolytica
NIRSGEGEGQPG

SEQ ID NO: 2569697 - protein, 6 aa, Entamoeba histolytica
NISGGA

SEQ ID NO: 2569698 - protein, 9 aa, Entamoeba histolytica
NISNQNEYS

SEQ ID NO: 2569699 - protein, 7 aa, Entamoeba histolytica
NISRGKE

SEQ ID NO: 2569700 - protein, 6 aa, Entamoeba histolytica
NISSNS

SEQ ID NO: 2569701 - protein, 15 aa, Entamoeba histolytica
NISSSHEKPEESIGL

SEQ ID NO: 2569702 - protein, 8 aa, Entamoeba histolytica
NITANEEM

SEQ ID NO: 2569703 - protein, 12 aa, Entamoeba histolytica
NITAPTYVGSDK

SEQ ID NO: 2569704 - protein, 6 aa, Entamoeba histolytica
NITDSI

SEQ ID NO: 2569705 - protein, 12 aa, Entamoeba histolytica
NITEERKEQGIH

SEQ ID NO: 2569706 - protein, 9 aa, Entamoeba histolytica
NITKENDTK

SEQ ID NO: 2569707 - protein, 10 aa, Entamoeba histolytica
NITKNNDNDN

SEQ ID NO: 2569708 - protein, 5 aa, Entamoeba histolytica
NITNP

SEQ ID NO: 2569709 - protein, 8 aa, Entamoeba histolytica
NITNTSHK

SEQ ID NO: 2569710 - protein, 9 aa, Entamoeba histolytica
NKADKLQPI

SEQ ID NO: 2569711 - protein, 22 aa, Entamoeba histolytica
NKAHLEDQETDPLLPNEDDLAP

SEQ ID NO: 2569712 - protein, 14 aa, Entamoeba histolytica
NKAKDDNNKDKTLT

SEQ ID NO: 2569713 - protein, 14 aa, Entamoeba histolytica
NKAKDESNKDKTLT

SEQ ID NO: 2569714 - protein, 5 aa, Entamoeba histolytica
NKAPL

SEQ ID NO: 2569715 - protein, 9 aa, Entamoeba histolytica
NKAQEESIK

SEQ ID NO: 2569716 - protein, 9 aa, Entamoeba histolytica
NKAQEETIK

SEQ ID NO: 2569717 - protein, 16 aa, Entamoeba histolytica
NKATTSQKPQQDNSCM

SEQ ID NO: 2569718 - protein, 8 aa, Entamoeba histolytica
NKCKRQQT

SEQ ID NO: 2569719 - protein, 8 aa, Entamoeba histolytica
NKCQECPA

SEQ ID NO: 2569720 - protein, 6 aa, Entamoeba histolytica
NKCTPI

SEQ ID NO: 2569721 - protein, 8 aa, Entamoeba histolytica
NKCTTCED

SEQ ID NO: 2569722 - protein, 13 aa, Entamoeba histolytica
NKCYENNSTKTKS

SEQ ID NO: 2569723 - protein, 10 aa, Entamoeba histolytica
NKDDDSFTPK

SEQ ID NO: 2569724 - protein, 13 aa, Entamoeba histolytica
NKDDDSPQCGEQA

SEQ ID NO: 2569725 - protein, 9 aa, Entamoeba histolytica
NKDDVEKKL

SEQ ID NO: 2569726 - protein, 5 aa, Entamoeba histolytica
NKDEA

SEQ ID NO: 2569727 - protein, 6 aa, Entamoeba histolytica
NKDGEC

SEQ ID NO: 2569728 - protein, 8 aa, Entamoeba histolytica
NKDGTKGA

SEQ ID NO: 2569729 - protein, 6 aa, Entamoeba histolytica
NKDGTY

SEQ ID NO: 2569730 - protein, 6 aa, Entamoeba histolytica
NKDKEV

SEQ ID NO: 2569731 - protein, 7 aa, Entamoeba histolytica
NKDKNDH

SEQ ID NO: 2569732 - protein, 12 aa, Entamoeba histolytica
NKDKQRPTPLQE

SEQ ID NO: 2569733 - protein, 4 aa, Entamoeba histolytica
NKDM

SEQ ID NO: 2569734 - protein, 5 aa, Entamoeba histolytica
NKDNE

SEQ ID NO: 2569735 - protein, 13 aa, Entamoeba histolytica
NKDSKDSSESLNQ

SEQ ID NO: 2569736 - protein, 9 aa, Entamoeba histolytica
NKDTNNRYK

SEQ ID NO: 2569737 - protein, 7 aa, Entamoeba histolytica
NKDVPTE

SEQ ID NO: 2569738 - protein, 8 aa, Entamoeba histolytica
NKEDQIES

SEQ ID NO: 2569739 - protein, 4 aa, Entamoeba histolytica
NKEE

SEQ ID NO: 2569740 - protein, 8 aa, Entamoeba histolytica
NKEEENGV

SEQ ID NO: 2569741 - protein, 5 aa, Entamoeba histolytica
NKEEI

SEQ ID NO: 2569742 - protein, 8 aa, Entamoeba histolytica
NKEEKRRV

SEQ ID NO: 2569743 - protein, 6 aa, Entamoeba histolytica
NKEETF

SEQ ID NO: 2569744 - protein, 6 aa, Entamoeba histolytica
NKEGFN

SEQ ID NO: 2569745 - protein, 10 aa, Entamoeba histolytica
NKEGKTYQNA

SEQ ID NO: 2569746 - protein, 6 aa, Entamoeba histolytica
NKEIGY

SEQ ID NO: 2569747 - protein, 7 aa, Entamoeba histolytica
NKEINKA

SEQ ID NO: 2569748 - protein, 9 aa, Entamoeba histolytica
NKEINNKET

SEQ ID NO: 2569749 - protein, 9 aa, Entamoeba histolytica
NKEKEAIQY

SEQ ID NO: 2569750 - protein, 7 aa, Entamoeba histolytica
NKEKKKY

SEQ ID NO: 2569751 - protein, 17 aa, Entamoeba histolytica
NKEKPINPEIEMEVNEN

SEQ ID NO: 2569752 - protein, 10 aa, Entamoeba histolytica
NKEKSYHSKD

SEQ ID NO: 2569753 - protein, 5 aa, Entamoeba histolytica
NKENG

SEQ ID NO: 2569754 - protein, 9 aa, Entamoeba histolytica
NKENSSPIN

SEQ ID NO: 2569755 - protein, 6 aa, Entamoeba histolytica
NKEPHE

SEQ ID NO: 2569756 - protein, 7 aa, Entamoeba histolytica
NKEQGIT

SEQ ID NO: 2569757 - protein, 9 aa, Entamoeba histolytica
NKESNPREF

SEQ ID NO: 2569758 - protein, 14 aa, Entamoeba histolytica
NKESTKIKDKKDKL

SEQ ID NO: 2569759 - protein, 6 aa, Entamoeba histolytica
NKETEN

SEQ ID NO: 2569760 - protein, 7 aa, Entamoeba histolytica
NKETNEL

SEQ ID NO: 2569761 - protein, 7 aa, Entamoeba histolytica
NKETSAT

SEQ ID NO: 2569762 - protein, 7 aa, Entamoeba histolytica
NKEVDNE

SEQ ID NO: 2569763 - protein, 11 aa, Entamoeba histolytica
NKEVPKGSPQC

SEQ ID NO: 2569764 - protein, 11 aa, Entamoeba histolytica
NKEVTPAAPEQ

SEQ ID NO: 2569765 - protein, 45 aa, Entamoeba histolytica
NKEVTSPQKLREESIDPNMKTTTTTTTLTSTMNSDVGYNTNQTGM

SEQ ID NO: 2569766 - protein, 11 aa, Entamoeba histolytica
NKEYAKTAKAY

SEQ ID NO: 2569767 - protein, 12 aa, Entamoeba histolytica
NKEYCSESNCQC

SEQ ID NO: 2569768 - protein, 7 aa, Entamoeba histolytica
NKEYIGQ

SEQ ID NO: 2569769 - protein, 16 aa, Entamoeba histolytica
NKFEEERKKNAEVYKK

SEQ ID NO: 2569770 - protein, 11 aa, Entamoeba histolytica
NKFERIQSDCD

SEQ ID NO: 2569771 - protein, 15 aa, Entamoeba histolytica
NKFGKKEYESIGSDD

SEQ ID NO: 2569772 - protein, 9 aa, Entamoeba histolytica
NKFSGSSRP

SEQ ID NO: 2569773 - protein, 8 aa, Entamoeba histolytica
NKGASYRS

SEQ ID NO: 2569774 - protein, 6 aa, Entamoeba histolytica
NKGEER

SEQ ID NO: 2569775 - protein, 8 aa, Entamoeba histolytica
NKGESCNE

SEQ ID NO: 2569776 - protein, 6 aa, Entamoeba histolytica
NKGESK

SEQ ID NO: 2569777 - protein, 7 aa, Entamoeba histolytica
NKGETTV

SEQ ID NO: 2569778 - protein, 6 aa, Entamoeba histolytica
NKGKNL

SEQ ID NO: 2569779 - protein, 5 aa, Entamoeba histolytica
NKGKR

SEQ ID NO: 2569780 - protein, 6 aa, Entamoeba histolytica
NKGKTL

SEQ ID NO: 2569781 - protein, 7 aa, Entamoeba histolytica
NKGNTLL

SEQ ID NO: 2569782 - protein, 7 aa, Entamoeba histolytica
NKGNYPN

SEQ ID NO: 2569783 - protein, 9 aa, Entamoeba histolytica
NKGSSSITF

SEQ ID NO: 2569784 - protein, 11 aa, Entamoeba histolytica
NKGTQDKIPES

SEQ ID NO: 2569785 - protein, 9 aa, Entamoeba histolytica
NKGTRGNEL

SEQ ID NO: 2569786 - protein, 17 aa, Entamoeba histolytica
NKHENALREEKSKKKLL

SEQ ID NO: 2569787 - protein, 8 aa, Entamoeba histolytica
NKHPDKQE

SEQ ID NO: 2569788 - protein, 8 aa, Entamoeba histolytica
NKHTDSDV

SEQ ID NO: 2569789 - protein, 5 aa, Entamoeba histolytica
NKIDD

SEQ ID NO: 2569790 - protein, 5 aa, Entamoeba histolytica
NKIEE

SEQ ID NO: 2569791 - protein, 8 aa, Entamoeba histolytica
NKINTKTT

SEQ ID NO: 2569792 - protein, 5 aa, Entamoeba histolytica
NKIPS

SEQ ID NO: 2569793 - protein, 7 aa, Entamoeba histolytica
NKITSSS

SEQ ID NO: 2569794 - protein, 4 aa, Entamoeba histolytica
NKKA

SEQ ID NO: 2569795 - protein, 11 aa, Entamoeba histolytica
NKKAGKLLSTG

SEQ ID NO: 2569796 - protein, 9 aa, Entamoeba histolytica
NKKASKVYQ

SEQ ID NO: 2569797 - protein, 7 aa, Entamoeba histolytica
NKKDETF

SEQ ID NO: 2569798 - protein, 17 aa, Entamoeba histolytica
NKKDGNSSADINRKIHG

SEQ ID NO: 2569799 - protein, 10 aa, Entamoeba histolytica
NKKDNNNLTI

SEQ ID NO: 2569800 - protein, 6 aa, Entamoeba histolytica
NKKEEL

SEQ ID NO: 2569801 - protein, 7 aa, Entamoeba histolytica
NKKEKDA

SEQ ID NO: 2569802 - protein, 6 aa, Entamoeba histolytica
NKKELK

SEQ ID NO: 2569803 - protein, 9 aa, Entamoeba histolytica
NKKESERIE

SEQ ID NO: 2569804 - protein, 14 aa, Entamoeba histolytica
NKKFCSNKVENNRY

SEQ ID NO: 2569805 - protein, 7 aa, Entamoeba histolytica
NKKHGDG

SEQ ID NO: 2569806 - protein, 29 aa, Entamoeba histolytica
NKKKESHQEEQEINENSQPKDTNEKQIKT

SEQ ID NO: 2569807 - protein, 13 aa, Entamoeba histolytica
NKKKSTKGEYQNF

SEQ ID NO: 2569808 - protein, 6 aa, Entamoeba histolytica
NKKKYV

SEQ ID NO: 2569809 - protein, 6 aa, Entamoeba histolytica
NKKNEP

SEQ ID NO: 2569810 - protein, 10 aa, Entamoeba histolytica
NKKNGRSRAK

SEQ ID NO: 2569811 - protein, 9 aa, Entamoeba histolytica
NKKNPNERI

SEQ ID NO: 2569812 - protein, 5 aa, Entamoeba histolytica
NKKNY

SEQ ID NO: 2569813 - protein, 9 aa, Entamoeba histolytica
NKKPIGNKT

SEQ ID NO: 2569814 - protein, 7 aa, Entamoeba histolytica
NKKPKYN

SEQ ID NO: 2569815 - protein, 7 aa, Entamoeba histolytica
NKKPTIQ

SEQ ID NO: 2569816 - protein, 35 aa, Entamoeba histolytica
NKKQQQQQSNEPTTKIEKEKRKIHPPKKEQNNEKS

SEQ ID NO: 2569817 - protein, 10 aa, Entamoeba histolytica
NKKRSPKTKF

SEQ ID NO: 2569818 - protein, 4 aa, Entamoeba histolytica
NKKS

SEQ ID NO: 2569819 - protein, 6 aa, Entamoeba histolytica
NKKSIN

SEQ ID NO: 2569820 - protein, 19 aa, Entamoeba histolytica
NKKSNGEYQQIDEEDTDYS

SEQ ID NO: 2569821 - protein, 6 aa, Entamoeba histolytica
NKKVTV

SEQ ID NO: 2569822 - protein, 7 aa, Entamoeba histolytica
NKKVVSS

SEQ ID NO: 2569823 - protein, 15 aa, Entamoeba histolytica
NKKWDKGEECDGGDG

SEQ ID NO: 2569824 - protein, 6 aa, Entamoeba histolytica
NKLDTE

SEQ ID NO: 2569825 - protein, 16 aa, Entamoeba histolytica
NKLEDKKEKMGGLKPS

SEQ ID NO: 2569826 - protein, 5 aa, Entamoeba histolytica
NKLKD

SEQ ID NO: 2569827 - protein, 5 aa, Entamoeba histolytica
NKLKS

SEQ ID NO: 2569828 - protein, 19 aa, Entamoeba histolytica
NKLPPPTPRNYYRGSHSSK

SEQ ID NO: 2569829 - protein, 4 aa, Entamoeba histolytica
NKNA

SEQ ID NO: 2569830 - protein, 9 aa, Entamoeba histolytica
NKNAPSTAK

SEQ ID NO: 2569831 - protein, 12 aa, Entamoeba histolytica
NKNASENEINKA

SEQ ID NO: 2569832 - protein, 4 aa, Entamoeba histolytica
NKNC

SEQ ID NO: 2569833 - protein, 8 aa, Entamoeba histolytica
NKNDKQKC

SEQ ID NO: 2569834 - protein, 8 aa, Entamoeba histolytica
NKNDSSIH

SEQ ID NO: 2569835 - protein, 4 aa, Entamoeba histolytica
NKNE

SEQ ID NO: 2569836 - protein, 14 aa, Entamoeba histolytica
NKNEEGTLEDSVAL

SEQ ID NO: 2569837 - protein, 10 aa, Entamoeba histolytica
NKNEITNEKR

SEQ ID NO: 2569838 - protein, 5 aa, Entamoeba histolytica
NKNEL

SEQ ID NO: 2569839 - protein, 7 aa, Entamoeba histolytica
NKNFPLK

SEQ ID NO: 2569840 - protein, 8 aa, Entamoeba histolytica
NKNGEEEC

SEQ ID NO: 2569841 - protein, 5 aa, Entamoeba histolytica
NKNGW

SEQ ID NO: 2569842 - protein, 5 aa, Entamoeba histolytica
NKNGY

SEQ ID NO: 2569843 - protein, 7 aa, Entamoeba histolytica
NKNIETH

SEQ ID NO: 2569844 - protein, 15 aa, Entamoeba histolytica
NKNIGKSGIVGKKSY

SEQ ID NO: 2569845 - protein, 7 aa, Entamoeba histolytica
NKNIKDL

SEQ ID NO: 2569846 - protein, 18 aa, Entamoeba histolytica
NKNKGKEEKLQTITETKE

SEQ ID NO: 2569847 - protein, 5 aa, Entamoeba histolytica
NKNMG

SEQ ID NO: 2569848 - protein, 4 aa, Entamoeba histolytica
NKNN

SEQ ID NO: 2569849 - protein, 9 aa, Entamoeba histolytica
NKNNDTRYM

SEQ ID NO: 2569850 - protein, 8 aa, Entamoeba histolytica
NKNQPMSF

SEQ ID NO: 2569851 - protein, 9 aa, Entamoeba histolytica
NKNSDENKN

SEQ ID NO: 2569852 - protein, 9 aa, Entamoeba histolytica
NKNSKRTKF

SEQ ID NO: 2569853 - protein, 6 aa, Entamoeba histolytica
NKNTFK

SEQ ID NO: 2569854 - protein, 11 aa, Entamoeba histolytica
NKNTKKSVLPT

SEQ ID NO: 2569855 - protein, 10 aa, Entamoeba histolytica
NKNTQTNKKV

SEQ ID NO: 2569856 - protein, 8 aa, Entamoeba histolytica
NKNTQYPT

SEQ ID NO: 2569857 - protein, 10 aa, Entamoeba histolytica
NKNTYSVQTT

SEQ ID NO: 2569858 - protein, 13 aa, Entamoeba histolytica
NKNVSSEVKRQSA

SEQ ID NO: 2569859 - protein, 5 aa, Entamoeba histolytica
NKNWP

SEQ ID NO: 2569860 - protein, 6 aa, Entamoeba histolytica
NKPAYF

SEQ ID NO: 2569861 - protein, 10 aa, Entamoeba histolytica
NKPDRKEYTK

SEQ ID NO: 2569862 - protein, 6 aa, Entamoeba histolytica
NKPEQF

SEQ ID NO: 2569863 - protein, 7 aa, Entamoeba histolytica
NKPESFK

SEQ ID NO: 2569864 - protein, 6 aa, Entamoeba histolytica
NKPGYT

SEQ ID NO: 2569865 - protein, 13 aa, Entamoeba histolytica
NKPIEAETKNMEI

SEQ ID NO: 2569866 - protein, 14 aa, Entamoeba histolytica
NKPIQNDNKEPITI

SEQ ID NO: 2569867 - protein, 5 aa, Entamoeba histolytica
NKPLH

SEQ ID NO: 2569868 - protein, 10 aa, Entamoeba histolytica
NKPNQKEYNK

SEQ ID NO: 2569869 - protein, 7 aa, Entamoeba histolytica
NKPPNGK

SEQ ID NO: 2569870 - protein, 6 aa, Entamoeba histolytica
NKPPPC

SEQ ID NO: 2569871 - protein, 8 aa, Entamoeba histolytica
NKPQEDFN

SEQ ID NO: 2569872 - protein, 6 aa, Entamoeba histolytica
NKPTQF

SEQ ID NO: 2569873 - protein, 4 aa, Entamoeba histolytica
NKPV

SEQ ID NO: 2569874 - protein, 6 aa, Entamoeba histolytica
NKPVAF

SEQ ID NO: 2569875 - protein, 6 aa, Entamoeba histolytica
NKPVSN

SEQ ID NO: 2569876 - protein, 7 aa, Entamoeba histolytica
NKQCQSC

SEQ ID NO: 2569877 - protein, 12 aa, Entamoeba histolytica
NKQEEEKEKKKR

SEQ ID NO: 2569878 - protein, 8 aa, Entamoeba histolytica
NKQIPTED

SEQ ID NO: 2569879 - protein, 9 aa, Entamoeba histolytica
NKQKSSNHL

SEQ ID NO: 2569880 - protein, 6 aa, Entamoeba histolytica
NKQPIK

SEQ ID NO: 2569881 - protein, 14 aa, Entamoeba histolytica
NKQPSAFKTEDAQN

SEQ ID NO: 2569882 - protein, 11 aa, Entamoeba histolytica
NKQSNNSCKPW

SEQ ID NO: 2569883 - protein, 15 aa, Entamoeba histolytica
NKQWDKGEECDGGNG

SEQ ID NO: 2569884 - protein, 7 aa, Entamoeba histolytica
NKRADCS

SEQ ID NO: 2569885 - protein, 11 aa, Entamoeba histolytica
NKRCKYEKCGN

SEQ ID NO: 2569886 - protein, 8 aa, Entamoeba histolytica
NKRGNISG

SEQ ID NO: 2569887 - protein, 6 aa, Entamoeba histolytica
NKRGTY

SEQ ID NO: 2569888 - protein, 7 aa, Entamoeba histolytica
NKRKETI

SEQ ID NO: 2569889 - protein, 21 aa, Entamoeba histolytica
NKRNEQFRRERRQKKREEKIE

SEQ ID NO: 2569890 - protein, 6 aa, Entamoeba histolytica
NKRRIQ

SEQ ID NO: 2569891 - protein, 15 aa, Entamoeba histolytica
NKRWNEGEECDGGDG

SEQ ID NO: 2569892 - protein, 7 aa, Entamoeba histolytica
NKRYDEK

SEQ ID NO: 2569893 - protein, 6 aa, Entamoeba histolytica
NKSFSQ

SEQ ID NO: 2569894 - protein, 4 aa, Entamoeba histolytica
NKSI

SEQ ID NO: 2569895 - protein, 7 aa, Entamoeba histolytica
NKSIEEQ

SEQ ID NO: 2569896 - protein, 7 aa, Entamoeba histolytica
NKSIEGY

SEQ ID NO: 2569897 - protein, 5 aa, Entamoeba histolytica
NKSIS

SEQ ID NO: 2569898 - protein, 9 aa, Entamoeba histolytica
NKSKYSSIA

SEQ ID NO: 2569899 - protein, 7 aa, Entamoeba histolytica
NKSPSNI

SEQ ID NO: 2569900 - protein, 16 aa, Entamoeba histolytica
NKSQSYDFNSPNPLTN

SEQ ID NO: 2569901 - protein, 5 aa, Entamoeba histolytica
NKSRI

SEQ ID NO: 2569902 - protein, 51 aa, Entamoeba histolytica
NKSSPSSVPAAQSTTPVNVPKAENQFTLQGNNSSTGLSTSTQPVTSTIPPM

SEQ ID NO: 2569903 - protein, 9 aa, Entamoeba histolytica
NKSTGTQNF

SEQ ID NO: 2569904 - protein, 10 aa, Entamoeba histolytica
NKTANDTGRA

SEQ ID NO: 2569905 - protein, 14 aa, Entamoeba histolytica
NKTCPELAPNGTSL

SEQ ID NO: 2569906 - protein, 8 aa, Entamoeba histolytica
NKTCQSCD

SEQ ID NO: 2569907 - protein, 7 aa, Entamoeba histolytica
NKTDRDD

SEQ ID NO: 2569908 - protein, 12 aa, Entamoeba histolytica
NKTGELENLINQ

SEQ ID NO: 2569909 - protein, 4 aa, Entamoeba histolytica
NKTI

SEQ ID NO: 2569910 - protein, 7 aa, Entamoeba histolytica
NKTKAAE

SEQ ID NO: 2569911 - protein, 6 aa, Entamoeba histolytica
NKTNDI

SEQ ID NO: 2569912 - protein, 7 aa, Entamoeba histolytica
NKTNEDI

SEQ ID NO: 2569913 - protein, 7 aa, Entamoeba histolytica
NKTNEEF

SEQ ID NO: 2569914 - protein, 8 aa, Entamoeba histolytica
NKTNNVCS

SEQ ID NO: 2569915 - protein, 6 aa, Entamoeba histolytica
NKTNSI

SEQ ID NO: 2569916 - protein, 12 aa, Entamoeba histolytica
NKTNVKKRNAEE

SEQ ID NO: 2569917 - protein, 49 aa, Entamoeba histolytica
NKTPHPSSVTPPSLPQSINQTQHLQQPQQSNIHPIETNKNTNNYSNSKR

SEQ ID NO: 2569918 - protein, 8 aa, Entamoeba histolytica
NKTRERIN

SEQ ID NO: 2569919 - protein, 8 aa, Entamoeba histolytica
NKTRSKQI

SEQ ID NO: 2569920 - protein, 7 aa, Entamoeba histolytica
NKTSCVP

SEQ ID NO: 2569921 - protein, 9 aa, Entamoeba histolytica
NKTSGTEPL

SEQ ID NO: 2569922 - protein, 8 aa, Entamoeba histolytica
NKTSKTTY

SEQ ID NO: 2569923 - protein, 4 aa, Entamoeba histolytica
NKTT

SEQ ID NO: 2569924 - protein, 8 aa, Entamoeba histolytica
NKTTIKSK

SEQ ID NO: 2569925 - protein, 5 aa, Entamoeba histolytica
NKTTS

SEQ ID NO: 2569926 - protein, 8 aa, Entamoeba histolytica
NKTTYNRD

SEQ ID NO: 2569927 - protein, 9 aa, Entamoeba histolytica
NKTVNENNI

SEQ ID NO: 2569928 - protein, 15 aa, Entamoeba histolytica
NKVDPVNSNENIPPK

SEQ ID NO: 2569929 - protein, 13 aa, Entamoeba histolytica
NKVENGNYCDSSK

SEQ ID NO: 2569930 - protein, 15 aa, Entamoeba histolytica
NKVESDGKQIDEMQN

SEQ ID NO: 2569931 - protein, 6 aa, Entamoeba histolytica
NKVFDD

SEQ ID NO: 2569932 - protein, 8 aa, Entamoeba histolytica
NKVIDGQP

SEQ ID NO: 2569933 - protein, 13 aa, Entamoeba histolytica
NKVKNGNYCNSKN

SEQ ID NO: 2569934 - protein, 10 aa, Entamoeba histolytica
NKVSVSEAKS

SEQ ID NO: 2569935 - protein, 15 aa, Entamoeba histolytica
NKVVGSSGDAWTESN

SEQ ID NO: 2569936 - protein, 7 aa, Entamoeba histolytica
NKYEAYR

SEQ ID NO: 2569937 - protein, 5 aa, Entamoeba histolytica
NKYGR

SEQ ID NO: 2569938 - protein, 22 aa, Entamoeba histolytica
NKYIPSSNIQQSCQPKISSGTI

SEQ ID NO: 2569939 - protein, 7 aa, Entamoeba histolytica
NKYLQDT

SEQ ID NO: 2569940 - protein, 5 aa, Entamoeba histolytica
NKYQD

SEQ ID NO: 2569941 - protein, 6 aa, Entamoeba histolytica
NLAKDG

SEQ ID NO: 2569942 - protein, 17 aa, Entamoeba histolytica
NLAKTQKKNMISRSVSL

SEQ ID NO: 2569943 - protein, 8 aa, Entamoeba histolytica
NLASPDGI

SEQ ID NO: 2569944 - protein, 6 aa, Entamoeba histolytica
NLDGES

SEQ ID NO: 2569945 - protein, 8 aa, Entamoeba histolytica
NLDGTDDV

SEQ ID NO: 2569946 - protein, 12 aa, Entamoeba histolytica
NLDNSADTSSRL

SEQ ID NO: 2569947 - protein, 6 aa, Entamoeba histolytica
NLDQYN

SEQ ID NO: 2569948 - protein, 8 aa, Entamoeba histolytica
NLDSSNNI

SEQ ID NO: 2569949 - protein, 7 aa, Entamoeba histolytica
NLEDNEE

SEQ ID NO: 2569950 - protein, 11 aa, Entamoeba histolytica
NLENKSPYYDD

SEQ ID NO: 2569951 - protein, 7 aa, Entamoeba histolytica
NLGAHSG

SEQ ID NO: 2569952 - protein, 7 aa, Entamoeba histolytica
NLGEEGQ

SEQ ID NO: 2569953 - protein, 6 aa, Entamoeba histolytica
NLGPGG

SEQ ID NO: 2569954 - protein, 4 aa, Entamoeba histolytica
NLHQ

SEQ ID NO: 2569955 - protein, 4 aa, Entamoeba histolytica
NLHS

SEQ ID NO: 2569956 - protein, 11 aa, Entamoeba histolytica
NLKEKKDIGTP

SEQ ID NO: 2569957 - protein, 8 aa, Entamoeba histolytica
NLKEPNNF

SEQ ID NO: 2569958 - protein, 7 aa, Entamoeba histolytica
NLKNPEE

SEQ ID NO: 2569959 - protein, 6 aa, Entamoeba histolytica
NLNAQQ

SEQ ID NO: 2569960 - protein, 8 aa, Entamoeba histolytica
NLNEKNSS

SEQ ID NO: 2569961 - protein, 4 aa, Entamoeba histolytica
NLNI

SEQ ID NO: 2569962 - protein, 6 aa, Entamoeba histolytica
NLNQRS

SEQ ID NO: 2569963 - protein, 11 aa, Entamoeba histolytica
NLPDEAKKRIS

SEQ ID NO: 2569964 - protein, 12 aa, Entamoeba histolytica
NLPNNNKLTPSY

SEQ ID NO: 2569965 - protein, 11 aa, Entamoeba histolytica
NLPNPYDEGIK

SEQ ID NO: 2569966 - protein, 4 aa, Entamoeba histolytica
NLPR

SEQ ID NO: 2569967 - protein, 44 aa, Entamoeba histolytica
NLQNSQKSGEFENKSNPSSKNSSTVHSGVSNNLSSKKKKTNKNI

SEQ ID NO: 2569968 - protein, 7 aa, Entamoeba histolytica
NLRPTAD

SEQ ID NO: 2569969 - protein, 6 aa, Entamoeba histolytica
NLSEDS

SEQ ID NO: 2569970 - protein, 5 aa, Entamoeba histolytica
NLSES

SEQ ID NO: 2569971 - protein, 4 aa, Entamoeba histolytica
NLSN

SEQ ID NO: 2569972 - protein, 9 aa, Entamoeba histolytica
NLSNGTPRM

SEQ ID NO: 2569973 - protein, 21 aa, Entamoeba histolytica
NLSNKQDVRIDSTDSNQNDKT

SEQ ID NO: 2569974 - protein, 13 aa, Entamoeba histolytica
NLSNPNDEQQKKL

SEQ ID NO: 2569975 - protein, 9 aa, Entamoeba histolytica
NLSSERVKG

SEQ ID NO: 2569976 - protein, 6 aa, Entamoeba histolytica
NLSSVS

SEQ ID NO: 2569977 - protein, 7 aa, Entamoeba histolytica
NLTATNT

SEQ ID NO: 2569978 - protein, 7 aa, Entamoeba histolytica
NLTDKEK

SEQ ID NO: 2569979 - protein, 6 aa, Entamoeba histolytica
NLTTQE

SEQ ID NO: 2569980 - protein, 11 aa, Entamoeba histolytica
NMAGDSETIEE

SEQ ID NO: 2569981 - protein, 5 aa, Entamoeba histolytica
NMEGN

SEQ ID NO: 2569982 - protein, 13 aa, Entamoeba histolytica
NMKDAYKSFPSGH

SEQ ID NO: 2569983 - protein, 11 aa, Entamoeba histolytica
NMKNESTPEIT

SEQ ID NO: 2569984 - protein, 6 aa, Entamoeba histolytica
NMNDRT

SEQ ID NO: 2569985 - protein, 18 aa, Entamoeba histolytica
NMNTQNNTMNDDKCPSAR

SEQ ID NO: 2569986 - protein, 4 aa, Entamoeba histolytica
NMPK

SEQ ID NO: 2569987 - protein, 4 aa, Entamoeba histolytica
NMPP

SEQ ID NO: 2569988 - protein, 10 aa, Entamoeba histolytica
NMRDESLKEF

SEQ ID NO: 2569989 - protein, 7 aa, Entamoeba histolytica
NMSKSGH

SEQ ID NO: 2569990 - protein, 17 aa, Entamoeba histolytica
NMTEEQQNDNSLEEVVN

SEQ ID NO: 2569991 - protein, 4 aa, Entamoeba histolytica
NNAG

SEQ ID NO: 2569992 - protein, 9 aa, Entamoeba histolytica
NNAKTMKEL

SEQ ID NO: 2569993 - protein, 11 aa, Entamoeba histolytica
NNANSKTTLGN

SEQ ID NO: 2569994 - protein, 8 aa, Entamoeba histolytica
NNCGNNGL

SEQ ID NO: 2569995 - protein, 10 aa, Entamoeba histolytica
NNCKEEGHYK

SEQ ID NO: 2569996 - protein, 12 aa, Entamoeba histolytica
NNCKKEGKYEIS

SEQ ID NO: 2569997 - protein, 9 aa, Entamoeba histolytica
NNCTKSERN

SEQ ID NO: 2569998 - protein, 4 aa, Entamoeba histolytica
NNCV

SEQ ID NO: 2569999 - protein, 4 aa, Entamoeba histolytica
NNDA

SEQ ID NO: 2570000 - protein, 8 aa, Entamoeba histolytica
NNDEKNNF

SEQ ID NO: 2570001 - protein, 9 aa, Entamoeba histolytica
NNDETDETR

SEQ ID NO: 2570002 - protein, 7 aa, Entamoeba histolytica
NNDETIR

SEQ ID NO: 2570003 - protein, 4 aa, Entamoeba histolytica
NNDI

SEQ ID NO: 2570004 - protein, 11 aa, Entamoeba histolytica
NNDKGHGNCSA

SEQ ID NO: 2570005 - protein, 4 aa, Entamoeba histolytica
NNDL

SEQ ID NO: 2570006 - protein, 6 aa, Entamoeba histolytica
NNDNKC

SEQ ID NO: 2570007 - protein, 6 aa, Entamoeba histolytica
NNDPGI

SEQ ID NO: 2570008 - protein, 9 aa, Entamoeba histolytica
NNDQPDTDL

SEQ ID NO: 2570009 - protein, 7 aa, Entamoeba histolytica
NNDRNEF

SEQ ID NO: 2570010 - protein, 9 aa, Entamoeba histolytica
NNDSNSEFG

SEQ ID NO: 2570011 - protein, 5 aa, Entamoeba histolytica
NNDTT

SEQ ID NO: 2570012 - protein, 12 aa, Entamoeba histolytica
NNDVSEKVKSSR

SEQ ID NO: 2570013 - protein, 13 aa, Entamoeba histolytica
NNEFEKYKQTEQY

SEQ ID NO: 2570014 - protein, 9 aa, Entamoeba histolytica
NNEKAKSQL

SEQ ID NO: 2570015 - protein, 8 aa, Entamoeba histolytica
NNEKELKT

SEQ ID NO: 2570016 - protein, 12 aa, Entamoeba histolytica
NNEKKDIEIETD

SEQ ID NO: 2570017 - protein, 8 aa, Entamoeba histolytica
NNELTGNE

SEQ ID NO: 2570018 - protein, 4 aa, Entamoeba histolytica
NNEN

SEQ ID NO: 2570019 - protein, 5 aa, Entamoeba histolytica
NNENK

SEQ ID NO: 2570020 - protein, 6 aa, Entamoeba histolytica
NNENKD

SEQ ID NO: 2570021 - protein, 5 aa, Entamoeba histolytica
NNEPI

SEQ ID NO: 2570022 - protein, 4 aa, Entamoeba histolytica
NNEQ

SEQ ID NO: 2570023 - protein, 5 aa, Entamoeba histolytica
NNEQF

SEQ ID NO: 2570024 - protein, 7 aa, Entamoeba histolytica
NNERNKI

SEQ ID NO: 2570025 - protein, 4 aa, Entamoeba histolytica
NNET

SEQ ID NO: 2570026 - protein, 5 aa, Entamoeba histolytica
NNETG

SEQ ID NO: 2570027 - protein, 8 aa, Entamoeba histolytica
NNETQSHI

SEQ ID NO: 2570028 - protein, 6 aa, Entamoeba histolytica
NNEWNK

SEQ ID NO: 2570029 - protein, 9 aa, Entamoeba histolytica
NNEYDDDNC

SEQ ID NO: 2570030 - protein, 9 aa, Entamoeba histolytica
NNFNQSENE

SEQ ID NO: 2570031 - protein, 5 aa, Entamoeba histolytica
NNGEF

SEQ ID NO: 2570032 - protein, 5 aa, Entamoeba histolytica
NNGIQ

SEQ ID NO: 2570033 - protein, 12 aa, Entamoeba histolytica
NNGKAHDGRPTY

SEQ ID NO: 2570034 - protein, 7 aa, Entamoeba histolytica
NNGKNEI

SEQ ID NO: 2570035 - protein, 7 aa, Entamoeba histolytica
NNGKNRI

SEQ ID NO: 2570036 - protein, 8 aa, Entamoeba histolytica
NNGNGDCG

SEQ ID NO: 2570037 - protein, 8 aa, Entamoeba histolytica
NNGNYAEA

SEQ ID NO: 2570038 - protein, 18 aa, Entamoeba histolytica
NNGPHANDPKYKSGYNNQ

SEQ ID NO: 2570039 - protein, 9 aa, Entamoeba histolytica
NNGSCSDAS

SEQ ID NO: 2570040 - protein, 5 aa, Entamoeba histolytica
NNGTG

SEQ ID NO: 2570041 - protein, 6 aa, Entamoeba histolytica
NNGVQQ

SEQ ID NO: 2570042 - protein, 7 aa, Entamoeba histolytica
NNHSEDR

SEQ ID NO: 2570043 - protein, 5 aa, Entamoeba histolytica
NNHTC

SEQ ID NO: 2570044 - protein, 21 aa, Entamoeba histolytica
NNIAPPPQQQSIGNAENEPLI

SEQ ID NO: 2570045 - protein, 4 aa, Entamoeba histolytica
NNID

SEQ ID NO: 2570046 - protein, 19 aa, Entamoeba histolytica
NNINDEANDGLENEKPTKH

SEQ ID NO: 2570047 - protein, 9 aa, Entamoeba histolytica
NNINENGEI

SEQ ID NO: 2570048 - protein, 8 aa, Entamoeba histolytica
NNIPNDQF

SEQ ID NO: 2570049 - protein, 7 aa, Entamoeba histolytica
NNIPNQE

SEQ ID NO: 2570050 - protein, 8 aa, Entamoeba histolytica
NNIPPTTA

SEQ ID NO: 2570051 - protein, 5 aa, Entamoeba histolytica
NNITA

SEQ ID NO: 2570052 - protein, 9 aa, Entamoeba histolytica
NNITENIGK

SEQ ID NO: 2570053 - protein, 8 aa, Entamoeba histolytica
NNKAPQCE

SEQ ID NO: 2570054 - protein, 9 aa, Entamoeba histolytica
NNKCQENSH

SEQ ID NO: 2570055 - protein, 15 aa, Entamoeba histolytica
NNKCTSKERVSRTNQ

SEQ ID NO: 2570056 - protein, 12 aa, Entamoeba histolytica
NNKCTSKETVEQ

SEQ ID NO: 2570057 - protein, 14 aa, Entamoeba histolytica
NNKEMSQDQKEKYR

SEQ ID NO: 2570058 - protein, 11 aa, Entamoeba histolytica
NNKETSEGFKS

SEQ ID NO: 2570059 - protein, 7 aa, Entamoeba histolytica
NNKGKDQ

SEQ ID NO: 2570060 - protein, 5 aa, Entamoeba histolytica
NNKGV

SEQ ID NO: 2570061 - protein, 18 aa, Entamoeba histolytica
NNKHNVKPGEVDFSQLTY

SEQ ID NO: 2570062 - protein, 26 aa, Entamoeba histolytica
NNKIKKNKEINENTNNFNNNNSKEIN

SEQ ID NO: 2570063 - protein, 7 aa, Entamoeba histolytica
NNKKGYE

SEQ ID NO: 2570064 - protein, 7 aa, Entamoeba histolytica
NNKKIST

SEQ ID NO: 2570065 - protein, 12 aa, Entamoeba histolytica
NNKNIQQPPDGN

SEQ ID NO: 2570066 - protein, 8 aa, Entamoeba histolytica
NNKQITPD

SEQ ID NO: 2570067 - protein, 57 aa, Entamoeba histolytica
NNKQKVPNLPPIKREPIEPTTEQIPPEKKKPEIKDDTTTAEDNNETHLKSETVSEKE

SEQ ID NO: 2570068 - protein, 9 aa, Entamoeba histolytica
NNKRTNESI

SEQ ID NO: 2570069 - protein, 7 aa, Entamoeba histolytica
NNKSEMY

SEQ ID NO: 2570070 - protein, 13 aa, Entamoeba histolytica
NNKSETPSIEGTI

SEQ ID NO: 2570071 - protein, 10 aa, Entamoeba histolytica
NNKSTETSEF

SEQ ID NO: 2570072 - protein, 9 aa, Entamoeba histolytica
NNKTEDNSK

SEQ ID NO: 2570073 - protein, 11 aa, Entamoeba histolytica
NNKWNSTNCPC

SEQ ID NO: 2570074 - protein, 8 aa, Entamoeba histolytica
NNLEEFEE

SEQ ID NO: 2570075 - protein, 7 aa, Entamoeba histolytica
NNLGNIS

SEQ ID NO: 2570076 - protein, 7 aa, Entamoeba histolytica
NNLGPSG

SEQ ID NO: 2570077 - protein, 5 aa, Entamoeba histolytica
NNLNK

SEQ ID NO: 2570078 - protein, 7 aa, Entamoeba histolytica
NNLPPEL

SEQ ID NO: 2570079 - protein, 4 aa, Entamoeba histolytica
NNLQ

SEQ ID NO: 2570080 - protein, 8 aa, Entamoeba histolytica
NNLQQGTV

SEQ ID NO: 2570081 - protein, 7 aa, Entamoeba histolytica
NNNDAHA

SEQ ID NO: 2570082 - protein, 9 aa, Entamoeba histolytica
NNNDGDNNL

SEQ ID NO: 2570083 - protein, 32 aa, Entamoeba histolytica
NNNEEELEENDDEDDEMEFEEPDDEEFEDPSS

SEQ ID NO: 2570084 - protein, 11 aa, Entamoeba histolytica
NNNEEKEDEKR

SEQ ID NO: 2570085 - protein, 6 aa, Entamoeba histolytica
NNNELK

SEQ ID NO: 2570086 - protein, 24 aa, Entamoeba histolytica
NNNETIKHQEEKHEARAIINKEEN

SEQ ID NO: 2570087 - protein, 8 aa, Entamoeba histolytica
NNNETIKT

SEQ ID NO: 2570088 - protein, 12 aa, Entamoeba histolytica
NNNGCSDAFGNL

SEQ ID NO: 2570089 - protein, 6 aa, Entamoeba histolytica
NNNIEK

SEQ ID NO: 2570090 - protein, 13 aa, Entamoeba histolytica
NNNISSDKGFTSQ

SEQ ID NO: 2570091 - protein, 5 aa, Entamoeba histolytica
NNNMQ

SEQ ID NO: 2570092 - protein, 9 aa, Entamoeba histolytica
NNNNDDELE

SEQ ID NO: 2570093 - protein, 18 aa, Entamoeba histolytica
NNNNEKKVNDDSDDKIDD

SEQ ID NO: 2570094 - protein, 5 aa, Entamoeba histolytica
NNNNS

SEQ ID NO: 2570095 - protein, 7 aa, Entamoeba histolytica
NNNNYSH

SEQ ID NO: 2570096 - protein, 8 aa, Entamoeba histolytica
NNNPQQRL

SEQ ID NO: 2570097 - protein, 16 aa, Entamoeba histolytica
NNNQKQSTLNTQPWGT

SEQ ID NO: 2570098 - protein, 6 aa, Entamoeba histolytica
NNNSEM

SEQ ID NO: 2570099 - protein, 15 aa, Entamoeba histolytica
NNPAAGALADDHRND

SEQ ID NO: 2570100 - protein, 4 aa, Entamoeba histolytica
NNPE

SEQ ID NO: 2570101 - protein, 6 aa, Entamoeba histolytica
NNPEGF

SEQ ID NO: 2570102 - protein, 6 aa, Entamoeba histolytica
NNPHDA

SEQ ID NO: 2570103 - protein, 7 aa, Entamoeba histolytica
NNPHQRP

SEQ ID NO: 2570104 - protein, 5 aa, Entamoeba histolytica
NNPID

SEQ ID NO: 2570105 - protein, 13 aa, Entamoeba histolytica
NNPIPPLPNNSSH

SEQ ID NO: 2570106 - protein, 7 aa, Entamoeba histolytica
NNPKDGV

SEQ ID NO: 2570107 - protein, 8 aa, Entamoeba histolytica
NNPKSREV

SEQ ID NO: 2570108 - protein, 9 aa, Entamoeba histolytica
NNPNNKIVT

SEQ ID NO: 2570109 - protein, 6 aa, Entamoeba histolytica
NNPPNK

SEQ ID NO: 2570110 - protein, 6 aa, Entamoeba histolytica
NNPQDL

SEQ ID NO: 2570111 - protein, 7 aa, Entamoeba histolytica
NNPQERL

SEQ ID NO: 2570112 - protein, 13 aa, Entamoeba histolytica
NNPQMKKSASGLF

SEQ ID NO: 2570113 - protein, 10 aa, Entamoeba histolytica
NNPQREEKSK

SEQ ID NO: 2570114 - protein, 8 aa, Entamoeba histolytica
NNPRKPTD

SEQ ID NO: 2570115 - protein, 14 aa, Entamoeba histolytica
NNPSASALADDHRN

SEQ ID NO: 2570116 - protein, 7 aa, Entamoeba histolytica
NNPTSQL

SEQ ID NO: 2570117 - protein, 5 aa, Entamoeba histolytica
NNQDR

SEQ ID NO: 2570118 - protein, 11 aa, Entamoeba histolytica
NNQELSYTQQT

SEQ ID NO: 2570119 - protein, 9 aa, Entamoeba histolytica
NNQEPRTAV

SEQ ID NO: 2570120 - protein, 8 aa, Entamoeba histolytica
NNQFTNGK

SEQ ID NO: 2570121 - protein, 4 aa, Entamoeba histolytica
NNQN

SEQ ID NO: 2570122 - protein, 27 aa, Entamoeba histolytica
NNQNTTPYRNSYQQQYQQPYSGYTYFP

SEQ ID NO: 2570123 - protein, 8 aa, Entamoeba histolytica
NNQQLDNN

SEQ ID NO: 2570124 - protein, 5 aa, Entamoeba histolytica
NNQQQ

SEQ ID NO: 2570125 - protein, 8 aa, Entamoeba histolytica
NNQQYGLE

SEQ ID NO: 2570126 - protein, 5 aa, Entamoeba histolytica
NNQSM

SEQ ID NO: 2570127 - protein, 9 aa, Entamoeba histolytica
NNQSPDIPN

SEQ ID NO: 2570128 - protein, 4 aa, Entamoeba histolytica
NNQT

SEQ ID NO: 2570129 - protein, 8 aa, Entamoeba histolytica
NNQTNTQN

SEQ ID NO: 2570130 - protein, 7 aa, Entamoeba histolytica
NNQTTDL

SEQ ID NO: 2570131 - protein, 6 aa, Entamoeba histolytica
NNREGI

SEQ ID NO: 2570132 - protein, 18 aa, Entamoeba histolytica
NNRNSVYNSTLNDSNRLT

SEQ ID NO: 2570133 - protein, 5 aa, Entamoeba histolytica
NNRQV

SEQ ID NO: 2570134 - protein, 16 aa, Entamoeba histolytica
NNRRDTLKHQDSTYIE

SEQ ID NO: 2570135 - protein, 12 aa, Entamoeba histolytica
NNRRQKKRITPD

SEQ ID NO: 2570136 - protein, 6 aa, Entamoeba histolytica
NNRTNN

SEQ ID NO: 2570137 - protein, 17 aa, Entamoeba histolytica
NNSDNNEVSYSQITTKQ

SEQ ID NO: 2570138 - protein, 9 aa, Entamoeba histolytica
NNSDTQPFE

SEQ ID NO: 2570139 - protein, 24 aa, Entamoeba histolytica
NNSFNSTESTQPINYSEKSNELRN

SEQ ID NO: 2570140 - protein, 4 aa, Entamoeba histolytica
NNSI

SEQ ID NO: 2570141 - protein, 4 aa, Entamoeba histolytica
NNSK

SEQ ID NO: 2570142 - protein, 7 aa, Entamoeba histolytica
NNSKNPH

SEQ ID NO: 2570143 - protein, 9 aa, Entamoeba histolytica
NNSLQDSPF

SEQ ID NO: 2570144 - protein, 23 aa, Entamoeba histolytica
NNSNERRTTRRERRRKRKTRKVQ

SEQ ID NO: 2570145 - protein, 6 aa, Entamoeba histolytica
NNSNIK

SEQ ID NO: 2570146 - protein, 6 aa, Entamoeba histolytica
NNSNYF

SEQ ID NO: 2570147 - protein, 5 aa, Entamoeba histolytica
NNSPI

SEQ ID NO: 2570148 - protein, 14 aa, Entamoeba histolytica
NNSPNEKDSSSIEE

SEQ ID NO: 2570149 - protein, 11 aa, Entamoeba histolytica
NNSPYGHRGSH

SEQ ID NO: 2570150 - protein, 6 aa, Entamoeba histolytica
NNSQEY

SEQ ID NO: 2570151 - protein, 9 aa, Entamoeba histolytica
NNSQGTCSI

SEQ ID NO: 2570152 - protein, 7 aa, Entamoeba histolytica
NNSRPIT

SEQ ID NO: 2570153 - protein, 5 aa, Entamoeba histolytica
NNSSK

SEQ ID NO: 2570154 - protein, 8 aa, Entamoeba histolytica
NNSSSTTV

SEQ ID NO: 2570155 - protein, 4 aa, Entamoeba histolytica
NNST

SEQ ID NO: 2570156 - protein, 14 aa, Entamoeba histolytica
NNSTCQSPIGIKTG

SEQ ID NO: 2570157 - protein, 17 aa, Entamoeba histolytica
NNSTMQRIDDTEVQPEY

SEQ ID NO: 2570158 - protein, 7 aa, Entamoeba histolytica
NNTCESC

SEQ ID NO: 2570159 - protein, 9 aa, Entamoeba histolytica
NNTDSNEDI

SEQ ID NO: 2570160 - protein, 4 aa, Entamoeba histolytica
NNTI

SEQ ID NO: 2570161 - protein, 5 aa, Entamoeba histolytica
NNTIK

SEQ ID NO: 2570162 - protein, 6 aa, Entamoeba histolytica
NNTKIQ

SEQ ID NO: 2570163 - protein, 7 aa, Entamoeba histolytica
NNTKKTY

SEQ ID NO: 2570164 - protein, 13 aa, Entamoeba histolytica
NNTKNELEINENE

SEQ ID NO: 2570165 - protein, 5 aa, Entamoeba histolytica
NNTLV

SEQ ID NO: 2570166 - protein, 5 aa, Entamoeba histolytica
NNTMN

SEQ ID NO: 2570167 - protein, 11 aa, Entamoeba histolytica
NNTNDNDDDQF

SEQ ID NO: 2570168 - protein, 5 aa, Entamoeba histolytica
NNTNE

SEQ ID NO: 2570169 - protein, 8 aa, Entamoeba histolytica
NNTNGNVE

SEQ ID NO: 2570170 - protein, 6 aa, Entamoeba histolytica
NNTPAP

SEQ ID NO: 2570171 - protein, 15 aa, Entamoeba histolytica
NNTQNQKNNHKNHHH

SEQ ID NO: 2570172 - protein, 12 aa, Entamoeba histolytica
NNTQTTHTSDNI

SEQ ID NO: 2570173 - protein, 9 aa, Entamoeba histolytica
NNTSPTAYH

SEQ ID NO: 2570174 - protein, 17 aa, Entamoeba histolytica
NNTTPLNITENDGIPNK

SEQ ID NO: 2570175 - protein, 6 aa, Entamoeba histolytica
NNVQSI

SEQ ID NO: 2570176 - protein, 9 aa, Entamoeba histolytica
NNVQTVTAD

SEQ ID NO: 2570177 - protein, 6 aa, Entamoeba histolytica
NNVSKA

SEQ ID NO: 2570178 - protein, 22 aa, Entamoeba histolytica
NNYEDDTPLLNGNKTEFTDEQK

SEQ ID NO: 2570179 - protein, 6 aa, Entamoeba histolytica
NNYRRD

SEQ ID NO: 2570180 - protein, 5 aa, Entamoeba histolytica
NNYSR

SEQ ID NO: 2570181 - protein, 16 aa, Entamoeba histolytica
NNYTSCQTTSYDEEPF

SEQ ID NO: 2570182 - protein, 12 aa, Entamoeba histolytica
NPAERKLNSSNS

SEQ ID NO: 2570183 - protein, 11 aa, Entamoeba histolytica
NPANLDVSEGK

SEQ ID NO: 2570184 - protein, 6 aa, Entamoeba histolytica
NPATGK

SEQ ID NO: 2570185 - protein, 6 aa, Entamoeba histolytica
NPCGIT

SEQ ID NO: 2570186 - protein, 6 aa, Entamoeba histolytica
NPCGRC

SEQ ID NO: 2570187 - protein, 15 aa, Entamoeba histolytica
NPCTGQDNSRSENEI

SEQ ID NO: 2570188 - protein, 6 aa, Entamoeba histolytica
NPDDQG

SEQ ID NO: 2570189 - protein, 15 aa, Entamoeba histolytica
NPDEGYSPKKKHNTI

SEQ ID NO: 2570190 - protein, 8 aa, Entamoeba histolytica
NPDERPNF

SEQ ID NO: 2570191 - protein, 8 aa, Entamoeba histolytica
NPDLPPAV

SEQ ID NO: 2570192 - protein, 6 aa, Entamoeba histolytica
NPEEKG

SEQ ID NO: 2570193 - protein, 10 aa, Entamoeba histolytica
NPEGKKIKHK

SEQ ID NO: 2570194 - protein, 9 aa, Entamoeba histolytica
NPEKQERIK

SEQ ID NO: 2570195 - protein, 9 aa, Entamoeba histolytica
NPEKQNDGN

SEQ ID NO: 2570196 - protein, 9 aa, Entamoeba histolytica
NPENKITKS

SEQ ID NO: 2570197 - protein, 4 aa, Entamoeba histolytica
NPER

SEQ ID NO: 2570198 - protein, 11 aa, Entamoeba histolytica
NPETRKCEGCD

SEQ ID NO: 2570199 - protein, 4 aa, Entamoeba histolytica
NPFD

SEQ ID NO: 2570200 - protein, 7 aa, Entamoeba histolytica
NPFDPVT

SEQ ID NO: 2570201 - protein, 13 aa, Entamoeba histolytica
NPFSEEEKASHSL

SEQ ID NO: 2570202 - protein, 4 aa, Entamoeba histolytica
NPGE

SEQ ID NO: 2570203 - protein, 8 aa, Entamoeba histolytica
NPGFGGDD

SEQ ID NO: 2570204 - protein, 4 aa, Entamoeba histolytica
NPGH

SEQ ID NO: 2570205 - protein, 4 aa, Entamoeba histolytica
NPGI

SEQ ID NO: 2570206 - protein, 9 aa, Entamoeba histolytica
NPGIGPSAD

SEQ ID NO: 2570207 - protein, 4 aa, Entamoeba histolytica
NPGV

SEQ ID NO: 2570208 - protein, 7 aa, Entamoeba histolytica
NPHNPEE

SEQ ID NO: 2570209 - protein, 5 aa, Entamoeba histolytica
NPIAE

SEQ ID NO: 2570210 - protein, 6 aa, Entamoeba histolytica
NPIETH

SEQ ID NO: 2570211 - protein, 7 aa, Entamoeba histolytica
NPIETTK

SEQ ID NO: 2570212 - protein, 6 aa, Entamoeba histolytica
NPIGTD

SEQ ID NO: 2570213 - protein, 12 aa, Entamoeba histolytica
NPIIEDETYENN

SEQ ID NO: 2570214 - protein, 16 aa, Entamoeba histolytica
NPINEQPNQQTRDQKI

SEQ ID NO: 2570215 - protein, 43 aa, Entamoeba histolytica
NPIQNSESTLTSNSTTNGPQSETEKEQKNTTLQSNDLENEPPL

SEQ ID NO: 2570216 - protein, 7 aa, Entamoeba histolytica
NPIQTTS

SEQ ID NO: 2570217 - protein, 11 aa, Entamoeba histolytica
NPIRKKEFENA

SEQ ID NO: 2570218 - protein, 17 aa, Entamoeba histolytica
NPISNINSNSNPQSQSQ

SEQ ID NO: 2570219 - protein, 10 aa, Entamoeba histolytica
NPKEEIEKAE

SEQ ID NO: 2570220 - protein, 7 aa, Entamoeba histolytica
NPKINTN

SEQ ID NO: 2570221 - protein, 10 aa, Entamoeba histolytica
NPKPAPQKHA

SEQ ID NO: 2570222 - protein, 13 aa, Entamoeba histolytica
NPKRISKKEEQKI

SEQ ID NO: 2570223 - protein, 5 aa, Entamoeba histolytica
NPKRK

SEQ ID NO: 2570224 - protein, 13 aa, Entamoeba histolytica
NPKSATLKPGTAI

SEQ ID NO: 2570225 - protein, 8 aa, Entamoeba histolytica
NPKTEMKS

SEQ ID NO: 2570226 - protein, 6 aa, Entamoeba histolytica
NPLFQK

SEQ ID NO: 2570227 - protein, 5 aa, Entamoeba histolytica
NPLPK

SEQ ID NO: 2570228 - protein, 5 aa, Entamoeba histolytica
NPLRK

SEQ ID NO: 2570229 - protein, 7 aa, Entamoeba histolytica
NPLTKEE

SEQ ID NO: 2570230 - protein, 6 aa, Entamoeba histolytica
NPLTSK

SEQ ID NO: 2570231 - protein, 5 aa, Entamoeba histolytica
NPMFT

SEQ ID NO: 2570232 - protein, 5 aa, Entamoeba histolytica
NPMNS

SEQ ID NO: 2570233 - protein, 9 aa, Entamoeba histolytica
NPMRNNPGL

SEQ ID NO: 2570234 - protein, 5 aa, Entamoeba histolytica
NPNDY

SEQ ID NO: 2570235 - protein, 5 aa, Entamoeba histolytica
NPNEA

SEQ ID NO: 2570236 - protein, 6 aa, Entamoeba histolytica
NPNIGS

SEQ ID NO: 2570237 - protein, 8 aa, Entamoeba histolytica
NPNNIKYD

SEQ ID NO: 2570238 - protein, 11 aa, Entamoeba histolytica
NPNNLSEGNEC

SEQ ID NO: 2570239 - protein, 5 aa, Entamoeba histolytica
NPNQF

SEQ ID NO: 2570240 - protein, 7 aa, Entamoeba histolytica
NPNSNEI

SEQ ID NO: 2570241 - protein, 12 aa, Entamoeba histolytica
NPNVSKVKSTTV

SEQ ID NO: 2570242 - protein, 4 aa, Entamoeba histolytica
NPNW

SEQ ID NO: 2570243 - protein, 5 aa, Entamoeba histolytica
NPPNE

SEQ ID NO: 2570244 - protein, 5 aa, Entamoeba histolytica
NPPNH

SEQ ID NO: 2570245 - protein, 12 aa, Entamoeba histolytica
NPPNPSNGTPQM

SEQ ID NO: 2570246 - protein, 6 aa, Entamoeba histolytica
NPPSLP

SEQ ID NO: 2570247 - protein, 7 aa, Entamoeba histolytica
NPPTPDF

SEQ ID NO: 2570248 - protein, 4 aa, Entamoeba histolytica
NPQF

SEQ ID NO: 2570249 - protein, 19 aa, Entamoeba histolytica
NPQGSTYCKEQTSSTSGTL

SEQ ID NO: 2570250 - protein, 6 aa, Entamoeba histolytica
NPQGTL

SEQ ID NO: 2570251 - protein, 18 aa, Entamoeba histolytica
NPQQQEKKQLPVNQKEQI

SEQ ID NO: 2570252 - protein, 9 aa, Entamoeba histolytica
NPQTDLNKT

SEQ ID NO: 2570253 - protein, 5 aa, Entamoeba histolytica
NPRKR

SEQ ID NO: 2570254 - protein, 8 aa, Entamoeba histolytica
NPRNELPR

SEQ ID NO: 2570255 - protein, 8 aa, Entamoeba histolytica
NPSDPLIG

SEQ ID NO: 2570256 - protein, 6 aa, Entamoeba histolytica
NPSEIE

SEQ ID NO: 2570257 - protein, 5 aa, Entamoeba histolytica
NPSEN

SEQ ID NO: 2570258 - protein, 4 aa, Entamoeba histolytica
NPSF

SEQ ID NO: 2570259 - protein, 12 aa, Entamoeba histolytica
NPSFSNKQCSHA

SEQ ID NO: 2570260 - protein, 4 aa, Entamoeba histolytica
NPSK

SEQ ID NO: 2570261 - protein, 5 aa, Entamoeba histolytica
NPSKE

SEQ ID NO: 2570262 - protein, 34 aa, Entamoeba histolytica
NPSKEHERYYDGNEEKEDKSNGVEVEVHNDEDEE

SEQ ID NO: 2570263 - protein, 5 aa, Entamoeba histolytica
NPSKF

SEQ ID NO: 2570264 - protein, 6 aa, Entamoeba histolytica
NPSKWK

SEQ ID NO: 2570265 - protein, 6 aa, Entamoeba histolytica
NPSKYL

SEQ ID NO: 2570266 - protein, 4 aa, Entamoeba histolytica
NPSL

SEQ ID NO: 2570267 - protein, 5 aa, Entamoeba histolytica
NPSNS

SEQ ID NO: 2570268 - protein, 5 aa, Entamoeba histolytica
NPSRL

SEQ ID NO: 2570269 - protein, 8 aa, Entamoeba histolytica
NPSSIQSE

SEQ ID NO: 2570270 - protein, 6 aa, Entamoeba histolytica
NPSSNR

SEQ ID NO: 2570271 - protein, 5 aa, Entamoeba histolytica
NPSYI

SEQ ID NO: 2570272 - protein, 4 aa, Entamoeba histolytica
NPTE

SEQ ID NO: 2570273 - protein, 5 aa, Entamoeba histolytica
NPTGL

SEQ ID NO: 2570274 - protein, 14 aa, Entamoeba histolytica
NPTGSLHKRSDGIY

SEQ ID NO: 2570275 - protein, 17 aa, Entamoeba histolytica
NPTGTLNTQGGQVTITS

SEQ ID NO: 2570276 - protein, 4 aa, Entamoeba histolytica
NPTI

SEQ ID NO: 2570277 - protein, 9 aa, Entamoeba histolytica
NPTIKTPTI

SEQ ID NO: 2570278 - protein, 5 aa, Entamoeba histolytica
NPTIQ

SEQ ID NO: 2570279 - protein, 6 aa, Entamoeba histolytica
NPTKCP

SEQ ID NO: 2570280 - protein, 8 aa, Entamoeba histolytica
NPTKDLQA

SEQ ID NO: 2570281 - protein, 14 aa, Entamoeba histolytica
NPTKGERGVEPQYE

SEQ ID NO: 2570282 - protein, 5 aa, Entamoeba histolytica
NPTKK

SEQ ID NO: 2570283 - protein, 6 aa, Entamoeba histolytica
NPTNEL

SEQ ID NO: 2570284 - protein, 6 aa, Entamoeba histolytica
NPTNQK

SEQ ID NO: 2570285 - protein, 8 aa, Entamoeba histolytica
NPTNVDTL

SEQ ID NO: 2570286 - protein, 6 aa, Entamoeba histolytica
NPTPSM

SEQ ID NO: 2570287 - protein, 5 aa, Entamoeba histolytica
NPTQF

SEQ ID NO: 2570288 - protein, 14 aa, Entamoeba histolytica
NPTQIKNDAKYTKH

SEQ ID NO: 2570289 - protein, 17 aa, Entamoeba histolytica
NPTQLINPKTKDIKYPY

SEQ ID NO: 2570290 - protein, 4 aa, Entamoeba histolytica
NPTS

SEQ ID NO: 2570291 - protein, 14 aa, Entamoeba histolytica
NPTSASVPPPSNQY

SEQ ID NO: 2570292 - protein, 5 aa, Entamoeba histolytica
NPTSI

SEQ ID NO: 2570293 - protein, 9 aa, Entamoeba histolytica
NPTSTTCSN

SEQ ID NO: 2570294 - protein, 6 aa, Entamoeba histolytica
NPTTNE

SEQ ID NO: 2570295 - protein, 4 aa, Entamoeba histolytica
NPTV

SEQ ID NO: 2570296 - protein, 4 aa, Entamoeba histolytica
NPVG

SEQ ID NO: 2570297 - protein, 8 aa, Entamoeba histolytica
NPVQTYPS

SEQ ID NO: 2570298 - protein, 81 aa, Entamoeba histolytica
NPVTSTTVSPKQEKPAVVQPTQSEITQQAKDGTTQQTQDATAQQTHDHQGEQHNEQQPTPERQPHPYNEHQPIPEQNQHPF

SEQ ID NO: 2570299 - protein, 95 aa, Entamoeba histolytica
NPVTSTTVSPKQEKPAVVQPTQSEITQQAKDGTTQQTQDATAQQTHDHQGEQHNEQQPTPERQPHPYNEHQPIPERQPHPYNEHQPIPEQNQHPF

SEQ ID NO: 2570300 - protein, 98 aa, Entamoeba histolytica
NPVTSTTVSPKQEKPAVVQQTQNGDAQPAHDGTAQNAKETTVVQPTQNGAAQSTKDGDAQQTHDHQGEQHNEHQPIPERQPHPYNEHQPIPEQNQHPF

SEQ ID NO: 2570301 - protein, 12 aa, Entamoeba histolytica
NPYAPDNDGQSP

SEQ ID NO: 2570302 - protein, 6 aa, Entamoeba histolytica
NPYDGY

SEQ ID NO: 2570303 - protein, 11 aa, Entamoeba histolytica
NPYDKDEGSRF

SEQ ID NO: 2570304 - protein, 21 aa, Entamoeba histolytica
NPYQTTPQMQQQSMYSSQKYY

SEQ ID NO: 2570305 - protein, 6 aa, Entamoeba histolytica
NPYSDP

SEQ ID NO: 2570306 - protein, 7 aa, Entamoeba histolytica
NPYYTPR

SEQ ID NO: 2570307 - protein, 8 aa, Entamoeba histolytica
NQCSGSSL

SEQ ID NO: 2570308 - protein, 25 aa, Entamoeba histolytica
NQCSQCSATKCERCSDGTPLQKDGT

SEQ ID NO: 2570309 - protein, 12 aa, Entamoeba histolytica
NQEEDDDNKSSF

SEQ ID NO: 2570310 - protein, 7 aa, Entamoeba histolytica
NQEIKGN

SEQ ID NO: 2570311 - protein, 6 aa, Entamoeba histolytica
NQEKKK

SEQ ID NO: 2570312 - protein, 31 aa, Entamoeba histolytica
NQEMGKKQQEKFDNDEDLEEDVVPDQTEVDK

SEQ ID NO: 2570313 - protein, 5 aa, Entamoeba histolytica
NQENG

SEQ ID NO: 2570314 - protein, 10 aa, Entamoeba histolytica
NQEQITKQKD

SEQ ID NO: 2570315 - protein, 8 aa, Entamoeba histolytica
NQEREYEK

SEQ ID NO: 2570316 - protein, 4 aa, Entamoeba histolytica
NQEY

SEQ ID NO: 2570317 - protein, 9 aa, Entamoeba histolytica
NQGIDDSDL

SEQ ID NO: 2570318 - protein, 8 aa, Entamoeba histolytica
NQGKHSVD

SEQ ID NO: 2570319 - protein, 4 aa, Entamoeba histolytica
NQGM

SEQ ID NO: 2570320 - protein, 7 aa, Entamoeba histolytica
NQGTTIK

SEQ ID NO: 2570321 - protein, 9 aa, Entamoeba histolytica
NQHQQGERE

SEQ ID NO: 2570322 - protein, 14 aa, Entamoeba histolytica
NQIDERETEQKSKQ

SEQ ID NO: 2570323 - protein, 4 aa, Entamoeba histolytica
NQIE

SEQ ID NO: 2570324 - protein, 7 aa, Entamoeba histolytica
NQIPPSA

SEQ ID NO: 2570325 - protein, 9 aa, Entamoeba histolytica
NQIQSRNQD

SEQ ID NO: 2570326 - protein, 6 aa, Entamoeba histolytica
NQKNKK

SEQ ID NO: 2570327 - protein, 9 aa, Entamoeba histolytica
NQKREKDVD

SEQ ID NO: 2570328 - protein, 32 aa, Entamoeba histolytica
NQKRQIKKNKNNKKIKKEDIKKELDKKKKQLV

SEQ ID NO: 2570329 - protein, 4 aa, Entamoeba histolytica
NQKS

SEQ ID NO: 2570330 - protein, 5 aa, Entamoeba histolytica
NQLDS

SEQ ID NO: 2570331 - protein, 8 aa, Entamoeba histolytica
NQLKSNSS

SEQ ID NO: 2570332 - protein, 7 aa, Entamoeba histolytica
NQLNESY

SEQ ID NO: 2570333 - protein, 4 aa, Entamoeba histolytica
NQMQ

SEQ ID NO: 2570334 - protein, 9 aa, Entamoeba histolytica
NQNDNNDEI

SEQ ID NO: 2570335 - protein, 10 aa, Entamoeba histolytica
NQNIGGGQCS

SEQ ID NO: 2570336 - protein, 4 aa, Entamoeba histolytica
NQNM

SEQ ID NO: 2570337 - protein, 5 aa, Entamoeba histolytica
NQNNS

SEQ ID NO: 2570338 - protein, 8 aa, Entamoeba histolytica
NQNPKERI

SEQ ID NO: 2570339 - protein, 7 aa, Entamoeba histolytica
NQNPPIC

SEQ ID NO: 2570340 - protein, 7 aa, Entamoeba histolytica
NQNSDKS

SEQ ID NO: 2570341 - protein, 7 aa, Entamoeba histolytica
NQNTEFK

SEQ ID NO: 2570342 - protein, 13 aa, Entamoeba histolytica
NQNVEEYKNQNNE

SEQ ID NO: 2570343 - protein, 33 aa, Entamoeba histolytica
NQPDESENQDRDEENNEDSDDVKEVKSHGEEMA

SEQ ID NO: 2570344 - protein, 6 aa, Entamoeba histolytica
NQPEGD

SEQ ID NO: 2570345 - protein, 6 aa, Entamoeba histolytica
NQPKTC

SEQ ID NO: 2570346 - protein, 6 aa, Entamoeba histolytica
NQPNEL

SEQ ID NO: 2570347 - protein, 14 aa, Entamoeba histolytica
NQPPPGMTESYQQP

SEQ ID NO: 2570348 - protein, 7 aa, Entamoeba histolytica
NQPSTSI

SEQ ID NO: 2570349 - protein, 4 aa, Entamoeba histolytica
NQPT

SEQ ID NO: 2570350 - protein, 8 aa, Entamoeba histolytica
NQPTSTEA

SEQ ID NO: 2570351 - protein, 14 aa, Entamoeba histolytica
NQPVDSRAKPQRSF

SEQ ID NO: 2570352 - protein, 21 aa, Entamoeba histolytica
NQPVSPFNGLSPNYGGYQSSP

SEQ ID NO: 2570353 - protein, 8 aa, Entamoeba histolytica
NQQDKINR

SEQ ID NO: 2570354 - protein, 5 aa, Entamoeba histolytica
NQQEF

SEQ ID NO: 2570355 - protein, 28 aa, Entamoeba histolytica
NQQHPESQNQNNTTNQQTQQNAQQQDNT

SEQ ID NO: 2570356 - protein, 4 aa, Entamoeba histolytica
NQQI

SEQ ID NO: 2570357 - protein, 15 aa, Entamoeba histolytica
NQQLPASTQPLAQQQ

SEQ ID NO: 2570358 - protein, 19 aa, Entamoeba histolytica
NQQPTPSLPQQPLTPSNDT

SEQ ID NO: 2570359 - protein, 4 aa, Entamoeba histolytica
NQQQ

SEQ ID NO: 2570360 - protein, 5 aa, Entamoeba histolytica
NQQQF

SEQ ID NO: 2570361 - protein, 16 aa, Entamoeba histolytica
NQQQQAKYREKEENSL

SEQ ID NO: 2570362 - protein, 6 aa, Entamoeba histolytica
NQRGND

SEQ ID NO: 2570363 - protein, 6 aa, Entamoeba histolytica
NQRINK

SEQ ID NO: 2570364 - protein, 7 aa, Entamoeba histolytica
NQRKPTD

SEQ ID NO: 2570365 - protein, 4 aa, Entamoeba histolytica
NQRL

SEQ ID NO: 2570366 - protein, 6 aa, Entamoeba histolytica
NQRSQS

SEQ ID NO: 2570367 - protein, 17 aa, Entamoeba histolytica
NQRSSQMTKNGSGRKQY

SEQ ID NO: 2570368 - protein, 8 aa, Entamoeba histolytica
NQRTITTT

SEQ ID NO: 2570369 - protein, 14 aa, Entamoeba histolytica
NQSIENKKPFNKNS

SEQ ID NO: 2570370 - protein, 6 aa, Entamoeba histolytica
NQSNQN

SEQ ID NO: 2570371 - protein, 26 aa, Entamoeba histolytica
NQSSSNSSTSPVPERQTTTNNLTTSS

SEQ ID NO: 2570372 - protein, 11 aa, Entamoeba histolytica
NQTCTKCNSID

SEQ ID NO: 2570373 - protein, 9 aa, Entamoeba histolytica
NQTFNGNNN

SEQ ID NO: 2570374 - protein, 6 aa, Entamoeba histolytica
NQTGEN

SEQ ID NO: 2570375 - protein, 4 aa, Entamoeba histolytica
NQTI

SEQ ID NO: 2570376 - protein, 10 aa, Entamoeba histolytica
NQTLKSASIN

SEQ ID NO: 2570377 - protein, 9 aa, Entamoeba histolytica
NQTNDENQI

SEQ ID NO: 2570378 - protein, 10 aa, Entamoeba histolytica
NQTSNEKTKS

SEQ ID NO: 2570379 - protein, 7 aa, Entamoeba histolytica
NQTSSHG

SEQ ID NO: 2570380 - protein, 4 aa, Entamoeba histolytica
NQTT

SEQ ID NO: 2570381 - protein, 7 aa, Entamoeba histolytica
NQTTSLN

SEQ ID NO: 2570382 - protein, 15 aa, Entamoeba histolytica
NQTYSVDSAEELKEE

SEQ ID NO: 2570383 - protein, 5 aa, Entamoeba histolytica
NQTYT

SEQ ID NO: 2570384 - protein, 24 aa, Entamoeba histolytica
NQVGDSKSYGQSQSDKESVVAQPT

SEQ ID NO: 2570385 - protein, 8 aa, Entamoeba histolytica
NQVKESSF

SEQ ID NO: 2570386 - protein, 6 aa, Entamoeba histolytica
NQVKQN

SEQ ID NO: 2570387 - protein, 12 aa, Entamoeba histolytica
NQVSSSSQQLNE

SEQ ID NO: 2570388 - protein, 10 aa, Entamoeba histolytica
NQYDNTTQQI

SEQ ID NO: 2570389 - protein, 4 aa, Entamoeba histolytica
NQYN

SEQ ID NO: 2570390 - protein, 20 aa, Entamoeba histolytica
NQYPTYREATTTGIAPNYKG

SEQ ID NO: 2570391 - protein, 5 aa, Entamoeba histolytica
NRADV

SEQ ID NO: 2570392 - protein, 5 aa, Entamoeba histolytica
NRATF

SEQ ID NO: 2570393 - protein, 6 aa, Entamoeba histolytica
NRCNKC

SEQ ID NO: 2570394 - protein, 7 aa, Entamoeba histolytica
NRDGNGR

SEQ ID NO: 2570395 - protein, 10 aa, Entamoeba histolytica
NRDKSTDYQT

SEQ ID NO: 2570396 - protein, 8 aa, Entamoeba histolytica
NRDTSAVS

SEQ ID NO: 2570397 - protein, 4 aa, Entamoeba histolytica
NRET

SEQ ID NO: 2570398 - protein, 13 aa, Entamoeba histolytica
NRGITCPDSTPLL

SEQ ID NO: 2570399 - protein, 5 aa, Entamoeba histolytica
NRGKG

SEQ ID NO: 2570400 - protein, 4 aa, Entamoeba histolytica
NRGS

SEQ ID NO: 2570401 - protein, 23 aa, Entamoeba histolytica
NRINEQLKDEYSKEYNKKLQEMR

SEQ ID NO: 2570402 - protein, 8 aa, Entamoeba histolytica
NRIPTTTG

SEQ ID NO: 2570403 - protein, 5 aa, Entamoeba histolytica
NRISN

SEQ ID NO: 2570404 - protein, 18 aa, Entamoeba histolytica
NRKDSLNEITPKINQPSK

SEQ ID NO: 2570405 - protein, 19 aa, Entamoeba histolytica
NRKDSLNEITPKINQPSKI

SEQ ID NO: 2570406 - protein, 4 aa, Entamoeba histolytica
NRKI

SEQ ID NO: 2570407 - protein, 8 aa, Entamoeba histolytica
NRKRRDDE

SEQ ID NO: 2570408 - protein, 8 aa, Entamoeba histolytica
NRKSENNY

SEQ ID NO: 2570409 - protein, 7 aa, Entamoeba histolytica
NRKTKEE

SEQ ID NO: 2570410 - protein, 4 aa, Entamoeba histolytica
NRLS

SEQ ID NO: 2570411 - protein, 7 aa, Entamoeba histolytica
NRMSEFP

SEQ ID NO: 2570412 - protein, 16 aa, Entamoeba histolytica
NRNENKQIDKDKQKIQ

SEQ ID NO: 2570413 - protein, 16 aa, Entamoeba histolytica
NRNEPVSGIAKDPDRM

SEQ ID NO: 2570414 - protein, 93 aa, Entamoeba histolytica
NRNNPTNIIPRDKQKETNELNKNNQESSGKGTSKNYSNNQNRNNKYNNEQSNSNTKNNEKYNTQLSNNHYKTQDQKNKNDNNKKEMDPNNNPV

SEQ ID NO: 2570415 - protein, 13 aa, Entamoeba histolytica
NRPEETKNSFTED

SEQ ID NO: 2570416 - protein, 6 aa, Entamoeba histolytica
NRPITN

SEQ ID NO: 2570417 - protein, 7 aa, Entamoeba histolytica
NRPLSPD

SEQ ID NO: 2570418 - protein, 7 aa, Entamoeba histolytica
NRPNKER

SEQ ID NO: 2570419 - protein, 6 aa, Entamoeba histolytica
NRPPEK

SEQ ID NO: 2570420 - protein, 6 aa, Entamoeba histolytica
NRPSGV

SEQ ID NO: 2570421 - protein, 18 aa, Entamoeba histolytica
NRQKSLSSNTSTSSSLGV

SEQ ID NO: 2570422 - protein, 8 aa, Entamoeba histolytica
NRQNKQNI

SEQ ID NO: 2570423 - protein, 7 aa, Entamoeba histolytica
NRRKELK

SEQ ID NO: 2570424 - protein, 9 aa, Entamoeba histolytica
NRSAGDDFS

SEQ ID NO: 2570425 - protein, 14 aa, Entamoeba histolytica
NRSEEFKQSPLPKP

SEQ ID NO: 2570426 - protein, 6 aa, Entamoeba histolytica
NRSHSN

SEQ ID NO: 2570427 - protein, 4 aa, Entamoeba histolytica
NRSI

SEQ ID NO: 2570428 - protein, 5 aa, Entamoeba histolytica
NRSIT

SEQ ID NO: 2570429 - protein, 11 aa, Entamoeba histolytica
NRSSKRPSFNE

SEQ ID NO: 2570430 - protein, 13 aa, Entamoeba histolytica
NRSSSSEDISPTV

SEQ ID NO: 2570431 - protein, 18 aa, Entamoeba histolytica
NRTIESTENEELKNEYGS

SEQ ID NO: 2570432 - protein, 16 aa, Entamoeba histolytica
NRTNAGSCKDRSRYCS

SEQ ID NO: 2570433 - protein, 8 aa, Entamoeba histolytica
NRTNDTTG

SEQ ID NO: 2570434 - protein, 4 aa, Entamoeba histolytica
NRTP

SEQ ID NO: 2570435 - protein, 9 aa, Entamoeba histolytica
NRTSRNREG

SEQ ID NO: 2570436 - protein, 5 aa, Entamoeba histolytica
NRTTI

SEQ ID NO: 2570437 - protein, 5 aa, Entamoeba histolytica
NRVKE

SEQ ID NO: 2570438 - protein, 5 aa, Entamoeba histolytica
NRYGL

SEQ ID NO: 2570439 - protein, 4 aa, Entamoeba histolytica
NRYP

SEQ ID NO: 2570440 - protein, 4 aa, Entamoeba histolytica
NSAF

SEQ ID NO: 2570441 - protein, 9 aa, Entamoeba histolytica
NSAGIEDTG

SEQ ID NO: 2570442 - protein, 7 aa, Entamoeba histolytica
NSAHCNG

SEQ ID NO: 2570443 - protein, 7 aa, Entamoeba histolytica
NSAPTKC

SEQ ID NO: 2570444 - protein, 8 aa, Entamoeba histolytica
NSASGIEE

SEQ ID NO: 2570445 - protein, 7 aa, Entamoeba histolytica
NSATISD

SEQ ID NO: 2570446 - protein, 24 aa, Entamoeba histolytica
NSCDSTKCTSCKPGYKQIPSQDAA

SEQ ID NO: 2570447 - protein, 9 aa, Entamoeba histolytica
NSCGNCGNC

SEQ ID NO: 2570448 - protein, 7 aa, Entamoeba histolytica
NSDDGYD

SEQ ID NO: 2570449 - protein, 16 aa, Entamoeba histolytica
NSDDSSDIHNNLDGTS

SEQ ID NO: 2570450 - protein, 4 aa, Entamoeba histolytica
NSDE

SEQ ID NO: 2570451 - protein, 8 aa, Entamoeba histolytica
NSDEKIQS

SEQ ID NO: 2570452 - protein, 9 aa, Entamoeba histolytica
NSDENNGEL

SEQ ID NO: 2570453 - protein, 8 aa, Entamoeba histolytica
NSDGECSK

SEQ ID NO: 2570454 - protein, 5 aa, Entamoeba histolytica
NSDGS

SEQ ID NO: 2570455 - protein, 6 aa, Entamoeba histolytica
NSDGST

SEQ ID NO: 2570456 - protein, 7 aa, Entamoeba histolytica
NSDHDAY

SEQ ID NO: 2570457 - protein, 9 aa, Entamoeba histolytica
NSDKGAKVN

SEQ ID NO: 2570458 - protein, 8 aa, Entamoeba histolytica
NSDQKAFT

SEQ ID NO: 2570459 - protein, 6 aa, Entamoeba histolytica
NSDRKR

SEQ ID NO: 2570460 - protein, 6 aa, Entamoeba histolytica
NSDVRV

SEQ ID NO: 2570461 - protein, 6 aa, Entamoeba histolytica
NSDYPS

SEQ ID NO: 2570462 - protein, 10 aa, Entamoeba histolytica
NSEEGKKIRN

SEQ ID NO: 2570463 - protein, 13 aa, Entamoeba histolytica
NSEKEQHQNGVKE

SEQ ID NO: 2570464 - protein, 9 aa, Entamoeba histolytica
NSELGKYGK

SEQ ID NO: 2570465 - protein, 5 aa, Entamoeba histolytica
NSEPF

SEQ ID NO: 2570466 - protein, 7 aa, Entamoeba histolytica
NSESQMS

SEQ ID NO: 2570467 - protein, 8 aa, Entamoeba histolytica
NSETKDTG

SEQ ID NO: 2570468 - protein, 12 aa, Entamoeba histolytica
NSETNTLEIDGN

SEQ ID NO: 2570469 - protein, 9 aa, Entamoeba histolytica
NSEVYKSID

SEQ ID NO: 2570470 - protein, 9 aa, Entamoeba histolytica
NSFAQSGDI

SEQ ID NO: 2570471 - protein, 4 aa, Entamoeba histolytica
NSFE

SEQ ID NO: 2570472 - protein, 26 aa, Entamoeba histolytica
NSFKETLNKSYQHYGDPHIGGSDEIA

SEQ ID NO: 2570473 - protein, 13 aa, Entamoeba histolytica
NSFTDNQQNEFKK

SEQ ID NO: 2570474 - protein, 7 aa, Entamoeba histolytica
NSFTPQT

SEQ ID NO: 2570475 - protein, 8 aa, Entamoeba histolytica
NSGNYPAS

SEQ ID NO: 2570476 - protein, 19 aa, Entamoeba histolytica
NSGPEPQQAAAPVAEKPKT

SEQ ID NO: 2570477 - protein, 9 aa, Entamoeba histolytica
NSGTKTENY

SEQ ID NO: 2570478 - protein, 6 aa, Entamoeba histolytica
NSHEQT

SEQ ID NO: 2570479 - protein, 7 aa, Entamoeba histolytica
NSHNNEP

SEQ ID NO: 2570480 - protein, 10 aa, Entamoeba histolytica
NSHSPRNKKT

SEQ ID NO: 2570481 - protein, 9 aa, Entamoeba histolytica
NSHTNTKNL

SEQ ID NO: 2570482 - protein, 8 aa, Entamoeba histolytica
NSIDDTPT

SEQ ID NO: 2570483 - protein, 4 aa, Entamoeba histolytica
NSIE

SEQ ID NO: 2570484 - protein, 11 aa, Entamoeba histolytica
NSIEGHNKGII

SEQ ID NO: 2570485 - protein, 8 aa, Entamoeba histolytica
NSIEGRRY

SEQ ID NO: 2570486 - protein, 7 aa, Entamoeba histolytica
NSIEPQM

SEQ ID NO: 2570487 - protein, 8 aa, Entamoeba histolytica
NSINPSVN

SEQ ID NO: 2570488 - protein, 16 aa, Entamoeba histolytica
NSIQSSPATAAYEQSG

SEQ ID NO: 2570489 - protein, 6 aa, Entamoeba histolytica
NSISHN

SEQ ID NO: 2570490 - protein, 27 aa, Entamoeba histolytica
NSITETTKLRANDYGYEPCGNDEGRSY

SEQ ID NO: 2570491 - protein, 5 aa, Entamoeba histolytica
NSKDD

SEQ ID NO: 2570492 - protein, 8 aa, Entamoeba histolytica
NSKDKRAS

SEQ ID NO: 2570493 - protein, 11 aa, Entamoeba histolytica
NSKDLSEGNEC

SEQ ID NO: 2570494 - protein, 13 aa, Entamoeba histolytica
NSKEDDEKQNEIT

SEQ ID NO: 2570495 - protein, 4 aa, Entamoeba histolytica
NSKG

SEQ ID NO: 2570496 - protein, 7 aa, Entamoeba histolytica
NSKKEKM

SEQ ID NO: 2570497 - protein, 6 aa, Entamoeba histolytica
NSKKEV

SEQ ID NO: 2570498 - protein, 8 aa, Entamoeba histolytica
NSKKTTSV

SEQ ID NO: 2570499 - protein, 4 aa, Entamoeba histolytica
NSKN

SEQ ID NO: 2570500 - protein, 10 aa, Entamoeba histolytica
NSKNCKDESY

SEQ ID NO: 2570501 - protein, 10 aa, Entamoeba histolytica
NSKNESRSEM

SEQ ID NO: 2570502 - protein, 5 aa, Entamoeba histolytica
NSKNK

SEQ ID NO: 2570503 - protein, 8 aa, Entamoeba histolytica
NSKPEEIG

SEQ ID NO: 2570504 - protein, 6 aa, Entamoeba histolytica
NSKRIY

SEQ ID NO: 2570505 - protein, 9 aa, Entamoeba histolytica
NSKSVKSGK

SEQ ID NO: 2570506 - protein, 10 aa, Entamoeba histolytica
NSKTSFDKQW

SEQ ID NO: 2570507 - protein, 6 aa, Entamoeba histolytica
NSKTTC

SEQ ID NO: 2570508 - protein, 5 aa, Entamoeba histolytica
NSKTY

SEQ ID NO: 2570509 - protein, 10 aa, Entamoeba histolytica
NSKTYYSSNQ

SEQ ID NO: 2570510 - protein, 4 aa, Entamoeba histolytica
NSKV

SEQ ID NO: 2570511 - protein, 7 aa, Entamoeba histolytica
NSKVPIN

SEQ ID NO: 2570512 - protein, 4 aa, Entamoeba histolytica
NSLD

SEQ ID NO: 2570513 - protein, 11 aa, Entamoeba histolytica
NSLDEQHDFER

SEQ ID NO: 2570514 - protein, 13 aa, Entamoeba histolytica
NSLDNSTSLQPKE

SEQ ID NO: 2570515 - protein, 6 aa, Entamoeba histolytica
NSLLRS

SEQ ID NO: 2570516 - protein, 10 aa, Entamoeba histolytica
NSLNEEEEMK

SEQ ID NO: 2570517 - protein, 7 aa, Entamoeba histolytica
NSLNNGR

SEQ ID NO: 2570518 - protein, 8 aa, Entamoeba histolytica
NSLNQNQT

SEQ ID NO: 2570519 - protein, 5 aa, Entamoeba histolytica
NSLQQ

SEQ ID NO: 2570520 - protein, 9 aa, Entamoeba histolytica
NSLSENTIK

SEQ ID NO: 2570521 - protein, 5 aa, Entamoeba histolytica
NSLTL

SEQ ID NO: 2570522 - protein, 6 aa, Entamoeba histolytica
NSMSEK

SEQ ID NO: 2570523 - protein, 6 aa, Entamoeba histolytica
NSNDFA

SEQ ID NO: 2570524 - protein, 7 aa, Entamoeba histolytica
NSNDPNI

SEQ ID NO: 2570525 - protein, 13 aa, Entamoeba histolytica
NSNDSYQKEPQKL

SEQ ID NO: 2570526 - protein, 4 aa, Entamoeba histolytica
NSNE

SEQ ID NO: 2570527 - protein, 7 aa, Entamoeba histolytica
NSNEDNI

SEQ ID NO: 2570528 - protein, 6 aa, Entamoeba histolytica
NSNEEY

SEQ ID NO: 2570529 - protein, 6 aa, Entamoeba histolytica
NSNEKQ

SEQ ID NO: 2570530 - protein, 7 aa, Entamoeba histolytica
NSNGGNY

SEQ ID NO: 2570531 - protein, 4 aa, Entamoeba histolytica
NSNI

SEQ ID NO: 2570532 - protein, 8 aa, Entamoeba histolytica
NSNIQNNT

SEQ ID NO: 2570533 - protein, 8 aa, Entamoeba histolytica
NSNKDNSL

SEQ ID NO: 2570534 - protein, 7 aa, Entamoeba histolytica
NSNKNEL

SEQ ID NO: 2570535 - protein, 9 aa, Entamoeba histolytica
NSNKTYQNP

SEQ ID NO: 2570536 - protein, 8 aa, Entamoeba histolytica
NSNNATPV

SEQ ID NO: 2570537 - protein, 5 aa, Entamoeba histolytica
NSNNK

SEQ ID NO: 2570538 - protein, 7 aa, Entamoeba histolytica
NSNNNIS

SEQ ID NO: 2570539 - protein, 7 aa, Entamoeba histolytica
NSNNPEN

SEQ ID NO: 2570540 - protein, 19 aa, Entamoeba histolytica
NSNNPILPEEANDLDGVYT

SEQ ID NO: 2570541 - protein, 6 aa, Entamoeba histolytica
NSNNPK

SEQ ID NO: 2570542 - protein, 8 aa, Entamoeba histolytica
NSNPPPSF

SEQ ID NO: 2570543 - protein, 12 aa, Entamoeba histolytica
NSNRINTNSPLD

SEQ ID NO: 2570544 - protein, 7 aa, Entamoeba histolytica
NSNRRER

SEQ ID NO: 2570545 - protein, 10 aa, Entamoeba histolytica
NSNRTASEIE

SEQ ID NO: 2570546 - protein, 9 aa, Entamoeba histolytica
NSNSFDQNP

SEQ ID NO: 2570547 - protein, 6 aa, Entamoeba histolytica
NSNSIS

SEQ ID NO: 2570548 - protein, 5 aa, Entamoeba histolytica
NSNSQ

SEQ ID NO: 2570549 - protein, 5 aa, Entamoeba histolytica
NSNSY

SEQ ID NO: 2570550 - protein, 8 aa, Entamoeba histolytica
NSNSYETQ

SEQ ID NO: 2570551 - protein, 11 aa, Entamoeba histolytica
NSNYRKEFQDE

SEQ ID NO: 2570552 - protein, 8 aa, Entamoeba histolytica
NSNYSYSA

SEQ ID NO: 2570553 - protein, 20 aa, Entamoeba histolytica
NSPGQSHSISVDDDVSGNSL

SEQ ID NO: 2570554 - protein, 7 aa, Entamoeba histolytica
NSPIPKI

SEQ ID NO: 2570555 - protein, 5 aa, Entamoeba histolytica
NSPKG

SEQ ID NO: 2570556 - protein, 7 aa, Entamoeba histolytica
NSPKVPN

SEQ ID NO: 2570557 - protein, 9 aa, Entamoeba histolytica
NSPLPNEKV

SEQ ID NO: 2570558 - protein, 7 aa, Entamoeba histolytica
NSPNNNG

SEQ ID NO: 2570559 - protein, 6 aa, Entamoeba histolytica
NSPNPS

SEQ ID NO: 2570560 - protein, 7 aa, Entamoeba histolytica
NSPNPVE

SEQ ID NO: 2570561 - protein, 14 aa, Entamoeba histolytica
NSPRNVVKTETPEC

SEQ ID NO: 2570562 - protein, 8 aa, Entamoeba histolytica
NSPSENPV

SEQ ID NO: 2570563 - protein, 6 aa, Entamoeba histolytica
NSPSIS

SEQ ID NO: 2570564 - protein, 7 aa, Entamoeba histolytica
NSPSLPS

SEQ ID NO: 2570565 - protein, 6 aa, Entamoeba histolytica
NSPTFT

SEQ ID NO: 2570566 - protein, 6 aa, Entamoeba histolytica
NSQCSQ

SEQ ID NO: 2570567 - protein, 16 aa, Entamoeba histolytica
NSQENNQDGCEEQQAT

SEQ ID NO: 2570568 - protein, 18 aa, Entamoeba histolytica
NSQEVTQEEFENEGECGD

SEQ ID NO: 2570569 - protein, 4 aa, Entamoeba histolytica
NSQF

SEQ ID NO: 2570570 - protein, 5 aa, Entamoeba histolytica
NSQGY

SEQ ID NO: 2570571 - protein, 7 aa, Entamoeba histolytica
NSQIGNR

SEQ ID NO: 2570572 - protein, 5 aa, Entamoeba histolytica
NSQKG

SEQ ID NO: 2570573 - protein, 4 aa, Entamoeba histolytica
NSQL

SEQ ID NO: 2570574 - protein, 10 aa, Entamoeba histolytica
NSQNDDPNQD

SEQ ID NO: 2570575 - protein, 7 aa, Entamoeba histolytica
NSQPELY

SEQ ID NO: 2570576 - protein, 9 aa, Entamoeba histolytica
NSQPPTVTI

SEQ ID NO: 2570577 - protein, 50 aa, Entamoeba histolytica
NSQQQEKQPTNDNTESQQQETQPANERTESQQLEPQVNNDNTESQQQEIQ

SEQ ID NO: 2570578 - protein, 6 aa, Entamoeba histolytica
NSQQVQ

SEQ ID NO: 2570579 - protein, 4 aa, Entamoeba histolytica
NSQR

SEQ ID NO: 2570580 - protein, 9 aa, Entamoeba histolytica
NSQRSIGPI

SEQ ID NO: 2570581 - protein, 8 aa, Entamoeba histolytica
NSQTNEPD

SEQ ID NO: 2570582 - protein, 12 aa, Entamoeba histolytica
NSQVTSSTGLQL

SEQ ID NO: 2570583 - protein, 5 aa, Entamoeba histolytica
NSQYK

SEQ ID NO: 2570584 - protein, 8 aa, Entamoeba histolytica
NSQYSQNK

SEQ ID NO: 2570585 - protein, 4 aa, Entamoeba histolytica
NSRF

SEQ ID NO: 2570586 - protein, 8 aa, Entamoeba histolytica
NSRIPADG

SEQ ID NO: 2570587 - protein, 5 aa, Entamoeba histolytica
NSSCA

SEQ ID NO: 2570588 - protein, 15 aa, Entamoeba histolytica
NSSCGTTNGRSIQQP

SEQ ID NO: 2570589 - protein, 6 aa, Entamoeba histolytica
NSSCPN

SEQ ID NO: 2570590 - protein, 6 aa, Entamoeba histolytica
NSSDSL

SEQ ID NO: 2570591 - protein, 10 aa, Entamoeba histolytica
NSSDVSNSQY

SEQ ID NO: 2570592 - protein, 5 aa, Entamoeba histolytica
NSSEC

SEQ ID NO: 2570593 - protein, 7 aa, Entamoeba histolytica
NSSESYP

SEQ ID NO: 2570594 - protein, 6 aa, Entamoeba histolytica
NSSGCI

SEQ ID NO: 2570595 - protein, 5 aa, Entamoeba histolytica
NSSGI

SEQ ID NO: 2570596 - protein, 6 aa, Entamoeba histolytica
NSSGIE

SEQ ID NO: 2570597 - protein, 7 aa, Entamoeba histolytica
NSSIKEH

SEQ ID NO: 2570598 - protein, 10 aa, Entamoeba histolytica
NSSKISPEAP

SEQ ID NO: 2570599 - protein, 10 aa, Entamoeba histolytica
NSSKPADGIY

SEQ ID NO: 2570600 - protein, 8 aa, Entamoeba histolytica
NSSKPSSF

SEQ ID NO: 2570601 - protein, 10 aa, Entamoeba histolytica
NSSKRNQNNF

SEQ ID NO: 2570602 - protein, 5 aa, Entamoeba histolytica
NSSKT

SEQ ID NO: 2570603 - protein, 8 aa, Entamoeba histolytica
NSSNATII

SEQ ID NO: 2570604 - protein, 10 aa, Entamoeba histolytica
NSSNETNTFK

SEQ ID NO: 2570605 - protein, 6 aa, Entamoeba histolytica
NSSNIA

SEQ ID NO: 2570606 - protein, 11 aa, Entamoeba histolytica
NSSNSRCSECS

SEQ ID NO: 2570607 - protein, 5 aa, Entamoeba histolytica
NSSPN

SEQ ID NO: 2570608 - protein, 6 aa, Entamoeba histolytica
NSSPNW

SEQ ID NO: 2570609 - protein, 14 aa, Entamoeba histolytica
NSSPSTSLVEENGQ

SEQ ID NO: 2570610 - protein, 14 aa, Entamoeba histolytica
NSSPSTTLISENGE

SEQ ID NO: 2570611 - protein, 55 aa, Entamoeba histolytica
NSSQNSDISDDPRNKSDTTSSHSTDKGHGITKNNSVISNESGQSKSKKNKEDRLK

SEQ ID NO: 2570612 - protein, 8 aa, Entamoeba histolytica
NSSSDEVI

SEQ ID NO: 2570613 - protein, 10 aa, Entamoeba histolytica
NSSSSCSGVR

SEQ ID NO: 2570614 - protein, 19 aa, Entamoeba histolytica
NSSTKVNEKGETEMIGDPT

SEQ ID NO: 2570615 - protein, 5 aa, Entamoeba histolytica
NSSYD

SEQ ID NO: 2570616 - protein, 8 aa, Entamoeba histolytica
NSSYEEIK

SEQ ID NO: 2570617 - protein, 24 aa, Entamoeba histolytica
NSTCEETDDSETSGKSQSNTTKSY

SEQ ID NO: 2570618 - protein, 5 aa, Entamoeba histolytica
NSTDK

SEQ ID NO: 2570619 - protein, 7 aa, Entamoeba histolytica
NSTDYSY

SEQ ID NO: 2570620 - protein, 16 aa, Entamoeba histolytica
NSTGTASCEGNNNDIN

SEQ ID NO: 2570621 - protein, 7 aa, Entamoeba histolytica
NSTHYVS

SEQ ID NO: 2570622 - protein, 9 aa, Entamoeba histolytica
NSTKTLKIR

SEQ ID NO: 2570623 - protein, 17 aa, Entamoeba histolytica
NSTLSSSPHYSNTPSIQ

SEQ ID NO: 2570624 - protein, 7 aa, Entamoeba histolytica
NSTNNCN

SEQ ID NO: 2570625 - protein, 6 aa, Entamoeba histolytica
NSTNSN

SEQ ID NO: 2570626 - protein, 17 aa, Entamoeba histolytica
NSTPSELQDTKSSSEIQ

SEQ ID NO: 2570627 - protein, 7 aa, Entamoeba histolytica
NSTQSQK

SEQ ID NO: 2570628 - protein, 7 aa, Entamoeba histolytica
NSTSGGE

SEQ ID NO: 2570629 - protein, 9 aa, Entamoeba histolytica
NSTSKSSLG

SEQ ID NO: 2570630 - protein, 9 aa, Entamoeba histolytica
NSTSREQSS

SEQ ID NO: 2570631 - protein, 4 aa, Entamoeba histolytica
NSTT

SEQ ID NO: 2570632 - protein, 6 aa, Entamoeba histolytica
NSTTIE

SEQ ID NO: 2570633 - protein, 8 aa, Entamoeba histolytica
NSTTITGN

SEQ ID NO: 2570634 - protein, 7 aa, Entamoeba histolytica
NSTTNAP

SEQ ID NO: 2570635 - protein, 29 aa, Entamoeba histolytica
NSTTTNDPRGAPRPQGHYTQPPPAPQPNP

SEQ ID NO: 2570636 - protein, 8 aa, Entamoeba histolytica
NSTVFTPN

SEQ ID NO: 2570637 - protein, 10 aa, Entamoeba histolytica
NSVENNSSIK

SEQ ID NO: 2570638 - protein, 7 aa, Entamoeba histolytica
NSVSSLS

SEQ ID NO: 2570639 - protein, 5 aa, Entamoeba histolytica
NSVST

SEQ ID NO: 2570640 - protein, 7 aa, Entamoeba histolytica
NSYHPKT

SEQ ID NO: 2570641 - protein, 4 aa, Entamoeba histolytica
NSYN

SEQ ID NO: 2570642 - protein, 13 aa, Entamoeba histolytica
NSYQSQTESQTDI

SEQ ID NO: 2570643 - protein, 6 aa, Entamoeba histolytica
NSYQTE

SEQ ID NO: 2570644 - protein, 14 aa, Entamoeba histolytica
NSYTNSLSSSEDDL

SEQ ID NO: 2570645 - protein, 10 aa, Entamoeba histolytica
NTAAIAAGTT

SEQ ID NO: 2570646 - protein, 13 aa, Entamoeba histolytica
NTAKRTSTGQYNI

SEQ ID NO: 2570647 - protein, 4 aa, Entamoeba histolytica
NTAL

SEQ ID NO: 2570648 - protein, 18 aa, Entamoeba histolytica
NTAPECENSTEFNVDEQG

SEQ ID NO: 2570649 - protein, 6 aa, Entamoeba histolytica
NTATLG

SEQ ID NO: 2570650 - protein, 9 aa, Entamoeba histolytica
NTCKTGNND

SEQ ID NO: 2570651 - protein, 11 aa, Entamoeba histolytica
NTDAFSGDDNI

SEQ ID NO: 2570652 - protein, 7 aa, Entamoeba histolytica
NTDEIEK

SEQ ID NO: 2570653 - protein, 14 aa, Entamoeba histolytica
NTDGHNRQRPAPRT

SEQ ID NO: 2570654 - protein, 6 aa, Entamoeba histolytica
NTDGSG

SEQ ID NO: 2570655 - protein, 6 aa, Entamoeba histolytica
NTDHPK

SEQ ID NO: 2570656 - protein, 4 aa, Entamoeba histolytica
NTDI

SEQ ID NO: 2570657 - protein, 14 aa, Entamoeba histolytica
NTDIGNKESKSDTP

SEQ ID NO: 2570658 - protein, 5 aa, Entamoeba histolytica
NTDIN

SEQ ID NO: 2570659 - protein, 5 aa, Entamoeba histolytica
NTDKM

SEQ ID NO: 2570660 - protein, 15 aa, Entamoeba histolytica
NTDNTTVGIEPGSSI

SEQ ID NO: 2570661 - protein, 9 aa, Entamoeba histolytica
NTDYEKEAT

SEQ ID NO: 2570662 - protein, 5 aa, Entamoeba histolytica
NTEDA

SEQ ID NO: 2570663 - protein, 6 aa, Entamoeba histolytica
NTEEGS

SEQ ID NO: 2570664 - protein, 7 aa, Entamoeba histolytica
NTEGLQE

SEQ ID NO: 2570665 - protein, 9 aa, Entamoeba histolytica
NTEKFDSKQ

SEQ ID NO: 2570666 - protein, 11 aa, Entamoeba histolytica
NTEKSLNTDFT

SEQ ID NO: 2570667 - protein, 5 aa, Entamoeba histolytica
NTELN

SEQ ID NO: 2570668 - protein, 8 aa, Entamoeba histolytica
NTENAGSQ

SEQ ID NO: 2570669 - protein, 6 aa, Entamoeba histolytica
NTENNN

SEQ ID NO: 2570670 - protein, 17 aa, Entamoeba histolytica
NTENNSFEESNEKKGQI

SEQ ID NO: 2570671 - protein, 6 aa, Entamoeba histolytica
NTESSV

SEQ ID NO: 2570672 - protein, 6 aa, Entamoeba histolytica
NTETDE

SEQ ID NO: 2570673 - protein, 21 aa, Entamoeba histolytica
NTFDETKQEISKNTKNYQPEV

SEQ ID NO: 2570674 - protein, 7 aa, Entamoeba histolytica
NTFDQND

SEQ ID NO: 2570675 - protein, 7 aa, Entamoeba histolytica
NTFQGEK

SEQ ID NO: 2570676 - protein, 12 aa, Entamoeba histolytica
NTFSGLKSPHAR

SEQ ID NO: 2570677 - protein, 10 aa, Entamoeba histolytica
NTGDGKSSLG

SEQ ID NO: 2570678 - protein, 6 aa, Entamoeba histolytica
NTGGFD

SEQ ID NO: 2570679 - protein, 16 aa, Entamoeba histolytica
NTGSIVAGGDDDTFKE

SEQ ID NO: 2570680 - protein, 4 aa, Entamoeba histolytica
NTGT

SEQ ID NO: 2570681 - protein, 7 aa, Entamoeba histolytica
NTHKKDR

SEQ ID NO: 2570682 - protein, 6 aa, Entamoeba histolytica
NTIEGT

SEQ ID NO: 2570683 - protein, 12 aa, Entamoeba histolytica
NTIESYNTDPNL

SEQ ID NO: 2570684 - protein, 5 aa, Entamoeba histolytica
NTIID

SEQ ID NO: 2570685 - protein, 24 aa, Entamoeba histolytica
NTINRNSKKIQTTLRPGSSCPNAR

SEQ ID NO: 2570686 - protein, 6 aa, Entamoeba histolytica
NTIPQS

SEQ ID NO: 2570687 - protein, 6 aa, Entamoeba histolytica
NTIPSG

SEQ ID NO: 2570688 - protein, 6 aa, Entamoeba histolytica
NTISSF

SEQ ID NO: 2570689 - protein, 9 aa, Entamoeba histolytica
NTITTPSHQ

SEQ ID NO: 2570690 - protein, 12 aa, Entamoeba histolytica
NTKCQSTPTFNG

SEQ ID NO: 2570691 - protein, 7 aa, Entamoeba histolytica
NTKDIGS

SEQ ID NO: 2570692 - protein, 5 aa, Entamoeba histolytica
NTKDP

SEQ ID NO: 2570693 - protein, 10 aa, Entamoeba histolytica
NTKDRAKDNL

SEQ ID NO: 2570694 - protein, 13 aa, Entamoeba histolytica
NTKIRKSSANLEK

SEQ ID NO: 2570695 - protein, 25 aa, Entamoeba histolytica
NTKKSSTKTGGSSHSTEQDIDSKKI

SEQ ID NO: 2570696 - protein, 8 aa, Entamoeba histolytica
NTKMKEIN

SEQ ID NO: 2570697 - protein, 9 aa, Entamoeba histolytica
NTKNHPTNA

SEQ ID NO: 2570698 - protein, 6 aa, Entamoeba histolytica
NTKNKN

SEQ ID NO: 2570699 - protein, 4 aa, Entamoeba histolytica
NTKT

SEQ ID NO: 2570700 - protein, 9 aa, Entamoeba histolytica
NTKVTNVKE

SEQ ID NO: 2570701 - protein, 10 aa, Entamoeba histolytica
NTLAGDSTKL

SEQ ID NO: 2570702 - protein, 17 aa, Entamoeba histolytica
NTLGSTVHSGETPLNGK

SEQ ID NO: 2570703 - protein, 19 aa, Entamoeba histolytica
NTLKEDELKEDTNNNFEPV

SEQ ID NO: 2570704 - protein, 12 aa, Entamoeba histolytica
NTLKTGRRTHTS

SEQ ID NO: 2570705 - protein, 7 aa, Entamoeba histolytica
NTLKYSD

SEQ ID NO: 2570706 - protein, 6 aa, Entamoeba histolytica
NTLSIG

SEQ ID NO: 2570707 - protein, 8 aa, Entamoeba histolytica
NTLTQSSQ

SEQ ID NO: 2570708 - protein, 7 aa, Entamoeba histolytica
NTLTTGE

SEQ ID NO: 2570709 - protein, 11 aa, Entamoeba histolytica
NTLVKSNKKQS

SEQ ID NO: 2570710 - protein, 9 aa, Entamoeba histolytica
NTLVTTKTS

SEQ ID NO: 2570711 - protein, 4 aa, Entamoeba histolytica
NTMP

SEQ ID NO: 2570712 - protein, 6 aa, Entamoeba histolytica
NTMPSS

SEQ ID NO: 2570713 - protein, 9 aa, Entamoeba histolytica
NTNETTGQQ

SEQ ID NO: 2570714 - protein, 4 aa, Entamoeba histolytica
NTNG

SEQ ID NO: 2570715 - protein, 5 aa, Entamoeba histolytica
NTNHE

SEQ ID NO: 2570716 - protein, 7 aa, Entamoeba histolytica
NTNKQDL

SEQ ID NO: 2570717 - protein, 8 aa, Entamoeba histolytica
NTNKREGC

SEQ ID NO: 2570718 - protein, 12 aa, Entamoeba histolytica
NTNKSIKDEEQV

SEQ ID NO: 2570719 - protein, 8 aa, Entamoeba histolytica
NTNLPEAL

SEQ ID NO: 2570720 - protein, 7 aa, Entamoeba histolytica
NTNNNEM

SEQ ID NO: 2570721 - protein, 8 aa, Entamoeba histolytica
NTNNPVAN

SEQ ID NO: 2570722 - protein, 5 aa, Entamoeba histolytica
NTNPT

SEQ ID NO: 2570723 - protein, 5 aa, Entamoeba histolytica
NTNSH

SEQ ID NO: 2570724 - protein, 7 aa, Entamoeba histolytica
NTNSITT

SEQ ID NO: 2570725 - protein, 7 aa, Entamoeba histolytica
NTPEGSR

SEQ ID NO: 2570726 - protein, 65 aa, Entamoeba histolytica
NTPIEPSEQSSEHSSSSQPQPIEPSEESSEKPIEPSEGSSSHSSSVGPSSGNSSDSESNDGINDK

SEQ ID NO: 2570727 - protein, 4 aa, Entamoeba histolytica
NTPP

SEQ ID NO: 2570728 - protein, 10 aa, Entamoeba histolytica
NTPTEGQQEI

SEQ ID NO: 2570729 - protein, 7 aa, Entamoeba histolytica
NTPTNAR

SEQ ID NO: 2570730 - protein, 8 aa, Entamoeba histolytica
NTPTSEDS

SEQ ID NO: 2570731 - protein, 10 aa, Entamoeba histolytica
NTQDGTNGSQ

SEQ ID NO: 2570732 - protein, 4 aa, Entamoeba histolytica
NTQI

SEQ ID NO: 2570733 - protein, 11 aa, Entamoeba histolytica
NTQKDKDGKYV

SEQ ID NO: 2570734 - protein, 4 aa, Entamoeba histolytica
NTQP

SEQ ID NO: 2570735 - protein, 7 aa, Entamoeba histolytica
NTQQGQN

SEQ ID NO: 2570736 - protein, 12 aa, Entamoeba histolytica
NTQQREDGWLLF

SEQ ID NO: 2570737 - protein, 6 aa, Entamoeba histolytica
NTQQYN

SEQ ID NO: 2570738 - protein, 6 aa, Entamoeba histolytica
NTQTEM

SEQ ID NO: 2570739 - protein, 8 aa, Entamoeba histolytica
NTRECSGD

SEQ ID NO: 2570740 - protein, 6 aa, Entamoeba histolytica
NTRNSS

SEQ ID NO: 2570741 - protein, 6 aa, Entamoeba histolytica
NTRPTI

SEQ ID NO: 2570742 - protein, 6 aa, Entamoeba histolytica
NTRREP

SEQ ID NO: 2570743 - protein, 10 aa, Entamoeba histolytica
NTSDVSNSQY

SEQ ID NO: 2570744 - protein, 5 aa, Entamoeba histolytica
NTSES

SEQ ID NO: 2570745 - protein, 7 aa, Entamoeba histolytica
NTSGQLT

SEQ ID NO: 2570746 - protein, 6 aa, Entamoeba histolytica
NTSKET

SEQ ID NO: 2570747 - protein, 7 aa, Entamoeba histolytica
NTSKLTG

SEQ ID NO: 2570748 - protein, 9 aa, Entamoeba histolytica
NTSKSEEVK

SEQ ID NO: 2570749 - protein, 7 aa, Entamoeba histolytica
NTSLSYP

SEQ ID NO: 2570750 - protein, 9 aa, Entamoeba histolytica
NTSNDLNKN

SEQ ID NO: 2570751 - protein, 6 aa, Entamoeba histolytica
NTSNKS

SEQ ID NO: 2570752 - protein, 6 aa, Entamoeba histolytica
NTSRTM

SEQ ID NO: 2570753 - protein, 20 aa, Entamoeba histolytica
NTSSLSLGDESHIDNSSYEI

SEQ ID NO: 2570754 - protein, 8 aa, Entamoeba histolytica
NTSSVSQV

SEQ ID NO: 2570755 - protein, 6 aa, Entamoeba histolytica
NTSTYI

SEQ ID NO: 2570756 - protein, 11 aa, Entamoeba histolytica
NTSVPPNPQFT

SEQ ID NO: 2570757 - protein, 7 aa, Entamoeba histolytica
NTTDTQS

SEQ ID NO: 2570758 - protein, 14 aa, Entamoeba histolytica
NTTESDNDNDNSNL

SEQ ID NO: 2570759 - protein, 8 aa, Entamoeba histolytica
NTTEYENA

SEQ ID NO: 2570760 - protein, 7 aa, Entamoeba histolytica
NTTITSE

SEQ ID NO: 2570761 - protein, 4 aa, Entamoeba histolytica
NTTK

SEQ ID NO: 2570762 - protein, 8 aa, Entamoeba histolytica
NTTKSSPI

SEQ ID NO: 2570763 - protein, 6 aa, Entamoeba histolytica
NTTLRE

SEQ ID NO: 2570764 - protein, 6 aa, Entamoeba histolytica
NTTNND

SEQ ID NO: 2570765 - protein, 12 aa, Entamoeba histolytica
NTTNVNQFSKQK

SEQ ID NO: 2570766 - protein, 18 aa, Entamoeba histolytica
NTTQSKPNLSNDKSKLRR

SEQ ID NO: 2570767 - protein, 9 aa, Entamoeba histolytica
NTTSNCQKA

SEQ ID NO: 2570768 - protein, 26 aa, Entamoeba histolytica
NTTSRPRPPLPKRNISKSPLSTTASV

SEQ ID NO: 2570769 - protein, 7 aa, Entamoeba histolytica
NTTTDSI

SEQ ID NO: 2570770 - protein, 12 aa, Entamoeba histolytica
NTTTKGRYEKEH

SEQ ID NO: 2570771 - protein, 8 aa, Entamoeba histolytica
NTTTNTCD

SEQ ID NO: 2570772 - protein, 18 aa, Entamoeba histolytica
NTTTPAQSTPAQPVQQQQ

SEQ ID NO: 2570773 - protein, 5 aa, Entamoeba histolytica
NTTTY

SEQ ID NO: 2570774 - protein, 5 aa, Entamoeba histolytica
NTTWD

SEQ ID NO: 2570775 - protein, 6 aa, Entamoeba histolytica
NTVSIP

SEQ ID NO: 2570776 - protein, 4 aa, Entamoeba histolytica
NTVT

SEQ ID NO: 2570777 - protein, 10 aa, Entamoeba histolytica
NTWSNEGADE

SEQ ID NO: 2570778 - protein, 4 aa, Entamoeba histolytica
NTYD

SEQ ID NO: 2570779 - protein, 5 aa, Entamoeba histolytica
NTYEI

SEQ ID NO: 2570780 - protein, 4 aa, Entamoeba histolytica
NTYK

SEQ ID NO: 2570781 - protein, 7 aa, Entamoeba histolytica
NTYTNYN

SEQ ID NO: 2570782 - protein, 16 aa, Entamoeba histolytica
NVADQNKFRQIIDALN

SEQ ID NO: 2570783 - protein, 9 aa, Entamoeba histolytica
NVAQEIGGK

SEQ ID NO: 2570784 - protein, 10 aa, Entamoeba histolytica
NVDDPKLKAA

SEQ ID NO: 2570785 - protein, 16 aa, Entamoeba histolytica
NVDETEANNNENPNSS

SEQ ID NO: 2570786 - protein, 17 aa, Entamoeba histolytica
NVDGRQARRTKNATPLG

SEQ ID NO: 2570787 - protein, 20 aa, Entamoeba histolytica
NVDQQENKSIYSENNESNTS

SEQ ID NO: 2570788 - protein, 5 aa, Entamoeba histolytica
NVEEP

SEQ ID NO: 2570789 - protein, 6 aa, Entamoeba histolytica
NVEIKG

SEQ ID NO: 2570790 - protein, 5 aa, Entamoeba histolytica
NVEST

SEQ ID NO: 2570791 - protein, 9 aa, Entamoeba histolytica
NVGNEKTRS

SEQ ID NO: 2570792 - protein, 7 aa, Entamoeba histolytica
NVGTPTY

SEQ ID NO: 2570793 - protein, 12 aa, Entamoeba histolytica
NVISKKGENEYL

SEQ ID NO: 2570794 - protein, 5 aa, Entamoeba histolytica
NVKDE

SEQ ID NO: 2570795 - protein, 5 aa, Entamoeba histolytica
NVKER

SEQ ID NO: 2570796 - protein, 7 aa, Entamoeba histolytica
NVKTKNS

SEQ ID NO: 2570797 - protein, 7 aa, Entamoeba histolytica
NVNGKSN

SEQ ID NO: 2570798 - protein, 8 aa, Entamoeba histolytica
NVNGQAQA

SEQ ID NO: 2570799 - protein, 9 aa, Entamoeba histolytica
NVNPKECNP

SEQ ID NO: 2570800 - protein, 10 aa, Entamoeba histolytica
NVNRGSPLTK

SEQ ID NO: 2570801 - protein, 6 aa, Entamoeba histolytica
NVNSNS

SEQ ID NO: 2570802 - protein, 7 aa, Entamoeba histolytica
NVPGNRV

SEQ ID NO: 2570803 - protein, 9 aa, Entamoeba histolytica
NVPKGLPTK

SEQ ID NO: 2570804 - protein, 4 aa, Entamoeba histolytica
NVQN

SEQ ID NO: 2570805 - protein, 26 aa, Entamoeba histolytica
NVQNPQQSPLVQPESSFYARSENGYN

SEQ ID NO: 2570806 - protein, 6 aa, Entamoeba histolytica
NVQQCN

SEQ ID NO: 2570807 - protein, 17 aa, Entamoeba histolytica
NVQQSTVKVTTKDGDIV

SEQ ID NO: 2570808 - protein, 20 aa, Entamoeba histolytica
NVSCGEGDSTCVGYSDRGCG

SEQ ID NO: 2570809 - protein, 7 aa, Entamoeba histolytica
NVSDEIK

SEQ ID NO: 2570810 - protein, 5 aa, Entamoeba histolytica
NVSDV

SEQ ID NO: 2570811 - protein, 6 aa, Entamoeba histolytica
NVSGRS

SEQ ID NO: 2570812 - protein, 6 aa, Entamoeba histolytica
NVSSNF

SEQ ID NO: 2570813 - protein, 7 aa, Entamoeba histolytica
NVSSSET

SEQ ID NO: 2570814 - protein, 8 aa, Entamoeba histolytica
NVSSSSIN

SEQ ID NO: 2570815 - protein, 10 aa, Entamoeba histolytica
NVTEEEKEFN

SEQ ID NO: 2570816 - protein, 4 aa, Entamoeba histolytica
NVTN

SEQ ID NO: 2570817 - protein, 40 aa, Entamoeba histolytica
NVTNLEGCETNSQDPSSSKPSCCSKSKNKLSESEKKLEEQ

SEQ ID NO: 2570818 - protein, 6 aa, Entamoeba histolytica
NVTQPS

SEQ ID NO: 2570819 - protein, 7 aa, Entamoeba histolytica
NVTSTMK

SEQ ID NO: 2570820 - protein, 6 aa, Entamoeba histolytica
NWANET

SEQ ID NO: 2570821 - protein, 7 aa, Entamoeba histolytica
NWERTDE

SEQ ID NO: 2570822 - protein, 16 aa, Entamoeba histolytica
NWERTDEALVPHPRFG

SEQ ID NO: 2570823 - protein, 4 aa, Entamoeba histolytica
NWIP

SEQ ID NO: 2570824 - protein, 10 aa, Entamoeba histolytica
NWKKNGDESP

SEQ ID NO: 2570825 - protein, 14 aa, Entamoeba histolytica
NWNPQHSGDFTTSD

SEQ ID NO: 2570826 - protein, 11 aa, Entamoeba histolytica
NWSKDIQPKHN

SEQ ID NO: 2570827 - protein, 4 aa, Entamoeba histolytica
NYCY

SEQ ID NO: 2570828 - protein, 17 aa, Entamoeba histolytica
NYDPNGGRVTLDGKDIR

SEQ ID NO: 2570829 - protein, 7 aa, Entamoeba histolytica
NYDQIDT

SEQ ID NO: 2570830 - protein, 6 aa, Entamoeba histolytica
NYDSND

SEQ ID NO: 2570831 - protein, 9 aa, Entamoeba histolytica
NYEDPTKGG

SEQ ID NO: 2570832 - protein, 8 aa, Entamoeba histolytica
NYEKEKDN

SEQ ID NO: 2570833 - protein, 4 aa, Entamoeba histolytica
NYEN

SEQ ID NO: 2570834 - protein, 6 aa, Entamoeba histolytica
NYEQKR

SEQ ID NO: 2570835 - protein, 11 aa, Entamoeba histolytica
NYESYKESERE

SEQ ID NO: 2570836 - protein, 9 aa, Entamoeba histolytica
NYGEGSSLP

SEQ ID NO: 2570837 - protein, 4 aa, Entamoeba histolytica
NYGK

SEQ ID NO: 2570838 - protein, 29 aa, Entamoeba histolytica
NYGMKSSTTPPINGKSPKLQENGSIITPD

SEQ ID NO: 2570839 - protein, 4 aa, Entamoeba histolytica
NYKM

SEQ ID NO: 2570840 - protein, 8 aa, Entamoeba histolytica
NYKPTKLG

SEQ ID NO: 2570841 - protein, 5 aa, Entamoeba histolytica
NYLTS

SEQ ID NO: 2570842 - protein, 24 aa, Entamoeba histolytica
NYNDQRASWSYQNPEPVIGESHDD

SEQ ID NO: 2570843 - protein, 7 aa, Entamoeba histolytica
NYNENIP

SEQ ID NO: 2570844 - protein, 5 aa, Entamoeba histolytica
NYNQY

SEQ ID NO: 2570845 - protein, 15 aa, Entamoeba histolytica
NYPGATGRNARGSHS

SEQ ID NO: 2570846 - protein, 8 aa, Entamoeba histolytica
NYPGQFSA

SEQ ID NO: 2570847 - protein, 13 aa, Entamoeba histolytica
NYPKDKMEGDVPQ

SEQ ID NO: 2570848 - protein, 10 aa, Entamoeba histolytica
NYPKGNNDEY

SEQ ID NO: 2570849 - protein, 13 aa, Entamoeba histolytica
NYPSSRKGNWLNF

SEQ ID NO: 2570850 - protein, 6 aa, Entamoeba histolytica
NYPSTI

SEQ ID NO: 2570851 - protein, 4 aa, Entamoeba histolytica
NYQG

SEQ ID NO: 2570852 - protein, 9 aa, Entamoeba histolytica
NYQKPKKNI

SEQ ID NO: 2570853 - protein, 22 aa, Entamoeba histolytica
NYQNGTIKNETLKKTTTNGASS

SEQ ID NO: 2570854 - protein, 4 aa, Entamoeba histolytica
NYQQ

SEQ ID NO: 2570855 - protein, 5 aa, Entamoeba histolytica
NYQQD

SEQ ID NO: 2570856 - protein, 11 aa, Entamoeba histolytica
NYQVNGDTLSS

SEQ ID NO: 2570857 - protein, 4 aa, Entamoeba histolytica
NYRC

SEQ ID NO: 2570858 - protein, 22 aa, Entamoeba histolytica
NYSEITDQDDKTVSDQNALQRS

SEQ ID NO: 2570859 - protein, 4 aa, Entamoeba histolytica
NYSN

SEQ ID NO: 2570860 - protein, 6 aa, Entamoeba histolytica
NYSPNR

SEQ ID NO: 2570861 - protein, 5 aa, Entamoeba histolytica
NYSPS

SEQ ID NO: 2570862 - protein, 4 aa, Entamoeba histolytica
NYSR

SEQ ID NO: 2570863 - protein, 8 aa, Entamoeba histolytica
NYTADSDG

SEQ ID NO: 2570864 - protein, 6 aa, Entamoeba histolytica
NYTEKY

SEQ ID NO: 2570865 - protein, 8 aa, Entamoeba histolytica
NYTGKNQK

SEQ ID NO: 2570866 - protein, 27 aa, Entamoeba histolytica
NYTNSFGPKIKSTGFKKVTTPGASGGY

SEQ ID NO: 2570867 - protein, 6 aa, Entamoeba histolytica
NYTSDG

SEQ ID NO: 2570868 - protein, 9 aa, Entamoeba histolytica
NYTSFGKPQ

SEQ ID NO: 2570869 - protein, 10 aa, Entamoeba histolytica
NYTTDECNTS

SEQ ID NO: 2570870 - protein, 5 aa, Entamoeba histolytica
NYYTS

SEQ ID NO: 2570871 - protein, 13 aa, Entamoeba histolytica
PACENGPLEDSSD

SEQ ID NO: 2570872 - protein, 5 aa, Entamoeba histolytica
PAEEL

SEQ ID NO: 2570873 - protein, 8 aa, Entamoeba histolytica
PAGATGQK

SEQ ID NO: 2570874 - protein, 4 aa, Entamoeba histolytica
PAGD

SEQ ID NO: 2570875 - protein, 13 aa, Entamoeba histolytica
PAGKQPNQNKDQC

SEQ ID NO: 2570876 - protein, 7 aa, Entamoeba histolytica
PAKGDKN

SEQ ID NO: 2570877 - protein, 15 aa, Entamoeba histolytica
PAKPTPKPLTPEEIE

SEQ ID NO: 2570878 - protein, 7 aa, Entamoeba histolytica
PAKRAPF

SEQ ID NO: 2570879 - protein, 4 aa, Entamoeba histolytica
PAKY

SEQ ID NO: 2570880 - protein, 15 aa, Entamoeba histolytica
PANEAQQEEIPEGRF

SEQ ID NO: 2570881 - protein, 10 aa, Entamoeba histolytica
PANGNVKPTI

SEQ ID NO: 2570882 - protein, 12 aa, Entamoeba histolytica
PAPDEISPQTEK

SEQ ID NO: 2570883 - protein, 8 aa, Entamoeba histolytica
PAPHLPPS

SEQ ID NO: 2570884 - protein, 10 aa, Entamoeba histolytica
PAQAAYEKSG

SEQ ID NO: 2570885 - protein, 7 aa, Entamoeba histolytica
PARADQY

SEQ ID NO: 2570886 - protein, 11 aa, Entamoeba histolytica
PASEDKIKQEE

SEQ ID NO: 2570887 - protein, 15 aa, Entamoeba histolytica
PASKPKKFKKESASL

SEQ ID NO: 2570888 - protein, 5 aa, Entamoeba histolytica
PATEE

SEQ ID NO: 2570889 - protein, 20 aa, Entamoeba histolytica
PATVNTTTLNTTVGSSSSAL

SEQ ID NO: 2570890 - protein, 5 aa, Entamoeba histolytica
PAVRA

SEQ ID NO: 2570891 - protein, 7 aa, Entamoeba histolytica
PAYPKEQ

SEQ ID NO: 2570892 - protein, 4 aa, Entamoeba histolytica
PCDS

SEQ ID NO: 2570893 - protein, 7 aa, Entamoeba histolytica
PCHEGKH

SEQ ID NO: 2570894 - protein, 14 aa, Entamoeba histolytica
PCKQWTEESKATHN

SEQ ID NO: 2570895 - protein, 5 aa, Entamoeba histolytica
PCNGN

SEQ ID NO: 2570896 - protein, 10 aa, Entamoeba histolytica
PCRGQEEPIN

SEQ ID NO: 2570897 - protein, 4 aa, Entamoeba histolytica
PCSN

SEQ ID NO: 2570898 - protein, 8 aa, Entamoeba histolytica
PCSPANSH

SEQ ID NO: 2570899 - protein, 11 aa, Entamoeba histolytica
PDACPSNKTFP

SEQ ID NO: 2570900 - protein, 4 aa, Entamoeba histolytica
PDAL

SEQ ID NO: 2570901 - protein, 43 aa, Entamoeba histolytica
PDANQQPVPEVNQQPQETEQQPVPEVNQAPQPETVQPTSEVQQ

SEQ ID NO: 2570902 - protein, 14 aa, Entamoeba histolytica
PDDCPNESNSSKYK

SEQ ID NO: 2570903 - protein, 9 aa, Entamoeba histolytica
PDDDEQMEE

SEQ ID NO: 2570904 - protein, 4 aa, Entamoeba histolytica
PDDL

SEQ ID NO: 2570905 - protein, 22 aa, Entamoeba histolytica
PDDQEVNLTKETKETAKALEQP

SEQ ID NO: 2570906 - protein, 13 aa, Entamoeba histolytica
PDDSSCSNKDNTV

SEQ ID NO: 2570907 - protein, 7 aa, Entamoeba histolytica
PDDVPNC

SEQ ID NO: 2570908 - protein, 17 aa, Entamoeba histolytica
PDEKTLTKNVGEVNPRS

SEQ ID NO: 2570909 - protein, 4 aa, Entamoeba histolytica
PDFS

SEQ ID NO: 2570910 - protein, 7 aa, Entamoeba histolytica
PDGETAF

SEQ ID NO: 2570911 - protein, 4 aa, Entamoeba histolytica
PDGP

SEQ ID NO: 2570912 - protein, 5 aa, Entamoeba histolytica
PDGSL

SEQ ID NO: 2570913 - protein, 10 aa, Entamoeba histolytica
PDGTHKNVRG

SEQ ID NO: 2570914 - protein, 5 aa, Entamoeba histolytica
PDGTL

SEQ ID NO: 2570915 - protein, 15 aa, Entamoeba histolytica
PDIKTGSASTSDSIK

SEQ ID NO: 2570916 - protein, 7 aa, Entamoeba histolytica
PDIPQNN

SEQ ID NO: 2570917 - protein, 8 aa, Entamoeba histolytica
PDKDPAPM

SEQ ID NO: 2570918 - protein, 4 aa, Entamoeba histolytica
PDLA

SEQ ID NO: 2570919 - protein, 8 aa, Entamoeba histolytica
PDLNDSLE

SEQ ID NO: 2570920 - protein, 9 aa, Entamoeba histolytica
PDLSKKHNT

SEQ ID NO: 2570921 - protein, 4 aa, Entamoeba histolytica
PDNI

SEQ ID NO: 2570922 - protein, 5 aa, Entamoeba histolytica
PDNPK

SEQ ID NO: 2570923 - protein, 7 aa, Entamoeba histolytica
PDNYSNP

SEQ ID NO: 2570924 - protein, 10 aa, Entamoeba histolytica
PDPPTTTAQR

SEQ ID NO: 2570925 - protein, 13 aa, Entamoeba histolytica
PDPSGRPSTVNTS

SEQ ID NO: 2570926 - protein, 8 aa, Entamoeba histolytica
PDPTKGID

SEQ ID NO: 2570927 - protein, 8 aa, Entamoeba histolytica
PDPTTIPE

SEQ ID NO: 2570928 - protein, 9 aa, Entamoeba histolytica
PDQEEEIGM

SEQ ID NO: 2570929 - protein, 6 aa, Entamoeba histolytica
PDQESI

SEQ ID NO: 2570930 - protein, 6 aa, Entamoeba histolytica
PDRDPV

SEQ ID NO: 2570931 - protein, 10 aa, Entamoeba histolytica
PDRDPVASLG

SEQ ID NO: 2570932 - protein, 5 aa, Entamoeba histolytica
PDRTT

SEQ ID NO: 2570933 - protein, 4 aa, Entamoeba histolytica
PDSE

SEQ ID NO: 2570934 - protein, 6 aa, Entamoeba histolytica
PDSISS

SEQ ID NO: 2570935 - protein, 34 aa, Entamoeba histolytica
PDSTDSSDSQSPYHSSNSQHSSSPFITESPRTLS

SEQ ID NO: 2570936 - protein, 9 aa, Entamoeba histolytica
PDSVSTKQE

SEQ ID NO: 2570937 - protein, 9 aa, Entamoeba histolytica
PDTESTCGF

SEQ ID NO: 2570938 - protein, 8 aa, Entamoeba histolytica
PDTLSTDK

SEQ ID NO: 2570939 - protein, 7 aa, Entamoeba histolytica
PDTQYTI

SEQ ID NO: 2570940 - protein, 10 aa, Entamoeba histolytica
PDVEPTTEQL

SEQ ID NO: 2570941 - protein, 4 aa, Entamoeba histolytica
PDYC

SEQ ID NO: 2570942 - protein, 12 aa, Entamoeba histolytica
PDYINRKTPRGR

SEQ ID NO: 2570943 - protein, 5 aa, Entamoeba histolytica
PDYKK

SEQ ID NO: 2570944 - protein, 14 aa, Entamoeba histolytica
PDYPKNRTVLIPFL

SEQ ID NO: 2570945 - protein, 8 aa, Entamoeba histolytica
PDYSSSIT

SEQ ID NO: 2570946 - protein, 7 aa, Entamoeba histolytica
PEAERIE

SEQ ID NO: 2570947 - protein, 13 aa, Entamoeba histolytica
PEAKGCCGGDTEE

SEQ ID NO: 2570948 - protein, 4 aa, Entamoeba histolytica
PEAY

SEQ ID NO: 2570949 - protein, 7 aa, Entamoeba histolytica
PEDACYD

SEQ ID NO: 2570950 - protein, 10 aa, Entamoeba histolytica
PEDAQTGVTK

SEQ ID NO: 2570951 - protein, 5 aa, Entamoeba histolytica
PEDAS

SEQ ID NO: 2570952 - protein, 11 aa, Entamoeba histolytica
PEDLKNPKEII

SEQ ID NO: 2570953 - protein, 10 aa, Entamoeba histolytica
PEDPTITDLS

SEQ ID NO: 2570954 - protein, 11 aa, Entamoeba histolytica
PEDWPKEGKIE

SEQ ID NO: 2570955 - protein, 8 aa, Entamoeba histolytica
PEDYKTSC

SEQ ID NO: 2570956 - protein, 6 aa, Entamoeba histolytica
PEEACQ

SEQ ID NO: 2570957 - protein, 9 aa, Entamoeba histolytica
PEENGSSTL

SEQ ID NO: 2570958 - protein, 6 aa, Entamoeba histolytica
PEEPTA

SEQ ID NO: 2570959 - protein, 10 aa, Entamoeba histolytica
PEETKKLDIE

SEQ ID NO: 2570960 - protein, 6 aa, Entamoeba histolytica
PEEVNG

SEQ ID NO: 2570961 - protein, 7 aa, Entamoeba histolytica
PEEYEIK

SEQ ID NO: 2570962 - protein, 7 aa, Entamoeba histolytica
PEEYEVP

SEQ ID NO: 2570963 - protein, 7 aa, Entamoeba histolytica
PEFDNGI

SEQ ID NO: 2570964 - protein, 6 aa, Entamoeba histolytica
PEFDPN

SEQ ID NO: 2570965 - protein, 6 aa, Entamoeba histolytica
PEFGTR

SEQ ID NO: 2570966 - protein, 6 aa, Entamoeba histolytica
PEGNKG

SEQ ID NO: 2570967 - protein, 10 aa, Entamoeba histolytica
PEGQKTCHSC

SEQ ID NO: 2570968 - protein, 4 aa, Entamoeba histolytica
PEHA

SEQ ID NO: 2570969 - protein, 6 aa, Entamoeba histolytica
PEHRPT

SEQ ID NO: 2570970 - protein, 5 aa, Entamoeba histolytica
PEHSS

SEQ ID NO: 2570971 - protein, 4 aa, Entamoeba histolytica
PEID

SEQ ID NO: 2570972 - protein, 5 aa, Entamoeba histolytica
PEIDE

SEQ ID NO: 2570973 - protein, 4 aa, Entamoeba histolytica
PEIK

SEQ ID NO: 2570974 - protein, 5 aa, Entamoeba histolytica
PEIND

SEQ ID NO: 2570975 - protein, 8 aa, Entamoeba histolytica
PEINDPVE

SEQ ID NO: 2570976 - protein, 7 aa, Entamoeba histolytica
PEINEPI

SEQ ID NO: 2570977 - protein, 17 aa, Entamoeba histolytica
PEINQKNVKTTLLKEGK

SEQ ID NO: 2570978 - protein, 8 aa, Entamoeba histolytica
PEIYPTPT

SEQ ID NO: 2570979 - protein, 15 aa, Entamoeba histolytica
PEKDPIAALGEDGGL

SEQ ID NO: 2570980 - protein, 8 aa, Entamoeba histolytica
PEKEGKTQ

SEQ ID NO: 2570981 - protein, 14 aa, Entamoeba histolytica
PEKYPQANSKLKKH

SEQ ID NO: 2570982 - protein, 4 aa, Entamoeba histolytica
PENI

SEQ ID NO: 2570983 - protein, 14 aa, Entamoeba histolytica
PENIQDNSKSNYYY

SEQ ID NO: 2570984 - protein, 5 aa, Entamoeba histolytica
PENQR

SEQ ID NO: 2570985 - protein, 9 aa, Entamoeba histolytica
PENQRPTLY

SEQ ID NO: 2570986 - protein, 5 aa, Entamoeba histolytica
PENRI

SEQ ID NO: 2570987 - protein, 7 aa, Entamoeba histolytica
PENTKSK

SEQ ID NO: 2570988 - protein, 7 aa, Entamoeba histolytica
PENTYPQ

SEQ ID NO: 2570989 - protein, 4 aa, Entamoeba histolytica
PEPD

SEQ ID NO: 2570990 - protein, 19 aa, Entamoeba histolytica
PEPLPNDNISYGPKRSKGF

SEQ ID NO: 2570991 - protein, 10 aa, Entamoeba histolytica
PEPNELEYPE

SEQ ID NO: 2570992 - protein, 6 aa, Entamoeba histolytica
PEPNKK

SEQ ID NO: 2570993 - protein, 7 aa, Entamoeba histolytica
PEPYYSK

SEQ ID NO: 2570994 - protein, 5 aa, Entamoeba histolytica
PEQAK

SEQ ID NO: 2570995 - protein, 7 aa, Entamoeba histolytica
PEQCTAN

SEQ ID NO: 2570996 - protein, 11 aa, Entamoeba histolytica
PEQDADGTTVT

SEQ ID NO: 2570997 - protein, 7 aa, Entamoeba histolytica
PEQGKPN

SEQ ID NO: 2570998 - protein, 5 aa, Entamoeba histolytica
PEQTI

SEQ ID NO: 2570999 - protein, 6 aa, Entamoeba histolytica
PEQYTG

SEQ ID NO: 2571000 - protein, 6 aa, Entamoeba histolytica
PEQYTI

SEQ ID NO: 2571001 - protein, 4 aa, Entamoeba histolytica
PERI

SEQ ID NO: 2571002 - protein, 22 aa, Entamoeba histolytica
PESDSNKTDESDDAPITDETYR

SEQ ID NO: 2571003 - protein, 4 aa, Entamoeba histolytica
PESI

SEQ ID NO: 2571004 - protein, 5 aa, Entamoeba histolytica
PESIK

SEQ ID NO: 2571005 - protein, 5 aa, Entamoeba histolytica
PESRP

SEQ ID NO: 2571006 - protein, 14 aa, Entamoeba histolytica
PESSCKSFQSSETG

SEQ ID NO: 2571007 - protein, 9 aa, Entamoeba histolytica
PESTSYEQK

SEQ ID NO: 2571008 - protein, 5 aa, Entamoeba histolytica
PESTY

SEQ ID NO: 2571009 - protein, 6 aa, Entamoeba histolytica
PETCNP

SEQ ID NO: 2571010 - protein, 4 aa, Entamoeba histolytica
PETE

SEQ ID NO: 2571011 - protein, 12 aa, Entamoeba histolytica
PETHALDDAPND

SEQ ID NO: 2571012 - protein, 6 aa, Entamoeba histolytica
PETKSN

SEQ ID NO: 2571013 - protein, 9 aa, Entamoeba histolytica
PETRSQTRG

SEQ ID NO: 2571014 - protein, 7 aa, Entamoeba histolytica
PETTTEE

SEQ ID NO: 2571015 - protein, 11 aa, Entamoeba histolytica
PETYHDEYSYA

SEQ ID NO: 2571016 - protein, 14 aa, Entamoeba histolytica
PETYHDEYTNAGDV

SEQ ID NO: 2571017 - protein, 6 aa, Entamoeba histolytica
PEVSGN

SEQ ID NO: 2571018 - protein, 4 aa, Entamoeba histolytica
PFEE

SEQ ID NO: 2571019 - protein, 5 aa, Entamoeba histolytica
PFEMT

SEQ ID NO: 2571020 - protein, 5 aa, Entamoeba histolytica
PFEQE

SEQ ID NO: 2571021 - protein, 11 aa, Entamoeba histolytica
PFESQKADFDN

SEQ ID NO: 2571022 - protein, 4 aa, Entamoeba histolytica
PFGI

SEQ ID NO: 2571023 - protein, 6 aa, Entamoeba histolytica
PFKSGN

SEQ ID NO: 2571024 - protein, 6 aa, Entamoeba histolytica
PFNSSQ

SEQ ID NO: 2571025 - protein, 9 aa, Entamoeba histolytica
PFPEEATEE

SEQ ID NO: 2571026 - protein, 10 aa, Entamoeba histolytica
PFQKTTTKSI

SEQ ID NO: 2571027 - protein, 5 aa, Entamoeba histolytica
PFQSA

SEQ ID NO: 2571028 - protein, 18 aa, Entamoeba histolytica
PFRQKEADMTSGIHEEKK

SEQ ID NO: 2571029 - protein, 4 aa, Entamoeba histolytica
PFSD

SEQ ID NO: 2571030 - protein, 12 aa, Entamoeba histolytica
PFSPSDKLNEST

SEQ ID NO: 2571031 - protein, 5 aa, Entamoeba histolytica
PFSST

SEQ ID NO: 2571032 - protein, 12 aa, Entamoeba histolytica
PFSTPDVSESDV

SEQ ID NO: 2571033 - protein, 4 aa, Entamoeba histolytica
PFTK

SEQ ID NO: 2571034 - protein, 24 aa, Entamoeba histolytica
PGAQPDVVETSSGDSSSNTDGPKV

SEQ ID NO: 2571035 - protein, 5 aa, Entamoeba histolytica
PGCAS

SEQ ID NO: 2571036 - protein, 11 aa, Entamoeba histolytica
PGCNEPAKTRY

SEQ ID NO: 2571037 - protein, 11 aa, Entamoeba histolytica
PGCNEPPKTRY

SEQ ID NO: 2571038 - protein, 4 aa, Entamoeba histolytica
PGDC

SEQ ID NO: 2571039 - protein, 17 aa, Entamoeba histolytica
PGDCGKRGICSTSSGQC

SEQ ID NO: 2571040 - protein, 7 aa, Entamoeba histolytica
PGENEPS

SEQ ID NO: 2571041 - protein, 4 aa, Entamoeba histolytica
PGFG

SEQ ID NO: 2571042 - protein, 7 aa, Entamoeba histolytica
PGFGEDD

SEQ ID NO: 2571043 - protein, 15 aa, Entamoeba histolytica
PGFNDSKGQESQREY

SEQ ID NO: 2571044 - protein, 17 aa, Entamoeba histolytica
PGFNDSNGGINKDRQHM

SEQ ID NO: 2571045 - protein, 12 aa, Entamoeba histolytica
PGFNDTDNFDEG

SEQ ID NO: 2571046 - protein, 11 aa, Entamoeba histolytica
PGFNDTNNFDN

SEQ ID NO: 2571047 - protein, 6 aa, Entamoeba histolytica
PGGENN

SEQ ID NO: 2571048 - protein, 4 aa, Entamoeba histolytica
PGGF

SEQ ID NO: 2571049 - protein, 4 aa, Entamoeba histolytica
PGIR

SEQ ID NO: 2571050 - protein, 16 aa, Entamoeba histolytica
PGKENEGEESSISMSE

SEQ ID NO: 2571051 - protein, 9 aa, Entamoeba histolytica
PGKQSKEVE

SEQ ID NO: 2571052 - protein, 7 aa, Entamoeba histolytica
PGKTFEE

SEQ ID NO: 2571053 - protein, 5 aa, Entamoeba histolytica
PGLAE

SEQ ID NO: 2571054 - protein, 13 aa, Entamoeba histolytica
PGLPSTDIDGKKE

SEQ ID NO: 2571055 - protein, 4 aa, Entamoeba histolytica
PGMK

SEQ ID NO: 2571056 - protein, 12 aa, Entamoeba histolytica
PGMRKNKKIKSQ

SEQ ID NO: 2571057 - protein, 9 aa, Entamoeba histolytica
PGNKKEEKQ

SEQ ID NO: 2571058 - protein, 5 aa, Entamoeba histolytica
PGQPF

SEQ ID NO: 2571059 - protein, 8 aa, Entamoeba histolytica
PGQTNESK

SEQ ID NO: 2571060 - protein, 5 aa, Entamoeba histolytica
PGQVG

SEQ ID NO: 2571061 - protein, 7 aa, Entamoeba histolytica
PGSGIPS

SEQ ID NO: 2571062 - protein, 6 aa, Entamoeba histolytica
PGTGAW

SEQ ID NO: 2571063 - protein, 7 aa, Entamoeba histolytica
PGTGAWG

SEQ ID NO: 2571064 - protein, 6 aa, Entamoeba histolytica
PGTKYN

SEQ ID NO: 2571065 - protein, 10 aa, Entamoeba histolytica
PGTVDYEKKV

SEQ ID NO: 2571066 - protein, 4 aa, Entamoeba histolytica
PGYG

SEQ ID NO: 2571067 - protein, 12 aa, Entamoeba histolytica
PGYGYDSNKKQC

SEQ ID NO: 2571068 - protein, 5 aa, Entamoeba histolytica
PGYSI

SEQ ID NO: 2571069 - protein, 12 aa, Entamoeba histolytica
PGYSINKDKTTC

SEQ ID NO: 2571070 - protein, 5 aa, Entamoeba histolytica
PHASS

SEQ ID NO: 2571071 - protein, 4 aa, Entamoeba histolytica
PHFP

SEQ ID NO: 2571072 - protein, 29 aa, Entamoeba histolytica
PHGKTRDYSKDIPEEDEEITTSSDSEMNE

SEQ ID NO: 2571073 - protein, 4 aa, Entamoeba histolytica
PHGR

SEQ ID NO: 2571074 - protein, 4 aa, Entamoeba histolytica
PHIQ

SEQ ID NO: 2571075 - protein, 8 aa, Entamoeba histolytica
PHKNEPKT

SEQ ID NO: 2571076 - protein, 6 aa, Entamoeba histolytica
PHLNSN

SEQ ID NO: 2571077 - protein, 7 aa, Entamoeba histolytica
PHPKRNT

SEQ ID NO: 2571078 - protein, 13 aa, Entamoeba histolytica
PHQPKIPPTGKSL

SEQ ID NO: 2571079 - protein, 9 aa, Entamoeba histolytica
PHQSISDKN

SEQ ID NO: 2571080 - protein, 13 aa, Entamoeba histolytica
PHQYTQNDNVSGD

SEQ ID NO: 2571081 - protein, 5 aa, Entamoeba histolytica
PHSNT

SEQ ID NO: 2571082 - protein, 7 aa, Entamoeba histolytica
PIDEGLN

SEQ ID NO: 2571083 - protein, 4 aa, Entamoeba histolytica
PIDP

SEQ ID NO: 2571084 - protein, 27 aa, Entamoeba histolytica
PIEEPKKKKSSSSSSSSSDEKEKRQFE

SEQ ID NO: 2571085 - protein, 5 aa, Entamoeba histolytica
PIEGN

SEQ ID NO: 2571086 - protein, 5 aa, Entamoeba histolytica
PIEPE

SEQ ID NO: 2571087 - protein, 6 aa, Entamoeba histolytica
PIEQET

SEQ ID NO: 2571088 - protein, 7 aa, Entamoeba histolytica
PIEQRRK

SEQ ID NO: 2571089 - protein, 6 aa, Entamoeba histolytica
PIERPK

SEQ ID NO: 2571090 - protein, 4 aa, Entamoeba histolytica
PIES

SEQ ID NO: 2571091 - protein, 7 aa, Entamoeba histolytica
PIESPEQ

SEQ ID NO: 2571092 - protein, 21 aa, Entamoeba histolytica
PIEYQSKKNSKRVTSVNEGDI

SEQ ID NO: 2571093 - protein, 6 aa, Entamoeba histolytica
PIGEGA

SEQ ID NO: 2571094 - protein, 7 aa, Entamoeba histolytica
PIGEGKS

SEQ ID NO: 2571095 - protein, 9 aa, Entamoeba histolytica
PIGETGIST

SEQ ID NO: 2571096 - protein, 4 aa, Entamoeba histolytica
PIGG

SEQ ID NO: 2571097 - protein, 7 aa, Entamoeba histolytica
PIGPSSA

SEQ ID NO: 2571098 - protein, 4 aa, Entamoeba histolytica
PIGY

SEQ ID NO: 2571099 - protein, 11 aa, Entamoeba histolytica
PIHTPTPRKKH

SEQ ID NO: 2571100 - protein, 7 aa, Entamoeba histolytica
PIKGGSI

SEQ ID NO: 2571101 - protein, 11 aa, Entamoeba histolytica
PIKREPKDFEE

SEQ ID NO: 2571102 - protein, 7 aa, Entamoeba histolytica
PILPNTN

SEQ ID NO: 2571103 - protein, 5 aa, Entamoeba histolytica
PILPT

SEQ ID NO: 2571104 - protein, 4 aa, Entamoeba histolytica
PIMG

SEQ ID NO: 2571105 - protein, 7 aa, Entamoeba histolytica
PINKMST

SEQ ID NO: 2571106 - protein, 12 aa, Entamoeba histolytica
PIPKEVENNAKE

SEQ ID NO: 2571107 - protein, 7 aa, Entamoeba histolytica
PIPSSDL

SEQ ID NO: 2571108 - protein, 8 aa, Entamoeba histolytica
PIQNRNDK

SEQ ID NO: 2571109 - protein, 5 aa, Entamoeba histolytica
PIRQR

SEQ ID NO: 2571110 - protein, 8 aa, Entamoeba histolytica
PISENNES

SEQ ID NO: 2571111 - protein, 22 aa, Entamoeba histolytica
PISSNNPDTSLPSFKKPAQNPI

SEQ ID NO: 2571112 - protein, 15 aa, Entamoeba histolytica
PITNNKSTELNTPQI

SEQ ID NO: 2571113 - protein, 4 aa, Entamoeba histolytica
PITT

SEQ ID NO: 2571114 - protein, 17 aa, Entamoeba histolytica
PITTGDTYFDNNNKELP

SEQ ID NO: 2571115 - protein, 9 aa, Entamoeba histolytica
PITTNDGTL

SEQ ID NO: 2571116 - protein, 11 aa, Entamoeba histolytica
PIYGGEKGQVY

SEQ ID NO: 2571117 - protein, 13 aa, Entamoeba histolytica
PKAKPKAKKECPA

SEQ ID NO: 2571118 - protein, 12 aa, Entamoeba histolytica
PKCDEKLKGEHI

SEQ ID NO: 2571119 - protein, 12 aa, Entamoeba histolytica
PKDDLNEKGLTE

SEQ ID NO: 2571120 - protein, 14 aa, Entamoeba histolytica
PKDDNNTEETQEEI

SEQ ID NO: 2571121 - protein, 8 aa, Entamoeba histolytica
PKDGTQRI

SEQ ID NO: 2571122 - protein, 7 aa, Entamoeba histolytica
PKDRENV

SEQ ID NO: 2571123 - protein, 16 aa, Entamoeba histolytica
PKDSSEEEIKKEVNET

SEQ ID NO: 2571124 - protein, 5 aa, Entamoeba histolytica
PKEDA

SEQ ID NO: 2571125 - protein, 7 aa, Entamoeba histolytica
PKEDNHL

SEQ ID NO: 2571126 - protein, 12 aa, Entamoeba histolytica
PKEEEKEIEEEE

SEQ ID NO: 2571127 - protein, 5 aa, Entamoeba histolytica
PKEFN

SEQ ID NO: 2571128 - protein, 14 aa, Entamoeba histolytica
PKEIKRSRSHSRHS

SEQ ID NO: 2571129 - protein, 17 aa, Entamoeba histolytica
PKEISPAETKMKSTNTR

SEQ ID NO: 2571130 - protein, 8 aa, Entamoeba histolytica
PKENDSKM

SEQ ID NO: 2571131 - protein, 20 aa, Entamoeba histolytica
PKEQREMNEITSEVDANGYD

SEQ ID NO: 2571132 - protein, 14 aa, Entamoeba histolytica
PKERIDRTNGSNAN

SEQ ID NO: 2571133 - protein, 5 aa, Entamoeba histolytica
PKETE

SEQ ID NO: 2571134 - protein, 17 aa, Entamoeba histolytica
PKETLTAQTKMKSTNTR

SEQ ID NO: 2571135 - protein, 17 aa, Entamoeba histolytica
PKETLTAQTKMNSTNTR

SEQ ID NO: 2571136 - protein, 5 aa, Entamoeba histolytica
PKETV

SEQ ID NO: 2571137 - protein, 4 aa, Entamoeba histolytica
PKEV

SEQ ID NO: 2571138 - protein, 7 aa, Entamoeba histolytica
PKEYPDF

SEQ ID NO: 2571139 - protein, 7 aa, Entamoeba histolytica
PKEYQNQ

SEQ ID NO: 2571140 - protein, 8 aa, Entamoeba histolytica
PKGKKIRV

SEQ ID NO: 2571141 - protein, 5 aa, Entamoeba histolytica
PKGMQ

SEQ ID NO: 2571142 - protein, 5 aa, Entamoeba histolytica
PKGNK

SEQ ID NO: 2571143 - protein, 7 aa, Entamoeba histolytica
PKGNKGM

SEQ ID NO: 2571144 - protein, 4 aa, Entamoeba histolytica
PKGS

SEQ ID NO: 2571145 - protein, 7 aa, Entamoeba histolytica
PKGTEAT

SEQ ID NO: 2571146 - protein, 6 aa, Entamoeba histolytica
PKGTVN

SEQ ID NO: 2571147 - protein, 8 aa, Entamoeba histolytica
PKHLNSDS

SEQ ID NO: 2571148 - protein, 4 aa, Entamoeba histolytica
PKHM

SEQ ID NO: 2571149 - protein, 8 aa, Entamoeba histolytica
PKIGGKRL

SEQ ID NO: 2571150 - protein, 6 aa, Entamoeba histolytica
PKIGKE

SEQ ID NO: 2571151 - protein, 11 aa, Entamoeba histolytica
PKINDNSSEIE

SEQ ID NO: 2571152 - protein, 5 aa, Entamoeba histolytica
PKIPE

SEQ ID NO: 2571153 - protein, 19 aa, Entamoeba histolytica
PKIQPQGVDYQESVSDNSI

SEQ ID NO: 2571154 - protein, 11 aa, Entamoeba histolytica
PKISHSDITGK

SEQ ID NO: 2571155 - protein, 4 aa, Entamoeba histolytica
PKKF

SEQ ID NO: 2571156 - protein, 17 aa, Entamoeba histolytica
PKKIDEGKKEKEQYKED

SEQ ID NO: 2571157 - protein, 14 aa, Entamoeba histolytica
PKKIKHNKNKYKGI

SEQ ID NO: 2571158 - protein, 5 aa, Entamoeba histolytica
PKKPL

SEQ ID NO: 2571159 - protein, 16 aa, Entamoeba histolytica
PKKPSQERNNSPTSHV

SEQ ID NO: 2571160 - protein, 9 aa, Entamoeba histolytica
PKKTPSKSY

SEQ ID NO: 2571161 - protein, 5 aa, Entamoeba histolytica
PKKVK

SEQ ID NO: 2571162 - protein, 6 aa, Entamoeba histolytica
PKKVKE

SEQ ID NO: 2571163 - protein, 8 aa, Entamoeba histolytica
PKLQQKNS

SEQ ID NO: 2571164 - protein, 10 aa, Entamoeba histolytica
PKLTSASGAV

SEQ ID NO: 2571165 - protein, 7 aa, Entamoeba histolytica
PKMAKKS

SEQ ID NO: 2571166 - protein, 7 aa, Entamoeba histolytica
PKMNDIN

SEQ ID NO: 2571167 - protein, 11 aa, Entamoeba histolytica
PKNATDEQIED

SEQ ID NO: 2571168 - protein, 7 aa, Entamoeba histolytica
PKNEINE

SEQ ID NO: 2571169 - protein, 7 aa, Entamoeba histolytica
PKNPNYN

SEQ ID NO: 2571170 - protein, 6 aa, Entamoeba histolytica
PKNPPE

SEQ ID NO: 2571171 - protein, 14 aa, Entamoeba histolytica
PKNSFEPQRTKTLE

SEQ ID NO: 2571172 - protein, 7 aa, Entamoeba histolytica
PKNSQIK

SEQ ID NO: 2571173 - protein, 24 aa, Entamoeba histolytica
PKPEAPKRKRPQKKTQDDKPKSSI

SEQ ID NO: 2571174 - protein, 9 aa, Entamoeba histolytica
PKPKCPEGY

SEQ ID NO: 2571175 - protein, 5 aa, Entamoeba histolytica
PKPQA

SEQ ID NO: 2571176 - protein, 5 aa, Entamoeba histolytica
PKPQH

SEQ ID NO: 2571177 - protein, 8 aa, Entamoeba histolytica
PKPSDSTT

SEQ ID NO: 2571178 - protein, 11 aa, Entamoeba histolytica
PKPSESTSLSG

SEQ ID NO: 2571179 - protein, 12 aa, Entamoeba histolytica
PKPSVDRSGQKI

SEQ ID NO: 2571180 - protein, 5 aa, Entamoeba histolytica
PKPVM

SEQ ID NO: 2571181 - protein, 5 aa, Entamoeba histolytica
PKQEN

SEQ ID NO: 2571182 - protein, 11 aa, Entamoeba histolytica
PKQHKKEKFQP

SEQ ID NO: 2571183 - protein, 4 aa, Entamoeba histolytica
PKQK

SEQ ID NO: 2571184 - protein, 8 aa, Entamoeba histolytica
PKQKAEIT

SEQ ID NO: 2571185 - protein, 5 aa, Entamoeba histolytica
PKQPI

SEQ ID NO: 2571186 - protein, 8 aa, Entamoeba histolytica
PKQPNGKY

SEQ ID NO: 2571187 - protein, 4 aa, Entamoeba histolytica
PKQS

SEQ ID NO: 2571188 - protein, 8 aa, Entamoeba histolytica
PKQYPTNN

SEQ ID NO: 2571189 - protein, 8 aa, Entamoeba histolytica
PKRLPSDD

SEQ ID NO: 2571190 - protein, 7 aa, Entamoeba histolytica
PKRNTDK

SEQ ID NO: 2571191 - protein, 7 aa, Entamoeba histolytica
PKRPTMY

SEQ ID NO: 2571192 - protein, 7 aa, Entamoeba histolytica
PKSEQSL

SEQ ID NO: 2571193 - protein, 7 aa, Entamoeba histolytica
PKSGPVS

SEQ ID NO: 2571194 - protein, 12 aa, Entamoeba histolytica
PKSHRETFTDKQ

SEQ ID NO: 2571195 - protein, 4 aa, Entamoeba histolytica
PKSI

SEQ ID NO: 2571196 - protein, 11 aa, Entamoeba histolytica
PKSQSSDTTYK

SEQ ID NO: 2571197 - protein, 6 aa, Entamoeba histolytica
PKSSIP

SEQ ID NO: 2571198 - protein, 18 aa, Entamoeba histolytica
PKSSNELSNIILSQNLIF

SEQ ID NO: 2571199 - protein, 8 aa, Entamoeba histolytica
PKSTTTQN

SEQ ID NO: 2571200 - protein, 10 aa, Entamoeba histolytica
PKTATRRSEN

SEQ ID NO: 2571201 - protein, 12 aa, Entamoeba histolytica
PKTCQQRRGKWT

SEQ ID NO: 2571202 - protein, 9 aa, Entamoeba histolytica
PKTCQQRRS

SEQ ID NO: 2571203 - protein, 5 aa, Entamoeba histolytica
PKTEE

SEQ ID NO: 2571204 - protein, 4 aa, Entamoeba histolytica
PKTP

SEQ ID NO: 2571205 - protein, 6 aa, Entamoeba histolytica
PKTPFT

SEQ ID NO: 2571206 - protein, 7 aa, Entamoeba histolytica
PKTPMHN

SEQ ID NO: 2571207 - protein, 7 aa, Entamoeba histolytica
PKTSSKV

SEQ ID NO: 2571208 - protein, 4 aa, Entamoeba histolytica
PKTT

SEQ ID NO: 2571209 - protein, 4 aa, Entamoeba histolytica
PKTV

SEQ ID NO: 2571210 - protein, 13 aa, Entamoeba histolytica
PKVGKLQPGYGET

SEQ ID NO: 2571211 - protein, 14 aa, Entamoeba histolytica
PKVPIGDKKYKIEK

SEQ ID NO: 2571212 - protein, 7 aa, Entamoeba histolytica
PKVPNSG

SEQ ID NO: 2571213 - protein, 9 aa, Entamoeba histolytica
PKVPPPIPI

SEQ ID NO: 2571214 - protein, 5 aa, Entamoeba histolytica
PKVQE

SEQ ID NO: 2571215 - protein, 7 aa, Entamoeba histolytica
PKYDAPE

SEQ ID NO: 2571216 - protein, 5 aa, Entamoeba histolytica
PKYDP

SEQ ID NO: 2571217 - protein, 7 aa, Entamoeba histolytica
PKYGEVN

SEQ ID NO: 2571218 - protein, 6 aa, Entamoeba histolytica
PKYPST

SEQ ID NO: 2571219 - protein, 8 aa, Entamoeba histolytica
PLDGPMPT

SEQ ID NO: 2571220 - protein, 19 aa, Entamoeba histolytica
PLDTPEKTTISLTNKRKET

SEQ ID NO: 2571221 - protein, 12 aa, Entamoeba histolytica
PLEKNNESFETN

SEQ ID NO: 2571222 - protein, 6 aa, Entamoeba histolytica
PLFEKD

SEQ ID NO: 2571223 - protein, 12 aa, Entamoeba histolytica
PLFSEDKNQVYK

SEQ ID NO: 2571224 - protein, 5 aa, Entamoeba histolytica
PLGPF

SEQ ID NO: 2571225 - protein, 11 aa, Entamoeba histolytica
PLIRKKEPSKV

SEQ ID NO: 2571226 - protein, 8 aa, Entamoeba histolytica
PLKEDQYY

SEQ ID NO: 2571227 - protein, 10 aa, Entamoeba histolytica
PLKSSKSNYI

SEQ ID NO: 2571228 - protein, 14 aa, Entamoeba histolytica
PLKTGKAFGASNKW

SEQ ID NO: 2571229 - protein, 4 aa, Entamoeba histolytica
PLNE

SEQ ID NO: 2571230 - protein, 24 aa, Entamoeba histolytica
PLNLPQRSQIGSRNYDEITFRNND

SEQ ID NO: 2571231 - protein, 4 aa, Entamoeba histolytica
PLNR

SEQ ID NO: 2571232 - protein, 4 aa, Entamoeba histolytica
PLNT

SEQ ID NO: 2571233 - protein, 5 aa, Entamoeba histolytica
PLPER

SEQ ID NO: 2571234 - protein, 10 aa, Entamoeba histolytica
PLPGGERDIN

SEQ ID NO: 2571235 - protein, 12 aa, Entamoeba histolytica
PLPKQENTNPLI

SEQ ID NO: 2571236 - protein, 9 aa, Entamoeba histolytica
PLPKRETQS

SEQ ID NO: 2571237 - protein, 5 aa, Entamoeba histolytica
PLPPR

SEQ ID NO: 2571238 - protein, 12 aa, Entamoeba histolytica
PLPSSISSLHDS

SEQ ID NO: 2571239 - protein, 9 aa, Entamoeba histolytica
PLPSTIEQR

SEQ ID NO: 2571240 - protein, 8 aa, Entamoeba histolytica
PLQTTNED

SEQ ID NO: 2571241 - protein, 52 aa, Entamoeba histolytica
PLREKNIKQGWSREETLSEEFNKEAKVQRRARTEEVQRSGGTRLTGKDPKER

SEQ ID NO: 2571242 - protein, 14 aa, Entamoeba histolytica
PLRGDGKREDTERR

SEQ ID NO: 2571243 - protein, 4 aa, Entamoeba histolytica
PLSL

SEQ ID NO: 2571244 - protein, 5 aa, Entamoeba histolytica
PLSNT

SEQ ID NO: 2571245 - protein, 10 aa, Entamoeba histolytica
PLSPENSQLP

SEQ ID NO: 2571246 - protein, 8 aa, Entamoeba histolytica
PLSRPEKL

SEQ ID NO: 2571247 - protein, 10 aa, Entamoeba histolytica
PLSSRQNERK

SEQ ID NO: 2571248 - protein, 10 aa, Entamoeba histolytica
PLTKKSYTIH

SEQ ID NO: 2571249 - protein, 5 aa, Entamoeba histolytica
PLTLK

SEQ ID NO: 2571250 - protein, 6 aa, Entamoeba histolytica
PLTNER

SEQ ID NO: 2571251 - protein, 20 aa, Entamoeba histolytica
PLTNESKINHQEITSNEEEQ

SEQ ID NO: 2571252 - protein, 12 aa, Entamoeba histolytica
PLTPNSYQYQPN

SEQ ID NO: 2571253 - protein, 6 aa, Entamoeba histolytica
PLTSDE

SEQ ID NO: 2571254 - protein, 13 aa, Entamoeba histolytica
PLVESTDKVKPGL

SEQ ID NO: 2571255 - protein, 5 aa, Entamoeba histolytica
PMAET

SEQ ID NO: 2571256 - protein, 5 aa, Entamoeba histolytica
PMDAP

SEQ ID NO: 2571257 - protein, 11 aa, Entamoeba histolytica
PMECKSTDFSG

SEQ ID NO: 2571258 - protein, 7 aa, Entamoeba histolytica
PMGSKED

SEQ ID NO: 2571259 - protein, 25 aa, Entamoeba histolytica
PMNDQNEKGVPKNFANATNDPQIDQ

SEQ ID NO: 2571260 - protein, 12 aa, Entamoeba histolytica
PMPTRDPPAPVY

SEQ ID NO: 2571261 - protein, 24 aa, Entamoeba histolytica
PMTGTTSEKISRKQSLSKKDDNSQ

SEQ ID NO: 2571262 - protein, 5 aa, Entamoeba histolytica
PMTNE

SEQ ID NO: 2571263 - protein, 4 aa, Entamoeba histolytica
PNAE

SEQ ID NO: 2571264 - protein, 5 aa, Entamoeba histolytica
PNAPK

SEQ ID NO: 2571265 - protein, 5 aa, Entamoeba histolytica
PNDES

SEQ ID NO: 2571266 - protein, 12 aa, Entamoeba histolytica
PNDKCNTEERLT

SEQ ID NO: 2571267 - protein, 15 aa, Entamoeba histolytica
PNDKMKKDERISHTK

SEQ ID NO: 2571268 - protein, 8 aa, Entamoeba histolytica
PNDNINQK

SEQ ID NO: 2571269 - protein, 9 aa, Entamoeba histolytica
PNDSNARAI

SEQ ID NO: 2571270 - protein, 7 aa, Entamoeba histolytica
PNEAFYD

SEQ ID NO: 2571271 - protein, 5 aa, Entamoeba histolytica
PNECE

SEQ ID NO: 2571272 - protein, 11 aa, Entamoeba histolytica
PNECSTCQQPA

SEQ ID NO: 2571273 - protein, 9 aa, Entamoeba histolytica
PNEDIEASY

SEQ ID NO: 2571274 - protein, 5 aa, Entamoeba histolytica
PNEEG

SEQ ID NO: 2571275 - protein, 10 aa, Entamoeba histolytica
PNEFDEEVRP

SEQ ID NO: 2571276 - protein, 15 aa, Entamoeba histolytica
PNENYNLPEQGHDVG

SEQ ID NO: 2571277 - protein, 5 aa, Entamoeba histolytica
PNEPI

SEQ ID NO: 2571278 - protein, 17 aa, Entamoeba histolytica
PNEQKEELLNDEQKIKN

SEQ ID NO: 2571279 - protein, 8 aa, Entamoeba histolytica
PNESGQKC

SEQ ID NO: 2571280 - protein, 11 aa, Entamoeba histolytica
PNETVASDETI

SEQ ID NO: 2571281 - protein, 7 aa, Entamoeba histolytica
PNEVSRQ

SEQ ID NO: 2571282 - protein, 7 aa, Entamoeba histolytica
PNFSDVN

SEQ ID NO: 2571283 - protein, 5 aa, Entamoeba histolytica
PNGIT

SEQ ID NO: 2571284 - protein, 6 aa, Entamoeba histolytica
PNGKPL

SEQ ID NO: 2571285 - protein, 7 aa, Entamoeba histolytica
PNGQWDN

SEQ ID NO: 2571286 - protein, 14 aa, Entamoeba histolytica
PNGRNIDVTDKNKQ

SEQ ID NO: 2571287 - protein, 6 aa, Entamoeba histolytica
PNGTTE

SEQ ID NO: 2571288 - protein, 5 aa, Entamoeba histolytica
PNGWN

SEQ ID NO: 2571289 - protein, 6 aa, Entamoeba histolytica
PNHSNG

SEQ ID NO: 2571290 - protein, 8 aa, Entamoeba histolytica
PNIATREN

SEQ ID NO: 2571291 - protein, 4 aa, Entamoeba histolytica
PNIP

SEQ ID NO: 2571292 - protein, 6 aa, Entamoeba histolytica
PNIPGC

SEQ ID NO: 2571293 - protein, 9 aa, Entamoeba histolytica
PNIQQTEGI

SEQ ID NO: 2571294 - protein, 5 aa, Entamoeba histolytica
PNISG

SEQ ID NO: 2571295 - protein, 4 aa, Entamoeba histolytica
PNIT

SEQ ID NO: 2571296 - protein, 8 aa, Entamoeba histolytica
PNKDAQEI

SEQ ID NO: 2571297 - protein, 9 aa, Entamoeba histolytica
PNKDKANIE

SEQ ID NO: 2571298 - protein, 6 aa, Entamoeba histolytica
PNKKLG

SEQ ID NO: 2571299 - protein, 17 aa, Entamoeba histolytica
PNKQTQDQKQHEVYNFQ

SEQ ID NO: 2571300 - protein, 12 aa, Entamoeba histolytica
PNKSNEEDIKKA

SEQ ID NO: 2571301 - protein, 5 aa, Entamoeba histolytica
PNKTA

SEQ ID NO: 2571302 - protein, 24 aa, Entamoeba histolytica
PNLNAAQGNSQEKGKKQKMKFKTR

SEQ ID NO: 2571303 - protein, 9 aa, Entamoeba histolytica
PNLSNGAQR

SEQ ID NO: 2571304 - protein, 9 aa, Entamoeba histolytica
PNMGGKSTY

SEQ ID NO: 2571305 - protein, 4 aa, Entamoeba histolytica
PNND

SEQ ID NO: 2571306 - protein, 6 aa, Entamoeba histolytica
PNNEIK

SEQ ID NO: 2571307 - protein, 5 aa, Entamoeba histolytica
PNNIQ

SEQ ID NO: 2571308 - protein, 14 aa, Entamoeba histolytica
PNNKCNTEERLTHE

SEQ ID NO: 2571309 - protein, 5 aa, Entamoeba histolytica
PNNPK

SEQ ID NO: 2571310 - protein, 7 aa, Entamoeba histolytica
PNNPSLK

SEQ ID NO: 2571311 - protein, 4 aa, Entamoeba histolytica
PNNQ

SEQ ID NO: 2571312 - protein, 8 aa, Entamoeba histolytica
PNNTQNGK

SEQ ID NO: 2571313 - protein, 4 aa, Entamoeba histolytica
PNPI

SEQ ID NO: 2571314 - protein, 8 aa, Entamoeba histolytica
PNPKKPTI

SEQ ID NO: 2571315 - protein, 6 aa, Entamoeba histolytica
PNPLEN

SEQ ID NO: 2571316 - protein, 7 aa, Entamoeba histolytica
PNPTEVR

SEQ ID NO: 2571317 - protein, 4 aa, Entamoeba histolytica
PNPY

SEQ ID NO: 2571318 - protein, 4 aa, Entamoeba histolytica
PNQN

SEQ ID NO: 2571319 - protein, 18 aa, Entamoeba histolytica
PNQPTIQPELYLSGWVKN

SEQ ID NO: 2571320 - protein, 9 aa, Entamoeba histolytica
PNQVDASGN

SEQ ID NO: 2571321 - protein, 5 aa, Entamoeba histolytica
PNQYP

SEQ ID NO: 2571322 - protein, 8 aa, Entamoeba histolytica
PNRDLKKG

SEQ ID NO: 2571323 - protein, 7 aa, Entamoeba histolytica
PNSDEEL

SEQ ID NO: 2571324 - protein, 8 aa, Entamoeba histolytica
PNSEDIKT

SEQ ID NO: 2571325 - protein, 6 aa, Entamoeba histolytica
PNSEPN

SEQ ID NO: 2571326 - protein, 31 aa, Entamoeba histolytica
PNSKSFDNEIHTNSSSNSVINNETTPSRSIE

SEQ ID NO: 2571327 - protein, 5 aa, Entamoeba histolytica
PNSLW

SEQ ID NO: 2571328 - protein, 4 aa, Entamoeba histolytica
PNSM

SEQ ID NO: 2571329 - protein, 5 aa, Entamoeba histolytica
PNSPL

SEQ ID NO: 2571330 - protein, 6 aa, Entamoeba histolytica
PNSPRV

SEQ ID NO: 2571331 - protein, 4 aa, Entamoeba histolytica
PNSV

SEQ ID NO: 2571332 - protein, 5 aa, Entamoeba histolytica
PNTEN

SEQ ID NO: 2571333 - protein, 4 aa, Entamoeba histolytica
PNTL

SEQ ID NO: 2571334 - protein, 19 aa, Entamoeba histolytica
PNTMSSKKFNETIKSQRGR

SEQ ID NO: 2571335 - protein, 8 aa, Entamoeba histolytica
PNTQENIA

SEQ ID NO: 2571336 - protein, 4 aa, Entamoeba histolytica
PNTT

SEQ ID NO: 2571337 - protein, 7 aa, Entamoeba histolytica
PNVNTSQ

SEQ ID NO: 2571338 - protein, 7 aa, Entamoeba histolytica
PNVPPKT

SEQ ID NO: 2571339 - protein, 8 aa, Entamoeba histolytica
PNVPVGDR

SEQ ID NO: 2571340 - protein, 58 aa, Entamoeba histolytica
PNVQQPTQQETVQPTENQAPQPEVVQPTSEVQQPVNPNVQQPVNPNVQQPVNPNVQQP

SEQ ID NO: 2571341 - protein, 17 aa, Entamoeba histolytica
PNVSDEEVKQAIESNDN

SEQ ID NO: 2571342 - protein, 4 aa, Entamoeba histolytica
PNYD

SEQ ID NO: 2571343 - protein, 4 aa, Entamoeba histolytica
PNYE

SEQ ID NO: 2571344 - protein, 5 aa, Entamoeba histolytica
PNYEK

SEQ ID NO: 2571345 - protein, 6 aa, Entamoeba histolytica
PNYESI

SEQ ID NO: 2571346 - protein, 6 aa, Entamoeba histolytica
PNYETF

SEQ ID NO: 2571347 - protein, 9 aa, Entamoeba histolytica
PNYNDTKTD

SEQ ID NO: 2571348 - protein, 11 aa, Entamoeba histolytica
PNYSFKTQKKE

SEQ ID NO: 2571349 - protein, 12 aa, Entamoeba histolytica
PPAIKGKADYYQ

SEQ ID NO: 2571350 - protein, 4 aa, Entamoeba histolytica
PPDG

SEQ ID NO: 2571351 - protein, 5 aa, Entamoeba histolytica
PPDIN

SEQ ID NO: 2571352 - protein, 14 aa, Entamoeba histolytica
PPDKKGKWCEEQSD

SEQ ID NO: 2571353 - protein, 12 aa, Entamoeba histolytica
PPEDSDEPPLLN

SEQ ID NO: 2571354 - protein, 5 aa, Entamoeba histolytica
PPERM

SEQ ID NO: 2571355 - protein, 5 aa, Entamoeba histolytica
PPGMS

SEQ ID NO: 2571356 - protein, 7 aa, Entamoeba histolytica
PPGTGSV

SEQ ID NO: 2571357 - protein, 6 aa, Entamoeba histolytica
PPGTQI

SEQ ID NO: 2571358 - protein, 7 aa, Entamoeba histolytica
PPHQNNP

SEQ ID NO: 2571359 - protein, 12 aa, Entamoeba histolytica
PPKFTEPTKTNF

SEQ ID NO: 2571360 - protein, 5 aa, Entamoeba histolytica
PPKIK

SEQ ID NO: 2571361 - protein, 13 aa, Entamoeba histolytica
PPKIPKEEKEKKN

SEQ ID NO: 2571362 - protein, 19 aa, Entamoeba histolytica
PPKIQGEEKREKNEIGEEY

SEQ ID NO: 2571363 - protein, 6 aa, Entamoeba histolytica
PPKLTA

SEQ ID NO: 2571364 - protein, 4 aa, Entamoeba histolytica
PPKP

SEQ ID NO: 2571365 - protein, 7 aa, Entamoeba histolytica
PPKPFES

SEQ ID NO: 2571366 - protein, 5 aa, Entamoeba histolytica
PPKPI

SEQ ID NO: 2571367 - protein, 11 aa, Entamoeba histolytica
PPLDKGEEKEM

SEQ ID NO: 2571368 - protein, 8 aa, Entamoeba histolytica
PPLKSNKD

SEQ ID NO: 2571369 - protein, 7 aa, Entamoeba histolytica
PPLKSSK

SEQ ID NO: 2571370 - protein, 6 aa, Entamoeba histolytica
PPLNSI

SEQ ID NO: 2571371 - protein, 5 aa, Entamoeba histolytica
PPNDM

SEQ ID NO: 2571372 - protein, 7 aa, Entamoeba histolytica
PPNDTAW

SEQ ID NO: 2571373 - protein, 10 aa, Entamoeba histolytica
PPNPSNGAQR

SEQ ID NO: 2571374 - protein, 5 aa, Entamoeba histolytica
PPPFN

SEQ ID NO: 2571375 - protein, 6 aa, Entamoeba histolytica
PPPNIE

SEQ ID NO: 2571376 - protein, 7 aa, Entamoeba histolytica
PPPPDTR

SEQ ID NO: 2571377 - protein, 9 aa, Entamoeba histolytica
PPPPKPLRQ

SEQ ID NO: 2571378 - protein, 4 aa, Entamoeba histolytica
PPQS

SEQ ID NO: 2571379 - protein, 7 aa, Entamoeba histolytica
PPSFTGE

SEQ ID NO: 2571380 - protein, 6 aa, Entamoeba histolytica
PPSGCK

SEQ ID NO: 2571381 - protein, 8 aa, Entamoeba histolytica
PPSIGEGT

SEQ ID NO: 2571382 - protein, 6 aa, Entamoeba histolytica
PPSNSI

SEQ ID NO: 2571383 - protein, 6 aa, Entamoeba histolytica
PPSVTS

SEQ ID NO: 2571384 - protein, 5 aa, Entamoeba histolytica
PPTDE

SEQ ID NO: 2571385 - protein, 5 aa, Entamoeba histolytica
PPTEP

SEQ ID NO: 2571386 - protein, 5 aa, Entamoeba histolytica
PPTGL

SEQ ID NO: 2571387 - protein, 4 aa, Entamoeba histolytica
PPTI

SEQ ID NO: 2571388 - protein, 9 aa, Entamoeba histolytica
PPTKYPATM

SEQ ID NO: 2571389 - protein, 17 aa, Entamoeba histolytica
PPTPGTYVQPVYGLGQA

SEQ ID NO: 2571390 - protein, 6 aa, Entamoeba histolytica
PPTTRT

SEQ ID NO: 2571391 - protein, 9 aa, Entamoeba histolytica
PPVPNEKVN

SEQ ID NO: 2571392 - protein, 6 aa, Entamoeba histolytica
PQANHK

SEQ ID NO: 2571393 - protein, 4 aa, Entamoeba histolytica
PQDI

SEQ ID NO: 2571394 - protein, 10 aa, Entamoeba histolytica
PQDNSDEEGC

SEQ ID NO: 2571395 - protein, 10 aa, Entamoeba histolytica
PQDQEKKLQF

SEQ ID NO: 2571396 - protein, 5 aa, Entamoeba histolytica
PQDTI

SEQ ID NO: 2571397 - protein, 7 aa, Entamoeba histolytica
PQEEKDL

SEQ ID NO: 2571398 - protein, 14 aa, Entamoeba histolytica
PQEGEIKKEETDSS

SEQ ID NO: 2571399 - protein, 5 aa, Entamoeba histolytica
PQEGG

SEQ ID NO: 2571400 - protein, 5 aa, Entamoeba histolytica
PQEID

SEQ ID NO: 2571401 - protein, 9 aa, Entamoeba histolytica
PQEKKYGIR

SEQ ID NO: 2571402 - protein, 7 aa, Entamoeba histolytica
PQERPQF

SEQ ID NO: 2571403 - protein, 23 aa, Entamoeba histolytica
PQEVEAELKEKAPSQENIGKDPF

SEQ ID NO: 2571404 - protein, 4 aa, Entamoeba histolytica
PQEY

SEQ ID NO: 2571405 - protein, 11 aa, Entamoeba histolytica
PQGVTATQTNK

SEQ ID NO: 2571406 - protein, 13 aa, Entamoeba histolytica
PQGYKTSVQSGQI

SEQ ID NO: 2571407 - protein, 9 aa, Entamoeba histolytica
PQHKETFDN

SEQ ID NO: 2571408 - protein, 5 aa, Entamoeba histolytica
PQHSL

SEQ ID NO: 2571409 - protein, 9 aa, Entamoeba histolytica
PQKQELKGN

SEQ ID NO: 2571410 - protein, 6 aa, Entamoeba histolytica
PQKSLE

SEQ ID NO: 2571411 - protein, 5 aa, Entamoeba histolytica
PQLGA

SEQ ID NO: 2571412 - protein, 4 aa, Entamoeba histolytica
PQLS

SEQ ID NO: 2571413 - protein, 8 aa, Entamoeba histolytica
PQLSQTPQ

SEQ ID NO: 2571414 - protein, 4 aa, Entamoeba histolytica
PQMC

SEQ ID NO: 2571415 - protein, 4 aa, Entamoeba histolytica
PQNE

SEQ ID NO: 2571416 - protein, 10 aa, Entamoeba histolytica
PQNNESEPCA

SEQ ID NO: 2571417 - protein, 5 aa, Entamoeba histolytica
PQPKF

SEQ ID NO: 2571418 - protein, 7 aa, Entamoeba histolytica
PQPMSSD

SEQ ID NO: 2571419 - protein, 5 aa, Entamoeba histolytica
PQQEF

SEQ ID NO: 2571420 - protein, 10 aa, Entamoeba histolytica
PQQNDTIGTI

SEQ ID NO: 2571421 - protein, 9 aa, Entamoeba histolytica
PQQPNGDKY

SEQ ID NO: 2571422 - protein, 4 aa, Entamoeba histolytica
PQQS

SEQ ID NO: 2571423 - protein, 6 aa, Entamoeba histolytica
PQSLHN

SEQ ID NO: 2571424 - protein, 10 aa, Entamoeba histolytica
PQSTPRMTGE

SEQ ID NO: 2571425 - protein, 19 aa, Entamoeba histolytica
PQSVSEKITKSETNKKQRI

SEQ ID NO: 2571426 - protein, 11 aa, Entamoeba histolytica
PQTCEKSTAIT

SEQ ID NO: 2571427 - protein, 22 aa, Entamoeba histolytica
PQTIMTKSERRQEKKEEEEGER

SEQ ID NO: 2571428 - protein, 7 aa, Entamoeba histolytica
PQTKKAV

SEQ ID NO: 2571429 - protein, 14 aa, Entamoeba histolytica
PQTNKENEINDTAA

SEQ ID NO: 2571430 - protein, 7 aa, Entamoeba histolytica
PQTPMYS

SEQ ID NO: 2571431 - protein, 8 aa, Entamoeba histolytica
PQTTQNIK

SEQ ID NO: 2571432 - protein, 8 aa, Entamoeba histolytica
PQWSTTTY

SEQ ID NO: 2571433 - protein, 5 aa, Entamoeba histolytica
PQYKG

SEQ ID NO: 2571434 - protein, 6 aa, Entamoeba histolytica
PQYTDN

SEQ ID NO: 2571435 - protein, 18 aa, Entamoeba histolytica
PQYTQPPAYTQSTSYQEG

SEQ ID NO: 2571436 - protein, 4 aa, Entamoeba histolytica
PREN

SEQ ID NO: 2571437 - protein, 12 aa, Entamoeba histolytica
PRGATISGTGSL

SEQ ID NO: 2571438 - protein, 14 aa, Entamoeba histolytica
PRGREGKKEKIEEI

SEQ ID NO: 2571439 - protein, 5 aa, Entamoeba histolytica
PRKQT

SEQ ID NO: 2571440 - protein, 6 aa, Entamoeba histolytica
PRKREW

SEQ ID NO: 2571441 - protein, 16 aa, Entamoeba histolytica
PRKTESPQESPRSSTK

SEQ ID NO: 2571442 - protein, 12 aa, Entamoeba histolytica
PRMKNSSGCYPS

SEQ ID NO: 2571443 - protein, 12 aa, Entamoeba histolytica
PRNADAHKRRGQ

SEQ ID NO: 2571444 - protein, 4 aa, Entamoeba histolytica
PRND

SEQ ID NO: 2571445 - protein, 4 aa, Entamoeba histolytica
PRNY

SEQ ID NO: 2571446 - protein, 4 aa, Entamoeba histolytica
PRPT

SEQ ID NO: 2571447 - protein, 5 aa, Entamoeba histolytica
PRQPT

SEQ ID NO: 2571448 - protein, 8 aa, Entamoeba histolytica
PRQSTTIT

SEQ ID NO: 2571449 - protein, 4 aa, Entamoeba histolytica
PRRA

SEQ ID NO: 2571450 - protein, 5 aa, Entamoeba histolytica
PRRSS

SEQ ID NO: 2571451 - protein, 7 aa, Entamoeba histolytica
PRRTDDR

SEQ ID NO: 2571452 - protein, 19 aa, Entamoeba histolytica
PRSAGKVNVTVSDSRNSEN

SEQ ID NO: 2571453 - protein, 8 aa, Entamoeba histolytica
PRSDRVRA

SEQ ID NO: 2571454 - protein, 6 aa, Entamoeba histolytica
PRSEYN

SEQ ID NO: 2571455 - protein, 11 aa, Entamoeba histolytica
PRSNASQRESL

SEQ ID NO: 2571456 - protein, 5 aa, Entamoeba histolytica
PRSPV

SEQ ID NO: 2571457 - protein, 9 aa, Entamoeba histolytica
PRSRKVGQS

SEQ ID NO: 2571458 - protein, 7 aa, Entamoeba histolytica
PRSVYRP

SEQ ID NO: 2571459 - protein, 10 aa, Entamoeba histolytica
PRTLKQRKKN

SEQ ID NO: 2571460 - protein, 15 aa, Entamoeba histolytica
PRVSLNNDNKPPFGP

SEQ ID NO: 2571461 - protein, 7 aa, Entamoeba histolytica
PRYEQDE

SEQ ID NO: 2571462 - protein, 5 aa, Entamoeba histolytica
PRYTG

SEQ ID NO: 2571463 - protein, 14 aa, Entamoeba histolytica
PSCSEEEKSQAIER

SEQ ID NO: 2571464 - protein, 10 aa, Entamoeba histolytica
PSDAESKNDV

SEQ ID NO: 2571465 - protein, 4 aa, Entamoeba histolytica
PSDD

SEQ ID NO: 2571466 - protein, 12 aa, Entamoeba histolytica
PSDRKSPGPQLD

SEQ ID NO: 2571467 - protein, 8 aa, Entamoeba histolytica
PSEDPLLS

SEQ ID NO: 2571468 - protein, 7 aa, Entamoeba histolytica
PSELPEN

SEQ ID NO: 2571469 - protein, 17 aa, Entamoeba histolytica
PSERGIKETDPTVTGHV

SEQ ID NO: 2571470 - protein, 9 aa, Entamoeba histolytica
PSERPSFKE

SEQ ID NO: 2571471 - protein, 9 aa, Entamoeba histolytica
PSESSLDTQ

SEQ ID NO: 2571472 - protein, 6 aa, Entamoeba histolytica
PSFKSD

SEQ ID NO: 2571473 - protein, 19 aa, Entamoeba histolytica
PSFNENGEKYYQASSPDEV

SEQ ID NO: 2571474 - protein, 10 aa, Entamoeba histolytica
PSFSEKESRE

SEQ ID NO: 2571475 - protein, 8 aa, Entamoeba histolytica
PSFSKTEF

SEQ ID NO: 2571476 - protein, 6 aa, Entamoeba histolytica
PSGHSK

SEQ ID NO: 2571477 - protein, 4 aa, Entamoeba histolytica
PSGR

SEQ ID NO: 2571478 - protein, 10 aa, Entamoeba histolytica
PSGSASIIQS

SEQ ID NO: 2571479 - protein, 6 aa, Entamoeba histolytica
PSGSNN

SEQ ID NO: 2571480 - protein, 5 aa, Entamoeba histolytica
PSGSS

SEQ ID NO: 2571481 - protein, 4 aa, Entamoeba histolytica
PSGV

SEQ ID NO: 2571482 - protein, 8 aa, Entamoeba histolytica
PSHPTPIE

SEQ ID NO: 2571483 - protein, 7 aa, Entamoeba histolytica
PSHSSNE

SEQ ID NO: 2571484 - protein, 4 aa, Entamoeba histolytica
PSID

SEQ ID NO: 2571485 - protein, 5 aa, Entamoeba histolytica
PSIDC

SEQ ID NO: 2571486 - protein, 4 aa, Entamoeba histolytica
PSII

SEQ ID NO: 2571487 - protein, 8 aa, Entamoeba histolytica
PSINASTN

SEQ ID NO: 2571488 - protein, 13 aa, Entamoeba histolytica
PSINYSTATGNPL

SEQ ID NO: 2571489 - protein, 4 aa, Entamoeba histolytica
PSIP

SEQ ID NO: 2571490 - protein, 14 aa, Entamoeba histolytica
PSIPSLEETTESTA

SEQ ID NO: 2571491 - protein, 19 aa, Entamoeba histolytica
PSISNEGERYYQASSPDEV

SEQ ID NO: 2571492 - protein, 4 aa, Entamoeba histolytica
PSKG

SEQ ID NO: 2571493 - protein, 8 aa, Entamoeba histolytica
PSKKEDVH

SEQ ID NO: 2571494 - protein, 8 aa, Entamoeba histolytica
PSKLRGVA

SEQ ID NO: 2571495 - protein, 4 aa, Entamoeba histolytica
PSKN

SEQ ID NO: 2571496 - protein, 5 aa, Entamoeba histolytica
PSKNT

SEQ ID NO: 2571497 - protein, 22 aa, Entamoeba histolytica
PSKPTPTPPHRANTQPLNTSTN

SEQ ID NO: 2571498 - protein, 10 aa, Entamoeba histolytica
PSKQQSHITE

SEQ ID NO: 2571499 - protein, 7 aa, Entamoeba histolytica
PSKRPCC

SEQ ID NO: 2571500 - protein, 7 aa, Entamoeba histolytica
PSKTSFD

SEQ ID NO: 2571501 - protein, 6 aa, Entamoeba histolytica
PSKTYS

SEQ ID NO: 2571502 - protein, 13 aa, Entamoeba histolytica
PSKVTKKKTLIPD

SEQ ID NO: 2571503 - protein, 10 aa, Entamoeba histolytica
PSLDNQKRRQ

SEQ ID NO: 2571504 - protein, 4 aa, Entamoeba histolytica
PSLK

SEQ ID NO: 2571505 - protein, 8 aa, Entamoeba histolytica
PSLKHSAS

SEQ ID NO: 2571506 - protein, 5 aa, Entamoeba histolytica
PSLNC

SEQ ID NO: 2571507 - protein, 7 aa, Entamoeba histolytica
PSLQQSL

SEQ ID NO: 2571508 - protein, 5 aa, Entamoeba histolytica
PSLSH

SEQ ID NO: 2571509 - protein, 7 aa, Entamoeba histolytica
PSLSKTK

SEQ ID NO: 2571510 - protein, 36 aa, Entamoeba histolytica
PSLSRSDKQRKISLEESNELPTPTAQSSHSEKKGNL

SEQ ID NO: 2571511 - protein, 4 aa, Entamoeba histolytica
PSLT

SEQ ID NO: 2571512 - protein, 4 aa, Entamoeba histolytica
PSME

SEQ ID NO: 2571513 - protein, 6 aa, Entamoeba histolytica
PSMSEL

SEQ ID NO: 2571514 - protein, 8 aa, Entamoeba histolytica
PSNDCSGL

SEQ ID NO: 2571515 - protein, 17 aa, Entamoeba histolytica
PSNDENPKCKGDSTTFD

SEQ ID NO: 2571516 - protein, 4 aa, Entamoeba histolytica
PSNE

SEQ ID NO: 2571517 - protein, 6 aa, Entamoeba histolytica
PSNEGK

SEQ ID NO: 2571518 - protein, 16 aa, Entamoeba histolytica
PSNEYLTKPGDSRGTL

SEQ ID NO: 2571519 - protein, 8 aa, Entamoeba histolytica
PSNGEMTS

SEQ ID NO: 2571520 - protein, 4 aa, Entamoeba histolytica
PSNI

SEQ ID NO: 2571521 - protein, 5 aa, Entamoeba histolytica
PSNPR

SEQ ID NO: 2571522 - protein, 9 aa, Entamoeba histolytica
PSNRKPRTI

SEQ ID NO: 2571523 - protein, 4 aa, Entamoeba histolytica
PSNT

SEQ ID NO: 2571524 - protein, 6 aa, Entamoeba histolytica
PSNTPF

SEQ ID NO: 2571525 - protein, 5 aa, Entamoeba histolytica
PSNTS

SEQ ID NO: 2571526 - protein, 6 aa, Entamoeba histolytica
PSNTSL

SEQ ID NO: 2571527 - protein, 7 aa, Entamoeba histolytica
PSNTTCN

SEQ ID NO: 2571528 - protein, 6 aa, Entamoeba histolytica
PSNVEE

SEQ ID NO: 2571529 - protein, 8 aa, Entamoeba histolytica
PSPKEEGS

SEQ ID NO: 2571530 - protein, 6 aa, Entamoeba histolytica
PSPLEE

SEQ ID NO: 2571531 - protein, 7 aa, Entamoeba histolytica
PSPLGTT

SEQ ID NO: 2571532 - protein, 7 aa, Entamoeba histolytica
PSPPQQT

SEQ ID NO: 2571533 - protein, 6 aa, Entamoeba histolytica
PSPSIE

SEQ ID NO: 2571534 - protein, 4 aa, Entamoeba histolytica
PSPY

SEQ ID NO: 2571535 - protein, 6 aa, Entamoeba histolytica
PSQDGH

SEQ ID NO: 2571536 - protein, 4 aa, Entamoeba histolytica
PSQF

SEQ ID NO: 2571537 - protein, 15 aa, Entamoeba histolytica
PSQFSSEKGKGGAAH

SEQ ID NO: 2571538 - protein, 7 aa, Entamoeba histolytica
PSQGQYG

SEQ ID NO: 2571539 - protein, 7 aa, Entamoeba histolytica
PSQKAKI

SEQ ID NO: 2571540 - protein, 9 aa, Entamoeba histolytica
PSQKQPNGR

SEQ ID NO: 2571541 - protein, 10 aa, Entamoeba histolytica
PSQLKETQFN

SEQ ID NO: 2571542 - protein, 7 aa, Entamoeba histolytica
PSQRPKD

SEQ ID NO: 2571543 - protein, 12 aa, Entamoeba histolytica
PSQYSDKEFPRK

SEQ ID NO: 2571544 - protein, 5 aa, Entamoeba histolytica
PSRFT

SEQ ID NO: 2571545 - protein, 21 aa, Entamoeba histolytica
PSRITGVSSSNMTISGASSSI

SEQ ID NO: 2571546 - protein, 4 aa, Entamoeba histolytica
PSRL

SEQ ID NO: 2571547 - protein, 4 aa, Entamoeba histolytica
PSRP

SEQ ID NO: 2571548 - protein, 20 aa, Entamoeba histolytica
PSSCGNKKLDEGEECDGGDG

SEQ ID NO: 2571549 - protein, 7 aa, Entamoeba histolytica
PSSDSGG

SEQ ID NO: 2571550 - protein, 16 aa, Entamoeba histolytica
PSSFEQQPDYSKYTAQ

SEQ ID NO: 2571551 - protein, 7 aa, Entamoeba histolytica
PSSKTEI

SEQ ID NO: 2571552 - protein, 4 aa, Entamoeba histolytica
PSSL

SEQ ID NO: 2571553 - protein, 4 aa, Entamoeba histolytica
PSSN

SEQ ID NO: 2571554 - protein, 6 aa, Entamoeba histolytica
PSSPYV

SEQ ID NO: 2571555 - protein, 6 aa, Entamoeba histolytica
PSSQNA

SEQ ID NO: 2571556 - protein, 5 aa, Entamoeba histolytica
PSSSS

SEQ ID NO: 2571557 - protein, 4 aa, Entamoeba histolytica
PSSY

SEQ ID NO: 2571558 - protein, 5 aa, Entamoeba histolytica
PSTEE

SEQ ID NO: 2571559 - protein, 6 aa, Entamoeba histolytica
PSTEGV

SEQ ID NO: 2571560 - protein, 6 aa, Entamoeba histolytica
PSTEYK

SEQ ID NO: 2571561 - protein, 7 aa, Entamoeba histolytica
PSTEYKT

SEQ ID NO: 2571562 - protein, 10 aa, Entamoeba histolytica
PSTGDYQISP

SEQ ID NO: 2571563 - protein, 5 aa, Entamoeba histolytica
PSTGK

SEQ ID NO: 2571564 - protein, 4 aa, Entamoeba histolytica
PSTH

SEQ ID NO: 2571565 - protein, 4 aa, Entamoeba histolytica
PSTK

SEQ ID NO: 2571566 - protein, 4 aa, Entamoeba histolytica
PSTN

SEQ ID NO: 2571567 - protein, 15 aa, Entamoeba histolytica
PSTNCINEKTQNIVN

SEQ ID NO: 2571568 - protein, 10 aa, Entamoeba histolytica
PSTNYSDPVE

SEQ ID NO: 2571569 - protein, 4 aa, Entamoeba histolytica
PSTP

SEQ ID NO: 2571570 - protein, 5 aa, Entamoeba histolytica
PSTQL

SEQ ID NO: 2571571 - protein, 8 aa, Entamoeba histolytica
PSTQQTPI

SEQ ID NO: 2571572 - protein, 5 aa, Entamoeba histolytica
PSTTI

SEQ ID NO: 2571573 - protein, 4 aa, Entamoeba histolytica
PSTV

SEQ ID NO: 2571574 - protein, 4 aa, Entamoeba histolytica
PSVD

SEQ ID NO: 2571575 - protein, 11 aa, Entamoeba histolytica
PSVDEEKETEL

SEQ ID NO: 2571576 - protein, 11 aa, Entamoeba histolytica
PSVKSKQINGE

SEQ ID NO: 2571577 - protein, 6 aa, Entamoeba histolytica
PSVNEY

SEQ ID NO: 2571578 - protein, 10 aa, Entamoeba histolytica
PSVSNSSGQS

SEQ ID NO: 2571579 - protein, 7 aa, Entamoeba histolytica
PSVYGSY

SEQ ID NO: 2571580 - protein, 4 aa, Entamoeba histolytica
PSYD

SEQ ID NO: 2571581 - protein, 4 aa, Entamoeba histolytica
PSYG

SEQ ID NO: 2571582 - protein, 7 aa, Entamoeba histolytica
PSYQNNT

SEQ ID NO: 2571583 - protein, 8 aa, Entamoeba histolytica
PSYRDSLN

SEQ ID NO: 2571584 - protein, 7 aa, Entamoeba histolytica
PSYYNGG

SEQ ID NO: 2571585 - protein, 4 aa, Entamoeba histolytica
PTAG

SEQ ID NO: 2571586 - protein, 11 aa, Entamoeba histolytica
PTCGNGKIDEF

SEQ ID NO: 2571587 - protein, 9 aa, Entamoeba histolytica
PTCGNGQID

SEQ ID NO: 2571588 - protein, 4 aa, Entamoeba histolytica
PTDN

SEQ ID NO: 2571589 - protein, 4 aa, Entamoeba histolytica
PTDS

SEQ ID NO: 2571590 - protein, 8 aa, Entamoeba histolytica
PTDSTLTS

SEQ ID NO: 2571591 - protein, 4 aa, Entamoeba histolytica
PTDV

SEQ ID NO: 2571592 - protein, 4 aa, Entamoeba histolytica
PTEA

SEQ ID NO: 2571593 - protein, 5 aa, Entamoeba histolytica
PTEFE

SEQ ID NO: 2571594 - protein, 8 aa, Entamoeba histolytica
PTEGDCGE

SEQ ID NO: 2571595 - protein, 6 aa, Entamoeba histolytica
PTENYL

SEQ ID NO: 2571596 - protein, 8 aa, Entamoeba histolytica
PTERGEGV

SEQ ID NO: 2571597 - protein, 5 aa, Entamoeba histolytica
PTFIT

SEQ ID NO: 2571598 - protein, 8 aa, Entamoeba histolytica
PTFPSKKE

SEQ ID NO: 2571599 - protein, 5 aa, Entamoeba histolytica
PTFSI

SEQ ID NO: 2571600 - protein, 5 aa, Entamoeba histolytica
PTGAN

SEQ ID NO: 2571601 - protein, 7 aa, Entamoeba histolytica
PTGETSL

SEQ ID NO: 2571602 - protein, 7 aa, Entamoeba histolytica
PTGGGKS

SEQ ID NO: 2571603 - protein, 6 aa, Entamoeba histolytica
PTGGVL

SEQ ID NO: 2571604 - protein, 7 aa, Entamoeba histolytica
PTGKPSC

SEQ ID NO: 2571605 - protein, 9 aa, Entamoeba histolytica
PTGKTNPMA

SEQ ID NO: 2571606 - protein, 22 aa, Entamoeba histolytica
PTGLEDKKQIDVSNSKSHRPYI

SEQ ID NO: 2571607 - protein, 15 aa, Entamoeba histolytica
PTGLSGKEKIRKATE

SEQ ID NO: 2571608 - protein, 7 aa, Entamoeba histolytica
PTGTEPI

SEQ ID NO: 2571609 - protein, 4 aa, Entamoeba histolytica
PTHE

SEQ ID NO: 2571610 - protein, 8 aa, Entamoeba histolytica
PTIPNSPY

SEQ ID NO: 2571611 - protein, 5 aa, Entamoeba histolytica
PTIPQ

SEQ ID NO: 2571612 - protein, 4 aa, Entamoeba histolytica
PTIS

SEQ ID NO: 2571613 - protein, 9 aa, Entamoeba histolytica
PTKDEEVGT

SEQ ID NO: 2571614 - protein, 6 aa, Entamoeba histolytica
PTKQHS

SEQ ID NO: 2571615 - protein, 11 aa, Entamoeba histolytica
PTKQPIDKHTS

SEQ ID NO: 2571616 - protein, 16 aa, Entamoeba histolytica
PTLENKRKIPNNNNAI

SEQ ID NO: 2571617 - protein, 30 aa, Entamoeba histolytica
PTLPNEKEITIEPQDVEENKNVSTKKKNIN

SEQ ID NO: 2571618 - protein, 6 aa, Entamoeba histolytica
PTLTES

SEQ ID NO: 2571619 - protein, 20 aa, Entamoeba histolytica
PTLTKPETPISNGGLDNENQ

SEQ ID NO: 2571620 - protein, 6 aa, Entamoeba histolytica
PTNDGA

SEQ ID NO: 2571621 - protein, 9 aa, Entamoeba histolytica
PTNGEPRSL

SEQ ID NO: 2571622 - protein, 8 aa, Entamoeba histolytica
PTNGSSSL

SEQ ID NO: 2571623 - protein, 8 aa, Entamoeba histolytica
PTNPADEI

SEQ ID NO: 2571624 - protein, 89 aa, Entamoeba histolytica
PTNPFDEPTTHTTTNPFDETPSNPISSTNPFDEPSSKSIPTTNPFDEPSAQQQSLSPKKSINPFENSYSPKRYQNKNTTIIPSQTQSLK

SEQ ID NO: 2571625 - protein, 4 aa, Entamoeba histolytica
PTNR

SEQ ID NO: 2571626 - protein, 4 aa, Entamoeba histolytica
PTPF

SEQ ID NO: 2571627 - protein, 5 aa, Entamoeba histolytica
PTPIE

SEQ ID NO: 2571628 - protein, 13 aa, Entamoeba histolytica
PTPKRTPSSRECF

SEQ ID NO: 2571629 - protein, 5 aa, Entamoeba histolytica
PTPPY

SEQ ID NO: 2571630 - protein, 6 aa, Entamoeba histolytica
PTPREK

SEQ ID NO: 2571631 - protein, 12 aa, Entamoeba histolytica
PTPSPTDTEEDM

SEQ ID NO: 2571632 - protein, 4 aa, Entamoeba histolytica
PTPT

SEQ ID NO: 2571633 - protein, 6 aa, Entamoeba histolytica
PTPYSG

SEQ ID NO: 2571634 - protein, 11 aa, Entamoeba histolytica
PTQAPAGSMCE

SEQ ID NO: 2571635 - protein, 6 aa, Entamoeba histolytica
PTQCPN

SEQ ID NO: 2571636 - protein, 8 aa, Entamoeba histolytica
PTQETTNS

SEQ ID NO: 2571637 - protein, 6 aa, Entamoeba histolytica
PTQPPI

SEQ ID NO: 2571638 - protein, 10 aa, Entamoeba histolytica
PTQYGTKTLN

SEQ ID NO: 2571639 - protein, 35 aa, Entamoeba histolytica
PTQYSNQPVQQPQVNQPVPQEKPNVDQSSMPAPTI

SEQ ID NO: 2571640 - protein, 5 aa, Entamoeba histolytica
PTRKG

SEQ ID NO: 2571641 - protein, 5 aa, Entamoeba histolytica
PTRNI

SEQ ID NO: 2571642 - protein, 7 aa, Entamoeba histolytica
PTRPDNA

SEQ ID NO: 2571643 - protein, 8 aa, Entamoeba histolytica
PTRPDNSV

SEQ ID NO: 2571644 - protein, 5 aa, Entamoeba histolytica
PTRPI

SEQ ID NO: 2571645 - protein, 6 aa, Entamoeba histolytica
PTRPQT

SEQ ID NO: 2571646 - protein, 6 aa, Entamoeba histolytica
PTRPYT

SEQ ID NO: 2571647 - protein, 10 aa, Entamoeba histolytica
PTRSSTGQFE

SEQ ID NO: 2571648 - protein, 4 aa, Entamoeba histolytica
PTSD

SEQ ID NO: 2571649 - protein, 14 aa, Entamoeba histolytica
PTSKPKKFKNQPSL

SEQ ID NO: 2571650 - protein, 4 aa, Entamoeba histolytica
PTSL

SEQ ID NO: 2571651 - protein, 10 aa, Entamoeba histolytica
PTSNTEDTVK

SEQ ID NO: 2571652 - protein, 5 aa, Entamoeba histolytica
PTSVE

SEQ ID NO: 2571653 - protein, 9 aa, Entamoeba histolytica
PTSYTTKTE

SEQ ID NO: 2571654 - protein, 4 aa, Entamoeba histolytica
PTTD

SEQ ID NO: 2571655 - protein, 7 aa, Entamoeba histolytica
PTTGALH

SEQ ID NO: 2571656 - protein, 7 aa, Entamoeba histolytica
PTTGLDS

SEQ ID NO: 2571657 - protein, 13 aa, Entamoeba histolytica
PTTPYTQNNYPIQ

SEQ ID NO: 2571658 - protein, 10 aa, Entamoeba histolytica
PTTSGKVPNQ

SEQ ID NO: 2571659 - protein, 9 aa, Entamoeba histolytica
PTTTSTEQF

SEQ ID NO: 2571660 - protein, 11 aa, Entamoeba histolytica
PTYNKTNSFTQ

SEQ ID NO: 2571661 - protein, 7 aa, Entamoeba histolytica
PTYNVPE

SEQ ID NO: 2571662 - protein, 9 aa, Entamoeba histolytica
PVDPSSENI

SEQ ID NO: 2571663 - protein, 6 aa, Entamoeba histolytica
PVEETK

SEQ ID NO: 2571664 - protein, 6 aa, Entamoeba histolytica
PVETGI

SEQ ID NO: 2571665 - protein, 29 aa, Entamoeba histolytica
PVETTSEEIPQSPRKGERSSPSLDGTKKI

SEQ ID NO: 2571666 - protein, 7 aa, Entamoeba histolytica
PVGDPKD

SEQ ID NO: 2571667 - protein, 5 aa, Entamoeba histolytica
PVGKS

SEQ ID NO: 2571668 - protein, 4 aa, Entamoeba histolytica
PVIK

SEQ ID NO: 2571669 - protein, 11 aa, Entamoeba histolytica
PVIKDDSEELD

SEQ ID NO: 2571670 - protein, 8 aa, Entamoeba histolytica
PVKGEKRK

SEQ ID NO: 2571671 - protein, 6 aa, Entamoeba histolytica
PVKPSP

SEQ ID NO: 2571672 - protein, 33 aa, Entamoeba histolytica
PVKTPESNLPVNETSALKSDKKLSNNNAIEDTV

SEQ ID NO: 2571673 - protein, 14 aa, Entamoeba histolytica
PVNEETIKNLKNTS

SEQ ID NO: 2571674 - protein, 4 aa, Entamoeba histolytica
PVNG

SEQ ID NO: 2571675 - protein, 6 aa, Entamoeba histolytica
PVNKEN

SEQ ID NO: 2571676 - protein, 24 aa, Entamoeba histolytica
PVPEIKDTKKQKKEETLKEEKGVI

SEQ ID NO: 2571677 - protein, 7 aa, Entamoeba histolytica
PVPEKDF

SEQ ID NO: 2571678 - protein, 6 aa, Entamoeba histolytica
PVPSES

SEQ ID NO: 2571679 - protein, 5 aa, Entamoeba histolytica
PVPSL

SEQ ID NO: 2571680 - protein, 13 aa, Entamoeba histolytica
PVQPEGFTEETSV

SEQ ID NO: 2571681 - protein, 29 aa, Entamoeba histolytica
PVRKNNNPQQTNQNEEEEMSEEEEEEESD

SEQ ID NO: 2571682 - protein, 9 aa, Entamoeba histolytica
PVSASESLR

SEQ ID NO: 2571683 - protein, 12 aa, Entamoeba histolytica
PVSASESLRGGG

SEQ ID NO: 2571684 - protein, 22 aa, Entamoeba histolytica
PVSKEPSATFTPKNGSTRQTPI

SEQ ID NO: 2571685 - protein, 27 aa, Entamoeba histolytica
PVSSNQQPTSSPLNQPTQQQPSNQSND

SEQ ID NO: 2571686 - protein, 7 aa, Entamoeba histolytica
PVTGSLR

SEQ ID NO: 2571687 - protein, 14 aa, Entamoeba histolytica
PWEGAQEGEDGKIV

SEQ ID NO: 2571688 - protein, 10 aa, Entamoeba histolytica
PYAQENEGQW

SEQ ID NO: 2571689 - protein, 12 aa, Entamoeba histolytica
PYDPEQFPDSES

SEQ ID NO: 2571690 - protein, 6 aa, Entamoeba histolytica
PYEDGY

SEQ ID NO: 2571691 - protein, 12 aa, Entamoeba histolytica
PYEDTNNQNNSN

SEQ ID NO: 2571692 - protein, 29 aa, Entamoeba histolytica
PYEQSKTQEEEEEYSVSSNGYTIQDNPIE

SEQ ID NO: 2571693 - protein, 4 aa, Entamoeba histolytica
PYGS

SEQ ID NO: 2571694 - protein, 4 aa, Entamoeba histolytica
PYHN

SEQ ID NO: 2571695 - protein, 4 aa, Entamoeba histolytica
PYHS

SEQ ID NO: 2571696 - protein, 4 aa, Entamoeba histolytica
PYHT

SEQ ID NO: 2571697 - protein, 10 aa, Entamoeba histolytica
PYLPNENDGY

SEQ ID NO: 2571698 - protein, 15 aa, Entamoeba histolytica
PYLTQPTQMNQETTM

SEQ ID NO: 2571699 - protein, 11 aa, Entamoeba histolytica
PYNESLDKTDA

SEQ ID NO: 2571700 - protein, 11 aa, Entamoeba histolytica
PYPDNENVANE

SEQ ID NO: 2571701 - protein, 4 aa, Entamoeba histolytica
PYPL

SEQ ID NO: 2571702 - protein, 13 aa, Entamoeba histolytica
PYPPQIDSYKGYD

SEQ ID NO: 2571703 - protein, 7 aa, Entamoeba histolytica
PYQEQSP

SEQ ID NO: 2571704 - protein, 6 aa, Entamoeba histolytica
PYQKED

SEQ ID NO: 2571705 - protein, 8 aa, Entamoeba histolytica
PYQQTEHP

SEQ ID NO: 2571706 - protein, 7 aa, Entamoeba histolytica
PYSQSGV

SEQ ID NO: 2571707 - protein, 9 aa, Entamoeba histolytica
PYSYPSNGK

SEQ ID NO: 2571708 - protein, 13 aa, Entamoeba histolytica
PYTARPKFGERTQ

SEQ ID NO: 2571709 - protein, 9 aa, Entamoeba histolytica
PYTPTDEDE

SEQ ID NO: 2571710 - protein, 9 aa, Entamoeba histolytica
QADFTSQKG

SEQ ID NO: 2571711 - protein, 4 aa, Entamoeba histolytica
QADS

SEQ ID NO: 2571712 - protein, 5 aa, Entamoeba histolytica
QADSF

SEQ ID NO: 2571713 - protein, 32 aa, Entamoeba histolytica; identical to SEQ ID NO: 2372794

SEQ ID NO: 2571714 - protein, 8 aa, Entamoeba histolytica
QAGTSGCE

SEQ ID NO: 2571715 - protein, 6 aa, Entamoeba histolytica
QAITPT

SEQ ID NO: 2571716 - protein, 4 aa, Entamoeba histolytica
QAKD

SEQ ID NO: 2571717 - protein, 8 aa, Entamoeba histolytica
QAKDAIQG

SEQ ID NO: 2571718 - protein, 5 aa, Entamoeba histolytica
QAKGV

SEQ ID NO: 2571719 - protein, 17 aa, Entamoeba histolytica
QAKPQGEKEIREKTGIE

SEQ ID NO: 2571720 - protein, 5 aa, Entamoeba histolytica
QALSC

SEQ ID NO: 2571721 - protein, 6 aa, Entamoeba histolytica
QALTNG

SEQ ID NO: 2571722 - protein, 16 aa, Entamoeba histolytica
QAMQRAGRAGREAPGQ

SEQ ID NO: 2571723 - protein, 6 aa, Entamoeba histolytica
QANDYY

SEQ ID NO: 2571724 - protein, 9 aa, Entamoeba histolytica
QANEESTKL

SEQ ID NO: 2571725 - protein, 10 aa, Entamoeba histolytica
QANQEPRVNH

SEQ ID NO: 2571726 - protein, 7 aa, Entamoeba histolytica
QANTLSS

SEQ ID NO: 2571727 - protein, 19 aa, Entamoeba histolytica
QANTTIAQGVSTDNSTLTN

SEQ ID NO: 2571728 - protein, 5 aa, Entamoeba histolytica
QAQNG

SEQ ID NO: 2571729 - protein, 14 aa, Entamoeba histolytica
QAQRSVDDEINRET

SEQ ID NO: 2571730 - protein, 6 aa, Entamoeba histolytica
QAQTTR

SEQ ID NO: 2571731 - protein, 8 aa, Entamoeba histolytica
QARPKKGL

SEQ ID NO: 2571732 - protein, 7 aa, Entamoeba histolytica
QARQDEQ

SEQ ID NO: 2571733 - protein, 5 aa, Entamoeba histolytica
QASEP

SEQ ID NO: 2571734 - protein, 5 aa, Entamoeba histolytica
QASHN

SEQ ID NO: 2571735 - protein, 9 aa, Entamoeba histolytica
QASSNDEAA

SEQ ID NO: 2571736 - protein, 8 aa, Entamoeba histolytica
QASSPDEI

SEQ ID NO: 2571737 - protein, 6 aa, Entamoeba histolytica
QATLTI

SEQ ID NO: 2571738 - protein, 6 aa, Entamoeba histolytica
QATRKN

SEQ ID NO: 2571739 - protein, 4 aa, Entamoeba histolytica
QATT

SEQ ID NO: 2571740 - protein, 5 aa, Entamoeba histolytica
QCDSC

SEQ ID NO: 2571741 - protein, 10 aa, Entamoeba histolytica
QCEEDELEEF

SEQ ID NO: 2571742 - protein, 6 aa, Entamoeba histolytica
QCEKCQ

SEQ ID NO: 2571743 - protein, 12 aa, Entamoeba histolytica
QCGKYNDKNIES

SEQ ID NO: 2571744 - protein, 10 aa, Entamoeba histolytica
QCHSSGSSSF

SEQ ID NO: 2571745 - protein, 12 aa, Entamoeba histolytica
QCNDSTTCQKCS

SEQ ID NO: 2571746 - protein, 12 aa, Entamoeba histolytica
QCNDYKQGYEID

SEQ ID NO: 2571747 - protein, 15 aa, Entamoeba histolytica
QCNEYKETQEDTVDG

SEQ ID NO: 2571748 - protein, 4 aa, Entamoeba histolytica
QCPS

SEQ ID NO: 2571749 - protein, 6 aa, Entamoeba histolytica
QCQSCS

SEQ ID NO: 2571750 - protein, 7 aa, Entamoeba histolytica
QCRNSTC

SEQ ID NO: 2571751 - protein, 4 aa, Entamoeba histolytica
QCSE

SEQ ID NO: 2571752 - protein, 13 aa, Entamoeba histolytica
QCSSATNVDLTNS

SEQ ID NO: 2571753 - protein, 9 aa, Entamoeba histolytica
QDAPTISLD

SEQ ID NO: 2571754 - protein, 14 aa, Entamoeba histolytica
QDAYCDKETGEIET

SEQ ID NO: 2571755 - protein, 6 aa, Entamoeba histolytica
QDCPNK

SEQ ID NO: 2571756 - protein, 24 aa, Entamoeba histolytica
QDDDSSESSLLTQNNETFPFIHPN

SEQ ID NO: 2571757 - protein, 12 aa, Entamoeba histolytica
QDDNRNNETQPL

SEQ ID NO: 2571758 - protein, 4 aa, Entamoeba histolytica
QDDQ

SEQ ID NO: 2571759 - protein, 12 aa, Entamoeba histolytica
QDDSQSDNDDHS

SEQ ID NO: 2571760 - protein, 7 aa, Entamoeba histolytica
QDEAIQQ

SEQ ID NO: 2571761 - protein, 7 aa, Entamoeba histolytica
QDENEKY

SEQ ID NO: 2571762 - protein, 7 aa, Entamoeba histolytica
QDGDLKL

SEQ ID NO: 2571763 - protein, 8 aa, Entamoeba histolytica
QDGKINNQ

SEQ ID NO: 2571764 - protein, 19 aa, Entamoeba histolytica
QDGKYSSDEQSCNKDCSEL

SEQ ID NO: 2571765 - protein, 7 aa, Entamoeba histolytica
QDGYNAT

SEQ ID NO: 2571766 - protein, 4 aa, Entamoeba histolytica
QDIE

SEQ ID NO: 2571767 - protein, 14 aa, Entamoeba histolytica
QDIETIRTNCLLRT

SEQ ID NO: 2571768 - protein, 5 aa, Entamoeba histolytica
QDIGH

SEQ ID NO: 2571769 - protein, 5 aa, Entamoeba histolytica
QDIGS

SEQ ID NO: 2571770 - protein, 13 aa, Entamoeba histolytica
QDINKDNSKNILP

SEQ ID NO: 2571771 - protein, 6 aa, Entamoeba histolytica
QDIPQK

SEQ ID NO: 2571772 - protein, 8 aa, Entamoeba histolytica
QDKESQCK

SEQ ID NO: 2571773 - protein, 5 aa, Entamoeba histolytica
QDKGV

SEQ ID NO: 2571774 - protein, 11 aa, Entamoeba histolytica
QDNGLASPEGI

SEQ ID NO: 2571775 - protein, 11 aa, Entamoeba histolytica
QDNGLSSPNGI

SEQ ID NO: 2571776 - protein, 4 aa, Entamoeba histolytica
QDNQ

SEQ ID NO: 2571777 - protein, 9 aa, Entamoeba histolytica
QDNQNNCQP

SEQ ID NO: 2571778 - protein, 11 aa, Entamoeba histolytica
QDNRLSSPNGV

SEQ ID NO: 2571779 - protein, 21 aa, Entamoeba histolytica
QDNSECIKKDGNCSLADQAGC

SEQ ID NO: 2571780 - protein, 11 aa, Entamoeba histolytica
QDNSLGSPNGI

SEQ ID NO: 2571781 - protein, 12 aa, Entamoeba histolytica
QDNTITYSGDVP

SEQ ID NO: 2571782 - protein, 7 aa, Entamoeba histolytica
QDPNIEI

SEQ ID NO: 2571783 - protein, 9 aa, Entamoeba histolytica
QDPRDRPSF

SEQ ID NO: 2571784 - protein, 6 aa, Entamoeba histolytica
QDPSAR

SEQ ID NO: 2571785 - protein, 20 aa, Entamoeba histolytica
QDPSKQLGSVSVDDTSDDYV

SEQ ID NO: 2571786 - protein, 5 aa, Entamoeba histolytica
QDPSL

SEQ ID NO: 2571787 - protein, 11 aa, Entamoeba histolytica
QDQDVNTPTKG

SEQ ID NO: 2571788 - protein, 7 aa, Entamoeba histolytica
QDRTKKL

SEQ ID NO: 2571789 - protein, 9 aa, Entamoeba histolytica
QDSNTFDYE

SEQ ID NO: 2571790 - protein, 21 aa, Entamoeba histolytica
QDSVDKEGKVGELRRKANDQA

SEQ ID NO: 2571791 - protein, 17 aa, Entamoeba histolytica
QDTIANQEQADKVENLA

SEQ ID NO: 2571792 - protein, 10 aa, Entamoeba histolytica
QDTSEAPATT

SEQ ID NO: 2571793 - protein, 14 aa, Entamoeba histolytica
QDVDEGLTQPTLPT

SEQ ID NO: 2571794 - protein, 4 aa, Entamoeba histolytica
QDVN

SEQ ID NO: 2571795 - protein, 9 aa, Entamoeba histolytica
QDVNSAETF

SEQ ID NO: 2571796 - protein, 4 aa, Entamoeba histolytica
QDYN

SEQ ID NO: 2571797 - protein, 8 aa, Entamoeba histolytica
QDYTPKEC

SEQ ID NO: 2571798 - protein, 7 aa, Entamoeba histolytica
QDYYSTE

SEQ ID NO: 2571799 - protein, 11 aa, Entamoeba histolytica
QEADKRPTATE

SEQ ID NO: 2571800 - protein, 4 aa, Entamoeba histolytica
QEAG

SEQ ID NO: 2571801 - protein, 222 aa, Entamoeba histolytica
QEAKETGNSNQGSGKKTEDSEEKDDKHVDGGKQNDGETNTPKAEPKEVSNTEEKVTGNEKEEEQGNSNDSKKEEAKKEQEKTKESGEGDSEKKHDIPTNEGKENKDTTKDKNDKEEKKDTNEEGESSGKEGQKTNEESKKETENPQNNESSNKEEEQKKEEEKKKEEEQKKEEEQKKEEEQNQEKPINEKNEQKENKTTNTSDNSGTKVDDKTDEHNNLDGA

SEQ ID NO: 2571802 - protein, 8 aa, Entamoeba histolytica
QEAMPTDP

SEQ ID NO: 2571803 - protein, 5 aa, Entamoeba histolytica
QEARK

SEQ ID NO: 2571804 - protein, 35 aa, Entamoeba histolytica
QEAVQSSMQKPEEKVVSERGNTESNKVNDESVNPV

SEQ ID NO: 2571805 - protein, 6 aa, Entamoeba histolytica
QECDSG

SEQ ID NO: 2571806 - protein, 14 aa, Entamoeba histolytica
QECGSNGKCSPYSG

SEQ ID NO: 2571807 - protein, 27 aa, Entamoeba histolytica
QECNNTNGKCKNCPTGYGYNSKKGSCT

SEQ ID NO: 2571808 - protein, 6 aa, Entamoeba histolytica
QEDKYQ

SEQ ID NO: 2571809 - protein, 15 aa, Entamoeba histolytica
QEDRKRKEGKSKYTE

SEQ ID NO: 2571810 - protein, 7 aa, Entamoeba histolytica
QEDSLQT

SEQ ID NO: 2571811 - protein, 13 aa, Entamoeba histolytica
QEEAQTPKKTCQQ

SEQ ID NO: 2571812 - protein, 9 aa, Entamoeba histolytica
QEEDKNHLD

SEQ ID NO: 2571813 - protein, 9 aa, Entamoeba histolytica
QEEEKRTGS

SEQ ID NO: 2571814 - protein, 11 aa, Entamoeba histolytica
QEELKERQEYS

SEQ ID NO: 2571815 - protein, 6 aa, Entamoeba histolytica
QEEMNK

SEQ ID NO: 2571816 - protein, 13 aa, Entamoeba histolytica
QEENEEQNTHSIT

SEQ ID NO: 2571817 - protein, 39 aa, Entamoeba histolytica
QEESDRTGESYETIKQSTDRIKSSLNTQNDISETLNTSK

SEQ ID NO: 2571818 - protein, 6 aa, Entamoeba histolytica
QEFEEK

SEQ ID NO: 2571819 - protein, 18 aa, Entamoeba histolytica
QEGETKNKYALTPDDDGN

SEQ ID NO: 2571820 - protein, 20 aa, Entamoeba histolytica
QEGITQRISESTTTNSEDYL

SEQ ID NO: 2571821 - protein, 5 aa, Entamoeba histolytica
QEGLK

SEQ ID NO: 2571822 - protein, 20 aa, Entamoeba histolytica
QEIEKEPTPTNQEDQDTMNK

SEQ ID NO: 2571823 - protein, 5 aa, Entamoeba histolytica
QEIND

SEQ ID NO: 2571824 - protein, 5 aa, Entamoeba histolytica
QEINT

SEQ ID NO: 2571825 - protein, 7 aa, Entamoeba histolytica
QEIQNTK

SEQ ID NO: 2571826 - protein, 8 aa, Entamoeba histolytica
QEIQPGGG

SEQ ID NO: 2571827 - protein, 5 aa, Entamoeba histolytica
QEKDT

SEQ ID NO: 2571828 - protein, 6 aa, Entamoeba histolytica
QEKEEY

SEQ ID NO: 2571829 - protein, 4 aa, Entamoeba histolytica
QEKG

SEQ ID NO: 2571830 - protein, 5 aa, Entamoeba histolytica
QEKGT

SEQ ID NO: 2571831 - protein, 12 aa, Entamoeba histolytica
QEKIEEQSSNTI

SEQ ID NO: 2571832 - protein, 23 aa, Entamoeba histolytica
QEKQREREEQKKLQELEEENDLR

SEQ ID NO: 2571833 - protein, 4 aa, Entamoeba histolytica
QEKY

SEQ ID NO: 2571834 - protein, 9 aa, Entamoeba histolytica
QEKYKKEAD

SEQ ID NO: 2571835 - protein, 5 aa, Entamoeba histolytica
QEKYQ

SEQ ID NO: 2571836 - protein, 8 aa, Entamoeba histolytica
QEKYTESA

SEQ ID NO: 2571837 - protein, 10 aa, Entamoeba histolytica
QELKKRSDEL

SEQ ID NO: 2571838 - protein, 14 aa, Entamoeba histolytica
QELRQNKMKKEEGI

SEQ ID NO: 2571839 - protein, 9 aa, Entamoeba histolytica
QELTEKTDV

SEQ ID NO: 2571840 - protein, 6 aa, Entamoeba histolytica
QELTKQ

SEQ ID NO: 2571841 - protein, 4 aa, Entamoeba histolytica
QELY

SEQ ID NO: 2571842 - protein, 7 aa, Entamoeba histolytica
QEMKDGC

SEQ ID NO: 2571843 - protein, 7 aa, Entamoeba histolytica
QEMSDGV

SEQ ID NO: 2571844 - protein, 6 aa, Entamoeba histolytica
QEMTDG

SEQ ID NO: 2571845 - protein, 5 aa, Entamoeba histolytica
QENCK

SEQ ID NO: 2571846 - protein, 6 aa, Entamoeba histolytica
QENDEY

SEQ ID NO: 2571847 - protein, 5 aa, Entamoeba histolytica
QENDP

SEQ ID NO: 2571848 - protein, 4 aa, Entamoeba histolytica
QENK

SEQ ID NO: 2571849 - protein, 6 aa, Entamoeba histolytica
QENKKE

SEQ ID NO: 2571850 - protein, 6 aa, Entamoeba histolytica
QENKQQ

SEQ ID NO: 2571851 - protein, 8 aa, Entamoeba histolytica
QENKSIKS

SEQ ID NO: 2571852 - protein, 6 aa, Entamoeba histolytica
QENLGY

SEQ ID NO: 2571853 - protein, 8 aa, Entamoeba histolytica
QENNERSK

SEQ ID NO: 2571854 - protein, 7 aa, Entamoeba histolytica
QENNKCK

SEQ ID NO: 2571855 - protein, 19 aa, Entamoeba histolytica
QENNNNRDEFGNKEYNSVK

SEQ ID NO: 2571856 - protein, 8 aa, Entamoeba histolytica
QENPTKEY

SEQ ID NO: 2571857 - protein, 17 aa, Entamoeba histolytica
QENQGKTNMMKTNNSGK

SEQ ID NO: 2571858 - protein, 6 aa, Entamoeba histolytica
QENQTI

SEQ ID NO: 2571859 - protein, 6 aa, Entamoeba histolytica
QENREL

SEQ ID NO: 2571860 - protein, 7 aa, Entamoeba histolytica
QENTEQI

SEQ ID NO: 2571861 - protein, 7 aa, Entamoeba histolytica
QEPDPQS

SEQ ID NO: 2571862 - protein, 8 aa, Entamoeba histolytica
QEPNERPN

SEQ ID NO: 2571863 - protein, 9 aa, Entamoeba histolytica
QEPNQRPNF

SEQ ID NO: 2571864 - protein, 12 aa, Entamoeba histolytica
QEPNSQSTSEFN

SEQ ID NO: 2571865 - protein, 7 aa, Entamoeba histolytica
QEPTKIN

SEQ ID NO: 2571866 - protein, 5 aa, Entamoeba histolytica
QEPTS

SEQ ID NO: 2571867 - protein, 7 aa, Entamoeba histolytica
QEQKEGH

SEQ ID NO: 2571868 - protein, 6 aa, Entamoeba histolytica
QEQYSN

SEQ ID NO: 2571869 - protein, 6 aa, Entamoeba histolytica
QERFEE

SEQ ID NO: 2571870 - protein, 8 aa, Entamoeba histolytica
QERKEPIP

SEQ ID NO: 2571871 - protein, 12 aa, Entamoeba histolytica
QESENSNGFNSR

SEQ ID NO: 2571872 - protein, 14 aa, Entamoeba histolytica
QESGRAGRDGKPSD

SEQ ID NO: 2571873 - protein, 33 aa, Entamoeba histolytica
QESNVTPFGGYANNKVNGKYNSDSNQNKSPGSL

SEQ ID NO: 2571874 - protein, 19 aa, Entamoeba histolytica
QESSKRIKAEEIISCLEAV

SEQ ID NO: 2571875 - protein, 8 aa, Entamoeba histolytica
QESTTNRM

SEQ ID NO: 2571876 - protein, 9 aa, Entamoeba histolytica
QETALPQDS

SEQ ID NO: 2571877 - protein, 7 aa, Entamoeba histolytica
QETGKRI

SEQ ID NO: 2571878 - protein, 6 aa, Entamoeba histolytica
QETIER

SEQ ID NO: 2571879 - protein, 6 aa, Entamoeba histolytica
QETIEY

SEQ ID NO: 2571880 - protein, 8 aa, Entamoeba histolytica
QETISEQN

SEQ ID NO: 2571881 - protein, 5 aa, Entamoeba histolytica
QETSR

SEQ ID NO: 2571882 - protein, 5 aa, Entamoeba histolytica
QETTD

SEQ ID NO: 2571883 - protein, 7 aa, Entamoeba histolytica
QETTDVA

SEQ ID NO: 2571884 - protein, 10 aa, Entamoeba histolytica
QEVKNENEFK

SEQ ID NO: 2571885 - protein, 6 aa, Entamoeba histolytica
QEYEKR

SEQ ID NO: 2571886 - protein, 11 aa, Entamoeba histolytica
QEYIQEQQSNL

SEQ ID NO: 2571887 - protein, 13 aa, Entamoeba histolytica
QEYKEEQKKLKHS

SEQ ID NO: 2571888 - protein, 9 aa, Entamoeba histolytica
QFAKGKSVT

SEQ ID NO: 2571889 - protein, 5 aa, Entamoeba histolytica
QFDDS

SEQ ID NO: 2571890 - protein, 9 aa, Entamoeba histolytica
QFDGGENDR

SEQ ID NO: 2571891 - protein, 12 aa, Entamoeba histolytica
QFDGPFGDLLNS

SEQ ID NO: 2571892 - protein, 6 aa, Entamoeba histolytica
QFDRTL

SEQ ID NO: 2571893 - protein, 7 aa, Entamoeba histolytica
QFDTDNR

SEQ ID NO: 2571894 - protein, 20 aa, Entamoeba histolytica
QFEDTSNQQTQQVSAGQQIG

SEQ ID NO: 2571895 - protein, 6 aa, Entamoeba histolytica
QFENED

SEQ ID NO: 2571896 - protein, 8 aa, Entamoeba histolytica
QFGTGSRW

SEQ ID NO: 2571897 - protein, 18 aa, Entamoeba histolytica
QFKDSSSAIIPKQSKGLS

SEQ ID NO: 2571898 - protein, 18 aa, Entamoeba histolytica
QFNDTSFSQDIENKQREI

SEQ ID NO: 2571899 - protein, 9 aa, Entamoeba histolytica
QFNGKSRWR

SEQ ID NO: 2571900 - protein, 8 aa, Entamoeba histolytica
QFNQGSCG

SEQ ID NO: 2571901 - protein, 9 aa, Entamoeba histolytica
QFSNENEKH

SEQ ID NO: 2571902 - protein, 5 aa, Entamoeba histolytica
QFSPE

SEQ ID NO: 2571903 - protein, 8 aa, Entamoeba histolytica
QFTEAKSA

SEQ ID NO: 2571904 - protein, 15 aa, Entamoeba histolytica
QFTGYNKDDSKVIDE

SEQ ID NO: 2571905 - protein, 7 aa, Entamoeba histolytica
QGAAATG

SEQ ID NO: 2571906 - protein, 6 aa, Entamoeba histolytica
QGAKLE

SEQ ID NO: 2571907 - protein, 5 aa, Entamoeba histolytica
QGASA

SEQ ID NO: 2571908 - protein, 6 aa, Entamoeba histolytica
QGATSV

SEQ ID NO: 2571909 - protein, 4 aa, Entamoeba histolytica
QGCN

SEQ ID NO: 2571910 - protein, 9 aa, Entamoeba histolytica
QGCPYTKDD

SEQ ID NO: 2571911 - protein, 5 aa, Entamoeba histolytica
QGCQN

SEQ ID NO: 2571912 - protein, 7 aa, Entamoeba histolytica
QGDGKHR

SEQ ID NO: 2571913 - protein, 12 aa, Entamoeba histolytica
QGEIKEITEEVR

SEQ ID NO: 2571914 - protein, 14 aa, Entamoeba histolytica
QGEIKELTEEVRQE

SEQ ID NO: 2571915 - protein, 8 aa, Entamoeba histolytica
QGEKRNDY

SEQ ID NO: 2571916 - protein, 10 aa, Entamoeba histolytica
QGEPTNRGGH

SEQ ID NO: 2571917 - protein, 9 aa, Entamoeba histolytica
QGEQRENTV

SEQ ID NO: 2571918 - protein, 4 aa, Entamoeba histolytica
QGFD

SEQ ID NO: 2571919 - protein, 4 aa, Entamoeba histolytica
QGGK

SEQ ID NO: 2571920 - protein, 10 aa, Entamoeba histolytica
QGIDPNSGET

SEQ ID NO: 2571921 - protein, 7 aa, Entamoeba histolytica
QGINETR

SEQ ID NO: 2571922 - protein, 8 aa, Entamoeba histolytica
QGKEIEKT

SEQ ID NO: 2571923 - protein, 18 aa, Entamoeba histolytica
QGKEKDAWKSFPSGHSAA

SEQ ID NO: 2571924 - protein, 6 aa, Entamoeba histolytica
QGKSKE

SEQ ID NO: 2571925 - protein, 14 aa, Entamoeba histolytica
QGKTQYSPRLNPEE

SEQ ID NO: 2571926 - protein, 8 aa, Entamoeba histolytica
QGLDKRRV

SEQ ID NO: 2571927 - protein, 5 aa, Entamoeba histolytica
QGLGG

SEQ ID NO: 2571928 - protein, 8 aa, Entamoeba histolytica
QGNAYGED

SEQ ID NO: 2571929 - protein, 13 aa, Entamoeba histolytica
QGNEANVERVQTN

SEQ ID NO: 2571930 - protein, 8 aa, Entamoeba histolytica
QGNEEQMK

SEQ ID NO: 2571931 - protein, 8 aa, Entamoeba histolytica
QGNKTTNV

SEQ ID NO: 2571932 - protein, 5 aa, Entamoeba histolytica
QGPKN

SEQ ID NO: 2571933 - protein, 4 aa, Entamoeba histolytica
QGPN

SEQ ID NO: 2571934 - protein, 8 aa, Entamoeba histolytica
QGQEYAKR

SEQ ID NO: 2571935 - protein, 5 aa, Entamoeba histolytica
QGRKD

SEQ ID NO: 2571936 - protein, 7 aa, Entamoeba histolytica
QGSEHYP

SEQ ID NO: 2571937 - protein, 18 aa, Entamoeba histolytica
QGSISSNYDINDDSENIV

SEQ ID NO: 2571938 - protein, 14 aa, Entamoeba histolytica
QGSSDQPISVPNED

SEQ ID NO: 2571939 - protein, 5 aa, Entamoeba histolytica
QGTEG

SEQ ID NO: 2571940 - protein, 14 aa, Entamoeba histolytica
QGTLKIDHSINQYL

SEQ ID NO: 2571941 - protein, 9 aa, Entamoeba histolytica
QGTSSSCGF

SEQ ID NO: 2571942 - protein, 6 aa, Entamoeba histolytica
QGVIPQ

SEQ ID NO: 2571943 - protein, 350 aa, Entamoeba histolytica
QHEEQGASGPAGSKQEQPQSIAASNESHNDVSPKSVSGQKVPGSTISPPSGEPAKTVSSSTDSPQSQAGSLPPNNLSHEGEESPAQVLPQSGVPTGTEHSEQTQAGASPAAPQEKSKETAQGVASSGTTKEGTETVPATPKGIDTQTAGTSSTETHPGTTGTGVAPPAPTKESPTTKPPTSTEPQQPPSKDTVSGQSSTTTSGAEQKPSAGSQTPSSSNQDKSQDSLPLPTPQDTQPSGTNPSTTPGQTIPSDKPPSTGQTPAQTDGQQGKPTPSETTNPTPNTPVKSDDSPDSNPVQPNNQQPESPSNNQQNKQQNETVSPHLPNTSETTNGTENNNVNKTNDDLNNHN

SEQ ID NO: 2571944 - protein, 10 aa, Entamoeba histolytica
QHKSSDRPTF

SEQ ID NO: 2571945 - protein, 5 aa, Entamoeba histolytica
QHNDT

SEQ ID NO: 2571946 - protein, 9 aa, Entamoeba histolytica
QHNKNSQNA

SEQ ID NO: 2571947 - protein, 5 aa, Entamoeba histolytica
QHPEM

SEQ ID NO: 2571948 - protein, 6 aa, Entamoeba histolytica
QHSSRM

SEQ ID NO: 2571949 - protein, 5 aa, Entamoeba histolytica
QHTNR

SEQ ID NO: 2571950 - protein, 7 aa, Entamoeba histolytica
QHTYESD

SEQ ID NO: 2571951 - protein, 5 aa, Entamoeba histolytica
QIASG

SEQ ID NO: 2571952 - protein, 12 aa, Entamoeba histolytica
QIDKNENKMTEF

SEQ ID NO: 2571953 - protein, 9 aa, Entamoeba histolytica
QIEDNKPGT

SEQ ID NO: 2571954 - protein, 8 aa, Entamoeba histolytica
QIEEERKS

SEQ ID NO: 2571955 - protein, 14 aa, Entamoeba histolytica
QIEENEDKKKEFEK

SEQ ID NO: 2571956 - protein, 14 aa, Entamoeba histolytica
QIEESEDKKKEFEK

SEQ ID NO: 2571957 - protein, 12 aa, Entamoeba histolytica
QIEKSEDKLKEF

SEQ ID NO: 2571958 - protein, 5 aa, Entamoeba histolytica
QIEQT

SEQ ID NO: 2571959 - protein, 11 aa, Entamoeba histolytica
QIESTSSIGNS

SEQ ID NO: 2571960 - protein, 11 aa, Entamoeba histolytica
QIETENIENNE

SEQ ID NO: 2571961 - protein, 5 aa, Entamoeba histolytica
QIETH

SEQ ID NO: 2571962 - protein, 9 aa, Entamoeba histolytica
QIGEGSTGI

SEQ ID NO: 2571963 - protein, 7 aa, Entamoeba histolytica
QIGEGTF

SEQ ID NO: 2571964 - protein, 11 aa, Entamoeba histolytica
QIGERGEHKNI

SEQ ID NO: 2571965 - protein, 5 aa, Entamoeba histolytica
QIGET

SEQ ID NO: 2571966 - protein, 16 aa, Entamoeba histolytica
QIGGSTDNKDEPKSFN

SEQ ID NO: 2571967 - protein, 4 aa, Entamoeba histolytica
QIGN

SEQ ID NO: 2571968 - protein, 10 aa, Entamoeba histolytica
QIHPPDNNSS

SEQ ID NO: 2571969 - protein, 5 aa, Entamoeba histolytica
QIING

SEQ ID NO: 2571970 - protein, 7 aa, Entamoeba histolytica
QIKKENH

SEQ ID NO: 2571971 - protein, 9 aa, Entamoeba histolytica
QIKKSKKIK

SEQ ID NO: 2571972 - protein, 10 aa, Entamoeba histolytica
QIKPSVDNDT

SEQ ID NO: 2571973 - protein, 8 aa, Entamoeba histolytica
QIKTTGSD

SEQ ID NO: 2571974 - protein, 11 aa, Entamoeba histolytica
QINDAKQIGGT

SEQ ID NO: 2571975 - protein, 7 aa, Entamoeba histolytica
QINGNNN

SEQ ID NO: 2571976 - protein, 5 aa, Entamoeba histolytica
QINND

SEQ ID NO: 2571977 - protein, 7 aa, Entamoeba histolytica
QINNETK

SEQ ID NO: 2571978 - protein, 5 aa, Entamoeba histolytica
QINNT

SEQ ID NO: 2571979 - protein, 6 aa, Entamoeba histolytica
QINPTE

SEQ ID NO: 2571980 - protein, 10 aa, Entamoeba histolytica
QINSNGKEEI

SEQ ID NO: 2571981 - protein, 13 aa, Entamoeba histolytica
QIPEADNLKSING

SEQ ID NO: 2571982 - protein, 8 aa, Entamoeba histolytica
QIPPQSDF

SEQ ID NO: 2571983 - protein, 5 aa, Entamoeba histolytica
QIPQT

SEQ ID NO: 2571984 - protein, 6 aa, Entamoeba histolytica
QIPSES

SEQ ID NO: 2571985 - protein, 5 aa, Entamoeba histolytica
QIPSM

SEQ ID NO: 2571986 - protein, 7 aa, Entamoeba histolytica
QIPSSLR

SEQ ID NO: 2571987 - protein, 8 aa, Entamoeba histolytica
QIQPSELN

SEQ ID NO: 2571988 - protein, 5 aa, Entamoeba histolytica
QIQPT

SEQ ID NO: 2571989 - protein, 13 aa, Entamoeba histolytica
QIQQPANSLTEKK

SEQ ID NO: 2571990 - protein, 7 aa, Entamoeba histolytica
QIRKEED

SEQ ID NO: 2571991 - protein, 11 aa, Entamoeba histolytica
QIRKESQTHKV

SEQ ID NO: 2571992 - protein, 13 aa, Entamoeba histolytica
QIRKRNKKERGNN

SEQ ID NO: 2571993 - protein, 8 aa, Entamoeba histolytica
QISEPNDP

SEQ ID NO: 2571994 - protein, 19 aa, Entamoeba histolytica
QISNRGNLNLQGAQSGKIF

SEQ ID NO: 2571995 - protein, 5 aa, Entamoeba histolytica
QISPK

SEQ ID NO: 2571996 - protein, 10 aa, Entamoeba histolytica
QITEQYDTTS

SEQ ID NO: 2571997 - protein, 26 aa, Entamoeba histolytica
QITKRQKNETIDKNSNDEGILKEEPK

SEQ ID NO: 2571998 - protein, 12 aa, Entamoeba histolytica
QITPREISTNEF

SEQ ID NO: 2571999 - protein, 10 aa, Entamoeba histolytica
QITPTGDSQP

SEQ ID NO: 2572000 - protein, 24 aa, Entamoeba histolytica
QKAQDNPEDLTTSPTKTNQVKSNS

SEQ ID NO: 2572001 - protein, 8 aa, Entamoeba histolytica
QKASNAEV

SEQ ID NO: 2572002 - protein, 8 aa, Entamoeba histolytica
QKATDSSC

SEQ ID NO: 2572003 - protein, 12 aa, Entamoeba histolytica
QKDEGTLKTMNE

SEQ ID NO: 2572004 - protein, 9 aa, Entamoeba histolytica
QKDESGNLS

SEQ ID NO: 2572005 - protein, 9 aa, Entamoeba histolytica
QKDETNNLS

SEQ ID NO: 2572006 - protein, 7 aa, Entamoeba histolytica
QKDHSSL

SEQ ID NO: 2572007 - protein, 23 aa, Entamoeba histolytica
QKDNKQGIPKKKNIQKQVKTAPL

SEQ ID NO: 2572008 - protein, 9 aa, Entamoeba histolytica
QKDPSKRIT

SEQ ID NO: 2572009 - protein, 33 aa, Entamoeba histolytica
QKEETSQKDSLSNFENTNVKSNTTTPEKKVTMK

SEQ ID NO: 2572010 - protein, 9 aa, Entamoeba histolytica
QKEGYEEFN

SEQ ID NO: 2572011 - protein, 15 aa, Entamoeba histolytica
QKEISNECPKSVPSE

SEQ ID NO: 2572012 - protein, 9 aa, Entamoeba histolytica
QKEKVEDDN

SEQ ID NO: 2572013 - protein, 4 aa, Entamoeba histolytica
QKEL

SEQ ID NO: 2572014 - protein, 13 aa, Entamoeba histolytica
QKELKKEVEENDV

SEQ ID NO: 2572015 - protein, 18 aa, Entamoeba histolytica
QKENEELRADKKRLEESI

SEQ ID NO: 2572016 - protein, 8 aa, Entamoeba histolytica
QKENSFAK

SEQ ID NO: 2572017 - protein, 19 aa, Entamoeba histolytica
QKEQEKLQGDEETYERETT

SEQ ID NO: 2572018 - protein, 56 aa, Entamoeba histolytica
QKEQSGISKESSSHEDRSTSSSRKKADSIYQDETSSLNSRGSKALSNTKKNKTKMS

SEQ ID NO: 2572019 - protein, 8 aa, Entamoeba histolytica
QKERTARA

SEQ ID NO: 2572020 - protein, 7 aa, Entamoeba histolytica
QKETDNN

SEQ ID NO: 2572021 - protein, 13 aa, Entamoeba histolytica
QKETDREQRETEY

SEQ ID NO: 2572022 - protein, 8 aa, Entamoeba histolytica
QKETGNTI

SEQ ID NO: 2572023 - protein, 8 aa, Entamoeba histolytica
QKEVERNV

SEQ ID NO: 2572024 - protein, 10 aa, Entamoeba histolytica
QKEVKSSQLL

SEQ ID NO: 2572025 - protein, 7 aa, Entamoeba histolytica
QKFTSKA

SEQ ID NO: 2572026 - protein, 4 aa, Entamoeba histolytica
QKGD

SEQ ID NO: 2572027 - protein, 9 aa, Entamoeba histolytica
QKGEAIPAQ

SEQ ID NO: 2572028 - protein, 22 aa, Entamoeba histolytica
QKGHSETEKCDCTRTHNKYSEI

SEQ ID NO: 2572029 - protein, 9 aa, Entamoeba histolytica
QKGKNTYIQ

SEQ ID NO: 2572030 - protein, 4 aa, Entamoeba histolytica
QKGL

SEQ ID NO: 2572031 - protein, 8 aa, Entamoeba histolytica
QKGNTTTC

SEQ ID NO: 2572032 - protein, 8 aa, Entamoeba histolytica
QKGNVKET

SEQ ID NO: 2572033 - protein, 6 aa, Entamoeba histolytica
QKGQNL

SEQ ID NO: 2572034 - protein, 12 aa, Entamoeba histolytica
QKHNKNDDSEEC

SEQ ID NO: 2572035 - protein, 6 aa, Entamoeba histolytica
QKIEQV

SEQ ID NO: 2572036 - protein, 12 aa, Entamoeba histolytica
QKITNNETKEKK

SEQ ID NO: 2572037 - protein, 16 aa, Entamoeba histolytica
QKKEEGSTKENTDDID

SEQ ID NO: 2572038 - protein, 8 aa, Entamoeba histolytica
QKKENRKV

SEQ ID NO: 2572039 - protein, 8 aa, Entamoeba histolytica
QKKERKEE

SEQ ID NO: 2572040 - protein, 6 aa, Entamoeba histolytica
QKKGQW

SEQ ID NO: 2572041 - protein, 9 aa, Entamoeba histolytica
QKKKELNTN

SEQ ID NO: 2572042 - protein, 10 aa, Entamoeba histolytica
QKKKETKHLP

SEQ ID NO: 2572043 - protein, 6 aa, Entamoeba histolytica
QKKQEK

SEQ ID NO: 2572044 - protein, 7 aa, Entamoeba histolytica
QKKQRGI

SEQ ID NO: 2572045 - protein, 9 aa, Entamoeba histolytica
QKKSPEQAL

SEQ ID NO: 2572046 - protein, 8 aa, Entamoeba histolytica
QKKSSCKA

SEQ ID NO: 2572047 - protein, 10 aa, Entamoeba histolytica
QKKTLRNEKQ

SEQ ID NO: 2572048 - protein, 5 aa, Entamoeba histolytica
QKKVI

SEQ ID NO: 2572049 - protein, 9 aa, Entamoeba histolytica
QKLDDATYD

SEQ ID NO: 2572050 - protein, 7 aa, Entamoeba histolytica
QKLLGKT

SEQ ID NO: 2572051 - protein, 5 aa, Entamoeba histolytica
QKLSE

SEQ ID NO: 2572052 - protein, 17 aa, Entamoeba histolytica
QKLSTESNDEKKVSEVD

SEQ ID NO: 2572053 - protein, 11 aa, Entamoeba histolytica
QKLTEATSGSL

SEQ ID NO: 2572054 - protein, 28 aa, Entamoeba histolytica
QKMKEEEDRIAQKRHEKYVKRREKNPPF

SEQ ID NO: 2572055 - protein, 10 aa, Entamoeba histolytica
QKNDEKVSSE

SEQ ID NO: 2572056 - protein, 4 aa, Entamoeba histolytica
QKNE

SEQ ID NO: 2572057 - protein, 10 aa, Entamoeba histolytica
QKNETNDTTH

SEQ ID NO: 2572058 - protein, 5 aa, Entamoeba histolytica
QKNKF

SEQ ID NO: 2572059 - protein, 6 aa, Entamoeba histolytica
QKNKNV

SEQ ID NO: 2572060 - protein, 7 aa, Entamoeba histolytica
QKNKSNL

SEQ ID NO: 2572061 - protein, 8 aa, Entamoeba histolytica
QKNNTTSL

SEQ ID NO: 2572062 - protein, 21 aa, Entamoeba histolytica
QKNPEKISEIDENEREAVADK

SEQ ID NO: 2572063 - protein, 19 aa, Entamoeba histolytica
QKNSARKASTITGNPQDVV

SEQ ID NO: 2572064 - protein, 5 aa, Entamoeba histolytica
QKNSI

SEQ ID NO: 2572065 - protein, 9 aa, Entamoeba histolytica
QKPDERPKF

SEQ ID NO: 2572066 - protein, 7 aa, Entamoeba histolytica
QKPEERL

SEQ ID NO: 2572067 - protein, 9 aa, Entamoeba histolytica
QKPERRPGF

SEQ ID NO: 2572068 - protein, 5 aa, Entamoeba histolytica
QKPKY

SEQ ID NO: 2572069 - protein, 6 aa, Entamoeba histolytica
QKPLNG

SEQ ID NO: 2572070 - protein, 65 aa, Entamoeba histolytica
QKPLPPPPAKPSLSLSSQQEFNTQKPLPTPLPKSVSSVGYANGYPPQPSLYSSSQQYPPSQYTNL

SEQ ID NO: 2572071 - protein, 12 aa, Entamoeba histolytica
QKPNERPTFKEA

SEQ ID NO: 2572072 - protein, 7 aa, Entamoeba histolytica
QKPSERP

SEQ ID NO: 2572073 - protein, 9 aa, Entamoeba histolytica
QKPSSCKRA

SEQ ID NO: 2572074 - protein, 4 aa, Entamoeba histolytica
QKPT

SEQ ID NO: 2572075 - protein, 4 aa, Entamoeba histolytica
QKQE

SEQ ID NO: 2572076 - protein, 9 aa, Entamoeba histolytica
QKQHGKVGG

SEQ ID NO: 2572077 - protein, 371 aa, Entamoeba histolytica
QKQLTEENKGIKESKKQAKQQAIKEAEEKAKKEAEEKARKEAEEKARKEAEEKARQEAEEKARLEAEEKARQEAKEKAKKEAEEKARQEAEEKARQEAEEKARLEAEEKARQEAEEKARQEAEEKARQEAEEKARQEAEEKARQEAEEKARQEAEEKARQEAEEKARQEAEEKARQEAEEKARQEAEEKARLEAEEKARQEAEEKARKEAEEKARQEAEEKARQEAEEKARKEAEEKARKEAEEKARKEAEEKARKEAEEKARQEAEEKARKEAEEKARQEAKEKAKKEAEEKARQEAEEKARQEAEEKARKEKSEQAKKEAKEKAKKEAKKEAKKEAKKQQLKQRGDIKKKVEEVKEKDSKEVITPKNDS

SEQ ID NO: 2572078 - protein, 6 aa, Entamoeba histolytica
QKQQSS

SEQ ID NO: 2572079 - protein, 8 aa, Entamoeba histolytica
QKQSNPLS

SEQ ID NO: 2572080 - protein, 6 aa, Entamoeba histolytica
QKQTTT

SEQ ID NO: 2572081 - protein, 9 aa, Entamoeba histolytica
QKREWNSKS

SEQ ID NO: 2572082 - protein, 4 aa, Entamoeba histolytica
QKRH

SEQ ID NO: 2572083 - protein, 7 aa, Entamoeba histolytica
QKRNGIK

SEQ ID NO: 2572084 - protein, 9 aa, Entamoeba histolytica
QKRPPQRGG

SEQ ID NO: 2572085 - protein, 6 aa, Entamoeba histolytica
QKSCKS

SEQ ID NO: 2572086 - protein, 5 aa, Entamoeba histolytica
QKSMT

SEQ ID NO: 2572087 - protein, 8 aa, Entamoeba histolytica
QKSNETTI

SEQ ID NO: 2572088 - protein, 13 aa, Entamoeba histolytica
QKSPLHSPPNGRV

SEQ ID NO: 2572089 - protein, 10 aa, Entamoeba histolytica
QKSPTNRKYI

SEQ ID NO: 2572090 - protein, 6 aa, Entamoeba histolytica
QKSSNI

SEQ ID NO: 2572091 - protein, 6 aa, Entamoeba histolytica
QKSYPL

SEQ ID NO: 2572092 - protein, 7 aa, Entamoeba histolytica
QKTGSEH

SEQ ID NO: 2572093 - protein, 5 aa, Entamoeba histolytica
QKTLS

SEQ ID NO: 2572094 - protein, 4 aa, Entamoeba histolytica
QKTN

SEQ ID NO: 2572095 - protein, 8 aa, Entamoeba histolytica
QKTPKNCE

SEQ ID NO: 2572096 - protein, 7 aa, Entamoeba histolytica
QKTSLTP

SEQ ID NO: 2572097 - protein, 8 aa, Entamoeba histolytica
QKTSNDNS

SEQ ID NO: 2572098 - protein, 8 aa, Entamoeba histolytica
QKTTQKVD

SEQ ID NO: 2572099 - protein, 8 aa, Entamoeba histolytica
QKTWVSSE

SEQ ID NO: 2572100 - protein, 15 aa, Entamoeba histolytica
QKVEERKQNAKPYED

SEQ ID NO: 2572101 - protein, 14 aa, Entamoeba histolytica
QKVEVARESNVQID

SEQ ID NO: 2572102 - protein, 6 aa, Entamoeba histolytica
QKYDDS

SEQ ID NO: 2572103 - protein, 11 aa, Entamoeba histolytica
QKYGNGYCSKY

SEQ ID NO: 2572104 - protein, 8 aa, Entamoeba histolytica
QKYKKTAD

SEQ ID NO: 2572105 - protein, 6 aa, Entamoeba histolytica
QKYPRT

SEQ ID NO: 2572106 - protein, 8 aa, Entamoeba histolytica
QKYSRGND

SEQ ID NO: 2572107 - protein, 13 aa, Entamoeba histolytica
QKYTTNKVSNTRT

SEQ ID NO: 2572108 - protein, 5 aa, Entamoeba histolytica
QLANK

SEQ ID NO: 2572109 - protein, 5 aa, Entamoeba histolytica
QLDAK

SEQ ID NO: 2572110 - protein, 8 aa, Entamoeba histolytica
QLDGETDW

SEQ ID NO: 2572111 - protein, 11 aa, Entamoeba histolytica
QLDSENKTKLI

SEQ ID NO: 2572112 - protein, 28 aa, Entamoeba histolytica
QLEGELNAATQKLTKELSTDKKEVNVDD

SEQ ID NO: 2572113 - protein, 4 aa, Entamoeba histolytica
QLES

SEQ ID NO: 2572114 - protein, 8 aa, Entamoeba histolytica
QLGNTQTA

SEQ ID NO: 2572115 - protein, 6 aa, Entamoeba histolytica
QLKEKG

SEQ ID NO: 2572116 - protein, 5 aa, Entamoeba histolytica
QLKNN

SEQ ID NO: 2572117 - protein, 14 aa, Entamoeba histolytica
QLKNPWGKTKTIEG

SEQ ID NO: 2572118 - protein, 14 aa, Entamoeba histolytica
QLKNPWGKTKTLEG

SEQ ID NO: 2572119 - protein, 10 aa, Entamoeba histolytica
QLKQEKENID

SEQ ID NO: 2572120 - protein, 9 aa, Entamoeba histolytica
QLKTSANYL

SEQ ID NO: 2572121 - protein, 6 aa, Entamoeba histolytica
QLNNGQ

SEQ ID NO: 2572122 - protein, 6 aa, Entamoeba histolytica
QLPEPN

SEQ ID NO: 2572123 - protein, 6 aa, Entamoeba histolytica
QLPPGF

SEQ ID NO: 2572124 - protein, 4 aa, Entamoeba histolytica
QLPS

SEQ ID NO: 2572125 - protein, 86 aa, Entamoeba histolytica
QLPSDQTPEKQYHNEHQPLPDKQEPSAPQDGKDNQQPNKKPEDGNDNQQKDGNKEIDNKTTSSSDSSDNKQDDDRNNYNNDDGTTS

SEQ ID NO: 2572126 - protein, 86 aa, Entamoeba histolytica
QLPSDQTPEKQYHNEHQPLPDKQEPSAPQDGNDNQQPNKKPEDGNDNQQKDGNKEIDNKTTSSSDSSDNKQDDDRNNYNNDDGTTS

SEQ ID NO: 2572127 - protein, 14 aa, Entamoeba histolytica
QLQRGDDPEDGSIE

SEQ ID NO: 2572128 - protein, 11 aa, Entamoeba histolytica
QLRNNAPKGSI

SEQ ID NO: 2572129 - protein, 4 aa, Entamoeba histolytica
QLSD

SEQ ID NO: 2572130 - protein, 12 aa, Entamoeba histolytica
QLSKSSENSTLD

SEQ ID NO: 2572131 - protein, 5 aa, Entamoeba histolytica
QLSQP

SEQ ID NO: 2572132 - protein, 8 aa, Entamoeba histolytica
QLSSDEYK

SEQ ID NO: 2572133 - protein, 8 aa, Entamoeba histolytica
QLSSSNRQ

SEQ ID NO: 2572134 - protein, 8 aa, Entamoeba histolytica
QLTAQDYS

SEQ ID NO: 2572135 - protein, 10 aa, Entamoeba histolytica
QLTNASEISI

SEQ ID NO: 2572136 - protein, 10 aa, Entamoeba histolytica
QLTNQSYQNC

SEQ ID NO: 2572137 - protein, 9 aa, Entamoeba histolytica
QLTQNPIQI

SEQ ID NO: 2572138 - protein, 6 aa, Entamoeba histolytica
QLTTQT

SEQ ID NO: 2572139 - protein, 8 aa, Entamoeba histolytica
QMKAEAAG

SEQ ID NO: 2572140 - protein, 14 aa, Entamoeba histolytica
QMKKEKTKPKEVSD

SEQ ID NO: 2572141 - protein, 6 aa, Entamoeba histolytica
QMKTST

SEQ ID NO: 2572142 - protein, 10 aa, Entamoeba histolytica
QMQKDKNYCN

SEQ ID NO: 2572143 - protein, 8 aa, Entamoeba histolytica
QMQSTNDR

SEQ ID NO: 2572144 - protein, 4 aa, Entamoeba histolytica
QMSD

SEQ ID NO: 2572145 - protein, 17 aa, Entamoeba histolytica
QMSGRAGRFGIDEKGES

SEQ ID NO: 2572146 - protein, 10 aa, Entamoeba histolytica
QMSSPEKEQY

SEQ ID NO: 2572147 - protein, 5 aa, Entamoeba histolytica
QMSTR

SEQ ID NO: 2572148 - protein, 20 aa, Entamoeba histolytica
QMTQPYNPVTNQNEIKTPPT

SEQ ID NO: 2572149 - protein, 16 aa, Entamoeba histolytica
QNAEEYTAKSAMEIDK

SEQ ID NO: 2572150 - protein, 4 aa, Entamoeba histolytica
QNAG

SEQ ID NO: 2572151 - protein, 7 aa, Entamoeba histolytica
QNAPRGR

SEQ ID NO: 2572152 - protein, 9 aa, Entamoeba histolytica
QNAQTNNEN

SEQ ID NO: 2572153 - protein, 6 aa, Entamoeba histolytica
QNATGG

SEQ ID NO: 2572154 - protein, 5 aa, Entamoeba histolytica
QNCSS

SEQ ID NO: 2572155 - protein, 14 aa, Entamoeba histolytica
QNDCIGDGKQVKEE

SEQ ID NO: 2572156 - protein, 14 aa, Entamoeba histolytica
QNDKEKIKSIPRGN

SEQ ID NO: 2572157 - protein, 6 aa, Entamoeba histolytica
QNDPID

SEQ ID NO: 2572158 - protein, 7 aa, Entamoeba histolytica
QNDSKSF

SEQ ID NO: 2572159 - protein, 9 aa, Entamoeba histolytica
QNDSTLEEL

SEQ ID NO: 2572160 - protein, 18 aa, Entamoeba histolytica
QNDTGYYIPEGSQTCQPC

SEQ ID NO: 2572161 - protein, 5 aa, Entamoeba histolytica
QNDVK

SEQ ID NO: 2572162 - protein, 14 aa, Entamoeba histolytica
QNECIDDGKQIKEE

SEQ ID NO: 2572163 - protein, 9 aa, Entamoeba histolytica
QNECNPNNK

SEQ ID NO: 2572164 - protein, 6 aa, Entamoeba histolytica
QNEEAE

SEQ ID NO: 2572165 - protein, 8 aa, Entamoeba histolytica
QNEEFNEE

SEQ ID NO: 2572166 - protein, 5 aa, Entamoeba histolytica
QNEEP

SEQ ID NO: 2572167 - protein, 7 aa, Entamoeba histolytica
QNEEYNQ

SEQ ID NO: 2572168 - protein, 34 aa, Entamoeba histolytica
QNEGEENDGFGGYTTYEPETCEPRKTLSTPEKIG

SEQ ID NO: 2572169 - protein, 8 aa, Entamoeba histolytica
QNENPNET

SEQ ID NO: 2572170 - protein, 9 aa, Entamoeba histolytica
QNEPEKEVE

SEQ ID NO: 2572171 - protein, 16 aa, Entamoeba histolytica
QNESITPQLEPHTDAV

SEQ ID NO: 2572172 - protein, 6 aa, Entamoeba histolytica
QNESLT

SEQ ID NO: 2572173 - protein, 5 aa, Entamoeba histolytica
QNFGD

SEQ ID NO: 2572174 - protein, 10 aa, Entamoeba histolytica
QNGAGKTTTI

SEQ ID NO: 2572175 - protein, 8 aa, Entamoeba histolytica
QNGCQSSI

SEQ ID NO: 2572176 - protein, 4 aa, Entamoeba histolytica
QNGF

SEQ ID NO: 2572177 - protein, 10 aa, Entamoeba histolytica
QNGRGYSSEF

SEQ ID NO: 2572178 - protein, 9 aa, Entamoeba histolytica
QNGVTSDGQ

SEQ ID NO: 2572179 - protein, 22 aa, Entamoeba histolytica
QNHSYSTPAIVGSPSVEYTKEE

SEQ ID NO: 2572180 - protein, 4 aa, Entamoeba histolytica
QNIF

SEQ ID NO: 2572181 - protein, 7 aa, Entamoeba histolytica
QNIKSNK

SEQ ID NO: 2572182 - protein, 4 aa, Entamoeba histolytica
QNIN

SEQ ID NO: 2572183 - protein, 11 aa, Entamoeba histolytica
QNISEENPVTI

SEQ ID NO: 2572184 - protein, 9 aa, Entamoeba histolytica
QNKEAPKDC

SEQ ID NO: 2572185 - protein, 6 aa, Entamoeba histolytica
QNKEIT

SEQ ID NO: 2572186 - protein, 6 aa, Entamoeba histolytica
QNKEKE

SEQ ID NO: 2572187 - protein, 8 aa, Entamoeba histolytica
QNKENTNA

SEQ ID NO: 2572188 - protein, 8 aa, Entamoeba histolytica
QNKEYPIQ

SEQ ID NO: 2572189 - protein, 12 aa, Entamoeba histolytica
QNKGDRPNFEQV

SEQ ID NO: 2572190 - protein, 7 aa, Entamoeba histolytica
QNKHPPI

SEQ ID NO: 2572191 - protein, 4 aa, Entamoeba histolytica
QNKL

SEQ ID NO: 2572192 - protein, 5 aa, Entamoeba histolytica
QNKNS

SEQ ID NO: 2572193 - protein, 47 aa, Entamoeba histolytica
QNKNSNNSISTIEEKEETQDNQKEIPEEKEEKTEDVEKSTKETGQNQ

SEQ ID NO: 2572194 - protein, 9 aa, Entamoeba histolytica
QNKPSTMYS

SEQ ID NO: 2572195 - protein, 6 aa, Entamoeba histolytica
QNKRPN

SEQ ID NO: 2572196 - protein, 6 aa, Entamoeba histolytica
QNKSNT

SEQ ID NO: 2572197 - protein, 8 aa, Entamoeba histolytica
QNKTLAPY

SEQ ID NO: 2572198 - protein, 6 aa, Entamoeba histolytica
QNLEGG

SEQ ID NO: 2572199 - protein, 15 aa, Entamoeba histolytica
QNLQRLQSTTKSPRL

SEQ ID NO: 2572200 - protein, 8 aa, Entamoeba histolytica
QNMNSDKK

SEQ ID NO: 2572201 - protein, 13 aa, Entamoeba histolytica
QNNCQWNSSLLYC

SEQ ID NO: 2572202 - protein, 12 aa, Entamoeba histolytica
QNNDPPKYSYSP

SEQ ID NO: 2572203 - protein, 5 aa, Entamoeba histolytica
QNNGI

SEQ ID NO: 2572204 - protein, 10 aa, Entamoeba histolytica
QNNGNISQIN

SEQ ID NO: 2572205 - protein, 13 aa, Entamoeba histolytica
QNNGNRECYNTND

SEQ ID NO: 2572206 - protein, 8 aa, Entamoeba histolytica
QNNIPIPT

SEQ ID NO: 2572207 - protein, 10 aa, Entamoeba histolytica
QNNLNRTSGF

SEQ ID NO: 2572208 - protein, 18 aa, Entamoeba histolytica
QNNNEESNEENEKEEEIG

SEQ ID NO: 2572209 - protein, 16 aa, Entamoeba histolytica
QNNNGTCESTTGKCQY

SEQ ID NO: 2572210 - protein, 9 aa, Entamoeba histolytica
QNNNQHNNQ

SEQ ID NO: 2572211 - protein, 5 aa, Entamoeba histolytica
QNNPK

SEQ ID NO: 2572212 - protein, 9 aa, Entamoeba histolytica
QNNTKREDN

SEQ ID NO: 2572213 - protein, 5 aa, Entamoeba histolytica
QNPED

SEQ ID NO: 2572214 - protein, 6 aa, Entamoeba histolytica
QNPKDR

SEQ ID NO: 2572215 - protein, 7 aa, Entamoeba histolytica
QNPKDRY

SEQ ID NO: 2572216 - protein, 10 aa, Entamoeba histolytica
QNPKERYNSN

SEQ ID NO: 2572217 - protein, 4 aa, Entamoeba histolytica
QNPQ

SEQ ID NO: 2572218 - protein, 7 aa, Entamoeba histolytica
QNPQDRL

SEQ ID NO: 2572219 - protein, 6 aa, Entamoeba histolytica
QNPSDW

SEQ ID NO: 2572220 - protein, 10 aa, Entamoeba histolytica
QNPSESLKAN

SEQ ID NO: 2572221 - protein, 6 aa, Entamoeba histolytica
QNPSYN

SEQ ID NO: 2572222 - protein, 6 aa, Entamoeba histolytica
QNPTHI

SEQ ID NO: 2572223 - protein, 13 aa, Entamoeba histolytica
QNPTHNSSLLFAS

SEQ ID NO: 2572224 - protein, 7 aa, Entamoeba histolytica
QNPYHSD

SEQ ID NO: 2572225 - protein, 4 aa, Entamoeba histolytica
QNQI

SEQ ID NO: 2572226 - protein, 35 aa, Entamoeba histolytica
QNQLQNKSNDEISSNQIVSTDTPIPISNESPSSIQ

SEQ ID NO: 2572227 - protein, 6 aa, Entamoeba histolytica
QNQTTF

SEQ ID NO: 2572228 - protein, 5 aa, Entamoeba histolytica
QNQTY

SEQ ID NO: 2572229 - protein, 8 aa, Entamoeba histolytica
QNQVSGQD

SEQ ID NO: 2572230 - protein, 5 aa, Entamoeba histolytica
QNREQ

SEQ ID NO: 2572231 - protein, 17 aa, Entamoeba histolytica
QNRTGTVDINGEPKRPQ

SEQ ID NO: 2572232 - protein, 4 aa, Entamoeba histolytica
QNSA

SEQ ID NO: 2572233 - protein, 8 aa, Entamoeba histolytica
QNSEYNTL

SEQ ID NO: 2572234 - protein, 5 aa, Entamoeba histolytica
QNSLN

SEQ ID NO: 2572235 - protein, 4 aa, Entamoeba histolytica
QNSP

SEQ ID NO: 2572236 - protein, 6 aa, Entamoeba histolytica
QNSQWG

SEQ ID NO: 2572237 - protein, 14 aa, Entamoeba histolytica
QNSSDTTGKEYSYQ

SEQ ID NO: 2572238 - protein, 14 aa, Entamoeba histolytica
QNSSHYENKPFTTT

SEQ ID NO: 2572239 - protein, 5 aa, Entamoeba histolytica
QNSYG

SEQ ID NO: 2572240 - protein, 5 aa, Entamoeba histolytica
QNTIS

SEQ ID NO: 2572241 - protein, 13 aa, Entamoeba histolytica
QNTKKDKEVKEYD

SEQ ID NO: 2572242 - protein, 5 aa, Entamoeba histolytica
QNTLP

SEQ ID NO: 2572243 - protein, 8 aa, Entamoeba histolytica
QNTPKDSK

SEQ ID NO: 2572244 - protein, 8 aa, Entamoeba histolytica
QNTSRSET

SEQ ID NO: 2572245 - protein, 5 aa, Entamoeba histolytica
QNTTI

SEQ ID NO: 2572246 - protein, 13 aa, Entamoeba histolytica
QNTYEQEDCSSSY

SEQ ID NO: 2572247 - protein, 4 aa, Entamoeba histolytica
QNVP

SEQ ID NO: 2572248 - protein, 77 aa, Entamoeba histolytica
QNVQGKTKQQQTKGGKDEKQKQGKTKEEKKEGQLKGDGIPQLSNKELKALKKQQKHDKKAAKLGENNQQLKTGESQV

SEQ ID NO: 2572249 - protein, 6 aa, Entamoeba histolytica
QNVQQP

SEQ ID NO: 2572250 - protein, 13 aa, Entamoeba histolytica
QNVRPKNSMCSNA

SEQ ID NO: 2572251 - protein, 6 aa, Entamoeba histolytica
QNYGTA

SEQ ID NO: 2572252 - protein, 8 aa, Entamoeba histolytica
QNYKEASS

SEQ ID NO: 2572253 - protein, 4 aa, Entamoeba histolytica
QNYP

SEQ ID NO: 2572254 - protein, 9 aa, Entamoeba histolytica
QNYQERKAE

SEQ ID NO: 2572255 - protein, 9 aa, Entamoeba histolytica
QNYSSKSFH

SEQ ID NO: 2572256 - protein, 9 aa, Entamoeba histolytica
QPAKVRPNS

SEQ ID NO: 2572257 - protein, 5 aa, Entamoeba histolytica
QPANV

SEQ ID NO: 2572258 - protein, 6 aa, Entamoeba histolytica
QPDTFN

SEQ ID NO: 2572259 - protein, 8 aa, Entamoeba histolytica
QPEEKRDD

SEQ ID NO: 2572260 - protein, 5 aa, Entamoeba histolytica
QPEGM

SEQ ID NO: 2572261 - protein, 8 aa, Entamoeba histolytica
QPEKESSS

SEQ ID NO: 2572262 - protein, 15 aa, Entamoeba histolytica
QPEKSQRDQNNPMTP

SEQ ID NO: 2572263 - protein, 6 aa, Entamoeba histolytica
QPFDSI

SEQ ID NO: 2572264 - protein, 4 aa, Entamoeba histolytica
QPFE

SEQ ID NO: 2572265 - protein, 6 aa, Entamoeba histolytica
QPFSKY

SEQ ID NO: 2572266 - protein, 9 aa, Entamoeba histolytica
QPGSSEYVT

SEQ ID NO: 2572267 - protein, 9 aa, Entamoeba histolytica
QPHNSNQIA

SEQ ID NO: 2572268 - protein, 5 aa, Entamoeba histolytica
QPHSI

SEQ ID NO: 2572269 - protein, 11 aa, Entamoeba histolytica
QPIAEGASGTV

SEQ ID NO: 2572270 - protein, 10 aa, Entamoeba histolytica
QPIDNPNSDL

SEQ ID NO: 2572271 - protein, 6 aa, Entamoeba histolytica
QPIESH

SEQ ID NO: 2572272 - protein, 48 aa, Entamoeba histolytica
QPIKEESIKEESTKEESTKEESTKEEPVKEEPVKEEPIKTEEDKPELI

SEQ ID NO: 2572273 - protein, 7 aa, Entamoeba histolytica
QPIQSSY

SEQ ID NO: 2572274 - protein, 26 aa, Entamoeba histolytica
QPKDNYSTTTGLSKKDKSKSLPHRRG

SEQ ID NO: 2572275 - protein, 7 aa, Entamoeba histolytica
QPKENIK

SEQ ID NO: 2572276 - protein, 4 aa, Entamoeba histolytica
QPKH

SEQ ID NO: 2572277 - protein, 12 aa, Entamoeba histolytica
QPKKKKAKDNNM

SEQ ID NO: 2572278 - protein, 9 aa, Entamoeba histolytica
QPKKSGGVH

SEQ ID NO: 2572279 - protein, 6 aa, Entamoeba histolytica
QPKSQL

SEQ ID NO: 2572280 - protein, 8 aa, Entamoeba histolytica
QPKTPTPQ

SEQ ID NO: 2572281 - protein, 11 aa, Entamoeba histolytica
QPLNTPTRSKT

SEQ ID NO: 2572282 - protein, 9 aa, Entamoeba histolytica
QPLPVETES

SEQ ID NO: 2572283 - protein, 5 aa, Entamoeba histolytica
QPMSG

SEQ ID NO: 2572284 - protein, 5 aa, Entamoeba histolytica
QPNEN

SEQ ID NO: 2572285 - protein, 12 aa, Entamoeba histolytica
QPNENQMKHTTS

SEQ ID NO: 2572286 - protein, 6 aa, Entamoeba histolytica
QPNETL

SEQ ID NO: 2572287 - protein, 5 aa, Entamoeba histolytica
QPNGD

SEQ ID NO: 2572288 - protein, 6 aa, Entamoeba histolytica
QPNKDS

SEQ ID NO: 2572289 - protein, 9 aa, Entamoeba histolytica
QPNKSNKPI

SEQ ID NO: 2572290 - protein, 7 aa, Entamoeba histolytica
QPNSNFD

SEQ ID NO: 2572291 - protein, 6 aa, Entamoeba histolytica
QPPEER

SEQ ID NO: 2572292 - protein, 4 aa, Entamoeba histolytica
QPPF

SEQ ID NO: 2572293 - protein, 7 aa, Entamoeba histolytica
QPPIGEG

SEQ ID NO: 2572294 - protein, 4 aa, Entamoeba histolytica
QPPN

SEQ ID NO: 2572295 - protein, 9 aa, Entamoeba histolytica
QPPQNTPQI

SEQ ID NO: 2572296 - protein, 5 aa, Entamoeba histolytica
QPPQR

SEQ ID NO: 2572297 - protein, 12 aa, Entamoeba histolytica
QPPSGDSISRAE

SEQ ID NO: 2572298 - protein, 13 aa, Entamoeba histolytica
QPPSYQEYSRQNI

SEQ ID NO: 2572299 - protein, 12 aa, Entamoeba histolytica
QPQEPVDKSLQN

SEQ ID NO: 2572300 - protein, 6 aa, Entamoeba histolytica
QPQPQI

SEQ ID NO: 2572301 - protein, 13 aa, Entamoeba histolytica
QPQSPTNISSSME

SEQ ID NO: 2572302 - protein, 23 aa, Entamoeba histolytica
QPSEPSKESLNDHKNDDKPTEEI

SEQ ID NO: 2572303 - protein, 8 aa, Entamoeba histolytica
QPSKKRFS

SEQ ID NO: 2572304 - protein, 6 aa, Entamoeba histolytica
QPSKRR

SEQ ID NO: 2572305 - protein, 6 aa, Entamoeba histolytica
QPSNAQ

SEQ ID NO: 2572306 - protein, 5 aa, Entamoeba histolytica
QPSSI

SEQ ID NO: 2572307 - protein, 7 aa, Entamoeba histolytica
QPSYNQN

SEQ ID NO: 2572308 - protein, 22 aa, Entamoeba histolytica
QPTDECDPTNSTIDSDDGKVIT

SEQ ID NO: 2572309 - protein, 4 aa, Entamoeba histolytica
QPTL

SEQ ID NO: 2572310 - protein, 7 aa, Entamoeba histolytica
QPTNEVQ

SEQ ID NO: 2572311 - protein, 13 aa, Entamoeba histolytica
QPTPIKQNINTNE

SEQ ID NO: 2572312 - protein, 9 aa, Entamoeba histolytica
QPTQNCNEN

SEQ ID NO: 2572313 - protein, 6 aa, Entamoeba histolytica
QPTSSY

SEQ ID NO: 2572314 - protein, 17 aa, Entamoeba histolytica
QPVYSSNTPGCEQNEYG

SEQ ID NO: 2572315 - protein, 4 aa, Entamoeba histolytica
QPYL

SEQ ID NO: 2572316 - protein, 7 aa, Entamoeba histolytica
QPYPTPL

SEQ ID NO: 2572317 - protein, 8 aa, Entamoeba histolytica
QQAPTDPQ

SEQ ID NO: 2572318 - protein, 8 aa, Entamoeba histolytica
QQAQNNNQ

SEQ ID NO: 2572319 - protein, 5 aa, Entamoeba histolytica
QQAQS

SEQ ID NO: 2572320 - protein, 12 aa, Entamoeba histolytica
QQDEETENPDDI

SEQ ID NO: 2572321 - protein, 8 aa, Entamoeba histolytica
QQDERNKQ

SEQ ID NO: 2572322 - protein, 7 aa, Entamoeba histolytica
QQDPTMS

SEQ ID NO: 2572323 - protein, 7 aa, Entamoeba histolytica
QQEHHNK

SEQ ID NO: 2572324 - protein, 9 aa, Entamoeba histolytica
QQEKHDEFE

SEQ ID NO: 2572325 - protein, 5 aa, Entamoeba histolytica
QQELK

SEQ ID NO: 2572326 - protein, 6 aa, Entamoeba histolytica
QQESCE

SEQ ID NO: 2572327 - protein, 5 aa, Entamoeba histolytica
QQESE

SEQ ID NO: 2572328 - protein, 6 aa, Entamoeba histolytica
QQESLN

SEQ ID NO: 2572329 - protein, 7 aa, Entamoeba histolytica
QQGEWES

SEQ ID NO: 2572330 - protein, 6 aa, Entamoeba histolytica
QQGGPK

SEQ ID NO: 2572331 - protein, 7 aa, Entamoeba histolytica
QQGITEY

SEQ ID NO: 2572332 - protein, 7 aa, Entamoeba histolytica
QQGKMES

SEQ ID NO: 2572333 - protein, 16 aa, Entamoeba histolytica
QQGQLPKELYEEAQKT

SEQ ID NO: 2572334 - protein, 6 aa, Entamoeba histolytica
QQGSHE

SEQ ID NO: 2572335 - protein, 38 aa, Entamoeba histolytica
QQIKSPKTLLTTEEKTEQTSSQSNNSSTKYKKTNNQID

SEQ ID NO: 2572336 - protein, 12 aa, Entamoeba histolytica
QQKDIQQTQECT

SEQ ID NO: 2572337 - protein, 6 aa, Entamoeba histolytica
QQKEDQ

SEQ ID NO: 2572338 - protein, 7 aa, Entamoeba histolytica
QQKGELL

SEQ ID NO: 2572339 - protein, 6 aa, Entamoeba histolytica
QQKIGS

SEQ ID NO: 2572340 - protein, 25 aa, Entamoeba histolytica
QQKNEEINKPTIETDDKEEKQIPPE

SEQ ID NO: 2572341 - protein, 8 aa, Entamoeba histolytica
QQKNRQVR

SEQ ID NO: 2572342 - protein, 9 aa, Entamoeba histolytica
QQKQNTSIQ

SEQ ID NO: 2572343 - protein, 10 aa, Entamoeba histolytica
QQKSDKKQKN

SEQ ID NO: 2572344 - protein, 10 aa, Entamoeba histolytica
QQKTESPLYH

SEQ ID NO: 2572345 - protein, 8 aa, Entamoeba histolytica
QQLDPDQQ

SEQ ID NO: 2572346 - protein, 8 aa, Entamoeba histolytica
QQLTPSTI

SEQ ID NO: 2572347 - protein, 4 aa, Entamoeba histolytica
QQNI

SEQ ID NO: 2572348 - protein, 8 aa, Entamoeba histolytica
QQNNDNES

SEQ ID NO: 2572349 - protein, 16 aa, Entamoeba histolytica
QQNSQTENKQESPIAN

SEQ ID NO: 2572350 - protein, 8 aa, Entamoeba histolytica
QQNTPTSF

SEQ ID NO: 2572351 - protein, 8 aa, Entamoeba histolytica
QQPAEQAP

SEQ ID NO: 2572352 - protein, 11 aa, Entamoeba histolytica
QQPDKRLSPSE

SEQ ID NO: 2572353 - protein, 11 aa, Entamoeba histolytica
QQPETKEEEDP

SEQ ID NO: 2572354 - protein, 5 aa, Entamoeba histolytica
QQPID

SEQ ID NO: 2572355 - protein, 9 aa, Entamoeba histolytica
QQPLNRPKI

SEQ ID NO: 2572356 - protein, 4 aa, Entamoeba histolytica
QQPQ

SEQ ID NO: 2572357 - protein, 13 aa, Entamoeba histolytica
QQPSKITNNTRGH

SEQ ID NO: 2572358 - protein, 10 aa, Entamoeba histolytica
QQPSYLGPQQ

SEQ ID NO: 2572359 - protein, 7 aa, Entamoeba histolytica
QQPTYEA

SEQ ID NO: 2572360 - protein, 16 aa, Entamoeba histolytica
QQQASNLDKLNDENSN

SEQ ID NO: 2572361 - protein, 5 aa, Entamoeba histolytica
QQQDT

SEQ ID NO: 2572362 - protein, 10 aa, Entamoeba histolytica
QQQEKQQQQI

SEQ ID NO: 2572363 - protein, 8 aa, Entamoeba histolytica
QQQGKEKV

SEQ ID NO: 2572364 - protein, 6 aa, Entamoeba histolytica
QQQKKF

SEQ ID NO: 2572365 - protein, 8 aa, Entamoeba histolytica
QQQKKIKE

SEQ ID NO: 2572366 - protein, 13 aa, Entamoeba histolytica
QQQKTKKDIHSED

SEQ ID NO: 2572367 - protein, 8 aa, Entamoeba histolytica
QQQPETFE

SEQ ID NO: 2572368 - protein, 6 aa, Entamoeba histolytica
QQQPIE

SEQ ID NO: 2572369 - protein, 5 aa, Entamoeba histolytica
QQQPN

SEQ ID NO: 2572370 - protein, 5 aa, Entamoeba histolytica
QQQPQ

SEQ ID NO: 2572371 - protein, 6 aa, Entamoeba histolytica
QQQPTY

SEQ ID NO: 2572372 - protein, 6 aa, Entamoeba histolytica
QQQTFH

SEQ ID NO: 2572373 - protein, 10 aa, Entamoeba histolytica
QQSDKIKKQK

SEQ ID NO: 2572374 - protein, 8 aa, Entamoeba histolytica
QQSFDNQQ

SEQ ID NO: 2572375 - protein, 5 aa, Entamoeba histolytica
QQSIQ

SEQ ID NO: 2572376 - protein, 10 aa, Entamoeba histolytica
QQSNKELDSQ

SEQ ID NO: 2572377 - protein, 11 aa, Entamoeba histolytica
QQSNQQLENEE

SEQ ID NO: 2572378 - protein, 14 aa, Entamoeba histolytica
QQSSLSESSKEKEK

SEQ ID NO: 2572379 - protein, 9 aa, Entamoeba histolytica
QQSSSNVTE

SEQ ID NO: 2572380 - protein, 6 aa, Entamoeba histolytica
QQSTLR

SEQ ID NO: 2572381 - protein, 13 aa, Entamoeba histolytica
QQSTNGYENDRNK

SEQ ID NO: 2572382 - protein, 4 aa, Entamoeba histolytica
QQSY

SEQ ID NO: 2572383 - protein, 12 aa, Entamoeba histolytica
QQTGYTNKTIPT

SEQ ID NO: 2572384 - protein, 13 aa, Entamoeba histolytica
QQTHSTQENSEQT

SEQ ID NO: 2572385 - protein, 5 aa, Entamoeba histolytica
QQTID

SEQ ID NO: 2572386 - protein, 8 aa, Entamoeba histolytica
QQTLSTNS

SEQ ID NO: 2572387 - protein, 12 aa, Entamoeba histolytica
QQTNSLEKEIEP

SEQ ID NO: 2572388 - protein, 6 aa, Entamoeba histolytica
QQTTEK

SEQ ID NO: 2572389 - protein, 5 aa, Entamoeba histolytica
QQVSC

SEQ ID NO: 2572390 - protein, 15 aa, Entamoeba histolytica
QRAEKAVREKLTESM

SEQ ID NO: 2572391 - protein, 11 aa, Entamoeba histolytica
QRAYKKKKGVV

SEQ ID NO: 2572392 - protein, 5 aa, Entamoeba histolytica
QRCSV

SEQ ID NO: 2572393 - protein, 7 aa, Entamoeba histolytica
QRDETNP

SEQ ID NO: 2572394 - protein, 12 aa, Entamoeba histolytica
QRDSKTNQYKKE

SEQ ID NO: 2572395 - protein, 5 aa, Entamoeba histolytica
QREAF

SEQ ID NO: 2572396 - protein, 10 aa, Entamoeba histolytica
QRENELRKGS

SEQ ID NO: 2572397 - protein, 21 aa, Entamoeba histolytica
QRETNKQAKASIKSASNYPQV

SEQ ID NO: 2572398 - protein, 11 aa, Entamoeba histolytica
QRFSNGISGVD

SEQ ID NO: 2572399 - protein, 8 aa, Entamoeba histolytica
QRGETSSE

SEQ ID NO: 2572400 - protein, 10 aa, Entamoeba histolytica
QRGKNAEEAC

SEQ ID NO: 2572401 - protein, 8 aa, Entamoeba histolytica
QRGSTNQK

SEQ ID NO: 2572402 - protein, 5 aa, Entamoeba histolytica
QRGVA

SEQ ID NO: 2572403 - protein, 10 aa, Entamoeba histolytica
QRKDKTNEKY

SEQ ID NO: 2572404 - protein, 5 aa, Entamoeba histolytica
QRKDL

SEQ ID NO: 2572405 - protein, 7 aa, Entamoeba histolytica
QRKGIEK

SEQ ID NO: 2572406 - protein, 38 aa, Entamoeba histolytica
QRKKETKKKNTVKTNKKKNKKRVKGLKKSKADTQEEEF

SEQ ID NO: 2572407 - protein, 7 aa, Entamoeba histolytica
QRKPKKR

SEQ ID NO: 2572408 - protein, 7 aa, Entamoeba histolytica
QRKQEES

SEQ ID NO: 2572409 - protein, 6 aa, Entamoeba histolytica
QRKQGS

SEQ ID NO: 2572410 - protein, 5 aa, Entamoeba histolytica
QRLIE

SEQ ID NO: 2572411 - protein, 9 aa, Entamoeba histolytica
QRNAPPDME

SEQ ID NO: 2572412 - protein, 15 aa, Entamoeba histolytica
QRNDPSLLSVFGISI

SEQ ID NO: 2572413 - protein, 6 aa, Entamoeba histolytica
QRNIKR

SEQ ID NO: 2572414 - protein, 5 aa, Entamoeba histolytica
QRNPT

SEQ ID NO: 2572415 - protein, 5 aa, Entamoeba histolytica
QRNTE

SEQ ID NO: 2572416 - protein, 4 aa, Entamoeba histolytica
QRNY

SEQ ID NO: 2572417 - protein, 6 aa, Entamoeba histolytica
QRPNLK

SEQ ID NO: 2572418 - protein, 6 aa, Entamoeba histolytica
QRPQAI

SEQ ID NO: 2572419 - protein, 12 aa, Entamoeba histolytica
QRRDINEAANAS

SEQ ID NO: 2572420 - protein, 17 aa, Entamoeba histolytica
QRREKYGTNELPKPPKM

SEQ ID NO: 2572421 - protein, 4 aa, Entamoeba histolytica
QRRY

SEQ ID NO: 2572422 - protein, 5 aa, Entamoeba histolytica
QRSAC

SEQ ID NO: 2572423 - protein, 10 aa, Entamoeba histolytica
QRSDARVKEH

SEQ ID NO: 2572424 - protein, 13 aa, Entamoeba histolytica
QRSDKRSKKDIKK

SEQ ID NO: 2572425 - protein, 11 aa, Entamoeba histolytica
QRSDQRYKKDI

SEQ ID NO: 2572426 - protein, 16 aa, Entamoeba histolytica
QRSDRRSKKDIKKISD

SEQ ID NO: 2572427 - protein, 16 aa, Entamoeba histolytica
QRSDSKLKTSIEPLTN

SEQ ID NO: 2572428 - protein, 4 aa, Entamoeba histolytica
QRSK

SEQ ID NO: 2572429 - protein, 7 aa, Entamoeba histolytica
QRSKREW

SEQ ID NO: 2572430 - protein, 6 aa, Entamoeba histolytica
QRSPEI

SEQ ID NO: 2572431 - protein, 9 aa, Entamoeba histolytica
QRYENTKDG

SEQ ID NO: 2572432 - protein, 7 aa, Entamoeba histolytica
QRYKTTA

SEQ ID NO: 2572433 - protein, 11 aa, Entamoeba histolytica
QRYLTTEEIPK

SEQ ID NO: 2572434 - protein, 15 aa, Entamoeba histolytica
QSANALENCEASDSS

SEQ ID NO: 2572435 - protein, 14 aa, Entamoeba histolytica
QSASMTKAVGTPAY

SEQ ID NO: 2572436 - protein, 7 aa, Entamoeba histolytica
QSDDIDE

SEQ ID NO: 2572437 - protein, 11 aa, Entamoeba histolytica
QSDKQLSQLQD

SEQ ID NO: 2572438 - protein, 6 aa, Entamoeba histolytica
QSDKYD

SEQ ID NO: 2572439 - protein, 8 aa, Entamoeba histolytica
QSDLTGKT

SEQ ID NO: 2572440 - protein, 13 aa, Entamoeba histolytica
QSDNKEDETTSLN

SEQ ID NO: 2572441 - protein, 8 aa, Entamoeba histolytica
QSDPQGLK

SEQ ID NO: 2572442 - protein, 7 aa, Entamoeba histolytica
QSECNPL

SEQ ID NO: 2572443 - protein, 6 aa, Entamoeba histolytica
QSEDRP

SEQ ID NO: 2572444 - protein, 9 aa, Entamoeba histolytica
QSEINRSTT

SEQ ID NO: 2572445 - protein, 11 aa, Entamoeba histolytica
QSEKRNKCSEV

SEQ ID NO: 2572446 - protein, 8 aa, Entamoeba histolytica
QSEKTSCV

SEQ ID NO: 2572447 - protein, 4 aa, Entamoeba histolytica
QSEL

SEQ ID NO: 2572448 - protein, 12 aa, Entamoeba histolytica
QSEMSKASNKQY

SEQ ID NO: 2572449 - protein, 6 aa, Entamoeba histolytica
QSENYD

SEQ ID NO: 2572450 - protein, 6 aa, Entamoeba histolytica
QSEPEV

SEQ ID NO: 2572451 - protein, 5 aa, Entamoeba histolytica
QSEQI

SEQ ID NO: 2572452 - protein, 4 aa, Entamoeba histolytica
QSES

SEQ ID NO: 2572453 - protein, 14 aa, Entamoeba histolytica
QSFPSGHSSSISNG

SEQ ID NO: 2572454 - protein, 6 aa, Entamoeba histolytica
QSGDSV

SEQ ID NO: 2572455 - protein, 10 aa, Entamoeba histolytica
QSGEGERSDV

SEQ ID NO: 2572456 - protein, 8 aa, Entamoeba histolytica
QSGETKDV

SEQ ID NO: 2572457 - protein, 4 aa, Entamoeba histolytica
QSGM

SEQ ID NO: 2572458 - protein, 8 aa, Entamoeba histolytica
QSGNKSSV

SEQ ID NO: 2572459 - protein, 9 aa, Entamoeba histolytica
QSHPKPSAM

SEQ ID NO: 2572460 - protein, 5 aa, Entamoeba histolytica
QSIEQ

SEQ ID NO: 2572461 - protein, 15 aa, Entamoeba histolytica
QSIGNKYNDLDDSSF

SEQ ID NO: 2572462 - protein, 6 aa, Entamoeba histolytica
QSIHNP

SEQ ID NO: 2572463 - protein, 14 aa, Entamoeba histolytica
QSINRNRSVDRERL

SEQ ID NO: 2572464 - protein, 5 aa, Entamoeba histolytica
QSISK

SEQ ID NO: 2572465 - protein, 11 aa, Entamoeba histolytica
QSISQKLEGKL

SEQ ID NO: 2572466 - protein, 9 aa, Entamoeba histolytica
QSISTTRDQ

SEQ ID NO: 2572467 - protein, 8 aa, Entamoeba histolytica
QSKCQNGY

SEQ ID NO: 2572468 - protein, 7 aa, Entamoeba histolytica
QSKDNEI

SEQ ID NO: 2572469 - protein, 7 aa, Entamoeba histolytica
QSKDNPS

SEQ ID NO: 2572470 - protein, 5 aa, Entamoeba histolytica
QSKKK

SEQ ID NO: 2572471 - protein, 6 aa, Entamoeba histolytica
QSKKNK

SEQ ID NO: 2572472 - protein, 7 aa, Entamoeba histolytica
QSKKPVA

SEQ ID NO: 2572473 - protein, 13 aa, Entamoeba histolytica
QSKLPSSKRRVAV

SEQ ID NO: 2572474 - protein, 4 aa, Entamoeba histolytica
QSKP

SEQ ID NO: 2572475 - protein, 11 aa, Entamoeba histolytica
QSKQDASKIRG

SEQ ID NO: 2572476 - protein, 5 aa, Entamoeba histolytica
QSKRT

SEQ ID NO: 2572477 - protein, 7 aa, Entamoeba histolytica
QSKTDSL

SEQ ID NO: 2572478 - protein, 7 aa, Entamoeba histolytica
QSKTKSC

SEQ ID NO: 2572479 - protein, 7 aa, Entamoeba histolytica
QSKTNYG

SEQ ID NO: 2572480 - protein, 7 aa, Entamoeba histolytica
QSKYDQE

SEQ ID NO: 2572481 - protein, 9 aa, Entamoeba histolytica
QSKYSEKAD

SEQ ID NO: 2572482 - protein, 13 aa, Entamoeba histolytica
QSLGKEDYFSQKY

SEQ ID NO: 2572483 - protein, 4 aa, Entamoeba histolytica
QSLH

SEQ ID NO: 2572484 - protein, 7 aa, Entamoeba histolytica
QSLNSTV

SEQ ID NO: 2572485 - protein, 7 aa, Entamoeba histolytica
QSLPDGQ

SEQ ID NO: 2572486 - protein, 4 aa, Entamoeba histolytica
QSME

SEQ ID NO: 2572487 - protein, 8 aa, Entamoeba histolytica
QSNAQKVN

SEQ ID NO: 2572488 - protein, 5 aa, Entamoeba histolytica
QSNEE

SEQ ID NO: 2572489 - protein, 7 aa, Entamoeba histolytica
QSNESIR

SEQ ID NO: 2572490 - protein, 8 aa, Entamoeba histolytica
QSNNELNG

SEQ ID NO: 2572491 - protein, 6 aa, Entamoeba histolytica
QSNNKI

SEQ ID NO: 2572492 - protein, 8 aa, Entamoeba histolytica
QSNNNDQL

SEQ ID NO: 2572493 - protein, 8 aa, Entamoeba histolytica
QSNNNSDN

SEQ ID NO: 2572494 - protein, 10 aa, Entamoeba histolytica
QSNNNTNEEC

SEQ ID NO: 2572495 - protein, 12 aa, Entamoeba histolytica
QSNNTQHSNLMD

SEQ ID NO: 2572496 - protein, 16 aa, Entamoeba histolytica
QSNQKIKQEKNRNKKW

SEQ ID NO: 2572497 - protein, 4 aa, Entamoeba histolytica
QSNS

SEQ ID NO: 2572498 - protein, 9 aa, Entamoeba histolytica
QSNSEKAKQ

SEQ ID NO: 2572499 - protein, 6 aa, Entamoeba histolytica
QSNSME

SEQ ID NO: 2572500 - protein, 7 aa, Entamoeba histolytica
QSNSPHG

SEQ ID NO: 2572501 - protein, 5 aa, Entamoeba histolytica
QSNST

SEQ ID NO: 2572502 - protein, 26 aa, Entamoeba histolytica
QSNSVSKSNISKEELQTNFVGNEEII

SEQ ID NO: 2572503 - protein, 8 aa, Entamoeba histolytica
QSNYKEVS

SEQ ID NO: 2572504 - protein, 8 aa, Entamoeba histolytica
QSPEFEEK

SEQ ID NO: 2572505 - protein, 7 aa, Entamoeba histolytica
QSPEISG

SEQ ID NO: 2572506 - protein, 5 aa, Entamoeba histolytica
QSPEY

SEQ ID NO: 2572507 - protein, 6 aa, Entamoeba histolytica
QSPNHL

SEQ ID NO: 2572508 - protein, 6 aa, Entamoeba histolytica
QSPRRE

SEQ ID NO: 2572509 - protein, 6 aa, Entamoeba histolytica
QSPSPV

SEQ ID NO: 2572510 - protein, 4 aa, Entamoeba histolytica
QSQG

SEQ ID NO: 2572511 - protein, 5 aa, Entamoeba histolytica
QSQHN

SEQ ID NO: 2572512 - protein, 13 aa, Entamoeba histolytica
QSQQESVDQTIST

SEQ ID NO: 2572513 - protein, 29 aa, Entamoeba histolytica
QSQSSQNTSEFSERSSKSKSSSLRSNSSL

SEQ ID NO: 2572514 - protein, 7 aa, Entamoeba histolytica
QSRYKTA

SEQ ID NO: 2572515 - protein, 7 aa, Entamoeba histolytica
QSSEECK

SEQ ID NO: 2572516 - protein, 9 aa, Entamoeba histolytica
QSSGSDHTS

SEQ ID NO: 2572517 - protein, 7 aa, Entamoeba histolytica
QSSGSGL

SEQ ID NO: 2572518 - protein, 4 aa, Entamoeba histolytica
QSSN

SEQ ID NO: 2572519 - protein, 6 aa, Entamoeba histolytica
QSSNNA

SEQ ID NO: 2572520 - protein, 8 aa, Entamoeba histolytica
QSSPNPNY

SEQ ID NO: 2572521 - protein, 8 aa, Entamoeba histolytica
QSSSEQEC

SEQ ID NO: 2572522 - protein, 10 aa, Entamoeba histolytica
QSSSKSESGK

SEQ ID NO: 2572523 - protein, 7 aa, Entamoeba histolytica
QSSSQLD

SEQ ID NO: 2572524 - protein, 6 aa, Entamoeba histolytica
QSTCIQ

SEQ ID NO: 2572525 - protein, 7 aa, Entamoeba histolytica
QSTDPNI

SEQ ID NO: 2572526 - protein, 22 aa, Entamoeba histolytica
QSTEELPKKIKQNLSKKTIKEM

SEQ ID NO: 2572527 - protein, 7 aa, Entamoeba histolytica
QSTHPSP

SEQ ID NO: 2572528 - protein, 18 aa, Entamoeba histolytica
QSTKQHVKKNYAPSRGYG

SEQ ID NO: 2572529 - protein, 7 aa, Entamoeba histolytica
QSTLSSY

SEQ ID NO: 2572530 - protein, 8 aa, Entamoeba histolytica
QSTQTFNP

SEQ ID NO: 2572531 - protein, 6 aa, Entamoeba histolytica
QSTQTH

SEQ ID NO: 2572532 - protein, 7 aa, Entamoeba histolytica
QSTSVCD

SEQ ID NO: 2572533 - protein, 7 aa, Entamoeba histolytica
QSTTNEE

SEQ ID NO: 2572534 - protein, 4 aa, Entamoeba histolytica
QSTV

SEQ ID NO: 2572535 - protein, 4 aa, Entamoeba histolytica
QSTY

SEQ ID NO: 2572536 - protein, 5 aa, Entamoeba histolytica
QSVEH

SEQ ID NO: 2572537 - protein, 4 aa, Entamoeba histolytica
QSVN

SEQ ID NO: 2572538 - protein, 7 aa, Entamoeba histolytica
QSVNQSD

SEQ ID NO: 2572539 - protein, 15 aa, Entamoeba histolytica
QSVNSTSPTLAVGTS

SEQ ID NO: 2572540 - protein, 9 aa, Entamoeba histolytica
QSVRPGQSI

SEQ ID NO: 2572541 - protein, 7 aa, Entamoeba histolytica
QSVRTNE

SEQ ID NO: 2572542 - protein, 5 aa, Entamoeba histolytica
QSVTN

SEQ ID NO: 2572543 - protein, 14 aa, Entamoeba histolytica
QSYAKSSTTEQEEI

SEQ ID NO: 2572544 - protein, 8 aa, Entamoeba histolytica
QSYEDNSH

SEQ ID NO: 2572545 - protein, 6 aa, Entamoeba histolytica
QSYEEK

SEQ ID NO: 2572546 - protein, 5 aa, Entamoeba histolytica
QSYEK

SEQ ID NO: 2572547 - protein, 7 aa, Entamoeba histolytica
QSYEKKM

SEQ ID NO: 2572548 - protein, 12 aa, Entamoeba histolytica
QSYLNSHTQGVD

SEQ ID NO: 2572549 - protein, 6 aa, Entamoeba histolytica
QSYPFT

SEQ ID NO: 2572550 - protein, 7 aa, Entamoeba histolytica
QSYSKTD

SEQ ID NO: 2572551 - protein, 9 aa, Entamoeba histolytica
QTAGSNGLS

SEQ ID NO: 2572552 - protein, 6 aa, Entamoeba histolytica
QTAKNI

SEQ ID NO: 2572553 - protein, 11 aa, Entamoeba histolytica
QTDCNPSNDRL

SEQ ID NO: 2572554 - protein, 5 aa, Entamoeba histolytica
QTDIA

SEQ ID NO: 2572555 - protein, 6 aa, Entamoeba histolytica
QTDKLA

SEQ ID NO: 2572556 - protein, 7 aa, Entamoeba histolytica
QTDPTQN

SEQ ID NO: 2572557 - protein, 12 aa, Entamoeba histolytica
QTDQTPLLLPSS

SEQ ID NO: 2572558 - protein, 6 aa, Entamoeba histolytica
QTDTDL

SEQ ID NO: 2572559 - protein, 8 aa, Entamoeba histolytica
QTDTPEEV

SEQ ID NO: 2572560 - protein, 8 aa, Entamoeba histolytica
QTEENPDL

SEQ ID NO: 2572561 - protein, 8 aa, Entamoeba histolytica
QTENKREK

SEQ ID NO: 2572562 - protein, 62 aa, Entamoeba histolytica
  misc_feature (13)..(46): Xaa can be any naturally occurring amino acid
QTENKREKLQIKXXXXXXXXXXXXXXXXXXXXXXXXXXXXXXXXXXFLPRWRLIKSFHIFQV

SEQ ID NO: 2572563 - protein, 14 aa, Entamoeba histolytica
QTENRKPGTRRRKS

SEQ ID NO: 2572564 - protein, 7 aa, Entamoeba histolytica
QTENRMD

SEQ ID NO: 2572565 - protein, 20 aa, Entamoeba histolytica
QTEQVSKNSSSDEGHRKSKL

SEQ ID NO: 2572566 - protein, 7 aa, Entamoeba histolytica
QTESLPK

SEQ ID NO: 2572567 - protein, 7 aa, Entamoeba histolytica
QTETPFQ

SEQ ID NO: 2572568 - protein, 14 aa, Entamoeba histolytica
QTETRKPGSRKKKN

SEQ ID NO: 2572569 - protein, 7 aa, Entamoeba histolytica
QTGEPAI

SEQ ID NO: 2572570 - protein, 4 aa, Entamoeba histolytica
QTGG

SEQ ID NO: 2572571 - protein, 9 aa, Entamoeba histolytica
QTHPGTMES

SEQ ID NO: 2572572 - protein, 4 aa, Entamoeba histolytica
QTIE

SEQ ID NO: 2572573 - protein, 12 aa, Entamoeba histolytica
QTIEDKLKRNND

SEQ ID NO: 2572574 - protein, 9 aa, Entamoeba histolytica
QTIPEKSTI

SEQ ID NO: 2572575 - protein, 6 aa, Entamoeba histolytica
QTIPLS

SEQ ID NO: 2572576 - protein, 11 aa, Entamoeba histolytica
QTIPYDTQCPE

SEQ ID NO: 2572577 - protein, 15 aa, Entamoeba histolytica
QTIQEDNKKSIKEKH

SEQ ID NO: 2572578 - protein, 17 aa, Entamoeba histolytica
QTIQNSKRVEYQKIDET

SEQ ID NO: 2572579 - protein, 11 aa, Entamoeba histolytica
QTITTNSDYSS

SEQ ID NO: 2572580 - protein, 8 aa, Entamoeba histolytica
QTKDPNEI

SEQ ID NO: 2572581 - protein, 9 aa, Entamoeba histolytica
QTKFENGNP

SEQ ID NO: 2572582 - protein, 4 aa, Entamoeba histolytica
QTKN

SEQ ID NO: 2572583 - protein, 10 aa, Entamoeba histolytica
QTKPSFPKKI

SEQ ID NO: 2572584 - protein, 8 aa, Entamoeba histolytica
QTKSGVQE

SEQ ID NO: 2572585 - protein, 17 aa, Entamoeba histolytica
QTKVNKNEPTRETLTVS

SEQ ID NO: 2572586 - protein, 13 aa, Entamoeba histolytica
QTLDQTVSQVNEN

SEQ ID NO: 2572587 - protein, 11 aa, Entamoeba histolytica
QTLKKESKKVR

SEQ ID NO: 2572588 - protein, 21 aa, Entamoeba histolytica
QTLPKTTSIENTTESENCYFS

SEQ ID NO: 2572589 - protein, 6 aa, Entamoeba histolytica
QTNEIT

SEQ ID NO: 2572590 - protein, 7 aa, Entamoeba histolytica
QTNEPTH

SEQ ID NO: 2572591 - protein, 16 aa, Entamoeba histolytica
QTNGKLDNNAKEAYTQ

SEQ ID NO: 2572592 - protein, 6 aa, Entamoeba histolytica
QTNGTT

SEQ ID NO: 2572593 - protein, 5 aa, Entamoeba histolytica
QTNNA

SEQ ID NO: 2572594 - protein, 8 aa, Entamoeba histolytica
QTNPKFST

SEQ ID NO: 2572595 - protein, 14 aa, Entamoeba histolytica
QTNQQQKELLNELL

SEQ ID NO: 2572596 - protein, 33 aa, Entamoeba histolytica
QTNSLKNSNQLNDEKLSNYSNFDSSKKEGSLLT

SEQ ID NO: 2572597 - protein, 10 aa, Entamoeba histolytica
QTNSTSEYPI

SEQ ID NO: 2572598 - protein, 5 aa, Entamoeba histolytica
QTPPF

SEQ ID NO: 2572599 - protein, 26 aa, Entamoeba histolytica
QTPSINNNTNNNEQSFSSGLGVTSTG

SEQ ID NO: 2572600 - protein, 7 aa, Entamoeba histolytica
QTPYDSL

SEQ ID NO: 2572601 - protein, 5 aa, Entamoeba histolytica
QTQCT

SEQ ID NO: 2572602 - protein, 12 aa, Entamoeba histolytica
QTQLKDNGENKS

SEQ ID NO: 2572603 - protein, 6 aa, Entamoeba histolytica
QTQYNQ

SEQ ID NO: 2572604 - protein, 7 aa, Entamoeba histolytica
QTSEEID

SEQ ID NO: 2572605 - protein, 11 aa, Entamoeba histolytica
QTSGDENAQAL

SEQ ID NO: 2572606 - protein, 10 aa, Entamoeba histolytica
QTSGEGVGYY

SEQ ID NO: 2572607 - protein, 4 aa, Entamoeba histolytica
QTSI

SEQ ID NO: 2572608 - protein, 5 aa, Entamoeba histolytica
QTSQY

SEQ ID NO: 2572609 - protein, 9 aa, Entamoeba histolytica
QTSSHNFPR

SEQ ID NO: 2572610 - protein, 5 aa, Entamoeba histolytica
QTSTD

SEQ ID NO: 2572611 - protein, 5 aa, Entamoeba histolytica
QTSTP

SEQ ID NO: 2572612 - protein, 8 aa, Entamoeba histolytica
QTTDSNCE

SEQ ID NO: 2572613 - protein, 5 aa, Entamoeba histolytica
QTTEA

SEQ ID NO: 2572614 - protein, 10 aa, Entamoeba histolytica
QTTEDENTDI

SEQ ID NO: 2572615 - protein, 6 aa, Entamoeba histolytica
QTTEEF

SEQ ID NO: 2572616 - protein, 9 aa, Entamoeba histolytica
QTTEKNDNM

SEQ ID NO: 2572617 - protein, 10 aa, Entamoeba histolytica
QTTKITTSLD

SEQ ID NO: 2572618 - protein, 10 aa, Entamoeba histolytica
QTTMESIENE

SEQ ID NO: 2572619 - protein, 7 aa, Entamoeba histolytica
QTTQQPL

SEQ ID NO: 2572620 - protein, 7 aa, Entamoeba histolytica
QTTSTSV

SEQ ID NO: 2572621 - protein, 7 aa, Entamoeba histolytica
QTTTRNC

SEQ ID NO: 2572622 - protein, 17 aa, Entamoeba histolytica
QTTTTTQTIAASTAQFK

SEQ ID NO: 2572623 - protein, 5 aa, Entamoeba histolytica
QTTTY

SEQ ID NO: 2572624 - protein, 6 aa, Entamoeba histolytica
QTVPNG

SEQ ID NO: 2572625 - protein, 9 aa, Entamoeba histolytica
QTVTTTHAQ

SEQ ID NO: 2572626 - protein, 5 aa, Entamoeba histolytica
QVAEM

SEQ ID NO: 2572627 - protein, 16 aa, Entamoeba histolytica
QVEETVKRKKQENEEK

SEQ ID NO: 2572628 - protein, 15 aa, Entamoeba histolytica
QVGPNSSPKSSSKYD

SEQ ID NO: 2572629 - protein, 5 aa, Entamoeba histolytica
QVGQS

SEQ ID NO: 2572630 - protein, 6 aa, Entamoeba histolytica
QVKCSS

SEQ ID NO: 2572631 - protein, 10 aa, Entamoeba histolytica
QVKGEGENLA

SEQ ID NO: 2572632 - protein, 8 aa, Entamoeba histolytica
QVKGPLGT

SEQ ID NO: 2572633 - protein, 6 aa, Entamoeba histolytica
QVKPTF

SEQ ID NO: 2572634 - protein, 15 aa, Entamoeba histolytica
QVNASDESRTTEEIN

SEQ ID NO: 2572635 - protein, 7 aa, Entamoeba histolytica
QVNEMPD

SEQ ID NO: 2572636 - protein, 7 aa, Entamoeba histolytica
QVNKRRS

SEQ ID NO: 2572637 - protein, 14 aa, Entamoeba histolytica
QVNSPSSSFSSPDY

SEQ ID NO: 2572638 - protein, 5 aa, Entamoeba histolytica
QVNTK

SEQ ID NO: 2572639 - protein, 8 aa, Entamoeba histolytica
QVPPKTVG

SEQ ID NO: 2572640 - protein, 8 aa, Entamoeba histolytica
QVPPNQGG

SEQ ID NO: 2572641 - protein, 12 aa, Entamoeba histolytica
QVSEAEFDKEPI

SEQ ID NO: 2572642 - protein, 6 aa, Entamoeba histolytica
QVSPSE

SEQ ID NO: 2572643 - protein, 25 aa, Entamoeba histolytica
QVTEPNSEQPQQEISEKLQENTNEL

SEQ ID NO: 2572644 - protein, 8 aa, Entamoeba histolytica
QVTRSDTQ

SEQ ID NO: 2572645 - protein, 17 aa, Entamoeba histolytica
QVTTNQLQNEPKKEIQK

SEQ ID NO: 2572646 - protein, 29 aa, Entamoeba histolytica
QWDNTTKSCVEGNDNCTRYSTDDGSCSTC

SEQ ID NO: 2572647 - protein, 11 aa, Entamoeba histolytica
QWEQTNSDEPL

SEQ ID NO: 2572648 - protein, 12 aa, Entamoeba histolytica
QWGATTVAATSR

SEQ ID NO: 2572649 - protein, 42 aa, Entamoeba histolytica
QWKNENEKRDAAKATELVETSKPDIADNDNDDMKPSENGSNA

SEQ ID NO: 2572650 - protein, 6 aa, Entamoeba histolytica
QWSTNE

SEQ ID NO: 2572651 - protein, 5 aa, Entamoeba histolytica
QWTEE

SEQ ID NO: 2572652 - protein, 17 aa, Entamoeba histolytica
QYCDSANKKVAKEYGDY

SEQ ID NO: 2572653 - protein, 6 aa, Entamoeba histolytica
QYEEPN

SEQ ID NO: 2572654 - protein, 4 aa, Entamoeba histolytica
QYEP

SEQ ID NO: 2572655 - protein, 6 aa, Entamoeba histolytica
QYGADD

SEQ ID NO: 2572656 - protein, 7 aa, Entamoeba histolytica
QYNEENE

SEQ ID NO: 2572657 - protein, 4 aa, Entamoeba histolytica
QYNG

SEQ ID NO: 2572658 - protein, 7 aa, Entamoeba histolytica
QYNKREA

SEQ ID NO: 2572659 - protein, 4 aa, Entamoeba histolytica
QYNP

SEQ ID NO: 2572660 - protein, 10 aa, Entamoeba histolytica
QYNPQNGVGT

SEQ ID NO: 2572661 - protein, 5 aa, Entamoeba histolytica
QYNPT

SEQ ID NO: 2572662 - protein, 5 aa, Entamoeba histolytica
QYPDD

SEQ ID NO: 2572663 - protein, 6 aa, Entamoeba histolytica
QYPPAP

SEQ ID NO: 2572664 - protein, 5 aa, Entamoeba histolytica
QYQGN

SEQ ID NO: 2572665 - protein, 5 aa, Entamoeba histolytica
QYQQP

SEQ ID NO: 2572666 - protein, 4 aa, Entamoeba histolytica
QYSE

SEQ ID NO: 2572667 - protein, 4 aa, Entamoeba histolytica
QYSP

SEQ ID NO: 2572668 - protein, 4 aa, Entamoeba histolytica
QYTQ

SEQ ID NO: 2572669 - protein, 8 aa, Entamoeba histolytica
QYVTKGKT

SEQ ID NO: 2572670 - protein, 11 aa, Entamoeba histolytica
RAAEKQRETEI

SEQ ID NO: 2572671 - protein, 5 aa, Entamoeba histolytica
RADDD

SEQ ID NO: 2572672 - protein, 6 aa, Entamoeba histolytica
RADFSK

SEQ ID NO: 2572673 - protein, 12 aa, Entamoeba histolytica
RAEAQESEYIDG

SEQ ID NO: 2572674 - protein, 17 aa, Entamoeba histolytica
RAEAVQRAGRAGRTSNG

SEQ ID NO: 2572675 - protein, 4 aa, Entamoeba histolytica
RAGT

SEQ ID NO: 2572676 - protein, 12 aa, Entamoeba histolytica
RAKRNIKEFPSS

SEQ ID NO: 2572677 - protein, 9 aa, Entamoeba histolytica
RAKSATKKQ

SEQ ID NO: 2572678 - protein, 9 aa, Entamoeba histolytica
RAKVAAEKI

SEQ ID NO: 2572679 - protein, 8 aa, Entamoeba histolytica
RALKSKEE

SEQ ID NO: 2572680 - protein, 34 aa, Entamoeba histolytica
RALSKRLPTDQEKQEYWAEKSTKTPDTWPLLFSS

SEQ ID NO: 2572681 - protein, 11 aa, Entamoeba histolytica
RANKNEGSSRY

SEQ ID NO: 2572682 - protein, 11 aa, Entamoeba histolytica
RANSSQEVSKN

SEQ ID NO: 2572683 - protein, 6 aa, Entamoeba histolytica
RAPRHN

SEQ ID NO: 2572684 - protein, 7 aa, Entamoeba histolytica
RAPRHNG

SEQ ID NO: 2572685 - protein, 7 aa, Entamoeba histolytica
RAQKALN

SEQ ID NO: 2572686 - protein, 7 aa, Entamoeba histolytica
RARKEQN

SEQ ID NO: 2572687 - protein, 8 aa, Entamoeba histolytica
RASEKSKG

SEQ ID NO: 2572688 - protein, 8 aa, Entamoeba histolytica
RASEKSKS

SEQ ID NO: 2572689 - protein, 7 aa, Entamoeba histolytica
RASEQKK

SEQ ID NO: 2572690 - protein, 8 aa, Entamoeba histolytica
RASTNNKG

SEQ ID NO: 2572691 - protein, 12 aa, Entamoeba histolytica
RASYRKYSKEQF

SEQ ID NO: 2572692 - protein, 7 aa, Entamoeba histolytica
RATSGSF

SEQ ID NO: 2572693 - protein, 6 aa, Entamoeba histolytica
RATTAD

SEQ ID NO: 2572694 - protein, 8 aa, Entamoeba histolytica
RCNEEGKE

SEQ ID NO: 2572695 - protein, 4 aa, Entamoeba histolytica
RCRN

SEQ ID NO: 2572696 - protein, 4 aa, Entamoeba histolytica
RCSP

SEQ ID NO: 2572697 - protein, 6 aa, Entamoeba histolytica
RCSPCS

SEQ ID NO: 2572698 - protein, 15 aa, Entamoeba histolytica
RCSTCSSKTNKCSEC

SEQ ID NO: 2572699 - protein, 8 aa, Entamoeba histolytica
RCTNDRSA

SEQ ID NO: 2572700 - protein, 16 aa, Entamoeba histolytica
RCTQCTGDDAHECGKC

SEQ ID NO: 2572701 - protein, 6 aa, Entamoeba histolytica
RDASSF

SEQ ID NO: 2572702 - protein, 7 aa, Entamoeba histolytica
RDDDDSF

SEQ ID NO: 2572703 - protein, 6 aa, Entamoeba histolytica
RDDDGI

SEQ ID NO: 2572704 - protein, 8 aa, Entamoeba histolytica
RDDEDQND

SEQ ID NO: 2572705 - protein, 9 aa, Entamoeba histolytica
RDDESPDTG

SEQ ID NO: 2572706 - protein, 6 aa, Entamoeba histolytica
RDEIEQ

SEQ ID NO: 2572707 - protein, 7 aa, Entamoeba histolytica
RDELCEG

SEQ ID NO: 2572708 - protein, 4 aa, Entamoeba histolytica
RDEN

SEQ ID NO: 2572709 - protein, 7 aa, Entamoeba histolytica
RDEQITN

SEQ ID NO: 2572710 - protein, 6 aa, Entamoeba histolytica
RDETED

SEQ ID NO: 2572711 - protein, 15 aa, Entamoeba histolytica
RDETIITSSSSTQDD

SEQ ID NO: 2572712 - protein, 10 aa, Entamoeba histolytica
RDGETPTEEE

SEQ ID NO: 2572713 - protein, 11 aa, Entamoeba histolytica
RDIDEKDHTVS

SEQ ID NO: 2572714 - protein, 7 aa, Entamoeba histolytica
RDIGPNV

SEQ ID NO: 2572715 - protein, 8 aa, Entamoeba histolytica
RDKNPRVR

SEQ ID NO: 2572716 - protein, 9 aa, Entamoeba histolytica
RDLPTSKTY

SEQ ID NO: 2572717 - protein, 8 aa, Entamoeba histolytica
RDNDYQVR

SEQ ID NO: 2572718 - protein, 15 aa, Entamoeba histolytica
RDNKGGCVPSSNGLS

SEQ ID NO: 2572719 - protein, 15 aa, Entamoeba histolytica
RDNLDPTKHTSDEEM

SEQ ID NO: 2572720 - protein, 9 aa, Entamoeba histolytica
RDPEDKARR

SEQ ID NO: 2572721 - protein, 11 aa, Entamoeba histolytica
RDPNQRASSRD

SEQ ID NO: 2572722 - protein, 20 aa, Entamoeba histolytica
RDPPKEEKNKENKEFEDTMT

SEQ ID NO: 2572723 - protein, 9 aa, Entamoeba histolytica
RDQGKTQMN

SEQ ID NO: 2572724 - protein, 11 aa, Entamoeba histolytica
RDQRKPFENTK

SEQ ID NO: 2572725 - protein, 6 aa, Entamoeba histolytica
RDQTLP

SEQ ID NO: 2572726 - protein, 9 aa, Entamoeba histolytica
RDSHQDPNL

SEQ ID NO: 2572727 - protein, 5 aa, Entamoeba histolytica
RDTDG

SEQ ID NO: 2572728 - protein, 4 aa, Entamoeba histolytica
RDTE

SEQ ID NO: 2572729 - protein, 6 aa, Entamoeba histolytica
RDTENM

SEQ ID NO: 2572730 - protein, 9 aa, Entamoeba histolytica
RDTKGTTFD

SEQ ID NO: 2572731 - protein, 4 aa, Entamoeba histolytica
RDTN

SEQ ID NO: 2572732 - protein, 7 aa, Entamoeba histolytica
RDYPEVK

SEQ ID NO: 2572733 - protein, 4 aa, Entamoeba histolytica
RDYS

SEQ ID NO: 2572734 - protein, 8 aa, Entamoeba histolytica
RDYSKSGQ

SEQ ID NO: 2572735 - protein, 9 aa, Entamoeba histolytica
READTPFDQ

SEQ ID NO: 2572736 - protein, 5 aa, Entamoeba histolytica
REASV

SEQ ID NO: 2572737 - protein, 14 aa, Entamoeba histolytica
REATDDKKLDKVTR

SEQ ID NO: 2572738 - protein, 14 aa, Entamoeba histolytica
REDKCSKKEYTEEF

SEQ ID NO: 2572739 - protein, 5 aa, Entamoeba histolytica
REDQS

SEQ ID NO: 2572740 - protein, 8 aa, Entamoeba histolytica
REEESTND

SEQ ID NO: 2572741 - protein, 16 aa, Entamoeba histolytica
REEGEEILSTSNAPAL

SEQ ID NO: 2572742 - protein, 6 aa, Entamoeba histolytica
REEGEQ

SEQ ID NO: 2572743 - protein, 7 aa, Entamoeba histolytica
REERRGD

SEQ ID NO: 2572744 - protein, 15 aa, Entamoeba histolytica
REGDDDDEGHDDDCE

SEQ ID NO: 2572745 - protein, 4 aa, Entamoeba histolytica
REGK

SEQ ID NO: 2572746 - protein, 8 aa, Entamoeba histolytica
REGSGNEF

SEQ ID NO: 2572747 - protein, 5 aa, Entamoeba histolytica
REGYS

SEQ ID NO: 2572748 - protein, 6 aa, Entamoeba histolytica
REIEKA

SEQ ID NO: 2572749 - protein, 4 aa, Entamoeba histolytica
REIK

SEQ ID NO: 2572750 - protein, 8 aa, Entamoeba histolytica
REITASRT

SEQ ID NO: 2572751 - protein, 8 aa, Entamoeba histolytica
REKDTEGL

SEQ ID NO: 2572752 - protein, 17 aa, Entamoeba histolytica
REKEELPDEPDDAEELL

SEQ ID NO: 2572753 - protein, 12 aa, Entamoeba histolytica
REKKKAETLTNE

SEQ ID NO: 2572754 - protein, 4 aa, Entamoeba histolytica
REKR

SEQ ID NO: 2572755 - protein, 6 aa, Entamoeba histolytica
REKSDL

SEQ ID NO: 2572756 - protein, 6 aa, Entamoeba histolytica
REKYNN

SEQ ID NO: 2572757 - protein, 9 aa, Entamoeba histolytica
RENEQIGAE

SEQ ID NO: 2572758 - protein, 5 aa, Entamoeba histolytica
RENRK

SEQ ID NO: 2572759 - protein, 21 aa, Entamoeba histolytica
REPKKIKTLSSDEKIFNENKV

SEQ ID NO: 2572760 - protein, 9 aa, Entamoeba histolytica
REPPIGNGA

SEQ ID NO: 2572761 - protein, 13 aa, Entamoeba histolytica
REQTITSNLSDSE

SEQ ID NO: 2572762 - protein, 22 aa, Entamoeba histolytica
REQVEMGEKAEDQMEDEKYKED

SEQ ID NO: 2572763 - protein, 4 aa, Entamoeba histolytica
RERN

SEQ ID NO: 2572764 - protein, 7 aa, Entamoeba histolytica
RERSSKI

SEQ ID NO: 2572765 - protein, 9 aa, Entamoeba histolytica
RESDGNRLS

SEQ ID NO: 2572766 - protein, 7 aa, Entamoeba histolytica
RESDNQV

SEQ ID NO: 2572767 - protein, 9 aa, Entamoeba histolytica
RESKSLQGN

SEQ ID NO: 2572768 - protein, 5 aa, Entamoeba histolytica
RETET

SEQ ID NO: 2572769 - protein, 11 aa, Entamoeba histolytica
RETFSESQSRR

SEQ ID NO: 2572770 - protein, 6 aa, Entamoeba histolytica
RETGSI

SEQ ID NO: 2572771 - protein, 4 aa, Entamoeba histolytica
RETK

SEQ ID NO: 2572772 - protein, 6 aa, Entamoeba histolytica
RETPPL

SEQ ID NO: 2572773 - protein, 7 aa, Entamoeba histolytica
RETTPQN

SEQ ID NO: 2572774 - protein, 4 aa, Entamoeba histolytica
RETV

SEQ ID NO: 2572775 - protein, 5 aa, Entamoeba histolytica
REYEK

SEQ ID NO: 2572776 - protein, 7 aa, Entamoeba histolytica
REYHNGT

SEQ ID NO: 2572777 - protein, 5 aa, Entamoeba histolytica
REYKE

SEQ ID NO: 2572778 - protein, 13 aa, Entamoeba histolytica
RFAGKKEKAPKIS

SEQ ID NO: 2572779 - protein, 4 aa, Entamoeba histolytica
RFET

SEQ ID NO: 2572780 - protein, 8 aa, Entamoeba histolytica
RFGNSSDS

SEQ ID NO: 2572781 - protein, 13 aa, Entamoeba histolytica
RFNNNNENGKCDQ

SEQ ID NO: 2572782 - protein, 5 aa, Entamoeba histolytica
RFNPT

SEQ ID NO: 2572783 - protein, 5 aa, Entamoeba histolytica
RFNSS

SEQ ID NO: 2572784 - protein, 12 aa, Entamoeba histolytica
RFPNNKDETLQK

SEQ ID NO: 2572785 - protein, 5 aa, Entamoeba histolytica
RFPPE

SEQ ID NO: 2572786 - protein, 5 aa, Entamoeba histolytica
RFQRR

SEQ ID NO: 2572787 - protein, 12 aa, Entamoeba histolytica
RFTSKKGDSIDL

SEQ ID NO: 2572788 - protein, 6 aa, Entamoeba histolytica
RGADRV

SEQ ID NO: 2572789 - protein, 6 aa, Entamoeba histolytica
RGADTT

SEQ ID NO: 2572790 - protein, 8 aa, Entamoeba histolytica
RGATYEQV

SEQ ID NO: 2572791 - protein, 5 aa, Entamoeba histolytica
RGCGI

SEQ ID NO: 2572792 - protein, 10 aa, Entamoeba histolytica
RGDESSQTTE

SEQ ID NO: 2572793 - protein, 4 aa, Entamoeba histolytica
RGEA

SEQ ID NO: 2572794 - protein, 6 aa, Entamoeba histolytica
RGEGKM

SEQ ID NO: 2572795 - protein, 7 aa, Entamoeba histolytica
RGGIKSI

SEQ ID NO: 2572796 - protein, 12 aa, Entamoeba histolytica
RGGRGIKPENTI

SEQ ID NO: 2572797 - protein, 6 aa, Entamoeba histolytica
RGHCNE

SEQ ID NO: 2572798 - protein, 4 aa, Entamoeba histolytica
RGIG

SEQ ID NO: 2572799 - protein, 19 aa, Entamoeba histolytica
RGINESKCIPKDKSLNEYV

SEQ ID NO: 2572800 - protein, 8 aa, Entamoeba histolytica
RGKGDWEC

SEQ ID NO: 2572801 - protein, 12 aa, Entamoeba histolytica
RGKGGKKNVTAG

SEQ ID NO: 2572802 - protein, 9 aa, Entamoeba histolytica
RGKGGSKGV

SEQ ID NO: 2572803 - protein, 5 aa, Entamoeba histolytica
RGKGK

SEQ ID NO: 2572804 - protein, 4 aa, Entamoeba histolytica
RGKI

SEQ ID NO: 2572805 - protein, 31 aa, Entamoeba histolytica
RGKTPTELNDGLDPEEEQQCYQGKSTTKDGI

SEQ ID NO: 2572806 - protein, 7 aa, Entamoeba histolytica
RGLSKKN

SEQ ID NO: 2572807 - protein, 4 aa, Entamoeba histolytica
RGNE

SEQ ID NO: 2572808 - protein, 6 aa, Entamoeba histolytica
RGNPND

SEQ ID NO: 2572809 - protein, 10 aa, Entamoeba histolytica
RGNSKNSGNL

SEQ ID NO: 2572810 - protein, 10 aa, Entamoeba histolytica
RGPCKEESRV

SEQ ID NO: 2572811 - protein, 5 aa, Entamoeba histolytica
RGPPG

SEQ ID NO: 2572812 - protein, 5 aa, Entamoeba histolytica
RGQKV

SEQ ID NO: 2572813 - protein, 11 aa, Entamoeba histolytica
RGRKGVANGQG

SEQ ID NO: 2572814 - protein, 7 aa, Entamoeba histolytica
RGSECSG

SEQ ID NO: 2572815 - protein, 5 aa, Entamoeba histolytica
RGSES

SEQ ID NO: 2572816 - protein, 4 aa, Entamoeba histolytica
RGSF

SEQ ID NO: 2572817 - protein, 31 aa, Entamoeba histolytica
RGSNSRATESSELNTGTTQTETTTTTTTLTT

SEQ ID NO: 2572818 - protein, 4 aa, Entamoeba histolytica
RGSP

SEQ ID NO: 2572819 - protein, 6 aa, Entamoeba histolytica
RGSSIR

SEQ ID NO: 2572820 - protein, 6 aa, Entamoeba histolytica
RGSSLT

SEQ ID NO: 2572821 - protein, 12 aa, Entamoeba histolytica
RGSSYGKDSRCF

SEQ ID NO: 2572822 - protein, 8 aa, Entamoeba histolytica
RGSTQPLP

SEQ ID NO: 2572823 - protein, 6 aa, Entamoeba histolytica
RGTAAG

SEQ ID NO: 2572824 - protein, 6 aa, Entamoeba histolytica
RGTAAT

SEQ ID NO: 2572825 - protein, 16 aa, Entamoeba histolytica
RGTANQYELPNFNLID

SEQ ID NO: 2572826 - protein, 5 aa, Entamoeba histolytica
RGTIE

SEQ ID NO: 2572827 - protein, 57 aa, Entamoeba histolytica
RGTLATSTEQRSFHNSGLKGQIPKKCRRSIGKTDEIDSNLDTTLSSPNNLSSLPSHQ

SEQ ID NO: 2572828 - protein, 5 aa, Entamoeba histolytica
RGTRP

SEQ ID NO: 2572829 - protein, 5 aa, Entamoeba histolytica
RGTTL

SEQ ID NO: 2572830 - protein, 6 aa, Entamoeba histolytica
RGVDYK

SEQ ID NO: 2572831 - protein, 4 aa, Entamoeba histolytica
RGVI

SEQ ID NO: 2572832 - protein, 14 aa, Entamoeba histolytica
RGYDSAGIASINNN

SEQ ID NO: 2572833 - protein, 11 aa, Entamoeba histolytica
RHKDDKTINTK

SEQ ID NO: 2572834 - protein, 5 aa, Entamoeba histolytica
RHNGQ

SEQ ID NO: 2572835 - protein, 14 aa, Entamoeba histolytica
RHRDDQRENNRTTL

SEQ ID NO: 2572836 - protein, 12 aa, Entamoeba histolytica
RHRSDKEFNNKK

SEQ ID NO: 2572837 - protein, 10 aa, Entamoeba histolytica
RHSPSERPTF

SEQ ID NO: 2572838 - protein, 5 aa, Entamoeba histolytica
RIDGT

SEQ ID NO: 2572839 - protein, 9 aa, Entamoeba histolytica
RIENNEEDN

SEQ ID NO: 2572840 - protein, 18 aa, Entamoeba histolytica
RIESTINKEDKSEENTSE

SEQ ID NO: 2572841 - protein, 4 aa, Entamoeba histolytica
RIGI

SEQ ID NO: 2572842 - protein, 5 aa, Entamoeba histolytica
RIGQN

SEQ ID NO: 2572843 - protein, 9 aa, Entamoeba histolytica
RIKDTNRGI

SEQ ID NO: 2572844 - protein, 6 aa, Entamoeba histolytica
RINDEN

SEQ ID NO: 2572845 - protein, 5 aa, Entamoeba histolytica
RINSK

SEQ ID NO: 2572846 - protein, 7 aa, Entamoeba histolytica
RINTTDK

SEQ ID NO: 2572847 - protein, 16 aa, Entamoeba histolytica
RIPQSGTIDKTLQPYS

SEQ ID NO: 2572848 - protein, 4 aa, Entamoeba histolytica
RIPS

SEQ ID NO: 2572849 - protein, 9 aa, Entamoeba histolytica
RIQSAGQKL

SEQ ID NO: 2572850 - protein, 7 aa, Entamoeba histolytica
RISDSTP

SEQ ID NO: 2572851 - protein, 10 aa, Entamoeba histolytica
RISDYNSSRC

SEQ ID NO: 2572852 - protein, 6 aa, Entamoeba histolytica
RISEPR

SEQ ID NO: 2572853 - protein, 8 aa, Entamoeba histolytica
RISNGSNS

SEQ ID NO: 2572854 - protein, 11 aa, Entamoeba histolytica
RISSKIKEKFK

SEQ ID NO: 2572855 - protein, 20 aa, Entamoeba histolytica
RISSSYKTTINKNNETCSQY

SEQ ID NO: 2572856 - protein, 132 aa, Entamoeba histolytica
  misc_feature (85)..(118): Xaa can be any naturally occurring amino acid
RITAKNQKKDYGGVGNYGGISSSSYGNYSSNTTSFGSDDFNSFNKPASTYGGYHDDPQPTSTTYSNNPQPTYGRPGTYKDNVVEXXXXXXXXXXXXXXXXXXXXXXXXXXXXXXXXXXISFILITSMNKTRM

SEQ ID NO: 2572857 - protein, 4 aa, Entamoeba histolytica
RITQ

SEQ ID NO: 2572858 - protein, 4 aa, Entamoeba histolytica
RITS

SEQ ID NO: 2572859 - protein, 10 aa, Entamoeba histolytica
RIYKKKKKSL

SEQ ID NO: 2572860 - protein, 7 aa, Entamoeba histolytica
RIYPDGK

SEQ ID NO: 2572861 - protein, 11 aa, Entamoeba histolytica
RIYSEDKVTKE

SEQ ID NO: 2572862 - protein, 19 aa, Entamoeba histolytica
RKCDEESGCTDCPSGNQMN

SEQ ID NO: 2572863 - protein, 12 aa, Entamoeba histolytica
RKCESDLNDKCE

SEQ ID NO: 2572864 - protein, 13 aa, Entamoeba histolytica
RKDDTNPLRKKRT

SEQ ID NO: 2572865 - protein, 7 aa, Entamoeba histolytica
RKDKEDY

SEQ ID NO: 2572866 - protein, 9 aa, Entamoeba histolytica
RKDKSGSFT

SEQ ID NO: 2572867 - protein, 7 aa, Entamoeba histolytica
RKDLNRT

SEQ ID NO: 2572868 - protein, 5 aa, Entamoeba histolytica
RKDNE

SEQ ID NO: 2572869 - protein, 9 aa, Entamoeba histolytica
RKDSGLNGQ

SEQ ID NO: 2572870 - protein, 5 aa, Entamoeba histolytica
RKDYT

SEQ ID NO: 2572871 - protein, 8 aa, Entamoeba histolytica
RKEAGLKV

SEQ ID NO: 2572872 - protein, 5 aa, Entamoeba histolytica
RKEDY

SEQ ID NO: 2572873 - protein, 9 aa, Entamoeba histolytica
RKEEEEVHK

SEQ ID NO: 2572874 - protein, 25 aa, Entamoeba histolytica
RKEEEKRARIKKERQRKERELQRLE

SEQ ID NO: 2572875 - protein, 5 aa, Entamoeba histolytica
RKEFG

SEQ ID NO: 2572876 - protein, 13 aa, Entamoeba histolytica
RKEGETEHKLPQG

SEQ ID NO: 2572877 - protein, 7 aa, Entamoeba histolytica
RKEKEDY

SEQ ID NO: 2572878 - protein, 6 aa, Entamoeba histolytica
RKEKEP

SEQ ID NO: 2572879 - protein, 4 aa, Entamoeba histolytica
RKEN

SEQ ID NO: 2572880 - protein, 10 aa, Entamoeba histolytica
RKENEDSSLE

SEQ ID NO: 2572881 - protein, 6 aa, Entamoeba histolytica
RKENGY

SEQ ID NO: 2572882 - protein, 8 aa, Entamoeba histolytica
RKERKEEE

SEQ ID NO: 2572883 - protein, 4 aa, Entamoeba histolytica
RKET

SEQ ID NO: 2572884 - protein, 5 aa, Entamoeba histolytica
RKETL

SEQ ID NO: 2572885 - protein, 5 aa, Entamoeba histolytica
RKFSR

SEQ ID NO: 2572886 - protein, 8 aa, Entamoeba histolytica
RKGCEPNC

SEQ ID NO: 2572887 - protein, 6 aa, Entamoeba histolytica
RKGENT

SEQ ID NO: 2572888 - protein, 14 aa, Entamoeba histolytica
RKGIKQKTNPTPLK

SEQ ID NO: 2572889 - protein, 5 aa, Entamoeba histolytica
RKGKG

SEQ ID NO: 2572890 - protein, 7 aa, Entamoeba histolytica
RKGNEKY

SEQ ID NO: 2572891 - protein, 6 aa, Entamoeba histolytica
RKGNTS

SEQ ID NO: 2572892 - protein, 9 aa, Entamoeba histolytica
RKGQMEGKT

SEQ ID NO: 2572893 - protein, 8 aa, Entamoeba histolytica
RKGQNKEI

SEQ ID NO: 2572894 - protein, 7 aa, Entamoeba histolytica
RKHAKQP

SEQ ID NO: 2572895 - protein, 13 aa, Entamoeba histolytica
RKHRQYEDAYHNV

SEQ ID NO: 2572896 - protein, 6 aa, Entamoeba histolytica
RKIEEM

SEQ ID NO: 2572897 - protein, 9 aa, Entamoeba histolytica
RKKDREEMR

SEQ ID NO: 2572898 - protein, 9 aa, Entamoeba histolytica
RKKDRLSDF

SEQ ID NO: 2572899 - protein, 19 aa, Entamoeba histolytica
RKKERQNDERKHFGDYGNL

SEQ ID NO: 2572900 - protein, 8 aa, Entamoeba histolytica
RKKGTQNH

SEQ ID NO: 2572901 - protein, 16 aa, Entamoeba histolytica
RKKINEKKPSALVGED

SEQ ID NO: 2572902 - protein, 9 aa, Entamoeba histolytica
RKKKEREEK

SEQ ID NO: 2572903 - protein, 10 aa, Entamoeba histolytica
RKKKREQEKT

SEQ ID NO: 2572904 - protein, 5 aa, Entamoeba histolytica
RKKMV

SEQ ID NO: 2572905 - protein, 15 aa, Entamoeba histolytica
RKKREEEEKTEKGKN

SEQ ID NO: 2572906 - protein, 7 aa, Entamoeba histolytica
RKKREIL

SEQ ID NO: 2572907 - protein, 8 aa, Entamoeba histolytica
RKKTSQIL

SEQ ID NO: 2572908 - protein, 10 aa, Entamoeba histolytica
RKLASDDSEW

SEQ ID NO: 2572909 - protein, 16 aa, Entamoeba histolytica
RKLGQEDLEKTRNEKQ

SEQ ID NO: 2572910 - protein, 8 aa, Entamoeba histolytica
RKNATYQT

SEQ ID NO: 2572911 - protein, 5 aa, Entamoeba histolytica
RKNDF

SEQ ID NO: 2572912 - protein, 9 aa, Entamoeba histolytica
RKNGEGLSP

SEQ ID NO: 2572913 - protein, 12 aa, Entamoeba histolytica
RKNGSTKETRSL

SEQ ID NO: 2572914 - protein, 4 aa, Entamoeba histolytica
RKNK

SEQ ID NO: 2572915 - protein, 7 aa, Entamoeba histolytica
RKNKCYK

SEQ ID NO: 2572916 - protein, 5 aa, Entamoeba histolytica
RKNKK

SEQ ID NO: 2572917 - protein, 10 aa, Entamoeba histolytica
RKNPDIENMT

SEQ ID NO: 2572918 - protein, 27 aa, Entamoeba histolytica
RKNTVDNTVNNPQFTAKDDNATNANFN

SEQ ID NO: 2572919 - protein, 9 aa, Entamoeba histolytica
RKNYKQEEH

SEQ ID NO: 2572920 - protein, 7 aa, Entamoeba histolytica
RKPGVAK

SEQ ID NO: 2572921 - protein, 9 aa, Entamoeba histolytica
RKPRDPNSN

SEQ ID NO: 2572922 - protein, 4 aa, Entamoeba histolytica
RKPT

SEQ ID NO: 2572923 - protein, 5 aa, Entamoeba histolytica
RKPVD

SEQ ID NO: 2572924 - protein, 12 aa, Entamoeba histolytica
RKQCNEPMNKNN

SEQ ID NO: 2572925 - protein, 7 aa, Entamoeba histolytica
RKQEIEN

SEQ ID NO: 2572926 - protein, 4 aa, Entamoeba histolytica
RKQF

SEQ ID NO: 2572927 - protein, 6 aa, Entamoeba histolytica
RKQKGE

SEQ ID NO: 2572928 - protein, 12 aa, Entamoeba histolytica
RKQKQTMETYQQ

SEQ ID NO: 2572929 - protein, 23 aa, Entamoeba histolytica
RKQNNKPQFKYNSETNTLEIDGN

SEQ ID NO: 2572930 - protein, 23 aa, Entamoeba histolytica
RKQNNKPRFKYNSETNTLEIDGN

SEQ ID NO: 2572931 - protein, 24 aa, Entamoeba histolytica
RKQNNKPRFKYNSETNTLEIDGSN

SEQ ID NO: 2572932 - protein, 24 aa, Entamoeba histolytica
RKQNNKSQFKYNSETNTLEIDGSN

SEQ ID NO: 2572933 - protein, 5 aa, Entamoeba histolytica
RKRDR

SEQ ID NO: 2572934 - protein, 45 aa, Entamoeba histolytica
RKRGGSNSKSENEVKRENGEEIAYEPKISTKNESTEPTDEERVNQ

SEQ ID NO: 2572935 - protein, 17 aa, Entamoeba histolytica
RKRKQDYDQNPENHEIE

SEQ ID NO: 2572936 - protein, 12 aa, Entamoeba histolytica
RKRSEIEETSNI

SEQ ID NO: 2572937 - protein, 6 aa, Entamoeba histolytica
RKRSVK

SEQ ID NO: 2572938 - protein, 31 aa, Entamoeba histolytica
RKSEKFTKKQFENKTKKSKKQKKEEDELKEL

SEQ ID NO: 2572939 - protein, 7 aa, Entamoeba histolytica
RKSGDNV

SEQ ID NO: 2572940 - protein, 12 aa, Entamoeba histolytica
RKSGIEIPKASE

SEQ ID NO: 2572941 - protein, 16 aa, Entamoeba histolytica
RKSPQDPFSEEGEKNF

SEQ ID NO: 2572942 - protein, 8 aa, Entamoeba histolytica
RKSSQPFT

SEQ ID NO: 2572943 - protein, 24 aa, Entamoeba histolytica
RKSSSLKSKGIDLPQEDNGKEEIL

SEQ ID NO: 2572944 - protein, 13 aa, Entamoeba histolytica
RKSSVVAEKLLEL

SEQ ID NO: 2572945 - protein, 4 aa, Entamoeba histolytica
RKTF

SEQ ID NO: 2572946 - protein, 222 aa, Entamoeba histolytica
RKTNVNGHWSGKQFDNNRDNFKENTNRLTSSGIDVRKDSGISMNPSSSKPSPQFAQPSLASQSKSISEITAERQAANTNSINSQTSNSLNNTSNTNNNSNQLSNTTNNTNLNNSTQLNNNGTQLNNSTQLNNGTQLNNTTQLNNGTQLNNGTQLNNGTQLNNSTQLNNSTQLNNSTQLNNSTQLNNGTQLNNGTQLNNGTQLNNSKRSSNIMQSKGTTNLNN

SEQ ID NO: 2572947 - protein, 8 aa, Entamoeba histolytica
RKTPATQI

SEQ ID NO: 2572948 - protein, 7 aa, Entamoeba histolytica
RKTRGLE

SEQ ID NO: 2572949 - protein, 9 aa, Entamoeba histolytica
RKTSEGLSP

SEQ ID NO: 2572950 - protein, 8 aa, Entamoeba histolytica
RKTTSGKF

SEQ ID NO: 2572951 - protein, 6 aa, Entamoeba histolytica
RKTVLP

SEQ ID NO: 2572952 - protein, 8 aa, Entamoeba histolytica
RKVGNDAE

SEQ ID NO: 2572953 - protein, 7 aa, Entamoeba histolytica
RKVSDPV

SEQ ID NO: 2572954 - protein, 14 aa, Entamoeba histolytica
RKYGKRKGQNQKKI

SEQ ID NO: 2572955 - protein, 4 aa, Entamoeba histolytica
RKYK

SEQ ID NO: 2572956 - protein, 6 aa, Entamoeba histolytica
RLDSAG

SEQ ID NO: 2572957 - protein, 10 aa, Entamoeba histolytica
RLEKPTKLPD

SEQ ID NO: 2572958 - protein, 8 aa, Entamoeba histolytica
RLERKDTM

SEQ ID NO: 2572959 - protein, 10 aa, Entamoeba histolytica
RLERPDKMPD

SEQ ID NO: 2572960 - protein, 7 aa, Entamoeba histolytica
RLGKDES

SEQ ID NO: 2572961 - protein, 19 aa, Entamoeba histolytica
RLGPSSQIKIKPNATTIDS

SEQ ID NO: 2572962 - protein, 4 aa, Entamoeba histolytica
RLGQ

SEQ ID NO: 2572963 - protein, 4 aa, Entamoeba histolytica
RLGS

SEQ ID NO: 2572964 - protein, 7 aa, Entamoeba histolytica
RLKAANS

SEQ ID NO: 2572965 - protein, 15 aa, Entamoeba histolytica
RLKEEKELEKTNNQI

SEQ ID NO: 2572966 - protein, 4 aa, Entamoeba histolytica
RLNA

SEQ ID NO: 2572967 - protein, 9 aa, Entamoeba histolytica
RLNNETDKY

SEQ ID NO: 2572968 - protein, 8 aa, Entamoeba histolytica
RLNSPNKT

SEQ ID NO: 2572969 - protein, 14 aa, Entamoeba histolytica
RLNSSFNQSSIEKI

SEQ ID NO: 2572970 - protein, 6 aa, Entamoeba histolytica
RLPEDI

SEQ ID NO: 2572971 - protein, 10 aa, Entamoeba histolytica
RLPKPDGIPE

SEQ ID NO: 2572972 - protein, 11 aa, Entamoeba histolytica
RLPKVSSITDE

SEQ ID NO: 2572973 - protein, 15 aa, Entamoeba histolytica
RLPSNMTRNERKNSQ

SEQ ID NO: 2572974 - protein, 9 aa, Entamoeba histolytica
RLPTEEERA

SEQ ID NO: 2572975 - protein, 9 aa, Entamoeba histolytica
RLSCEEKSM

SEQ ID NO: 2572976 - protein, 8 aa, Entamoeba histolytica
RLSGQEEK

SEQ ID NO: 2572977 - protein, 6 aa, Entamoeba histolytica
RLSQTK

SEQ ID NO: 2572978 - protein, 7 aa, Entamoeba histolytica
RLSYTSG

SEQ ID NO: 2572979 - protein, 8 aa, Entamoeba histolytica
RLTDSHTL

SEQ ID NO: 2572980 - protein, 6 aa, Entamoeba histolytica
RLYETS

SEQ ID NO: 2572981 - protein, 6 aa, Entamoeba histolytica
RMGSPE

SEQ ID NO: 2572982 - protein, 4 aa, Entamoeba histolytica
RMKE

SEQ ID NO: 2572983 - protein, 11 aa, Entamoeba histolytica
RMKTSSPSGGM

SEQ ID NO: 2572984 - protein, 6 aa, Entamoeba histolytica
RNCPGG

SEQ ID NO: 2572985 - protein, 10 aa, Entamoeba histolytica
RNDACASDIG

SEQ ID NO: 2572986 - protein, 5 aa, Entamoeba histolytica
RNDFN

SEQ ID NO: 2572987 - protein, 6 aa, Entamoeba histolytica
RNECNK

SEQ ID NO: 2572988 - protein, 13 aa, Entamoeba histolytica
RNEEESEKQIEKE

SEQ ID NO: 2572989 - protein, 11 aa, Entamoeba histolytica
RNEEKGLDNDS

SEQ ID NO: 2572990 - protein, 25 aa, Entamoeba histolytica
RNEKIPSELPTGLTQGRTTEDGPVT

SEQ ID NO: 2572991 - protein, 5 aa, Entamoeba histolytica
RNELK

SEQ ID NO: 2572992 - protein, 10 aa, Entamoeba histolytica
RNELSESIQT

SEQ ID NO: 2572993 - protein, 5 aa, Entamoeba histolytica
RNEPR

SEQ ID NO: 2572994 - protein, 7 aa, Entamoeba histolytica
RNEPYKY

SEQ ID NO: 2572995 - protein, 6 aa, Entamoeba histolytica
RNEQQL

SEQ ID NO: 2572996 - protein, 7 aa, Entamoeba histolytica
RNERSTC

SEQ ID NO: 2572997 - protein, 17 aa, Entamoeba histolytica
RNESTKGELSEKSSIKL

SEQ ID NO: 2572998 - protein, 7 aa, Entamoeba histolytica
RNESYNE

SEQ ID NO: 2572999 - protein, 6 aa, Entamoeba histolytica
RNFGKN

SEQ ID NO: 2573000 - protein, 9 aa, Entamoeba histolytica
RNFQKETGK

SEQ ID NO: 2573001 - protein, 7 aa, Entamoeba histolytica
RNGAGSI

SEQ ID NO: 2573002 - protein, 16 aa, Entamoeba histolytica
RNGEFQSFEKESTENL

SEQ ID NO: 2573003 - protein, 9 aa, Entamoeba histolytica
RNGENQKTS

SEQ ID NO: 2573004 - protein, 7 aa, Entamoeba histolytica
RNGEQQQ

SEQ ID NO: 2573005 - protein, 9 aa, Entamoeba histolytica
RNGESSSYK

SEQ ID NO: 2573006 - protein, 8 aa, Entamoeba histolytica
RNGGEAEQ

SEQ ID NO: 2573007 - protein, 7 aa, Entamoeba histolytica
RNGNDVG

SEQ ID NO: 2573008 - protein, 4 aa, Entamoeba histolytica
RNGQ

SEQ ID NO: 2573009 - protein, 7 aa, Entamoeba histolytica
RNGQLYS

SEQ ID NO: 2573010 - protein, 9 aa, Entamoeba histolytica
RNGSSQNPF

SEQ ID NO: 2573011 - protein, 36 aa, Entamoeba histolytica
RNIENSRNRINKQKVQPQVSQPHSNASMLPPFNSDN

SEQ ID NO: 2573012 - protein, 18 aa, Entamoeba histolytica
RNIGTYDGNDISKCNKDT

SEQ ID NO: 2573013 - protein, 8 aa, Entamoeba histolytica
RNKAYFDG

SEQ ID NO: 2573014 - protein, 9 aa, Entamoeba histolytica
RNKDSKITY

SEQ ID NO: 2573015 - protein, 7 aa, Entamoeba histolytica
RNKDWEE

SEQ ID NO: 2573016 - protein, 9 aa, Entamoeba histolytica
RNKETNNRQ

SEQ ID NO: 2573017 - protein, 4 aa, Entamoeba histolytica
RNKI

SEQ ID NO: 2573018 - protein, 15 aa, Entamoeba histolytica
RNKKEGFPDNSVKTT

SEQ ID NO: 2573019 - protein, 39 aa, Entamoeba histolytica
RNKQIFSDNEEQSLAPNETNNEPPKTFGEIEEEQQPKRL

SEQ ID NO: 2573020 - protein, 9 aa, Entamoeba histolytica
RNLPGDDMT

SEQ ID NO: 2573021 - protein, 5 aa, Entamoeba histolytica
RNLSS

SEQ ID NO: 2573022 - protein, 4 aa, Entamoeba histolytica
RNLT

SEQ ID NO: 2573023 - protein, 5 aa, Entamoeba histolytica
RNNAT

SEQ ID NO: 2573024 - protein, 18 aa, Entamoeba histolytica
RNNPQLLQDSSSTNSSSS

SEQ ID NO: 2573025 - protein, 9 aa, Entamoeba histolytica
RNNTDVPQR

SEQ ID NO: 2573026 - protein, 6 aa, Entamoeba histolytica
RNPDFP

SEQ ID NO: 2573027 - protein, 7 aa, Entamoeba histolytica
RNPHNTL

SEQ ID NO: 2573028 - protein, 5 aa, Entamoeba histolytica
RNPTE

SEQ ID NO: 2573029 - protein, 17 aa, Entamoeba histolytica
RNPTTTSSLNKIKEANE

SEQ ID NO: 2573030 - protein, 7 aa, Entamoeba histolytica
RNPYGRC

SEQ ID NO: 2573031 - protein, 9 aa, Entamoeba histolytica
RNQALGKKN

SEQ ID NO: 2573032 - protein, 4 aa, Entamoeba histolytica
RNQI

SEQ ID NO: 2573033 - protein, 5 aa, Entamoeba histolytica
RNQKY

SEQ ID NO: 2573034 - protein, 7 aa, Entamoeba histolytica
RNQLTNK

SEQ ID NO: 2573035 - protein, 6 aa, Entamoeba histolytica
RNQNDI

SEQ ID NO: 2573036 - protein, 22 aa, Entamoeba histolytica
RNQTEETYSKEDRDKHNLMTQG

SEQ ID NO: 2573037 - protein, 19 aa, Entamoeba histolytica
RNRKEEKTNFKKVSDEPDS

SEQ ID NO: 2573038 - protein, 29 aa, Entamoeba histolytica
RNRSDITRSEAKALRKKEKNVKGHESVSD

SEQ ID NO: 2573039 - protein, 39 aa, Entamoeba histolytica
RNRSTTPNTAKLEKQKAKLEKKKAKKIESLTKKGLSQEE

SEQ ID NO: 2573040 - protein, 10 aa, Entamoeba histolytica
RNRYSSPPIY

SEQ ID NO: 2573041 - protein, 6 aa, Entamoeba histolytica
RNSGDL

SEQ ID NO: 2573042 - protein, 6 aa, Entamoeba histolytica
RNSHPG

SEQ ID NO: 2573043 - protein, 9 aa, Entamoeba histolytica
RNSKDGGVY

SEQ ID NO: 2573044 - protein, 9 aa, Entamoeba histolytica
RNSLDSQPQ

SEQ ID NO: 2573045 - protein, 6 aa, Entamoeba histolytica
RNSPQR

SEQ ID NO: 2573046 - protein, 4 aa, Entamoeba histolytica
RNST

SEQ ID NO: 2573047 - protein, 7 aa, Entamoeba histolytica
RNSTNLD

SEQ ID NO: 2573048 - protein, 4 aa, Entamoeba histolytica
RNTE

SEQ ID NO: 2573049 - protein, 8 aa, Entamoeba histolytica
RNTQEERK

SEQ ID NO: 2573050 - protein, 6 aa, Entamoeba histolytica
RNTSKI

SEQ ID NO: 2573051 - protein, 4 aa, Entamoeba histolytica
RNYC

SEQ ID NO: 2573052 - protein, 4 aa, Entamoeba histolytica
RNYE

SEQ ID NO: 2573053 - protein, 8 aa, Entamoeba histolytica
RNYTGNKV

SEQ ID NO: 2573054 - protein, 6 aa, Entamoeba histolytica
RPAIAQ

SEQ ID NO: 2573055 - protein, 7 aa, Entamoeba histolytica
RPDIQSK

SEQ ID NO: 2573056 - protein, 10 aa, Entamoeba histolytica
RPDSVYSNNN

SEQ ID NO: 2573057 - protein, 5 aa, Entamoeba histolytica
RPELE

SEQ ID NO: 2573058 - protein, 12 aa, Entamoeba histolytica
RPEPLKSAQIKE

SEQ ID NO: 2573059 - protein, 6 aa, Entamoeba histolytica
RPEQSD

SEQ ID NO: 2573060 - protein, 5 aa, Entamoeba histolytica
RPERD

SEQ ID NO: 2573061 - protein, 6 aa, Entamoeba histolytica
RPERMA

SEQ ID NO: 2573062 - protein, 15 aa, Entamoeba histolytica
RPERNSGRVKAATKC

SEQ ID NO: 2573063 - protein, 9 aa, Entamoeba histolytica
RPGEERPTL

SEQ ID NO: 2573064 - protein, 7 aa, Entamoeba histolytica
RPGETGE

SEQ ID NO: 2573065 - protein, 4 aa, Entamoeba histolytica
RPHS

SEQ ID NO: 2573066 - protein, 4 aa, Entamoeba histolytica
RPKF

SEQ ID NO: 2573067 - protein, 12 aa, Entamoeba histolytica
RPKKQKETTYPQ

SEQ ID NO: 2573068 - protein, 8 aa, Entamoeba histolytica
RPLPPDID

SEQ ID NO: 2573069 - protein, 6 aa, Entamoeba histolytica
RPNPSK

SEQ ID NO: 2573070 - protein, 4 aa, Entamoeba histolytica
RPPL

SEQ ID NO: 2573071 - protein, 7 aa, Entamoeba histolytica
RPPPDGI

SEQ ID NO: 2573072 - protein, 8 aa, Entamoeba histolytica
RPPQEYAT

SEQ ID NO: 2573073 - protein, 18 aa, Entamoeba histolytica
RPRKPQPASERKDLHSKS

SEQ ID NO: 2573074 - protein, 9 aa, Entamoeba histolytica
RPRNESNTY

SEQ ID NO: 2573075 - protein, 8 aa, Entamoeba histolytica
RPRRTDDR

SEQ ID NO: 2573076 - protein, 6 aa, Entamoeba histolytica
RPSFSS

SEQ ID NO: 2573077 - protein, 5 aa, Entamoeba histolytica
RPSNI

SEQ ID NO: 2573078 - protein, 6 aa, Entamoeba histolytica
RPSTIN

SEQ ID NO: 2573079 - protein, 14 aa, Entamoeba histolytica
RPSTLKTQKKTSNV

SEQ ID NO: 2573080 - protein, 21 aa, Entamoeba histolytica
RPSTVNKNNPFDLSHSKTFED

SEQ ID NO: 2573081 - protein, 4 aa, Entamoeba histolytica
RPTP

SEQ ID NO: 2573082 - protein, 5 aa, Entamoeba histolytica
RPYES

SEQ ID NO: 2573083 - protein, 5 aa, Entamoeba histolytica
RPYGE

SEQ ID NO: 2573084 - protein, 5 aa, Entamoeba histolytica
RPYPE

SEQ ID NO: 2573085 - protein, 8 aa, Entamoeba histolytica
RQADGSGL

SEQ ID NO: 2573086 - protein, 6 aa, Entamoeba histolytica
RQAESE

SEQ ID NO: 2573087 - protein, 8 aa, Entamoeba histolytica
RQEAEKEK

SEQ ID NO: 2573088 - protein, 20 aa, Entamoeba histolytica
RQEELPTQSKKQQKKEEEER

SEQ ID NO: 2573089 - protein, 6 aa, Entamoeba histolytica
RQESHG

SEQ ID NO: 2573090 - protein, 8 aa, Entamoeba histolytica
RQFDNSDA

SEQ ID NO: 2573091 - protein, 6 aa, Entamoeba histolytica
RQFGES

SEQ ID NO: 2573092 - protein, 7 aa, Entamoeba histolytica
RQHNAYK

SEQ ID NO: 2573093 - protein, 8 aa, Entamoeba histolytica
RQKFKSRN

SEQ ID NO: 2573094 - protein, 14 aa, Entamoeba histolytica
RQKHNYDPQRTECQ

SEQ ID NO: 2573095 - protein, 9 aa, Entamoeba histolytica
RQKKQSIRN

SEQ ID NO: 2573096 - protein, 4 aa, Entamoeba histolytica
RQKP

SEQ ID NO: 2573097 - protein, 17 aa, Entamoeba histolytica
RQKTDRSNESVSNDERK

SEQ ID NO: 2573098 - protein, 7 aa, Entamoeba histolytica
RQNANKL

SEQ ID NO: 2573099 - protein, 6 aa, Entamoeba histolytica
RQNKDE

SEQ ID NO: 2573100 - protein, 8 aa, Entamoeba histolytica
RQPIPEKK

SEQ ID NO: 2573101 - protein, 5 aa, Entamoeba histolytica
RQPLT

SEQ ID NO: 2573102 - protein, 8 aa, Entamoeba histolytica
RQPTKEEI

SEQ ID NO: 2573103 - protein, 9 aa, Entamoeba histolytica
RQSDYSQQQ

SEQ ID NO: 2573104 - protein, 6 aa, Entamoeba histolytica
RQSPDE

SEQ ID NO: 2573105 - protein, 10 aa, Entamoeba histolytica
RQSRKTEKTI

SEQ ID NO: 2573106 - protein, 5 aa, Entamoeba histolytica
RQTAD

SEQ ID NO: 2573107 - protein, 18 aa, Entamoeba histolytica
RQTNASDIKKSIPSNVDG

SEQ ID NO: 2573108 - protein, 11 aa, Entamoeba histolytica
RQYNSSYGGGI

SEQ ID NO: 2573109 - protein, 9 aa, Entamoeba histolytica
RRDDNNQYY

SEQ ID NO: 2573110 - protein, 9 aa, Entamoeba histolytica
RRDGSGLSP

SEQ ID NO: 2573111 - protein, 9 aa, Entamoeba histolytica
RRDNETELP

SEQ ID NO: 2573112 - protein, 5 aa, Entamoeba histolytica
RRDNY

SEQ ID NO: 2573113 - protein, 10 aa, Entamoeba histolytica
RRDPKKESWE

SEQ ID NO: 2573114 - protein, 6 aa, Entamoeba histolytica
RRDRNM

SEQ ID NO: 2573115 - protein, 16 aa, Entamoeba histolytica
RRDRRSLNSQPSSPFF

SEQ ID NO: 2573116 - protein, 7 aa, Entamoeba histolytica
RRERDEQ

SEQ ID NO: 2573117 - protein, 9 aa, Entamoeba histolytica
RRESGKGLY

SEQ ID NO: 2573118 - protein, 6 aa, Entamoeba histolytica
RRESKL

SEQ ID NO: 2573119 - protein, 6 aa, Entamoeba histolytica
RRGRYK

SEQ ID NO: 2573120 - protein, 4 aa, Entamoeba histolytica
RRGY

SEQ ID NO: 2573121 - protein, 9 aa, Entamoeba histolytica
RRHRQMKEE

SEQ ID NO: 2573122 - protein, 12 aa, Entamoeba histolytica
RRITKKKVHQAT

SEQ ID NO: 2573123 - protein, 5 aa, Entamoeba histolytica
RRKDI

SEQ ID NO: 2573124 - protein, 14 aa, Entamoeba histolytica
RRKQNEVELEDIRE

SEQ ID NO: 2573125 - protein, 9 aa, Entamoeba histolytica
RRMTPQERS

SEQ ID NO: 2573126 - protein, 35 aa, Entamoeba histolytica
RRNAKRLSREEQPTPLSTVTQPQKPNNTSDEADDI

SEQ ID NO: 2573127 - protein, 26 aa, Entamoeba histolytica
RRNDLGESKIKNPKSEDNDVQKEYKK

SEQ ID NO: 2573128 - protein, 6 aa, Entamoeba histolytica
RRPEDS

SEQ ID NO: 2573129 - protein, 7 aa, Entamoeba histolytica
RRPERAK

SEQ ID NO: 2573130 - protein, 13 aa, Entamoeba histolytica
RRQAKRADPTNQD

SEQ ID NO: 2573131 - protein, 6 aa, Entamoeba histolytica
RRQGNV

SEQ ID NO: 2573132 - protein, 7 aa, Entamoeba histolytica
RRREKGH

SEQ ID NO: 2573133 - protein, 15 aa, Entamoeba histolytica
RRRREKIEKPEKDYE

SEQ ID NO: 2573134 - protein, 7 aa, Entamoeba histolytica
RRSEEKE

SEQ ID NO: 2573135 - protein, 9 aa, Entamoeba histolytica
RRSEERRGI

SEQ ID NO: 2573136 - protein, 16 aa, Entamoeba histolytica
RRSRDITPTQQEQHET

SEQ ID NO: 2573137 - protein, 7 aa, Entamoeba histolytica
RRTNNEI

SEQ ID NO: 2573138 - protein, 12 aa, Entamoeba histolytica
RRTTRKGNTYKY

SEQ ID NO: 2573139 - protein, 13 aa, Entamoeba histolytica
RRTVADAKKTAQL

SEQ ID NO: 2573140 - protein, 14 aa, Entamoeba histolytica
RSAGTNDITIFHIK

SEQ ID NO: 2573141 - protein, 17 aa, Entamoeba histolytica
RSAGTNDITIFHIKPLE

SEQ ID NO: 2573142 - protein, 9 aa, Entamoeba histolytica
RSDARVKEH

SEQ ID NO: 2573143 - protein, 7 aa, Entamoeba histolytica
RSDEIDI

SEQ ID NO: 2573144 - protein, 5 aa, Entamoeba histolytica
RSDES

SEQ ID NO: 2573145 - protein, 8 aa, Entamoeba histolytica
RSDGIDNP

SEQ ID NO: 2573146 - protein, 5 aa, Entamoeba histolytica
RSDGN

SEQ ID NO: 2573147 - protein, 5 aa, Entamoeba histolytica
RSDIT

SEQ ID NO: 2573148 - protein, 12 aa, Entamoeba histolytica
RSDQRNKNEIQK

SEQ ID NO: 2573149 - protein, 8 aa, Entamoeba histolytica
RSDSDGRP

SEQ ID NO: 2573150 - protein, 13 aa, Entamoeba histolytica
RSDSRTKTKIAPI

SEQ ID NO: 2573151 - protein, 7 aa, Entamoeba histolytica
RSEEGGY

SEQ ID NO: 2573152 - protein, 5 aa, Entamoeba histolytica
RSEGF

SEQ ID NO: 2573153 - protein, 5 aa, Entamoeba histolytica
RSEIP

SEQ ID NO: 2573154 - protein, 7 aa, Entamoeba histolytica
RSELTNE

SEQ ID NO: 2573155 - protein, 4 aa, Entamoeba histolytica
RSEN

SEQ ID NO: 2573156 - protein, 8 aa, Entamoeba histolytica
RSENIRQE

SEQ ID NO: 2573157 - protein, 5 aa, Entamoeba histolytica
RSEQT

SEQ ID NO: 2573158 - protein, 6 aa, Entamoeba histolytica
RSEQTV

SEQ ID NO: 2573159 - protein, 6 aa, Entamoeba histolytica
RSERDG

SEQ ID NO: 2573160 - protein, 7 aa, Entamoeba histolytica
RSETKYW

SEQ ID NO: 2573161 - protein, 15 aa, Entamoeba histolytica
RSGEIGRQMLKKTTS

SEQ ID NO: 2573162 - protein, 5 aa, Entamoeba histolytica
RSGLI

SEQ ID NO: 2573163 - protein, 5 aa, Entamoeba histolytica
RSGNA

SEQ ID NO: 2573164 - protein, 5 aa, Entamoeba histolytica
RSGST

SEQ ID NO: 2573165 - protein, 12 aa, Entamoeba histolytica
RSGTSAGINNDT

SEQ ID NO: 2573166 - protein, 4 aa, Entamoeba histolytica
RSHG

SEQ ID NO: 2573167 - protein, 5 aa, Entamoeba histolytica
RSHTP

SEQ ID NO: 2573168 - protein, 5 aa, Entamoeba histolytica
RSIRP

SEQ ID NO: 2573169 - protein, 5 aa, Entamoeba histolytica
RSKDK

SEQ ID NO: 2573170 - protein, 7 aa, Entamoeba histolytica
RSKESEF

SEQ ID NO: 2573171 - protein, 8 aa, Entamoeba histolytica
RSKIDSQK

SEQ ID NO: 2573172 - protein, 9 aa, Entamoeba histolytica
RSKRRGIRG

SEQ ID NO: 2573173 - protein, 9 aa, Entamoeba histolytica
RSKSNTWTF

SEQ ID NO: 2573174 - protein, 4 aa, Entamoeba histolytica
RSLI

SEQ ID NO: 2573175 - protein, 17 aa, Entamoeba histolytica
RSLTGTINADSDLTIGS

SEQ ID NO: 2573176 - protein, 22 aa, Entamoeba histolytica
RSNKEAAYTQLEDGEKIPEKQA

SEQ ID NO: 2573177 - protein, 7 aa, Entamoeba histolytica
RSNNETV

SEQ ID NO: 2573178 - protein, 6 aa, Entamoeba histolytica
RSNPNY

SEQ ID NO: 2573179 - protein, 6 aa, Entamoeba histolytica
RSNPTK

SEQ ID NO: 2573180 - protein, 7 aa, Entamoeba histolytica
RSNQRQS

SEQ ID NO: 2573181 - protein, 7 aa, Entamoeba histolytica
RSNQRVG

SEQ ID NO: 2573182 - protein, 7 aa, Entamoeba histolytica
RSNTSYF

SEQ ID NO: 2573183 - protein, 5 aa, Entamoeba histolytica
RSPFR

SEQ ID NO: 2573184 - protein, 8 aa, Entamoeba histolytica
RSPNDYKS

SEQ ID NO: 2573185 - protein, 30 aa, Entamoeba histolytica
RSPYAYTDERKTEVTKGEGENNKGEENIPP

SEQ ID NO: 2573186 - protein, 6 aa, Entamoeba histolytica
RSQGDY

SEQ ID NO: 2573187 - protein, 35 aa, Entamoeba histolytica
RSQKQNNEEEITNSLSTSSNPEKKGNESISNKPMA

SEQ ID NO: 2573188 - protein, 15 aa, Entamoeba histolytica
RSQNPEEERKSVDKE

SEQ ID NO: 2573189 - protein, 10 aa, Entamoeba histolytica
RSQQKVISSS

SEQ ID NO: 2573190 - protein, 6 aa, Entamoeba histolytica
RSQTEL

SEQ ID NO: 2573191 - protein, 4 aa, Entamoeba histolytica
RSRF

SEQ ID NO: 2573192 - protein, 19 aa, Entamoeba histolytica
RSRLNKPKISRNKINNEEN

SEQ ID NO: 2573193 - protein, 8 aa, Entamoeba histolytica
RSSDGTIK

SEQ ID NO: 2573194 - protein, 8 aa, Entamoeba histolytica
RSSDMVTS

SEQ ID NO: 2573195 - protein, 5 aa, Entamoeba histolytica
RSSEH

SEQ ID NO: 2573196 - protein, 5 aa, Entamoeba histolytica
RSSGV

SEQ ID NO: 2573197 - protein, 8 aa, Entamoeba histolytica
RSSIERTS

SEQ ID NO: 2573198 - protein, 10 aa, Entamoeba histolytica
RSSNGAEGLS

SEQ ID NO: 2573199 - protein, 7 aa, Entamoeba histolytica
RSSNKCN

SEQ ID NO: 2573200 - protein, 4 aa, Entamoeba histolytica
RSSS

SEQ ID NO: 2573201 - protein, 7 aa, Entamoeba histolytica
RSSSADS

SEQ ID NO: 2573202 - protein, 26 aa, Entamoeba histolytica
RSSSHHSHVSSRNSSSIKESSSFPTR

SEQ ID NO: 2573203 - protein, 55 aa, Entamoeba histolytica
RSSTLENELGNTSKRNTNTTTKQEEEKKDNFSEKSQSKSSADSSIEEFDGKLEAI

SEQ ID NO: 2573204 - protein, 11 aa, Entamoeba histolytica
RSTAGECPTEC

SEQ ID NO: 2573205 - protein, 10 aa, Entamoeba histolytica
RSTDGKEHEC

SEQ ID NO: 2573206 - protein, 8 aa, Entamoeba histolytica
RSTIDTGY

SEQ ID NO: 2573207 - protein, 12 aa, Entamoeba histolytica
RSTKDRDEYKED

SEQ ID NO: 2573208 - protein, 4 aa, Entamoeba histolytica
RSTM

SEQ ID NO: 2573209 - protein, 11 aa, Entamoeba histolytica
RSTNDSSTVSE

SEQ ID NO: 2573210 - protein, 11 aa, Entamoeba histolytica
RSTSAKSEEEK

SEQ ID NO: 2573211 - protein, 9 aa, Entamoeba histolytica
RSTSGYEGV

SEQ ID NO: 2573212 - protein, 9 aa, Entamoeba histolytica
RSVKAETAA

SEQ ID NO: 2573213 - protein, 6 aa, Entamoeba histolytica
RSVKST

SEQ ID NO: 2573214 - protein, 15 aa, Entamoeba histolytica
RSVPSEPSESSRYSI

SEQ ID NO: 2573215 - protein, 6 aa, Entamoeba histolytica
RSWRNK

SEQ ID NO: 2573216 - protein, 9 aa, Entamoeba histolytica
RSYPIGEGE

SEQ ID NO: 2573217 - protein, 13 aa, Entamoeba histolytica
RSYQTQPSSQGTV

SEQ ID NO: 2573218 - protein, 5 aa, Entamoeba histolytica
RTDAL

SEQ ID NO: 2573219 - protein, 23 aa, Entamoeba histolytica
RTDNGPAQYNPGYGYYNPQQQYR

SEQ ID NO: 2573220 - protein, 6 aa, Entamoeba histolytica
RTEEFT

SEQ ID NO: 2573221 - protein, 30 aa, Entamoeba histolytica
RTENQSLISNDSLSTDQNQEVNFFAIQNRD

SEQ ID NO: 2573222 - protein, 14 aa, Entamoeba histolytica
RTERIQEQLKEINQ

SEQ ID NO: 2573223 - protein, 11 aa, Entamoeba histolytica
RTETKEQYPFN

SEQ ID NO: 2573224 - protein, 13 aa, Entamoeba histolytica
RTFPNDPQMTEDK

SEQ ID NO: 2573225 - protein, 7 aa, Entamoeba histolytica
RTFTSGI

SEQ ID NO: 2573226 - protein, 15 aa, Entamoeba histolytica
RTGAMSGKLANKGGV

SEQ ID NO: 2573227 - protein, 5 aa, Entamoeba histolytica
RTGKL

SEQ ID NO: 2573228 - protein, 6 aa, Entamoeba histolytica
RTHDGM

SEQ ID NO: 2573229 - protein, 6 aa, Entamoeba histolytica
RTIDGT

SEQ ID NO: 2573230 - protein, 6 aa, Entamoeba histolytica
RTIESK

SEQ ID NO: 2573231 - protein, 6 aa, Entamoeba histolytica
RTIKGT

SEQ ID NO: 2573232 - protein, 13 aa, Entamoeba histolytica
RTINRKPSDNQHF

SEQ ID NO: 2573233 - protein, 7 aa, Entamoeba histolytica
RTIPSYS

SEQ ID NO: 2573234 - protein, 5 aa, Entamoeba histolytica
RTIPT

SEQ ID NO: 2573235 - protein, 15 aa, Entamoeba histolytica
RTKEGLSDSIENPKV

SEQ ID NO: 2573236 - protein, 6 aa, Entamoeba histolytica
RTKGML

SEQ ID NO: 2573237 - protein, 10 aa, Entamoeba histolytica
RTKKNTRTVR

SEQ ID NO: 2573238 - protein, 6 aa, Entamoeba histolytica
RTKNNP

SEQ ID NO: 2573239 - protein, 9 aa, Entamoeba histolytica
RTKQMEESE

SEQ ID NO: 2573240 - protein, 7 aa, Entamoeba histolytica
RTKTKGL

SEQ ID NO: 2573241 - protein, 10 aa, Entamoeba histolytica
RTNGGDNYKC

SEQ ID NO: 2573242 - protein, 10 aa, Entamoeba histolytica
RTNKPTEMLN

SEQ ID NO: 2573243 - protein, 5 aa, Entamoeba histolytica
RTNKY

SEQ ID NO: 2573244 - protein, 8 aa, Entamoeba histolytica
RTPGSQEW

SEQ ID NO: 2573245 - protein, 14 aa, Entamoeba histolytica
RTQRMQDQLNEISH

SEQ ID NO: 2573246 - protein, 7 aa, Entamoeba histolytica
RTRNEKD

SEQ ID NO: 2573247 - protein, 10 aa, Entamoeba histolytica
RTRPQPCDSI

SEQ ID NO: 2573248 - protein, 4 aa, Entamoeba histolytica
RTSK

SEQ ID NO: 2573249 - protein, 5 aa, Entamoeba histolytica
RTSKP

SEQ ID NO: 2573250 - protein, 16 aa, Entamoeba histolytica
RTSNDKAFVGNRADTA

SEQ ID NO: 2573251 - protein, 8 aa, Entamoeba histolytica
RTSNGQET

SEQ ID NO: 2573252 - protein, 4 aa, Entamoeba histolytica
RTSS

SEQ ID NO: 2573253 - protein, 11 aa, Entamoeba histolytica
RTSTEKQTEIT

SEQ ID NO: 2573254 - protein, 4 aa, Entamoeba histolytica
RTTF

SEQ ID NO: 2573255 - protein, 5 aa, Entamoeba histolytica
RTTGN

SEQ ID NO: 2573256 - protein, 10 aa, Entamoeba histolytica
RTTIKKEKNE

SEQ ID NO: 2573257 - protein, 13 aa, Entamoeba histolytica
RTTKKSAKEACNG

SEQ ID NO: 2573258 - protein, 7 aa, Entamoeba histolytica
RTTPECS

SEQ ID NO: 2573259 - protein, 7 aa, Entamoeba histolytica
RTTPNYS

SEQ ID NO: 2573260 - protein, 7 aa, Entamoeba histolytica
RTTSTFP

SEQ ID NO: 2573261 - protein, 7 aa, Entamoeba histolytica
RTTYSNS

SEQ ID NO: 2573262 - protein, 16 aa, Entamoeba histolytica
RTVRSKVNGPQQEDDY

SEQ ID NO: 2573263 - protein, 6 aa, Entamoeba histolytica
RTVTEA

SEQ ID NO: 2573264 - protein, 7 aa, Entamoeba histolytica
RTYGGQE

SEQ ID NO: 2573265 - protein, 6 aa, Entamoeba histolytica
RVDAGA

SEQ ID NO: 2573266 - protein, 4 aa, Entamoeba histolytica
RVDD

SEQ ID NO: 2573267 - protein, 7 aa, Entamoeba histolytica
RVDPTTQ

SEQ ID NO: 2573268 - protein, 14 aa, Entamoeba histolytica
RVDRRKERATGVKR

SEQ ID NO: 2573269 - protein, 5 aa, Entamoeba histolytica
RVDSG

SEQ ID NO: 2573270 - protein, 7 aa, Entamoeba histolytica
RVEGEVK

SEQ ID NO: 2573271 - protein, 8 aa, Entamoeba histolytica
RVERPSIA

SEQ ID NO: 2573272 - protein, 16 aa, Entamoeba histolytica
RVEYSGKQDATTPFEI

SEQ ID NO: 2573273 - protein, 10 aa, Entamoeba histolytica
RVGPKRIKER

SEQ ID NO: 2573274 - protein, 10 aa, Entamoeba histolytica
RVKTSNSLNV

SEQ ID NO: 2573275 - protein, 8 aa, Entamoeba histolytica
RVNQERLD

SEQ ID NO: 2573276 - protein, 8 aa, Entamoeba histolytica
RVSQPGTV

SEQ ID NO: 2573277 - protein, 8 aa, Entamoeba histolytica
RVSSSSRL

SEQ ID NO: 2573278 - protein, 11 aa, Entamoeba histolytica
RVTASSVSSIE

SEQ ID NO: 2573279 - protein, 8 aa, Entamoeba histolytica
RVTPQQKE

SEQ ID NO: 2573280 - protein, 17 aa, Entamoeba histolytica
RWDSYNEECDSTAGCGN

SEQ ID NO: 2573281 - protein, 7 aa, Entamoeba histolytica
RYAEGGK

SEQ ID NO: 2573282 - protein, 14 aa, Entamoeba histolytica
RYDEADSSVAGHDE

SEQ ID NO: 2573283 - protein, 12 aa, Entamoeba histolytica
RYDEDEPSYSNW

SEQ ID NO: 2573284 - protein, 5 aa, Entamoeba histolytica
RYDTY

SEQ ID NO: 2573285 - protein, 20 aa, Entamoeba histolytica
RYEEKEEKGITIKETKSNLT

SEQ ID NO: 2573286 - protein, 24 aa, Entamoeba histolytica
RYEEKEETKTIKETKSDITYEKKT

SEQ ID NO: 2573287 - protein, 5 aa, Entamoeba histolytica
RYENY

SEQ ID NO: 2573288 - protein, 5 aa, Entamoeba histolytica
RYEPD

SEQ ID NO: 2573289 - protein, 9 aa, Entamoeba histolytica
RYETPSQKL

SEQ ID NO: 2573290 - protein, 5 aa, Entamoeba histolytica
RYETQ

SEQ ID NO: 2573291 - protein, 8 aa, Entamoeba histolytica
RYGEEENK

SEQ ID NO: 2573292 - protein, 7 aa, Entamoeba histolytica
RYGEPSV

SEQ ID NO: 2573293 - protein, 5 aa, Entamoeba histolytica
RYGSY

SEQ ID NO: 2573294 - protein, 7 aa, Entamoeba histolytica
RYKGKTI

SEQ ID NO: 2573295 - protein, 6 aa, Entamoeba histolytica
RYKKNI

SEQ ID NO: 2573296 - protein, 8 aa, Entamoeba histolytica
RYNERSKS

SEQ ID NO: 2573297 - protein, 5 aa, Entamoeba histolytica
RYNNE

SEQ ID NO: 2573298 - protein, 7 aa, Entamoeba histolytica
RYPAHST

SEQ ID NO: 2573299 - protein, 11 aa, Entamoeba histolytica
RYPRNENGEIV

SEQ ID NO: 2573300 - protein, 6 aa, Entamoeba histolytica
RYSEEE

SEQ ID NO: 2573301 - protein, 5 aa, Entamoeba histolytica
RYSHQ

SEQ ID NO: 2573302 - protein, 18 aa, Entamoeba histolytica
RYSVEEEKKENSNQSIAN

SEQ ID NO: 2573303 - protein, 10 aa, Entamoeba histolytica
RYTDPSRPYT

SEQ ID NO: 2573304 - protein, 6 aa, Entamoeba histolytica
RYTGTN

SEQ ID NO: 2573305 - protein, 7 aa, Entamoeba histolytica
SAASPVA

SEQ ID NO: 2573306 - protein, 6 aa, Entamoeba histolytica
SACDNN

SEQ ID NO: 2573307 - protein, 26 aa, Entamoeba histolytica
SADFESKVQEQQKNANGRREARKPKL

SEQ ID NO: 2573308 - protein, 12 aa, Entamoeba histolytica
SADGFKSSATRL

SEQ ID NO: 2573309 - protein, 13 aa, Entamoeba histolytica
SADGGCPGNVGDV

SEQ ID NO: 2573310 - protein, 9 aa, Entamoeba histolytica
SADGLEQEC

SEQ ID NO: 2573311 - protein, 6 aa, Entamoeba histolytica
SADRSI

SEQ ID NO: 2573312 - protein, 9 aa, Entamoeba histolytica
SADSKRDEN

SEQ ID NO: 2573313 - protein, 4 aa, Entamoeba histolytica
SAED

SEQ ID NO: 2573314 - protein, 7 aa, Entamoeba histolytica
SAEINRK

SEQ ID NO: 2573315 - protein, 10 aa, Entamoeba histolytica
SAEKELYKKS

SEQ ID NO: 2573316 - protein, 6 aa, Entamoeba histolytica
SAETEN

SEQ ID NO: 2573317 - protein, 7 aa, Entamoeba histolytica
SAETKKN

SEQ ID NO: 2573318 - protein, 7 aa, Entamoeba histolytica
SAGGGGE

SEQ ID NO: 2573319 - protein, 5 aa, Entamoeba histolytica
SAGGI

SEQ ID NO: 2573320 - protein, 5 aa, Entamoeba histolytica
SAHAK

SEQ ID NO: 2573321 - protein, 11 aa, Entamoeba histolytica
SAKGSGNGIKE

SEQ ID NO: 2573322 - protein, 7 aa, Entamoeba histolytica
SAKQEIE

SEQ ID NO: 2573323 - protein, 35 aa, Entamoeba histolytica
SAKQLKNKQRNSIGRNPDSLRKEKGNKKSIGKEKI

SEQ ID NO: 2573324 - protein, 5 aa, Entamoeba histolytica
SAKRR

SEQ ID NO: 2573325 - protein, 8 aa, Entamoeba histolytica
SAKSKEDV

SEQ ID NO: 2573326 - protein, 5 aa, Entamoeba histolytica
SAKTK

SEQ ID NO: 2573327 - protein, 8 aa, Entamoeba histolytica
SAKYSTDD

SEQ ID NO: 2573328 - protein, 11 aa, Entamoeba histolytica
SALKNELGKRE

SEQ ID NO: 2573329 - protein, 17 aa, Entamoeba histolytica
SALKNKNKKEEKEPKDV

SEQ ID NO: 2573330 - protein, 4 aa, Entamoeba histolytica
SALS

SEQ ID NO: 2573331 - protein, 9 aa, Entamoeba histolytica
SALSRGEPI

SEQ ID NO: 2573332 - protein, 6 aa, Entamoeba histolytica
SALSTK

SEQ ID NO: 2573333 - protein, 8 aa, Entamoeba histolytica
SALSTKID

SEQ ID NO: 2573334 - protein, 8 aa, Entamoeba histolytica
SALSTKLD

SEQ ID NO: 2573335 - protein, 7 aa, Entamoeba histolytica
SANDRDI

SEQ ID NO: 2573336 - protein, 7 aa, Entamoeba histolytica
SANPSYD

SEQ ID NO: 2573337 - protein, 13 aa, Entamoeba histolytica
SANRDRLKASISN

SEQ ID NO: 2573338 - protein, 8 aa, Entamoeba histolytica
SANSTKPQ

SEQ ID NO: 2573339 - protein, 8 aa, Entamoeba histolytica
SAPIDNRK

SEQ ID NO: 2573340 - protein, 8 aa, Entamoeba histolytica
SAPLPSRL

SEQ ID NO: 2573341 - protein, 12 aa, Entamoeba histolytica
SAPPDSLAAKGN

SEQ ID NO: 2573342 - protein, 10 aa, Entamoeba histolytica
SAPTSSGKTL

SEQ ID NO: 2573343 - protein, 6 aa, Entamoeba histolytica
SAQNDP

SEQ ID NO: 2573344 - protein, 5 aa, Entamoeba histolytica
SAQTN

SEQ ID NO: 2573345 - protein, 8 aa, Entamoeba histolytica
SARDSGNM

SEQ ID NO: 2573346 - protein, 6 aa, Entamoeba histolytica
SARGID

SEQ ID NO: 2573347 - protein, 5 aa, Entamoeba histolytica
SARKR

SEQ ID NO: 2573348 - protein, 5 aa, Entamoeba histolytica
SARSP

SEQ ID NO: 2573349 - protein, 7 aa, Entamoeba histolytica
SARTSWE

SEQ ID NO: 2573350 - protein, 12 aa, Entamoeba histolytica
SASEQETENEKD

SEQ ID NO: 2573351 - protein, 4 aa, Entamoeba histolytica
SASG

SEQ ID NO: 2573352 - protein, 17 aa, Entamoeba histolytica
SASLSRSSSISPHSKPL

SEQ ID NO: 2573353 - protein, 11 aa, Entamoeba histolytica
SASNRRKMNNK

SEQ ID NO: 2573354 - protein, 13 aa, Entamoeba histolytica
SASNSASLSPSSG

SEQ ID NO: 2573355 - protein, 14 aa, Entamoeba histolytica
SASRTTTGNSAVEG

SEQ ID NO: 2573356 - protein, 6 aa, Entamoeba histolytica
SASRYG

SEQ ID NO: 2573357 - protein, 19 aa, Entamoeba histolytica
SATHSPPVKSKSPSISNDI

SEQ ID NO: 2573358 - protein, 4 aa, Entamoeba histolytica
SATL

SEQ ID NO: 2573359 - protein, 7 aa, Entamoeba histolytica
SATLTDT

SEQ ID NO: 2573360 - protein, 7 aa, Entamoeba histolytica
SATNPIT

SEQ ID NO: 2573361 - protein, 7 aa, Entamoeba histolytica
SATPSYF

SEQ ID NO: 2573362 - protein, 4 aa, Entamoeba histolytica
SATQ

SEQ ID NO: 2573363 - protein, 13 aa, Entamoeba histolytica
SATQLNKKRQHDM

SEQ ID NO: 2573364 - protein, 7 aa, Entamoeba histolytica
SATQLSG

SEQ ID NO: 2573365 - protein, 9 aa, Entamoeba histolytica
SATSAGTCA

SEQ ID NO: 2573366 - protein, 7 aa, Entamoeba histolytica
SATSSVP

SEQ ID NO: 2573367 - protein, 7 aa, Entamoeba histolytica
SATTSFA

SEQ ID NO: 2573368 - protein, 5 aa, Entamoeba histolytica
SATTY

SEQ ID NO: 2573369 - protein, 5 aa, Entamoeba histolytica
SCAKD

SEQ ID NO: 2573370 - protein, 11 aa, Entamoeba histolytica
SCDDSSKYFNG

SEQ ID NO: 2573371 - protein, 5 aa, Entamoeba histolytica
SCDEA

SEQ ID NO: 2573372 - protein, 17 aa, Entamoeba histolytica
SCDSSDLEKFNKSTKEF

SEQ ID NO: 2573373 - protein, 6 aa, Entamoeba histolytica
SCERSN

SEQ ID NO: 2573374 - protein, 7 aa, Entamoeba histolytica
SCESDVE

SEQ ID NO: 2573375 - protein, 12 aa, Entamoeba histolytica
SCETKTNEKTCL

SEQ ID NO: 2573376 - protein, 12 aa, Entamoeba histolytica
SCETKTNQNTCL

SEQ ID NO: 2573377 - protein, 12 aa, Entamoeba histolytica
SCFASQTGKYDG

SEQ ID NO: 2573378 - protein, 15 aa, Entamoeba histolytica
SCGDSCTDCNKTNNT

SEQ ID NO: 2573379 - protein, 18 aa, Entamoeba histolytica
SCGEETNTNIGVTASGDY

SEQ ID NO: 2573380 - protein, 20 aa, Entamoeba histolytica
SCGNGINDNEEEECDGGEYC

SEQ ID NO: 2573381 - protein, 5 aa, Entamoeba histolytica
SCGNL

SEQ ID NO: 2573382 - protein, 9 aa, Entamoeba histolytica
SCGPIEGNT

SEQ ID NO: 2573383 - protein, 4 aa, Entamoeba histolytica
SCGS

SEQ ID NO: 2573384 - protein, 19 aa, Entamoeba histolytica
SCGSAADASSTNPNNQKRN

SEQ ID NO: 2573385 - protein, 9 aa, Entamoeba histolytica
SCKNNNRND

SEQ ID NO: 2573386 - protein, 44 aa, Entamoeba histolytica
SCKTNQSGGIDSSSSSQILTSSSSEDDGDNDKTEQQTISKQPKD

SEQ ID NO: 2573387 - protein, 10 aa, Entamoeba histolytica
SCKTPSQGIG

SEQ ID NO: 2573388 - protein, 8 aa, Entamoeba histolytica
SCNEEQKK

SEQ ID NO: 2573389 - protein, 6 aa, Entamoeba histolytica
SCNENG

SEQ ID NO: 2573390 - protein, 8 aa, Entamoeba histolytica
SCNNNGNI

SEQ ID NO: 2573391 - protein, 4 aa, Entamoeba histolytica
SCNQ

SEQ ID NO: 2573392 - protein, 5 aa, Entamoeba histolytica
SCNQC

SEQ ID NO: 2573393 - protein, 6 aa, Entamoeba histolytica
SCNRNN

SEQ ID NO: 2573394 - protein, 4 aa, Entamoeba histolytica
SCNS

SEQ ID NO: 2573395 - protein, 8 aa, Entamoeba histolytica
SCNSQGCT

SEQ ID NO: 2573396 - protein, 8 aa, Entamoeba histolytica
SCNSTTGV

SEQ ID NO: 2573397 - protein, 4 aa, Entamoeba histolytica
SCPN

SEQ ID NO: 2573398 - protein, 8 aa, Entamoeba histolytica
SCPNNKDK

SEQ ID NO: 2573399 - protein, 9 aa, Entamoeba histolytica
SCPSGPSVN

SEQ ID NO: 2573400 - protein, 6 aa, Entamoeba histolytica
SCQKPI

SEQ ID NO: 2573401 - protein, 11 aa, Entamoeba histolytica
SCRSGYKCSSV

SEQ ID NO: 2573402 - protein, 6 aa, Entamoeba histolytica
SCRSKP

SEQ ID NO: 2573403 - protein, 7 aa, Entamoeba histolytica
SCSGGSV

SEQ ID NO: 2573404 - protein, 7 aa, Entamoeba histolytica
SCSNSNT

SEQ ID NO: 2573405 - protein, 4 aa, Entamoeba histolytica
SCSP

SEQ ID NO: 2573406 - protein, 11 aa, Entamoeba histolytica
SCSSNKATCSR

SEQ ID NO: 2573407 - protein, 4 aa, Entamoeba histolytica
SCST

SEQ ID NO: 2573408 - protein, 9 aa, Entamoeba histolytica
SCSTNQTNQ

SEQ ID NO: 2573409 - protein, 4 aa, Entamoeba histolytica
SCSV

SEQ ID NO: 2573410 - protein, 5 aa, Entamoeba histolytica
SCSVE

SEQ ID NO: 2573411 - protein, 7 aa, Entamoeba histolytica
SCTKCPK

SEQ ID NO: 2573412 - protein, 12 aa, Entamoeba histolytica
SCTKGKKGTVKY

SEQ ID NO: 2573413 - protein, 5 aa, Entamoeba histolytica
SCTNG

SEQ ID NO: 2573414 - protein, 16 aa, Entamoeba histolytica
SCVGANDGDPNGLCDG

SEQ ID NO: 2573415 - protein, 9 aa, Entamoeba histolytica
SDAATKEFA

SEQ ID NO: 2573416 - protein, 5 aa, Entamoeba histolytica
SDAIP

SEQ ID NO: 2573417 - protein, 11 aa, Entamoeba histolytica
SDARSKTDIEE

SEQ ID NO: 2573418 - protein, 7 aa, Entamoeba histolytica
SDASAGF

SEQ ID NO: 2573419 - protein, 8 aa, Entamoeba histolytica
SDAYENHN

SEQ ID NO: 2573420 - protein, 6 aa, Entamoeba histolytica
SDCKKT

SEQ ID NO: 2573421 - protein, 10 aa, Entamoeba histolytica
SDCSHRDNTQ

SEQ ID NO: 2573422 - protein, 20 aa, Entamoeba histolytica
SDCTGSVTASVTADLNDDKI

SEQ ID NO: 2573423 - protein, 8 aa, Entamoeba histolytica
SDDDNKFK

SEQ ID NO: 2573424 - protein, 9 aa, Entamoeba histolytica
SDDDTVIDE

SEQ ID NO: 2573425 - protein, 13 aa, Entamoeba histolytica
SDDEEINEDSTTQ

SEQ ID NO: 2573426 - protein, 9 aa, Entamoeba histolytica
SDDEKQTYN

SEQ ID NO: 2573427 - protein, 10 aa, Entamoeba histolytica
SDDGNDADEF

SEQ ID NO: 2573428 - protein, 7 aa, Entamoeba histolytica
SDDGTYC

SEQ ID NO: 2573429 - protein, 9 aa, Entamoeba histolytica
SDDHCDDSY

SEQ ID NO: 2573430 - protein, 9 aa, Entamoeba histolytica
SDDIKISQT

SEQ ID NO: 2573431 - protein, 15 aa, Entamoeba histolytica
SDDISDNHNNLDGAS

SEQ ID NO: 2573432 - protein, 9 aa, Entamoeba histolytica
SDDNKPVET

SEQ ID NO: 2573433 - protein, 7 aa, Entamoeba histolytica
SDDTNSH

SEQ ID NO: 2573434 - protein, 6 aa, Entamoeba histolytica
SDECKN

SEQ ID NO: 2573435 - protein, 29 aa, Entamoeba histolytica
SDEECKTVESIEATSSNNSNRIKCGDTTY

SEQ ID NO: 2573436 - protein, 15 aa, Entamoeba histolytica
SDEEFSKSCKQQTLS

SEQ ID NO: 2573437 - protein, 6 aa, Entamoeba histolytica
SDEEIE

SEQ ID NO: 2573438 - protein, 7 aa, Entamoeba histolytica
SDEEMTE

SEQ ID NO: 2573439 - protein, 6 aa, Entamoeba histolytica
SDEEPF

SEQ ID NO: 2573440 - protein, 14 aa, Entamoeba histolytica
SDEEREKVVGDKKY

SEQ ID NO: 2573441 - protein, 19 aa, Entamoeba histolytica
SDEGQKELKTKKKYIDGIK

SEQ ID NO: 2573442 - protein, 25 aa, Entamoeba histolytica
SDEGVAQNKLAESGIDNSCSASSEY

SEQ ID NO: 2573443 - protein, 4 aa, Entamoeba histolytica
SDEH

SEQ ID NO: 2573444 - protein, 5 aa, Entamoeba histolytica
SDELS

SEQ ID NO: 2573445 - protein, 4 aa, Entamoeba histolytica
SDEN

SEQ ID NO: 2573446 - protein, 8 aa, Entamoeba histolytica
SDENGEKV

SEQ ID NO: 2573447 - protein, 9 aa, Entamoeba histolytica
SDENKPKVK

SEQ ID NO: 2573448 - protein, 6 aa, Entamoeba histolytica
SDERAA

SEQ ID NO: 2573449 - protein, 11 aa, Entamoeba histolytica
SDERNKKEIEK

SEQ ID NO: 2573450 - protein, 6 aa, Entamoeba histolytica
SDERTK

SEQ ID NO: 2573451 - protein, 22 aa, Entamoeba histolytica
SDESNSAKEDNSTEPQSPGGQF

SEQ ID NO: 2573452 - protein, 25 aa, Entamoeba histolytica
SDETIQPEDFPVTAKKDIKTSNANR

SEQ ID NO: 2573453 - protein, 5 aa, Entamoeba histolytica
SDFET

SEQ ID NO: 2573454 - protein, 7 aa, Entamoeba histolytica
SDFGTSK

SEQ ID NO: 2573455 - protein, 23 aa, Entamoeba histolytica
SDFGTTRNVSSSSASDSMTKGIG

SEQ ID NO: 2573456 - protein, 8 aa, Entamoeba histolytica
SDFSHESP

SEQ ID NO: 2573457 - protein, 11 aa, Entamoeba histolytica
SDGASTTQPNI

SEQ ID NO: 2573458 - protein, 5 aa, Entamoeba histolytica
SDGCS

SEQ ID NO: 2573459 - protein, 4 aa, Entamoeba histolytica
SDGD

SEQ ID NO: 2573460 - protein, 34 aa, Entamoeba histolytica
SDGFSGRSPYSNCTTCTKSNYYPKEGEKNGCAKC

SEQ ID NO: 2573461 - protein, 20 aa, Entamoeba histolytica
SDGIEEAAGNFATKNGKRKF

SEQ ID NO: 2573462 - protein, 9 aa, Entamoeba histolytica
SDGKEKQEC

SEQ ID NO: 2573463 - protein, 9 aa, Entamoeba histolytica
SDGKKMSKR

SEQ ID NO: 2573464 - protein, 38 aa, Entamoeba histolytica
SDGKPKTLSLGEEKENKSKEEPTPIPKPQKKKVKIILP

SEQ ID NO: 2573465 - protein, 9 aa, Entamoeba histolytica
SDGKTSVKR

SEQ ID NO: 2573466 - protein, 5 aa, Entamoeba histolytica
SDGLQ

SEQ ID NO: 2573467 - protein, 4 aa, Entamoeba histolytica
SDGM

SEQ ID NO: 2573468 - protein, 8 aa, Entamoeba histolytica
SDGPINSS

SEQ ID NO: 2573469 - protein, 8 aa, Entamoeba histolytica
SDGPSFDS

SEQ ID NO: 2573470 - protein, 13 aa, Entamoeba histolytica
SDGSLGCKNKATL

SEQ ID NO: 2573471 - protein, 8 aa, Entamoeba histolytica
SDGTDFAP

SEQ ID NO: 2573472 - protein, 6 aa, Entamoeba histolytica
SDHKPV

SEQ ID NO: 2573473 - protein, 21 aa, Entamoeba histolytica
SDHQNNSEVSQHDTITTQPLN

SEQ ID NO: 2573474 - protein, 10 aa, Entamoeba histolytica
SDIEGQQDNC

SEQ ID NO: 2573475 - protein, 10 aa, Entamoeba histolytica
SDIEKHREEK

SEQ ID NO: 2573476 - protein, 23 aa, Entamoeba histolytica
SDIGQKDKRLRTSTESTDPSEYN

SEQ ID NO: 2573477 - protein, 4 aa, Entamoeba histolytica
SDIN

SEQ ID NO: 2573478 - protein, 34 aa, Entamoeba histolytica
SDINPSDSSTCYYGETGCKSRDCTCDEGYSTKEH

SEQ ID NO: 2573479 - protein, 12 aa, Entamoeba histolytica
SDINSDITIKNS

SEQ ID NO: 2573480 - protein, 11 aa, Entamoeba histolytica
SDITGKDGLNG

SEQ ID NO: 2573481 - protein, 8 aa, Entamoeba histolytica
SDITIENS

SEQ ID NO: 2573482 - protein, 5 aa, Entamoeba histolytica
SDIVN

SEQ ID NO: 2573483 - protein, 8 aa, Entamoeba histolytica
SDKDIETP

SEQ ID NO: 2573484 - protein, 20 aa, Entamoeba histolytica
SDKDPKPQNRRSSQLSGGMR

SEQ ID NO: 2573485 - protein, 5 aa, Entamoeba histolytica
SDKEN

SEQ ID NO: 2573486 - protein, 5 aa, Entamoeba histolytica
SDKGK

SEQ ID NO: 2573487 - protein, 25 aa, Entamoeba histolytica
SDKGNVLRKGTKRVKVEPCKKSNCS

SEQ ID NO: 2573488 - protein, 8 aa, Entamoeba histolytica
SDKITGYD

SEQ ID NO: 2573489 - protein, 9 aa, Entamoeba histolytica
SDKLQKEKQ

SEQ ID NO: 2573490 - protein, 6 aa, Entamoeba histolytica
SDKNGK

SEQ ID NO: 2573491 - protein, 10 aa, Entamoeba histolytica
SDKRKKHNIQ

SEQ ID NO: 2573492 - protein, 5 aa, Entamoeba histolytica
SDKRR

SEQ ID NO: 2573493 - protein, 9 aa, Entamoeba histolytica
SDKTAGSKE

SEQ ID NO: 2573494 - protein, 7 aa, Entamoeba histolytica
SDKTDDK

SEQ ID NO: 2573495 - protein, 9 aa, Entamoeba histolytica
SDKVENSNI

SEQ ID NO: 2573496 - protein, 7 aa, Entamoeba histolytica
SDKVTSY

SEQ ID NO: 2573497 - protein, 8 aa, Entamoeba histolytica
SDLEETQG

SEQ ID NO: 2573498 - protein, 4 aa, Entamoeba histolytica
SDLG

SEQ ID NO: 2573499 - protein, 8 aa, Entamoeba histolytica
SDLPELPR

SEQ ID NO: 2573500 - protein, 6 aa, Entamoeba histolytica
SDLSAE

SEQ ID NO: 2573501 - protein, 5 aa, Entamoeba histolytica
SDNAK

SEQ ID NO: 2573502 - protein, 9 aa, Entamoeba histolytica
SDNCDTNCY

SEQ ID NO: 2573503 - protein, 5 aa, Entamoeba histolytica
SDNEN

SEQ ID NO: 2573504 - protein, 8 aa, Entamoeba histolytica
SDNFSDDS

SEQ ID NO: 2573505 - protein, 5 aa, Entamoeba histolytica
SDNIG

SEQ ID NO: 2573506 - protein, 14 aa, Entamoeba histolytica
SDNISSKKLEGIKS

SEQ ID NO: 2573507 - protein, 6 aa, Entamoeba histolytica
SDNKTL

SEQ ID NO: 2573508 - protein, 4 aa, Entamoeba histolytica
SDNL

SEQ ID NO: 2573509 - protein, 9 aa, Entamoeba histolytica
SDNPIAEGA

SEQ ID NO: 2573510 - protein, 7 aa, Entamoeba histolytica
SDNSEIR

SEQ ID NO: 2573511 - protein, 5 aa, Entamoeba histolytica
SDNSF

SEQ ID NO: 2573512 - protein, 15 aa, Entamoeba histolytica
SDNTNINLSSQSKIR

SEQ ID NO: 2573513 - protein, 7 aa, Entamoeba histolytica
SDPAFSN

SEQ ID NO: 2573514 - protein, 16 aa, Entamoeba histolytica
SDPDEEHDNSRSEEEI

SEQ ID NO: 2573515 - protein, 11 aa, Entamoeba histolytica
SDPETSNNYGT

SEQ ID NO: 2573516 - protein, 5 aa, Entamoeba histolytica
SDPGK

SEQ ID NO: 2573517 - protein, 7 aa, Entamoeba histolytica
SDPIASE

SEQ ID NO: 2573518 - protein, 9 aa, Entamoeba histolytica
SDPKGEQDL

SEQ ID NO: 2573519 - protein, 12 aa, Entamoeba histolytica
SDPKTCNKRGNL

SEQ ID NO: 2573520 - protein, 4 aa, Entamoeba histolytica
SDPS

SEQ ID NO: 2573521 - protein, 7 aa, Entamoeba histolytica
SDPSLRS

SEQ ID NO: 2573522 - protein, 9 aa, Entamoeba histolytica
SDPSSRENG

SEQ ID NO: 2573523 - protein, 7 aa, Entamoeba histolytica
SDQSSIK

SEQ ID NO: 2573524 - protein, 83 aa, Entamoeba histolytica
SDQTPEKQYHNEHQPLPDKQEPSAPQDGKDNQQPNKKPEDGNDNQQKDGNKEIDNKTTSSSDSSDNKQDDDRNNYNNDDGTTS

SEQ ID NO: 2573525 - protein, 5 aa, Entamoeba histolytica
SDRKR

SEQ ID NO: 2573526 - protein, 7 aa, Entamoeba histolytica
SDRKRQS

SEQ ID NO: 2573527 - protein, 6 aa, Entamoeba histolytica
SDRQNE

SEQ ID NO: 2573528 - protein, 8 aa, Entamoeba histolytica
SDRRNDQP

SEQ ID NO: 2573529 - protein, 5 aa, Entamoeba histolytica
SDRSL

SEQ ID NO: 2573530 - protein, 11 aa, Entamoeba histolytica
SDSCQFETTSY

SEQ ID NO: 2573531 - protein, 8 aa, Entamoeba histolytica
SDSDASYI

SEQ ID NO: 2573532 - protein, 11 aa, Entamoeba histolytica
SDSEPSTSNPY

SEQ ID NO: 2573533 - protein, 20 aa, Entamoeba histolytica
SDSESDSVDLDHQNELELTK

SEQ ID NO: 2573534 - protein, 12 aa, Entamoeba histolytica
SDSFGDCTKASV

SEQ ID NO: 2573535 - protein, 4 aa, Entamoeba histolytica
SDSG

SEQ ID NO: 2573536 - protein, 6 aa, Entamoeba histolytica
SDSITA

SEQ ID NO: 2573537 - protein, 5 aa, Entamoeba histolytica
SDSKN

SEQ ID NO: 2573538 - protein, 4 aa, Entamoeba histolytica
SDSL

SEQ ID NO: 2573539 - protein, 16 aa, Entamoeba histolytica
SDSLVGGERSKGEDEI

SEQ ID NO: 2573540 - protein, 6 aa, Entamoeba histolytica
SDSNEC

SEQ ID NO: 2573541 - protein, 7 aa, Entamoeba histolytica
SDSPPAL

SEQ ID NO: 2573542 - protein, 6 aa, Entamoeba histolytica
SDSSAY

SEQ ID NO: 2573543 - protein, 32 aa, Entamoeba histolytica
SDSSIATPPDNISDDTLISEEDLNDNYSQVSN

SEQ ID NO: 2573544 - protein, 7 aa, Entamoeba histolytica
SDSTMSS

SEQ ID NO: 2573545 - protein, 10 aa, Entamoeba histolytica
SDSTRSKSTI

SEQ ID NO: 2573546 - protein, 8 aa, Entamoeba histolytica
SDSVRKPA

SEQ ID NO: 2573547 - protein, 4 aa, Entamoeba histolytica
SDSY

SEQ ID NO: 2573548 - protein, 6 aa, Entamoeba histolytica
SDSYGI

SEQ ID NO: 2573549 - protein, 8 aa, Entamoeba histolytica
SDSYPTDL

SEQ ID NO: 2573550 - protein, 6 aa, Entamoeba histolytica
SDTGCS

SEQ ID NO: 2573551 - protein, 7 aa, Entamoeba histolytica
SDTIRNN

SEQ ID NO: 2573552 - protein, 4 aa, Entamoeba histolytica
SDTM

SEQ ID NO: 2573553 - protein, 6 aa, Entamoeba histolytica
SDTPSV

SEQ ID NO: 2573554 - protein, 11 aa, Entamoeba histolytica
SDTPTTTDKKC

SEQ ID NO: 2573555 - protein, 10 aa, Entamoeba histolytica
SDTSPDSSVS

SEQ ID NO: 2573556 - protein, 8 aa, Entamoeba histolytica
SDTTSTDF

SEQ ID NO: 2573557 - protein, 19 aa, Entamoeba histolytica
SDTYLSSNRTCQSNKELNG

SEQ ID NO: 2573558 - protein, 14 aa, Entamoeba histolytica
SDVEIQGTLSDGSL

SEQ ID NO: 2573559 - protein, 5 aa, Entamoeba histolytica
SDVQQ

SEQ ID NO: 2573560 - protein, 18 aa, Entamoeba histolytica
SDVTESKNTINSYSEKEY

SEQ ID NO: 2573561 - protein, 5 aa, Entamoeba histolytica
SDYIA

SEQ ID NO: 2573562 - protein, 5 aa, Entamoeba histolytica
SDYIQ

SEQ ID NO: 2573563 - protein, 7 aa, Entamoeba histolytica
SDYNTSE

SEQ ID NO: 2573564 - protein, 6 aa, Entamoeba histolytica
SDYSGL

SEQ ID NO: 2573565 - protein, 7 aa, Entamoeba histolytica
SDYSTMQ

SEQ ID NO: 2573566 - protein, 8 aa, Entamoeba histolytica
SEAAQSIA

SEQ ID NO: 2573567 - protein, 13 aa, Entamoeba histolytica
SEAIDSRDTSYTE

SEQ ID NO: 2573568 - protein, 4 aa, Entamoeba histolytica
SEAN

SEQ ID NO: 2573569 - protein, 10 aa, Entamoeba histolytica
SECPTSTSSM

SEQ ID NO: 2573570 - protein, 10 aa, Entamoeba histolytica
SECVTPEEEA

SEQ ID NO: 2573571 - protein, 12 aa, Entamoeba histolytica
SEDANGEKGISL

SEQ ID NO: 2573572 - protein, 7 aa, Entamoeba histolytica
SEDDDGI

SEQ ID NO: 2573573 - protein, 5 aa, Entamoeba histolytica
SEDDI

SEQ ID NO: 2573574 - protein, 10 aa, Entamoeba histolytica
SEDIKEENKS

SEQ ID NO: 2573575 - protein, 8 aa, Entamoeba histolytica
SEDISLTT

SEQ ID NO: 2573576 - protein, 8 aa, Entamoeba histolytica
SEDNNKKR

SEQ ID NO: 2573577 - protein, 9 aa, Entamoeba histolytica
SEDQMEETS

SEQ ID NO: 2573578 - protein, 8 aa, Entamoeba histolytica
SEDSISQT

SEQ ID NO: 2573579 - protein, 6 aa, Entamoeba histolytica
SEDSTL

SEQ ID NO: 2573580 - protein, 4 aa, Entamoeba histolytica
SEDT

SEQ ID NO: 2573581 - protein, 13 aa, Entamoeba histolytica
SEDVEYDKNNEEL

SEQ ID NO: 2573582 - protein, 4 aa, Entamoeba histolytica
SEEA

SEQ ID NO: 2573583 - protein, 7 aa, Entamoeba histolytica
SEEDLDG

SEQ ID NO: 2573584 - protein, 7 aa, Entamoeba histolytica
SEEEPQI

SEQ ID NO: 2573585 - protein, 9 aa, Entamoeba histolytica
SEEGETFND

SEQ ID NO: 2573586 - protein, 7 aa, Entamoeba histolytica
SEEGKDY

SEQ ID NO: 2573587 - protein, 9 aa, Entamoeba histolytica
SEEGLKQPG

SEQ ID NO: 2573588 - protein, 4 aa, Entamoeba histolytica
SEEI

SEQ ID NO: 2573589 - protein, 13 aa, Entamoeba histolytica
SEEIRKEQSHEQA

SEQ ID NO: 2573590 - protein, 6 aa, Entamoeba histolytica
SEEKEK

SEQ ID NO: 2573591 - protein, 4 aa, Entamoeba histolytica
SEEL

SEQ ID NO: 2573592 - protein, 11 aa, Entamoeba histolytica
SEENGKEYKSL

SEQ ID NO: 2573593 - protein, 10 aa, Entamoeba histolytica
SEENIEDDDK

SEQ ID NO: 2573594 - protein, 9 aa, Entamoeba histolytica
SEEPIAEGA

SEQ ID NO: 2573595 - protein, 7 aa, Entamoeba histolytica
SEEPTAR

SEQ ID NO: 2573596 - protein, 7 aa, Entamoeba histolytica
SEEQIST

SEQ ID NO: 2573597 - protein, 8 aa, Entamoeba histolytica
SEEQKSQY

SEQ ID NO: 2573598 - protein, 5 aa, Entamoeba histolytica
SEERI

SEQ ID NO: 2573599 - protein, 12 aa, Entamoeba histolytica
SEETSAILSTDS

SEQ ID NO: 2573600 - protein, 221 aa, Entamoeba histolytica
SEEVSKGTTEERSDEKKKENVEESKDGVVTEGEKGQSQEGTKEHNDNQKEKGEGAQHDKEEKSQVSGGEEPTQKNKEEGSDKEKTKEQESEEKKEQEEEQKEGKNNNEEKSKEDSTKEKKEVEDEKSKEDSEKEKAEKEKAEKEKAEKEKAEKEKAEKEEKEKITDDTKNGKEKDNQNDKQGDEEKKQEGDGNKEKEDITESKSDEKENDTSNDNNNLNGT

SEQ ID NO: 2573601 - protein, 7 aa, Entamoeba histolytica
SEFETNE

SEQ ID NO: 2573602 - protein, 5 aa, Entamoeba histolytica
SEFNG

SEQ ID NO: 2573603 - protein, 4 aa, Entamoeba histolytica
SEGD

SEQ ID NO: 2573604 - protein, 7 aa, Entamoeba histolytica
SEGGAQY

SEQ ID NO: 2573605 - protein, 13 aa, Entamoeba histolytica
SEGIKEERTDEVK

SEQ ID NO: 2573606 - protein, 7 aa, Entamoeba histolytica
SEGKIDK

SEQ ID NO: 2573607 - protein, 8 aa, Entamoeba histolytica
SEGRQAYP

SEQ ID NO: 2573608 - protein, 9 aa, Entamoeba histolytica
SEGSKERVG

SEQ ID NO: 2573609 - protein, 27 aa, Entamoeba histolytica
SEGYEQTSSHQNEQLNHEDSTEAHRQV

SEQ ID NO: 2573610 - protein, 8 aa, Entamoeba histolytica
SEHGNQFK

SEQ ID NO: 2573611 - protein, 7 aa, Entamoeba histolytica
SEHPADC

SEQ ID NO: 2573612 - protein, 7 aa, Entamoeba histolytica
SEHQPTS

SEQ ID NO: 2573613 - protein, 6 aa, Entamoeba histolytica
SEHRNT

SEQ ID NO: 2573614 - protein, 6 aa, Entamoeba histolytica
SEICGN

SEQ ID NO: 2573615 - protein, 5 aa, Entamoeba histolytica
SEIDD

SEQ ID NO: 2573616 - protein, 9 aa, Entamoeba histolytica
SEIEEGDQP

SEQ ID NO: 2573617 - protein, 43 aa, Entamoeba histolytica
SEIELSSPSSSISLSGSERKSESESQECSNEHRIEEQKGSVIE

SEQ ID NO: 2573618 - protein, 5 aa, Entamoeba histolytica
SEIGT

SEQ ID NO: 2573619 - protein, 6 aa, Entamoeba histolytica
SEIKTG

SEQ ID NO: 2573620 - protein, 22 aa, Entamoeba histolytica
SEINDNNPKDEDSDEENDEEGT

SEQ ID NO: 2573621 - protein, 8 aa, Entamoeba histolytica
SEIPSQRR

SEQ ID NO: 2573622 - protein, 8 aa, Entamoeba histolytica
SEITNTVS

SEQ ID NO: 2573623 - protein, 5 aa, Entamoeba histolytica
SEKAR

SEQ ID NO: 2573624 - protein, 9 aa, Entamoeba histolytica
SEKAVSMDN

SEQ ID NO: 2573625 - protein, 6 aa, Entamoeba histolytica
SEKDTK

SEQ ID NO: 2573626 - protein, 7 aa, Entamoeba histolytica
SEKEIEE

SEQ ID NO: 2573627 - protein, 11 aa, Entamoeba histolytica
SEKELEESQQT

SEQ ID NO: 2573628 - protein, 9 aa, Entamoeba histolytica
SEKENTKTY

SEQ ID NO: 2573629 - protein, 8 aa, Entamoeba histolytica
SEKESLTR

SEQ ID NO: 2573630 - protein, 5 aa, Entamoeba histolytica
SEKIE

SEQ ID NO: 2573631 - protein, 5 aa, Entamoeba histolytica
SEKIN

SEQ ID NO: 2573632 - protein, 7 aa, Entamoeba histolytica
SEKISNK

SEQ ID NO: 2573633 - protein, 9 aa, Entamoeba histolytica
SEKKEELAT

SEQ ID NO: 2573634 - protein, 15 aa, Entamoeba histolytica
SEKLDKNCKTCKNNY

SEQ ID NO: 2573635 - protein, 8 aa, Entamoeba histolytica
SEKNETST

SEQ ID NO: 2573636 - protein, 5 aa, Entamoeba histolytica
SEKPD

SEQ ID NO: 2573637 - protein, 8 aa, Entamoeba histolytica
SEKPDKRR

SEQ ID NO: 2573638 - protein, 10 aa, Entamoeba histolytica
SEKQGERGNY

SEQ ID NO: 2573639 - protein, 12 aa, Entamoeba histolytica
SELEEKNNIGRG

SEQ ID NO: 2573640 - protein, 4 aa, Entamoeba histolytica
SELG

SEQ ID NO: 2573641 - protein, 38 aa, Entamoeba histolytica
SELKGERAVQQEINEKEQNESQNEETNQLQEIKSEEPQ

SEQ ID NO: 2573642 - protein, 14 aa, Entamoeba histolytica
SELPQYSKYSTENQ

SEQ ID NO: 2573643 - protein, 7 aa, Entamoeba histolytica
SELSTRI

SEQ ID NO: 2573644 - protein, 40 aa, Entamoeba histolytica
SELTEVNEDSTEDKSHNKSDDKSEEIDNLSHSSNSTDGSL

SEQ ID NO: 2573645 - protein, 5 aa, Entamoeba histolytica
SELYS

SEQ ID NO: 2573646 - protein, 6 aa, Entamoeba histolytica
SENEVL

SEQ ID NO: 2573647 - protein, 8 aa, Entamoeba histolytica
SENEYDSD

SEQ ID NO: 2573648 - protein, 6 aa, Entamoeba histolytica
SENGQG

SEQ ID NO: 2573649 - protein, 4 aa, Entamoeba histolytica
SENI

SEQ ID NO: 2573650 - protein, 7 aa, Entamoeba histolytica
SENKISK

SEQ ID NO: 2573651 - protein, 5 aa, Entamoeba histolytica
SENND

SEQ ID NO: 2573652 - protein, 12 aa, Entamoeba histolytica
SENPIAEGATSK

SEQ ID NO: 2573653 - protein, 10 aa, Entamoeba histolytica
SENPKRKTEL

SEQ ID NO: 2573654 - protein, 15 aa, Entamoeba histolytica
SENQFDKSCDTVDES

SEQ ID NO: 2573655 - protein, 11 aa, Entamoeba histolytica
SENQYYNAGEC

SEQ ID NO: 2573656 - protein, 5 aa, Entamoeba histolytica
SENVE

SEQ ID NO: 2573657 - protein, 10 aa, Entamoeba histolytica
SENWKNEDYE

SEQ ID NO: 2573658 - protein, 16 aa, Entamoeba histolytica
SEPDERCDNIRSENEI

SEQ ID NO: 2573659 - protein, 16 aa, Entamoeba histolytica
SEPDERCDNRRSENEI

SEQ ID NO: 2573660 - protein, 4 aa, Entamoeba histolytica
SEPK

SEQ ID NO: 2573661 - protein, 13 aa, Entamoeba histolytica
SEPSPFEKNAFDL

SEQ ID NO: 2573662 - protein, 5 aa, Entamoeba histolytica
SEPVN

SEQ ID NO: 2573663 - protein, 4 aa, Entamoeba histolytica
SEQI

SEQ ID NO: 2573664 - protein, 13 aa, Entamoeba histolytica
SEQKNCASGNSVS

SEQ ID NO: 2573665 - protein, 6 aa, Entamoeba histolytica
SEQKVE

SEQ ID NO: 2573666 - protein, 6 aa, Entamoeba histolytica
SEQNAS

SEQ ID NO: 2573667 - protein, 50 aa, Entamoeba histolytica
SEQNNERNIKFFKAPSSLFSNTKITSFNPTSGNVCGIRVNIEDMNKEENR

SEQ ID NO: 2573668 - protein, 8 aa, Entamoeba histolytica
SEQPQNEV

SEQ ID NO: 2573669 - protein, 8 aa, Entamoeba histolytica
SEQQKDER

SEQ ID NO: 2573670 - protein, 5 aa, Entamoeba histolytica
SEQQS

SEQ ID NO: 2573671 - protein, 7 aa, Entamoeba histolytica
SERARSS

SEQ ID NO: 2573672 - protein, 6 aa, Entamoeba histolytica
SERDPV

SEQ ID NO: 2573673 - protein, 5 aa, Entamoeba histolytica
SERKR

SEQ ID NO: 2573674 - protein, 19 aa, Entamoeba histolytica
SERNLSAKELSQGIGTPTY

SEQ ID NO: 2573675 - protein, 10 aa, Entamoeba histolytica
SERNNDNLNQ

SEQ ID NO: 2573676 - protein, 8 aa, Entamoeba histolytica
SERPFGSV

SEQ ID NO: 2573677 - protein, 6 aa, Entamoeba histolytica
SERPTY

SEQ ID NO: 2573678 - protein, 13 aa, Entamoeba histolytica
SERQEGMKNKESF

SEQ ID NO: 2573679 - protein, 14 aa, Entamoeba histolytica
SERYNAASQPNEFQ

SEQ ID NO: 2573680 - protein, 4 aa, Entamoeba histolytica
SESA

SEQ ID NO: 2573681 - protein, 4 aa, Entamoeba histolytica
SESD

SEQ ID NO: 2573682 - protein, 10 aa, Entamoeba histolytica
SESEIKLSTG

SEQ ID NO: 2573683 - protein, 6 aa, Entamoeba histolytica
SESENG

SEQ ID NO: 2573684 - protein, 40 aa, Entamoeba histolytica
SESEVEKSEDSSDISNDSIINGTPSEIAQSSVSSSPTPFI

SEQ ID NO: 2573685 - protein, 14 aa, Entamoeba histolytica
SESHEGSELTRSTI

SEQ ID NO: 2573686 - protein, 8 aa, Entamoeba histolytica
SESKEPIL

SEQ ID NO: 2573687 - protein, 11 aa, Entamoeba histolytica
SESKESKQQPI

SEQ ID NO: 2573688 - protein, 18 aa, Entamoeba histolytica
SESKSTKKPTNDSQQISP

SEQ ID NO: 2573689 - protein, 6 aa, Entamoeba histolytica
SESLNI

SEQ ID NO: 2573690 - protein, 4 aa, Entamoeba histolytica
SESN

SEQ ID NO: 2573691 - protein, 18 aa, Entamoeba histolytica
SESNDTPPTSFISLSLFP

SEQ ID NO: 2573692 - protein, 10 aa, Entamoeba histolytica
SESNENNQQN

SEQ ID NO: 2573693 - protein, 17 aa, Entamoeba histolytica
SESPHGCSGTPENGKGK

SEQ ID NO: 2573694 - protein, 6 aa, Entamoeba histolytica
SESPSI

SEQ ID NO: 2573695 - protein, 9 aa, Entamoeba histolytica
SESRKLGPV

SEQ ID NO: 2573696 - protein, 15 aa, Entamoeba histolytica
SESSGFNEDCSNCKE

SEQ ID NO: 2573697 - protein, 5 aa, Entamoeba histolytica
SESSI

SEQ ID NO: 2573698 - protein, 11 aa, Entamoeba histolytica
SESSNREEESQ

SEQ ID NO: 2573699 - protein, 6 aa, Entamoeba histolytica
SESSSF

SEQ ID NO: 2573700 - protein, 8 aa, Entamoeba histolytica
SESSSQQC

SEQ ID NO: 2573701 - protein, 24 aa, Entamoeba histolytica
SESSTCSGNKKSGTFSLDSKEIKG

SEQ ID NO: 2573702 - protein, 10 aa, Entamoeba histolytica
SESTTDSIVR

SEQ ID NO: 2573703 - protein, 5 aa, Entamoeba histolytica
SESVP

SEQ ID NO: 2573704 - protein, 84 aa, Entamoeba histolytica
SESVPANSQSASQASGISTPTGSAVTTQEGNSPAQSGLAPAENPASTSPKGNEPPAKVEGNSLQSKQVSGDTPEGGSSTTHSEI

SEQ ID NO: 2573705 - protein, 8 aa, Entamoeba histolytica
SETDQIES

SEQ ID NO: 2573706 - protein, 6 aa, Entamoeba histolytica
SETDSE

SEQ ID NO: 2573707 - protein, 7 aa, Entamoeba histolytica
SETEPEL

SEQ ID NO: 2573708 - protein, 261 aa, Entamoeba histolytica
SETETPEHGNEGVAKPANPQQTQPAQPPKTVNSQEAQTRPDHVSEQPKEPTQEVAPTGPTNTKSPNPPESSPNPSGSSKDEATTGTGGSQATPQSTGASSSQTTQPQSKDSVSSPQSQNTQSTGSQPTQPSTSQDTKQSPQSTNPPVSKPESSPSLTPSPEQTETLSQSPTTSPQQDGQQSKPAPAETTNPTPNTPAKSDQSPDSNPAQSNNQQHEPPTDNQQNKQQNETLTPHLPNKNETTNGTENNNVNKTNDNLNNHN

SEQ ID NO: 2573709 - protein, 9 aa, Entamoeba histolytica
SETETQIGK

SEQ ID NO: 2573710 - protein, 7 aa, Entamoeba histolytica
SETGETL

SEQ ID NO: 2573711 - protein, 6 aa, Entamoeba histolytica
SETITD

SEQ ID NO: 2573712 - protein, 10 aa, Entamoeba histolytica
SETKQYSKLK

SEQ ID NO: 2573713 - protein, 10 aa, Entamoeba histolytica
SETPSSIATS

SEQ ID NO: 2573714 - protein, 18 aa, Entamoeba histolytica
SETSSRVVSSSNEEGEKC

SEQ ID NO: 2573715 - protein, 4 aa, Entamoeba histolytica
SETT

SEQ ID NO: 2573716 - protein, 12 aa, Entamoeba histolytica
SETTESHKISPF

SEQ ID NO: 2573717 - protein, 16 aa, Entamoeba histolytica
SETTTEVTSVKGTDCD

SEQ ID NO: 2573718 - protein, 6 aa, Entamoeba histolytica
SETTYQ

SEQ ID NO: 2573719 - protein, 6 aa, Entamoeba histolytica
SEVHED

SEQ ID NO: 2573720 - protein, 22 aa, Entamoeba histolytica
SEVKPEEPKEEKRQAKTKSSKV

SEQ ID NO: 2573721 - protein, 8 aa, Entamoeba histolytica
SEVNSTTF

SEQ ID NO: 2573722 - protein, 4 aa, Entamoeba histolytica
SEVT

SEQ ID NO: 2573723 - protein, 9 aa, Entamoeba histolytica
SEYLKDKKD

SEQ ID NO: 2573724 - protein, 7 aa, Entamoeba histolytica
SEYPHYN

SEQ ID NO: 2573725 - protein, 5 aa, Entamoeba histolytica
SEYRE

SEQ ID NO: 2573726 - protein, 18 aa, Entamoeba histolytica
SEYSLKTQSGFKSVEGDG

SEQ ID NO: 2573727 - protein, 8 aa, Entamoeba histolytica
SFCNSNNS

SEQ ID NO: 2573728 - protein, 6 aa, Entamoeba histolytica
SFDPDF

SEQ ID NO: 2573729 - protein, 8 aa, Entamoeba histolytica
SFEAETTK

SEQ ID NO: 2573730 - protein, 13 aa, Entamoeba histolytica
SFEESGGESEGNV

SEQ ID NO: 2573731 - protein, 8 aa, Entamoeba histolytica
SFEKENDF

SEQ ID NO: 2573732 - protein, 5 aa, Entamoeba histolytica
SFENC

SEQ ID NO: 2573733 - protein, 67 aa, Entamoeba histolytica
SFENQSSYRNSLTKPSNDNSPSPSSSPNFIDPNDDEWVSGNTIKRRSESPRPILSDAEDEDIAPRSH

SEQ ID NO: 2573734 - protein, 6 aa, Entamoeba histolytica
SFENTY

SEQ ID NO: 2573735 - protein, 4 aa, Entamoeba histolytica
SFEP

SEQ ID NO: 2573736 - protein, 10 aa, Entamoeba histolytica
SFESEQSFKN

SEQ ID NO: 2573737 - protein, 11 aa, Entamoeba histolytica
SFETWTPEDQV

SEQ ID NO: 2573738 - protein, 6 aa, Entamoeba histolytica
SFGGDD

SEQ ID NO: 2573739 - protein, 7 aa, Entamoeba histolytica
SFGGSDC

SEQ ID NO: 2573740 - protein, 15 aa, Entamoeba histolytica
SFGNEGKTTNINETR

SEQ ID NO: 2573741 - protein, 7 aa, Entamoeba histolytica
SFGPQTC

SEQ ID NO: 2573742 - protein, 4 aa, Entamoeba histolytica
SFGQ

SEQ ID NO: 2573743 - protein, 9 aa, Entamoeba histolytica
SFGSNTSVS

SEQ ID NO: 2573744 - protein, 6 aa, Entamoeba histolytica
SFGSQN

SEQ ID NO: 2573745 - protein, 7 aa, Entamoeba histolytica
SFKDTEE

SEQ ID NO: 2573746 - protein, 9 aa, Entamoeba histolytica
SFKESPQII

SEQ ID NO: 2573747 - protein, 5 aa, Entamoeba histolytica
SFKGT

SEQ ID NO: 2573748 - protein, 7 aa, Entamoeba histolytica
SFKNKNI

SEQ ID NO: 2573749 - protein, 9 aa, Entamoeba histolytica
SFKPVDEAN

SEQ ID NO: 2573750 - protein, 7 aa, Entamoeba histolytica
SFKVTNN

SEQ ID NO: 2573751 - protein, 10 aa, Entamoeba histolytica
SFNEKSDNLI

SEQ ID NO: 2573752 - protein, 9 aa, Entamoeba histolytica
SFNENEGVT

SEQ ID NO: 2573753 - protein, 4 aa, Entamoeba histolytica
SFNP

SEQ ID NO: 2573754 - protein, 8 aa, Entamoeba histolytica
SFNPTNQT

SEQ ID NO: 2573755 - protein, 9 aa, Entamoeba histolytica
SFNQSISSS

SEQ ID NO: 2573756 - protein, 4 aa, Entamoeba histolytica
SFNS

SEQ ID NO: 2573757 - protein, 19 aa, Entamoeba histolytica
SFNSTSSNSQINEIELVEE

SEQ ID NO: 2573758 - protein, 22 aa, Entamoeba histolytica
SFPETEEKEELQNEINNCSDAE

SEQ ID NO: 2573759 - protein, 5 aa, Entamoeba histolytica
SFPIN

SEQ ID NO: 2573760 - protein, 9 aa, Entamoeba histolytica
SFPKESYPH

SEQ ID NO: 2573761 - protein, 19 aa, Entamoeba histolytica
SFPKGENKKPIAYEGGREV

SEQ ID NO: 2573762 - protein, 6 aa, Entamoeba histolytica
SFPKTI

SEQ ID NO: 2573763 - protein, 6 aa, Entamoeba histolytica
SFPQTV

SEQ ID NO: 2573764 - protein, 9 aa, Entamoeba histolytica
SFPSGHSSF

SEQ ID NO: 2573765 - protein, 11 aa, Entamoeba histolytica
SFPSGHSSTTF

SEQ ID NO: 2573766 - protein, 5 aa, Entamoeba histolytica
SFPSY

SEQ ID NO: 2573767 - protein, 4 aa, Entamoeba histolytica
SFPT

SEQ ID NO: 2573768 - protein, 12 aa, Entamoeba histolytica
SFPTETSQNEEI

SEQ ID NO: 2573769 - protein, 15 aa, Entamoeba histolytica
SFQRNNEEESNSENE

SEQ ID NO: 2573770 - protein, 11 aa, Entamoeba histolytica
SFSLSGSETLT

SEQ ID NO: 2573771 - protein, 4 aa, Entamoeba histolytica
SFSP

SEQ ID NO: 2573772 - protein, 6 aa, Entamoeba histolytica
SFSPSN

SEQ ID NO: 2573773 - protein, 5 aa, Entamoeba histolytica
SFSQC

SEQ ID NO: 2573774 - protein, 8 aa, Entamoeba histolytica
SFSQGNET

SEQ ID NO: 2573775 - protein, 17 aa, Entamoeba histolytica
SFSSNSYNYSKVPEVPL

SEQ ID NO: 2573776 - protein, 12 aa, Entamoeba histolytica
SFSSSDNSRNTF

SEQ ID NO: 2573777 - protein, 24 aa, Entamoeba histolytica
SFSSSDSSSSDEDTSKPLTQVQIT

SEQ ID NO: 2573778 - protein, 4 aa, Entamoeba histolytica
SFTK

SEQ ID NO: 2573779 - protein, 7 aa, Entamoeba histolytica
SFTPLNN

SEQ ID NO: 2573780 - protein, 5 aa, Entamoeba histolytica
SFTQP

SEQ ID NO: 2573781 - protein, 6 aa, Entamoeba histolytica
SFTSGT

SEQ ID NO: 2573782 - protein, 7 aa, Entamoeba histolytica
SFTTGDS

SEQ ID NO: 2573783 - protein, 14 aa, Entamoeba histolytica
SFVNEDDNQSFDKY

SEQ ID NO: 2573784 - protein, 7 aa, Entamoeba histolytica
SGATREN

SEQ ID NO: 2573785 - protein, 4 aa, Entamoeba histolytica
SGAV

SEQ ID NO: 2573786 - protein, 7 aa, Entamoeba histolytica
SGCADEL

SEQ ID NO: 2573787 - protein, 9 aa, Entamoeba histolytica
SGCADELKR

SEQ ID NO: 2573788 - protein, 7 aa, Entamoeba histolytica
SGCDGTI

SEQ ID NO: 2573789 - protein, 6 aa, Entamoeba histolytica
SGCDRT

SEQ ID NO: 2573790 - protein, 8 aa, Entamoeba histolytica
SGCGKSTS

SEQ ID NO: 2573791 - protein, 9 aa, Entamoeba histolytica
SGCGKSTSV

SEQ ID NO: 2573792 - protein, 8 aa, Entamoeba histolytica
SGCRKSTT

SEQ ID NO: 2573793 - protein, 9 aa, Entamoeba histolytica
SGCSTDSYS

SEQ ID NO: 2573794 - protein, 6 aa, Entamoeba histolytica
SGCTSA

SEQ ID NO: 2573795 - protein, 4 aa, Entamoeba histolytica
SGCY

SEQ ID NO: 2573796 - protein, 4 aa, Entamoeba histolytica
SGDD

SEQ ID NO: 2573797 - protein, 7 aa, Entamoeba histolytica
SGDGENV

SEQ ID NO: 2573798 - protein, 8 aa, Entamoeba histolytica
SGDIETVG

SEQ ID NO: 2573799 - protein, 5 aa, Entamoeba histolytica
SGDIM

SEQ ID NO: 2573800 - protein, 8 aa, Entamoeba histolytica
SGDLDGGY

SEQ ID NO: 2573801 - protein, 9 aa, Entamoeba histolytica
SGDNGSTAY

SEQ ID NO: 2573802 - protein, 5 aa, Entamoeba histolytica
SGDNI

SEQ ID NO: 2573803 - protein, 35 aa, Entamoeba histolytica
SGDPDGKDEEFEVGQSPSKEFKGTFEEENTDSDPL

SEQ ID NO: 2573804 - protein, 8 aa, Entamoeba histolytica
SGDPEGDL

SEQ ID NO: 2573805 - protein, 8 aa, Entamoeba histolytica
SGDPTSMN

SEQ ID NO: 2573806 - protein, 9 aa, Entamoeba histolytica
SGDSSEMEE

SEQ ID NO: 2573807 - protein, 6 aa, Entamoeba histolytica
SGDTVG

SEQ ID NO: 2573808 - protein, 7 aa, Entamoeba histolytica
SGDVSIS

SEQ ID NO: 2573809 - protein, 5 aa, Entamoeba histolytica
SGDYI

SEQ ID NO: 2573810 - protein, 7 aa, Entamoeba histolytica
SGEEDIR

SEQ ID NO: 2573811 - protein, 5 aa, Entamoeba histolytica
SGEEG

SEQ ID NO: 2573812 - protein, 10 aa, Entamoeba histolytica
SGEEPTAVGP

SEQ ID NO: 2573813 - protein, 8 aa, Entamoeba histolytica
SGEHDNSC

SEQ ID NO: 2573814 - protein, 13 aa, Entamoeba histolytica
SGEKVPSPIDLFS

SEQ ID NO: 2573815 - protein, 5 aa, Entamoeba histolytica
SGELK

SEQ ID NO: 2573816 - protein, 5 aa, Entamoeba histolytica
SGERF

SEQ ID NO: 2573817 - protein, 7 aa, Entamoeba histolytica
SGERPSL

SEQ ID NO: 2573818 - protein, 14 aa, Entamoeba histolytica
SGEYIRDDSNAKTC

SEQ ID NO: 2573819 - protein, 7 aa, Entamoeba histolytica
SGFANQT

SEQ ID NO: 2573820 - protein, 5 aa, Entamoeba histolytica
SGFNE

SEQ ID NO: 2573821 - protein, 4 aa, Entamoeba histolytica
SGFP

SEQ ID NO: 2573822 - protein, 8 aa, Entamoeba histolytica
SGGGDGTL

SEQ ID NO: 2573823 - protein, 13 aa, Entamoeba histolytica
SGGIKRVNKERED

SEQ ID NO: 2573824 - protein, 6 aa, Entamoeba histolytica
SGGNKD

SEQ ID NO: 2573825 - protein, 7 aa, Entamoeba histolytica
SGHTGSI

SEQ ID NO: 2573826 - protein, 6 aa, Entamoeba histolytica
SGIENS

SEQ ID NO: 2573827 - protein, 8 aa, Entamoeba histolytica
SGIESSFN

SEQ ID NO: 2573828 - protein, 5 aa, Entamoeba histolytica
SGIGG

SEQ ID NO: 2573829 - protein, 5 aa, Entamoeba histolytica
SGIRR

SEQ ID NO: 2573830 - protein, 6 aa, Entamoeba histolytica
SGISGS

SEQ ID NO: 2573831 - protein, 7 aa, Entamoeba histolytica
SGITENK

SEQ ID NO: 2573832 - protein, 7 aa, Entamoeba histolytica
SGKCASI

SEQ ID NO: 2573833 - protein, 7 aa, Entamoeba histolytica
SGKDEYH

SEQ ID NO: 2573834 - protein, 7 aa, Entamoeba histolytica
SGKEKQR

SEQ ID NO: 2573835 - protein, 8 aa, Entamoeba histolytica
SGKGRTGL

SEQ ID NO: 2573836 - protein, 6 aa, Entamoeba histolytica
SGKNKT

SEQ ID NO: 2573837 - protein, 10 aa, Entamoeba histolytica
SGKPEGNVYG

SEQ ID NO: 2573838 - protein, 16 aa, Entamoeba histolytica
SGKRLEKPNKCQSGFI

SEQ ID NO: 2573839 - protein, 7 aa, Entamoeba histolytica
SGKRLPF

SEQ ID NO: 2573840 - protein, 8 aa, Entamoeba histolytica
SGKRLPLD

SEQ ID NO: 2573841 - protein, 9 aa, Entamoeba histolytica
SGKRNGDAA

SEQ ID NO: 2573842 - protein, 9 aa, Entamoeba histolytica
SGKTSSTSA

SEQ ID NO: 2573843 - protein, 7 aa, Entamoeba histolytica
SGKYSSS

SEQ ID NO: 2573844 - protein, 5 aa, Entamoeba histolytica
SGLGA

SEQ ID NO: 2573845 - protein, 4 aa, Entamoeba histolytica
SGLP

SEQ ID NO: 2573846 - protein, 15 aa, Entamoeba histolytica
SGLSKKNATKRFEDE

SEQ ID NO: 2573847 - protein, 8 aa, Entamoeba histolytica
SGLSTKLD

SEQ ID NO: 2573848 - protein, 8 aa, Entamoeba histolytica
SGLSYNST

SEQ ID NO: 2573849 - protein, 4 aa, Entamoeba histolytica
SGLT

SEQ ID NO: 2573850 - protein, 4 aa, Entamoeba histolytica
SGLV

SEQ ID NO: 2573851 - protein, 7 aa, Entamoeba histolytica
SGNCPNT

SEQ ID NO: 2573852 - protein, 5 aa, Entamoeba histolytica
SGNDL

SEQ ID NO: 2573853 - protein, 6 aa, Entamoeba histolytica
SGNEKQ

SEQ ID NO: 2573854 - protein, 5 aa, Entamoeba histolytica
SGNGC

SEQ ID NO: 2573855 - protein, 7 aa, Entamoeba histolytica
SGNGCNS

SEQ ID NO: 2573856 - protein, 8 aa, Entamoeba histolytica
SGNGKGSA

SEQ ID NO: 2573857 - protein, 7 aa, Entamoeba histolytica
SGNISTS

SEQ ID NO: 2573858 - protein, 5 aa, Entamoeba histolytica
SGNLE

SEQ ID NO: 2573859 - protein, 14 aa, Entamoeba histolytica
SGNLKDRGEMTSPR

SEQ ID NO: 2573860 - protein, 5 aa, Entamoeba histolytica
SGNNK

SEQ ID NO: 2573861 - protein, 6 aa, Entamoeba histolytica
SGNNSV

SEQ ID NO: 2573862 - protein, 31 aa, Entamoeba histolytica
SGNNVTVSQYNTSSECTGTKNETSVAVSEEN

SEQ ID NO: 2573863 - protein, 11 aa, Entamoeba histolytica
SGNRADKEFEE

SEQ ID NO: 2573864 - protein, 12 aa, Entamoeba histolytica
SGNSSKTLDNIS

SEQ ID NO: 2573865 - protein, 8 aa, Entamoeba histolytica
SGNTAKLP

SEQ ID NO: 2573866 - protein, 7 aa, Entamoeba histolytica
SGNVNQN

SEQ ID NO: 2573867 - protein, 5 aa, Entamoeba histolytica
SGPGL

SEQ ID NO: 2573868 - protein, 7 aa, Entamoeba histolytica
SGPSLKP

SEQ ID NO: 2573869 - protein, 6 aa, Entamoeba histolytica
SGPSMK

SEQ ID NO: 2573870 - protein, 5 aa, Entamoeba histolytica
SGQCE

SEQ ID NO: 2573871 - protein, 11 aa, Entamoeba histolytica
SGQCTKKNEKI

SEQ ID NO: 2573872 - protein, 6 aa, Entamoeba histolytica
SGRGTN

SEQ ID NO: 2573873 - protein, 10 aa, Entamoeba histolytica
SGRTARAGRS

SEQ ID NO: 2573874 - protein, 5 aa, Entamoeba histolytica
SGSDN

SEQ ID NO: 2573875 - protein, 8 aa, Entamoeba histolytica
SGSGKSVV

SEQ ID NO: 2573876 - protein, 4 aa, Entamoeba histolytica
SGSI

SEQ ID NO: 2573877 - protein, 5 aa, Entamoeba histolytica
SGSIG

SEQ ID NO: 2573878 - protein, 17 aa, Entamoeba histolytica
SGSINSTLSCSEDNPTA

SEQ ID NO: 2573879 - protein, 9 aa, Entamoeba histolytica
SGSKQTAHY

SEQ ID NO: 2573880 - protein, 9 aa, Entamoeba histolytica
SGSPEIETI

SEQ ID NO: 2573881 - protein, 6 aa, Entamoeba histolytica
SGSQGK

SEQ ID NO: 2573882 - protein, 16 aa, Entamoeba histolytica
SGSSSADVKKQLADQR

SEQ ID NO: 2573883 - protein, 17 aa, Entamoeba histolytica
SGSTAKLQQFEENEAER

SEQ ID NO: 2573884 - protein, 5 aa, Entamoeba histolytica
SGSTI

SEQ ID NO: 2573885 - protein, 10 aa, Entamoeba histolytica
SGSVTTDGTI

SEQ ID NO: 2573886 - protein, 6 aa, Entamoeba histolytica
SGSYYD

SEQ ID NO: 2573887 - protein, 9 aa, Entamoeba histolytica
SGTAKEPKG

SEQ ID NO: 2573888 - protein, 7 aa, Entamoeba histolytica
SGTCSPN

SEQ ID NO: 2573889 - protein, 8 aa, Entamoeba histolytica
SGTEKSND

SEQ ID NO: 2573890 - protein, 7 aa, Entamoeba histolytica
SGTEPSI

SEQ ID NO: 2573891 - protein, 5 aa, Entamoeba histolytica
SGTFN

SEQ ID NO: 2573892 - protein, 13 aa, Entamoeba histolytica
SGTKRTNLKSSIE

SEQ ID NO: 2573893 - protein, 4 aa, Entamoeba histolytica
SGTN

SEQ ID NO: 2573894 - protein, 6 aa, Entamoeba histolytica
SGTNLR

SEQ ID NO: 2573895 - protein, 6 aa, Entamoeba histolytica
SGTNRS

SEQ ID NO: 2573896 - protein, 7 aa, Entamoeba histolytica
SGTRPIS

SEQ ID NO: 2573897 - protein, 4 aa, Entamoeba histolytica
SGTS

SEQ ID NO: 2573898 - protein, 7 aa, Entamoeba histolytica
SGTSKTL

SEQ ID NO: 2573899 - protein, 10 aa, Entamoeba histolytica
SGTTGTPKGV

SEQ ID NO: 2573900 - protein, 10 aa, Entamoeba histolytica
SGTTKEPKGV

SEQ ID NO: 2573901 - protein, 7 aa, Entamoeba histolytica
SGTTNFD

SEQ ID NO: 2573902 - protein, 7 aa, Entamoeba histolytica
SGTTQLN

SEQ ID NO: 2573903 - protein, 14 aa, Entamoeba histolytica
SGTTQNNDYYPPTS

SEQ ID NO: 2573904 - protein, 30 aa, Entamoeba histolytica
SGTVQAEGKNNEIIKPEEDLEEKKKKDKMI

SEQ ID NO: 2573905 - protein, 8 aa, Entamoeba histolytica
SGTYNEEE

SEQ ID NO: 2573906 - protein, 13 aa, Entamoeba histolytica
SGVKANSCVWRKL

SEQ ID NO: 2573907 - protein, 6 aa, Entamoeba histolytica
SGWDEK

SEQ ID NO: 2573908 - protein, 8 aa, Entamoeba histolytica
SGWTEGKT

SEQ ID NO: 2573909 - protein, 6 aa, Entamoeba histolytica
SGYGTR

SEQ ID NO: 2573910 - protein, 16 aa, Entamoeba histolytica
SGYSLNSNNKCQENSH

SEQ ID NO: 2573911 - protein, 4 aa, Entamoeba histolytica
SHAT

SEQ ID NO: 2573912 - protein, 7 aa, Entamoeba histolytica
SHCSSCQ

SEQ ID NO: 2573913 - protein, 4 aa, Entamoeba histolytica
SHCT

SEQ ID NO: 2573914 - protein, 6 aa, Entamoeba histolytica
SHCTTC

SEQ ID NO: 2573915 - protein, 10 aa, Entamoeba histolytica
SHDEEEEEDI

SEQ ID NO: 2573916 - protein, 8 aa, Entamoeba histolytica
SHEKSDEM

SEQ ID NO: 2573917 - protein, 8 aa, Entamoeba histolytica
SHENGLRE

SEQ ID NO: 2573918 - protein, 4 aa, Entamoeba histolytica
SHEQ

SEQ ID NO: 2573919 - protein, 9 aa, Entamoeba histolytica
SHGDEHGKR

SEQ ID NO: 2573920 - protein, 6 aa, Entamoeba histolytica
SHGSDC

SEQ ID NO: 2573921 - protein, 5 aa, Entamoeba histolytica
SHHPP

SEQ ID NO: 2573922 - protein, 8 aa, Entamoeba histolytica
SHIATNNN

SEQ ID NO: 2573923 - protein, 7 aa, Entamoeba histolytica
SHIRGPQ

SEQ ID NO: 2573924 - protein, 5 aa, Entamoeba histolytica
SHIYT

SEQ ID NO: 2573925 - protein, 8 aa, Entamoeba histolytica
SHKNDGNI

SEQ ID NO: 2573926 - protein, 5 aa, Entamoeba histolytica
SHKNT

SEQ ID NO: 2573927 - protein, 10 aa, Entamoeba histolytica
SHKPNSNSSL

SEQ ID NO: 2573928 - protein, 6 aa, Entamoeba histolytica
SHKYEG

SEQ ID NO: 2573929 - protein, 11 aa, Entamoeba histolytica
SHLTSTDGPCK

SEQ ID NO: 2573930 - protein, 9 aa, Entamoeba histolytica
SHNKQTIKS

SEQ ID NO: 2573931 - protein, 5 aa, Entamoeba histolytica
SHNNI

SEQ ID NO: 2573932 - protein, 8 aa, Entamoeba histolytica
SHPTGFEK

SEQ ID NO: 2573933 - protein, 5 aa, Entamoeba histolytica
SHRPT

SEQ ID NO: 2573934 - protein, 5 aa, Entamoeba histolytica
SHSLS

SEQ ID NO: 2573935 - protein, 6 aa, Entamoeba histolytica
SHSPSL

SEQ ID NO: 2573936 - protein, 50 aa, Entamoeba histolytica
SHTEAQKSQRDNTNKEDSPSTSQKIETPSTNQSIDPSQTSKGEENPVDTT

SEQ ID NO: 2573937 - protein, 9 aa, Entamoeba histolytica
SHTGANKTL

SEQ ID NO: 2573938 - protein, 9 aa, Entamoeba histolytica
SHTPMYTGQ

SEQ ID NO: 2573939 - protein, 12 aa, Entamoeba histolytica
SHVGKDGKCSCG

SEQ ID NO: 2573940 - protein, 7 aa, Entamoeba histolytica
SIAGAAL

SEQ ID NO: 2573941 - protein, 13 aa, Entamoeba histolytica
SIASNKQPINGER

SEQ ID NO: 2573942 - protein, 4 aa, Entamoeba histolytica
SIDD

SEQ ID NO: 2573943 - protein, 7 aa, Entamoeba histolytica
SIDETSK

SEQ ID NO: 2573944 - protein, 5 aa, Entamoeba histolytica
SIDGN

SEQ ID NO: 2573945 - protein, 4 aa, Entamoeba histolytica
SIDH

SEQ ID NO: 2573946 - protein, 10 aa, Entamoeba histolytica
SIDKKQRVEN

SEQ ID NO: 2573947 - protein, 14 aa, Entamoeba histolytica
SIDKTTLDKFLFKQ

SEQ ID NO: 2573948 - protein, 13 aa, Entamoeba histolytica
SIDPETNQNTELI

SEQ ID NO: 2573949 - protein, 6 aa, Entamoeba histolytica
SIDPLA

SEQ ID NO: 2573950 - protein, 7 aa, Entamoeba histolytica
SIDPSGK

SEQ ID NO: 2573951 - protein, 7 aa, Entamoeba histolytica
SIDSNGI

SEQ ID NO: 2573952 - protein, 12 aa, Entamoeba histolytica
SIDTESSEKQIY

SEQ ID NO: 2573953 - protein, 6 aa, Entamoeba histolytica
SIEEEY

SEQ ID NO: 2573954 - protein, 27 aa, Entamoeba histolytica
SIEGETEISTRLDPDEIKEEKKIGEGT

SEQ ID NO: 2573955 - protein, 4 aa, Entamoeba histolytica
SIEN

SEQ ID NO: 2573956 - protein, 5 aa, Entamoeba histolytica
SIEND

SEQ ID NO: 2573957 - protein, 4 aa, Entamoeba histolytica
SIEQ

SEQ ID NO: 2573958 - protein, 4 aa, Entamoeba histolytica
SIER

SEQ ID NO: 2573959 - protein, 10 aa, Entamoeba histolytica
SIESISANSL

SEQ ID NO: 2573960 - protein, 5 aa, Entamoeba histolytica
SIETL

SEQ ID NO: 2573961 - protein, 12 aa, Entamoeba histolytica
SIETPDPKECRS

SEQ ID NO: 2573962 - protein, 18 aa, Entamoeba histolytica
SIETTETNGRNELEKKEG

SEQ ID NO: 2573963 - protein, 6 aa, Entamoeba histolytica
SIETTI

SEQ ID NO: 2573964 - protein, 5 aa, Entamoeba histolytica
SIEVE

SEQ ID NO: 2573965 - protein, 9 aa, Entamoeba histolytica
SIGGDGSLT

SEQ ID NO: 2573966 - protein, 7 aa, Entamoeba histolytica
SIGGRDT

SEQ ID NO: 2573967 - protein, 6 aa, Entamoeba histolytica
SIGKNN

SEQ ID NO: 2573968 - protein, 6 aa, Entamoeba histolytica
SIGKTT

SEQ ID NO: 2573969 - protein, 8 aa, Entamoeba histolytica
SIGNKNKL

SEQ ID NO: 2573970 - protein, 14 aa, Entamoeba histolytica
SIGPTRKPRASFSI

SEQ ID NO: 2573971 - protein, 13 aa, Entamoeba histolytica
SIKEKKRKLEIEQ

SEQ ID NO: 2573972 - protein, 6 aa, Entamoeba histolytica
SIKEPT

SEQ ID NO: 2573973 - protein, 7 aa, Entamoeba histolytica
SIKPKSC

SEQ ID NO: 2573974 - protein, 6 aa, Entamoeba histolytica
SIKQQT

SEQ ID NO: 2573975 - protein, 8 aa, Entamoeba histolytica
SIKSTANL

SEQ ID NO: 2573976 - protein, 9 aa, Entamoeba histolytica
SINGDKPHT

SEQ ID NO: 2573977 - protein, 8 aa, Entamoeba histolytica
SINNKKAP

SEQ ID NO: 2573978 - protein, 9 aa, Entamoeba histolytica
SINNSNDQF

SEQ ID NO: 2573979 - protein, 4 aa, Entamoeba histolytica
SINP

SEQ ID NO: 2573980 - protein, 8 aa, Entamoeba histolytica
SINPSSES

SEQ ID NO: 2573981 - protein, 8 aa, Entamoeba histolytica
SINQLESE

SEQ ID NO: 2573982 - protein, 16 aa, Entamoeba histolytica
SINSPSSQIPLTISSS

SEQ ID NO: 2573983 - protein, 6 aa, Entamoeba histolytica
SINTEV

SEQ ID NO: 2573984 - protein, 5 aa, Entamoeba histolytica
SINTS

SEQ ID NO: 2573985 - protein, 6 aa, Entamoeba histolytica
SIPKNT

SEQ ID NO: 2573986 - protein, 7 aa, Entamoeba histolytica
SIPKSSD

SEQ ID NO: 2573987 - protein, 4 aa, Entamoeba histolytica
SIPL

SEQ ID NO: 2573988 - protein, 4 aa, Entamoeba histolytica
SIPN

SEQ ID NO: 2573989 - protein, 5 aa, Entamoeba histolytica
SIPNA

SEQ ID NO: 2573990 - protein, 18 aa, Entamoeba histolytica
SIPPAPVVTGNESSPLIN

SEQ ID NO: 2573991 - protein, 10 aa, Entamoeba histolytica
SIPQEKWSHE

SEQ ID NO: 2573992 - protein, 15 aa, Entamoeba histolytica
SIPRLPNPLSKYETP

SEQ ID NO: 2573993 - protein, 4 aa, Entamoeba histolytica
SIPS

SEQ ID NO: 2573994 - protein, 8 aa, Entamoeba histolytica
SIPSEGSF

SEQ ID NO: 2573995 - protein, 10 aa, Entamoeba histolytica
SIPSQSKTIK

SEQ ID NO: 2573996 - protein, 7 aa, Entamoeba histolytica
SIPSSEI

SEQ ID NO: 2573997 - protein, 4 aa, Entamoeba histolytica
SIPT

SEQ ID NO: 2573998 - protein, 6 aa, Entamoeba histolytica
SIPYQT

SEQ ID NO: 2573999 - protein, 12 aa, Entamoeba histolytica
SIQEDEQEMKET

SEQ ID NO: 2574000 - protein, 20 aa, Entamoeba histolytica
SIQENPQTPLITTPDQHTNC

SEQ ID NO: 2574001 - protein, 7 aa, Entamoeba histolytica
SIQNPTV

SEQ ID NO: 2574002 - protein, 4 aa, Entamoeba histolytica
SIQP

SEQ ID NO: 2574003 - protein, 5 aa, Entamoeba histolytica
SIQQD

SEQ ID NO: 2574004 - protein, 7 aa, Entamoeba histolytica
SIQRGGA

SEQ ID NO: 2574005 - protein, 5 aa, Entamoeba histolytica
SIQRP

SEQ ID NO: 2574006 - protein, 9 aa, Entamoeba histolytica
SIQSSTSQY

SEQ ID NO: 2574007 - protein, 7 aa, Entamoeba histolytica
SIQTTRT

SEQ ID NO: 2574008 - protein, 10 aa, Entamoeba histolytica
SIREKAQQSM

SEQ ID NO: 2574009 - protein, 91 aa, Entamoeba histolytica
SIRETTHKTKLQKVNDKEKQVKEKEVQVNDKEKQVNEKEVQVNDKEKQVNDKEKQINQTKEELEKKESQIKQNQNSLEKEKEAIEKKKKGL

SEQ ID NO: 2574010 - protein, 6 aa, Entamoeba histolytica
SISEDF

SEQ ID NO: 2574011 - protein, 4 aa, Entamoeba histolytica
SISH

SEQ ID NO: 2574012 - protein, 8 aa, Entamoeba histolytica
SISLNGRT

SEQ ID NO: 2574013 - protein, 14 aa, Entamoeba histolytica
SISNCTQCQNEGNQ

SEQ ID NO: 2574014 - protein, 7 aa, Entamoeba histolytica
SISNGEC

SEQ ID NO: 2574015 - protein, 7 aa, Entamoeba histolytica
SISNNPL

SEQ ID NO: 2574016 - protein, 7 aa, Entamoeba histolytica
SISPSNC

SEQ ID NO: 2574017 - protein, 9 aa, Entamoeba histolytica
SISPTISPS

SEQ ID NO: 2574018 - protein, 8 aa, Entamoeba histolytica
SISSKQRL

SEQ ID NO: 2574019 - protein, 7 aa, Entamoeba histolytica
SISSSDI

SEQ ID NO: 2574020 - protein, 6 aa, Entamoeba histolytica
SISSTS

SEQ ID NO: 2574021 - protein, 17 aa, Entamoeba histolytica
SISTSGTDDDSKNSLDQ

SEQ ID NO: 2574022 - protein, 10 aa, Entamoeba histolytica
SISTTSQSAS

SEQ ID NO: 2574023 - protein, 4 aa, Entamoeba histolytica
SITE

SEQ ID NO: 2574024 - protein, 11 aa, Entamoeba histolytica
SITECTSGTCN

SEQ ID NO: 2574025 - protein, 11 aa, Entamoeba histolytica
SITGKPTKDLE

SEQ ID NO: 2574026 - protein, 8 aa, Entamoeba histolytica
SITGPTIS

SEQ ID NO: 2574027 - protein, 5 aa, Entamoeba histolytica
SITGQ

SEQ ID NO: 2574028 - protein, 9 aa, Entamoeba histolytica
SITKEGNEL

SEQ ID NO: 2574029 - protein, 7 aa, Entamoeba histolytica
SITPLTH

SEQ ID NO: 2574030 - protein, 7 aa, Entamoeba histolytica
SITPPQL

SEQ ID NO: 2574031 - protein, 6 aa, Entamoeba histolytica
SITPRH

SEQ ID NO: 2574032 - protein, 13 aa, Entamoeba histolytica
SITSPNLKRETTS

SEQ ID NO: 2574033 - protein, 12 aa, Entamoeba histolytica
SITSSPPSFNNY

SEQ ID NO: 2574034 - protein, 4 aa, Entamoeba histolytica
SITT

SEQ ID NO: 2574035 - protein, 6 aa, Entamoeba histolytica
SITTNN

SEQ ID NO: 2574036 - protein, 8 aa, Entamoeba histolytica
SITTRRGK

SEQ ID NO: 2574037 - protein, 6 aa, Entamoeba histolytica
SITVNG

SEQ ID NO: 2574038 - protein, 10 aa, Entamoeba histolytica
SIVNPKGALT

SEQ ID NO: 2574039 - protein, 7 aa, Entamoeba histolytica
SIYEGPE

SEQ ID NO: 2574040 - protein, 12 aa, Entamoeba histolytica
SIYNPSSGIIPS

SEQ ID NO: 2574041 - protein, 6 aa, Entamoeba histolytica
SIYPEK

SEQ ID NO: 2574042 - protein, 8 aa, Entamoeba histolytica
SKAANDAL

SEQ ID NO: 2574043 - protein, 6 aa, Entamoeba histolytica
SKAEQI

SEQ ID NO: 2574044 - protein, 8 aa, Entamoeba histolytica
SKALEPLS

SEQ ID NO: 2574045 - protein, 8 aa, Entamoeba histolytica
SKAVGGNV

SEQ ID NO: 2574046 - protein, 5 aa, Entamoeba histolytica
SKCDD

SEQ ID NO: 2574047 - protein, 13 aa, Entamoeba histolytica
SKCETDNTFNDID

SEQ ID NO: 2574048 - protein, 14 aa, Entamoeba histolytica
SKCHGNTPCPTTPC

SEQ ID NO: 2574049 - protein, 20 aa, Entamoeba histolytica
SKCKENCTRCSTKNECNSCE

SEQ ID NO: 2574050 - protein, 10 aa, Entamoeba histolytica
SKCKENCTTY

SEQ ID NO: 2574051 - protein, 6 aa, Entamoeba histolytica
SKCTEE

SEQ ID NO: 2574052 - protein, 11 aa, Entamoeba histolytica
SKDDEESENEG

SEQ ID NO: 2574053 - protein, 8 aa, Entamoeba histolytica
SKDDEKKL

SEQ ID NO: 2574054 - protein, 10 aa, Entamoeba histolytica
SKDEEIEENG

SEQ ID NO: 2574055 - protein, 5 aa, Entamoeba histolytica
SKDKK

SEQ ID NO: 2574056 - protein, 8 aa, Entamoeba histolytica
SKDNDKCG

SEQ ID NO: 2574057 - protein, 6 aa, Entamoeba histolytica
SKDRNK

SEQ ID NO: 2574058 - protein, 10 aa, Entamoeba histolytica
SKDSNQIRSV

SEQ ID NO: 2574059 - protein, 6 aa, Entamoeba histolytica
SKDSRF

SEQ ID NO: 2574060 - protein, 7 aa, Entamoeba histolytica
SKDTTLS

SEQ ID NO: 2574061 - protein, 23 aa, Entamoeba histolytica
SKEAAKFNSYAKQFNKKHSSNTV

SEQ ID NO: 2574062 - protein, 13 aa, Entamoeba histolytica
SKECEDGENEDIK

SEQ ID NO: 2574063 - protein, 4 aa, Entamoeba histolytica
SKED

SEQ ID NO: 2574064 - protein, 8 aa, Entamoeba histolytica
SKEEEEEQ

SEQ ID NO: 2574065 - protein, 6 aa, Entamoeba histolytica
SKEELS

SEQ ID NO: 2574066 - protein, 9 aa, Entamoeba histolytica
SKEESKINS

SEQ ID NO: 2574067 - protein, 6 aa, Entamoeba histolytica
SKEETT

SEQ ID NO: 2574068 - protein, 5 aa, Entamoeba histolytica
SKEEV

SEQ ID NO: 2574069 - protein, 9 aa, Entamoeba histolytica
SKEGETKVE

SEQ ID NO: 2574070 - protein, 5 aa, Entamoeba histolytica
SKEGG

SEQ ID NO: 2574071 - protein, 6 aa, Entamoeba histolytica
SKEGIE

SEQ ID NO: 2574072 - protein, 5 aa, Entamoeba histolytica
SKEHD

SEQ ID NO: 2574073 - protein, 8 aa, Entamoeba histolytica
SKEHEQKG

SEQ ID NO: 2574074 - protein, 9 aa, Entamoeba histolytica
SKEKEGYSI

SEQ ID NO: 2574075 - protein, 6 aa, Entamoeba histolytica
SKELDE

SEQ ID NO: 2574076 - protein, 7 aa, Entamoeba histolytica
SKENKVI

SEQ ID NO: 2574077 - protein, 6 aa, Entamoeba histolytica
SKENNN

SEQ ID NO: 2574078 - protein, 6 aa, Entamoeba histolytica
SKEPKL

SEQ ID NO: 2574079 - protein, 11 aa, Entamoeba histolytica
SKEPKPEDDTV

SEQ ID NO: 2574080 - protein, 6 aa, Entamoeba histolytica
SKEPKY

SEQ ID NO: 2574081 - protein, 20 aa, Entamoeba histolytica
SKEQKKDSDDENYQHDEEVE

SEQ ID NO: 2574082 - protein, 6 aa, Entamoeba histolytica
SKEQLQ

SEQ ID NO: 2574083 - protein, 15 aa, Entamoeba histolytica
SKESESTIESSESIT

SEQ ID NO: 2574084 - protein, 8 aa, Entamoeba histolytica
SKESSQLT

SEQ ID NO: 2574085 - protein, 8 aa, Entamoeba histolytica
SKESTGQI

SEQ ID NO: 2574086 - protein, 13 aa, Entamoeba histolytica
SKETNFGSEYGIT

SEQ ID NO: 2574087 - protein, 4 aa, Entamoeba histolytica
SKEW

SEQ ID NO: 2574088 - protein, 7 aa, Entamoeba histolytica
SKFAPSL

SEQ ID NO: 2574089 - protein, 4 aa, Entamoeba histolytica
SKFD

SEQ ID NO: 2574090 - protein, 8 aa, Entamoeba histolytica
SKFQQGSC

SEQ ID NO: 2574091 - protein, 13 aa, Entamoeba histolytica
SKFSETNSLPELS

SEQ ID NO: 2574092 - protein, 11 aa, Entamoeba histolytica
SKFSGTKPKEW

SEQ ID NO: 2574093 - protein, 8 aa, Entamoeba histolytica
SKGEGFGQ

SEQ ID NO: 2574094 - protein, 6 aa, Entamoeba histolytica
SKGEVK

SEQ ID NO: 2574095 - protein, 29 aa, Entamoeba histolytica
SKGFGTVSPTTTTSPKQSTSSKVAEKQKS

SEQ ID NO: 2574096 - protein, 5 aa, Entamoeba histolytica
SKGID

SEQ ID NO: 2574097 - protein, 6 aa, Entamoeba histolytica
SKGISN

SEQ ID NO: 2574098 - protein, 4 aa, Entamoeba histolytica
SKGK

SEQ ID NO: 2574099 - protein, 7 aa, Entamoeba histolytica
SKGLGIK

SEQ ID NO: 2574100 - protein, 7 aa, Entamoeba histolytica
SKGNDVI

SEQ ID NO: 2574101 - protein, 7 aa, Entamoeba histolytica
SKGNRVN

SEQ ID NO: 2574102 - protein, 9 aa, Entamoeba histolytica
SKGRGTETV

SEQ ID NO: 2574103 - protein, 7 aa, Entamoeba histolytica
SKGTEGC

SEQ ID NO: 2574104 - protein, 6 aa, Entamoeba histolytica
SKGYRT

SEQ ID NO: 2574105 - protein, 12 aa, Entamoeba histolytica
SKGYTSDCQGCQ

SEQ ID NO: 2574106 - protein, 11 aa, Entamoeba histolytica
SKHAKKRKEVT

SEQ ID NO: 2574107 - protein, 9 aa, Entamoeba histolytica
SKHALGDYS

SEQ ID NO: 2574108 - protein, 5 aa, Entamoeba histolytica
SKHDQ

SEQ ID NO: 2574109 - protein, 12 aa, Entamoeba histolytica
SKHHEKISKTED

SEQ ID NO: 2574110 - protein, 7 aa, Entamoeba histolytica
SKHHPTK

SEQ ID NO: 2574111 - protein, 8 aa, Entamoeba histolytica
SKIDKSDI

SEQ ID NO: 2574112 - protein, 8 aa, Entamoeba histolytica
SKIGDNND

SEQ ID NO: 2574113 - protein, 10 aa, Entamoeba histolytica
SKIKGDSSSF

SEQ ID NO: 2574114 - protein, 8 aa, Entamoeba histolytica
SKINKNNN

SEQ ID NO: 2574115 - protein, 12 aa, Entamoeba histolytica
SKIQKEPNEEEF

SEQ ID NO: 2574116 - protein, 5 aa, Entamoeba histolytica
SKIRI

SEQ ID NO: 2574117 - protein, 6 aa, Entamoeba histolytica
SKISNG

SEQ ID NO: 2574118 - protein, 6 aa, Entamoeba histolytica
SKITVT

SEQ ID NO: 2574119 - protein, 5 aa, Entamoeba histolytica
SKKCQ

SEQ ID NO: 2574120 - protein, 9 aa, Entamoeba histolytica
SKKDEKSEL

SEQ ID NO: 2574121 - protein, 8 aa, Entamoeba histolytica
SKKEEENE

SEQ ID NO: 2574122 - protein, 6 aa, Entamoeba histolytica
SKKEEY

SEQ ID NO: 2574123 - protein, 43 aa, Entamoeba histolytica
SKKEIQEEKTKVKYKKIEESPLVQTNDELGYHSKDRDDDETPI

SEQ ID NO: 2574124 - protein, 6 aa, Entamoeba histolytica
SKKEIT

SEQ ID NO: 2574125 - protein, 11 aa, Entamoeba histolytica
SKKEPDPSKAQ

SEQ ID NO: 2574126 - protein, 6 aa, Entamoeba histolytica
SKKEQE

SEQ ID NO: 2574127 - protein, 6 aa, Entamoeba histolytica
SKKGEL

SEQ ID NO: 2574128 - protein, 5 aa, Entamoeba histolytica
SKKIT

SEQ ID NO: 2574129 - protein, 11 aa, Entamoeba histolytica
SKKKGINEQRK

SEQ ID NO: 2574130 - protein, 7 aa, Entamoeba histolytica
SKKMNKS

SEQ ID NO: 2574131 - protein, 8 aa, Entamoeba histolytica
SKKNSINS

SEQ ID NO: 2574132 - protein, 14 aa, Entamoeba histolytica
SKKPKDDEDEYYDG

SEQ ID NO: 2574133 - protein, 14 aa, Entamoeba histolytica
SKKPKNDEDEYYDG

SEQ ID NO: 2574134 - protein, 14 aa, Entamoeba histolytica
SKKRESKYVLFHDD

SEQ ID NO: 2574135 - protein, 13 aa, Entamoeba histolytica
SKKSQVDSLKDKK

SEQ ID NO: 2574136 - protein, 6 aa, Entamoeba histolytica
SKKSRY

SEQ ID NO: 2574137 - protein, 16 aa, Entamoeba histolytica
SKKSSSSPKKSMFEEE

SEQ ID NO: 2574138 - protein, 14 aa, Entamoeba histolytica
SKKSTAIKRLHKKQ

SEQ ID NO: 2574139 - protein, 7 aa, Entamoeba histolytica
SKKTCSR

SEQ ID NO: 2574140 - protein, 6 aa, Entamoeba histolytica
SKKTGI

SEQ ID NO: 2574141 - protein, 5 aa, Entamoeba histolytica
SKKTL

SEQ ID NO: 2574142 - protein, 11 aa, Entamoeba histolytica
SKKTQKTKYEF

SEQ ID NO: 2574143 - protein, 9 aa, Entamoeba histolytica
SKKVDPEVD

SEQ ID NO: 2574144 - protein, 6 aa, Entamoeba histolytica
SKKYSS

SEQ ID NO: 2574145 - protein, 7 aa, Entamoeba histolytica
SKLEAKG

SEQ ID NO: 2574146 - protein, 10 aa, Entamoeba histolytica
SKLSDSDKIE

SEQ ID NO: 2574147 - protein, 7 aa, Entamoeba histolytica
SKLSTRQ

SEQ ID NO: 2574148 - protein, 8 aa, Entamoeba histolytica
SKLTQSSE

SEQ ID NO: 2574149 - protein, 6 aa, Entamoeba histolytica
SKMHTS

SEQ ID NO: 2574150 - protein, 18 aa, Entamoeba histolytica
SKMKDGSVIGDPAEKAAL

SEQ ID NO: 2574151 - protein, 10 aa, Entamoeba histolytica
SKMNSDKCNG

SEQ ID NO: 2574152 - protein, 5 aa, Entamoeba histolytica
SKMVS

SEQ ID NO: 2574153 - protein, 8 aa, Entamoeba histolytica
SKNAKLER

SEQ ID NO: 2574154 - protein, 9 aa, Entamoeba histolytica
SKNDKSIVG

SEQ ID NO: 2574155 - protein, 8 aa, Entamoeba histolytica
SKNDQSNH

SEQ ID NO: 2574156 - protein, 7 aa, Entamoeba histolytica
SKNEKEW

SEQ ID NO: 2574157 - protein, 8 aa, Entamoeba histolytica
SKNGYTPI

SEQ ID NO: 2574158 - protein, 6 aa, Entamoeba histolytica
SKNIKG

SEQ ID NO: 2574159 - protein, 9 aa, Entamoeba histolytica
SKNKDNKET

SEQ ID NO: 2574160 - protein, 6 aa, Entamoeba histolytica
SKNSDE

SEQ ID NO: 2574161 - protein, 6 aa, Entamoeba histolytica
SKNSLS

SEQ ID NO: 2574162 - protein, 5 aa, Entamoeba histolytica
SKNTM

SEQ ID NO: 2574163 - protein, 7 aa, Entamoeba histolytica
SKNYRDD

SEQ ID NO: 2574164 - protein, 4 aa, Entamoeba histolytica
SKPA

SEQ ID NO: 2574165 - protein, 28 aa, Entamoeba histolytica
SKPAPPLPSKKESTQFRTTSSSDNGMIS

SEQ ID NO: 2574166 - protein, 8 aa, Entamoeba histolytica
SKPASSRV

SEQ ID NO: 2574167 - protein, 4 aa, Entamoeba histolytica
SKPC

SEQ ID NO: 2574168 - protein, 6 aa, Entamoeba histolytica
SKPIDL

SEQ ID NO: 2574169 - protein, 5 aa, Entamoeba histolytica
SKPNI

SEQ ID NO: 2574170 - protein, 9 aa, Entamoeba histolytica
SKPPESLAP

SEQ ID NO: 2574171 - protein, 8 aa, Entamoeba histolytica
SKPSEMKN

SEQ ID NO: 2574172 - protein, 20 aa, Entamoeba histolytica
SKPSGDISKSCEGYPEQSGT

SEQ ID NO: 2574173 - protein, 10 aa, Entamoeba histolytica
SKPSKQEEKL

SEQ ID NO: 2574174 - protein, 12 aa, Entamoeba histolytica
SKPSPDSISDGT

SEQ ID NO: 2574175 - protein, 9 aa, Entamoeba histolytica
SKPSPQQTV

SEQ ID NO: 2574176 - protein, 6 aa, Entamoeba histolytica
SKPTFS

SEQ ID NO: 2574177 - protein, 11 aa, Entamoeba histolytica
SKPTKKEDKEV

SEQ ID NO: 2574178 - protein, 7 aa, Entamoeba histolytica
SKPVKRL

SEQ ID NO: 2574179 - protein, 8 aa, Entamoeba histolytica
SKPVPPSQ

SEQ ID NO: 2574180 - protein, 13 aa, Entamoeba histolytica
SKQEKKLRKQYSE

SEQ ID NO: 2574181 - protein, 5 aa, Entamoeba histolytica
SKQEL

SEQ ID NO: 2574182 - protein, 9 aa, Entamoeba histolytica
SKQGKQEIP

SEQ ID NO: 2574183 - protein, 7 aa, Entamoeba histolytica
SKQHYSN

SEQ ID NO: 2574184 - protein, 20 aa, Entamoeba histolytica
SKQIEEKTKAETKEEIPQKN

SEQ ID NO: 2574185 - protein, 17 aa, Entamoeba histolytica
SKQINDKISVSHIKLVF

SEQ ID NO: 2574186 - protein, 7 aa, Entamoeba histolytica
SKQKEGK

SEQ ID NO: 2574187 - protein, 8 aa, Entamoeba histolytica
SKQKLRGT

SEQ ID NO: 2574188 - protein, 14 aa, Entamoeba histolytica
SKQLDKYSAKYGTM

SEQ ID NO: 2574189 - protein, 6 aa, Entamoeba histolytica
SKQNDV

SEQ ID NO: 2574190 - protein, 10 aa, Entamoeba histolytica
SKQSVDYAQT

SEQ ID NO: 2574191 - protein, 11 aa, Entamoeba histolytica
SKQTFSTNGIN

SEQ ID NO: 2574192 - protein, 13 aa, Entamoeba histolytica
SKQVQSIQTAAEN

SEQ ID NO: 2574193 - protein, 9 aa, Entamoeba histolytica
SKREISYEP

SEQ ID NO: 2574194 - protein, 4 aa, Entamoeba histolytica
SKRF

SEQ ID NO: 2574195 - protein, 8 aa, Entamoeba histolytica
SKRGLSTN

SEQ ID NO: 2574196 - protein, 4 aa, Entamoeba histolytica
SKRI

SEQ ID NO: 2574197 - protein, 11 aa, Entamoeba histolytica
SKRKDNNEYIQ

SEQ ID NO: 2574198 - protein, 10 aa, Entamoeba histolytica
SKRKGKGTKI

SEQ ID NO: 2574199 - protein, 14 aa, Entamoeba histolytica
SKRKLRADDFKPLD

SEQ ID NO: 2574200 - protein, 7 aa, Entamoeba histolytica
SKRMTAQ

SEQ ID NO: 2574201 - protein, 7 aa, Entamoeba histolytica
SKRNMKN

SEQ ID NO: 2574202 - protein, 6 aa, Entamoeba histolytica
SKRPAF

SEQ ID NO: 2574203 - protein, 4 aa, Entamoeba histolytica
SKRS

SEQ ID NO: 2574204 - protein, 9 aa, Entamoeba histolytica
SKRTTKPTT

SEQ ID NO: 2574205 - protein, 25 aa, Entamoeba histolytica
SKRVDESVKELKKSESNTSIQTPKI

SEQ ID NO: 2574206 - protein, 10 aa, Entamoeba histolytica
SKRYSPEVSK

SEQ ID NO: 2574207 - protein, 7 aa, Entamoeba histolytica
SKSAASS

SEQ ID NO: 2574208 - protein, 26 aa, Entamoeba histolytica
SKSAPSSKTPSPGLNRNQSSTKLHPG

SEQ ID NO: 2574209 - protein, 4 aa, Entamoeba histolytica
SKSE

SEQ ID NO: 2574210 - protein, 7 aa, Entamoeba histolytica
SKSEDPV

SEQ ID NO: 2574211 - protein, 8 aa, Entamoeba histolytica
SKSEREME

SEQ ID NO: 2574212 - protein, 5 aa, Entamoeba histolytica
SKSES

SEQ ID NO: 2574213 - protein, 8 aa, Entamoeba histolytica
SKSIPNCT

SEQ ID NO: 2574214 - protein, 9 aa, Entamoeba histolytica
SKSISLSQN

SEQ ID NO: 2574215 - protein, 4 aa, Entamoeba histolytica
SKSK

SEQ ID NO: 2574216 - protein, 9 aa, Entamoeba histolytica
SKSKSNYKD

SEQ ID NO: 2574217 - protein, 11 aa, Entamoeba histolytica
SKSLNNQYKQQ

SEQ ID NO: 2574218 - protein, 10 aa, Entamoeba histolytica
SKSLSNGPVS

SEQ ID NO: 2574219 - protein, 14 aa, Entamoeba histolytica
SKSLSRQSKRFANK

SEQ ID NO: 2574220 - protein, 6 aa, Entamoeba histolytica
SKSNIT

SEQ ID NO: 2574221 - protein, 8 aa, Entamoeba histolytica
SKSNQTNI

SEQ ID NO: 2574222 - protein, 9 aa, Entamoeba histolytica
SKSPIDSSN

SEQ ID NO: 2574223 - protein, 4 aa, Entamoeba histolytica
SKSR

SEQ ID NO: 2574224 - protein, 15 aa, Entamoeba histolytica
SKSTDSNTFGSTSFN

SEQ ID NO: 2574225 - protein, 7 aa, Entamoeba histolytica
SKSTLET

SEQ ID NO: 2574226 - protein, 7 aa, Entamoeba histolytica
SKSTLQE

SEQ ID NO: 2574227 - protein, 9 aa, Entamoeba histolytica
SKSYKKPAD

SEQ ID NO: 2574228 - protein, 7 aa, Entamoeba histolytica
SKTDSKC

SEQ ID NO: 2574229 - protein, 6 aa, Entamoeba histolytica
SKTEPY

SEQ ID NO: 2574230 - protein, 10 aa, Entamoeba histolytica
SKTFNQQNKS

SEQ ID NO: 2574231 - protein, 6 aa, Entamoeba histolytica
SKTFSN

SEQ ID NO: 2574232 - protein, 6 aa, Entamoeba histolytica
SKTKRM

SEQ ID NO: 2574233 - protein, 8 aa, Entamoeba histolytica
SKTLEEDN

SEQ ID NO: 2574234 - protein, 5 aa, Entamoeba histolytica
SKTLR

SEQ ID NO: 2574235 - protein, 5 aa, Entamoeba histolytica
SKTLS

SEQ ID NO: 2574236 - protein, 9 aa, Entamoeba histolytica
SKTMSEEGR

SEQ ID NO: 2574237 - protein, 7 aa, Entamoeba histolytica
SKTNEIQ

SEQ ID NO: 2574238 - protein, 22 aa, Entamoeba histolytica
SKTNEKAQQEIINQKDKEIQNV

SEQ ID NO: 2574239 - protein, 6 aa, Entamoeba histolytica
SKTPNR

SEQ ID NO: 2574240 - protein, 8 aa, Entamoeba histolytica
SKTPQQRR

SEQ ID NO: 2574241 - protein, 18 aa, Entamoeba histolytica
SKTPSVPLEEDKEEKTKT

SEQ ID NO: 2574242 - protein, 9 aa, Entamoeba histolytica
SKTPVPGKL

SEQ ID NO: 2574243 - protein, 4 aa, Entamoeba histolytica
SKTQ

SEQ ID NO: 2574244 - protein, 6 aa, Entamoeba histolytica
SKTQKR

SEQ ID NO: 2574245 - protein, 13 aa, Entamoeba histolytica
SKTQLQNNTSGYI

SEQ ID NO: 2574246 - protein, 9 aa, Entamoeba histolytica
SKTSDGITN

SEQ ID NO: 2574247 - protein, 8 aa, Entamoeba histolytica
SKTSNAVT

SEQ ID NO: 2574248 - protein, 6 aa, Entamoeba histolytica
SKTSYS

SEQ ID NO: 2574249 - protein, 4 aa, Entamoeba histolytica
SKTY

SEQ ID NO: 2574250 - protein, 6 aa, Entamoeba histolytica
SKTYNT

SEQ ID NO: 2574251 - protein, 9 aa, Entamoeba histolytica
SKVAGEGEH

SEQ ID NO: 2574252 - protein, 14 aa, Entamoeba histolytica
SKVPTTNTYKRPNE

SEQ ID NO: 2574253 - protein, 14 aa, Entamoeba histolytica
SKVPTTNTYKSPNE

SEQ ID NO: 2574254 - protein, 7 aa, Entamoeba histolytica
SKWNTED

SEQ ID NO: 2574255 - protein, 6 aa, Entamoeba histolytica
SKYDSV

SEQ ID NO: 2574256 - protein, 6 aa, Entamoeba histolytica
SKYFNG

SEQ ID NO: 2574257 - protein, 7 aa, Entamoeba histolytica
SKYNNNN

SEQ ID NO: 2574258 - protein, 6 aa, Entamoeba histolytica
SKYNST

SEQ ID NO: 2574259 - protein, 4 aa, Entamoeba histolytica
SKYP

SEQ ID NO: 2574260 - protein, 17 aa, Entamoeba histolytica
SKYPGCKKTDSCNVDSR

SEQ ID NO: 2574261 - protein, 19 aa, Entamoeba histolytica
SKYPGCKTTDTCNVDSRTG

SEQ ID NO: 2574262 - protein, 12 aa, Entamoeba histolytica
SKYPIVTSSDEI

SEQ ID NO: 2574263 - protein, 7 aa, Entamoeba histolytica
SKYSTQI

SEQ ID NO: 2574264 - protein, 12 aa, Entamoeba histolytica
SLADKATSIPPQ

SEQ ID NO: 2574265 - protein, 32 aa, Entamoeba histolytica
SLATNQQGLNNTDKKNEEGNTSLYSETTIETS

SEQ ID NO: 2574266 - protein, 8 aa, Entamoeba histolytica
SLDEPEAK

SEQ ID NO: 2574267 - protein, 5 aa, Entamoeba histolytica
SLDGT

SEQ ID NO: 2574268 - protein, 9 aa, Entamoeba histolytica
SLDPPPNHS

SEQ ID NO: 2574269 - protein, 5 aa, Entamoeba histolytica
SLDSS

SEQ ID NO: 2574270 - protein, 9 aa, Entamoeba histolytica
SLDSSLKPI

SEQ ID NO: 2574271 - protein, 12 aa, Entamoeba histolytica
SLEDASALDEGV

SEQ ID NO: 2574272 - protein, 6 aa, Entamoeba histolytica
SLEEKH

SEQ ID NO: 2574273 - protein, 13 aa, Entamoeba histolytica
SLEEKQDAIARAN

SEQ ID NO: 2574274 - protein, 10 aa, Entamoeba histolytica
SLEKDGVKPH

SEQ ID NO: 2574275 - protein, 12 aa, Entamoeba histolytica
SLEKESSEKLNS

SEQ ID NO: 2574276 - protein, 9 aa, Entamoeba histolytica
SLEKQGGEV

SEQ ID NO: 2574277 - protein, 10 aa, Entamoeba histolytica
SLESNKTKIS

SEQ ID NO: 2574278 - protein, 6 aa, Entamoeba histolytica
SLETVT

SEQ ID NO: 2574279 - protein, 12 aa, Entamoeba histolytica
SLEVSEQMSSDK

SEQ ID NO: 2574280 - protein, 10 aa, Entamoeba histolytica
SLFDESNPDA

SEQ ID NO: 2574281 - protein, 10 aa, Entamoeba histolytica
SLGDGSQCTK

SEQ ID NO: 2574282 - protein, 8 aa, Entamoeba histolytica
SLGDTDVD

SEQ ID NO: 2574283 - protein, 4 aa, Entamoeba histolytica
SLGE

SEQ ID NO: 2574284 - protein, 7 aa, Entamoeba histolytica
SLGGASV

SEQ ID NO: 2574285 - protein, 10 aa, Entamoeba histolytica
SLGKEKKKSG

SEQ ID NO: 2574286 - protein, 19 aa, Entamoeba histolytica
SLGRMPEKYGGDKQFEANG

SEQ ID NO: 2574287 - protein, 10 aa, Entamoeba histolytica
SLGVDKKVGD

SEQ ID NO: 2574288 - protein, 12 aa, Entamoeba histolytica
SLGYKEDCSGCE

SEQ ID NO: 2574289 - protein, 10 aa, Entamoeba histolytica
SLHGNKKAKM

SEQ ID NO: 2574290 - protein, 20 aa, Entamoeba histolytica
SLIGTEKRRGISGGEKKRVS

SEQ ID NO: 2574291 - protein, 6 aa, Entamoeba histolytica
SLKDGK

SEQ ID NO: 2574292 - protein, 7 aa, Entamoeba histolytica
SLKEIKS

SEQ ID NO: 2574293 - protein, 7 aa, Entamoeba histolytica
SLKETFK

SEQ ID NO: 2574294 - protein, 7 aa, Entamoeba histolytica
SLKKGIN

SEQ ID NO: 2574295 - protein, 9 aa, Entamoeba histolytica
SLKPKQTTH

SEQ ID NO: 2574296 - protein, 20 aa, Entamoeba histolytica
SLKRKDEKTEGSENNEVAPT

SEQ ID NO: 2574297 - protein, 10 aa, Entamoeba histolytica
SLKSTTDEEF

SEQ ID NO: 2574298 - protein, 12 aa, Entamoeba histolytica
SLKSTYDNRTYS

SEQ ID NO: 2574299 - protein, 4 aa, Entamoeba histolytica
SLLP

SEQ ID NO: 2574300 - protein, 8 aa, Entamoeba histolytica
SLNEGEEI

SEQ ID NO: 2574301 - protein, 7 aa, Entamoeba histolytica
SLNEVGN

SEQ ID NO: 2574302 - protein, 11 aa, Entamoeba histolytica
SLNIPNKNETI

SEQ ID NO: 2574303 - protein, 12 aa, Entamoeba histolytica
SLNSNAGYNKLD

SEQ ID NO: 2574304 - protein, 9 aa, Entamoeba histolytica
SLPDTNNEI

SEQ ID NO: 2574305 - protein, 12 aa, Entamoeba histolytica
SLPEEKRKEVKS

SEQ ID NO: 2574306 - protein, 22 aa, Entamoeba histolytica
SLPESDDKRIREIEENDKNIDN

SEQ ID NO: 2574307 - protein, 7 aa, Entamoeba histolytica
SLPKRSE

SEQ ID NO: 2574308 - protein, 9 aa, Entamoeba histolytica
SLPPSDERQ

SEQ ID NO: 2574309 - protein, 9 aa, Entamoeba histolytica
SLPPSKPGE

SEQ ID NO: 2574310 - protein, 10 aa, Entamoeba histolytica
SLPPSVPKKV

SEQ ID NO: 2574311 - protein, 9 aa, Entamoeba histolytica
SLPSSKFPS

SEQ ID NO: 2574312 - protein, 6 aa, Entamoeba histolytica
SLPSYT

SEQ ID NO: 2574313 - protein, 12 aa, Entamoeba histolytica
SLPTFSQSKSKT

SEQ ID NO: 2574314 - protein, 6 aa, Entamoeba histolytica
SLPTKT

SEQ ID NO: 2574315 - protein, 7 aa, Entamoeba histolytica
SLPVDGE

SEQ ID NO: 2574316 - protein, 7 aa, Entamoeba histolytica
SLPVKSS

SEQ ID NO: 2574317 - protein, 13 aa, Entamoeba histolytica
SLQPNQSVHNTNE

SEQ ID NO: 2574318 - protein, 10 aa, Entamoeba histolytica
SLQQESKERI

SEQ ID NO: 2574319 - protein, 12 aa, Entamoeba histolytica
SLQRRKKELNDR

SEQ ID NO: 2574320 - protein, 9 aa, Entamoeba histolytica
SLRGPSSII

SEQ ID NO: 2574321 - protein, 9 aa, Entamoeba histolytica
SLRKDNDHS

SEQ ID NO: 2574322 - protein, 4 aa, Entamoeba histolytica
SLSD

SEQ ID NO: 2574323 - protein, 47 aa, Entamoeba histolytica
SLSHSTSNSSKPALPPKPLSMSTEKSKPNKERPTLPKKSIKQVATEP

SEQ ID NO: 2574324 - protein, 13 aa, Entamoeba histolytica
SLSKKNSKQTTPE

SEQ ID NO: 2574325 - protein, 8 aa, Entamoeba histolytica
SLSNGNYK

SEQ ID NO: 2574326 - protein, 7 aa, Entamoeba histolytica
SLSNNKA

SEQ ID NO: 2574327 - protein, 10 aa, Entamoeba histolytica
SLSPAPDRLS

SEQ ID NO: 2574328 - protein, 7 aa, Entamoeba histolytica
SLSPNSV

SEQ ID NO: 2574329 - protein, 8 aa, Entamoeba histolytica
SLSPPSHS

SEQ ID NO: 2574330 - protein, 4 aa, Entamoeba histolytica
SLSQ

SEQ ID NO: 2574331 - protein, 7 aa, Entamoeba histolytica
SLSQIST

SEQ ID NO: 2574332 - protein, 5 aa, Entamoeba histolytica
SLSQQ

SEQ ID NO: 2574333 - protein, 42 aa, Entamoeba histolytica
SLSQTSSNSIKTGSTTTQSITSVSNSLSDISSFTSNSTNEEM

SEQ ID NO: 2574334 - protein, 10 aa, Entamoeba histolytica
SLSSDHSDDL

SEQ ID NO: 2574335 - protein, 9 aa, Entamoeba histolytica
SLSSSLNSS

SEQ ID NO: 2574336 - protein, 5 aa, Entamoeba histolytica
SLSTS

SEQ ID NO: 2574337 - protein, 6 aa, Entamoeba histolytica
SLSYND

SEQ ID NO: 2574338 - protein, 4 aa, Entamoeba histolytica
SLTA

SEQ ID NO: 2574339 - protein, 9 aa, Entamoeba histolytica
SLTASSKSL

SEQ ID NO: 2574340 - protein, 11 aa, Entamoeba histolytica
SLTDAADEAKG

SEQ ID NO: 2574341 - protein, 18 aa, Entamoeba histolytica
SLTEDNNIPKEEKEQDIN

SEQ ID NO: 2574342 - protein, 31 aa, Entamoeba histolytica
SLTESSSNIAITGQTEDGNELKEAKESPELK

SEQ ID NO: 2574343 - protein, 31 aa, Entamoeba histolytica
SLTESSSTIEITGQTKENPELKEAKENPELK

SEQ ID NO: 2574344 - protein, 10 aa, Entamoeba histolytica
SLTETKEKVE

SEQ ID NO: 2574345 - protein, 6 aa, Entamoeba histolytica
SLTGEW

SEQ ID NO: 2574346 - protein, 6 aa, Entamoeba histolytica
SLTGRE

SEQ ID NO: 2574347 - protein, 8 aa, Entamoeba histolytica
SLTNESIQ

SEQ ID NO: 2574348 - protein, 5 aa, Entamoeba histolytica
SLTNP

SEQ ID NO: 2574349 - protein, 8 aa, Entamoeba histolytica
SLTPEQSL

SEQ ID NO: 2574350 - protein, 13 aa, Entamoeba histolytica
SLVNSGEVEQPTI

SEQ ID NO: 2574351 - protein, 8 aa, Entamoeba histolytica
SMAQNGSR

SEQ ID NO: 2574352 - protein, 4 aa, Entamoeba histolytica
SMAT

SEQ ID NO: 2574353 - protein, 6 aa, Entamoeba histolytica
SMDDKS

SEQ ID NO: 2574354 - protein, 4 aa, Entamoeba histolytica
SMES

SEQ ID NO: 2574355 - protein, 4 aa, Entamoeba histolytica
SMGL

SEQ ID NO: 2574356 - protein, 5 aa, Entamoeba histolytica
SMGLS

SEQ ID NO: 2574357 - protein, 5 aa, Entamoeba histolytica
SMKLS

SEQ ID NO: 2574358 - protein, 7 aa, Entamoeba histolytica
SMNEEDK

SEQ ID NO: 2574359 - protein, 13 aa, Entamoeba histolytica
SMNSESPFEEEPK

SEQ ID NO: 2574360 - protein, 8 aa, Entamoeba histolytica
SMNSTNYD

SEQ ID NO: 2574361 - protein, 4 aa, Entamoeba histolytica
SMPK

SEQ ID NO: 2574362 - protein, 5 aa, Entamoeba histolytica
SMPTT

SEQ ID NO: 2574363 - protein, 6 aa, Entamoeba histolytica
SMPYGQ

SEQ ID NO: 2574364 - protein, 6 aa, Entamoeba histolytica
SMPYSN

SEQ ID NO: 2574365 - protein, 12 aa, Entamoeba histolytica
SMSITNEPTNIN

SEQ ID NO: 2574366 - protein, 5 aa, Entamoeba histolytica
SMSPY

SEQ ID NO: 2574367 - protein, 10 aa, Entamoeba histolytica
SMTEADRKKP

SEQ ID NO: 2574368 - protein, 7 aa, Entamoeba histolytica
SMTNKTI

SEQ ID NO: 2574369 - protein, 7 aa, Entamoeba histolytica
SMTNNIS

SEQ ID NO: 2574370 - protein, 5 aa, Entamoeba histolytica
SMTTH

SEQ ID NO: 2574371 - protein, 16 aa, Entamoeba histolytica
SNADEIKSTYEKNIKK

SEQ ID NO: 2574372 - protein, 4 aa, Entamoeba histolytica
SNAE

SEQ ID NO: 2574373 - protein, 6 aa, Entamoeba histolytica
SNAEAL

SEQ ID NO: 2574374 - protein, 13 aa, Entamoeba histolytica
SNAGNGVYESTTD

SEQ ID NO: 2574375 - protein, 8 aa, Entamoeba histolytica
SNARQYEY

SEQ ID NO: 2574376 - protein, 6 aa, Entamoeba histolytica
SNCDKE

SEQ ID NO: 2574377 - protein, 7 aa, Entamoeba histolytica
SNCENSK

SEQ ID NO: 2574378 - protein, 7 aa, Entamoeba histolytica
SNCGDSF

SEQ ID NO: 2574379 - protein, 5 aa, Entamoeba histolytica
SNCSP

SEQ ID NO: 2574380 - protein, 6 aa, Entamoeba histolytica
SNCTED

SEQ ID NO: 2574381 - protein, 7 aa, Entamoeba histolytica
SNDCECN

SEQ ID NO: 2574382 - protein, 11 aa, Entamoeba histolytica
SNDDKNFNAVK

SEQ ID NO: 2574383 - protein, 8 aa, Entamoeba histolytica
SNDDVTKK

SEQ ID NO: 2574384 - protein, 9 aa, Entamoeba histolytica
SNDGKLSVA

SEQ ID NO: 2574385 - protein, 5 aa, Entamoeba histolytica
SNDGM

SEQ ID NO: 2574386 - protein, 5 aa, Entamoeba histolytica
SNDID

SEQ ID NO: 2574387 - protein, 4 aa, Entamoeba histolytica
SNDK

SEQ ID NO: 2574388 - protein, 7 aa, Entamoeba histolytica
SNDKRIQ

SEQ ID NO: 2574389 - protein, 8 aa, Entamoeba histolytica
SNDLYSQA

SEQ ID NO: 2574390 - protein, 6 aa, Entamoeba histolytica
SNDNIN

SEQ ID NO: 2574391 - protein, 6 aa, Entamoeba histolytica
SNDNTR

SEQ ID NO: 2574392 - protein, 5 aa, Entamoeba histolytica
SNDPG

SEQ ID NO: 2574393 - protein, 9 aa, Entamoeba histolytica
SNDTEPCVN

SEQ ID NO: 2574394 - protein, 4 aa, Entamoeba histolytica
SNDW

SEQ ID NO: 2574395 - protein, 5 aa, Entamoeba histolytica
SNDYN

SEQ ID NO: 2574396 - protein, 14 aa, Entamoeba histolytica
SNECSPKAKLSTKT

SEQ ID NO: 2574397 - protein, 5 aa, Entamoeba histolytica
SNEDC

SEQ ID NO: 2574398 - protein, 5 aa, Entamoeba histolytica
SNEDP

SEQ ID NO: 2574399 - protein, 4 aa, Entamoeba histolytica
SNEE

SEQ ID NO: 2574400 - protein, 5 aa, Entamoeba histolytica
SNEEI

SEQ ID NO: 2574401 - protein, 7 aa, Entamoeba histolytica
SNEEMEE

SEQ ID NO: 2574402 - protein, 8 aa, Entamoeba histolytica
SNEGDDFK

SEQ ID NO: 2574403 - protein, 8 aa, Entamoeba histolytica
SNEGHGYT

SEQ ID NO: 2574404 - protein, 21 aa, Entamoeba histolytica
SNEGSEISLTSEAKINSISTD

SEQ ID NO: 2574405 - protein, 4 aa, Entamoeba histolytica
SNEI

SEQ ID NO: 2574406 - protein, 5 aa, Entamoeba histolytica
SNEIK

SEQ ID NO: 2574407 - protein, 5 aa, Entamoeba histolytica
SNEKE

SEQ ID NO: 2574408 - protein, 10 aa, Entamoeba histolytica
SNEKQSSNPL

SEQ ID NO: 2574409 - protein, 7 aa, Entamoeba histolytica
SNEMAGE

SEQ ID NO: 2574410 - protein, 15 aa, Entamoeba histolytica
SNENDLSSPSESSSS

SEQ ID NO: 2574411 - protein, 10 aa, Entamoeba histolytica
SNENKSNNIS

SEQ ID NO: 2574412 - protein, 7 aa, Entamoeba histolytica
SNENPNL

SEQ ID NO: 2574413 - protein, 7 aa, Entamoeba histolytica
SNEPDLT

SEQ ID NO: 2574414 - protein, 7 aa, Entamoeba histolytica
SNEPGYT

SEQ ID NO: 2574415 - protein, 14 aa, Entamoeba histolytica
SNEQENQEESNKND

SEQ ID NO: 2574416 - protein, 23 aa, Entamoeba histolytica
SNERNSLKDSISSSISSANEFDT

SEQ ID NO: 2574417 - protein, 7 aa, Entamoeba histolytica
SNESFQK

SEQ ID NO: 2574418 - protein, 9 aa, Entamoeba histolytica
SNESSENSV

SEQ ID NO: 2574419 - protein, 5 aa, Entamoeba histolytica
SNETI

SEQ ID NO: 2574420 - protein, 5 aa, Entamoeba histolytica
SNETK

SEQ ID NO: 2574421 - protein, 11 aa, Entamoeba histolytica
SNFKGNTKQRN

SEQ ID NO: 2574422 - protein, 11 aa, Entamoeba histolytica
SNFPTKDQSKY

SEQ ID NO: 2574423 - protein, 6 aa, Entamoeba histolytica
SNFQTE

SEQ ID NO: 2574424 - protein, 25 aa, Entamoeba histolytica
SNGACTSCDTGYELTTTGNNKTCTL

SEQ ID NO: 2574425 - protein, 9 aa, Entamoeba histolytica
SNGECKRDS

SEQ ID NO: 2574426 - protein, 9 aa, Entamoeba histolytica
SNGESSLEV

SEQ ID NO: 2574427 - protein, 16 aa, Entamoeba histolytica
SNGKISPNITISTNSS

SEQ ID NO: 2574428 - protein, 7 aa, Entamoeba histolytica
SNGKYQT

SEQ ID NO: 2574429 - protein, 8 aa, Entamoeba histolytica
SNGLSVGE

SEQ ID NO: 2574430 - protein, 7 aa, Entamoeba histolytica
SNGMSGG

SEQ ID NO: 2574431 - protein, 6 aa, Entamoeba histolytica
SNGNID

SEQ ID NO: 2574432 - protein, 5 aa, Entamoeba histolytica
SNGQI

SEQ ID NO: 2574433 - protein, 12 aa, Entamoeba histolytica
SNGQVENKTDIE

SEQ ID NO: 2574434 - protein, 5 aa, Entamoeba histolytica
SNGQY

SEQ ID NO: 2574435 - protein, 10 aa, Entamoeba histolytica
SNGRAIAKSI

SEQ ID NO: 2574436 - protein, 9 aa, Entamoeba histolytica
SNGSPGQYT

SEQ ID NO: 2574437 - protein, 14 aa, Entamoeba histolytica
SNGTTQQPSKKLPS

SEQ ID NO: 2574438 - protein, 8 aa, Entamoeba histolytica
SNHESNIR

SEQ ID NO: 2574439 - protein, 12 aa, Entamoeba histolytica
SNHEVNIKTIID

SEQ ID NO: 2574440 - protein, 7 aa, Entamoeba histolytica
SNHQKDK

SEQ ID NO: 2574441 - protein, 9 aa, Entamoeba histolytica
SNHSMDKSI

SEQ ID NO: 2574442 - protein, 4 aa, Entamoeba histolytica
SNIE

SEQ ID NO: 2574443 - protein, 10 aa, Entamoeba histolytica
SNIEESVNTA

SEQ ID NO: 2574444 - protein, 6 aa, Entamoeba histolytica
SNIGQD

SEQ ID NO: 2574445 - protein, 24 aa, Entamoeba histolytica
SNIKEEIKEQREKDQTKRKSEAAV

SEQ ID NO: 2574446 - protein, 6 aa, Entamoeba histolytica
SNIPNN

SEQ ID NO: 2574447 - protein, 33 aa, Entamoeba histolytica
SNISNKSGGSDKNSSHEQSQQSSKSSKKHRTDR

SEQ ID NO: 2574448 - protein, 16 aa, Entamoeba histolytica
SNISQLSSENTSKVSF

SEQ ID NO: 2574449 - protein, 4 aa, Entamoeba histolytica
SNIT

SEQ ID NO: 2574450 - protein, 13 aa, Entamoeba histolytica
SNITSKGCDSCED

SEQ ID NO: 2574451 - protein, 4 aa, Entamoeba histolytica
SNIY

SEQ ID NO: 2574452 - protein, 12 aa, Entamoeba histolytica
SNKAGPSKENNY

SEQ ID NO: 2574453 - protein, 4 aa, Entamoeba histolytica
SNKE

SEQ ID NO: 2574454 - protein, 7 aa, Entamoeba histolytica
SNKENVE

SEQ ID NO: 2574455 - protein, 4 aa, Entamoeba histolytica
SNKF

SEQ ID NO: 2574456 - protein, 4 aa, Entamoeba histolytica
SNKK

SEQ ID NO: 2574457 - protein, 6 aa, Entamoeba histolytica
SNKKIK

SEQ ID NO: 2574458 - protein, 8 aa, Entamoeba histolytica
SNKLKESD

SEQ ID NO: 2574459 - protein, 10 aa, Entamoeba histolytica
SNKNPGATTH

SEQ ID NO: 2574460 - protein, 8 aa, Entamoeba histolytica
SNKPPYEI

SEQ ID NO: 2574461 - protein, 8 aa, Entamoeba histolytica
SNKPTTQG

SEQ ID NO: 2574462 - protein, 9 aa, Entamoeba histolytica
SNKQNKFEC

SEQ ID NO: 2574463 - protein, 10 aa, Entamoeba histolytica
SNKSHLNSPN

SEQ ID NO: 2574464 - protein, 7 aa, Entamoeba histolytica
SNKSPFS

SEQ ID NO: 2574465 - protein, 7 aa, Entamoeba histolytica
SNKSQSQ

SEQ ID NO: 2574466 - protein, 9 aa, Entamoeba histolytica
SNKSSPKNI

SEQ ID NO: 2574467 - protein, 8 aa, Entamoeba histolytica
SNKSYDPF

SEQ ID NO: 2574468 - protein, 12 aa, Entamoeba histolytica
SNKTETNNYFDN

SEQ ID NO: 2574469 - protein, 30 aa, Entamoeba histolytica
SNKTQRSGTLTNRCRTNDSPRSSSHTPTLR

SEQ ID NO: 2574470 - protein, 8 aa, Entamoeba histolytica
SNKTSTYI

SEQ ID NO: 2574471 - protein, 13 aa, Entamoeba histolytica
SNLFDSSSNWSPI

SEQ ID NO: 2574472 - protein, 5 aa, Entamoeba histolytica
SNLNQ

SEQ ID NO: 2574473 - protein, 14 aa, Entamoeba histolytica
SNLQEQSSTPRFKS

SEQ ID NO: 2574474 - protein, 9 aa, Entamoeba histolytica
SNLQTSSTS

SEQ ID NO: 2574475 - protein, 11 aa, Entamoeba histolytica
SNLRSNSDTYI

SEQ ID NO: 2574476 - protein, 19 aa, Entamoeba histolytica
SNLTHSSLSNCSDKITTSG

SEQ ID NO: 2574477 - protein, 7 aa, Entamoeba histolytica
SNMDTPG

SEQ ID NO: 2574478 - protein, 6 aa, Entamoeba histolytica
SNNADE

SEQ ID NO: 2574479 - protein, 10 aa, Entamoeba histolytica
SNNADLNTLS

SEQ ID NO: 2574480 - protein, 7 aa, Entamoeba histolytica
SNNCEPS

SEQ ID NO: 2574481 - protein, 5 aa, Entamoeba histolytica
SNNDG

SEQ ID NO: 2574482 - protein, 4 aa, Entamoeba histolytica
SNNE

SEQ ID NO: 2574483 - protein, 12 aa, Entamoeba histolytica
SNNEIRSNAEKL

SEQ ID NO: 2574484 - protein, 6 aa, Entamoeba histolytica
SNNEYV

SEQ ID NO: 2574485 - protein, 18 aa, Entamoeba histolytica
SNNHLKGKPTNSIDSKYE

SEQ ID NO: 2574486 - protein, 17 aa, Entamoeba histolytica
SNNKCQKNSHCTKINNQ

SEQ ID NO: 2574487 - protein, 9 aa, Entamoeba histolytica
SNNKEFDKG

SEQ ID NO: 2574488 - protein, 6 aa, Entamoeba histolytica
SNNKRD

SEQ ID NO: 2574489 - protein, 8 aa, Entamoeba histolytica
SNNPNEFK

SEQ ID NO: 2574490 - protein, 8 aa, Entamoeba histolytica
SNNQIEKV

SEQ ID NO: 2574491 - protein, 7 aa, Entamoeba histolytica
SNNQINE

SEQ ID NO: 2574492 - protein, 9 aa, Entamoeba histolytica
SNNQISTLS

SEQ ID NO: 2574493 - protein, 8 aa, Entamoeba histolytica
SNNRGGSF

SEQ ID NO: 2574494 - protein, 13 aa, Entamoeba histolytica
SNNSPSLIIVESD

SEQ ID NO: 2574495 - protein, 6 aa, Entamoeba histolytica
SNNTLE

SEQ ID NO: 2574496 - protein, 16 aa, Entamoeba histolytica
SNNTLSTQVSGKNDYY

SEQ ID NO: 2574497 - protein, 7 aa, Entamoeba histolytica
SNNTNTT

SEQ ID NO: 2574498 - protein, 10 aa, Entamoeba histolytica
SNNYREPGSC

SEQ ID NO: 2574499 - protein, 9 aa, Entamoeba histolytica
SNNYSSKMQ

SEQ ID NO: 2574500 - protein, 9 aa, Entamoeba histolytica
SNPDERPSF

SEQ ID NO: 2574501 - protein, 7 aa, Entamoeba histolytica
SNPDLEN

SEQ ID NO: 2574502 - protein, 5 aa, Entamoeba histolytica
SNPEQ

SEQ ID NO: 2574503 - protein, 15 aa, Entamoeba histolytica
SNPFTLSSTHGKGVK

SEQ ID NO: 2574504 - protein, 5 aa, Entamoeba histolytica
SNPGI

SEQ ID NO: 2574505 - protein, 6 aa, Entamoeba histolytica
SNPGYI

SEQ ID NO: 2574506 - protein, 5 aa, Entamoeba histolytica
SNPHN

SEQ ID NO: 2574507 - protein, 6 aa, Entamoeba histolytica
SNPKIL

SEQ ID NO: 2574508 - protein, 8 aa, Entamoeba histolytica
SNPLPNPE

SEQ ID NO: 2574509 - protein, 7 aa, Entamoeba histolytica
SNPNDEV

SEQ ID NO: 2574510 - protein, 7 aa, Entamoeba histolytica
SNPPESI

SEQ ID NO: 2574511 - protein, 20 aa, Entamoeba histolytica
SNPPKQLSDFPTHENINPKQ

SEQ ID NO: 2574512 - protein, 7 aa, Entamoeba histolytica
SNPRCGA

SEQ ID NO: 2574513 - protein, 5 aa, Entamoeba histolytica
SNPSM

SEQ ID NO: 2574514 - protein, 9 aa, Entamoeba histolytica
SNPSMTVEQ

SEQ ID NO: 2574515 - protein, 14 aa, Entamoeba histolytica
SNPTDNIGEKATIK

SEQ ID NO: 2574516 - protein, 6 aa, Entamoeba histolytica
SNPTIE

SEQ ID NO: 2574517 - protein, 6 aa, Entamoeba histolytica
SNQDGI

SEQ ID NO: 2574518 - protein, 10 aa, Entamoeba histolytica
SNQDNLGENG

SEQ ID NO: 2574519 - protein, 6 aa, Entamoeba histolytica
SNQESY

SEQ ID NO: 2574520 - protein, 11 aa, Entamoeba histolytica
SNQLDKNNDNY

SEQ ID NO: 2574521 - protein, 6 aa, Entamoeba histolytica
SNQLDN

SEQ ID NO: 2574522 - protein, 16 aa, Entamoeba histolytica
SNQRENKLDGSSSLST

SEQ ID NO: 2574523 - protein, 27 aa, Entamoeba histolytica
SNQTKGLDGNDLKERYSQFGQNKYPDP

SEQ ID NO: 2574524 - protein, 8 aa, Entamoeba histolytica
SNQVHPKQ

SEQ ID NO: 2574525 - protein, 12 aa, Entamoeba histolytica
SNRFNKYNKRSS

SEQ ID NO: 2574526 - protein, 4 aa, Entamoeba histolytica
SNRG

SEQ ID NO: 2574527 - protein, 5 aa, Entamoeba histolytica
SNRKR

SEQ ID NO: 2574528 - protein, 4 aa, Entamoeba histolytica
SNRN

SEQ ID NO: 2574529 - protein, 8 aa, Entamoeba histolytica
SNSASINE

SEQ ID NO: 2574530 - protein, 11 aa, Entamoeba histolytica
SNSATKNQKNF

SEQ ID NO: 2574531 - protein, 11 aa, Entamoeba histolytica
SNSDNQLQKNF

SEQ ID NO: 2574532 - protein, 10 aa, Entamoeba histolytica
SNSDSTDKNP

SEQ ID NO: 2574533 - protein, 14 aa, Entamoeba histolytica
SNSDTSSPYIEGTP

SEQ ID NO: 2574534 - protein, 18 aa, Entamoeba histolytica
SNSEGNEVQQSSDSKEIE

SEQ ID NO: 2574535 - protein, 7 aa, Entamoeba histolytica
SNSESSI

SEQ ID NO: 2574536 - protein, 4 aa, Entamoeba histolytica
SNSF

SEQ ID NO: 2574537 - protein, 6 aa, Entamoeba histolytica
SNSGGK

SEQ ID NO: 2574538 - protein, 14 aa, Entamoeba histolytica
SNSGICSTNDRNES

SEQ ID NO: 2574539 - protein, 6 aa, Entamoeba histolytica
SNSISC

SEQ ID NO: 2574540 - protein, 7 aa, Entamoeba histolytica
SNSKFHS

SEQ ID NO: 2574541 - protein, 14 aa, Entamoeba histolytica
SNSLEQTLNNNQQE

SEQ ID NO: 2574542 - protein, 6 aa, Entamoeba histolytica
SNSLNS

SEQ ID NO: 2574543 - protein, 5 aa, Entamoeba histolytica
SNSNF

SEQ ID NO: 2574544 - protein, 9 aa, Entamoeba histolytica
SNSNSYGNC

SEQ ID NO: 2574545 - protein, 9 aa, Entamoeba histolytica
SNSNTCTKC

SEQ ID NO: 2574546 - protein, 9 aa, Entamoeba histolytica
SNSSEDSEA

SEQ ID NO: 2574547 - protein, 6 aa, Entamoeba histolytica
SNSSID

SEQ ID NO: 2574548 - protein, 8 aa, Entamoeba histolytica
SNSSNRLN

SEQ ID NO: 2574549 - protein, 7 aa, Entamoeba histolytica
SNSSPNA

SEQ ID NO: 2574550 - protein, 7 aa, Entamoeba histolytica
SNSTKKI

SEQ ID NO: 2574551 - protein, 19 aa, Entamoeba histolytica
SNSTVSTKNVSISNTSNDD

SEQ ID NO: 2574552 - protein, 6 aa, Entamoeba histolytica
SNTCSE

SEQ ID NO: 2574553 - protein, 8 aa, Entamoeba histolytica
SNTEIKSI

SEQ ID NO: 2574554 - protein, 12 aa, Entamoeba histolytica
SNTENLDLFIQE

SEQ ID NO: 2574555 - protein, 7 aa, Entamoeba histolytica
SNTEPKV

SEQ ID NO: 2574556 - protein, 8 aa, Entamoeba histolytica
SNTGEYEK

SEQ ID NO: 2574557 - protein, 7 aa, Entamoeba histolytica
SNTGTRK

SEQ ID NO: 2574558 - protein, 7 aa, Entamoeba histolytica
SNTIEGY

SEQ ID NO: 2574559 - protein, 10 aa, Entamoeba histolytica
SNTKSSSFHC

SEQ ID NO: 2574560 - protein, 8 aa, Entamoeba histolytica
SNTKTRQL

SEQ ID NO: 2574561 - protein, 19 aa, Entamoeba histolytica
SNTLESQEDNTDATKKTSS

SEQ ID NO: 2574562 - protein, 6 aa, Entamoeba histolytica
SNTNNV

SEQ ID NO: 2574563 - protein, 6 aa, Entamoeba histolytica
SNTNRS

SEQ ID NO: 2574564 - protein, 8 aa, Entamoeba histolytica
SNTPGNKV

SEQ ID NO: 2574565 - protein, 20 aa, Entamoeba histolytica
SNTQALAKLGSSEVVKPTGT

SEQ ID NO: 2574566 - protein, 5 aa, Entamoeba histolytica
SNTQD

SEQ ID NO: 2574567 - protein, 15 aa, Entamoeba histolytica
SNTSTQINSPFNSSP

SEQ ID NO: 2574568 - protein, 13 aa, Entamoeba histolytica
SNTSVSQSYQNDT

SEQ ID NO: 2574569 - protein, 7 aa, Entamoeba histolytica
SNTTGFR

SEQ ID NO: 2574570 - protein, 5 aa, Entamoeba histolytica
SNTTP

SEQ ID NO: 2574571 - protein, 7 aa, Entamoeba histolytica
SNVESGK

SEQ ID NO: 2574572 - protein, 8 aa, Entamoeba histolytica
SNVESSTI

SEQ ID NO: 2574573 - protein, 17 aa, Entamoeba histolytica
SNVITQNEINSESKEEL

SEQ ID NO: 2574574 - protein, 4 aa, Entamoeba histolytica
SNVK

SEQ ID NO: 2574575 - protein, 4 aa, Entamoeba histolytica
SNVP

SEQ ID NO: 2574576 - protein, 5 aa, Entamoeba histolytica
SNVPG

SEQ ID NO: 2574577 - protein, 6 aa, Entamoeba histolytica
SNVSEA

SEQ ID NO: 2574578 - protein, 5 aa, Entamoeba histolytica
SNVSG

SEQ ID NO: 2574579 - protein, 13 aa, Entamoeba histolytica
SNYIEPKTRYYRS

SEQ ID NO: 2574580 - protein, 9 aa, Entamoeba histolytica
SNYISKGNT

SEQ ID NO: 2574581 - protein, 6 aa, Entamoeba histolytica
SNYNDY

SEQ ID NO: 2574582 - protein, 5 aa, Entamoeba histolytica
SNYPL

SEQ ID NO: 2574583 - protein, 12 aa, Entamoeba histolytica
SNYQDDNSKPQF

SEQ ID NO: 2574584 - protein, 6 aa, Entamoeba histolytica
SNYTTI

SEQ ID NO: 2574585 - protein, 6 aa, Entamoeba histolytica
SPAIPP

SEQ ID NO: 2574586 - protein, 40 aa, Entamoeba histolytica
SPDDDDDDNDGSSSSQKPTESSGSNNNNKDDDDYNNSTTP

SEQ ID NO: 2574587 - protein, 7 aa, Entamoeba histolytica
SPDGQSI

SEQ ID NO: 2574588 - protein, 9 aa, Entamoeba histolytica
SPDNEISNR

SEQ ID NO: 2574589 - protein, 15 aa, Entamoeba histolytica
SPDYSNVSYSSSQWS

SEQ ID NO: 2574590 - protein, 11 aa, Entamoeba histolytica
SPEDAKKGSPF

SEQ ID NO: 2574591 - protein, 10 aa, Entamoeba histolytica
SPEGLKKGDS

SEQ ID NO: 2574592 - protein, 8 aa, Entamoeba histolytica
SPEGRKSK

SEQ ID NO: 2574593 - protein, 5 aa, Entamoeba histolytica
SPESY

SEQ ID NO: 2574594 - protein, 7 aa, Entamoeba histolytica
SPETGEM

SEQ ID NO: 2574595 - protein, 14 aa, Entamoeba histolytica
SPETQNKFTTPSSD

SEQ ID NO: 2574596 - protein, 5 aa, Entamoeba histolytica
SPFEE

SEQ ID NO: 2574597 - protein, 5 aa, Entamoeba histolytica
SPFSS

SEQ ID NO: 2574598 - protein, 4 aa, Entamoeba histolytica
SPFT

SEQ ID NO: 2574599 - protein, 4 aa, Entamoeba histolytica
SPGK

SEQ ID NO: 2574600 - protein, 6 aa, Entamoeba histolytica
SPHDIT

SEQ ID NO: 2574601 - protein, 10 aa, Entamoeba histolytica
SPHEDERQTW

SEQ ID NO: 2574602 - protein, 9 aa, Entamoeba histolytica
SPHGEYSSE

SEQ ID NO: 2574603 - protein, 4 aa, Entamoeba histolytica
SPID

SEQ ID NO: 2574604 - protein, 10 aa, Entamoeba histolytica
SPIDTLSGEL

SEQ ID NO: 2574605 - protein, 12 aa, Entamoeba histolytica
SPINSSRGYTQP

SEQ ID NO: 2574606 - protein, 4 aa, Entamoeba histolytica
SPIS

SEQ ID NO: 2574607 - protein, 5 aa, Entamoeba histolytica
SPISI

SEQ ID NO: 2574608 - protein, 6 aa, Entamoeba histolytica
SPKAGE

SEQ ID NO: 2574609 - protein, 8 aa, Entamoeba histolytica
SPKFSDKQ

SEQ ID NO: 2574610 - protein, 5 aa, Entamoeba histolytica
SPKIT

SEQ ID NO: 2574611 - protein, 7 aa, Entamoeba histolytica
SPKQKAD

SEQ ID NO: 2574612 - protein, 6 aa, Entamoeba histolytica
SPKRYE

SEQ ID NO: 2574613 - protein, 8 aa, Entamoeba histolytica
SPLGSEYT

SEQ ID NO: 2574614 - protein, 7 aa, Entamoeba histolytica
SPLSDDL

SEQ ID NO: 2574615 - protein, 9 aa, Entamoeba histolytica
SPLSYSGRG

SEQ ID NO: 2574616 - protein, 6 aa, Entamoeba histolytica
SPNAFD

SEQ ID NO: 2574617 - protein, 5 aa, Entamoeba histolytica
SPNDI

SEQ ID NO: 2574618 - protein, 7 aa, Entamoeba histolytica
SPNGDDP

SEQ ID NO: 2574619 - protein, 9 aa, Entamoeba histolytica
SPNGFRGSY

SEQ ID NO: 2574620 - protein, 6 aa, Entamoeba histolytica
SPNIAK

SEQ ID NO: 2574621 - protein, 4 aa, Entamoeba histolytica
SPNL

SEQ ID NO: 2574622 - protein, 7 aa, Entamoeba histolytica
SPNLQES

SEQ ID NO: 2574623 - protein, 5 aa, Entamoeba histolytica
SPNPL

SEQ ID NO: 2574624 - protein, 15 aa, Entamoeba histolytica
SPNSRISGSEKQLHS

SEQ ID NO: 2574625 - protein, 4 aa, Entamoeba histolytica
SPNT

SEQ ID NO: 2574626 - protein, 4 aa, Entamoeba histolytica
SPNV

SEQ ID NO: 2574627 - protein, 8 aa, Entamoeba histolytica
SPNVPDTS

SEQ ID NO: 2574628 - protein, 30 aa, Entamoeba histolytica
SPPALSPFSKKKQNKINEESFQKSIKTDEL

SEQ ID NO: 2574629 - protein, 5 aa, Entamoeba histolytica
SPPEE

SEQ ID NO: 2574630 - protein, 4 aa, Entamoeba histolytica
SPPG

SEQ ID NO: 2574631 - protein, 8 aa, Entamoeba histolytica
SPPGTYLG

SEQ ID NO: 2574632 - protein, 4 aa, Entamoeba histolytica
SPPH

SEQ ID NO: 2574633 - protein, 19 aa, Entamoeba histolytica
SPPSALAKYSSTTLTTTGI

SEQ ID NO: 2574634 - protein, 10 aa, Entamoeba histolytica
SPPTDECANS

SEQ ID NO: 2574635 - protein, 6 aa, Entamoeba histolytica
SPPTFP

SEQ ID NO: 2574636 - protein, 6 aa, Entamoeba histolytica
SPPVPM

SEQ ID NO: 2574637 - protein, 5 aa, Entamoeba histolytica
SPQEI

SEQ ID NO: 2574638 - protein, 8 aa, Entamoeba histolytica
SPQEKNDS

SEQ ID NO: 2574639 - protein, 6 aa, Entamoeba histolytica
SPQGPF

SEQ ID NO: 2574640 - protein, 5 aa, Entamoeba histolytica
SPQHR

SEQ ID NO: 2574641 - protein, 7 aa, Entamoeba histolytica
SPQKDDI

SEQ ID NO: 2574642 - protein, 4 aa, Entamoeba histolytica
SPQM

SEQ ID NO: 2574643 - protein, 5 aa, Entamoeba histolytica
SPQNI

SEQ ID NO: 2574644 - protein, 6 aa, Entamoeba histolytica
SPQQKA

SEQ ID NO: 2574645 - protein, 10 aa, Entamoeba histolytica
SPQQQRPNDK

SEQ ID NO: 2574646 - protein, 6 aa, Entamoeba histolytica
SPQTVY

SEQ ID NO: 2574647 - protein, 5 aa, Entamoeba histolytica
SPRII

SEQ ID NO: 2574648 - protein, 12 aa, Entamoeba histolytica
SPRKFADKRFLR

SEQ ID NO: 2574649 - protein, 17 aa, Entamoeba histolytica
SPRKTESPQESPRSSTK

SEQ ID NO: 2574650 - protein, 15 aa, Entamoeba histolytica
SPRLPSKGLNTLTQK

SEQ ID NO: 2574651 - protein, 4 aa, Entamoeba histolytica
SPRS

SEQ ID NO: 2574652 - protein, 7 aa, Entamoeba histolytica
SPSASQQ

SEQ ID NO: 2574653 - protein, 8 aa, Entamoeba histolytica
SPSDSTIQ

SEQ ID NO: 2574654 - protein, 7 aa, Entamoeba histolytica
SPSESSF

SEQ ID NO: 2574655 - protein, 5 aa, Entamoeba histolytica
SPSGD

SEQ ID NO: 2574656 - protein, 9 aa, Entamoeba histolytica
SPSKENDFS

SEQ ID NO: 2574657 - protein, 5 aa, Entamoeba histolytica
SPSKI

SEQ ID NO: 2574658 - protein, 4 aa, Entamoeba histolytica
SPSL

SEQ ID NO: 2574659 - protein, 9 aa, Entamoeba histolytica
SPSRNRIKQ

SEQ ID NO: 2574660 - protein, 8 aa, Entamoeba histolytica
SPSSSLFS

SEQ ID NO: 2574661 - protein, 8 aa, Entamoeba histolytica
SPSSSLQQ

SEQ ID NO: 2574662 - protein, 4 aa, Entamoeba histolytica
SPST

SEQ ID NO: 2574663 - protein, 7 aa, Entamoeba histolytica
SPSTNQL

SEQ ID NO: 2574664 - protein, 10 aa, Entamoeba histolytica
SPSTPLTPTQ

SEQ ID NO: 2574665 - protein, 13 aa, Entamoeba histolytica
SPSTSPNTPTPQI

SEQ ID NO: 2574666 - protein, 7 aa, Entamoeba histolytica
SPSTTNF

SEQ ID NO: 2574667 - protein, 8 aa, Entamoeba histolytica
SPSYSDDD

SEQ ID NO: 2574668 - protein, 8 aa, Entamoeba histolytica
SPTASTIA

SEQ ID NO: 2574669 - protein, 7 aa, Entamoeba histolytica
SPTEDSA

SEQ ID NO: 2574670 - protein, 8 aa, Entamoeba histolytica
SPTETNNC

SEQ ID NO: 2574671 - protein, 8 aa, Entamoeba histolytica
SPTETTNC

SEQ ID NO: 2574672 - protein, 8 aa, Entamoeba histolytica
SPTKITDD

SEQ ID NO: 2574673 - protein, 9 aa, Entamoeba histolytica
SPTNNNEDQ

SEQ ID NO: 2574674 - protein, 5 aa, Entamoeba histolytica
SPTNV

SEQ ID NO: 2574675 - protein, 7 aa, Entamoeba histolytica
SPTQSQQ

SEQ ID NO: 2574676 - protein, 15 aa, Entamoeba histolytica
SPTTEIKSTCKNEFG

SEQ ID NO: 2574677 - protein, 11 aa, Entamoeba histolytica
SPTTPTKPRAL

SEQ ID NO: 2574678 - protein, 4 aa, Entamoeba histolytica
SPTV

SEQ ID NO: 2574679 - protein, 4 aa, Entamoeba histolytica
SPVK

SEQ ID NO: 2574680 - protein, 10 aa, Entamoeba histolytica
SPVNSSYPSF

SEQ ID NO: 2574681 - protein, 5 aa, Entamoeba histolytica
SPVPK

SEQ ID NO: 2574682 - protein, 5 aa, Entamoeba histolytica
SPYFE

SEQ ID NO: 2574683 - protein, 7 aa, Entamoeba histolytica
SPYNPVK

SEQ ID NO: 2574684 - protein, 5 aa, Entamoeba histolytica
SPYQE

SEQ ID NO: 2574685 - protein, 10 aa, Entamoeba histolytica
SQADKMKSKG

SEQ ID NO: 2574686 - protein, 13 aa, Entamoeba histolytica
SQAFSGFSDSGTM

SEQ ID NO: 2574687 - protein, 13 aa, Entamoeba histolytica
SQCDEQVKNKTKE

SEQ ID NO: 2574688 - protein, 9 aa, Entamoeba histolytica
SQCKTGTCT

SEQ ID NO: 2574689 - protein, 16 aa, Entamoeba histolytica
SQCSSIPTVSTPSNIK

SEQ ID NO: 2574690 - protein, 18 aa, Entamoeba histolytica
SQDDPIAISSKGSRSRIS

SEQ ID NO: 2574691 - protein, 7 aa, Entamoeba histolytica
SQDEKNV

SEQ ID NO: 2574692 - protein, 10 aa, Entamoeba histolytica
SQDEKPIRKP

SEQ ID NO: 2574693 - protein, 5 aa, Entamoeba histolytica
SQDIN

SEQ ID NO: 2574694 - protein, 6 aa, Entamoeba histolytica
SQEDEV

SEQ ID NO: 2574695 - protein, 7 aa, Entamoeba histolytica
SQEEKDV

SEQ ID NO: 2574696 - protein, 15 aa, Entamoeba histolytica
SQESGTVPIEQSQQT

SEQ ID NO: 2574697 - protein, 6 aa, Entamoeba histolytica
SQETST

SEQ ID NO: 2574698 - protein, 12 aa, Entamoeba histolytica
SQETTYSSIDGS

SEQ ID NO: 2574699 - protein, 6 aa, Entamoeba histolytica
SQFDGT

SEQ ID NO: 2574700 - protein, 20 aa, Entamoeba histolytica
SQFEETEEYNSIKQKSIDKK

SEQ ID NO: 2574701 - protein, 6 aa, Entamoeba histolytica
SQGRRE

SEQ ID NO: 2574702 - protein, 6 aa, Entamoeba histolytica
SQGYSE

SEQ ID NO: 2574703 - protein, 8 aa, Entamoeba histolytica
SQHNGGRT

SEQ ID NO: 2574704 - protein, 11 aa, Entamoeba histolytica
SQHNNYGDDSH

SEQ ID NO: 2574705 - protein, 4 aa, Entamoeba histolytica
SQHT

SEQ ID NO: 2574706 - protein, 6 aa, Entamoeba histolytica
SQIASE

SEQ ID NO: 2574707 - protein, 5 aa, Entamoeba histolytica
SQIPT

SEQ ID NO: 2574708 - protein, 10 aa, Entamoeba histolytica
SQIQDKENDY

SEQ ID NO: 2574709 - protein, 4 aa, Entamoeba histolytica
SQIT

SEQ ID NO: 2574710 - protein, 5 aa, Entamoeba histolytica
SQITL

SEQ ID NO: 2574711 - protein, 5 aa, Entamoeba histolytica
SQIYP

SEQ ID NO: 2574712 - protein, 10 aa, Entamoeba histolytica
SQKALTSKEI

SEQ ID NO: 2574713 - protein, 8 aa, Entamoeba histolytica
SQKEMNSK

SEQ ID NO: 2574714 - protein, 12 aa, Entamoeba histolytica
SQKFQTNEHEEI

SEQ ID NO: 2574715 - protein, 19 aa, Entamoeba histolytica
SQKGSRPKIPKKLATNEIN

SEQ ID NO: 2574716 - protein, 6 aa, Entamoeba histolytica
SQKNEL

SEQ ID NO: 2574717 - protein, 8 aa, Entamoeba histolytica
SQKNNETF

SEQ ID NO: 2574718 - protein, 9 aa, Entamoeba histolytica
SQKNNTNLS

SEQ ID NO: 2574719 - protein, 10 aa, Entamoeba histolytica
SQKNSQSSIS

SEQ ID NO: 2574720 - protein, 5 aa, Entamoeba histolytica
SQKQW

SEQ ID NO: 2574721 - protein, 9 aa, Entamoeba histolytica
SQKTEQQKQ

SEQ ID NO: 2574722 - protein, 7 aa, Entamoeba histolytica
SQKTIGC

SEQ ID NO: 2574723 - protein, 10 aa, Entamoeba histolytica
SQLDGETNLK

SEQ ID NO: 2574724 - protein, 18 aa, Entamoeba histolytica
SQLEENQEQEEKDDEEYS

SEQ ID NO: 2574725 - protein, 16 aa, Entamoeba histolytica
SQLNADPYECKNTNGL

SEQ ID NO: 2574726 - protein, 5 aa, Entamoeba histolytica
SQLND

SEQ ID NO: 2574727 - protein, 4 aa, Entamoeba histolytica
SQLR

SEQ ID NO: 2574728 - protein, 7 aa, Entamoeba histolytica
SQLSNKL

SEQ ID NO: 2574729 - protein, 20 aa, Entamoeba histolytica
SQLSSLGGKIPEEITNNDGK

SEQ ID NO: 2574730 - protein, 5 aa, Entamoeba histolytica
SQLTA

SEQ ID NO: 2574731 - protein, 7 aa, Entamoeba histolytica
SQNDSNH

SEQ ID NO: 2574732 - protein, 5 aa, Entamoeba histolytica
SQNIK

SEQ ID NO: 2574733 - protein, 13 aa, Entamoeba histolytica
SQNKADCSSMSKG

SEQ ID NO: 2574734 - protein, 7 aa, Entamoeba histolytica
SQNKESG

SEQ ID NO: 2574735 - protein, 27 aa, Entamoeba histolytica
SQNKGNDAFETDEKKKNLISTQEEPMT

SEQ ID NO: 2574736 - protein, 12 aa, Entamoeba histolytica
SQNNADCKNISK

SEQ ID NO: 2574737 - protein, 11 aa, Entamoeba histolytica
SQNNSSPLNSN

SEQ ID NO: 2574738 - protein, 9 aa, Entamoeba histolytica
SQNPEDRPK

SEQ ID NO: 2574739 - protein, 9 aa, Entamoeba histolytica
SQNPEDRPS

SEQ ID NO: 2574740 - protein, 9 aa, Entamoeba histolytica
SQNPEDRPT

SEQ ID NO: 2574741 - protein, 5 aa, Entamoeba histolytica
SQNQM

SEQ ID NO: 2574742 - protein, 21 aa, Entamoeba histolytica
SQNSSHVSENSQQPGEPRRSF

SEQ ID NO: 2574743 - protein, 7 aa, Entamoeba histolytica
SQNTEIN

SEQ ID NO: 2574744 - protein, 6 aa, Entamoeba histolytica
SQNTSL

SEQ ID NO: 2574745 - protein, 16 aa, Entamoeba histolytica
SQPDEDFDNSRSENEI

SEQ ID NO: 2574746 - protein, 48 aa, Entamoeba histolytica
SQPDEDIDEGDDKKQDKDNDKKQDEKPDEKLDEKQDKKPDNSRSEKEI

SEQ ID NO: 2574747 - protein, 16 aa, Entamoeba histolytica
SQPDEDSDNSRSEKEI

SEQ ID NO: 2574748 - protein, 16 aa, Entamoeba histolytica
SQPDEDYDNRRSENEI

SEQ ID NO: 2574749 - protein, 16 aa, Entamoeba histolytica
SQPDEERDNIRSEEEI

SEQ ID NO: 2574750 - protein, 16 aa, Entamoeba histolytica
SQPDKRCDNIRSENEI

SEQ ID NO: 2574751 - protein, 16 aa, Entamoeba histolytica
SQPDKRYDNRRSEEEI

SEQ ID NO: 2574752 - protein, 15 aa, Entamoeba histolytica
SQPFPDNPSSEVSGV

SEQ ID NO: 2574753 - protein, 7 aa, Entamoeba histolytica
SQPLSSS

SEQ ID NO: 2574754 - protein, 6 aa, Entamoeba histolytica
SQPPER

SEQ ID NO: 2574755 - protein, 5 aa, Entamoeba histolytica
SQPTT

SEQ ID NO: 2574756 - protein, 4 aa, Entamoeba histolytica
SQPV

SEQ ID NO: 2574757 - protein, 5 aa, Entamoeba histolytica
SQQCE

SEQ ID NO: 2574758 - protein, 9 aa, Entamoeba histolytica
SQQEDGISE

SEQ ID NO: 2574759 - protein, 6 aa, Entamoeba histolytica
SQQEFD

SEQ ID NO: 2574760 - protein, 7 aa, Entamoeba histolytica
SQQELNE

SEQ ID NO: 2574761 - protein, 9 aa, Entamoeba histolytica
SQQGEQNEI

SEQ ID NO: 2574762 - protein, 4 aa, Entamoeba histolytica
SQQH

SEQ ID NO: 2574763 - protein, 28 aa, Entamoeba histolytica
SQQNENKITDNPINLTSTKESSSSNSSL

SEQ ID NO: 2574764 - protein, 8 aa, Entamoeba histolytica
SQQPFDNI

SEQ ID NO: 2574765 - protein, 5 aa, Entamoeba histolytica
SQQPH

SEQ ID NO: 2574766 - protein, 4 aa, Entamoeba histolytica
SQQS

SEQ ID NO: 2574767 - protein, 6 aa, Entamoeba histolytica
SQRDIK

SEQ ID NO: 2574768 - protein, 8 aa, Entamoeba histolytica
SQRIDTDD

SEQ ID NO: 2574769 - protein, 20 aa, Entamoeba histolytica
SQRKEFGKATSEKNTENESI

SEQ ID NO: 2574770 - protein, 5 aa, Entamoeba histolytica
SQRPF

SEQ ID NO: 2574771 - protein, 5 aa, Entamoeba histolytica
SQRST

SEQ ID NO: 2574772 - protein, 6 aa, Entamoeba histolytica
SQSDDI

SEQ ID NO: 2574773 - protein, 7 aa, Entamoeba histolytica
SQSGRQV

SEQ ID NO: 2574774 - protein, 5 aa, Entamoeba histolytica
SQSIS

SEQ ID NO: 2574775 - protein, 4 aa, Entamoeba histolytica
SQSK

SEQ ID NO: 2574776 - protein, 8 aa, Entamoeba histolytica
SQSKEEIT

SEQ ID NO: 2574777 - protein, 7 aa, Entamoeba histolytica
SQSRISD

SEQ ID NO: 2574778 - protein, 57 aa, Entamoeba histolytica
SQSSQNSEGEGNSQSSGTNGSNSIKKSHHSKSTPSGSGKSGSSHDSDAKKKKGKTKI

SEQ ID NO: 2574779 - protein, 57 aa, Entamoeba histolytica
SQSSQNSESEGKSQTSGTNGSNSIKKSHISKSTPSGSGKSGSSHESDSKKKGKSKVS

SEQ ID NO: 2574780 - protein, 6 aa, Entamoeba histolytica
SQSSSV

SEQ ID NO: 2574781 - protein, 15 aa, Entamoeba histolytica
SQSTETELDPEGFTT

SEQ ID NO: 2574782 - protein, 5 aa, Entamoeba histolytica
SQSTQ

SEQ ID NO: 2574783 - protein, 8 aa, Entamoeba histolytica
SQSYSVSE

SEQ ID NO: 2574784 - protein, 6 aa, Entamoeba histolytica
SQTCDE

SEQ ID NO: 2574785 - protein, 11 aa, Entamoeba histolytica
SQTCGEEQEMN

SEQ ID NO: 2574786 - protein, 15 aa, Entamoeba histolytica
SQTFNESWQEKGEEI

SEQ ID NO: 2574787 - protein, 18 aa, Entamoeba histolytica
SQTHPHQQPASPQMNTPQ

SEQ ID NO: 2574788 - protein, 6 aa, Entamoeba histolytica
SQTIKP

SEQ ID NO: 2574789 - protein, 4 aa, Entamoeba histolytica
SQTK

SEQ ID NO: 2574790 - protein, 8 aa, Entamoeba histolytica
SQTNEDTN

SEQ ID NO: 2574791 - protein, 10 aa, Entamoeba histolytica
SQTNLPISSN

SEQ ID NO: 2574792 - protein, 5 aa, Entamoeba histolytica
SQTNN

SEQ ID NO: 2574793 - protein, 7 aa, Entamoeba histolytica
SQTPVKA

SEQ ID NO: 2574794 - protein, 8 aa, Entamoeba histolytica
SQTPVPGK

SEQ ID NO: 2574795 - protein, 9 aa, Entamoeba histolytica
SQTQNKIQQ

SEQ ID NO: 2574796 - protein, 8 aa, Entamoeba histolytica
SQTRKTQF

SEQ ID NO: 2574797 - protein, 13 aa, Entamoeba histolytica
SQTTGPQKNEIKD

SEQ ID NO: 2574798 - protein, 19 aa, Entamoeba histolytica
SQTTNCPEGCTTCDSGSSY

SEQ ID NO: 2574799 - protein, 14 aa, Entamoeba histolytica
SQTTQLKQKYNNTH

SEQ ID NO: 2574800 - protein, 28 aa, Entamoeba histolytica
SQTTSNKDLEKISRTIDQSLQNPSHSNW

SEQ ID NO: 2574801 - protein, 4 aa, Entamoeba histolytica
SQVI

SEQ ID NO: 2574802 - protein, 7 aa, Entamoeba histolytica
SQVKESF

SEQ ID NO: 2574803 - protein, 5 aa, Entamoeba histolytica
SQVKS

SEQ ID NO: 2574804 - protein, 15 aa, Entamoeba histolytica
SQVPETKVECTTSAP

SEQ ID NO: 2574805 - protein, 23 aa, Entamoeba histolytica
SQYDSNGNHCTMESTDQNCVPTG

SEQ ID NO: 2574806 - protein, 5 aa, Entamoeba histolytica
SQYKG

SEQ ID NO: 2574807 - protein, 10 aa, Entamoeba histolytica
SQYNSSSNEL

SEQ ID NO: 2574808 - protein, 9 aa, Entamoeba histolytica
SQYRTDTIQ

SEQ ID NO: 2574809 - protein, 9 aa, Entamoeba histolytica
SRAKSDSVL

SEQ ID NO: 2574810 - protein, 8 aa, Entamoeba histolytica
SRANPNSI

SEQ ID NO: 2574811 - protein, 6 aa, Entamoeba histolytica
SRAPAL

SEQ ID NO: 2574812 - protein, 8 aa, Entamoeba histolytica
SRDFPPCD

SEQ ID NO: 2574813 - protein, 8 aa, Entamoeba histolytica
SRDNDTNE

SEQ ID NO: 2574814 - protein, 11 aa, Entamoeba histolytica
SRDNVKSISQE

SEQ ID NO: 2574815 - protein, 5 aa, Entamoeba histolytica
SRDRK

SEQ ID NO: 2574816 - protein, 9 aa, Entamoeba histolytica
SRDSTIQYK

SEQ ID NO: 2574817 - protein, 7 aa, Entamoeba histolytica
SRENNTI

SEQ ID NO: 2574818 - protein, 16 aa, Entamoeba histolytica
SREPKKQVVQNEGTMA

SEQ ID NO: 2574819 - protein, 5 aa, Entamoeba histolytica
SRESA

SEQ ID NO: 2574820 - protein, 12 aa, Entamoeba histolytica
SRESSAASNSFK

SEQ ID NO: 2574821 - protein, 13 aa, Entamoeba histolytica
SRETTQKGNTTIR

SEQ ID NO: 2574822 - protein, 5 aa, Entamoeba histolytica
SRGEL

SEQ ID NO: 2574823 - protein, 6 aa, Entamoeba histolytica
SRGSPF

SEQ ID NO: 2574824 - protein, 8 aa, Entamoeba histolytica
SRHCPGGG

SEQ ID NO: 2574825 - protein, 4 aa, Entamoeba histolytica
SRHI

SEQ ID NO: 2574826 - protein, 6 aa, Entamoeba histolytica
SRIKDE

SEQ ID NO: 2574827 - protein, 14 aa, Entamoeba histolytica
SRIKEENCGGTKSR

SEQ ID NO: 2574828 - protein, 4 aa, Entamoeba histolytica
SRIR

SEQ ID NO: 2574829 - protein, 5 aa, Entamoeba histolytica
SRISP

SEQ ID NO: 2574830 - protein, 5 aa, Entamoeba histolytica
SRISS

SEQ ID NO: 2574831 - protein, 4 aa, Entamoeba histolytica
SRKA

SEQ ID NO: 2574832 - protein, 11 aa, Entamoeba histolytica
SRKHAKSFTID

SEQ ID NO: 2574833 - protein, 7 aa, Entamoeba histolytica
SRKMSST

SEQ ID NO: 2574834 - protein, 7 aa, Entamoeba histolytica
SRKPTNY

SEQ ID NO: 2574835 - protein, 8 aa, Entamoeba histolytica
SRKSIPST

SEQ ID NO: 2574836 - protein, 9 aa, Entamoeba histolytica
SRKTEKSLR

SEQ ID NO: 2574837 - protein, 7 aa, Entamoeba histolytica
SRKVNGE

SEQ ID NO: 2574838 - protein, 8 aa, Entamoeba histolytica
SRKVNGEH

SEQ ID NO: 2574839 - protein, 9 aa, Entamoeba histolytica
SRLPPPCPY

SEQ ID NO: 2574840 - protein, 4 aa, Entamoeba histolytica
SRNI

SEQ ID NO: 2574841 - protein, 12 aa, Entamoeba histolytica
SRNKKDQLSREG

SEQ ID NO: 2574842 - protein, 6 aa, Entamoeba histolytica
SRNTDT

SEQ ID NO: 2574843 - protein, 7 aa, Entamoeba histolytica
SRNTKGS

SEQ ID NO: 2574844 - protein, 5 aa, Entamoeba histolytica
SRNTT

SEQ ID NO: 2574845 - protein, 6 aa, Entamoeba histolytica
SRPFSD

SEQ ID NO: 2574846 - protein, 12 aa, Entamoeba histolytica
SRPLNIASNNEN

SEQ ID NO: 2574847 - protein, 47 aa, Entamoeba histolytica
SRPPSTTRTSESTLIGSQPIGRFSEPPVPIKSSSTISIKSKKNEDIR

SEQ ID NO: 2574848 - protein, 6 aa, Entamoeba histolytica
SRPVKD

SEQ ID NO: 2574849 - protein, 17 aa, Entamoeba histolytica
SRQEEQNSILITKVLDK

SEQ ID NO: 2574850 - protein, 5 aa, Entamoeba histolytica
SRQKL

SEQ ID NO: 2574851 - protein, 5 aa, Entamoeba histolytica
SRQPS

SEQ ID NO: 2574852 - protein, 9 aa, Entamoeba histolytica
SRRVNGETD

SEQ ID NO: 2574853 - protein, 18 aa, Entamoeba histolytica
SRSAPVNDSWTKTNNICS

SEQ ID NO: 2574854 - protein, 4 aa, Entamoeba histolytica
SRSH

SEQ ID NO: 2574855 - protein, 7 aa, Entamoeba histolytica
SRSIKST

SEQ ID NO: 2574856 - protein, 14 aa, Entamoeba histolytica
SRSQYSGEQDSSDI

SEQ ID NO: 2574857 - protein, 7 aa, Entamoeba histolytica
SRSSDVA

SEQ ID NO: 2574858 - protein, 16 aa, Entamoeba histolytica
SRSSNVSVKKETTKFG

SEQ ID NO: 2574859 - protein, 4 aa, Entamoeba histolytica
SRTR

SEQ ID NO: 2574860 - protein, 4 aa, Entamoeba histolytica
SRTS

SEQ ID NO: 2574861 - protein, 10 aa, Entamoeba histolytica
SRVSNNGLED

SEQ ID NO: 2574862 - protein, 6 aa, Entamoeba histolytica
SRYENN

SEQ ID NO: 2574863 - protein, 21 aa, Entamoeba histolytica
SRYKENTKQIENNNEEESLKS

SEQ ID NO: 2574864 - protein, 5 aa, Entamoeba histolytica
SRYTE

SEQ ID NO: 2574865 - protein, 4 aa, Entamoeba histolytica
SSAE

SEQ ID NO: 2574866 - protein, 10 aa, Entamoeba histolytica
SSAKDQQKRL

SEQ ID NO: 2574867 - protein, 6 aa, Entamoeba histolytica
SSAKSV

SEQ ID NO: 2574868 - protein, 4 aa, Entamoeba histolytica
SSAL

SEQ ID NO: 2574869 - protein, 31 aa, Entamoeba histolytica
SSANVTAQKEIENQSTNMTQEELNSSKEEVI

SEQ ID NO: 2574870 - protein, 8 aa, Entamoeba histolytica
SSAPITGG

SEQ ID NO: 2574871 - protein, 14 aa, Entamoeba histolytica
SSAPTCPCTSDSLD

SEQ ID NO: 2574872 - protein, 13 aa, Entamoeba histolytica
SSARKSDNTEEII

SEQ ID NO: 2574873 - protein, 8 aa, Entamoeba histolytica
SSASIDTN

SEQ ID NO: 2574874 - protein, 5 aa, Entamoeba histolytica
SSASS

SEQ ID NO: 2574875 - protein, 7 aa, Entamoeba histolytica
SSASYKN

SEQ ID NO: 2574876 - protein, 29 aa, Entamoeba histolytica
SSASYSMTTESDSNNSSYQEQLSMSSDSM

SEQ ID NO: 2574877 - protein, 4 aa, Entamoeba histolytica
SSCD

SEQ ID NO: 2574878 - protein, 9 aa, Entamoeba histolytica
SSCEEPTNG

SEQ ID NO: 2574879 - protein, 8 aa, Entamoeba histolytica
SSCEKDRD

SEQ ID NO: 2574880 - protein, 6 aa, Entamoeba histolytica
SSCGIN

SEQ ID NO: 2574881 - protein, 13 aa, Entamoeba histolytica
SSCGINDSSSVIE

SEQ ID NO: 2574882 - protein, 19 aa, Entamoeba histolytica
SSCGNGKKDENEDCDNSYK

SEQ ID NO: 2574883 - protein, 7 aa, Entamoeba histolytica
SSCKKCE

SEQ ID NO: 2574884 - protein, 9 aa, Entamoeba histolytica
SSCNNDNNY

SEQ ID NO: 2574885 - protein, 6 aa, Entamoeba histolytica
SSCSCN

SEQ ID NO: 2574886 - protein, 8 aa, Entamoeba histolytica
SSCSSGYL

SEQ ID NO: 2574887 - protein, 12 aa, Entamoeba histolytica
SSCSYDSSKSKV

SEQ ID NO: 2574888 - protein, 11 aa, Entamoeba histolytica
SSCTDNTQTDH

SEQ ID NO: 2574889 - protein, 13 aa, Entamoeba histolytica
SSCTTGCNKCKDS

SEQ ID NO: 2574890 - protein, 7 aa, Entamoeba histolytica
SSDEDGS

SEQ ID NO: 2574891 - protein, 5 aa, Entamoeba histolytica
SSDEE

SEQ ID NO: 2574892 - protein, 9 aa, Entamoeba histolytica
SSDEVPSGF

SEQ ID NO: 2574893 - protein, 4 aa, Entamoeba histolytica
SSDF

SEQ ID NO: 2574894 - protein, 11 aa, Entamoeba histolytica
SSDGQKKEYMK

SEQ ID NO: 2574895 - protein, 8 aa, Entamoeba histolytica
SSDGVASN

SEQ ID NO: 2574896 - protein, 6 aa, Entamoeba histolytica
SSDIHE

SEQ ID NO: 2574897 - protein, 5 aa, Entamoeba histolytica
SSDLP

SEQ ID NO: 2574898 - protein, 6 aa, Entamoeba histolytica
SSDNGD

SEQ ID NO: 2574899 - protein, 8 aa, Entamoeba histolytica
SSDNIKSS

SEQ ID NO: 2574900 - protein, 7 aa, Entamoeba histolytica
SSDNSNK

SEQ ID NO: 2574901 - protein, 8 aa, Entamoeba histolytica
SSDPERQL

SEQ ID NO: 2574902 - protein, 9 aa, Entamoeba histolytica
SSDSIETDI

SEQ ID NO: 2574903 - protein, 4 aa, Entamoeba histolytica
SSDT

SEQ ID NO: 2574904 - protein, 8 aa, Entamoeba histolytica
SSDTSTNM

SEQ ID NO: 2574905 - protein, 4 aa, Entamoeba histolytica
SSDV

SEQ ID NO: 2574906 - protein, 4 aa, Entamoeba histolytica
SSDY

SEQ ID NO: 2574907 - protein, 8 aa, Entamoeba histolytica
SSEAISGL

SEQ ID NO: 2574908 - protein, 8 aa, Entamoeba histolytica
SSECPPDV

SEQ ID NO: 2574909 - protein, 10 aa, Entamoeba histolytica
SSECSNKLRE

SEQ ID NO: 2574910 - protein, 10 aa, Entamoeba histolytica
SSEEAEEREE

SEQ ID NO: 2574911 - protein, 17 aa, Entamoeba histolytica
SSEEEREKEENEETTMI

SEQ ID NO: 2574912 - protein, 7 aa, Entamoeba histolytica
SSEEPVE

SEQ ID NO: 2574913 - protein, 7 aa, Entamoeba histolytica
SSEESIS

SEQ ID NO: 2574914 - protein, 20 aa, Entamoeba histolytica
SSEFPKTRPEKRPPPEEEKG

SEQ ID NO: 2574915 - protein, 7 aa, Entamoeba histolytica
SSEGVRL

SEQ ID NO: 2574916 - protein, 4 aa, Entamoeba histolytica
SSEH

SEQ ID NO: 2574917 - protein, 25 aa, Entamoeba histolytica
SSEISSEYVSNKKGRDVSINENEIK

SEQ ID NO: 2574918 - protein, 6 aa, Entamoeba histolytica
SSEMET

SEQ ID NO: 2574919 - protein, 12 aa, Entamoeba histolytica
SSENECSECSPG

SEQ ID NO: 2574920 - protein, 19 aa, Entamoeba histolytica
SSENQVDTLSPPSESLAGH

SEQ ID NO: 2574921 - protein, 8 aa, Entamoeba histolytica
SSENSYPK

SEQ ID NO: 2574922 - protein, 7 aa, Entamoeba histolytica
SSEPKEY

SEQ ID NO: 2574923 - protein, 8 aa, Entamoeba histolytica
SSEPNGSC

SEQ ID NO: 2574924 - protein, 10 aa, Entamoeba histolytica
SSEQMTSSDG

SEQ ID NO: 2574925 - protein, 6 aa, Entamoeba histolytica
SSEQTL

SEQ ID NO: 2574926 - protein, 5 aa, Entamoeba histolytica
SSERK

SEQ ID NO: 2574927 - protein, 10 aa, Entamoeba histolytica
SSERSLSRTL

SEQ ID NO: 2574928 - protein, 6 aa, Entamoeba histolytica
SSESIT

SEQ ID NO: 2574929 - protein, 13 aa, Entamoeba histolytica
SSESRRKNKYDLG

SEQ ID NO: 2574930 - protein, 7 aa, Entamoeba histolytica
SSESSGT

SEQ ID NO: 2574931 - protein, 13 aa, Entamoeba histolytica
SSETDKLNGRIDE

SEQ ID NO: 2574932 - protein, 5 aa, Entamoeba histolytica
SSETF

SEQ ID NO: 2574933 - protein, 6 aa, Entamoeba histolytica
SSETGK

SEQ ID NO: 2574934 - protein, 5 aa, Entamoeba histolytica
SSETI

SEQ ID NO: 2574935 - protein, 5 aa, Entamoeba histolytica
SSFGF

SEQ ID NO: 2574936 - protein, 20 aa, Entamoeba histolytica
SSFIGDDKDKVNITTHQSEE

SEQ ID NO: 2574937 - protein, 8 aa, Entamoeba histolytica
SSFNGDDT

SEQ ID NO: 2574938 - protein, 7 aa, Entamoeba histolytica
SSFPTPE

SEQ ID NO: 2574939 - protein, 4 aa, Entamoeba histolytica
SSFR

SEQ ID NO: 2574940 - protein, 4 aa, Entamoeba histolytica
SSFS

SEQ ID NO: 2574941 - protein, 13 aa, Entamoeba histolytica
SSFTSQLSQSVDG

SEQ ID NO: 2574942 - protein, 6 aa, Entamoeba histolytica
SSGGPF

SEQ ID NO: 2574943 - protein, 8 aa, Entamoeba histolytica
SSGKTQKE

SEQ ID NO: 2574944 - protein, 4 aa, Entamoeba histolytica
SSGM

SEQ ID NO: 2574945 - protein, 9 aa, Entamoeba histolytica
SSGNHMETR

SEQ ID NO: 2574946 - protein, 9 aa, Entamoeba histolytica
SSGNNFDSI

SEQ ID NO: 2574947 - protein, 6 aa, Entamoeba histolytica
SSGQRL

SEQ ID NO: 2574948 - protein, 6 aa, Entamoeba histolytica
SSGSGF

SEQ ID NO: 2574949 - protein, 7 aa, Entamoeba histolytica
SSGSPTR

SEQ ID NO: 2574950 - protein, 7 aa, Entamoeba histolytica
SSGTSLS

SEQ ID NO: 2574951 - protein, 7 aa, Entamoeba histolytica
SSGVGKT

SEQ ID NO: 2574952 - protein, 7 aa, Entamoeba histolytica
SSHGTPL

SEQ ID NO: 2574953 - protein, 7 aa, Entamoeba histolytica
SSHIPSK

SEQ ID NO: 2574954 - protein, 7 aa, Entamoeba histolytica
SSHKKYK

SEQ ID NO: 2574955 - protein, 14 aa, Entamoeba histolytica
SSHNAKEELKYGEQ

SEQ ID NO: 2574956 - protein, 6 aa, Entamoeba histolytica
SSHNTG

SEQ ID NO: 2574957 - protein, 29 aa, Entamoeba histolytica
SSHPKEDKKKPELPKKTTTPNGNTSSKIN

SEQ ID NO: 2574958 - protein, 19 aa, Entamoeba histolytica
SSIDQSENPRFSQKPSKLT

SEQ ID NO: 2574959 - protein, 19 aa, Entamoeba histolytica
SSIETNNSPIITNKESNQL

SEQ ID NO: 2574960 - protein, 6 aa, Entamoeba histolytica
SSIGEK

SEQ ID NO: 2574961 - protein, 4 aa, Entamoeba histolytica
SSIK

SEQ ID NO: 2574962 - protein, 7 aa, Entamoeba histolytica
SSIKSIS

SEQ ID NO: 2574963 - protein, 9 aa, Entamoeba histolytica
SSIKSSSSW

SEQ ID NO: 2574964 - protein, 7 aa, Entamoeba histolytica
SSINDPD

SEQ ID NO: 2574965 - protein, 6 aa, Entamoeba histolytica
SSINNQ

SEQ ID NO: 2574966 - protein, 9 aa, Entamoeba histolytica
SSINSEKTI

SEQ ID NO: 2574967 - protein, 8 aa, Entamoeba histolytica
SSIPKSDE

SEQ ID NO: 2574968 - protein, 12 aa, Entamoeba histolytica
SSIQSQENKEKL

SEQ ID NO: 2574969 - protein, 11 aa, Entamoeba histolytica
SSIRSGLRASK

SEQ ID NO: 2574970 - protein, 4 aa, Entamoeba histolytica
SSIS

SEQ ID NO: 2574971 - protein, 9 aa, Entamoeba histolytica
SSISDYNKQ

SEQ ID NO: 2574972 - protein, 9 aa, Entamoeba histolytica
SSISEKRLR

SEQ ID NO: 2574973 - protein, 11 aa, Entamoeba histolytica
SSISELSEEYD

SEQ ID NO: 2574974 - protein, 13 aa, Entamoeba histolytica
SSISPDTTKDNIN

SEQ ID NO: 2574975 - protein, 11 aa, Entamoeba histolytica
SSITGSPNPIM

SEQ ID NO: 2574976 - protein, 9 aa, Entamoeba histolytica
SSKANSVDA

SEQ ID NO: 2574977 - protein, 5 aa, Entamoeba histolytica
SSKDI

SEQ ID NO: 2574978 - protein, 7 aa, Entamoeba histolytica
SSKEISE

SEQ ID NO: 2574979 - protein, 13 aa, Entamoeba histolytica
SSKKKEKKGSSEV

SEQ ID NO: 2574980 - protein, 24 aa, Entamoeba histolytica
SSKKSENNEENGEISSGDGCNTKI

SEQ ID NO: 2574981 - protein, 32 aa, Entamoeba histolytica
SSKKSENNEENGEVISGDSYNTKTREEGKELG

SEQ ID NO: 2574982 - protein, 8 aa, Entamoeba histolytica
SSKNEQTF

SEQ ID NO: 2574983 - protein, 10 aa, Entamoeba histolytica
SSKQSSGSHG

SEQ ID NO: 2574984 - protein, 7 aa, Entamoeba histolytica
SSKQTYA

SEQ ID NO: 2574985 - protein, 4 aa, Entamoeba histolytica
SSKS

SEQ ID NO: 2574986 - protein, 6 aa, Entamoeba histolytica
SSKSSF

SEQ ID NO: 2574987 - protein, 8 aa, Entamoeba histolytica
SSKSTKKI

SEQ ID NO: 2574988 - protein, 7 aa, Entamoeba histolytica
SSKVPLG

SEQ ID NO: 2574989 - protein, 4 aa, Entamoeba histolytica
SSKY

SEQ ID NO: 2574990 - protein, 9 aa, Entamoeba histolytica
SSLAKEYHS

SEQ ID NO: 2574991 - protein, 16 aa, Entamoeba histolytica
SSLDEKELANKLTSTY

SEQ ID NO: 2574992 - protein, 4 aa, Entamoeba histolytica
SSLN

SEQ ID NO: 2574993 - protein, 8 aa, Entamoeba histolytica
SSLNGDST

SEQ ID NO: 2574994 - protein, 7 aa, Entamoeba histolytica
SSLNPEW

SEQ ID NO: 2574995 - protein, 4 aa, Entamoeba histolytica
SSLP

SEQ ID NO: 2574996 - protein, 10 aa, Entamoeba histolytica
SSLSQYPDHP

SEQ ID NO: 2574997 - protein, 7 aa, Entamoeba histolytica
SSLSSKG

SEQ ID NO: 2574998 - protein, 7 aa, Entamoeba histolytica
SSLTQRQ

SEQ ID NO: 2574999 - protein, 16 aa, Entamoeba histolytica
SSMDGRGSLYTRSGTA

SEQ ID NO: 2575000 - protein, 9 aa, Entamoeba histolytica
SSMKQEEKL

SEQ ID NO: 2575001 - protein, 11 aa, Entamoeba histolytica
SSMSKRARKKV

SEQ ID NO: 2575002 - protein, 6 aa, Entamoeba histolytica
SSMSLP

SEQ ID NO: 2575003 - protein, 5 aa, Entamoeba histolytica
SSMST

SEQ ID NO: 2575004 - protein, 7 aa, Entamoeba histolytica
SSNAKNM

SEQ ID NO: 2575005 - protein, 6 aa, Entamoeba histolytica
SSNANK

SEQ ID NO: 2575006 - protein, 8 aa, Entamoeba histolytica
SSNDDFGT

SEQ ID NO: 2575007 - protein, 9 aa, Entamoeba histolytica
SSNDIESNG

SEQ ID NO: 2575008 - protein, 4 aa, Entamoeba histolytica
SSNE

SEQ ID NO: 2575009 - protein, 7 aa, Entamoeba histolytica
SSNEELR

SEQ ID NO: 2575010 - protein, 10 aa, Entamoeba histolytica
SSNEFNPFPT

SEQ ID NO: 2575011 - protein, 5 aa, Entamoeba histolytica
SSNEI

SEQ ID NO: 2575012 - protein, 20 aa, Entamoeba histolytica
SSNEQKRYSCGTTGGLKQKS

SEQ ID NO: 2575013 - protein, 4 aa, Entamoeba histolytica
SSNG

SEQ ID NO: 2575014 - protein, 9 aa, Entamoeba histolytica
SSNGTNDNE

SEQ ID NO: 2575015 - protein, 7 aa, Entamoeba histolytica
SSNHPNG

SEQ ID NO: 2575016 - protein, 5 aa, Entamoeba histolytica
SSNIA

SEQ ID NO: 2575017 - protein, 7 aa, Entamoeba histolytica
SSNINEQ

SEQ ID NO: 2575018 - protein, 4 aa, Entamoeba histolytica
SSNK

SEQ ID NO: 2575019 - protein, 7 aa, Entamoeba histolytica
SSNKDNH

SEQ ID NO: 2575020 - protein, 9 aa, Entamoeba histolytica
SSNKFRSER

SEQ ID NO: 2575021 - protein, 8 aa, Entamoeba histolytica
SSNLSSAP

SEQ ID NO: 2575022 - protein, 6 aa, Entamoeba histolytica
SSNMPS

SEQ ID NO: 2575023 - protein, 7 aa, Entamoeba histolytica
SSNNQYE

SEQ ID NO: 2575024 - protein, 8 aa, Entamoeba histolytica
SSNPFKNK

SEQ ID NO: 2575025 - protein, 6 aa, Entamoeba histolytica
SSNPKF

SEQ ID NO: 2575026 - protein, 6 aa, Entamoeba histolytica
SSNPNE

SEQ ID NO: 2575027 - protein, 5 aa, Entamoeba histolytica
SSNQE

SEQ ID NO: 2575028 - protein, 6 aa, Entamoeba histolytica
SSNSEI

SEQ ID NO: 2575029 - protein, 9 aa, Entamoeba histolytica
SSNSQQQET

SEQ ID NO: 2575030 - protein, 5 aa, Entamoeba histolytica
SSNSY

SEQ ID NO: 2575031 - protein, 4 aa, Entamoeba histolytica
SSNT

SEQ ID NO: 2575032 - protein, 7 aa, Entamoeba histolytica
SSNTCRE

SEQ ID NO: 2575033 - protein, 7 aa, Entamoeba histolytica
SSNTIEA

SEQ ID NO: 2575034 - protein, 7 aa, Entamoeba histolytica
SSNTKKF

SEQ ID NO: 2575035 - protein, 7 aa, Entamoeba histolytica
SSNTSVV

SEQ ID NO: 2575036 - protein, 5 aa, Entamoeba histolytica
SSNVS

SEQ ID NO: 2575037 - protein, 7 aa, Entamoeba histolytica
SSNYSST

SEQ ID NO: 2575038 - protein, 6 aa, Entamoeba histolytica
SSPAYP

SEQ ID NO: 2575039 - protein, 4 aa, Entamoeba histolytica
SSPE

SEQ ID NO: 2575040 - protein, 8 aa, Entamoeba histolytica
SSPENLDQ

SEQ ID NO: 2575041 - protein, 16 aa, Entamoeba histolytica
SSPERCVNPSLLKLCF

SEQ ID NO: 2575042 - protein, 20 aa, Entamoeba histolytica
SSPIHSPYRSKSSRSSHQTL

SEQ ID NO: 2575043 - protein, 5 aa, Entamoeba histolytica
SSPIK

SEQ ID NO: 2575044 - protein, 11 aa, Entamoeba histolytica
SSPKKTLNDKM

SEQ ID NO: 2575045 - protein, 6 aa, Entamoeba histolytica
SSPLRC

SEQ ID NO: 2575046 - protein, 19 aa, Entamoeba histolytica
SSPMNGTCSSEPFDSNTPL

SEQ ID NO: 2575047 - protein, 4 aa, Entamoeba histolytica
SSPN

SEQ ID NO: 2575048 - protein, 16 aa, Entamoeba histolytica
SSPNAYITKDGSCEVD

SEQ ID NO: 2575049 - protein, 8 aa, Entamoeba histolytica
SSPNESQI

SEQ ID NO: 2575050 - protein, 6 aa, Entamoeba histolytica
SSPNKR

SEQ ID NO: 2575051 - protein, 9 aa, Entamoeba histolytica
SSPPKNKGK

SEQ ID NO: 2575052 - protein, 7 aa, Entamoeba histolytica
SSPQNLQ

SEQ ID NO: 2575053 - protein, 34 aa, Entamoeba histolytica
SSPSCSSSLTNSLPSQRLSNSSSLQLSSTPSTTI

SEQ ID NO: 2575054 - protein, 7 aa, Entamoeba histolytica
SSPSLNL

SEQ ID NO: 2575055 - protein, 8 aa, Entamoeba histolytica
SSPSNNEQ

SEQ ID NO: 2575056 - protein, 14 aa, Entamoeba histolytica
SSPSSQSNQSPTYD

SEQ ID NO: 2575057 - protein, 5 aa, Entamoeba histolytica
SSPSY

SEQ ID NO: 2575058 - protein, 4 aa, Entamoeba histolytica
SSPT

SEQ ID NO: 2575059 - protein, 9 aa, Entamoeba histolytica
SSPWKGERY

SEQ ID NO: 2575060 - protein, 6 aa, Entamoeba histolytica
SSPYEL

SEQ ID NO: 2575061 - protein, 5 aa, Entamoeba histolytica
SSQES

SEQ ID NO: 2575062 - protein, 4 aa, Entamoeba histolytica
SSQG

SEQ ID NO: 2575063 - protein, 5 aa, Entamoeba histolytica
SSQGG

SEQ ID NO: 2575064 - protein, 4 aa, Entamoeba histolytica
SSQI

SEQ ID NO: 2575065 - protein, 18 aa, Entamoeba histolytica
SSQISTPNDSSRRQPSFE

SEQ ID NO: 2575066 - protein, 8 aa, Entamoeba histolytica
SSQLSSDA

SEQ ID NO: 2575067 - protein, 7 aa, Entamoeba histolytica
SSQPPTI

SEQ ID NO: 2575068 - protein, 7 aa, Entamoeba histolytica
SSQPTAY

SEQ ID NO: 2575069 - protein, 5 aa, Entamoeba histolytica
SSQQI

SEQ ID NO: 2575070 - protein, 8 aa, Entamoeba histolytica
SSQRTLTS

SEQ ID NO: 2575071 - protein, 57 aa, Entamoeba histolytica
SSQSSQNSESERSSKSSGTNGSNSTNKTGEQKLTPSGSGKFGSSHESDSKKKGKTKI

SEQ ID NO: 2575072 - protein, 7 aa, Entamoeba histolytica
SSQTIGN

SEQ ID NO: 2575073 - protein, 6 aa, Entamoeba histolytica
SSQTNI

SEQ ID NO: 2575074 - protein, 15 aa, Entamoeba histolytica
SSQTTSSKLTSETYT

SEQ ID NO: 2575075 - protein, 8 aa, Entamoeba histolytica
SSQTVYNE

SEQ ID NO: 2575076 - protein, 7 aa, Entamoeba histolytica
SSRAPIG

SEQ ID NO: 2575077 - protein, 14 aa, Entamoeba histolytica
SSRCIPKSCGNKKI

SEQ ID NO: 2575078 - protein, 27 aa, Entamoeba histolytica
SSRESLSDVSNSQGRIGNGKEGMPDLG

SEQ ID NO: 2575079 - protein, 10 aa, Entamoeba histolytica
SSRGGDINGN

SEQ ID NO: 2575080 - protein, 6 aa, Entamoeba histolytica
SSRHVS

SEQ ID NO: 2575081 - protein, 5 aa, Entamoeba histolytica
SSRKR

SEQ ID NO: 2575082 - protein, 4 aa, Entamoeba histolytica
SSRN

SEQ ID NO: 2575083 - protein, 8 aa, Entamoeba histolytica
SSRPTRYE

SEQ ID NO: 2575084 - protein, 7 aa, Entamoeba histolytica
SSRQTYQ

SEQ ID NO: 2575085 - protein, 8 aa, Entamoeba histolytica
SSRSAAKY

SEQ ID NO: 2575086 - protein, 7 aa, Entamoeba histolytica
SSSCSEN

SEQ ID NO: 2575087 - protein, 9 aa, Entamoeba histolytica
SSSDEYASF

SEQ ID NO: 2575088 - protein, 8 aa, Entamoeba histolytica
SSSDKMQS

SEQ ID NO: 2575089 - protein, 7 aa, Entamoeba histolytica
SSSDTNI

SEQ ID NO: 2575090 - protein, 9 aa, Entamoeba histolytica
SSSEECTEC

SEQ ID NO: 2575091 - protein, 7 aa, Entamoeba histolytica
SSSEFSD

SEQ ID NO: 2575092 - protein, 6 aa, Entamoeba histolytica
SSSENI

SEQ ID NO: 2575093 - protein, 6 aa, Entamoeba histolytica
SSSEPR

SEQ ID NO: 2575094 - protein, 17 aa, Entamoeba histolytica
SSSESSETTDETNDETN

SEQ ID NO: 2575095 - protein, 16 aa, Entamoeba histolytica
SSSETTNRISSKSTLE

SEQ ID NO: 2575096 - protein, 5 aa, Entamoeba histolytica
SSSFS

SEQ ID NO: 2575097 - protein, 13 aa, Entamoeba histolytica
SSSGWKMSKKKRK

SEQ ID NO: 2575098 - protein, 6 aa, Entamoeba histolytica
SSSHVN

SEQ ID NO: 2575099 - protein, 4 aa, Entamoeba histolytica
SSSI

SEQ ID NO: 2575100 - protein, 15 aa, Entamoeba histolytica
SSSIDDFKQTGTCGD

SEQ ID NO: 2575101 - protein, 7 aa, Entamoeba histolytica
SSSLEKM

SEQ ID NO: 2575102 - protein, 9 aa, Entamoeba histolytica
SSSNKNGEL

SEQ ID NO: 2575103 - protein, 8 aa, Entamoeba histolytica
SSSNNNIP

SEQ ID NO: 2575104 - protein, 9 aa, Entamoeba histolytica
SSSNQEELT

SEQ ID NO: 2575105 - protein, 6 aa, Entamoeba histolytica
SSSNQI

SEQ ID NO: 2575106 - protein, 9 aa, Entamoeba histolytica
SSSNQPDYR

SEQ ID NO: 2575107 - protein, 10 aa, Entamoeba histolytica
SSSNSKCTSC

SEQ ID NO: 2575108 - protein, 41 aa, Entamoeba histolytica
SSSNVGSLSKSCDGKINGSSRFYTGTDPKCNCEYSKNSFKQ

SEQ ID NO: 2575109 - protein, 6 aa, Entamoeba histolytica
SSSPNR

SEQ ID NO: 2575110 - protein, 8 aa, Entamoeba histolytica
SSSPSQCT

SEQ ID NO: 2575111 - protein, 4 aa, Entamoeba histolytica
SSSQ

SEQ ID NO: 2575112 - protein, 21 aa, Entamoeba histolytica
SSSRSMSSSPILPNSERPTSF

SEQ ID NO: 2575113 - protein, 11 aa, Entamoeba histolytica
SSSSDAEISDR

SEQ ID NO: 2575114 - protein, 8 aa, Entamoeba histolytica
SSSSEHKF

SEQ ID NO: 2575115 - protein, 5 aa, Entamoeba histolytica
SSSSI

SEQ ID NO: 2575116 - protein, 6 aa, Entamoeba histolytica
SSSSKE

SEQ ID NO: 2575117 - protein, 5 aa, Entamoeba histolytica
SSSSL

SEQ ID NO: 2575118 - protein, 12 aa, Entamoeba histolytica
SSSSNCKGGNFN

SEQ ID NO: 2575119 - protein, 14 aa, Entamoeba histolytica
SSSSNEENEECSEG

SEQ ID NO: 2575120 - protein, 9 aa, Entamoeba histolytica
SSSSQSNLP

SEQ ID NO: 2575121 - protein, 5 aa, Entamoeba histolytica
SSSSS

SEQ ID NO: 2575122 - protein, 11 aa, Entamoeba histolytica
SSSSSDSEQSK

SEQ ID NO: 2575123 - protein, 8 aa, Entamoeba histolytica
SSSSVKEF

SEQ ID NO: 2575124 - protein, 14 aa, Entamoeba histolytica
SSSSYVKQSFKSHK

SEQ ID NO: 2575125 - protein, 17 aa, Entamoeba histolytica
SSSTPLTPKEINPQNDK

SEQ ID NO: 2575126 - protein, 12 aa, Entamoeba histolytica
SSSTPNSVSPTV

SEQ ID NO: 2575127 - protein, 9 aa, Entamoeba histolytica
SSSTSGYPH

SEQ ID NO: 2575128 - protein, 9 aa, Entamoeba histolytica
SSSVDNPKD

SEQ ID NO: 2575129 - protein, 8 aa, Entamoeba histolytica
SSTDENAT

SEQ ID NO: 2575130 - protein, 17 aa, Entamoeba histolytica
SSTENIEGLNREQLKQE

SEQ ID NO: 2575131 - protein, 19 aa, Entamoeba histolytica
SSTFGYDNGPIDSQDTGSF

SEQ ID NO: 2575132 - protein, 8 aa, Entamoeba histolytica
SSTFSSSE

SEQ ID NO: 2575133 - protein, 7 aa, Entamoeba histolytica
SSTGKDS

SEQ ID NO: 2575134 - protein, 9 aa, Entamoeba histolytica
SSTGNNGIN

SEQ ID NO: 2575135 - protein, 4 aa, Entamoeba histolytica
SSTH

SEQ ID NO: 2575136 - protein, 12 aa, Entamoeba histolytica
SSTLKSEELERD

SEQ ID NO: 2575137 - protein, 12 aa, Entamoeba histolytica
SSTLNSTPPKYQ

SEQ ID NO: 2575138 - protein, 8 aa, Entamoeba histolytica
SSTNITVQ

SEQ ID NO: 2575139 - protein, 7 aa, Entamoeba histolytica
SSTNSTI

SEQ ID NO: 2575140 - protein, 7 aa, Entamoeba histolytica
SSTPDKL

SEQ ID NO: 2575141 - protein, 7 aa, Entamoeba histolytica
SSTPKKR

SEQ ID NO: 2575142 - protein, 8 aa, Entamoeba histolytica
SSTPKPEV

SEQ ID NO: 2575143 - protein, 10 aa, Entamoeba histolytica
SSTPQIEPNN

SEQ ID NO: 2575144 - protein, 7 aa, Entamoeba histolytica
SSTPSFP

SEQ ID NO: 2575145 - protein, 8 aa, Entamoeba histolytica
SSTPTTLT

SEQ ID NO: 2575146 - protein, 10 aa, Entamoeba histolytica
SSTPYDQGPC

SEQ ID NO: 2575147 - protein, 7 aa, Entamoeba histolytica
SSTSSDS

SEQ ID NO: 2575148 - protein, 12 aa, Entamoeba histolytica
SSTSTDKEIRSA

SEQ ID NO: 2575149 - protein, 5 aa, Entamoeba histolytica
SSTSY

SEQ ID NO: 2575150 - protein, 4 aa, Entamoeba histolytica
SSTT

SEQ ID NO: 2575151 - protein, 44 aa, Entamoeba histolytica
SSTTATTSVESKEVLSDSGEEVTVSSVTSDSTTSDNVVSTPDTL

SEQ ID NO: 2575152 - protein, 8 aa, Entamoeba histolytica
SSTTQDYY

SEQ ID NO: 2575153 - protein, 6 aa, Entamoeba histolytica
SSTVKG

SEQ ID NO: 2575154 - protein, 8 aa, Entamoeba histolytica
SSVDSESG

SEQ ID NO: 2575155 - protein, 6 aa, Entamoeba histolytica
SSVGLS

SEQ ID NO: 2575156 - protein, 4 aa, Entamoeba histolytica
SSVI

SEQ ID NO: 2575157 - protein, 9 aa, Entamoeba histolytica
SSVKDTNSI

SEQ ID NO: 2575158 - protein, 5 aa, Entamoeba histolytica
SSVPR

SEQ ID NO: 2575159 - protein, 5 aa, Entamoeba histolytica
SSVQQ

SEQ ID NO: 2575160 - protein, 8 aa, Entamoeba histolytica
SSVTDYPT

SEQ ID NO: 2575161 - protein, 6 aa, Entamoeba histolytica
SSVTNG

SEQ ID NO: 2575162 - protein, 28 aa, Entamoeba histolytica
SSVTPRISNEYESKDPFETQIKPTKSTI

SEQ ID NO: 2575163 - protein, 8 aa, Entamoeba histolytica
SSVTSYGN

SEQ ID NO: 2575164 - protein, 8 aa, Entamoeba histolytica
SSWKSNEW

SEQ ID NO: 2575165 - protein, 6 aa, Entamoeba histolytica
SSYANS

SEQ ID NO: 2575166 - protein, 7 aa, Entamoeba histolytica
SSYEGGI

SEQ ID NO: 2575167 - protein, 7 aa, Entamoeba histolytica
SSYEGSV

SEQ ID NO: 2575168 - protein, 6 aa, Entamoeba histolytica
SSYHSP

SEQ ID NO: 2575169 - protein, 8 aa, Entamoeba histolytica
SSYSGRGD

SEQ ID NO: 2575170 - protein, 7 aa, Entamoeba histolytica
SSYSSLK

SEQ ID NO: 2575171 - protein, 7 aa, Entamoeba histolytica
SSYTGSG

SEQ ID NO: 2575172 - protein, 14 aa, Entamoeba histolytica
SSYTPNTQNGCGSC

SEQ ID NO: 2575173 - protein, 7 aa, Entamoeba histolytica
STAADKV

SEQ ID NO: 2575174 - protein, 5 aa, Entamoeba histolytica
STAGH

SEQ ID NO: 2575175 - protein, 5 aa, Entamoeba histolytica
STAGL

SEQ ID NO: 2575176 - protein, 6 aa, Entamoeba histolytica
STAQAA

SEQ ID NO: 2575177 - protein, 10 aa, Entamoeba histolytica
STARDTTSHK

SEQ ID NO: 2575178 - protein, 9 aa, Entamoeba histolytica
STARSYTKR

SEQ ID NO: 2575179 - protein, 5 aa, Entamoeba histolytica
STATP

SEQ ID NO: 2575180 - protein, 4 aa, Entamoeba histolytica
STCG

SEQ ID NO: 2575181 - protein, 6 aa, Entamoeba histolytica
STCKNY

SEQ ID NO: 2575182 - protein, 14 aa, Entamoeba histolytica
STCRTPAASTSQPI

SEQ ID NO: 2575183 - protein, 7 aa, Entamoeba histolytica
STCSSQE

SEQ ID NO: 2575184 - protein, 4 aa, Entamoeba histolytica
STDK

SEQ ID NO: 2575185 - protein, 7 aa, Entamoeba histolytica
STDNSLH

SEQ ID NO: 2575186 - protein, 6 aa, Entamoeba histolytica
STDRYT

SEQ ID NO: 2575187 - protein, 9 aa, Entamoeba histolytica
STDSGKISP

SEQ ID NO: 2575188 - protein, 11 aa, Entamoeba histolytica
STDSPKKRGRL

SEQ ID NO: 2575189 - protein, 9 aa, Entamoeba histolytica
STDSTISSV

SEQ ID NO: 2575190 - protein, 10 aa, Entamoeba histolytica
STEDTANKVK

SEQ ID NO: 2575191 - protein, 4 aa, Entamoeba histolytica
STEE

SEQ ID NO: 2575192 - protein, 6 aa, Entamoeba histolytica
STEEKC

SEQ ID NO: 2575193 - protein, 7 aa, Entamoeba histolytica
STEESGS

SEQ ID NO: 2575194 - protein, 21 aa, Entamoeba histolytica
STEGESEQDTNEEGKKEFRNQ

SEQ ID NO: 2575195 - protein, 6 aa, Entamoeba histolytica
STEGIS

SEQ ID NO: 2575196 - protein, 7 aa, Entamoeba histolytica
STEGVET

SEQ ID NO: 2575197 - protein, 6 aa, Entamoeba histolytica
STEKGQ

SEQ ID NO: 2575198 - protein, 7 aa, Entamoeba histolytica
STELARE

SEQ ID NO: 2575199 - protein, 4 aa, Entamoeba histolytica
STEN

SEQ ID NO: 2575200 - protein, 13 aa, Entamoeba histolytica
STENNEIINPTNK

SEQ ID NO: 2575201 - protein, 10 aa, Entamoeba histolytica
STERKTANNL

SEQ ID NO: 2575202 - protein, 5 aa, Entamoeba histolytica
STESH

SEQ ID NO: 2575203 - protein, 8 aa, Entamoeba histolytica
STETKITE

SEQ ID NO: 2575204 - protein, 18 aa, Entamoeba histolytica
STEVSNQSLIDSQNTNIS

SEQ ID NO: 2575205 - protein, 6 aa, Entamoeba histolytica
STFESN

SEQ ID NO: 2575206 - protein, 7 aa, Entamoeba histolytica
STFSSSK

SEQ ID NO: 2575207 - protein, 7 aa, Entamoeba histolytica
STFTPSN

SEQ ID NO: 2575208 - protein, 8 aa, Entamoeba histolytica
STGDGLQL

SEQ ID NO: 2575209 - protein, 8 aa, Entamoeba histolytica
STGEIAEL

SEQ ID NO: 2575210 - protein, 15 aa, Entamoeba histolytica
STGENSCVATASSSS

SEQ ID NO: 2575211 - protein, 6 aa, Entamoeba histolytica
STGESA

SEQ ID NO: 2575212 - protein, 5 aa, Entamoeba histolytica
STGGQ

SEQ ID NO: 2575213 - protein, 8 aa, Entamoeba histolytica
STGKLTVT

SEQ ID NO: 2575214 - protein, 5 aa, Entamoeba histolytica
STGKR

SEQ ID NO: 2575215 - protein, 7 aa, Entamoeba histolytica
STGKTVN

SEQ ID NO: 2575216 - protein, 7 aa, Entamoeba histolytica
STGNKSK

SEQ ID NO: 2575217 - protein, 35 aa, Entamoeba histolytica
STGNSSLPKKSPNEKTKSRQNGGDVARLAGMYENM

SEQ ID NO: 2575218 - protein, 6 aa, Entamoeba histolytica
STGRDA

SEQ ID NO: 2575219 - protein, 9 aa, Entamoeba histolytica
STGSQNFGN

SEQ ID NO: 2575220 - protein, 11 aa, Entamoeba histolytica
STGSSGKGSIK

SEQ ID NO: 2575221 - protein, 9 aa, Entamoeba histolytica
STGSTTYGY

SEQ ID NO: 2575222 - protein, 5 aa, Entamoeba histolytica
STGYG

SEQ ID NO: 2575223 - protein, 4 aa, Entamoeba histolytica
STHA

SEQ ID NO: 2575224 - protein, 6 aa, Entamoeba histolytica
STHCQQ

SEQ ID NO: 2575225 - protein, 8 aa, Entamoeba histolytica
STHESEPS

SEQ ID NO: 2575226 - protein, 8 aa, Entamoeba histolytica
STHKSSNV

SEQ ID NO: 2575227 - protein, 5 aa, Entamoeba histolytica
STHPF

SEQ ID NO: 2575228 - protein, 4 aa, Entamoeba histolytica
STHT

SEQ ID NO: 2575229 - protein, 5 aa, Entamoeba histolytica
STIGG

SEQ ID NO: 2575230 - protein, 5 aa, Entamoeba histolytica
STIKN

SEQ ID NO: 2575231 - protein, 11 aa, Entamoeba histolytica
STIKNTTAFGP

SEQ ID NO: 2575232 - protein, 4 aa, Entamoeba histolytica
STIN

SEQ ID NO: 2575233 - protein, 11 aa, Entamoeba histolytica
STINENDVKPK

SEQ ID NO: 2575234 - protein, 6 aa, Entamoeba histolytica
STIPDK

SEQ ID NO: 2575235 - protein, 8 aa, Entamoeba histolytica
STIPSPDY

SEQ ID NO: 2575236 - protein, 8 aa, Entamoeba histolytica
STIQNRTA

SEQ ID NO: 2575237 - protein, 5 aa, Entamoeba histolytica
STISD

SEQ ID NO: 2575238 - protein, 5 aa, Entamoeba histolytica
STISG

SEQ ID NO: 2575239 - protein, 5 aa, Entamoeba histolytica
STISS

SEQ ID NO: 2575240 - protein, 27 aa, Entamoeba histolytica
STITQTTVGNTTIKAATVDNGTTPKKT

SEQ ID NO: 2575241 - protein, 7 aa, Entamoeba histolytica
STKDDSC

SEQ ID NO: 2575242 - protein, 6 aa, Entamoeba histolytica
STKDSP

SEQ ID NO: 2575243 - protein, 6 aa, Entamoeba histolytica
STKEEL

SEQ ID NO: 2575244 - protein, 59 aa, Entamoeba histolytica
STKEERQASEKLKKEKDLKEDRSDIELKDENNEHSCVENEQSEEGLEEKHRAGNEKDMN

SEQ ID NO: 2575245 - protein, 5 aa, Entamoeba histolytica
STKEG

SEQ ID NO: 2575246 - protein, 6 aa, Entamoeba histolytica
STKEKM

SEQ ID NO: 2575247 - protein, 8 aa, Entamoeba histolytica
STKENQLK

SEQ ID NO: 2575248 - protein, 7 aa, Entamoeba histolytica
STKENRA

SEQ ID NO: 2575249 - protein, 6 aa, Entamoeba histolytica
STKETI

SEQ ID NO: 2575250 - protein, 9 aa, Entamoeba histolytica
STKHPCGNF

SEQ ID NO: 2575251 - protein, 4 aa, Entamoeba histolytica
STKI

SEQ ID NO: 2575252 - protein, 6 aa, Entamoeba histolytica
STKIQR

SEQ ID NO: 2575253 - protein, 10 aa, Entamoeba histolytica
STKKDKYGHC

SEQ ID NO: 2575254 - protein, 7 aa, Entamoeba histolytica
STKKGRC

SEQ ID NO: 2575255 - protein, 6 aa, Entamoeba histolytica
STKLDH

SEQ ID NO: 2575256 - protein, 7 aa, Entamoeba histolytica
STKLDHT

SEQ ID NO: 2575257 - protein, 16 aa, Entamoeba histolytica
STKNGYYSISTDNDYS

SEQ ID NO: 2575258 - protein, 10 aa, Entamoeba histolytica
STKNNQYKNG

SEQ ID NO: 2575259 - protein, 11 aa, Entamoeba histolytica
STKNQNEWNNR

SEQ ID NO: 2575260 - protein, 7 aa, Entamoeba histolytica
STKPPIK

SEQ ID NO: 2575261 - protein, 6 aa, Entamoeba histolytica
STKQQP

SEQ ID NO: 2575262 - protein, 8 aa, Entamoeba histolytica
STKQSQYG

SEQ ID NO: 2575263 - protein, 10 aa, Entamoeba histolytica
STKSGGSMSL

SEQ ID NO: 2575264 - protein, 6 aa, Entamoeba histolytica
STKSNR

SEQ ID NO: 2575265 - protein, 11 aa, Entamoeba histolytica
STKSNTESTKL

SEQ ID NO: 2575266 - protein, 13 aa, Entamoeba histolytica
STKSSDNSAKQTI

SEQ ID NO: 2575267 - protein, 7 aa, Entamoeba histolytica
STKTAKY

SEQ ID NO: 2575268 - protein, 7 aa, Entamoeba histolytica
STKTPHR

SEQ ID NO: 2575269 - protein, 13 aa, Entamoeba histolytica
STLDSNCQSCSTN

SEQ ID NO: 2575270 - protein, 4 aa, Entamoeba histolytica
STLE

SEQ ID NO: 2575271 - protein, 6 aa, Entamoeba histolytica
STLEGT

SEQ ID NO: 2575272 - protein, 13 aa, Entamoeba histolytica
STLGNTKIYPGTT

SEQ ID NO: 2575273 - protein, 9 aa, Entamoeba histolytica
STLKNSIDP

SEQ ID NO: 2575274 - protein, 7 aa, Entamoeba histolytica
STLNPGY

SEQ ID NO: 2575275 - protein, 4 aa, Entamoeba histolytica
STLP

SEQ ID NO: 2575276 - protein, 5 aa, Entamoeba histolytica
STLSG

SEQ ID NO: 2575277 - protein, 20 aa, Entamoeba histolytica
STLSGASKSNVACPCSSSKD

SEQ ID NO: 2575278 - protein, 11 aa, Entamoeba histolytica
STLSLTTPKSL

SEQ ID NO: 2575279 - protein, 14 aa, Entamoeba histolytica
STLYKEGDVQGTYR

SEQ ID NO: 2575280 - protein, 4 aa, Entamoeba histolytica
STMS

SEQ ID NO: 2575281 - protein, 7 aa, Entamoeba histolytica
STNAPEN

SEQ ID NO: 2575282 - protein, 11 aa, Entamoeba histolytica
STNAPPSKTAR

SEQ ID NO: 2575283 - protein, 16 aa, Entamoeba histolytica
STNATQFSISNSDNSY

SEQ ID NO: 2575284 - protein, 5 aa, Entamoeba histolytica
STNCC

SEQ ID NO: 2575285 - protein, 8 aa, Entamoeba histolytica
STNDNTKR

SEQ ID NO: 2575286 - protein, 8 aa, Entamoeba histolytica
STNDTTPL

SEQ ID NO: 2575287 - protein, 6 aa, Entamoeba histolytica
STNEKY

SEQ ID NO: 2575288 - protein, 9 aa, Entamoeba histolytica
STNENSISE

SEQ ID NO: 2575289 - protein, 4 aa, Entamoeba histolytica
STNI

SEQ ID NO: 2575290 - protein, 11 aa, Entamoeba histolytica
STNKKCSNYEK

SEQ ID NO: 2575291 - protein, 6 aa, Entamoeba histolytica
STNKQI

SEQ ID NO: 2575292 - protein, 4 aa, Entamoeba histolytica
STNM

SEQ ID NO: 2575293 - protein, 16 aa, Entamoeba histolytica
STNMSSPLNPSKMPEI

SEQ ID NO: 2575294 - protein, 4 aa, Entamoeba histolytica
STNN

SEQ ID NO: 2575295 - protein, 7 aa, Entamoeba histolytica
STNNDYS

SEQ ID NO: 2575296 - protein, 6 aa, Entamoeba histolytica
STNNEG

SEQ ID NO: 2575297 - protein, 10 aa, Entamoeba histolytica
STNNKEIYDK

SEQ ID NO: 2575298 - protein, 8 aa, Entamoeba histolytica
STNPERTN

SEQ ID NO: 2575299 - protein, 17 aa, Entamoeba histolytica
STNPEVSYTRNNGKNVT

SEQ ID NO: 2575300 - protein, 8 aa, Entamoeba histolytica
STNSFKGN

SEQ ID NO: 2575301 - protein, 11 aa, Entamoeba histolytica
STNSNTESTKL

SEQ ID NO: 2575302 - protein, 8 aa, Entamoeba histolytica
STNSPNNL

SEQ ID NO: 2575303 - protein, 7 aa, Entamoeba histolytica
STNSTTC

SEQ ID NO: 2575304 - protein, 6 aa, Entamoeba histolytica
STNTSE

SEQ ID NO: 2575305 - protein, 5 aa, Entamoeba histolytica
STNTT

SEQ ID NO: 2575306 - protein, 37 aa, Entamoeba histolytica
STPEHLSESSEGKTPRTSEVNESKTPSKNSEESEPNI

SEQ ID NO: 2575307 - protein, 16 aa, Entamoeba histolytica
STPENPPVNQPNSQIG

SEQ ID NO: 2575308 - protein, 5 aa, Entamoeba histolytica
STPKL

SEQ ID NO: 2575309 - protein, 7 aa, Entamoeba histolytica
STPLPNE

SEQ ID NO: 2575310 - protein, 9 aa, Entamoeba histolytica
STPMKQNTK

SEQ ID NO: 2575311 - protein, 5 aa, Entamoeba histolytica
STPNK

SEQ ID NO: 2575312 - protein, 23 aa, Entamoeba histolytica
STPNTPATSLNQSGIQTPRNRKR

SEQ ID NO: 2575313 - protein, 6 aa, Entamoeba histolytica
STPQFK

SEQ ID NO: 2575314 - protein, 11 aa, Entamoeba histolytica
STPQQTVEQME

SEQ ID NO: 2575315 - protein, 10 aa, Entamoeba histolytica
STPQSDALEV

SEQ ID NO: 2575316 - protein, 5 aa, Entamoeba histolytica
STPQT

SEQ ID NO: 2575317 - protein, 13 aa, Entamoeba histolytica
STPREEKKPGDES

SEQ ID NO: 2575318 - protein, 7 aa, Entamoeba histolytica
STPSDFQ

SEQ ID NO: 2575319 - protein, 4 aa, Entamoeba histolytica
STQD

SEQ ID NO: 2575320 - protein, 4 aa, Entamoeba histolytica
STQI

SEQ ID NO: 2575321 - protein, 5 aa, Entamoeba histolytica
STQIP

SEQ ID NO: 2575322 - protein, 13 aa, Entamoeba histolytica
STQLNGDTQTETL

SEQ ID NO: 2575323 - protein, 5 aa, Entamoeba histolytica
STQQT

SEQ ID NO: 2575324 - protein, 13 aa, Entamoeba histolytica
STQREEGGCFIYS

SEQ ID NO: 2575325 - protein, 6 aa, Entamoeba histolytica
STQSLR

SEQ ID NO: 2575326 - protein, 7 aa, Entamoeba histolytica
STQTDNL

SEQ ID NO: 2575327 - protein, 9 aa, Entamoeba histolytica
STQYSTGPC

SEQ ID NO: 2575328 - protein, 19 aa, Entamoeba histolytica
STRLDPEELKEEKKIGEGS

SEQ ID NO: 2575329 - protein, 6 aa, Entamoeba histolytica
STRNAK

SEQ ID NO: 2575330 - protein, 6 aa, Entamoeba histolytica
STRNGK

SEQ ID NO: 2575331 - protein, 19 aa, Entamoeba histolytica
STRRHRTIRRTQRHTAPYQ

SEQ ID NO: 2575332 - protein, 5 aa, Entamoeba histolytica
STSAV

SEQ ID NO: 2575333 - protein, 7 aa, Entamoeba histolytica
STSEEIN

SEQ ID NO: 2575334 - protein, 6 aa, Entamoeba histolytica
STSESQ

SEQ ID NO: 2575335 - protein, 58 aa, Entamoeba histolytica
STSESSSSSMNHDSESSSSSMSHDSEGSSSSMSHDSEGSSSSMNHDSESSANGPSQNS

SEQ ID NO: 2575336 - protein, 10 aa, Entamoeba histolytica
STSGSIGSGV

SEQ ID NO: 2575337 - protein, 10 aa, Entamoeba histolytica
STSGSKEQCS

SEQ ID NO: 2575338 - protein, 12 aa, Entamoeba histolytica
STSHEEETYGME

SEQ ID NO: 2575339 - protein, 7 aa, Entamoeba histolytica
STSHKYG

SEQ ID NO: 2575340 - protein, 7 aa, Entamoeba histolytica
STSIEDK

SEQ ID NO: 2575341 - protein, 8 aa, Entamoeba histolytica
STSIESDL

SEQ ID NO: 2575342 - protein, 6 aa, Entamoeba histolytica
STSIPY

SEQ ID NO: 2575343 - protein, 4 aa, Entamoeba histolytica
STSK

SEQ ID NO: 2575344 - protein, 37 aa, Entamoeba histolytica
STSKHNTNNQLNNAIEDAAEAEGIPLTKSSCSSPSSA

SEQ ID NO: 2575345 - protein, 5 aa, Entamoeba histolytica
STSKM

SEQ ID NO: 2575346 - protein, 8 aa, Entamoeba histolytica
STSKMNDV

SEQ ID NO: 2575347 - protein, 17 aa, Entamoeba histolytica
STSLNQSSSSSLSKSPA

SEQ ID NO: 2575348 - protein, 7 aa, Entamoeba histolytica
STSLPSY

SEQ ID NO: 2575349 - protein, 12 aa, Entamoeba histolytica
STSNINSFQQSG

SEQ ID NO: 2575350 - protein, 9 aa, Entamoeba histolytica
STSNTTKNE

SEQ ID NO: 2575351 - protein, 29 aa, Entamoeba histolytica
STSQEGNKILKSKKDKTNKQNKYLNDEEK

SEQ ID NO: 2575352 - protein, 9 aa, Entamoeba histolytica
STSRQNDYQ

SEQ ID NO: 2575353 - protein, 7 aa, Entamoeba histolytica
STSSLED

SEQ ID NO: 2575354 - protein, 6 aa, Entamoeba histolytica
STSSQS

SEQ ID NO: 2575355 - protein, 24 aa, Entamoeba histolytica
STSSSSNKQNLQRTEYSNNENLKE

SEQ ID NO: 2575356 - protein, 14 aa, Entamoeba histolytica
STSSSTSAQINSPI

SEQ ID NO: 2575357 - protein, 11 aa, Entamoeba histolytica
STSSVFDSTPT

SEQ ID NO: 2575358 - protein, 4 aa, Entamoeba histolytica
STST

SEQ ID NO: 2575359 - protein, 7 aa, Entamoeba histolytica
STSTDTG

SEQ ID NO: 2575360 - protein, 5 aa, Entamoeba histolytica
STSTI

SEQ ID NO: 2575361 - protein, 24 aa, Entamoeba histolytica
STSVSPKSRQTKTKSRQGTKKVQE

SEQ ID NO: 2575362 - protein, 5 aa, Entamoeba histolytica
STSVT

SEQ ID NO: 2575363 - protein, 9 aa, Entamoeba histolytica
STSWTPDED

SEQ ID NO: 2575364 - protein, 6 aa, Entamoeba histolytica
STTCDK

SEQ ID NO: 2575365 - protein, 9 aa, Entamoeba histolytica
STTDCSRSN

SEQ ID NO: 2575366 - protein, 4 aa, Entamoeba histolytica
STTE

SEQ ID NO: 2575367 - protein, 6 aa, Entamoeba histolytica
STTEDE

SEQ ID NO: 2575368 - protein, 5 aa, Entamoeba histolytica
STTFN

SEQ ID NO: 2575369 - protein, 7 aa, Entamoeba histolytica
STTGFEG

SEQ ID NO: 2575370 - protein, 7 aa, Entamoeba histolytica
STTGGIS

SEQ ID NO: 2575371 - protein, 4 aa, Entamoeba histolytica
STTI

SEQ ID NO: 2575372 - protein, 5 aa, Entamoeba histolytica
STTIQ

SEQ ID NO: 2575373 - protein, 6 aa, Entamoeba histolytica
STTISE

SEQ ID NO: 2575374 - protein, 8 aa, Entamoeba histolytica
STTKKGNA

SEQ ID NO: 2575375 - protein, 6 aa, Entamoeba histolytica
STTKSF

SEQ ID NO: 2575376 - protein, 19 aa, Entamoeba histolytica
STTLFNPKNSKYGNESDES

SEQ ID NO: 2575377 - protein, 9 aa, Entamoeba histolytica
STTMSSASA

SEQ ID NO: 2575378 - protein, 7 aa, Entamoeba histolytica
STTNDMG

SEQ ID NO: 2575379 - protein, 5 aa, Entamoeba histolytica
STTNH

SEQ ID NO: 2575380 - protein, 8 aa, Entamoeba histolytica
STTPDSSS

SEQ ID NO: 2575381 - protein, 14 aa, Entamoeba histolytica
STTRQLTKNENYSR

SEQ ID NO: 2575382 - protein, 4 aa, Entamoeba histolytica
STTS

SEQ ID NO: 2575383 - protein, 7 aa, Entamoeba histolytica
STTSSGY

SEQ ID NO: 2575384 - protein, 6 aa, Entamoeba histolytica
STTTIN

SEQ ID NO: 2575385 - protein, 9 aa, Entamoeba histolytica
STTTNGGQK

SEQ ID NO: 2575386 - protein, 7 aa, Entamoeba histolytica
STTTNTC

SEQ ID NO: 2575387 - protein, 6 aa, Entamoeba histolytica
STTYAS

SEQ ID NO: 2575388 - protein, 15 aa, Entamoeba histolytica
STVAGENEGTRRKQW

SEQ ID NO: 2575389 - protein, 7 aa, Entamoeba histolytica
STVHKNE

SEQ ID NO: 2575390 - protein, 4 aa, Entamoeba histolytica
STVI

SEQ ID NO: 2575391 - protein, 8 aa, Entamoeba histolytica
STVPEEGT

SEQ ID NO: 2575392 - protein, 14 aa, Entamoeba histolytica
STVSDNEKIRSRKV

SEQ ID NO: 2575393 - protein, 5 aa, Entamoeba histolytica
STVSV

SEQ ID NO: 2575394 - protein, 6 aa, Entamoeba histolytica
STYDNE

SEQ ID NO: 2575395 - protein, 5 aa, Entamoeba histolytica
STYNK

SEQ ID NO: 2575396 - protein, 11 aa, Entamoeba histolytica
STYQYPTGLQP

SEQ ID NO: 2575397 - protein, 6 aa, Entamoeba histolytica
STYSTI

SEQ ID NO: 2575398 - protein, 6 aa, Entamoeba histolytica
SVAEGN

SEQ ID NO: 2575399 - protein, 8 aa, Entamoeba histolytica
SVAKTDPG

SEQ ID NO: 2575400 - protein, 10 aa, Entamoeba histolytica
SVAPLQDKRK

SEQ ID NO: 2575401 - protein, 5 aa, Entamoeba histolytica
SVASM

SEQ ID NO: 2575402 - protein, 9 aa, Entamoeba histolytica
SVDDNPSIA

SEQ ID NO: 2575403 - protein, 11 aa, Entamoeba histolytica
SVDREKKYYQE

SEQ ID NO: 2575404 - protein, 10 aa, Entamoeba histolytica
SVDSKDDPQC

SEQ ID NO: 2575405 - protein, 10 aa, Entamoeba histolytica
SVDSKKDPEC

SEQ ID NO: 2575406 - protein, 8 aa, Entamoeba histolytica
SVDSNLKP

SEQ ID NO: 2575407 - protein, 20 aa, Entamoeba histolytica
SVEERQRPTGKYVIEWGAII

SEQ ID NO: 2575408 - protein, 13 aa, Entamoeba histolytica
SVEGSIDDIQSDG

SEQ ID NO: 2575409 - protein, 9 aa, Entamoeba histolytica
SVEGYDKKR

SEQ ID NO: 2575410 - protein, 23 aa, Entamoeba histolytica
SVEKDLKQTISDCTATENDLEKI

SEQ ID NO: 2575411 - protein, 12 aa, Entamoeba histolytica
SVEKKKSIAKKL

SEQ ID NO: 2575412 - protein, 5 aa, Entamoeba histolytica
SVEND

SEQ ID NO: 2575413 - protein, 8 aa, Entamoeba histolytica
SVENKTIS

SEQ ID NO: 2575414 - protein, 4 aa, Entamoeba histolytica
SVEQ

SEQ ID NO: 2575415 - protein, 8 aa, Entamoeba histolytica
SVEQSRSE

SEQ ID NO: 2575416 - protein, 8 aa, Entamoeba histolytica
SVERDGLA

SEQ ID NO: 2575417 - protein, 13 aa, Entamoeba histolytica
SVESGIPDFRSSN

SEQ ID NO: 2575418 - protein, 8 aa, Entamoeba histolytica
SVESKETF

SEQ ID NO: 2575419 - protein, 8 aa, Entamoeba histolytica
SVESNKGV

SEQ ID NO: 2575420 - protein, 7 aa, Entamoeba histolytica
SVESSIT

SEQ ID NO: 2575421 - protein, 9 aa, Entamoeba histolytica
SVGDFSGQT

SEQ ID NO: 2575422 - protein, 16 aa, Entamoeba histolytica
SVGERKDDKIKSIENS

SEQ ID NO: 2575423 - protein, 11 aa, Entamoeba histolytica
SVGGGVPKRPS

SEQ ID NO: 2575424 - protein, 8 aa, Entamoeba histolytica
SVGNVTDV

SEQ ID NO: 2575425 - protein, 7 aa, Entamoeba histolytica
SVGSKQV

SEQ ID NO: 2575426 - protein, 4 aa, Entamoeba histolytica
SVIA

SEQ ID NO: 2575427 - protein, 11 aa, Entamoeba histolytica
SVINSIGSKPY

SEQ ID NO: 2575428 - protein, 12 aa, Entamoeba histolytica
SVKEQIKKDIPR

SEQ ID NO: 2575429 - protein, 49 aa, Entamoeba histolytica
SVKPSTDGGIEPKNGEDETKNGGSEAKSGSTDGKSGSTDGKSESTYRKN

SEQ ID NO: 2575430 - protein, 49 aa, Entamoeba histolytica
SVKPSTDGGIEPKNGEDETKNGGSETKSGSTDGKSGSTDGKSESTYRKN

SEQ ID NO: 2575431 - protein, 11 aa, Entamoeba histolytica
SVKSNNVQGHD

SEQ ID NO: 2575432 - protein, 10 aa, Entamoeba histolytica
SVKVEPKNIK

SEQ ID NO: 2575433 - protein, 10 aa, Entamoeba histolytica
SVLGTSGNNH

SEQ ID NO: 2575434 - protein, 6 aa, Entamoeba histolytica
SVMDPQ

SEQ ID NO: 2575435 - protein, 6 aa, Entamoeba histolytica
SVNDTS

SEQ ID NO: 2575436 - protein, 12 aa, Entamoeba histolytica
SVNGTKGNGGDY

SEQ ID NO: 2575437 - protein, 4 aa, Entamoeba histolytica
SVNT

SEQ ID NO: 2575438 - protein, 6 aa, Entamoeba histolytica
SVPDEN

SEQ ID NO: 2575439 - protein, 5 aa, Entamoeba histolytica
SVPDK

SEQ ID NO: 2575440 - protein, 8 aa, Entamoeba histolytica
SVPEENGA

SEQ ID NO: 2575441 - protein, 10 aa, Entamoeba histolytica
SVPTNGITED

SEQ ID NO: 2575442 - protein, 11 aa, Entamoeba histolytica
SVQQPDHSGAI

SEQ ID NO: 2575443 - protein, 21 aa, Entamoeba histolytica
SVQSGDSTSVKSDEPVETTLD

SEQ ID NO: 2575444 - protein, 10 aa, Entamoeba histolytica
SVQTRETENF

SEQ ID NO: 2575445 - protein, 5 aa, Entamoeba histolytica
SVQTV

SEQ ID NO: 2575446 - protein, 7 aa, Entamoeba histolytica
SVQVGSG

SEQ ID NO: 2575447 - protein, 4 aa, Entamoeba histolytica
SVRD

SEQ ID NO: 2575448 - protein, 10 aa, Entamoeba histolytica
SVRGDGTGID

SEQ ID NO: 2575449 - protein, 6 aa, Entamoeba histolytica
SVRRAG

SEQ ID NO: 2575450 - protein, 6 aa, Entamoeba histolytica
SVSDIG

SEQ ID NO: 2575451 - protein, 6 aa, Entamoeba histolytica
SVSDPM

SEQ ID NO: 2575452 - protein, 13 aa, Entamoeba histolytica
SVSEQDKITEIEK

SEQ ID NO: 2575453 - protein, 4 aa, Entamoeba histolytica
SVSG

SEQ ID NO: 2575454 - protein, 7 aa, Entamoeba histolytica
SVSGAAV

SEQ ID NO: 2575455 - protein, 6 aa, Entamoeba histolytica
SVSGSI

SEQ ID NO: 2575456 - protein, 9 aa, Entamoeba histolytica
SVSKENQMS

SEQ ID NO: 2575457 - protein, 8 aa, Entamoeba histolytica
SVSKEVSE

SEQ ID NO: 2575458 - protein, 8 aa, Entamoeba histolytica
SVSNDRDC

SEQ ID NO: 2575459 - protein, 4 aa, Entamoeba histolytica
SVSS

SEQ ID NO: 2575460 - protein, 11 aa, Entamoeba histolytica
SVSSKPLKENK

SEQ ID NO: 2575461 - protein, 7 aa, Entamoeba histolytica
SVSSNAR

SEQ ID NO: 2575462 - protein, 6 aa, Entamoeba histolytica
SVSSNL

SEQ ID NO: 2575463 - protein, 14 aa, Entamoeba histolytica
SVTFKGSKFEGEDV

SEQ ID NO: 2575464 - protein, 17 aa, Entamoeba histolytica
SVTFNDSTIRPDVDEVA

SEQ ID NO: 2575465 - protein, 9 aa, Entamoeba histolytica
SVTKGLKEW

SEQ ID NO: 2575466 - protein, 15 aa, Entamoeba histolytica
SVTKRKRRKNNLPPR

SEQ ID NO: 2575467 - protein, 8 aa, Entamoeba histolytica
SVTTAKSN

SEQ ID NO: 2575468 - protein, 43 aa, Entamoeba histolytica
SVTYEDENKNKLKTSASRTSNKLKATSDNKKTFTATSSTISFP

SEQ ID NO: 2575469 - protein, 8 aa, Entamoeba histolytica
SWDNTEEC

SEQ ID NO: 2575470 - protein, 15 aa, Entamoeba histolytica
SWEKNTTKLPKLPTN

SEQ ID NO: 2575471 - protein, 5 aa, Entamoeba histolytica
SWGNK

SEQ ID NO: 2575472 - protein, 8 aa, Entamoeba histolytica
SWKETQSL

SEQ ID NO: 2575473 - protein, 9 aa, Entamoeba histolytica
SWKQEPDQR

SEQ ID NO: 2575474 - protein, 9 aa, Entamoeba histolytica
SWQQEPKER

SEQ ID NO: 2575475 - protein, 5 aa, Entamoeba histolytica
SYASI

SEQ ID NO: 2575476 - protein, 14 aa, Entamoeba histolytica
SYATYGTKGKRSSD

SEQ ID NO: 2575477 - protein, 11 aa, Entamoeba histolytica
SYDESTINQST

SEQ ID NO: 2575478 - protein, 6 aa, Entamoeba histolytica
SYDGTN

SEQ ID NO: 2575479 - protein, 14 aa, Entamoeba histolytica
SYDKEGSNKLWNIC

SEQ ID NO: 2575480 - protein, 11 aa, Entamoeba histolytica
SYDSYDHPHSQ

SEQ ID NO: 2575481 - protein, 9 aa, Entamoeba histolytica
SYDTEHNGE

SEQ ID NO: 2575482 - protein, 8 aa, Entamoeba histolytica
SYDTNTNK

SEQ ID NO: 2575483 - protein, 8 aa, Entamoeba histolytica
SYENENEM

SEQ ID NO: 2575484 - protein, 7 aa, Entamoeba histolytica
SYETTQK

SEQ ID NO: 2575485 - protein, 5 aa, Entamoeba histolytica
SYFPN

SEQ ID NO: 2575486 - protein, 7 aa, Entamoeba histolytica
SYGEHGH

SEQ ID NO: 2575487 - protein, 6 aa, Entamoeba histolytica
SYGESV

SEQ ID NO: 2575488 - protein, 4 aa, Entamoeba histolytica
SYGP

SEQ ID NO: 2575489 - protein, 9 aa, Entamoeba histolytica
SYGSDIDIS

SEQ ID NO: 2575490 - protein, 5 aa, Entamoeba histolytica
SYGTG

SEQ ID NO: 2575491 - protein, 5 aa, Entamoeba histolytica
SYIRS

SEQ ID NO: 2575492 - protein, 12 aa, Entamoeba histolytica
SYKNDSDNKKYG

SEQ ID NO: 2575493 - protein, 6 aa, Entamoeba histolytica
SYKQEK

SEQ ID NO: 2575494 - protein, 8 aa, Entamoeba histolytica
SYKSIRKE

SEQ ID NO: 2575495 - protein, 7 aa, Entamoeba histolytica
SYKSPHQ

SEQ ID NO: 2575496 - protein, 9 aa, Entamoeba histolytica
SYKSSEQTY

SEQ ID NO: 2575497 - protein, 10 aa, Entamoeba histolytica
SYKSSRDPHI

SEQ ID NO: 2575498 - protein, 42 aa, Entamoeba histolytica
SYKSYEEEKALRKTNSSIQIKPQTQQCNESTSQLGVEIEMNN

SEQ ID NO: 2575499 - protein, 13 aa, Entamoeba histolytica
SYKTESLEIQSRN

SEQ ID NO: 2575500 - protein, 10 aa, Entamoeba histolytica
SYLKGNEDNI

SEQ ID NO: 2575501 - protein, 9 aa, Entamoeba histolytica
SYNSRSSTI

SEQ ID NO: 2575502 - protein, 12 aa, Entamoeba histolytica
SYNTNTPCSSTS

SEQ ID NO: 2575503 - protein, 4 aa, Entamoeba histolytica
SYNV

SEQ ID NO: 2575504 - protein, 4 aa, Entamoeba histolytica
SYPD

SEQ ID NO: 2575505 - protein, 31 aa, Entamoeba histolytica
SYPSIPEDAVAPEEPNPDPDRLEDPPAEDSV

SEQ ID NO: 2575506 - protein, 5 aa, Entamoeba histolytica
SYPSK

SEQ ID NO: 2575507 - protein, 7 aa, Entamoeba histolytica
SYPSLRS

SEQ ID NO: 2575508 - protein, 9 aa, Entamoeba histolytica
SYQDEEGKT

SEQ ID NO: 2575509 - protein, 11 aa, Entamoeba histolytica
SYQDGSSYSTT

SEQ ID NO: 2575510 - protein, 25 aa, Entamoeba histolytica
SYQPDQREYNLPPPFEVPSSSTTEY

SEQ ID NO: 2575511 - protein, 5 aa, Entamoeba histolytica
SYQPT

SEQ ID NO: 2575512 - protein, 8 aa, Entamoeba histolytica
SYQSTQNP

SEQ ID NO: 2575513 - protein, 9 aa, Entamoeba histolytica
SYQTQPDTN

SEQ ID NO: 2575514 - protein, 8 aa, Entamoeba histolytica
SYRDNGIR

SEQ ID NO: 2575515 - protein, 7 aa, Entamoeba histolytica
SYRQNGI

SEQ ID NO: 2575516 - protein, 21 aa, Entamoeba histolytica
SYSDSSDCSTVPTTTKPNIED

SEQ ID NO: 2575517 - protein, 5 aa, Entamoeba histolytica
SYSDY

SEQ ID NO: 2575518 - protein, 4 aa, Entamoeba histolytica
SYSE

SEQ ID NO: 2575519 - protein, 6 aa, Entamoeba histolytica
SYSGAP

SEQ ID NO: 2575520 - protein, 6 aa, Entamoeba histolytica
SYSGRG

SEQ ID NO: 2575521 - protein, 7 aa, Entamoeba histolytica
SYSIPTN

SEQ ID NO: 2575522 - protein, 8 aa, Entamoeba histolytica
SYSLTETT

SEQ ID NO: 2575523 - protein, 6 aa, Entamoeba histolytica
SYSNGT

SEQ ID NO: 2575524 - protein, 16 aa, Entamoeba histolytica
SYSTLTSPSTDKNIST

SEQ ID NO: 2575525 - protein, 11 aa, Entamoeba histolytica
SYSTTAESNYR

SEQ ID NO: 2575526 - protein, 5 aa, Entamoeba histolytica
SYTDP

SEQ ID NO: 2575527 - protein, 16 aa, Entamoeba histolytica
SYTKSDEEATTNSEEC

SEQ ID NO: 2575528 - protein, 12 aa, Entamoeba histolytica
SYTQTGDAQTCS

SEQ ID NO: 2575529 - protein, 4 aa, Entamoeba histolytica
SYTR

SEQ ID NO: 2575530 - protein, 16 aa, Entamoeba histolytica
SYTTTTDCSGEQPTEQ

SEQ ID NO: 2575531 - protein, 6 aa, Entamoeba histolytica
SYVTEN

SEQ ID NO: 2575532 - protein, 8 aa, Entamoeba histolytica
SYYEKNGD

SEQ ID NO: 2575533 - protein, 7 aa, Entamoeba histolytica
SYYKGNI

SEQ ID NO: 2575534 - protein, 13 aa, Entamoeba histolytica
TACPDDYKQYADT

SEQ ID NO: 2575535 - protein, 12 aa, Entamoeba histolytica
TADAQQSELSSE

SEQ ID NO: 2575536 - protein, 7 aa, Entamoeba histolytica
TADKCEY

SEQ ID NO: 2575537 - protein, 8 aa, Entamoeba histolytica
TADLNDGK

SEQ ID NO: 2575538 - protein, 9 aa, Entamoeba histolytica
TADRAHKIK

SEQ ID NO: 2575539 - protein, 8 aa, Entamoeba histolytica
TADYSKTY

SEQ ID NO: 2575540 - protein, 12 aa, Entamoeba histolytica
TAEEDKDSAGVT

SEQ ID NO: 2575541 - protein, 7 aa, Entamoeba histolytica
TAEQNNA

SEQ ID NO: 2575542 - protein, 7 aa, Entamoeba histolytica
TAESEKV

SEQ ID NO: 2575543 - protein, 10 aa, Entamoeba histolytica
TAFSGESDRV

SEQ ID NO: 2575544 - protein, 7 aa, Entamoeba histolytica
TAGASIE

SEQ ID NO: 2575545 - protein, 8 aa, Entamoeba histolytica
TAGKSVDQ

SEQ ID NO: 2575546 - protein, 8 aa, Entamoeba histolytica
TAGQGQVD

SEQ ID NO: 2575547 - protein, 4 aa, Entamoeba histolytica
TAGR

SEQ ID NO: 2575548 - protein, 5 aa, Entamoeba histolytica
TAKAQ

SEQ ID NO: 2575549 - protein, 11 aa, Entamoeba histolytica
TAKDSSSKQCD

SEQ ID NO: 2575550 - protein, 17 aa, Entamoeba histolytica
TAKGENSLSDAGAIAEA

SEQ ID NO: 2575551 - protein, 7 aa, Entamoeba histolytica
TAKNTTT

SEQ ID NO: 2575552 - protein, 7 aa, Entamoeba histolytica
TAKTYTE

SEQ ID NO: 2575553 - protein, 6 aa, Entamoeba histolytica
TALSTH

SEQ ID NO: 2575554 - protein, 5 aa, Entamoeba histolytica
TALTS

SEQ ID NO: 2575555 - protein, 5 aa, Entamoeba histolytica
TANEM

SEQ ID NO: 2575556 - protein, 4 aa, Entamoeba histolytica
TANN

SEQ ID NO: 2575557 - protein, 8 aa, Entamoeba histolytica
TANQETCN

SEQ ID NO: 2575558 - protein, 14 aa, Entamoeba histolytica
TANSNGICDERNPI

SEQ ID NO: 2575559 - protein, 9 aa, Entamoeba histolytica
TANVDLQTE

SEQ ID NO: 2575560 - protein, 7 aa, Entamoeba histolytica
TAPDDFD

SEQ ID NO: 2575561 - protein, 6 aa, Entamoeba histolytica
TAPEIT

SEQ ID NO: 2575562 - protein, 8 aa, Entamoeba histolytica
TAPFESDV

SEQ ID NO: 2575563 - protein, 7 aa, Entamoeba histolytica
TAPPKLG

SEQ ID NO: 2575564 - protein, 4 aa, Entamoeba histolytica
TAPS

SEQ ID NO: 2575565 - protein, 11 aa, Entamoeba histolytica
TAPTPAARRAA

SEQ ID NO: 2575566 - protein, 5 aa, Entamoeba histolytica
TAPVK

SEQ ID NO: 2575567 - protein, 5 aa, Entamoeba histolytica
TAQKG

SEQ ID NO: 2575568 - protein, 7 aa, Entamoeba histolytica
TAQKYYN

SEQ ID NO: 2575569 - protein, 11 aa, Entamoeba histolytica
TAQLTEEPTKV

SEQ ID NO: 2575570 - protein, 8 aa, Entamoeba histolytica
TAQTNIKP

SEQ ID NO: 2575571 - protein, 10 aa, Entamoeba histolytica
TARKSTEDDW

SEQ ID NO: 2575572 - protein, 7 aa, Entamoeba histolytica
TASNFGI

SEQ ID NO: 2575573 - protein, 5 aa, Entamoeba histolytica
TASSD

SEQ ID NO: 2575574 - protein, 8 aa, Entamoeba histolytica
TASSVSDL

SEQ ID NO: 2575575 - protein, 7 aa, Entamoeba histolytica
TASTGEK

SEQ ID NO: 2575576 - protein, 14 aa, Entamoeba histolytica
TATDNNNSNKNTIP

SEQ ID NO: 2575577 - protein, 8 aa, Entamoeba histolytica
TATDSTQS

SEQ ID NO: 2575578 - protein, 7 aa, Entamoeba histolytica
TATLPTF

SEQ ID NO: 2575579 - protein, 4 aa, Entamoeba histolytica
TATQ

SEQ ID NO: 2575580 - protein, 7 aa, Entamoeba histolytica
TATRLNS

SEQ ID NO: 2575581 - protein, 8 aa, Entamoeba histolytica
TATSQFST

SEQ ID NO: 2575582 - protein, 4 aa, Entamoeba histolytica
TATT

SEQ ID NO: 2575583 - protein, 4 aa, Entamoeba histolytica
TAYP

SEQ ID NO: 2575584 - protein, 4 aa, Entamoeba histolytica
TCAQ

SEQ ID NO: 2575585 - protein, 11 aa, Entamoeba histolytica
TCDGSKDDKYQ

SEQ ID NO: 2575586 - protein, 17 aa, Entamoeba histolytica
TCDNGKVDEFEECDGGY

SEQ ID NO: 2575587 - protein, 9 aa, Entamoeba histolytica
TCDRESQRC

SEQ ID NO: 2575588 - protein, 8 aa, Entamoeba histolytica
TCDSETGN

SEQ ID NO: 2575589 - protein, 6 aa, Entamoeba histolytica
TCDSGA

SEQ ID NO: 2575590 - protein, 6 aa, Entamoeba histolytica
TCEIET

SEQ ID NO: 2575591 - protein, 4 aa, Entamoeba histolytica
TCEK

SEQ ID NO: 2575592 - protein, 8 aa, Entamoeba histolytica
TCETSTNM

SEQ ID NO: 2575593 - protein, 18 aa, Entamoeba histolytica
TCGKEQSSETIKSYDKEP

SEQ ID NO: 2575594 - protein, 19 aa, Entamoeba histolytica
TCGNEQIDEYEECDGGNGC

SEQ ID NO: 2575595 - protein, 17 aa, Entamoeba histolytica
TCGNGKIDAYEECDGGY

SEQ ID NO: 2575596 - protein, 19 aa, Entamoeba histolytica
TCGNGKINDYEECDGGEGC

SEQ ID NO: 2575597 - protein, 9 aa, Entamoeba histolytica
TCGNGQVDD

SEQ ID NO: 2575598 - protein, 17 aa, Entamoeba histolytica
TCGNGQVDDYEECDGGY

SEQ ID NO: 2575599 - protein, 15 aa, Entamoeba histolytica
TCGNKQKNEFEECDG

SEQ ID NO: 2575600 - protein, 19 aa, Entamoeba histolytica
TCGNNKIDEYEECDGGRGC

SEQ ID NO: 2575601 - protein, 6 aa, Entamoeba histolytica
TCGSTA

SEQ ID NO: 2575602 - protein, 6 aa, Entamoeba histolytica
TCHQDG

SEQ ID NO: 2575603 - protein, 4 aa, Entamoeba histolytica
TCKN

SEQ ID NO: 2575604 - protein, 5 aa, Entamoeba histolytica
TCKNY

SEQ ID NO: 2575605 - protein, 5 aa, Entamoeba histolytica
TCKPG

SEQ ID NO: 2575606 - protein, 13 aa, Entamoeba histolytica
TCKRKTNSDELDQ

SEQ ID NO: 2575607 - protein, 6 aa, Entamoeba histolytica
TCNEGY

SEQ ID NO: 2575608 - protein, 23 aa, Entamoeba histolytica
TCNENGLSNELQTIDTKTRCDDS

SEQ ID NO: 2575609 - protein, 6 aa, Entamoeba histolytica
TCNNAN

SEQ ID NO: 2575610 - protein, 8 aa, Entamoeba histolytica
TCNNSQDL

SEQ ID NO: 2575611 - protein, 4 aa, Entamoeba histolytica
TCNS

SEQ ID NO: 2575612 - protein, 9 aa, Entamoeba histolytica
TCNSPSEYD

SEQ ID NO: 2575613 - protein, 10 aa, Entamoeba histolytica
TCNTENGVNA

SEQ ID NO: 2575614 - protein, 31 aa, Entamoeba histolytica
TCPADTTYRTYTYDSKTGTCKATVKPTPSCS

SEQ ID NO: 2575615 - protein, 29 aa, Entamoeba histolytica
TCPADTTYRTYTYDSKTGTCKATVQPTPA

SEQ ID NO: 2575616 - protein, 11 aa, Entamoeba histolytica
TCPSKSGETKI

SEQ ID NO: 2575617 - protein, 9 aa, Entamoeba histolytica
TCQYSSANQ

SEQ ID NO: 2575618 - protein, 9 aa, Entamoeba histolytica
TCQYSSASQ

SEQ ID NO: 2575619 - protein, 8 aa, Entamoeba histolytica
TCRESDPY

SEQ ID NO: 2575620 - protein, 7 aa, Entamoeba histolytica
TCRPDGS

SEQ ID NO: 2575621 - protein, 13 aa, Entamoeba histolytica
TCSGDKCATCEDG

SEQ ID NO: 2575622 - protein, 6 aa, Entamoeba histolytica
TCSGTG

SEQ ID NO: 2575623 - protein, 7 aa, Entamoeba histolytica
TCSIDAE

SEQ ID NO: 2575624 - protein, 9 aa, Entamoeba histolytica
TCSNSASSC

SEQ ID NO: 2575625 - protein, 10 aa, Entamoeba histolytica
TCSPSTTSDS

SEQ ID NO: 2575626 - protein, 8 aa, Entamoeba histolytica
TCSQSVQY

SEQ ID NO: 2575627 - protein, 4 aa, Entamoeba histolytica
TCSS

SEQ ID NO: 2575628 - protein, 6 aa, Entamoeba histolytica
TCSSAT

SEQ ID NO: 2575629 - protein, 7 aa, Entamoeba histolytica
TCSSNGS

SEQ ID NO: 2575630 - protein, 6 aa, Entamoeba histolytica
TCSTCN

SEQ ID NO: 2575631 - protein, 5 aa, Entamoeba histolytica
TCSTT

SEQ ID NO: 2575632 - protein, 4 aa, Entamoeba histolytica
TCTN

SEQ ID NO: 2575633 - protein, 5 aa, Entamoeba histolytica
TCTQD

SEQ ID NO: 2575634 - protein, 6 aa, Entamoeba histolytica
TCTSCE

SEQ ID NO: 2575635 - protein, 6 aa, Entamoeba histolytica
TCYKSP

SEQ ID NO: 2575636 - protein, 9 aa, Entamoeba histolytica
TDAASSTHI

SEQ ID NO: 2575637 - protein, 8 aa, Entamoeba histolytica
TDAESSLS

SEQ ID NO: 2575638 - protein, 6 aa, Entamoeba histolytica
TDAEVG

SEQ ID NO: 2575639 - protein, 7 aa, Entamoeba histolytica
TDAIQSK

SEQ ID NO: 2575640 - protein, 24 aa, Entamoeba histolytica
TDAIRSAEYAESVEGVRGETKEEC

SEQ ID NO: 2575641 - protein, 8 aa, Entamoeba histolytica
TDASSSTF

SEQ ID NO: 2575642 - protein, 6 aa, Entamoeba histolytica
TDCSDT

SEQ ID NO: 2575643 - protein, 6 aa, Entamoeba histolytica
TDDEIK

SEQ ID NO: 2575644 - protein, 4 aa, Entamoeba histolytica
TDDF

SEQ ID NO: 2575645 - protein, 5 aa, Entamoeba histolytica
TDDIG

SEQ ID NO: 2575646 - protein, 10 aa, Entamoeba histolytica
TDDSNTEEEY

SEQ ID NO: 2575647 - protein, 19 aa, Entamoeba histolytica
TDDVKNELAQRQAAWANKG

SEQ ID NO: 2575648 - protein, 19 aa, Entamoeba histolytica
TDEDVNINDPNATNSNKAF

SEQ ID NO: 2575649 - protein, 6 aa, Entamoeba histolytica
TDEEER

SEQ ID NO: 2575650 - protein, 28 aa, Entamoeba histolytica
TDEIKKEGNETKSPETENKNKKSIEEVE

SEQ ID NO: 2575651 - protein, 6 aa, Entamoeba histolytica
TDEKGA

SEQ ID NO: 2575652 - protein, 6 aa, Entamoeba histolytica
TDEKSC

SEQ ID NO: 2575653 - protein, 7 aa, Entamoeba histolytica
TDEWKGE

SEQ ID NO: 2575654 - protein, 9 aa, Entamoeba histolytica
TDFEKARRS

SEQ ID NO: 2575655 - protein, 8 aa, Entamoeba histolytica
TDFGSARN

SEQ ID NO: 2575656 - protein, 11 aa, Entamoeba histolytica
TDFGSSRNINS

SEQ ID NO: 2575657 - protein, 10 aa, Entamoeba histolytica
TDFGSSRNVN

SEQ ID NO: 2575658 - protein, 11 aa, Entamoeba histolytica
TDFGSSRSITL

SEQ ID NO: 2575659 - protein, 19 aa, Entamoeba histolytica
TDFGTSRIKRNSDKGLGTP

SEQ ID NO: 2575660 - protein, 4 aa, Entamoeba histolytica
TDFN

SEQ ID NO: 2575661 - protein, 11 aa, Entamoeba histolytica
TDFPPTPDQYK

SEQ ID NO: 2575662 - protein, 11 aa, Entamoeba histolytica
TDGCSKDSKLA

SEQ ID NO: 2575663 - protein, 11 aa, Entamoeba histolytica
TDGEICPGEYA

SEQ ID NO: 2575664 - protein, 6 aa, Entamoeba histolytica
TDGFLG

SEQ ID NO: 2575665 - protein, 10 aa, Entamoeba histolytica
TDGKKETSLH

SEQ ID NO: 2575666 - protein, 7 aa, Entamoeba histolytica
TDGSTLT

SEQ ID NO: 2575667 - protein, 9 aa, Entamoeba histolytica
TDHDKQTQE

SEQ ID NO: 2575668 - protein, 8 aa, Entamoeba histolytica
TDIKDNSI

SEQ ID NO: 2575669 - protein, 4 aa, Entamoeba histolytica
TDIN

SEQ ID NO: 2575670 - protein, 4 aa, Entamoeba histolytica
TDIP

SEQ ID NO: 2575671 - protein, 6 aa, Entamoeba histolytica
TDIPGQ

SEQ ID NO: 2575672 - protein, 5 aa, Entamoeba histolytica
TDIRK

SEQ ID NO: 2575673 - protein, 7 aa, Entamoeba histolytica
TDITQQK

SEQ ID NO: 2575674 - protein, 15 aa, Entamoeba histolytica
TDKENYSMQDNSNTL

SEQ ID NO: 2575675 - protein, 10 aa, Entamoeba histolytica
TDKNNKPTNV

SEQ ID NO: 2575676 - protein, 9 aa, Entamoeba histolytica
TDKPEDKTN

SEQ ID NO: 2575677 - protein, 12 aa, Entamoeba histolytica
TDKSKKPTDETL

SEQ ID NO: 2575678 - protein, 63 aa, Entamoeba histolytica
TDKSNSTKGHSGSTRTETKSQEFSSSEKRYSINTSSSSTTHNMEDSKENEESIGTSTSSQVIS

SEQ ID NO: 2575679 - protein, 8 aa, Entamoeba histolytica
TDKSTNKR

SEQ ID NO: 2575680 - protein, 7 aa, Entamoeba histolytica
TDKTCTC

SEQ ID NO: 2575681 - protein, 10 aa, Entamoeba histolytica
TDKTGTLTEN

SEQ ID NO: 2575682 - protein, 10 aa, Entamoeba histolytica
TDKTSQVRKD

SEQ ID NO: 2575683 - protein, 6 aa, Entamoeba histolytica
TDLHRE

SEQ ID NO: 2575684 - protein, 5 aa, Entamoeba histolytica
TDLPE

SEQ ID NO: 2575685 - protein, 4 aa, Entamoeba histolytica
TDLR

SEQ ID NO: 2575686 - protein, 15 aa, Entamoeba histolytica
TDLSTSNNSKYQKKI

SEQ ID NO: 2575687 - protein, 5 aa, Entamoeba histolytica
TDMKD

SEQ ID NO: 2575688 - protein, 8 aa, Entamoeba histolytica
TDNGSNGV

SEQ ID NO: 2575689 - protein, 4 aa, Entamoeba histolytica
TDNK

SEQ ID NO: 2575690 - protein, 17 aa, Entamoeba histolytica
TDNNKALKINKKNQKIS

SEQ ID NO: 2575691 - protein, 13 aa, Entamoeba histolytica
TDNPFSVTKPTTT

SEQ ID NO: 2575692 - protein, 8 aa, Entamoeba histolytica
TDNPPRGE

SEQ ID NO: 2575693 - protein, 9 aa, Entamoeba histolytica
TDNTDSYYS

SEQ ID NO: 2575694 - protein, 7 aa, Entamoeba histolytica
TDNTPTL

SEQ ID NO: 2575695 - protein, 9 aa, Entamoeba histolytica
TDPFPKSID

SEQ ID NO: 2575696 - protein, 9 aa, Entamoeba histolytica
TDPGDGSNI

SEQ ID NO: 2575697 - protein, 7 aa, Entamoeba histolytica
TDPKGAS

SEQ ID NO: 2575698 - protein, 5 aa, Entamoeba histolytica
TDPKQ

SEQ ID NO: 2575699 - protein, 6 aa, Entamoeba histolytica
TDPLKT

SEQ ID NO: 2575700 - protein, 8 aa, Entamoeba histolytica
TDPSGSNI

SEQ ID NO: 2575701 - protein, 7 aa, Entamoeba histolytica
TDPSRKL

SEQ ID NO: 2575702 - protein, 10 aa, Entamoeba histolytica
TDPTDKGTNY

SEQ ID NO: 2575703 - protein, 8 aa, Entamoeba histolytica
TDPTGLER

SEQ ID NO: 2575704 - protein, 4 aa, Entamoeba histolytica
TDQN

SEQ ID NO: 2575705 - protein, 9 aa, Entamoeba histolytica
TDQNNKSPI

SEQ ID NO: 2575706 - protein, 9 aa, Entamoeba histolytica
TDQPSINEQ

SEQ ID NO: 2575707 - protein, 12 aa, Entamoeba histolytica
TDQSSVDIKPPT

SEQ ID NO: 2575708 - protein, 24 aa, Entamoeba histolytica
TDQTCSDVSSVGYDDNTCGGSNPR

SEQ ID NO: 2575709 - protein, 6 aa, Entamoeba histolytica
TDRERV

SEQ ID NO: 2575710 - protein, 6 aa, Entamoeba histolytica
TDRKVA

SEQ ID NO: 2575711 - protein, 5 aa, Entamoeba histolytica
TDRPD

SEQ ID NO: 2575712 - protein, 16 aa, Entamoeba histolytica
TDSKGIDKKEISNNEI

SEQ ID NO: 2575713 - protein, 17 aa, Entamoeba histolytica
TDSLRGTTTISNSERQL

SEQ ID NO: 2575714 - protein, 4 aa, Entamoeba histolytica
TDSS

SEQ ID NO: 2575715 - protein, 9 aa, Entamoeba histolytica
TDSSEYGDI

SEQ ID NO: 2575716 - protein, 5 aa, Entamoeba histolytica
TDSSV

SEQ ID NO: 2575717 - protein, 8 aa, Entamoeba histolytica
TDSTIQTD

SEQ ID NO: 2575718 - protein, 9 aa, Entamoeba histolytica
TDSTNNQRI

SEQ ID NO: 2575719 - protein, 4 aa, Entamoeba histolytica
TDSY

SEQ ID NO: 2575720 - protein, 6 aa, Entamoeba histolytica
TDSYGI

SEQ ID NO: 2575721 - protein, 11 aa, Entamoeba histolytica
TDSYGTPRYGE

SEQ ID NO: 2575722 - protein, 19 aa, Entamoeba histolytica
TDTLGGNYTIKKGTANVVG

SEQ ID NO: 2575723 - protein, 6 aa, Entamoeba histolytica
TDTPDS

SEQ ID NO: 2575724 - protein, 6 aa, Entamoeba histolytica
TDTPNN

SEQ ID NO: 2575725 - protein, 4 aa, Entamoeba histolytica
TDTT

SEQ ID NO: 2575726 - protein, 4 aa, Entamoeba histolytica
TDTV

SEQ ID NO: 2575727 - protein, 6 aa, Entamoeba histolytica
TDVPSS

SEQ ID NO: 2575728 - protein, 7 aa, Entamoeba histolytica
TDWKATS

SEQ ID NO: 2575729 - protein, 17 aa, Entamoeba histolytica
TDYDAAPYDGSKTLPES

SEQ ID NO: 2575730 - protein, 6 aa, Entamoeba histolytica
TDYGEQ

SEQ ID NO: 2575731 - protein, 4 aa, Entamoeba histolytica
TDYN

SEQ ID NO: 2575732 - protein, 9 aa, Entamoeba histolytica
TEAAGSTHI

SEQ ID NO: 2575733 - protein, 28 aa, Entamoeba histolytica
TEAEEEQEISNQGDTTEENKNDVTEDVE

SEQ ID NO: 2575734 - protein, 9 aa, Entamoeba histolytica
TEAKGNFVE

SEQ ID NO: 2575735 - protein, 8 aa, Entamoeba histolytica
TEATKAPI

SEQ ID NO: 2575736 - protein, 11 aa, Entamoeba histolytica
TECGVNEETEL

SEQ ID NO: 2575737 - protein, 12 aa, Entamoeba histolytica
TECKEQVGDITG

SEQ ID NO: 2575738 - protein, 8 aa, Entamoeba histolytica
TEDCDSGL

SEQ ID NO: 2575739 - protein, 14 aa, Entamoeba histolytica
TEDDNNSNNKNESI

SEQ ID NO: 2575740 - protein, 6 aa, Entamoeba histolytica
TEDSSS

SEQ ID NO: 2575741 - protein, 4 aa, Entamoeba histolytica
TEDY

SEQ ID NO: 2575742 - protein, 5 aa, Entamoeba histolytica
TEDYN

SEQ ID NO: 2575743 - protein, 10 aa, Entamoeba histolytica
TEECNELETS

SEQ ID NO: 2575744 - protein, 8 aa, Entamoeba histolytica
TEECTDFK

SEQ ID NO: 2575745 - protein, 12 aa, Entamoeba histolytica
TEEDIDQQQRDS

SEQ ID NO: 2575746 - protein, 8 aa, Entamoeba histolytica
TEEEDETV

SEQ ID NO: 2575747 - protein, 6 aa, Entamoeba histolytica
TEEEGQ

SEQ ID NO: 2575748 - protein, 7 aa, Entamoeba histolytica
TEEEMNE

SEQ ID NO: 2575749 - protein, 5 aa, Entamoeba histolytica
TEEET

SEQ ID NO: 2575750 - protein, 8 aa, Entamoeba histolytica
TEEETNEL

SEQ ID NO: 2575751 - protein, 6 aa, Entamoeba histolytica
TEEEYP

SEQ ID NO: 2575752 - protein, 5 aa, Entamoeba histolytica
TEEGS

SEQ ID NO: 2575753 - protein, 4 aa, Entamoeba histolytica
TEEH

SEQ ID NO: 2575754 - protein, 6 aa, Entamoeba histolytica
TEEKDS

SEQ ID NO: 2575755 - protein, 4 aa, Entamoeba histolytica
TEEL

SEQ ID NO: 2575756 - protein, 8 aa, Entamoeba histolytica
TEEQAKPY

SEQ ID NO: 2575757 - protein, 10 aa, Entamoeba histolytica
TEEQLKEKAE

SEQ ID NO: 2575758 - protein, 6 aa, Entamoeba histolytica
TEEQTI

SEQ ID NO: 2575759 - protein, 4 aa, Entamoeba histolytica
TEER

SEQ ID NO: 2575760 - protein, 8 aa, Entamoeba histolytica
TEESPVPE

SEQ ID NO: 2575761 - protein, 5 aa, Entamoeba histolytica
TEGEE

SEQ ID NO: 2575762 - protein, 8 aa, Entamoeba histolytica
TEGFDEND

SEQ ID NO: 2575763 - protein, 6 aa, Entamoeba histolytica
TEGFNK

SEQ ID NO: 2575764 - protein, 6 aa, Entamoeba histolytica
TEGIPI

SEQ ID NO: 2575765 - protein, 17 aa, Entamoeba histolytica
TEGNGAITLTGKSDSTL

SEQ ID NO: 2575766 - protein, 7 aa, Entamoeba histolytica
TEGPNNS

SEQ ID NO: 2575767 - protein, 12 aa, Entamoeba histolytica
TEGSIIKNSNSI

SEQ ID NO: 2575768 - protein, 9 aa, Entamoeba histolytica
TEHENGKKM

SEQ ID NO: 2575769 - protein, 5 aa, Entamoeba histolytica
TEHSD

SEQ ID NO: 2575770 - protein, 5 aa, Entamoeba histolytica
TEIAG

SEQ ID NO: 2575771 - protein, 11 aa, Entamoeba histolytica
TEIDDQQDAVV

SEQ ID NO: 2575772 - protein, 4 aa, Entamoeba histolytica
TEIE

SEQ ID NO: 2575773 - protein, 12 aa, Entamoeba histolytica
TEIKDPNNKEKM

SEQ ID NO: 2575774 - protein, 5 aa, Entamoeba histolytica
TEIKN

SEQ ID NO: 2575775 - protein, 7 aa, Entamoeba histolytica
TEISHPT

SEQ ID NO: 2575776 - protein, 4 aa, Entamoeba histolytica
TEIT

SEQ ID NO: 2575777 - protein, 6 aa, Entamoeba histolytica
TEITTR

SEQ ID NO: 2575778 - protein, 11 aa, Entamoeba histolytica
TEKAHSSRSKC

SEQ ID NO: 2575779 - protein, 8 aa, Entamoeba histolytica
TEKDFMES

SEQ ID NO: 2575780 - protein, 10 aa, Entamoeba histolytica
TEKEGRASIS

SEQ ID NO: 2575781 - protein, 7 aa, Entamoeba histolytica
TEKELTT

SEQ ID NO: 2575782 - protein, 23 aa, Entamoeba histolytica
TEKERNILDTKSKKEKRLTSTVD

SEQ ID NO: 2575783 - protein, 5 aa, Entamoeba histolytica
TEKEY

SEQ ID NO: 2575784 - protein, 4 aa, Entamoeba histolytica
TEKF

SEQ ID NO: 2575785 - protein, 11 aa, Entamoeba histolytica
TEKGCSKCTEG

SEQ ID NO: 2575786 - protein, 11 aa, Entamoeba histolytica
TEKGKKSTNKL

SEQ ID NO: 2575787 - protein, 10 aa, Entamoeba histolytica
TEKQHSTELN

SEQ ID NO: 2575788 - protein, 9 aa, Entamoeba histolytica
TEKSGERLK

SEQ ID NO: 2575789 - protein, 7 aa, Entamoeba histolytica
TEKTGKL

SEQ ID NO: 2575790 - protein, 14 aa, Entamoeba histolytica
TEKTKTKGKINYEN

SEQ ID NO: 2575791 - protein, 6 aa, Entamoeba histolytica
TEKTQL

SEQ ID NO: 2575792 - protein, 4 aa, Entamoeba histolytica
TEKY

SEQ ID NO: 2575793 - protein, 6 aa, Entamoeba histolytica
TELDRS

SEQ ID NO: 2575794 - protein, 6 aa, Entamoeba histolytica
TELESK

SEQ ID NO: 2575795 - protein, 4 aa, Entamoeba histolytica
TELG

SEQ ID NO: 2575796 - protein, 9 aa, Entamoeba histolytica
TELKNEKSI

SEQ ID NO: 2575797 - protein, 4 aa, Entamoeba histolytica
TELM

SEQ ID NO: 2575798 - protein, 15 aa, Entamoeba histolytica
TELNTLKKEDNVKKE

SEQ ID NO: 2575799 - protein, 4 aa, Entamoeba histolytica
TELP

SEQ ID NO: 2575800 - protein, 25 aa, Entamoeba histolytica
TELPEEDAMDSASAFNTQDKPKPFP

SEQ ID NO: 2575801 - protein, 9 aa, Entamoeba histolytica
TELQNPKYS

SEQ ID NO: 2575802 - protein, 12 aa, Entamoeba histolytica
TELTPPKNSTSI

SEQ ID NO: 2575803 - protein, 4 aa, Entamoeba histolytica
TENE

SEQ ID NO: 2575804 - protein, 6 aa, Entamoeba histolytica
TENEIP

SEQ ID NO: 2575805 - protein, 16 aa, Entamoeba histolytica
TENEKDGKGRKTVACN

SEQ ID NO: 2575806 - protein, 13 aa, Entamoeba histolytica
TENEVKMKSTPKI

SEQ ID NO: 2575807 - protein, 8 aa, Entamoeba histolytica
TENKDGMI

SEQ ID NO: 2575808 - protein, 8 aa, Entamoeba histolytica
TENRNELN

SEQ ID NO: 2575809 - protein, 7 aa, Entamoeba histolytica
TENSKCS

SEQ ID NO: 2575810 - protein, 5 aa, Entamoeba histolytica
TENSM

SEQ ID NO: 2575811 - protein, 14 aa, Entamoeba histolytica
TENVIQSDSTTREI

SEQ ID NO: 2575812 - protein, 6 aa, Entamoeba histolytica
TEPDSI

SEQ ID NO: 2575813 - protein, 7 aa, Entamoeba histolytica
TEPEEDD

SEQ ID NO: 2575814 - protein, 5 aa, Entamoeba histolytica
TEPKN

SEQ ID NO: 2575815 - protein, 57 aa, Entamoeba histolytica
TEPKPEVENEISKPLDENNSNSKESASSSSSASEKSSDVKKEDISKSESRSSASSDD

SEQ ID NO: 2575816 - protein, 8 aa, Entamoeba histolytica
TEPKTDSS

SEQ ID NO: 2575817 - protein, 8 aa, Entamoeba histolytica
TEPPKTRY

SEQ ID NO: 2575818 - protein, 6 aa, Entamoeba histolytica
TEPPLE

SEQ ID NO: 2575819 - protein, 4 aa, Entamoeba histolytica
TEQE

SEQ ID NO: 2575820 - protein, 10 aa, Entamoeba histolytica
TEQEEDVDDG

SEQ ID NO: 2575821 - protein, 5 aa, Entamoeba histolytica
TEQFH

SEQ ID NO: 2575822 - protein, 12 aa, Entamoeba histolytica
TEQGHSKIKSYK

SEQ ID NO: 2575823 - protein, 11 aa, Entamoeba histolytica
TEQKLKKREMK

SEQ ID NO: 2575824 - protein, 7 aa, Entamoeba histolytica
TEQNDPY

SEQ ID NO: 2575825 - protein, 7 aa, Entamoeba histolytica
TEQNSSD

SEQ ID NO: 2575826 - protein, 8 aa, Entamoeba histolytica
TEQPFPDN

SEQ ID NO: 2575827 - protein, 7 aa, Entamoeba histolytica
TEQPIAA

SEQ ID NO: 2575828 - protein, 8 aa, Entamoeba histolytica
TEQRKESV

SEQ ID NO: 2575829 - protein, 6 aa, Entamoeba histolytica
TEQRNI

SEQ ID NO: 2575830 - protein, 19 aa, Entamoeba histolytica
TEQSKSNSSHDSSNDQEII

SEQ ID NO: 2575831 - protein, 4 aa, Entamoeba histolytica
TEQV

SEQ ID NO: 2575832 - protein, 4 aa, Entamoeba histolytica
TERD

SEQ ID NO: 2575833 - protein, 4 aa, Entamoeba histolytica
TERE

SEQ ID NO: 2575834 - protein, 5 aa, Entamoeba histolytica
TEREV

SEQ ID NO: 2575835 - protein, 12 aa, Entamoeba histolytica
TERGKNKFGRHT

SEQ ID NO: 2575836 - protein, 11 aa, Entamoeba histolytica
TERIPSEDIQN

SEQ ID NO: 2575837 - protein, 6 aa, Entamoeba histolytica
TERKLP

SEQ ID NO: 2575838 - protein, 6 aa, Entamoeba histolytica
TERNDI

SEQ ID NO: 2575839 - protein, 8 aa, Entamoeba histolytica
TERNERVR

SEQ ID NO: 2575840 - protein, 4 aa, Entamoeba histolytica
TERP

SEQ ID NO: 2575841 - protein, 4 aa, Entamoeba histolytica
TERR

SEQ ID NO: 2575842 - protein, 13 aa, Entamoeba histolytica
TESIVNKEERNRE

SEQ ID NO: 2575843 - protein, 5 aa, Entamoeba histolytica
TESKI

SEQ ID NO: 2575844 - protein, 5 aa, Entamoeba histolytica
TESKV

SEQ ID NO: 2575845 - protein, 4 aa, Entamoeba histolytica
TESN

SEQ ID NO: 2575846 - protein, 14 aa, Entamoeba histolytica
TESQETSKRKKKDC

SEQ ID NO: 2575847 - protein, 15 aa, Entamoeba histolytica
TESQETSKRKKKDCR

SEQ ID NO: 2575848 - protein, 20 aa, Entamoeba histolytica
TESQETSKRKKKDCSYYTKK

SEQ ID NO: 2575849 - protein, 20 aa, Entamoeba histolytica
TESRCKRGNSINARKEREFK

SEQ ID NO: 2575850 - protein, 10 aa, Entamoeba histolytica
TESTKERKEF

SEQ ID NO: 2575851 - protein, 11 aa, Entamoeba histolytica
TESYKGEENKK

SEQ ID NO: 2575852 - protein, 6 aa, Entamoeba histolytica
TESYQK

SEQ ID NO: 2575853 - protein, 8 aa, Entamoeba histolytica
TESYTDTI

SEQ ID NO: 2575854 - protein, 6 aa, Entamoeba histolytica
TETCSG

SEQ ID NO: 2575855 - protein, 5 aa, Entamoeba histolytica
TETEV

SEQ ID NO: 2575856 - protein, 6 aa, Entamoeba histolytica
TETGNK

SEQ ID NO: 2575857 - protein, 6 aa, Entamoeba histolytica
TETGTF

SEQ ID NO: 2575858 - protein, 9 aa, Entamoeba histolytica
TETINGSEK

SEQ ID NO: 2575859 - protein, 10 aa, Entamoeba histolytica
TETKGNKTHL

SEQ ID NO: 2575860 - protein, 6 aa, Entamoeba histolytica
TETNGV

SEQ ID NO: 2575861 - protein, 6 aa, Entamoeba histolytica
TETNST

SEQ ID NO: 2575862 - protein, 4 aa, Entamoeba histolytica
TETP

SEQ ID NO: 2575863 - protein, 30 aa, Entamoeba histolytica
TETPTEDSTSSSQEGCSYRDQEKQSTENIL

SEQ ID NO: 2575864 - protein, 10 aa, Entamoeba histolytica
TETSNETNTP

SEQ ID NO: 2575865 - protein, 15 aa, Entamoeba histolytica
TEVDQEPKQEETKTV

SEQ ID NO: 2575866 - protein, 5 aa, Entamoeba histolytica
TEVKQ

SEQ ID NO: 2575867 - protein, 9 aa, Entamoeba histolytica
TEVQGDEFR

SEQ ID NO: 2575868 - protein, 4 aa, Entamoeba histolytica
TEVR

SEQ ID NO: 2575869 - protein, 17 aa, Entamoeba histolytica
TEYAGHEQEIAEKTDFS

SEQ ID NO: 2575870 - protein, 6 aa, Entamoeba histolytica
TEYENN

SEQ ID NO: 2575871 - protein, 15 aa, Entamoeba histolytica
TEYPSFREGTTTGLA

SEQ ID NO: 2575872 - protein, 6 aa, Entamoeba histolytica
TEYQPL

SEQ ID NO: 2575873 - protein, 7 aa, Entamoeba histolytica
TFAEPSI

SEQ ID NO: 2575874 - protein, 16 aa, Entamoeba histolytica
TFARSSPPLPSTPLSQ

SEQ ID NO: 2575875 - protein, 19 aa, Entamoeba histolytica
TFDEKTNTNLAGKNTGKLS

SEQ ID NO: 2575876 - protein, 6 aa, Entamoeba histolytica
TFDENF

SEQ ID NO: 2575877 - protein, 13 aa, Entamoeba histolytica
TFDETNTEIPTSF

SEQ ID NO: 2575878 - protein, 6 aa, Entamoeba histolytica
TFDGKN

SEQ ID NO: 2575879 - protein, 5 aa, Entamoeba histolytica
TFDSE

SEQ ID NO: 2575880 - protein, 6 aa, Entamoeba histolytica
TFDSNQ

SEQ ID NO: 2575881 - protein, 9 aa, Entamoeba histolytica
TFEEQKEDL

SEQ ID NO: 2575882 - protein, 13 aa, Entamoeba histolytica
TFERGDTQETIKS

SEQ ID NO: 2575883 - protein, 5 aa, Entamoeba histolytica
TFESK

SEQ ID NO: 2575884 - protein, 8 aa, Entamoeba histolytica
TFGEDEED

SEQ ID NO: 2575885 - protein, 6 aa, Entamoeba histolytica
TFKENQ

SEQ ID NO: 2575886 - protein, 12 aa, Entamoeba histolytica
TFKKDNSSSSSS

SEQ ID NO: 2575887 - protein, 4 aa, Entamoeba histolytica
TFKN

SEQ ID NO: 2575888 - protein, 11 aa, Entamoeba histolytica
TFNNDNEKEQL

SEQ ID NO: 2575889 - protein, 5 aa, Entamoeba histolytica
TFNNN

SEQ ID NO: 2575890 - protein, 4 aa, Entamoeba histolytica
TFNS

SEQ ID NO: 2575891 - protein, 4 aa, Entamoeba histolytica
TFPT

SEQ ID NO: 2575892 - protein, 14 aa, Entamoeba histolytica
TFQKTVESQYSPIT

SEQ ID NO: 2575893 - protein, 11 aa, Entamoeba histolytica
TFQKYPGKREC

SEQ ID NO: 2575894 - protein, 7 aa, Entamoeba histolytica
TFQNEDG

SEQ ID NO: 2575895 - protein, 4 aa, Entamoeba histolytica
TFQR

SEQ ID NO: 2575896 - protein, 10 aa, Entamoeba histolytica
TFQSGSPDEI

SEQ ID NO: 2575897 - protein, 5 aa, Entamoeba histolytica
TFRGK

SEQ ID NO: 2575898 - protein, 7 aa, Entamoeba histolytica
TFSDSDE

SEQ ID NO: 2575899 - protein, 9 aa, Entamoeba histolytica
TFSHSQDNI

SEQ ID NO: 2575900 - protein, 6 aa, Entamoeba histolytica
TFSNTY

SEQ ID NO: 2575901 - protein, 7 aa, Entamoeba histolytica
TFSSGDR

SEQ ID NO: 2575902 - protein, 14 aa, Entamoeba histolytica
TFSSPKSSQDRTVS

SEQ ID NO: 2575903 - protein, 6 aa, Entamoeba histolytica
TFSTEY

SEQ ID NO: 2575904 - protein, 4 aa, Entamoeba histolytica
TFSV

SEQ ID NO: 2575905 - protein, 5 aa, Entamoeba histolytica
TFTIN

SEQ ID NO: 2575906 - protein, 4 aa, Entamoeba histolytica
TFYD

SEQ ID NO: 2575907 - protein, 6 aa, Entamoeba histolytica
TGAGLN

SEQ ID NO: 2575908 - protein, 5 aa, Entamoeba histolytica
TGAKN

SEQ ID NO: 2575909 - protein, 9 aa, Entamoeba histolytica
TGASTSEYY

SEQ ID NO: 2575910 - protein, 7 aa, Entamoeba histolytica
TGCGKTT

SEQ ID NO: 2575911 - protein, 9 aa, Entamoeba histolytica
TGCGKTTQL

SEQ ID NO: 2575912 - protein, 9 aa, Entamoeba histolytica
TGCNKEKTN

SEQ ID NO: 2575913 - protein, 13 aa, Entamoeba histolytica
TGCTKCKEKYSGE

SEQ ID NO: 2575914 - protein, 11 aa, Entamoeba histolytica
TGDEQKEYEQP

SEQ ID NO: 2575915 - protein, 4 aa, Entamoeba histolytica
TGDF

SEQ ID NO: 2575916 - protein, 10 aa, Entamoeba histolytica
TGDGTNDVPA

SEQ ID NO: 2575917 - protein, 5 aa, Entamoeba histolytica
TGDKI

SEQ ID NO: 2575918 - protein, 14 aa, Entamoeba histolytica
TGDLERNDDGSNHG

SEQ ID NO: 2575919 - protein, 11 aa, Entamoeba histolytica
TGDLERNIDGA

SEQ ID NO: 2575920 - protein, 4 aa, Entamoeba histolytica
TGEC

SEQ ID NO: 2575921 - protein, 13 aa, Entamoeba histolytica
TGEDGTKSKETVR

SEQ ID NO: 2575922 - protein, 5 aa, Entamoeba histolytica
TGEGK

SEQ ID NO: 2575923 - protein, 10 aa, Entamoeba histolytica
TGEKVKEAQM

SEQ ID NO: 2575924 - protein, 6 aa, Entamoeba histolytica
TGELTS

SEQ ID NO: 2575925 - protein, 8 aa, Entamoeba histolytica
TGESETDW

SEQ ID NO: 2575926 - protein, 14 aa, Entamoeba histolytica
TGESSKKEDLNTPQ

SEQ ID NO: 2575927 - protein, 17 aa, Entamoeba histolytica
TGETDELGENAKSKANQ

SEQ ID NO: 2575928 - protein, 5 aa, Entamoeba histolytica
TGETE

SEQ ID NO: 2575929 - protein, 7 aa, Entamoeba histolytica
TGETTMN

SEQ ID NO: 2575930 - protein, 7 aa, Entamoeba histolytica
TGEVENL

SEQ ID NO: 2575931 - protein, 16 aa, Entamoeba histolytica
TGFDIEEGNVEKKEEK

SEQ ID NO: 2575932 - protein, 6 aa, Entamoeba histolytica
TGFDNL

SEQ ID NO: 2575933 - protein, 7 aa, Entamoeba histolytica
TGFDNSS

SEQ ID NO: 2575934 - protein, 4 aa, Entamoeba histolytica
TGGF

SEQ ID NO: 2575935 - protein, 9 aa, Entamoeba histolytica
TGGKTTGCC

SEQ ID NO: 2575936 - protein, 5 aa, Entamoeba histolytica
TGGNS

SEQ ID NO: 2575937 - protein, 7 aa, Entamoeba histolytica
TGGQETL

SEQ ID NO: 2575938 - protein, 5 aa, Entamoeba histolytica
TGGQG

SEQ ID NO: 2575939 - protein, 9 aa, Entamoeba histolytica
TGHGKSSLG

SEQ ID NO: 2575940 - protein, 6 aa, Entamoeba histolytica
TGIAES

SEQ ID NO: 2575941 - protein, 21 aa, Entamoeba histolytica
TGIDEETPNCCGTSSCNEREL

SEQ ID NO: 2575942 - protein, 22 aa, Entamoeba histolytica
TGIELKQNKSGWTSCRKNKQVN

SEQ ID NO: 2575943 - protein, 7 aa, Entamoeba histolytica
TGIKPEE

SEQ ID NO: 2575944 - protein, 4 aa, Entamoeba histolytica
TGIN

SEQ ID NO: 2575945 - protein, 8 aa, Entamoeba histolytica
TGISEDSI

SEQ ID NO: 2575946 - protein, 6 aa, Entamoeba histolytica
TGISSF

SEQ ID NO: 2575947 - protein, 8 aa, Entamoeba histolytica
TGKATYKE

SEQ ID NO: 2575948 - protein, 9 aa, Entamoeba histolytica
TGKCDTSTG

SEQ ID NO: 2575949 - protein, 4 aa, Entamoeba histolytica
TGKI

SEQ ID NO: 2575950 - protein, 11 aa, Entamoeba histolytica
TGKKLKGHGRR

SEQ ID NO: 2575951 - protein, 12 aa, Entamoeba histolytica
TGKLTTNIHDAF

SEQ ID NO: 2575952 - protein, 9 aa, Entamoeba histolytica
TGKNCSGSI

SEQ ID NO: 2575953 - protein, 5 aa, Entamoeba histolytica
TGKSR

SEQ ID NO: 2575954 - protein, 8 aa, Entamoeba histolytica
TGKTTNCQ

SEQ ID NO: 2575955 - protein, 9 aa, Entamoeba histolytica
TGKVENNFV

SEQ ID NO: 2575956 - protein, 13 aa, Entamoeba histolytica
TGLAGGWGKGETQ

SEQ ID NO: 2575957 - protein, 11 aa, Entamoeba histolytica
TGLGDLGNPVA

SEQ ID NO: 2575958 - protein, 8 aa, Entamoeba histolytica
TGLNASSN

SEQ ID NO: 2575959 - protein, 13 aa, Entamoeba histolytica
TGNERARSNAGTF

SEQ ID NO: 2575960 - protein, 7 aa, Entamoeba histolytica
TGNGYRT

SEQ ID NO: 2575961 - protein, 7 aa, Entamoeba histolytica
TGNSTEI

SEQ ID NO: 2575962 - protein, 6 aa, Entamoeba histolytica
TGPNNT

SEQ ID NO: 2575963 - protein, 7 aa, Entamoeba histolytica
TGPSQSP

SEQ ID NO: 2575964 - protein, 6 aa, Entamoeba histolytica
TGPTQR

SEQ ID NO: 2575965 - protein, 7 aa, Entamoeba histolytica
TGQGTTF

SEQ ID NO: 2575966 - protein, 7 aa, Entamoeba histolytica
TGQTAMN

SEQ ID NO: 2575967 - protein, 8 aa, Entamoeba histolytica
TGQYQKPQ

SEQ ID NO: 2575968 - protein, 6 aa, Entamoeba histolytica
TGREEE

SEQ ID NO: 2575969 - protein, 5 aa, Entamoeba histolytica
TGRHD

SEQ ID NO: 2575970 - protein, 11 aa, Entamoeba histolytica
TGRNGGFGIGN

SEQ ID NO: 2575971 - protein, 11 aa, Entamoeba histolytica
TGRVTYTRKDA

SEQ ID NO: 2575972 - protein, 8 aa, Entamoeba histolytica
TGSEGSDI

SEQ ID NO: 2575973 - protein, 14 aa, Entamoeba histolytica
TGSKSCENGDTYHS

SEQ ID NO: 2575974 - protein, 7 aa, Entamoeba histolytica
TGSKTPI

SEQ ID NO: 2575975 - protein, 4 aa, Entamoeba histolytica
TGSM

SEQ ID NO: 2575976 - protein, 5 aa, Entamoeba histolytica
TGSNT

SEQ ID NO: 2575977 - protein, 5 aa, Entamoeba histolytica
TGSSL

SEQ ID NO: 2575978 - protein, 4 aa, Entamoeba histolytica
TGST

SEQ ID NO: 2575979 - protein, 6 aa, Entamoeba histolytica
TGSTKI

SEQ ID NO: 2575980 - protein, 14 aa, Entamoeba histolytica
TGTCTKYDSTCKSV

SEQ ID NO: 2575981 - protein, 6 aa, Entamoeba histolytica
TGTDKE

SEQ ID NO: 2575982 - protein, 8 aa, Entamoeba histolytica
TGTFSTNS

SEQ ID NO: 2575983 - protein, 6 aa, Entamoeba histolytica
TGTGTV

SEQ ID NO: 2575984 - protein, 20 aa, Entamoeba histolytica
TGTKAMKTDYTRNGKRGFSG

SEQ ID NO: 2575985 - protein, 4 aa, Entamoeba histolytica
TGTP

SEQ ID NO: 2575986 - protein, 6 aa, Entamoeba histolytica
TGTSNI

SEQ ID NO: 2575987 - protein, 9 aa, Entamoeba histolytica
TGTSQLCEP

SEQ ID NO: 2575988 - protein, 8 aa, Entamoeba histolytica
TGTTPQCK

SEQ ID NO: 2575989 - protein, 9 aa, Entamoeba histolytica
TGTTTNESI

SEQ ID NO: 2575990 - protein, 13 aa, Entamoeba histolytica
TGTVDESSKYSIE

SEQ ID NO: 2575991 - protein, 9 aa, Entamoeba histolytica
TGTVKSGQT

SEQ ID NO: 2575992 - protein, 5 aa, Entamoeba histolytica
TGVCT

SEQ ID NO: 2575993 - protein, 11 aa, Entamoeba histolytica
TGVGKSSFGNS

SEQ ID NO: 2575994 - protein, 12 aa, Entamoeba histolytica
TGVTDKDEDSYT

SEQ ID NO: 2575995 - protein, 5 aa, Entamoeba histolytica
TGYNL

SEQ ID NO: 2575996 - protein, 4 aa, Entamoeba histolytica
TGYY

SEQ ID NO: 2575997 - protein, 9 aa, Entamoeba histolytica
THCSESNTF

SEQ ID NO: 2575998 - protein, 7 aa, Entamoeba histolytica
THDLKKD

SEQ ID NO: 2575999 - protein, 5 aa, Entamoeba histolytica
THEYT

SEQ ID NO: 2576000 - protein, 5 aa, Entamoeba histolytica
THFSH

SEQ ID NO: 2576001 - protein, 4 aa, Entamoeba histolytica
THGT

SEQ ID NO: 2576002 - protein, 12 aa, Entamoeba histolytica
THITEDNNTGIE

SEQ ID NO: 2576003 - protein, 4 aa, Entamoeba histolytica
THKR

SEQ ID NO: 2576004 - protein, 7 aa, Entamoeba histolytica
THNETEY

SEQ ID NO: 2576005 - protein, 10 aa, Entamoeba histolytica
THNSTGGLKC

SEQ ID NO: 2576006 - protein, 5 aa, Entamoeba histolytica
THQRT

SEQ ID NO: 2576007 - protein, 4 aa, Entamoeba histolytica
THSK

SEQ ID NO: 2576008 - protein, 24 aa, Entamoeba histolytica
THTGSLGTIESTESKSKKKNYKIP

SEQ ID NO: 2576009 - protein, 9 aa, Entamoeba histolytica
THTNSQTVR

SEQ ID NO: 2576010 - protein, 4 aa, Entamoeba histolytica
THVE

SEQ ID NO: 2576011 - protein, 10 aa, Entamoeba histolytica
TIASRNIEED

SEQ ID NO: 2576012 - protein, 23 aa, Entamoeba histolytica
TIDDSKNTTATNSSLDEVTSNVS

SEQ ID NO: 2576013 - protein, 13 aa, Entamoeba histolytica
TIDGCQDNQCTTT

SEQ ID NO: 2576014 - protein, 5 aa, Entamoeba histolytica
TIDGL

SEQ ID NO: 2576015 - protein, 10 aa, Entamoeba histolytica
TIDPATNQSI

SEQ ID NO: 2576016 - protein, 20 aa, Entamoeba histolytica
TIDPTIQESDYYSKTSHELE

SEQ ID NO: 2576017 - protein, 5 aa, Entamoeba histolytica
TIDRG

SEQ ID NO: 2576018 - protein, 7 aa, Entamoeba histolytica
TIEDQSD

SEQ ID NO: 2576019 - protein, 13 aa, Entamoeba histolytica
TIEEDKKQEEIKD

SEQ ID NO: 2576020 - protein, 13 aa, Entamoeba histolytica
TIESQGVNNAKKD

SEQ ID NO: 2576021 - protein, 4 aa, Entamoeba histolytica
TIET

SEQ ID NO: 2576022 - protein, 8 aa, Entamoeba histolytica
TIETWTQN

SEQ ID NO: 2576023 - protein, 10 aa, Entamoeba histolytica
TIGENETKGC

SEQ ID NO: 2576024 - protein, 7 aa, Entamoeba histolytica
TIGHPKS

SEQ ID NO: 2576025 - protein, 5 aa, Entamoeba histolytica
TIGNQ

SEQ ID NO: 2576026 - protein, 5 aa, Entamoeba histolytica
TIGSS

SEQ ID NO: 2576027 - protein, 12 aa, Entamoeba histolytica
TIKSDKERAGDE

SEQ ID NO: 2576028 - protein, 6 aa, Entamoeba histolytica
TIKTPV

SEQ ID NO: 2576029 - protein, 5 aa, Entamoeba histolytica
TIKYG

SEQ ID NO: 2576030 - protein, 9 aa, Entamoeba histolytica
TILGNERET

SEQ ID NO: 2576031 - protein, 7 aa, Entamoeba histolytica
TILTESN

SEQ ID NO: 2576032 - protein, 9 aa, Entamoeba histolytica
TINGANSQL

SEQ ID NO: 2576033 - protein, 6 aa, Entamoeba histolytica
TINGDL

SEQ ID NO: 2576034 - protein, 11 aa, Entamoeba histolytica
TINGKSDGEIE

SEQ ID NO: 2576035 - protein, 10 aa, Entamoeba histolytica
TINKELEEKD

SEQ ID NO: 2576036 - protein, 13 aa, Entamoeba histolytica
TINNSSYFTGETQ

SEQ ID NO: 2576037 - protein, 37 aa, Entamoeba histolytica
TINPTKELNSSPLPESDKPIELQTKEETEKENTHATS

SEQ ID NO: 2576038 - protein, 4 aa, Entamoeba histolytica
TINS

SEQ ID NO: 2576039 - protein, 10 aa, Entamoeba histolytica
TINSNDGDLM

SEQ ID NO: 2576040 - protein, 9 aa, Entamoeba histolytica
TINTNQLEE

SEQ ID NO: 2576041 - protein, 5 aa, Entamoeba histolytica
TIPEE

SEQ ID NO: 2576042 - protein, 24 aa, Entamoeba histolytica
TIPKELTDSQSKLPTNKEPKTGRE

SEQ ID NO: 2576043 - protein, 9 aa, Entamoeba histolytica
TIPSTTTLN

SEQ ID NO: 2576044 - protein, 6 aa, Entamoeba histolytica
TIPTLS

SEQ ID NO: 2576045 - protein, 9 aa, Entamoeba histolytica
TIPVGEESR

SEQ ID NO: 2576046 - protein, 7 aa, Entamoeba histolytica
TIPYSSE

SEQ ID NO: 2576047 - protein, 4 aa, Entamoeba histolytica
TIQN

SEQ ID NO: 2576048 - protein, 5 aa, Entamoeba histolytica
TIQNA

SEQ ID NO: 2576049 - protein, 6 aa, Entamoeba histolytica
TIREKP

SEQ ID NO: 2576050 - protein, 9 aa, Entamoeba histolytica
TIRNDSTIN

SEQ ID NO: 2576051 - protein, 7 aa, Entamoeba histolytica
TIRSTNF

SEQ ID NO: 2576052 - protein, 9 aa, Entamoeba histolytica
TISASDKKI

SEQ ID NO: 2576053 - protein, 5 aa, Entamoeba histolytica
TISKG

SEQ ID NO: 2576054 - protein, 9 aa, Entamoeba histolytica
TISPKGEKQ

SEQ ID NO: 2576055 - protein, 6 aa, Entamoeba histolytica
TISTQM

SEQ ID NO: 2576056 - protein, 11 aa, Entamoeba histolytica
TITASKGLTTL

SEQ ID NO: 2576057 - protein, 5 aa, Entamoeba histolytica
TITHG

SEQ ID NO: 2576058 - protein, 7 aa, Entamoeba histolytica
TITKKTF

SEQ ID NO: 2576059 - protein, 4 aa, Entamoeba histolytica
TITN

SEQ ID NO: 2576060 - protein, 8 aa, Entamoeba histolytica
TITPNNQP

SEQ ID NO: 2576061 - protein, 15 aa, Entamoeba histolytica
TITQSSDVSTPSINV

SEQ ID NO: 2576062 - protein, 17 aa, Entamoeba histolytica
TITQSSDVSTPSINVEN

SEQ ID NO: 2576063 - protein, 15 aa, Entamoeba histolytica
TITSDNELEVGNTSS

SEQ ID NO: 2576064 - protein, 7 aa, Entamoeba histolytica
TITSGKR

SEQ ID NO: 2576065 - protein, 5 aa, Entamoeba histolytica
TITSK

SEQ ID NO: 2576066 - protein, 5 aa, Entamoeba histolytica
TITSS

SEQ ID NO: 2576067 - protein, 7 aa, Entamoeba histolytica
TITTGKR

SEQ ID NO: 2576068 - protein, 10 aa, Entamoeba histolytica
TITTGKRPNI

SEQ ID NO: 2576069 - protein, 10 aa, Entamoeba histolytica
TITTGNRPNI

SEQ ID NO: 2576070 - protein, 9 aa, Entamoeba histolytica
TIVSSNTES

SEQ ID NO: 2576071 - protein, 10 aa, Entamoeba histolytica
TIYNPRNANN

SEQ ID NO: 2576072 - protein, 9 aa, Entamoeba histolytica
TKAASEGGH

SEQ ID NO: 2576073 - protein, 9 aa, Entamoeba histolytica
TKAESNQSL

SEQ ID NO: 2576074 - protein, 16 aa, Entamoeba histolytica
TKAGDKQVGNYSGGMK

SEQ ID NO: 2576075 - protein, 9 aa, Entamoeba histolytica
TKAGNSDSI

SEQ ID NO: 2576076 - protein, 9 aa, Entamoeba histolytica
TKAQSFSNN

SEQ ID NO: 2576077 - protein, 5 aa, Entamoeba histolytica
TKATY

SEQ ID NO: 2576078 - protein, 9 aa, Entamoeba histolytica
TKAVSSENE

SEQ ID NO: 2576079 - protein, 14 aa, Entamoeba histolytica
TKCGNSKLDNNEEC

SEQ ID NO: 2576080 - protein, 4 aa, Entamoeba histolytica
TKCK

SEQ ID NO: 2576081 - protein, 5 aa, Entamoeba histolytica
TKCLS

SEQ ID NO: 2576082 - protein, 17 aa, Entamoeba histolytica
TKCNPKNKRLVKRDEKC

SEQ ID NO: 2576083 - protein, 15 aa, Entamoeba histolytica
TKCSDEPSNDRDCTD

SEQ ID NO: 2576084 - protein, 9 aa, Entamoeba histolytica
TKCTNDGNC

SEQ ID NO: 2576085 - protein, 9 aa, Entamoeba histolytica
TKDDDGNAV

SEQ ID NO: 2576086 - protein, 6 aa, Entamoeba histolytica
TKDEGC

SEQ ID NO: 2576087 - protein, 8 aa, Entamoeba histolytica
TKDKNGDC

SEQ ID NO: 2576088 - protein, 9 aa, Entamoeba histolytica
TKDMTNTGI

SEQ ID NO: 2576089 - protein, 6 aa, Entamoeba histolytica
TKDNQT

SEQ ID NO: 2576090 - protein, 4 aa, Entamoeba histolytica
TKDP

SEQ ID NO: 2576091 - protein, 7 aa, Entamoeba histolytica
TKDQLDK

SEQ ID NO: 2576092 - protein, 7 aa, Entamoeba histolytica
TKDRTLN

SEQ ID NO: 2576093 - protein, 7 aa, Entamoeba histolytica
TKDTTFT

SEQ ID NO: 2576094 - protein, 17 aa, Entamoeba histolytica
TKEDSPYTNTHFELTQF

SEQ ID NO: 2576095 - protein, 10 aa, Entamoeba histolytica
TKEEGKLENS

SEQ ID NO: 2576096 - protein, 8 aa, Entamoeba histolytica
TKEEKETV

SEQ ID NO: 2576097 - protein, 9 aa, Entamoeba histolytica
TKEEPADIQ

SEQ ID NO: 2576098 - protein, 6 aa, Entamoeba histolytica
TKEGTT

SEQ ID NO: 2576099 - protein, 9 aa, Entamoeba histolytica
TKEIPKTNA

SEQ ID NO: 2576100 - protein, 8 aa, Entamoeba histolytica
TKEKEHWG

SEQ ID NO: 2576101 - protein, 23 aa, Entamoeba histolytica
TKEKQVEKRKKVVKEEKIKEKIS

SEQ ID NO: 2576102 - protein, 13 aa, Entamoeba histolytica
TKEKTDSQQQETH

SEQ ID NO: 2576103 - protein, 13 aa, Entamoeba histolytica
TKEKTESQQPETH

SEQ ID NO: 2576104 - protein, 5 aa, Entamoeba histolytica
TKELN

SEQ ID NO: 2576105 - protein, 9 aa, Entamoeba histolytica
TKENEIPTR

SEQ ID NO: 2576106 - protein, 7 aa, Entamoeba histolytica
TKEQKGL

SEQ ID NO: 2576107 - protein, 4 aa, Entamoeba histolytica
TKER

SEQ ID NO: 2576108 - protein, 8 aa, Entamoeba histolytica
TKESREKA

SEQ ID NO: 2576109 - protein, 4 aa, Entamoeba histolytica
TKEV

SEQ ID NO: 2576110 - protein, 8 aa, Entamoeba histolytica
TKEVDESE

SEQ ID NO: 2576111 - protein, 5 aa, Entamoeba histolytica
TKEVP

SEQ ID NO: 2576112 - protein, 11 aa, Entamoeba histolytica
TKEYNKAYGDP

SEQ ID NO: 2576113 - protein, 6 aa, Entamoeba histolytica
TKFDPD

SEQ ID NO: 2576114 - protein, 9 aa, Entamoeba histolytica
TKFESDGDK

SEQ ID NO: 2576115 - protein, 4 aa, Entamoeba histolytica
TKFP

SEQ ID NO: 2576116 - protein, 6 aa, Entamoeba histolytica
TKFSSR

SEQ ID NO: 2576117 - protein, 8 aa, Entamoeba histolytica
TKFTDNDN

SEQ ID NO: 2576118 - protein, 25 aa, Entamoeba histolytica
TKGCSKCPDNCKKCNSNGKCSECDS

SEQ ID NO: 2576119 - protein, 17 aa, Entamoeba histolytica
TKGDGYSFPTNNSFNDT

SEQ ID NO: 2576120 - protein, 10 aa, Entamoeba histolytica
TKGEKEKASL

SEQ ID NO: 2576121 - protein, 12 aa, Entamoeba histolytica
TKGIGTPKYMAP

SEQ ID NO: 2576122 - protein, 5 aa, Entamoeba histolytica
TKGKE

SEQ ID NO: 2576123 - protein, 8 aa, Entamoeba histolytica
TKGLSKKT

SEQ ID NO: 2576124 - protein, 4 aa, Entamoeba histolytica
TKGS

SEQ ID NO: 2576125 - protein, 8 aa, Entamoeba histolytica
TKGSDNKI

SEQ ID NO: 2576126 - protein, 5 aa, Entamoeba histolytica
TKGSN

SEQ ID NO: 2576127 - protein, 9 aa, Entamoeba histolytica
TKGSNTAPY

SEQ ID NO: 2576128 - protein, 9 aa, Entamoeba histolytica
TKGTSDNTI

SEQ ID NO: 2576129 - protein, 8 aa, Entamoeba histolytica
TKHDEKDL

SEQ ID NO: 2576130 - protein, 12 aa, Entamoeba histolytica
TKHGCENCEEGY

SEQ ID NO: 2576131 - protein, 8 aa, Entamoeba histolytica
TKHPRNPN

SEQ ID NO: 2576132 - protein, 6 aa, Entamoeba histolytica
TKIDEG

SEQ ID NO: 2576133 - protein, 8 aa, Entamoeba histolytica
TKIDPTKD

SEQ ID NO: 2576134 - protein, 8 aa, Entamoeba histolytica
TKIKEAQR

SEQ ID NO: 2576135 - protein, 13 aa, Entamoeba histolytica
TKIKEENRKSGTV

SEQ ID NO: 2576136 - protein, 4 aa, Entamoeba histolytica
TKIN

SEQ ID NO: 2576137 - protein, 6 aa, Entamoeba histolytica
TKINPS

SEQ ID NO: 2576138 - protein, 6 aa, Entamoeba histolytica
TKITGN

SEQ ID NO: 2576139 - protein, 9 aa, Entamoeba histolytica
TKITPRSKA

SEQ ID NO: 2576140 - protein, 13 aa, Entamoeba histolytica
TKKEETESQSENP

SEQ ID NO: 2576141 - protein, 7 aa, Entamoeba histolytica
TKKEGGK

SEQ ID NO: 2576142 - protein, 7 aa, Entamoeba histolytica
TKKEQQA

SEQ ID NO: 2576143 - protein, 4 aa, Entamoeba histolytica
TKKG

SEQ ID NO: 2576144 - protein, 9 aa, Entamoeba histolytica
TKKHGEPSV

SEQ ID NO: 2576145 - protein, 15 aa, Entamoeba histolytica
TKKNDNTENTRDEYY

SEQ ID NO: 2576146 - protein, 6 aa, Entamoeba histolytica
TKKNKI

SEQ ID NO: 2576147 - protein, 10 aa, Entamoeba histolytica
TKKNKYVGSS

SEQ ID NO: 2576148 - protein, 10 aa, Entamoeba histolytica
TKKPKPDDAV

SEQ ID NO: 2576149 - protein, 19 aa, Entamoeba histolytica
TKKQQEKIKAKEEGKNMKP

SEQ ID NO: 2576150 - protein, 11 aa, Entamoeba histolytica
TKKQQNENEDW

SEQ ID NO: 2576151 - protein, 14 aa, Entamoeba histolytica
TKKQTKSLEGTAPQ

SEQ ID NO: 2576152 - protein, 5 aa, Entamoeba histolytica
TKKQY

SEQ ID NO: 2576153 - protein, 13 aa, Entamoeba histolytica
TKKSSEDAKKKTF

SEQ ID NO: 2576154 - protein, 10 aa, Entamoeba histolytica
TKKSTQQENA

SEQ ID NO: 2576155 - protein, 6 aa, Entamoeba histolytica
TKKTPG

SEQ ID NO: 2576156 - protein, 5 aa, Entamoeba histolytica
TKKTQ

SEQ ID NO: 2576157 - protein, 7 aa, Entamoeba histolytica
TKKYAKA

SEQ ID NO: 2576158 - protein, 11 aa, Entamoeba histolytica
TKKYAKARDGC

SEQ ID NO: 2576159 - protein, 9 aa, Entamoeba histolytica
TKKYAKARN

SEQ ID NO: 2576160 - protein, 8 aa, Entamoeba histolytica
TKKYAKGR

SEQ ID NO: 2576161 - protein, 6 aa, Entamoeba histolytica
TKLETG

SEQ ID NO: 2576162 - protein, 4 aa, Entamoeba histolytica
TKLN

SEQ ID NO: 2576163 - protein, 5 aa, Entamoeba histolytica
TKLNN

SEQ ID NO: 2576164 - protein, 6 aa, Entamoeba histolytica
TKLNPD

SEQ ID NO: 2576165 - protein, 17 aa, Entamoeba histolytica
TKLTSDPTSLQGISAER

SEQ ID NO: 2576166 - protein, 4 aa, Entamoeba histolytica
TKND

SEQ ID NO: 2576167 - protein, 9 aa, Entamoeba histolytica
TKNDQKDTN

SEQ ID NO: 2576168 - protein, 7 aa, Entamoeba histolytica
TKNETGA

SEQ ID NO: 2576169 - protein, 11 aa, Entamoeba histolytica
TKNGKWNSSTN

SEQ ID NO: 2576170 - protein, 6 aa, Entamoeba histolytica
TKNKSK

SEQ ID NO: 2576171 - protein, 9 aa, Entamoeba histolytica
TKNNPQQVN

SEQ ID NO: 2576172 - protein, 12 aa, Entamoeba histolytica
TKNPSGCKIGND

SEQ ID NO: 2576173 - protein, 12 aa, Entamoeba histolytica
TKNPSGCKIGNE

SEQ ID NO: 2576174 - protein, 8 aa, Entamoeba histolytica
TKNPYTKP

SEQ ID NO: 2576175 - protein, 7 aa, Entamoeba histolytica
TKNQAGF

SEQ ID NO: 2576176 - protein, 8 aa, Entamoeba histolytica
TKNSTEYH

SEQ ID NO: 2576177 - protein, 5 aa, Entamoeba histolytica
TKPED

SEQ ID NO: 2576178 - protein, 6 aa, Entamoeba histolytica
TKPKAV

SEQ ID NO: 2576179 - protein, 10 aa, Entamoeba histolytica
TKPKRPVVES

SEQ ID NO: 2576180 - protein, 7 aa, Entamoeba histolytica
TKPLAKS

SEQ ID NO: 2576181 - protein, 5 aa, Entamoeba histolytica
TKPPQ

SEQ ID NO: 2576182 - protein, 9 aa, Entamoeba histolytica
TKPRERTND

SEQ ID NO: 2576183 - protein, 9 aa, Entamoeba histolytica
TKPSPALSS

SEQ ID NO: 2576184 - protein, 7 aa, Entamoeba histolytica
TKPYTYG

SEQ ID NO: 2576185 - protein, 9 aa, Entamoeba histolytica
TKQADQCDG

SEQ ID NO: 2576186 - protein, 7 aa, Entamoeba histolytica
TKQDASN

SEQ ID NO: 2576187 - protein, 20 aa, Entamoeba histolytica
TKQDKNSINEKESTHTHSSH

SEQ ID NO: 2576188 - protein, 9 aa, Entamoeba histolytica
TKQEKQIGL

SEQ ID NO: 2576189 - protein, 6 aa, Entamoeba histolytica
TKQIEQ

SEQ ID NO: 2576190 - protein, 9 aa, Entamoeba histolytica
TKQKLEPEI

SEQ ID NO: 2576191 - protein, 9 aa, Entamoeba histolytica
TKQLDLSDQ

SEQ ID NO: 2576192 - protein, 10 aa, Entamoeba histolytica
TKQLKENSTE

SEQ ID NO: 2576193 - protein, 13 aa, Entamoeba histolytica
TKQLQNGTNNPVI

SEQ ID NO: 2576194 - protein, 7 aa, Entamoeba histolytica
TKQNENQ

SEQ ID NO: 2576195 - protein, 7 aa, Entamoeba histolytica
TKQNIPE

SEQ ID NO: 2576196 - protein, 8 aa, Entamoeba histolytica
TKQPKQQL

SEQ ID NO: 2576197 - protein, 6 aa, Entamoeba histolytica
TKQPTN

SEQ ID NO: 2576198 - protein, 6 aa, Entamoeba histolytica
TKQQHN

SEQ ID NO: 2576199 - protein, 5 aa, Entamoeba histolytica
TKQSV

SEQ ID NO: 2576200 - protein, 19 aa, Entamoeba histolytica
TKQTQLNQLKKKKKKISKI

SEQ ID NO: 2576201 - protein, 12 aa, Entamoeba histolytica
TKQTRQDNPYDL

SEQ ID NO: 2576202 - protein, 4 aa, Entamoeba histolytica
TKRG

SEQ ID NO: 2576203 - protein, 5 aa, Entamoeba histolytica
TKRKH

SEQ ID NO: 2576204 - protein, 6 aa, Entamoeba histolytica
TKRPHA

SEQ ID NO: 2576205 - protein, 9 aa, Entamoeba histolytica
TKRSTPENI

SEQ ID NO: 2576206 - protein, 6 aa, Entamoeba histolytica
TKSAKI

SEQ ID NO: 2576207 - protein, 13 aa, Entamoeba histolytica
TKSEEDNSYELQP

SEQ ID NO: 2576208 - protein, 4 aa, Entamoeba histolytica
TKSG

SEQ ID NO: 2576209 - protein, 7 aa, Entamoeba histolytica
TKSGESM

SEQ ID NO: 2576210 - protein, 5 aa, Entamoeba histolytica
TKSNV

SEQ ID NO: 2576211 - protein, 10 aa, Entamoeba histolytica
TKSPLKSEGN

SEQ ID NO: 2576212 - protein, 40 aa, Entamoeba histolytica
TKSPRENKNSPSPSLKSPSLRSPRRDFPKSAFTSSSSLIP

SEQ ID NO: 2576213 - protein, 8 aa, Entamoeba histolytica
TKSRQISK

SEQ ID NO: 2576214 - protein, 8 aa, Entamoeba histolytica
TKSSIQLP

SEQ ID NO: 2576215 - protein, 13 aa, Entamoeba histolytica
TKTAKEYLETYDD

SEQ ID NO: 2576216 - protein, 22 aa, Entamoeba histolytica
TKTDTSNAEAGSINCESSDSVE

SEQ ID NO: 2576217 - protein, 7 aa, Entamoeba histolytica
TKTGSKK

SEQ ID NO: 2576218 - protein, 13 aa, Entamoeba histolytica
TKTNSGNNTKSSN

SEQ ID NO: 2576219 - protein, 6 aa, Entamoeba histolytica
TKTPGV

SEQ ID NO: 2576220 - protein, 5 aa, Entamoeba histolytica
TKTPL

SEQ ID NO: 2576221 - protein, 6 aa, Entamoeba histolytica
TKTPRF

SEQ ID NO: 2576222 - protein, 7 aa, Entamoeba histolytica
TKTQEGR

SEQ ID NO: 2576223 - protein, 6 aa, Entamoeba histolytica
TKTQKT

SEQ ID NO: 2576224 - protein, 7 aa, Entamoeba histolytica
TKTQQTV

SEQ ID NO: 2576225 - protein, 8 aa, Entamoeba histolytica
TKTQTTRY

SEQ ID NO: 2576226 - protein, 4 aa, Entamoeba histolytica
TKTR

SEQ ID NO: 2576227 - protein, 5 aa, Entamoeba histolytica
TKTRR

SEQ ID NO: 2576228 - protein, 5 aa, Entamoeba histolytica
TKTSE

SEQ ID NO: 2576229 - protein, 7 aa, Entamoeba histolytica
TKTSGFE

SEQ ID NO: 2576230 - protein, 7 aa, Entamoeba histolytica
TKTSGGH

SEQ ID NO: 2576231 - protein, 19 aa, Entamoeba histolytica
TKTSKDPQAEEAPAEDPEV

SEQ ID NO: 2576232 - protein, 5 aa, Entamoeba histolytica
TKTTV

SEQ ID NO: 2576233 - protein, 11 aa, Entamoeba histolytica
TKVADSSKPNI

SEQ ID NO: 2576234 - protein, 4 aa, Entamoeba histolytica
TKVG

SEQ ID NO: 2576235 - protein, 6 aa, Entamoeba histolytica
TKVGTF

SEQ ID NO: 2576236 - protein, 4 aa, Entamoeba histolytica
TKVN

SEQ ID NO: 2576237 - protein, 10 aa, Entamoeba histolytica
TKVPPKKETL

SEQ ID NO: 2576238 - protein, 9 aa, Entamoeba histolytica
TKVSGGISN

SEQ ID NO: 2576239 - protein, 8 aa, Entamoeba histolytica
TKVTDGNG

SEQ ID NO: 2576240 - protein, 9 aa, Entamoeba histolytica
TKVTDGNGQ

SEQ ID NO: 2576241 - protein, 8 aa, Entamoeba histolytica
TKYEDPTQ

SEQ ID NO: 2576242 - protein, 10 aa, Entamoeba histolytica
TKYNGDEIEG

SEQ ID NO: 2576243 - protein, 10 aa, Entamoeba histolytica
TKYNIDDTSD

SEQ ID NO: 2576244 - protein, 8 aa, Entamoeba histolytica
TKYNNQSM

SEQ ID NO: 2576245 - protein, 6 aa, Entamoeba histolytica
TKYPDG

SEQ ID NO: 2576246 - protein, 10 aa, Entamoeba histolytica
TKYPSYSNNK

SEQ ID NO: 2576247 - protein, 4 aa, Entamoeba histolytica
TKYQ

SEQ ID NO: 2576248 - protein, 4 aa, Entamoeba histolytica
TLAP

SEQ ID NO: 2576249 - protein, 9 aa, Entamoeba histolytica
TLDDDDSSV

SEQ ID NO: 2576250 - protein, 7 aa, Entamoeba histolytica
TLDNEGS

SEQ ID NO: 2576251 - protein, 36 aa, Entamoeba histolytica
TLDSYEQEKDIPLTPRKGDHSQTGSDTPKKSTVYSE

SEQ ID NO: 2576252 - protein, 26 aa, Entamoeba histolytica
TLDVPKSSDIMNSQQQSKLSSANTIS

SEQ ID NO: 2576253 - protein, 11 aa, Entamoeba histolytica
TLEDGKEYKYN

SEQ ID NO: 2576254 - protein, 5 aa, Entamoeba histolytica
TLEEV

SEQ ID NO: 2576255 - protein, 7 aa, Entamoeba histolytica
TLETKKD

SEQ ID NO: 2576256 - protein, 8 aa, Entamoeba histolytica
TLETNPSN

SEQ ID NO: 2576257 - protein, 18 aa, Entamoeba histolytica
TLETNTNKISITTQSENS

SEQ ID NO: 2576258 - protein, 7 aa, Entamoeba histolytica
TLGDSSN

SEQ ID NO: 2576259 - protein, 9 aa, Entamoeba histolytica
TLGDSTEDI

SEQ ID NO: 2576260 - protein, 4 aa, Entamoeba histolytica
TLGN

SEQ ID NO: 2576261 - protein, 11 aa, Entamoeba histolytica
TLHSPKKLTST

SEQ ID NO: 2576262 - protein, 8 aa, Entamoeba histolytica
TLISGTSD

SEQ ID NO: 2576263 - protein, 4 aa, Entamoeba histolytica
TLKE

SEQ ID NO: 2576264 - protein, 18 aa, Entamoeba histolytica
TLKKEEKKLDHHDDLAYI

SEQ ID NO: 2576265 - protein, 8 aa, Entamoeba histolytica
TLKKTKPE

SEQ ID NO: 2576266 - protein, 6 aa, Entamoeba histolytica
TLKQEE

SEQ ID NO: 2576267 - protein, 8 aa, Entamoeba histolytica
TLKTEQNM

SEQ ID NO: 2576268 - protein, 4 aa, Entamoeba histolytica
TLKV

SEQ ID NO: 2576269 - protein, 11 aa, Entamoeba histolytica
TLKYTSNNVNT

SEQ ID NO: 2576270 - protein, 5 aa, Entamoeba histolytica
TLLGG

SEQ ID NO: 2576271 - protein, 13 aa, Entamoeba histolytica
TLNEQEEIERSTS

SEQ ID NO: 2576272 - protein, 4 aa, Entamoeba histolytica
TLNN

SEQ ID NO: 2576273 - protein, 6 aa, Entamoeba histolytica
TLNNKT

SEQ ID NO: 2576274 - protein, 7 aa, Entamoeba histolytica
TLNNPAI

SEQ ID NO: 2576275 - protein, 11 aa, Entamoeba histolytica
TLNNSNSMKTD

SEQ ID NO: 2576276 - protein, 9 aa, Entamoeba histolytica
TLPAAPAIA

SEQ ID NO: 2576277 - protein, 9 aa, Entamoeba histolytica
TLPEQNKEI

SEQ ID NO: 2576278 - protein, 7 aa, Entamoeba histolytica
TLPPNAL

SEQ ID NO: 2576279 - protein, 13 aa, Entamoeba histolytica
TLPSRDACHSKEM

SEQ ID NO: 2576280 - protein, 7 aa, Entamoeba histolytica
TLPTRSL

SEQ ID NO: 2576281 - protein, 8 aa, Entamoeba histolytica
TLPTSTPI

SEQ ID NO: 2576282 - protein, 13 aa, Entamoeba histolytica
TLQESGVTEDTPI

SEQ ID NO: 2576283 - protein, 6 aa, Entamoeba histolytica
TLQQCG

SEQ ID NO: 2576284 - protein, 6 aa, Entamoeba histolytica
TLQSSD

SEQ ID NO: 2576285 - protein, 5 aa, Entamoeba histolytica
TLSAL

SEQ ID NO: 2576286 - protein, 6 aa, Entamoeba histolytica
TLSDKD

SEQ ID NO: 2576287 - protein, 9 aa, Entamoeba histolytica
TLSGGQKQR

SEQ ID NO: 2576288 - protein, 6 aa, Entamoeba histolytica
TLSGTF

SEQ ID NO: 2576289 - protein, 7 aa, Entamoeba histolytica
TLSNQRM

SEQ ID NO: 2576290 - protein, 13 aa, Entamoeba histolytica
TLSSAEQTNSQEV

SEQ ID NO: 2576291 - protein, 6 aa, Entamoeba histolytica
TLSSNS

SEQ ID NO: 2576292 - protein, 4 aa, Entamoeba histolytica
TLTG

SEQ ID NO: 2576293 - protein, 17 aa, Entamoeba histolytica
TLTLSKDKTVNTINQKD

SEQ ID NO: 2576294 - protein, 15 aa, Entamoeba histolytica
TLTNEPEKVPSPTLI

SEQ ID NO: 2576295 - protein, 9 aa, Entamoeba histolytica
TLTNNGRKT

SEQ ID NO: 2576296 - protein, 6 aa, Entamoeba histolytica
TLTNYG

SEQ ID NO: 2576297 - protein, 8 aa, Entamoeba histolytica
TLTSNKKN

SEQ ID NO: 2576298 - protein, 23 aa, Entamoeba histolytica
TLTSPNPESIKTRYQQDTSWKED

SEQ ID NO: 2576299 - protein, 13 aa, Entamoeba histolytica
TLTYEPKRDGIDI

SEQ ID NO: 2576300 - protein, 4 aa, Entamoeba histolytica
TMPK

SEQ ID NO: 2576301 - protein, 7 aa, Entamoeba histolytica
TMPTTTI

SEQ ID NO: 2576302 - protein, 6 aa, Entamoeba histolytica
TMSDKK

SEQ ID NO: 2576303 - protein, 6 aa, Entamoeba histolytica
TMSTNP

SEQ ID NO: 2576304 - protein, 11 aa, Entamoeba histolytica
TMTNSLPKEEL

SEQ ID NO: 2576305 - protein, 9 aa, Entamoeba histolytica
TMTSSKDYW

SEQ ID NO: 2576306 - protein, 10 aa, Entamoeba histolytica
TMTTENRKRR

SEQ ID NO: 2576307 - protein, 15 aa, Entamoeba histolytica
TNAAPIPSSLKTKPI

SEQ ID NO: 2576308 - protein, 12 aa, Entamoeba histolytica
TNAHSQVQHSGS

SEQ ID NO: 2576309 - protein, 9 aa, Entamoeba histolytica
TNAKCQSLE

SEQ ID NO: 2576310 - protein, 6 aa, Entamoeba histolytica
TNAQKS

SEQ ID NO: 2576311 - protein, 6 aa, Entamoeba histolytica
TNASDT

SEQ ID NO: 2576312 - protein, 9 aa, Entamoeba histolytica
TNATEENKQ

SEQ ID NO: 2576313 - protein, 5 aa, Entamoeba histolytica
TNCSE

SEQ ID NO: 2576314 - protein, 10 aa, Entamoeba histolytica
TNDAQSEKKY

SEQ ID NO: 2576315 - protein, 6 aa, Entamoeba histolytica
TNDEVS

SEQ ID NO: 2576316 - protein, 8 aa, Entamoeba histolytica
TNDGKEIE

SEQ ID NO: 2576317 - protein, 9 aa, Entamoeba histolytica
TNDGKEIES

SEQ ID NO: 2576318 - protein, 8 aa, Entamoeba histolytica
TNDPLNKI

SEQ ID NO: 2576319 - protein, 6 aa, Entamoeba histolytica
TNDRIP

SEQ ID NO: 2576320 - protein, 20 aa, Entamoeba histolytica
TNDSSIQITSAESIERNEKS

SEQ ID NO: 2576321 - protein, 15 aa, Entamoeba histolytica
TNEEKQNIVNENKEY

SEQ ID NO: 2576322 - protein, 13 aa, Entamoeba histolytica
TNEENDDKCGKCP

SEQ ID NO: 2576323 - protein, 15 aa, Entamoeba histolytica
TNEEPTGDIDSKKIE

SEQ ID NO: 2576324 - protein, 5 aa, Entamoeba histolytica
TNEEW

SEQ ID NO: 2576325 - protein, 10 aa, Entamoeba histolytica
TNEGAQLSSG

SEQ ID NO: 2576326 - protein, 7 aa, Entamoeba histolytica
TNEISVS

SEQ ID NO: 2576327 - protein, 19 aa, Entamoeba histolytica
TNENKEIEIQEKEEIQEKE

SEQ ID NO: 2576328 - protein, 10 aa, Entamoeba histolytica
TNENNKQNNP

SEQ ID NO: 2576329 - protein, 10 aa, Entamoeba histolytica
TNENTNEKPV

SEQ ID NO: 2576330 - protein, 14 aa, Entamoeba histolytica
TNENTNENTNEKQV

SEQ ID NO: 2576331 - protein, 7 aa, Entamoeba histolytica
TNEPIQQ

SEQ ID NO: 2576332 - protein, 4 aa, Entamoeba histolytica
TNEQ

SEQ ID NO: 2576333 - protein, 8 aa, Entamoeba histolytica
TNEQRASI

SEQ ID NO: 2576334 - protein, 5 aa, Entamoeba histolytica
TNERI

SEQ ID NO: 2576335 - protein, 9 aa, Entamoeba histolytica
TNERYTNNM

SEQ ID NO: 2576336 - protein, 7 aa, Entamoeba histolytica
TNESDYQ

SEQ ID NO: 2576337 - protein, 8 aa, Entamoeba histolytica
TNESKNKS

SEQ ID NO: 2576338 - protein, 6 aa, Entamoeba histolytica
TNESSK

SEQ ID NO: 2576339 - protein, 8 aa, Entamoeba histolytica
TNESTGTM

SEQ ID NO: 2576340 - protein, 7 aa, Entamoeba histolytica
TNESTSL

SEQ ID NO: 2576341 - protein, 5 aa, Entamoeba histolytica
TNETD

SEQ ID NO: 2576342 - protein, 13 aa, Entamoeba histolytica
TNETDELGNDAKN

SEQ ID NO: 2576343 - protein, 6 aa, Entamoeba histolytica
TNFKNR

SEQ ID NO: 2576344 - protein, 12 aa, Entamoeba histolytica
TNFPDNHGSGDL

SEQ ID NO: 2576345 - protein, 7 aa, Entamoeba histolytica
TNGAENG

SEQ ID NO: 2576346 - protein, 11 aa, Entamoeba histolytica
TNGAYSVSGGF

SEQ ID NO: 2576347 - protein, 13 aa, Entamoeba histolytica
TNGCSSKSEDEKI

SEQ ID NO: 2576348 - protein, 10 aa, Entamoeba histolytica
TNGCSSKSKD

SEQ ID NO: 2576349 - protein, 9 aa, Entamoeba histolytica
TNGDIAEQQ

SEQ ID NO: 2576350 - protein, 9 aa, Entamoeba histolytica
TNGDTWSSE

SEQ ID NO: 2576351 - protein, 4 aa, Entamoeba histolytica
TNGI

SEQ ID NO: 2576352 - protein, 5 aa, Entamoeba histolytica
TNGIP

SEQ ID NO: 2576353 - protein, 10 aa, Entamoeba histolytica
TNGKELPDKK

SEQ ID NO: 2576354 - protein, 6 aa, Entamoeba histolytica
TNGKVK

SEQ ID NO: 2576355 - protein, 4 aa, Entamoeba histolytica
TNGN

SEQ ID NO: 2576356 - protein, 5 aa, Entamoeba histolytica
TNGPI

SEQ ID NO: 2576357 - protein, 12 aa, Entamoeba histolytica
TNGQQKIPDTIT

SEQ ID NO: 2576358 - protein, 5 aa, Entamoeba histolytica
TNGTL

SEQ ID NO: 2576359 - protein, 4 aa, Entamoeba histolytica
TNID

SEQ ID NO: 2576360 - protein, 6 aa, Entamoeba histolytica
TNIKGQ

SEQ ID NO: 2576361 - protein, 34 aa, Entamoeba histolytica
TNIKQGNDEIEAMKGTKGDEHNNRYNQTKRRFEN

SEQ ID NO: 2576362 - protein, 7 aa, Entamoeba histolytica
TNIPSNV

SEQ ID NO: 2576363 - protein, 4 aa, Entamoeba histolytica
TNIT

SEQ ID NO: 2576364 - protein, 9 aa, Entamoeba histolytica
TNITPANQS

SEQ ID NO: 2576365 - protein, 4 aa, Entamoeba histolytica
TNIY

SEQ ID NO: 2576366 - protein, 5 aa, Entamoeba histolytica
TNIYD

SEQ ID NO: 2576367 - protein, 6 aa, Entamoeba histolytica
TNKDLS

SEQ ID NO: 2576368 - protein, 6 aa, Entamoeba histolytica
TNKFNS

SEQ ID NO: 2576369 - protein, 6 aa, Entamoeba histolytica
TNKITG

SEQ ID NO: 2576370 - protein, 12 aa, Entamoeba histolytica
TNKKEGDKEDMQ

SEQ ID NO: 2576371 - protein, 8 aa, Entamoeba histolytica
TNKKNING

SEQ ID NO: 2576372 - protein, 7 aa, Entamoeba histolytica
TNKKTNV

SEQ ID NO: 2576373 - protein, 8 aa, Entamoeba histolytica
TNKNQLDK

SEQ ID NO: 2576374 - protein, 7 aa, Entamoeba histolytica
TNKNVQN

SEQ ID NO: 2576375 - protein, 8 aa, Entamoeba histolytica
TNKPTLYP

SEQ ID NO: 2576376 - protein, 5 aa, Entamoeba histolytica
TNKQN

SEQ ID NO: 2576377 - protein, 4 aa, Entamoeba histolytica
TNKT

SEQ ID NO: 2576378 - protein, 9 aa, Entamoeba histolytica
TNKTEPRMQ

SEQ ID NO: 2576379 - protein, 8 aa, Entamoeba histolytica
TNKTETYD

SEQ ID NO: 2576380 - protein, 23 aa, Entamoeba histolytica
TNKTEYPPNKSPSPSTGASNDTF

SEQ ID NO: 2576381 - protein, 7 aa, Entamoeba histolytica
TNLDSGS

SEQ ID NO: 2576382 - protein, 8 aa, Entamoeba histolytica
TNLHNENS

SEQ ID NO: 2576383 - protein, 4 aa, Entamoeba histolytica
TNLS

SEQ ID NO: 2576384 - protein, 9 aa, Entamoeba histolytica
TNLSSETVN

SEQ ID NO: 2576385 - protein, 13 aa, Entamoeba histolytica
TNLSTTAKHKDVE

SEQ ID NO: 2576386 - protein, 9 aa, Entamoeba histolytica
TNLTQSETF

SEQ ID NO: 2576387 - protein, 8 aa, Entamoeba histolytica
TNLTTSSC

SEQ ID NO: 2576388 - protein, 10 aa, Entamoeba histolytica
TNMKGDVSTS

SEQ ID NO: 2576389 - protein, 4 aa, Entamoeba histolytica
TNND

SEQ ID NO: 2576390 - protein, 12 aa, Entamoeba histolytica
TNNIPRAQGGRL

SEQ ID NO: 2576391 - protein, 7 aa, Entamoeba histolytica
TNNKLGI

SEQ ID NO: 2576392 - protein, 4 aa, Entamoeba histolytica
TNNQ

SEQ ID NO: 2576393 - protein, 7 aa, Entamoeba histolytica
TNPAISR

SEQ ID NO: 2576394 - protein, 8 aa, Entamoeba histolytica
TNPARVET

SEQ ID NO: 2576395 - protein, 5 aa, Entamoeba histolytica
TNPEL

SEQ ID NO: 2576396 - protein, 9 aa, Entamoeba histolytica
TNPGPSNVS

SEQ ID NO: 2576397 - protein, 5 aa, Entamoeba histolytica
TNPHT

SEQ ID NO: 2576398 - protein, 6 aa, Entamoeba histolytica
TNPKSI

SEQ ID NO: 2576399 - protein, 4 aa, Entamoeba histolytica
TNPL

SEQ ID NO: 2576400 - protein, 9 aa, Entamoeba histolytica
TNPLASAGL

SEQ ID NO: 2576401 - protein, 9 aa, Entamoeba histolytica
TNPSKKSLK

SEQ ID NO: 2576402 - protein, 5 aa, Entamoeba histolytica
TNPYP

SEQ ID NO: 2576403 - protein, 9 aa, Entamoeba histolytica
TNQNKRPAN

SEQ ID NO: 2576404 - protein, 11 aa, Entamoeba histolytica
TNQQEQPSQME

SEQ ID NO: 2576405 - protein, 7 aa, Entamoeba histolytica
TNQQGEL

SEQ ID NO: 2576406 - protein, 9 aa, Entamoeba histolytica
TNQSGNEIT

SEQ ID NO: 2576407 - protein, 9 aa, Entamoeba histolytica
TNQSIEQSI

SEQ ID NO: 2576408 - protein, 11 aa, Entamoeba histolytica
TNQTPDVPYGD

SEQ ID NO: 2576409 - protein, 11 aa, Entamoeba histolytica
TNQYPNGNVSL

SEQ ID NO: 2576410 - protein, 5 aa, Entamoeba histolytica
TNRDK

SEQ ID NO: 2576411 - protein, 4 aa, Entamoeba histolytica
TNRE

SEQ ID NO: 2576412 - protein, 8 aa, Entamoeba histolytica
TNREEGKL

SEQ ID NO: 2576413 - protein, 8 aa, Entamoeba histolytica
TNREPSEV

SEQ ID NO: 2576414 - protein, 4 aa, Entamoeba histolytica
TNRI

SEQ ID NO: 2576415 - protein, 7 aa, Entamoeba histolytica
TNRISNN

SEQ ID NO: 2576416 - protein, 15 aa, Entamoeba histolytica
TNRNNSNPSKNNENG

SEQ ID NO: 2576417 - protein, 15 aa, Entamoeba histolytica
TNRYSSEKKNETENN

SEQ ID NO: 2576418 - protein, 9 aa, Entamoeba histolytica
TNSDDKINV

SEQ ID NO: 2576419 - protein, 4 aa, Entamoeba histolytica
TNSE

SEQ ID NO: 2576420 - protein, 8 aa, Entamoeba histolytica
TNSESSVN

SEQ ID NO: 2576421 - protein, 19 aa, Entamoeba histolytica
TNSGEIETEEYKEFDDNYI

SEQ ID NO: 2576422 - protein, 5 aa, Entamoeba histolytica
TNSGT

SEQ ID NO: 2576423 - protein, 7 aa, Entamoeba histolytica
TNSGTQV

SEQ ID NO: 2576424 - protein, 8 aa, Entamoeba histolytica
TNSLSNTS

SEQ ID NO: 2576425 - protein, 6 aa, Entamoeba histolytica
TNSLTT

SEQ ID NO: 2576426 - protein, 16 aa, Entamoeba histolytica
TNSPNEDTLNEEVTPS

SEQ ID NO: 2576427 - protein, 10 aa, Entamoeba histolytica
TNSQRDAYTG

SEQ ID NO: 2576428 - protein, 6 aa, Entamoeba histolytica
TNSQTG

SEQ ID NO: 2576429 - protein, 8 aa, Entamoeba histolytica
TNSQTPSI

SEQ ID NO: 2576430 - protein, 5 aa, Entamoeba histolytica
TNSSD

SEQ ID NO: 2576431 - protein, 10 aa, Entamoeba histolytica
TNSSFGNSTL

SEQ ID NO: 2576432 - protein, 9 aa, Entamoeba histolytica
TNSTSQKAE

SEQ ID NO: 2576433 - protein, 13 aa, Entamoeba histolytica
TNSYKTQKVESIE

SEQ ID NO: 2576434 - protein, 9 aa, Entamoeba histolytica
TNTDGNNVG

SEQ ID NO: 2576435 - protein, 7 aa, Entamoeba histolytica
TNTEVPE

SEQ ID NO: 2576436 - protein, 8 aa, Entamoeba histolytica
TNTHSCTE

SEQ ID NO: 2576437 - protein, 6 aa, Entamoeba histolytica
TNTIDK

SEQ ID NO: 2576438 - protein, 16 aa, Entamoeba histolytica
TNTISSKVTVSSTSTL

SEQ ID NO: 2576439 - protein, 11 aa, Entamoeba histolytica
TNTKKYKGEKT

SEQ ID NO: 2576440 - protein, 8 aa, Entamoeba histolytica
TNTKSECK

SEQ ID NO: 2576441 - protein, 7 aa, Entamoeba histolytica
TNTLQSN

SEQ ID NO: 2576442 - protein, 19 aa, Entamoeba histolytica
TNTPKSKIAPESGSLKEVQ

SEQ ID NO: 2576443 - protein, 7 aa, Entamoeba histolytica
TNTPSRE

SEQ ID NO: 2576444 - protein, 295 aa, Entamoeba histolytica
TNTVSPGSDEQEAKGPTSSGTTEMEEKGSVSGSAGGSPGTTGMGDAEQNPSSSGDSKKPGSNNPGKEETHVEQNSGTGSGSSKDVSVEGNSKEEKTESRNDEKGQSSSKNTGESPSSGANDKGNSETQTGSSEKANTANGEKGSESQGKNKGAGSSNVTGNTGGDDPSKTTEKEKNGEGADNKTDKGSTGTDGVENGNKGTTGTGSSDTTGKNEEPKDENTKKDKTNEQQGKDENNEKGQQNQPNAKEESKEQNGENKQTGNDEKDKDNKTNTTSESSENKLNDESNSHNNLDGS

SEQ ID NO: 2576445 - protein, 5 aa, Entamoeba histolytica
TNTYD

SEQ ID NO: 2576446 - protein, 4 aa, Entamoeba histolytica
TNVN

SEQ ID NO: 2576447 - protein, 11 aa, Entamoeba histolytica
TNVNRGSPLTK

SEQ ID NO: 2576448 - protein, 4 aa, Entamoeba histolytica
TNYD

SEQ ID NO: 2576449 - protein, 19 aa, Entamoeba histolytica
TNYSTHEKQLSSIKNNKKI

SEQ ID NO: 2576450 - protein, 9 aa, Entamoeba histolytica
TNYTKDTGD

SEQ ID NO: 2576451 - protein, 12 aa, Entamoeba histolytica
TPAKRNKNKDTL

SEQ ID NO: 2576452 - protein, 12 aa, Entamoeba histolytica
TPANSVNSQVKE

SEQ ID NO: 2576453 - protein, 4 aa, Entamoeba histolytica
TPAY

SEQ ID NO: 2576454 - protein, 4 aa, Entamoeba histolytica
TPCK

SEQ ID NO: 2576455 - protein, 5 aa, Entamoeba histolytica
TPCQV

SEQ ID NO: 2576456 - protein, 13 aa, Entamoeba histolytica
TPDKQEDLNETVC

SEQ ID NO: 2576457 - protein, 9 aa, Entamoeba histolytica
TPDLTSKIN

SEQ ID NO: 2576458 - protein, 18 aa, Entamoeba histolytica
TPDNSQSSTSDSNDKIKD

SEQ ID NO: 2576459 - protein, 20 aa, Entamoeba histolytica
TPDPDELARKHKKPNDHGSV

SEQ ID NO: 2576460 - protein, 20 aa, Entamoeba histolytica
TPDPDELSTKNKLHDTEGNV

SEQ ID NO: 2576461 - protein, 20 aa, Entamoeba histolytica
TPDPNEISAKKKMQETEGKV

SEQ ID NO: 2576462 - protein, 11 aa, Entamoeba histolytica
TPDPNELNNKR

SEQ ID NO: 2576463 - protein, 18 aa, Entamoeba histolytica
TPDQNSKATDQNETTQLM

SEQ ID NO: 2576464 - protein, 8 aa, Entamoeba histolytica
TPDTPSVS

SEQ ID NO: 2576465 - protein, 8 aa, Entamoeba histolytica
TPDTREKA

SEQ ID NO: 2576466 - protein, 37 aa, Entamoeba histolytica
TPEETTEHEESQGETESSETSGSGSDGSSKTSQVSSV

SEQ ID NO: 2576467 - protein, 5 aa, Entamoeba histolytica
TPELA

SEQ ID NO: 2576468 - protein, 11 aa, Entamoeba histolytica
TPEPWKSKFDE

SEQ ID NO: 2576469 - protein, 14 aa, Entamoeba histolytica
TPERADRSGLNAEF

SEQ ID NO: 2576470 - protein, 5 aa, Entamoeba histolytica
TPERD

SEQ ID NO: 2576471 - protein, 8 aa, Entamoeba histolytica
TPESIQKR

SEQ ID NO: 2576472 - protein, 5 aa, Entamoeba histolytica
TPESM

SEQ ID NO: 2576473 - protein, 18 aa, Entamoeba histolytica
TPESSTEKHNKKMRSNLK

SEQ ID NO: 2576474 - protein, 6 aa, Entamoeba histolytica
TPFEKN

SEQ ID NO: 2576475 - protein, 15 aa, Entamoeba histolytica
TPGFNDSDNDDNGEL

SEQ ID NO: 2576476 - protein, 27 aa, Entamoeba histolytica
TPGVQPQAAPAQPQQTNKPAVDLSFLG

SEQ ID NO: 2576477 - protein, 205 aa, Entamoeba histolytica
TPGVSTPKSGTAPTEGGSVTTQGDTTQTPSKSEKPQATETSAQTPTTTHPASGNEATHSTETTSQPSSTSPASPQQQNQPSSVSTPSGNGQKTEKSNEQKPQKEDSKGQPQQPPSQPNSSAKPSEETSPTQTTNNPTQISPSTSTQQPKGNKDTQQKDEPPKEQPQNQPQDNGKQDYNKPEPQQQNHPQQNEKQDNKNTNTSDIS

SEQ ID NO: 2576478 - protein, 190 aa, Entamoeba histolytica
TPGVSTPKSGTAPTEGGSVTTQGDTTQTPSKSEKPQATETSAQTPTTTHPASGNEATHSTETTSQPSSTSPASPQQQNQPSSVSTPSGNGQKTEKSNEQKPQKEDSKGQPQQPPSQPNSSAKPSEETSPTQTTNNPTQISPSTSTQQPKGNKDTQQKDEPPKEQQQNHPQQNEKQDNKNTTTSDISHDKT

SEQ ID NO: 2576479 - protein, 212 aa, Entamoeba histolytica
TPGVSTPKSGTAPTEGGSVTTQGDTTQTPSKSEKSEKPQATETSAQTPTTTHPASGNEATHSTETTSQPSSTSPASPQQQNQPSSVSTPSGNGQKTEKSNEQKPQKEDSKGQPQQPPSQPNSSAKPSEETSPTQTTNNPTQISPSTSTQQPKGNKDTQQKDEPPKEQPQNQPQDNGKQDHNKPEPQQQNHPQQNEKQDNKNTNTSDISHDKT

SEQ ID NO: 2576480 - protein, 213 aa, Entamoeba histolytica
TPGVSTPKSGTAPTEGGSVTTQGDTTQTPSKSEKSEKPQATETSAQTPTTTHPASGNEATHSTETTSQPSSTSPASPQQQNQPSSVSTPSGNGQKTEKSNEQKPQKEDSKGQPQQPPSQPNSSAKPSEETSPTQTTNNPTQISPSTSTQQPKGNKDTQQKDEPPKEQQQNHPQQNEKQDNKNTTTSDISHDKTVVSSDDISDNHNNLDGTSGG

SEQ ID NO: 2576481 - protein, 13 aa, Entamoeba histolytica
TPGYGTSDNPYCG

SEQ ID NO: 2576482 - protein, 22 aa, Entamoeba histolytica
TPHHPSYSRSSSSLTKTCNRPI

SEQ ID NO: 2576483 - protein, 8 aa, Entamoeba histolytica
TPHNHPSY

SEQ ID NO: 2576484 - protein, 9 aa, Entamoeba histolytica
TPHPKREVS

SEQ ID NO: 2576485 - protein, 5 aa, Entamoeba histolytica
TPIKH

SEQ ID NO: 2576486 - protein, 22 aa, Entamoeba histolytica
TPIPKTSIVPGNSNTYDIQKKE

SEQ ID NO: 2576487 - protein, 5 aa, Entamoeba histolytica
TPIQR

SEQ ID NO: 2576488 - protein, 5 aa, Entamoeba histolytica
TPIQS

SEQ ID NO: 2576489 - protein, 4 aa, Entamoeba histolytica
TPIR

SEQ ID NO: 2576490 - protein, 12 aa, Entamoeba histolytica
TPISKDSQGKPL

SEQ ID NO: 2576491 - protein, 8 aa, Entamoeba histolytica
TPITTPPS

SEQ ID NO: 2576492 - protein, 7 aa, Entamoeba histolytica
TPKDFSK

SEQ ID NO: 2576493 - protein, 5 aa, Entamoeba histolytica
TPKEI

SEQ ID NO: 2576494 - protein, 24 aa, Entamoeba histolytica
TPKKCTFKTGETDIDFNSESSYNE

SEQ ID NO: 2576495 - protein, 10 aa, Entamoeba histolytica
TPKKGAEENY

SEQ ID NO: 2576496 - protein, 6 aa, Entamoeba histolytica
TPKKSK

SEQ ID NO: 2576497 - protein, 6 aa, Entamoeba histolytica
TPKPLQ

SEQ ID NO: 2576498 - protein, 10 aa, Entamoeba histolytica
TPKPYNQHPS

SEQ ID NO: 2576499 - protein, 4 aa, Entamoeba histolytica
TPKQ

SEQ ID NO: 2576500 - protein, 5 aa, Entamoeba histolytica
TPKQL

SEQ ID NO: 2576501 - protein, 12 aa, Entamoeba histolytica
TPKQLEEEKSYL

SEQ ID NO: 2576502 - protein, 8 aa, Entamoeba histolytica
TPKSTSIR

SEQ ID NO: 2576503 - protein, 6 aa, Entamoeba histolytica
TPKTSG

SEQ ID NO: 2576504 - protein, 9 aa, Entamoeba histolytica
TPLDKTTSS

SEQ ID NO: 2576505 - protein, 15 aa, Entamoeba histolytica
TPLQEDQYKNEIESK

SEQ ID NO: 2576506 - protein, 7 aa, Entamoeba histolytica
TPLQGAQ

SEQ ID NO: 2576507 - protein, 9 aa, Entamoeba histolytica
TPLTEQGNL

SEQ ID NO: 2576508 - protein, 8 aa, Entamoeba histolytica
TPNDKSNV

SEQ ID NO: 2576509 - protein, 7 aa, Entamoeba histolytica
TPNDSAG

SEQ ID NO: 2576510 - protein, 4 aa, Entamoeba histolytica
TPNE

SEQ ID NO: 2576511 - protein, 12 aa, Entamoeba histolytica
TPNGIGKSSIMN

SEQ ID NO: 2576512 - protein, 6 aa, Entamoeba histolytica
TPNIDA

SEQ ID NO: 2576513 - protein, 6 aa, Entamoeba histolytica
TPNKEL

SEQ ID NO: 2576514 - protein, 4 aa, Entamoeba histolytica
TPNM

SEQ ID NO: 2576515 - protein, 17 aa, Entamoeba histolytica
TPNNKEIKGQVKKGEHG

SEQ ID NO: 2576516 - protein, 8 aa, Entamoeba histolytica
TPNSNYSE

SEQ ID NO: 2576517 - protein, 4 aa, Entamoeba histolytica
TPPF

SEQ ID NO: 2576518 - protein, 7 aa, Entamoeba histolytica
TPPGYIK

SEQ ID NO: 2576519 - protein, 6 aa, Entamoeba histolytica
TPPIGD

SEQ ID NO: 2576520 - protein, 4 aa, Entamoeba histolytica
TPPL

SEQ ID NO: 2576521 - protein, 7 aa, Entamoeba histolytica
TPPLQST

SEQ ID NO: 2576522 - protein, 4 aa, Entamoeba histolytica
TPPP

SEQ ID NO: 2576523 - protein, 9 aa, Entamoeba histolytica
TPPPDLPDK

SEQ ID NO: 2576524 - protein, 4 aa, Entamoeba histolytica
TPPQ

SEQ ID NO: 2576525 - protein, 18 aa, Entamoeba histolytica
TPPRPNRKETLNEMQTHR

SEQ ID NO: 2576526 - protein, 7 aa, Entamoeba histolytica
TPPSSLQ

SEQ ID NO: 2576527 - protein, 4 aa, Entamoeba histolytica
TPPT

SEQ ID NO: 2576528 - protein, 5 aa, Entamoeba histolytica
TPPVN

SEQ ID NO: 2576529 - protein, 6 aa, Entamoeba histolytica
TPQGTP

SEQ ID NO: 2576530 - protein, 5 aa, Entamoeba histolytica
TPQPI

SEQ ID NO: 2576531 - protein, 7 aa, Entamoeba histolytica
TPQSDPR

SEQ ID NO: 2576532 - protein, 6 aa, Entamoeba histolytica
TPRNDY

SEQ ID NO: 2576533 - protein, 8 aa, Entamoeba histolytica
TPRRKEYN

SEQ ID NO: 2576534 - protein, 12 aa, Entamoeba histolytica
TPRVGPKRLKER

SEQ ID NO: 2576535 - protein, 4 aa, Entamoeba histolytica
TPRW

SEQ ID NO: 2576536 - protein, 7 aa, Entamoeba histolytica
TPSCSGK

SEQ ID NO: 2576537 - protein, 23 aa, Entamoeba histolytica
TPSEEGYEELGSEHTPSPQLPES

SEQ ID NO: 2576538 - protein, 9 aa, Entamoeba histolytica
TPSFTDPIQ

SEQ ID NO: 2576539 - protein, 6 aa, Entamoeba histolytica
TPSKGL

SEQ ID NO: 2576540 - protein, 8 aa, Entamoeba histolytica
TPSKISYQ

SEQ ID NO: 2576541 - protein, 11 aa, Entamoeba histolytica
TPSLQESKEFN

SEQ ID NO: 2576542 - protein, 11 aa, Entamoeba histolytica
TPSNNKVNRNL

SEQ ID NO: 2576543 - protein, 7 aa, Entamoeba histolytica
TPSPSIS

SEQ ID NO: 2576544 - protein, 9 aa, Entamoeba histolytica
TPSQGFQGF

SEQ ID NO: 2576545 - protein, 6 aa, Entamoeba histolytica
TPSSNK

SEQ ID NO: 2576546 - protein, 13 aa, Entamoeba histolytica
TPSSVSSPILPPS

SEQ ID NO: 2576547 - protein, 7 aa, Entamoeba histolytica
TPSTKSL

SEQ ID NO: 2576548 - protein, 13 aa, Entamoeba histolytica
TPSTNQLKQPIPT

SEQ ID NO: 2576549 - protein, 8 aa, Entamoeba histolytica
TPSTTVTS

SEQ ID NO: 2576550 - protein, 16 aa, Entamoeba histolytica
TPTDSQLQKLTPPHKD

SEQ ID NO: 2576551 - protein, 10 aa, Entamoeba histolytica
TPTKSGDGNL

SEQ ID NO: 2576552 - protein, 4 aa, Entamoeba histolytica
TPTP

SEQ ID NO: 2576553 - protein, 6 aa, Entamoeba histolytica
TPTQKI

SEQ ID NO: 2576554 - protein, 7 aa, Entamoeba histolytica
TPTQTTP

SEQ ID NO: 2576555 - protein, 4 aa, Entamoeba histolytica
TPTS

SEQ ID NO: 2576556 - protein, 6 aa, Entamoeba histolytica
TPTTTI

SEQ ID NO: 2576557 - protein, 9 aa, Entamoeba histolytica
TPVGEYTQN

SEQ ID NO: 2576558 - protein, 4 aa, Entamoeba histolytica
TPYA

SEQ ID NO: 2576559 - protein, 5 aa, Entamoeba histolytica
TPYAQ

SEQ ID NO: 2576560 - protein, 7 aa, Entamoeba histolytica
TPYDTPQ

SEQ ID NO: 2576561 - protein, 4 aa, Entamoeba histolytica
TPYL

SEQ ID NO: 2576562 - protein, 9 aa, Entamoeba histolytica
TPYNKSQVP

SEQ ID NO: 2576563 - protein, 5 aa, Entamoeba histolytica
TPYPM

SEQ ID NO: 2576564 - protein, 6 aa, Entamoeba histolytica
TPYSKA

SEQ ID NO: 2576565 - protein, 8 aa, Entamoeba histolytica
TQCGNGKI

SEQ ID NO: 2576566 - protein, 14 aa, Entamoeba histolytica
TQCSPNAFKDENNK

SEQ ID NO: 2576567 - protein, 8 aa, Entamoeba histolytica
TQDPEDRL

SEQ ID NO: 2576568 - protein, 5 aa, Entamoeba histolytica
TQDQM

SEQ ID NO: 2576569 - protein, 10 aa, Entamoeba histolytica
TQEDADYLSS

SEQ ID NO: 2576570 - protein, 22 aa, Entamoeba histolytica
TQEKIKKEELQQQKDSTLLKKE

SEQ ID NO: 2576571 - protein, 5 aa, Entamoeba histolytica
TQELQ

SEQ ID NO: 2576572 - protein, 16 aa, Entamoeba histolytica
TQENGMRLSTKSANEW

SEQ ID NO: 2576573 - protein, 5 aa, Entamoeba histolytica
TQEST

SEQ ID NO: 2576574 - protein, 6 aa, Entamoeba histolytica
TQETPN

SEQ ID NO: 2576575 - protein, 15 aa, Entamoeba histolytica
TQETSSACTSSQSKG

SEQ ID NO: 2576576 - protein, 12 aa, Entamoeba histolytica
TQFDSQNKKNTF

SEQ ID NO: 2576577 - protein, 9 aa, Entamoeba histolytica
TQFGQSSNG

SEQ ID NO: 2576578 - protein, 5 aa, Entamoeba histolytica
TQGIG

SEQ ID NO: 2576579 - protein, 9 aa, Entamoeba histolytica
TQGNIPRGV

SEQ ID NO: 2576580 - protein, 6 aa, Entamoeba histolytica
TQGPVG

SEQ ID NO: 2576581 - protein, 21 aa, Entamoeba histolytica
TQGTGASPQTQLPFGRDPQQA

SEQ ID NO: 2576582 - protein, 6 aa, Entamoeba histolytica
TQIGER

SEQ ID NO: 2576583 - protein, 12 aa, Entamoeba histolytica
TQINPPDNDSEV

SEQ ID NO: 2576584 - protein, 6 aa, Entamoeba histolytica
TQIPQQ

SEQ ID NO: 2576585 - protein, 295 aa, Entamoeba histolytica
TQITEDANTQMNKVSEEPKGSEISKDGVTSTEEERVENSKTKQTNEQEQTTNPKSKMTEGVSAEESAEAESKKPKVENKQEGENTINEKGNEKENIEHKDKSKEESTSETGKSATGSSDKTEKSGESDKGSKQGDKGTEHNEAGKTGTDGTGNNKQEGDKTGGTGNDGTSAKEKEEEKDKQKGENGESGKTENESKGSDKIDETDQTGKDGESGKKEEENNQEEKDKNKEGKETNDNTQNTGNNSKEEKDNSKQNEQNKENEKEQENKVINNNTTNNSESKTDDDDINNQKNVDG

SEQ ID NO: 2576586 - protein, 6 aa, Entamoeba histolytica
TQKDAE

SEQ ID NO: 2576587 - protein, 6 aa, Entamoeba histolytica
TQKELS

SEQ ID NO: 2576588 - protein, 5 aa, Entamoeba histolytica
TQKEY

SEQ ID NO: 2576589 - protein, 7 aa, Entamoeba histolytica
TQKHTQG

SEQ ID NO: 2576590 - protein, 7 aa, Entamoeba histolytica
TQKISTD

SEQ ID NO: 2576591 - protein, 14 aa, Entamoeba histolytica
TQKLDKECSYSGDG

SEQ ID NO: 2576592 - protein, 8 aa, Entamoeba histolytica
TQKLEDST

SEQ ID NO: 2576593 - protein, 5 aa, Entamoeba histolytica
TQKND

SEQ ID NO: 2576594 - protein, 8 aa, Entamoeba histolytica
TQKVRSAS

SEQ ID NO: 2576595 - protein, 6 aa, Entamoeba histolytica
TQKYVN

SEQ ID NO: 2576596 - protein, 12 aa, Entamoeba histolytica
TQLPGATREPNS

SEQ ID NO: 2576597 - protein, 7 aa, Entamoeba histolytica
TQLSTKL

SEQ ID NO: 2576598 - protein, 11 aa, Entamoeba histolytica
TQLTGSTTTTE

SEQ ID NO: 2576599 - protein, 24 aa, Entamoeba histolytica
TQMKQTTKNTSGKVNFTTNDDIED

SEQ ID NO: 2576600 - protein, 15 aa, Entamoeba histolytica
TQNDSEEGNEKTALL

SEQ ID NO: 2576601 - protein, 6 aa, Entamoeba histolytica
TQNEIE

SEQ ID NO: 2576602 - protein, 10 aa, Entamoeba histolytica
TQNENEPTSE

SEQ ID NO: 2576603 - protein, 12 aa, Entamoeba histolytica
TQNESNNQQEIT

SEQ ID NO: 2576604 - protein, 11 aa, Entamoeba histolytica
TQNFSKSMTGE

SEQ ID NO: 2576605 - protein, 8 aa, Entamoeba histolytica
TQNMPEKI

SEQ ID NO: 2576606 - protein, 5 aa, Entamoeba histolytica
TQNPI

SEQ ID NO: 2576607 - protein, 6 aa, Entamoeba histolytica
TQNPKQ

SEQ ID NO: 2576608 - protein, 5 aa, Entamoeba histolytica
TQNQK

SEQ ID NO: 2576609 - protein, 4 aa, Entamoeba histolytica
TQNT

SEQ ID NO: 2576610 - protein, 5 aa, Entamoeba histolytica
TQNTG

SEQ ID NO: 2576611 - protein, 6 aa, Entamoeba histolytica
TQPGKV

SEQ ID NO: 2576612 - protein, 7 aa, Entamoeba histolytica
TQPIAGA

SEQ ID NO: 2576613 - protein, 9 aa, Entamoeba histolytica
TQPKQPLPK

SEQ ID NO: 2576614 - protein, 6 aa, Entamoeba histolytica
TQPLDK

SEQ ID NO: 2576615 - protein, 7 aa, Entamoeba histolytica
TQPLRNA

SEQ ID NO: 2576616 - protein, 8 aa, Entamoeba histolytica
TQPQNNYQ

SEQ ID NO: 2576617 - protein, 18 aa, Entamoeba histolytica
TQPRPNRKETLDEMQTHR

SEQ ID NO: 2576618 - protein, 10 aa, Entamoeba histolytica
TQPSRTTQTP

SEQ ID NO: 2576619 - protein, 5 aa, Entamoeba histolytica
TQQAT

SEQ ID NO: 2576620 - protein, 9 aa, Entamoeba histolytica
TQQNEDSSK

SEQ ID NO: 2576621 - protein, 15 aa, Entamoeba histolytica
TQQNSKETSNPTELE

SEQ ID NO: 2576622 - protein, 6 aa, Entamoeba histolytica
TQQPSY

SEQ ID NO: 2576623 - protein, 7 aa, Entamoeba histolytica
TQQPSYH

SEQ ID NO: 2576624 - protein, 7 aa, Entamoeba histolytica
TQQSQSY

SEQ ID NO: 2576625 - protein, 8 aa, Entamoeba histolytica
TQRKSQQY

SEQ ID NO: 2576626 - protein, 18 aa, Entamoeba histolytica
TQSDENLNNGGVSSNKCG

SEQ ID NO: 2576627 - protein, 4 aa, Entamoeba histolytica
TQSG

SEQ ID NO: 2576628 - protein, 5 aa, Entamoeba histolytica
TQSIS

SEQ ID NO: 2576629 - protein, 6 aa, Entamoeba histolytica
TQSKVN

SEQ ID NO: 2576630 - protein, 23 aa, Entamoeba histolytica
TQSNDNVDTKGETGVSSNKCGTY

SEQ ID NO: 2576631 - protein, 10 aa, Entamoeba histolytica
TQSNVESSRK

SEQ ID NO: 2576632 - protein, 19 aa, Entamoeba histolytica
TQSSLYEAEDNESQNSLFQ

SEQ ID NO: 2576633 - protein, 9 aa, Entamoeba histolytica
TQSSSENYS

SEQ ID NO: 2576634 - protein, 12 aa, Entamoeba histolytica
TQSTDDNKQPTY

SEQ ID NO: 2576635 - protein, 12 aa, Entamoeba histolytica
TQSTDNNKQPTY

SEQ ID NO: 2576636 - protein, 8 aa, Entamoeba histolytica
TQTIPESK

SEQ ID NO: 2576637 - protein, 5 aa, Entamoeba histolytica
TQTKD

SEQ ID NO: 2576638 - protein, 27 aa, Entamoeba histolytica
TQTLQTENQNMENTLRNTTEVNTNKKE

SEQ ID NO: 2576639 - protein, 7 aa, Entamoeba histolytica
TQTPEND

SEQ ID NO: 2576640 - protein, 9 aa, Entamoeba histolytica
TQTQSKIEQ

SEQ ID NO: 2576641 - protein, 12 aa, Entamoeba histolytica
TQTTDNQSTTLS

SEQ ID NO: 2576642 - protein, 6 aa, Entamoeba histolytica
TQTTNI

SEQ ID NO: 2576643 - protein, 5 aa, Entamoeba histolytica
TQVPR

SEQ ID NO: 2576644 - protein, 6 aa, Entamoeba histolytica
TQWKEV

SEQ ID NO: 2576645 - protein, 7 aa, Entamoeba histolytica
TQWQSPV

SEQ ID NO: 2576646 - protein, 9 aa, Entamoeba histolytica
TQYDDDDNE

SEQ ID NO: 2576647 - protein, 8 aa, Entamoeba histolytica
TQYKQITT

SEQ ID NO: 2576648 - protein, 11 aa, Entamoeba histolytica
TQYLTTEDNAT

SEQ ID NO: 2576649 - protein, 8 aa, Entamoeba histolytica
TRAETKSE

SEQ ID NO: 2576650 - protein, 13 aa, Entamoeba histolytica
TRAQGGPPTKTET

SEQ ID NO: 2576651 - protein, 29 aa, Entamoeba histolytica
TRAREVQSTPQTPTTPKGNRTKAPGKLDH

SEQ ID NO: 2576652 - protein, 18 aa, Entamoeba histolytica
TRASSIQYKDTSGNISTS

SEQ ID NO: 2576653 - protein, 10 aa, Entamoeba histolytica
TRCNPKNKRL

SEQ ID NO: 2576654 - protein, 5 aa, Entamoeba histolytica
TRDED

SEQ ID NO: 2576655 - protein, 5 aa, Entamoeba histolytica
TRDEL

SEQ ID NO: 2576656 - protein, 5 aa, Entamoeba histolytica
TREDP

SEQ ID NO: 2576657 - protein, 4 aa, Entamoeba histolytica
TREE

SEQ ID NO: 2576658 - protein, 19 aa, Entamoeba histolytica
TREPENKGKNDSQIKEPGE

SEQ ID NO: 2576659 - protein, 4 aa, Entamoeba histolytica
TREV

SEQ ID NO: 2576660 - protein, 7 aa, Entamoeba histolytica
TRGKDEG

SEQ ID NO: 2576661 - protein, 6 aa, Entamoeba histolytica
TRGSHN

SEQ ID NO: 2576662 - protein, 12 aa, Entamoeba histolytica
TRISKKYQGSFP

SEQ ID NO: 2576663 - protein, 11 aa, Entamoeba histolytica
TRKEAKSVEEV

SEQ ID NO: 2576664 - protein, 9 aa, Entamoeba histolytica
TRKEDKSYL

SEQ ID NO: 2576665 - protein, 9 aa, Entamoeba histolytica
TRKEKQNRY

SEQ ID NO: 2576666 - protein, 5 aa, Entamoeba histolytica
TRKNT

SEQ ID NO: 2576667 - protein, 5 aa, Entamoeba histolytica
TRKPY

SEQ ID NO: 2576668 - protein, 21 aa, Entamoeba histolytica
TRKQQRKSCVPPSNDFDDSSS

SEQ ID NO: 2576669 - protein, 5 aa, Entamoeba histolytica
TRKSA

SEQ ID NO: 2576670 - protein, 18 aa, Entamoeba histolytica
TRLASDPTTLKGISGERV

SEQ ID NO: 2576671 - protein, 18 aa, Entamoeba histolytica
TRLDPDDIKEEKKIGEGT

SEQ ID NO: 2576672 - protein, 7 aa, Entamoeba histolytica
TRLPQKQ

SEQ ID NO: 2576673 - protein, 5 aa, Entamoeba histolytica
TRNEL

SEQ ID NO: 2576674 - protein, 6 aa, Entamoeba histolytica
TRNETE

SEQ ID NO: 2576675 - protein, 10 aa, Entamoeba histolytica
TRNGDNVNEG

SEQ ID NO: 2576676 - protein, 17 aa, Entamoeba histolytica
TRNLEQAEDLEEKTDAM

SEQ ID NO: 2576677 - protein, 7 aa, Entamoeba histolytica
TRNNRGD

SEQ ID NO: 2576678 - protein, 17 aa, Entamoeba histolytica
TRNSEDNMLCNKTHLQL

SEQ ID NO: 2576679 - protein, 9 aa, Entamoeba histolytica
TRPEDRPDF

SEQ ID NO: 2576680 - protein, 8 aa, Entamoeba histolytica
TRPELGPT

SEQ ID NO: 2576681 - protein, 9 aa, Entamoeba histolytica
TRRELNEYP

SEQ ID NO: 2576682 - protein, 5 aa, Entamoeba histolytica
TRRGT

SEQ ID NO: 2576683 - protein, 14 aa, Entamoeba histolytica
TRSASLTQDSVSNT

SEQ ID NO: 2576684 - protein, 14 aa, Entamoeba histolytica
TRSDQRTKTDIANL

SEQ ID NO: 2576685 - protein, 7 aa, Entamoeba histolytica
TRSNDDI

SEQ ID NO: 2576686 - protein, 9 aa, Entamoeba histolytica
TRSNSLGRL

SEQ ID NO: 2576687 - protein, 11 aa, Entamoeba histolytica
TRSTHRTNPSM

SEQ ID NO: 2576688 - protein, 6 aa, Entamoeba histolytica
TRTDHR

SEQ ID NO: 2576689 - protein, 7 aa, Entamoeba histolytica
TRTDHRH

SEQ ID NO: 2576690 - protein, 6 aa, Entamoeba histolytica
TRTISL

SEQ ID NO: 2576691 - protein, 7 aa, Entamoeba histolytica
TRTTNDI

SEQ ID NO: 2576692 - protein, 4 aa, Entamoeba histolytica
TRVE

SEQ ID NO: 2576693 - protein, 6 aa, Entamoeba histolytica
TRVNVS

SEQ ID NO: 2576694 - protein, 4 aa, Entamoeba histolytica
TRYQ

SEQ ID NO: 2576695 - protein, 8 aa, Entamoeba histolytica
TRYSTDDR

SEQ ID NO: 2576696 - protein, 4 aa, Entamoeba histolytica
TSAL

SEQ ID NO: 2576697 - protein, 5 aa, Entamoeba histolytica
TSALD

SEQ ID NO: 2576698 - protein, 5 aa, Entamoeba histolytica
TSARR

SEQ ID NO: 2576699 - protein, 32 aa, Entamoeba histolytica
TSCGYDKESIETKKQCCSKTDQQQNISNKANE

SEQ ID NO: 2576700 - protein, 8 aa, Entamoeba histolytica
TSCQPGYK

SEQ ID NO: 2576701 - protein, 7 aa, Entamoeba histolytica
TSCSSKN

SEQ ID NO: 2576702 - protein, 10 aa, Entamoeba histolytica
TSCVGSKDTF

SEQ ID NO: 2576703 - protein, 5 aa, Entamoeba histolytica
TSDAE

SEQ ID NO: 2576704 - protein, 7 aa, Entamoeba histolytica
TSDEPIR

SEQ ID NO: 2576705 - protein, 7 aa, Entamoeba histolytica
TSDGNDQ

SEQ ID NO: 2576706 - protein, 18 aa, Entamoeba histolytica
TSDGRFTPSKKTNKQIQP

SEQ ID NO: 2576707 - protein, 11 aa, Entamoeba histolytica
TSDGTKCKPCN

SEQ ID NO: 2576708 - protein, 4 aa, Entamoeba histolytica
TSDI

SEQ ID NO: 2576709 - protein, 7 aa, Entamoeba histolytica
TSDKNRV

SEQ ID NO: 2576710 - protein, 8 aa, Entamoeba histolytica
TSDPEVKE

SEQ ID NO: 2576711 - protein, 7 aa, Entamoeba histolytica
TSDSSGH

SEQ ID NO: 2576712 - protein, 6 aa, Entamoeba histolytica
TSDSVR

SEQ ID NO: 2576713 - protein, 4 aa, Entamoeba histolytica
TSDT

SEQ ID NO: 2576714 - protein, 7 aa, Entamoeba histolytica
TSDVNGA

SEQ ID NO: 2576715 - protein, 12 aa, Entamoeba histolytica
TSEEKDVLLKQA

SEQ ID NO: 2576716 - protein, 21 aa, Entamoeba histolytica
TSEFSEETLSTTDARESKTRT

SEQ ID NO: 2576717 - protein, 5 aa, Entamoeba histolytica
TSEHQ

SEQ ID NO: 2576718 - protein, 8 aa, Entamoeba histolytica
TSEHSNTK

SEQ ID NO: 2576719 - protein, 6 aa, Entamoeba histolytica
TSEIKQ

SEQ ID NO: 2576720 - protein, 13 aa, Entamoeba histolytica
TSEINKKPLYPQN

SEQ ID NO: 2576721 - protein, 5 aa, Entamoeba histolytica
TSEKE

SEQ ID NO: 2576722 - protein, 8 aa, Entamoeba histolytica
TSEKEYQA

SEQ ID NO: 2576723 - protein, 10 aa, Entamoeba histolytica
TSEKNSEVYS

SEQ ID NO: 2576724 - protein, 11 aa, Entamoeba histolytica
TSELDRNINEA

SEQ ID NO: 2576725 - protein, 18 aa, Entamoeba histolytica
TSENDINGCRNRGDQNPN

SEQ ID NO: 2576726 - protein, 5 aa, Entamoeba histolytica
TSEPD

SEQ ID NO: 2576727 - protein, 6 aa, Entamoeba histolytica
TSEQPL

SEQ ID NO: 2576728 - protein, 21 aa, Entamoeba histolytica
TSFETVRTDGPFRSLTGGYTT

SEQ ID NO: 2576729 - protein, 5 aa, Entamoeba histolytica
TSFKG

SEQ ID NO: 2576730 - protein, 13 aa, Entamoeba histolytica
TSFNPTSGNDGCG

SEQ ID NO: 2576731 - protein, 6 aa, Entamoeba histolytica
TSGADI

SEQ ID NO: 2576732 - protein, 6 aa, Entamoeba histolytica
TSGCDK

SEQ ID NO: 2576733 - protein, 4 aa, Entamoeba histolytica
TSGF

SEQ ID NO: 2576734 - protein, 5 aa, Entamoeba histolytica
TSGIA

SEQ ID NO: 2576735 - protein, 5 aa, Entamoeba histolytica
TSGKR

SEQ ID NO: 2576736 - protein, 7 aa, Entamoeba histolytica
TSGLSIN

SEQ ID NO: 2576737 - protein, 7 aa, Entamoeba histolytica
TSGTYCQ

SEQ ID NO: 2576738 - protein, 11 aa, Entamoeba histolytica
TSHPHDSIKSE

SEQ ID NO: 2576739 - protein, 5 aa, Entamoeba histolytica
TSHRQ

SEQ ID NO: 2576740 - protein, 4 aa, Entamoeba histolytica
TSIG

SEQ ID NO: 2576741 - protein, 14 aa, Entamoeba histolytica
TSIKEQSTDKYARD

SEQ ID NO: 2576742 - protein, 12 aa, Entamoeba histolytica
TSINPEDNCSKQ

SEQ ID NO: 2576743 - protein, 13 aa, Entamoeba histolytica
TSIPDDKYKVSTE

SEQ ID NO: 2576744 - protein, 7 aa, Entamoeba histolytica
TSIPRSF

SEQ ID NO: 2576745 - protein, 7 aa, Entamoeba histolytica
TSIPSSS

SEQ ID NO: 2576746 - protein, 4 aa, Entamoeba histolytica
TSIQ

SEQ ID NO: 2576747 - protein, 8 aa, Entamoeba histolytica
TSIQDAID

SEQ ID NO: 2576748 - protein, 15 aa, Entamoeba histolytica
TSKAMNTLGAKNDYE

SEQ ID NO: 2576749 - protein, 7 aa, Entamoeba histolytica
TSKDPDV

SEQ ID NO: 2576750 - protein, 7 aa, Entamoeba histolytica
TSKEQND

SEQ ID NO: 2576751 - protein, 7 aa, Entamoeba histolytica
TSKGERK

SEQ ID NO: 2576752 - protein, 24 aa, Entamoeba histolytica
TSKGQTIKSGASVSLSSTLSNDQK

SEQ ID NO: 2576753 - protein, 7 aa, Entamoeba histolytica
TSKLANT

SEQ ID NO: 2576754 - protein, 9 aa, Entamoeba histolytica
TSKRNDIDS

SEQ ID NO: 2576755 - protein, 5 aa, Entamoeba histolytica
TSKTG

SEQ ID NO: 2576756 - protein, 9 aa, Entamoeba histolytica
TSKTPAPYS

SEQ ID NO: 2576757 - protein, 6 aa, Entamoeba histolytica
TSKTTG

SEQ ID NO: 2576758 - protein, 5 aa, Entamoeba histolytica
TSLEI

SEQ ID NO: 2576759 - protein, 10 aa, Entamoeba histolytica
TSLETNYGKK

SEQ ID NO: 2576760 - protein, 7 aa, Entamoeba histolytica
TSLGCSQ

SEQ ID NO: 2576761 - protein, 21 aa, Entamoeba histolytica
TSLKRKDEKIEGSENNEVAPT

SEQ ID NO: 2576762 - protein, 12 aa, Entamoeba histolytica
TSLNDNNSLEKA

SEQ ID NO: 2576763 - protein, 12 aa, Entamoeba histolytica
TSLPITQSNELS

SEQ ID NO: 2576764 - protein, 4 aa, Entamoeba histolytica
TSLQ

SEQ ID NO: 2576765 - protein, 6 aa, Entamoeba histolytica
TSLRTS

SEQ ID NO: 2576766 - protein, 13 aa, Entamoeba histolytica
TSLSSCSRQPQPG

SEQ ID NO: 2576767 - protein, 5 aa, Entamoeba histolytica
TSLST

SEQ ID NO: 2576768 - protein, 10 aa, Entamoeba histolytica
TSLSTQSDND

SEQ ID NO: 2576769 - protein, 7 aa, Entamoeba histolytica
TSLTKEI

SEQ ID NO: 2576770 - protein, 7 aa, Entamoeba histolytica
TSLTPKQ

SEQ ID NO: 2576771 - protein, 4 aa, Entamoeba histolytica
TSME

SEQ ID NO: 2576772 - protein, 6 aa, Entamoeba histolytica
TSMSEA

SEQ ID NO: 2576773 - protein, 8 aa, Entamoeba histolytica
TSNENNTY

SEQ ID NO: 2576774 - protein, 8 aa, Entamoeba histolytica
TSNETSDV

SEQ ID NO: 2576775 - protein, 4 aa, Entamoeba histolytica
TSNF

SEQ ID NO: 2576776 - protein, 6 aa, Entamoeba histolytica
TSNGIE

SEQ ID NO: 2576777 - protein, 8 aa, Entamoeba histolytica
TSNKDFNK

SEQ ID NO: 2576778 - protein, 10 aa, Entamoeba histolytica
TSNKEGKHAD

SEQ ID NO: 2576779 - protein, 11 aa, Entamoeba histolytica
TSNKQSSEGQK

SEQ ID NO: 2576780 - protein, 6 aa, Entamoeba histolytica
TSNKTT

SEQ ID NO: 2576781 - protein, 7 aa, Entamoeba histolytica
TSNLEKA

SEQ ID NO: 2576782 - protein, 7 aa, Entamoeba histolytica
TSNPTVS

SEQ ID NO: 2576783 - protein, 4 aa, Entamoeba histolytica
TSNR

SEQ ID NO: 2576784 - protein, 10 aa, Entamoeba histolytica
TSNSEVSTTI

SEQ ID NO: 2576785 - protein, 9 aa, Entamoeba histolytica
TSNSTTLDM

SEQ ID NO: 2576786 - protein, 4 aa, Entamoeba histolytica
TSNT

SEQ ID NO: 2576787 - protein, 7 aa, Entamoeba histolytica
TSNTLKT

SEQ ID NO: 2576788 - protein, 9 aa, Entamoeba histolytica
TSNTTKGHS

SEQ ID NO: 2576789 - protein, 8 aa, Entamoeba histolytica
TSNTTTPA

SEQ ID NO: 2576790 - protein, 6 aa, Entamoeba histolytica
TSNVTG

SEQ ID NO: 2576791 - protein, 6 aa, Entamoeba histolytica
TSPASL

SEQ ID NO: 2576792 - protein, 8 aa, Entamoeba histolytica
TSPATFST

SEQ ID NO: 2576793 - protein, 8 aa, Entamoeba histolytica
TSPATNVR

SEQ ID NO: 2576794 - protein, 10 aa, Entamoeba histolytica
TSPGTTPNGW

SEQ ID NO: 2576795 - protein, 4 aa, Entamoeba histolytica
TSPI

SEQ ID NO: 2576796 - protein, 7 aa, Entamoeba histolytica
TSPIGNN

SEQ ID NO: 2576797 - protein, 19 aa, Entamoeba histolytica
TSPIPSCDDTMEDSSTDTL

SEQ ID NO: 2576798 - protein, 8 aa, Entamoeba histolytica
TSPISYTE

SEQ ID NO: 2576799 - protein, 21 aa, Entamoeba histolytica
TSPKLEHKTEEKTTSQNSYEL

SEQ ID NO: 2576800 - protein, 7 aa, Entamoeba histolytica
TSPKNIQ

SEQ ID NO: 2576801 - protein, 8 aa, Entamoeba histolytica
TSPKTENN

SEQ ID NO: 2576802 - protein, 8 aa, Entamoeba histolytica
TSPKVSKE

SEQ ID NO: 2576803 - protein, 5 aa, Entamoeba histolytica
TSPNM

SEQ ID NO: 2576804 - protein, 24 aa, Entamoeba histolytica
TSPNQISKTNSNSQQNSSSMETNR

SEQ ID NO: 2576805 - protein, 4 aa, Entamoeba histolytica
TSPS

SEQ ID NO: 2576806 - protein, 8 aa, Entamoeba histolytica
TSPSGSLT

SEQ ID NO: 2576807 - protein, 8 aa, Entamoeba histolytica
TSPSKWKK

SEQ ID NO: 2576808 - protein, 4 aa, Entamoeba histolytica
TSPT

SEQ ID NO: 2576809 - protein, 5 aa, Entamoeba histolytica
TSPVD

SEQ ID NO: 2576810 - protein, 5 aa, Entamoeba histolytica
TSQGG

SEQ ID NO: 2576811 - protein, 7 aa, Entamoeba histolytica
TSQHSEL

SEQ ID NO: 2576812 - protein, 5 aa, Entamoeba histolytica
TSQHT

SEQ ID NO: 2576813 - protein, 16 aa, Entamoeba histolytica
TSQINTLSSSEYSPRQ

SEQ ID NO: 2576814 - protein, 6 aa, Entamoeba histolytica
TSQKNL

SEQ ID NO: 2576815 - protein, 10 aa, Entamoeba histolytica
TSQLDGETTL

SEQ ID NO: 2576816 - protein, 5 aa, Entamoeba histolytica
TSQPE

SEQ ID NO: 2576817 - protein, 10 aa, Entamoeba histolytica
TSQPNEGTAA

SEQ ID NO: 2576818 - protein, 24 aa, Entamoeba histolytica
TSQRAEYYSNSKAPNYNPPTAQNF

SEQ ID NO: 2576819 - protein, 5 aa, Entamoeba histolytica
TSQSS

SEQ ID NO: 2576820 - protein, 8 aa, Entamoeba histolytica
TSQTDTTF

SEQ ID NO: 2576821 - protein, 6 aa, Entamoeba histolytica
TSQTGK

SEQ ID NO: 2576822 - protein, 11 aa, Entamoeba histolytica
TSQTTKDSGDY

SEQ ID NO: 2576823 - protein, 7 aa, Entamoeba histolytica
TSRDNSI

SEQ ID NO: 2576824 - protein, 4 aa, Entamoeba histolytica
TSRG

SEQ ID NO: 2576825 - protein, 11 aa, Entamoeba histolytica
TSRIYSNKNQI

SEQ ID NO: 2576826 - protein, 14 aa, Entamoeba histolytica
TSRNSNNSLQQNGY

SEQ ID NO: 2576827 - protein, 8 aa, Entamoeba histolytica
TSRNTPRI

SEQ ID NO: 2576828 - protein, 13 aa, Entamoeba histolytica
TSRQARVQSMLDE

SEQ ID NO: 2576829 - protein, 4 aa, Entamoeba histolytica
TSRS

SEQ ID NO: 2576830 - protein, 17 aa, Entamoeba histolytica
TSRTSQTHCGGDSQKKG

SEQ ID NO: 2576831 - protein, 9 aa, Entamoeba histolytica
TSSDDKINV

SEQ ID NO: 2576832 - protein, 5 aa, Entamoeba histolytica
TSSDP

SEQ ID NO: 2576833 - protein, 17 aa, Entamoeba histolytica
TSSFSSYDKSEFVKLAS

SEQ ID NO: 2576834 - protein, 6 aa, Entamoeba histolytica
TSSGCS

SEQ ID NO: 2576835 - protein, 16 aa, Entamoeba histolytica
TSSGESDNSVGSNFNG

SEQ ID NO: 2576836 - protein, 5 aa, Entamoeba histolytica
TSSGI

SEQ ID NO: 2576837 - protein, 9 aa, Entamoeba histolytica
TSSGNETYL

SEQ ID NO: 2576838 - protein, 11 aa, Entamoeba histolytica
TSSHEDNPNVE

SEQ ID NO: 2576839 - protein, 8 aa, Entamoeba histolytica
TSSKEQID

SEQ ID NO: 2576840 - protein, 9 aa, Entamoeba histolytica
TSSKSGIKE

SEQ ID NO: 2576841 - protein, 7 aa, Entamoeba histolytica
TSSNQAS

SEQ ID NO: 2576842 - protein, 8 aa, Entamoeba histolytica
TSSQERSA

SEQ ID NO: 2576843 - protein, 8 aa, Entamoeba histolytica
TSSRDSHK

SEQ ID NO: 2576844 - protein, 12 aa, Entamoeba histolytica
TSSRGDKCKPCD

SEQ ID NO: 2576845 - protein, 4 aa, Entamoeba histolytica
TSSS

SEQ ID NO: 2576846 - protein, 10 aa, Entamoeba histolytica
TSSSDTSDYE

SEQ ID NO: 2576847 - protein, 5 aa, Entamoeba histolytica
TSSSI

SEQ ID NO: 2576848 - protein, 9 aa, Entamoeba histolytica
TSSSKQYEA

SEQ ID NO: 2576849 - protein, 5 aa, Entamoeba histolytica
TSSTK

SEQ ID NO: 2576850 - protein, 10 aa, Entamoeba histolytica
TSSTPAQTRV

SEQ ID NO: 2576851 - protein, 7 aa, Entamoeba histolytica
TSSTPSV

SEQ ID NO: 2576852 - protein, 8 aa, Entamoeba histolytica
TSSTSKSL

SEQ ID NO: 2576853 - protein, 13 aa, Entamoeba histolytica
TSSTTIKSIGKTT

SEQ ID NO: 2576854 - protein, 6 aa, Entamoeba histolytica
TSTDTN

SEQ ID NO: 2576855 - protein, 6 aa, Entamoeba histolytica
TSTEDL

SEQ ID NO: 2576856 - protein, 5 aa, Entamoeba histolytica
TSTGR

SEQ ID NO: 2576857 - protein, 7 aa, Entamoeba histolytica
TSTGSGR

SEQ ID NO: 2576858 - protein, 5 aa, Entamoeba histolytica
TSTIP

SEQ ID NO: 2576859 - protein, 9 aa, Entamoeba histolytica
TSTIQYNGT

SEQ ID NO: 2576860 - protein, 59 aa, Entamoeba histolytica
TSTKAEREALKKAEAEAKDNEIELSNSKENKVEISKNSSSSSRSSDEIQHPEEDIKELN

SEQ ID NO: 2576861 - protein, 21 aa, Entamoeba histolytica
TSTKEDDADSVSTQWESSDES

SEQ ID NO: 2576862 - protein, 10 aa, Entamoeba histolytica
TSTKPENQCT

SEQ ID NO: 2576863 - protein, 5 aa, Entamoeba histolytica
TSTLS

SEQ ID NO: 2576864 - protein, 6 aa, Entamoeba histolytica
TSTNID

SEQ ID NO: 2576865 - protein, 7 aa, Entamoeba histolytica
TSTNPKV

SEQ ID NO: 2576866 - protein, 8 aa, Entamoeba histolytica
TSTPSPVT

SEQ ID NO: 2576867 - protein, 5 aa, Entamoeba histolytica
TSTQL

SEQ ID NO: 2576868 - protein, 6 aa, Entamoeba histolytica
TSTQPL

SEQ ID NO: 2576869 - protein, 8 aa, Entamoeba histolytica
TSTSESNY

SEQ ID NO: 2576870 - protein, 9 aa, Entamoeba histolytica
TSTSGNSAW

SEQ ID NO: 2576871 - protein, 10 aa, Entamoeba histolytica
TSTSKHDRCE

SEQ ID NO: 2576872 - protein, 15 aa, Entamoeba histolytica
TSTSTRISFSGTENT

SEQ ID NO: 2576873 - protein, 10 aa, Entamoeba histolytica
TSTTTEDTSN

SEQ ID NO: 2576874 - protein, 4 aa, Entamoeba histolytica
TSTV

SEQ ID NO: 2576875 - protein, 7 aa, Entamoeba histolytica
TSVDPQP

SEQ ID NO: 2576876 - protein, 13 aa, Entamoeba histolytica
TSVNLGGSDSTAQ

SEQ ID NO: 2576877 - protein, 9 aa, Entamoeba histolytica
TSVPPNPQF

SEQ ID NO: 2576878 - protein, 15 aa, Entamoeba histolytica
TSVSNYDSKPLKKEQ

SEQ ID NO: 2576879 - protein, 6 aa, Entamoeba histolytica
TSVSPK

SEQ ID NO: 2576880 - protein, 5 aa, Entamoeba histolytica
TSVST

SEQ ID NO: 2576881 - protein, 5 aa, Entamoeba histolytica
TSVTV

SEQ ID NO: 2576882 - protein, 7 aa, Entamoeba histolytica
TSYDSDK

SEQ ID NO: 2576883 - protein, 10 aa, Entamoeba histolytica
TSYEPYRRPP

SEQ ID NO: 2576884 - protein, 4 aa, Entamoeba histolytica
TSYT

SEQ ID NO: 2576885 - protein, 13 aa, Entamoeba histolytica
TTAIDPKATSVSY

SEQ ID NO: 2576886 - protein, 8 aa, Entamoeba histolytica
TTAQPTSI

SEQ ID NO: 2576887 - protein, 18 aa, Entamoeba histolytica
TTARTSETKCGGVKPRKG

SEQ ID NO: 2576888 - protein, 24 aa, Entamoeba histolytica
TTASALYPSYTPQLAKTSISHQEA

SEQ ID NO: 2576889 - protein, 6 aa, Entamoeba histolytica
TTASNK

SEQ ID NO: 2576890 - protein, 5 aa, Entamoeba histolytica
TTASQ

SEQ ID NO: 2576891 - protein, 9 aa, Entamoeba histolytica
TTATEENKC

SEQ ID NO: 2576892 - protein, 14 aa, Entamoeba histolytica
TTAVQDSSSSLSSD

SEQ ID NO: 2576893 - protein, 6 aa, Entamoeba histolytica
TTCKEC

SEQ ID NO: 2576894 - protein, 8 aa, Entamoeba histolytica
TTCPGEDS

SEQ ID NO: 2576895 - protein, 15 aa, Entamoeba histolytica
TTCSKDRETLNGVNG

SEQ ID NO: 2576896 - protein, 4 aa, Entamoeba histolytica
TTCV

SEQ ID NO: 2576897 - protein, 9 aa, Entamoeba histolytica
TTDEENVGK

SEQ ID NO: 2576898 - protein, 16 aa, Entamoeba histolytica
TTDEKVADGVDEISQA

SEQ ID NO: 2576899 - protein, 10 aa, Entamoeba histolytica
TTDKPLTLSN

SEQ ID NO: 2576900 - protein, 6 aa, Entamoeba histolytica
TTDNSN

SEQ ID NO: 2576901 - protein, 6 aa, Entamoeba histolytica
TTDPLN

SEQ ID NO: 2576902 - protein, 11 aa, Entamoeba histolytica
TTDPNDPLSCK

SEQ ID NO: 2576903 - protein, 4 aa, Entamoeba histolytica
TTDS

SEQ ID NO: 2576904 - protein, 6 aa, Entamoeba histolytica
TTDTTL

SEQ ID NO: 2576905 - protein, 5 aa, Entamoeba histolytica
TTDYS

SEQ ID NO: 2576906 - protein, 7 aa, Entamoeba histolytica
TTECTDT

SEQ ID NO: 2576907 - protein, 6 aa, Entamoeba histolytica
TTEEER

SEQ ID NO: 2576908 - protein, 6 aa, Entamoeba histolytica
TTEENR

SEQ ID NO: 2576909 - protein, 7 aa, Entamoeba histolytica
TTEGDQF

SEQ ID NO: 2576910 - protein, 5 aa, Entamoeba histolytica
TTEMT

SEQ ID NO: 2576911 - protein, 4 aa, Entamoeba histolytica
TTEN

SEQ ID NO: 2576912 - protein, 6 aa, Entamoeba histolytica
TTERNN

SEQ ID NO: 2576913 - protein, 10 aa, Entamoeba histolytica
TTESKKDGLI

SEQ ID NO: 2576914 - protein, 6 aa, Entamoeba histolytica
TTESNS

SEQ ID NO: 2576915 - protein, 7 aa, Entamoeba histolytica
TTETNQT

SEQ ID NO: 2576916 - protein, 17 aa, Entamoeba histolytica
TTEVGEECEEGDGCKTE

SEQ ID NO: 2576917 - protein, 9 aa, Entamoeba histolytica
TTFKTTQRI

SEQ ID NO: 2576918 - protein, 4 aa, Entamoeba histolytica
TTFN

SEQ ID NO: 2576919 - protein, 11 aa, Entamoeba histolytica
TTFNPSSLTPG

SEQ ID NO: 2576920 - protein, 6 aa, Entamoeba histolytica
TTGDGY

SEQ ID NO: 2576921 - protein, 5 aa, Entamoeba histolytica
TTGIS

SEQ ID NO: 2576922 - protein, 5 aa, Entamoeba histolytica
TTGKN

SEQ ID NO: 2576923 - protein, 7 aa, Entamoeba histolytica
TTGNTDY

SEQ ID NO: 2576924 - protein, 7 aa, Entamoeba histolytica
TTGPTTN

SEQ ID NO: 2576925 - protein, 8 aa, Entamoeba histolytica
TTGQESIE

SEQ ID NO: 2576926 - protein, 8 aa, Entamoeba histolytica
TTGVGSPA

SEQ ID NO: 2576927 - protein, 14 aa, Entamoeba histolytica
TTHNTLETTSKPYI

SEQ ID NO: 2576928 - protein, 18 aa, Entamoeba histolytica
TTIAQDDPITIDPSGNYH

SEQ ID NO: 2576929 - protein, 11 aa, Entamoeba histolytica
TTINNNKGING

SEQ ID NO: 2576930 - protein, 11 aa, Entamoeba histolytica
TTIQPQQPPQI

SEQ ID NO: 2576931 - protein, 8 aa, Entamoeba histolytica
TTKEENNR

SEQ ID NO: 2576932 - protein, 15 aa, Entamoeba histolytica
TTKFDKRIDSSGIGI

SEQ ID NO: 2576933 - protein, 6 aa, Entamoeba histolytica
TTKFND

SEQ ID NO: 2576934 - protein, 8 aa, Entamoeba histolytica
TTKIDQSP

SEQ ID NO: 2576935 - protein, 6 aa, Entamoeba histolytica
TTKIPA

SEQ ID NO: 2576936 - protein, 7 aa, Entamoeba histolytica
TTKNGYS

SEQ ID NO: 2576937 - protein, 6 aa, Entamoeba histolytica
TTKPSV

SEQ ID NO: 2576938 - protein, 4 aa, Entamoeba histolytica
TTKS

SEQ ID NO: 2576939 - protein, 7 aa, Entamoeba histolytica
TTKSWNG

SEQ ID NO: 2576940 - protein, 4 aa, Entamoeba histolytica
TTKT

SEQ ID NO: 2576941 - protein, 5 aa, Entamoeba histolytica
TTKTN

SEQ ID NO: 2576942 - protein, 5 aa, Entamoeba histolytica
TTKVD

SEQ ID NO: 2576943 - protein, 9 aa, Entamoeba histolytica
TTLEVGGQT

SEQ ID NO: 2576944 - protein, 11 aa, Entamoeba histolytica
TTLSMKDENGI

SEQ ID NO: 2576945 - protein, 8 aa, Entamoeba histolytica
TTLSSDAQ

SEQ ID NO: 2576946 - protein, 5 aa, Entamoeba histolytica
TTLST

SEQ ID NO: 2576947 - protein, 9 aa, Entamoeba histolytica
TTLSTNNTT

SEQ ID NO: 2576948 - protein, 7 aa, Entamoeba histolytica
TTLTTGE

SEQ ID NO: 2576949 - protein, 6 aa, Entamoeba histolytica
TTMPEK

SEQ ID NO: 2576950 - protein, 4 aa, Entamoeba histolytica
TTND

SEQ ID NO: 2576951 - protein, 5 aa, Entamoeba histolytica
TTNEI

SEQ ID NO: 2576952 - protein, 9 aa, Entamoeba histolytica
TTNEITKTG

SEQ ID NO: 2576953 - protein, 4 aa, Entamoeba histolytica
TTNG

SEQ ID NO: 2576954 - protein, 7 aa, Entamoeba histolytica
TTNIDKS

SEQ ID NO: 2576955 - protein, 8 aa, Entamoeba histolytica
TTNKSQCY

SEQ ID NO: 2576956 - protein, 7 aa, Entamoeba histolytica
TTNKSSD

SEQ ID NO: 2576957 - protein, 7 aa, Entamoeba histolytica
TTNNDYS

SEQ ID NO: 2576958 - protein, 6 aa, Entamoeba histolytica
TTNNEC

SEQ ID NO: 2576959 - protein, 9 aa, Entamoeba histolytica
TTNPKTGSY

SEQ ID NO: 2576960 - protein, 10 aa, Entamoeba histolytica
TTNQTDINEE

SEQ ID NO: 2576961 - protein, 4 aa, Entamoeba histolytica
TTNS

SEQ ID NO: 2576962 - protein, 5 aa, Entamoeba histolytica
TTNSI

SEQ ID NO: 2576963 - protein, 6 aa, Entamoeba histolytica
TTNSIP

SEQ ID NO: 2576964 - protein, 10 aa, Entamoeba histolytica
TTNSPSDSTA

SEQ ID NO: 2576965 - protein, 4 aa, Entamoeba histolytica
TTNT

SEQ ID NO: 2576966 - protein, 9 aa, Entamoeba histolytica
TTNVPQNDI

SEQ ID NO: 2576967 - protein, 17 aa, Entamoeba histolytica
TTPCRSDNFDDPKTGER

SEQ ID NO: 2576968 - protein, 8 aa, Entamoeba histolytica
TTPDTKEI

SEQ ID NO: 2576969 - protein, 9 aa, Entamoeba histolytica
TTPDTQTQI

SEQ ID NO: 2576970 - protein, 14 aa, Entamoeba histolytica
TTPDYLNNPNTKKV

SEQ ID NO: 2576971 - protein, 4 aa, Entamoeba histolytica
TTPE

SEQ ID NO: 2576972 - protein, 7 aa, Entamoeba histolytica
TTPKEYA

SEQ ID NO: 2576973 - protein, 9 aa, Entamoeba histolytica
TTPNNQRRK

SEQ ID NO: 2576974 - protein, 5 aa, Entamoeba histolytica
TTPNS

SEQ ID NO: 2576975 - protein, 4 aa, Entamoeba histolytica
TTPP

SEQ ID NO: 2576976 - protein, 8 aa, Entamoeba histolytica
TTPPQQAK

SEQ ID NO: 2576977 - protein, 5 aa, Entamoeba histolytica
TTPPT

SEQ ID NO: 2576978 - protein, 8 aa, Entamoeba histolytica
TTPSDGPV

SEQ ID NO: 2576979 - protein, 5 aa, Entamoeba histolytica
TTPVS

SEQ ID NO: 2576980 - protein, 14 aa, Entamoeba histolytica
TTQDENDKYNIRTE

SEQ ID NO: 2576981 - protein, 20 aa, Entamoeba histolytica
TTQEERNAENNQVIEKGSHH

SEQ ID NO: 2576982 - protein, 6 aa, Entamoeba histolytica
TTQGDG

SEQ ID NO: 2576983 - protein, 12 aa, Entamoeba histolytica
TTQLNNDSPSSG

SEQ ID NO: 2576984 - protein, 5 aa, Entamoeba histolytica
TTQNF

SEQ ID NO: 2576985 - protein, 15 aa, Entamoeba histolytica
TTQNFQSGINKNDGY

SEQ ID NO: 2576986 - protein, 4 aa, Entamoeba histolytica
TTQP

SEQ ID NO: 2576987 - protein, 6 aa, Entamoeba histolytica
TTQSNT

SEQ ID NO: 2576988 - protein, 9 aa, Entamoeba histolytica
TTRDQWDNT

SEQ ID NO: 2576989 - protein, 8 aa, Entamoeba histolytica
TTRKRQNT

SEQ ID NO: 2576990 - protein, 6 aa, Entamoeba histolytica
TTRPST

SEQ ID NO: 2576991 - protein, 22 aa, Entamoeba histolytica
TTSDVNGADNVLEGDKIQGENI

SEQ ID NO: 2576992 - protein, 4 aa, Entamoeba histolytica
TTSE

SEQ ID NO: 2576993 - protein, 8 aa, Entamoeba histolytica
TTSGESTN

SEQ ID NO: 2576994 - protein, 7 aa, Entamoeba histolytica
TTSIEDK

SEQ ID NO: 2576995 - protein, 6 aa, Entamoeba histolytica
TTSIGK

SEQ ID NO: 2576996 - protein, 5 aa, Entamoeba histolytica
TTSIT

SEQ ID NO: 2576997 - protein, 6 aa, Entamoeba histolytica
TTSLAK

SEQ ID NO: 2576998 - protein, 25 aa, Entamoeba histolytica
TTSNENSFKKSQKTSVGSGGKNDTF

SEQ ID NO: 2576999 - protein, 7 aa, Entamoeba histolytica
TTSQLGS

SEQ ID NO: 2577000 - protein, 6 aa, Entamoeba histolytica
TTSSEV

SEQ ID NO: 2577001 - protein, 7 aa, Entamoeba histolytica
TTSSKIS

SEQ ID NO: 2577002 - protein, 13 aa, Entamoeba histolytica
TTSSSDKDNNPQC

SEQ ID NO: 2577003 - protein, 6 aa, Entamoeba histolytica
TTSSTS

SEQ ID NO: 2577004 - protein, 7 aa, Entamoeba histolytica
TTSTESN

SEQ ID NO: 2577005 - protein, 24 aa, Entamoeba histolytica
TTSTPSIDTQQKSVAQITEAQSTN

SEQ ID NO: 2577006 - protein, 8 aa, Entamoeba histolytica
TTSTTVTV

SEQ ID NO: 2577007 - protein, 5 aa, Entamoeba histolytica
TTSTV

SEQ ID NO: 2577008 - protein, 6 aa, Entamoeba histolytica
TTSWKD

SEQ ID NO: 2577009 - protein, 7 aa, Entamoeba histolytica
TTTATNG

SEQ ID NO: 2577010 - protein, 19 aa, Entamoeba histolytica
TTTCKPRYDPVTNKYNGDW

SEQ ID NO: 2577011 - protein, 9 aa, Entamoeba histolytica
TTTDGNKEC

SEQ ID NO: 2577012 - protein, 10 aa, Entamoeba histolytica
TTTDNNRRTQ

SEQ ID NO: 2577013 - protein, 4 aa, Entamoeba histolytica
TTTF

SEQ ID NO: 2577014 - protein, 4 aa, Entamoeba histolytica
TTTI

SEQ ID NO: 2577015 - protein, 4 aa, Entamoeba histolytica
TTTM

SEQ ID NO: 2577016 - protein, 8 aa, Entamoeba histolytica
TTTNSITT

SEQ ID NO: 2577017 - protein, 5 aa, Entamoeba histolytica
TTTQN

SEQ ID NO: 2577018 - protein, 5 aa, Entamoeba histolytica
TTTST

SEQ ID NO: 2577019 - protein, 10 aa, Entamoeba histolytica
TTTSVSSKQE

SEQ ID NO: 2577020 - protein, 5 aa, Entamoeba histolytica
TTTTE

SEQ ID NO: 2577021 - protein, 8 aa, Entamoeba histolytica
TTTTPTYK

SEQ ID NO: 2577022 - protein, 6 aa, Entamoeba histolytica
TTTTSY

SEQ ID NO: 2577023 - protein, 13 aa, Entamoeba histolytica
TTTTTTDNNNKIP

SEQ ID NO: 2577024 - protein, 5 aa, Entamoeba histolytica
TTTYK

SEQ ID NO: 2577025 - protein, 8 aa, Entamoeba histolytica
TTVDGSKL

SEQ ID NO: 2577026 - protein, 4 aa, Entamoeba histolytica
TTVE

SEQ ID NO: 2577027 - protein, 9 aa, Entamoeba histolytica
TTVEQNRLK

SEQ ID NO: 2577028 - protein, 5 aa, Entamoeba histolytica
TTVPQ

SEQ ID NO: 2577029 - protein, 4 aa, Entamoeba histolytica
TTVS

SEQ ID NO: 2577030 - protein, 7 aa, Entamoeba histolytica
TTWSQNS

SEQ ID NO: 2577031 - protein, 14 aa, Entamoeba histolytica
TTYAAESKNKEGNF

SEQ ID NO: 2577032 - protein, 4 aa, Entamoeba histolytica
TTYD

SEQ ID NO: 2577033 - protein, 7 aa, Entamoeba histolytica
TTYNLGS

SEQ ID NO: 2577034 - protein, 9 aa, Entamoeba histolytica
TVADPSDTF

SEQ ID NO: 2577035 - protein, 6 aa, Entamoeba histolytica
TVASGN

SEQ ID NO: 2577036 - protein, 29 aa, Entamoeba histolytica
TVDDNSNGSIPSSKSEETTDNSLENEGKY

SEQ ID NO: 2577037 - protein, 9 aa, Entamoeba histolytica
TVDGKKQKP

SEQ ID NO: 2577038 - protein, 9 aa, Entamoeba histolytica
TVEENPMTS

SEQ ID NO: 2577039 - protein, 5 aa, Entamoeba histolytica
TVEEV

SEQ ID NO: 2577040 - protein, 8 aa, Entamoeba histolytica
TVENNETS

SEQ ID NO: 2577041 - protein, 4 aa, Entamoeba histolytica
TVET

SEQ ID NO: 2577042 - protein, 8 aa, Entamoeba histolytica
TVETSTSN

SEQ ID NO: 2577043 - protein, 8 aa, Entamoeba histolytica
TVGEQNPV

SEQ ID NO: 2577044 - protein, 17 aa, Entamoeba histolytica
TVGKEASIGKENRNSSI

SEQ ID NO: 2577045 - protein, 15 aa, Entamoeba histolytica
TVIGGDSCKNATEME

SEQ ID NO: 2577046 - protein, 23 aa, Entamoeba histolytica
TVIQNKGTSKFKKRIKKEENKEI

SEQ ID NO: 2577047 - protein, 9 aa, Entamoeba histolytica
TVKIPEKPC

SEQ ID NO: 2577048 - protein, 4 aa, Entamoeba histolytica
TVKN

SEQ ID NO: 2577049 - protein, 10 aa, Entamoeba histolytica
TVKNNPENKQ

SEQ ID NO: 2577050 - protein, 5 aa, Entamoeba histolytica
TVKSD

SEQ ID NO: 2577051 - protein, 11 aa, Entamoeba histolytica
TVKTALGNSNL

SEQ ID NO: 2577052 - protein, 5 aa, Entamoeba histolytica
TVKTQ

SEQ ID NO: 2577053 - protein, 8 aa, Entamoeba histolytica
TVNGKHKQ

SEQ ID NO: 2577054 - protein, 18 aa, Entamoeba histolytica
TVNKENDDKNKPNADEDI

SEQ ID NO: 2577055 - protein, 8 aa, Entamoeba histolytica
TVNQNQSI

SEQ ID NO: 2577056 - protein, 28 aa, Entamoeba histolytica
TVNQRKRKPYKTGLGDTIESSKEIENNN

SEQ ID NO: 2577057 - protein, 4 aa, Entamoeba histolytica
TVNY

SEQ ID NO: 2577058 - protein, 23 aa, Entamoeba histolytica
TVPGGANVTSSSSAFQVKEGTYS

SEQ ID NO: 2577059 - protein, 5 aa, Entamoeba histolytica
TVPGI

SEQ ID NO: 2577060 - protein, 12 aa, Entamoeba histolytica
TVPPSSLPDSTE

SEQ ID NO: 2577061 - protein, 9 aa, Entamoeba histolytica
TVPSNYDYP

SEQ ID NO: 2577062 - protein, 4 aa, Entamoeba histolytica
TVPT

SEQ ID NO: 2577063 - protein, 6 aa, Entamoeba histolytica
TVQEQI

SEQ ID NO: 2577064 - protein, 5 aa, Entamoeba histolytica
TVQTP

SEQ ID NO: 2577065 - protein, 6 aa, Entamoeba histolytica
TVRPGD

SEQ ID NO: 2577066 - protein, 89 aa, Entamoeba histolytica
TVSDAAKKYEQNSIKAMEDAKRVREEERKKQKEEQNKREEQSKREKEQKEEKIKEEKKEEPNEQKQTKDFPKKIDQKEETSPIKKEDKK

SEQ ID NO: 2577067 - protein, 8 aa, Entamoeba histolytica
TVSNLDEA

SEQ ID NO: 2577068 - protein, 12 aa, Entamoeba histolytica
TVSNLKEGALNG

SEQ ID NO: 2577069 - protein, 6 aa, Entamoeba histolytica
TVSPIT

SEQ ID NO: 2577070 - protein, 4 aa, Entamoeba histolytica
TVSQ

SEQ ID NO: 2577071 - protein, 9 aa, Entamoeba histolytica
TVSSDTKVD

SEQ ID NO: 2577072 - protein, 21 aa, Entamoeba histolytica
TVSSKKKDNNKKQDTETVPQD

SEQ ID NO: 2577073 - protein, 14 aa, Entamoeba histolytica
TVSSTTKVKEFPKQ

SEQ ID NO: 2577074 - protein, 12 aa, Entamoeba histolytica
TVTDSTCETTEC

SEQ ID NO: 2577075 - protein, 9 aa, Entamoeba histolytica
TVTTDEHAE

SEQ ID NO: 2577076 - protein, 12 aa, Entamoeba histolytica
TVTTGSESLETG

SEQ ID NO: 2577077 - protein, 5 aa, Entamoeba histolytica
TWDDI

SEQ ID NO: 2577078 - protein, 5 aa, Entamoeba histolytica
TWNDE

SEQ ID NO: 2577079 - protein, 13 aa, Entamoeba histolytica
TWQPKGNNGNGQC

SEQ ID NO: 2577080 - protein, 13 aa, Entamoeba histolytica
TWSRTGNPDWSRT

SEQ ID NO: 2577081 - protein, 5 aa, Entamoeba histolytica
TYASQ

SEQ ID NO: 2577082 - protein, 8 aa, Entamoeba histolytica
TYCNDPNN

SEQ ID NO: 2577083 - protein, 9 aa, Entamoeba histolytica
TYDTEHSKE

SEQ ID NO: 2577084 - protein, 5 aa, Entamoeba histolytica
TYEGS

SEQ ID NO: 2577085 - protein, 6 aa, Entamoeba histolytica
TYEVKP

SEQ ID NO: 2577086 - protein, 7 aa, Entamoeba histolytica
TYFSPSS

SEQ ID NO: 2577087 - protein, 9 aa, Entamoeba histolytica
TYGCGENSR

SEQ ID NO: 2577088 - protein, 8 aa, Entamoeba histolytica
TYGGTPNV

SEQ ID NO: 2577089 - protein, 9 aa, Entamoeba histolytica
TYGHPHPNA

SEQ ID NO: 2577090 - protein, 5 aa, Entamoeba histolytica
TYGKE

SEQ ID NO: 2577091 - protein, 11 aa, Entamoeba histolytica
TYGTTTFNSVT

SEQ ID NO: 2577092 - protein, 5 aa, Entamoeba histolytica
TYIDD

SEQ ID NO: 2577093 - protein, 8 aa, Entamoeba histolytica
TYKEENRR

SEQ ID NO: 2577094 - protein, 6 aa, Entamoeba histolytica
TYKETN

SEQ ID NO: 2577095 - protein, 11 aa, Entamoeba histolytica
TYKFETRTTPQ

SEQ ID NO: 2577096 - protein, 9 aa, Entamoeba histolytica
TYKNNNKNK

SEQ ID NO: 2577097 - protein, 7 aa, Entamoeba histolytica
TYKSNKI

SEQ ID NO: 2577098 - protein, 10 aa, Entamoeba histolytica
TYLNETTQSA

SEQ ID NO: 2577099 - protein, 8 aa, Entamoeba histolytica
TYNDNSDL

SEQ ID NO: 2577100 - protein, 9 aa, Entamoeba histolytica
TYNDPGKYL

SEQ ID NO: 2577101 - protein, 12 aa, Entamoeba histolytica
TYNDTKQQKSVP

SEQ ID NO: 2577102 - protein, 11 aa, Entamoeba histolytica
TYNKATGKSIL

SEQ ID NO: 2577103 - protein, 5 aa, Entamoeba histolytica
TYNSG

SEQ ID NO: 2577104 - protein, 11 aa, Entamoeba histolytica
TYPIPKPSVQR

SEQ ID NO: 2577105 - protein, 5 aa, Entamoeba histolytica
TYPIQ

SEQ ID NO: 2577106 - protein, 4 aa, Entamoeba histolytica
TYPK

SEQ ID NO: 2577107 - protein, 5 aa, Entamoeba histolytica
TYPPC

SEQ ID NO: 2577108 - protein, 9 aa, Entamoeba histolytica
TYQPPIGEG

SEQ ID NO: 2577109 - protein, 5 aa, Entamoeba histolytica
TYQTF

SEQ ID NO: 2577110 - protein, 6 aa, Entamoeba histolytica
TYRGQD

SEQ ID NO: 2577111 - protein, 6 aa, Entamoeba histolytica
TYSASA

SEQ ID NO: 2577112 - protein, 7 aa, Entamoeba histolytica
TYSGQFD

SEQ ID NO: 2577113 - protein, 6 aa, Entamoeba histolytica
TYSHSQ

SEQ ID NO: 2577114 - protein, 11 aa, Entamoeba histolytica
TYSKGEKNTYC

SEQ ID NO: 2577115 - protein, 13 aa, Entamoeba histolytica
TYSKTKFRQGNPK

SEQ ID NO: 2577116 - protein, 12 aa, Entamoeba histolytica
TYSNGNDNEQIQ

SEQ ID NO: 2577117 - protein, 10 aa, Entamoeba histolytica
TYSNKEGSGI

SEQ ID NO: 2577118 - protein, 8 aa, Entamoeba histolytica
TYSNPNEF

SEQ ID NO: 2577119 - protein, 12 aa, Entamoeba histolytica
TYSPDSKGECIN

SEQ ID NO: 2577120 - protein, 12 aa, Entamoeba histolytica
TYSPSSYSGRGD

SEQ ID NO: 2577121 - protein, 12 aa, Entamoeba histolytica
TYSTEKSTSCSK

SEQ ID NO: 2577122 - protein, 9 aa, Entamoeba histolytica
TYSTGNTSK

SEQ ID NO: 2577123 - protein, 17 aa, Entamoeba histolytica
TYTDETGQLQQCSDDCN

SEQ ID NO: 2577124 - protein, 10 aa, Entamoeba histolytica
TYTEKNGKCI

SEQ ID NO: 2577125 - protein, 12 aa, Entamoeba histolytica
TYTGRNGGWGEG

SEQ ID NO: 2577126 - protein, 7 aa, Entamoeba histolytica
TYTKPKK

SEQ ID NO: 2577127 - protein, 4 aa, Entamoeba histolytica
TYTQ

SEQ ID NO: 2577128 - protein, 4 aa, Entamoeba histolytica
TYTS

SEQ ID NO: 2577129 - protein, 4 aa, Entamoeba histolytica
TYYE

SEQ ID NO: 2577130 - protein, 14 aa, Entamoeba histolytica
VAASTKNCKRSTEN

SEQ ID NO: 2577131 - protein, 7 aa, Entamoeba histolytica
VADDGIS

SEQ ID NO: 2577132 - protein, 5 aa, Entamoeba histolytica
VADSD

SEQ ID NO: 2577133 - protein, 4 aa, Entamoeba histolytica
VADT

SEQ ID NO: 2577134 - protein, 12 aa, Entamoeba histolytica
VAEKPKTIKEKC

SEQ ID NO: 2577135 - protein, 9 aa, Entamoeba histolytica
VAGETKSGF

SEQ ID NO: 2577136 - protein, 5 aa, Entamoeba histolytica
VAGSY

SEQ ID NO: 2577137 - protein, 7 aa, Entamoeba histolytica
VAGSYDN

SEQ ID NO: 2577138 - protein, 9 aa, Entamoeba histolytica
VAKKKTTIF

SEQ ID NO: 2577139 - protein, 9 aa, Entamoeba histolytica
VANAATQAR

SEQ ID NO: 2577140 - protein, 11 aa, Entamoeba histolytica
VAPEPQDKSMS

SEQ ID NO: 2577141 - protein, 5 aa, Entamoeba histolytica
VAPNE

SEQ ID NO: 2577142 - protein, 23 aa, Entamoeba histolytica
VAREYDNDPYTLTAKASGKTGLE

SEQ ID NO: 2577143 - protein, 4 aa, Entamoeba histolytica
VASS

SEQ ID NO: 2577144 - protein, 4 aa, Entamoeba histolytica
VAST

SEQ ID NO: 2577145 - protein, 5 aa, Entamoeba histolytica
VATAT

SEQ ID NO: 2577146 - protein, 17 aa, Entamoeba histolytica
VAVEQGTKVAVSAAASQ

SEQ ID NO: 2577147 - protein, 11 aa, Entamoeba histolytica
VAVQSSTSSPV

SEQ ID NO: 2577148 - protein, 8 aa, Entamoeba histolytica
VCNTPGDS

SEQ ID NO: 2577149 - protein, 9 aa, Entamoeba histolytica
VDATKDASA

SEQ ID NO: 2577150 - protein, 11 aa, Entamoeba histolytica
VDDGEECDGGI

SEQ ID NO: 2577151 - protein, 8 aa, Entamoeba histolytica
VDDGSEGK

SEQ ID NO: 2577152 - protein, 7 aa, Entamoeba histolytica
VDDNGNV

SEQ ID NO: 2577153 - protein, 9 aa, Entamoeba histolytica
VDDQTKETA

SEQ ID NO: 2577154 - protein, 25 aa, Entamoeba histolytica
VDDSQQDTQTNATQDEVLCAIVDDV

SEQ ID NO: 2577155 - protein, 8 aa, Entamoeba histolytica
VDDTNGNY

SEQ ID NO: 2577156 - protein, 16 aa, Entamoeba histolytica
VDEEEDCDISQQKDDI

SEQ ID NO: 2577157 - protein, 11 aa, Entamoeba histolytica
VDEEKKEEDQY

SEQ ID NO: 2577158 - protein, 9 aa, Entamoeba histolytica
VDENKELPN

SEQ ID NO: 2577159 - protein, 6 aa, Entamoeba histolytica
VDEQQI

SEQ ID NO: 2577160 - protein, 11 aa, Entamoeba histolytica
VDESGNKKMIE

SEQ ID NO: 2577161 - protein, 10 aa, Entamoeba histolytica
VDESKNKKLP

SEQ ID NO: 2577162 - protein, 22 aa, Entamoeba histolytica
VDGAVGGAVGGAVGGAVGGAVG

SEQ ID NO: 2577163 - protein, 8 aa, Entamoeba histolytica
VDGECKEC

SEQ ID NO: 2577164 - protein, 7 aa, Entamoeba histolytica
VDGKWSD

SEQ ID NO: 2577165 - protein, 7 aa, Entamoeba histolytica
VDGNSEK

SEQ ID NO: 2577166 - protein, 16 aa, Entamoeba histolytica
VDHKKNSVDKEINDTE

SEQ ID NO: 2577167 - protein, 9 aa, Entamoeba histolytica
VDIAPTNVA

SEQ ID NO: 2577168 - protein, 7 aa, Entamoeba histolytica
VDKTGGL

SEQ ID NO: 2577169 - protein, 41 aa, Entamoeba histolytica
VDLSQGDESFDSEESSGSEQSDKKDNSSESKESQKSDGPTK

SEQ ID NO: 2577170 - protein, 13 aa, Entamoeba histolytica
VDPHATKKAVGQE

SEQ ID NO: 2577171 - protein, 9 aa, Entamoeba histolytica
VDPHPAKDK

SEQ ID NO: 2577172 - protein, 4 aa, Entamoeba histolytica
VDPN

SEQ ID NO: 2577173 - protein, 15 aa, Entamoeba histolytica
VDPTKKDSAVISSPN

SEQ ID NO: 2577174 - protein, 8 aa, Entamoeba histolytica
VDPTNNST

SEQ ID NO: 2577175 - protein, 9 aa, Entamoeba histolytica
VDQGTDIAQ

SEQ ID NO: 2577176 - protein, 9 aa, Entamoeba histolytica
VDQKEERAK

SEQ ID NO: 2577177 - protein, 8 aa, Entamoeba histolytica
VDQQQRRE

SEQ ID NO: 2577178 - protein, 7 aa, Entamoeba histolytica
VDRENTK

SEQ ID NO: 2577179 - protein, 8 aa, Entamoeba histolytica
VDRGKQGI

SEQ ID NO: 2577180 - protein, 8 aa, Entamoeba histolytica
VDSEEGVE

SEQ ID NO: 2577181 - protein, 8 aa, Entamoeba histolytica
VDSGKRLE

SEQ ID NO: 2577182 - protein, 7 aa, Entamoeba histolytica
VDSHGNA

SEQ ID NO: 2577183 - protein, 4 aa, Entamoeba histolytica
VDSL

SEQ ID NO: 2577184 - protein, 4 aa, Entamoeba histolytica
VDSR

SEQ ID NO: 2577185 - protein, 6 aa, Entamoeba histolytica
VDSSPN

SEQ ID NO: 2577186 - protein, 9 aa, Entamoeba histolytica
VDSSYNQTE

SEQ ID NO: 2577187 - protein, 48 aa, Entamoeba histolytica
VDTNDGEFGDFSDNQYSSDNNTLLNNNEGINENNTKQEEEEDNEEGNS

SEQ ID NO: 2577188 - protein, 6 aa, Entamoeba histolytica
VDYESR

SEQ ID NO: 2577189 - protein, 5 aa, Entamoeba histolytica
VEADK

SEQ ID NO: 2577190 - protein, 6 aa, Entamoeba histolytica
VEDEDY

SEQ ID NO: 2577191 - protein, 5 aa, Entamoeba histolytica
VEDEI

SEQ ID NO: 2577192 - protein, 8 aa, Entamoeba histolytica
VEDEIRPK

SEQ ID NO: 2577193 - protein, 5 aa, Entamoeba histolytica
VEDGE

SEQ ID NO: 2577194 - protein, 8 aa, Entamoeba histolytica
VEDGNYTT

SEQ ID NO: 2577195 - protein, 29 aa, Entamoeba histolytica
VEDKKEGTQELNQGETQQENKSLSSEGES

SEQ ID NO: 2577196 - protein, 12 aa, Entamoeba histolytica
VEDKPQTYRLDG

SEQ ID NO: 2577197 - protein, 13 aa, Entamoeba histolytica
VEDRLQDNVPQTI

SEQ ID NO: 2577198 - protein, 9 aa, Entamoeba histolytica
VEDTDTTFE

SEQ ID NO: 2577199 - protein, 9 aa, Entamoeba histolytica
VEEDDDEFI

SEQ ID NO: 2577200 - protein, 4 aa, Entamoeba histolytica
VEEG

SEQ ID NO: 2577201 - protein, 7 aa, Entamoeba histolytica
VEEKVGT

SEQ ID NO: 2577202 - protein, 18 aa, Entamoeba histolytica
VEENAKKAKETVQEKSSS

SEQ ID NO: 2577203 - protein, 13 aa, Entamoeba histolytica
VEENGKNLSSGTK

SEQ ID NO: 2577204 - protein, 10 aa, Entamoeba histolytica
VEEQKKEGYP

SEQ ID NO: 2577205 - protein, 6 aa, Entamoeba histolytica
VEEQQT

SEQ ID NO: 2577206 - protein, 6 aa, Entamoeba histolytica
VEERRQ

SEQ ID NO: 2577207 - protein, 9 aa, Entamoeba histolytica
VEESKRSSI

SEQ ID NO: 2577208 - protein, 8 aa, Entamoeba histolytica
VEESSKGF

SEQ ID NO: 2577209 - protein, 11 aa, Entamoeba histolytica
VEGDVYARSNE

SEQ ID NO: 2577210 - protein, 4 aa, Entamoeba histolytica
VEGG

SEQ ID NO: 2577211 - protein, 4 aa, Entamoeba histolytica
VEGQ

SEQ ID NO: 2577212 - protein, 7 aa, Entamoeba histolytica
VEHNDKI

SEQ ID NO: 2577213 - protein, 9 aa, Entamoeba histolytica
VEKGNKGSL

SEQ ID NO: 2577214 - protein, 10 aa, Entamoeba histolytica
VEKKKKIEGV

SEQ ID NO: 2577215 - protein, 4 aa, Entamoeba histolytica
VEKP

SEQ ID NO: 2577216 - protein, 7 aa, Entamoeba histolytica
VEKPKPL

SEQ ID NO: 2577217 - protein, 8 aa, Entamoeba histolytica
VEKRTQSL

SEQ ID NO: 2577218 - protein, 7 aa, Entamoeba histolytica
VELGEGK

SEQ ID NO: 2577219 - protein, 4 aa, Entamoeba histolytica
VELT

SEQ ID NO: 2577220 - protein, 4 aa, Entamoeba histolytica
VENA

SEQ ID NO: 2577221 - protein, 6 aa, Entamoeba histolytica
VENEPT

SEQ ID NO: 2577222 - protein, 8 aa, Entamoeba histolytica
VENGNSYG

SEQ ID NO: 2577223 - protein, 23 aa, Entamoeba histolytica
VENIPKNQNMTNQAPQKEIEMTS

SEQ ID NO: 2577224 - protein, 14 aa, Entamoeba histolytica
VENKASEQTKKEKE

SEQ ID NO: 2577225 - protein, 37 aa, Entamoeba histolytica
VENKNKVKTSASRTSNKLKATLDNKKTFTATSSTISF

SEQ ID NO: 2577226 - protein, 4 aa, Entamoeba histolytica
VENS

SEQ ID NO: 2577227 - protein, 14 aa, Entamoeba histolytica
VEQDQSSCISSYEP

SEQ ID NO: 2577228 - protein, 9 aa, Entamoeba histolytica
VEQENTFNQ

SEQ ID NO: 2577229 - protein, 7 aa, Entamoeba histolytica
VEQEPIT

SEQ ID NO: 2577230 - protein, 6 aa, Entamoeba histolytica
VEQGKT

SEQ ID NO: 2577231 - protein, 12 aa, Entamoeba histolytica
VEQNESTTSQQL

SEQ ID NO: 2577232 - protein, 8 aa, Entamoeba histolytica
VEQPKRNK

SEQ ID NO: 2577233 - protein, 5 aa, Entamoeba histolytica
VERDE

SEQ ID NO: 2577234 - protein, 12 aa, Entamoeba histolytica
VERDQSYADDDG

SEQ ID NO: 2577235 - protein, 9 aa, Entamoeba histolytica
VEREENDFN

SEQ ID NO: 2577236 - protein, 13 aa, Entamoeba histolytica
VERSHSNSSIKGL

SEQ ID NO: 2577237 - protein, 7 aa, Entamoeba histolytica
VESDSSL

SEQ ID NO: 2577238 - protein, 8 aa, Entamoeba histolytica
VESGKRLG

SEQ ID NO: 2577239 - protein, 11 aa, Entamoeba histolytica
VESGKRLPLGD

SEQ ID NO: 2577240 - protein, 11 aa, Entamoeba histolytica
VESPNDETSEK

SEQ ID NO: 2577241 - protein, 6 aa, Entamoeba histolytica
VESQTI

SEQ ID NO: 2577242 - protein, 9 aa, Entamoeba histolytica
VESSSYGAT

SEQ ID NO: 2577243 - protein, 17 aa, Entamoeba histolytica
VETPKQSIELPRNEKPI

SEQ ID NO: 2577244 - protein, 6 aa, Entamoeba histolytica
VETQNA

SEQ ID NO: 2577245 - protein, 12 aa, Entamoeba histolytica
VETQRCGKNNSY

SEQ ID NO: 2577246 - protein, 5 aa, Entamoeba histolytica
VETSH

SEQ ID NO: 2577247 - protein, 8 aa, Entamoeba histolytica
VEVKEERG

SEQ ID NO: 2577248 - protein, 9 aa, Entamoeba histolytica
VEVQTQSTA

SEQ ID NO: 2577249 - protein, 10 aa, Entamoeba histolytica
VEYPKGSDGY

SEQ ID NO: 2577250 - protein, 8 aa, Entamoeba histolytica
VFGSKNPA

SEQ ID NO: 2577251 - protein, 4 aa, Entamoeba histolytica
VFSE

SEQ ID NO: 2577252 - protein, 11 aa, Entamoeba histolytica
VFTEDNAENCK

SEQ ID NO: 2577253 - protein, 8 aa, Entamoeba histolytica
VGDGANDI

SEQ ID NO: 2577254 - protein, 12 aa, Entamoeba histolytica
VGDGKTDQERRI

SEQ ID NO: 2577255 - protein, 9 aa, Entamoeba histolytica
VGDMSDSSI

SEQ ID NO: 2577256 - protein, 22 aa, Entamoeba histolytica
VGDTTKSETEKAKVENGEEERS

SEQ ID NO: 2577257 - protein, 9 aa, Entamoeba histolytica
VGEEKPRSV

SEQ ID NO: 2577258 - protein, 14 aa, Entamoeba histolytica
VGEGSALTCKQGAT

SEQ ID NO: 2577259 - protein, 24 aa, Entamoeba histolytica
VGEQDTSPSEISRDDNQSLDSQEK

SEQ ID NO: 2577260 - protein, 10 aa, Entamoeba histolytica
VGETEQTQFS

SEQ ID NO: 2577261 - protein, 12 aa, Entamoeba histolytica
VGETGKTKKGWD

SEQ ID NO: 2577262 - protein, 21 aa, Entamoeba histolytica
VGFHSDDGKLFNENGNGEVFN

SEQ ID NO: 2577263 - protein, 6 aa, Entamoeba histolytica
VGGAES

SEQ ID NO: 2577264 - protein, 4 aa, Entamoeba histolytica
VGGD

SEQ ID NO: 2577265 - protein, 8 aa, Entamoeba histolytica
VGGGDGSI

SEQ ID NO: 2577266 - protein, 7 aa, Entamoeba histolytica
VGHDESV

SEQ ID NO: 2577267 - protein, 14 aa, Entamoeba histolytica
VGKEAPKGQENRRS

SEQ ID NO: 2577268 - protein, 36 aa, Entamoeba histolytica
VGKEKKPKKVKTKAVKQNKENKKKEKKVSEKEKQGI

SEQ ID NO: 2577269 - protein, 5 aa, Entamoeba histolytica
VGKES

SEQ ID NO: 2577270 - protein, 16 aa, Entamoeba histolytica
VGKGTTVIKPQNNGVT

SEQ ID NO: 2577271 - protein, 5 aa, Entamoeba histolytica
VGKNA

SEQ ID NO: 2577272 - protein, 8 aa, Entamoeba histolytica
VGKSGDVT

SEQ ID NO: 2577273 - protein, 7 aa, Entamoeba histolytica
VGKTRTY

SEQ ID NO: 2577274 - protein, 11 aa, Entamoeba histolytica
VGNSTKSETDI

SEQ ID NO: 2577275 - protein, 9 aa, Entamoeba histolytica
VGNTSSSSV

SEQ ID NO: 2577276 - protein, 5 aa, Entamoeba histolytica
VGPKP

SEQ ID NO: 2577277 - protein, 19 aa, Entamoeba histolytica
VGQSPSSVVEGTELNTTEA

SEQ ID NO: 2577278 - protein, 7 aa, Entamoeba histolytica
VGQSPTT

SEQ ID NO: 2577279 - protein, 11 aa, Entamoeba histolytica
VGSGEGKELEH

SEQ ID NO: 2577280 - protein, 6 aa, Entamoeba histolytica
VGSNEA

SEQ ID NO: 2577281 - protein, 7 aa, Entamoeba histolytica
VGSSNKF

SEQ ID NO: 2577282 - protein, 13 aa, Entamoeba histolytica
VGSYSSMKGSDRC

SEQ ID NO: 2577283 - protein, 9 aa, Entamoeba histolytica
VGTPTPIHS

SEQ ID NO: 2577284 - protein, 8 aa, Entamoeba histolytica
VGTSNGPY

SEQ ID NO: 2577285 - protein, 7 aa, Entamoeba histolytica
VGTSNQL

SEQ ID NO: 2577286 - protein, 14 aa, Entamoeba histolytica
VGVAGSGAALADAQ

SEQ ID NO: 2577287 - protein, 4 aa, Entamoeba histolytica
VGYQ

SEQ ID NO: 2577288 - protein, 4 aa, Entamoeba histolytica
VHDL

SEQ ID NO: 2577289 - protein, 19 aa, Entamoeba histolytica
VIDDTKKISPAATKTGNDY

SEQ ID NO: 2577290 - protein, 4 aa, Entamoeba histolytica
VIDS

SEQ ID NO: 2577291 - protein, 20 aa, Entamoeba histolytica
VIEPKKQRSEVKKRNIESMK

SEQ ID NO: 2577292 - protein, 6 aa, Entamoeba histolytica
VIGASG

SEQ ID NO: 2577293 - protein, 5 aa, Entamoeba histolytica
VIGEG

SEQ ID NO: 2577294 - protein, 5 aa, Entamoeba histolytica
VIGGE

SEQ ID NO: 2577295 - protein, 4 aa, Entamoeba histolytica
VIKS

SEQ ID NO: 2577296 - protein, 5 aa, Entamoeba histolytica
VIKSD

SEQ ID NO: 2577297 - protein, 10 aa, Entamoeba histolytica
VIPKNQQSRG

SEQ ID NO: 2577298 - protein, 10 aa, Entamoeba histolytica
VKASEIQDEI

SEQ ID NO: 2577299 - protein, 10 aa, Entamoeba histolytica
VKCGGSQSRI

SEQ ID NO: 2577300 - protein, 7 aa, Entamoeba histolytica
VKDETSF

SEQ ID NO: 2577301 - protein, 9 aa, Entamoeba histolytica
VKDNEQVKV

SEQ ID NO: 2577302 - protein, 6 aa, Entamoeba histolytica
VKDNPE

SEQ ID NO: 2577303 - protein, 8 aa, Entamoeba histolytica
VKDQDNSF

SEQ ID NO: 2577304 - protein, 15 aa, Entamoeba histolytica
VKDTKEKEEEITQED

SEQ ID NO: 2577305 - protein, 27 aa, Entamoeba histolytica
VKDTPQEHDKISNKEEKMEEENSEIKE

SEQ ID NO: 2577306 - protein, 6 aa, Entamoeba histolytica
VKEATK

SEQ ID NO: 2577307 - protein, 10 aa, Entamoeba histolytica
VKEDEDGRLS

SEQ ID NO: 2577308 - protein, 10 aa, Entamoeba histolytica
VKEDEDGTLS

SEQ ID NO: 2577309 - protein, 15 aa, Entamoeba histolytica
VKEDNKNQTNLTEDN

SEQ ID NO: 2577310 - protein, 7 aa, Entamoeba histolytica
VKEEMKD

SEQ ID NO: 2577311 - protein, 14 aa, Entamoeba histolytica
VKEETEKNSQTEIK

SEQ ID NO: 2577312 - protein, 12 aa, Entamoeba histolytica
VKEKPKMKKQEM

SEQ ID NO: 2577313 - protein, 28 aa, Entamoeba histolytica
VKEKTKNYSETEIKSDQTEDKKEIKHQK

SEQ ID NO: 2577314 - protein, 5 aa, Entamoeba histolytica
VKEPT

SEQ ID NO: 2577315 - protein, 14 aa, Entamoeba histolytica
VKEQKERPTNQNSY

SEQ ID NO: 2577316 - protein, 7 aa, Entamoeba histolytica
VKETQDI

SEQ ID NO: 2577317 - protein, 13 aa, Entamoeba histolytica
VKGNKEKRNNEPH

SEQ ID NO: 2577318 - protein, 7 aa, Entamoeba histolytica
VKGNTPK

SEQ ID NO: 2577319 - protein, 7 aa, Entamoeba histolytica
VKGREEK

SEQ ID NO: 2577320 - protein, 5 aa, Entamoeba histolytica
VKGRG

SEQ ID NO: 2577321 - protein, 10 aa, Entamoeba histolytica
VKKDDNCALA

SEQ ID NO: 2577322 - protein, 8 aa, Entamoeba histolytica
VKKGMKAS

SEQ ID NO: 2577323 - protein, 21 aa, Entamoeba histolytica
VKKKEENETKKPKKMNEQNQK

SEQ ID NO: 2577324 - protein, 11 aa, Entamoeba histolytica
VKKKPEKDYMP

SEQ ID NO: 2577325 - protein, 12 aa, Entamoeba histolytica
VKKQNYECNPNT

SEQ ID NO: 2577326 - protein, 9 aa, Entamoeba histolytica
VKKTTNCDS

SEQ ID NO: 2577327 - protein, 4 aa, Entamoeba histolytica
VKLP

SEQ ID NO: 2577328 - protein, 9 aa, Entamoeba histolytica
VKNGKIKPN

SEQ ID NO: 2577329 - protein, 8 aa, Entamoeba histolytica
VKNPTRNI

SEQ ID NO: 2577330 - protein, 7 aa, Entamoeba histolytica
VKNQFSR

SEQ ID NO: 2577331 - protein, 8 aa, Entamoeba histolytica
VKPIEGKY

SEQ ID NO: 2577332 - protein, 12 aa, Entamoeba histolytica
VKPLSPSSSLSQ

SEQ ID NO: 2577333 - protein, 23 aa, Entamoeba histolytica
VKPPKEIEKNEYEPVKTINGEDP

SEQ ID NO: 2577334 - protein, 23 aa, Entamoeba histolytica
VKPPKEIENNEYEPVKTINGEDP

SEQ ID NO: 2577335 - protein, 23 aa, Entamoeba histolytica
VKPPKEIGNNEYEPVKTINGEDP

SEQ ID NO: 2577336 - protein, 7 aa, Entamoeba histolytica
VKPPSAT

SEQ ID NO: 2577337 - protein, 14 aa, Entamoeba histolytica
VKPTEEDKNNPRFK

SEQ ID NO: 2577338 - protein, 8 aa, Entamoeba histolytica
VKQDDEEI

SEQ ID NO: 2577339 - protein, 7 aa, Entamoeba histolytica
VKRPNIN

SEQ ID NO: 2577340 - protein, 8 aa, Entamoeba histolytica
VKSDNKYM

SEQ ID NO: 2577341 - protein, 39 aa, Entamoeba histolytica
VKSENESSDTEEVDFENKTRNSLGQSYDNDKLNKPVEPM

SEQ ID NO: 2577342 - protein, 7 aa, Entamoeba histolytica
VKSKYED

SEQ ID NO: 2577343 - protein, 4 aa, Entamoeba histolytica
VKSN

SEQ ID NO: 2577344 - protein, 10 aa, Entamoeba histolytica
VKSSQKLPAG

SEQ ID NO: 2577345 - protein, 12 aa, Entamoeba histolytica
VKSTDGKCQECS

SEQ ID NO: 2577346 - protein, 8 aa, Entamoeba histolytica
VKTDTPGF

SEQ ID NO: 2577347 - protein, 12 aa, Entamoeba histolytica
VKTEQDDHDEDV

SEQ ID NO: 2577348 - protein, 9 aa, Entamoeba histolytica
VKTINGKDP

SEQ ID NO: 2577349 - protein, 12 aa, Entamoeba histolytica
VKTNSDKSEKKT

SEQ ID NO: 2577350 - protein, 9 aa, Entamoeba histolytica
VKTPKGNKE

SEQ ID NO: 2577351 - protein, 10 aa, Entamoeba histolytica
VKTQGFEYTD

SEQ ID NO: 2577352 - protein, 12 aa, Entamoeba histolytica
VKTQPAKENRYD

SEQ ID NO: 2577353 - protein, 9 aa, Entamoeba histolytica
VKTRSHPKT

SEQ ID NO: 2577354 - protein, 8 aa, Entamoeba histolytica
VKVGNGVN

SEQ ID NO: 2577355 - protein, 4 aa, Entamoeba histolytica
VKVP

SEQ ID NO: 2577356 - protein, 7 aa, Entamoeba histolytica
VKVPKVP

SEQ ID NO: 2577357 - protein, 5 aa, Entamoeba histolytica
VKYDN

SEQ ID NO: 2577358 - protein, 10 aa, Entamoeba histolytica
VKYGGEKDVD

SEQ ID NO: 2577359 - protein, 5 aa, Entamoeba histolytica
VKYRE

SEQ ID NO: 2577360 - protein, 18 aa, Entamoeba histolytica
VLGKKNENKPVEGLFKKD

SEQ ID NO: 2577361 - protein, 11 aa, Entamoeba histolytica
VLNSRNEEKSY

SEQ ID NO: 2577362 - protein, 7 aa, Entamoeba histolytica
VLPPTNN

SEQ ID NO: 2577363 - protein, 13 aa, Entamoeba histolytica
VLTGNKPTTKSDI

SEQ ID NO: 2577364 - protein, 6 aa, Entamoeba histolytica
VMDGNG

SEQ ID NO: 2577365 - protein, 6 aa, Entamoeba histolytica
VMTDEK

SEQ ID NO: 2577366 - protein, 6 aa, Entamoeba histolytica
VNAQKA

SEQ ID NO: 2577367 - protein, 10 aa, Entamoeba histolytica
VNASNNTPKK

SEQ ID NO: 2577368 - protein, 8 aa, Entamoeba histolytica
VNDDPATF

SEQ ID NO: 2577369 - protein, 4 aa, Entamoeba histolytica
VNDE

SEQ ID NO: 2577370 - protein, 13 aa, Entamoeba histolytica
VNDGEECDGGDGC

SEQ ID NO: 2577371 - protein, 5 aa, Entamoeba histolytica
VNDKT

SEQ ID NO: 2577372 - protein, 5 aa, Entamoeba histolytica
VNDQS

SEQ ID NO: 2577373 - protein, 30 aa, Entamoeba histolytica
VNDRDEKKIRKEEKAKVQSENNKEVNTSTS

SEQ ID NO: 2577374 - protein, 7 aa, Entamoeba histolytica
VNDTAKK

SEQ ID NO: 2577375 - protein, 5 aa, Entamoeba histolytica
VNEEN

SEQ ID NO: 2577376 - protein, 4 aa, Entamoeba histolytica
VNEN

SEQ ID NO: 2577377 - protein, 6 aa, Entamoeba histolytica
VNENRD

SEQ ID NO: 2577378 - protein, 16 aa, Entamoeba histolytica
VNEQNYSSACFMTKTV

SEQ ID NO: 2577379 - protein, 54 aa, Entamoeba histolytica
VNESDDIAKKEEGLDNDGEISVSSESASGSASSSYSSNGSGSSNGSDVGSGSAS

SEQ ID NO: 2577380 - protein, 5 aa, Entamoeba histolytica
VNETT

SEQ ID NO: 2577381 - protein, 7 aa, Entamoeba histolytica
VNGCTKC

SEQ ID NO: 2577382 - protein, 4 aa, Entamoeba histolytica
VNGG

SEQ ID NO: 2577383 - protein, 4 aa, Entamoeba histolytica
VNGL

SEQ ID NO: 2577384 - protein, 11 aa, Entamoeba histolytica
VNGNSSSITPI

SEQ ID NO: 2577385 - protein, 10 aa, Entamoeba histolytica
VNGTSSTKCA

SEQ ID NO: 2577386 - protein, 13 aa, Entamoeba histolytica
VNIPEEENKEKNW

SEQ ID NO: 2577387 - protein, 5 aa, Entamoeba histolytica
VNKAP

SEQ ID NO: 2577388 - protein, 6 aa, Entamoeba histolytica
VNKESK

SEQ ID NO: 2577389 - protein, 9 aa, Entamoeba histolytica
VNKESSNNI

SEQ ID NO: 2577390 - protein, 4 aa, Entamoeba histolytica
VNKG

SEQ ID NO: 2577391 - protein, 9 aa, Entamoeba histolytica
VNKKKRSVT

SEQ ID NO: 2577392 - protein, 7 aa, Entamoeba histolytica
VNKLGNS

SEQ ID NO: 2577393 - protein, 10 aa, Entamoeba histolytica
VNKMNEQSLA

SEQ ID NO: 2577394 - protein, 21 aa, Entamoeba histolytica
VNKQNNGCDCTDGYTANGPQQ

SEQ ID NO: 2577395 - protein, 6 aa, Entamoeba histolytica
VNLPEK

SEQ ID NO: 2577396 - protein, 8 aa, Entamoeba histolytica
VNNDKKND

SEQ ID NO: 2577397 - protein, 8 aa, Entamoeba histolytica
VNNGDSKY

SEQ ID NO: 2577398 - protein, 10 aa, Entamoeba histolytica
VNNTKENEHY

SEQ ID NO: 2577399 - protein, 16 aa, Entamoeba histolytica
VNPDSSLSKNDGWEEL

SEQ ID NO: 2577400 - protein, 8 aa, Entamoeba histolytica
VNPSDNAV

SEQ ID NO: 2577401 - protein, 10 aa, Entamoeba histolytica
VNPSLNENNY

SEQ ID NO: 2577402 - protein, 32 aa, Entamoeba histolytica
VNQNEQPAQENQVPQSQEQTNQNEVPQQPNQE

SEQ ID NO: 2577403 - protein, 6 aa, Entamoeba histolytica
VNQNER

SEQ ID NO: 2577404 - protein, 6 aa, Entamoeba histolytica
VNQNGQ

SEQ ID NO: 2577405 - protein, 10 aa, Entamoeba histolytica
VNQPSAPVIP

SEQ ID NO: 2577406 - protein, 12 aa, Entamoeba histolytica
VNQQKDSEISSE

SEQ ID NO: 2577407 - protein, 11 aa, Entamoeba histolytica
VNQQNIKQEVP

SEQ ID NO: 2577408 - protein, 7 aa, Entamoeba histolytica
VNRDQEE

SEQ ID NO: 2577409 - protein, 13 aa, Entamoeba histolytica
VNRNGGNEYDESG

SEQ ID NO: 2577410 - protein, 5 aa, Entamoeba histolytica
VNRRS

SEQ ID NO: 2577411 - protein, 7 aa, Entamoeba histolytica
VNSEHNQ

SEQ ID NO: 2577412 - protein, 7 aa, Entamoeba histolytica
VNSETPH

SEQ ID NO: 2577413 - protein, 8 aa, Entamoeba histolytica
VNSGPSSN

SEQ ID NO: 2577414 - protein, 7 aa, Entamoeba histolytica
VNSIQTD

SEQ ID NO: 2577415 - protein, 7 aa, Entamoeba histolytica
VNSNNPE

SEQ ID NO: 2577416 - protein, 5 aa, Entamoeba histolytica
VNSNS

SEQ ID NO: 2577417 - protein, 7 aa, Entamoeba histolytica
VNSNSRD

SEQ ID NO: 2577418 - protein, 15 aa, Entamoeba histolytica
VNSQSKTTITTESPL

SEQ ID NO: 2577419 - protein, 4 aa, Entamoeba histolytica
VNSS

SEQ ID NO: 2577420 - protein, 7 aa, Entamoeba histolytica
VNSTESY

SEQ ID NO: 2577421 - protein, 7 aa, Entamoeba histolytica
VNSTNEV

SEQ ID NO: 2577422 - protein, 9 aa, Entamoeba histolytica
VNTDETQLT

SEQ ID NO: 2577423 - protein, 7 aa, Entamoeba histolytica
VNTGENK

SEQ ID NO: 2577424 - protein, 7 aa, Entamoeba histolytica
VNTNTNQ

SEQ ID NO: 2577425 - protein, 6 aa, Entamoeba histolytica
VNTTKK

SEQ ID NO: 2577426 - protein, 6 aa, Entamoeba histolytica
VNVSSE

SEQ ID NO: 2577427 - protein, 11 aa, Entamoeba histolytica
VPAGTNGGVSS

SEQ ID NO: 2577428 - protein, 5 aa, Entamoeba histolytica
VPDIE

SEQ ID NO: 2577429 - protein, 4 aa, Entamoeba histolytica
VPEL

SEQ ID NO: 2577430 - protein, 9 aa, Entamoeba histolytica
VPGDPTQAT

SEQ ID NO: 2577431 - protein, 5 aa, Entamoeba histolytica
VPGKD

SEQ ID NO: 2577432 - protein, 7 aa, Entamoeba histolytica
VPGQDNP

SEQ ID NO: 2577433 - protein, 6 aa, Entamoeba histolytica
VPGSSN

SEQ ID NO: 2577434 - protein, 34 aa, Entamoeba histolytica
VPHTGNEQQPNNQNNNNNDGDNDYINNDYDSGFG

SEQ ID NO: 2577435 - protein, 4 aa, Entamoeba histolytica
VPIE

SEQ ID NO: 2577436 - protein, 8 aa, Entamoeba histolytica
VPKGYDDD

SEQ ID NO: 2577437 - protein, 7 aa, Entamoeba histolytica
VPKNNSN

SEQ ID NO: 2577438 - protein, 6 aa, Entamoeba histolytica
VPKNSV

SEQ ID NO: 2577439 - protein, 5 aa, Entamoeba histolytica
VPKQI

SEQ ID NO: 2577440 - protein, 6 aa, Entamoeba histolytica
VPKRPQ

SEQ ID NO: 2577441 - protein, 8 aa, Entamoeba histolytica
VPNEENDQ

SEQ ID NO: 2577442 - protein, 5 aa, Entamoeba histolytica
VPNGR

SEQ ID NO: 2577443 - protein, 4 aa, Entamoeba histolytica
VPNK

SEQ ID NO: 2577444 - protein, 10 aa, Entamoeba histolytica
VPNQQESESP

SEQ ID NO: 2577445 - protein, 5 aa, Entamoeba histolytica
VPNSN

SEQ ID NO: 2577446 - protein, 13 aa, Entamoeba histolytica
VPPDDTYKSSRYE

SEQ ID NO: 2577447 - protein, 5 aa, Entamoeba histolytica
VPPEG

SEQ ID NO: 2577448 - protein, 5 aa, Entamoeba histolytica
VPPQV

SEQ ID NO: 2577449 - protein, 13 aa, Entamoeba histolytica
VPSCSNGKYYGKT

SEQ ID NO: 2577450 - protein, 18 aa, Entamoeba histolytica
VPSDDDPLSCQEKSSATT

SEQ ID NO: 2577451 - protein, 7 aa, Entamoeba histolytica
VPSDPTI

SEQ ID NO: 2577452 - protein, 10 aa, Entamoeba histolytica
VPSGEVPTQY

SEQ ID NO: 2577453 - protein, 8 aa, Entamoeba histolytica
VPTCGNGK

SEQ ID NO: 2577454 - protein, 24 aa, Entamoeba histolytica
VPTIVSNSNASTIKINSANDKSEN

SEQ ID NO: 2577455 - protein, 4 aa, Entamoeba histolytica
VPTN

SEQ ID NO: 2577456 - protein, 22 aa, Entamoeba histolytica
VPTSLNTSVSSSCSSSIRMSLD

SEQ ID NO: 2577457 - protein, 11 aa, Entamoeba histolytica
VPTTKSNSIDK

SEQ ID NO: 2577458 - protein, 17 aa, Entamoeba histolytica
VPYPQQQTQQRTTTNNN

SEQ ID NO: 2577459 - protein, 8 aa, Entamoeba histolytica
VQAKDKSY

SEQ ID NO: 2577460 - protein, 11 aa, Entamoeba histolytica
VQDELQEGVPE

SEQ ID NO: 2577461 - protein, 15 aa, Entamoeba histolytica
VQEDPIGRIETEGSS

SEQ ID NO: 2577462 - protein, 35 aa, Entamoeba histolytica
VQEEEEEGQGTGPKLLPQDESQEAQKEAKKIEEKT

SEQ ID NO: 2577463 - protein, 263 aa, Entamoeba histolytica
VQEEESSKESGTLSEPNSKGTINSTRSDRNSQTGTVVEGQEDSSISGSGTTGTVSGKNNRVSETGNTNVKQENKEGEVVSEQESTSAWNENTKEQSDKEVVKPGNTGSSGTEQKGTSDTQNVGTESDGAETSARHGKDEKHQINEEAGSSKEGVSDKGSSGTGNEDKGIGTSGKNSKGGETETTTGKNGEKNIKGENEKENKEEKEPKNEQKDQELKKTSEDEKKNEQKDGNQEIDNKTASSSDSSESKTDNDINNNFDSTAS

SEQ ID NO: 2577464 - protein, 10 aa, Entamoeba histolytica
VQEISNENSI

SEQ ID NO: 2577465 - protein, 19 aa, Entamoeba histolytica
VQEQKDDEETEEEEEEDLG

SEQ ID NO: 2577466 - protein, 6 aa, Entamoeba histolytica
VQGDDN

SEQ ID NO: 2577467 - protein, 5 aa, Entamoeba histolytica
VQGPL

SEQ ID NO: 2577468 - protein, 8 aa, Entamoeba histolytica
VQHKTSSI

SEQ ID NO: 2577469 - protein, 5 aa, Entamoeba histolytica
VQLNG

SEQ ID NO: 2577470 - protein, 14 aa, Entamoeba histolytica
VQPERSDPSNHDGG

SEQ ID NO: 2577471 - protein, 5 aa, Entamoeba histolytica
VQPTN

SEQ ID NO: 2577472 - protein, 10 aa, Entamoeba histolytica
VQPTTKKGRQ

SEQ ID NO: 2577473 - protein, 10 aa, Entamoeba histolytica
VQQPTTKNRT

SEQ ID NO: 2577474 - protein, 5 aa, Entamoeba histolytica
VQSAG

SEQ ID NO: 2577475 - protein, 18 aa, Entamoeba histolytica
VQSFSQSKYLDQEDPNEE

SEQ ID NO: 2577476 - protein, 7 aa, Entamoeba histolytica
VQSKPSS

SEQ ID NO: 2577477 - protein, 6 aa, Entamoeba histolytica
VQSKRY

SEQ ID NO: 2577478 - protein, 7 aa, Entamoeba histolytica
VQSPSKV

SEQ ID NO: 2577479 - protein, 4 aa, Entamoeba histolytica
VQSQ

SEQ ID NO: 2577480 - protein, 9 aa, Entamoeba histolytica
VQSQKKDIQ

SEQ ID NO: 2577481 - protein, 13 aa, Entamoeba histolytica
VQSSPKAKNLSKD

SEQ ID NO: 2577482 - protein, 8 aa, Entamoeba histolytica
VQSTTENT

SEQ ID NO: 2577483 - protein, 10 aa, Entamoeba histolytica
VQTDSNQQTY

SEQ ID NO: 2577484 - protein, 7 aa, Entamoeba histolytica
VQTNNPG

SEQ ID NO: 2577485 - protein, 6 aa, Entamoeba histolytica
VQTRDM

SEQ ID NO: 2577486 - protein, 18 aa, Entamoeba histolytica
VRAPPINKTDVDEEDGER

SEQ ID NO: 2577487 - protein, 7 aa, Entamoeba histolytica
VRDEYDT

SEQ ID NO: 2577488 - protein, 7 aa, Entamoeba histolytica
VRDKETI

SEQ ID NO: 2577489 - protein, 11 aa, Entamoeba histolytica
VREDEDGSLSI

SEQ ID NO: 2577490 - protein, 21 aa, Entamoeba histolytica
VREREKRKKEAAQHQKEPEDM

SEQ ID NO: 2577491 - protein, 23 aa, Entamoeba histolytica
VRERLKSEKQEKEKKDNQHSTQL

SEQ ID NO: 2577492 - protein, 17 aa, Entamoeba histolytica
VRGEDKRAELTKKSLSD

SEQ ID NO: 2577493 - protein, 5 aa, Entamoeba histolytica
VRGPD

SEQ ID NO: 2577494 - protein, 4 aa, Entamoeba histolytica
VRKD

SEQ ID NO: 2577495 - protein, 6 aa, Entamoeba histolytica
VRKEKP

SEQ ID NO: 2577496 - protein, 10 aa, Entamoeba histolytica
VRKEYEKKGI

SEQ ID NO: 2577497 - protein, 8 aa, Entamoeba histolytica
VRKTSENF

SEQ ID NO: 2577498 - protein, 7 aa, Entamoeba histolytica
VRQPEPS

SEQ ID NO: 2577499 - protein, 11 aa, Entamoeba histolytica
VRQRESKKEKF

SEQ ID NO: 2577500 - protein, 4 aa, Entamoeba histolytica
VRRS

SEQ ID NO: 2577501 - protein, 8 aa, Entamoeba histolytica
VRRSVSGN

SEQ ID NO: 2577502 - protein, 6 aa, Entamoeba histolytica
VRTDVE

SEQ ID NO: 2577503 - protein, 23 aa, Entamoeba histolytica
VSAKKKDNNKKEEQKQETTPQDV

SEQ ID NO: 2577504 - protein, 20 aa, Entamoeba histolytica
VSANPDSQTNETKGCYGISD

SEQ ID NO: 2577505 - protein, 9 aa, Entamoeba histolytica
VSATNKEYD

SEQ ID NO: 2577506 - protein, 17 aa, Entamoeba histolytica
VSCDTKSNCKTCSTDSN

SEQ ID NO: 2577507 - protein, 14 aa, Entamoeba histolytica
VSCPPGTRLDNSNN

SEQ ID NO: 2577508 - protein, 7 aa, Entamoeba histolytica
VSCSPSS

SEQ ID NO: 2577509 - protein, 11 aa, Entamoeba histolytica
VSDDTNSETRD

SEQ ID NO: 2577510 - protein, 6 aa, Entamoeba histolytica
VSDEKI

SEQ ID NO: 2577511 - protein, 7 aa, Entamoeba histolytica
VSDETFE

SEQ ID NO: 2577512 - protein, 7 aa, Entamoeba histolytica
VSDPLKS

SEQ ID NO: 2577513 - protein, 4 aa, Entamoeba histolytica
VSDS

SEQ ID NO: 2577514 - protein, 5 aa, Entamoeba histolytica
VSDSS

SEQ ID NO: 2577515 - protein, 13 aa, Entamoeba histolytica
VSDVSSVECETRQ

SEQ ID NO: 2577516 - protein, 5 aa, Entamoeba histolytica
VSEEK

SEQ ID NO: 2577517 - protein, 7 aa, Entamoeba histolytica
VSEETTY

SEQ ID NO: 2577518 - protein, 7 aa, Entamoeba histolytica
VSEGTEN

SEQ ID NO: 2577519 - protein, 9 aa, Entamoeba histolytica
VSEKEESGF

SEQ ID NO: 2577520 - protein, 9 aa, Entamoeba histolytica
VSEKSKHIQ

SEQ ID NO: 2577521 - protein, 10 aa, Entamoeba histolytica
VSEQSFSSDS

SEQ ID NO: 2577522 - protein, 34 aa, Entamoeba histolytica; identical to SEQ ID NO: 2378623

SEQ ID NO: 2577523 - protein, 9 aa, Entamoeba histolytica
VSFSPNGIT

SEQ ID NO: 2577524 - protein, 12 aa, Entamoeba histolytica
VSFSQENDGTTI

SEQ ID NO: 2577525 - protein, 13 aa, Entamoeba histolytica
VSGDELDEEHSEC

SEQ ID NO: 2577526 - protein, 7 aa, Entamoeba histolytica
VSGIDEY

SEQ ID NO: 2577527 - protein, 4 aa, Entamoeba histolytica
VSGN

SEQ ID NO: 2577528 - protein, 4 aa, Entamoeba histolytica
VSGR

SEQ ID NO: 2577529 - protein, 22 aa, Entamoeba histolytica
VSGSPNSQTREVDVQSGEGDRK

SEQ ID NO: 2577530 - protein, 8 aa, Entamoeba histolytica
VSGTCDSN

SEQ ID NO: 2577531 - protein, 8 aa, Entamoeba histolytica
VSGTCGSN

SEQ ID NO: 2577532 - protein, 8 aa, Entamoeba histolytica
VSGYADEI

SEQ ID NO: 2577533 - protein, 7 aa, Entamoeba histolytica
VSHNTTN

SEQ ID NO: 2577534 - protein, 10 aa, Entamoeba histolytica
VSIKGNEKCK

SEQ ID NO: 2577535 - protein, 9 aa, Entamoeba histolytica
VSKEKKIEK

SEQ ID NO: 2577536 - protein, 10 aa, Entamoeba histolytica
VSKGEKAEAV

SEQ ID NO: 2577537 - protein, 30 aa, Entamoeba histolytica
VSKSSTRYSTYGTSSDISEGELNEDIEQGN

SEQ ID NO: 2577538 - protein, 13 aa, Entamoeba histolytica
VSLENSSRKEYTE

SEQ ID NO: 2577539 - protein, 7 aa, Entamoeba histolytica
VSLSSQE

SEQ ID NO: 2577540 - protein, 9 aa, Entamoeba histolytica
VSLSTNSLY

SEQ ID NO: 2577541 - protein, 5 aa, Entamoeba histolytica
VSNCE

SEQ ID NO: 2577542 - protein, 6 aa, Entamoeba histolytica
VSNDEP

SEQ ID NO: 2577543 - protein, 10 aa, Entamoeba histolytica
VSNDVQEKFE

SEQ ID NO: 2577544 - protein, 8 aa, Entamoeba histolytica
VSNEVNAN

SEQ ID NO: 2577545 - protein, 28 aa, Entamoeba histolytica
VSNGACASCDEGYELKTESGSGSTQKCT

SEQ ID NO: 2577546 - protein, 7 aa, Entamoeba histolytica
VSNGNQT

SEQ ID NO: 2577547 - protein, 8 aa, Entamoeba histolytica
VSNGQNEF

SEQ ID NO: 2577548 - protein, 9 aa, Entamoeba histolytica
VSNGQNEFK

SEQ ID NO: 2577549 - protein, 7 aa, Entamoeba histolytica
VSNNGAL

SEQ ID NO: 2577550 - protein, 12 aa, Entamoeba histolytica
VSNSNNDNQSIK

SEQ ID NO: 2577551 - protein, 5 aa, Entamoeba histolytica
VSNYQ

SEQ ID NO: 2577552 - protein, 9 aa, Entamoeba histolytica
VSPDNTTTR

SEQ ID NO: 2577553 - protein, 7 aa, Entamoeba histolytica
VSPEDKL

SEQ ID NO: 2577554 - protein, 7 aa, Entamoeba histolytica
VSPEPLK

SEQ ID NO: 2577555 - protein, 17 aa, Entamoeba histolytica
VSPLESASLEPATVGSG

SEQ ID NO: 2577556 - protein, 7 aa, Entamoeba histolytica
VSPMQKK

SEQ ID NO: 2577557 - protein, 10 aa, Entamoeba histolytica
VSPPKGSLGW

SEQ ID NO: 2577558 - protein, 9 aa, Entamoeba histolytica
VSPSAASHG

SEQ ID NO: 2577559 - protein, 5 aa, Entamoeba histolytica
VSPSK

SEQ ID NO: 2577560 - protein, 26 aa, Entamoeba histolytica
VSPSLQQEIEESQMTKEQINQEEKDD

SEQ ID NO: 2577561 - protein, 17 aa, Entamoeba histolytica
VSPSQNQSSVQNSFDKR

SEQ ID NO: 2577562 - protein, 6 aa, Entamoeba histolytica
VSPSSL

SEQ ID NO: 2577563 - protein, 8 aa, Entamoeba histolytica
VSPSTGGS

SEQ ID NO: 2577564 - protein, 6 aa, Entamoeba histolytica
VSPTED

SEQ ID NO: 2577565 - protein, 9 aa, Entamoeba histolytica
VSPYEENPC

SEQ ID NO: 2577566 - protein, 12 aa, Entamoeba histolytica
VSQKPEPQDSKD

SEQ ID NO: 2577567 - protein, 5 aa, Entamoeba histolytica
VSQSA

SEQ ID NO: 2577568 - protein, 7 aa, Entamoeba histolytica
VSQSATH

SEQ ID NO: 2577569 - protein, 6 aa, Entamoeba histolytica
VSQSEE

SEQ ID NO: 2577570 - protein, 7 aa, Entamoeba histolytica
VSRDHTY

SEQ ID NO: 2577571 - protein, 25 aa, Entamoeba histolytica
VSREGSGSLMSSSEPSNSTVSTPRR

SEQ ID NO: 2577572 - protein, 6 aa, Entamoeba histolytica
VSSAKG

SEQ ID NO: 2577573 - protein, 8 aa, Entamoeba histolytica
VSSDNAVH

SEQ ID NO: 2577574 - protein, 6 aa, Entamoeba histolytica
VSSEST

SEQ ID NO: 2577575 - protein, 10 aa, Entamoeba histolytica
VSSGNCKPCP

SEQ ID NO: 2577576 - protein, 10 aa, Entamoeba histolytica
VSSKKINGEV

SEQ ID NO: 2577577 - protein, 9 aa, Entamoeba histolytica
VSSLSTSLP

SEQ ID NO: 2577578 - protein, 26 aa, Entamoeba histolytica
VSSNKEERDADRSNSQEENNEGGDIY

SEQ ID NO: 2577579 - protein, 8 aa, Entamoeba histolytica
VSSNLKEE

SEQ ID NO: 2577580 - protein, 12 aa, Entamoeba histolytica
VSSQAKKPKRDV

SEQ ID NO: 2577581 - protein, 7 aa, Entamoeba histolytica
VSSQMTD

SEQ ID NO: 2577582 - protein, 4 aa, Entamoeba histolytica
VSSS

SEQ ID NO: 2577583 - protein, 9 aa, Entamoeba histolytica
VSSSAPMSG

SEQ ID NO: 2577584 - protein, 23 aa, Entamoeba histolytica
VSSSPNSQTRDAVRENGKGERSD

SEQ ID NO: 2577585 - protein, 8 aa, Entamoeba histolytica
VSSTPRKP

SEQ ID NO: 2577586 - protein, 6 aa, Entamoeba histolytica
VSSTQK

SEQ ID NO: 2577587 - protein, 15 aa, Entamoeba histolytica
VSSVDSSDIPNNIDG

SEQ ID NO: 2577588 - protein, 10 aa, Entamoeba histolytica
VSTCSKDISH

SEQ ID NO: 2577589 - protein, 20 aa, Entamoeba histolytica
VSTQKKIAQNINQEIDEQEP

SEQ ID NO: 2577590 - protein, 18 aa, Entamoeba histolytica
VSTQRLQPQQGTSRPLPK

SEQ ID NO: 2577591 - protein, 13 aa, Entamoeba histolytica
VSTSNLSIESPDL

SEQ ID NO: 2577592 - protein, 6 aa, Entamoeba histolytica
VSTSPT

SEQ ID NO: 2577593 - protein, 7 aa, Entamoeba histolytica
VSTSQAM

SEQ ID NO: 2577594 - protein, 8 aa, Entamoeba histolytica
VSTTTTCK

SEQ ID NO: 2577595 - protein, 5 aa, Entamoeba histolytica
VSVSS

SEQ ID NO: 2577596 - protein, 9 aa, Entamoeba histolytica
VSVSTGNGK

SEQ ID NO: 2577597 - protein, 11 aa, Entamoeba histolytica
VSYQTSGNSGN

SEQ ID NO: 2577598 - protein, 9 aa, Entamoeba histolytica
VTASSGDNQ

SEQ ID NO: 2577599 - protein, 8 aa, Entamoeba histolytica
VTDGKRLG

SEQ ID NO: 2577600 - protein, 12 aa, Entamoeba histolytica
VTDGNEGHTFEA

SEQ ID NO: 2577601 - protein, 7 aa, Entamoeba histolytica
VTDGNGT

SEQ ID NO: 2577602 - protein, 8 aa, Entamoeba histolytica
VTDGNGTM

SEQ ID NO: 2577603 - protein, 5 aa, Entamoeba histolytica
VTDNE

SEQ ID NO: 2577604 - protein, 14 aa, Entamoeba histolytica
VTDTSSSVKSIQSS

SEQ ID NO: 2577605 - protein, 4 aa, Entamoeba histolytica
VTEN

SEQ ID NO: 2577606 - protein, 17 aa, Entamoeba histolytica
VTENKSKQEGKKESEKW

SEQ ID NO: 2577607 - protein, 12 aa, Entamoeba histolytica
VTGDGTNDVPAF

SEQ ID NO: 2577608 - protein, 14 aa, Entamoeba histolytica
VTGDGTNDVPALKE

SEQ ID NO: 2577609 - protein, 36 aa, Entamoeba histolytica
VTGKGRKKTGSVNHSDITELSDTTSSDDIKRSGKEN

SEQ ID NO: 2577610 - protein, 20 aa, Entamoeba histolytica
VTGSPSPISLGGSKASSTSI

SEQ ID NO: 2577611 - protein, 8 aa, Entamoeba histolytica
VTGTKLTG

SEQ ID NO: 2577612 - protein, 5 aa, Entamoeba histolytica
VTGYA

SEQ ID NO: 2577613 - protein, 4 aa, Entamoeba histolytica
VTIT

SEQ ID NO: 2577614 - protein, 5 aa, Entamoeba histolytica
VTKDN

SEQ ID NO: 2577615 - protein, 13 aa, Entamoeba histolytica
VTKQSNKKNESPL

SEQ ID NO: 2577616 - protein, 8 aa, Entamoeba histolytica
VTKTTTLD

SEQ ID NO: 2577617 - protein, 12 aa, Entamoeba histolytica
VTLEDGKEYQYN

SEQ ID NO: 2577618 - protein, 7 aa, Entamoeba histolytica
VTNGQCS

SEQ ID NO: 2577619 - protein, 7 aa, Entamoeba histolytica
VTNNTET

SEQ ID NO: 2577620 - protein, 5 aa, Entamoeba histolytica
VTNPQ

SEQ ID NO: 2577621 - protein, 6 aa, Entamoeba histolytica
VTPAEH

SEQ ID NO: 2577622 - protein, 213 aa, Entamoeba histolytica
VTPGESTPKSGTAPTEGGSVTTQGDTTQTPSKSEKSEKPQATETSAQTPTTTHPASGNEATHSTETTSQPSSTSPASPQQQNQPSSVSTPSGNGQKTEKSNEQKPQKEDSKGQPQQPPSQPNSSAKPSEETSPTQTTNNPTQISPSTSTQQPKGNKDTQQKDEPPKEQPQNQPQDNGKQDHNKPEPQQQNHPQQNEKQDNKNTTTSDISHDKT

SEQ ID NO: 2577623 - protein, 6 aa, Entamoeba histolytica
VTPKQK

SEQ ID NO: 2577624 - protein, 9 aa, Entamoeba histolytica
VTPQLSSSY

SEQ ID NO: 2577625 - protein, 6 aa, Entamoeba histolytica
VTPSIP

SEQ ID NO: 2577626 - protein, 4 aa, Entamoeba histolytica
VTQG

SEQ ID NO: 2577627 - protein, 4 aa, Entamoeba histolytica
VTQK

SEQ ID NO: 2577628 - protein, 4 aa, Entamoeba histolytica
VTQP

SEQ ID NO: 2577629 - protein, 5 aa, Entamoeba histolytica
VTQPI

SEQ ID NO: 2577630 - protein, 13 aa, Entamoeba histolytica
VTQPLADDEGNVQ

SEQ ID NO: 2577631 - protein, 7 aa, Entamoeba histolytica
VTQQSNV

SEQ ID NO: 2577632 - protein, 14 aa, Entamoeba histolytica
VTQSPQSVSTIGET

SEQ ID NO: 2577633 - protein, 11 aa, Entamoeba histolytica
VTQTGKTEPID

SEQ ID NO: 2577634 - protein, 6 aa, Entamoeba histolytica
VTRDGE

SEQ ID NO: 2577635 - protein, 10 aa, Entamoeba histolytica
VTRENETFAG

SEQ ID NO: 2577636 - protein, 6 aa, Entamoeba histolytica
VTRESV

SEQ ID NO: 2577637 - protein, 9 aa, Entamoeba histolytica
VTRSASGQF

SEQ ID NO: 2577638 - protein, 9 aa, Entamoeba histolytica
VTRSDGSAS

SEQ ID NO: 2577639 - protein, 5 aa, Entamoeba histolytica
VTRSQ

SEQ ID NO: 2577640 - protein, 14 aa, Entamoeba histolytica
VTSEPAKEGSENTY

SEQ ID NO: 2577641 - protein, 7 aa, Entamoeba histolytica
VTSEQPF

SEQ ID NO: 2577642 - protein, 7 aa, Entamoeba histolytica
VTSNPSK

SEQ ID NO: 2577643 - protein, 8 aa, Entamoeba histolytica
VTSSDSHR

SEQ ID NO: 2577644 - protein, 6 aa, Entamoeba histolytica
VTSSDT

SEQ ID NO: 2577645 - protein, 5 aa, Entamoeba histolytica
VTTDE

SEQ ID NO: 2577646 - protein, 6 aa, Entamoeba histolytica
VTTIQK

SEQ ID NO: 2577647 - protein, 15 aa, Entamoeba histolytica
VTTNPRKIGAESVAE

SEQ ID NO: 2577648 - protein, 20 aa, Entamoeba histolytica
VTTPAQPTAAPAQQAPQQQS

SEQ ID NO: 2577649 - protein, 8 aa, Entamoeba histolytica
VTTPRGRN

SEQ ID NO: 2577650 - protein, 8 aa, Entamoeba histolytica
VTTSNGCM

SEQ ID NO: 2577651 - protein, 4 aa, Entamoeba histolytica
VTTT

SEQ ID NO: 2577652 - protein, 22 aa, Entamoeba histolytica
VTVTENSADVVSRNTKETNRDD

SEQ ID NO: 2577653 - protein, 5 aa, Entamoeba histolytica
VTYES

SEQ ID NO: 2577654 - protein, 6 aa, Entamoeba histolytica
VTYGSQ

SEQ ID NO: 2577655 - protein, 21 aa, Entamoeba histolytica
VVDANEDCDLSSGVNDTQCTE

SEQ ID NO: 2577656 - protein, 7 aa, Entamoeba histolytica
VVNPPDE

SEQ ID NO: 2577657 - protein, 7 aa, Entamoeba histolytica
VVPMSTG

SEQ ID NO: 2577658 - protein, 4 aa, Entamoeba histolytica
VVST

SEQ ID NO: 2577659 - protein, 10 aa, Entamoeba histolytica
VVTPTKPKNH

SEQ ID NO: 2577660 - protein, 12 aa, Entamoeba histolytica
VYESDNAGKEIV

SEQ ID NO: 2577661 - protein, 8 aa, Entamoeba histolytica
VYGKESHQ

SEQ ID NO: 2577662 - protein, 5 aa, Entamoeba histolytica
VYGQP

SEQ ID NO: 2577663 - protein, 5 aa, Entamoeba histolytica
VYNYD

SEQ ID NO: 2577664 - protein, 11 aa, Entamoeba histolytica
VYPDGSSDDGL

SEQ ID NO: 2577665 - protein, 9 aa, Entamoeba histolytica
VYSSTGSKW

SEQ ID NO: 2577666 - protein, 4 aa, Entamoeba histolytica
WADS

SEQ ID NO: 2577667 - protein, 8 aa, Entamoeba histolytica
WASKGYRT

SEQ ID NO: 2577668 - protein, 8 aa, Entamoeba histolytica
WDENDDKQ

SEQ ID NO: 2577669 - protein, 9 aa, Entamoeba histolytica
WDPRGAEEL

SEQ ID NO: 2577670 - protein, 11 aa, Entamoeba histolytica
WDYDGEDYQAK

SEQ ID NO: 2577671 - protein, 4 aa, Entamoeba histolytica
WDYT

SEQ ID NO: 2577672 - protein, 9 aa, Entamoeba histolytica
WEDEKDKQC

SEQ ID NO: 2577673 - protein, 15 aa, Entamoeba histolytica
WEEAQGKLEGREDAI

SEQ ID NO: 2577674 - protein, 5 aa, Entamoeba histolytica
WEESM

SEQ ID NO: 2577675 - protein, 8 aa, Entamoeba histolytica
WEKSNETV

SEQ ID NO: 2577676 - protein, 11 aa, Entamoeba histolytica
WEKTTEKRIGK

SEQ ID NO: 2577677 - protein, 17 aa, Entamoeba histolytica
WENNEEEKEEIDEEEER

SEQ ID NO: 2577678 - protein, 6 aa, Entamoeba histolytica
WENPSM

SEQ ID NO: 2577679 - protein, 9 aa, Entamoeba histolytica
WEQEPKERI

SEQ ID NO: 2577680 - protein, 8 aa, Entamoeba histolytica
WEQQKERE

SEQ ID NO: 2577681 - protein, 7 aa, Entamoeba histolytica
WGEEKGG

SEQ ID NO: 2577682 - protein, 6 aa, Entamoeba histolytica
WGNAGH

SEQ ID NO: 2577683 - protein, 8 aa, Entamoeba histolytica
WIPDPSSI

SEQ ID NO: 2577684 - protein, 8 aa, Entamoeba histolytica
WITDESGK

SEQ ID NO: 2577685 - protein, 6 aa, Entamoeba histolytica
WKDAST

SEQ ID NO: 2577686 - protein, 6 aa, Entamoeba histolytica
WKDSDV

SEQ ID NO: 2577687 - protein, 6 aa, Entamoeba histolytica
WKDSEA

SEQ ID NO: 2577688 - protein, 12 aa, Entamoeba histolytica
WKEEEKVEKIRK

SEQ ID NO: 2577689 - protein, 7 aa, Entamoeba histolytica
WKEKSPK

SEQ ID NO: 2577690 - protein, 6 aa, Entamoeba histolytica
WKGSDS

SEQ ID NO: 2577691 - protein, 7 aa, Entamoeba histolytica
WKKEQGP

SEQ ID NO: 2577692 - protein, 9 aa, Entamoeba histolytica
WKKRDNFTK

SEQ ID NO: 2577693 - protein, 9 aa, Entamoeba histolytica
WKQEPKERI

SEQ ID NO: 2577694 - protein, 7 aa, Entamoeba histolytica
WKSGDME

SEQ ID NO: 2577695 - protein, 10 aa, Entamoeba histolytica
WNAPEEEKMK

SEQ ID NO: 2577696 - protein, 17 aa, Entamoeba histolytica
WNEEDNQIIPAKSDSMI

SEQ ID NO: 2577697 - protein, 5 aa, Entamoeba histolytica
WNGDP

SEQ ID NO: 2577698 - protein, 4 aa, Entamoeba histolytica
WNKE

SEQ ID NO: 2577699 - protein, 5 aa, Entamoeba histolytica
WNNAG

SEQ ID NO: 2577700 - protein, 8 aa, Entamoeba histolytica
WNNGRAQG

SEQ ID NO: 2577701 - protein, 5 aa, Entamoeba histolytica
WNNNP

SEQ ID NO: 2577702 - protein, 11 aa, Entamoeba histolytica
WNNTQSNEKIN

SEQ ID NO: 2577703 - protein, 5 aa, Entamoeba histolytica
WNRNQ

SEQ ID NO: 2577704 - protein, 7 aa, Entamoeba histolytica
WNSENGM

SEQ ID NO: 2577705 - protein, 16 aa, Entamoeba histolytica
WNSGTACSFGEQPTQV

SEQ ID NO: 2577706 - protein, 5 aa, Entamoeba histolytica
WNSKK

SEQ ID NO: 2577707 - protein, 9 aa, Entamoeba histolytica
WNSNEEKVK

SEQ ID NO: 2577708 - protein, 9 aa, Entamoeba histolytica
WPSLSTANA

SEQ ID NO: 2577709 - protein, 22 aa, Entamoeba histolytica
WPTQAPYYGETQARGCTPDRGA

SEQ ID NO: 2577710 - protein, 11 aa, Entamoeba histolytica
WQNQYKQTRTH

SEQ ID NO: 2577711 - protein, 5 aa, Entamoeba histolytica
WQPIP

SEQ ID NO: 2577712 - protein, 11 aa, Entamoeba histolytica
WQPSSNTGKNQ

SEQ ID NO: 2577713 - protein, 12 aa, Entamoeba histolytica
WQPSTNKGDNQC

SEQ ID NO: 2577714 - protein, 12 aa, Entamoeba histolytica
WQQEPNKRLTTD

SEQ ID NO: 2577715 - protein, 8 aa, Entamoeba histolytica
WQSTGSAH

SEQ ID NO: 2577716 - protein, 4 aa, Entamoeba histolytica
WQTT

SEQ ID NO: 2577717 - protein, 10 aa, Entamoeba histolytica
WQYNGPNLNS

SEQ ID NO: 2577718 - protein, 4 aa, Entamoeba histolytica
WRNT

SEQ ID NO: 2577719 - protein, 6 aa, Entamoeba histolytica
WSAENG

SEQ ID NO: 2577720 - protein, 6 aa, Entamoeba histolytica
WSDNKN

SEQ ID NO: 2577721 - protein, 4 aa, Entamoeba histolytica
WSPN

SEQ ID NO: 2577722 - protein, 5 aa, Entamoeba histolytica
WSQVE

SEQ ID NO: 2577723 - protein, 12 aa, Entamoeba histolytica
WSSGTGFAGVAG

SEQ ID NO: 2577724 - protein, 13 aa, Entamoeba histolytica
WTISDTNGKCKYG

SEQ ID NO: 2577725 - protein, 6 aa, Entamoeba histolytica
WTQGSP

SEQ ID NO: 2577726 - protein, 5 aa, Entamoeba histolytica
WYEKD

SEQ ID NO: 2577727 - protein, 16 aa, Entamoeba histolytica
YAAGGTLKSSLGSSTS

SEQ ID NO: 2577728 - protein, 19 aa, Entamoeba histolytica
YAGASGKSSNGGDANYPTF

SEQ ID NO: 2577729 - protein, 7 aa, Entamoeba histolytica
YAGKASN

SEQ ID NO: 2577730 - protein, 8 aa, Entamoeba histolytica
YAGRPRPN

SEQ ID NO: 2577731 - protein, 8 aa, Entamoeba histolytica
YAGSDEVH

SEQ ID NO: 2577732 - protein, 11 aa, Entamoeba histolytica
YAIKDGECEEV

SEQ ID NO: 2577733 - protein, 11 aa, Entamoeba histolytica
YAKGNNVAELT

SEQ ID NO: 2577734 - protein, 13 aa, Entamoeba histolytica
YAQKVKQDKAKKE

SEQ ID NO: 2577735 - protein, 7 aa, Entamoeba histolytica
YASDDCG

SEQ ID NO: 2577736 - protein, 8 aa, Entamoeba histolytica
YASKPMGG

SEQ ID NO: 2577737 - protein, 6 aa, Entamoeba histolytica
YASRSY

SEQ ID NO: 2577738 - protein, 10 aa, Entamoeba histolytica
YASSSNARFG

SEQ ID NO: 2577739 - protein, 13 aa, Entamoeba histolytica
YASSSNDAPIQEA

SEQ ID NO: 2577740 - protein, 8 aa, Entamoeba histolytica
YASTEEEI

SEQ ID NO: 2577741 - protein, 10 aa, Entamoeba histolytica
YCNQNDCTCP

SEQ ID NO: 2577742 - protein, 5 aa, Entamoeba histolytica
YCSDG

SEQ ID NO: 2577743 - protein, 4 aa, Entamoeba histolytica
YCSS

SEQ ID NO: 2577744 - protein, 9 aa, Entamoeba histolytica
YCSSNNGNI

SEQ ID NO: 2577745 - protein, 13 aa, Entamoeba histolytica
YCTSPERNNTNQC

SEQ ID NO: 2577746 - protein, 6 aa, Entamoeba histolytica
YDDDRQ

SEQ ID NO: 2577747 - protein, 5 aa, Entamoeba histolytica
YDDER

SEQ ID NO: 2577748 - protein, 9 aa, Entamoeba histolytica
YDDNDDSCE

SEQ ID NO: 2577749 - protein, 7 aa, Entamoeba histolytica
YDDNGDV

SEQ ID NO: 2577750 - protein, 16 aa, Entamoeba histolytica
YDDNNKDNEENKTVRG

SEQ ID NO: 2577751 - protein, 14 aa, Entamoeba histolytica
YDEGYSDEELTDKN

SEQ ID NO: 2577752 - protein, 6 aa, Entamoeba histolytica
YDEKKR

SEQ ID NO: 2577753 - protein, 8 aa, Entamoeba histolytica
YDEMQNND

SEQ ID NO: 2577754 - protein, 16 aa, Entamoeba histolytica
YDENELSSLGGPLIQY

SEQ ID NO: 2577755 - protein, 16 aa, Entamoeba histolytica
YDESSEKKSNKEVEDK

SEQ ID NO: 2577756 - protein, 11 aa, Entamoeba histolytica
YDESTQTMAEI

SEQ ID NO: 2577757 - protein, 7 aa, Entamoeba histolytica
YDETNSS

SEQ ID NO: 2577758 - protein, 10 aa, Entamoeba histolytica
YDFSSRGIKP

SEQ ID NO: 2577759 - protein, 4 aa, Entamoeba histolytica
YDGE

SEQ ID NO: 2577760 - protein, 4 aa, Entamoeba histolytica
YDGK

SEQ ID NO: 2577761 - protein, 7 aa, Entamoeba histolytica
YDGKEKG

SEQ ID NO: 2577762 - protein, 7 aa, Entamoeba histolytica
YDGPNGQ

SEQ ID NO: 2577763 - protein, 5 aa, Entamoeba histolytica
YDKHS

SEQ ID NO: 2577764 - protein, 12 aa, Entamoeba histolytica
YDKKYDNTEKRS

SEQ ID NO: 2577765 - protein, 8 aa, Entamoeba histolytica
YDKTPNTI

SEQ ID NO: 2577766 - protein, 4 aa, Entamoeba histolytica
YDNG

SEQ ID NO: 2577767 - protein, 8 aa, Entamoeba histolytica
YDNPDSMM

SEQ ID NO: 2577768 - protein, 16 aa, Entamoeba histolytica
YDNSLNKSKDLSRRLE

SEQ ID NO: 2577769 - protein, 10 aa, Entamoeba histolytica
YDPDDENGNN

SEQ ID NO: 2577770 - protein, 15 aa, Entamoeba histolytica
YDPKCGDAYKRRGQT

SEQ ID NO: 2577771 - protein, 8 aa, Entamoeba histolytica
YDPNDELK

SEQ ID NO: 2577772 - protein, 6 aa, Entamoeba histolytica
YDPQHN

SEQ ID NO: 2577773 - protein, 4 aa, Entamoeba histolytica
YDPT

SEQ ID NO: 2577774 - protein, 16 aa, Entamoeba histolytica
YDPVGGSVKLDGKDLR

SEQ ID NO: 2577775 - protein, 7 aa, Entamoeba histolytica
YDQEDLQ

SEQ ID NO: 2577776 - protein, 8 aa, Entamoeba histolytica
YDQGSCGS

SEQ ID NO: 2577777 - protein, 9 aa, Entamoeba histolytica
YDQTTYNYD

SEQ ID NO: 2577778 - protein, 14 aa, Entamoeba histolytica
YDQVTSKVTDFGTS

SEQ ID NO: 2577779 - protein, 7 aa, Entamoeba histolytica
YDRTNGK

SEQ ID NO: 2577780 - protein, 18 aa, Entamoeba histolytica
YDSPSYDDIADKQRNELS

SEQ ID NO: 2577781 - protein, 10 aa, Entamoeba histolytica
YDSSTKKCNK

SEQ ID NO: 2577782 - protein, 11 aa, Entamoeba histolytica
YDTEGRGELDS

SEQ ID NO: 2577783 - protein, 8 aa, Entamoeba histolytica
YDTQTNPV

SEQ ID NO: 2577784 - protein, 13 aa, Entamoeba histolytica
YDTRRGLNEATNS

SEQ ID NO: 2577785 - protein, 5 aa, Entamoeba histolytica
YDVPQ

SEQ ID NO: 2577786 - protein, 6 aa, Entamoeba histolytica
YEAVPD

SEQ ID NO: 2577787 - protein, 12 aa, Entamoeba histolytica
YECQNDQCTSCS

SEQ ID NO: 2577788 - protein, 10 aa, Entamoeba histolytica
YEDEEDSEIS

SEQ ID NO: 2577789 - protein, 12 aa, Entamoeba histolytica
YEDGNKAPINRT

SEQ ID NO: 2577790 - protein, 4 aa, Entamoeba histolytica
YEDP

SEQ ID NO: 2577791 - protein, 11 aa, Entamoeba histolytica
YEDSGNEENYY

SEQ ID NO: 2577792 - protein, 4 aa, Entamoeba histolytica
YEED

SEQ ID NO: 2577793 - protein, 4 aa, Entamoeba histolytica
YEEI

SEQ ID NO: 2577794 - protein, 5 aa, Entamoeba histolytica
YEEIN

SEQ ID NO: 2577795 - protein, 4 aa, Entamoeba histolytica
YEEK

SEQ ID NO: 2577796 - protein, 19 aa, Entamoeba histolytica
YEEKPEKGKIIKETGSSIT

SEQ ID NO: 2577797 - protein, 20 aa, Entamoeba histolytica
YEENKERKDKVTIRSNSDIN

SEQ ID NO: 2577798 - protein, 19 aa, Entamoeba histolytica
YEENSNPQSQQVSAGQQIG

SEQ ID NO: 2577799 - protein, 7 aa, Entamoeba histolytica
YEEQTQR

SEQ ID NO: 2577800 - protein, 9 aa, Entamoeba histolytica
YEGEEGKKS

SEQ ID NO: 2577801 - protein, 5 aa, Entamoeba histolytica
YEGGP

SEQ ID NO: 2577802 - protein, 6 aa, Entamoeba histolytica
YEGKAV

SEQ ID NO: 2577803 - protein, 9 aa, Entamoeba histolytica
YEGKKNHKV

SEQ ID NO: 2577804 - protein, 8 aa, Entamoeba histolytica
YEGSSSRC

SEQ ID NO: 2577805 - protein, 9 aa, Entamoeba histolytica
YEKGRADFR

SEQ ID NO: 2577806 - protein, 12 aa, Entamoeba histolytica
YEKKAPKSNYSH

SEQ ID NO: 2577807 - protein, 13 aa, Entamoeba histolytica
YEMNTEEKKKLST

SEQ ID NO: 2577808 - protein, 24 aa, Entamoeba histolytica
YENASSEQLSSNERYKELSESTQQ

SEQ ID NO: 2577809 - protein, 4 aa, Entamoeba histolytica
YENE

SEQ ID NO: 2577810 - protein, 7 aa, Entamoeba histolytica
YENEGKL

SEQ ID NO: 2577811 - protein, 11 aa, Entamoeba histolytica
YENGTITTEEY

SEQ ID NO: 2577812 - protein, 6 aa, Entamoeba histolytica
YENNDS

SEQ ID NO: 2577813 - protein, 10 aa, Entamoeba histolytica
YENNEEYLQP

SEQ ID NO: 2577814 - protein, 8 aa, Entamoeba histolytica
YENNERTE

SEQ ID NO: 2577815 - protein, 9 aa, Entamoeba histolytica
YENNETKEK

SEQ ID NO: 2577816 - protein, 7 aa, Entamoeba histolytica
YENNTEN

SEQ ID NO: 2577817 - protein, 6 aa, Entamoeba histolytica
YENPSD

SEQ ID NO: 2577818 - protein, 12 aa, Entamoeba histolytica
YEPDPNQPGSCK

SEQ ID NO: 2577819 - protein, 16 aa, Entamoeba histolytica
YEPNGGRVTLDGKDIR

SEQ ID NO: 2577820 - protein, 4 aa, Entamoeba histolytica
YEPT

SEQ ID NO: 2577821 - protein, 5 aa, Entamoeba histolytica
YEQDG

SEQ ID NO: 2577822 - protein, 7 aa, Entamoeba histolytica
YEQDNSC

SEQ ID NO: 2577823 - protein, 14 aa, Entamoeba histolytica
YEQNKKDPLSCSKK

SEQ ID NO: 2577824 - protein, 19 aa, Entamoeba histolytica
YEQTRKKSYIPSPTNVHEQ

SEQ ID NO: 2577825 - protein, 30 aa, Entamoeba histolytica
YERKEKKRFHPKKSSSKNLFESPDKRKTMM

SEQ ID NO: 2577826 - protein, 5 aa, Entamoeba histolytica
YESST

SEQ ID NO: 2577827 - protein, 11 aa, Entamoeba histolytica
YETLTDPSKLK

SEQ ID NO: 2577828 - protein, 6 aa, Entamoeba histolytica
YETPSF

SEQ ID NO: 2577829 - protein, 6 aa, Entamoeba histolytica
YETYTK

SEQ ID NO: 2577830 - protein, 9 aa, Entamoeba histolytica
YEVKGDCTD

SEQ ID NO: 2577831 - protein, 6 aa, Entamoeba histolytica
YEYNNK

SEQ ID NO: 2577832 - protein, 5 aa, Entamoeba histolytica
YFDGS

SEQ ID NO: 2577833 - protein, 7 aa, Entamoeba histolytica
YFGTPDT

SEQ ID NO: 2577834 - protein, 4 aa, Entamoeba histolytica
YFNT

SEQ ID NO: 2577835 - protein, 9 aa, Entamoeba histolytica
YFQQEGTSL

SEQ ID NO: 2577836 - protein, 18 aa, Entamoeba histolytica
YFSGDEKSNDNGKKTFEN

SEQ ID NO: 2577837 - protein, 4 aa, Entamoeba histolytica
YGDE

SEQ ID NO: 2577838 - protein, 7 aa, Entamoeba histolytica
YGDGEAS

SEQ ID NO: 2577839 - protein, 6 aa, Entamoeba histolytica
YGDNTI

SEQ ID NO: 2577840 - protein, 6 aa, Entamoeba histolytica
YGDPSE

SEQ ID NO: 2577841 - protein, 15 aa, Entamoeba histolytica
YGDSIEQKEFEKSQN

SEQ ID NO: 2577842 - protein, 6 aa, Entamoeba histolytica
YGEEIS

SEQ ID NO: 2577843 - protein, 9 aa, Entamoeba histolytica
YGEETGKTS

SEQ ID NO: 2577844 - protein, 6 aa, Entamoeba histolytica
YGEEYS

SEQ ID NO: 2577845 - protein, 4 aa, Entamoeba histolytica
YGEG

SEQ ID NO: 2577846 - protein, 5 aa, Entamoeba histolytica
YGEHP

SEQ ID NO: 2577847 - protein, 9 aa, Entamoeba histolytica
YGEKKINRN

SEQ ID NO: 2577848 - protein, 6 aa, Entamoeba histolytica
YGEPLG

SEQ ID NO: 2577849 - protein, 7 aa, Entamoeba histolytica
YGEREKY

SEQ ID NO: 2577850 - protein, 12 aa, Entamoeba histolytica
YGESSSSYFTHD

SEQ ID NO: 2577851 - protein, 13 aa, Entamoeba histolytica
YGETNNDFNEEGR

SEQ ID NO: 2577852 - protein, 7 aa, Entamoeba histolytica
YGKDEEF

SEQ ID NO: 2577853 - protein, 10 aa, Entamoeba histolytica
YGKEGNQAAI

SEQ ID NO: 2577854 - protein, 5 aa, Entamoeba histolytica
YGKNE

SEQ ID NO: 2577855 - protein, 9 aa, Entamoeba histolytica
YGKNETDPF

SEQ ID NO: 2577856 - protein, 11 aa, Entamoeba histolytica
YGKPNKPSKGV

SEQ ID NO: 2577857 - protein, 19 aa, Entamoeba histolytica
YGKSSQTYRVKASSTNATT

SEQ ID NO: 2577858 - protein, 7 aa, Entamoeba histolytica
YGKTISE

SEQ ID NO: 2577859 - protein, 7 aa, Entamoeba histolytica
YGLKEDR

SEQ ID NO: 2577860 - protein, 10 aa, Entamoeba histolytica
YGLNENSEDI

SEQ ID NO: 2577861 - protein, 12 aa, Entamoeba histolytica
YGLNNTSTDLSS

SEQ ID NO: 2577862 - protein, 9 aa, Entamoeba histolytica
YGNDTTATA

SEQ ID NO: 2577863 - protein, 9 aa, Entamoeba histolytica
YGNEGVPTE

SEQ ID NO: 2577864 - protein, 13 aa, Entamoeba histolytica
YGNENGTTDIEDT

SEQ ID NO: 2577865 - protein, 6 aa, Entamoeba histolytica
YGNRTG

SEQ ID NO: 2577866 - protein, 9 aa, Entamoeba histolytica
YGNSTNCTT

SEQ ID NO: 2577867 - protein, 20 aa, Entamoeba histolytica
YGPSKDETFIDPETNSHYNA

SEQ ID NO: 2577868 - protein, 7 aa, Entamoeba histolytica
YGQSGKR

SEQ ID NO: 2577869 - protein, 6 aa, Entamoeba histolytica
YGRAGK

SEQ ID NO: 2577870 - protein, 5 aa, Entamoeba histolytica
YGSGM

SEQ ID NO: 2577871 - protein, 6 aa, Entamoeba histolytica
YGSKTA

SEQ ID NO: 2577872 - protein, 4 aa, Entamoeba histolytica
YGSN

SEQ ID NO: 2577873 - protein, 7 aa, Entamoeba histolytica
YGSQSTS

SEQ ID NO: 2577874 - protein, 11 aa, Entamoeba histolytica
YGSSNCEDNCT

SEQ ID NO: 2577875 - protein, 5 aa, Entamoeba histolytica
YGSTD

SEQ ID NO: 2577876 - protein, 18 aa, Entamoeba histolytica
YGSVNDYKKKYKEKPFSR

SEQ ID NO: 2577877 - protein, 5 aa, Entamoeba histolytica
YGSYI

SEQ ID NO: 2577878 - protein, 4 aa, Entamoeba histolytica
YGTI

SEQ ID NO: 2577879 - protein, 4 aa, Entamoeba histolytica
YGTK

SEQ ID NO: 2577880 - protein, 15 aa, Entamoeba histolytica
YGTKPMSLSYNGKTE

SEQ ID NO: 2577881 - protein, 6 aa, Entamoeba histolytica
YGTQPM

SEQ ID NO: 2577882 - protein, 8 aa, Entamoeba histolytica
YGTTTKPN

SEQ ID NO: 2577883 - protein, 7 aa, Entamoeba histolytica
YGTVSQR

SEQ ID NO: 2577884 - protein, 19 aa, Entamoeba histolytica
YGYDRDENGKLGKTAGRIA

SEQ ID NO: 2577885 - protein, 34 aa, Entamoeba histolytica
YGYEGNDNKVRISQGSTLSIQETDSRELNNLKRN

SEQ ID NO: 2577886 - protein, 41 aa, Entamoeba histolytica
YGYESNVEEIEEDVEEESFTDEISDTEEEDDDEGDEDELIE

SEQ ID NO: 2577887 - protein, 9 aa, Entamoeba histolytica
YHEEIAPDD

SEQ ID NO: 2577888 - protein, 6 aa, Entamoeba histolytica
YHGTNK

SEQ ID NO: 2577889 - protein, 5 aa, Entamoeba histolytica
YHKED

SEQ ID NO: 2577890 - protein, 12 aa, Entamoeba histolytica
YHPDKNKEEGAE

SEQ ID NO: 2577891 - protein, 12 aa, Entamoeba histolytica
YHPDRNPNSTEF

SEQ ID NO: 2577892 - protein, 12 aa, Entamoeba histolytica
YHSSSQNKCLSQ

SEQ ID NO: 2577893 - protein, 14 aa, Entamoeba histolytica
YIGDAQLNKEQQTL

SEQ ID NO: 2577894 - protein, 10 aa, Entamoeba histolytica
YIGEENKNIS

SEQ ID NO: 2577895 - protein, 4 aa, Entamoeba histolytica
YINE

SEQ ID NO: 2577896 - protein, 11 aa, Entamoeba histolytica
YINQEDNKTQE

SEQ ID NO: 2577897 - protein, 7 aa, Entamoeba histolytica
YIPDGIP

SEQ ID NO: 2577898 - protein, 12 aa, Entamoeba histolytica
YIPKSVDKASDC

SEQ ID NO: 2577899 - protein, 10 aa, Entamoeba histolytica
YIPNEPYSTQ

SEQ ID NO: 2577900 - protein, 10 aa, Entamoeba histolytica
YIPNNGECPK

SEQ ID NO: 2577901 - protein, 10 aa, Entamoeba histolytica
YIPRKPEWTD

SEQ ID NO: 2577902 - protein, 4 aa, Entamoeba histolytica
YIRT

SEQ ID NO: 2577903 - protein, 5 aa, Entamoeba histolytica
YITEQ

SEQ ID NO: 2577904 - protein, 15 aa, Entamoeba histolytica
YKAKEKKSNLADEIS

SEQ ID NO: 2577905 - protein, 4 aa, Entamoeba histolytica
YKAP

SEQ ID NO: 2577906 - protein, 11 aa, Entamoeba histolytica
YKDNEGSNQQI

SEQ ID NO: 2577907 - protein, 7 aa, Entamoeba histolytica
YKEDNTV

SEQ ID NO: 2577908 - protein, 11 aa, Entamoeba histolytica
YKEEGETKDWK

SEQ ID NO: 2577909 - protein, 8 aa, Entamoeba histolytica
YKEENDTM

SEQ ID NO: 2577910 - protein, 8 aa, Entamoeba histolytica
YKEGGSKQ

SEQ ID NO: 2577911 - protein, 7 aa, Entamoeba histolytica
YKEGISK

SEQ ID NO: 2577912 - protein, 7 aa, Entamoeba histolytica
YKEKGTW

SEQ ID NO: 2577913 - protein, 15 aa, Entamoeba histolytica
YKELNKQSYGQESQK

SEQ ID NO: 2577914 - protein, 11 aa, Entamoeba histolytica
YKENEDPVFSE

SEQ ID NO: 2577915 - protein, 8 aa, Entamoeba histolytica
YKENSAGL

SEQ ID NO: 2577916 - protein, 6 aa, Entamoeba histolytica
YKEPKL

SEQ ID NO: 2577917 - protein, 4 aa, Entamoeba histolytica
YKES

SEQ ID NO: 2577918 - protein, 9 aa, Entamoeba histolytica
YKETYGDGG

SEQ ID NO: 2577919 - protein, 8 aa, Entamoeba histolytica
YKGETNKW

SEQ ID NO: 2577920 - protein, 13 aa, Entamoeba histolytica
YKGEWSKKSIDSR

SEQ ID NO: 2577921 - protein, 10 aa, Entamoeba histolytica
YKGKEDETNK

SEQ ID NO: 2577922 - protein, 4 aa, Entamoeba histolytica
YKGR

SEQ ID NO: 2577923 - protein, 8 aa, Entamoeba histolytica
YKGTEQRK

SEQ ID NO: 2577924 - protein, 10 aa, Entamoeba histolytica
YKIGDNESIS

SEQ ID NO: 2577925 - protein, 23 aa, Entamoeba histolytica
YKKEKEKKEKKEDKEDKEEKKKE

SEQ ID NO: 2577926 - protein, 9 aa, Entamoeba histolytica
YKKENKELN

SEQ ID NO: 2577927 - protein, 4 aa, Entamoeba histolytica
YKKI

SEQ ID NO: 2577928 - protein, 5 aa, Entamoeba histolytica
YKKKK

SEQ ID NO: 2577929 - protein, 9 aa, Entamoeba histolytica
YKKNDLSSG

SEQ ID NO: 2577930 - protein, 12 aa, Entamoeba histolytica
YKKQTIKSPRQI

SEQ ID NO: 2577931 - protein, 7 aa, Entamoeba histolytica
YKKTSNQ

SEQ ID NO: 2577932 - protein, 12 aa, Entamoeba histolytica
YKLDAGSMSCSK

SEQ ID NO: 2577933 - protein, 4 aa, Entamoeba histolytica
YKLP

SEQ ID NO: 2577934 - protein, 8 aa, Entamoeba histolytica
YKNDSSFS

SEQ ID NO: 2577935 - protein, 11 aa, Entamoeba histolytica
YKNETSPYPRG

SEQ ID NO: 2577936 - protein, 7 aa, Entamoeba histolytica
YKNIQNK

SEQ ID NO: 2577937 - protein, 9 aa, Entamoeba histolytica
YKNQNNECK

SEQ ID NO: 2577938 - protein, 10 aa, Entamoeba histolytica
YKNSNKAYIP

SEQ ID NO: 2577939 - protein, 11 aa, Entamoeba histolytica
YKPEDRLTPQE

SEQ ID NO: 2577940 - protein, 12 aa, Entamoeba histolytica
YKPEDRLTPQEA

SEQ ID NO: 2577941 - protein, 6 aa, Entamoeba histolytica
YKPEEL

SEQ ID NO: 2577942 - protein, 10 aa, Entamoeba histolytica
YKPGDGQFSG

SEQ ID NO: 2577943 - protein, 5 aa, Entamoeba histolytica
YKPIN

SEQ ID NO: 2577944 - protein, 13 aa, Entamoeba histolytica
YKPKEKNKSITKY

SEQ ID NO: 2577945 - protein, 7 aa, Entamoeba histolytica
YKPNNQR

SEQ ID NO: 2577946 - protein, 7 aa, Entamoeba histolytica
YKPNSGI

SEQ ID NO: 2577947 - protein, 7 aa, Entamoeba histolytica
YKPTELG

SEQ ID NO: 2577948 - protein, 19 aa, Entamoeba histolytica
YKPTKRKEDFYSMYTNIGE

SEQ ID NO: 2577949 - protein, 10 aa, Entamoeba histolytica
YKPVNGTCTE

SEQ ID NO: 2577950 - protein, 8 aa, Entamoeba histolytica
YKQGNQRD

SEQ ID NO: 2577951 - protein, 6 aa, Entamoeba histolytica
YKQSNN

SEQ ID NO: 2577952 - protein, 9 aa, Entamoeba histolytica
YKSEESQTK

SEQ ID NO: 2577953 - protein, 16 aa, Entamoeba histolytica
YKSKISSYSKKPNQIS

SEQ ID NO: 2577954 - protein, 8 aa, Entamoeba histolytica
YKSKNDIH

SEQ ID NO: 2577955 - protein, 10 aa, Entamoeba histolytica
YKSSGTNANT

SEQ ID NO: 2577956 - protein, 16 aa, Entamoeba histolytica
YKSTRDFCNQKESQEI

SEQ ID NO: 2577957 - protein, 8 aa, Entamoeba histolytica
YKSVDKNI

SEQ ID NO: 2577958 - protein, 4 aa, Entamoeba histolytica
YKTE

SEQ ID NO: 2577959 - protein, 10 aa, Entamoeba histolytica
YKTGDTSCRS

SEQ ID NO: 2577960 - protein, 11 aa, Entamoeba histolytica
YKTKNAEGLPL

SEQ ID NO: 2577961 - protein, 7 aa, Entamoeba histolytica
YKTNETS

SEQ ID NO: 2577962 - protein, 27 aa, Entamoeba histolytica
YKTQPTSTVREQFDSSSKIKPSLPPKT

SEQ ID NO: 2577963 - protein, 8 aa, Entamoeba histolytica
YKTSKNTS

SEQ ID NO: 2577964 - protein, 12 aa, Entamoeba histolytica
YKTTDNDDNNKK

SEQ ID NO: 2577965 - protein, 10 aa, Entamoeba histolytica
YKVGSSNMCE

SEQ ID NO: 2577966 - protein, 10 aa, Entamoeba histolytica
YLANKEKGFD

SEQ ID NO: 2577967 - protein, 12 aa, Entamoeba histolytica
YLNGGNSNSERI

SEQ ID NO: 2577968 - protein, 11 aa, Entamoeba histolytica
YLPNGERGEYE

SEQ ID NO: 2577969 - protein, 7 aa, Entamoeba histolytica
YLPQNGK

SEQ ID NO: 2577970 - protein, 8 aa, Entamoeba histolytica
YLSGTESI

SEQ ID NO: 2577971 - protein, 11 aa, Entamoeba histolytica
YLSPSNVNVNN

SEQ ID NO: 2577972 - protein, 8 aa, Entamoeba histolytica
YMKKDGTT

SEQ ID NO: 2577973 - protein, 14 aa, Entamoeba histolytica
YNANSCSFTSTDRK

SEQ ID NO: 2577974 - protein, 4 aa, Entamoeba histolytica
YNDG

SEQ ID NO: 2577975 - protein, 6 aa, Entamoeba histolytica
YNDGSM

SEQ ID NO: 2577976 - protein, 12 aa, Entamoeba histolytica
YNDGSNDDNDEM

SEQ ID NO: 2577977 - protein, 4 aa, Entamoeba histolytica
YNDN

SEQ ID NO: 2577978 - protein, 12 aa, Entamoeba histolytica
YNEDGTNKNPEI

SEQ ID NO: 2577979 - protein, 7 aa, Entamoeba histolytica
YNEERFN

SEQ ID NO: 2577980 - protein, 10 aa, Entamoeba histolytica
YNEHQNEEQL

SEQ ID NO: 2577981 - protein, 12 aa, Entamoeba histolytica
YNEIHNDNSAAV

SEQ ID NO: 2577982 - protein, 5 aa, Entamoeba histolytica
YNETI

SEQ ID NO: 2577983 - protein, 7 aa, Entamoeba histolytica
YNGEEIE

SEQ ID NO: 2577984 - protein, 4 aa, Entamoeba histolytica
YNGF

SEQ ID NO: 2577985 - protein, 4 aa, Entamoeba histolytica
YNGG

SEQ ID NO: 2577986 - protein, 8 aa, Entamoeba histolytica
YNGGNGEC

SEQ ID NO: 2577987 - protein, 6 aa, Entamoeba histolytica
YNGGNN

SEQ ID NO: 2577988 - protein, 5 aa, Entamoeba histolytica
YNGKE

SEQ ID NO: 2577989 - protein, 8 aa, Entamoeba histolytica
YNGKGDFV

SEQ ID NO: 2577990 - protein, 9 aa, Entamoeba histolytica
YNGSGNIKN

SEQ ID NO: 2577991 - protein, 7 aa, Entamoeba histolytica
YNGTSSL

SEQ ID NO: 2577992 - protein, 14 aa, Entamoeba histolytica
YNKGYKGINKACQD

SEQ ID NO: 2577993 - protein, 4 aa, Entamoeba histolytica
YNKQ

SEQ ID NO: 2577994 - protein, 5 aa, Entamoeba histolytica
YNKQE

SEQ ID NO: 2577995 - protein, 15 aa, Entamoeba histolytica
YNKRKTELYDPKEQD

SEQ ID NO: 2577996 - protein, 20 aa, Entamoeba histolytica
YNNGDSENSRENKRNQRKSL

SEQ ID NO: 2577997 - protein, 8 aa, Entamoeba histolytica
YNNLQNEV

SEQ ID NO: 2577998 - protein, 6 aa, Entamoeba histolytica
YNNQST

SEQ ID NO: 2577999 - protein, 5 aa, Entamoeba histolytica
YNPER

SEQ ID NO: 2578000 - protein, 5 aa, Entamoeba histolytica
YNPQD

SEQ ID NO: 2578001 - protein, 11 aa, Entamoeba histolytica
YNPVTKKLSEE

SEQ ID NO: 2578002 - protein, 4 aa, Entamoeba histolytica
YNQG

SEQ ID NO: 2578003 - protein, 7 aa, Entamoeba histolytica
YNQRSTN

SEQ ID NO: 2578004 - protein, 4 aa, Entamoeba histolytica
YNRL

SEQ ID NO: 2578005 - protein, 11 aa, Entamoeba histolytica
YNSDSSSSTRI

SEQ ID NO: 2578006 - protein, 11 aa, Entamoeba histolytica
YNSEGKGCVNG

SEQ ID NO: 2578007 - protein, 7 aa, Entamoeba histolytica
YNSESEA

SEQ ID NO: 2578008 - protein, 13 aa, Entamoeba histolytica
YNSETNTLEIDGN

SEQ ID NO: 2578009 - protein, 14 aa, Entamoeba histolytica
YNSETNTLEIDGSN

SEQ ID NO: 2578010 - protein, 30 aa, Entamoeba histolytica
YNSNEDALEGINENDELMEEAEENEEEEKI

SEQ ID NO: 2578011 - protein, 13 aa, Entamoeba histolytica
YNSNRINTNSPLD

SEQ ID NO: 2578012 - protein, 4 aa, Entamoeba histolytica
YNSY

SEQ ID NO: 2578013 - protein, 22 aa, Entamoeba histolytica
YNTFGNPRPLDENAQFKTTGTN

SEQ ID NO: 2578014 - protein, 10 aa, Entamoeba histolytica
YNVEENKPYT

SEQ ID NO: 2578015 - protein, 4 aa, Entamoeba histolytica
YNYN

SEQ ID NO: 2578016 - protein, 9 aa, Entamoeba histolytica
YNYSEKIPS

SEQ ID NO: 2578017 - protein, 6 aa, Entamoeba histolytica
YPANQT

SEQ ID NO: 2578018 - protein, 8 aa, Entamoeba histolytica
YPDNQQAS

SEQ ID NO: 2578019 - protein, 5 aa, Entamoeba histolytica
YPDYS

SEQ ID NO: 2578020 - protein, 9 aa, Entamoeba histolytica
YPEGNEFET

SEQ ID NO: 2578021 - protein, 5 aa, Entamoeba histolytica
YPEQV

SEQ ID NO: 2578022 - protein, 8 aa, Entamoeba histolytica
YPERGEGE

SEQ ID NO: 2578023 - protein, 14 aa, Entamoeba histolytica
YPGCNEPAKTKYNC

SEQ ID NO: 2578024 - protein, 9 aa, Entamoeba histolytica
YPGQEKGRL

SEQ ID NO: 2578025 - protein, 5 aa, Entamoeba histolytica
YPGTY

SEQ ID NO: 2578026 - protein, 10 aa, Entamoeba histolytica
YPIPRTNDKG

SEQ ID NO: 2578027 - protein, 5 aa, Entamoeba histolytica
YPIRS

SEQ ID NO: 2578028 - protein, 4 aa, Entamoeba histolytica
YPIT

SEQ ID NO: 2578029 - protein, 7 aa, Entamoeba histolytica
YPKALTT

SEQ ID NO: 2578030 - protein, 6 aa, Entamoeba histolytica
YPKENK

SEQ ID NO: 2578031 - protein, 5 aa, Entamoeba histolytica
YPKET

SEQ ID NO: 2578032 - protein, 8 aa, Entamoeba histolytica
YPKGPVPI

SEQ ID NO: 2578033 - protein, 14 aa, Entamoeba histolytica
YPNDKMKNDERISH

SEQ ID NO: 2578034 - protein, 4 aa, Entamoeba histolytica
YPNG

SEQ ID NO: 2578035 - protein, 7 aa, Entamoeba histolytica
YPNKPTD

SEQ ID NO: 2578036 - protein, 5 aa, Entamoeba histolytica
YPNNH

SEQ ID NO: 2578037 - protein, 5 aa, Entamoeba histolytica
YPNSD

SEQ ID NO: 2578038 - protein, 4 aa, Entamoeba histolytica
YPNT

SEQ ID NO: 2578039 - protein, 7 aa, Entamoeba histolytica
YPNTSLS

SEQ ID NO: 2578040 - protein, 7 aa, Entamoeba histolytica
YPPTDKQ

SEQ ID NO: 2578041 - protein, 6 aa, Entamoeba histolytica
YPPTKI

SEQ ID NO: 2578042 - protein, 11 aa, Entamoeba histolytica
YPPTNGYKSAY

SEQ ID NO: 2578043 - protein, 4 aa, Entamoeba histolytica
YPQD

SEQ ID NO: 2578044 - protein, 9 aa, Entamoeba histolytica
YPQKPNDQL

SEQ ID NO: 2578045 - protein, 4 aa, Entamoeba histolytica
YPQN

SEQ ID NO: 2578046 - protein, 5 aa, Entamoeba histolytica
YPQTS

SEQ ID NO: 2578047 - protein, 7 aa, Entamoeba histolytica
YPRPYQS

SEQ ID NO: 2578048 - protein, 8 aa, Entamoeba histolytica
YPRQSRKL

SEQ ID NO: 2578049 - protein, 5 aa, Entamoeba histolytica
YPSDF

SEQ ID NO: 2578050 - protein, 9 aa, Entamoeba histolytica
YPSESVPDI

SEQ ID NO: 2578051 - protein, 5 aa, Entamoeba histolytica
YPSNE

SEQ ID NO: 2578052 - protein, 7 aa, Entamoeba histolytica
YPSRLSS

SEQ ID NO: 2578053 - protein, 5 aa, Entamoeba histolytica
YPTAP

SEQ ID NO: 2578054 - protein, 5 aa, Entamoeba histolytica
YPTEK

SEQ ID NO: 2578055 - protein, 9 aa, Entamoeba histolytica
YPTESSLES

SEQ ID NO: 2578056 - protein, 7 aa, Entamoeba histolytica
YPTQKVN

SEQ ID NO: 2578057 - protein, 6 aa, Entamoeba histolytica
YPTRPE

SEQ ID NO: 2578058 - protein, 9 aa, Entamoeba histolytica
YPTRPNKQI

SEQ ID NO: 2578059 - protein, 9 aa, Entamoeba histolytica
YPTRPTKQI

SEQ ID NO: 2578060 - protein, 6 aa, Entamoeba histolytica
YPTTKP

SEQ ID NO: 2578061 - protein, 5 aa, Entamoeba histolytica
YPVGD

SEQ ID NO: 2578062 - protein, 4 aa, Entamoeba histolytica
YPYV

SEQ ID NO: 2578063 - protein, 9 aa, Entamoeba histolytica
YQCGNNGTY

SEQ ID NO: 2578064 - protein, 13 aa, Entamoeba histolytica
YQCTERKNISNCD

SEQ ID NO: 2578065 - protein, 7 aa, Entamoeba histolytica
YQDGIGP

SEQ ID NO: 2578066 - protein, 14 aa, Entamoeba histolytica
YQEDKKEEETEEEN

SEQ ID NO: 2578067 - protein, 7 aa, Entamoeba histolytica
YQFEDGN

SEQ ID NO: 2578068 - protein, 8 aa, Entamoeba histolytica
YQGETNQK

SEQ ID NO: 2578069 - protein, 5 aa, Entamoeba histolytica
YQGEY

SEQ ID NO: 2578070 - protein, 7 aa, Entamoeba histolytica
YQGNGQK

SEQ ID NO: 2578071 - protein, 7 aa, Entamoeba histolytica
YQGTINE

SEQ ID NO: 2578072 - protein, 4 aa, Entamoeba histolytica
YQKA

SEQ ID NO: 2578073 - protein, 4 aa, Entamoeba histolytica
YQKG

SEQ ID NO: 2578074 - protein, 7 aa, Entamoeba histolytica
YQKKASK

SEQ ID NO: 2578075 - protein, 4 aa, Entamoeba histolytica
YQLK

SEQ ID NO: 2578076 - protein, 11 aa, Entamoeba histolytica
YQLSDEEYPNE

SEQ ID NO: 2578077 - protein, 10 aa, Entamoeba histolytica
YQNCSTCNST

SEQ ID NO: 2578078 - protein, 5 aa, Entamoeba histolytica
YQNGT

SEQ ID NO: 2578079 - protein, 7 aa, Entamoeba histolytica
YQNSEEN

SEQ ID NO: 2578080 - protein, 9 aa, Entamoeba histolytica
YQNTSSLGY

SEQ ID NO: 2578081 - protein, 12 aa, Entamoeba histolytica
YQPSAQPNGLEY

SEQ ID NO: 2578082 - protein, 7 aa, Entamoeba histolytica
YQQLQSE

SEQ ID NO: 2578083 - protein, 9 aa, Entamoeba histolytica
YQQNENGRY

SEQ ID NO: 2578084 - protein, 10 aa, Entamoeba histolytica
YQRKGKQGKI

SEQ ID NO: 2578085 - protein, 19 aa, Entamoeba histolytica
YQRTERKEGKEKKKNDEKR

SEQ ID NO: 2578086 - protein, 4 aa, Entamoeba histolytica
YQTD

SEQ ID NO: 2578087 - protein, 11 aa, Entamoeba histolytica
YQTEGVQNDQT

SEQ ID NO: 2578088 - protein, 7 aa, Entamoeba histolytica
YQTKEKF

SEQ ID NO: 2578089 - protein, 9 aa, Entamoeba histolytica
YQTKQRNGF

SEQ ID NO: 2578090 - protein, 7 aa, Entamoeba histolytica
YQTTPSQ

SEQ ID NO: 2578091 - protein, 14 aa, Entamoeba histolytica
YQYTGESCGKENFK

SEQ ID NO: 2578092 - protein, 12 aa, Entamoeba histolytica
YRANGIRSGYLS

SEQ ID NO: 2578093 - protein, 7 aa, Entamoeba histolytica
YRDEKVN

SEQ ID NO: 2578094 - protein, 10 aa, Entamoeba histolytica
YRDEYTPAGD

SEQ ID NO: 2578095 - protein, 6 aa, Entamoeba histolytica
YRDPSQ

SEQ ID NO: 2578096 - protein, 5 aa, Entamoeba histolytica
YRGTQ

SEQ ID NO: 2578097 - protein, 18 aa, Entamoeba histolytica
YRHNESEKLCRSQSEINS

SEQ ID NO: 2578098 - protein, 5 aa, Entamoeba histolytica
YRIEK

SEQ ID NO: 2578099 - protein, 5 aa, Entamoeba histolytica
YRKGD

SEQ ID NO: 2578100 - protein, 13 aa, Entamoeba histolytica
YRKNGLEKGYLES

SEQ ID NO: 2578101 - protein, 11 aa, Entamoeba histolytica
YRMNNEDGTYS

SEQ ID NO: 2578102 - protein, 15 aa, Entamoeba histolytica
YRNANGTCSTIEPTD

SEQ ID NO: 2578103 - protein, 8 aa, Entamoeba histolytica
YRNSTEIS

SEQ ID NO: 2578104 - protein, 6 aa, Entamoeba histolytica
YRPPRS

SEQ ID NO: 2578105 - protein, 12 aa, Entamoeba histolytica
YRPTTCNNETTT

SEQ ID NO: 2578106 - protein, 4 aa, Entamoeba histolytica
YRRP

SEQ ID NO: 2578107 - protein, 14 aa, Entamoeba histolytica
YRRSRNAQRPQNEI

SEQ ID NO: 2578108 - protein, 10 aa, Entamoeba histolytica
YRSKSSGNSI

SEQ ID NO: 2578109 - protein, 12 aa, Entamoeba histolytica
YRSSFNPNASEV

SEQ ID NO: 2578110 - protein, 16 aa, Entamoeba histolytica
YRTETVKKTTEPQWKS

SEQ ID NO: 2578111 - protein, 6 aa, Entamoeba histolytica
YRTPYK

SEQ ID NO: 2578112 - protein, 9 aa, Entamoeba histolytica
YRTRGYSTS

SEQ ID NO: 2578113 - protein, 9 aa, Entamoeba histolytica
YRYKNSPQL

SEQ ID NO: 2578114 - protein, 13 aa, Entamoeba histolytica
YRYSPDGKTFPFR

SEQ ID NO: 2578115 - protein, 7 aa, Entamoeba histolytica
YSCGSEN

SEQ ID NO: 2578116 - protein, 12 aa, Entamoeba histolytica
YSDDKCTKPTTN

SEQ ID NO: 2578117 - protein, 8 aa, Entamoeba histolytica
YSDDLNPH

SEQ ID NO: 2578118 - protein, 16 aa, Entamoeba histolytica
YSDEEAMKNVDPELTE

SEQ ID NO: 2578119 - protein, 30 aa, Entamoeba histolytica
YSDEECKTVESIEATSSNNSNRIKCGDTTY

SEQ ID NO: 2578120 - protein, 9 aa, Entamoeba histolytica
YSDEQIKTK

SEQ ID NO: 2578121 - protein, 6 aa, Entamoeba histolytica
YSDGVR

SEQ ID NO: 2578122 - protein, 15 aa, Entamoeba histolytica
YSDISDSTVNYPTGD

SEQ ID NO: 2578123 - protein, 11 aa, Entamoeba histolytica
YSDKSKEKQDI

SEQ ID NO: 2578124 - protein, 6 aa, Entamoeba histolytica
YSDNEC

SEQ ID NO: 2578125 - protein, 5 aa, Entamoeba histolytica
YSDPE

SEQ ID NO: 2578126 - protein, 5 aa, Entamoeba histolytica
YSDRR

SEQ ID NO: 2578127 - protein, 4 aa, Entamoeba histolytica
YSDS

SEQ ID NO: 2578128 - protein, 4 aa, Entamoeba histolytica
YSED

SEQ ID NO: 2578129 - protein, 8 aa, Entamoeba histolytica
YSEDPTDL

SEQ ID NO: 2578130 - protein, 8 aa, Entamoeba histolytica
YSEINSTN

SEQ ID NO: 2578131 - protein, 4 aa, Entamoeba histolytica
YSEK

SEQ ID NO: 2578132 - protein, 17 aa, Entamoeba histolytica
YSENQRVDNNQEEGTKT

SEQ ID NO: 2578133 - protein, 9 aa, Entamoeba histolytica
YSEPPQSGL

SEQ ID NO: 2578134 - protein, 9 aa, Entamoeba histolytica
YSETYYTTS

SEQ ID NO: 2578135 - protein, 4 aa, Entamoeba histolytica
YSFE

SEQ ID NO: 2578136 - protein, 4 aa, Entamoeba histolytica
YSGG

SEQ ID NO: 2578137 - protein, 6 aa, Entamoeba histolytica
YSGIGS

SEQ ID NO: 2578138 - protein, 8 aa, Entamoeba histolytica
YSGKPRPF

SEQ ID NO: 2578139 - protein, 4 aa, Entamoeba histolytica
YSGN

SEQ ID NO: 2578140 - protein, 9 aa, Entamoeba histolytica
YSGNPTSEL

SEQ ID NO: 2578141 - protein, 6 aa, Entamoeba histolytica
YSGPLT

SEQ ID NO: 2578142 - protein, 4 aa, Entamoeba histolytica
YSID

SEQ ID NO: 2578143 - protein, 8 aa, Entamoeba histolytica
YSIGGKGS

SEQ ID NO: 2578144 - protein, 10 aa, Entamoeba histolytica
YSIGRRRQTT

SEQ ID NO: 2578145 - protein, 6 aa, Entamoeba histolytica
YSIPTS

SEQ ID NO: 2578146 - protein, 5 aa, Entamoeba histolytica
YSISE

SEQ ID NO: 2578147 - protein, 5 aa, Entamoeba histolytica
YSITS

SEQ ID NO: 2578148 - protein, 8 aa, Entamoeba histolytica
YSKETPSR

SEQ ID NO: 2578149 - protein, 12 aa, Entamoeba histolytica
YSKPPNNISTDD

SEQ ID NO: 2578150 - protein, 6 aa, Entamoeba histolytica
YSKSRD

SEQ ID NO: 2578151 - protein, 11 aa, Entamoeba histolytica
YSKWNKQRENL

SEQ ID NO: 2578152 - protein, 17 aa, Entamoeba histolytica
YSKYRSPSKFPAFTSQS

SEQ ID NO: 2578153 - protein, 10 aa, Entamoeba histolytica
YSLKEDKIDE

SEQ ID NO: 2578154 - protein, 4 aa, Entamoeba histolytica
YSLP

SEQ ID NO: 2578155 - protein, 6 aa, Entamoeba histolytica
YSLQDS

SEQ ID NO: 2578156 - protein, 6 aa, Entamoeba histolytica
YSLTTP

SEQ ID NO: 2578157 - protein, 4 aa, Entamoeba histolytica
YSND

SEQ ID NO: 2578158 - protein, 6 aa, Entamoeba histolytica
YSNGEF

SEQ ID NO: 2578159 - protein, 5 aa, Entamoeba histolytica
YSNHE

SEQ ID NO: 2578160 - protein, 6 aa, Entamoeba histolytica
YSNKKG

SEQ ID NO: 2578161 - protein, 14 aa, Entamoeba histolytica
YSNNKEHNCDSDTG

SEQ ID NO: 2578162 - protein, 7 aa, Entamoeba histolytica
YSNNPEF

SEQ ID NO: 2578163 - protein, 8 aa, Entamoeba histolytica
YSNNQTVT

SEQ ID NO: 2578164 - protein, 22 aa, Entamoeba histolytica
YSNYISSKSSHAEKLSNAISSM

SEQ ID NO: 2578165 - protein, 4 aa, Entamoeba histolytica
YSPE

SEQ ID NO: 2578166 - protein, 6 aa, Entamoeba histolytica
YSPKKS

SEQ ID NO: 2578167 - protein, 18 aa, Entamoeba histolytica
YSPKSPDLSLASSSDSTL

SEQ ID NO: 2578168 - protein, 13 aa, Entamoeba histolytica
YSPLRSQKKTFKK

SEQ ID NO: 2578169 - protein, 8 aa, Entamoeba histolytica
YSPNERVT

SEQ ID NO: 2578170 - protein, 5 aa, Entamoeba histolytica
YSPPS

SEQ ID NO: 2578171 - protein, 6 aa, Entamoeba histolytica
YSPPTK

SEQ ID NO: 2578172 - protein, 10 aa, Entamoeba histolytica
YSPSSTNGID

SEQ ID NO: 2578173 - protein, 5 aa, Entamoeba histolytica
YSQND

SEQ ID NO: 2578174 - protein, 20 aa, Entamoeba histolytica
YSQQTAQQYQTVPPQYNPQP

SEQ ID NO: 2578175 - protein, 6 aa, Entamoeba histolytica
YSRPTR

SEQ ID NO: 2578176 - protein, 17 aa, Entamoeba histolytica
YSRSSIKGCQHPVTESG

SEQ ID NO: 2578177 - protein, 5 aa, Entamoeba histolytica
YSSDD

SEQ ID NO: 2578178 - protein, 11 aa, Entamoeba histolytica
YSSDKNPEVAK

SEQ ID NO: 2578179 - protein, 27 aa, Entamoeba histolytica
YSSGEECSNNGEGEANEKKYGCGKCED

SEQ ID NO: 2578180 - protein, 27 aa, Entamoeba histolytica
YSSGEECSNNGEGEANENKYGCGKCED

SEQ ID NO: 2578181 - protein, 10 aa, Entamoeba histolytica
YSSNGKTGGW

SEQ ID NO: 2578182 - protein, 8 aa, Entamoeba histolytica
YSSNQTAE

SEQ ID NO: 2578183 - protein, 4 aa, Entamoeba histolytica
YSSP

SEQ ID NO: 2578184 - protein, 34 aa, Entamoeba histolytica
YSSPSSTKIKSDTPIFNENQNSPKTPKAKKQSII

SEQ ID NO: 2578185 - protein, 7 aa, Entamoeba histolytica
YSSQELD

SEQ ID NO: 2578186 - protein, 15 aa, Entamoeba histolytica
YSSTYAKESGKGKGI

SEQ ID NO: 2578187 - protein, 4 aa, Entamoeba histolytica
YSTD

SEQ ID NO: 2578188 - protein, 8 aa, Entamoeba histolytica
YSTKNQIK

SEQ ID NO: 2578189 - protein, 21 aa, Entamoeba histolytica
YSTNKVKKPTSYPPALPKTKQ

SEQ ID NO: 2578190 - protein, 6 aa, Entamoeba histolytica
YSTNSI

SEQ ID NO: 2578191 - protein, 4 aa, Entamoeba histolytica
YSTP

SEQ ID NO: 2578192 - protein, 7 aa, Entamoeba histolytica
YSTSGNC

SEQ ID NO: 2578193 - protein, 6 aa, Entamoeba histolytica
YSTTSE

SEQ ID NO: 2578194 - protein, 7 aa, Entamoeba histolytica
YSVDANA

SEQ ID NO: 2578195 - protein, 10 aa, Entamoeba histolytica
YSVDENGNCV

SEQ ID NO: 2578196 - protein, 8 aa, Entamoeba histolytica
YSVEEKKK

SEQ ID NO: 2578197 - protein, 8 aa, Entamoeba histolytica
YSVGPTKQ

SEQ ID NO: 2578198 - protein, 13 aa, Entamoeba histolytica
YSYDKEKNACNPQ

SEQ ID NO: 2578199 - protein, 5 aa, Entamoeba histolytica
YSYDS

SEQ ID NO: 2578200 - protein, 5 aa, Entamoeba histolytica
YSYNP

SEQ ID NO: 2578201 - protein, 5 aa, Entamoeba histolytica
YTADF

SEQ ID NO: 2578202 - protein, 9 aa, Entamoeba histolytica
YTCSASNNK

SEQ ID NO: 2578203 - protein, 6 aa, Entamoeba histolytica
YTDGKS

SEQ ID NO: 2578204 - protein, 10 aa, Entamoeba histolytica
YTDIEQQRSI

SEQ ID NO: 2578205 - protein, 7 aa, Entamoeba histolytica
YTDKYGQ

SEQ ID NO: 2578206 - protein, 15 aa, Entamoeba histolytica
YTDPYGGCEKCNGGD

SEQ ID NO: 2578207 - protein, 12 aa, Entamoeba histolytica
YTDSSSKSSPKQ

SEQ ID NO: 2578208 - protein, 7 aa, Entamoeba histolytica
YTEGSDC

SEQ ID NO: 2578209 - protein, 6 aa, Entamoeba histolytica
YTEKTN

SEQ ID NO: 2578210 - protein, 9 aa, Entamoeba histolytica
YTEQAQNKG

SEQ ID NO: 2578211 - protein, 12 aa, Entamoeba histolytica
YTESKEEPQSKN

SEQ ID NO: 2578212 - protein, 11 aa, Entamoeba histolytica
YTGCPNNNNLA

SEQ ID NO: 2578213 - protein, 7 aa, Entamoeba histolytica
YTGDKPK

SEQ ID NO: 2578214 - protein, 11 aa, Entamoeba histolytica
YTGSATNLENI

SEQ ID NO: 2578215 - protein, 7 aa, Entamoeba histolytica
YTGSMKG

SEQ ID NO: 2578216 - protein, 5 aa, Entamoeba histolytica
YTISK

SEQ ID NO: 2578217 - protein, 8 aa, Entamoeba histolytica
YTISTGNN

SEQ ID NO: 2578218 - protein, 6 aa, Entamoeba histolytica
YTKETK

SEQ ID NO: 2578219 - protein, 6 aa, Entamoeba histolytica
YTKQND

SEQ ID NO: 2578220 - protein, 6 aa, Entamoeba histolytica
YTKSSS

SEQ ID NO: 2578221 - protein, 26 aa, Entamoeba histolytica
YTKVKNPEDLTEEELKTEEEKKKNEP

SEQ ID NO: 2578222 - protein, 5 aa, Entamoeba histolytica
YTKYS

SEQ ID NO: 2578223 - protein, 5 aa, Entamoeba histolytica
YTLGE

SEQ ID NO: 2578224 - protein, 21 aa, Entamoeba histolytica
YTLNNGTCESKENKNGKNQEI

SEQ ID NO: 2578225 - protein, 5 aa, Entamoeba histolytica
YTNEM

SEQ ID NO: 2578226 - protein, 4 aa, Entamoeba histolytica
YTNS

SEQ ID NO: 2578227 - protein, 5 aa, Entamoeba histolytica
YTNSL

SEQ ID NO: 2578228 - protein, 5 aa, Entamoeba histolytica
YTNSP

SEQ ID NO: 2578229 - protein, 4 aa, Entamoeba histolytica
YTNT

SEQ ID NO: 2578230 - protein, 4 aa, Entamoeba histolytica
YTPA

SEQ ID NO: 2578231 - protein, 9 aa, Entamoeba histolytica
YTPENRQAE

SEQ ID NO: 2578232 - protein, 9 aa, Entamoeba histolytica
YTPGDNTII

SEQ ID NO: 2578233 - protein, 6 aa, Entamoeba histolytica
YTPLKD

SEQ ID NO: 2578234 - protein, 11 aa, Entamoeba histolytica
YTPPKNTGDNP

SEQ ID NO: 2578235 - protein, 4 aa, Entamoeba histolytica
YTPR

SEQ ID NO: 2578236 - protein, 8 aa, Entamoeba histolytica
YTPSIKEG

SEQ ID NO: 2578237 - protein, 9 aa, Entamoeba histolytica
YTPSTAGDE

SEQ ID NO: 2578238 - protein, 5 aa, Entamoeba histolytica
YTPTP

SEQ ID NO: 2578239 - protein, 12 aa, Entamoeba histolytica
YTQQPFQKSQNH

SEQ ID NO: 2578240 - protein, 6 aa, Entamoeba histolytica
YTQRGG

SEQ ID NO: 2578241 - protein, 7 aa, Entamoeba histolytica
YTQYPEY

SEQ ID NO: 2578242 - protein, 8 aa, Entamoeba histolytica
YTSDTISS

SEQ ID NO: 2578243 - protein, 5 aa, Entamoeba histolytica
YTSFP

SEQ ID NO: 2578244 - protein, 11 aa, Entamoeba histolytica
YTSGISDKARP

SEQ ID NO: 2578245 - protein, 6 aa, Entamoeba histolytica
YTSNAN

SEQ ID NO: 2578246 - protein, 6 aa, Entamoeba histolytica
YTSPSH

SEQ ID NO: 2578247 - protein, 5 aa, Entamoeba histolytica
YTTDN

SEQ ID NO: 2578248 - protein, 12 aa, Entamoeba histolytica
YTTKEKSQRGSI

SEQ ID NO: 2578249 - protein, 8 aa, Entamoeba histolytica
YTTTLDGE

SEQ ID NO: 2578250 - protein, 9 aa, Entamoeba histolytica
YTWEDNDSI

SEQ ID NO: 2578251 - protein, 4 aa, Entamoeba histolytica
YTYD

SEQ ID NO: 2578252 - protein, 6 aa, Entamoeba histolytica
YVDNGG

SEQ ID NO: 2578253 - protein, 11 aa, Entamoeba histolytica
YVNENGECQEM

SEQ ID NO: 2578254 - protein, 14 aa, Entamoeba histolytica
YVNKDKQRPTPLQE

SEQ ID NO: 2578255 - protein, 21 aa, Entamoeba histolytica
YVNSGDTCSTCGNGKLDAEEQ

SEQ ID NO: 2578256 - protein, 22 aa, Entamoeba histolytica
YVPKKRQGTPEYEMKQIEDDEK

SEQ ID NO: 2578257 - protein, 10 aa, Entamoeba histolytica
YVQNDSGTGI

SEQ ID NO: 2578258 - protein, 7 aa, Entamoeba histolytica
YVRKDNE

SEQ ID NO: 2578259 - protein, 7 aa, Entamoeba histolytica
YVSGTDL

SEQ ID NO: 2578260 - protein, 7 aa, Entamoeba histolytica
YVSQDKP

SEQ ID NO: 2578261 - protein, 8 aa, Entamoeba histolytica
YVSSNNKK

SEQ ID NO: 2578262 - protein, 12 aa, Entamoeba histolytica
YVTGKPNERDSW

SEQ ID NO: 2578263 - protein, 5 aa, Entamoeba histolytica
YYASE

SEQ ID NO: 2578264 - protein, 23 aa, Entamoeba histolytica
YYDEPSFKNTKEEFEDKLRRTDE

SEQ ID NO: 2578265 - protein, 11 aa, Entamoeba histolytica
YYDGSDSNSPK

SEQ ID NO: 2578266 - protein, 7 aa, Entamoeba histolytica
YYDPEEG

SEQ ID NO: 2578267 - protein, 16 aa, Entamoeba histolytica
YYDQDTKKCVKNSQGC

SEQ ID NO: 2578268 - protein, 9 aa, Entamoeba histolytica
YYESNGCKQ

SEQ ID NO: 2578269 - protein, 6 aa, Entamoeba histolytica
YYKKEA

SEQ ID NO: 2578270 - protein, 11 aa, Entamoeba histolytica
YYKSKAKAYVQ

SEQ ID NO: 2578271 - protein, 5 aa, Entamoeba histolytica
YYKST

SEQ ID NO: 2578272 - protein, 16 aa, Entamoeba histolytica
YYKTNDGLCKKAQDNC

SEQ ID NO: 2578273 - protein, 4 aa, Entamoeba histolytica
YYNT

SEQ ID NO: 2578274 - protein, 11 aa, Entamoeba histolytica
YYPENDGHLSR

SEQ ID NO: 2578275 - protein, 9 aa, Entamoeba histolytica
YYPEPQDKQ

SEQ ID NO: 2578276 - protein, 14 aa, Entamoeba histolytica
YYPKEGEKNGCAKC

SEQ ID NO: 2578277 - protein, 25 aa, Entamoeba histolytica
YYPNGSGCSTCASKNCGDDCNTSNG

SEQ ID NO: 2578278 - protein, 4 aa, Entamoeba histolytica
YYPP

SEQ ID NO: 2578279 - protein, 5 aa, Entamoeba histolytica
YYQDS

SEQ ID NO: 2578280 - protein, 8 aa, Entamoeba histolytica
YYQNETRS

SEQ ID NO: 2578281 - protein, 6 aa, Entamoeba histolytica
YYQQDD

SEQ ID NO: 2578282 - protein, 4 aa, Entamoeba histolytica
YYRE

SEQ ID NO: 2578283 - protein, 12 aa, Entamoeba histolytica
YYRKGTSCPKCP

SEQ ID NO: 2578284 - protein, 6 aa, Entamoeba histolytica
YYRNGK

SEQ ID NO: 2578285 - protein, 12 aa, Entamoeba histolytica
YYRNGKGCSECE

SEQ ID NO: 2578286 - protein, 28 aa, Entamoeba histolytica
YYRNGKGCSECGEKCSTCNQKDKCTTCA

SEQ ID NO: 2578287 - protein, 28 aa, Entamoeba histolytica
YYRNGKGCSECGENCSTCNQKDKCTTCA

SEQ ID NO: 2578288 - protein, 36 aa, Entamoeba histolytica
YYRQPSQGYPPQQINQPNYSAPGYSAQTATGYPVQP

SEQ ID NO: 2578289 - protein, 9 aa, Entamoeba histolytica
YYSAGNNTC

SEQ ID NO: 2578290 - protein, 10 aa, Entamoeba histolytica
YYSGREPSKR

SEQ ID NO: 2578291 - protein, 4 aa, Entamoeba histolytica
YYSP

SEQ ID NO: 2578292 - protein, 8 aa, Entamoeba histolytica
YYSTENSP

SEQ ID NO: 2578293 - protein, 5 aa, Entamoeba histolytica
YYVSP

SEQ ID NO: 2578294 - protein, 13 aa, Entamoeba histolytica
YYYKDNDKTFLNG

SEQ ID NO: 2578295 - protein, 19 aa, Entamoeba histolytica
EYGCRECSEGYYLINKECS

SEQ ID NO: 2578296 - protein, 23 aa, Entamoeba histolytica
TYGCKRCSDGYYLTTNMKCSKCD

SEQ ID NO: 2578297 - protein, 18 aa, Entamoeba histolytica
EFEKEVAMLDKFRDEYII

SEQ ID NO: 2578298 - protein, 19 aa, Entamoeba histolytica
GGYGCDHCVCVNGTKKYAK

SEQ ID NO: 2578299 - protein, 31 aa, Entamoeba histolytica
INKCKEVKNNKCWKCSFWYGTNEEGNECNKE

SEQ ID NO: 2578300 - protein, 23 aa, Entamoeba histolytica
KGLKEWGGAILVGFDGDPYGKDE

SEQ ID NO: 2578301 - protein, 19 aa, Entamoeba histolytica
PKNKRLVKRDSICDKEINI

SEQ ID NO: 2578302 - protein, 19 aa, Entamoeba histolytica
CKNNNCIIDPNFDCQPIEC

SEQ ID NO: 2578303 - protein, 19 aa, Entamoeba histolytica
DELKIKKGELVCVLGSVGS

SEQ ID NO: 2578304 - protein, 28 aa, Entamoeba histolytica
DVYSFAICMLEIWLGRDPYDPMKFPDSE

SEQ ID NO: 2578305 - protein, 26 aa, Entamoeba histolytica
GDNGEWSSKCVLAYCDEGYKFDYINN

SEQ ID NO: 2578306 - protein, 27 aa, Entamoeba histolytica
GDNGEWSSKCVLAYCDSGYKFDYINNK

SEQ ID NO: 2578307 - protein, 22 aa, Entamoeba histolytica
GSGCGICNKGYYRNGKGCEICE

SEQ ID NO: 2578308 - protein, 22 aa, Entamoeba histolytica
GSGCGICNKGYYRNGKGCSECG

SEQ ID NO: 2578309 - protein, 24 aa, Entamoeba histolytica
IFDGKSFFDSWAIFNTAGLNIELS

SEQ ID NO: 2578310 - protein, 18 aa, Entamoeba histolytica
IRIKFMIDGAKGISYLHS

SEQ ID NO: 2578311 - protein, 18 aa, Entamoeba histolytica
KLMKHPRKPTEIVVYTDS

SEQ ID NO: 2578312 - protein, 20 aa, Entamoeba histolytica
KNGGGYSIYSQWIEKILSPY

SEQ ID NO: 2578313 - protein, 21 aa, Entamoeba histolytica
LNNACLKYKCVESKGSDGKIT

SEQ ID NO: 2578314 - protein, 27 aa, Entamoeba histolytica
NGKTCFKYAAKRPLAYVYLNTKMTYAT

SEQ ID NO: 2578315 - protein, 30 aa, Entamoeba histolytica
NKCKEVKNNKCWKCSFWYGTNEEGNECNKE

SEQ ID NO: 2578316 - protein, 25 aa, Entamoeba histolytica
PNQGRCFYCQCSYLDGSSVLTMYGE

SEQ ID NO: 2578317 - protein, 22 aa, Entamoeba histolytica
QVKTMRFRTRLFSSAYNQQTET

SEQ ID NO: 2578318 - protein, 24 aa, Entamoeba histolytica
STIDEIRNSYLLIYTYHDQGCKNL

SEQ ID NO: 2578319 - protein, 17 aa, Entamoeba histolytica
TKHVLKTGFAVNLYDPK

SEQ ID NO: 2578320 - protein, 18 aa, Entamoeba histolytica
YGCRECSEGYYLINKECS

SEQ ID NO: 2578321 - protein, 18 aa, Entamoeba histolytica
YTKKTCTVSEEFPTITPN

SEQ ID NO: 2578322 - protein, 21 aa, Entamoeba histolytica
AAKGRTTIVIAHRLSTIQNAD

SEQ ID NO: 2578323 - protein, 21 aa, Entamoeba histolytica
DCNTESWGGCGGGFAEDVLDS

SEQ ID NO: 2578324 - protein, 19 aa, Entamoeba histolytica
DPKITRSALRLVSLGPHYH

SEQ ID NO: 2578325 - protein, 17 aa, Entamoeba histolytica
DYPLKFATSNKFTHFAN

SEQ ID NO: 2578326 - protein, 23 aa, Entamoeba histolytica
EDLVRDGCLIKRCNETSKTTYWE

SEQ ID NO: 2578327 - protein, 19 aa, Entamoeba histolytica
EIKYGDWKLIKVMSNEKQS

SEQ ID NO: 2578328 - protein, 17 aa, Entamoeba histolytica
FKIDWNTLCGINGVDEY

SEQ ID NO: 2578329 - protein, 26 aa, Entamoeba histolytica
FNGIKGQCLGLGFSVITFFMIASYAL

SEQ ID NO: 2578330 - protein, 27 aa, Entamoeba histolytica
GDNGEWSTKCVLAYCDSGYKFDYINNK

SEQ ID NO: 2578331 - protein, 26 aa, Entamoeba histolytica
GDNGEWSTKCVLSYCDSGYKFDYINN

SEQ ID NO: 2578332 - protein, 26 aa, Entamoeba histolytica
GGGTFGIVYRAEWRRVDVAVKVMKTD

SEQ ID NO: 2578333 - protein, 23 aa, Entamoeba histolytica
IEQELKDVGLYDLFSKKESIHEN

SEQ ID NO: 2578334 - protein, 21 aa, Entamoeba histolytica
IKGICSSGIPISIINVSMVII

SEQ ID NO: 2578335 - protein, 17 aa, Entamoeba histolytica
IRIKFMIDGAKGISYLH

SEQ ID NO: 2578336 - protein, 18 aa, Entamoeba histolytica
ITAWEIFYQDEPYKEFKS

SEQ ID NO: 2578337 - protein, 23 aa, Entamoeba histolytica
KDKCTTCADGYFMSWIGECKSID

SEQ ID NO: 2578338 - protein, 17 aa, Entamoeba histolytica
KGELVCVLGSVGSGKSS

SEQ ID NO: 2578339 - protein, 18 aa, Entamoeba histolytica
KKKLCFPDNGRWLNITIV

SEQ ID NO: 2578340 - protein, 17 aa, Entamoeba histolytica
LQTIFSKKKLCFPDNGR

SEQ ID NO: 2578341 - protein, 18 aa, Entamoeba histolytica
NDLDICFANTQKNYFYID

SEQ ID NO: 2578342 - protein, 18 aa, Entamoeba histolytica
NEYIIQFYGAVFIPNKIC

SEQ ID NO: 2578343 - protein, 18 aa, Entamoeba histolytica
NGGGYSIYSQWIEKILSP

SEQ ID NO: 2578344 - protein, 22 aa, Entamoeba histolytica
NIQFKSEVVNPVTSTTVSPKQE

SEQ ID NO: 2578345 - protein, 17 aa, Entamoeba histolytica
NSFTNDLDICFANTQKN

SEQ ID NO: 2578346 - protein, 24 aa, Entamoeba histolytica
PLVKKDGKCIGIFNKIEVLNTTGI

SEQ ID NO: 2578347 - protein, 20 aa, Entamoeba histolytica
PSSDGYCWSYTCDQTTGFCK

SEQ ID NO: 2578348 - protein, 23 aa, Entamoeba histolytica
QNLCGGCYAIATAHHLSTIYAYL

SEQ ID NO: 2578349 - protein, 17 aa, Entamoeba histolytica
RDKVCVKTSPYIEMSCY

SEQ ID NO: 2578350 - protein, 20 aa, Entamoeba histolytica
SAKLRCWDTIYVQRTTSIDT

SEQ ID NO: 2578351 - protein, 21 aa, Entamoeba histolytica
SGAILSYIMCKAMNRSFMSVI

SEQ ID NO: 2578352 - protein, 19 aa, Entamoeba histolytica
SGIATKVYVPLSYEDEKNT

SEQ ID NO: 2578353 - protein, 19 aa, Entamoeba histolytica
SKGRTTIIVAHRLTTVRNA

SEQ ID NO: 2578354 - protein, 22 aa, Entamoeba histolytica
SNECKRCSKGYAFDSQHTCTKC

SEQ ID NO: 2578355 - protein, 19 aa, Entamoeba histolytica
TRECKTCSLIETREKVQEV

SEQ ID NO: 2578356 - protein, 25 aa, Entamoeba histolytica
TSCKRCKEGYLLKNGECVSCTELPE

SEQ ID NO: 2578357 - protein, 19 aa, Entamoeba histolytica
VAGRLPGHMNVLLAEANVP

SEQ ID NO: 2578358 - protein, 17 aa, Entamoeba histolytica
VKRDSICDKEINIEHGH

SEQ ID NO: 2578359 - protein, 25 aa, Entamoeba histolytica
VTKGLKEWGGAILVGFDGDPYGKDE

SEQ ID NO: 2578360 - protein, 19 aa, Entamoeba histolytica
WNGNVSFERLIKFETTPSL

SEQ ID NO: 2578361 - protein, 26 aa, Entamoeba histolytica
YMKSENKVGYFGVFYYKDENCTEELG

SEQ ID NO: 2578362 - protein, 22 aa, Entamoeba histolytica
ADNEVLKGISFKAEQGKTIALV

SEQ ID NO: 2578363 - protein, 18 aa, Entamoeba histolytica
ALASGFFVGPMLMEIAGK

SEQ ID NO: 2578364 - protein, 17 aa, Entamoeba histolytica
ANDLAIPFLHGAFTAET

SEQ ID NO: 2578365 - protein, 21 aa, Entamoeba histolytica
ASKGRTTIIIAHRLSTIQNAD

SEQ ID NO: 2578366 - protein, 24 aa, Entamoeba histolytica
AVATCQRAGIIVRMVTGDNIATAR

SEQ ID NO: 2578367 - protein, 24 aa, Entamoeba histolytica
AYFFDTCESNMKYLIAGSLFQQFE

SEQ ID NO: 2578368 - protein, 19 aa, Entamoeba histolytica
CANSGCYWCTPSNECQAIP

SEQ ID NO: 2578369 - protein, 20 aa, Entamoeba histolytica
CDGGDGCIECECQPDWYTQD

SEQ ID NO: 2578370 - protein, 17 aa, Entamoeba histolytica
CGMCVPQSNGDKYVKYE

SEQ ID NO: 2578371 - protein, 19 aa, Entamoeba histolytica
CKLLIKIPIGTTFIGMKLK

SEQ ID NO: 2578372 - protein, 19 aa, Entamoeba histolytica
CLLCIPYIIFEYLTLNDST

SEQ ID NO: 2578373 - protein, 18 aa, Entamoeba histolytica
CNILLTIVVLCYDSSQKE

SEQ ID NO: 2578374 - protein, 20 aa, Entamoeba histolytica
CPENCKECLSSTNCHECMNG

SEQ ID NO: 2578375 - protein, 24 aa, Entamoeba histolytica
CTTSDIPCSGIIYINDKTKTTSID

SEQ ID NO: 2578376 - protein, 19 aa, Entamoeba histolytica
CVFHKDCLISLFDQSIEEV

SEQ ID NO: 2578377 - protein, 23 aa, Entamoeba histolytica
CYVFCSVCGQYFIYRLITLANSL

SEQ ID NO: 2578378 - protein, 22 aa, Entamoeba histolytica
DGPCKLPGCLLCSDDDTICYKC

SEQ ID NO: 2578379 - protein, 24 aa, Entamoeba histolytica
DGSKEGFAACISRLCHDNNLRQKL

SEQ ID NO: 2578380 - protein, 25 aa, Entamoeba histolytica
DIVCPEDRLAGYVKNTEFPKWTIGV

SEQ ID NO: 2578381 - protein, 23 aa, Entamoeba histolytica
DKFFNMIFPFVLFILDDSEKINE

SEQ ID NO: 2578382 - protein, 18 aa, Entamoeba histolytica
DQRSNFLGGTIVENSVQT

SEQ ID NO: 2578383 - protein, 17 aa, Entamoeba histolytica
DSAMFMSYEFDKCYYTD

SEQ ID NO: 2578384 - protein, 19 aa, Entamoeba histolytica
DTICYKCENGLTLNGTHCY

SEQ ID NO: 2578385 - protein, 21 aa, Entamoeba histolytica
ECDGHKFLWVRSSWGNDWGVE

SEQ ID NO: 2578386 - protein, 24 aa, Entamoeba histolytica
EESKITCLLYHDYYSVCTDKEDEC

SEQ ID NO: 2578387 - protein, 23 aa, Entamoeba histolytica
EEVKCPKCNQPIFTQQDIPNQIK

SEQ ID NO: 2578388 - protein, 19 aa, Entamoeba histolytica
EEVYKIWGNYYKELFYCGK

SEQ ID NO: 2578389 - protein, 19 aa, Entamoeba histolytica
EFEKEVAMLDKFRDEYIIH

SEQ ID NO: 2578390 - protein, 18 aa, Entamoeba histolytica
EFEKEVAMLDKFRNEYII

SEQ ID NO: 2578391 - protein, 19 aa, Entamoeba histolytica
EFEKEVAMLDKFRNEYIIQ

SEQ ID NO: 2578392 - protein, 25 aa, Entamoeba histolytica
ELLPILNKKYRVMLITFIMDNFEHF

SEQ ID NO: 2578393 - protein, 20 aa, Entamoeba histolytica
ELMDLKGFYYTLAMQQFGTV

SEQ ID NO: 2578394 - protein, 22 aa, Entamoeba histolytica
EMIECAKMANAHEFISHLPEGY

SEQ ID NO: 2578395 - protein, 29 aa, Entamoeba histolytica
ENKLPTGCYCTYSLISKQECIFDCENENE

SEQ ID NO: 2578396 - protein, 25 aa, Entamoeba histolytica
EPETWKGVVYLLVIAFMQILTSFCF

SEQ ID NO: 2578397 - protein, 18 aa, Entamoeba histolytica
EQNQHPFNEHQLPSDQTP

SEQ ID NO: 2578398 - protein, 20 aa, Entamoeba histolytica
ERNYCLKCLNGYKIENNTCV

SEQ ID NO: 2578399 - protein, 22 aa, Entamoeba histolytica
ESTYRKNFRNNWKKSIKGEEPV

SEQ ID NO: 2578400 - protein, 22 aa, Entamoeba histolytica
FAAIILPFGLCWYNQEEDTSCV

SEQ ID NO: 2578401 - protein, 18 aa, Entamoeba histolytica
FDSCRSCINNTKVVDGEC

SEQ ID NO: 2578402 - protein, 17 aa, Entamoeba histolytica
FEKEVAMLDKFRNEYII

SEQ ID NO: 2578403 - protein, 19 aa, Entamoeba histolytica
FESSMCGLVMTLVLLLSFI

SEQ ID NO: 2578404 - protein, 20 aa, Entamoeba histolytica
FKKVSVKEFIQFIDNGGNMV

SEQ ID NO: 2578405 - protein, 21 aa, Entamoeba histolytica
FKLERMTGYTVTVFKNYCVEN

SEQ ID NO: 2578406 - protein, 27 aa, Entamoeba histolytica
FKSRDCIFMFISWCCTLSALSVVNGLF

SEQ ID NO: 2578407 - protein, 17 aa, Entamoeba histolytica
FLWVRSSWGNDWGVENG

SEQ ID NO: 2578408 - protein, 26 aa, Entamoeba histolytica
FMKKIYRIPFDWLEEKSMGLSDSIVV

SEQ ID NO: 2578409 - protein, 27 aa, Entamoeba histolytica
FNDTFPMCIFCIMVLSALFIGIDYRKV

SEQ ID NO: 2578410 - protein, 17 aa, Entamoeba histolytica
FQFSDIQFNAGFIGIPF

SEQ ID NO: 2578411 - protein, 17 aa, Entamoeba histolytica
FRNNWKKSIKGEEPVTI

SEQ ID NO: 2578412 - protein, 25 aa, Entamoeba histolytica
FSAIFTKVFLKRKVYAYQWVGVAFV

SEQ ID NO: 2578413 - protein, 17 aa, Entamoeba histolytica
FSTLGAYVLIKITKQHF

SEQ ID NO: 2578414 - protein, 17 aa, Entamoeba histolytica
FTNDLDICFANTQKNYF

SEQ ID NO: 2578415 - protein, 17 aa, Entamoeba histolytica
FTTATNVIPDIEQELKD

SEQ ID NO: 2578416 - protein, 18 aa, Entamoeba histolytica
FTTATNVIPDIEQELKDV

SEQ ID NO: 2578417 - protein, 26 aa, Entamoeba histolytica
FVLLSESIFFDWSVVLVTFIIMIIVL

SEQ ID NO: 2578418 - protein, 17 aa, Entamoeba histolytica
FYAIPLFAIISIVTGDL

SEQ ID NO: 2578419 - protein, 26 aa, Entamoeba histolytica
GDNGEWSTKCVLAYCDEGYKFDYINN

SEQ ID NO: 2578420 - protein, 28 aa, Entamoeba histolytica
GDNGEWSTKCVLAYCDSGYKFDYINNKC

SEQ ID NO: 2578421 - protein, 20 aa, Entamoeba histolytica
GEGAFGMVFRGTYRGREVAI

SEQ ID NO: 2578422 - protein, 26 aa, Entamoeba histolytica
GFPSSHAQFWCCFIVLFYYYINQQPK

SEQ ID NO: 2578423 - protein, 18 aa, Entamoeba histolytica
GICSSGMPIMTVNLVMII

SEQ ID NO: 2578424 - protein, 24 aa, Entamoeba histolytica
GIRVRRLYFKSLLRQDATWYDFQE

SEQ ID NO: 2578425 - protein, 21 aa, Entamoeba histolytica
GMCYQCPIGCSLCSGPDSCIT

SEQ ID NO: 2578426 - protein, 27 aa, Entamoeba histolytica
GQKVGEFFSYFGMCITGYVIGFVKEWK

SEQ ID NO: 2578427 - protein, 18 aa, Entamoeba histolytica
GRNDLKEKLIVDSTSNTV

SEQ ID NO: 2578428 - protein, 23 aa, Entamoeba histolytica
GSYECRDLEGCVVKQYNTSCEPK

SEQ ID NO: 2578429 - protein, 18 aa, Entamoeba histolytica
GTCLECINESALLKGGIC

SEQ ID NO: 2578430 - protein, 18 aa, Entamoeba histolytica
GTTSMFIILCATIILLFF

SEQ ID NO: 2578431 - protein, 18 aa, Entamoeba histolytica
GVPVIACNNGGPLETVQN

SEQ ID NO: 2578432 - protein, 26 aa, Entamoeba histolytica
GVSWIWRIIVIIAFEFLEMSVFLIPL

SEQ ID NO: 2578433 - protein, 20 aa, Entamoeba histolytica
GWMGNGYIDFTTKFNGLSAS

SEQ ID NO: 2578434 - protein, 18 aa, Entamoeba histolytica
GYACEFELFITIKCTTKI

SEQ ID NO: 2578435 - protein, 18 aa, Entamoeba histolytica
GYACEFEVFITIKCTAKI

SEQ ID NO: 2578436 - protein, 25 aa, Entamoeba histolytica
GYSTPTGMKCKKCRYGFNSDGSCIV

SEQ ID NO: 2578437 - protein, 17 aa, Entamoeba histolytica
HEIDIPKGITIYSSSIV

SEQ ID NO: 2578438 - protein, 24 aa, Entamoeba histolytica
HFLMDILFLLGINFNTYITNGKNG

SEQ ID NO: 2578439 - protein, 23 aa, Entamoeba histolytica
HKKHPNCCQIAFMQRAPKYIRKG

SEQ ID NO: 2578440 - protein, 23 aa, Entamoeba histolytica
HMLNELLGLYNHITFLVSTQEEM

SEQ ID NO: 2578441 - protein, 21 aa, Entamoeba histolytica
HREIVCKHLNYLVKNTTKSFT

SEQ ID NO: 2578442 - protein, 18 aa, Entamoeba histolytica
IAARAGGMVFPLIFSTIV

SEQ ID NO: 2578443 - protein, 19 aa, Entamoeba histolytica
IFTLKGKWISTLIKAGMGF

SEQ ID NO: 2578444 - protein, 23 aa, Entamoeba histolytica
IGKKFGFTLLMVFMFLFVLVLIP

SEQ ID NO: 2578445 - protein, 17 aa, Entamoeba histolytica
IHLKMTLAPSFRINGGL

SEQ ID NO: 2578446 - protein, 18 aa, Entamoeba histolytica
IHTLILFFDFKLNSMQSS

SEQ ID NO: 2578447 - protein, 19 aa, Entamoeba histolytica
IILGYSIFICFKIRHPTRQ

SEQ ID NO: 2578448 - protein, 19 aa, Entamoeba histolytica
IINKEERNTEVIHTQIETK

SEQ ID NO: 2578449 - protein, 18 aa, Entamoeba histolytica
IITQAITIILERFDKQKE

SEQ ID NO: 2578450 - protein, 17 aa, Entamoeba histolytica
IKHGLNIKTALRRFHKN

SEQ ID NO: 2578451 - protein, 22 aa, Entamoeba histolytica
IKIRMLYFRALLRQDAGWYDFH

SEQ ID NO: 2578452 - protein, 17 aa, Entamoeba histolytica
ILECLVVCKQACIIHCD

SEQ ID NO: 2578453 - protein, 18 aa, Entamoeba histolytica
IMLLLTVVMAAIFYGIKA

SEQ ID NO: 2578454 - protein, 21 aa, Entamoeba histolytica
IPACCDLCATALSNVGLLWIP

SEQ ID NO: 2578455 - protein, 18 aa, Entamoeba histolytica
IPIGTTFIGMKLKKFIEE

SEQ ID NO: 2578456 - protein, 17 aa, Entamoeba histolytica
IPPKRKKVIDKRNEINI

SEQ ID NO: 2578457 - protein, 17 aa, Entamoeba histolytica
IPSYRYPDVDPFETTPF

SEQ ID NO: 2578458 - protein, 24 aa, Entamoeba histolytica
ITAICLVVSFLSVGFFAEYLTKHQ

SEQ ID NO: 2578459 - protein, 18 aa, Entamoeba histolytica
ITTEVEWERKTCPCSGDK

SEQ ID NO: 2578460 - protein, 17 aa, Entamoeba histolytica
ITYYTCFLIAGIFYYHF

SEQ ID NO: 2578461 - protein, 17 aa, Entamoeba histolytica
IVTMIISVIVFKHPITK

SEQ ID NO: 2578462 - protein, 17 aa, Entamoeba histolytica
IYEGISYDDEMNEEMYY

SEQ ID NO: 2578463 - protein, 34 aa, Entamoeba histolytica
KAGNIKLLGINVFNELILEGSIIKSDNSFDIDKV

SEQ ID NO: 2578464 - protein, 20 aa, Entamoeba histolytica
KCASCSAPLVLASDSLSCKN

SEQ ID NO: 2578465 - protein, 23 aa, Entamoeba histolytica
KCDKCDVLGCAWCQDDHTSCKRC

SEQ ID NO: 2578466 - protein, 24 aa, Entamoeba histolytica
KEADKEAYCTYEITTRECKTCSLI

SEQ ID NO: 2578467 - protein, 18 aa, Entamoeba histolytica
KEETASDCLLYYNNKCVK

SEQ ID NO: 2578468 - protein, 21 aa, Entamoeba histolytica
KEIESEWYLFSRGIKTEKKKT

SEQ ID NO: 2578469 - protein, 25 aa, Entamoeba histolytica
KEQRRAEKLHHFFPIQKIWNENKVI

SEQ ID NO: 2578470 - protein, 17 aa, Entamoeba histolytica
KERITIDEIVRMLERIE

SEQ ID NO: 2578471 - protein, 27 aa, Entamoeba histolytica
KEVKNNKCWKCSFWYGTNEEGNECNKE

SEQ ID NO: 2578472 - protein, 18 aa, Entamoeba histolytica
KGAVVICAITYYTCFLIA

SEQ ID NO: 2578473 - protein, 19 aa, Entamoeba histolytica
KGDEVVRIKEGEAIAEGVK

SEQ ID NO: 2578474 - protein, 23 aa, Entamoeba histolytica
KISGSTLLILFGLMVLLVVFMVV

SEQ ID NO: 2578475 - protein, 21 aa, Entamoeba histolytica
KKKVCMIIFLVLGICFPPFLV

SEQ ID NO: 2578476 - protein, 25 aa, Entamoeba histolytica
KKTDKEILPFLLINKIQIYGEDPIY

SEQ ID NO: 2578477 - protein, 19 aa, Entamoeba histolytica
KLENLRVIARCSPQDKERL

SEQ ID NO: 2578478 - protein, 19 aa, Entamoeba histolytica
KLLDPVIVKNFKRIDNGKY

SEQ ID NO: 2578479 - protein, 25 aa, Entamoeba histolytica
KLPSNEKYEGLKISEDQIRGEDVKI

SEQ ID NO: 2578480 - protein, 21 aa, Entamoeba histolytica
KNFKKCTTLTIAHRLHSIMDS

SEQ ID NO: 2578481 - protein, 20 aa, Entamoeba histolytica
KNKACPNGIDAVWLWVNGSD

SEQ ID NO: 2578482 - protein, 17 aa, Entamoeba histolytica
KNKRLVKRDSICDKEIN

SEQ ID NO: 2578483 - protein, 19 aa, Entamoeba histolytica
KPTDLYCVHHKKHICIECI

SEQ ID NO: 2578484 - protein, 21 aa, Entamoeba histolytica
KRLVIPLKVDFKGIVSNEEVD

SEQ ID NO: 2578485 - protein, 26 aa, Entamoeba histolytica
KVKLIECGGIVLQECKTDTTTYNCPP

SEQ ID NO: 2578486 - protein, 24 aa, Entamoeba histolytica
KYAIISCAVFPPFALACLVGSVKT

SEQ ID NO: 2578487 - protein, 20 aa, Entamoeba histolytica
KYNYAYRIAQIPVFILLIIA

SEQ ID NO: 2578488 - protein, 18 aa, Entamoeba histolytica
LCDGVLYPLIAILIGDVF

SEQ ID NO: 2578489 - protein, 18 aa, Entamoeba histolytica
LCKEGGFMKKIYRIPFDW

SEQ ID NO: 2578490 - protein, 18 aa, Entamoeba histolytica
LDIPVVLDNLFFSVITEE

SEQ ID NO: 2578491 - protein, 17 aa, Entamoeba histolytica
LDKFRNEYIIQFYGAVF

SEQ ID NO: 2578492 - protein, 28 aa, Entamoeba histolytica
LETDNSFTRRIEVTGGQIEVNNKITFSE

SEQ ID NO: 2578493 - protein, 19 aa, Entamoeba histolytica
LIDLGSCCFDNYSLYSYIQ

SEQ ID NO: 2578494 - protein, 24 aa, Entamoeba histolytica
LIECKTSDCYIELNTDSSVTSESI

SEQ ID NO: 2578495 - protein, 19 aa, Entamoeba histolytica
LKHSNRFVLLRVILDNFRH

SEQ ID NO: 2578496 - protein, 21 aa, Entamoeba histolytica
LKMTLAPSFRINGGLLPEEIH

SEQ ID NO: 2578497 - protein, 19 aa, Entamoeba histolytica
LKWQMHMNLFLNLQKDMTH

SEQ ID NO: 2578498 - protein, 19 aa, Entamoeba histolytica
LLAFGLPMPYLRANYIEWQ

SEQ ID NO: 2578499 - protein, 18 aa, Entamoeba histolytica
LLDFCYYTNAGVITTLIS

SEQ ID NO: 2578500 - protein, 21 aa, Entamoeba histolytica
LLRIFNHWHLNYAVYPFMRFE

SEQ ID NO: 2578501 - protein, 17 aa, Entamoeba histolytica
LMKHPRKPTEIVVYTDS

SEQ ID NO: 2578502 - protein, 25 aa, Entamoeba histolytica
LPAWMCIFNSFSILWFWIADSCDGI

SEQ ID NO: 2578503 - protein, 17 aa, Entamoeba histolytica
LPLIITRGNNVFGPHQF

SEQ ID NO: 2578504 - protein, 19 aa, Entamoeba histolytica
LQDFTCLLGSVIVGLVLGV

SEQ ID NO: 2578505 - protein, 23 aa, Entamoeba histolytica
LRLKRLTNSLIHHCEKETTVGCQ

SEQ ID NO: 2578506 - protein, 21 aa, Entamoeba histolytica
LSEKYKFLFTTHLCPLSDHIK

SEQ ID NO: 2578507 - protein, 19 aa, Entamoeba histolytica
LSYSGRGDYIFNYPHCPCD

SEQ ID NO: 2578508 - protein, 30 aa, Entamoeba histolytica
LTGAYPFYAACASMAVGFIVFSFIYLNQIE

SEQ ID NO: 2578509 - protein, 18 aa, Entamoeba histolytica
LVKRDSICDKEINIEHGH

SEQ ID NO: 2578510 - protein, 25 aa, Entamoeba histolytica
LYSLPLFFCLSNFYPSKSFFTKERL

SEQ ID NO: 2578511 - protein, 18 aa, Entamoeba histolytica
MESVWPYQFAKTRTHKFR

SEQ ID NO: 2578512 - protein, 22 aa, Entamoeba histolytica
MIEQLRMNFVLFILATIGGIVG

SEQ ID NO: 2578513 - protein, 23 aa, Entamoeba histolytica
MKSENKVGYFGTFYYKDENCTEE

SEQ ID NO: 2578514 - protein, 19 aa, Entamoeba histolytica
MKYLIAGSLFQQFEYNENT

SEQ ID NO: 2578515 - protein, 21 aa, Entamoeba histolytica
MSNDCSISFTGSTQLNRMVMK

SEQ ID NO: 2578516 - protein, 23 aa, Entamoeba histolytica
MYLIPRYSFKFSVVNPPDEIIKN

SEQ ID NO: 2578517 - protein, 23 aa, Entamoeba histolytica
MYLIPRYSFKFSVVNPPDEIKKN

SEQ ID NO: 2578518 - protein, 18 aa, Entamoeba histolytica
NCSISRMNIKGDKMKEVV

SEQ ID NO: 2578519 - protein, 27 aa, Entamoeba histolytica
NCSLLSVKISVALPANFREMLSQFECL

SEQ ID NO: 2578520 - protein, 24 aa, Entamoeba histolytica
NEKYFWELCWDILRSNSISRKPLL

SEQ ID NO: 2578521 - protein, 20 aa, Entamoeba histolytica
NETDCALLLFLKKIAMSPSL

SEQ ID NO: 2578522 - protein, 17 aa, Entamoeba histolytica
NHINCTVCKYREYVEEN

SEQ ID NO: 2578523 - protein, 17 aa, Entamoeba histolytica
NIHCSFSVNGVNTLVVR

SEQ ID NO: 2578524 - protein, 20 aa, Entamoeba histolytica
NINKISGKLAKLTELAKSKS

SEQ ID NO: 2578525 - protein, 21 aa, Entamoeba histolytica
NLDGASPVFMLLAFVIQLIFF

SEQ ID NO: 2578526 - protein, 29 aa, Entamoeba histolytica
NRIKNCYECTIIGCEWCNNQCSLTFSDCS

SEQ ID NO: 2578527 - protein, 17 aa, Entamoeba histolytica
NRMCILPQEATMFSGTV

SEQ ID NO: 2578528 - protein, 23 aa, Entamoeba histolytica
NRMVMKKNIEIHSDFQIDEIITS

SEQ ID NO: 2578529 - protein, 20 aa, Entamoeba histolytica
NVNTHLAIIFGITDSTVIKS

SEQ ID NO: 2578530 - protein, 25 aa, Entamoeba histolytica
NWKKSIKGEEPVTITYHIKYYNNND

SEQ ID NO: 2578531 - protein, 23 aa, Entamoeba histolytica
NYLSRVGPALAMNFIHMINFTSN

SEQ ID NO: 2578532 - protein, 25 aa, Entamoeba histolytica
PDPGLRMLGLVKWLLSGFYLMPTGI

SEQ ID NO: 2578533 - protein, 22 aa, Entamoeba histolytica
PIGEGAFGMVFRGTYRGREVAI

SEQ ID NO: 2578534 - protein, 19 aa, Entamoeba histolytica
PIIDVYKAKVCVVNKRSLN

SEQ ID NO: 2578535 - protein, 20 aa, Entamoeba histolytica
PITKLQIFAIFIVFGTLFID

SEQ ID NO: 2578536 - protein, 19 aa, Entamoeba histolytica
PKFGMIFQIISMVITGYVI

SEQ ID NO: 2578537 - protein, 19 aa, Entamoeba histolytica
PKVKCMVPYCDNDKNLTEV

SEQ ID NO: 2578538 - protein, 24 aa, Entamoeba histolytica
PLSYKRIRIIPSIFLMSLVYLSLV

SEQ ID NO: 2578539 - protein, 26 aa, Entamoeba histolytica
PLTDLLKVRFCQDIARGMEYLHQNDI

SEQ ID NO: 2578540 - protein, 23 aa, Entamoeba histolytica
PPEPIIPMQIFWYIVYYGMIVFA

SEQ ID NO: 2578541 - protein, 22 aa, Entamoeba histolytica
PSIEVFPKMKLMKHPRKPTEIV

SEQ ID NO: 2578542 - protein, 23 aa, Entamoeba histolytica
PSLLPFLKAVCGSKKSWYARHTG

SEQ ID NO: 2578543 - protein, 21 aa, Entamoeba histolytica
PSVCKQLRSRGYGIYVESGAG

SEQ ID NO: 2578544 - protein, 21 aa, Entamoeba histolytica
QELLDLKGFYYTLAMQQFGTV

SEQ ID NO: 2578545 - protein, 20 aa, Entamoeba histolytica
QIMSKIFPSHDFLKHICIVW

SEQ ID NO: 2578546 - protein, 17 aa, Entamoeba histolytica
QPFEIVDIPGYGKVRGL

SEQ ID NO: 2578547 - protein, 21 aa, Entamoeba histolytica
QRQIICLARALLKKSKILIMD

SEQ ID NO: 2578548 - protein, 22 aa, Entamoeba histolytica
QSIVNSVKWGRCVYDNIRKFLQ

SEQ ID NO: 2578549 - protein, 22 aa, Entamoeba histolytica
QSRFYRAPEVCIGYRYNCAIDM

SEQ ID NO: 2578550 - protein, 25 aa, Entamoeba histolytica
QTGKKWKQQYIYSISKDGELTFEDN

SEQ ID NO: 2578551 - protein, 19 aa, Entamoeba histolytica
RAGGMVFPLIFSTIVKQLC

SEQ ID NO: 2578552 - protein, 20 aa, Entamoeba histolytica
RIAQIPVFILLIIAFFFMCL

SEQ ID NO: 2578553 - protein, 23 aa, Entamoeba histolytica
RKENRVGSLVTRLSSDPTKLNGI

SEQ ID NO: 2578554 - protein, 21 aa, Entamoeba histolytica
RKKRNRFSIIRIMIEQLRMNF

SEQ ID NO: 2578555 - protein, 26 aa, Entamoeba histolytica
RKLRTKELWCMGGTMSARSTLVTLML

SEQ ID NO: 2578556 - protein, 28 aa, Entamoeba histolytica
RKTCPCSGDKCIIDFSATTSVIYKLPSN

SEQ ID NO: 2578557 - protein, 21 aa, Entamoeba histolytica
RKWALWFGLILQCVGIVLCII

SEQ ID NO: 2578558 - protein, 23 aa, Entamoeba histolytica
RQLYRYANWLDLILLAVGIFGSI

SEQ ID NO: 2578559 - protein, 20 aa, Entamoeba histolytica
SAAFIKKSLRLCLEAPTGSI

SEQ ID NO: 2578560 - protein, 19 aa, Entamoeba histolytica
SAQPYVNWFLAFLGGLAGG

SEQ ID NO: 2578561 - protein, 17 aa, Entamoeba histolytica
SDEECKTVESIEATSSN

SEQ ID NO: 2578562 - protein, 18 aa, Entamoeba histolytica
SDKTRICLKCQRGFNLAS

SEQ ID NO: 2578563 - protein, 20 aa, Entamoeba histolytica
SEIMKYFYIFLGISGAMFIS

SEQ ID NO: 2578564 - protein, 20 aa, Entamoeba histolytica
SERNYCLKCSNGYKIENNTC

SEQ ID NO: 2578565 - protein, 20 aa, Entamoeba histolytica
SFFIGWHMVMAIGGADMPVV

SEQ ID NO: 2578566 - protein, 17 aa, Entamoeba histolytica
SGCGICNKGYYRNGKGC

SEQ ID NO: 2578567 - protein, 21 aa, Entamoeba histolytica
SIEVFPKMKLMKHPRKPTEIV

SEQ ID NO: 2578568 - protein, 17 aa, Entamoeba histolytica
SKDCLRCNAEYLEAKGG

SEQ ID NO: 2578569 - protein, 18 aa, Entamoeba histolytica
SLDVSKLEKLGWRATTSF

SEQ ID NO: 2578570 - protein, 19 aa, Entamoeba histolytica
SLFCLQCAENFYFVSSNTC

SEQ ID NO: 2578571 - protein, 25 aa, Entamoeba histolytica
SLVSCLSVAPCQRLNEGVKIQPPQS

SEQ ID NO: 2578572 - protein, 21 aa, Entamoeba histolytica
SMDCVPRLSKAQCMDALSSQN

SEQ ID NO: 2578573 - protein, 27 aa, Entamoeba histolytica
SMSDLLKIRFCQDIARGMEYLHQNDIL

SEQ ID NO: 2578574 - protein, 17 aa, Entamoeba histolytica
SNLPLITTSSFKAYSVN

SEQ ID NO: 2578575 - protein, 17 aa, Entamoeba histolytica
STNKYKYNYAYRIAQIP

SEQ ID NO: 2578576 - protein, 22 aa, Entamoeba histolytica
SVCMVCTMTCRFVDCFTDILCN

SEQ ID NO: 2578577 - protein, 19 aa, Entamoeba histolytica
SVNYKIYRRRAFVSNSNEK

SEQ ID NO: 2578578 - protein, 17 aa, Entamoeba histolytica
SVTNIWIGNEVMEVDQT

SEQ ID NO: 2578579 - protein, 18 aa, Entamoeba histolytica
SVYNFAPYIKNYYIVTMG

SEQ ID NO: 2578580 - protein, 25 aa, Entamoeba histolytica
SWCSPCTTIRCSSCQVGTYLSNGLC

SEQ ID NO: 2578581 - protein, 24 aa, Entamoeba histolytica
SYALGSWYGSLVIRGKGGSKGVFA

SEQ ID NO: 2578582 - protein, 25 aa, Entamoeba histolytica
SYQLKIKFLDDMAVALSYLHQNQIL

SEQ ID NO: 2578583 - protein, 19 aa, Entamoeba histolytica
SYYTCPLPYTCTDTTNCQH

SEQ ID NO: 2578584 - protein, 22 aa, Entamoeba histolytica
TALLCGVPWAFFLHKFGPKRAL

SEQ ID NO: 2578585 - protein, 17 aa, Entamoeba histolytica
TECSDGFSGRSPYSNCT

SEQ ID NO: 2578586 - protein, 17 aa, Entamoeba histolytica
TEVPVSGATVIRIESDV

SEQ ID NO: 2578587 - protein, 20 aa, Entamoeba histolytica
TIVGCLAVFIACLNIFGGFF

SEQ ID NO: 2578588 - protein, 24 aa, Entamoeba histolytica
TKGLKEWGSAIIVGYGGDIYGEDK

SEQ ID NO: 2578589 - protein, 19 aa, Entamoeba histolytica
TKHVLKTGFAVNLYDPKTC

SEQ ID NO: 2578590 - protein, 18 aa, Entamoeba histolytica
TLAIPFAFLYSGWGIGLI

SEQ ID NO: 2578591 - protein, 23 aa, Entamoeba histolytica
TLIFKCISLAPSITLPITIPEFI

SEQ ID NO: 2578592 - protein, 23 aa, Entamoeba histolytica
TLTPRLLLSPVMSTYYDRLYKYI

SEQ ID NO: 2578593 - protein, 19 aa, Entamoeba histolytica
TNFFFWGIGSIVYVLYYIF

SEQ ID NO: 2578594 - protein, 19 aa, Entamoeba histolytica
TRICLKCQRGFNLASNQTK

SEQ ID NO: 2578595 - protein, 25 aa, Entamoeba histolytica
TSKYSDFSFLFGLILIVTSLLCDGI

SEQ ID NO: 2578596 - protein, 17 aa, Entamoeba histolytica
TTLTIAHRLHSIMDSNR

SEQ ID NO: 2578597 - protein, 24 aa, Entamoeba histolytica
TTYNCPPIRCSYKQENKLPTGCYC

SEQ ID NO: 2578598 - protein, 19 aa, Entamoeba histolytica
TVRENICFLAPYNKEKYKQ

SEQ ID NO: 2578599 - protein, 21 aa, Entamoeba histolytica
TYSLMCLHHLIVQHGLTVPSY

SEQ ID NO: 2578600 - protein, 25 aa, Entamoeba histolytica
VCIILLCIITYWAFIPIGVCLVFVS

SEQ ID NO: 2578601 - protein, 18 aa, Entamoeba histolytica
VDALRFDFAFSTDYPPLF

SEQ ID NO: 2578602 - protein, 19 aa, Entamoeba histolytica
VECPCSLNKDDVNPISTTD

SEQ ID NO: 2578603 - protein, 26 aa, Entamoeba histolytica
VIGFVKEWKLCFVMISVAPFMVGAAG

SEQ ID NO: 2578604 - protein, 25 aa, Entamoeba histolytica
VITGSCAPVLFLIVCIILLCIITYW

SEQ ID NO: 2578605 - protein, 24 aa, Entamoeba histolytica
VKNNKCSKCSFWYGTNEEGNECNK

SEQ ID NO: 2578606 - protein, 26 aa, Entamoeba histolytica
VLGICFPPFLVFSLVYMRKYRTSQKL

SEQ ID NO: 2578607 - protein, 25 aa, Entamoeba histolytica
VMNLEIKGDVTINGFSSVDINSQTG

SEQ ID NO: 2578608 - protein, 19 aa, Entamoeba histolytica
VNGSDPVFRKALEENGRKG

SEQ ID NO: 2578609 - protein, 17 aa, Entamoeba histolytica
VNNCIICSTELASKETV

SEQ ID NO: 2578610 - protein, 18 aa, Entamoeba histolytica
VSIFMMFKYATWIEIIFN

SEQ ID NO: 2578611 - protein, 21 aa, Entamoeba histolytica
VSQPSVMKWEPMKLMRKPRKP

SEQ ID NO: 2578612 - protein, 21 aa, Entamoeba histolytica
VVVPYAMPGVFVLLSESIFFD

SEQ ID NO: 2578613 - protein, 19 aa, Entamoeba histolytica
VYFFSKCQEKKKFTIAGSY

SEQ ID NO: 2578614 - protein, 17 aa, Entamoeba histolytica
YACEFELFIIIKCTTKI

SEQ ID NO: 2578615 - protein, 24 aa, Entamoeba histolytica
YAQSHPPELCWTTPLFKKTALYLV

SEQ ID NO: 2578616 - protein, 25 aa, Entamoeba histolytica
YAVYPFMRFELIPSLIVVYRTYFLG

SEQ ID NO: 2578617 - protein, 22 aa, Entamoeba histolytica
YCVHHKKHICIECIFKNHINCT

SEQ ID NO: 2578618 - protein, 25 aa, Entamoeba histolytica
YDVFYYLAMQPWRHFVWTTCDKNDN

SEQ ID NO: 2578619 - protein, 18 aa, Entamoeba histolytica
YGCKRCSDGYYLTTNMKC

SEQ ID NO: 2578620 - protein, 17 aa, Entamoeba histolytica
YGCRECSEGYYLINKEC

SEQ ID NO: 2578621 - protein, 19 aa, Entamoeba histolytica
YKETIPLRTFRLTQVDRFL

SEQ ID NO: 2578622 - protein, 18 aa, Entamoeba histolytica
YPMHFTFHSGDYTKYEIM

SEQ ID NO: 2578623 - protein, 19 aa, Entamoeba histolytica
YQDGIGPKFGMIFQIISMV

SEQ ID NO: 2578624 - protein, 18 aa, Entamoeba histolytica
YRDSTGLITTGRLISRPK

SEQ ID NO: 2578625 - protein, 19 aa, Entamoeba histolytica
YREGLPLVLKGVDAVINDK

SEQ ID NO: 2578626 - protein, 19 aa, Entamoeba histolytica
YSIFICFKIRHPTRQQFIP

SEQ ID NO: 2578627 - protein, 23 aa, Entamoeba histolytica
YTKHMLKKGFAVNLYDPKTCQQR

SEQ ID NO: 2578628 - protein, 20 aa, Entamoeba histolytica
YVFPCAFVLASRRISVARNG

SEQ ID NO: 2578629 - protein, 28 aa, Entamoeba histolytica
YVKNTEFPKWTIGVMVIFVIALIVIVVV

SEQ ID NO: 2578630 - protein, 18 aa, Entamoeba histolytica
YYLITKGWSFLISKEQRR

SEQ ID NO: 2578631 - protein, 23 aa, Entamoeba histolytica
YYYYRYGFEFLWETYLYHGTRTD

SEQ ID NO: 2578632 - protein, 14 aa, Entamoeba histolytica
KVKLVLKQKVLKEN

SEQ ID NO: 2578633 - protein, 25 aa, Entamoeba histolytica
AAAHGVIIGCLFFDYFKSKKALRDE

SEQ ID NO: 2578634 - protein, 17 aa, Entamoeba histolytica
AACCILGLLSSTLTVIL

SEQ ID NO: 2578635 - protein, 18 aa, Entamoeba histolytica
AACFNYFLSCIVGERSSE

SEQ ID NO: 2578636 - protein, 17 aa, Entamoeba histolytica
AACIVFLSARIVALYFY

SEQ ID NO: 2578637 - protein, 17 aa, Entamoeba histolytica
AAGRTSVIIAHRLSTIR

SEQ ID NO: 2578638 - protein, 18 aa, Entamoeba histolytica
AAIDLELINGSAISRIAD

SEQ ID NO: 2578639 - protein, 23 aa, Entamoeba histolytica
AAKNCFYCECSLQSESGWILTMY

SEQ ID NO: 2578640 - protein, 17 aa, Entamoeba histolytica
AALALGLIFQGTMDGDI

SEQ ID NO: 2578641 - protein, 21 aa, Entamoeba histolytica
AALISFCVFISFLNNTLYSSQ

SEQ ID NO: 2578642 - protein, 24 aa, Entamoeba histolytica
AALVGKIFRCMNLTDSIINYVNKT

SEQ ID NO: 2578643 - protein, 17 aa, Entamoeba histolytica
AAPLMFILVYIALGIIV

SEQ ID NO: 2578644 - protein, 20 aa, Entamoeba histolytica
AASGCKDCQPGYYKNTTGKS

SEQ ID NO: 2578645 - protein, 18 aa, Entamoeba histolytica
AATFSAHYLIEKKRINEL

SEQ ID NO: 2578646 - protein, 24 aa, Entamoeba histolytica
AATSRIASMVGIKVFVTGGLGGVH

SEQ ID NO: 2578647 - protein, 27 aa, Entamoeba histolytica
AAVVFIVLTLWWFYKAITFTGYVQPDD

SEQ ID NO: 2578648 - protein, 23 aa, Entamoeba histolytica
ACCLGYAPSCLGIYEPEKVILNR

SEQ ID NO: 2578649 - protein, 24 aa, Entamoeba histolytica
ACIHIIGLFPLFAILEKEEYSGCL

SEQ ID NO: 2578650 - protein, 20 aa, Entamoeba histolytica
ACISVPFYGFIKSMEQKNIE

SEQ ID NO: 2578651 - protein, 20 aa, Entamoeba histolytica
ACKNPMCFDILCKTKFEELI

SEQ ID NO: 2578652 - protein, 20 aa, Entamoeba histolytica
ACLLSLGANRFVDFLREIAY

SEQ ID NO: 2578653 - protein, 19 aa, Entamoeba histolytica
ACLPGTIMRVIRFSIWYEG

SEQ ID NO: 2578654 - protein, 17 aa, Entamoeba histolytica
ACLSNRYLITNLFPDVL

SEQ ID NO: 2578655 - protein, 20 aa, Entamoeba histolytica
ACPSHCMKCVSGSKCISCED

SEQ ID NO: 2578656 - protein, 17 aa, Entamoeba histolytica
ACSCVTKGLKEWGGAIL

SEQ ID NO: 2578657 - protein, 18 aa, Entamoeba histolytica
ACSCVTKGLKEWGGAILV

SEQ ID NO: 2578658 - protein, 18 aa, Entamoeba histolytica
ACSFFGIERSKICHTHSI

SEQ ID NO: 2578659 - protein, 22 aa, Entamoeba histolytica
ACSKPSLSGMWFHLYGADRSLI

SEQ ID NO: 2578660 - protein, 30 aa, Entamoeba histolytica
ACSMITKGLKEWGGAILVGFSGDPDGKDEE

SEQ ID NO: 2578661 - protein, 17 aa, Entamoeba histolytica
ACSSSYYNIDWNVLSSS

SEQ ID NO: 2578662 - protein, 18 aa, Entamoeba histolytica
ACTQCSPNAFKDENNKCQ

SEQ ID NO: 2578663 - protein, 22 aa, Entamoeba histolytica
ACVWLVMIIIEFCWAGHGEKLS

SEQ ID NO: 2578664 - protein, 23 aa, Entamoeba histolytica
ACYKMGIVGFVLWSLATIVYFIY

SEQ ID NO: 2578665 - protein, 25 aa, Entamoeba histolytica
ACYLEKKMCIAIEFAPDGSLGHVLK

SEQ ID NO: 2578666 - protein, 25 aa, Entamoeba histolytica
ADCYEGKCYRCEDSFDGILENNQCI

SEQ ID NO: 2578667 - protein, 20 aa, Entamoeba histolytica
ADDPKFKYQWQIAEYVCKGN

SEQ ID NO: 2578668 - protein, 27 aa, Entamoeba histolytica
ADFYIPLFISEALCFLFLIIFQGTFTN

SEQ ID NO: 2578669 - protein, 21 aa, Entamoeba histolytica
ADILNEFNLLILKSGSKQTAH

SEQ ID NO: 2578670 - protein, 19 aa, Entamoeba histolytica
ADKVLRPFIQRGKAIHDLI

SEQ ID NO: 2578671 - protein, 30 aa, Entamoeba histolytica
ADLKRPKKNILRWGPTLAFVSAANTFVTSC

SEQ ID NO: 2578672 - protein, 17 aa, Entamoeba histolytica
ADLPYLFVVLFAIGMTL

SEQ ID NO: 2578673 - protein, 25 aa, Entamoeba histolytica
ADMNCLYRFNLLLSSNITHLHFENY

SEQ ID NO: 2578674 - protein, 22 aa, Entamoeba histolytica
ADNELLKGISFKAEQGKTIALV

SEQ ID NO: 2578675 - protein, 24 aa, Entamoeba histolytica
ADPCCNPKAAGKCNTFQERPSIYI

SEQ ID NO: 2578676 - protein, 17 aa, Entamoeba histolytica
ADPYPDIPRFHLIEKVG

SEQ ID NO: 2578677 - protein, 19 aa, Entamoeba histolytica
ADRNVLEFIKTVSGLNQSG

SEQ ID NO: 2578678 - protein, 22 aa, Entamoeba histolytica
ADSKLKRMTFRLITDKFVQIGI

SEQ ID NO: 2578679 - protein, 19 aa, Entamoeba histolytica
ADSTIYRTEVSGLNKITFT

SEQ ID NO: 2578680 - protein, 18 aa, Entamoeba histolytica
ADTLFRWLNETVVKERKT

SEQ ID NO: 2578681 - protein, 20 aa, Entamoeba histolytica
ADWLGYKYVEMFSKDTEDHS

SEQ ID NO: 2578682 - protein, 17 aa, Entamoeba histolytica
ADYSKSRDVLIEDGVEI

SEQ ID NO: 2578683 - protein, 18 aa, Entamoeba histolytica
AEAIEFVKIWQKIDVEDA

SEQ ID NO: 2578684 - protein, 27 aa, Entamoeba histolytica
AEDLFFKSGLLFYVLVILYIIVSRTIV

SEQ ID NO: 2578685 - protein, 20 aa, Entamoeba histolytica
AEECIKFYKSCNVLLQTISM

SEQ ID NO: 2578686 - protein, 21 aa, Entamoeba histolytica
AEEGLRILVIAGRELKKEEIQ

SEQ ID NO: 2578687 - protein, 18 aa, Entamoeba histolytica
AEFDICKNPQIINGSTNI

SEQ ID NO: 2578688 - protein, 25 aa, Entamoeba histolytica
AEGMSPCRFEYIGGKVITFRSSSEF

SEQ ID NO: 2578689 - protein, 17 aa, Entamoeba histolytica
AEGYYLEQYECVGCPFN

SEQ ID NO: 2578690 - protein, 26 aa, Entamoeba histolytica
AEIFARVLSRPELFFFAFPKKPELVV

SEQ ID NO: 2578691 - protein, 18 aa, Entamoeba histolytica
AEILLKKIFENIISYEIK

SEQ ID NO: 2578692 - protein, 23 aa, Entamoeba histolytica
AEISFNIFNVIWKRFLNKNYGIT

SEQ ID NO: 2578693 - protein, 25 aa, Entamoeba histolytica
AEITLKINGLVPFHSFLDLYIIPSI

SEQ ID NO: 2578694 - protein, 21 aa, Entamoeba histolytica
AEKFAKEGFNLIIMDRLAEPL

SEQ ID NO: 2578695 - protein, 21 aa, Entamoeba histolytica
AELKKKRGVQHFDREALQYSF

SEQ ID NO: 2578696 - protein, 29 aa, Entamoeba histolytica
AELLRIDFLSILSSFPYFVEVSVPVVTPT

SEQ ID NO: 2578697 - protein, 17 aa, Entamoeba histolytica
AELVIKFSEYALEQQTQ

SEQ ID NO: 2578698 - protein, 24 aa, Entamoeba histolytica
AENARTTLGFGYPTVIKMYELFSL

SEQ ID NO: 2578699 - protein, 26 aa, Entamoeba histolytica
AERGMTLKECESAHNFISETIKKLSN

SEQ ID NO: 2578700 - protein, 21 aa, Entamoeba histolytica
AESLVIPSALLIIIFVIIVII

SEQ ID NO: 2578701 - protein, 18 aa, Entamoeba histolytica
AESVICCRVSPKQKADIA

SEQ ID NO: 2578702 - protein, 20 aa, Entamoeba histolytica
AEVCYNCQEGYVLNNAGECI

SEQ ID NO: 2578703 - protein, 26 aa, Entamoeba histolytica
AFASSRISIYILFGIILIVSLFSIFY

SEQ ID NO: 2578704 - protein, 24 aa, Entamoeba histolytica
AFCPIDRTALIFSYTRRPFSILKA

SEQ ID NO: 2578705 - protein, 26 aa, Entamoeba histolytica
AFCSFLKIILHLSLLILVFGPPYSKA

SEQ ID NO: 2578706 - protein, 26 aa, Entamoeba histolytica
AFDRKCPYSMLGSSWEVLEFVNKGKR

SEQ ID NO: 2578707 - protein, 20 aa, Entamoeba histolytica
AFEIDIPFFSARDYPEAHKE

SEQ ID NO: 2578708 - protein, 25 aa, Entamoeba histolytica
AFEYVWKCWSNFHFYFYVILAGMYV

SEQ ID NO: 2578709 - protein, 22 aa, Entamoeba histolytica
AFFLSKLFWVILGYFIIALAIL

SEQ ID NO: 2578710 - protein, 23 aa, Entamoeba histolytica
AFGCSDSLVGICCLNQPQEVPIY

SEQ ID NO: 2578711 - protein, 18 aa, Entamoeba histolytica
AFGKTWLHFLNIFMCCCG

SEQ ID NO: 2578712 - protein, 18 aa, Entamoeba histolytica
AFHDFTIALVIPNRNIIA

SEQ ID NO: 2578713 - protein, 18 aa, Entamoeba histolytica
AFICFNFLAVLVVVAHSF

SEQ ID NO: 2578714 - protein, 23 aa, Entamoeba histolytica
AFKEADVALAMGLRGTDVAKQAA

SEQ ID NO: 2578715 - protein, 25 aa, Entamoeba histolytica
AFKNYSLEVSPLFMNASCFHCSVYY

SEQ ID NO: 2578716 - protein, 27 aa, Entamoeba histolytica
AFLYDASCFFYWIVVPLLFNEQGATSV

SEQ ID NO: 2578717 - protein, 27 aa, Entamoeba histolytica
AFLYNTSCYFYWIVVPLLFNEQGASAI

SEQ ID NO: 2578718 - protein, 24 aa, Entamoeba histolytica
AFNVFPISLLMNFRSKAPKITWRL

SEQ ID NO: 2578719 - protein, 25 aa, Entamoeba histolytica
AFYFLIGFICSWTFGSDVLSPITNA

SEQ ID NO: 2578720 - protein, 20 aa, Entamoeba histolytica
AFYSDVIRLIGIITQLVHRI

SEQ ID NO: 2578721 - protein, 20 aa, Entamoeba histolytica
AGAAFPFYSLNFVDLIRVLM

SEQ ID NO: 2578722 - protein, 19 aa, Entamoeba histolytica
AGALLGIGTCCSGVKSDVD

SEQ ID NO: 2578723 - protein, 19 aa, Entamoeba histolytica
AGAVFPFYMIQFIGLLMTL

SEQ ID NO: 2578724 - protein, 18 aa, Entamoeba histolytica
AGGALVFIALTIYYIVSQ

SEQ ID NO: 2578725 - protein, 19 aa, Entamoeba histolytica
AGGFIGLILCLIPFVVRCA

SEQ ID NO: 2578726 - protein, 18 aa, Entamoeba histolytica
AGGVQTIIMKCFDCFDNI

SEQ ID NO: 2578727 - protein, 18 aa, Entamoeba histolytica
AGHLRSTIIGNFIANIHK

SEQ ID NO: 2578728 - protein, 19 aa, Entamoeba histolytica
AGIIPLPFFGTTIKTENEN

SEQ ID NO: 2578729 - protein, 22 aa, Entamoeba histolytica
AGIVCGCCAVLFIIILIIIIFI

SEQ ID NO: 2578730 - protein, 20 aa, Entamoeba histolytica
AGKCLCILLTCSANQISFVK

SEQ ID NO: 2578731 - protein, 17 aa, Entamoeba histolytica
AGPKIKGVILGMSECVG

SEQ ID NO: 2578732 - protein, 17 aa, Entamoeba histolytica
AGPTWLMILLSSPSILF

SEQ ID NO: 2578733 - protein, 23 aa, Entamoeba histolytica
AGSISWLIALSIISLVWLVLPFS

SEQ ID NO: 2578734 - protein, 27 aa, Entamoeba histolytica
AGTFGIVYRAKWRKIEIAVKVLKTDMV

SEQ ID NO: 2578735 - protein, 25 aa, Entamoeba histolytica
AGTGCAICKDGFYRKDVDCQECIKN

SEQ ID NO: 2578736 - protein, 23 aa, Entamoeba histolytica
AGTKFIVSDAMGYVAVYRFTVNE

SEQ ID NO: 2578737 - protein, 25 aa, Entamoeba histolytica
AGYFYCSFCTSLLKKRKCESDLNDK

SEQ ID NO: 2578738 - protein, 22 aa, Entamoeba histolytica
AHCIPRSIAPNMITLIGGLFMV

SEQ ID NO: 2578739 - protein, 19 aa, Entamoeba histolytica
AHDGRPTYDIYTLSNNGLL

SEQ ID NO: 2578740 - protein, 17 aa, Entamoeba histolytica
AHECGKCKSGYYFSVEQ

SEQ ID NO: 2578741 - protein, 18 aa, Entamoeba histolytica
AHEYEFINDLVLKNRMKD

SEQ ID NO: 2578742 - protein, 24 aa, Entamoeba histolytica
AHFLRFAPCALVMLFFQLPNFQEL

SEQ ID NO: 2578743 - protein, 25 aa, Entamoeba histolytica
AHGGYKCGVDGKWSDECVATYCDNG

SEQ ID NO: 2578744 - protein, 23 aa, Entamoeba histolytica
AHIRMEFKTGKKLKGHGRRKYIL

SEQ ID NO: 2578745 - protein, 21 aa, Entamoeba histolytica
AHSFGCLKCGDYIPNNGECPK

SEQ ID NO: 2578746 - protein, 18 aa, Entamoeba histolytica
AICIDSCNRESKLGICST

SEQ ID NO: 2578747 - protein, 19 aa, Entamoeba histolytica
AICMLEVYLRKSPYPRESF

SEQ ID NO: 2578748 - protein, 20 aa, Entamoeba histolytica
AIDIFFKVIQTWPGLLTLTS

SEQ ID NO: 2578749 - protein, 23 aa, Entamoeba histolytica
AIDSCKNAGISVRMVTGDHVKTA

SEQ ID NO: 2578750 - protein, 18 aa, Entamoeba histolytica
AIEMKGLMIKQSDKQLSQ

SEQ ID NO: 2578751 - protein, 18 aa, Entamoeba histolytica
AIESTYFVNGCDYGTTTG

SEQ ID NO: 2578752 - protein, 19 aa, Entamoeba histolytica
AIFIPFVFSPFLLLYSILS

SEQ ID NO: 2578753 - protein, 19 aa, Entamoeba histolytica
AIFNCIKLPFQSFGYLIAC

SEQ ID NO: 2578754 - protein, 28 aa, Entamoeba histolytica
AIFPFFTLKIVDLIMCLLSINSDTLTDD

SEQ ID NO: 2578755 - protein, 22 aa, Entamoeba histolytica
AIFSPLCIFVAYLINIKSQIQP

SEQ ID NO: 2578756 - protein, 18 aa, Entamoeba histolytica
AIGSPQLHFTWMCELSHK

SEQ ID NO: 2578757 - protein, 17 aa, Entamoeba histolytica
AIIDILGLCIIAASTFI

SEQ ID NO: 2578758 - protein, 17 aa, Entamoeba histolytica
AIIEPSGIILKESYLRE

SEQ ID NO: 2578759 - protein, 24 aa, Entamoeba histolytica
AIIFPSMYFLMGITILLSIILWIF

SEQ ID NO: 2578760 - protein, 24 aa, Entamoeba histolytica
AIKTPCKKSRWILYDKELEACWKK

SEQ ID NO: 2578761 - protein, 32 aa, Entamoeba histolytica
AILFALGFLCCCVWCYGWCQYRHSTNSQARMF

SEQ ID NO: 2578762 - protein, 18 aa, Entamoeba histolytica
AILFSLKTLFLIINTFAF

SEQ ID NO: 2578763 - protein, 19 aa, Entamoeba histolytica
AILTLRFHLFVGAMKSTST

SEQ ID NO: 2578764 - protein, 23 aa, Entamoeba histolytica
AINCMSCTMGLYYHHTYLSKGYN

SEQ ID NO: 2578765 - protein, 26 aa, Entamoeba histolytica
AINPICRNHIYASFSVDCAKYTEYFN

SEQ ID NO: 2578766 - protein, 22 aa, Entamoeba histolytica
AIQCGICYEVVGPKGVIRLRIV

SEQ ID NO: 2578767 - protein, 26 aa, Entamoeba histolytica
AIQFGKLYGEIILKGILKNCALIHLL

SEQ ID NO: 2578768 - protein, 17 aa, Entamoeba histolytica
AIRDCGLKTPGIIEGLN

SEQ ID NO: 2578769 - protein, 22 aa, Entamoeba histolytica
AISCPFQYNPSLVIIGEDLLRK

SEQ ID NO: 2578770 - protein, 24 aa, Entamoeba histolytica
AISMLRCFYTLYVNCDIGENNKKP

SEQ ID NO: 2578771 - protein, 21 aa, Entamoeba histolytica
AITFTCCFNILVGNFIKNLFG

SEQ ID NO: 2578772 - protein, 20 aa, Entamoeba histolytica
AITLIISLVVPHIFVFSTFV

SEQ ID NO: 2578773 - protein, 20 aa, Entamoeba histolytica
AITLKARISTPIDLFNLLEV

SEQ ID NO: 2578774 - protein, 26 aa, Entamoeba histolytica
AITMIKRLVPLFQMIGCSVCSLYSGM

SEQ ID NO: 2578775 - protein, 18 aa, Entamoeba histolytica
AITMYQTWSWKNPYDKDE

SEQ ID NO: 2578776 - protein, 17 aa, Entamoeba histolytica
AITWMVPHQFAIEKNET

SEQ ID NO: 2578777 - protein, 20 aa, Entamoeba histolytica
AIVAIWPSSKIAIYFSAAFW

SEQ ID NO: 2578778 - protein, 19 aa, Entamoeba histolytica
AIVALSAWPNAAFDLCGMC

SEQ ID NO: 2578779 - protein, 19 aa, Entamoeba histolytica
AIVLLAFIIYRKCTSKNDY

SEQ ID NO: 2578780 - protein, 27 aa, Entamoeba histolytica
AIVRSCWKLNVFEGYEGIVSLQVLKKL

SEQ ID NO: 2578781 - protein, 24 aa, Entamoeba histolytica
AIYMLQKAFHCFDHKDEPMKSSLE

SEQ ID NO: 2578782 - protein, 19 aa, Entamoeba histolytica
AKAAMIWIIGEYSDRITNV

SEQ ID NO: 2578783 - protein, 25 aa, Entamoeba histolytica
AKALARSLLDLGLKKGDVVGFFSKR

SEQ ID NO: 2578784 - protein, 22 aa, Entamoeba histolytica
AKCIKYGNKYMKVYTQSVKPST

SEQ ID NO: 2578785 - protein, 17 aa, Entamoeba histolytica
AKCSFEMKDSIENNIYN

SEQ ID NO: 2578786 - protein, 23 aa, Entamoeba histolytica
AKDISKAVPCYKIVGEPFLESVN

SEQ ID NO: 2578787 - protein, 20 aa, Entamoeba histolytica
AKEGNAFFSGLFGKRDLVLF

SEQ ID NO: 2578788 - protein, 17 aa, Entamoeba histolytica
AKFYLHVFICLLAPLAP

SEQ ID NO: 2578789 - protein, 18 aa, Entamoeba histolytica
AKGKCFLVNISESNQYNL

SEQ ID NO: 2578790 - protein, 17 aa, Entamoeba histolytica
AKKECPATCVGSYECRD

SEQ ID NO: 2578791 - protein, 19 aa, Entamoeba histolytica
AKKSLPFLTVVSLQRGNTF

SEQ ID NO: 2578792 - protein, 17 aa, Entamoeba histolytica
AKLKFDKEGIPIKKEVT

SEQ ID NO: 2578793 - protein, 17 aa, Entamoeba histolytica
AKLLFDFISGINKGILG

SEQ ID NO: 2578794 - protein, 19 aa, Entamoeba histolytica
AKLPLSIQYVRLELNKVLV

SEQ ID NO: 2578795 - protein, 17 aa, Entamoeba histolytica
AKMANAHEFISHLPEGY

SEQ ID NO: 2578796 - protein, 19 aa, Entamoeba histolytica
AKMGDEFKKILKEANESPL

SEQ ID NO: 2578797 - protein, 18 aa, Entamoeba histolytica
AKMSLTYRDEKVNNAFNL

SEQ ID NO: 2578798 - protein, 17 aa, Entamoeba histolytica
AKNVMALMCKKPTPFTI

SEQ ID NO: 2578799 - protein, 17 aa, Entamoeba histolytica
AKNVPVVRCAPLKEPWT

SEQ ID NO: 2578800 - protein, 21 aa, Entamoeba histolytica
AKPHIKVVLVSSVINVLITTI

SEQ ID NO: 2578801 - protein, 18 aa, Entamoeba histolytica
AKQFPRCLSIVDKVSATK

SEQ ID NO: 2578802 - protein, 23 aa, Entamoeba histolytica
AKQSSKLMCIILIVVAIIMVIVV

SEQ ID NO: 2578803 - protein, 25 aa, Entamoeba histolytica
AKQYPSIFGGMKFFEIFPFILPNLV

SEQ ID NO: 2578804 - protein, 26 aa, Entamoeba histolytica
AKRNPRLFCGIFEEFLGNGIEEESNW

SEQ ID NO: 2578805 - protein, 20 aa, Entamoeba histolytica
AKSARCAMFNKMMNVAEEIG

SEQ ID NO: 2578806 - protein, 28 aa, Entamoeba histolytica
AKSLKDCEPFSELLRMVYYLFCQIKDSS

SEQ ID NO: 2578807 - protein, 19 aa, Entamoeba histolytica
AKSNIIIMHGFRGYSGPLT

SEQ ID NO: 2578808 - protein, 18 aa, Entamoeba histolytica
AKSVGVIKKEEFMKEHET

SEQ ID NO: 2578809 - protein, 25 aa, Entamoeba histolytica
AKTFKPSIVSFKFTYGKNETDPFIV

SEQ ID NO: 2578810 - protein, 18 aa, Entamoeba histolytica
AKYGSLFHLIFKQGMKKL

SEQ ID NO: 2578811 - protein, 17 aa, Entamoeba histolytica
AKYGWEIIRVVVREFKT

SEQ ID NO: 2578812 - protein, 18 aa, Entamoeba histolytica
AKYGWEIIRVVVREFKTS

SEQ ID NO: 2578813 - protein, 20 aa, Entamoeba histolytica
ALCQKCKEGYILINNACYIS

SEQ ID NO: 2578814 - protein, 18 aa, Entamoeba histolytica
ALCSMGVCTQCEDDYAIK

SEQ ID NO: 2578815 - protein, 19 aa, Entamoeba histolytica
ALFAMAICHNVTPTKSGDG

SEQ ID NO: 2578816 - protein, 28 aa, Entamoeba histolytica
ALFLTDLLRIYRRCVILEAIDRYLSIVA

SEQ ID NO: 2578817 - protein, 18 aa, Entamoeba histolytica
ALFYFPIKTKIIALTVDD

SEQ ID NO: 2578818 - protein, 25 aa, Entamoeba histolytica
ALHLPKHLPIILGFIPYDFKNKEHQ

SEQ ID NO: 2578819 - protein, 19 aa, Entamoeba histolytica
ALILIQLLTGYVILKTNVG

SEQ ID NO: 2578820 - protein, 21 aa, Entamoeba histolytica
ALKAADVGLAMGIRGTDVAKQ

SEQ ID NO: 2578821 - protein, 22 aa, Entamoeba histolytica
ALKAADVGLAMGIRGTDVAKQA

SEQ ID NO: 2578822 - protein, 21 aa, Entamoeba histolytica
ALKIDCLHPSISTTSISVSSS

SEQ ID NO: 2578823 - protein, 24 aa, Entamoeba histolytica
ALKNAHIGLAMGIRGTDVAKQASD

SEQ ID NO: 2578824 - protein, 19 aa, Entamoeba histolytica
ALKPIIVMFVGFYHKKYVK

SEQ ID NO: 2578825 - protein, 20 aa, Entamoeba histolytica
ALLCGVPWAFFLHKFGPKRA

SEQ ID NO: 2578826 - protein, 17 aa, Entamoeba histolytica
ALLLLTLFMLVFTELMY

SEQ ID NO: 2578827 - protein, 18 aa, Entamoeba histolytica
ALLLTYIDFIIAAKERLL

SEQ ID NO: 2578828 - protein, 24 aa, Entamoeba histolytica
ALLPLCVIVYFLPVKVVNGYIPQI

SEQ ID NO: 2578829 - protein, 24 aa, Entamoeba histolytica
ALLRARSEVFFAIPPFGHLINKYA

SEQ ID NO: 2578830 - protein, 17 aa, Entamoeba histolytica
ALLSPRFTDHKSMFSPI

SEQ ID NO: 2578831 - protein, 27 aa, Entamoeba histolytica
ALLTAFVIGVLNWVGCTIIIHKRKRTA

SEQ ID NO: 2578832 - protein, 19 aa, Entamoeba histolytica
ALMIYQFLSELGFVNAQLN

SEQ ID NO: 2578833 - protein, 24 aa, Entamoeba histolytica
ALMSQMMICYAICDVIPMYLPVKQ

SEQ ID NO: 2578834 - protein, 26 aa, Entamoeba histolytica
ALNGNFPFIWGFFMLCSLSYWVSFQM

SEQ ID NO: 2578835 - protein, 24 aa, Entamoeba histolytica
ALNPEIREKLPLTQIASIHEDLLN

SEQ ID NO: 2578836 - protein, 18 aa, Entamoeba histolytica
ALQLKWANLTYLRDGKPQ

SEQ ID NO: 2578837 - protein, 17 aa, Entamoeba histolytica
ALQQFGEIVYNFVQLLD

SEQ ID NO: 2578838 - protein, 21 aa, Entamoeba histolytica
ALVDLIGYLLVERKFLFVSQS

SEQ ID NO: 2578839 - protein, 28 aa, Entamoeba histolytica
ALVEELKIHIGFRFKFLRNKDTLNINLD

SEQ ID NO: 2578840 - protein, 18 aa, Entamoeba histolytica
ALVLFKAIYFWISAPLGI

SEQ ID NO: 2578841 - protein, 24 aa, Entamoeba histolytica
ALYQARPKKGLKILGDVKSIVLIC

SEQ ID NO: 2578842 - protein, 21 aa, Entamoeba histolytica
ALYVGLICWVICVIVILVMSC

SEQ ID NO: 2578843 - protein, 17 aa, Entamoeba histolytica
ALYYCFELGYHLHSLMF

SEQ ID NO: 2578844 - protein, 17 aa, Entamoeba histolytica
AMACSKTNWALIIPLVI

SEQ ID NO: 2578845 - protein, 19 aa, Entamoeba histolytica
AMGVCGLVISLAISTRLIY

SEQ ID NO: 2578846 - protein, 24 aa, Entamoeba histolytica
AMGWSCVLYGPLVFYFCPLSLVFY

SEQ ID NO: 2578847 - protein, 23 aa, Entamoeba histolytica
AMKKLYPLFLWILSGLFPQFANI

SEQ ID NO: 2578848 - protein, 19 aa, Entamoeba histolytica
AMMVPKPILLYVLKKKDQK

SEQ ID NO: 2578849 - protein, 33 aa, Entamoeba histolytica; identical to SEQ ID NO: 2380120

SEQ ID NO: 2578850 - protein, 22 aa, Entamoeba histolytica
AMWGIAQVCWFIANSNLPYVVS

SEQ ID NO: 2578851 - protein, 19 aa, Entamoeba histolytica
ANASTLWFSIIIIVVVILL

SEQ ID NO: 2578852 - protein, 24 aa, Entamoeba histolytica
ANDVPFDYVEFLFMPAREYMDLLQ

SEQ ID NO: 2578853 - protein, 25 aa, Entamoeba histolytica
ANELLKRILKIVALYPKSNQVLINS

SEQ ID NO: 2578854 - protein, 18 aa, Entamoeba histolytica
ANGGMAKDEECLRGSEGC

SEQ ID NO: 2578855 - protein, 17 aa, Entamoeba histolytica
ANHEVNSLISLILMYQY

SEQ ID NO: 2578856 - protein, 22 aa, Entamoeba histolytica
ANICDYVRIGVLMIAVFFVLKA

SEQ ID NO: 2578857 - protein, 19 aa, Entamoeba histolytica
ANIGIWGWFDHCHITYIFS

SEQ ID NO: 2578858 - protein, 24 aa, Entamoeba histolytica
ANIKKYLDGIGWKEIEIHEKKKDD

SEQ ID NO: 2578859 - protein, 20 aa, Entamoeba histolytica
ANIRIEKSCVYYLNAKSDSY

SEQ ID NO: 2578860 - protein, 23 aa, Entamoeba histolytica
ANKKMKISLCDSSYEGSVSIQVI

SEQ ID NO: 2578861 - protein, 19 aa, Entamoeba histolytica
ANKLKNVGIAFLILFIGTF

SEQ ID NO: 2578862 - protein, 17 aa, Entamoeba histolytica
ANLTILITSFVFVVMST

SEQ ID NO: 2578863 - protein, 24 aa, Entamoeba histolytica
ANLYLKGINKWLLYDSEFQLPMGF

SEQ ID NO: 2578864 - protein, 17 aa, Entamoeba histolytica
ANNLYLRGMAFTVSVPE

SEQ ID NO: 2578865 - protein, 18 aa, Entamoeba histolytica
ANQTGLWYFIEKSGFKVK

SEQ ID NO: 2578866 - protein, 28 aa, Entamoeba histolytica
ANSGRSEIDWVILICRALMTVVVCIAYP

SEQ ID NO: 2578867 - protein, 17 aa, Entamoeba histolytica
ANSIEMDNIFPGADIVN

SEQ ID NO: 2578868 - protein, 24 aa, Entamoeba histolytica
ANSSLEHFVGFIGYNERSEARHNM

SEQ ID NO: 2578869 - protein, 18 aa, Entamoeba histolytica
ANTKRYFGLMSEEQRANL

SEQ ID NO: 2578870 - protein, 17 aa, Entamoeba histolytica
ANVPYKIVFAMEEAEDL

SEQ ID NO: 2578871 - protein, 24 aa, Entamoeba histolytica
ANVVLARFIVRQMRKLMIIKDTRV

SEQ ID NO: 2578872 - protein, 28 aa, Entamoeba histolytica
ANWKKRKIRYCPPELLNELDLDETTDVY

SEQ ID NO: 2578873 - protein, 20 aa, Entamoeba histolytica
ANYFLNCLCQGMINRKSVIS

SEQ ID NO: 2578874 - protein, 23 aa, Entamoeba histolytica
APAICLLSGIALAEFFTQIQKQL

SEQ ID NO: 2578875 - protein, 22 aa, Entamoeba histolytica
APATCKTLWIGQEHGVLSKQGT

SEQ ID NO: 2578876 - protein, 19 aa, Entamoeba histolytica
APEYVPIVYTPRVGPKRIK

SEQ ID NO: 2578877 - protein, 18 aa, Entamoeba histolytica
APFGRKTFDGCCSFIFFS

SEQ ID NO: 2578878 - protein, 17 aa, Entamoeba histolytica
APFNILVYLFFKKAYGL

SEQ ID NO: 2578879 - protein, 18 aa, Entamoeba histolytica
APFTAIINGLVLGWVHAF

SEQ ID NO: 2578880 - protein, 21 aa, Entamoeba histolytica
APGRLMKVMFFETEFKGDFSL

SEQ ID NO: 2578881 - protein, 24 aa, Entamoeba histolytica
APIFKLDCLNSWPINSPTGYPLRF

SEQ ID NO: 2578882 - protein, 27 aa, Entamoeba histolytica
APLIIIVYFFFCYKTIPHFHSLFHITE

SEQ ID NO: 2578883 - protein, 17 aa, Entamoeba histolytica
APPAIAFLTTWQQGGPK

SEQ ID NO: 2578884 - protein, 28 aa, Entamoeba histolytica
APRSKYRPKPIYYRKYKRVVKQVKPVQY

SEQ ID NO: 2578885 - protein, 23 aa, Entamoeba histolytica
APSESVPQALKDNSATVSHGGST

SEQ ID NO: 2578886 - protein, 18 aa, Entamoeba histolytica
APSFKIAAIMLIALFCYD

SEQ ID NO: 2578887 - protein, 18 aa, Entamoeba histolytica
AQAVVCCRCLPSQKADIV

SEQ ID NO: 2578888 - protein, 18 aa, Entamoeba histolytica
AQDETGCFCIDQMTDGCN

SEQ ID NO: 2578889 - protein, 21 aa, Entamoeba histolytica
AQDGICIPVLCGNGQIDQGEE

SEQ ID NO: 2578890 - protein, 18 aa, Entamoeba histolytica
AQDPLNWDTCYGNCYENN

SEQ ID NO: 2578891 - protein, 26 aa, Entamoeba histolytica
AQFVFSLPIDVCFGIASNNDGYMIVT

SEQ ID NO: 2578892 - protein, 20 aa, Entamoeba histolytica
AQIDRSVKVPFALKSLAIIV

SEQ ID NO: 2578893 - protein, 18 aa, Entamoeba histolytica
AQILGLKSSITLTAPLSI

SEQ ID NO: 2578894 - protein, 23 aa, Entamoeba histolytica
AQLSSGFSRFDFQQNIGNYPNAI

SEQ ID NO: 2578895 - protein, 20 aa, Entamoeba histolytica
AQMYKCGMCVPQQPNGDKYV

SEQ ID NO: 2578896 - protein, 21 aa, Entamoeba histolytica
AQNCFMCSNGFALKDPTDPLS

SEQ ID NO: 2578897 - protein, 40 aa, Entamoeba histolytica
AQRKRINTLFKYPHLKSHWSLSQFFLWIIVFLLLHISFTI

SEQ ID NO: 2578898 - protein, 20 aa, Entamoeba histolytica
AQRLCLPRRVVRPLISDLVR

SEQ ID NO: 2578899 - protein, 18 aa, Entamoeba histolytica
AQTDLPFLESTIIPFNKT

SEQ ID NO: 2578900 - protein, 18 aa, Entamoeba histolytica
AQTTRLISTYVHINPEFQ

SEQ ID NO: 2578901 - protein, 19 aa, Entamoeba histolytica
AQVMKKRVDEMIADGKTPR

SEQ ID NO: 2578902 - protein, 18 aa, Entamoeba histolytica
AQVRCTIIMCSLGKVLEP

SEQ ID NO: 2578903 - protein, 19 aa, Entamoeba histolytica
AQYYYDWEENIKLNIKQRY

SEQ ID NO: 2578904 - protein, 20 aa, Entamoeba histolytica
ARELQREGARYGPFTDGGIV

SEQ ID NO: 2578905 - protein, 17 aa, Entamoeba histolytica
AREYCLSTKCGNGKLEE

SEQ ID NO: 2578906 - protein, 20 aa, Entamoeba histolytica
ARFGCIPATCGNKKWDEGEE

SEQ ID NO: 2578907 - protein, 18 aa, Entamoeba histolytica
ARGLKKKDIRLFARAVIP

SEQ ID NO: 2578908 - protein, 18 aa, Entamoeba histolytica
ARHNMPIYYNRSNPTKLY

SEQ ID NO: 2578909 - protein, 17 aa, Entamoeba histolytica
ARIKLNELIQVITSPDI

SEQ ID NO: 2578910 - protein, 18 aa, Entamoeba histolytica
ARINDMFEKNVIFPPPEV

SEQ ID NO: 2578911 - protein, 23 aa, Entamoeba histolytica
ARIPEWIPCHVFITSHKDGSIKV

SEQ ID NO: 2578912 - protein, 20 aa, Entamoeba histolytica
ARISISYSFIPFVIYTFSDS

SEQ ID NO: 2578913 - protein, 26 aa, Entamoeba histolytica
ARKEREFKNQLAFQHCLLIGVLNQFA

SEQ ID NO: 2578914 - protein, 19 aa, Entamoeba histolytica
ARLQGAAATGEFWIDDISL

SEQ ID NO: 2578915 - protein, 17 aa, Entamoeba histolytica
ARLSYTSGNAVFFNNLL

SEQ ID NO: 2578916 - protein, 17 aa, Entamoeba histolytica
ARMKEIYEGISYDDEMN

SEQ ID NO: 2578917 - protein, 18 aa, Entamoeba histolytica
ARMKEIYEGISYDDEMNE

SEQ ID NO: 2578918 - protein, 18 aa, Entamoeba histolytica
ARNGCMLSTCGNRKWDEG

SEQ ID NO: 2578919 - protein, 24 aa, Entamoeba histolytica
ARPECFKRAPIDKFFDLEFTSLPH

SEQ ID NO: 2578920 - protein, 18 aa, Entamoeba histolytica
ARPITVLVLYSLAIFIVP

SEQ ID NO: 2578921 - protein, 21 aa, Entamoeba histolytica
ARQFCSTINFYVHAANKNLFP

SEQ ID NO: 2578922 - protein, 26 aa, Entamoeba histolytica
ARRNNFRAIVFIKRGLSGIEVTTGKL

SEQ ID NO: 2578923 - protein, 20 aa, Entamoeba histolytica
ARSLTRAFLPLGKFGILSAL

SEQ ID NO: 2578924 - protein, 23 aa, Entamoeba histolytica
ASEGLRTLFIARRIFTPEEILQW

SEQ ID NO: 2578925 - protein, 41 aa, Entamoeba histolytica; identical to SEQ ID NO: 2475430

SEQ ID NO: 2578926 - protein, 21 aa, Entamoeba histolytica
ASENRALFCIGNISNSTKKIQ

SEQ ID NO: 2578927 - protein, 19 aa, Entamoeba histolytica
ASEPFVIDFIKGIIESCKY

SEQ ID NO: 2578928 - protein, 28 aa, Entamoeba histolytica
ASEQLIKICAWCIEVNETIHFPVECVSE

SEQ ID NO: 2578929 - protein, 24 aa, Entamoeba histolytica
ASFDRRFINEIKRCEEIERIIRIF

SEQ ID NO: 2578930 - protein, 22 aa, Entamoeba histolytica
ASGCAICKDGFYQTYKNCAECH

SEQ ID NO: 2578931 - protein, 23 aa, Entamoeba histolytica
ASGEENAKCVLYGDGKTIKVYSS

SEQ ID NO: 2578932 - protein, 25 aa, Entamoeba histolytica
ASGLFASSVIGCWQFEHNTQNLVNT

SEQ ID NO: 2578933 - protein, 27 aa, Entamoeba histolytica
ASGRYKGDFPINIAFQNQRSCGILLET

SEQ ID NO: 2578934 - protein, 22 aa, Entamoeba histolytica
ASGWSRKSKFSFEQKKTLLFFI

SEQ ID NO: 2578935 - protein, 23 aa, Entamoeba histolytica
ASIFAHKLIWFFIISILTMLFLY

SEQ ID NO: 2578936 - protein, 22 aa, Entamoeba histolytica
ASIPERNFIKFLQSIIKQQDPT

SEQ ID NO: 2578937 - protein, 19 aa, Entamoeba histolytica
ASIRELSCDDALNNDLNKF

SEQ ID NO: 2578938 - protein, 17 aa, Entamoeba histolytica
ASIYLTIHINIFLVRSV

SEQ ID NO: 2578939 - protein, 21 aa, Entamoeba histolytica
ASKGRTTIVIAHRLSTIQNAD

SEQ ID NO: 2578940 - protein, 32 aa, Entamoeba histolytica; identical to SEQ ID NO: 2380215

SEQ ID NO: 2578941 - protein, 28 aa, Entamoeba histolytica
ASLQGAVCIAVLTCSFFFVFMAVSGHVS

SEQ ID NO: 2578942 - protein, 19 aa, Entamoeba histolytica
ASLSLKRRTFFIGTKNHLY

SEQ ID NO: 2578943 - protein, 23 aa, Entamoeba histolytica
ASLVAGLVYFVWSFASYKPVYLL

SEQ ID NO: 2578944 - protein, 17 aa, Entamoeba histolytica
ASMFLDNRITIVIRAII

SEQ ID NO: 2578945 - protein, 23 aa, Entamoeba histolytica
ASMILLVIIYRGWALASPAIPPL

SEQ ID NO: 2578946 - protein, 18 aa, Entamoeba histolytica
ASNFPAYFAQNFATLLYY

SEQ ID NO: 2578947 - protein, 19 aa, Entamoeba histolytica
ASQLQFFTQFIIKGDDHST

SEQ ID NO: 2578948 - protein, 26 aa, Entamoeba histolytica
ASRFIWDIFCLFAILIHLSCMRSRGY

SEQ ID NO: 2578949 - protein, 24 aa, Entamoeba histolytica
ASSDALCCAVTFFYFHHLFNLWGN

SEQ ID NO: 2578950 - protein, 18 aa, Entamoeba histolytica
ASSIIPFISLHWRPSLYK

SEQ ID NO: 2578951 - protein, 26 aa, Entamoeba histolytica
ASSPLRCRADAFSLEALLLLKDVPGL

SEQ ID NO: 2578952 - protein, 27 aa, Entamoeba histolytica
ASSRDLLKHKWFITNGIKIEESKKPTF

SEQ ID NO: 2578953 - protein, 23 aa, Entamoeba histolytica
ASSSNARFGRTFSIPINVIVSVG

SEQ ID NO: 2578954 - protein, 23 aa, Entamoeba histolytica
ASSVLFPLLQIIALFAKSNLISL

SEQ ID NO: 2578955 - protein, 24 aa, Entamoeba histolytica
ASTCYPETVIAPRIIVGTKCENDV

SEQ ID NO: 2578956 - protein, 17 aa, Entamoeba histolytica
ASTDLKRTMWWKNMKLW

SEQ ID NO: 2578957 - protein, 23 aa, Entamoeba histolytica
ASTECTFKFLKLVLQKSQRPFLD

SEQ ID NO: 2578958 - protein, 25 aa, Entamoeba histolytica
ASTSLRLILMNSLLFIFKFTLTFVT

SEQ ID NO: 2578959 - protein, 24 aa, Entamoeba histolytica
ASVSCPIRLCDRAYFATVSSTQKI

SEQ ID NO: 2578960 - protein, 24 aa, Entamoeba histolytica
ASVYKRTTKIFGFNRVQSPSKVTI

SEQ ID NO: 2578961 - protein, 23 aa, Entamoeba histolytica
ASYKNGILCFGFIVILVLTVFIR

SEQ ID NO: 2578962 - protein, 22 aa, Entamoeba histolytica
ATCSGDKCATCEDGYKLDAGSM

SEQ ID NO: 2578963 - protein, 17 aa, Entamoeba histolytica
ATEQSYWSPLTWICGSI

SEQ ID NO: 2578964 - protein, 22 aa, Entamoeba histolytica
ATESLQWFYGINYLVHRIFFTF

SEQ ID NO: 2578965 - protein, 21 aa, Entamoeba histolytica
ATFGYGRRRPIMILGLGIWFV

SEQ ID NO: 2578966 - protein, 25 aa, Entamoeba histolytica
ATFICILVIRECFPTFVHLFALPFV

SEQ ID NO: 2578967 - protein, 26 aa, Entamoeba histolytica
ATFMKRFPFNFLAHFSFILYLILFVL

SEQ ID NO: 2578968 - protein, 21 aa, Entamoeba histolytica
ATFRCCGYDSISPSNCACKNP

SEQ ID NO: 2578969 - protein, 17 aa, Entamoeba histolytica
ATITALFKGIRANLTER

SEQ ID NO: 2578970 - protein, 21 aa, Entamoeba histolytica
ATKLRCYMAYFSTIGIAIINK

SEQ ID NO: 2578971 - protein, 21 aa, Entamoeba histolytica
ATLFLPMSFIAALFGMNVTVP

SEQ ID NO: 2578972 - protein, 23 aa, Entamoeba histolytica
ATLGSIILCCFIYIGIALVTSWC

SEQ ID NO: 2578973 - protein, 22 aa, Entamoeba histolytica
ATLKPGTAIPVTFKIKILCTCT

SEQ ID NO: 2578974 - protein, 24 aa, Entamoeba histolytica
ATNLRTTILFLIGCFVIMAMGCFQ

SEQ ID NO: 2578975 - protein, 19 aa, Entamoeba histolytica
ATPFIKYVFGILSQMHCKV

SEQ ID NO: 2578976 - protein, 24 aa, Entamoeba histolytica
ATPLNLAGGFLFGFSKGSLINIIG

SEQ ID NO: 2578977 - protein, 32 aa, Entamoeba histolytica
ATPRWIGSAKFFSGDCSFGFEENDNDWIYYGN

SEQ ID NO: 2578978 - protein, 23 aa, Entamoeba histolytica
ATRFPIKLEFDREFINGYDNGKF

SEQ ID NO: 2578979 - protein, 24 aa, Entamoeba histolytica
ATRTMKIRPSLVYIPTRLPTTVIG

SEQ ID NO: 2578980 - protein, 17 aa, Entamoeba histolytica
ATSYDVYHLPEIATNIK

SEQ ID NO: 2578981 - protein, 19 aa, Entamoeba histolytica
ATTCHWKVLTDYFPTPTSE

SEQ ID NO: 2578982 - protein, 25 aa, Entamoeba histolytica
ATTVKRWNGLIIFGFFVSVGSFFFT

SEQ ID NO: 2578983 - protein, 20 aa, Entamoeba histolytica
ATTYYGCFLIFIALLISFLT

SEQ ID NO: 2578984 - protein, 24 aa, Entamoeba histolytica
ATVRRGYSTLVFQYFVPAIIFTQT

SEQ ID NO: 2578985 - protein, 17 aa, Entamoeba histolytica
ATYPIMKMFSLSVLAGM

SEQ ID NO: 2578986 - protein, 23 aa, Entamoeba histolytica
AVAVALCVWFIDGDWKYYLDPSL

SEQ ID NO: 2578987 - protein, 25 aa, Entamoeba histolytica
AVCAIESRLLITVPRYLKEVEEMYL

SEQ ID NO: 2578988 - protein, 27 aa, Entamoeba histolytica
AVCKCCCLSISIFPCSIIFASIAVIVV

SEQ ID NO: 2578989 - protein, 18 aa, Entamoeba histolytica
AVCLLIAIIILKFPNNST

SEQ ID NO: 2578990 - protein, 22 aa, Entamoeba histolytica
AVCNACTIGKVIERAKKRKRRE

SEQ ID NO: 2578991 - protein, 19 aa, Entamoeba histolytica
AVCNGHTSFDLSLKDWPFT

SEQ ID NO: 2578992 - protein, 21 aa, Entamoeba histolytica
AVDTEGTFRLNVYTLNPPSHS

SEQ ID NO: 2578993 - protein, 20 aa, Entamoeba histolytica
AVEIKKAPKHIGFKGEGDDD

SEQ ID NO: 2578994 - protein, 17 aa, Entamoeba histolytica
AVFAVSLIGAWNDYSKQ

SEQ ID NO: 2578995 - protein, 25 aa, Entamoeba histolytica
AVFRPEAILENSICFEGKKVVVGYT

SEQ ID NO: 2578996 - protein, 23 aa, Entamoeba histolytica
AVFYKMRPVWDIVFLSFNVEHHP

SEQ ID NO: 2578997 - protein, 20 aa, Entamoeba histolytica
AVGLNLLVDCIWRFLETPFK

SEQ ID NO: 2578998 - protein, 19 aa, Entamoeba histolytica
AVHDFELSEQWFAHQMCCF

SEQ ID NO: 2578999 - protein, 23 aa, Entamoeba histolytica
AVIPVWIIFFILLFGYYTLKVVV

SEQ ID NO: 2579000 - protein, 26 aa, Entamoeba histolytica
AVIYHEMVRLLGIIAVRQPSLSHNVS

SEQ ID NO: 2579001 - protein, 22 aa, Entamoeba histolytica
AVLTIKLIFSYFIDNPNYIPMY

SEQ ID NO: 2579002 - protein, 19 aa, Entamoeba histolytica
AVMFPVVWSAYLGSDPTGL

SEQ ID NO: 2579003 - protein, 20 aa, Entamoeba histolytica
AVPTCGNGKIDAYEECDGGY

SEQ ID NO: 2579004 - protein, 19 aa, Entamoeba histolytica
AVTALCISKDYSIIVSGDE

SEQ ID NO: 2579005 - protein, 24 aa, Entamoeba histolytica
AVVTRCALSLIVAGIKYGKPNKPS

SEQ ID NO: 2579006 - protein, 19 aa, Entamoeba histolytica
AVYSRPVKDTSVFIDIPRL

SEQ ID NO: 2579007 - protein, 26 aa, Entamoeba histolytica
AWKENCWKYLIEFISDVFPVHSLIDY

SEQ ID NO: 2579008 - protein, 19 aa, Entamoeba histolytica
AWKKYTYPIMFTPTSIVYF

SEQ ID NO: 2579009 - protein, 17 aa, Entamoeba histolytica
AWVKLSITEDSYYIIET

SEQ ID NO: 2579010 - protein, 17 aa, Entamoeba histolytica
AYACFGISLGYLLTIHI

SEQ ID NO: 2579011 - protein, 18 aa, Entamoeba histolytica
AYCNVLSNSSLNHCFPCT

SEQ ID NO: 2579012 - protein, 25 aa, Entamoeba histolytica
AYEVFCPFPQFCQGNITIPSEHPEN

SEQ ID NO: 2579013 - protein, 24 aa, Entamoeba histolytica
AYIKDEFTQLLAIKVLSDCAKGMR

SEQ ID NO: 2579014 - protein, 17 aa, Entamoeba histolytica
AYIPIWRYIVYGIAMLI

SEQ ID NO: 2579015 - protein, 18 aa, Entamoeba histolytica
AYNCSLCPSECETCQYSS

SEQ ID NO: 2579016 - protein, 26 aa, Entamoeba histolytica
AYSGRCECKPGFVFKDEGCTECGNGV

SEQ ID NO: 2579017 - protein, 26 aa, Entamoeba histolytica
CADIPPKKAVVFTIFIKPLICCCITH

SEQ ID NO: 2579018 - protein, 25 aa, Entamoeba histolytica
CADTFKYVIEKGVVTKYTFKSNSDC

SEQ ID NO: 2579019 - protein, 24 aa, Entamoeba histolytica
CAEDYFRYGFEVSTLCLPQNQINN

SEQ ID NO: 2579020 - protein, 20 aa, Entamoeba histolytica
CAGALACGNTVFLKMSKYSM

SEQ ID NO: 2579021 - protein, 41 aa, Entamoeba histolytica
CAIAISFIYGSCLIRFFGFYLATLLLFWGCTIKYCNDISFY

SEQ ID NO: 2579022 - protein, 20 aa, Entamoeba histolytica
CAIFIPFVFSPFLLLYSILS

SEQ ID NO: 2579023 - protein, 26 aa, Entamoeba histolytica
CAKLFAGRPRPHFYARLSEHPEQVKS

SEQ ID NO: 2579024 - protein, 22 aa, Entamoeba histolytica
CALISHCICNFLLSNVIVFKTL

SEQ ID NO: 2579025 - protein, 19 aa, Entamoeba histolytica
CALSSLVIQNCQFLFSNNE

SEQ ID NO: 2579026 - protein, 24 aa, Entamoeba histolytica
CAPLKEPWTFETFNLDEIMKTHKV

SEQ ID NO: 2579027 - protein, 19 aa, Entamoeba histolytica
CAQYVYGICVKCTNKMYVS

SEQ ID NO: 2579028 - protein, 39 aa, Entamoeba histolytica
CATNIVKECLKHLGMAPEIYRYFKVILITMQIILLSPLI

SEQ ID NO: 2579029 - protein, 20 aa, Entamoeba histolytica
CAVCMKGYYRSSSLCKKCKS

SEQ ID NO: 2579030 - protein, 21 aa, Entamoeba histolytica
CAVCQKGYYRYGLDCVPCNSS

SEQ ID NO: 2579031 - protein, 17 aa, Entamoeba histolytica
CAVFMTMTLFGRLLIVY

SEQ ID NO: 2579032 - protein, 20 aa, Entamoeba histolytica
CAVGEYYYNFFRGCWDCSDE

SEQ ID NO: 2579033 - protein, 19 aa, Entamoeba histolytica
CAVPTCGNGKIDVYEECDG

SEQ ID NO: 2579034 - protein, 17 aa, Entamoeba histolytica
CCAFNVISCIGNKEMVE

SEQ ID NO: 2579035 - protein, 18 aa, Entamoeba histolytica
CCEWCCSNCCNDCECCEN

SEQ ID NO: 2579036 - protein, 17 aa, Entamoeba histolytica
CCITHTLGIIIKRKHSD

SEQ ID NO: 2579037 - protein, 20 aa, Entamoeba histolytica
CCTQSPKLKVCLMSFSALTA

SEQ ID NO: 2579038 - protein, 26 aa, Entamoeba histolytica
CDAMFAFPWYITWFLHSVENIEVGLR

SEQ ID NO: 2579039 - protein, 17 aa, Entamoeba histolytica
CDASCKKCFFADKCEEC

SEQ ID NO: 2579040 - protein, 26 aa, Entamoeba histolytica
CDDKWKLCDVAKAFLIDDIDEAVSTT

SEQ ID NO: 2579041 - protein, 17 aa, Entamoeba histolytica
CDDNCTICFGSSTYCMS

SEQ ID NO: 2579042 - protein, 21 aa, Entamoeba histolytica
CDEKSKLLLELTVGTELQNPK

SEQ ID NO: 2579043 - protein, 23 aa, Entamoeba histolytica
CDFDCFIEGLSFTVDLEGKMSTM

SEQ ID NO: 2579044 - protein, 17 aa, Entamoeba histolytica
CDFELQRNISYDMKMQL

SEQ ID NO: 2579045 - protein, 17 aa, Entamoeba histolytica
CDFFISTYWPSYILNEL

SEQ ID NO: 2579046 - protein, 19 aa, Entamoeba histolytica
CDFRDFLFVIGMSIIPIFT

SEQ ID NO: 2579047 - protein, 19 aa, Entamoeba histolytica
CDGGDGCIECECQENWYTN

SEQ ID NO: 2579048 - protein, 20 aa, Entamoeba histolytica
CDGGDGCIECECQPGWYSNG

SEQ ID NO: 2579049 - protein, 21 aa, Entamoeba histolytica
CDGGDGCIECECQPGWYSQDK

SEQ ID NO: 2579050 - protein, 21 aa, Entamoeba histolytica
CDGGDGCIECECQPGWYSQNK

SEQ ID NO: 2579051 - protein, 20 aa, Entamoeba histolytica
CDGGDGCYECECQAGWYKTG

SEQ ID NO: 2579052 - protein, 27 aa, Entamoeba histolytica
CDGGEGCYACQCIEGYYSVHSLSCRRN

SEQ ID NO: 2579053 - protein, 20 aa, Entamoeba histolytica
CDGGEGCYECECQAGWFEAH

SEQ ID NO: 2579054 - protein, 19 aa, Entamoeba histolytica
CDGGKGCDHCFCQEGYIKY

SEQ ID NO: 2579055 - protein, 38 aa, Entamoeba histolytica
CDGIECKKCKIEYGLKIGRHGCMKCFDLDSKCLECGEG

SEQ ID NO: 2579056 - protein, 19 aa, Entamoeba histolytica
CDHYPKPQAWRGILSISSG

SEQ ID NO: 2579057 - protein, 18 aa, Entamoeba histolytica
CDIEGCIGGCISPNECTR

SEQ ID NO: 2579058 - protein, 22 aa, Entamoeba histolytica
CDIEPYIRPVVFVNKTTINNNK

SEQ ID NO: 2579059 - protein, 21 aa, Entamoeba histolytica
CDKCDVLGCAWCQDDHTSCKR

SEQ ID NO: 2579060 - protein, 23 aa, Entamoeba histolytica
CDLDECYECPSGYGLSMKKDKCI

SEQ ID NO: 2579061 - protein, 20 aa, Entamoeba histolytica
CDLIKVTIDCRIEVKEINIK

SEQ ID NO: 2579062 - protein, 18 aa, Entamoeba histolytica
CDSFCYCVSGYIPDPDNP

SEQ ID NO: 2579063 - protein, 18 aa, Entamoeba histolytica
CDSSSCYCKLGYSSFSIA

SEQ ID NO: 2579064 - protein, 25 aa, Entamoeba histolytica
CDSTDVIAAISWRRIVKKYTTHNAI

SEQ ID NO: 2579065 - protein, 18 aa, Entamoeba histolytica
CDTMKRWCLKCSSEYYLN

SEQ ID NO: 2579066 - protein, 28 aa, Entamoeba histolytica
CDYGKVLRNGKCIPLEAVVNCIETSNGK

SEQ ID NO: 2579067 - protein, 20 aa, Entamoeba histolytica
CEAYSYQGCTDFVEDKKVVN

SEQ ID NO: 2579068 - protein, 20 aa, Entamoeba histolytica
CEFELFIIIKCTTKIKDKIM

SEQ ID NO: 2579069 - protein, 20 aa, Entamoeba histolytica
CEFELFIIIKCTTKINDKIM

SEQ ID NO: 2579070 - protein, 19 aa, Entamoeba histolytica
CEFGEVFDYLCVKFLKEQQ

SEQ ID NO: 2579071 - protein, 21 aa, Entamoeba histolytica
CEGRIDCAFISNGEGNTLDAG

SEQ ID NO: 2579072 - protein, 24 aa, Entamoeba histolytica
CEHHCPFHPAICYLLGYLDTIVDN

SEQ ID NO: 2579073 - protein, 18 aa, Entamoeba histolytica
CEIIKCLSSSALNELNCI

SEQ ID NO: 2579074 - protein, 19 aa, Entamoeba histolytica
CEILWQHQGCFVIEASYTS

SEQ ID NO: 2579075 - protein, 20 aa, Entamoeba histolytica
CEINIKWWIIVIIIIMILIG

SEQ ID NO: 2579076 - protein, 23 aa, Entamoeba histolytica
CEINKRGTYTFDIWINNKRIKAL

SEQ ID NO: 2579077 - protein, 20 aa, Entamoeba histolytica
CEKCNGSGRVSETTEFNITI

SEQ ID NO: 2579078 - protein, 18 aa, Entamoeba histolytica
CEKCTKDKCFKCKEGYML

SEQ ID NO: 2579079 - protein, 17 aa, Entamoeba histolytica
CEKRFWISLILTLLFFL

SEQ ID NO: 2579080 - protein, 17 aa, Entamoeba histolytica
CELSHKLKIAELNIEEG

SEQ ID NO: 2579081 - protein, 17 aa, Entamoeba histolytica
CELSLPFISVLIVSVTF

SEQ ID NO: 2579082 - protein, 17 aa, Entamoeba histolytica
CENGISFTCGNVELESS

SEQ ID NO: 2579083 - protein, 17 aa, Entamoeba histolytica
CEPKVKCMVPYCDDDNN

SEQ ID NO: 2579084 - protein, 17 aa, Entamoeba histolytica
CEPNCGSCVVGYQCNSL

SEQ ID NO: 2579085 - protein, 18 aa, Entamoeba histolytica
CERFPKPTFSSIFKYLVF

SEQ ID NO: 2579086 - protein, 19 aa, Entamoeba histolytica
CESILRFVGTGNRLSIDDN

SEQ ID NO: 2579087 - protein, 21 aa, Entamoeba histolytica
CESLSKFLINYGIRATHYHAG

SEQ ID NO: 2579088 - protein, 19 aa, Entamoeba histolytica
CETAKIGKEFKCISDESLS

SEQ ID NO: 2579089 - protein, 19 aa, Entamoeba histolytica
CETKYYLDDSMKCVNCPDN

SEQ ID NO: 2579090 - protein, 27 aa, Entamoeba histolytica
CETVPMCLYDFLIVHIFPLITPLISVL

SEQ ID NO: 2579091 - protein, 30 aa, Entamoeba histolytica
CEYPHKFSDVMYNWMKDSIIPFNIESVPKI

SEQ ID NO: 2579092 - protein, 18 aa, Entamoeba histolytica
CFDMRNGCYYNKQEKSLF

SEQ ID NO: 2579093 - protein, 20 aa, Entamoeba histolytica
CFDMRNGCYYNKQEKSLIVR

SEQ ID NO: 2579094 - protein, 31 aa, Entamoeba histolytica
CFEVKATLDDGCWCLFAGVIVYTVTTITIMK

SEQ ID NO: 2579095 - protein, 19 aa, Entamoeba histolytica
CFFPLAALVVITGIIYALL

SEQ ID NO: 2579096 - protein, 21 aa, Entamoeba histolytica
CFIAFSLVVYFTDWKMAEIGD

SEQ ID NO: 2579097 - protein, 18 aa, Entamoeba histolytica
CFIMFYSLTNATECSCES

SEQ ID NO: 2579098 - protein, 24 aa, Entamoeba histolytica
CFIVVGLLVLWLFIKNGSMTWEDT

SEQ ID NO: 2579099 - protein, 29 aa, Entamoeba histolytica
CFLIAGIFYYHFWLLCILFCIARTSFELV

SEQ ID NO: 2579100 - protein, 20 aa, Entamoeba histolytica
CFLSCCFYGVTIIVTMGLGC

SEQ ID NO: 2579101 - protein, 18 aa, Entamoeba histolytica
CFPETKGRFQVFVHGDFL

SEQ ID NO: 2579102 - protein, 19 aa, Entamoeba histolytica
CFPETKGRFQVFVHGDFLP

SEQ ID NO: 2579103 - protein, 26 aa, Entamoeba histolytica
CFPRCGSCRNGLICSSGKCVKEISYN

SEQ ID NO: 2579104 - protein, 18 aa, Entamoeba histolytica
CFPTFVHLFALPFVSVIP

SEQ ID NO: 2579105 - protein, 23 aa, Entamoeba histolytica
CFTFCGCFSCNLLPWAWSPPKFE

SEQ ID NO: 2579106 - protein, 17 aa, Entamoeba histolytica
CFVSRAFNVFPISLLMN

SEQ ID NO: 2579107 - protein, 19 aa, Entamoeba histolytica
CFYCPEGTYYEQGHCYNCP

SEQ ID NO: 2579108 - protein, 17 aa, Entamoeba histolytica
CFYDLSVGQREAFDKDL

SEQ ID NO: 2579109 - protein, 18 aa, Entamoeba histolytica
CFYEHCLTCADDYYQHYN

SEQ ID NO: 2579110 - protein, 27 aa, Entamoeba histolytica
CGECQIDSYGIKKCLTCISDEYYLNEQ

SEQ ID NO: 2579111 - protein, 19 aa, Entamoeba histolytica
CGEDSRLARLIQRIDSKHL

SEQ ID NO: 2579112 - protein, 18 aa, Entamoeba histolytica
CGEHCILCSTIGICEGCE

SEQ ID NO: 2579113 - protein, 30 aa, Entamoeba histolytica
CGFCLSFSACCFWLIIPILMRDIGASPFEI

SEQ ID NO: 2579114 - protein, 19 aa, Entamoeba histolytica
CGFINNFLPGWLLARIGVL

SEQ ID NO: 2579115 - protein, 17 aa, Entamoeba histolytica
CGGDSRLARLIQKIDKE

SEQ ID NO: 2579116 - protein, 17 aa, Entamoeba histolytica
CGHDTAITCCVIDNNNN

SEQ ID NO: 2579117 - protein, 27 aa, Entamoeba histolytica
CGHMFCWECLREWLTRQETCPICKSKV

SEQ ID NO: 2579118 - protein, 19 aa, Entamoeba histolytica
CGHPPVQHNCHFGPCPKCT

SEQ ID NO: 2579119 - protein, 23 aa, Entamoeba histolytica
CGILECFWVKWFVLGNLMVILGL

SEQ ID NO: 2579120 - protein, 20 aa, Entamoeba histolytica
CGKCKSGYYFSVEQKACTKC

SEQ ID NO: 2579121 - protein, 25 aa, Entamoeba histolytica
CGLLCPIIGLFLNKKWFPIADICRI

SEQ ID NO: 2579122 - protein, 19 aa, Entamoeba histolytica
CGLNKFPIDLTLLSNLTSL

SEQ ID NO: 2579123 - protein, 20 aa, Entamoeba histolytica
CGLTGVIFGLCLMFIGLILL

SEQ ID NO: 2579124 - protein, 19 aa, Entamoeba histolytica
CGLVMTLVLLLSFIYYGGS

SEQ ID NO: 2579125 - protein, 19 aa, Entamoeba histolytica
CGMFSNIIGKYFKEKGEEN

SEQ ID NO: 2579126 - protein, 20 aa, Entamoeba histolytica
CGQKIPYQIFFRDVVNQRLP

SEQ ID NO: 2579127 - protein, 17 aa, Entamoeba histolytica
CGSDCQCAKGYSSDGNG

SEQ ID NO: 2579128 - protein, 24 aa, Entamoeba histolytica
CGTYYRIGKDTTCTCTLKDNEQTI

SEQ ID NO: 2579129 - protein, 30 aa, Entamoeba histolytica
CGVFFASTLVPSVCRWYRLKQIIKQQELLN

SEQ ID NO: 2579130 - protein, 19 aa, Entamoeba histolytica
CGYSEDFSYIEVMKLFTAH

SEQ ID NO: 2579131 - protein, 18 aa, Entamoeba histolytica
CGYTLAINYCDYDATGRF

SEQ ID NO: 2579132 - protein, 17 aa, Entamoeba histolytica
CGYYYSIIFSISFIVLL

SEQ ID NO: 2579133 - protein, 18 aa, Entamoeba histolytica
CHFNCYLSSPSLVCRSLV

SEQ ID NO: 2579134 - protein, 18 aa, Entamoeba histolytica
CHHCQEYLFGKWFKIPKS

SEQ ID NO: 2579135 - protein, 24 aa, Entamoeba histolytica
CHPYCGTCLRGFKCNKAARCVKPK

SEQ ID NO: 2579136 - protein, 17 aa, Entamoeba histolytica
CHTCMVSTCSLDLSLKD

SEQ ID NO: 2579137 - protein, 25 aa, Entamoeba histolytica
CHWYWIPEIFEGMCIYYAGDTDWWF

SEQ ID NO: 2579138 - protein, 24 aa, Entamoeba histolytica
CHYVDGCAPGQCDGIKCLRCKRGY

SEQ ID NO: 2579139 - protein, 21 aa, Entamoeba histolytica
CIARECLRDSKIICIDEATSG

SEQ ID NO: 2579140 - protein, 21 aa, Entamoeba histolytica
CICIIALLILTLCLIEQGNGL

SEQ ID NO: 2579141 - protein, 19 aa, Entamoeba histolytica
CICSTCFSKGNHEGHDAYA

SEQ ID NO: 2579142 - protein, 22 aa, Entamoeba histolytica
CIDCSYHPMQVYFRQQVGNMYC

SEQ ID NO: 2579143 - protein, 17 aa, Entamoeba histolytica
CIDEWIRCHSFCPLCKV

SEQ ID NO: 2579144 - protein, 19 aa, Entamoeba histolytica
CIDFLFKTHYFLISVIGYC

SEQ ID NO: 2579145 - protein, 18 aa, Entamoeba histolytica
CIECDLIGCESCSVDSYS

SEQ ID NO: 2579146 - protein, 19 aa, Entamoeba histolytica
CIECQNGICQECMNNFDLS

SEQ ID NO: 2579147 - protein, 21 aa, Entamoeba histolytica
CIECTEGYKLINGVCTAVTPE

SEQ ID NO: 2579148 - protein, 19 aa, Entamoeba histolytica
CIEQELFVLYDLFKSDRTI

SEQ ID NO: 2579149 - protein, 25 aa, Entamoeba histolytica
CIFISICFYILIMLIVIYVVGNKQP

SEQ ID NO: 2579150 - protein, 18 aa, Entamoeba histolytica
CIFIYFSYLYYKKFLFIK

SEQ ID NO: 2579151 - protein, 31 aa, Entamoeba histolytica
CIGICSMILLIICSRIKRTGIIQTMMIFLIT

SEQ ID NO: 2579152 - protein, 18 aa, Entamoeba histolytica
CIHCEKGYYLNSMKECES

SEQ ID NO: 2579153 - protein, 20 aa, Entamoeba histolytica
CIIFNRFSTITTYIIRTKFF

SEQ ID NO: 2579154 - protein, 18 aa, Entamoeba histolytica
CIIGVAFTMYYFVSDKHV

SEQ ID NO: 2579155 - protein, 17 aa, Entamoeba histolytica
CIILLCLKNHYISGLFN

SEQ ID NO: 2579156 - protein, 22 aa, Entamoeba histolytica
CIKCGTGCKTCKTSGDNSCTSC

SEQ ID NO: 2579157 - protein, 23 aa, Entamoeba histolytica
CIKCGTGCKTCKTSGDNSCTSCK

SEQ ID NO: 2579158 - protein, 24 aa, Entamoeba histolytica
CIKCPIECKTCFYEHCLTCADDYY

SEQ ID NO: 2579159 - protein, 28 aa, Entamoeba histolytica
CIKDKVPGYCPFCGNPITLDSLVSIFNE

SEQ ID NO: 2579160 - protein, 19 aa, Entamoeba histolytica
CIKLLKQRINEVVPVSFDW

SEQ ID NO: 2579161 - protein, 22 aa, Entamoeba histolytica
CIKMAELFINRGIKTLIVKLSA

SEQ ID NO: 2579162 - protein, 25 aa, Entamoeba histolytica
CIKSKEWIMAISIGSTILILFVVII

SEQ ID NO: 2579163 - protein, 20 aa, Entamoeba histolytica
CILCKTGYYANEGICQKCDS

SEQ ID NO: 2579164 - protein, 23 aa, Entamoeba histolytica
CINEIKNIISLFLNESLIEKLEE

SEQ ID NO: 2579165 - protein, 32 aa, Entamoeba histolytica
CINGYYLKNGKCFKCQDGCNVCYEDTQSNSLK

SEQ ID NO: 2579166 - protein, 17 aa, Entamoeba histolytica
CISICFVVVLVVANFGI

SEQ ID NO: 2579167 - protein, 19 aa, Entamoeba histolytica
CITCVDGYFMSWIGECKSI

SEQ ID NO: 2579168 - protein, 17 aa, Entamoeba histolytica
CITGCSICEGGKCLQCE

SEQ ID NO: 2579169 - protein, 24 aa, Entamoeba histolytica
CITSECRRKIQLMYFDESFNEEKC

SEQ ID NO: 2579170 - protein, 24 aa, Entamoeba histolytica
CIVAEMFLGIPLFPANSEYDLLYR

SEQ ID NO: 2579171 - protein, 18 aa, Entamoeba histolytica
CIVDVCFQESSSSESLFS

SEQ ID NO: 2579172 - protein, 19 aa, Entamoeba histolytica
CIYVLMNIYIDFKEIHSKD

SEQ ID NO: 2579173 - protein, 17 aa, Entamoeba histolytica
CKAIPLASQIYLTHPNY

SEQ ID NO: 2579174 - protein, 21 aa, Entamoeba histolytica
CKDGYFIKDKMCSPCLSGCQI

SEQ ID NO: 2579175 - protein, 25 aa, Entamoeba histolytica
CKDVSIRQPIEWEIEKSDSRWKVLV

SEQ ID NO: 2579176 - protein, 26 aa, Entamoeba histolytica
CKEANNSKCLKCFGWNKPNKQGNACL

SEQ ID NO: 2579177 - protein, 18 aa, Entamoeba histolytica
CKECPVGTYSQLRRSIKC

SEQ ID NO: 2579178 - protein, 18 aa, Entamoeba histolytica
CKHCTSIQCIKCNKEYVL

SEQ ID NO: 2579179 - protein, 19 aa, Entamoeba histolytica
CKIERLPIILPLVQEDVLS

SEQ ID NO: 2579180 - protein, 20 aa, Entamoeba histolytica
CKKCDLKVSNCWECDETGIC

SEQ ID NO: 2579181 - protein, 22 aa, Entamoeba histolytica
CKKGIQWYVCKGNTVKIPEKPC

SEQ ID NO: 2579182 - protein, 17 aa, Entamoeba histolytica
CKKNLTLSWNDSNQDSV

SEQ ID NO: 2579183 - protein, 21 aa, Entamoeba histolytica
CKLFICCVMMFGKHRGFPERV

SEQ ID NO: 2579184 - protein, 24 aa, Entamoeba histolytica
CKLNIRLSVKILKQLYSMIKSCSG

SEQ ID NO: 2579185 - protein, 33 aa, Entamoeba histolytica
CKMAVICLKELLLLLRYTPRYEQDEGIITLWST

SEQ ID NO: 2579186 - protein, 17 aa, Entamoeba histolytica
CKNHPTHFCLKEHSQYI

SEQ ID NO: 2579187 - protein, 19 aa, Entamoeba histolytica
CKNKLLLNGVCTVSSDNCN

SEQ ID NO: 2579188 - protein, 20 aa, Entamoeba histolytica
CKNKLLLNGVCTVSSDNCNN

SEQ ID NO: 2579189 - protein, 18 aa, Entamoeba histolytica
CKNLRQNILFNYQKILIN

SEQ ID NO: 2579190 - protein, 17 aa, Entamoeba histolytica
CKNQIIGLILFTNTAKN

SEQ ID NO: 2579191 - protein, 20 aa, Entamoeba histolytica
CKNSTAAQCLLCKQKVVEDE

SEQ ID NO: 2579192 - protein, 20 aa, Entamoeba histolytica
CKNTNGLNCVATYTGSATNL

SEQ ID NO: 2579193 - protein, 31 aa, Entamoeba histolytica
CKQCTIDHCKYCTSSDCLLCNDNYQLKDSKC

SEQ ID NO: 2579194 - protein, 22 aa, Entamoeba histolytica
CKRDSFGCGIHGRIIKKLEYKK

SEQ ID NO: 2579195 - protein, 27 aa, Entamoeba histolytica
CKSDLCELEPTLVIGVPTVFNRIRKAI

SEQ ID NO: 2579196 - protein, 19 aa, Entamoeba histolytica
CKSEGKAYNIGCVFEAGAL

SEQ ID NO: 2579197 - protein, 19 aa, Entamoeba histolytica
CKSSPVWWVIVLVVIGGII

SEQ ID NO: 2579198 - protein, 28 aa, Entamoeba histolytica
CKTCPEHCLDCLNSEYCFKCENGYTAIN

SEQ ID NO: 2579199 - protein, 17 aa, Entamoeba histolytica
CLAMKPRMFMPIDENGK

SEQ ID NO: 2579200 - protein, 18 aa, Entamoeba histolytica
CLCNKSLDENGCWNNVCC

SEQ ID NO: 2579201 - protein, 19 aa, Entamoeba histolytica
CLCTCIYLWANRSIPQEKW

SEQ ID NO: 2579202 - protein, 19 aa, Entamoeba histolytica
CLDGYYVYDSYCFNCPDNC

SEQ ID NO: 2579203 - protein, 22 aa, Entamoeba histolytica
CLEFCILSFFGSIGYANARTLM

SEQ ID NO: 2579204 - protein, 18 aa, Entamoeba histolytica
CLEHPFLHLLDVETDIDI

SEQ ID NO: 2579205 - protein, 18 aa, Entamoeba histolytica
CLEITGPTQRPFVCMIAG

SEQ ID NO: 2579206 - protein, 19 aa, Entamoeba histolytica
CLEQVVGCTDYVYAKFDSC

SEQ ID NO: 2579207 - protein, 29 aa, Entamoeba histolytica
CLESKLWKYLCPFVSFSMKQKNIIRPIEQ

SEQ ID NO: 2579208 - protein, 20 aa, Entamoeba histolytica
CLFIHYTVLLIYTWGQRLMG

SEQ ID NO: 2579209 - protein, 21 aa, Entamoeba histolytica
CLFIPFMIFPIFIAFIPYILV

SEQ ID NO: 2579210 - protein, 19 aa, Entamoeba histolytica
CLFSAEKGSTISISTSLAT

SEQ ID NO: 2579211 - protein, 19 aa, Entamoeba histolytica
CLFTNKLFIWLLFTIAVSG

SEQ ID NO: 2579212 - protein, 24 aa, Entamoeba histolytica
CLGGVRGTQGCFCPKPFKKASGEG

SEQ ID NO: 2579213 - protein, 39 aa, Entamoeba histolytica
CLGIPVKPFRLFVPMDFINEFPFLIILYFTLPYMNNVDK

SEQ ID NO: 2579214 - protein, 17 aa, Entamoeba histolytica
CLHYSFIPNCINSSNSR

SEQ ID NO: 2579215 - protein, 19 aa, Entamoeba histolytica
CLIGFIPFFVMTRFPLVNN

SEQ ID NO: 2579216 - protein, 17 aa, Entamoeba histolytica
CLIKTIIEQSWKHNPKD

SEQ ID NO: 2579217 - protein, 17 aa, Entamoeba histolytica
CLILCISSNIAITNCAK

SEQ ID NO: 2579218 - protein, 20 aa, Entamoeba histolytica
CLITSLPGFVLLLFLFSIDL

SEQ ID NO: 2579219 - protein, 20 aa, Entamoeba histolytica
CLKCGEGKPVEGDCPERPIV

SEQ ID NO: 2579220 - protein, 20 aa, Entamoeba histolytica
CLLCIPYIASEVIVMNDIPV

SEQ ID NO: 2579221 - protein, 17 aa, Entamoeba histolytica
CLLKDVIEQSWRHSPSE

SEQ ID NO: 2579222 - protein, 18 aa, Entamoeba histolytica
CLMYCRYERFFQRFIPKT

SEQ ID NO: 2579223 - protein, 17 aa, Entamoeba histolytica
CLPCVDVHCKWCNNKMC

SEQ ID NO: 2579224 - protein, 19 aa, Entamoeba histolytica
CLPMCGDEILAGWEECDGG

SEQ ID NO: 2579225 - protein, 22 aa, Entamoeba histolytica
CLPTCECEKGYSLIEGYCVSDL

SEQ ID NO: 2579226 - protein, 28 aa, Entamoeba histolytica
CLPVYKRAPCSFTKVLYCTIPSCSIVAS

SEQ ID NO: 2579227 - protein, 25 aa, Entamoeba histolytica
CLQLNNFFIVVCIVTLFETSALHRL

SEQ ID NO: 2579228 - protein, 25 aa, Entamoeba histolytica
CLQVIQRKCRLWNGNIIEYLPKGNK

SEQ ID NO: 2579229 - protein, 19 aa, Entamoeba histolytica
CLQYIHLLCNKLTPERADR

SEQ ID NO: 2579230 - protein, 18 aa, Entamoeba histolytica
CLRCTSDSCIQCVEGKQI

SEQ ID NO: 2579231 - protein, 17 aa, Entamoeba histolytica
CLRYFFQRLDHITIYIM

SEQ ID NO: 2579232 - protein, 23 aa, Entamoeba histolytica
CLSCDKNGCKKCEKGYSPKDNGM

SEQ ID NO: 2579233 - protein, 17 aa, Entamoeba histolytica
CLSHIWDIHLRHLSNIT

SEQ ID NO: 2579234 - protein, 33 aa, Entamoeba histolytica
CLSSVIPLIGLKAYQRVRIAAVRCSVSLIGSFI

SEQ ID NO: 2579235 - protein, 28 aa, Entamoeba histolytica
CLTCDSIECLSCSNNLFLKDNKCQNCSD

SEQ ID NO: 2579236 - protein, 20 aa, Entamoeba histolytica
CLTCTNTSTYCLSCKEGYFI

SEQ ID NO: 2579237 - protein, 26 aa, Entamoeba histolytica
CLTIILGLICFITITFFLLFKYSPKV

SEQ ID NO: 2579238 - protein, 25 aa, Entamoeba histolytica
CLVWFMYRMVHYHKYYVYAYASGIY

SEQ ID NO: 2579239 - protein, 18 aa, Entamoeba histolytica
CMVAEMFFGIPLFVANSE

SEQ ID NO: 2579240 - protein, 24 aa, Entamoeba histolytica
CMVAEMFFGIPLFVANSELGLLRK

SEQ ID NO: 2579241 - protein, 17 aa, Entamoeba histolytica
CMVLFKDTFLNIVSISF

SEQ ID NO: 2579242 - protein, 19 aa, Entamoeba histolytica
CNCGEILNIVCTKRGIQIG

SEQ ID NO: 2579243 - protein, 25 aa, Entamoeba histolytica
CNCHKDSNCAFIFEDQEQITLHIPY

SEQ ID NO: 2579244 - protein, 25 aa, Entamoeba histolytica
CNEICVKKPQILFDMITKILQKYSE

SEQ ID NO: 2579245 - protein, 24 aa, Entamoeba histolytica
CNEIIKLFESFGWLMKLDFTNITS

SEQ ID NO: 2579246 - protein, 24 aa, Entamoeba histolytica
CNETRFSWNHIETVDSAFECIESI

SEQ ID NO: 2579247 - protein, 27 aa, Entamoeba histolytica
CNFEGGRKCLWISILIDSITVVLLLSM

SEQ ID NO: 2579248 - protein, 17 aa, Entamoeba histolytica
CNITSCNLCGSGMTIDN

SEQ ID NO: 2579249 - protein, 26 aa, Entamoeba histolytica
CNKHFRIVAVLLKYWLKTRNLNCPFK

SEQ ID NO: 2579250 - protein, 21 aa, Entamoeba histolytica
CNKYCYCINGFEPDPNHIGSC

SEQ ID NO: 2579251 - protein, 33 aa, Entamoeba histolytica
CNLLVGFFLAEYWKFGFIIIICSPWLFNDKKTN

SEQ ID NO: 2579252 - protein, 26 aa, Entamoeba histolytica
CNLMERIRCPYVLSFVGSVQMPDQLC

SEQ ID NO: 2579253 - protein, 18 aa, Entamoeba histolytica
CNNKCNWYNGACVESHCT

SEQ ID NO: 2579254 - protein, 26 aa, Entamoeba histolytica
CNNQIKYFYCGGVSNVEPHCIDNQEK

SEQ ID NO: 2579255 - protein, 19 aa, Entamoeba histolytica
CNNVPHLGTLIGCVLSADV

SEQ ID NO: 2579256 - protein, 24 aa, Entamoeba histolytica
CNPMKGICITCEHEYIIIDGKCIH

SEQ ID NO: 2579257 - protein, 20 aa, Entamoeba histolytica
CNPRFGCGVDENLFPRSAFY

SEQ ID NO: 2579258 - protein, 21 aa, Entamoeba histolytica
CNSAMKLFEGKCVPSIDNCAR

SEQ ID NO: 2579259 - protein, 19 aa, Entamoeba histolytica
CNSTLCLETSYSTIDIKYK

SEQ ID NO: 2579260 - protein, 25 aa, Entamoeba histolytica
CNVVECPYWLAPEVILNNHFTEASD

SEQ ID NO: 2579261 - protein, 20 aa, Entamoeba histolytica
CNWLVLLFGWMSFVAFDSCN

SEQ ID NO: 2579262 - protein, 22 aa, Entamoeba histolytica
CPCKGIYCHIIIYSSIINEPLI

SEQ ID NO: 2579263 - protein, 19 aa, Entamoeba histolytica
CPDDPCGTNDAVIIQNITK

SEQ ID NO: 2579264 - protein, 19 aa, Entamoeba histolytica
CPENCKECLSSTNCHECMN

SEQ ID NO: 2579265 - protein, 20 aa, Entamoeba histolytica
CPFGISLFHQMIFKSNLQFQ

SEQ ID NO: 2579266 - protein, 25 aa, Entamoeba histolytica
CPFKCSTCSMNYCIDCYKMVNQNFD

SEQ ID NO: 2579267 - protein, 21 aa, Entamoeba histolytica
CPHYFCEIMTWIFFNALTGFP

SEQ ID NO: 2579268 - protein, 17 aa, Entamoeba histolytica
CPIELNCKNCIWYSDLE

SEQ ID NO: 2579269 - protein, 27 aa, Entamoeba histolytica
CPIPSFCRPSFPTLGMLISKKLKKQRV

SEQ ID NO: 2579270 - protein, 20 aa, Entamoeba histolytica
CPKDPCGTNEAGIFSQITTK

SEQ ID NO: 2579271 - protein, 19 aa, Entamoeba histolytica
CPKDPCGTNEAGISSQITN

SEQ ID NO: 2579272 - protein, 21 aa, Entamoeba histolytica
CPNGIKLNKTVICTLNDKIYS

SEQ ID NO: 2579273 - protein, 20 aa, Entamoeba histolytica
CPNGIKLNKTVICTLNDMTY

SEQ ID NO: 2579274 - protein, 21 aa, Entamoeba histolytica
CPNGIKLNKTVICTLNNKIYS

SEQ ID NO: 2579275 - protein, 21 aa, Entamoeba histolytica
CPNGIKLNKTVICTLNNMIYS

SEQ ID NO: 2579276 - protein, 19 aa, Entamoeba histolytica
CPSHCMKCVSGSKCISCED

SEQ ID NO: 2579277 - protein, 25 aa, Entamoeba histolytica
CPYITRHKWLFISLYFVGIMVCGIL

SEQ ID NO: 2579278 - protein, 20 aa, Entamoeba histolytica
CPYKKIIKSCWRNRSSKRPS

SEQ ID NO: 2579279 - protein, 23 aa, Entamoeba histolytica
CQECDSGYELLNGICKTVCGNKI

SEQ ID NO: 2579280 - protein, 25 aa, Entamoeba histolytica
CQECVKLHSGIKCRMCSNSSLILVK

SEQ ID NO: 2579281 - protein, 23 aa, Entamoeba histolytica
CQEKKKFTIAGSYFQELKYSDEE

SEQ ID NO: 2579282 - protein, 21 aa, Entamoeba histolytica
CQEKKKFTIAGSYIQQLKYSD

SEQ ID NO: 2579283 - protein, 17 aa, Entamoeba histolytica
CQFIIKKNENNEMKITR

SEQ ID NO: 2579284 - protein, 17 aa, Entamoeba histolytica
CQFSYSMLLMKLSLQTT

SEQ ID NO: 2579285 - protein, 18 aa, Entamoeba histolytica
CQGPCQCLNNQFLYYKHS

SEQ ID NO: 2579286 - protein, 17 aa, Entamoeba histolytica
CQIIIKKNENNEMKITR

SEQ ID NO: 2579287 - protein, 19 aa, Entamoeba histolytica
CQKLWPIVIIYTLLIVLME

SEQ ID NO: 2579288 - protein, 17 aa, Entamoeba histolytica
CQQKLITAFIISLFLFF

SEQ ID NO: 2579289 - protein, 22 aa, Entamoeba histolytica
CQSYTRPSCYTVKEFAQTLTSY

SEQ ID NO: 2579290 - protein, 21 aa, Entamoeba histolytica
CQVLRCISYLHSKGICHRDIK

SEQ ID NO: 2579291 - protein, 17 aa, Entamoeba histolytica
CQVSLELAKFAQGIFFE

SEQ ID NO: 2579292 - protein, 26 aa, Entamoeba histolytica
CQYCNSSECILCYNGYQLQNKKCVLY

SEQ ID NO: 2579293 - protein, 21 aa, Entamoeba histolytica
CQYNRGTCWALATIGLLEQSY

SEQ ID NO: 2579294 - protein, 18 aa, Entamoeba histolytica
CQYQRAFEIVKKLLPEQL

SEQ ID NO: 2579295 - protein, 18 aa, Entamoeba histolytica
CRALKEHCEYVSPFEFYM

SEQ ID NO: 2579296 - protein, 25 aa, Entamoeba histolytica
CREKDELNQLLSLVSDWPLQESIST

SEQ ID NO: 2579297 - protein, 25 aa, Entamoeba histolytica
CRENFVLGNWFYWYLTVECGCTNGD

SEQ ID NO: 2579298 - protein, 17 aa, Entamoeba histolytica
CRFKGAFQCCPKLFPNN

SEQ ID NO: 2579299 - protein, 26 aa, Entamoeba histolytica
CRGYGYYQCWDCMTGYIKNGSYCTRL

SEQ ID NO: 2579300 - protein, 22 aa, Entamoeba histolytica
CRKRECFCISNILKNHLYFHLE

SEQ ID NO: 2579301 - protein, 24 aa, Entamoeba histolytica
CRLLSKKELEEWISEYQENFNRFC

SEQ ID NO: 2579302 - protein, 18 aa, Entamoeba histolytica
CRMRKRLIHDTDFFERYK

SEQ ID NO: 2579303 - protein, 20 aa, Entamoeba histolytica
CRNLYRITVWDSFNKYCCNI

SEQ ID NO: 2579304 - protein, 19 aa, Entamoeba histolytica
CRRDEVWTSLVLKTTGRVT

SEQ ID NO: 2579305 - protein, 18 aa, Entamoeba histolytica
CRSKPIGWWVWLLIALGI

SEQ ID NO: 2579306 - protein, 18 aa, Entamoeba histolytica
CRTKIAIYGSFIVNVCLC

SEQ ID NO: 2579307 - protein, 18 aa, Entamoeba histolytica
CRTLKTFSSHGILMAYYQ

SEQ ID NO: 2579308 - protein, 18 aa, Entamoeba histolytica
CSDGILLLASMNNVDLLV

SEQ ID NO: 2579309 - protein, 17 aa, Entamoeba histolytica
CSDWRHIFQILSTAAED

SEQ ID NO: 2579310 - protein, 22 aa, Entamoeba histolytica
CSECLHRFEADFVRQYSPENFR

SEQ ID NO: 2579311 - protein, 21 aa, Entamoeba histolytica
CSESPSILKGVLQYHNLLNNS

SEQ ID NO: 2579312 - protein, 21 aa, Entamoeba histolytica
CSFNGLLPFARLNMKTGEMTF

SEQ ID NO: 2579313 - protein, 21 aa, Entamoeba histolytica
CSFRYKLYFIKYLQQLIESQI

SEQ ID NO: 2579314 - protein, 19 aa, Entamoeba histolytica
CSICEGGKCLQCEKKEDIL

SEQ ID NO: 2579315 - protein, 18 aa, Entamoeba histolytica
CSICYSRLKRKCVSFSCG

SEQ ID NO: 2579316 - protein, 19 aa, Entamoeba histolytica
CSIPIPTFMDLYKEQIMQP

SEQ ID NO: 2579317 - protein, 19 aa, Entamoeba histolytica
CSKCKSCILEMDHHCNYIG

SEQ ID NO: 2579318 - protein, 19 aa, Entamoeba histolytica
CSLADQAGCKECFNDLSEE

SEQ ID NO: 2579319 - protein, 19 aa, Entamoeba histolytica
CSLEVIISIVWLFCVVQWS

SEQ ID NO: 2579320 - protein, 19 aa, Entamoeba histolytica
CSLFFFYVLMRMAFKPIMA

SEQ ID NO: 2579321 - protein, 25 aa, Entamoeba histolytica
CSLFYRLYLNYIPLIPLIINKIQQF

SEQ ID NO: 2579322 - protein, 28 aa, Entamoeba histolytica
CSLLILHIYWFKLIIEMIFKVASHEGIV

SEQ ID NO: 2579323 - protein, 28 aa, Entamoeba histolytica
CSLPPSFLSYFFVYGFNKKCCCITPHVT

SEQ ID NO: 2579324 - protein, 20 aa, Entamoeba histolytica
CSLSLKSMSYWSLTPDKQED

SEQ ID NO: 2579325 - protein, 19 aa, Entamoeba histolytica
CSLWEGKPIHSKCYRCQSC

SEQ ID NO: 2579326 - protein, 21 aa, Entamoeba histolytica
CSNCNKYIHQRCLEKFSNTFC

SEQ ID NO: 2579327 - protein, 20 aa, Entamoeba histolytica
CSNFSLPLWTLALIIIGIIC

SEQ ID NO: 2579328 - protein, 32 aa, Entamoeba histolytica
CSNRVELRLLKIVLNWLIPEVFNECLYFKGEF

SEQ ID NO: 2579329 - protein, 19 aa, Entamoeba histolytica
CSPEAKGCCGGDTEEILKD

SEQ ID NO: 2579330 - protein, 22 aa, Entamoeba histolytica
CSPGCPACLTSYTCASHCLAGY

SEQ ID NO: 2579331 - protein, 24 aa, Entamoeba histolytica
CSQECSLEYPVQVMQAIPVNRYTI

SEQ ID NO: 2579332 - protein, 25 aa, Entamoeba histolytica
CSQFKIGNSWFSYKLGEIKKIGTVS

SEQ ID NO: 2579333 - protein, 33 aa, Entamoeba histolytica; identical to SEQ ID NO: 2380619

SEQ ID NO: 2579334 - protein, 17 aa, Entamoeba histolytica
CSSCAKGYINYPYCTAL

SEQ ID NO: 2579335 - protein, 21 aa, Entamoeba histolytica
CSSCLSYSLSPLIAGVLSTLL

SEQ ID NO: 2579336 - protein, 18 aa, Entamoeba histolytica
CSSIDWYISTSYLALYYN

SEQ ID NO: 2579337 - protein, 18 aa, Entamoeba histolytica
CSSSLIKQYFTHDWIMGL

SEQ ID NO: 2579338 - protein, 21 aa, Entamoeba histolytica
CSSTGKSASFFDLKANTTMYV

SEQ ID NO: 2579339 - protein, 25 aa, Entamoeba histolytica
CSSTKSNCEISLFSSHSTYQYPTGL

SEQ ID NO: 2579340 - protein, 20 aa, Entamoeba histolytica
CSTSFKGKELIHCTYCSIVD

SEQ ID NO: 2579341 - protein, 24 aa, Entamoeba histolytica
CSVICSFLGALAWWYPKPWLESYW

SEQ ID NO: 2579342 - protein, 38 aa, Entamoeba histolytica
CSVIKTKFIKIIRGMVFYFNKLISVILDGARFTKHSII

SEQ ID NO: 2579343 - protein, 26 aa, Entamoeba histolytica
CSVLPHLSALVAIVFPRLNDIEANIT

SEQ ID NO: 2579344 - protein, 18 aa, Entamoeba histolytica
CSVMGVAVLCFFLNQLYI

SEQ ID NO: 2579345 - protein, 17 aa, Entamoeba histolytica
CSVSLIGSFISGKEKET

SEQ ID NO: 2579346 - protein, 28 aa, Entamoeba histolytica
CSYFIKEGYKLISNVLLDIALYNEGTVI

SEQ ID NO: 2579347 - protein, 21 aa, Entamoeba histolytica
CSYKSWSLILLWSSLILFEFL

SEQ ID NO: 2579348 - protein, 23 aa, Entamoeba histolytica
CSYYFKRDFTYSLTKPMECKSTD

SEQ ID NO: 2579349 - protein, 20 aa, Entamoeba histolytica
CTACSIKGCEKCTRGVDTCD

SEQ ID NO: 2579350 - protein, 20 aa, Entamoeba histolytica
CTAFSCLVIDTLIGVLPAQV

SEQ ID NO: 2579351 - protein, 17 aa, Entamoeba histolytica
CTAFSNVFSLKFKTSSS

SEQ ID NO: 2579352 - protein, 22 aa, Entamoeba histolytica
CTCKPGYTLNFGICSLCGNGVY

SEQ ID NO: 2579353 - protein, 20 aa, Entamoeba histolytica
CTEHCFIFFFDLADTQYKQI

SEQ ID NO: 2579354 - protein, 19 aa, Entamoeba histolytica
CTEPFRIPFAGIVDICAFD

SEQ ID NO: 2579355 - protein, 26 aa, Entamoeba histolytica
CTFLLMSTLIYWVFGYSFIQKNQIET

SEQ ID NO: 2579356 - protein, 17 aa, Entamoeba histolytica
CTICFGSSTYCMSCSSD

SEQ ID NO: 2579357 - protein, 21 aa, Entamoeba histolytica
CTICPEGCEFCYLNAKQQVSC

SEQ ID NO: 2579358 - protein, 27 aa, Entamoeba histolytica
CTIEGIPLFVEHSFRFFELSSKIEKEV

SEQ ID NO: 2579359 - protein, 20 aa, Entamoeba histolytica
CTIGAIIVFFITRFVVLETI

SEQ ID NO: 2579360 - protein, 27 aa, Entamoeba histolytica
CTIITSFVVAFGIMYPITFAIDIYGVA

SEQ ID NO: 2579361 - protein, 27 aa, Entamoeba histolytica
CTKDKCFKCKEGYMLYEIIGSDGKEKQ

SEQ ID NO: 2579362 - protein, 18 aa, Entamoeba histolytica
CTKGRITYYDQWASGGSC

SEQ ID NO: 2579363 - protein, 18 aa, Entamoeba histolytica
CTKMANAHDFISKLPEGY

SEQ ID NO: 2579364 - protein, 18 aa, Entamoeba histolytica
CTKQHIIHKYSSLCDKQN

SEQ ID NO: 2579365 - protein, 18 aa, Entamoeba histolytica
CTLKEDMCKTAFSYYDKT

SEQ ID NO: 2579366 - protein, 17 aa, Entamoeba histolytica
CTLKSDIDSVSFEEKDC

SEQ ID NO: 2579367 - protein, 19 aa, Entamoeba histolytica
CTLTSAGYEEWDCTENYAE

SEQ ID NO: 2579368 - protein, 18 aa, Entamoeba histolytica
CTLYRYLDNLFRYSYLNN

SEQ ID NO: 2579369 - protein, 20 aa, Entamoeba histolytica
CTMSSPSSTCVRGKDDSQEY

SEQ ID NO: 2579370 - protein, 22 aa, Entamoeba histolytica
CTNCCAEALAIVKENTKIRKSS

SEQ ID NO: 2579371 - protein, 19 aa, Entamoeba histolytica
CTQEANFGKSMIKCGVCSP

SEQ ID NO: 2579372 - protein, 24 aa, Entamoeba histolytica
CTQRMCFAESFTGYYDKTKKRITT

SEQ ID NO: 2579373 - protein, 23 aa, Entamoeba histolytica
CTSCSANHQLCWTGFSKTPNRMC

SEQ ID NO: 2579374 - protein, 17 aa, Entamoeba histolytica
CTSLINGIFEISCTLDF

SEQ ID NO: 2579375 - protein, 17 aa, Entamoeba histolytica
CTSMFYGIFPSLEGFNG

SEQ ID NO: 2579376 - protein, 19 aa, Entamoeba histolytica
CTTALPIIVQQSYIYHHKI

SEQ ID NO: 2579377 - protein, 19 aa, Entamoeba histolytica
CTTFSYLLTNGFLYALFVS

SEQ ID NO: 2579378 - protein, 18 aa, Entamoeba histolytica
CTTILKERVPVTLRYGKL

SEQ ID NO: 2579379 - protein, 21 aa, Entamoeba histolytica
CTVAALMGLLGIILCVYSLIP

SEQ ID NO: 2579380 - protein, 17 aa, Entamoeba histolytica
CTVIELITGNPPYYDLN

SEQ ID NO: 2579381 - protein, 28 aa, Entamoeba histolytica
CTYNPSSELPFVEFDCNKYATNMESPLL

SEQ ID NO: 2579382 - protein, 18 aa, Entamoeba histolytica
CTYYWGFALAVSINVNLF

SEQ ID NO: 2579383 - protein, 18 aa, Entamoeba histolytica
CTYYYGFAIAVAINVNFF

SEQ ID NO: 2579384 - protein, 23 aa, Entamoeba histolytica
CVACSGDKCATCEDGYSLDAGSM

SEQ ID NO: 2579385 - protein, 30 aa, Entamoeba histolytica
CVCGWSDRCTFKYGRRRIFIGIGVLFECIS

SEQ ID NO: 2579386 - protein, 29 aa, Entamoeba histolytica
CVDVHCKWCNNKMCFVCADDYLLSTDGIC

SEQ ID NO: 2579387 - protein, 18 aa, Entamoeba histolytica
CVECSNELLLNSKGECIN

SEQ ID NO: 2579388 - protein, 22 aa, Entamoeba histolytica
CVECSSHCKVCYKDNNDNQNHC

SEQ ID NO: 2579389 - protein, 17 aa, Entamoeba histolytica
CVFAASVVMSFDMQTLT

SEQ ID NO: 2579390 - protein, 18 aa, Entamoeba histolytica
CVFADAFHDFTIALVIPN

SEQ ID NO: 2579391 - protein, 17 aa, Entamoeba histolytica
CVGCIGGVCSSKFQECL

SEQ ID NO: 2579392 - protein, 22 aa, Entamoeba histolytica
CVKAEGLQGIVLTMNYNDCKFI

SEQ ID NO: 2579393 - protein, 22 aa, Entamoeba histolytica
CVLGCFKYYLNVSHWSQKNNTN

SEQ ID NO: 2579394 - protein, 21 aa, Entamoeba histolytica
CVLSCVVGAFMARRISPSIHI

SEQ ID NO: 2579395 - protein, 19 aa, Entamoeba histolytica
CVMDVCLALAAVFIVVMLL

SEQ ID NO: 2579396 - protein, 22 aa, Entamoeba histolytica
CVPALLRVFFQAVSVRYNSESE

SEQ ID NO: 2579397 - protein, 19 aa, Entamoeba histolytica
CVQCGESISKYTLVCSSGI

SEQ ID NO: 2579398 - protein, 18 aa, Entamoeba histolytica
CVRMYDNLLRLFLFAFQS

SEQ ID NO: 2579399 - protein, 18 aa, Entamoeba histolytica
CVRSLSLNKCENIEFEIY

SEQ ID NO: 2579400 - protein, 19 aa, Entamoeba histolytica
CVSCSSGITDHCKSCLQKG

SEQ ID NO: 2579401 - protein, 23 aa, Entamoeba histolytica
CVVEEIKPNFQLVLSDKEIYDIF

SEQ ID NO: 2579402 - protein, 18 aa, Entamoeba histolytica
CVVQMACYLRFLKERKMY

SEQ ID NO: 2579403 - protein, 21 aa, Entamoeba histolytica
CVYDIIGRGSIHLTKEVTSRI

SEQ ID NO: 2579404 - protein, 19 aa, Entamoeba histolytica
CVYGLPVFIWVTLCGALLP

SEQ ID NO: 2579405 - protein, 18 aa, Entamoeba histolytica
CVYKRIIRKCWAHKPKNR

SEQ ID NO: 2579406 - protein, 19 aa, Entamoeba histolytica
CWLLFVAVIIYTVCSIAIM

SEQ ID NO: 2579407 - protein, 20 aa, Entamoeba histolytica
CWLLPIKFGLSDVFDQNLYE

SEQ ID NO: 2579408 - protein, 17 aa, Entamoeba histolytica
CWRNRSSKRPSFNEIEK

SEQ ID NO: 2579409 - protein, 18 aa, Entamoeba histolytica
CYAHVWDSHIKQFLAEEG

SEQ ID NO: 2579410 - protein, 17 aa, Entamoeba histolytica
CYCGKNKVKIPCYIESA

SEQ ID NO: 2579411 - protein, 21 aa, Entamoeba histolytica
CYDGFKLIMELVHSHIAAVVL

SEQ ID NO: 2579412 - protein, 18 aa, Entamoeba histolytica
CYECSKKLSKCPICRAQI

SEQ ID NO: 2579413 - protein, 25 aa, Entamoeba histolytica
CYENEGKLSFANDILRIIVTTIVSL

SEQ ID NO: 2579414 - protein, 17 aa, Entamoeba histolytica
CYFKEIYASSLKVNELN

SEQ ID NO: 2579415 - protein, 19 aa, Entamoeba histolytica
CYGLAAGLEKVDFTLNDKE

SEQ ID NO: 2579416 - protein, 20 aa, Entamoeba histolytica
CYHSCFLSFSVVSKVITQYD

SEQ ID NO: 2579417 - protein, 25 aa, Entamoeba histolytica
CYILFPEHWSTFLALADMHELLAIY

SEQ ID NO: 2579418 - protein, 24 aa, Entamoeba histolytica
CYIQRGQIELAFKIFKIAADNNNV

SEQ ID NO: 2579419 - protein, 18 aa, Entamoeba histolytica
CYITCLKIYYLNHQLDWF

SEQ ID NO: 2579420 - protein, 20 aa, Entamoeba histolytica
CYKPDMCSSCNTTRYTKDCN

SEQ ID NO: 2579421 - protein, 18 aa, Entamoeba histolytica
CYLGCEYCMKKTIKLLYA

SEQ ID NO: 2579422 - protein, 17 aa, Entamoeba histolytica
CYLIFPIVQTYSIVGDF

SEQ ID NO: 2579423 - protein, 24 aa, Entamoeba histolytica
CYNHNILGHWFRFVGNKTVSYQIK

SEQ ID NO: 2579424 - protein, 25 aa, Entamoeba histolytica
CYNLFSITVVYSWKTPDNSEIFLTT

SEQ ID NO: 2579425 - protein, 17 aa, Entamoeba histolytica
CYNSIRPHWNINTVKLI

SEQ ID NO: 2579426 - protein, 18 aa, Entamoeba histolytica
CYNSYWIVLVCMVIGIII

SEQ ID NO: 2579427 - protein, 19 aa, Entamoeba histolytica
CYPSVTSPSIFCVNSTKEN

SEQ ID NO: 2579428 - protein, 17 aa, Entamoeba histolytica
CYQCKEGYVKENGECKR

SEQ ID NO: 2579429 - protein, 19 aa, Entamoeba histolytica
CYRVKCVDRGYRVNVNGNW

SEQ ID NO: 2579430 - protein, 18 aa, Entamoeba histolytica
CYSCKSGYYKNSTMGCVP

SEQ ID NO: 2579431 - protein, 18 aa, Entamoeba histolytica
CYSDDFYDIFSLVKGNQV

SEQ ID NO: 2579432 - protein, 19 aa, Entamoeba histolytica
CYSGFIGKDSKCFTCMDKF

SEQ ID NO: 2579433 - protein, 18 aa, Entamoeba histolytica
CYSHVWDAHLRHIISFQT

SEQ ID NO: 2579434 - protein, 18 aa, Entamoeba histolytica
CYSHVWDAHLRHLAASPI

SEQ ID NO: 2579435 - protein, 17 aa, Entamoeba histolytica
CYSHVWDAHLRHLNGEK

SEQ ID NO: 2579436 - protein, 18 aa, Entamoeba histolytica
CYSHVWDGHLRHLSNSPL

SEQ ID NO: 2579437 - protein, 19 aa, Entamoeba histolytica
CYVCKDGYFSNGYLNCQPL

SEQ ID NO: 2579438 - protein, 26 aa, Entamoeba histolytica
CYYRQKYRLGKWFRLDMKDIHTDALS

SEQ ID NO: 2579439 - protein, 19 aa, Entamoeba histolytica
DAASSPFIVLFAIIVVILF

SEQ ID NO: 2579440 - protein, 19 aa, Entamoeba histolytica
DACSIKCLSLPLKHDDSSK

SEQ ID NO: 2579441 - protein, 18 aa, Entamoeba histolytica
DAELRSKVLDLRRKRDRL

SEQ ID NO: 2579442 - protein, 22 aa, Entamoeba histolytica
DAKKLAYLYIMNYAKTQQDNAT

SEQ ID NO: 2579443 - protein, 20 aa, Entamoeba histolytica
DAKKTAQLRKIFDCYDTECV

SEQ ID NO: 2579444 - protein, 20 aa, Entamoeba histolytica
DAKNMIGYWILFVVSSVFIG

SEQ ID NO: 2579445 - protein, 18 aa, Entamoeba histolytica
DALFCLRNISPKPVMPSL

SEQ ID NO: 2579446 - protein, 21 aa, Entamoeba histolytica
DALGKWSFLDSYVMILMIMAF

SEQ ID NO: 2579447 - protein, 20 aa, Entamoeba histolytica
DALGKWSMLDSYVMVLMIVA

SEQ ID NO: 2579448 - protein, 26 aa, Entamoeba histolytica
DALGRWSWDVEPIWVESSLKMGSISE

SEQ ID NO: 2579449 - protein, 18 aa, Entamoeba histolytica
DALKRLGQLLALGHFPKH

SEQ ID NO: 2579450 - protein, 17 aa, Entamoeba histolytica
DALRRMGQMLALGNFPQ

SEQ ID NO: 2579451 - protein, 24 aa, Entamoeba histolytica
DANYCLVCGKQVFFENKKKKEEEK

SEQ ID NO: 2579452 - protein, 23 aa, Entamoeba histolytica
DAPKDLVCLSSINDIQCHNNEIQ

SEQ ID NO: 2579453 - protein, 19 aa, Entamoeba histolytica
DAPLLWKGIIFEPRFGITI

SEQ ID NO: 2579454 - protein, 20 aa, Entamoeba histolytica
DARGMCVGEWEDPYDGVDDG

SEQ ID NO: 2579455 - protein, 31 aa, Entamoeba histolytica
DASFKCDVFSFSICLLEIWLTHQPYDPEQFP

SEQ ID NO: 2579456 - protein, 26 aa, Entamoeba histolytica
DASVGYEFVQVCSIYLAIVPKGYTIQ

SEQ ID NO: 2579457 - protein, 18 aa, Entamoeba histolytica
DATSNVFVILSLIITIFF

SEQ ID NO: 2579458 - protein, 20 aa, Entamoeba histolytica
DAVTFCLAGVLAPVMGILTD

SEQ ID NO: 2579459 - protein, 18 aa, Entamoeba histolytica
DAYTNGRYMYITADKKSQ

SEQ ID NO: 2579460 - protein, 25 aa, Entamoeba histolytica
DCEKYHRLYHCLAYDLSCDYFNETI

SEQ ID NO: 2579461 - protein, 19 aa, Entamoeba histolytica
DCHKLCYYNNQWQVENHNG

SEQ ID NO: 2579462 - protein, 18 aa, Entamoeba histolytica
DCHSCGNGYHIEGFMNCV

SEQ ID NO: 2579463 - protein, 18 aa, Entamoeba histolytica
DCIFKTLIEQSWKHNPSE

SEQ ID NO: 2579464 - protein, 25 aa, Entamoeba histolytica
DCISCDINTCLKCKTNKLLNGKCII

SEQ ID NO: 2579465 - protein, 17 aa, Entamoeba histolytica
DCISKCNDTVIFSKKEK

SEQ ID NO: 2579466 - protein, 19 aa, Entamoeba histolytica
DCLSMVFMFASYRVSKGEK

SEQ ID NO: 2579467 - protein, 20 aa, Entamoeba histolytica
DCPLGKYGIEITIQQLRRIN

SEQ ID NO: 2579468 - protein, 19 aa, Entamoeba histolytica
DCPRKFHVPNVDTYKQLGH

SEQ ID NO: 2579469 - protein, 18 aa, Entamoeba histolytica
DCSDGDLHSFILCSECAE

SEQ ID NO: 2579470 - protein, 19 aa, Entamoeba histolytica
DCSELCYYNGKWRSDINPS

SEQ ID NO: 2579471 - protein, 26 aa, Entamoeba histolytica
DCSIDLHSWIFLPLFIPDESFDNSKY

SEQ ID NO: 2579472 - protein, 18 aa, Entamoeba histolytica
DCSRLCYYDGKFNTTQEN

SEQ ID NO: 2579473 - protein, 18 aa, Entamoeba histolytica
DCSSSFLNFIIKTLPMIK

SEQ ID NO: 2579474 - protein, 27 aa, Entamoeba histolytica
DCTLISSLLLNFTKGVSFYFEQEPNSQ

SEQ ID NO: 2579475 - protein, 19 aa, Entamoeba histolytica
DCVYREIIKQCWRQKPERR

SEQ ID NO: 2579476 - protein, 24 aa, Entamoeba histolytica
DDALQRMFWMFCAPREVQLVDNII

SEQ ID NO: 2579477 - protein, 20 aa, Entamoeba histolytica
DDCHKLCYYNGNWQVNDYSS

SEQ ID NO: 2579478 - protein, 22 aa, Entamoeba histolytica
DDCIKGWYVYQAQCWECPSNCT

SEQ ID NO: 2579479 - protein, 22 aa, Entamoeba histolytica
DDCRKLCYYNGKFYNGNTTVNG

SEQ ID NO: 2579480 - protein, 18 aa, Entamoeba histolytica
DDCTCSENYILSGHHCVS

SEQ ID NO: 2579481 - protein, 19 aa, Entamoeba histolytica
DDFYDIFSLVKGNQVDIAP

SEQ ID NO: 2579482 - protein, 24 aa, Entamoeba histolytica
DDGEIEWVYYFRKYNSEFFYPNEV

SEQ ID NO: 2579483 - protein, 26 aa, Entamoeba histolytica
DDGKWSNQCVAAYCDKGYKFDFYNQK

SEQ ID NO: 2579484 - protein, 25 aa, Entamoeba histolytica
DDGLRMGLIILCVFAVFQCLSVFIF

SEQ ID NO: 2579485 - protein, 17 aa, Entamoeba histolytica
DDGYFLQEGLCITCDER

SEQ ID NO: 2579486 - protein, 21 aa, Entamoeba histolytica
DDIKCSFSHKPECADIPPKKA

SEQ ID NO: 2579487 - protein, 23 aa, Entamoeba histolytica
DDIKRLCEDYMIKLIDKYPPTKI

SEQ ID NO: 2579488 - protein, 19 aa, Entamoeba histolytica
DDILSFLFTIFAHSQLIPL

SEQ ID NO: 2579489 - protein, 17 aa, Entamoeba histolytica
DDIPILVACASFCLVMA

SEQ ID NO: 2579490 - protein, 23 aa, Entamoeba histolytica
DDIQSSFGIRRRIVRDYRFKERY

SEQ ID NO: 2579491 - protein, 24 aa, Entamoeba histolytica
DDIQSSFGIRRRIVRDYRFKERYE

SEQ ID NO: 2579492 - protein, 21 aa, Entamoeba histolytica
DDKRLLVCASTNPERTNVLGV

SEQ ID NO: 2579493 - protein, 19 aa, Entamoeba histolytica
DDKTRFGFIAQELKEVIPE

SEQ ID NO: 2579494 - protein, 17 aa, Entamoeba histolytica
DDLKLLVRLLIHFISVM

SEQ ID NO: 2579495 - protein, 18 aa, Entamoeba histolytica
DDLYIFFEGLDVYNIYAI

SEQ ID NO: 2579496 - protein, 24 aa, Entamoeba histolytica
DDMCYKPVFGKGCIITSVTGYWQH

SEQ ID NO: 2579497 - protein, 18 aa, Entamoeba histolytica
DDQIKGILMKSLKTFDGK

SEQ ID NO: 2579498 - protein, 23 aa, Entamoeba histolytica
DDRTSSIVFKKKFESDICGISLK

SEQ ID NO: 2579499 - protein, 23 aa, Entamoeba histolytica
DDRVLICRKGVLLIQQEGKNFDD

SEQ ID NO: 2579500 - protein, 20 aa, Entamoeba histolytica
DDSFYILVGMIFFISLLLIF

SEQ ID NO: 2579501 - protein, 22 aa, Entamoeba histolytica
DDTSRFCLINGPNMGGKSTYIR

SEQ ID NO: 2579502 - protein, 23 aa, Entamoeba histolytica
DDVVCPKQPFNLRGVNVVLVPKK

SEQ ID NO: 2579503 - protein, 21 aa, Entamoeba histolytica
DDWVMTCFNTFFTSLPPAAIA

SEQ ID NO: 2579504 - protein, 20 aa, Entamoeba histolytica
DDYDLLSWNRRGCPCDGSQC

SEQ ID NO: 2579505 - protein, 22 aa, Entamoeba histolytica
DECITRYPLFIQTLISGISQEK

SEQ ID NO: 2579506 - protein, 19 aa, Entamoeba histolytica
DEDFERCSILGSQHITLPV

SEQ ID NO: 2579507 - protein, 17 aa, Entamoeba histolytica
DEECLRGSEGCLANCQC

SEQ ID NO: 2579508 - protein, 18 aa, Entamoeba histolytica
DEEKLRLVNSIQKEIQSV

SEQ ID NO: 2579509 - protein, 21 aa, Entamoeba histolytica
DEFIADILLVRKSFDHTHNIF

SEQ ID NO: 2579510 - protein, 21 aa, Entamoeba histolytica
DEFKKLISMFCHSIEIRKGNE

SEQ ID NO: 2579511 - protein, 17 aa, Entamoeba histolytica
DEFLEDIELTFKMICHN

SEQ ID NO: 2579512 - protein, 20 aa, Entamoeba histolytica
DEFSMLFSVVGIFFGVSNSF

SEQ ID NO: 2579513 - protein, 20 aa, Entamoeba histolytica
DEGYENFSWYHKNDSFLIVQ

SEQ ID NO: 2579514 - protein, 17 aa, Entamoeba histolytica
DEIELLLEIAVENITNL

SEQ ID NO: 2579515 - protein, 21 aa, Entamoeba histolytica
DEIHIGAPVRSRLNKPKISRN

SEQ ID NO: 2579516 - protein, 26 aa, Entamoeba histolytica
DEIKELKELWILPVACLIHGILEFFI

SEQ ID NO: 2579517 - protein, 25 aa, Entamoeba histolytica
DEKKRLPHFFQILSLTPIGRGILKD

SEQ ID NO: 2579518 - protein, 22 aa, Entamoeba histolytica
DEKRICERIGFNKHYCYNNNNN

SEQ ID NO: 2579519 - protein, 25 aa, Entamoeba histolytica
DELFRIDVVITKSCPYIGTDLQKSP

SEQ ID NO: 2579520 - protein, 22 aa, Entamoeba histolytica
DELKLFCSRMIETYSNNPEFSR

SEQ ID NO: 2579521 - protein, 17 aa, Entamoeba histolytica
DENKDIIGYFITNEENV

SEQ ID NO: 2579522 - protein, 18 aa, Entamoeba histolytica
DESWELMNNYYPFIHQIS

SEQ ID NO: 2579523 - protein, 24 aa, Entamoeba histolytica
DETYFWARYFKLLFLKSNKLGEYS

SEQ ID NO: 2579524 - protein, 23 aa, Entamoeba histolytica
DEVFIRNNFHSIVAITILLNAFI

SEQ ID NO: 2579525 - protein, 20 aa, Entamoeba histolytica
DEVISMFKRLIVELPNKEET

SEQ ID NO: 2579526 - protein, 28 aa, Entamoeba histolytica
DEWMIRPYSKYVICWFGLDTLQLLNFSI

SEQ ID NO: 2579527 - protein, 17 aa, Entamoeba histolytica
DEYKYRSLLPMIGNTKI

SEQ ID NO: 2579528 - protein, 34 aa, Entamoeba histolytica
DEYRKRAHLYNEKWRKTNVNGHWSGKQFDNNRDN

SEQ ID NO: 2579529 - protein, 17 aa, Entamoeba histolytica
DEYYIWGTINYYKDILI

SEQ ID NO: 2579530 - protein, 23 aa, Entamoeba histolytica
DFCCYAVLRPLYAVLGISQNKGN

SEQ ID NO: 2579531 - protein, 25 aa, Entamoeba histolytica
DFCLSCIYGQCEICDEKAGMLISCG

SEQ ID NO: 2579532 - protein, 26 aa, Entamoeba histolytica
DFESECIRWLGAFRFILWTLWYCVTL

SEQ ID NO: 2579533 - protein, 29 aa, Entamoeba histolytica
DFEVICFNPDLTIRWRQNYYKSKAKAYVQ

SEQ ID NO: 2579534 - protein, 25 aa, Entamoeba histolytica
DFFSGEILNCIGILFNSLQDIDVSP

SEQ ID NO: 2579535 - protein, 17 aa, Entamoeba histolytica
DFGEEWRNKNHIDPHHL

SEQ ID NO: 2579536 - protein, 26 aa, Entamoeba histolytica
DFHVSCLKGWLARASDCPICRNPINL

SEQ ID NO: 2579537 - protein, 18 aa, Entamoeba histolytica
DFIKEVYYHSTLIADEKE

SEQ ID NO: 2579538 - protein, 19 aa, Entamoeba histolytica
DFIKLSYKLKIKMLFDTAR

SEQ ID NO: 2579539 - protein, 22 aa, Entamoeba histolytica
DFINVICTFSRFGQTPEVNETG

SEQ ID NO: 2579540 - protein, 21 aa, Entamoeba histolytica
DFIRLTQWATRTMKIRPSLVY

SEQ ID NO: 2579541 - protein, 24 aa, Entamoeba histolytica
DFKNVRLDLFIKNVLEHFDIIFLQ

SEQ ID NO: 2579542 - protein, 27 aa, Entamoeba histolytica
DFLDIRWRYKLILSFCSSALIVIIYPG

SEQ ID NO: 2579543 - protein, 20 aa, Entamoeba histolytica
DFLSGCFQYDPKLRFTPKQA

SEQ ID NO: 2579544 - protein, 18 aa, Entamoeba histolytica
DFMYAVLPFIPDIVDNEV

SEQ ID NO: 2579545 - protein, 18 aa, Entamoeba histolytica
DFQCNLNAILILPVQHGA

SEQ ID NO: 2579546 - protein, 30 aa, Entamoeba histolytica
DFQKSLYLMDEFKSVLYYKGETSQRENEIV

SEQ ID NO: 2579547 - protein, 19 aa, Entamoeba histolytica
DFSLKCPFFPEKSLETLKD

SEQ ID NO: 2579548 - protein, 20 aa, Entamoeba histolytica
DFSLKCPFFPEKSLETLKDY

SEQ ID NO: 2579549 - protein, 23 aa, Entamoeba histolytica
DFSLRITANYSFVYFPSQTNNIN

SEQ ID NO: 2579550 - protein, 18 aa, Entamoeba histolytica
DFTFIRKLIRSIKRNVIF

SEQ ID NO: 2579551 - protein, 22 aa, Entamoeba histolytica
DFTVPLCCSILNTVGTVSYKDV

SEQ ID NO: 2579552 - protein, 17 aa, Entamoeba histolytica
DFVEKVVTSTGTNKITF

SEQ ID NO: 2579553 - protein, 18 aa, Entamoeba histolytica
DFVFKSKWFRIINLYSST

SEQ ID NO: 2579554 - protein, 25 aa, Entamoeba histolytica
DFVSLIFYCFFKILFYSLICDVLQQ

SEQ ID NO: 2579555 - protein, 22 aa, Entamoeba histolytica
DFWVGDWWGIWSTSAYLEQGLR

SEQ ID NO: 2579556 - protein, 23 aa, Entamoeba histolytica
DGDSEICLRRGMCQPIGGQSLVG

SEQ ID NO: 2579557 - protein, 23 aa, Entamoeba histolytica
DGERIINLLFNYGLIPKVQIILE

SEQ ID NO: 2579558 - protein, 19 aa, Entamoeba histolytica
DGGDGCYQCECQSGWYPHG

SEQ ID NO: 2579559 - protein, 19 aa, Entamoeba histolytica
DGGKGCIECECQPGWYSKH

SEQ ID NO: 2579560 - protein, 19 aa, Entamoeba histolytica
DGGNGCIECECQPGWYSQN

SEQ ID NO: 2579561 - protein, 23 aa, Entamoeba histolytica
DGGTGCYECKCENGWYNVDKLYC

SEQ ID NO: 2579562 - protein, 26 aa, Entamoeba histolytica
DGICRYQKCYLFYTTIGLFLLFAYTG

SEQ ID NO: 2579563 - protein, 19 aa, Entamoeba histolytica
DGIDACFQLVSSMGQNLIT

SEQ ID NO: 2579564 - protein, 17 aa, Entamoeba histolytica
DGIIIDKIKGCFNIFTA

SEQ ID NO: 2579565 - protein, 23 aa, Entamoeba histolytica
DGIKCLRCKRGYYPSGKGCIKCD

SEQ ID NO: 2579566 - protein, 18 aa, Entamoeba histolytica
DGIKGCGSDCQCAKGYSS

SEQ ID NO: 2579567 - protein, 24 aa, Entamoeba histolytica
DGIMKYRNYWNIPLVSNQQDKINR

SEQ ID NO: 2579568 - protein, 20 aa, Entamoeba histolytica
DGKCVIKCPKYCKTCERETL

SEQ ID NO: 2579569 - protein, 21 aa, Entamoeba histolytica
DGKWRLLVYALQYVIVPLIRV

SEQ ID NO: 2579570 - protein, 26 aa, Entamoeba histolytica
DGLDEMKLVGLLLVYGIVHNKKAILE

SEQ ID NO: 2579571 - protein, 22 aa, Entamoeba histolytica
DGLLRKLGWLTFLDVLPLPITP

SEQ ID NO: 2579572 - protein, 25 aa, Entamoeba histolytica
DGMCCSELKEFCAIINEHEELIKLY

SEQ ID NO: 2579573 - protein, 20 aa, Entamoeba histolytica
DGSCGIPHCQIEEDGKCSLC

SEQ ID NO: 2579574 - protein, 26 aa, Entamoeba histolytica
DGSCSKCSESNCIVCKDNDGTCIECT

SEQ ID NO: 2579575 - protein, 25 aa, Entamoeba histolytica
DGSQCTKCRCSVCDKKEGCYIGCDP

SEQ ID NO: 2579576 - protein, 26 aa, Entamoeba histolytica
DGSRLLWRYLTSWELFAMKNPMSEMF

SEQ ID NO: 2579577 - protein, 25 aa, Entamoeba histolytica
DGTCTACAYGSYSKGETSVCEICKN

SEQ ID NO: 2579578 - protein, 20 aa, Entamoeba histolytica
DGYISIALVYGFCGIGQFVS

SEQ ID NO: 2579579 - protein, 24 aa, Entamoeba histolytica
DGYTGWRICLTIEPQEIIIKHIKG

SEQ ID NO: 2579580 - protein, 24 aa, Entamoeba histolytica
DHGLCPKYKLTEGFDENDYYGIQI

SEQ ID NO: 2579581 - protein, 19 aa, Entamoeba histolytica
DHHCPWIGQCVGFKNHKYF

SEQ ID NO: 2579582 - protein, 20 aa, Entamoeba histolytica
DHHCPWVGNCIGRRNYRIFY

SEQ ID NO: 2579583 - protein, 18 aa, Entamoeba histolytica
DHHCPWVSNCIGKNNMKF

SEQ ID NO: 2579584 - protein, 28 aa, Entamoeba histolytica
DHSFRPREFFNITVLLRLSKALDIQIAI

SEQ ID NO: 2579585 - protein, 25 aa, Entamoeba histolytica
DHSNKCGICYEVVGPKGTVRFRADN

SEQ ID NO: 2579586 - protein, 18 aa, Entamoeba histolytica
DIAGLYGCIAHNFEQYNK

SEQ ID NO: 2579587 - protein, 27 aa, Entamoeba histolytica
DIAKFFRIVISDGFFIGYGMTETTGMG

SEQ ID NO: 2579588 - protein, 21 aa, Entamoeba histolytica
DICAKCSSLTCPADTTYRTYT

SEQ ID NO: 2579589 - protein, 17 aa, Entamoeba histolytica
DICSYLRDFIVRFRVSL

SEQ ID NO: 2579590 - protein, 21 aa, Entamoeba histolytica
DIDCCNSCIKNCHEGHDTIYL

SEQ ID NO: 2579591 - protein, 26 aa, Entamoeba histolytica
DIDEIRFNSFWNYKKFEIKMCDGTGH

SEQ ID NO: 2579592 - protein, 18 aa, Entamoeba histolytica
DIDHCLDEQLPLIYNDLV

SEQ ID NO: 2579593 - protein, 20 aa, Entamoeba histolytica
DIDIVICNCSLFNPTPSISA

SEQ ID NO: 2579594 - protein, 17 aa, Entamoeba histolytica
DIDVVFRAICPHDCNHK

SEQ ID NO: 2579595 - protein, 25 aa, Entamoeba histolytica
DIEQELKDVGLYDLFSKKDSNSELD

SEQ ID NO: 2579596 - protein, 24 aa, Entamoeba histolytica
DIEQELKDVGLYDLFSKKESIHEN

SEQ ID NO: 2579597 - protein, 25 aa, Entamoeba histolytica
DIEQELKDVGLYDLFSKKESIHEND

SEQ ID NO: 2579598 - protein, 17 aa, Entamoeba histolytica
DIESFYFTSWQPSKRRR

SEQ ID NO: 2579599 - protein, 17 aa, Entamoeba histolytica
DIFMYFVFSQSRQKLSL

SEQ ID NO: 2579600 - protein, 25 aa, Entamoeba histolytica
DIFNYEIVNEIAFWYYQQLFEEKCY

SEQ ID NO: 2579601 - protein, 18 aa, Entamoeba histolytica
DIFPVVLHPSIIKMKENA

SEQ ID NO: 2579602 - protein, 25 aa, Entamoeba histolytica
DIGQLVCLQCGNIITAYSLKIDKEF

SEQ ID NO: 2579603 - protein, 22 aa, Entamoeba histolytica
DIHIRYCAFEMLKVYEHELTAL

SEQ ID NO: 2579604 - protein, 20 aa, Entamoeba histolytica
DIIACWYYDKFLFIGVYVLF

SEQ ID NO: 2579605 - protein, 22 aa, Entamoeba histolytica
DIIEIMSTVGFGFGIGLYFSWK

SEQ ID NO: 2579606 - protein, 20 aa, Entamoeba histolytica
DIIGMRFDKFHSVCENLTLV

SEQ ID NO: 2579607 - protein, 25 aa, Entamoeba histolytica
DIIIKICVIMGTALIQLIVKRIYLR

SEQ ID NO: 2579608 - protein, 18 aa, Entamoeba histolytica
DIIKGYKLIMKHIEEDLD

SEQ ID NO: 2579609 - protein, 20 aa, Entamoeba histolytica
DIIKQLKKFIVILLSINIVL

SEQ ID NO: 2579610 - protein, 25 aa, Entamoeba histolytica
DIITLCIGIAFFLFSLHVTIFHVQY

SEQ ID NO: 2579611 - protein, 24 aa, Entamoeba histolytica
DIKEFKRLGLRKIKHNKKVVSSSY

SEQ ID NO: 2579612 - protein, 17 aa, Entamoeba histolytica
DIKFEVQYLNFWVEPSK

SEQ ID NO: 2579613 - protein, 18 aa, Entamoeba histolytica
DIKSRIKCGTYIVANAFK

SEQ ID NO: 2579614 - protein, 25 aa, Entamoeba histolytica
DIKSSLKMKVIRKMKIYNPSLNDNV

SEQ ID NO: 2579615 - protein, 24 aa, Entamoeba histolytica
DILCTRIKLNSGIFNEEQFKYIVE

SEQ ID NO: 2579616 - protein, 24 aa, Entamoeba histolytica
DILCTRIKLNSGIFNEEQFTSIVE

SEQ ID NO: 2579617 - protein, 19 aa, Entamoeba histolytica
DILLSMGLEEAIVFNQTFN

SEQ ID NO: 2579618 - protein, 23 aa, Entamoeba histolytica
DILSCVICSVIVIILVLIIFNSM

SEQ ID NO: 2579619 - protein, 17 aa, Entamoeba histolytica
DILSSLYSHQINKLPTK

SEQ ID NO: 2579620 - protein, 23 aa, Entamoeba histolytica
DILSVIYLCYAYVSWSSERSLSR

SEQ ID NO: 2579621 - protein, 27 aa, Entamoeba histolytica
DINCKAMAILAFCNFFSVCEQDQFEKL

SEQ ID NO: 2579622 - protein, 29 aa, Entamoeba histolytica
DINIYRLSFVMVMNFCYFLFELIIGLYLN

SEQ ID NO: 2579623 - protein, 25 aa, Entamoeba histolytica
DINNIIKTLCYWRNEKIIHQHHLLI

SEQ ID NO: 2579624 - protein, 25 aa, Entamoeba histolytica
DINPMRYWRIGVLFGGTIYVIILLI

SEQ ID NO: 2579625 - protein, 17 aa, Entamoeba histolytica
DIPDVWPTGKPSCISYH

SEQ ID NO: 2579626 - protein, 26 aa, Entamoeba histolytica
DIQFGENGERVMGNKGYVSIKYPMLI

SEQ ID NO: 2579627 - protein, 19 aa, Entamoeba histolytica
DIQKAFIISVVVGMEENSS

SEQ ID NO: 2579628 - protein, 18 aa, Entamoeba histolytica
DIQLRYLIKKVTLEEEKV

SEQ ID NO: 2579629 - protein, 18 aa, Entamoeba histolytica
DIQTITIIFKIGMEERFE

SEQ ID NO: 2579630 - protein, 20 aa, Entamoeba histolytica
DIRLLVSLSKIKSRVGSLAR

SEQ ID NO: 2579631 - protein, 26 aa, Entamoeba histolytica
DISLKKRITSLIQWYPKEMQCVESPD

SEQ ID NO: 2579632 - protein, 23 aa, Entamoeba histolytica
DITEVLKMKLVFIQENLLIVPPL

SEQ ID NO: 2579633 - protein, 24 aa, Entamoeba histolytica
DITFYKWVRDMFGYKRNPEHKKET

SEQ ID NO: 2579634 - protein, 24 aa, Entamoeba histolytica
DITRSLPLYLSIFIFGESSNEELR

SEQ ID NO: 2579635 - protein, 28 aa, Entamoeba histolytica
DITVFGFRGSYEFSDWVYDFKLFTESAL

SEQ ID NO: 2579636 - protein, 19 aa, Entamoeba histolytica
DIVRIWKYLWKFIDISVDI

SEQ ID NO: 2579637 - protein, 24 aa, Entamoeba histolytica
DIYAYGIILWEMITREKPFVGCKF

SEQ ID NO: 2579638 - protein, 25 aa, Entamoeba histolytica
DIYCPSCLEKGVFHIVNQESLKKGI

SEQ ID NO: 2579639 - protein, 29 aa, Entamoeba histolytica
DIYLGAIIIICLVFRFFITKYRLIILRRY

SEQ ID NO: 2579640 - protein, 19 aa, Entamoeba histolytica
DIYSFAVTMLQCFTWEDPF

SEQ ID NO: 2579641 - protein, 19 aa, Entamoeba histolytica
DIYSLAIVIVEAFDRKCPY

SEQ ID NO: 2579642 - protein, 29 aa, Entamoeba histolytica
DKAWECDKCSVGFMYQCGAVSTFIVSALF

SEQ ID NO: 2579643 - protein, 21 aa, Entamoeba histolytica
DKCGKCPLGKYFDIETFSCKE

SEQ ID NO: 2579644 - protein, 22 aa, Entamoeba histolytica
DKCITCADGYFMSWIGECKLTT

SEQ ID NO: 2579645 - protein, 33 aa, Entamoeba histolytica
DKCKKICCCKNCKRILECIVHHIGITVLFFDVI

SEQ ID NO: 2579646 - protein, 25 aa, Entamoeba histolytica
DKCTFKFGRRRIFLVVGAIIDILGL

SEQ ID NO: 2579647 - protein, 21 aa, Entamoeba histolytica
DKCTTCADGYFMNWIGECKSI

SEQ ID NO: 2579648 - protein, 22 aa, Entamoeba histolytica
DKCTTCADGYFMSWIGECKSID

SEQ ID NO: 2579649 - protein, 27 aa, Entamoeba histolytica
DKCVTLKIWDMFLLEGFVWLVKVSSAL

SEQ ID NO: 2579650 - protein, 18 aa, Entamoeba histolytica
DKCYCVGVVYISEDTLTI

SEQ ID NO: 2579651 - protein, 24 aa, Entamoeba histolytica
DKDMMMNVMILKTFYPVEEVMNFG

SEQ ID NO: 2579652 - protein, 24 aa, Entamoeba histolytica
DKDNSLWAILFVYRNADAKQNTMR

SEQ ID NO: 2579653 - protein, 18 aa, Entamoeba histolytica
DKEFPRKEVRQMFEEDQY

SEQ ID NO: 2579654 - protein, 18 aa, Entamoeba histolytica
DKEICVVLGSGGHTMEML

SEQ ID NO: 2579655 - protein, 30 aa, Entamoeba histolytica
DKEIIRYLIRNCGDRELFIWYCETNNDMVG

SEQ ID NO: 2579656 - protein, 25 aa, Entamoeba histolytica
DKELEACWKKLALLILTRKGEKSEE

SEQ ID NO: 2579657 - protein, 31 aa, Entamoeba histolytica
DKEYTFFFCFLKFIPCYSILGCICSIICDYC

SEQ ID NO: 2579658 - protein, 26 aa, Entamoeba histolytica
DKFIVWGCIAFCFIMAASFPLVHFAQ

SEQ ID NO: 2579659 - protein, 18 aa, Entamoeba histolytica
DKFKHLYDFNLIEAVDNR

SEQ ID NO: 2579660 - protein, 19 aa, Entamoeba histolytica
DKHAVWWIILIIVILLLIL

SEQ ID NO: 2579661 - protein, 23 aa, Entamoeba histolytica
DKIEATGVNWVWFTLYQTNSAFN

SEQ ID NO: 2579662 - protein, 17 aa, Entamoeba histolytica
DKIFISSSIPLILSPIS

SEQ ID NO: 2579663 - protein, 20 aa, Entamoeba histolytica
DKIKKICERYMIKLVDKTQG

SEQ ID NO: 2579664 - protein, 30 aa, Entamoeba histolytica
DKILKFHSFLYFPRELKLSIIGNKTTYNRD

SEQ ID NO: 2579665 - protein, 19 aa, Entamoeba histolytica
DKIMRFTLCPINKKELEDS

SEQ ID NO: 2579666 - protein, 23 aa, Entamoeba histolytica
DKIQWRTLMELSTKWRQISEPND

SEQ ID NO: 2579667 - protein, 22 aa, Entamoeba histolytica
DKKECILCSSIISSCEQCNLNE

SEQ ID NO: 2579668 - protein, 24 aa, Entamoeba histolytica
DKKRCSLCPDPFTECLTSKTPVPG

SEQ ID NO: 2579669 - protein, 24 aa, Entamoeba histolytica
DKKRCSLCPDPFTECLTSQTPVPG

SEQ ID NO: 2579670 - protein, 19 aa, Entamoeba histolytica
DKKRLHLDTTFKSVMVYVY

SEQ ID NO: 2579671 - protein, 25 aa, Entamoeba histolytica
DKKSDCLCTLKGDILKLEESSWTGA

SEQ ID NO: 2579672 - protein, 20 aa, Entamoeba histolytica
DKLFELFSILPSYSFSIYLY

SEQ ID NO: 2579673 - protein, 19 aa, Entamoeba histolytica
DKLFKESRIKEENCGGTKS

SEQ ID NO: 2579674 - protein, 24 aa, Entamoeba histolytica
DKLLKCISYFLPFISDKNILKDKQ

SEQ ID NO: 2579675 - protein, 18 aa, Entamoeba histolytica
DKLLMSDFWDCCEVNSLE

SEQ ID NO: 2579676 - protein, 19 aa, Entamoeba histolytica
DKLNWRKMLQECFKTLWEF

SEQ ID NO: 2579677 - protein, 18 aa, Entamoeba histolytica
DKMCSPCLSGCQICTDPN

SEQ ID NO: 2579678 - protein, 18 aa, Entamoeba histolytica
DKNDCILRSSSLDLDIEI

SEQ ID NO: 2579679 - protein, 20 aa, Entamoeba histolytica
DKSLQEFFAKVLKTFESFSP

SEQ ID NO: 2579680 - protein, 20 aa, Entamoeba histolytica
DKSLSQPVEGNSSPVTPKPA

SEQ ID NO: 2579681 - protein, 22 aa, Entamoeba histolytica
DKSRFRYPWDIATFVTKGLRLE

SEQ ID NO: 2579682 - protein, 17 aa, Entamoeba histolytica
DKTGGLKFVGRFLLPDT

SEQ ID NO: 2579683 - protein, 20 aa, Entamoeba histolytica
DKTLPCHDLGHYVARLRTII

SEQ ID NO: 2579684 - protein, 19 aa, Entamoeba histolytica
DKVNCLYRNGGLSEYILSP

SEQ ID NO: 2579685 - protein, 19 aa, Entamoeba histolytica
DKWRGEILCELACILQALS

SEQ ID NO: 2579686 - protein, 25 aa, Entamoeba histolytica
DKYKWKEMFLNFDLIQKLWKITGII

SEQ ID NO: 2579687 - protein, 20 aa, Entamoeba histolytica
DKYTPLWIRNEFKERYPDVR

SEQ ID NO: 2579688 - protein, 23 aa, Entamoeba histolytica
DLAKECNKLGASEFYMKSENKVG

SEQ ID NO: 2579689 - protein, 18 aa, Entamoeba histolytica
DLCEWKTSVCMKCVDGYQ

SEQ ID NO: 2579690 - protein, 21 aa, Entamoeba histolytica
DLCMKEEIFGPILPVIEYDTL

SEQ ID NO: 2579691 - protein, 21 aa, Entamoeba histolytica
DLCMRSEAVPGYFEEYQGYLS

SEQ ID NO: 2579692 - protein, 21 aa, Entamoeba histolytica
DLCPIPKTLILEGYEAELKEN

SEQ ID NO: 2579693 - protein, 26 aa, Entamoeba histolytica
DLCPSYCTSCFYGFCSSCEDGFFPMG

SEQ ID NO: 2579694 - protein, 19 aa, Entamoeba histolytica
DLDQEYARLRSENQHMLEE

SEQ ID NO: 2579695 - protein, 17 aa, Entamoeba histolytica
DLECFRGTEGCLENCYC

SEQ ID NO: 2579696 - protein, 18 aa, Entamoeba histolytica
DLEEIFGIDINIKEVKKK

SEQ ID NO: 2579697 - protein, 24 aa, Entamoeba histolytica
DLEIIVKTLMEWYYIISTHYQFKD

SEQ ID NO: 2579698 - protein, 23 aa, Entamoeba histolytica
DLEKRIFDGLTFAFIEQTSGDEN

SEQ ID NO: 2579699 - protein, 26 aa, Entamoeba histolytica
DLFIRDWKKYYPAKVMLHSCKTVTDI

SEQ ID NO: 2579700 - protein, 18 aa, Entamoeba histolytica
DLHFKAICIDSCNRESKL

SEQ ID NO: 2579701 - protein, 28 aa, Entamoeba histolytica
DLHRYFRLFPRMYLLVNSFYSIFDDTVS

SEQ ID NO: 2579702 - protein, 21 aa, Entamoeba histolytica
DLICKAIGSPVYISSNLPSIP

SEQ ID NO: 2579703 - protein, 21 aa, Entamoeba histolytica
DLIKPTKCYLRPEEMIISDHF

SEQ ID NO: 2579704 - protein, 24 aa, Entamoeba histolytica
DLIKSKFKPLIPVLTLKSEVDCSV

SEQ ID NO: 2579705 - protein, 26 aa, Entamoeba histolytica
DLILCCCGGLLLLIFIAYIALIVIGL

SEQ ID NO: 2579706 - protein, 21 aa, Entamoeba histolytica
DLITNCWNQDPSARWTFQQID

SEQ ID NO: 2579707 - protein, 17 aa, Entamoeba histolytica
DLIYKLSQYLSVQLKQM

SEQ ID NO: 2579708 - protein, 20 aa, Entamoeba histolytica
DLKGSCSPCIDNCRYCANST

SEQ ID NO: 2579709 - protein, 23 aa, Entamoeba histolytica
DLKKTLLPWSCFVKVAHDMKLKT

SEQ ID NO: 2579710 - protein, 29 aa, Entamoeba histolytica
DLKRTMWWKNMKLWLIIGGVVAVIVIVII

SEQ ID NO: 2579711 - protein, 25 aa, Entamoeba histolytica
DLKSSGICALVFLIIGLVFSFICAL

SEQ ID NO: 2579712 - protein, 25 aa, Entamoeba histolytica
DLLKQLRPGMDLGRISFPSHILEPR

SEQ ID NO: 2579713 - protein, 18 aa, Entamoeba histolytica
DLLVYSFGFFTKRIYMKQ

SEQ ID NO: 2579714 - protein, 19 aa, Entamoeba histolytica
DLNIKWLRNQIGLVGQEPI

SEQ ID NO: 2579715 - protein, 17 aa, Entamoeba histolytica
DLNKCYIGFSSIKRNIA

SEQ ID NO: 2579716 - protein, 22 aa, Entamoeba histolytica
DLNRGETVFIFVGGETAKDVGF

SEQ ID NO: 2579717 - protein, 25 aa, Entamoeba histolytica
DLNSNPLQITFKWSDTFKKDNSSSS

SEQ ID NO: 2579718 - protein, 26 aa, Entamoeba histolytica
DLQIPKRGIIKWGPLLSITNAITNLL

SEQ ID NO: 2579719 - protein, 26 aa, Entamoeba histolytica
DLQKKWLVTYSIYWLPYVNLAQDYTP

SEQ ID NO: 2579720 - protein, 17 aa, Entamoeba histolytica
DLRDILRSFAILLPKTG

SEQ ID NO: 2579721 - protein, 22 aa, Entamoeba histolytica
DLRTRHCFGGFLTIICVVIIIV

SEQ ID NO: 2579722 - protein, 18 aa, Entamoeba histolytica
DLVCYKCNATYFLSIDQK

SEQ ID NO: 2579723 - protein, 18 aa, Entamoeba histolytica
DLVDLGELLPNFMQEAEM

SEQ ID NO: 2579724 - protein, 27 aa, Entamoeba histolytica
DLVGKWGWRLKEIRNQNDIKEWKEIEK

SEQ ID NO: 2579725 - protein, 20 aa, Entamoeba histolytica
DLVHCILGIYALTLIASTAH

SEQ ID NO: 2579726 - protein, 25 aa, Entamoeba histolytica
DLVHFLPCILQRCIDVLNDRKREEI

SEQ ID NO: 2579727 - protein, 18 aa, Entamoeba histolytica
DMIHPLEYLTFMLQLFVT

SEQ ID NO: 2579728 - protein, 19 aa, Entamoeba histolytica
DMINLYGADALRLSLINSP

SEQ ID NO: 2579729 - protein, 17 aa, Entamoeba histolytica
DMLKDKYPLVSYQTQLT

SEQ ID NO: 2579730 - protein, 23 aa, Entamoeba histolytica
DMLKEKDIRIIASHGGGPILGIK

SEQ ID NO: 2579731 - protein, 19 aa, Entamoeba histolytica
DMRFFRWKLYTKINGLINK

SEQ ID NO: 2579732 - protein, 29 aa, Entamoeba histolytica
DMYCNVPLFKEMLLPALKYGCTLLLPHTI

SEQ ID NO: 2579733 - protein, 17 aa, Entamoeba histolytica
DMYCYFRIEESDDQYKF

SEQ ID NO: 2579734 - protein, 24 aa, Entamoeba histolytica
DMYIYRRVRINYPFIFDMQKRKYN

SEQ ID NO: 2579735 - protein, 21 aa, Entamoeba histolytica
DNAFCSYCFKCKRGCEACDEE

SEQ ID NO: 2579736 - protein, 25 aa, Entamoeba histolytica
DNAFCSYCYRLLTVIECKRGCEACD

SEQ ID NO: 2579737 - protein, 25 aa, Entamoeba histolytica
DNARFRIGNFHFFKTILSEEMIKFI

SEQ ID NO: 2579738 - protein, 21 aa, Entamoeba histolytica
DNARNIWAYEYLKDLPNEYDR

SEQ ID NO: 2579739 - protein, 30 aa, Entamoeba histolytica
DNCISCSVKHCIICTAEVCYNCQEGYVLNN

SEQ ID NO: 2579740 - protein, 23 aa, Entamoeba histolytica
DNCKTCFGSAIYCMSCSSDKYLS

SEQ ID NO: 2579741 - protein, 18 aa, Entamoeba histolytica
DNDLYWSGLKVILSDSKV

SEQ ID NO: 2579742 - protein, 17 aa, Entamoeba histolytica
DNECVKCDGSVINGNCY

SEQ ID NO: 2579743 - protein, 17 aa, Entamoeba histolytica
DNEKCKMIKIYNTIGNI

SEQ ID NO: 2579744 - protein, 19 aa, Entamoeba histolytica
DNEVCNICNFELKYSKAFD

SEQ ID NO: 2579745 - protein, 18 aa, Entamoeba histolytica
DNFIGCKTLQLYNKKCEY

SEQ ID NO: 2579746 - protein, 27 aa, Entamoeba histolytica
DNFKSIVNSVMWGRCVFDNIRKFLQFQ

SEQ ID NO: 2579747 - protein, 22 aa, Entamoeba histolytica
DNFRHEWFLSTFGFIGGIGGGA

SEQ ID NO: 2579748 - protein, 24 aa, Entamoeba histolytica
DNGEWSTHCVLSYCDDGYKFDSIN

SEQ ID NO: 2579749 - protein, 28 aa, Entamoeba histolytica
DNGFWSKRCVPTYCDYGYLFDFDTKRCI

SEQ ID NO: 2579750 - protein, 24 aa, Entamoeba histolytica
DNHKKTLLSICEYLIDSGINSDLF

SEQ ID NO: 2579751 - protein, 18 aa, Entamoeba histolytica
DNIQLLECQNWCYTTLKL

SEQ ID NO: 2579752 - protein, 20 aa, Entamoeba histolytica
DNLFCTMCKPGYYLQNQECK

SEQ ID NO: 2579753 - protein, 18 aa, Entamoeba histolytica
DNLFSFGPSSFVVPTAVI

SEQ ID NO: 2579754 - protein, 27 aa, Entamoeba histolytica
DNLLTKLIYWLAGMSFTPMVALEVIPF

SEQ ID NO: 2579755 - protein, 23 aa, Entamoeba histolytica
DNLPTEPLFGVFSIYNADETDPN

SEQ ID NO: 2579756 - protein, 21 aa, Entamoeba histolytica
DNLYHPSCYIENFIKGGEDEE

SEQ ID NO: 2579757 - protein, 22 aa, Entamoeba histolytica
DNNEYPITIILPMNGGGSGDLV

SEQ ID NO: 2579758 - protein, 28 aa, Entamoeba histolytica
DNNNKYYIKYYIDSNCDKEEEPGKEEVF

SEQ ID NO: 2579759 - protein, 21 aa, Entamoeba histolytica
DNPYCGGGYVFFDNILDFGYH

SEQ ID NO: 2579760 - protein, 18 aa, Entamoeba histolytica
DNQWSKRYIKHFFTKMHF

SEQ ID NO: 2579761 - protein, 18 aa, Entamoeba histolytica
DNRFLEWKSQWDQLTNST

SEQ ID NO: 2579762 - protein, 18 aa, Entamoeba histolytica
DNSCRHCQWVNPYKPVTE

SEQ ID NO: 2579763 - protein, 36 aa, Entamoeba histolytica
DNSFRIFPWKKRSKLVFCVPGAFIISNPQGVIYPYI

SEQ ID NO: 2579764 - protein, 19 aa, Entamoeba histolytica
DNTSSVFICLAIIIGFLLF

SEQ ID NO: 2579765 - protein, 25 aa, Entamoeba histolytica
DNTYYCPLKDLYLPYYFSVTKGSDN

SEQ ID NO: 2579766 - protein, 25 aa, Entamoeba histolytica
DNTYYCPLKDLYLPYYFSVTKGTSD

SEQ ID NO: 2579767 - protein, 23 aa, Entamoeba histolytica
DNVKAGTVLTVFMSVLLATQSLS

SEQ ID NO: 2579768 - protein, 25 aa, Entamoeba histolytica
DNVNRFFTLQGMRVLAFGYKAIKNG

SEQ ID NO: 2579769 - protein, 31 aa, Entamoeba histolytica; identical to SEQ ID NO: 2381021

SEQ ID NO: 2579770 - protein, 18 aa, Entamoeba histolytica
DNVYDYTPFFGIEENDTF

SEQ ID NO: 2579771 - protein, 19 aa, Entamoeba histolytica
DNYIEDWFLGGMRVNYHLD

SEQ ID NO: 2579772 - protein, 20 aa, Entamoeba histolytica
DNYYCHKIGDKIYRVSKEEK

SEQ ID NO: 2579773 - protein, 17 aa, Entamoeba histolytica
DPDFINWMRPAVSSTFR

SEQ ID NO: 2579774 - protein, 24 aa, Entamoeba histolytica
DPFDRTPLELSMVIPMNDLKQKIM

SEQ ID NO: 2579775 - protein, 20 aa, Entamoeba histolytica
DPFIGYGYGVSLSFFETFRF

SEQ ID NO: 2579776 - protein, 22 aa, Entamoeba histolytica
DPGPQILYCCVAFKTNILAEYY

SEQ ID NO: 2579777 - protein, 24 aa, Entamoeba histolytica
DPHFSKWWISHAVKRMNKFCSSTL

SEQ ID NO: 2579778 - protein, 17 aa, Entamoeba histolytica
DPKDFYSILGLPNKSNE

SEQ ID NO: 2579779 - protein, 19 aa, Entamoeba histolytica
DPLCISYGFHCYQCSSTHY

SEQ ID NO: 2579780 - protein, 28 aa, Entamoeba histolytica
DPLFKEGFCKHLIPAALHRYEEQASYDD

SEQ ID NO: 2579781 - protein, 24 aa, Entamoeba histolytica
DPQGWPLQVGPIMGRIVVEDVTRD

SEQ ID NO: 2579782 - protein, 24 aa, Entamoeba histolytica
DPQPRIICPNGYLYVKGECIKSKE

SEQ ID NO: 2579783 - protein, 21 aa, Entamoeba histolytica
DPRFVYPWRIAEFVINGKRLE

SEQ ID NO: 2579784 - protein, 20 aa, Entamoeba histolytica
DPSARWTFQQIDEFLDEYFK

SEQ ID NO: 2579785 - protein, 23 aa, Entamoeba histolytica
DPSMPKKVPIVWSSNETSFIKIK

SEQ ID NO: 2579786 - protein, 21 aa, Entamoeba histolytica
DPSSIPFVFTLLVELTDNMSN

SEQ ID NO: 2579787 - protein, 18 aa, Entamoeba histolytica
DPSYSMYFTDSFDCGCKS

SEQ ID NO: 2579788 - protein, 25 aa, Entamoeba histolytica
DPTFLSDIFLEFHSGSTMQFWLDVH

SEQ ID NO: 2579789 - protein, 20 aa, Entamoeba histolytica
DPTQYSCCLFTGEDSINVDE

SEQ ID NO: 2579790 - protein, 17 aa, Entamoeba histolytica
DPYDYDLFFSFSELKKN

SEQ ID NO: 2579791 - protein, 17 aa, Entamoeba histolytica
DPYFNYRASKYLLANGL

SEQ ID NO: 2579792 - protein, 20 aa, Entamoeba histolytica
DPYGSFDFWATMKGYIDGDS

SEQ ID NO: 2579793 - protein, 29 aa, Entamoeba histolytica
DQECAKRVQLEWEELLGLLEEFAAFQQNC

SEQ ID NO: 2579794 - protein, 23 aa, Entamoeba histolytica
DQIIKEKICILIGKRDKFTDLFT

SEQ ID NO: 2579795 - protein, 28 aa, Entamoeba histolytica
DQIMALPLFWDFNKKLNFIKSASDLFEM

SEQ ID NO: 2579796 - protein, 33 aa, Entamoeba histolytica
DQLSREGRFRFGGFWGKKWAKLTINKNESSCLN

SEQ ID NO: 2579797 - protein, 31 aa, Entamoeba histolytica
DQQLKLSSALDRLEINITFALNITSNSTTLD

SEQ ID NO: 2579798 - protein, 17 aa, Entamoeba histolytica
DQYIGGEIDFLIDIKGI

SEQ ID NO: 2579799 - protein, 23 aa, Entamoeba histolytica
DQYIPKLLPFSGHVLPSVRTAVM

SEQ ID NO: 2579800 - protein, 17 aa, Entamoeba histolytica
DRFKEWTVESFGKENEQ

SEQ ID NO: 2579801 - protein, 22 aa, Entamoeba histolytica
DRGKNCPLHGCGEEKRSFIYVQ

SEQ ID NO: 2579802 - protein, 24 aa, Entamoeba histolytica
DRGTTLRGECWFPSECLDTIVTKL

SEQ ID NO: 2579803 - protein, 22 aa, Entamoeba histolytica
DRIKVFKLSVDWQFSDIMNDEY

SEQ ID NO: 2579804 - protein, 18 aa, Entamoeba histolytica
DRIRLILPEVQFITKHKL

SEQ ID NO: 2579805 - protein, 25 aa, Entamoeba histolytica
DRKTCKGFCDGGARCTCPMCCHSEC

SEQ ID NO: 2579806 - protein, 17 aa, Entamoeba histolytica
DRLTLCSNKPILPNTNS

SEQ ID NO: 2579807 - protein, 20 aa, Entamoeba histolytica
DRMCEAWRYRGVTRSASGQF

SEQ ID NO: 2579808 - protein, 19 aa, Entamoeba histolytica
DRNCKTKAIALTFDDSPSG

SEQ ID NO: 2579809 - protein, 21 aa, Entamoeba histolytica
DRPRFSFYDGPPFATGLPHYG

SEQ ID NO: 2579810 - protein, 22 aa, Entamoeba histolytica
DRQLRVCTTIAIAVVADSCAPF

SEQ ID NO: 2579811 - protein, 17 aa, Entamoeba histolytica
DRTGMVFALASSLCQIL

SEQ ID NO: 2579812 - protein, 17 aa, Entamoeba histolytica
DRTPKVWLLGYDEDHKP

SEQ ID NO: 2579813 - protein, 18 aa, Entamoeba histolytica
DSAGYCFASTLNLTYFEG

SEQ ID NO: 2579814 - protein, 26 aa, Entamoeba histolytica
DSDIHRSWCAFRCTQLLTLLDQIVSV

SEQ ID NO: 2579815 - protein, 23 aa, Entamoeba histolytica
DSDISFLYTFKWVGFGTAFTHTA

SEQ ID NO: 2579816 - protein, 26 aa, Entamoeba histolytica
DSDPLRFSFNYSFFETFRHNYNYNET

SEQ ID NO: 2579817 - protein, 19 aa, Entamoeba histolytica
DSFDYWSLIKNPMIIMALV

SEQ ID NO: 2579818 - protein, 17 aa, Entamoeba histolytica
DSFSTLILIVFGFSFAF

SEQ ID NO: 2579819 - protein, 28 aa, Entamoeba histolytica
DSHCATTCKCYFGFIPITINGTTKCSPP

SEQ ID NO: 2579820 - protein, 20 aa, Entamoeba histolytica
DSIAGFWKYKHQPFILMDIF

SEQ ID NO: 2579821 - protein, 19 aa, Entamoeba histolytica
DSIELGMLFIHDGYHFHLF

SEQ ID NO: 2579822 - protein, 25 aa, Entamoeba histolytica
DSIKKDGYKWFAIQKVMNKKQISRN

SEQ ID NO: 2579823 - protein, 18 aa, Entamoeba histolytica
DSIVICFKYFPIIIIVLF

SEQ ID NO: 2579824 - protein, 25 aa, Entamoeba histolytica
DSKCSINCNCLYGFEPKSINGILKC

SEQ ID NO: 2579825 - protein, 17 aa, Entamoeba histolytica
DSLLSLTTFELLKNYSL

SEQ ID NO: 2579826 - protein, 18 aa, Entamoeba histolytica
DSLQILLFCLRGSSELYS

SEQ ID NO: 2579827 - protein, 33 aa, Entamoeba histolytica
DSLRMRIFGFHWKTSLPLIFFFTLVFLSFTIFG

SEQ ID NO: 2579828 - protein, 29 aa, Entamoeba histolytica
DSLYKVGRKMYKTKGKWYRVHTAGLGNNI

SEQ ID NO: 2579829 - protein, 24 aa, Entamoeba histolytica
DSNYRKEFYFAIQHDSEVIEWSSL

SEQ ID NO: 2579830 - protein, 22 aa, Entamoeba histolytica
DSRGTLKIKVVNLVSLVPTMKE

SEQ ID NO: 2579831 - protein, 18 aa, Entamoeba histolytica
DSRYFFLVMVICLIVLVL

SEQ ID NO: 2579832 - protein, 18 aa, Entamoeba histolytica
DSSILGLTVLCWGNSVGD

SEQ ID NO: 2579833 - protein, 25 aa, Entamoeba histolytica
DSSPIIRRMVCIFDKLLEALNKSTL

SEQ ID NO: 2579834 - protein, 21 aa, Entamoeba histolytica
DSSYYILIKLFRMGTKKQTKS

SEQ ID NO: 2579835 - protein, 24 aa, Entamoeba histolytica
DSVMSDVLWSLSFIAESRAYDGFL

SEQ ID NO: 2579836 - protein, 20 aa, Entamoeba histolytica
DSVYKLICDCWKQNPKDRLV

SEQ ID NO: 2579837 - protein, 18 aa, Entamoeba histolytica
DSYNRFIDVWNMTPEQCT

SEQ ID NO: 2579838 - protein, 19 aa, Entamoeba histolytica
DSYSCLKCEKGYYLDNGKC

SEQ ID NO: 2579839 - protein, 17 aa, Entamoeba histolytica
DTADCIVSEYSLYYTYQ

SEQ ID NO: 2579840 - protein, 23 aa, Entamoeba histolytica
DTAKWKWGEYKQFHMIAYINDNS

SEQ ID NO: 2579841 - protein, 26 aa, Entamoeba histolytica
DTCVGNEIFKNAILVTPYLPFTTDYN

SEQ ID NO: 2579842 - protein, 18 aa, Entamoeba histolytica
DTDLALPFLQGNYLIEQG

SEQ ID NO: 2579843 - protein, 18 aa, Entamoeba histolytica
DTFSSFLLFTPLRIISYF

SEQ ID NO: 2579844 - protein, 24 aa, Entamoeba histolytica
DTIKSHCWNDIMINGRIKEMEDEV

SEQ ID NO: 2579845 - protein, 20 aa, Entamoeba histolytica
DTIRIMKNNHRFTSILSEKL

SEQ ID NO: 2579846 - protein, 22 aa, Entamoeba histolytica
DTKEIKKILIIGVSEVLLLVII

SEQ ID NO: 2579847 - protein, 24 aa, Entamoeba histolytica
DTLGRRPLLLFGCLGSIVCTLSLG

SEQ ID NO: 2579848 - protein, 22 aa, Entamoeba histolytica
DTPKNWKWRMFNIIMLGVGFLI

SEQ ID NO: 2579849 - protein, 24 aa, Entamoeba histolytica
DTSFKLGYYLPYSITSKREISYEP

SEQ ID NO: 2579850 - protein, 22 aa, Entamoeba histolytica
DTTRESVHWVLYFSGAPNESES

SEQ ID NO: 2579851 - protein, 18 aa, Entamoeba histolytica
DTYCVFTGVMLCLIGYLM

SEQ ID NO: 2579852 - protein, 19 aa, Entamoeba histolytica
DTYSDYYFKSGTITNIVGG

SEQ ID NO: 2579853 - protein, 23 aa, Entamoeba histolytica
DVCGFLRRCLEIASEGFQAEDKV

SEQ ID NO: 2579854 - protein, 25 aa, Entamoeba histolytica
DVDYELTRIVPLYLAVHIFAESPCK

SEQ ID NO: 2579855 - protein, 19 aa, Entamoeba histolytica
DVFFPSLVYILIKANIPFF

SEQ ID NO: 2579856 - protein, 17 aa, Entamoeba histolytica
DVFKGIFTNYIFIGIEL

SEQ ID NO: 2579857 - protein, 31 aa, Entamoeba histolytica
DVFKIKDIWKHVCIVWNKCYNSLFQKIIKKG

SEQ ID NO: 2579858 - protein, 32 aa, Entamoeba histolytica
DVFKIKDIWKHVCIVWTMCYNYIPPKKIDEGK

SEQ ID NO: 2579859 - protein, 21 aa, Entamoeba histolytica
DVFMKTTLVMKYICPNGCNQN

SEQ ID NO: 2579860 - protein, 27 aa, Entamoeba histolytica
DVFSYAICILEIWICESVYPEDEFHDS

SEQ ID NO: 2579861 - protein, 24 aa, Entamoeba histolytica
DVIDRERMIFFTLNMFKVDRGTTL

SEQ ID NO: 2579862 - protein, 29 aa, Entamoeba histolytica
DVINPPFKMSWRIAATFLVSLFDAITEDD

SEQ ID NO: 2579863 - protein, 22 aa, Entamoeba histolytica
DVIRRFADLFVPLKCPHARFTN

SEQ ID NO: 2579864 - protein, 23 aa, Entamoeba histolytica
DVKGENLLIFSLNPHSPVCAKLT

SEQ ID NO: 2579865 - protein, 25 aa, Entamoeba histolytica
DVLKRMLWGLIPFFGNFFKQTEENP

SEQ ID NO: 2579866 - protein, 19 aa, Entamoeba histolytica
DVNKYQNIVLVSKINRNII

SEQ ID NO: 2579867 - protein, 25 aa, Entamoeba histolytica
DVPKTWYFACIEIPIYIYILIPIFS

SEQ ID NO: 2579868 - protein, 25 aa, Entamoeba histolytica
DVPRKYRYCFEIKTAAASSTHIDMD

SEQ ID NO: 2579869 - protein, 20 aa, Entamoeba histolytica
DVQLKFLLEYILENSVISLS

SEQ ID NO: 2579870 - protein, 18 aa, Entamoeba histolytica
DVSYPFVASTAMTEYSMN

SEQ ID NO: 2579871 - protein, 20 aa, Entamoeba histolytica
DVVCVSCKSGYFMKEDFTCG

SEQ ID NO: 2579872 - protein, 19 aa, Entamoeba histolytica
DVVKCIGYLIAASLRDGDG

SEQ ID NO: 2579873 - protein, 37 aa, Entamoeba histolytica
DVYAFAIVSYEVFLRKIPYGNGCFVHSWDVSDFVSQG

SEQ ID NO: 2579874 - protein, 32 aa, Entamoeba histolytica
DVYNLCDHFKFTVPFLKYWTFDNIIFHYKNLD

SEQ ID NO: 2579875 - protein, 26 aa, Entamoeba histolytica
DVYSFAICMLEIWLGQDPYDSTEFPN

SEQ ID NO: 2579876 - protein, 26 aa, Entamoeba histolytica
DVYSFAICMLEVWISKDPYDSIKFPD

SEQ ID NO: 2579877 - protein, 18 aa, Entamoeba histolytica
DVYSFAITSWEVYYQEEP

SEQ ID NO: 2579878 - protein, 18 aa, Entamoeba histolytica
DVYSFFLTKSFDCEPLIK

SEQ ID NO: 2579879 - protein, 20 aa, Entamoeba histolytica
DWIEGLAILAAVLVASLGAS

SEQ ID NO: 2579880 - protein, 17 aa, Entamoeba histolytica
DWIEGVAILIAVLAVSL

SEQ ID NO: 2579881 - protein, 20 aa, Entamoeba histolytica
DWLIIVCRMLMIILVLMSYP

SEQ ID NO: 2579882 - protein, 20 aa, Entamoeba histolytica
DWRTKIAIYGSFIVNLCLCI

SEQ ID NO: 2579883 - protein, 24 aa, Entamoeba histolytica
DWSFSLVFLPAWYVFGFYIIVTQL

SEQ ID NO: 2579884 - protein, 25 aa, Entamoeba histolytica
DYALPRLFVGVQIPVILSALSSLLS

SEQ ID NO: 2579885 - protein, 19 aa, Entamoeba histolytica
DYEIKCNYQLWRLITPIFL

SEQ ID NO: 2579886 - protein, 27 aa, Entamoeba histolytica
DYFPLNSCISFTDYAAYFFYNNNTHMN

SEQ ID NO: 2579887 - protein, 17 aa, Entamoeba histolytica
DYIIHFYGAVFIPNKIC

SEQ ID NO: 2579888 - protein, 17 aa, Entamoeba histolytica
DYIIYFYGSVLFKNKRY

SEQ ID NO: 2579889 - protein, 17 aa, Entamoeba histolytica
DYIKLTSNFYFVITAEK

SEQ ID NO: 2579890 - protein, 25 aa, Entamoeba histolytica
DYLMKRINIHLIGHFIVCEIDKTER

SEQ ID NO: 2579891 - protein, 21 aa, Entamoeba histolytica
DYNGFSWTRILLKTGSKTPIL

SEQ ID NO: 2579892 - protein, 24 aa, Entamoeba histolytica
DYNGMVCVLDLETGILLQKYDHPL

SEQ ID NO: 2579893 - protein, 18 aa, Entamoeba histolytica
DYSFIVWIFLCFLSYIHP

SEQ ID NO: 2579894 - protein, 23 aa, Entamoeba histolytica
DYSGSSYLLLLSMFVINIYLNYF

SEQ ID NO: 2579895 - protein, 20 aa, Entamoeba histolytica
DYSVCSSIPMALKMIRLHLK

SEQ ID NO: 2579896 - protein, 17 aa, Entamoeba histolytica
DYTFKHVVEHSVACLIT

SEQ ID NO: 2579897 - protein, 25 aa, Entamoeba histolytica
DYVNETFPLIAHWRDSFNSKEQHSN

SEQ ID NO: 2579898 - protein, 23 aa, Entamoeba histolytica
DYVSAPQLHMTWIAKLANEHRTK

SEQ ID NO: 2579899 - protein, 23 aa, Entamoeba histolytica
DYVSAPQLHMTWIAKLAQQHRLK

SEQ ID NO: 2579900 - protein, 20 aa, Entamoeba histolytica
DYYEGIAILVAVFAVSLIGA

SEQ ID NO: 2579901 - protein, 26 aa, Entamoeba histolytica
DYYRYNPLLWYRLACSCIQYHYNYIK

SEQ ID NO: 2579902 - protein, 20 aa, Entamoeba histolytica
EACKFAFEIGIKYTKHTIPI

SEQ ID NO: 2579903 - protein, 26 aa, Entamoeba histolytica
EADASIKHLFVRPAWGKGKYTQFNLE

SEQ ID NO: 2579904 - protein, 18 aa, Entamoeba histolytica
EADKNYSFFICSKVQSSF

SEQ ID NO: 2579905 - protein, 21 aa, Entamoeba histolytica
EAEKILDLFSYIRMDPKDDEL

SEQ ID NO: 2579906 - protein, 19 aa, Entamoeba histolytica
EAFKLLLFVFEQLDIQIRP

SEQ ID NO: 2579907 - protein, 17 aa, Entamoeba histolytica
EAFRETRRQVLISFFDM

SEQ ID NO: 2579908 - protein, 21 aa, Entamoeba histolytica
EAGNLLLPIVVNLTHINTKKS

SEQ ID NO: 2579909 - protein, 20 aa, Entamoeba histolytica
EAIFLACLNEFCDIQIHKPA

SEQ ID NO: 2579910 - protein, 17 aa, Entamoeba histolytica
EAIHEVSDIRQENGQHS

SEQ ID NO: 2579911 - protein, 24 aa, Entamoeba histolytica
EAKKCGICYEMVGPSGTLRFRVDS

SEQ ID NO: 2579912 - protein, 22 aa, Entamoeba histolytica
EAKKRISPFRVLPLRKEAEKYI

SEQ ID NO: 2579913 - protein, 28 aa, Entamoeba histolytica
EALLRAMFDFTFYWYNFMPLSRGTAATG

SEQ ID NO: 2579914 - protein, 20 aa, Entamoeba histolytica
EANCCGWKTLKIEGCQAKDI

SEQ ID NO: 2579915 - protein, 31 aa, Entamoeba histolytica
EASTHTFFWICFFLMQFCTVVLVLNLLKKKR

SEQ ID NO: 2579916 - protein, 20 aa, Entamoeba histolytica
EAVKAQILIGAHLSRLHEEL

SEQ ID NO: 2579917 - protein, 21 aa, Entamoeba histolytica
EAVVCLFVILTFYFLYKRKIW

SEQ ID NO: 2579918 - protein, 22 aa, Entamoeba histolytica
EAVVCLFVILTFYFLYKRKIWL

SEQ ID NO: 2579919 - protein, 19 aa, Entamoeba histolytica
EAYNLFKRAHCDTLQKKIE

SEQ ID NO: 2579920 - protein, 27 aa, Entamoeba histolytica
EAYTQELLRWNRLIVEVCLNNCSIERL

SEQ ID NO: 2579921 - protein, 20 aa, Entamoeba histolytica
ECDGGDGCFECECQSKWYKR

SEQ ID NO: 2579922 - protein, 24 aa, Entamoeba histolytica
ECDGGEGCSFCRCMDNYVGHYIPE

SEQ ID NO: 2579923 - protein, 30 aa, Entamoeba histolytica
ECDGGNGCKDCLCSPQYLPYSIPRLSCLDN

SEQ ID NO: 2579924 - protein, 23 aa, Entamoeba histolytica
ECDGHKFLWVRSSWGNDWGVENG

SEQ ID NO: 2579925 - protein, 17 aa, Entamoeba histolytica
ECDKGMITIDHITCVKN

SEQ ID NO: 2579926 - protein, 18 aa, Entamoeba histolytica
ECDPTLPNRSWAYLSIPF

SEQ ID NO: 2579927 - protein, 25 aa, Entamoeba histolytica
ECESCVIKKAFVLSPFGRTFINGTN

SEQ ID NO: 2579928 - protein, 17 aa, Entamoeba histolytica
ECETCQYSSASQMPICT

SEQ ID NO: 2579929 - protein, 21 aa, Entamoeba histolytica
ECGYDFIPFKVLEKYNENYVV

SEQ ID NO: 2579930 - protein, 21 aa, Entamoeba histolytica
ECIACKTKLLVNGVCGGTILG

SEQ ID NO: 2579931 - protein, 19 aa, Entamoeba histolytica
ECIGYETVCMMLFIFHNLS

SEQ ID NO: 2579932 - protein, 17 aa, Entamoeba histolytica
ECIKCLPGYSYYMGECF

SEQ ID NO: 2579933 - protein, 17 aa, Entamoeba histolytica
ECIRCLSQNLLLSDLGE

SEQ ID NO: 2579934 - protein, 18 aa, Entamoeba histolytica
ECKISNCFQCRVNPNECE

SEQ ID NO: 2579935 - protein, 25 aa, Entamoeba histolytica
ECKSSPVWWVIVLVIIGGIIFFIIF

SEQ ID NO: 2579936 - protein, 26 aa, Entamoeba histolytica
ECNDFRDSWNRGWIRQFFGEDIAYQY

SEQ ID NO: 2579937 - protein, 21 aa, Entamoeba histolytica
ECNIPHCLTCSGEHDNSCSIC

SEQ ID NO: 2579938 - protein, 18 aa, Entamoeba histolytica
ECNPELVLFEILHQSIMQ

SEQ ID NO: 2579939 - protein, 19 aa, Entamoeba histolytica
ECNTCLKGETNIYVNCCVS

SEQ ID NO: 2579940 - protein, 21 aa, Entamoeba histolytica
ECPYKGLIQRCWNQIPQERPQ

SEQ ID NO: 2579941 - protein, 24 aa, Entamoeba histolytica
ECQPCEVTGCLKCTTATTCSVCDV

SEQ ID NO: 2579942 - protein, 23 aa, Entamoeba histolytica
ECRLCNIKGCLTCSIDGTCTSCE

SEQ ID NO: 2579943 - protein, 17 aa, Entamoeba histolytica
ECTLDFSEKFFSFDMSE

SEQ ID NO: 2579944 - protein, 19 aa, Entamoeba histolytica
ECTTRYRLSQGLCIGCPTE

SEQ ID NO: 2579945 - protein, 18 aa, Entamoeba histolytica
ECVNLKPNKCCHVKVSLL

SEQ ID NO: 2579946 - protein, 28 aa, Entamoeba histolytica
ECYDHPLIKGACLNFNLVKRQELFNHLF

SEQ ID NO: 2579947 - protein, 24 aa, Entamoeba histolytica
ECYSSVCKKNCRFCNITTPNCVEC

SEQ ID NO: 2579948 - protein, 22 aa, Entamoeba histolytica
EDDICVLIAIFGKNIFPKDLIS

SEQ ID NO: 2579949 - protein, 23 aa, Entamoeba histolytica
EDFMRFLGECWIGEIDSIATFDK

SEQ ID NO: 2579950 - protein, 20 aa, Entamoeba histolytica
EDFYRPVIVLIQLLFIISNV

SEQ ID NO: 2579951 - protein, 26 aa, Entamoeba histolytica
EDGHKWRPLFFYCRFLVTKIIVPIFL

SEQ ID NO: 2579952 - protein, 21 aa, Entamoeba histolytica
EDIELTFKMICHNDCHYNEGH

SEQ ID NO: 2579953 - protein, 21 aa, Entamoeba histolytica
EDIIFIFKIFTKLICSEENYS

SEQ ID NO: 2579954 - protein, 21 aa, Entamoeba histolytica
EDIIPILRYILAPTPYSGLLT

SEQ ID NO: 2579955 - protein, 18 aa, Entamoeba histolytica
EDIRRWIADRGFNNAKYT

SEQ ID NO: 2579956 - protein, 17 aa, Entamoeba histolytica
EDIRYAFNVEVDKKIQG

SEQ ID NO: 2579957 - protein, 24 aa, Entamoeba histolytica
EDKKCYKIGISTSVKYAYVAATDS

SEQ ID NO: 2579958 - protein, 24 aa, Entamoeba histolytica
EDLVRDGCLIKRCNKTSKTTYWEN

SEQ ID NO: 2579959 - protein, 29 aa, Entamoeba histolytica
EDPFPKTQFKFAWDIADLVANGKRTNQIE

SEQ ID NO: 2579960 - protein, 18 aa, Entamoeba histolytica
EDQIDMFHRCFSLILSAL

SEQ ID NO: 2579961 - protein, 19 aa, Entamoeba histolytica
EDSIGIGINGIIGMGMRFI

SEQ ID NO: 2579962 - protein, 25 aa, Entamoeba histolytica
EDTKKEGCIICRSCEDSENDPLGFL

SEQ ID NO: 2579963 - protein, 24 aa, Entamoeba histolytica
EDTWKCYVVIDIGSIIIIQLISVL

SEQ ID NO: 2579964 - protein, 18 aa, Entamoeba histolytica
EDVMKLYDGYGFIEDLEK

SEQ ID NO: 2579965 - protein, 25 aa, Entamoeba histolytica
EDVNYASAMALVFMGKYEDALKVVD

SEQ ID NO: 2579966 - protein, 22 aa, Entamoeba histolytica
EDYCGFHIWPYSYIERNQKYRG

SEQ ID NO: 2579967 - protein, 31 aa, Entamoeba histolytica; identical to SEQ ID NO: 2381258

SEQ ID NO: 2579968 - protein, 29 aa, Entamoeba histolytica
EECIFKWLIQQPRCPMCRELVIQPQTFVG

SEQ ID NO: 2579969 - protein, 24 aa, Entamoeba histolytica
EEDHCYLLFIPFEYNGHTCYSYKI

SEQ ID NO: 2579970 - protein, 18 aa, Entamoeba histolytica
EEEIERLIEWGRGITPIN

SEQ ID NO: 2579971 - protein, 25 aa, Entamoeba histolytica
EEEPFCDFQDLFSIKSHVLAGYRLP

SEQ ID NO: 2579972 - protein, 19 aa, Entamoeba histolytica
EEFKREIFLLENFRSDYIV

SEQ ID NO: 2579973 - protein, 18 aa, Entamoeba histolytica
EEGPLLKNAWLSCLKVIS

SEQ ID NO: 2579974 - protein, 24 aa, Entamoeba histolytica
EEICKSPEIYKDFNCFAEDSQGWK

SEQ ID NO: 2579975 - protein, 29 aa, Entamoeba histolytica
EEIDCVICNCSLFCCTPSLAAMLMNHYKM

SEQ ID NO: 2579976 - protein, 19 aa, Entamoeba histolytica
EEIELFKGEIKTLIETIKN

SEQ ID NO: 2579977 - protein, 17 aa, Entamoeba histolytica
EEIELLLLEFKHMKEVI

SEQ ID NO: 2579978 - protein, 17 aa, Entamoeba histolytica
EEIIHTRIEPKQHKRIY

SEQ ID NO: 2579979 - protein, 22 aa, Entamoeba histolytica
EEKEIFERFTHLFDMQQIQLCL

SEQ ID NO: 2579980 - protein, 21 aa, Entamoeba histolytica
EEKELKYYFSLLTQTFSTYGL

SEQ ID NO: 2579981 - protein, 18 aa, Entamoeba histolytica
EEKERKLKEEKIKKMMAL

SEQ ID NO: 2579982 - protein, 23 aa, Entamoeba histolytica
EEKESIGIWYGIKTYGGITYVAT

SEQ ID NO: 2579983 - protein, 27 aa, Entamoeba histolytica
EEKILRAMFSFTFFWYNFMPLTRGTAA

SEQ ID NO: 2579984 - protein, 26 aa, Entamoeba histolytica
EEKMKRVCVIPIWLSHEDYPYLLSSC

SEQ ID NO: 2579985 - protein, 26 aa, Entamoeba histolytica
EEKRIVEVMYRFFACSIESTKCKISD

SEQ ID NO: 2579986 - protein, 17 aa, Entamoeba histolytica
EELEVEQPFGFPEYVAK

SEQ ID NO: 2579987 - protein, 43 aa, Entamoeba histolytica; identical to SEQ ID NO: 2381287

SEQ ID NO: 2579988 - protein, 25 aa, Entamoeba histolytica
EELKELFGNVVDVCFAYEAITERNE

SEQ ID NO: 2579989 - protein, 25 aa, Entamoeba histolytica
EELKKTCPEFAALVSKTGFDIEEGN

SEQ ID NO: 2579990 - protein, 17 aa, Entamoeba histolytica
EELKYIYPQSIISCPCQ

SEQ ID NO: 2579991 - protein, 20 aa, Entamoeba histolytica
EELPFTFSTEVLTFGYEDGN

SEQ ID NO: 2579992 - protein, 25 aa, Entamoeba histolytica
EELPYSSYCIYFFNNFAYGMPGIEF

SEQ ID NO: 2579993 - protein, 26 aa, Entamoeba histolytica
EELRKRKKLPIGFKYLQMVQKEHFQE

SEQ ID NO: 2579994 - protein, 29 aa, Entamoeba histolytica
EEMADKAIWRIIFIISPIALILLILGIVG

SEQ ID NO: 2579995 - protein, 20 aa, Entamoeba histolytica
EEMIECTKMANAHDFISKLP

SEQ ID NO: 2579996 - protein, 24 aa, Entamoeba histolytica
EEMNCCCLLCKMKKVVLQKNYIPW

SEQ ID NO: 2579997 - protein, 20 aa, Entamoeba histolytica
EEMSHTVLLMAKKAGQTRVN

SEQ ID NO: 2579998 - protein, 26 aa, Entamoeba histolytica
EENGWKTSRVRIARSLDKEELNNTVE

SEQ ID NO: 2579999 - protein, 24 aa, Entamoeba histolytica
EENKEYFIAIGIFLQIYEIKKRES

SEQ ID NO: 2580000 - protein, 31 aa, Entamoeba histolytica
EENPDLYGPLWIPLTVVFLAFFSGSLSSIIE

SEQ ID NO: 2580001 - protein, 24 aa, Entamoeba histolytica
EENRRINLLVLQTFYPSPLEEDEF

SEQ ID NO: 2580002 - protein, 20 aa, Entamoeba histolytica
EEPKHVVTIHRFHKSANDLF

SEQ ID NO: 2580003 - protein, 19 aa, Entamoeba histolytica
EEPMMIFKHCEWKEQERKL

SEQ ID NO: 2580004 - protein, 17 aa, Entamoeba histolytica
EEPVEWNKRGTIECNNY

SEQ ID NO: 2580005 - protein, 25 aa, Entamoeba histolytica
EEPYKEFKSLFDIKNFVCEGKRLPL

SEQ ID NO: 2580006 - protein, 20 aa, Entamoeba histolytica
EEQKCKLITCGNGRIEEGEE

SEQ ID NO: 2580007 - protein, 30 aa, Entamoeba histolytica
EEQKKEGYPWCDIDKKMSWCDINDDGIIYL

SEQ ID NO: 2580008 - protein, 18 aa, Entamoeba histolytica
EEQNKCKEYYLIITSQDF

SEQ ID NO: 2580009 - protein, 32 aa, Entamoeba histolytica
EERFRRAITFIRIGMPIPFYVLKKNIAAYPRY

SEQ ID NO: 2580010 - protein, 34 aa, Entamoeba histolytica
EERYSMEILHVVSWMYCNICRMRLVLDPHNMKAI

SEQ ID NO: 2580011 - protein, 18 aa, Entamoeba histolytica
EESCSIVSNGKYYIIMDD

SEQ ID NO: 2580012 - protein, 19 aa, Entamoeba histolytica
EESRKFLSNVLAFLSSCIW

SEQ ID NO: 2580013 - protein, 25 aa, Entamoeba histolytica
EESTCWFKLLMILLYVEFIKLRYYF

SEQ ID NO: 2580014 - protein, 19 aa, Entamoeba histolytica
EETELPNTFILELPNIPII

SEQ ID NO: 2580015 - protein, 22 aa, Entamoeba histolytica
EETTRISFIYFLLISIIEGVID

SEQ ID NO: 2580016 - protein, 20 aa, Entamoeba histolytica
EEVHCLSLPVFTILSLLNEL

SEQ ID NO: 2580017 - protein, 20 aa, Entamoeba histolytica
EEVIEFWKKIDVFNKCNEIT

SEQ ID NO: 2580018 - protein, 20 aa, Entamoeba histolytica
EEVRIQLKVITSRETTQKGN

SEQ ID NO: 2580019 - protein, 25 aa, Entamoeba histolytica
EEVSTVMSFACYFLQVFDKIDSGTH

SEQ ID NO: 2580020 - protein, 37 aa, Entamoeba histolytica
EEWKIFKKEVIYLIEFNEIFEIWANYVIKIQQIIISS

SEQ ID NO: 2580021 - protein, 19 aa, Entamoeba histolytica
EEWSESDSEIFLSEVKETY

SEQ ID NO: 2580022 - protein, 23 aa, Entamoeba histolytica
EEYCPCADCELIIEDSQPVILDF

SEQ ID NO: 2580023 - protein, 17 aa, Entamoeba histolytica
EEYHFLFIPSMIVLLSI

SEQ ID NO: 2580024 - protein, 22 aa, Entamoeba histolytica
EEYNPRIDPKMTSFLNDDSWKK

SEQ ID NO: 2580025 - protein, 23 aa, Entamoeba histolytica
EEYQKMMIKLRMEQKSMTEIKID

SEQ ID NO: 2580026 - protein, 27 aa, Entamoeba histolytica
EEYSGCLQLRLTSLQIINTILAKDNTS

SEQ ID NO: 2580027 - protein, 23 aa, Entamoeba histolytica
EEYVFDCFHFFGIDYYTNNSHLL

SEQ ID NO: 2580028 - protein, 19 aa, Entamoeba histolytica
EFCQRRISTVVVMEKYQIK

SEQ ID NO: 2580029 - protein, 29 aa, Entamoeba histolytica
EFDEEVRPSLKWYFMIFFGPNVETMTNSL

SEQ ID NO: 2580030 - protein, 17 aa, Entamoeba histolytica
EFDEWRYYFDVTVHSVI

SEQ ID NO: 2580031 - protein, 24 aa, Entamoeba histolytica
EFDKEPICGDGIWDSFTEQCDGSN

SEQ ID NO: 2580032 - protein, 19 aa, Entamoeba histolytica
EFEKEVAIICKIWINTRYN

SEQ ID NO: 2580033 - protein, 24 aa, Entamoeba histolytica
EFEQEMWLHLCITPHTREGLLKFI

SEQ ID NO: 2580034 - protein, 22 aa, Entamoeba histolytica
EFEVKMYHSLVCKYIESKQTSS

SEQ ID NO: 2580035 - protein, 20 aa, Entamoeba histolytica
EFGASYCRATKFIIKGKKTI

SEQ ID NO: 2580036 - protein, 19 aa, Entamoeba histolytica
EFGCIPATSIPAVVRELRW

SEQ ID NO: 2580037 - protein, 19 aa, Entamoeba histolytica
EFGEHVLIQVICENNIDIG

SEQ ID NO: 2580038 - protein, 18 aa, Entamoeba histolytica
EFGGCIGLNIGLFLFPIL

SEQ ID NO: 2580039 - protein, 24 aa, Entamoeba histolytica
EFIAHKFKGIGIIGNHDIKLRPPN

SEQ ID NO: 2580040 - protein, 23 aa, Entamoeba histolytica
EFIKKVGRKGIIYYLSLLLSTKY

SEQ ID NO: 2580041 - protein, 20 aa, Entamoeba histolytica
EFKHHCCGWLASNVDNCGAI

SEQ ID NO: 2580042 - protein, 18 aa, Entamoeba histolytica
EFKKPLCQSHVTIVSSIP

SEQ ID NO: 2580043 - protein, 20 aa, Entamoeba histolytica
EFKVLWKQYIDDYDFHTNQF

SEQ ID NO: 2580044 - protein, 24 aa, Entamoeba histolytica
EFLSFKFFFIESVINIILYFFGNE

SEQ ID NO: 2580045 - protein, 18 aa, Entamoeba histolytica
EFNDNSFRIFPWKKRSKL

SEQ ID NO: 2580046 - protein, 19 aa, Entamoeba histolytica
EFNECKPAILVELKEQLDM

SEQ ID NO: 2580047 - protein, 25 aa, Entamoeba histolytica
EFPNAESIFRFVCAGKRLHIPKKCL

SEQ ID NO: 2580048 - protein, 25 aa, Entamoeba histolytica
EFQEIPEEMAMFILNQLFLKEDQPL

SEQ ID NO: 2580049 - protein, 18 aa, Entamoeba histolytica
EFQMGPSLPIFNDPSIRR

SEQ ID NO: 2580050 - protein, 30 aa, Entamoeba histolytica
EFTSFEVFWRITLLTSMCCCTLFFMYVLRG

SEQ ID NO: 2580051 - protein, 20 aa, Entamoeba histolytica
EFVPIMFWIIVQKIPKGTVN

SEQ ID NO: 2580052 - protein, 21 aa, Entamoeba histolytica
EFVRRCINGLFIGGFISIIYG

SEQ ID NO: 2580053 - protein, 24 aa, Entamoeba histolytica
EFVVPAKERKKCNFVITVYIREDD

SEQ ID NO: 2580054 - protein, 20 aa, Entamoeba histolytica
EFYFKCVLLITLVLANLFIT

SEQ ID NO: 2580055 - protein, 22 aa, Entamoeba histolytica
EGAELKYDMAVFTYKTIFDLED

SEQ ID NO: 2580056 - protein, 19 aa, Entamoeba histolytica
EGCLIQFVSCPNIHIQGTV

SEQ ID NO: 2580057 - protein, 20 aa, Entamoeba histolytica
EGCYDCIDGFVLEEKKCISI

SEQ ID NO: 2580058 - protein, 23 aa, Entamoeba histolytica
EGECGDGIWDWFSEECDRTSGCG

SEQ ID NO: 2580059 - protein, 25 aa, Entamoeba histolytica
EGECKKGQVEACLFSAEKGSTISIS

SEQ ID NO: 2580060 - protein, 24 aa, Entamoeba histolytica
EGEGLKGIVVVLPFHEDKFSEVIQ

SEQ ID NO: 2580061 - protein, 32 aa, Entamoeba histolytica
EGFLNKIVWFFKSVICRFKLYPWYLKPKTIKY

SEQ ID NO: 2580062 - protein, 30 aa, Entamoeba histolytica
EGFNGSSLTIKWVVYSAFSFCWNLVTQNGF

SEQ ID NO: 2580063 - protein, 19 aa, Entamoeba histolytica
EGFNLILIARRTELLNEIK

SEQ ID NO: 2580064 - protein, 17 aa, Entamoeba histolytica
EGGHYYLFVGMKRGVDC

SEQ ID NO: 2580065 - protein, 24 aa, Entamoeba histolytica
EGGKKMKCNLCEYLSDVDDNYFSP

SEQ ID NO: 2580066 - protein, 22 aa, Entamoeba histolytica
EGGQECKKCFAGTYQNETGSTY

SEQ ID NO: 2580067 - protein, 18 aa, Entamoeba histolytica
EGIEIKTIIYKKGDDLRK

SEQ ID NO: 2580068 - protein, 22 aa, Entamoeba histolytica
EGIETFSSIIIRTETEITTRLD

SEQ ID NO: 2580069 - protein, 18 aa, Entamoeba histolytica
EGIKEERTDEVKVKTQIT

SEQ ID NO: 2580070 - protein, 20 aa, Entamoeba histolytica
EGILKLKSDVFSFAVCMLEI

SEQ ID NO: 2580071 - protein, 18 aa, Entamoeba histolytica
EGINGIVIILNYNTNRIS

SEQ ID NO: 2580072 - protein, 23 aa, Entamoeba histolytica
EGINRPTECIDIFDHNNSPYGHR

SEQ ID NO: 2580073 - protein, 19 aa, Entamoeba histolytica
EGKEALIYIHGLNHTLVDA

SEQ ID NO: 2580074 - protein, 20 aa, Entamoeba histolytica
EGKHADGIALWFTQTPLKTG

SEQ ID NO: 2580075 - protein, 22 aa, Entamoeba histolytica
EGKTVLFMWDLLKGLDNTTIIA

SEQ ID NO: 2580076 - protein, 26 aa, Entamoeba histolytica
EGKVGVKIGRELLKCVTRALTQNMNI

SEQ ID NO: 2580077 - protein, 25 aa, Entamoeba histolytica
EGLEMKFCYEREEFGKTIIDDLIPN

SEQ ID NO: 2580078 - protein, 22 aa, Entamoeba histolytica
EGLKKTVEWYLEHRNNWERTDE

SEQ ID NO: 2580079 - protein, 28 aa, Entamoeba histolytica
EGLKTKYNCISHIWDIHLRYLNGSKESF

SEQ ID NO: 2580080 - protein, 19 aa, Entamoeba histolytica
EGLQGIILTMDFNSCKFST

SEQ ID NO: 2580081 - protein, 17 aa, Entamoeba histolytica
EGLVCLKENGIVHGQLN

SEQ ID NO: 2580082 - protein, 18 aa, Entamoeba histolytica
EGLWYCLYTFLIIALMLR

SEQ ID NO: 2580083 - protein, 17 aa, Entamoeba histolytica
EGMKKNFLFNGDCLISI

SEQ ID NO: 2580084 - protein, 20 aa, Entamoeba histolytica
EGPFRVVYVGEFRRNKVAIK

SEQ ID NO: 2580085 - protein, 20 aa, Entamoeba histolytica
EGSFGIVYKGFFRGESVAIK

SEQ ID NO: 2580086 - protein, 20 aa, Entamoeba histolytica
EGSFKKCLDNINDYLMKRIN

SEQ ID NO: 2580087 - protein, 20 aa, Entamoeba histolytica
EGSIGIAVVIASLFPNDFKM

SEQ ID NO: 2580088 - protein, 25 aa, Entamoeba histolytica
EGSSFLKKWSVVKIKTSVSPKDFII

SEQ ID NO: 2580089 - protein, 23 aa, Entamoeba histolytica
EGTFGIVYKGHWRSLDVAVKIIK

SEQ ID NO: 2580090 - protein, 23 aa, Entamoeba histolytica
EGTKTMTIWSILILVNIIVFLLS

SEQ ID NO: 2580091 - protein, 18 aa, Entamoeba histolytica
EGTNRFGFFHSEDEEKSI

SEQ ID NO: 2580092 - protein, 25 aa, Entamoeba histolytica
EGTYGIVYKAEWRKVDVAVKIMKTD

SEQ ID NO: 2580093 - protein, 50 aa, Entamoeba histolytica
EGVLLNCFLMILPVLKPHRRLAIALAIEYLKKMNCCISNVNNFLQSFGEN

SEQ ID NO: 2580094 - protein, 17 aa, Entamoeba histolytica
EGYCHRLSLNEFVQTNH

SEQ ID NO: 2580095 - protein, 27 aa, Entamoeba histolytica
EGYFYLFPAFCLPWFVKQKKNIPMLNE

SEQ ID NO: 2580096 - protein, 20 aa, Entamoeba histolytica
EGYGGDNCVLKCWYNNSWQP

SEQ ID NO: 2580097 - protein, 23 aa, Entamoeba histolytica
EGYLRSCRDGVGSIIILSPSKTY

SEQ ID NO: 2580098 - protein, 24 aa, Entamoeba histolytica
EHCKSCNETNCFVCDENYIVNKNE

SEQ ID NO: 2580099 - protein, 24 aa, Entamoeba histolytica
EHEDWQLWMWFGIVTVVIMAIIVL

SEQ ID NO: 2580100 - protein, 23 aa, Entamoeba histolytica
EHEELRWFSLFTTDVFMKTTLVM

SEQ ID NO: 2580101 - protein, 21 aa, Entamoeba histolytica
EHFFHGLLIRQYIKLIVKDIQ

SEQ ID NO: 2580102 - protein, 21 aa, Entamoeba histolytica
EHHNECFFCKTKIEGLKKRSE

SEQ ID NO: 2580103 - protein, 25 aa, Entamoeba histolytica
EHICSMVHSLLKLSEPSIIDLFASS

SEQ ID NO: 2580104 - protein, 17 aa, Entamoeba histolytica
EHIDPFVALSFLDATLM

SEQ ID NO: 2580105 - protein, 33 aa, Entamoeba histolytica
EHIFPKLGDKFIFYKFYWEPGVREFRVKRFALV

SEQ ID NO: 2580106 - protein, 23 aa, Entamoeba histolytica
EHIPEMIIIPFFILCLSVIYLLK

SEQ ID NO: 2580107 - protein, 20 aa, Entamoeba histolytica
EHKRTLFFSNDWTKTTVDNF

SEQ ID NO: 2580108 - protein, 18 aa, Entamoeba histolytica
EHLLRLRAAYHEGITYDN

SEQ ID NO: 2580109 - protein, 21 aa, Entamoeba histolytica
EHPHPVYLYLLKKGFKDRPLV

SEQ ID NO: 2580110 - protein, 21 aa, Entamoeba histolytica
EHRKMFSSLFLKFTSNPINLY

SEQ ID NO: 2580111 - protein, 18 aa, Entamoeba histolytica
EHSLKLFPYKSQFEDTSN

SEQ ID NO: 2580112 - protein, 19 aa, Entamoeba histolytica
EHSQWKCDIDVLIDSFELF

SEQ ID NO: 2580113 - protein, 21 aa, Entamoeba histolytica
EHTGALIPFQFFIEMVEGISE

SEQ ID NO: 2580114 - protein, 27 aa, Entamoeba histolytica
EHTIGLMKGCARGVYYLHKLGIVHRDL

SEQ ID NO: 2580115 - protein, 18 aa, Entamoeba histolytica
EHTSKIIINLVVTCPHEE

SEQ ID NO: 2580116 - protein, 22 aa, Entamoeba histolytica
EHTVPFGLILLCILIIGPPTGL

SEQ ID NO: 2580117 - protein, 18 aa, Entamoeba histolytica
EHVTSYIKEIFKRYYQEI

SEQ ID NO: 2580118 - protein, 19 aa, Entamoeba histolytica
EHYFYKQSDSFSFSIICWE

SEQ ID NO: 2580119 - protein, 18 aa, Entamoeba histolytica
EIALNILMQTARTRSLIP

SEQ ID NO: 2580120 - protein, 22 aa, Entamoeba histolytica
EIAQSMSYHAFILSKITTLQND

SEQ ID NO: 2580121 - protein, 18 aa, Entamoeba histolytica
EIATCKFSDLFIEDDYLT

SEQ ID NO: 2580122 - protein, 17 aa, Entamoeba histolytica
EICHHFDMILSMLESSG

SEQ ID NO: 2580123 - protein, 23 aa, Entamoeba histolytica
EICRYQKCYLYYLNIGLLILLSY

SEQ ID NO: 2580124 - protein, 24 aa, Entamoeba histolytica
EIDRKLEFLAIPFVYKKNDNSFRS

SEQ ID NO: 2580125 - protein, 21 aa, Entamoeba histolytica
EIEEIKKALKLMENNKIDDAE

SEQ ID NO: 2580126 - protein, 25 aa, Entamoeba histolytica
EIEGSREWFIKKLVKVVDYCATSGR

SEQ ID NO: 2580127 - protein, 20 aa, Entamoeba histolytica
EIEINISYRILYPVITRIIP

SEQ ID NO: 2580128 - protein, 18 aa, Entamoeba histolytica
EIEMARAIGLGAKGILTD

SEQ ID NO: 2580129 - protein, 22 aa, Entamoeba histolytica
EIERLIEWGRDLDFIDEEEIKK

SEQ ID NO: 2580130 - protein, 17 aa, Entamoeba histolytica
EIETWDFLHFLLFVSTL

SEQ ID NO: 2580131 - protein, 20 aa, Entamoeba histolytica
EIEYPTTIWDRWRPTTFTDD

SEQ ID NO: 2580132 - protein, 19 aa, Entamoeba histolytica
EIFQFPIFLIITQFVVSIL

SEQ ID NO: 2580133 - protein, 28 aa, Entamoeba histolytica
EIGSIRVALLLWKHFFLSLPNPVIEEDV

SEQ ID NO: 2580134 - protein, 30 aa, Entamoeba histolytica
EIGTALGGQEQWKGLAIFVDTFQNSYASIP

SEQ ID NO: 2580135 - protein, 20 aa, Entamoeba histolytica
EIHPDLTLNIHVGFLSTSEK

SEQ ID NO: 2580136 - protein, 25 aa, Entamoeba histolytica
EIIALVGASGCRKSTTIQLIQRNYE

SEQ ID NO: 2580137 - protein, 24 aa, Entamoeba histolytica
EIIFDFAGIIAFFLAFTLPCLFIF

SEQ ID NO: 2580138 - protein, 24 aa, Entamoeba histolytica
EIIGAVLKPKCKNWNIIAKVMDLQ

SEQ ID NO: 2580139 - protein, 18 aa, Entamoeba histolytica
EIILFSVMYYLSKILSSF

SEQ ID NO: 2580140 - protein, 21 aa, Entamoeba histolytica
EIIPCDCVPIYSSLPDGICKV

SEQ ID NO: 2580141 - protein, 20 aa, Entamoeba histolytica
EIISMFGVFAPWVYGISTII

SEQ ID NO: 2580142 - protein, 25 aa, Entamoeba histolytica
EIKCRECSYGYYWKDGSCSKCSESN

SEQ ID NO: 2580143 - protein, 21 aa, Entamoeba histolytica
EIKKLCIPFLKYVTNAESERK

SEQ ID NO: 2580144 - protein, 24 aa, Entamoeba histolytica
EIKRNEFIPELLRRTEILTGAEET

SEQ ID NO: 2580145 - protein, 24 aa, Entamoeba histolytica
EILEFKILAIFSFNSDRKRQSVIV

SEQ ID NO: 2580146 - protein, 23 aa, Entamoeba histolytica
EILFLFLNVFYFKAKSMTNNISS

SEQ ID NO: 2580147 - protein, 19 aa, Entamoeba histolytica
EILGTGVGFIFSLLWVITR

SEQ ID NO: 2580148 - protein, 20 aa, Entamoeba histolytica
EILISVPVIGIFEKAAQIVP

SEQ ID NO: 2580149 - protein, 23 aa, Entamoeba histolytica
EILLSIRLQKIFNLPSDVLAVSI

SEQ ID NO: 2580150 - protein, 21 aa, Entamoeba histolytica
EILRSIKFIKYNAWEEPLHKR

SEQ ID NO: 2580151 - protein, 20 aa, Entamoeba histolytica
EILSETSLPLSEHIDELIPI

SEQ ID NO: 2580152 - protein, 23 aa, Entamoeba histolytica
EINKDFFHHLSFPIKLTKKVILD

SEQ ID NO: 2580153 - protein, 24 aa, Entamoeba histolytica
EINLKGWNKYCGKLDTKFESDGDK

SEQ ID NO: 2580154 - protein, 20 aa, Entamoeba histolytica
EINPFIRLEIIINLLNLICY

SEQ ID NO: 2580155 - protein, 21 aa, Entamoeba histolytica
EINVYPYIRYETVPPSSLPDS

SEQ ID NO: 2580156 - protein, 28 aa, Entamoeba histolytica
EIPIKVITFRGSQSFSDFVYDIQLFSES

SEQ ID NO: 2580157 - protein, 20 aa, Entamoeba histolytica
EIPINKWVKIGLTVNSTSLT

SEQ ID NO: 2580158 - protein, 20 aa, Entamoeba histolytica
EIPKGKKIRVNTCNKHTDSD

SEQ ID NO: 2580159 - protein, 23 aa, Entamoeba histolytica
EIPLPCLHSTALALTFSRDIFSR

SEQ ID NO: 2580160 - protein, 19 aa, Entamoeba histolytica
EIQFKVGLHSTHLHVFYTN

SEQ ID NO: 2580161 - protein, 20 aa, Entamoeba histolytica
EIQHKFDFVELFFDHIFNLQ

SEQ ID NO: 2580162 - protein, 20 aa, Entamoeba histolytica
EIRGWKNFIYFGGATIILLL

SEQ ID NO: 2580163 - protein, 23 aa, Entamoeba histolytica
EIRGWKNFLFFAIGTLILIGGIV

SEQ ID NO: 2580164 - protein, 24 aa, Entamoeba histolytica
EIRKIKIIIVGSLALIILGIAMLF

SEQ ID NO: 2580165 - protein, 17 aa, Entamoeba histolytica
EISSFVTNCLFAGSESY

SEQ ID NO: 2580166 - protein, 20 aa, Entamoeba histolytica
EISYCVGGKYLSIIVQLSAF

SEQ ID NO: 2580167 - protein, 21 aa, Entamoeba histolytica
EISYCVGGKYLSIIVQLSAFW

SEQ ID NO: 2580168 - protein, 18 aa, Entamoeba histolytica
EITDIFWIIGSICTVILA

SEQ ID NO: 2580169 - protein, 25 aa, Entamoeba histolytica
EIVHPCVAFPYNIQWNDIINTNGFS

SEQ ID NO: 2580170 - protein, 19 aa, Entamoeba histolytica
EIVPGLFTIRAQNLNQLLF

SEQ ID NO: 2580171 - protein, 19 aa, Entamoeba histolytica
EIVTIKFPKGMSYKGIQVG

SEQ ID NO: 2580172 - protein, 25 aa, Entamoeba histolytica
EIWVKEIYKEGCWYAFNTNGQQKIP

SEQ ID NO: 2580173 - protein, 25 aa, Entamoeba histolytica
EIYKYPWDIADTITIGKRPNIIQEV

SEQ ID NO: 2580174 - protein, 36 aa, Entamoeba histolytica
EIYPSPFRIAYELPIKLPYHYPLWKAMIAITSLLIP

SEQ ID NO: 2580175 - protein, 25 aa, Entamoeba histolytica
EIYPYCSTGSMGECLAEQYYNCGDD

SEQ ID NO: 2580176 - protein, 18 aa, Entamoeba histolytica
EKAEVAIPLIYNAKGFPE

SEQ ID NO: 2580177 - protein, 24 aa, Entamoeba histolytica
EKALKYLYCNGLDKEGLFRISSTP

SEQ ID NO: 2580178 - protein, 30 aa, Entamoeba histolytica
EKASYAFDFCFKWINKLKWIIVVFWIIVAL

SEQ ID NO: 2580179 - protein, 24 aa, Entamoeba histolytica
EKCFKCLTGFIPYNGQCITLKSIN

SEQ ID NO: 2580180 - protein, 18 aa, Entamoeba histolytica
EKCINIWFGKQYSFDTLN

SEQ ID NO: 2580181 - protein, 26 aa, Entamoeba histolytica
EKCLLYGSMCDLMIRKIPKTSSKVYG

SEQ ID NO: 2580182 - protein, 23 aa, Entamoeba histolytica
EKDGKGRKTVACNSKTVLYLNQT

SEQ ID NO: 2580183 - protein, 22 aa, Entamoeba histolytica
EKDGVCTKCGNGIVDVGEECDP

SEQ ID NO: 2580184 - protein, 19 aa, Entamoeba histolytica
EKEEFCCHLELNDAIDIGT

SEQ ID NO: 2580185 - protein, 23 aa, Entamoeba histolytica
EKEEGKGWCSIITLIFALSLHSF

SEQ ID NO: 2580186 - protein, 25 aa, Entamoeba histolytica
EKEEWKWTDMEGLEISPFNTKQVSS

SEQ ID NO: 2580187 - protein, 23 aa, Entamoeba histolytica
EKEGRASISASFVKGNGFSVRGN

SEQ ID NO: 2580188 - protein, 23 aa, Entamoeba histolytica
EKEIEIRSSALRKQLMKEREQNE

SEQ ID NO: 2580189 - protein, 20 aa, Entamoeba histolytica
EKEIKKPLIQKKERKVKEVK

SEQ ID NO: 2580190 - protein, 25 aa, Entamoeba histolytica
EKEIYDVLIKWGYFIQMPSVSPFIE

SEQ ID NO: 2580191 - protein, 26 aa, Entamoeba histolytica
EKEKKKRIINMIGIIMYQMRRSLYEW

SEQ ID NO: 2580192 - protein, 22 aa, Entamoeba histolytica
EKERYFHFLSNSFFFERIMTFY

SEQ ID NO: 2580193 - protein, 34 aa, Entamoeba histolytica; identical to SEQ ID NO: 2381504

SEQ ID NO: 2580194 - protein, 25 aa, Entamoeba histolytica
EKESRECLYRNGGISEYIRNPRLTA

SEQ ID NO: 2580195 - protein, 19 aa, Entamoeba histolytica
EKEYEVFKNSLISSIEDPF

SEQ ID NO: 2580196 - protein, 24 aa, Entamoeba histolytica
EKFAKEGFNLIVIARREEILKQMK

SEQ ID NO: 2580197 - protein, 17 aa, Entamoeba histolytica
EKFHLTSDFHFDPSVNH

SEQ ID NO: 2580198 - protein, 22 aa, Entamoeba histolytica
EKFKYPWDIAQFIGSGKRLEKP

SEQ ID NO: 2580199 - protein, 26 aa, Entamoeba histolytica
EKFTVGFKIFIGMFIGIAVVIVAIIV

SEQ ID NO: 2580200 - protein, 19 aa, Entamoeba histolytica
EKHQTICYCLNYFGMQEEA

SEQ ID NO: 2580201 - protein, 19 aa, Entamoeba histolytica
EKIDLKKNRLDVVKDKLNN

SEQ ID NO: 2580202 - protein, 22 aa, Entamoeba histolytica
EKIFSLWGFIISYVVYKGGCVT

SEQ ID NO: 2580203 - protein, 25 aa, Entamoeba histolytica
EKIKMKRMNGIFALRHCTVTMMNYP

SEQ ID NO: 2580204 - protein, 18 aa, Entamoeba histolytica
EKIPEKQASVFLILIPTT

SEQ ID NO: 2580205 - protein, 23 aa, Entamoeba histolytica
EKKFIKITESFRVDINNSDVRVS

SEQ ID NO: 2580206 - protein, 24 aa, Entamoeba histolytica
EKKKYYGVLQFEFSYLSSIDFESE

SEQ ID NO: 2580207 - protein, 23 aa, Entamoeba histolytica
EKKRNGVCVTVYLRDNDNDKFTP

SEQ ID NO: 2580208 - protein, 26 aa, Entamoeba histolytica
EKKYARLTITFAILGIFMSPLFILSF

SEQ ID NO: 2580209 - protein, 25 aa, Entamoeba histolytica
EKKYGCGKCEDKVKTICPGNTPSGD

SEQ ID NO: 2580210 - protein, 21 aa, Entamoeba histolytica
EKLFKETLFFFTADENASNIY

SEQ ID NO: 2580211 - protein, 27 aa, Entamoeba histolytica
EKLGWRATTSFEEGLKKTVEWYLEHRN

SEQ ID NO: 2580212 - protein, 35 aa, Entamoeba histolytica
EKLGWRATTSFEEGLKKTVEWYLGHRNNWERTDEA

SEQ ID NO: 2580213 - protein, 32 aa, Entamoeba histolytica; identical to SEQ ID NO: 2381524

SEQ ID NO: 2580214 - protein, 19 aa, Entamoeba histolytica
EKLLFGMNCSYHFAMYHLL

SEQ ID NO: 2580215 - protein, 28 aa, Entamoeba histolytica
EKLTYISFNVYISINYCVITNATESIVN

SEQ ID NO: 2580216 - protein, 17 aa, Entamoeba histolytica
EKLWAIANLILGIGFVF

SEQ ID NO: 2580217 - protein, 23 aa, Entamoeba histolytica
EKLWFENELKKWGGIEFLVSLFI

SEQ ID NO: 2580218 - protein, 33 aa, Entamoeba histolytica
EKMGGLKPSWEVAYCSWEESINCAISVVEWLSQ

SEQ ID NO: 2580219 - protein, 21 aa, Entamoeba histolytica
EKMKAFTLFLPHVNKDNLKEL

SEQ ID NO: 2580220 - protein, 23 aa, Entamoeba histolytica
EKMWLYEITHEFGINLSSFPSYF

SEQ ID NO: 2580221 - protein, 26 aa, Entamoeba histolytica
EKNLLICFSPSLKINGVLLQYLLFCS

SEQ ID NO: 2580222 - protein, 33 aa, Entamoeba histolytica
EKPMKKRIWWLRIIEEIWLILVGFVRSSFYTIT

SEQ ID NO: 2580223 - protein, 19 aa, Entamoeba histolytica
EKPRVVAVSSLAHLFTTNK

SEQ ID NO: 2580224 - protein, 18 aa, Entamoeba histolytica
EKQECIISMFQLYDCSIA

SEQ ID NO: 2580225 - protein, 21 aa, Entamoeba histolytica
EKQFRRIIVSSIGGNKTQFVF

SEQ ID NO: 2580226 - protein, 24 aa, Entamoeba histolytica
EKQIIINYMYWKNFIQAHYPEVTD

SEQ ID NO: 2580227 - protein, 21 aa, Entamoeba histolytica
EKRFPVWAYVLIVLFSFAILF

SEQ ID NO: 2580228 - protein, 29 aa, Entamoeba histolytica
EKRIGKKRLWELFFVFLVGFFRCSFFTLT

SEQ ID NO: 2580229 - protein, 18 aa, Entamoeba histolytica
EKRKVIGTFAIEEESFHF

SEQ ID NO: 2580230 - protein, 24 aa, Entamoeba histolytica
EKRKVISCIIAIVICIAVTLTFIS

SEQ ID NO: 2580231 - protein, 21 aa, Entamoeba histolytica
EKRSQIIIVIMRDFEVICFNP

SEQ ID NO: 2580232 - protein, 24 aa, Entamoeba histolytica
EKSELRYPTIHLFDYQRNKKEGFP

SEQ ID NO: 2580233 - protein, 18 aa, Entamoeba histolytica
EKSKWWISLISVGILLIL

SEQ ID NO: 2580234 - protein, 18 aa, Entamoeba histolytica
EKSPKIWLYSSRLVAAVP

SEQ ID NO: 2580235 - protein, 26 aa, Entamoeba histolytica
EKSSNWKIGLVIGVLVVVLIIIIILI

SEQ ID NO: 2580236 - protein, 23 aa, Entamoeba histolytica
EKSTSCSKCPFGYTPNEKQTDCV

SEQ ID NO: 2580237 - protein, 25 aa, Entamoeba histolytica
EKTIYKSKCCSIKLSFITQHSCYIN

SEQ ID NO: 2580238 - protein, 21 aa, Entamoeba histolytica
EKTPLGHCFLSINCEAKCCVC

SEQ ID NO: 2580239 - protein, 28 aa, Entamoeba histolytica
EKVCTECEFPCYAAASGEYIRDDSNAKT

SEQ ID NO: 2580240 - protein, 24 aa, Entamoeba histolytica
EKVCYKAFGIRALYYQFKITTNNV

SEQ ID NO: 2580241 - protein, 24 aa, Entamoeba histolytica
EKVGWFTFIEVFGFIFLTGGFLLY

SEQ ID NO: 2580242 - protein, 26 aa, Entamoeba histolytica
EKVHFIRKRLNKVINWDQDTHQLIDT

SEQ ID NO: 2580243 - protein, 29 aa, Entamoeba histolytica
EKVQFIFRFACRALKEKKVLWIVTGSSAI

SEQ ID NO: 2580244 - protein, 17 aa, Entamoeba histolytica
EKVRICITIECSCQPNE

SEQ ID NO: 2580245 - protein, 18 aa, Entamoeba histolytica
EKVVQCITPIISKLQSLL

SEQ ID NO: 2580246 - protein, 28 aa, Entamoeba histolytica
EKVWGVVKVLGFISLGVGVGVAIGVIGG

SEQ ID NO: 2580247 - protein, 22 aa, Entamoeba histolytica
EKWGCLQLGLLNPARADQYSAI

SEQ ID NO: 2580248 - protein, 20 aa, Entamoeba histolytica
EKYFYSFIGLLGLSYLVIGS

SEQ ID NO: 2580249 - protein, 19 aa, Entamoeba histolytica
EKYGSSGFIKWGSELVNIF

SEQ ID NO: 2580250 - protein, 19 aa, Entamoeba histolytica
EKYHFVMLYFIMNFPNDVK

SEQ ID NO: 2580251 - protein, 21 aa, Entamoeba histolytica
EKYKKFKIFSSFTEEFGEIQW

SEQ ID NO: 2580252 - protein, 19 aa, Entamoeba histolytica
EKYLPLVLFIAGFFIPLCW

SEQ ID NO: 2580253 - protein, 21 aa, Entamoeba histolytica
EKYYFKTGVCLDKQRYENTKD

SEQ ID NO: 2580254 - protein, 28 aa, Entamoeba histolytica
ELDAICSKELYLFWLFNVGNRKTKEEII

SEQ ID NO: 2580255 - protein, 19 aa, Entamoeba histolytica
ELDCLNCQLSTKSSDNSAK

SEQ ID NO: 2580256 - protein, 22 aa, Entamoeba histolytica
ELDQLCWTVFWTSEDSRLKFKV

SEQ ID NO: 2580257 - protein, 23 aa, Entamoeba histolytica
ELEEVKDPLFLLAVSGGGLVVNI

SEQ ID NO: 2580258 - protein, 24 aa, Entamoeba histolytica
ELFFECIKFNFSKERTHEEEIFII

SEQ ID NO: 2580259 - protein, 17 aa, Entamoeba histolytica
ELFKCLHDLAQFGSGEI

SEQ ID NO: 2580260 - protein, 19 aa, Entamoeba histolytica
ELFSLPLFYFISQNKSYWC

SEQ ID NO: 2580261 - protein, 19 aa, Entamoeba histolytica
ELGDFSVPVAKIIRQMKTE

SEQ ID NO: 2580262 - protein, 24 aa, Entamoeba histolytica
ELGIIIVFFIKCGKKLIHQHLYLF

SEQ ID NO: 2580263 - protein, 17 aa, Entamoeba histolytica
ELHLFKFSPEIIYQLSI

SEQ ID NO: 2580264 - protein, 20 aa, Entamoeba histolytica
ELHSQPVVPTVQHEEQGASG

SEQ ID NO: 2580265 - protein, 40 aa, Entamoeba histolytica
ELIHLPSPLLKIAESCLRLPLPADKLVSFMFISLPIASSI

SEQ ID NO: 2580266 - protein, 19 aa, Entamoeba histolytica
ELIKTYYSIHPKIRSFIYF

SEQ ID NO: 2580267 - protein, 19 aa, Entamoeba histolytica
ELINTLFLQMGYNMNYTES

SEQ ID NO: 2580268 - protein, 24 aa, Entamoeba histolytica
ELIPEFFYFPEFLKNFDHFDLKKR

SEQ ID NO: 2580269 - protein, 17 aa, Entamoeba histolytica
ELIPLTLHDHLFIKLQQ

SEQ ID NO: 2580270 - protein, 20 aa, Entamoeba histolytica
ELKDINAFTIDWEDLKRLKQ

SEQ ID NO: 2580271 - protein, 19 aa, Entamoeba histolytica
ELKDLLKRYQITKYHGTNK

SEQ ID NO: 2580272 - protein, 20 aa, Entamoeba histolytica
ELKIIIKLLTRMLLSCIIEN

SEQ ID NO: 2580273 - protein, 22 aa, Entamoeba histolytica
ELKLIISCGYYNYLSYTKGPLI

SEQ ID NO: 2580274 - protein, 31 aa, Entamoeba histolytica
ELKPLTHLMFWSIFEGIVFLLWIISLLLLII

SEQ ID NO: 2580275 - protein, 19 aa, Entamoeba histolytica
ELKQRNCPGGKIYTYTPSI

SEQ ID NO: 2580276 - protein, 19 aa, Entamoeba histolytica
ELKSFMGRVMQYHQVSLSF

SEQ ID NO: 2580277 - protein, 24 aa, Entamoeba histolytica
ELKTLRPFFDLEISVKSLIQLIIQ

SEQ ID NO: 2580278 - protein, 21 aa, Entamoeba histolytica
ELKVMFENECIYKQETKDSFN

SEQ ID NO: 2580279 - protein, 17 aa, Entamoeba histolytica
ELLFYQAQYYLKQKVYQ

SEQ ID NO: 2580280 - protein, 23 aa, Entamoeba histolytica
ELLKQVRPGMDLSRITFPSHILE

SEQ ID NO: 2580281 - protein, 19 aa, Entamoeba histolytica
ELLLEFLSYCCFIHQCCSK

SEQ ID NO: 2580282 - protein, 20 aa, Entamoeba histolytica
ELLLQYYLHIIFPIKTLDSS

SEQ ID NO: 2580283 - protein, 24 aa, Entamoeba histolytica
ELLMTLKVTLNFGNILNASSPLRC

SEQ ID NO: 2580284 - protein, 29 aa, Entamoeba histolytica
ELLPSIEFLPICISFIVLMISYNIYLVVI

SEQ ID NO: 2580285 - protein, 20 aa, Entamoeba histolytica
ELLRRPERNSGRVKAATKCV

SEQ ID NO: 2580286 - protein, 19 aa, Entamoeba histolytica
ELLSLKLVLFILFLVCLIF

SEQ ID NO: 2580287 - protein, 26 aa, Entamoeba histolytica
ELLSYGVWCLIGFFVYSIYKFLTSIN

SEQ ID NO: 2580288 - protein, 19 aa, Entamoeba histolytica
ELLSYICSDYCKTYCIDTF

SEQ ID NO: 2580289 - protein, 28 aa, Entamoeba histolytica
ELMKEFINAFFIIKQYFSVLSIHNENRI

SEQ ID NO: 2580290 - protein, 18 aa, Entamoeba histolytica
ELMNLGIVSFCFVIFDIA

SEQ ID NO: 2580291 - protein, 28 aa, Entamoeba histolytica
ELNFTLGCIPYFEISFMKQIVDPHNIPP

SEQ ID NO: 2580292 - protein, 23 aa, Entamoeba histolytica
ELNGVCISCKQFGNQCSQCSATK

SEQ ID NO: 2580293 - protein, 26 aa, Entamoeba histolytica
ELNRVTGICILLLFIVVLVMTICTTI

SEQ ID NO: 2580294 - protein, 24 aa, Entamoeba histolytica
ELNYNAKVAQYFSFTSNIQNNIAP

SEQ ID NO: 2580295 - protein, 23 aa, Entamoeba histolytica
ELPKEYKGSCDNIIKSLKADLAQ

SEQ ID NO: 2580296 - protein, 20 aa, Entamoeba histolytica
ELPNIRGCIFLYKHSNGCTI

SEQ ID NO: 2580297 - protein, 25 aa, Entamoeba histolytica
ELQQRLKPFLKEEMVIAEIERKFNQ

SEQ ID NO: 2580298 - protein, 20 aa, Entamoeba histolytica
ELRFHCCGWKTLPADASKCA

SEQ ID NO: 2580299 - protein, 21 aa, Entamoeba histolytica
ELRTYCLSKLCGNGEIDEGED

SEQ ID NO: 2580300 - protein, 24 aa, Entamoeba histolytica
ELSEIKTGFSTYAISALKKRFSLT

SEQ ID NO: 2580301 - protein, 19 aa, Entamoeba histolytica
ELSNYEFLYEVNRYANRSF

SEQ ID NO: 2580302 - protein, 20 aa, Entamoeba histolytica
ELSPFMAFVLYLVYIQIDYH

SEQ ID NO: 2580303 - protein, 24 aa, Entamoeba histolytica
ELSSKKGCTRCFDHFYLDSNGNCQ

SEQ ID NO: 2580304 - protein, 26 aa, Entamoeba histolytica
ELTFIPLKLFYDFLITKVLHEKSFFG

SEQ ID NO: 2580305 - protein, 24 aa, Entamoeba histolytica
ELTKLRSPLLINIIGAVTTPEHEC

SEQ ID NO: 2580306 - protein, 20 aa, Entamoeba histolytica
ELVGSYGLIVFVVLIFIIIR

SEQ ID NO: 2580307 - protein, 23 aa, Entamoeba histolytica
ELVKCYKHLINILLSTFCHTSIV

SEQ ID NO: 2580308 - protein, 22 aa, Entamoeba histolytica
ELWNCSEGIKFFISSPKVPNSG

SEQ ID NO: 2580309 - protein, 25 aa, Entamoeba histolytica
ELYFYCIKCSIKIQIIKECNFIQFG

SEQ ID NO: 2580310 - protein, 19 aa, Entamoeba histolytica
ELYKRWGEEKGGWYINYAT

SEQ ID NO: 2580311 - protein, 24 aa, Entamoeba histolytica
EMAGFLTERIEVIINTLSQISNAT

SEQ ID NO: 2580312 - protein, 24 aa, Entamoeba histolytica
EMCWLIKKNCCEIVSGSINVEAEK

SEQ ID NO: 2580313 - protein, 22 aa, Entamoeba histolytica
EMFAHRYAECWSDKMKEMNITS

SEQ ID NO: 2580314 - protein, 20 aa, Entamoeba histolytica
EMFFGIPLFVANSELGLLRK

SEQ ID NO: 2580315 - protein, 21 aa, Entamoeba histolytica
EMFVGVFFFCLYLAQTTSLVL

SEQ ID NO: 2580316 - protein, 22 aa, Entamoeba histolytica
EMIECAKMANAHDFISKLPEGY

SEQ ID NO: 2580317 - protein, 20 aa, Entamoeba histolytica
EMIECAKMANAHEFISHLPE

SEQ ID NO: 2580318 - protein, 20 aa, Entamoeba histolytica
EMIECTKMANAHEFVSKLPE

SEQ ID NO: 2580319 - protein, 17 aa, Entamoeba histolytica
EMIEGFMRMIRRNKEIV

SEQ ID NO: 2580320 - protein, 22 aa, Entamoeba histolytica
EMIKLRRLVCNESCATNIVKEC

SEQ ID NO: 2580321 - protein, 22 aa, Entamoeba histolytica
EMINSAILEICYSPQMFPIPIP

SEQ ID NO: 2580322 - protein, 21 aa, Entamoeba histolytica
EMKAPAFIRRFVKSIDNKTRL

SEQ ID NO: 2580323 - protein, 24 aa, Entamoeba histolytica
EMKELAESLVRDWPAIEKSVEASK

SEQ ID NO: 2580324 - protein, 22 aa, Entamoeba histolytica
EMLLEGVGALLIAKALVDYSTI

SEQ ID NO: 2580325 - protein, 22 aa, Entamoeba histolytica
EMLQIICVCYSFGDKYLKEIGN

SEQ ID NO: 2580326 - protein, 19 aa, Entamoeba histolytica
EMNEVYYPLDGMSLIVQTD

SEQ ID NO: 2580327 - protein, 24 aa, Entamoeba histolytica
EMPNEFTHRINIIFLLLLIEEGVN

SEQ ID NO: 2580328 - protein, 19 aa, Entamoeba histolytica
EMQICPNVRSFEQWTPLDE

SEQ ID NO: 2580329 - protein, 24 aa, Entamoeba histolytica
ENAGRYYLMIGCEGMVTTEGALCK

SEQ ID NO: 2580330 - protein, 18 aa, Entamoeba histolytica
ENEIERLIEWGREITPIN

SEQ ID NO: 2580331 - protein, 25 aa, Entamoeba histolytica
ENEIPMSLRLKFMIDSAKGIEYLHS

SEQ ID NO: 2580332 - protein, 18 aa, Entamoeba histolytica
ENERRSSTMFVRQISETP

SEQ ID NO: 2580333 - protein, 24 aa, Entamoeba histolytica
ENEVKLLVRTVCYTYFLYSLIIDE

SEQ ID NO: 2580334 - protein, 23 aa, Entamoeba histolytica
ENGVPGTIKTPISNEKILENGGQ

SEQ ID NO: 2580335 - protein, 20 aa, Entamoeba histolytica
ENHSFFNPWSLKNEYKKLYS

SEQ ID NO: 2580336 - protein, 17 aa, Entamoeba histolytica
ENIFNSRGDEWWSSVCL

SEQ ID NO: 2580337 - protein, 19 aa, Entamoeba histolytica
ENKCIPMCSIKGCDGECAS

SEQ ID NO: 2580338 - protein, 19 aa, Entamoeba histolytica
ENKELFVHMLAIASGCGVA

SEQ ID NO: 2580339 - protein, 26 aa, Entamoeba histolytica
ENLFFYFKFPNLISLPLNFSAETKKN

SEQ ID NO: 2580340 - protein, 24 aa, Entamoeba histolytica
ENLFPSCLLGMIRLEGFNETTKWL

SEQ ID NO: 2580341 - protein, 23 aa, Entamoeba histolytica
ENLHRIGNDILFISTIGNDLLGK

SEQ ID NO: 2580342 - protein, 21 aa, Entamoeba histolytica
ENNCCGWKTLKLYGCGSSIDS

SEQ ID NO: 2580343 - protein, 19 aa, Entamoeba histolytica
ENNGRYYFKEEGAITTCEY

SEQ ID NO: 2580344 - protein, 22 aa, Entamoeba histolytica
ENQRGVGYISHMLGHIAQQSNK

SEQ ID NO: 2580345 - protein, 20 aa, Entamoeba histolytica
ENQTFFSFFQSIFLTFQTTF

SEQ ID NO: 2580346 - protein, 25 aa, Entamoeba histolytica
ENRKRLDAITLMYLFTKCNYITTYD

SEQ ID NO: 2580347 - protein, 25 aa, Entamoeba histolytica
ENRNSSIYSVCWSFGKSLGYLFGGL

SEQ ID NO: 2580348 - protein, 29 aa, Entamoeba histolytica
ENSEIKYQIPLYLIVLVVFFGFDEFIAIL

SEQ ID NO: 2580349 - protein, 18 aa, Entamoeba histolytica
ENSKIIWNGYVSFERLIK

SEQ ID NO: 2580350 - protein, 24 aa, Entamoeba histolytica
ENSRCTKCSFGHTVIDDTYCSNFS

SEQ ID NO: 2580351 - protein, 26 aa, Entamoeba histolytica
ENSVFNRALLLFLRFYNHQSCDPYFL

SEQ ID NO: 2580352 - protein, 23 aa, Entamoeba histolytica
ENTECPLGCCLFIRVIPVEDLII

SEQ ID NO: 2580353 - protein, 19 aa, Entamoeba histolytica
ENVIECIHCEKGYYLNSMK

SEQ ID NO: 2580354 - protein, 21 aa, Entamoeba histolytica
ENVIRIKSLIPKMDHSELLNS

SEQ ID NO: 2580355 - protein, 25 aa, Entamoeba histolytica
ENWLRNARDWAISRNRFWGTPIPIW

SEQ ID NO: 2580356 - protein, 21 aa, Entamoeba histolytica
EPFAMIGGFIWSVGNVFSVPA

SEQ ID NO: 2580357 - protein, 23 aa, Entamoeba histolytica
EPFEIQIPLVFQKCPVHCSQHFL

SEQ ID NO: 2580358 - protein, 17 aa, Entamoeba histolytica
EPFTCFFEGNQIPSMTN

SEQ ID NO: 2580359 - protein, 26 aa, Entamoeba histolytica
EPGKEEVFRINKNIISATSKNLKHGT

SEQ ID NO: 2580360 - protein, 19 aa, Entamoeba histolytica
EPIEMNEMIYGIINGILEI

SEQ ID NO: 2580361 - protein, 21 aa, Entamoeba histolytica
EPIYKLITLCWAQEPKERLPI

SEQ ID NO: 2580362 - protein, 25 aa, Entamoeba histolytica
EPKIGIYKWAPLLSIFMCLTTLLTQ

SEQ ID NO: 2580363 - protein, 21 aa, Entamoeba histolytica
EPKRPQIIDMRERVWFLHDRV

SEQ ID NO: 2580364 - protein, 20 aa, Entamoeba histolytica
EPKTLVSYLSFCQIDGGHLD

SEQ ID NO: 2580365 - protein, 24 aa, Entamoeba histolytica
EPNHMFWGQSFIEPILFIFTVLSV

SEQ ID NO: 2580366 - protein, 25 aa, Entamoeba histolytica
EPNKKITVLFLKIFLINPTRFCTMY

SEQ ID NO: 2580367 - protein, 23 aa, Entamoeba histolytica
EPQIKKWWYVISIVLMPVLMTFG

SEQ ID NO: 2580368 - protein, 18 aa, Entamoeba histolytica
EPRCLSCTSTHFPMGKQC

SEQ ID NO: 2580369 - protein, 26 aa, Entamoeba histolytica
EPRNYCSSKILPTCYHVLITPHNTYK

SEQ ID NO: 2580370 - protein, 24 aa, Entamoeba histolytica
EPTCKMCNITCRICDKNPNWCTGC

SEQ ID NO: 2580371 - protein, 24 aa, Entamoeba histolytica
EPTNVTICPSLPPSKPGEVICMKT

SEQ ID NO: 2580372 - protein, 19 aa, Entamoeba histolytica
EPTYHFFKELDLQKQYERI

SEQ ID NO: 2580373 - protein, 18 aa, Entamoeba histolytica
EPYCSAVMPSMNKSLDDI

SEQ ID NO: 2580374 - protein, 22 aa, Entamoeba histolytica
EPYKEFKSLFDIKQYVEEGKRL

SEQ ID NO: 2580375 - protein, 22 aa, Entamoeba histolytica
EPYKEFKSLFDIKQYVTDGKRL

SEQ ID NO: 2580376 - protein, 24 aa, Entamoeba histolytica
EPYKEFKSLFDIKRFVENGERLKI

SEQ ID NO: 2580377 - protein, 37 aa, Entamoeba histolytica
EPYPILQWILRSCVLIAYFFCFILYFFMNILHHSSSI

SEQ ID NO: 2580378 - protein, 23 aa, Entamoeba histolytica
EQAFECIESVKVNRTVTEAIKKD

SEQ ID NO: 2580379 - protein, 23 aa, Entamoeba histolytica
EQAKEWLKYLPIKNKNEKLCNEL

SEQ ID NO: 2580380 - protein, 18 aa, Entamoeba histolytica
EQEVRMYKIYSSKTKRMY

SEQ ID NO: 2580381 - protein, 18 aa, Entamoeba histolytica
EQFKYPWEIADFISEGKR

SEQ ID NO: 2580382 - protein, 17 aa, Entamoeba histolytica
EQFKYPWQIAQFVSDKK

SEQ ID NO: 2580383 - protein, 18 aa, Entamoeba histolytica
EQFSCSKKVLGHGSLGTI

SEQ ID NO: 2580384 - protein, 23 aa, Entamoeba histolytica
EQGELLIGTWIDGVPVGPFESTE

SEQ ID NO: 2580385 - protein, 17 aa, Entamoeba histolytica
EQIFKFFSMTINQRAKM

SEQ ID NO: 2580386 - protein, 24 aa, Entamoeba histolytica
EQIIKMDTYRGWTEEERSCIAEMY

SEQ ID NO: 2580387 - protein, 17 aa, Entamoeba histolytica
EQIVACSSFPSFQNIYV

SEQ ID NO: 2580388 - protein, 25 aa, Entamoeba histolytica
EQKEWEMWMWFGIITAVIVIFCTLV

SEQ ID NO: 2580389 - protein, 24 aa, Entamoeba histolytica
EQKKRLEQFLSIKKLEPFACELLA

SEQ ID NO: 2580390 - protein, 24 aa, Entamoeba histolytica
EQKLKFMIDCCKGMAMMHSINIIH

SEQ ID NO: 2580391 - protein, 29 aa, Entamoeba histolytica
EQLIESFNCSKCPVGSASAVRNAAQCQLC

SEQ ID NO: 2580392 - protein, 26 aa, Entamoeba histolytica
EQLRSPCIISFIGYCITKESICLVME

SEQ ID NO: 2580393 - protein, 18 aa, Entamoeba histolytica
EQNQHPFNEHQLLSDQTP

SEQ ID NO: 2580394 - protein, 17 aa, Entamoeba histolytica
EQQKFAWNEFIFDIRKK

SEQ ID NO: 2580395 - protein, 25 aa, Entamoeba histolytica
EQRIRCQSCIGVFRDCVFKSQNKES

SEQ ID NO: 2580396 - protein, 19 aa, Entamoeba histolytica
EQSHLCGRDVFGIKPIEYS

SEQ ID NO: 2580397 - protein, 23 aa, Entamoeba histolytica
EQSSFFKWIFNQVNMDYSIKRLN

SEQ ID NO: 2580398 - protein, 26 aa, Entamoeba histolytica
EQSYKYCYLGMIFICGEQETGKRIKK

SEQ ID NO: 2580399 - protein, 24 aa, Entamoeba histolytica
EQVKIRICQDISKGMEYLHINDIL

SEQ ID NO: 2580400 - protein, 20 aa, Entamoeba histolytica
EQYSPFILKLFEFKNIDIIK

SEQ ID NO: 2580401 - protein, 19 aa, Entamoeba histolytica
EQYYCLINGIKIESEKINE

SEQ ID NO: 2580402 - protein, 27 aa, Entamoeba histolytica
ERATRWRFLGFWICAVLNLFVPNYISG

SEQ ID NO: 2580403 - protein, 18 aa, Entamoeba histolytica
ERCKRCENGYFISDGKCV

SEQ ID NO: 2580404 - protein, 18 aa, Entamoeba histolytica
ERDRAMSLSVTRGIKLSS

SEQ ID NO: 2580405 - protein, 17 aa, Entamoeba histolytica
EREEVRIQLKVITSRET

SEQ ID NO: 2580406 - protein, 24 aa, Entamoeba histolytica
EREGLKGIVIILNFTNPRLSDSIQ

SEQ ID NO: 2580407 - protein, 22 aa, Entamoeba histolytica
ERESKLGLIVNMSEWNGDPQYL

SEQ ID NO: 2580408 - protein, 19 aa, Entamoeba histolytica
ERFRFCHHECHNLIERLNT

SEQ ID NO: 2580409 - protein, 23 aa, Entamoeba histolytica
ERFSVRYAECNAALNMTPEQIYL

SEQ ID NO: 2580410 - protein, 20 aa, Entamoeba histolytica
ERGISLPLFFMGHSMGGLLT

SEQ ID NO: 2580411 - protein, 23 aa, Entamoeba histolytica
ERGNGFCSASFYGKSSQTYRVKA

SEQ ID NO: 2580412 - protein, 22 aa, Entamoeba histolytica
ERGYFRFVIFSVIMEAANMMML

SEQ ID NO: 2580413 - protein, 27 aa, Entamoeba histolytica
ERIKKVMKIFIHFIIKYMEENIKNKEI

SEQ ID NO: 2580414 - protein, 17 aa, Entamoeba histolytica
ERKASDLASEWMVSMRD

SEQ ID NO: 2580415 - protein, 17 aa, Entamoeba histolytica
ERKKFICDISFKEMIQN

SEQ ID NO: 2580416 - protein, 19 aa, Entamoeba histolytica
ERLDLFGYLSCKELHLKST

SEQ ID NO: 2580417 - protein, 21 aa, Entamoeba histolytica
ERLSGTIVMRAQDLILRLFNK

SEQ ID NO: 2580418 - protein, 17 aa, Entamoeba histolytica
ERNIPFYHIFAKSHRKV

SEQ ID NO: 2580419 - protein, 27 aa, Entamoeba histolytica
ERNIQLCVYGCGFALLSTFIFDGKSIL

SEQ ID NO: 2580420 - protein, 23 aa, Entamoeba histolytica
ERNLKSIIFLKLISVEEGALQNN

SEQ ID NO: 2580421 - protein, 21 aa, Entamoeba histolytica
ERNQLYGLVVFCRNFTHLFFG

SEQ ID NO: 2580422 - protein, 17 aa, Entamoeba histolytica
ERNREVIHTHKYANQLK

SEQ ID NO: 2580423 - protein, 24 aa, Entamoeba histolytica
ERNYCLKCLNGYKIENNTCVKDKE

SEQ ID NO: 2580424 - protein, 20 aa, Entamoeba histolytica
ERNYCLKCLNGYKLENNKCV

SEQ ID NO: 2580425 - protein, 36 aa, Entamoeba histolytica
ERRGDKIFNFLFRYIHKLRFVIVIFWILAVIGFAYP

SEQ ID NO: 2580426 - protein, 30 aa, Entamoeba histolytica
ERSFFKRYYLLFLVSFYLLAFIIPNYLASS

SEQ ID NO: 2580427 - protein, 24 aa, Entamoeba histolytica
ERSRLLPYTLFRLGGAAIILTNKW

SEQ ID NO: 2580428 - protein, 22 aa, Entamoeba histolytica
ERSSKIPVHFDITFPYSSCPIT

SEQ ID NO: 2580429 - protein, 18 aa, Entamoeba histolytica
ERTKEVIHTQIESNQNKM

SEQ ID NO: 2580430 - protein, 18 aa, Entamoeba histolytica
ERTNVLGVMGLFTYGVEA

SEQ ID NO: 2580431 - protein, 18 aa, Entamoeba histolytica
ERVDRGFTPYQIVINRKE

SEQ ID NO: 2580432 - protein, 24 aa, Entamoeba histolytica
ERYGRIIDLLRKWKNSKVPINETC

SEQ ID NO: 2580433 - protein, 19 aa, Entamoeba histolytica
ERYHLYRSGQMNEKQKQEF

SEQ ID NO: 2580434 - protein, 22 aa, Entamoeba histolytica
ERYSDIEILYFAASLLEDAKNV

SEQ ID NO: 2580435 - protein, 17 aa, Entamoeba histolytica
ERYSTTFLIKIQYCDGR

SEQ ID NO: 2580436 - protein, 24 aa, Entamoeba histolytica
ESALPRATKLLLLLGDAPTPTFEE

SEQ ID NO: 2580437 - protein, 19 aa, Entamoeba histolytica
ESCSEFFQRMELQNISSFS

SEQ ID NO: 2580438 - protein, 20 aa, Entamoeba histolytica
ESDESWKIIQLLKIDFIRDL

SEQ ID NO: 2580439 - protein, 24 aa, Entamoeba histolytica
ESDIRYYLYHNILSFIAGNDLNID

SEQ ID NO: 2580440 - protein, 22 aa, Entamoeba histolytica
ESDKDKCCFTCEELTESYQKLN

SEQ ID NO: 2580441 - protein, 21 aa, Entamoeba histolytica
ESDLEFGGFILFSSPIKKESN

SEQ ID NO: 2580442 - protein, 26 aa, Entamoeba histolytica
ESEKWGFWKTVVVIGLGAAGVVALVG

SEQ ID NO: 2580443 - protein, 18 aa, Entamoeba histolytica
ESELKRYVTFNNTTNVNQ

SEQ ID NO: 2580444 - protein, 23 aa, Entamoeba histolytica
ESETLYGMCYLLYGLIKTQWSQV

SEQ ID NO: 2580445 - protein, 22 aa, Entamoeba histolytica
ESGCSVCADGYYLFGNTCIVCN

SEQ ID NO: 2580446 - protein, 19 aa, Entamoeba histolytica
ESIIRPGVISVDLDKGIIY

SEQ ID NO: 2580447 - protein, 26 aa, Entamoeba histolytica
ESIPKLSIRLRFLLDAAKGIQYLHNN

SEQ ID NO: 2580448 - protein, 17 aa, Entamoeba histolytica
ESISGQMNCNWIGKMNK

SEQ ID NO: 2580449 - protein, 25 aa, Entamoeba histolytica
ESIVNELIYCFKKCLESTEYNLLII

SEQ ID NO: 2580450 - protein, 22 aa, Entamoeba histolytica
ESLEKFTSIFIQHFTSKFEYTQ

SEQ ID NO: 2580451 - protein, 18 aa, Entamoeba histolytica
ESLFPLCKTVVVNNFKEQ

SEQ ID NO: 2580452 - protein, 20 aa, Entamoeba histolytica
ESLFSDDLFWVIVGCVGGFI

SEQ ID NO: 2580453 - protein, 38 aa, Entamoeba histolytica
ESLKISKEFFSRPIYAVICMFLRIVVSEVQLQISSHNA

SEQ ID NO: 2580454 - protein, 20 aa, Entamoeba histolytica
ESLNGFARYHTKEDRGLNCY

SEQ ID NO: 2580455 - protein, 22 aa, Entamoeba histolytica
ESMIKHAWLAVHDFELSEQWFA

SEQ ID NO: 2580456 - protein, 19 aa, Entamoeba histolytica
ESMYKIILNIMNRTEFQPH

SEQ ID NO: 2580457 - protein, 20 aa, Entamoeba histolytica
ESNELFDFFETVMGKEETVK

SEQ ID NO: 2580458 - protein, 23 aa, Entamoeba histolytica
ESNMFKSMFTFCVVQMACYLRFL

SEQ ID NO: 2580459 - protein, 23 aa, Entamoeba histolytica
ESNPFLKRIKIISSIDASSQPTT

SEQ ID NO: 2580460 - protein, 18 aa, Entamoeba histolytica
ESPCCIKITDFGTSRFTK

SEQ ID NO: 2580461 - protein, 22 aa, Entamoeba histolytica
ESPMCKFALFFGNRITEEVELN

SEQ ID NO: 2580462 - protein, 27 aa, Entamoeba histolytica
ESPRSSTKLSFLIPSFMRKRSNSPSGG

SEQ ID NO: 2580463 - protein, 23 aa, Entamoeba histolytica
ESREIKIRTSICGGLIALCILLR

SEQ ID NO: 2580464 - protein, 24 aa, Entamoeba histolytica
ESRNGLFLPKLPPKIKEINETTSN

SEQ ID NO: 2580465 - protein, 20 aa, Entamoeba histolytica
ESSASFFKIFSEFVRDISSV

SEQ ID NO: 2580466 - protein, 22 aa, Entamoeba histolytica
ESSEFKMGMTFNQIITSTTFNP

SEQ ID NO: 2580467 - protein, 20 aa, Entamoeba histolytica
ESSKKCYTVGDVLDISELRY

SEQ ID NO: 2580468 - protein, 19 aa, Entamoeba histolytica
ESSSFKFSPTLKQCVPILC

SEQ ID NO: 2580469 - protein, 17 aa, Entamoeba histolytica
ESTCGFGSTIQLELYNT

SEQ ID NO: 2580470 - protein, 24 aa, Entamoeba histolytica
ESTLKEIIVFLIKEFQHLFPENVS

SEQ ID NO: 2580471 - protein, 22 aa, Entamoeba histolytica
ESTPRLFLEWFNSNELKFDGTI

SEQ ID NO: 2580472 - protein, 19 aa, Entamoeba histolytica
ESTQFKTIISIVSFCPTAL

SEQ ID NO: 2580473 - protein, 17 aa, Entamoeba histolytica
ESVDLSISFMAKCTTIL

SEQ ID NO: 2580474 - protein, 19 aa, Entamoeba histolytica
ESVYSFVLTCWDKDPKKRP

SEQ ID NO: 2580475 - protein, 19 aa, Entamoeba histolytica
ESYSKFEGIVFSLKKVKIV

SEQ ID NO: 2580476 - protein, 27 aa, Entamoeba histolytica
ETAREAAVMVICFKQIILPVNGINVSE

SEQ ID NO: 2580477 - protein, 19 aa, Entamoeba histolytica
ETASDVWSSPTCPCTGNGC

SEQ ID NO: 2580478 - protein, 17 aa, Entamoeba histolytica
ETDWKATSYDVYHLPEI

SEQ ID NO: 2580479 - protein, 27 aa, Entamoeba histolytica
ETDWKFRRCIKEFQGLDLLSLENTIFC

SEQ ID NO: 2580480 - protein, 20 aa, Entamoeba histolytica
ETDWKIRKTVPFTQNIDKQD

SEQ ID NO: 2580481 - protein, 22 aa, Entamoeba histolytica
ETDYKKFVEWQMKKLNELKEEL

SEQ ID NO: 2580482 - protein, 21 aa, Entamoeba histolytica
ETEDILDMYCYFRIEESDDQY

SEQ ID NO: 2580483 - protein, 27 aa, Entamoeba histolytica
ETELKRKDWYGVLAFSGIEPINEINEN

SEQ ID NO: 2580484 - protein, 20 aa, Entamoeba histolytica
ETFFICFLMFYVLSMFEALR

SEQ ID NO: 2580485 - protein, 31 aa, Entamoeba histolytica
ETFHWGECYPKLLFKFPWAIADFINKGQRRE

SEQ ID NO: 2580486 - protein, 22 aa, Entamoeba histolytica
ETFPFLFCCIFSWCIPVIVIFY

SEQ ID NO: 2580487 - protein, 17 aa, Entamoeba histolytica
ETFPFPWNIAEFISQGK

SEQ ID NO: 2580488 - protein, 18 aa, Entamoeba histolytica
ETGILWWHILLIIIGSVW

SEQ ID NO: 2580489 - protein, 23 aa, Entamoeba histolytica
ETGYKAEVIFNLRGTFSSDKYQT

SEQ ID NO: 2580490 - protein, 17 aa, Entamoeba histolytica
ETIEFLIRGGIKVWMIT

SEQ ID NO: 2580491 - protein, 22 aa, Entamoeba histolytica
ETIEIIRNFLLQCMLHPHETIS

SEQ ID NO: 2580492 - protein, 17 aa, Entamoeba histolytica
ETIHFPVECVSELPQRI

SEQ ID NO: 2580493 - protein, 25 aa, Entamoeba histolytica
ETIKKGESLFVFATTILREGSGNEF

SEQ ID NO: 2580494 - protein, 19 aa, Entamoeba histolytica
ETIKRFVVCCRERKPVDRT

SEQ ID NO: 2580495 - protein, 17 aa, Entamoeba histolytica
ETIPCWWSNKITDNSQV

SEQ ID NO: 2580496 - protein, 23 aa, Entamoeba histolytica
ETIPFWLCALISYVPPLLLILLF

SEQ ID NO: 2580497 - protein, 26 aa, Entamoeba histolytica
ETKEECWKKPLGLIEGEWKWKPKRNN

SEQ ID NO: 2580498 - protein, 23 aa, Entamoeba histolytica
ETKEILYLWNFIHQQRDILDIEN

SEQ ID NO: 2580499 - protein, 23 aa, Entamoeba histolytica
ETKEIPKTNALELKKTEQKPIEI

SEQ ID NO: 2580500 - protein, 18 aa, Entamoeba histolytica
ETKSGFLENEFIFTNAFP

SEQ ID NO: 2580501 - protein, 17 aa, Entamoeba histolytica
ETLLLVLHIGWLQKKEK

SEQ ID NO: 2580502 - protein, 19 aa, Entamoeba histolytica
ETLLSSALEKGHEVYINIK

SEQ ID NO: 2580503 - protein, 20 aa, Entamoeba histolytica
ETLVSITFPFPLKISHHYTV

SEQ ID NO: 2580504 - protein, 18 aa, Entamoeba histolytica
ETNESLAILKEFYAVILT

SEQ ID NO: 2580505 - protein, 25 aa, Entamoeba histolytica
ETNIFYKGCSGLLIPKIEQCEITKS

SEQ ID NO: 2580506 - protein, 24 aa, Entamoeba histolytica
ETPEVIKKPESVVSTTEQGTSGTD

SEQ ID NO: 2580507 - protein, 20 aa, Entamoeba histolytica
ETQSLSELLRLFGGIYSNVG

SEQ ID NO: 2580508 - protein, 24 aa, Entamoeba histolytica
ETRLYKIPQLNIIYSYSINNTSPT

SEQ ID NO: 2580509 - protein, 22 aa, Entamoeba histolytica
ETSSFKYVYGFYGITESKLYYK

SEQ ID NO: 2580510 - protein, 17 aa, Entamoeba histolytica
ETSYCYQKMSALSFDYY

SEQ ID NO: 2580511 - protein, 18 aa, Entamoeba histolytica
ETTSALLFQIFQETEEHP

SEQ ID NO: 2580512 - protein, 17 aa, Entamoeba histolytica
ETVCLVLEFCPLGSLKK

SEQ ID NO: 2580513 - protein, 17 aa, Entamoeba histolytica
ETVCMMLFIFHNLSRVS

SEQ ID NO: 2580514 - protein, 20 aa, Entamoeba histolytica
ETVQLIKFTQLWNDHLGIML

SEQ ID NO: 2580515 - protein, 21 aa, Entamoeba histolytica
ETYRFKYDYNETIPREFLLDP

SEQ ID NO: 2580516 - protein, 19 aa, Entamoeba histolytica
ETYYDYGPCITRKEKQNRY

SEQ ID NO: 2580517 - protein, 19 aa, Entamoeba histolytica
EVATLKEGMDCFGLDVYPV

SEQ ID NO: 2580518 - protein, 23 aa, Entamoeba histolytica
EVAYRCCGWKAYSQNDCAYYPIP

SEQ ID NO: 2580519 - protein, 17 aa, Entamoeba histolytica
EVDLKLIGATAIEDKLQ

SEQ ID NO: 2580520 - protein, 17 aa, Entamoeba histolytica
EVDSHWIKRCGSVAEGN

SEQ ID NO: 2580521 - protein, 17 aa, Entamoeba histolytica
EVFDCWFESGSMPYGQS

SEQ ID NO: 2580522 - protein, 26 aa, Entamoeba histolytica
EVFVFITSYIICYLLIQVSKRSGLIG

SEQ ID NO: 2580523 - protein, 21 aa, Entamoeba histolytica
EVGCGKTAFFKSLLGNLHKTN

SEQ ID NO: 2580524 - protein, 17 aa, Entamoeba histolytica
EVGEFICQYGLDVLIEL

SEQ ID NO: 2580525 - protein, 32 aa, Entamoeba histolytica
EVGHCKHYHIFKLLGIQSIQFFIIFKFIEFFL

SEQ ID NO: 2580526 - protein, 35 aa, Entamoeba histolytica
EVICIPSFGMIWIWTIVVSFINWLSYWKSDWNDEV

SEQ ID NO: 2580527 - protein, 20 aa, Entamoeba histolytica
EVIRGIKIYVGKKVPKQINF

SEQ ID NO: 2580528 - protein, 18 aa, Entamoeba histolytica
EVISIRWISSSGCDGTIS

SEQ ID NO: 2580529 - protein, 20 aa, Entamoeba histolytica
EVKESFKLQTLRDEINTLTQ

SEQ ID NO: 2580530 - protein, 25 aa, Entamoeba histolytica
EVKKNKCSKCSFWYGTNEEGNECNK

SEQ ID NO: 2580531 - protein, 20 aa, Entamoeba histolytica
EVLDGFQLEIRVGKIVEAGP

SEQ ID NO: 2580532 - protein, 23 aa, Entamoeba histolytica
EVLKRIIYHYGSFITSVKASSDW

SEQ ID NO: 2580533 - protein, 27 aa, Entamoeba histolytica
EVLKRLNFPRMRGILGTTELKKVFREI

SEQ ID NO: 2580534 - protein, 26 aa, Entamoeba histolytica
EVLKTRCCVCGIEASKIIYNCAICMT

SEQ ID NO: 2580535 - protein, 25 aa, Entamoeba histolytica
EVLNSIALKIINLFSTQTELMPNNK

SEQ ID NO: 2580536 - protein, 19 aa, Entamoeba histolytica
EVLQKMSTYYLKDYLMWGK

SEQ ID NO: 2580537 - protein, 23 aa, Entamoeba histolytica
EVMILKFLEYMLFNYSSDFRIYL

SEQ ID NO: 2580538 - protein, 30 aa, Entamoeba histolytica
EVPWIQRLGGCLGCNIGLFLFPILEILDGD

SEQ ID NO: 2580539 - protein, 17 aa, Entamoeba histolytica
EVPYPFEFEMKTSNKSE

SEQ ID NO: 2580540 - protein, 22 aa, Entamoeba histolytica
EVQEVKTEYSIEAKAKIVEITS

SEQ ID NO: 2580541 - protein, 25 aa, Entamoeba histolytica
EVRAFCYKFGWYLAALQLFDTFIPL

SEQ ID NO: 2580542 - protein, 27 aa, Entamoeba histolytica
EVRCYTSDLKLRWKQQIYSSLAQPYVQ

SEQ ID NO: 2580543 - protein, 23 aa, Entamoeba histolytica
EVRGWKNFIFFGIGTFILIIGIV

SEQ ID NO: 2580544 - protein, 23 aa, Entamoeba histolytica
EVRKMVSQYGNFVEIHNATPISV

SEQ ID NO: 2580545 - protein, 18 aa, Entamoeba histolytica
EVRLRGMKLSNIKKITRQ

SEQ ID NO: 2580546 - protein, 20 aa, Entamoeba histolytica
EVSKFIKIICQMYHKDEWEV

SEQ ID NO: 2580547 - protein, 19 aa, Entamoeba histolytica
EVTKMAVSVLNMLDSRQEE

SEQ ID NO: 2580548 - protein, 25 aa, Entamoeba histolytica
EVTKTGYVILRFKKNIFYNSTQFMD

SEQ ID NO: 2580549 - protein, 20 aa, Entamoeba histolytica
EVVFKVIFFIVFFILFYIAN

SEQ ID NO: 2580550 - protein, 24 aa, Entamoeba histolytica
EVVKIPIKKGELIYQQKKRHVGND

SEQ ID NO: 2580551 - protein, 23 aa, Entamoeba histolytica
EVVLFGLWGIFLFLIIPSIIVFS

SEQ ID NO: 2580552 - protein, 21 aa, Entamoeba histolytica
EVVVFKAEITPLCSTQIDDKI

SEQ ID NO: 2580553 - protein, 19 aa, Entamoeba histolytica
EVYDWFDISFNYFGRTSTE

SEQ ID NO: 2580554 - protein, 23 aa, Entamoeba histolytica
EVYRLVSGIFIKGCYENIEYILL

SEQ ID NO: 2580555 - protein, 19 aa, Entamoeba histolytica
EWCLNRHFFTFIFDQLEIV

SEQ ID NO: 2580556 - protein, 20 aa, Entamoeba histolytica
EWRLKEAKATIIILHGYGEY

SEQ ID NO: 2580557 - protein, 18 aa, Entamoeba histolytica
EWTVESFGKENEQQFYRI

SEQ ID NO: 2580558 - protein, 21 aa, Entamoeba histolytica
EWYLTSSICSPVALINAPYIY

SEQ ID NO: 2580559 - protein, 24 aa, Entamoeba histolytica
EYAKNYRRPMEFRCLNQFTSELCS

SEQ ID NO: 2580560 - protein, 22 aa, Entamoeba histolytica
EYARYHRRMGLFSPAITILEEL

SEQ ID NO: 2580561 - protein, 17 aa, Entamoeba histolytica
EYCFCINGAQPHSIPQI

SEQ ID NO: 2580562 - protein, 18 aa, Entamoeba histolytica
EYCVSIFNGHFIFYDKNN

SEQ ID NO: 2580563 - protein, 25 aa, Entamoeba histolytica
EYCYNDVYCPFKYITTHEMKDDSFN

SEQ ID NO: 2580564 - protein, 27 aa, Entamoeba histolytica
EYDELILCPTCLILGVDKCSAIPLKEI

SEQ ID NO: 2580565 - protein, 24 aa, Entamoeba histolytica
EYDKACGKYVSVGYDYLAVKNTSM

SEQ ID NO: 2580566 - protein, 18 aa, Entamoeba histolytica
EYEAIQLITFDGISEENI

SEQ ID NO: 2580567 - protein, 27 aa, Entamoeba histolytica
EYEFSESITTFFLFIGIHFFFLSGHAF

SEQ ID NO: 2580568 - protein, 20 aa, Entamoeba histolytica
EYFLPIFSGQPFEGYLTSTY

SEQ ID NO: 2580569 - protein, 21 aa, Entamoeba histolytica
EYGEKELVVIVWLLCYNPTKF

SEQ ID NO: 2580570 - protein, 27 aa, Entamoeba histolytica
EYGVLIHVCCEWMKVAVQYDLEGTINI

SEQ ID NO: 2580571 - protein, 20 aa, Entamoeba histolytica
EYHLNCLKILNGSEKIISLI

SEQ ID NO: 2580572 - protein, 24 aa, Entamoeba histolytica
EYIKIPLKEAEEIYIVSMKDYIFE

SEQ ID NO: 2580573 - protein, 20 aa, Entamoeba histolytica
EYILSPRVVTWMNADSTQYI

SEQ ID NO: 2580574 - protein, 23 aa, Entamoeba histolytica
EYIPIQWYLGMIILIAGVILLIV

SEQ ID NO: 2580575 - protein, 25 aa, Entamoeba histolytica
EYITYRFIHQYGFDLNSGMICKDNC

SEQ ID NO: 2580576 - protein, 19 aa, Entamoeba histolytica
EYKKLEAISRMPASVTVLN

SEQ ID NO: 2580577 - protein, 19 aa, Entamoeba histolytica
EYLIESGLCISMLLDDVIA

SEQ ID NO: 2580578 - protein, 18 aa, Entamoeba histolytica
EYLPTINLLKNFNITKIN

SEQ ID NO: 2580579 - protein, 17 aa, Entamoeba histolytica
EYMEGLIAPIPLQQPVY

SEQ ID NO: 2580580 - protein, 17 aa, Entamoeba histolytica
EYPAFGVDLIVDVHGAG

SEQ ID NO: 2580581 - protein, 17 aa, Entamoeba histolytica
EYQCTYPGCNEGLKTKY

SEQ ID NO: 2580582 - protein, 20 aa, Entamoeba histolytica
EYQSKIGMEALRTTWVSKAQ

SEQ ID NO: 2580583 - protein, 20 aa, Entamoeba histolytica
EYSDLLSLLMSMIILIVPPI

SEQ ID NO: 2580584 - protein, 22 aa, Entamoeba histolytica
EYSFNQPEIWTTMELTNGCPCN

SEQ ID NO: 2580585 - protein, 18 aa, Entamoeba histolytica
EYSKKCSSENIWLDRQIY

SEQ ID NO: 2580586 - protein, 19 aa, Entamoeba histolytica
EYSPLAVIDREFIAGKREV

SEQ ID NO: 2580587 - protein, 24 aa, Entamoeba histolytica
EYTFTSSCNLDFVVNGEYNTFGNP

SEQ ID NO: 2580588 - protein, 22 aa, Entamoeba histolytica
EYVSSILEYYGIIYLKNQVTQI

SEQ ID NO: 2580589 - protein, 19 aa, Entamoeba histolytica
EYWIEYFFFPNLKTCPYIY

SEQ ID NO: 2580590 - protein, 21 aa, Entamoeba histolytica
EYYKKVGCSVGRINVIGKPYN

SEQ ID NO: 2580591 - protein, 24 aa, Entamoeba histolytica
FAAALFFEICFFFTIPSASIHFVV

SEQ ID NO: 2580592 - protein, 17 aa, Entamoeba histolytica
FAASCCQMGIQFSFSAI

SEQ ID NO: 2580593 - protein, 18 aa, Entamoeba histolytica
FACPRPSGVWQPFKEIDF

SEQ ID NO: 2580594 - protein, 18 aa, Entamoeba histolytica
FACPRPSGVWQPLKELDF

SEQ ID NO: 2580595 - protein, 18 aa, Entamoeba histolytica
FADTGLISINFPPRINVI

SEQ ID NO: 2580596 - protein, 25 aa, Entamoeba histolytica
FAFVGVFCGYRLSEVITCPPDVLGF

SEQ ID NO: 2580597 - protein, 24 aa, Entamoeba histolytica
FAGKEFYINLVIFFVLLVRVALFK

SEQ ID NO: 2580598 - protein, 21 aa, Entamoeba histolytica
FAHEVCKTYPIVIVNLMNEFL

SEQ ID NO: 2580599 - protein, 21 aa, Entamoeba histolytica
FAHGLFYFIGVDSFLFQKSPN

SEQ ID NO: 2580600 - protein, 25 aa, Entamoeba histolytica
FAIKTPCTMPRWKLYDEELTECWKN

SEQ ID NO: 2580601 - protein, 20 aa, Entamoeba histolytica
FAILGFCGYFIKLVHIPITG

SEQ ID NO: 2580602 - protein, 23 aa, Entamoeba histolytica
FAILGFCGYIIKLIHIPIIEILM

SEQ ID NO: 2580603 - protein, 25 aa, Entamoeba histolytica
FAITMYETFGWREAYPVNTFKFPWK

SEQ ID NO: 2580604 - protein, 17 aa, Entamoeba histolytica
FAITMYETMKWGGAYDN

SEQ ID NO: 2580605 - protein, 22 aa, Entamoeba histolytica
FAKGYFKTGCLAIFIVVALALI

SEQ ID NO: 2580606 - protein, 20 aa, Entamoeba histolytica
FAKMEACGLIYRNDGQVKRR

SEQ ID NO: 2580607 - protein, 24 aa, Entamoeba histolytica
FAKTSMFYKLWLKVEDIHAELYMN

SEQ ID NO: 2580608 - protein, 20 aa, Entamoeba histolytica
FALEGYRVLVAGVRNITNIY

SEQ ID NO: 2580609 - protein, 25 aa, Entamoeba histolytica
FALFKKNCANIRKWNAERTNERDAH

SEQ ID NO: 2580610 - protein, 18 aa, Entamoeba histolytica
FALICLSVFFTNSINMFA

SEQ ID NO: 2580611 - protein, 19 aa, Entamoeba histolytica
FALSSSLRFLSKHREFLPF

SEQ ID NO: 2580612 - protein, 17 aa, Entamoeba histolytica
FAMALLMVKNDKQELSR

SEQ ID NO: 2580613 - protein, 22 aa, Entamoeba histolytica
FANFSWMAPVIITFVLDVLTAI

SEQ ID NO: 2580614 - protein, 20 aa, Entamoeba histolytica
FANILHIWKSNNIIFDDQKS

SEQ ID NO: 2580615 - protein, 18 aa, Entamoeba histolytica
FAPFIDLFHAIKMIRLDI

SEQ ID NO: 2580616 - protein, 19 aa, Entamoeba histolytica
FAPFSVIVYLFFKKAYGLY

SEQ ID NO: 2580617 - protein, 18 aa, Entamoeba histolytica
FAPQFVCDLMIMRYSLLK

SEQ ID NO: 2580618 - protein, 18 aa, Entamoeba histolytica
FARASFKTYAWVEMSMFL

SEQ ID NO: 2580619 - protein, 21 aa, Entamoeba histolytica
FAREGYRTLVLGYKIIPDSVF

SEQ ID NO: 2580620 - protein, 21 aa, Entamoeba histolytica
FASFLFAIIIFKFNKINEEEE

SEQ ID NO: 2580621 - protein, 25 aa, Entamoeba histolytica
FASFMVEPYCAAKIPQLGASIDDIV

SEQ ID NO: 2580622 - protein, 18 aa, Entamoeba histolytica
FASYFYWLVVPLKCVDMG

SEQ ID NO: 2580623 - protein, 22 aa, Entamoeba histolytica
FATIIICGGILISISGGSYLFK

SEQ ID NO: 2580624 - protein, 20 aa, Entamoeba histolytica
FATLLYYFCKNIKKNPTLHL

SEQ ID NO: 2580625 - protein, 20 aa, Entamoeba histolytica
FATRHLKIIFDYYSNHDIID

SEQ ID NO: 2580626 - protein, 19 aa, Entamoeba histolytica
FATRIIIGSSCIDDVTSSC

SEQ ID NO: 2580627 - protein, 21 aa, Entamoeba histolytica
FATRVRLLRFIQFSKNETSDV

SEQ ID NO: 2580628 - protein, 23 aa, Entamoeba histolytica
FAVCNACTIGKVIERAKKRKRRE

SEQ ID NO: 2580629 - protein, 20 aa, Entamoeba histolytica
FAVCPSFVISAIITLLLLLV

SEQ ID NO: 2580630 - protein, 18 aa, Entamoeba histolytica
FAVLRALGLSSIKMVLIY

SEQ ID NO: 2580631 - protein, 17 aa, Entamoeba histolytica
FAVSLIGAWNDYSKQSK

SEQ ID NO: 2580632 - protein, 20 aa, Entamoeba histolytica
FAVSMTSYFILKDQVQKLSE

SEQ ID NO: 2580633 - protein, 21 aa, Entamoeba histolytica
FCATFIIDIGVVFSVASAIFS

SEQ ID NO: 2580634 - protein, 24 aa, Entamoeba histolytica
FCCCSCGGCLSFFILSIVILSCGL

SEQ ID NO: 2580635 - protein, 17 aa, Entamoeba histolytica
FCCHLELNDAIDIGTTY

SEQ ID NO: 2580636 - protein, 17 aa, Entamoeba histolytica
FCCLVSVVFYGSNYVVV

SEQ ID NO: 2580637 - protein, 19 aa, Entamoeba histolytica
FCCSWSFGKAIGFVLGGPM

SEQ ID NO: 2580638 - protein, 17 aa, Entamoeba histolytica
FCCTFKYNNDETIRSGF

SEQ ID NO: 2580639 - protein, 25 aa, Entamoeba histolytica
FCDVSKAVICARCSPQQKAEVVLAA

SEQ ID NO: 2580640 - protein, 19 aa, Entamoeba histolytica
FCFSGCSIFTKGLKERGSA

SEQ ID NO: 2580641 - protein, 18 aa, Entamoeba histolytica
FCGKYLLSGDIGFGEIGM

SEQ ID NO: 2580642 - protein, 17 aa, Entamoeba histolytica
FCGMILLLVIVVGIIYL

SEQ ID NO: 2580643 - protein, 21 aa, Entamoeba histolytica
FCIAAKPNLLKTFKSIDMFLD

SEQ ID NO: 2580644 - protein, 30 aa, Entamoeba histolytica
FCIEGYYTNGLQCMSCTTITPNCEICENKK

SEQ ID NO: 2580645 - protein, 25 aa, Entamoeba histolytica
FCISISMTIPNPWFSKTLSTWDCDE

SEQ ID NO: 2580646 - protein, 19 aa, Entamoeba histolytica
FCLFFPEFINFFVSIPQLF

SEQ ID NO: 2580647 - protein, 17 aa, Entamoeba histolytica
FCLFIVMWTFTFSLTCF

SEQ ID NO: 2580648 - protein, 20 aa, Entamoeba histolytica
FCLVDLVLCYLIFPKTSTVH

SEQ ID NO: 2580649 - protein, 18 aa, Entamoeba histolytica
FCNQCLNGYYLLNSKCHK

SEQ ID NO: 2580650 - protein, 22 aa, Entamoeba histolytica
FCNTCNFTQCLSCMTNYSLNTM

SEQ ID NO: 2580651 - protein, 18 aa, Entamoeba histolytica
FCPLCKVSFHLNPLKKNK

SEQ ID NO: 2580652 - protein, 21 aa, Entamoeba histolytica
FCSEIRVVLDGAKPDVLEKAC

SEQ ID NO: 2580653 - protein, 19 aa, Entamoeba histolytica
FCSGGKAIGFFSAGSLKAL

SEQ ID NO: 2580654 - protein, 20 aa, Entamoeba histolytica
FCVADIIFAVIYFIWLCFSV

SEQ ID NO: 2580655 - protein, 19 aa, Entamoeba histolytica
FCVPTIASIIILTYIPITM

SEQ ID NO: 2580656 - protein, 25 aa, Entamoeba histolytica
FCYFLFELIIGLYLNSLILTVDSFN

SEQ ID NO: 2580657 - protein, 20 aa, Entamoeba histolytica
FCYGSDLLAKFHINKLMILS

SEQ ID NO: 2580658 - protein, 26 aa, Entamoeba histolytica
FCYPGTCPLLKFIVVGGLGTIIDILI

SEQ ID NO: 2580659 - protein, 17 aa, Entamoeba histolytica
FCYQLGVFISRSSLPLF

SEQ ID NO: 2580660 - protein, 17 aa, Entamoeba histolytica
FDALIKCNAEYFFDTTG

SEQ ID NO: 2580661 - protein, 24 aa, Entamoeba histolytica
FDASYYKIIIWILFTICGGTCAFL

SEQ ID NO: 2580662 - protein, 22 aa, Entamoeba histolytica
FDCIKRPKISLLTTHLKQKSSS

SEQ ID NO: 2580663 - protein, 20 aa, Entamoeba histolytica
FDCKLFGFGHYETYYYDIEQ

SEQ ID NO: 2580664 - protein, 19 aa, Entamoeba histolytica
FDCSVSLKQIGRIRGHKVA

SEQ ID NO: 2580665 - protein, 23 aa, Entamoeba histolytica
FDDLNGLKWNNMRIIKYKEDKLN

SEQ ID NO: 2580666 - protein, 21 aa, Entamoeba histolytica
FDDRTGVVMAIDLEKKKTYPR

SEQ ID NO: 2580667 - protein, 23 aa, Entamoeba histolytica
FDDYREAYRWLAHNTPEGSRVMS

SEQ ID NO: 2580668 - protein, 22 aa, Entamoeba histolytica
FDEKELKKCIGVNQEGFLNKIV

SEQ ID NO: 2580669 - protein, 18 aa, Entamoeba histolytica
FDHHCPWINQCVGEKNCK

SEQ ID NO: 2580670 - protein, 43 aa, Entamoeba histolytica; identical to SEQ ID NO: 2382022

SEQ ID NO: 2580671 - protein, 18 aa, Entamoeba histolytica
FDIEKVVGLKACRQRLWY

SEQ ID NO: 2580672 - protein, 22 aa, Entamoeba histolytica
FDIILSTIFMWMKLYSKDEDAW

SEQ ID NO: 2580673 - protein, 23 aa, Entamoeba histolytica
FDIIVNIILCFIYGFGQYTDSYI

SEQ ID NO: 2580674 - protein, 28 aa, Entamoeba histolytica
FDKCKKLYIDECENCQFIIKKNENNEMK

SEQ ID NO: 2580675 - protein, 27 aa, Entamoeba histolytica
FDKCKKLYIDECENCQIIIKKNENNEM

SEQ ID NO: 2580676 - protein, 19 aa, Entamoeba histolytica
FDKFTIFKGIFINYVNKLG

SEQ ID NO: 2580677 - protein, 26 aa, Entamoeba histolytica
FDLHIVCFFIPLGIYFMLKNITDENI

SEQ ID NO: 2580678 - protein, 19 aa, Entamoeba histolytica
FDMISWATTYLLGGNTSLG

SEQ ID NO: 2580679 - protein, 26 aa, Entamoeba histolytica
FDNFGPRGTLIFSFIFGTIGYLLFAL

SEQ ID NO: 2580680 - protein, 21 aa, Entamoeba histolytica
FDNGKAEGFCTWLDTAEQGEL

SEQ ID NO: 2580681 - protein, 24 aa, Entamoeba histolytica
FDNSLRLVSLVLKKPIKPEFGENQ

SEQ ID NO: 2580682 - protein, 18 aa, Entamoeba histolytica
FDPDSWYPLGRNIGTTVF

SEQ ID NO: 2580683 - protein, 21 aa, Entamoeba histolytica
FDPLAYCVSLIPLLSAALVYC

SEQ ID NO: 2580684 - protein, 19 aa, Entamoeba histolytica
FDPYFNFRATKYLVEHGPT

SEQ ID NO: 2580685 - protein, 20 aa, Entamoeba histolytica
FDPYFNFRATKYLVEHGPTA

SEQ ID NO: 2580686 - protein, 17 aa, Entamoeba histolytica
FDQFTVRWVHYKLINKR

SEQ ID NO: 2580687 - protein, 17 aa, Entamoeba histolytica
FDRTFILNLEMKIKDLH

SEQ ID NO: 2580688 - protein, 18 aa, Entamoeba histolytica
FDSRGELEYTIDITAQDI

SEQ ID NO: 2580689 - protein, 20 aa, Entamoeba histolytica
FDSRLTYFWITHIGSRRFNN

SEQ ID NO: 2580690 - protein, 17 aa, Entamoeba histolytica
FDSWEHGKLFLTNYRIK

SEQ ID NO: 2580691 - protein, 21 aa, Entamoeba histolytica
FDTKRCILQSCPIVQPDGFHD

SEQ ID NO: 2580692 - protein, 22 aa, Entamoeba histolytica
FDYELTCSKKIVLLCNNPSKLY

SEQ ID NO: 2580693 - protein, 19 aa, Entamoeba histolytica
FDYSQLISINPSFFKSNNS

SEQ ID NO: 2580694 - protein, 25 aa, Entamoeba histolytica
FDYTFRIIETLSFYIVTLLVASGWS

SEQ ID NO: 2580695 - protein, 19 aa, Entamoeba histolytica
FDYTLLLCPLTQSKTKSCQ

SEQ ID NO: 2580696 - protein, 17 aa, Entamoeba histolytica
FEAILIPHCSCTVNDYF

SEQ ID NO: 2580697 - protein, 21 aa, Entamoeba histolytica
FEAPLAFMSMSLLHFMHLKGK

SEQ ID NO: 2580698 - protein, 19 aa, Entamoeba histolytica
FECLSNKGVISKNNKSELL

SEQ ID NO: 2580699 - protein, 18 aa, Entamoeba histolytica
FEDFPINEIILIINTIVS

SEQ ID NO: 2580700 - protein, 25 aa, Entamoeba histolytica
FEDYKFRYRRGLPLVLKGINASIED

SEQ ID NO: 2580701 - protein, 18 aa, Entamoeba histolytica
FEEDSLEIPKLVRLASKK

SEQ ID NO: 2580702 - protein, 18 aa, Entamoeba histolytica
FEEVESINTLPTIDSVEE

SEQ ID NO: 2580703 - protein, 18 aa, Entamoeba histolytica
FEFGKCYYMGSAEGVTAS

SEQ ID NO: 2580704 - protein, 17 aa, Entamoeba histolytica
FEFSSQLPPGFYGVSNS

SEQ ID NO: 2580705 - protein, 24 aa, Entamoeba histolytica
FEFYKRLYKYWNWSLESVPTNGIT

SEQ ID NO: 2580706 - protein, 18 aa, Entamoeba histolytica
FEGGIKLRDCLSHGEYQF

SEQ ID NO: 2580707 - protein, 21 aa, Entamoeba histolytica
FEGIIYKRFIDLCTEVYGMPI

SEQ ID NO: 2580708 - protein, 18 aa, Entamoeba histolytica
FEGLDVYNIYAIFVILWN

SEQ ID NO: 2580709 - protein, 18 aa, Entamoeba histolytica
FEGMEILAKTALYAVHRA

SEQ ID NO: 2580710 - protein, 18 aa, Entamoeba histolytica
FEHHACITLIKIQHETGE

SEQ ID NO: 2580711 - protein, 20 aa, Entamoeba histolytica
FEINDKFKLAIKQIDKLPLR

SEQ ID NO: 2580712 - protein, 24 aa, Entamoeba histolytica
FEKEMSIGLLWFIDNNDFIKFKKS

SEQ ID NO: 2580713 - protein, 18 aa, Entamoeba histolytica
FEKEVAILDKFRDEYIIH

SEQ ID NO: 2580714 - protein, 24 aa, Entamoeba histolytica
FEKGYRYTYSLFYRKDGSISGEVS

SEQ ID NO: 2580715 - protein, 27 aa, Entamoeba histolytica
FEKSCSIKRKLLPVVGYIYDDIDLTRF

SEQ ID NO: 2580716 - protein, 20 aa, Entamoeba histolytica
FELDGIRQAMKMKNDQARKR

SEQ ID NO: 2580717 - protein, 17 aa, Entamoeba histolytica
FELFIIIKCTTKIKDKI

SEQ ID NO: 2580718 - protein, 17 aa, Entamoeba histolytica
FELFIIIKCTTKINDKI

SEQ ID NO: 2580719 - protein, 17 aa, Entamoeba histolytica
FELKIKILDDLAIALQF

SEQ ID NO: 2580720 - protein, 17 aa, Entamoeba histolytica
FELLLEFIYKSHRKNKL

SEQ ID NO: 2580721 - protein, 19 aa, Entamoeba histolytica
FELLRKFIERWGYSQPLNT

SEQ ID NO: 2580722 - protein, 28 aa, Entamoeba histolytica
FELSEQWFAHQMCCFLLPYYDCSSNIIE

SEQ ID NO: 2580723 - protein, 19 aa, Entamoeba histolytica
FEMISCFYDTELELLISGM

SEQ ID NO: 2580724 - protein, 24 aa, Entamoeba histolytica
FEMKEPISSFSFFFSNEFSSHLGP

SEQ ID NO: 2580725 - protein, 17 aa, Entamoeba histolytica
FEMPIFYNDSIGGRDTN

SEQ ID NO: 2580726 - protein, 18 aa, Entamoeba histolytica
FENFFFKTKAHQMLLSKE

SEQ ID NO: 2580727 - protein, 28 aa, Entamoeba histolytica
FENGRCLLCSSKFHGCSTCSSQECYSCF

SEQ ID NO: 2580728 - protein, 23 aa, Entamoeba histolytica
FENKFCKICFPKNCKEILECIFV

SEQ ID NO: 2580729 - protein, 20 aa, Entamoeba histolytica
FENRVWLSLIGRLMISIIII

SEQ ID NO: 2580730 - protein, 18 aa, Entamoeba histolytica
FENVPFELHWHLVVQDEY

SEQ ID NO: 2580731 - protein, 21 aa, Entamoeba histolytica
FENYILFPLLSFFSILLCLYY

SEQ ID NO: 2580732 - protein, 20 aa, Entamoeba histolytica
FEPKCIKLQPGFGQSVIIKF

SEQ ID NO: 2580733 - protein, 19 aa, Entamoeba histolytica
FEQFIKCSIIKTESKVSWD

SEQ ID NO: 2580734 - protein, 36 aa, Entamoeba histolytica
FERIKANLFLANFIRDLMRFWKLAYVVGLIDMVMDW

SEQ ID NO: 2580735 - protein, 17 aa, Entamoeba histolytica
FESCKNSTAAQCLLCKQ

SEQ ID NO: 2580736 - protein, 20 aa, Entamoeba histolytica
FETASFVFLCISGLIHVLLY

SEQ ID NO: 2580737 - protein, 17 aa, Entamoeba histolytica
FETLMKWLCDVDDIQEW

SEQ ID NO: 2580738 - protein, 17 aa, Entamoeba histolytica
FETRTAAGIAVEAMAKN

SEQ ID NO: 2580739 - protein, 17 aa, Entamoeba histolytica
FETVKGITEIKDPNNKE

SEQ ID NO: 2580740 - protein, 24 aa, Entamoeba histolytica
FEVKGRIIEMISIIATKLNDKYIG

SEQ ID NO: 2580741 - protein, 17 aa, Entamoeba histolytica
FEYMKFFGNFKNLYISA

SEQ ID NO: 2580742 - protein, 18 aa, Entamoeba histolytica
FFAIRLDNIIQRIQKNKS

SEQ ID NO: 2580743 - protein, 17 aa, Entamoeba histolytica
FFASRPKIYSSIKDSFP

SEQ ID NO: 2580744 - protein, 25 aa, Entamoeba histolytica
FFATWCGPCKMIAPYFEELARTNPS

SEQ ID NO: 2580745 - protein, 22 aa, Entamoeba histolytica
FFCIVIGYYGVMEFFVVDPRSP

SEQ ID NO: 2580746 - protein, 18 aa, Entamoeba histolytica
FFCVMELTVMNGEVVQSK

SEQ ID NO: 2580747 - protein, 20 aa, Entamoeba histolytica
FFCYGALWAYSSVFSSSVTM

SEQ ID NO: 2580748 - protein, 27 aa, Entamoeba histolytica
FFDIIPRFKQGYSFCFIGKEDQTESCG

SEQ ID NO: 2580749 - protein, 28 aa, Entamoeba histolytica
FFDKHWLELSVMLSWVFIIVFAAIIHGQ

SEQ ID NO: 2580750 - protein, 37 aa, Entamoeba histolytica
FFDVGCSPLKIILCPKKFLNNYACEGRIDCAFISNGE

SEQ ID NO: 2580751 - protein, 22 aa, Entamoeba histolytica
FFEIFPFILPNLVCSLITMVGV

SEQ ID NO: 2580752 - protein, 20 aa, Entamoeba histolytica
FFETFRFNYNYTETIPREFI

SEQ ID NO: 2580753 - protein, 24 aa, Entamoeba histolytica
FFFLLEAYNSFSLTVLSILILVIV

SEQ ID NO: 2580754 - protein, 27 aa, Entamoeba histolytica
FFFRVLDRIYLIIGIIIFALILKYFIK

SEQ ID NO: 2580755 - protein, 18 aa, Entamoeba histolytica
FFFSHIFYTLFIIVDFIQ

SEQ ID NO: 2580756 - protein, 19 aa, Entamoeba histolytica
FFFSYFWCFYFFNLWFIPH

SEQ ID NO: 2580757 - protein, 20 aa, Entamoeba histolytica
FFGACCLKDHICIVTEYAEY

SEQ ID NO: 2580758 - protein, 18 aa, Entamoeba histolytica
FFGCMKLKNLLYVSYQLR

SEQ ID NO: 2580759 - protein, 18 aa, Entamoeba histolytica
FFGSKAFPKSDYDLLDIA

SEQ ID NO: 2580760 - protein, 17 aa, Entamoeba histolytica
FFICSWYYQPGYYVPYL

SEQ ID NO: 2580761 - protein, 19 aa, Entamoeba histolytica
FFIGWHMVMAIGGADMPVV

SEQ ID NO: 2580762 - protein, 22 aa, Entamoeba histolytica
FFIICFWIMFVVDVIVLIGLAV

SEQ ID NO: 2580763 - protein, 23 aa, Entamoeba histolytica
FFIPLNRRINVVVKELWKREFGV

SEQ ID NO: 2580764 - protein, 17 aa, Entamoeba histolytica
FFISFCISDYCKKIEPN

SEQ ID NO: 2580765 - protein, 18 aa, Entamoeba histolytica
FFITRFVVLETINEYINK

SEQ ID NO: 2580766 - protein, 23 aa, Entamoeba histolytica
FFKIGICVLCHLLYIWTLLAPAL

SEQ ID NO: 2580767 - protein, 23 aa, Entamoeba histolytica
FFKMELVCRRNIRIISTLENSVD

SEQ ID NO: 2580768 - protein, 31 aa, Entamoeba histolytica
FFKNAAFFLHLLWFACICMFTSQRLYDDYMM

SEQ ID NO: 2580769 - protein, 17 aa, Entamoeba histolytica
FFKPLLFGLFSMVSELY

SEQ ID NO: 2580770 - protein, 17 aa, Entamoeba histolytica
FFLSLILFSLVIIFVVI

SEQ ID NO: 2580771 - protein, 18 aa, Entamoeba histolytica
FFMMGSLALGSWYGSLVI

SEQ ID NO: 2580772 - protein, 21 aa, Entamoeba histolytica
FFMYVLRGIPFKQWSLEQKCT

SEQ ID NO: 2580773 - protein, 25 aa, Entamoeba histolytica
FFNKSSNLLTLWKAPIYSVFSSNNA

SEQ ID NO: 2580774 - protein, 24 aa, Entamoeba histolytica
FFPMGGNCISCLVNNCTKCLSNGA

SEQ ID NO: 2580775 - protein, 18 aa, Entamoeba histolytica
FFPNLVLYYLRWKSSFPI

SEQ ID NO: 2580776 - protein, 19 aa, Entamoeba histolytica
FFPTKEEKETVLPIIKTLE

SEQ ID NO: 2580777 - protein, 21 aa, Entamoeba histolytica
FFPVLIASYIIRIPKEERSLY

SEQ ID NO: 2580778 - protein, 17 aa, Entamoeba histolytica
FFQRLFLNYQKCFKEVK

SEQ ID NO: 2580779 - protein, 19 aa, Entamoeba histolytica
FFQRMELQNISSFSFILNG

SEQ ID NO: 2580780 - protein, 24 aa, Entamoeba histolytica
FFSDYIFCITFFIVGWITNNDSNS

SEQ ID NO: 2580781 - protein, 21 aa, Entamoeba histolytica
FFTSFMFCTSFTKTSIILCIL

SEQ ID NO: 2580782 - protein, 26 aa, Entamoeba histolytica
FFTVTELFWRIAFVCVGSIQLMTFMY

SEQ ID NO: 2580783 - protein, 19 aa, Entamoeba histolytica
FFVMTRFPLVNNIKTKENV

SEQ ID NO: 2580784 - protein, 18 aa, Entamoeba histolytica
FFVNSGFNVFMLDLPGHG

SEQ ID NO: 2580785 - protein, 21 aa, Entamoeba histolytica
FFVSCCPCALDNPLPWKFFPT

SEQ ID NO: 2580786 - protein, 22 aa, Entamoeba histolytica
FFYDQRTIFYFFKKNFENKACV

SEQ ID NO: 2580787 - protein, 17 aa, Entamoeba histolytica
FFYFTMFIVHAFVEGVS

SEQ ID NO: 2580788 - protein, 17 aa, Entamoeba histolytica
FGALKYFGSNDDFLGYH

SEQ ID NO: 2580789 - protein, 19 aa, Entamoeba histolytica
FGASHGLFFLPILLSLIPS

SEQ ID NO: 2580790 - protein, 25 aa, Entamoeba histolytica
FGCMFLLIDLMRNWFLSSNDNLPNG

SEQ ID NO: 2580791 - protein, 25 aa, Entamoeba histolytica
FGDIELYKFIGRVVAKTVYDGEFLD

SEQ ID NO: 2580792 - protein, 21 aa, Entamoeba histolytica
FGDLQKVSFINGFEENENKEN

SEQ ID NO: 2580793 - protein, 26 aa, Entamoeba histolytica
FGECKHCIGHCKTCLYSSDFCLTCDN

SEQ ID NO: 2580794 - protein, 24 aa, Entamoeba histolytica
FGESDMKLYLLVGGKVKDKVVLRR

SEQ ID NO: 2580795 - protein, 19 aa, Entamoeba histolytica
FGFLSGFLYNKFVHVKDKR

SEQ ID NO: 2580796 - protein, 18 aa, Entamoeba histolytica
FGGGDTFEHLFFIGNDTN

SEQ ID NO: 2580797 - protein, 22 aa, Entamoeba histolytica
FGICSLCGNGVYDVGEDCDPSV

SEQ ID NO: 2580798 - protein, 26 aa, Entamoeba histolytica
FGIFAEFITALTLAARVEERRQKIIN

SEQ ID NO: 2580799 - protein, 24 aa, Entamoeba histolytica
FGKCGFSWVPVVIIILVFGFLFFV

SEQ ID NO: 2580800 - protein, 21 aa, Entamoeba histolytica
FGKNEVWYKFNGIEGRNITVD

SEQ ID NO: 2580801 - protein, 18 aa, Entamoeba histolytica
FGLFRKIIGGVFVEEINY

SEQ ID NO: 2580802 - protein, 19 aa, Entamoeba histolytica
FGLLTLLYPFIWQGVLIPF

SEQ ID NO: 2580803 - protein, 24 aa, Entamoeba histolytica
FGMVTCLPGAFSMIRPQAMETVLN

SEQ ID NO: 2580804 - protein, 19 aa, Entamoeba histolytica
FGNELVKGISPRGYVSDLS

SEQ ID NO: 2580805 - protein, 17 aa, Entamoeba histolytica
FGNGNIKLHYGTIEKED

SEQ ID NO: 2580806 - protein, 26 aa, Entamoeba histolytica
FGNYMKRVWESLVLVIFIRPFDIGDR

SEQ ID NO: 2580807 - protein, 25 aa, Entamoeba histolytica
FGPLFYRLIKVILMPKTTVPQTISW

SEQ ID NO: 2580808 - protein, 20 aa, Entamoeba histolytica
FGQKKIKIFNGFYSTATELA

SEQ ID NO: 2580809 - protein, 21 aa, Entamoeba histolytica
FGRKASLISINMLRNIVTQAI

SEQ ID NO: 2580810 - protein, 30 aa, Entamoeba histolytica
FGRMCRFWTMWSCWGCAFYFFVAFCKQMTL

SEQ ID NO: 2580811 - protein, 20 aa, Entamoeba histolytica
FGSCVIGLFVSYFSAFVMNK

SEQ ID NO: 2580812 - protein, 24 aa, Entamoeba histolytica
FGSEWCPYTIILLNMISLVIVSLI

SEQ ID NO: 2580813 - protein, 25 aa, Entamoeba histolytica
FGSHIFKDIRLMVSLVGIFFILPIT

SEQ ID NO: 2580814 - protein, 19 aa, Entamoeba histolytica
FGTLEIVQVGKFVFTDSTI

SEQ ID NO: 2580815 - protein, 26 aa, Entamoeba histolytica
FGVLAKICLGETFSIFETFINLFIEN

SEQ ID NO: 2580816 - protein, 20 aa, Entamoeba histolytica
FGVREMVWSNTFLNVTKNSA

SEQ ID NO: 2580817 - protein, 17 aa, Entamoeba histolytica
FGVVYRGTYRGIEVAVK

SEQ ID NO: 2580818 - protein, 21 aa, Entamoeba histolytica
FGYAIWRPMTLLWTFTLKQSS

SEQ ID NO: 2580819 - protein, 24 aa, Entamoeba histolytica
FGYIPELFLWHGRNAYKRTSLLSH

SEQ ID NO: 2580820 - protein, 18 aa, Entamoeba histolytica
FHAQEGIESVPIMTKILF

SEQ ID NO: 2580821 - protein, 18 aa, Entamoeba histolytica
FHHWQYVLSLNIIVQIII

SEQ ID NO: 2580822 - protein, 23 aa, Entamoeba histolytica
FHLDAGVKYIAKFYAKESDSQII

SEQ ID NO: 2580823 - protein, 17 aa, Entamoeba histolytica
FHMAFELLMSVLKDSFI

SEQ ID NO: 2580824 - protein, 17 aa, Entamoeba histolytica
FHMFARSQIQPSELNRE

SEQ ID NO: 2580825 - protein, 17 aa, Entamoeba histolytica
FHPDIKYQQFILDDIGF

SEQ ID NO: 2580826 - protein, 17 aa, Entamoeba histolytica
FHRARKLLLEKVNELDK

SEQ ID NO: 2580827 - protein, 22 aa, Entamoeba histolytica
FHSGSTMQFWLDVHLNNTIISF

SEQ ID NO: 2580828 - protein, 18 aa, Entamoeba histolytica
FHSKRLHYSLSLTFKIIV

SEQ ID NO: 2580829 - protein, 19 aa, Entamoeba histolytica
FIADIFVIQWEELKPLNRN

SEQ ID NO: 2580830 - protein, 26 aa, Entamoeba histolytica
FIAGYAIGFAKDWDLTLVIIIAIARA

SEQ ID NO: 2580831 - protein, 25 aa, Entamoeba histolytica
FIAGYAIGFAKDWDLTLVIMSMSPF

SEQ ID NO: 2580832 - protein, 26 aa, Entamoeba histolytica
FIAGYAIGFSKCWDLTLVIMAVTPFM

SEQ ID NO: 2580833 - protein, 18 aa, Entamoeba histolytica
FICCSMPKLKRCQLNGII

SEQ ID NO: 2580834 - protein, 21 aa, Entamoeba histolytica
FICDIICLFSVIIHISCMKSR

SEQ ID NO: 2580835 - protein, 19 aa, Entamoeba histolytica
FICLKEVVGYCLSVKDVHQ

SEQ ID NO: 2580836 - protein, 17 aa, Entamoeba histolytica
FIDCVNSVFGMYDVELM

SEQ ID NO: 2580837 - protein, 21 aa, Entamoeba histolytica
FIEDCLCVFMEFEVRKMALQL

SEQ ID NO: 2580838 - protein, 17 aa, Entamoeba histolytica
FIELLKVIYSISMREKI

SEQ ID NO: 2580839 - protein, 19 aa, Entamoeba histolytica
FIFGFQLILFIAVLFYTVI

SEQ ID NO: 2580840 - protein, 19 aa, Entamoeba histolytica
FIFVIWRVGVLYEQIDQKA

SEQ ID NO: 2580841 - protein, 19 aa, Entamoeba histolytica
FIFYCIITVYTRHWTIYTG

SEQ ID NO: 2580842 - protein, 17 aa, Entamoeba histolytica
FIGNGIINKVIHSTIVS

SEQ ID NO: 2580843 - protein, 48 aa, Entamoeba histolytica
FIGSPLLLFKAWMLRWWKIMYLRLLDLQKWKVIYGLYHLQYNKSSIPV

SEQ ID NO: 2580844 - protein, 18 aa, Entamoeba histolytica
FIGVCILSVLLLISHALK

SEQ ID NO: 2580845 - protein, 25 aa, Entamoeba histolytica
FIHPYSRIVLINVIILGGFYTISNH

SEQ ID NO: 2580846 - protein, 17 aa, Entamoeba histolytica
FIICYCHATITKNQVEV

SEQ ID NO: 2580847 - protein, 22 aa, Entamoeba histolytica
FIIFKFIIKNDIAWQVEFGGCI

SEQ ID NO: 2580848 - protein, 24 aa, Entamoeba histolytica
FIIGGEIMILFAFSILDITQQFDA

SEQ ID NO: 2580849 - protein, 17 aa, Entamoeba histolytica
FIIGYIVGDGLMFQSLK

SEQ ID NO: 2580850 - protein, 17 aa, Entamoeba histolytica
FIIHSILTLLFIPHLNW

SEQ ID NO: 2580851 - protein, 22 aa, Entamoeba histolytica
FIIHYYRFSVIFIIILDILEVI

SEQ ID NO: 2580852 - protein, 18 aa, Entamoeba histolytica
FIIIGIPIIIIFLFIIIF

SEQ ID NO: 2580853 - protein, 26 aa, Entamoeba histolytica
FIIKQIRHSWVIKVIFRIISAPWKKV

SEQ ID NO: 2580854 - protein, 18 aa, Entamoeba histolytica
FIIVCIFYFKACYSNPGI

SEQ ID NO: 2580855 - protein, 23 aa, Entamoeba histolytica
FIIYNLRKGFPVANHITPTNIIS

SEQ ID NO: 2580856 - protein, 25 aa, Entamoeba histolytica
FIIYSVLFQARWLMWIINKINPKAL

SEQ ID NO: 2580857 - protein, 25 aa, Entamoeba histolytica
FIKEYISLFSSMNWIIHDSIIISIL

SEQ ID NO: 2580858 - protein, 23 aa, Entamoeba histolytica
FIKGCYENIEYILLKKINEEEFE

SEQ ID NO: 2580859 - protein, 25 aa, Entamoeba histolytica
FIKKICKCIMPCWKDSFDENDIAPQ

SEQ ID NO: 2580860 - protein, 17 aa, Entamoeba histolytica
FIKKLCYNFFDSYSSDK

SEQ ID NO: 2580861 - protein, 19 aa, Entamoeba histolytica
FIKKYEIFVQYSVDLKLLI

SEQ ID NO: 2580862 - protein, 26 aa, Entamoeba histolytica
FIKLPYKLKVKMLFDTARGMQFLHEN

SEQ ID NO: 2580863 - protein, 18 aa, Entamoeba histolytica
FIKLRYYFVWEFGELLSI

SEQ ID NO: 2580864 - protein, 26 aa, Entamoeba histolytica
FIKNDFYLPFNLEKLNSFELLLQTEL

SEQ ID NO: 2580865 - protein, 18 aa, Entamoeba histolytica
FIKPDITPVHAFVSGEYD

SEQ ID NO: 2580866 - protein, 18 aa, Entamoeba histolytica
FIKWGSELVNIFQLSRRE

SEQ ID NO: 2580867 - protein, 17 aa, Entamoeba histolytica
FILGFFKAWQFKITLNI

SEQ ID NO: 2580868 - protein, 18 aa, Entamoeba histolytica
FILGFSVSGIGYFVLKLL

SEQ ID NO: 2580869 - protein, 18 aa, Entamoeba histolytica
FILICLILVTIICVLCLI

SEQ ID NO: 2580870 - protein, 17 aa, Entamoeba histolytica
FILISFLVGNDFLPRIP

SEQ ID NO: 2580871 - protein, 26 aa, Entamoeba histolytica
FILLLNRYTKLCVYTFSIVLPIIAGT

SEQ ID NO: 2580872 - protein, 18 aa, Entamoeba histolytica
FIMFAYLILCLIIKLVMI

SEQ ID NO: 2580873 - protein, 18 aa, Entamoeba histolytica
FIMQSLFNIFKNVKDSAN

SEQ ID NO: 2580874 - protein, 24 aa, Entamoeba histolytica
FIMSSNALGSWYGNFVVRGKGGSD

SEQ ID NO: 2580875 - protein, 17 aa, Entamoeba histolytica
FINYAYCIDLFYKTKYF

SEQ ID NO: 2580876 - protein, 23 aa, Entamoeba histolytica
FIPADRVPLFIFIKSCLKSILAI

SEQ ID NO: 2580877 - protein, 37 aa, Entamoeba histolytica
FIPLCWFINICLCCCKFKTGSLFPILSAVMLLVYTLI

SEQ ID NO: 2580878 - protein, 18 aa, Entamoeba histolytica
FIPVCLVAPKCGRIGAMR

SEQ ID NO: 2580879 - protein, 26 aa, Entamoeba histolytica
FIQNMIISFFLCWFVIGIGAACGFRL

SEQ ID NO: 2580880 - protein, 26 aa, Entamoeba histolytica
FIRKFGKKYVGLKCPHAQFTKAKSAI

SEQ ID NO: 2580881 - protein, 23 aa, Entamoeba histolytica
FISACPAFYWGLLWLTEQKQFGI

SEQ ID NO: 2580882 - protein, 18 aa, Entamoeba histolytica
FISAPCGYISTIEDYPGK

SEQ ID NO: 2580883 - protein, 17 aa, Entamoeba histolytica
FISMKFIPFMWIIYIIG

SEQ ID NO: 2580884 - protein, 18 aa, Entamoeba histolytica
FISQIIVTCWNHDPRIKA

SEQ ID NO: 2580885 - protein, 18 aa, Entamoeba histolytica
FISSKRLINADIEILLPQ

SEQ ID NO: 2580886 - protein, 17 aa, Entamoeba histolytica
FISSLPFVKIIREKNLI

SEQ ID NO: 2580887 - protein, 18 aa, Entamoeba histolytica
FISWCCLSFVGYFTLRNI

SEQ ID NO: 2580888 - protein, 19 aa, Entamoeba histolytica
FITCSTIALIQGKKVTIPP

SEQ ID NO: 2580889 - protein, 23 aa, Entamoeba histolytica
FITELIGTFLLNFVADGIYTNLF

SEQ ID NO: 2580890 - protein, 38 aa, Entamoeba histolytica
FITGYLIGFIKCWDLTLVVLCMFPFIMVSMMGLGMSAG

SEQ ID NO: 2580891 - protein, 19 aa, Entamoeba histolytica
FITKRGLNCLITIVISSIV

SEQ ID NO: 2580892 - protein, 25 aa, Entamoeba histolytica
FIVFLPCVWAFVVGLTRFYDHHHAI

SEQ ID NO: 2580893 - protein, 18 aa, Entamoeba histolytica
FIVGVINLFCELMPKILS

SEQ ID NO: 2580894 - protein, 27 aa, Entamoeba histolytica
FIVIKMIWFIILKRLQDWIVNKPSQFN

SEQ ID NO: 2580895 - protein, 19 aa, Entamoeba histolytica
FIVLICILGSIIVILIIAG

SEQ ID NO: 2580896 - protein, 17 aa, Entamoeba histolytica
FIVNCYLLISWMYECIV

SEQ ID NO: 2580897 - protein, 23 aa, Entamoeba histolytica
FIVNVCLCLIKIVAAVMSGSLTV

SEQ ID NO: 2580898 - protein, 18 aa, Entamoeba histolytica
FIVRFRVSLFTRSIEISL

SEQ ID NO: 2580899 - protein, 27 aa, Entamoeba histolytica
FIVSFALSCIACWIVFIFQPTFKPTVS

SEQ ID NO: 2580900 - protein, 18 aa, Entamoeba histolytica
FIYARISISYSFIPFVIY

SEQ ID NO: 2580901 - protein, 20 aa, Entamoeba histolytica
FIYFCYSFECSPGCIGGCEA

SEQ ID NO: 2580902 - protein, 23 aa, Entamoeba histolytica
FIYTGVIKLNFFGTENIEQNENI

SEQ ID NO: 2580903 - protein, 17 aa, Entamoeba histolytica
FKADYHFYYFIFQTDNS

SEQ ID NO: 2580904 - protein, 17 aa, Entamoeba histolytica
FKAKMGDEFKKILKEAN

SEQ ID NO: 2580905 - protein, 17 aa, Entamoeba histolytica
FKCISCPAGKQPNQNKD

SEQ ID NO: 2580906 - protein, 20 aa, Entamoeba histolytica
FKCQLRVESPLTLKTKQTLF

SEQ ID NO: 2580907 - protein, 17 aa, Entamoeba histolytica
FKDCSICTEKTCITCSS

SEQ ID NO: 2580908 - protein, 17 aa, Entamoeba histolytica
FKDICFRYPTRPDNAVL

SEQ ID NO: 2580909 - protein, 25 aa, Entamoeba histolytica
FKDSLKRLFPFMQFFLLTGVLFLLT

SEQ ID NO: 2580910 - protein, 17 aa, Entamoeba histolytica
FKEEFTFDANSKHPGIC

SEQ ID NO: 2580911 - protein, 24 aa, Entamoeba histolytica
FKEFKRVVCEQLTLVLCKRETTPQ

SEQ ID NO: 2580912 - protein, 21 aa, Entamoeba histolytica
FKEKIGFAVLPSMVKTLEITD

SEQ ID NO: 2580913 - protein, 20 aa, Entamoeba histolytica
FKEKVWGVVKVLGFISLGVG

SEQ ID NO: 2580914 - protein, 17 aa, Entamoeba histolytica
FKEKYCSYLVKPAKRAP

SEQ ID NO: 2580915 - protein, 18 aa, Entamoeba histolytica
FKELDLQKQYERIVQLLD

SEQ ID NO: 2580916 - protein, 23 aa, Entamoeba histolytica
FKEYCYKCSNSLSVLFGSANYCG

SEQ ID NO: 2580917 - protein, 21 aa, Entamoeba histolytica
FKEYRCIYPGCNEGLKTKYNC

SEQ ID NO: 2580918 - protein, 26 aa, Entamoeba histolytica
FKFFYFPRFLIVLLIGSFLVNLYLYN

SEQ ID NO: 2580919 - protein, 23 aa, Entamoeba histolytica
FKFSPEIIYQLSIDSISGSFNNE

SEQ ID NO: 2580920 - protein, 21 aa, Entamoeba histolytica
FKFSPTLKQCVPILCGNNQID

SEQ ID NO: 2580921 - protein, 20 aa, Entamoeba histolytica
FKGDGKYIVINTCNYYTNFD

SEQ ID NO: 2580922 - protein, 20 aa, Entamoeba histolytica
FKGDGYLSIDLITSENPVLI

SEQ ID NO: 2580923 - protein, 21 aa, Entamoeba histolytica
FKGDTGLLVYSLKDWVFTSID

SEQ ID NO: 2580924 - protein, 20 aa, Entamoeba histolytica
FKGFLTVFDFIAYRMGLVQQ

SEQ ID NO: 2580925 - protein, 19 aa, Entamoeba histolytica
FKGNLLIPSVSLSRIICQQ

SEQ ID NO: 2580926 - protein, 21 aa, Entamoeba histolytica
FKGSQAIKVDIVDIFTSLPTR

SEQ ID NO: 2580927 - protein, 19 aa, Entamoeba histolytica
FKGSSLIIKGCEETLISLI

SEQ ID NO: 2580928 - protein, 22 aa, Entamoeba histolytica
FKHEEWKCIWKMIEQEHWMTIC

SEQ ID NO: 2580929 - protein, 18 aa, Entamoeba histolytica
FKHMEMGDEAYLVKWKLF

SEQ ID NO: 2580930 - protein, 21 aa, Entamoeba histolytica
FKIAAIMLIALFCYDIFWVFG

SEQ ID NO: 2580931 - protein, 21 aa, Entamoeba histolytica
FKIETVYSCMAIFNCIKLPFQ

SEQ ID NO: 2580932 - protein, 21 aa, Entamoeba histolytica
FKIFPCLKPKDVRKIPLPLIY

SEQ ID NO: 2580933 - protein, 29 aa, Entamoeba histolytica
FKIGSVFRRPLPILFCLLLLPLPKNNISL

SEQ ID NO: 2580934 - protein, 21 aa, Entamoeba histolytica
FKIKVVCSVLNKLSEIVEKNG

SEQ ID NO: 2580935 - protein, 34 aa, Entamoeba histolytica; identical to SEQ ID NO: 2382307

SEQ ID NO: 2580936 - protein, 17 aa, Entamoeba histolytica
FKKCFIDGNEFTTSFSF

SEQ ID NO: 2580937 - protein, 17 aa, Entamoeba histolytica
FKKINTMTLKHSKGSRL

SEQ ID NO: 2580938 - protein, 28 aa, Entamoeba histolytica
FKKLIKYLPQFTSLVIVGGMAIPKQVRL

SEQ ID NO: 2580939 - protein, 19 aa, Entamoeba histolytica
FKKNLFKECLEKHIHQTDL

SEQ ID NO: 2580940 - protein, 20 aa, Entamoeba histolytica
FKKSLWKNWCEAFLVEDHQW

SEQ ID NO: 2580941 - protein, 21 aa, Entamoeba histolytica
FKKYPNYIGKYFKVITEYSLE

SEQ ID NO: 2580942 - protein, 31 aa, Entamoeba histolytica
FKLDCLLNKICGRIMTPIDFIWAYHSEAKES

SEQ ID NO: 2580943 - protein, 18 aa, Entamoeba histolytica
FKLFKGSSLISLILSLSY

SEQ ID NO: 2580944 - protein, 21 aa, Entamoeba histolytica
FKLGECYLHGKGVPKDSSKGF

SEQ ID NO: 2580945 - protein, 19 aa, Entamoeba histolytica
FKLLNDMFCVVSPNDSNAR

SEQ ID NO: 2580946 - protein, 19 aa, Entamoeba histolytica
FKLVFQILFLFSAICLFVF

SEQ ID NO: 2580947 - protein, 17 aa, Entamoeba histolytica
FKLYFNLINKFNSSQIP

SEQ ID NO: 2580948 - protein, 21 aa, Entamoeba histolytica
FKMIMIHSLGHSFSIHQHMGT

SEQ ID NO: 2580949 - protein, 17 aa, Entamoeba histolytica
FKMKSSQNMRIVPMVSK

SEQ ID NO: 2580950 - protein, 21 aa, Entamoeba histolytica
FKNDISFNMDVCKLLDNVKTS

SEQ ID NO: 2580951 - protein, 21 aa, Entamoeba histolytica
FKNGILKWRKGIIPNTTIKVS

SEQ ID NO: 2580952 - protein, 17 aa, Entamoeba histolytica
FKNNLKYGYFKKQIFAE

SEQ ID NO: 2580953 - protein, 24 aa, Entamoeba histolytica
FKNPHISNGLPFYIISGNKSFSQV

SEQ ID NO: 2580954 - protein, 20 aa, Entamoeba histolytica
FKNVICSVLSLLQKALEINK

SEQ ID NO: 2580955 - protein, 19 aa, Entamoeba histolytica
FKPTLVNSIVFIVSNIINV

SEQ ID NO: 2580956 - protein, 30 aa, Entamoeba histolytica; identical to SEQ ID NO: 2382334

SEQ ID NO: 2580957 - protein, 18 aa, Entamoeba histolytica
FKQYGYKLGLTVRETCRF

SEQ ID NO: 2580958 - protein, 19 aa, Entamoeba histolytica
FKRNVFVEHFSLFKFRIDS

SEQ ID NO: 2580959 - protein, 28 aa, Entamoeba histolytica
FKRRYSIPCSNPFGYVCPDNLPKVPCPS

SEQ ID NO: 2580960 - protein, 24 aa, Entamoeba histolytica
FKSCLTNLFFKWANRILPILLYFS

SEQ ID NO: 2580961 - protein, 17 aa, Entamoeba histolytica
FKSKWFRIINLYSSTID

SEQ ID NO: 2580962 - protein, 26 aa, Entamoeba histolytica
FKSRDCIFMFISWCCTLSALSVVNGL

SEQ ID NO: 2580963 - protein, 20 aa, Entamoeba histolytica
FKSSVPREFIKGRSNERVAL

SEQ ID NO: 2580964 - protein, 17 aa, Entamoeba histolytica
FKTLLTFNETIINVIAG

SEQ ID NO: 2580965 - protein, 17 aa, Entamoeba histolytica
FKTRKIWGFCILTISFI

SEQ ID NO: 2580966 - protein, 27 aa, Entamoeba histolytica
FKTVNYRSIYWPVFVSLYGWPLILLII

SEQ ID NO: 2580967 - protein, 18 aa, Entamoeba histolytica
FKTYAWVEMSMFLKSLKI

SEQ ID NO: 2580968 - protein, 19 aa, Entamoeba histolytica
FKVIQTWPGLLTLTSNKGI

SEQ ID NO: 2580969 - protein, 22 aa, Entamoeba histolytica
FKVKYYLKVVIGVSLFVSIFFL

SEQ ID NO: 2580970 - protein, 25 aa, Entamoeba histolytica
FKVYWEYIKAGLVFLGAACIVFLSA

SEQ ID NO: 2580971 - protein, 18 aa, Entamoeba histolytica
FKYDTCVGNEIFKNAILV

SEQ ID NO: 2580972 - protein, 19 aa, Entamoeba histolytica
FKYFPIIIIVLFVLLVIVT

SEQ ID NO: 2580973 - protein, 21 aa, Entamoeba histolytica
FKYPWNIASFIMNGDRLPKVS

SEQ ID NO: 2580974 - protein, 17 aa, Entamoeba histolytica
FKYQWQIAEYVCKGNRP

SEQ ID NO: 2580975 - protein, 18 aa, Entamoeba histolytica
FKYSDWIDMILVLVGLIS

SEQ ID NO: 2580976 - protein, 22 aa, Entamoeba histolytica
FKYTQERAIELALRMGGEQTSP

SEQ ID NO: 2580977 - protein, 26 aa, Entamoeba histolytica
FLAIKEKYPILQWILRSILFILYLSA

SEQ ID NO: 2580978 - protein, 26 aa, Entamoeba histolytica
FLDLFKRYGIHVTFFIIGERVKGREE

SEQ ID NO: 2580979 - protein, 18 aa, Entamoeba histolytica
FLECASYVRLRCGVITMK

SEQ ID NO: 2580980 - protein, 17 aa, Entamoeba histolytica
FLEDIELTFKMICHNDC

SEQ ID NO: 2580981 - protein, 30 aa, Entamoeba histolytica
FLEEIHFILKRGVRINDHFLTLLQLINIAK

SEQ ID NO: 2580982 - protein, 18 aa, Entamoeba histolytica
FLEHPFVSIILLTVTLIL

SEQ ID NO: 2580983 - protein, 27 aa, Entamoeba histolytica
FLEKESRASTLLTFDIFGPPIVVLLMG

SEQ ID NO: 2580984 - protein, 18 aa, Entamoeba histolytica
FLENEFIFTNAFPSVRTN

SEQ ID NO: 2580985 - protein, 17 aa, Entamoeba histolytica
FLESFRYNYNYDETIPR

SEQ ID NO: 2580986 - protein, 18 aa, Entamoeba histolytica
FLETYFVPYKVEGLLQET

SEQ ID NO: 2580987 - protein, 18 aa, Entamoeba histolytica
FLEVMARKLSVSCETLFN

SEQ ID NO: 2580988 - protein, 28 aa, Entamoeba histolytica
FLFLPSPIIPFCFLDFIKQQENCKLNNQ

SEQ ID NO: 2580989 - protein, 24 aa, Entamoeba histolytica
FLFLRVIYCKCSFVMTRLLLGPIL

SEQ ID NO: 2580990 - protein, 23 aa, Entamoeba histolytica
FLFNFANYFYWLVVPLIMNDKGG

SEQ ID NO: 2580991 - protein, 18 aa, Entamoeba histolytica
FLFVIGMSIIPIFTSMLL

SEQ ID NO: 2580992 - protein, 20 aa, Entamoeba histolytica
FLFYCYSEKIDLKKNRLDVV

SEQ ID NO: 2580993 - protein, 18 aa, Entamoeba histolytica
FLFYSLFCLILCISSNIA

SEQ ID NO: 2580994 - protein, 17 aa, Entamoeba histolytica
FLGEILRSIKFIKYNAW

SEQ ID NO: 2580995 - protein, 24 aa, Entamoeba histolytica
FLGEILRSIKFIKYNAWEEPLHKR

SEQ ID NO: 2580996 - protein, 17 aa, Entamoeba histolytica
FLGLAGWALDLLGYSQH

SEQ ID NO: 2580997 - protein, 25 aa, Entamoeba histolytica
FLGLFRLPLKFQDAKQFPRCLSIVD

SEQ ID NO: 2580998 - protein, 34 aa, Entamoeba histolytica
FLHTLRLHWVEFQNKFYLGDGIKFVPFKLSTNKK

SEQ ID NO: 2580999 - protein, 24 aa, Entamoeba histolytica
FLIILTWYCCYGVALYNMQYQIQA

SEQ ID NO: 2581000 - protein, 25 aa, Entamoeba histolytica
FLIIPSIIVFSVFYPSLKYPLDSLS

SEQ ID NO: 2581001 - protein, 20 aa, Entamoeba histolytica
FLILHIRLTRKIKQDIDDEN

SEQ ID NO: 2581002 - protein, 23 aa, Entamoeba histolytica
FLINLKIPLSMKVYEKLAFFASR

SEQ ID NO: 2581003 - protein, 17 aa, Entamoeba histolytica
FLINYGIRATHYHAGLD

SEQ ID NO: 2581004 - protein, 17 aa, Entamoeba histolytica
FLIPSFMRKRSNSSSGR

SEQ ID NO: 2581005 - protein, 21 aa, Entamoeba histolytica
FLKEFRWVGFGSMFTHVAFAL

SEQ ID NO: 2581006 - protein, 25 aa, Entamoeba histolytica
FLKSVKWYYCLGITFCDISATFCLV

SEQ ID NO: 2581007 - protein, 24 aa, Entamoeba histolytica
FLLDFCYYTNFLLLVTIILIFGFK

SEQ ID NO: 2581008 - protein, 34 aa, Entamoeba histolytica
FLLEFISSLLFLWCICIFPKFYFILEYISYKSML

SEQ ID NO: 2581009 - protein, 21 aa, Entamoeba histolytica
FLLGCVFSFNLFGCSSFFSLF

SEQ ID NO: 2581010 - protein, 20 aa, Entamoeba histolytica
FLLLYIRLTRKIKQEIDDEK

SEQ ID NO: 2581011 - protein, 18 aa, Entamoeba histolytica
FLMAIGYPTHFIAYRHAN

SEQ ID NO: 2581012 - protein, 17 aa, Entamoeba histolytica
FLMFFGMFLALIIYYFT

SEQ ID NO: 2581013 - protein, 17 aa, Entamoeba histolytica
FLMNCPFDITLFVLVSS

SEQ ID NO: 2581014 - protein, 25 aa, Entamoeba histolytica
FLMYVLCSLGYTFVVRKPTKVNCQR

SEQ ID NO: 2581015 - protein, 24 aa, Entamoeba histolytica
FLNDEIRYVFVYGTGGQETLSVGI

SEQ ID NO: 2581016 - protein, 17 aa, Entamoeba histolytica
FLNFFIVSFSFCCLACW

SEQ ID NO: 2581017 - protein, 18 aa, Entamoeba histolytica
FLNIIKWICCRTTKRKVD

SEQ ID NO: 2581018 - protein, 21 aa, Entamoeba histolytica
FLNKKWFPIADICRIGFVLQA

SEQ ID NO: 2581019 - protein, 25 aa, Entamoeba histolytica
FLPGLGIYICFALVLLIINSIKYSL

SEQ ID NO: 2581020 - protein, 23 aa, Entamoeba histolytica
FLPICIASLIILISYNIYIVAIN

SEQ ID NO: 2581021 - protein, 17 aa, Entamoeba histolytica
FLPITLFGYFYIFFATI

SEQ ID NO: 2581022 - protein, 18 aa, Entamoeba histolytica
FLPTRFAMTFTFGNILIF

SEQ ID NO: 2581023 - protein, 24 aa, Entamoeba histolytica
FLPTRIGIIDLEIIFSTTVNGFSL

SEQ ID NO: 2581024 - protein, 19 aa, Entamoeba histolytica
FLPYLFAYPCNEIIFQKPF

SEQ ID NO: 2581025 - protein, 25 aa, Entamoeba histolytica
FLQTSRVFCKYAFPDNLARVLSRIC

SEQ ID NO: 2581026 - protein, 26 aa, Entamoeba histolytica
FLRILKSGGMLGFFAMDNLNAITSLT

SEQ ID NO: 2581027 - protein, 19 aa, Entamoeba histolytica
FLRKHIRLTKMIEIEQSNL

SEQ ID NO: 2581028 - protein, 25 aa, Entamoeba histolytica
FLSCLLPTIFPFVSFVAVLQNSFIE

SEQ ID NO: 2581029 - protein, 19 aa, Entamoeba histolytica
FLSILCIAAIIGMGLYKFL

SEQ ID NO: 2581030 - protein, 34 aa, Entamoeba histolytica
FLSNSFFFERIMTFYIALLFRFHIFIGTPELMRK

SEQ ID NO: 2581031 - protein, 24 aa, Entamoeba histolytica
FLTCGAYGAICWVFYQLDTNPELC

SEQ ID NO: 2581032 - protein, 19 aa, Entamoeba histolytica
FLTIFSIFVIFSLPEFPFM

SEQ ID NO: 2581033 - protein, 24 aa, Entamoeba histolytica
FLTIIYFCMIHKLVHLFDNTPIIP

SEQ ID NO: 2581034 - protein, 23 aa, Entamoeba histolytica
FLTRLVFIISLSFLFAHYMFGYL

SEQ ID NO: 2581035 - protein, 23 aa, Entamoeba histolytica
FLTTYKYFVFKTITIKTFLHQLI

SEQ ID NO: 2581036 - protein, 17 aa, Entamoeba histolytica
FLVIGGFGYSVGSIQRG

SEQ ID NO: 2581037 - protein, 18 aa, Entamoeba histolytica
FLVILLLYFLKLHPLLLL

SEQ ID NO: 2581038 - protein, 19 aa, Entamoeba histolytica
FLVVAALISFCVFISFLNN

SEQ ID NO: 2581039 - protein, 22 aa, Entamoeba histolytica
FLVVCATVAFGMGIDKPDVRFV

SEQ ID NO: 2581040 - protein, 20 aa, Entamoeba histolytica
FLYCGHLCIVQELLGQNLYQ

SEQ ID NO: 2581041 - protein, 23 aa, Entamoeba histolytica
FLYKRKIWLCSLFFGLSIHMKIY

SEQ ID NO: 2581042 - protein, 20 aa, Entamoeba histolytica
FMANLKKLFVLSTNPIETHQ

SEQ ID NO: 2581043 - protein, 23 aa, Entamoeba histolytica
FMAPWESFFFYWESVLKKGLELS

SEQ ID NO: 2581044 - protein, 20 aa, Entamoeba histolytica
FMCTIFSREWIKVSGSSSAD

SEQ ID NO: 2581045 - protein, 26 aa, Entamoeba histolytica
FMEGAYSRWLFFKTHFVVYFGNLVGS

SEQ ID NO: 2581046 - protein, 17 aa, Entamoeba histolytica
FMESVWWVFKQLYEKNL

SEQ ID NO: 2581047 - protein, 24 aa, Entamoeba histolytica
FMIDFCYFCQIITLLCIFSLNTEY

SEQ ID NO: 2581048 - protein, 20 aa, Entamoeba histolytica
FMKCILLNRSELYTCDKMLK

SEQ ID NO: 2581049 - protein, 20 aa, Entamoeba histolytica
FMLCSLSYWVSFQMAPNGQW

SEQ ID NO: 2581050 - protein, 17 aa, Entamoeba histolytica
FMLETSDNFFVYFSYIM

SEQ ID NO: 2581051 - protein, 17 aa, Entamoeba histolytica
FMNASCFHCSVYYLYNL

SEQ ID NO: 2581052 - protein, 20 aa, Entamoeba histolytica
FMNKCFKDELQILIERMTII

SEQ ID NO: 2581053 - protein, 17 aa, Entamoeba histolytica
FMNVFKMSHLTIKDQFN

SEQ ID NO: 2581054 - protein, 22 aa, Entamoeba histolytica
FMNVLVHRGIDFYGMHFMENAL

SEQ ID NO: 2581055 - protein, 26 aa, Entamoeba histolytica
FMPSNARFIEKWAYPLCSQVYYDPIK

SEQ ID NO: 2581056 - protein, 24 aa, Entamoeba histolytica
FMSMSLLHFMHLKGKYYYKDNDKT

SEQ ID NO: 2581057 - protein, 30 aa, Entamoeba histolytica
FNAACIPLLWVCTLSSLILIIPNFHTINDF

SEQ ID NO: 2581058 - protein, 25 aa, Entamoeba histolytica
FNAIRRPFMNFGYFVSCLTTFKVAI

SEQ ID NO: 2581059 - protein, 17 aa, Entamoeba histolytica
FNAVIQWEHASDILYSL

SEQ ID NO: 2581060 - protein, 20 aa, Entamoeba histolytica
FNCDGWPFELFCEKMMQNIF

SEQ ID NO: 2581061 - protein, 21 aa, Entamoeba histolytica
FNCENAVSISLPFTRAQNVPS

SEQ ID NO: 2581062 - protein, 26 aa, Entamoeba histolytica
FNCRLSLYLPLFLKQFIPIIEQIQLY

SEQ ID NO: 2581063 - protein, 21 aa, Entamoeba histolytica
FNDFFPVCIVIVSAFSLLNHF

SEQ ID NO: 2581064 - protein, 22 aa, Entamoeba histolytica
FNDFFPVCIVIVSAFSLLNHFI

SEQ ID NO: 2581065 - protein, 19 aa, Entamoeba histolytica
FNDRITLAVCQRGRDYTAP

SEQ ID NO: 2581066 - protein, 19 aa, Entamoeba histolytica
FNECNKLKSIYYTGTDLFT

SEQ ID NO: 2581067 - protein, 18 aa, Entamoeba histolytica
FNEKIVFVMYYIPSEEQK

SEQ ID NO: 2581068 - protein, 20 aa, Entamoeba histolytica
FNFACLVLYLYGSLWAYAAT

SEQ ID NO: 2581069 - protein, 18 aa, Entamoeba histolytica
FNFYLLFHTASWIGLNCN

SEQ ID NO: 2581070 - protein, 26 aa, Entamoeba histolytica
FNGIKGQCLGLGFSIITFFMIASYAL

SEQ ID NO: 2581071 - protein, 17 aa, Entamoeba histolytica
FNGILFFEECPLKDQHW

SEQ ID NO: 2581072 - protein, 17 aa, Entamoeba histolytica
FNGITGFITTSVISTLR

SEQ ID NO: 2581073 - protein, 17 aa, Entamoeba histolytica
FNGLQLMNGLLVFAVVG

SEQ ID NO: 2581074 - protein, 17 aa, Entamoeba histolytica
FNGNAILQKIRIMGNTN

SEQ ID NO: 2581075 - protein, 18 aa, Entamoeba histolytica
FNIFPITFIMNLRKNSPK

SEQ ID NO: 2581076 - protein, 18 aa, Entamoeba histolytica
FNIHFAFFVVSLIALLVF

SEQ ID NO: 2581077 - protein, 18 aa, Entamoeba histolytica
FNIIEMTNFYNAFQNCLT

SEQ ID NO: 2581078 - protein, 20 aa, Entamoeba histolytica
FNILCLLFGVFFFVLVSIYE

SEQ ID NO: 2581079 - protein, 18 aa, Entamoeba histolytica
FNIMWKIVKERAKDRDEL

SEQ ID NO: 2581080 - protein, 17 aa, Entamoeba histolytica
FNIVFFVIKNCFLNEPS

SEQ ID NO: 2581081 - protein, 18 aa, Entamoeba histolytica
FNKCGGVGFWYWKPEDPR

SEQ ID NO: 2581082 - protein, 25 aa, Entamoeba histolytica
FNKLRCPLCDTFYCSVECKEKDKQK

SEQ ID NO: 2581083 - protein, 23 aa, Entamoeba histolytica
FNKPRLLVYLNMSLVIYQISRLL

SEQ ID NO: 2581084 - protein, 31 aa, Entamoeba histolytica
FNLCPCPTDSNCIVRLKVPRVYNMDDLNKFK

SEQ ID NO: 2581085 - protein, 23 aa, Entamoeba histolytica
FNLCSLPRFWIVLLYIICVPLVK

SEQ ID NO: 2581086 - protein, 22 aa, Entamoeba histolytica
FNLEKYKSLLYITVERKECFDD

SEQ ID NO: 2581087 - protein, 17 aa, Entamoeba histolytica
FNLEYYLYYKIVEQKMS

SEQ ID NO: 2581088 - protein, 17 aa, Entamoeba histolytica
FNLGVIFFYIIVYTVNF

SEQ ID NO: 2581089 - protein, 17 aa, Entamoeba histolytica
FNLLLREEMHELTQMLL

SEQ ID NO: 2581090 - protein, 17 aa, Entamoeba histolytica
FNLLLSFISYILSNQKN

SEQ ID NO: 2581091 - protein, 26 aa, Entamoeba histolytica
FNLLSRYPKYLTFEAKAQIFRKQIKK

SEQ ID NO: 2581092 - protein, 19 aa, Entamoeba histolytica
FNLTFPFVILKALINTHSL

SEQ ID NO: 2581093 - protein, 17 aa, Entamoeba histolytica
FNNFKIFCDCLYDKKMK

SEQ ID NO: 2581094 - protein, 20 aa, Entamoeba histolytica
FNNFLFWFIVEHPKMPVVDF

SEQ ID NO: 2581095 - protein, 19 aa, Entamoeba histolytica
FNNKCIVDVCFQESSSSES

SEQ ID NO: 2581096 - protein, 27 aa, Entamoeba histolytica
FNPYILIRIAMCFFVVAVAIILIWPNT

SEQ ID NO: 2581097 - protein, 19 aa, Entamoeba histolytica
FNRREAFKLSIDDYFLIMT

SEQ ID NO: 2581098 - protein, 25 aa, Entamoeba histolytica
FNSFPDKHSFIFRSFKQEFIVKMLW

SEQ ID NO: 2581099 - protein, 24 aa, Entamoeba histolytica
FNSIVKAVIWGRCVYDNIRKFIQF

SEQ ID NO: 2581100 - protein, 24 aa, Entamoeba histolytica
FNSIVKAVMWGRCVYDNIRKFLQF

SEQ ID NO: 2581101 - protein, 17 aa, Entamoeba histolytica
FNSSYTFIFFFKVGFYN

SEQ ID NO: 2581102 - protein, 19 aa, Entamoeba histolytica
FNSTFIFPISLALESISVR

SEQ ID NO: 2581103 - protein, 18 aa, Entamoeba histolytica
FNTHVSLQLTIRTCSTGT

SEQ ID NO: 2581104 - protein, 25 aa, Entamoeba histolytica
FNTKYKLSFNIIISVLVLFFLGVVV

SEQ ID NO: 2581105 - protein, 23 aa, Entamoeba histolytica
FNTPISFEFCLGAIGVLISISNY

SEQ ID NO: 2581106 - protein, 24 aa, Entamoeba histolytica
FNTQRISIVFPLIIILQLTLIQSS

SEQ ID NO: 2581107 - protein, 24 aa, Entamoeba histolytica
FNTSWTHKFIRKWSNATTHDACDG

SEQ ID NO: 2581108 - protein, 21 aa, Entamoeba histolytica
FNVCKLCKLLISDTEKEIIYG

SEQ ID NO: 2581109 - protein, 19 aa, Entamoeba histolytica
FNVICWLLPIKFGLSDVFD

SEQ ID NO: 2581110 - protein, 17 aa, Entamoeba histolytica
FNVIKKIVSVIALILFI

SEQ ID NO: 2581111 - protein, 21 aa, Entamoeba histolytica
FNVLHEFLSFYVVLMKFINYK

SEQ ID NO: 2581112 - protein, 17 aa, Entamoeba histolytica
FNWNTKMIFVWVKASFT

SEQ ID NO: 2581113 - protein, 17 aa, Entamoeba histolytica
FNYEAVYILAPKYNFAY

SEQ ID NO: 2581114 - protein, 18 aa, Entamoeba histolytica
FNYFLSCIVGERSSEFKV

SEQ ID NO: 2581115 - protein, 17 aa, Entamoeba histolytica
FNYMLAGIIVMIVSLVC

SEQ ID NO: 2581116 - protein, 17 aa, Entamoeba histolytica
FNYNYTETIPREFIPDI

SEQ ID NO: 2581117 - protein, 17 aa, Entamoeba histolytica
FNYPWAVVSRLLLGLVN

SEQ ID NO: 2581118 - protein, 19 aa, Entamoeba histolytica
FNYQLFKFEMVRNMVSQNH

SEQ ID NO: 2581119 - protein, 18 aa, Entamoeba histolytica
FPADIFAFGMVIFETIKW

SEQ ID NO: 2581120 - protein, 25 aa, Entamoeba histolytica
FPAYFAYKLTNGWRKIMALIVMILG

SEQ ID NO: 2581121 - protein, 18 aa, Entamoeba histolytica
FPDAESILSFVSSGQRLE

SEQ ID NO: 2581122 - protein, 20 aa, Entamoeba histolytica
FPDDCSLCDITKGYRDDCTG

SEQ ID NO: 2581123 - protein, 21 aa, Entamoeba histolytica
FPDGESILKFVGAGKRLEIPN

SEQ ID NO: 2581124 - protein, 21 aa, Entamoeba histolytica
FPDSESILRFVGAGKRLDISD

SEQ ID NO: 2581125 - protein, 21 aa, Entamoeba histolytica
FPDSESILRFVGAGKRLDVAE

SEQ ID NO: 2581126 - protein, 20 aa, Entamoeba histolytica
FPDSESILRFVGAGKRLHVS

SEQ ID NO: 2581127 - protein, 24 aa, Entamoeba histolytica
FPEDVFRFLFAFIVEVPISIICRY

SEQ ID NO: 2581128 - protein, 18 aa, Entamoeba histolytica
FPELQLPANLKGFELKKC

SEQ ID NO: 2581129 - protein, 19 aa, Entamoeba histolytica
FPFFDNWVWYRVFIQMLQT

SEQ ID NO: 2581130 - protein, 18 aa, Entamoeba histolytica
FPFILKFIYELLNPPKHM

SEQ ID NO: 2581131 - protein, 18 aa, Entamoeba histolytica
FPFNHSYRKELYFIEELR

SEQ ID NO: 2581132 - protein, 21 aa, Entamoeba histolytica
FPGLMFTSAFIFKFLAYFNLI

SEQ ID NO: 2581133 - protein, 20 aa, Entamoeba histolytica
FPGYPYFISLHVFESTNCIL

SEQ ID NO: 2581134 - protein, 18 aa, Entamoeba histolytica
FPHPIEWDKFFDTSQYTS

SEQ ID NO: 2581135 - protein, 21 aa, Entamoeba histolytica
FPHSACSFSSVDVLDTTGEVI

SEQ ID NO: 2581136 - protein, 27 aa, Entamoeba histolytica
FPIEHKIACLLPLFGPVLLLLIKSLFQ

SEQ ID NO: 2581137 - protein, 17 aa, Entamoeba histolytica
FPIFTIKFIDLIVMMME

SEQ ID NO: 2581138 - protein, 18 aa, Entamoeba histolytica
FPIFTIKFIDLIVMMMEL

SEQ ID NO: 2581139 - protein, 17 aa, Entamoeba histolytica
FPISVILVKNGGGYVDL

SEQ ID NO: 2581140 - protein, 18 aa, Entamoeba histolytica
FPIYRLPKDQIKKEYPTE

SEQ ID NO: 2581141 - protein, 26 aa, Entamoeba histolytica
FPKNDERFGFPWKIAEFITSGKRLEQ

SEQ ID NO: 2581142 - protein, 24 aa, Entamoeba histolytica
FPKSEFRFPWSIANATAQGQRPSL

SEQ ID NO: 2581143 - protein, 21 aa, Entamoeba histolytica
FPLFICTLSLFGSISSLVLIT

SEQ ID NO: 2581144 - protein, 19 aa, Entamoeba histolytica
FPLFYNWFNFLIAIIMTYL

SEQ ID NO: 2581145 - protein, 19 aa, Entamoeba histolytica
FPLICLCIKIIFNEKEPEN

SEQ ID NO: 2581146 - protein, 22 aa, Entamoeba histolytica
FPLKDIEALIKYLPNNAEYQII

SEQ ID NO: 2581147 - protein, 22 aa, Entamoeba histolytica
FPLLQWINWMCIFRKPRSDRVR

SEQ ID NO: 2581148 - protein, 19 aa, Entamoeba histolytica
FPLSGIITFVIGGIYISIS

SEQ ID NO: 2581149 - protein, 20 aa, Entamoeba histolytica
FPLYCMIGFVLYSVQSQHNN

SEQ ID NO: 2581150 - protein, 22 aa, Entamoeba histolytica
FPMGIGALLMRKDVVDKMSPIY

SEQ ID NO: 2581151 - protein, 21 aa, Entamoeba histolytica
FPMRESFVFLEAIKKAFISQF

SEQ ID NO: 2581152 - protein, 17 aa, Entamoeba histolytica
FPNCESILRFVGTGNRL

SEQ ID NO: 2581153 - protein, 18 aa, Entamoeba histolytica
FPNFPQRDYHLLFDYFTS

SEQ ID NO: 2581154 - protein, 25 aa, Entamoeba histolytica
FPRVRTSDLPQCFPLNKNIINKQKI

SEQ ID NO: 2581155 - protein, 23 aa, Entamoeba histolytica
FPSFEYLHSLALGVERDEQVKFF

SEQ ID NO: 2581156 - protein, 19 aa, Entamoeba histolytica
FPSHDFLKHICIVWNKCYY

SEQ ID NO: 2581157 - protein, 19 aa, Entamoeba histolytica
FPSIFFVAKIFKLDRLTTR

SEQ ID NO: 2581158 - protein, 22 aa, Entamoeba histolytica
FPSQLRTSIITGLRPTIPNSPY

SEQ ID NO: 2581159 - protein, 18 aa, Entamoeba histolytica
FPTCAGILRYIPKKWKIV

SEQ ID NO: 2581160 - protein, 25 aa, Entamoeba histolytica
FPTFDGKWWPQSFMSFFTMAPFISA

SEQ ID NO: 2581161 - protein, 28 aa, Entamoeba histolytica
FPTGDGFFYQWVMAIGVLLAGIFTLLIV

SEQ ID NO: 2581162 - protein, 29 aa, Entamoeba histolytica
FPTSDGIFFQWVMCVGILLVGIFTMLFNG

SEQ ID NO: 2581163 - protein, 17 aa, Entamoeba histolytica
FPYDSRCITIQDFCTSN

SEQ ID NO: 2581164 - protein, 24 aa, Entamoeba histolytica
FQENILFRFYLKFIGSPIATKIFE

SEQ ID NO: 2581165 - protein, 25 aa, Entamoeba histolytica
FQERPEPFVQFTVKIQKNYFYYLKQ

SEQ ID NO: 2581166 - protein, 18 aa, Entamoeba histolytica
FQFKCITPNCFISLDKNH

SEQ ID NO: 2581167 - protein, 17 aa, Entamoeba histolytica
FQFLKEFNCSFFEPLPS

SEQ ID NO: 2581168 - protein, 18 aa, Entamoeba histolytica
FQFLRAFGLNTFAGKEFY

SEQ ID NO: 2581169 - protein, 17 aa, Entamoeba histolytica
FQFPLSGIITFVIGGIY

SEQ ID NO: 2581170 - protein, 17 aa, Entamoeba histolytica
FQHCLLIGVLNQFASIV

SEQ ID NO: 2581171 - protein, 19 aa, Entamoeba histolytica
FQHVVPLVFVLTVAVLKEL

SEQ ID NO: 2581172 - protein, 21 aa, Entamoeba histolytica
FQIKLKMWVESMLIENEINRI

SEQ ID NO: 2581173 - protein, 18 aa, Entamoeba histolytica
FQKNIFSFILVSYAIIMA

SEQ ID NO: 2581174 - protein, 19 aa, Entamoeba histolytica
FQLILFIAVLFYTVILYSN

SEQ ID NO: 2581175 - protein, 18 aa, Entamoeba histolytica
FQLLALRFVSQKHLETTN

SEQ ID NO: 2581176 - protein, 17 aa, Entamoeba histolytica
FQNLPHTWSSYYDTHIV

SEQ ID NO: 2581177 - protein, 24 aa, Entamoeba histolytica
FQPSFWRFLKYWFMSLLTSQINVT

SEQ ID NO: 2581178 - protein, 20 aa, Entamoeba histolytica
FQRHIVALGNAFAFQMVQIG

SEQ ID NO: 2581179 - protein, 20 aa, Entamoeba histolytica
FQSDCFKSLMKEFSDSQEAL

SEQ ID NO: 2581180 - protein, 26 aa, Entamoeba histolytica
FQSDPSIQCISRFCSSSLVFCSSNQL

SEQ ID NO: 2581181 - protein, 34 aa, Entamoeba histolytica; identical to SEQ ID NO: 2382591

SEQ ID NO: 2581182 - protein, 18 aa, Entamoeba histolytica
FQTKIKIIEWLNSSHQMT

SEQ ID NO: 2581183 - protein, 18 aa, Entamoeba histolytica
FQVFMCYWMGNVVNGIFT

SEQ ID NO: 2581184 - protein, 21 aa, Entamoeba histolytica
FQYIPPIYFAYFIFIALIEGL

SEQ ID NO: 2581185 - protein, 23 aa, Entamoeba histolytica
FQYKANCWNFNKKTGVCTSDCYP

SEQ ID NO: 2581186 - protein, 24 aa, Entamoeba histolytica
FRCDPELPDGISLSYDKVGHLPRI

SEQ ID NO: 2581187 - protein, 17 aa, Entamoeba histolytica
FRCGPNYYFSGEEGQCI

SEQ ID NO: 2581188 - protein, 26 aa, Entamoeba histolytica
FRDDIIFLIYLYQRWIYPVDKNRMDS

SEQ ID NO: 2581189 - protein, 18 aa, Entamoeba histolytica
FREQLIIEQERLKQKTMI

SEQ ID NO: 2581190 - protein, 18 aa, Entamoeba histolytica
FRFHRVVWEWKTYHFLTL

SEQ ID NO: 2581191 - protein, 21 aa, Entamoeba histolytica
FRFILWTLWYCVTLMTTKAKI

SEQ ID NO: 2581192 - protein, 20 aa, Entamoeba histolytica
FRFLVKLLLVHGRYNYRRLS

SEQ ID NO: 2581193 - protein, 17 aa, Entamoeba histolytica
FRFLYVMLCGICVFIGI

SEQ ID NO: 2581194 - protein, 24 aa, Entamoeba histolytica
FRGSKCLVCNNGLFLTEEGECIPC

SEQ ID NO: 2581195 - protein, 18 aa, Entamoeba histolytica
FRGSNKFSDWVYDFKLFT

SEQ ID NO: 2581196 - protein, 19 aa, Entamoeba histolytica
FRGTEGCLENCYCDPNDYI

SEQ ID NO: 2581197 - protein, 19 aa, Entamoeba histolytica
FRHEDWMPSALFGVGKSDL

SEQ ID NO: 2581198 - protein, 19 aa, Entamoeba histolytica
FRHLAKLILYHGRTSLLRN

SEQ ID NO: 2581199 - protein, 17 aa, Entamoeba histolytica
FRKIHYIVMTIFLILFF

SEQ ID NO: 2581200 - protein, 18 aa, Entamoeba histolytica
FRLITDKFVQIGIIALLI

SEQ ID NO: 2581201 - protein, 17 aa, Entamoeba histolytica
FRLNIYDNLPLINSRID

SEQ ID NO: 2581202 - protein, 17 aa, Entamoeba histolytica
FRMYFMMLIFGASHGLF

SEQ ID NO: 2581203 - protein, 25 aa, Entamoeba histolytica
FRNKCALFCQLLPLIVIILCGIIVL

SEQ ID NO: 2581204 - protein, 20 aa, Entamoeba histolytica
FRPMVKAIILICFFYFTMFI

SEQ ID NO: 2581205 - protein, 22 aa, Entamoeba histolytica
FRPPDELFIIPAVMTVLDPTSF

SEQ ID NO: 2581206 - protein, 17 aa, Entamoeba histolytica
FRQLGGFEFYKRLYKYW

SEQ ID NO: 2581207 - protein, 34 aa, Entamoeba histolytica
FRRRFFILRPFFRRRRFTLSPILWKRRNQKRQIK

SEQ ID NO: 2581208 - protein, 20 aa, Entamoeba histolytica
FRSMINLWTLIAILAVDFHI

SEQ ID NO: 2581209 - protein, 27 aa, Entamoeba histolytica
FSAAYLCRLCAPLALNILHMIKFDGVH

SEQ ID NO: 2581210 - protein, 28 aa, Entamoeba histolytica
FSAAYLCRLCAPLALNILHMIKFDGVHF

SEQ ID NO: 2581211 - protein, 22 aa, Entamoeba histolytica
FSAKTAIFLFVFIIMMFILLLE

SEQ ID NO: 2581212 - protein, 20 aa, Entamoeba histolytica
FSCITCSDGLFTNNCSSSTN

SEQ ID NO: 2581213 - protein, 17 aa, Entamoeba histolytica
FSCRYSCNCQNYIRYKQ

SEQ ID NO: 2581214 - protein, 20 aa, Entamoeba histolytica
FSDEHISLFKSFDKESIVKM

SEQ ID NO: 2581215 - protein, 36 aa, Entamoeba histolytica
FSDLFIYLYLCDCIYRYINYYLKVLTIFLVKNILLL

SEQ ID NO: 2581216 - protein, 18 aa, Entamoeba histolytica
FSDSSACLSHLVQNGSNF

SEQ ID NO: 2581217 - protein, 25 aa, Entamoeba histolytica
FSECKSGVESVCFAKNESDAECTTV

SEQ ID NO: 2581218 - protein, 25 aa, Entamoeba histolytica
FSELKKNICPPFICVSSNGISISSD

SEQ ID NO: 2581219 - protein, 22 aa, Entamoeba histolytica
FSFAITAWELFYAKEPYSECKS

SEQ ID NO: 2581220 - protein, 19 aa, Entamoeba histolytica
FSFCWNLVTQNGFSSISTL

SEQ ID NO: 2581221 - protein, 17 aa, Entamoeba histolytica
FSFHGMYILLTIINCCY

SEQ ID NO: 2581222 - protein, 20 aa, Entamoeba histolytica
FSFLFAHVFYSIGFNTTLSS

SEQ ID NO: 2581223 - protein, 17 aa, Entamoeba histolytica
FSGFFMVFFTLCTQVKT

SEQ ID NO: 2581224 - protein, 17 aa, Entamoeba histolytica
FSGTKPKEWTMKYTKYP

SEQ ID NO: 2581225 - protein, 17 aa, Entamoeba histolytica
FSHLKYLIMTSLISSIP

SEQ ID NO: 2581226 - protein, 20 aa, Entamoeba histolytica
FSHMLKLLLWHGRNSYIRTS

SEQ ID NO: 2581227 - protein, 17 aa, Entamoeba histolytica
FSIGGLIVSRIASDKKA

SEQ ID NO: 2581228 - protein, 19 aa, Entamoeba histolytica
FSIIKAFLSKAFYGIGNPL

SEQ ID NO: 2581229 - protein, 25 aa, Entamoeba histolytica
FSILFEIIELAPFVEFPENTKSKIV

SEQ ID NO: 2581230 - protein, 22 aa, Entamoeba histolytica
FSIVFWELFYGIHAFSDLKTTY

SEQ ID NO: 2581231 - protein, 26 aa, Entamoeba histolytica
FSKCYPNLPSNVLIASLRLCSKICSF

SEQ ID NO: 2581232 - protein, 17 aa, Entamoeba histolytica
FSKECSCNTFMNLEQNC

SEQ ID NO: 2581233 - protein, 27 aa, Entamoeba histolytica
FSKEQRIAEKLHHFFPIQKIWNENGVI

SEQ ID NO: 2581234 - protein, 31 aa, Entamoeba histolytica
FSKRRLEWHYLFLACGYTGIVLVTLYESLSV

SEQ ID NO: 2581235 - protein, 19 aa, Entamoeba histolytica
FSKTDGFLGNPLKGFGMWY

SEQ ID NO: 2581236 - protein, 18 aa, Entamoeba histolytica
FSKTEFKKEYILLEEKGG

SEQ ID NO: 2581237 - protein, 19 aa, Entamoeba histolytica
FSKWLEGITHLVEKEYPYV

SEQ ID NO: 2581238 - protein, 19 aa, Entamoeba histolytica
FSLFFFIGIFIIHLTLVPT

SEQ ID NO: 2581239 - protein, 19 aa, Entamoeba histolytica
FSLIVILHIMVWRQGGALL

SEQ ID NO: 2581240 - protein, 26 aa, Entamoeba histolytica
FSLLQLFSLDSFDTWIMVIIIILTLI

SEQ ID NO: 2581241 - protein, 17 aa, Entamoeba histolytica
FSLLVCVGHMMLKANSL

SEQ ID NO: 2581242 - protein, 26 aa, Entamoeba histolytica
FSLPEKVFGYPLDFVCVIVGLMASNL

SEQ ID NO: 2581243 - protein, 17 aa, Entamoeba histolytica
FSLQELIYYARVYEPVI

SEQ ID NO: 2581244 - protein, 26 aa, Entamoeba histolytica
FSMALCTFPYLLLKYVFSDKMSKPKE

SEQ ID NO: 2581245 - protein, 25 aa, Entamoeba histolytica
FSMKDIARVEWLKRDMGKNELTASQ

SEQ ID NO: 2581246 - protein, 20 aa, Entamoeba histolytica
FSMMIVCMFVTVSLSKNRVY

SEQ ID NO: 2581247 - protein, 21 aa, Entamoeba histolytica
FSNECNEIFIGKPENPRDLIL

SEQ ID NO: 2581248 - protein, 22 aa, Entamoeba histolytica
FSNEFILSMLVDITKYYLNLSL

SEQ ID NO: 2581249 - protein, 17 aa, Entamoeba histolytica
FSNELTESLFLIGDQKL

SEQ ID NO: 2581250 - protein, 18 aa, Entamoeba histolytica
FSNMFYYIFESIITMFLS

SEQ ID NO: 2581251 - protein, 19 aa, Entamoeba histolytica
FSNMFYYIFESIITMFLSA

SEQ ID NO: 2581252 - protein, 25 aa, Entamoeba histolytica
FSNQEIKGNISISFEFVCPNNCGEH

SEQ ID NO: 2581253 - protein, 19 aa, Entamoeba histolytica
FSNRIFKLYPNTQENIADG

SEQ ID NO: 2581254 - protein, 24 aa, Entamoeba histolytica
FSNRVVELFSNFILSAKNLKHRIQ

SEQ ID NO: 2581255 - protein, 17 aa, Entamoeba histolytica
FSPDQYLILYFSLCIFT

SEQ ID NO: 2581256 - protein, 18 aa, Entamoeba histolytica
FSRCCEKLLFGMNCSYHF

SEQ ID NO: 2581257 - protein, 17 aa, Entamoeba histolytica
FSREWIKVSGSSSADVK

SEQ ID NO: 2581258 - protein, 18 aa, Entamoeba histolytica
FSSARKRMSTIIYNEDKS

SEQ ID NO: 2581259 - protein, 19 aa, Entamoeba histolytica
FSSATEINTLLKSETETPE

SEQ ID NO: 2581260 - protein, 23 aa, Entamoeba histolytica
FSSDDWFDIRVLLLSIAANALYE

SEQ ID NO: 2581261 - protein, 22 aa, Entamoeba histolytica
FSSFCCMLYLSSIRGIPISQWC

SEQ ID NO: 2581262 - protein, 25 aa, Entamoeba histolytica
FSSHDFLKHVCIVWNKCYYYISDRQ

SEQ ID NO: 2581263 - protein, 19 aa, Entamoeba histolytica
FSSHLSFLCPYCKEHYYCS

SEQ ID NO: 2581264 - protein, 18 aa, Entamoeba histolytica
FSSIKILPFNERTVIYTK

SEQ ID NO: 2581265 - protein, 19 aa, Entamoeba histolytica
FSSKEVIEQFTLEKSLYSI

SEQ ID NO: 2581266 - protein, 25 aa, Entamoeba histolytica
FSSLQWKQHWCDLFRDEMVIHKDAN

SEQ ID NO: 2581267 - protein, 29 aa, Entamoeba histolytica
FSSQLLRSIECLESFLIHHDILNIFKAAC

SEQ ID NO: 2581268 - protein, 19 aa, Entamoeba histolytica
FSSQLPPGFYGVSNSDTSS

SEQ ID NO: 2581269 - protein, 23 aa, Entamoeba histolytica
FSSSLMKYSIPISDFSCYRVKCV

SEQ ID NO: 2581270 - protein, 17 aa, Entamoeba histolytica
FSTFCQSHLRFGGYFVQ

SEQ ID NO: 2581271 - protein, 17 aa, Entamoeba histolytica
FSTFFSVIFWNLNGVEN

SEQ ID NO: 2581272 - protein, 17 aa, Entamoeba histolytica
FSTLILIVFGFSFAFLS

SEQ ID NO: 2581273 - protein, 21 aa, Entamoeba histolytica
FSTSIKLLFTFECVLGSALFI

SEQ ID NO: 2581274 - protein, 18 aa, Entamoeba histolytica
FSTTCFIGGSISDLAVQI

SEQ ID NO: 2581275 - protein, 23 aa, Entamoeba histolytica
FSVSIACPFGCNGHGRCTENGCL

SEQ ID NO: 2581276 - protein, 34 aa, Entamoeba histolytica
FSVTPFPGIGIIQWITCLVLSSLSLVIGQLAIRY

SEQ ID NO: 2581277 - protein, 25 aa, Entamoeba histolytica
FSYAICLLEIWLGRSPYNPVKFPDA

SEQ ID NO: 2581278 - protein, 19 aa, Entamoeba histolytica
FSYDLRQLFTMDEEKAKPF

SEQ ID NO: 2581279 - protein, 25 aa, Entamoeba histolytica
FSYNIMKGLPLDLFNLTNLSILDVS

SEQ ID NO: 2581280 - protein, 18 aa, Entamoeba histolytica
FSYQRTSIILLFNVLIYE

SEQ ID NO: 2581281 - protein, 22 aa, Entamoeba histolytica
FTCVCVYLSFKFFSREINVSYL

SEQ ID NO: 2581282 - protein, 17 aa, Entamoeba histolytica
FTDYAAYFFYNNNTHMN

SEQ ID NO: 2581283 - protein, 23 aa, Entamoeba histolytica
FTEFAGSLGYLVSKELFVGNFPK

SEQ ID NO: 2581284 - protein, 19 aa, Entamoeba histolytica
FTFIRTILHWYFGTDKSLK

SEQ ID NO: 2581285 - protein, 44 aa, Entamoeba histolytica
FTGHYANLFLRFIRRLLTSRGNYIFKENISFGFNLLKSTISLCD

SEQ ID NO: 2581286 - protein, 23 aa, Entamoeba histolytica
FTHLKGISLLSVFSLTMNIMIGT

SEQ ID NO: 2581287 - protein, 19 aa, Entamoeba histolytica
FTHWKRFIYVIILIIYFQL

SEQ ID NO: 2581288 - protein, 24 aa, Entamoeba histolytica
FTICGGTCAFLFTKYVSPTANGSG

SEQ ID NO: 2581289 - protein, 17 aa, Entamoeba histolytica
FTIIYAIFATFTLLLPY

SEQ ID NO: 2581290 - protein, 26 aa, Entamoeba histolytica
FTIMNFLKYCRFNGFFNKEDKLSSFY

SEQ ID NO: 2581291 - protein, 18 aa, Entamoeba histolytica
FTINCPVTVTTLNIIANP

SEQ ID NO: 2581292 - protein, 19 aa, Entamoeba histolytica
FTISISIFFFSPLTYLQLV

SEQ ID NO: 2581293 - protein, 22 aa, Entamoeba histolytica
FTKDCIYQFSSYYIGGAGVNDG

SEQ ID NO: 2581294 - protein, 17 aa, Entamoeba histolytica
FTKEVEMLYKIRCDYIV

SEQ ID NO: 2581295 - protein, 22 aa, Entamoeba histolytica
FTKMNFCKSLTLSIIAFTILAL

SEQ ID NO: 2581296 - protein, 18 aa, Entamoeba histolytica
FTLAFSILFIIGQSTLSA

SEQ ID NO: 2581297 - protein, 17 aa, Entamoeba histolytica
FTLAISIGGLGVVHTYQ

SEQ ID NO: 2581298 - protein, 20 aa, Entamoeba histolytica
FTLICMTIFCFKRTNNVDVV

SEQ ID NO: 2581299 - protein, 26 aa, Entamoeba histolytica
FTLKFLVQCLPHFIKVTSSQVIDTSS

SEQ ID NO: 2581300 - protein, 23 aa, Entamoeba histolytica
FTLNEYYLLFIITEHFIIESSID

SEQ ID NO: 2581301 - protein, 17 aa, Entamoeba histolytica
FTLNFFSYDGFLLGCVF

SEQ ID NO: 2581302 - protein, 23 aa, Entamoeba histolytica
FTNCVLIISCIRAFFLQQNISWI

SEQ ID NO: 2581303 - protein, 20 aa, Entamoeba histolytica
FTNDLDICFANTQKNYFYID

SEQ ID NO: 2581304 - protein, 24 aa, Entamoeba histolytica
FTNHMVVLVGFGFEAQGEGVNGNF

SEQ ID NO: 2581305 - protein, 34 aa, Entamoeba histolytica
FTNNHCSYCSFGGVTNGQCSKCECEYCADCYEGK

SEQ ID NO: 2581306 - protein, 18 aa, Entamoeba histolytica
FTPGIFPLIRSGATDIRT

SEQ ID NO: 2581307 - protein, 18 aa, Entamoeba histolytica
FTPGLFPLIRSGATDIRT

SEQ ID NO: 2581308 - protein, 17 aa, Entamoeba histolytica
FTPLELTCKTTLYEPFM

SEQ ID NO: 2581309 - protein, 27 aa, Entamoeba histolytica
FTRYTPCYWRSVLGFGYILLNFTMEVL

SEQ ID NO: 2581310 - protein, 29 aa, Entamoeba histolytica
FTSCKREALCLKSNLKCLVAMINVFVAII

SEQ ID NO: 2581311 - protein, 17 aa, Entamoeba histolytica
FTSFQSWAVDRMAASEI

SEQ ID NO: 2581312 - protein, 17 aa, Entamoeba histolytica
FTSGGLLTLCFVSLCFF

SEQ ID NO: 2581313 - protein, 17 aa, Entamoeba histolytica
FTSKKGDSIDLPSIDLG

SEQ ID NO: 2581314 - protein, 17 aa, Entamoeba histolytica
FTSLFVFTSSLLNHSFY

SEQ ID NO: 2581315 - protein, 19 aa, Entamoeba histolytica
FTSLLALQMDNLFYKLDNE

SEQ ID NO: 2581316 - protein, 22 aa, Entamoeba histolytica
FTSNCAFLIPGFMEGAYSRWLF

SEQ ID NO: 2581317 - protein, 18 aa, Entamoeba histolytica
FTSQLGLMDRSWVKRRGT

SEQ ID NO: 2581318 - protein, 23 aa, Entamoeba histolytica
FTSSDPYFQWTVHVHNPKNFSDF

SEQ ID NO: 2581319 - protein, 18 aa, Entamoeba histolytica
FTSVHWMVRIYKVKKDNN

SEQ ID NO: 2581320 - protein, 18 aa, Entamoeba histolytica
FTVLFTIVLIITSIRLIY

SEQ ID NO: 2581321 - protein, 18 aa, Entamoeba histolytica
FTVRWVHYKLINKRLDEL

SEQ ID NO: 2581322 - protein, 22 aa, Entamoeba histolytica
FTVYCFVCYILFLNKTYSKPPN

SEQ ID NO: 2581323 - protein, 18 aa, Entamoeba histolytica
FTYCEFGTHISLLFLLIF

SEQ ID NO: 2581324 - protein, 26 aa, Entamoeba histolytica
FVALCVYLINGHWKYYLDPISSLIVS

SEQ ID NO: 2581325 - protein, 17 aa, Entamoeba histolytica
FVALLLMVNGIYMIISP

SEQ ID NO: 2581326 - protein, 18 aa, Entamoeba histolytica
FVASTAMTEYSMNFYLYP

SEQ ID NO: 2581327 - protein, 17 aa, Entamoeba histolytica
FVCCITCYGNLLTYGSQ

SEQ ID NO: 2581328 - protein, 25 aa, Entamoeba histolytica
FVCSKLRVLYKLNWVQPNDFEDILK

SEQ ID NO: 2581329 - protein, 22 aa, Entamoeba histolytica
FVEDFAVVFLKKVMLKGTIESQ

SEQ ID NO: 2581330 - protein, 29 aa, Entamoeba histolytica
FVEGEFRLRYNLPIIMCLISTIIEFAMMK

SEQ ID NO: 2581331 - protein, 30 aa, Entamoeba histolytica
FVEGEFRLRYNLPIIMCLISTIIEFAMMKK

SEQ ID NO: 2581332 - protein, 18 aa, Entamoeba histolytica
FVEYCFLFFGQQNHIDPY

SEQ ID NO: 2581333 - protein, 18 aa, Entamoeba histolytica
FVEYVFCVILLQLSVANF

SEQ ID NO: 2581334 - protein, 17 aa, Entamoeba histolytica
FVHLFGELNWWPIKYEI

SEQ ID NO: 2581335 - protein, 25 aa, Entamoeba histolytica
FVIAFCIISSIIIVILIRKQIHQRR

SEQ ID NO: 2581336 - protein, 21 aa, Entamoeba histolytica
FVIDFIKGIIESCKYIGNTLS

SEQ ID NO: 2581337 - protein, 17 aa, Entamoeba histolytica
FVIFDIAGLYGCIAHNF

SEQ ID NO: 2581338 - protein, 19 aa, Entamoeba histolytica
FVIGLPVLFTRVLVKYVNN

SEQ ID NO: 2581339 - protein, 19 aa, Entamoeba histolytica
FVIKNCFLNEPSIIEDEEN

SEQ ID NO: 2581340 - protein, 19 aa, Entamoeba histolytica
FVISIIFSGFIPLLIKILF

SEQ ID NO: 2581341 - protein, 30 aa, Entamoeba histolytica
FVIVSLIALLLCFFVMLLSFTSNVYENSWE

SEQ ID NO: 2581342 - protein, 18 aa, Entamoeba histolytica
FVKYKFHGSFTIETDAVN

SEQ ID NO: 2581343 - protein, 19 aa, Entamoeba histolytica
FVLCFDYLYISNSTKLPVC

SEQ ID NO: 2581344 - protein, 17 aa, Entamoeba histolytica
FVLKEFISMDSLSRYNE

SEQ ID NO: 2581345 - protein, 25 aa, Entamoeba histolytica
FVLLKVVCCSIILCLKKVLINKDFS

SEQ ID NO: 2581346 - protein, 19 aa, Entamoeba histolytica
FVLMLVFMYRIFRVYNARE

SEQ ID NO: 2581347 - protein, 19 aa, Entamoeba histolytica
FVLSLLFFYTILRVLLRLN

SEQ ID NO: 2581348 - protein, 31 aa, Entamoeba histolytica
FVLVWRKKKLITFIVYCCLLVPIIMQCYLLV

SEQ ID NO: 2581349 - protein, 17 aa, Entamoeba histolytica
FVMAVSLFLNNTPVVAM

SEQ ID NO: 2581350 - protein, 19 aa, Entamoeba histolytica
FVMPILCVLMLVFMLLSKL

SEQ ID NO: 2581351 - protein, 17 aa, Entamoeba histolytica
FVMTLAILTRIDPNLRP

SEQ ID NO: 2581352 - protein, 28 aa, Entamoeba histolytica
FVPEFLRLPVWMLFLGIDVNLAYKRYNE

SEQ ID NO: 2581353 - protein, 25 aa, Entamoeba histolytica
FVSECPHINALFSMLEDMEILDFHS

SEQ ID NO: 2581354 - protein, 19 aa, Entamoeba histolytica
FVSISAKIGLKYAAKERTI

SEQ ID NO: 2581355 - protein, 23 aa, Entamoeba histolytica
FVSLVVVCWCTFFLPDSYFVHPH

SEQ ID NO: 2581356 - protein, 19 aa, Entamoeba histolytica
FVSNHVIHALAYYSTENNE

SEQ ID NO: 2581357 - protein, 24 aa, Entamoeba histolytica
FVSYPGVCSETTYQYSLSTLTGID

SEQ ID NO: 2581358 - protein, 18 aa, Entamoeba histolytica
FVTRLVIHMLKYIRMNPR

SEQ ID NO: 2581359 - protein, 24 aa, Entamoeba histolytica
FVTTCLSCAVGLVIWIISFISMLA

SEQ ID NO: 2581360 - protein, 25 aa, Entamoeba histolytica
FVVAICIVCVLIISMFVKKASSKII

SEQ ID NO: 2581361 - protein, 25 aa, Entamoeba histolytica
FVWLIPYFIGVVLQWIASIIDDCFS

SEQ ID NO: 2581362 - protein, 19 aa, Entamoeba histolytica
FWILWSGLIVLNLFILVVT

SEQ ID NO: 2581363 - protein, 24 aa, Entamoeba histolytica
FWKGENFGVLATRGKDEGLIVRIE

SEQ ID NO: 2581364 - protein, 17 aa, Entamoeba histolytica
FWLDDVELIKDPNAPDA

SEQ ID NO: 2581365 - protein, 23 aa, Entamoeba histolytica
FWPSKYHKMELEIGRVYEFSLMP

SEQ ID NO: 2581366 - protein, 28 aa, Entamoeba histolytica
FWWFVYALVCVMAFGALKYFGSNDDFLG

SEQ ID NO: 2581367 - protein, 18 aa, Entamoeba histolytica
FYAACASMAVGFIVFSFI

SEQ ID NO: 2581368 - protein, 17 aa, Entamoeba histolytica
FYAICRQDIGWFDKKEN

SEQ ID NO: 2581369 - protein, 17 aa, Entamoeba histolytica
FYAVILTGFEAFKNKEE

SEQ ID NO: 2581370 - protein, 17 aa, Entamoeba histolytica
FYECLLMGMIICSEVCY

SEQ ID NO: 2581371 - protein, 19 aa, Entamoeba histolytica
FYFLCCFLLPPFRIKIHFH

SEQ ID NO: 2581372 - protein, 20 aa, Entamoeba histolytica
FYFYSVRFLGKIFKSRDNDT

SEQ ID NO: 2581373 - protein, 18 aa, Entamoeba histolytica
FYGACFIPTKTCMVTEYA

SEQ ID NO: 2581374 - protein, 19 aa, Entamoeba histolytica
FYGALCFDFNKSIIMEYAP

SEQ ID NO: 2581375 - protein, 32 aa, Entamoeba histolytica
FYILLIIACIFFLFIIYWSLMLSRKCTNTLSK

SEQ ID NO: 2581376 - protein, 29 aa, Entamoeba histolytica
FYISMILSILLFFGWYVFYGFVGGFKFIS

SEQ ID NO: 2581377 - protein, 19 aa, Entamoeba histolytica
FYIVCSGFIKVSYGKVTFK

SEQ ID NO: 2581378 - protein, 28 aa, Entamoeba histolytica
FYKHYILCHTLRLRFSLNSVNISTIKPY

SEQ ID NO: 2581379 - protein, 19 aa, Entamoeba histolytica
FYKNHFFGILGVSYNSNED

SEQ ID NO: 2581380 - protein, 19 aa, Entamoeba histolytica
FYKNLKWLLENNVEGLEMK

SEQ ID NO: 2581381 - protein, 31 aa, Entamoeba histolytica
FYKPLVRIFGLRLTYVMTIICTSMFYGIFPS

SEQ ID NO: 2581382 - protein, 24 aa, Entamoeba histolytica
FYKVLLCSLLSYHLVSAIKHDGGI

SEQ ID NO: 2581383 - protein, 27 aa, Entamoeba histolytica
FYKYFHFKFPSLFTVLYSFVKEFYSHS

SEQ ID NO: 2581384 - protein, 24 aa, Entamoeba histolytica
FYLDELKSLIIYREYYLEESRKFL

SEQ ID NO: 2581385 - protein, 20 aa, Entamoeba histolytica
FYLFKDRIIFIESFSEVVKK

SEQ ID NO: 2581386 - protein, 23 aa, Entamoeba histolytica
FYLGYPRCRFINGPTLCQCQGPC

SEQ ID NO: 2581387 - protein, 28 aa, Entamoeba histolytica
FYLHVFICLLAPLAPRFISYFFNLLCPP

SEQ ID NO: 2581388 - protein, 18 aa, Entamoeba histolytica
FYLNELCILCEEGKRSSN

SEQ ID NO: 2581389 - protein, 30 aa, Entamoeba histolytica
FYLPGCCEMCLNELFAPFSTINLLRKQENR

SEQ ID NO: 2581390 - protein, 18 aa, Entamoeba histolytica
FYLTCIAFGGFFEVVMML

SEQ ID NO: 2581391 - protein, 18 aa, Entamoeba histolytica
FYNDLVIDEIVHFIEQHS

SEQ ID NO: 2581392 - protein, 25 aa, Entamoeba histolytica
FYNEFCLRCEDGLYLNNNICNKCDS

SEQ ID NO: 2581393 - protein, 23 aa, Entamoeba histolytica
FYNKKLYSCYSIYYIFATILSMQ

SEQ ID NO: 2581394 - protein, 20 aa, Entamoeba histolytica
FYNTFLTKWGRSIRPKLGLP

SEQ ID NO: 2581395 - protein, 25 aa, Entamoeba histolytica
FYPSSLKRLYCQREQLPHCLNVEEM

SEQ ID NO: 2581396 - protein, 21 aa, Entamoeba histolytica
FYPTFLFQVFMCYWMGNVVNG

SEQ ID NO: 2581397 - protein, 20 aa, Entamoeba histolytica
FYQIEGYDIFPITEHEEESF

SEQ ID NO: 2581398 - protein, 21 aa, Entamoeba histolytica
FYQKLIEIYSVFASTITSSAV

SEQ ID NO: 2581399 - protein, 21 aa, Entamoeba histolytica
FYQSFGLPLIITRGNNVFGPH

SEQ ID NO: 2581400 - protein, 22 aa, Entamoeba histolytica
FYSTYMRQCYPQVGQSTAIIVT

SEQ ID NO: 2581401 - protein, 24 aa, Entamoeba histolytica
FYYFKCSVCHFVIYVFLFFILLFL

SEQ ID NO: 2581402 - protein, 19 aa, Entamoeba histolytica
FYYLGCTLTLRKIKKEGKN

SEQ ID NO: 2581403 - protein, 18 aa, Entamoeba histolytica
FYYSLPFKVAISNTKQMY

SEQ ID NO: 2581404 - protein, 26 aa, Entamoeba histolytica
FYYTNTKRMFNLYNIHLKSETVHKES

SEQ ID NO: 2581405 - protein, 19 aa, Entamoeba histolytica
GAALACISVPFYGFIKSME

SEQ ID NO: 2581406 - protein, 18 aa, Entamoeba histolytica
GAFGIVFKGELRGNKVAI

SEQ ID NO: 2581407 - protein, 24 aa, Entamoeba histolytica
GAICLALIYLRNGWVLCVLAIPIG

SEQ ID NO: 2581408 - protein, 18 aa, Entamoeba histolytica
GAIDTGGDYLCYQYIVKY

SEQ ID NO: 2581409 - protein, 20 aa, Entamoeba histolytica
GAIFARALSEIGIDTTYILP

SEQ ID NO: 2581410 - protein, 29 aa, Entamoeba histolytica
GAIFPFFTLKIVDLIMCLLSINSDTLTDD

SEQ ID NO: 2581411 - protein, 19 aa, Entamoeba histolytica
GALLEKYVNCVKSQQLGGI

SEQ ID NO: 2581412 - protein, 32 aa, Entamoeba histolytica
GALSHCYKIIFAFWKELNKAISFGYSSQSTTI

SEQ ID NO: 2581413 - protein, 21 aa, Entamoeba histolytica
GANSKVMWYGSLSFQQLVKFK

SEQ ID NO: 2581414 - protein, 26 aa, Entamoeba histolytica
GARLLIKIFSICIDKMYSKKPVWVLK

SEQ ID NO: 2581415 - protein, 26 aa, Entamoeba histolytica
GASLFLHPRVNIVIRVIMPFLILLNI

SEQ ID NO: 2581416 - protein, 25 aa, Entamoeba histolytica
GATRENMSYFSLWRALQMPYFYLSS

SEQ ID NO: 2581417 - protein, 18 aa, Entamoeba histolytica
GATSSFLILCIIITFLFF

SEQ ID NO: 2581418 - protein, 24 aa, Entamoeba histolytica
GCDCVWSNSTFGQWDCLLYSPYLC

SEQ ID NO: 2581419 - protein, 24 aa, Entamoeba histolytica
GCDKRCKCTRRYKPNGNVSCEYKY

SEQ ID NO: 2581420 - protein, 31 aa, Entamoeba histolytica; identical to SEQ ID NO: 2382866

SEQ ID NO: 2581421 - protein, 18 aa, Entamoeba histolytica
GCESCKGNELLIMNLFQK

SEQ ID NO: 2581422 - protein, 17 aa, Entamoeba histolytica
GCESCSVDSYSCLKCEK

SEQ ID NO: 2581423 - protein, 21 aa, Entamoeba histolytica
GCGKASRLIYYFTKPSYIFIT

SEQ ID NO: 2581424 - protein, 22 aa, Entamoeba histolytica
GCGSCGTVIKGCVKCSTTSTEC

SEQ ID NO: 2581425 - protein, 27 aa, Entamoeba histolytica
GCGTFGIVYRAEWRGVDVAIKLMKTDL

SEQ ID NO: 2581426 - protein, 21 aa, Entamoeba histolytica
GCILSYCFILLLNRYTKLCVY

SEQ ID NO: 2581427 - protein, 17 aa, Entamoeba histolytica
GCKECKNDLSAEGQKTR

SEQ ID NO: 2581428 - protein, 19 aa, Entamoeba histolytica
GCNNVTCTCDVGFKAQDGI

SEQ ID NO: 2581429 - protein, 23 aa, Entamoeba histolytica
GCQTGYYPFGMRCEKIVNQPKTC

SEQ ID NO: 2581430 - protein, 18 aa, Entamoeba histolytica
GCSPVIRHKLVFSEPRFK

SEQ ID NO: 2581431 - protein, 29 aa, Entamoeba histolytica
GCSTIIKGLKEWGSAIIVGYGGDLYGEDE

SEQ ID NO: 2581432 - protein, 19 aa, Entamoeba histolytica
GCSVCSLYSGMEMSQRLRN

SEQ ID NO: 2581433 - protein, 27 aa, Entamoeba histolytica
GCSVLPHLSALVAIVFPRLNDIEANIT

SEQ ID NO: 2581434 - protein, 36 aa, Entamoeba histolytica
GCTDPLKTRYNCYSHIWDTHLRKVLCEKEPGRYEDV

SEQ ID NO: 2581435 - protein, 22 aa, Entamoeba histolytica
GCTIICGIYFVWVIFNQKRILS

SEQ ID NO: 2581436 - protein, 17 aa, Entamoeba histolytica
GCTQGSYCPGNDIKYSC

SEQ ID NO: 2581437 - protein, 19 aa, Entamoeba histolytica
GCVGLGAVVIFSSMRISSI

SEQ ID NO: 2581438 - protein, 18 aa, Entamoeba histolytica
GCYGEPTAKCIGSNTEGR

SEQ ID NO: 2581439 - protein, 23 aa, Entamoeba histolytica
GDAAMFIAIDFGLCYYIDETEST

SEQ ID NO: 2581440 - protein, 23 aa, Entamoeba histolytica
GDAEFWLGVFSGMWTFGQSLGYL

SEQ ID NO: 2581441 - protein, 18 aa, Entamoeba histolytica
GDAVGFISIEFDKCYYYG

SEQ ID NO: 2581442 - protein, 19 aa, Entamoeba histolytica
GDCGESIYINSETKDTGYW

SEQ ID NO: 2581443 - protein, 22 aa, Entamoeba histolytica
GDCGNCYAVSNAHELQLKYANL

SEQ ID NO: 2581444 - protein, 30 aa, Entamoeba histolytica
GDCQRSLPLCCLKKGLISPIDITNKYNYEQ

SEQ ID NO: 2581445 - protein, 18 aa, Entamoeba histolytica
GDDPFELIRSFGIAFSSF

SEQ ID NO: 2581446 - protein, 20 aa, Entamoeba histolytica
GDESPLFLKNVDQLILLVGK

SEQ ID NO: 2581447 - protein, 25 aa, Entamoeba histolytica
GDFTFIRKLIRSIKRNVIFYGTLIM

SEQ ID NO: 2581448 - protein, 27 aa, Entamoeba histolytica
GDGRWWAKKRMLIYLKRRWEKSNETVQ

SEQ ID NO: 2581449 - protein, 20 aa, Entamoeba histolytica
GDITGGFAFVYGIIAAVCVI

SEQ ID NO: 2581450 - protein, 17 aa, Entamoeba histolytica
GDKNFVKVWRYIRETNK

SEQ ID NO: 2581451 - protein, 17 aa, Entamoeba histolytica
GDLDVFITFVLECINVL

SEQ ID NO: 2581452 - protein, 29 aa, Entamoeba histolytica
GDLLSRFAVYIPIPWNKWPILGLSVVRVV

SEQ ID NO: 2581453 - protein, 17 aa, Entamoeba histolytica
GDLPLYLVCLNGIRNLL

SEQ ID NO: 2581454 - protein, 24 aa, Entamoeba histolytica
GDMKIKPTYEWFLGGLVFILVVCT

SEQ ID NO: 2581455 - protein, 17 aa, Entamoeba histolytica
GDMYEVAERGANLSGGQ

SEQ ID NO: 2581456 - protein, 26 aa, Entamoeba histolytica
GDNGEWSSKCVLAYCDEGYMFDYINN

SEQ ID NO: 2581457 - protein, 28 aa, Entamoeba histolytica
GDNGEWSSKCVLAYCDSGYKFDYINNKC

SEQ ID NO: 2581458 - protein, 25 aa, Entamoeba histolytica
GDNGEWSTKCIVSYCDDGYKFDYNN

SEQ ID NO: 2581459 - protein, 27 aa, Entamoeba histolytica
GDNGEWSTKCVLAYCDSGYKFDYIKNK

SEQ ID NO: 2581460 - protein, 27 aa, Entamoeba histolytica
GDNGEWSTKCVLSYCDSGYKFDYINNK

SEQ ID NO: 2581461 - protein, 17 aa, Entamoeba histolytica
GDSRLARLIQKIDKEHI

SEQ ID NO: 2581462 - protein, 17 aa, Entamoeba histolytica
GDSVYVFVGAHSNTNTG

SEQ ID NO: 2581463 - protein, 18 aa, Entamoeba histolytica
GDSVYVFVGAHSNTNTGL

SEQ ID NO: 2581464 - protein, 17 aa, Entamoeba histolytica
GDVIGRFVEIFAKPHIK

SEQ ID NO: 2581465 - protein, 24 aa, Entamoeba histolytica
GDVLIPMEIVNEIFRSERIYEKNP

SEQ ID NO: 2581466 - protein, 18 aa, Entamoeba histolytica
GDVLMVFMSVLSASQTLS

SEQ ID NO: 2581467 - protein, 27 aa, Entamoeba histolytica
GDVPNGFSLKCTNRALVYIKSADGISN

SEQ ID NO: 2581468 - protein, 19 aa, Entamoeba histolytica
GDVPNKFYLACYGRALIYN

SEQ ID NO: 2581469 - protein, 26 aa, Entamoeba histolytica
GDVSAWVSGLLYFFGRIPQIIHIYRT

SEQ ID NO: 2581470 - protein, 18 aa, Entamoeba histolytica
GDYCEFHLNVLIVILPII

SEQ ID NO: 2581471 - protein, 18 aa, Entamoeba histolytica
GDYIALMRSYFTGYDQRN

SEQ ID NO: 2581472 - protein, 22 aa, Entamoeba histolytica
GEALSWATLIQVFGFIVLAIGF

SEQ ID NO: 2581473 - protein, 24 aa, Entamoeba histolytica
GECGDITGGFAFVYGIIAAVCVII

SEQ ID NO: 2581474 - protein, 26 aa, Entamoeba histolytica
GECIQCSFSGCTNCSEGYYLNGVKCS

SEQ ID NO: 2581475 - protein, 19 aa, Entamoeba histolytica
GECITCPSGTLINEDSTKC

SEQ ID NO: 2581476 - protein, 19 aa, Entamoeba histolytica
GECVLCNYGFVLNNGSCIE

SEQ ID NO: 2581477 - protein, 17 aa, Entamoeba histolytica
GEESAIWCEERFKVIAV

SEQ ID NO: 2581478 - protein, 19 aa, Entamoeba histolytica
GEFHVAFGKISFRQGRLNQ

SEQ ID NO: 2581479 - protein, 21 aa, Entamoeba histolytica
GEGAFGLVFRGTYRGQDVAIK

SEQ ID NO: 2581480 - protein, 22 aa, Entamoeba histolytica
GEGGFGIVFKGRFRGNEVAIKK

SEQ ID NO: 2581481 - protein, 21 aa, Entamoeba histolytica
GEGSFGIVFLGKYRGVDVAIK

SEQ ID NO: 2581482 - protein, 26 aa, Entamoeba histolytica
GEGTFGVVFKGEWRKIDVAVKCVKTD

SEQ ID NO: 2581483 - protein, 25 aa, Entamoeba histolytica
GEGTSGVVFKGRFREHIVAIKDMKD

SEQ ID NO: 2581484 - protein, 19 aa, Entamoeba histolytica
GEHKICLDNSYASFSTTKT

SEQ ID NO: 2581485 - protein, 23 aa, Entamoeba histolytica
GEHPSRVLCVFNILSQYDPKELL

SEQ ID NO: 2581486 - protein, 17 aa, Entamoeba histolytica
GEIACSFILKGIQQKIY

SEQ ID NO: 2581487 - protein, 19 aa, Entamoeba histolytica
GEIKYGDWEIVKVMSNEKQ

SEQ ID NO: 2581488 - protein, 28 aa, Entamoeba histolytica
GEKKMCCLLKKRKCKRSGTIGSDVEIID

SEQ ID NO: 2581489 - protein, 21 aa, Entamoeba histolytica
GEKSIPIYLYHTFNYIYTPFA

SEQ ID NO: 2581490 - protein, 22 aa, Entamoeba histolytica
GELELLIAIVRSCWKLNVFEGY

SEQ ID NO: 2581491 - protein, 21 aa, Entamoeba histolytica
GELISKIILLFVSFLEYYANK

SEQ ID NO: 2581492 - protein, 24 aa, Entamoeba histolytica
GELTCSLCPLFAGLLATAMDDRRY

SEQ ID NO: 2581493 - protein, 21 aa, Entamoeba histolytica
GEMYSEFNVTLTFEKNNTIKL

SEQ ID NO: 2581494 - protein, 21 aa, Entamoeba histolytica
GENSKIIWNKGVSFERLITFE

SEQ ID NO: 2581495 - protein, 17 aa, Entamoeba histolytica
GEPLGWQTALQVLGFLL

SEQ ID NO: 2581496 - protein, 18 aa, Entamoeba histolytica
GEPPEVNFASLMKSKGVE

SEQ ID NO: 2581497 - protein, 17 aa, Entamoeba histolytica
GEQARLSVYGFEETTLL

SEQ ID NO: 2581498 - protein, 25 aa, Entamoeba histolytica
GEQIFNFFVNMSHYMFRASVDEISF

SEQ ID NO: 2581499 - protein, 18 aa, Entamoeba histolytica
GEQLLDWAKKSLSIDSCD

SEQ ID NO: 2581500 - protein, 18 aa, Entamoeba histolytica
GERPQFKPNILIDNSLKE

SEQ ID NO: 2581501 - protein, 20 aa, Entamoeba histolytica
GESDRVTAIIVGWNDDTMTS

SEQ ID NO: 2581502 - protein, 20 aa, Entamoeba histolytica
GESLLLFNLNDYKFYYIQYS

SEQ ID NO: 2581503 - protein, 21 aa, Entamoeba histolytica
GESWNDWSYLQLAGFFFLLEG

SEQ ID NO: 2581504 - protein, 24 aa, Entamoeba histolytica
GETKEFLVCLASIAVTPSCSIQQM

SEQ ID NO: 2581505 - protein, 21 aa, Entamoeba histolytica
GETLACLIYALFFTFLFLLPL

SEQ ID NO: 2581506 - protein, 17 aa, Entamoeba histolytica
GETMKFEMIPIGDRGRV

SEQ ID NO: 2581507 - protein, 19 aa, Entamoeba histolytica
GETNIYVNCCVSAFPDDCP

SEQ ID NO: 2581508 - protein, 19 aa, Entamoeba histolytica
GETSTSFCVCIVRKELLQF

SEQ ID NO: 2581509 - protein, 21 aa, Entamoeba histolytica
GEVNPGFLYIITFPFLFGVMF

SEQ ID NO: 2581510 - protein, 20 aa, Entamoeba histolytica
GEWKWKPKRNNNWDVTKDDQ

SEQ ID NO: 2581511 - protein, 30 aa, Entamoeba histolytica
GEYFPYLIRKSWPYLPLIFKESYCTRKLEE

SEQ ID NO: 2581512 - protein, 24 aa, Entamoeba histolytica
GEYVCKRCSEGTYSDVIGATSCKV

SEQ ID NO: 2581513 - protein, 26 aa, Entamoeba histolytica
GFALGIAFYYDWKVSLAVMAVSPVLI

SEQ ID NO: 2581514 - protein, 25 aa, Entamoeba histolytica
GFASELKIDLALMLNLTDPLKKYGE

SEQ ID NO: 2581515 - protein, 19 aa, Entamoeba histolytica
GFELKKCCAENEIHLKKEG

SEQ ID NO: 2581516 - protein, 20 aa, Entamoeba histolytica
GFESYVCCFILLYLKQLLIN

SEQ ID NO: 2581517 - protein, 18 aa, Entamoeba histolytica
GFFFPLVWIINYVLFSNS

SEQ ID NO: 2581518 - protein, 20 aa, Entamoeba histolytica
GFGILEFTLAISIGGLGVVH

SEQ ID NO: 2581519 - protein, 25 aa, Entamoeba histolytica
GFHNYRYFFLFLFYLWISMLIVDCH

SEQ ID NO: 2581520 - protein, 20 aa, Entamoeba histolytica
GFIHKAIELLGKWAKEDFAS

SEQ ID NO: 2581521 - protein, 25 aa, Entamoeba histolytica
GFILFIPFLIAYIIGKKSESKGIKL

SEQ ID NO: 2581522 - protein, 24 aa, Entamoeba histolytica
GFIPFPIIRKFGSAFSPYVVIPWF

SEQ ID NO: 2581523 - protein, 23 aa, Entamoeba histolytica
GFLGNPLKGFGMWYGSGNTAKLP

SEQ ID NO: 2581524 - protein, 29 aa, Entamoeba histolytica
GFLKSPEGWCSCIPQTILLLQRYGYDIYI

SEQ ID NO: 2581525 - protein, 30 aa, Entamoeba histolytica
GFLVLKMPFPLSYRFKLITQQGLGGMDLDV

SEQ ID NO: 2581526 - protein, 26 aa, Entamoeba histolytica
GFNAACAPLLWVCTISMIILIVPNFR

SEQ ID NO: 2581527 - protein, 18 aa, Entamoeba histolytica
GFNLSLNDSIPWKAPEVL

SEQ ID NO: 2581528 - protein, 37 aa, Entamoeba histolytica
GFQNLLIIFLICWCLFRISDLMIRFFLILFTHQPDDF

SEQ ID NO: 2581529 - protein, 17 aa, Entamoeba histolytica
GFSGVFMEKILKNKVDN

SEQ ID NO: 2581530 - protein, 18 aa, Entamoeba histolytica
GFSIFPYFICIFATHNNL

SEQ ID NO: 2581531 - protein, 20 aa, Entamoeba histolytica
GFSLFFIFVIWRVGVLYEQI

SEQ ID NO: 2581532 - protein, 26 aa, Entamoeba histolytica
GFVNFLCMWGALVLTTFTSQGMYYAI

SEQ ID NO: 2581533 - protein, 17 aa, Entamoeba histolytica
GFVPKIGGGFIKICQID

SEQ ID NO: 2581534 - protein, 20 aa, Entamoeba histolytica
GFYSYEFMSANELFPSINAI

SEQ ID NO: 2581535 - protein, 20 aa, Entamoeba histolytica
GGAQYPVFYLSIIGTDNDVV

SEQ ID NO: 2581536 - protein, 23 aa, Entamoeba histolytica
GGECNRFSFIYLRNVFNSSYTFI

SEQ ID NO: 2581537 - protein, 19 aa, Entamoeba histolytica
GGEMVLWVIIKVLLQSFPN

SEQ ID NO: 2581538 - protein, 17 aa, Entamoeba histolytica
GGFGIVYKGIFRENEVA

SEQ ID NO: 2581539 - protein, 25 aa, Entamoeba histolytica
GGFLFLRFINPAIVSPHRFGSNMLL

SEQ ID NO: 2581540 - protein, 18 aa, Entamoeba histolytica
GGFYKNFFSMILFFFPTV

SEQ ID NO: 2581541 - protein, 26 aa, Entamoeba histolytica
GGGTFGIVYRAEWRKVDVAVKVMKSD

SEQ ID NO: 2581542 - protein, 26 aa, Entamoeba histolytica
GGGTFGIVYRAEWRMVDVAVKVMKTD

SEQ ID NO: 2581543 - protein, 19 aa, Entamoeba histolytica
GGIIPILFFLASIVLIISP

SEQ ID NO: 2581544 - protein, 18 aa, Entamoeba histolytica
GGILLKYLPSYQMDIPLE

SEQ ID NO: 2581545 - protein, 17 aa, Entamoeba histolytica
GGILVALVMTYADVIVK

SEQ ID NO: 2581546 - protein, 22 aa, Entamoeba histolytica
GGINLTHTWNFLSFGDSFPGMI

SEQ ID NO: 2581547 - protein, 25 aa, Entamoeba histolytica
GGIYLNEECVLCFYNTEGITTPIEI

SEQ ID NO: 2581548 - protein, 28 aa, Entamoeba histolytica
GGLIALCILLRFCMCFTHVVQYFNEFST

SEQ ID NO: 2581549 - protein, 34 aa, Entamoeba histolytica
GGLLTLCFVSLCFFPLDVIITLGMGAAISIFITI

SEQ ID NO: 2581550 - protein, 18 aa, Entamoeba histolytica
GGMIPALMNILKFKEFHL

SEQ ID NO: 2581551 - protein, 24 aa, Entamoeba histolytica
GGMRRRLSIAIAMTGNPKVIFLDE

SEQ ID NO: 2581552 - protein, 26 aa, Entamoeba histolytica
GGNIATFAIGFGFPGMFNVNVFGGNV

SEQ ID NO: 2581553 - protein, 19 aa, Entamoeba histolytica
GGSQAIRLSYKYSSDLLQF

SEQ ID NO: 2581554 - protein, 22 aa, Entamoeba histolytica
GGSVRLEPRFQFIVTSNYSLAE

SEQ ID NO: 2581555 - protein, 25 aa, Entamoeba histolytica
GGTFGIVYRAEWRGVDVAVKVMKTD

SEQ ID NO: 2581556 - protein, 25 aa, Entamoeba histolytica
GGVKPRKGLWYKVVNNYKYAFPLFI

SEQ ID NO: 2581557 - protein, 38 aa, Entamoeba histolytica
GGVYVFLLLLFICSSSNYCVSFFFFSFHILLYLLFICL

SEQ ID NO: 2581558 - protein, 25 aa, Entamoeba histolytica
GGWGVGKAKWWAIIIKYMILLFPIV

SEQ ID NO: 2581559 - protein, 19 aa, Entamoeba histolytica
GGYACEFEVFITIKCTAKI

SEQ ID NO: 2581560 - protein, 19 aa, Entamoeba histolytica
GGYACEFEVFITIKCTTKI

SEQ ID NO: 2581561 - protein, 19 aa, Entamoeba histolytica
GGYGCDHCVCVDGTKKYAK

SEQ ID NO: 2581562 - protein, 18 aa, Entamoeba histolytica
GHCVFKNIYFFITAPLGI

SEQ ID NO: 2581563 - protein, 18 aa, Entamoeba histolytica
GHFCGIIIGVLYTRGFLD

SEQ ID NO: 2581564 - protein, 20 aa, Entamoeba histolytica
GHGKSSLGNFILKKNVFSVS

SEQ ID NO: 2581565 - protein, 19 aa, Entamoeba histolytica
GHICCCYECSKKLSKCPIC

SEQ ID NO: 2581566 - protein, 19 aa, Entamoeba histolytica
GHIFYKPKHAILLMIVNSI

SEQ ID NO: 2581567 - protein, 26 aa, Entamoeba histolytica
GHILFFLLLVYYKFEPNQLVISEQAI

SEQ ID NO: 2581568 - protein, 18 aa, Entamoeba histolytica
GHSSMMFNGMMFISLLLC

SEQ ID NO: 2581569 - protein, 24 aa, Entamoeba histolytica
GHVRCQQCSLDIITGILISPSFGE

SEQ ID NO: 2581570 - protein, 24 aa, Entamoeba histolytica
GIACIPLCIGYAIYSLYNNEFKSW

SEQ ID NO: 2581571 - protein, 25 aa, Entamoeba histolytica
GIACIPLCIGYAIYSLYNNEFKSWY

SEQ ID NO: 2581572 - protein, 26 aa, Entamoeba histolytica
GIALMRCCLPLEPPRDVIINKPYFFV

SEQ ID NO: 2581573 - protein, 24 aa, Entamoeba histolytica
GIARRLATDKIIMVLIIVCVLVII

SEQ ID NO: 2581574 - protein, 18 aa, Entamoeba histolytica
GIAVLPLYSIFHKQQDAF

SEQ ID NO: 2581575 - protein, 20 aa, Entamoeba histolytica
GICEPFTYYFAYVFGILSSV

SEQ ID NO: 2581576 - protein, 19 aa, Entamoeba histolytica
GICEYPWDIIDFIQKDNYL

SEQ ID NO: 2581577 - protein, 18 aa, Entamoeba histolytica
GICTIGYSTPTGMKCKKC

SEQ ID NO: 2581578 - protein, 26 aa, Entamoeba histolytica
GIGLIAFRIRFNFDPIVFISIGSAVV

SEQ ID NO: 2581579 - protein, 20 aa, Entamoeba histolytica
GIICCLGVFTSIIVSLTLLR

SEQ ID NO: 2581580 - protein, 17 aa, Entamoeba histolytica
GIIEVYNPLTLDKINEI

SEQ ID NO: 2581581 - protein, 18 aa, Entamoeba histolytica
GIIFLWKVIIKPLLFPTN

SEQ ID NO: 2581582 - protein, 19 aa, Entamoeba histolytica
GIIGGVFALFSLLDYFIFH

SEQ ID NO: 2581583 - protein, 28 aa, Entamoeba histolytica
GIILRRKANFIFGNAFYYKSYSSQYTLF

SEQ ID NO: 2581584 - protein, 23 aa, Entamoeba histolytica
GIKIRMLYFRALLRQDAGWYDFH

SEQ ID NO: 2581585 - protein, 23 aa, Entamoeba histolytica
GIKKRIAPIIFHNTFWLIKDYYT

SEQ ID NO: 2581586 - protein, 28 aa, Entamoeba histolytica
GIKLSYKFKMRILKDVAKGMSFLHENSI

SEQ ID NO: 2581587 - protein, 17 aa, Entamoeba histolytica
GIKNLCTPPTIATLLGI

SEQ ID NO: 2581588 - protein, 25 aa, Entamoeba histolytica
GIKPRRLYFKSLLRQDATWYDFQES

SEQ ID NO: 2581589 - protein, 23 aa, Entamoeba histolytica
GILCFKWGYPEYKSIPTPFLVKW

SEQ ID NO: 2581590 - protein, 18 aa, Entamoeba histolytica
GILFHIMRVLKILVSGLC

SEQ ID NO: 2581591 - protein, 17 aa, Entamoeba histolytica
GILIRRSFHNTGVDIVR

SEQ ID NO: 2581592 - protein, 17 aa, Entamoeba histolytica
GILRGLKCEKGVVTTHV

SEQ ID NO: 2581593 - protein, 36 aa, Entamoeba histolytica
GILSFDGRFPFIWTYSTLVASCYWISKKLCSNGKWD

SEQ ID NO: 2581594 - protein, 18 aa, Entamoeba histolytica
GILTVSGFLFIGVFNSFL

SEQ ID NO: 2581595 - protein, 18 aa, Entamoeba histolytica
GIMLPIVFAGKYIPFLNS

SEQ ID NO: 2581596 - protein, 24 aa, Entamoeba histolytica
GIPDFRSSNGLWKRYDPSVYGSYS

SEQ ID NO: 2581597 - protein, 24 aa, Entamoeba histolytica
GIPKKKLFPLLLMLLIEGISQNIL

SEQ ID NO: 2581598 - protein, 22 aa, Entamoeba histolytica
GISESIQLLALQLFKNNPQMKK

SEQ ID NO: 2581599 - protein, 21 aa, Entamoeba histolytica
GISIYEILSWEEAYPTSDPRF

SEQ ID NO: 2581600 - protein, 21 aa, Entamoeba histolytica
GISKCKYCLLGTYQDLKGQKT

SEQ ID NO: 2581601 - protein, 17 aa, Entamoeba histolytica
GISLKKNFFIVALKNVM

SEQ ID NO: 2581602 - protein, 22 aa, Entamoeba histolytica
GISTRFSDCFIFDRTDDLITPH

SEQ ID NO: 2581603 - protein, 18 aa, Entamoeba histolytica
GISTWAISILCSNKKYEK

SEQ ID NO: 2581604 - protein, 19 aa, Entamoeba histolytica
GITKYKLVGIVVHTGNAHG

SEQ ID NO: 2581605 - protein, 24 aa, Entamoeba histolytica
GITPLRYFVCFVLSNLPIIYLLYY

SEQ ID NO: 2581606 - protein, 25 aa, Entamoeba histolytica
GIVLSFYIMINWFFTLMEYLSIMSG

SEQ ID NO: 2581607 - protein, 24 aa, Entamoeba histolytica
GIVLSFYIMLNWFMTLLEYLSIMS

SEQ ID NO: 2581608 - protein, 18 aa, Entamoeba histolytica
GIVMKYAILPFAFVSVIY

SEQ ID NO: 2581609 - protein, 18 aa, Entamoeba histolytica
GIVSFCFVIFDIAGLYGC

SEQ ID NO: 2581610 - protein, 24 aa, Entamoeba histolytica
GIWQCIRLNAMITQACGENDDFLQ

SEQ ID NO: 2581611 - protein, 22 aa, Entamoeba histolytica
GIYFCYCSLIISEILQIKSNET

SEQ ID NO: 2581612 - protein, 19 aa, Entamoeba histolytica
GIYHGKFVFPYDYPKNPPE

SEQ ID NO: 2581613 - protein, 23 aa, Entamoeba histolytica
GIYKVGGIALLLALILKSDTKIK

SEQ ID NO: 2581614 - protein, 18 aa, Entamoeba histolytica
GKCIPLEAVVNCIETSNG

SEQ ID NO: 2581615 - protein, 22 aa, Entamoeba histolytica
GKCKECLEGFNLIKNSDGSWVC

SEQ ID NO: 2581616 - protein, 17 aa, Entamoeba histolytica
GKCKMVGCEKEFNKEII

SEQ ID NO: 2581617 - protein, 17 aa, Entamoeba histolytica
GKCKRCEDKQCKICLKG

SEQ ID NO: 2581618 - protein, 22 aa, Entamoeba histolytica
GKCYKCNVGKNYYCNYNEENGY

SEQ ID NO: 2581619 - protein, 19 aa, Entamoeba histolytica
GKDCLCKKGYTANGNGTCV

SEQ ID NO: 2581620 - protein, 26 aa, Entamoeba histolytica
GKDLYIPMFICELLCLLFLVIFQGTF

SEQ ID NO: 2581621 - protein, 22 aa, Entamoeba histolytica
GKDMIPYWVLFILSFSPHDLNR

SEQ ID NO: 2581622 - protein, 20 aa, Entamoeba histolytica
GKDNAKCVLYGDGKTIKVYS

SEQ ID NO: 2581623 - protein, 21 aa, Entamoeba histolytica
GKESRDLFCIGNKGINKIKIQ

SEQ ID NO: 2581624 - protein, 24 aa, Entamoeba histolytica
GKEYYCSINKFVAYGISSLDELVD

SEQ ID NO: 2581625 - protein, 21 aa, Entamoeba histolytica
GKFKTLRQFCQIWNILSNSKQ

SEQ ID NO: 2581626 - protein, 17 aa, Entamoeba histolytica
GKFLRKEDCDNGTNCNS

SEQ ID NO: 2581627 - protein, 24 aa, Entamoeba histolytica
GKGIEGWLKPLLEIPAFQIKLKMW

SEQ ID NO: 2581628 - protein, 26 aa, Entamoeba histolytica
GKISFKELIIKSALIKGFTMTSGIIN

SEQ ID NO: 2581629 - protein, 25 aa, Entamoeba histolytica
GKKFFPLGCYMNWYDDFDIEHFKDS

SEQ ID NO: 2581630 - protein, 24 aa, Entamoeba histolytica
GKKIKYRFNFTLKIEASASTDIDM

SEQ ID NO: 2581631 - protein, 22 aa, Entamoeba histolytica
GKKIRYGQLIGIFISVIALVLV

SEQ ID NO: 2581632 - protein, 17 aa, Entamoeba histolytica
GKKTIVWNRKDEQEDDR

SEQ ID NO: 2581633 - protein, 20 aa, Entamoeba histolytica
GKLDIFYGIWYFAIGFIGAA

SEQ ID NO: 2581634 - protein, 24 aa, Entamoeba histolytica
GKLQMALTFYRFFAFSVMLITCIV

SEQ ID NO: 2581635 - protein, 27 aa, Entamoeba histolytica
GKLSVAPRLGFCQLKMEKEEDIATLFS

SEQ ID NO: 2581636 - protein, 17 aa, Entamoeba histolytica
GKMLSFSAGVMIYVSFV

SEQ ID NO: 2581637 - protein, 20 aa, Entamoeba histolytica
GKMNDGWHIDTEYLSPTLVF

SEQ ID NO: 2581638 - protein, 17 aa, Entamoeba histolytica
GKMPFTIQRISCSEKLP

SEQ ID NO: 2581639 - protein, 21 aa, Entamoeba histolytica
GKNKVKIPCYIESASCGQICG

SEQ ID NO: 2581640 - protein, 23 aa, Entamoeba histolytica
GKPENPRDLILFSYQELQRKDKT

SEQ ID NO: 2581641 - protein, 27 aa, Entamoeba histolytica
GKPLQLCLCPLCINGIPNYNDTKTDLI

SEQ ID NO: 2581642 - protein, 19 aa, Entamoeba histolytica
GKQYYCWFGNEKSKFDVIN

SEQ ID NO: 2581643 - protein, 18 aa, Entamoeba histolytica
GKRLKIDDFMPLNLKELI

SEQ ID NO: 2581644 - protein, 30 aa, Entamoeba histolytica
GKRLLQPEGMPDWYYILICKCWQNNPQERL

SEQ ID NO: 2581645 - protein, 18 aa, Entamoeba histolytica
GKRYIPLESLHNYVVFNP

SEQ ID NO: 2581646 - protein, 25 aa, Entamoeba histolytica
GKSCLPCPKGTFQKYPGKRECKRCE

SEQ ID NO: 2581647 - protein, 20 aa, Entamoeba histolytica
GKSFIPSLIGWKIQHYVVWF

SEQ ID NO: 2581648 - protein, 23 aa, Entamoeba histolytica
GKSFWKLVLSCVLIITNVVPPEL

SEQ ID NO: 2581649 - protein, 19 aa, Entamoeba histolytica
GKSKIPFEVIYSTKDGCHQ

SEQ ID NO: 2581650 - protein, 25 aa, Entamoeba histolytica
GKSMIKCGVCSPILVPLDKDKQVVY

SEQ ID NO: 2581651 - protein, 17 aa, Entamoeba histolytica
GKSRWRKSMLDAINHSR

SEQ ID NO: 2581652 - protein, 18 aa, Entamoeba histolytica
GKSSDPFIGYGYGVSLSF

SEQ ID NO: 2581653 - protein, 18 aa, Entamoeba histolytica
GKSSFLLSILGELEQSKG

SEQ ID NO: 2581654 - protein, 17 aa, Entamoeba histolytica
GKSSVGNFILKKNVFEV

SEQ ID NO: 2581655 - protein, 18 aa, Entamoeba histolytica
GKTGGWAVVSMYLTFSGF

SEQ ID NO: 2581656 - protein, 27 aa, Entamoeba histolytica
GKTPRVDLYLMIFLKFLATVIPTMEYD

SEQ ID NO: 2581657 - protein, 18 aa, Entamoeba histolytica
GKTQWYAYIIRYLIVFFP

SEQ ID NO: 2581658 - protein, 28 aa, Entamoeba histolytica
GKVNIKELFRYAGVFEIILLIIGIIGSI

SEQ ID NO: 2581659 - protein, 17 aa, Entamoeba histolytica
GKYHICSILVASIPTLV

SEQ ID NO: 2581660 - protein, 35 aa, Entamoeba histolytica
GKYQITTLIKFCFYKNAAFFLMDIWFATISNFTCQ

SEQ ID NO: 2581661 - protein, 22 aa, Entamoeba histolytica
GLCDIPVPFVIRKVVTTVASGN

SEQ ID NO: 2581662 - protein, 19 aa, Entamoeba histolytica
GLCGDIVKLIGYICAATLR

SEQ ID NO: 2581663 - protein, 26 aa, Entamoeba histolytica
GLCVEKSRFIGCKTFGSIGCDQCIEG

SEQ ID NO: 2581664 - protein, 29 aa, Entamoeba histolytica
GLDPIPFRCLLKFSKKENNSHCIFESDET

SEQ ID NO: 2581665 - protein, 25 aa, Entamoeba histolytica
GLELSCIIEALMLRIEANKKELKLA

SEQ ID NO: 2581666 - protein, 28 aa, Entamoeba histolytica
GLFFEWKIPLKYIKVVLQVAIFKITVGL

SEQ ID NO: 2581667 - protein, 18 aa, Entamoeba histolytica
GLFSMAMAFIVIYIAIPI

SEQ ID NO: 2581668 - protein, 22 aa, Entamoeba histolytica
GLGFLCGGSVMLLLGNTFTLYL

SEQ ID NO: 2581669 - protein, 17 aa, Entamoeba histolytica
GLGRRIPIINIFLSPFV

SEQ ID NO: 2581670 - protein, 18 aa, Entamoeba histolytica
GLIAGGVYYWATRRRQVL

SEQ ID NO: 2581671 - protein, 19 aa, Entamoeba histolytica
GLIAGGVYYWATRRRQVLL

SEQ ID NO: 2581672 - protein, 18 aa, Entamoeba histolytica
GLIGELFSDVGYDVSKGL

SEQ ID NO: 2581673 - protein, 19 aa, Entamoeba histolytica
GLILRILNMLFLYKIPIKI

SEQ ID NO: 2581674 - protein, 24 aa, Entamoeba histolytica
GLIPSESLPQVYSRVEREENDFNS

SEQ ID NO: 2581675 - protein, 19 aa, Entamoeba histolytica
GLIQDCWKQNIGERPSFEQ

SEQ ID NO: 2581676 - protein, 18 aa, Entamoeba histolytica
GLISHYFYIGLFLSSGEH

SEQ ID NO: 2581677 - protein, 25 aa, Entamoeba histolytica
GLISINFPPRINVINEYAFSGCTNL

SEQ ID NO: 2581678 - protein, 18 aa, Entamoeba histolytica
GLIVEIIFALRFFLYFEH

SEQ ID NO: 2581679 - protein, 24 aa, Entamoeba histolytica
GLKELSILYPLIFFPTHLKMVFKY

SEQ ID NO: 2581680 - protein, 24 aa, Entamoeba histolytica
GLKGQIPKKCRRSIGKTDEIDSNL

SEQ ID NO: 2581681 - protein, 19 aa, Entamoeba histolytica
GLLCANGLHKMMIRNLFGT

SEQ ID NO: 2581682 - protein, 19 aa, Entamoeba histolytica
GLLCGLIVIIFIVIIIGII

SEQ ID NO: 2581683 - protein, 23 aa, Entamoeba histolytica
GLLFFFVFCAFWIGYIYGAKKIQ

SEQ ID NO: 2581684 - protein, 22 aa, Entamoeba histolytica
GLLFFFVFCAFWIGYIYVIQLI

SEQ ID NO: 2581685 - protein, 24 aa, Entamoeba histolytica
GLLFNFSAYFLWTVIPLKANDLGA

SEQ ID NO: 2581686 - protein, 17 aa, Entamoeba histolytica
GLLIIYLFWLIFSIIRS

SEQ ID NO: 2581687 - protein, 26 aa, Entamoeba histolytica
GLLKSLMHLLRACISYSFNTDNNKNF

SEQ ID NO: 2581688 - protein, 23 aa, Entamoeba histolytica
GLLPKEVLSFIVISIPVTILLAI

SEQ ID NO: 2581689 - protein, 17 aa, Entamoeba histolytica
GLLSHYVSLVIKLPIKK

SEQ ID NO: 2581690 - protein, 20 aa, Entamoeba histolytica
GLLVLFAFWFFHGIVDSLIG

SEQ ID NO: 2581691 - protein, 21 aa, Entamoeba histolytica
GLLVNIIGVFAFRDTDEDIEI

SEQ ID NO: 2581692 - protein, 19 aa, Entamoeba histolytica
GLLYYAGDVIGRFVEIFAK

SEQ ID NO: 2581693 - protein, 24 aa, Entamoeba histolytica
GLNHKRFYVGGVITFNSQTNEPDW

SEQ ID NO: 2581694 - protein, 21 aa, Entamoeba histolytica
GLPMLYCFVPIYNNNLINNRE

SEQ ID NO: 2581695 - protein, 24 aa, Entamoeba histolytica
GLPSIIIYLCISFAVKGSSTLSDY

SEQ ID NO: 2581696 - protein, 21 aa, Entamoeba histolytica
GLRIKGFKKGDKIGMFCETRF

SEQ ID NO: 2581697 - protein, 25 aa, Entamoeba histolytica
GLSIKSIFVSLGIEIIVLLYLIDND

SEQ ID NO: 2581698 - protein, 18 aa, Entamoeba histolytica
GLSVIFERLYLFILNSSL

SEQ ID NO: 2581699 - protein, 25 aa, Entamoeba histolytica
GLTFFKFLYYLGVAPFGVYLFRNED

SEQ ID NO: 2581700 - protein, 32 aa, Entamoeba histolytica
GLTIRDANLFFAEFIRDLSLLWRHDEIAKLVD

SEQ ID NO: 2581701 - protein, 20 aa, Entamoeba histolytica
GLTVLCWGNSVGDFVSNVIV

SEQ ID NO: 2581702 - protein, 27 aa, Entamoeba histolytica
GLVLGWVHAFIFWKYSVLMYVAGQELK

SEQ ID NO: 2581703 - protein, 18 aa, Entamoeba histolytica
GLVLTLFVLWNFKVGQPA

SEQ ID NO: 2581704 - protein, 32 aa, Entamoeba histolytica; identical to SEQ ID NO: 2483790

SEQ ID NO: 2581705 - protein, 24 aa, Entamoeba histolytica
GLYPLIDIESGFILQLKLFEKKLE

SEQ ID NO: 2581706 - protein, 18 aa, Entamoeba histolytica
GMCLPFIENLAHQLKCNV

SEQ ID NO: 2581707 - protein, 19 aa, Entamoeba histolytica
GMGLYLDKLFELFSILPSY

SEQ ID NO: 2581708 - protein, 17 aa, Entamoeba histolytica
GMIEMFEIPTLKKKGEL

SEQ ID NO: 2581709 - protein, 24 aa, Entamoeba histolytica
GMKKDFFKCSNWPTQAPYYGETQA

SEQ ID NO: 2581710 - protein, 17 aa, Entamoeba histolytica
GMMVMSGFHDLYISLVL

SEQ ID NO: 2581711 - protein, 17 aa, Entamoeba histolytica
GMMWGVAQVCWFIANSN

SEQ ID NO: 2581712 - protein, 23 aa, Entamoeba histolytica
GMRKYCYCRRKIHIDDSECICIV

SEQ ID NO: 2581713 - protein, 22 aa, Entamoeba histolytica
GMSATRSKIAWIEFPYECGLIQ

SEQ ID NO: 2581714 - protein, 34 aa, Entamoeba histolytica
GMSDLGCSSKLWIVCSKKTLSYKCPGNTQCTFKA

SEQ ID NO: 2581715 - protein, 31 aa, Entamoeba histolytica
GMTCSNRGYGWKLIWDGTIDWIIFTGECCEN

SEQ ID NO: 2581716 - protein, 22 aa, Entamoeba histolytica
GMVVCSFILFSFLVAKKFFTMK

SEQ ID NO: 2581717 - protein, 24 aa, Entamoeba histolytica
GMYCQRSPVWWVIILVILVILSIT

SEQ ID NO: 2581718 - protein, 22 aa, Entamoeba histolytica
GNEGFLLMIFYYLGCTLTLRKI

SEQ ID NO: 2581719 - protein, 20 aa, Entamoeba histolytica
GNERAWKRSGFCSEHGNQFK

SEQ ID NO: 2581720 - protein, 19 aa, Entamoeba histolytica
GNFIPYGVLIYYNDPALPS

SEQ ID NO: 2581721 - protein, 28 aa, Entamoeba histolytica
GNFPGHVVPICFNWPVGKHSLHGNKKAK

SEQ ID NO: 2581722 - protein, 26 aa, Entamoeba histolytica
GNGKEIFSKWGIQNIIGFNDNDNIFR

SEQ ID NO: 2581723 - protein, 20 aa, Entamoeba histolytica
GNGKSSLGNFILKNDVFTVS

SEQ ID NO: 2581724 - protein, 18 aa, Entamoeba histolytica
GNIKDFSLKCSMNGIDFI

SEQ ID NO: 2581725 - protein, 24 aa, Entamoeba histolytica
GNIKMEFANLILLNSDYEVETFVE

SEQ ID NO: 2581726 - protein, 25 aa, Entamoeba histolytica
GNIKTDYPSVFSIPSFFNNKQLDIL

SEQ ID NO: 2581727 - protein, 19 aa, Entamoeba histolytica
GNKMIWLHTLVCTLILNIL

SEQ ID NO: 2581728 - protein, 18 aa, Entamoeba histolytica
GNLCDKCREGCNYCNSTH

SEQ ID NO: 2581729 - protein, 18 aa, Entamoeba histolytica
GNLFIWLLSIFYIPKPTR

SEQ ID NO: 2581730 - protein, 19 aa, Entamoeba histolytica
GNLKYPDCHYLSYLYDFSL

SEQ ID NO: 2581731 - protein, 30 aa, Entamoeba histolytica
GNLRVIICAGAPLSLDIAKFFRIVISDGFF

SEQ ID NO: 2581732 - protein, 24 aa, Entamoeba histolytica
GNNFTSITSYVSWLVLAVYQSVML

SEQ ID NO: 2581733 - protein, 23 aa, Entamoeba histolytica
GNNKRLLCRSLIYNPEPYYSKHN

SEQ ID NO: 2581734 - protein, 17 aa, Entamoeba histolytica
GNPDWSRTKYVKHLTIN

SEQ ID NO: 2581735 - protein, 17 aa, Entamoeba histolytica
GNQCLTCMEGYYLSKTD

SEQ ID NO: 2581736 - protein, 27 aa, Entamoeba histolytica
GNSVWKCDKCGLLNEGSHCVLCNNEKK

SEQ ID NO: 2581737 - protein, 20 aa, Entamoeba histolytica
GNTEKLSWRVFGPQGALIQN

SEQ ID NO: 2581738 - protein, 23 aa, Entamoeba histolytica
GNTKGSEGYNEFIKQLGEEINLK

SEQ ID NO: 2581739 - protein, 24 aa, Entamoeba histolytica
GNVARSVSFIGVISKYFRQDAPTI

SEQ ID NO: 2581740 - protein, 18 aa, Entamoeba histolytica
GNYYCSYNRREEVLIDIK

SEQ ID NO: 2581741 - protein, 18 aa, Entamoeba histolytica
GPALCDFLGGYLMNVGLM

SEQ ID NO: 2581742 - protein, 17 aa, Entamoeba histolytica
GPFGIVYVGEFRGNKVA

SEQ ID NO: 2581743 - protein, 19 aa, Entamoeba histolytica
GPHSVLCMVALLGVLIYLY

SEQ ID NO: 2581744 - protein, 17 aa, Entamoeba histolytica
GPIIFNFNNSKSCYLTI

SEQ ID NO: 2581745 - protein, 19 aa, Entamoeba histolytica
GPKGFGIKSVKWNNAGTKF

SEQ ID NO: 2581746 - protein, 23 aa, Entamoeba histolytica
GPKGVIRLRIVDMCPSNDENPKC

SEQ ID NO: 2581747 - protein, 29 aa, Entamoeba histolytica
GPKLNWEIICGIAIDIAEGLVCLKENGIV

SEQ ID NO: 2581748 - protein, 26 aa, Entamoeba histolytica
GPLNYCCIMSFLSLLYWRNYPPSIIG

SEQ ID NO: 2581749 - protein, 25 aa, Entamoeba histolytica
GPLNYCCIMTFLSLLYWRNYPASII

SEQ ID NO: 2581750 - protein, 18 aa, Entamoeba histolytica
GPQRAVVILHYFESIKYF

SEQ ID NO: 2581751 - protein, 18 aa, Entamoeba histolytica
GQCSYILQNCEDVSFLIN

SEQ ID NO: 2581752 - protein, 20 aa, Entamoeba histolytica
GQCVKIYESWFILQQYTPQP

SEQ ID NO: 2581753 - protein, 22 aa, Entamoeba histolytica
GQFLKDLLRFYSRTTTMEALES

SEQ ID NO: 2581754 - protein, 17 aa, Entamoeba histolytica
GQGLFIAGLVLIVLGIV

SEQ ID NO: 2581755 - protein, 21 aa, Entamoeba histolytica
GQGLWNIIQIFDWTVYKKPNE

SEQ ID NO: 2581756 - protein, 27 aa, Entamoeba histolytica
GQGSFGLVYRGFWRGVEVAIKMIKSDL

SEQ ID NO: 2581757 - protein, 21 aa, Entamoeba histolytica
GQIILEYMDKLGLMNYLSLKT

SEQ ID NO: 2581758 - protein, 18 aa, Entamoeba histolytica
GQIIYQFIHELKIDNLVI

SEQ ID NO: 2581759 - protein, 17 aa, Entamoeba histolytica
GQLYSKEYPAFGVDLIV

SEQ ID NO: 2581760 - protein, 25 aa, Entamoeba histolytica
GQNLSFKTFSAWMFISILQGSVIMM

SEQ ID NO: 2581761 - protein, 18 aa, Entamoeba histolytica
GQPGVFIYYDVSPMVLEV

SEQ ID NO: 2581762 - protein, 24 aa, Entamoeba histolytica
GQQQGGLVPPRIQEETPSQKEKHE

SEQ ID NO: 2581763 - protein, 19 aa, Entamoeba histolytica
GQQTYELLLKMMKDKTMEE

SEQ ID NO: 2581764 - protein, 19 aa, Entamoeba histolytica
GQRAVAWAFPGEIVTIKFP

SEQ ID NO: 2581765 - protein, 18 aa, Entamoeba histolytica
GQRCPADLIPLHTDSLDP

SEQ ID NO: 2581766 - protein, 17 aa, Entamoeba histolytica
GQVVVPLYFASVLQGLI

SEQ ID NO: 2581767 - protein, 18 aa, Entamoeba histolytica
GRAPPSVIAERGMTLKEC

SEQ ID NO: 2581768 - protein, 17 aa, Entamoeba histolytica
GRCVQCKYNYYLNNQNP

SEQ ID NO: 2581769 - protein, 28 aa, Entamoeba histolytica
GRCYKIIIRPDLFLKIPSVINNDVPFLT

SEQ ID NO: 2581770 - protein, 27 aa, Entamoeba histolytica
GRDGKPSDCIIYFSMKDIARVEWLKRD

SEQ ID NO: 2581771 - protein, 19 aa, Entamoeba histolytica
GRDGLFTGVMAISYTFEPP

SEQ ID NO: 2581772 - protein, 17 aa, Entamoeba histolytica
GRDLDFIDEEEIKKLNA

SEQ ID NO: 2581773 - protein, 19 aa, Entamoeba histolytica
GRDSWYLDMEDISVGKNAV

SEQ ID NO: 2581774 - protein, 23 aa, Entamoeba histolytica
GREFFIMRNSWYDGWGDGDNYLK

SEQ ID NO: 2581775 - protein, 22 aa, Entamoeba histolytica
GRFDSLISFKMLRSILFQAAYQ

SEQ ID NO: 2581776 - protein, 17 aa, Entamoeba histolytica
GRFFCVMELTVMNGEVV

SEQ ID NO: 2581777 - protein, 23 aa, Entamoeba histolytica
GRFTTLLPLCIVIIVSMIKEFYE

SEQ ID NO: 2581778 - protein, 19 aa, Entamoeba histolytica
GRGTFGNVYKATWRNTDVA

SEQ ID NO: 2581779 - protein, 19 aa, Entamoeba histolytica
GRISFSWKEEEGLNDNSTN

SEQ ID NO: 2581780 - protein, 20 aa, Entamoeba histolytica
GRISFSWKEEEGLNDNSTNS

SEQ ID NO: 2581781 - protein, 25 aa, Entamoeba histolytica
GRLRLKEDYIRNAIDDMKMMYLSYV

SEQ ID NO: 2581782 - protein, 19 aa, Entamoeba histolytica
GRMKSLHGNFVRALNSITF

SEQ ID NO: 2581783 - protein, 24 aa, Entamoeba histolytica
GRNTIKCSNLIIKSGKISIQDISL

SEQ ID NO: 2581784 - protein, 19 aa, Entamoeba histolytica
GRVRWEMNGGGGINHGIEV

SEQ ID NO: 2581785 - protein, 23 aa, Entamoeba histolytica
GRVVLPILIPLYIPLEKRTKYCN

SEQ ID NO: 2581786 - protein, 20 aa, Entamoeba histolytica
GRYCASCYNESISLRGPSSI

SEQ ID NO: 2581787 - protein, 20 aa, Entamoeba histolytica
GRYTYPVCMPTTMTKVIRFS

SEQ ID NO: 2581788 - protein, 19 aa, Entamoeba histolytica
GSCGSCYAASTANLGQYLY

SEQ ID NO: 2581789 - protein, 20 aa, Entamoeba histolytica
GSCGSCYAASTANLGQYLYA

SEQ ID NO: 2581790 - protein, 24 aa, Entamoeba histolytica
GSCILWKYLSDVGYDYATMSLISI

SEQ ID NO: 2581791 - protein, 27 aa, Entamoeba histolytica
GSCKEKVFPSWGIALIIILSIIVMIIL

SEQ ID NO: 2581792 - protein, 18 aa, Entamoeba histolytica
GSCLRCKDGYYASNGICK

SEQ ID NO: 2581793 - protein, 19 aa, Entamoeba histolytica
GSCTMCKVGTYSTGNTSKC

SEQ ID NO: 2581794 - protein, 18 aa, Entamoeba histolytica
GSFGIVYLGIFRGNKVAI

SEQ ID NO: 2581795 - protein, 19 aa, Entamoeba histolytica
GSFGVVFKGTFQGNKVAIK

SEQ ID NO: 2581796 - protein, 19 aa, Entamoeba histolytica
GSFSIVFKGKFRGNTVAIK

SEQ ID NO: 2581797 - protein, 17 aa, Entamoeba histolytica
GSFTVMIITCIIQVIVD

SEQ ID NO: 2581798 - protein, 19 aa, Entamoeba histolytica
GSFVAFSFGVPRHTYNKAT

SEQ ID NO: 2581799 - protein, 20 aa, Entamoeba histolytica
GSFVIFMSWIYHKIWKYYER

SEQ ID NO: 2581800 - protein, 23 aa, Entamoeba histolytica
GSGCGICKKGYYRNGKGCSECEE

SEQ ID NO: 2581801 - protein, 22 aa, Entamoeba histolytica
GSGCGICNKGYYRNGKGCLECG

SEQ ID NO: 2581802 - protein, 17 aa, Entamoeba histolytica
GSGCLSAAFGSRLQFGN

SEQ ID NO: 2581803 - protein, 22 aa, Entamoeba histolytica
GSGKSTMMAGLFRIEEPAGGSI

SEQ ID NO: 2581804 - protein, 21 aa, Entamoeba histolytica
GSGLWCGKVGPSIHICSCIAA

SEQ ID NO: 2581805 - protein, 26 aa, Entamoeba histolytica
GSGTFGIVYRAEWRMVDVAVKVLKTD

SEQ ID NO: 2581806 - protein, 25 aa, Entamoeba histolytica
GSGYKSSKCLNIWSGKPHGVFADEE

SEQ ID NO: 2581807 - protein, 25 aa, Entamoeba histolytica
GSIKVWRLDETLCLGNGSCNTHEHT

SEQ ID NO: 2581808 - protein, 21 aa, Entamoeba histolytica
GSILIEKRAKISFNGGSLNIP

SEQ ID NO: 2581809 - protein, 17 aa, Entamoeba histolytica
GSILKRFIQKLEEKANF

SEQ ID NO: 2581810 - protein, 24 aa, Entamoeba histolytica
GSIWKITLCVVWIICLIIGIFFSF

SEQ ID NO: 2581811 - protein, 25 aa, Entamoeba histolytica
GSKERVGGVKIFFDKYLTSTGSGRF

SEQ ID NO: 2581812 - protein, 20 aa, Entamoeba histolytica
GSLIDPFAIFIIEGENYYVL

SEQ ID NO: 2581813 - protein, 20 aa, Entamoeba histolytica
GSLILYFIGFIFLKETKTYT

SEQ ID NO: 2581814 - protein, 25 aa, Entamoeba histolytica
GSLLFLKLIYYFILFSIKYLSRSYM

SEQ ID NO: 2581815 - protein, 24 aa, Entamoeba histolytica
GSLLHCLTCLVVGLLYIHVTSVLP

SEQ ID NO: 2581816 - protein, 21 aa, Entamoeba histolytica
GSLRWLPYCHLINNSVFIVHG

SEQ ID NO: 2581817 - protein, 18 aa, Entamoeba histolytica
GSMSCSKTNWALIIPLVI

SEQ ID NO: 2581818 - protein, 20 aa, Entamoeba histolytica
GSNLPFDVFLAVVKAPIEGN

SEQ ID NO: 2581819 - protein, 18 aa, Entamoeba histolytica
GSPVANFSRREEFKVLWK

SEQ ID NO: 2581820 - protein, 22 aa, Entamoeba histolytica
GSRFKYPWKIAEFVTSGKRLER

SEQ ID NO: 2581821 - protein, 19 aa, Entamoeba histolytica
GSSIALFCVGTLLLIEIFI

SEQ ID NO: 2581822 - protein, 17 aa, Entamoeba histolytica
GSSRAPIGGFVQLKSSH

SEQ ID NO: 2581823 - protein, 25 aa, Entamoeba histolytica
GSTIRALRFIECIIQTLKASKLTQS

SEQ ID NO: 2581824 - protein, 24 aa, Entamoeba histolytica
GSTYKLKVNWPKYSYKQLGGLITT

SEQ ID NO: 2581825 - protein, 17 aa, Entamoeba histolytica
GSVIIFIALLQYFIKKR

SEQ ID NO: 2581826 - protein, 26 aa, Entamoeba histolytica
GSVKTWKKRWFVLKDNRLWYFASKTA

SEQ ID NO: 2581827 - protein, 26 aa, Entamoeba histolytica
GSVSIKELYRYAGFIDYILLIGGIIG

SEQ ID NO: 2581828 - protein, 23 aa, Entamoeba histolytica
GSYECKDLEGCVVTKYNDTCQPK

SEQ ID NO: 2581829 - protein, 23 aa, Entamoeba histolytica
GSYFAVPLCNNFFSKQKHGINYY

SEQ ID NO: 2581830 - protein, 17 aa, Entamoeba histolytica
GSYPLKFFANLSLVLNC

SEQ ID NO: 2581831 - protein, 19 aa, Entamoeba histolytica
GTAATGFVFMLAMLASLNY

SEQ ID NO: 2581832 - protein, 23 aa, Entamoeba histolytica
GTAGCKIIAHGGHGEYVYSVNGE

SEQ ID NO: 2581833 - protein, 19 aa, Entamoeba histolytica
GTAVIRYSNAMIRNILEPM

SEQ ID NO: 2581834 - protein, 20 aa, Entamoeba histolytica
GTCIPLSSVSHCLRVSNSSC

SEQ ID NO: 2581835 - protein, 25 aa, Entamoeba histolytica
GTCNDKWYLLEIVGNSGFIQSAHTF

SEQ ID NO: 2581836 - protein, 31 aa, Entamoeba histolytica
GTDLVCPCQSLTGYECELEFTGSTNPITFPS

SEQ ID NO: 2581837 - protein, 19 aa, Entamoeba histolytica
GTETLKVFVEVGEIKERKL

SEQ ID NO: 2581838 - protein, 18 aa, Entamoeba histolytica
GTFGIVYKGIFRNNIVAI

SEQ ID NO: 2581839 - protein, 17 aa, Entamoeba histolytica
GTFGIVYLGIFRGNKVA

SEQ ID NO: 2581840 - protein, 22 aa, Entamoeba histolytica
GTFGVVYKGTWRSVDVAVKQLK

SEQ ID NO: 2581841 - protein, 17 aa, Entamoeba histolytica
GTFRLNIYDNLPLINSR

SEQ ID NO: 2581842 - protein, 25 aa, Entamoeba histolytica
GTGHIINWIGFILFFVRVDKDNEDS

SEQ ID NO: 2581843 - protein, 24 aa, Entamoeba histolytica
GTGKYYLVDTCSSLTQIDTYLVLV

SEQ ID NO: 2581844 - protein, 24 aa, Entamoeba histolytica
GTGTSFGWLSLVKIIVQFLVISIG

SEQ ID NO: 2581845 - protein, 22 aa, Entamoeba histolytica
GTIFLCCYTIVYSLLISFGSIK

SEQ ID NO: 2581846 - protein, 17 aa, Entamoeba histolytica
GTIKDTVCRYAIQTGHR

SEQ ID NO: 2581847 - protein, 20 aa, Entamoeba histolytica
GTILGCKTFYNEFCLRCEDG

SEQ ID NO: 2581848 - protein, 17 aa, Entamoeba histolytica
GTIRGIVNIGAIHKNNE

SEQ ID NO: 2581849 - protein, 20 aa, Entamoeba histolytica
GTKGKRSSDIICSMKKEGIQ

SEQ ID NO: 2581850 - protein, 17 aa, Entamoeba histolytica
GTKPKEWTMKYTKYPYW

SEQ ID NO: 2581851 - protein, 19 aa, Entamoeba histolytica
GTKQLLCIARECLRDSKII

SEQ ID NO: 2581852 - protein, 24 aa, Entamoeba histolytica
GTLAMPFAMLYSGWGGGLILMTGA

SEQ ID NO: 2581853 - protein, 24 aa, Entamoeba histolytica
GTLLRLLISMGYNIVLKKPKMAKK

SEQ ID NO: 2581854 - protein, 23 aa, Entamoeba histolytica
GTLTYERFDIFSLSSSSLEKMDQ

SEQ ID NO: 2581855 - protein, 17 aa, Entamoeba histolytica
GTMWGKRKHPFVGVAGV

SEQ ID NO: 2581856 - protein, 18 aa, Entamoeba histolytica
GTNELNISTLTIKSANGL

SEQ ID NO: 2581857 - protein, 21 aa, Entamoeba histolytica
GTPLVYSCVKILMQRVPQNVS

SEQ ID NO: 2581858 - protein, 21 aa, Entamoeba histolytica
GTSLLPILVIIPLWYISLPTN

SEQ ID NO: 2581859 - protein, 23 aa, Entamoeba histolytica
GTTIAFLVLLSFVTPKYPYFSFS

SEQ ID NO: 2581860 - protein, 18 aa, Entamoeba histolytica
GTYCSLFLGIVYFSQSFC

SEQ ID NO: 2581861 - protein, 19 aa, Entamoeba histolytica
GTYIKRNDLLTGYKHSKVD

SEQ ID NO: 2581862 - protein, 19 aa, Entamoeba histolytica
GVACGGFLILWMKRHPNVR

SEQ ID NO: 2581863 - protein, 27 aa, Entamoeba histolytica
GVAPFYYHWKIHYGLVDPITFEVQREE

SEQ ID NO: 2581864 - protein, 18 aa, Entamoeba histolytica
GVASEVWQSYSSGIINVS

SEQ ID NO: 2581865 - protein, 21 aa, Entamoeba histolytica
GVCLYILLWLSLLLIIMFRYK

SEQ ID NO: 2581866 - protein, 18 aa, Entamoeba histolytica
GVCVKRSQGDYIAWNHYG

SEQ ID NO: 2581867 - protein, 22 aa, Entamoeba histolytica
GVCYECPEKSFPINGECQPCEV

SEQ ID NO: 2581868 - protein, 18 aa, Entamoeba histolytica
GVDAVPFWDAIRNCLDSD

SEQ ID NO: 2581869 - protein, 27 aa, Entamoeba histolytica
GVDQKLCRCCYAASIANFLQIKHHIAN

SEQ ID NO: 2581870 - protein, 18 aa, Entamoeba histolytica
GVFALFSLLDYFIFHVYH

SEQ ID NO: 2581871 - protein, 21 aa, Entamoeba histolytica
GVFFKYELSPYIVINEMNDHS

SEQ ID NO: 2581872 - protein, 21 aa, Entamoeba histolytica
GVFGLRIIKNPSFSNKQCSHA

SEQ ID NO: 2581873 - protein, 17 aa, Entamoeba histolytica
GVFLCFFALKTNSLFVL

SEQ ID NO: 2581874 - protein, 17 aa, Entamoeba histolytica
GVFLEFPDMAKVPITLS

SEQ ID NO: 2581875 - protein, 19 aa, Entamoeba histolytica
GVFVSCCLFCKRLVEQKRY

SEQ ID NO: 2581876 - protein, 19 aa, Entamoeba histolytica
GVGCLNPLLMILTGDVVDT

SEQ ID NO: 2581877 - protein, 17 aa, Entamoeba histolytica
GVGLYLCDLQEKAHFVD

SEQ ID NO: 2581878 - protein, 19 aa, Entamoeba histolytica
GVIFYMWIYPLLYKLVSSL

SEQ ID NO: 2581879 - protein, 24 aa, Entamoeba histolytica
GVIICIILSILFSISFLVITNKRI

SEQ ID NO: 2581880 - protein, 24 aa, Entamoeba histolytica
GVKKSSKLGFGWLLKAAQQGNVKG

SEQ ID NO: 2581881 - protein, 22 aa, Entamoeba histolytica
GVKPYPGISLTQWGVCILLGLV

SEQ ID NO: 2581882 - protein, 18 aa, Entamoeba histolytica
GVLSIIGALLIILSVMLY

SEQ ID NO: 2581883 - protein, 18 aa, Entamoeba histolytica
GVLYTGSVKERFVVLNSL

SEQ ID NO: 2581884 - protein, 23 aa, Entamoeba histolytica
GVLYTRGFLDWLFNSRLITIIDT

SEQ ID NO: 2581885 - protein, 21 aa, Entamoeba histolytica
GVNNIHWVAGCEPVCDSCAIG

SEQ ID NO: 2581886 - protein, 21 aa, Entamoeba histolytica
GVPEMKVTLLGNRIPNLLTFK

SEQ ID NO: 2581887 - protein, 26 aa, Entamoeba histolytica
GVQQSSWKIVWIVLLISLILAAYFAF

SEQ ID NO: 2581888 - protein, 27 aa, Entamoeba histolytica
GVQVCEVFFKIGFLIVFFITFYYANRH

SEQ ID NO: 2581889 - protein, 20 aa, Entamoeba histolytica
GVTFFLIFFVDRVIVPHSHG

SEQ ID NO: 2581890 - protein, 25 aa, Entamoeba histolytica
GVTFFYNDMFKMFVYIVLSIENNSL

SEQ ID NO: 2581891 - protein, 19 aa, Entamoeba histolytica
GVTLYYLIRCEPFSHFGIE

SEQ ID NO: 2581892 - protein, 18 aa, Entamoeba histolytica
GVWLRYSHDPSFKYTAST

SEQ ID NO: 2581893 - protein, 20 aa, Entamoeba histolytica
GVYVSLMLLLWGCSQTLNTS

SEQ ID NO: 2581894 - protein, 19 aa, Entamoeba histolytica
GWCTGSFGLFGINAQPVDK

SEQ ID NO: 2581895 - protein, 17 aa, Entamoeba histolytica
GWEKGEETLHCCSPRKC

SEQ ID NO: 2581896 - protein, 17 aa, Entamoeba histolytica
GWKEPRNYCSSKILPTC

SEQ ID NO: 2581897 - protein, 21 aa, Entamoeba histolytica
GWKTSFEVNYNYPLDVSVQQI

SEQ ID NO: 2581898 - protein, 25 aa, Entamoeba histolytica
GWSNSSPNWLGWKNGYGLKEDKTWV

SEQ ID NO: 2581899 - protein, 22 aa, Entamoeba histolytica
GYACEFELFIIIKCTTKISDKL

SEQ ID NO: 2581900 - protein, 20 aa, Entamoeba histolytica
GYACEFELFITIKCTAKIKD

SEQ ID NO: 2581901 - protein, 20 aa, Entamoeba histolytica
GYACEFELFITIKCTTKIKD

SEQ ID NO: 2581902 - protein, 20 aa, Entamoeba histolytica
GYACEFELFITIKCTTKIND

SEQ ID NO: 2581903 - protein, 17 aa, Entamoeba histolytica
GYACEFEVFITIKCTTK

SEQ ID NO: 2581904 - protein, 18 aa, Entamoeba histolytica
GYACEFEVFITIKCTTKI

SEQ ID NO: 2581905 - protein, 20 aa, Entamoeba histolytica
GYALHFIVIIILWTFLWTVC

SEQ ID NO: 2581906 - protein, 26 aa, Entamoeba histolytica
GYAVSLCIIFGFSLLAIKRFNKKNYS

SEQ ID NO: 2581907 - protein, 22 aa, Entamoeba histolytica
GYCVKCYDGYYLKDNSCIRCTE

SEQ ID NO: 2581908 - protein, 17 aa, Entamoeba histolytica
GYETLSTIIELKYEFDE

SEQ ID NO: 2581909 - protein, 27 aa, Entamoeba histolytica
GYFFDFYNKKCVIDVCRSTSESSSSSM

SEQ ID NO: 2581910 - protein, 19 aa, Entamoeba histolytica
GYFYKLIFVISYIILSLIF

SEQ ID NO: 2581911 - protein, 18 aa, Entamoeba histolytica
GYGGDDCHLLCFYNFTWQ

SEQ ID NO: 2581912 - protein, 32 aa, Entamoeba histolytica
GYGIARILLSLSLCFIGLFIGLSQLFISILPI

SEQ ID NO: 2581913 - protein, 22 aa, Entamoeba histolytica
GYGLCQVCIIPLLNSLFDDSAI

SEQ ID NO: 2581914 - protein, 20 aa, Entamoeba histolytica
GYIHELNCLFYTRNGTLIKI

SEQ ID NO: 2581915 - protein, 17 aa, Entamoeba histolytica
GYIPLQFETELSTRLDP

SEQ ID NO: 2581916 - protein, 19 aa, Entamoeba histolytica
GYLARPAKQYPSIFGGMKF

SEQ ID NO: 2581917 - protein, 22 aa, Entamoeba histolytica
GYLRIAAPFFDYSHLDAAKQPE

SEQ ID NO: 2581918 - protein, 18 aa, Entamoeba histolytica
GYMFGGSLNEAFFDHSNK

SEQ ID NO: 2581919 - protein, 19 aa, Entamoeba histolytica
GYNADGKGHCIISCMYGDA

SEQ ID NO: 2581920 - protein, 18 aa, Entamoeba histolytica
GYNLGISVGETYRYNYEY

SEQ ID NO: 2581921 - protein, 19 aa, Entamoeba histolytica
GYSGGALKHGPFALIEKGL

SEQ ID NO: 2581922 - protein, 23 aa, Entamoeba histolytica
GYTAYCPTKFAIKGLLDSLRFEF

SEQ ID NO: 2581923 - protein, 26 aa, Entamoeba histolytica
GYTQLEWDLFWGFSVDYEFKYKELFH

SEQ ID NO: 2581924 - protein, 22 aa, Entamoeba histolytica
GYTQPHCPCGFSDNTLKYSDNG

SEQ ID NO: 2581925 - protein, 17 aa, Entamoeba histolytica
GYVEWLYAFTDLYDKVI

SEQ ID NO: 2581926 - protein, 18 aa, Entamoeba histolytica
GYVLRSGYCYKYLNNINC

SEQ ID NO: 2581927 - protein, 19 aa, Entamoeba histolytica
GYWKQQYLLRRQWSNIIIE

SEQ ID NO: 2581928 - protein, 19 aa, Entamoeba histolytica
GYWKQQYLLRRQWSNLIIE

SEQ ID NO: 2581929 - protein, 26 aa, Entamoeba histolytica
GYWLPLLFCLPFVFYFTFIPTFNFCV

SEQ ID NO: 2581930 - protein, 21 aa, Entamoeba histolytica
GYYYFWWLDAVGGIVLSFYIM

SEQ ID NO: 2581931 - protein, 25 aa, Entamoeba histolytica
HADILFFQGLLDWVSLFFITYLFEH

SEQ ID NO: 2581932 - protein, 17 aa, Entamoeba histolytica
HAFQFSDIQFNAGFIGI

SEQ ID NO: 2581933 - protein, 18 aa, Entamoeba histolytica
HAQLSWALSSISNVRLSK

SEQ ID NO: 2581934 - protein, 23 aa, Entamoeba histolytica
HCAACSATACITCEDINLILTGE

SEQ ID NO: 2581935 - protein, 23 aa, Entamoeba histolytica
HCFECKESFYLKNSLCYSYNQLT

SEQ ID NO: 2581936 - protein, 17 aa, Entamoeba histolytica
HCFLQLGTFSQIYFDCI

SEQ ID NO: 2581937 - protein, 26 aa, Entamoeba histolytica
HCIISHLDCLYDFVMNNCIDKEQQTY

SEQ ID NO: 2581938 - protein, 21 aa, Entamoeba histolytica
HCLDEQLPLIYNDLVVIAGIS

SEQ ID NO: 2581939 - protein, 25 aa, Entamoeba histolytica
HCLSSIPLKLLYRLIPLIQPNTSLS

SEQ ID NO: 2581940 - protein, 19 aa, Entamoeba histolytica
HCNEWRTFITQMIQSNIFV

SEQ ID NO: 2581941 - protein, 21 aa, Entamoeba histolytica
HCSEICIVVAPFGGWTNKLKE

SEQ ID NO: 2581942 - protein, 31 aa, Entamoeba histolytica
HCSISSPYGCLRCMTGYYLKDGICSSCDNNC

SEQ ID NO: 2581943 - protein, 21 aa, Entamoeba histolytica
HCTGETILRVYNILFQCVILP

SEQ ID NO: 2581944 - protein, 22 aa, Entamoeba histolytica
HCTSCSLISCYSCEENYILIEN

SEQ ID NO: 2581945 - protein, 18 aa, Entamoeba histolytica
HCYAYASEFILMYITITA

SEQ ID NO: 2581946 - protein, 20 aa, Entamoeba histolytica
HCYGYLNVIALTFVTVPGTI

SEQ ID NO: 2581947 - protein, 23 aa, Entamoeba histolytica
HDCNYIDFFQWFIKHMKDALENL

SEQ ID NO: 2581948 - protein, 22 aa, Entamoeba histolytica
HDDTRLIGSFKYFDSMNLFYKK

SEQ ID NO: 2581949 - protein, 30 aa, Entamoeba histolytica
HDELPLLSTFILKFIFFIIFALTIGGVIFF

SEQ ID NO: 2581950 - protein, 22 aa, Entamoeba histolytica
HDGQVFPFNYIVPLFHSKSYGM

SEQ ID NO: 2581951 - protein, 23 aa, Entamoeba histolytica
HDLDRLTSVYIHLFPGLVIYCIR

SEQ ID NO: 2581952 - protein, 18 aa, Entamoeba histolytica
HEAKKGFEPFKIEEQIPD

SEQ ID NO: 2581953 - protein, 25 aa, Entamoeba histolytica
HEARDSGLFAVSWSFGKAIGYAAGG

SEQ ID NO: 2581954 - protein, 27 aa, Entamoeba histolytica
HEARNSGLFAVCWSFGKAIGYAAGGTL

SEQ ID NO: 2581955 - protein, 24 aa, Entamoeba histolytica
HEDPELHWMYGFKNECLGKYDTET

SEQ ID NO: 2581956 - protein, 17 aa, Entamoeba histolytica
HEELTLYLSGFAMTLFT

SEQ ID NO: 2581957 - protein, 18 aa, Entamoeba histolytica
HEKELFIMKYLERENILI

SEQ ID NO: 2581958 - protein, 30 aa, Entamoeba histolytica
HETISMKAIEIFFRFCELDLFKESKEILKP

SEQ ID NO: 2581959 - protein, 21 aa, Entamoeba histolytica
HEVNSLISLILMYQYGVYFDK

SEQ ID NO: 2581960 - protein, 17 aa, Entamoeba histolytica
HEYCQRILNMIIDKCIE

SEQ ID NO: 2581961 - protein, 24 aa, Entamoeba histolytica
HFEKVTPIRPWRHDHVARFQQQCY

SEQ ID NO: 2581962 - protein, 19 aa, Entamoeba histolytica
HFFPNLVLYYLRWKSSFPI

SEQ ID NO: 2581963 - protein, 19 aa, Entamoeba histolytica
HFFTFIFDQLEIVIQKGND

SEQ ID NO: 2581964 - protein, 24 aa, Entamoeba histolytica
HFILVIIFCICFILILIIPTQTIT

SEQ ID NO: 2581965 - protein, 26 aa, Entamoeba histolytica
HFIPSGIKWILSFSICGSSVALITSL

SEQ ID NO: 2581966 - protein, 20 aa, Entamoeba histolytica
HFLFIPSMIVLLSIIISSIC

SEQ ID NO: 2581967 - protein, 30 aa, Entamoeba histolytica; identical to SEQ ID NO: 2383520

SEQ ID NO: 2581968 - protein, 24 aa, Entamoeba histolytica
HFLNIFMCCCGILIISIVASVYKR

SEQ ID NO: 2581969 - protein, 17 aa, Entamoeba histolytica
HFPFISRFIKKICKCIM

SEQ ID NO: 2581970 - protein, 17 aa, Entamoeba histolytica
HFSYFEWQALVTGTYKF

SEQ ID NO: 2581971 - protein, 18 aa, Entamoeba histolytica
HFTTLKIIHGFILGMVPA

SEQ ID NO: 2581972 - protein, 20 aa, Entamoeba histolytica
HFYISFDYSQLISINPSFFK

SEQ ID NO: 2581973 - protein, 27 aa, Entamoeba histolytica
HGCSTCSSQECYSCFNSSEIVTTSKSC

SEQ ID NO: 2581974 - protein, 23 aa, Entamoeba histolytica
HGFEKQFHCCYVFSNGTVQPECS

SEQ ID NO: 2581975 - protein, 36 aa, Entamoeba histolytica; identical to SEQ ID NO: 2383526

SEQ ID NO: 2581976 - protein, 24 aa, Entamoeba histolytica
HGIYPGYYLSFGMLALHHDVSCGF

SEQ ID NO: 2581977 - protein, 20 aa, Entamoeba histolytica
HGLDFIPWLQVHDNSLDEQH

SEQ ID NO: 2581978 - protein, 28 aa, Entamoeba histolytica
HGNICPKAFCIVDGVKLLVRELTEGEEC

SEQ ID NO: 2581979 - protein, 23 aa, Entamoeba histolytica
HGSGRACYCIDCDYISRADDDIW

SEQ ID NO: 2581980 - protein, 19 aa, Entamoeba histolytica
HGTYYFNGSFELQKTSNDN

SEQ ID NO: 2581981 - protein, 17 aa, Entamoeba histolytica
HHCPWLGNCIGRRNYKS

SEQ ID NO: 2581982 - protein, 17 aa, Entamoeba histolytica
HHCSTCKQCIGRYDHHC

SEQ ID NO: 2581983 - protein, 17 aa, Entamoeba histolytica
HHCSWMSACIGYHNAKY

SEQ ID NO: 2581984 - protein, 24 aa, Entamoeba histolytica
HHETLRLLQYPVINAILAGHNVLA

SEQ ID NO: 2581985 - protein, 23 aa, Entamoeba histolytica
HHMFCVDIGYPVRYCNKCQKIKK

SEQ ID NO: 2581986 - protein, 21 aa, Entamoeba histolytica
HIDELIPIFNIFANSSQQIVS

SEQ ID NO: 2581987 - protein, 17 aa, Entamoeba histolytica
HIDWLEKKVNIIIKKFF

SEQ ID NO: 2581988 - protein, 24 aa, Entamoeba histolytica
HIENLRIITPFISKWNEAEIKSKQ

SEQ ID NO: 2581989 - protein, 19 aa, Entamoeba histolytica
HIETSICSFILKVAQSIVL

SEQ ID NO: 2581990 - protein, 18 aa, Entamoeba histolytica
HIISIIFIFIIYGLTCYI

SEQ ID NO: 2581991 - protein, 24 aa, Entamoeba histolytica
HIKLCGCSQIIKADAQGAVKFDQK

SEQ ID NO: 2581992 - protein, 19 aa, Entamoeba histolytica
HILKQQFIDGLTFYLQSQS

SEQ ID NO: 2581993 - protein, 23 aa, Entamoeba histolytica
HILSESIVSLFIGIAIGLILLAL

SEQ ID NO: 2581994 - protein, 24 aa, Entamoeba histolytica
HILSESIVSLFIGVIVGLILLVLH

SEQ ID NO: 2581995 - protein, 18 aa, Entamoeba histolytica
HILSFCLNPFYLNEQNYG

SEQ ID NO: 2581996 - protein, 19 aa, Entamoeba histolytica
HIMRVLKILVSGLCLIIIP

SEQ ID NO: 2581997 - protein, 22 aa, Entamoeba histolytica
HISHIGINFAFIISGVVFIFQV

SEQ ID NO: 2581998 - protein, 18 aa, Entamoeba histolytica
HITRVCVILCCLCPAPSV

SEQ ID NO: 2581999 - protein, 19 aa, Entamoeba histolytica
HIVYFFCIFLIQFILYCLL

SEQ ID NO: 2582000 - protein, 17 aa, Entamoeba histolytica
HKDEGYENFSWYHKNDS

SEQ ID NO: 2582001 - protein, 25 aa, Entamoeba histolytica
HKDLIPIFCCISILLYLITSIAAYF

SEQ ID NO: 2582002 - protein, 20 aa, Entamoeba histolytica
HKDYCGYYFFPYDIVEQQQS

SEQ ID NO: 2582003 - protein, 22 aa, Entamoeba histolytica
HKEIMWSCCMTFIMIENQLNLN

SEQ ID NO: 2582004 - protein, 24 aa, Entamoeba histolytica
HKEIPICNYGGMGINQTSDGSVEF

SEQ ID NO: 2582005 - protein, 17 aa, Entamoeba histolytica
HKFKPMILNLVFMIAST

SEQ ID NO: 2582006 - protein, 19 aa, Entamoeba histolytica
HKHHIRFTKIGRISIGEHY

SEQ ID NO: 2582007 - protein, 22 aa, Entamoeba histolytica
HKIFDLFWFFLGLVEKSIVAYL

SEQ ID NO: 2582008 - protein, 17 aa, Entamoeba histolytica
HKIHGLWVMVFVDVIYL

SEQ ID NO: 2582009 - protein, 22 aa, Entamoeba histolytica
HKKEKRSTISHCFGPTYFVIFM

SEQ ID NO: 2582010 - protein, 19 aa, Entamoeba histolytica
HKLNSISFILPFDSKIITY

SEQ ID NO: 2582011 - protein, 20 aa, Entamoeba histolytica
HKLSYFDFFNLFAYNAFGWL

SEQ ID NO: 2582012 - protein, 18 aa, Entamoeba histolytica
HKMDIAYIYNCFSGDNGS

SEQ ID NO: 2582013 - protein, 19 aa, Entamoeba histolytica
HKRFSNLIHFIRPIVCGII

SEQ ID NO: 2582014 - protein, 20 aa, Entamoeba histolytica
HKTSFAVKVLTEYEKDNDIN

SEQ ID NO: 2582015 - protein, 27 aa, Entamoeba histolytica
HKYNFYEIGWRFVFIILSCIVMGLFTF

SEQ ID NO: 2582016 - protein, 19 aa, Entamoeba histolytica
HLEEMKKTWNFDSIGDRFY

SEQ ID NO: 2582017 - protein, 21 aa, Entamoeba histolytica
HLESLLKLLGLIYDILPYFIK

SEQ ID NO: 2582018 - protein, 26 aa, Entamoeba histolytica
HLEVGKVFTCIAYFNAIRRPFMNFGY

SEQ ID NO: 2582019 - protein, 19 aa, Entamoeba histolytica
HLFPGLVIYCIRWYVLTTV

SEQ ID NO: 2582020 - protein, 22 aa, Entamoeba histolytica
HLIAETLSEPALANSQSASQAS

SEQ ID NO: 2582021 - protein, 27 aa, Entamoeba histolytica
HLITWKDGKKFFPLGLYFDEIVDSDLE

SEQ ID NO: 2582022 - protein, 17 aa, Entamoeba histolytica
HLIYLFIQHEVYKVYSL

SEQ ID NO: 2582023 - protein, 24 aa, Entamoeba histolytica
HLKEIRDIIKYDMMKYVEGFIHYF

SEQ ID NO: 2582024 - protein, 25 aa, Entamoeba histolytica
HLKLCFCPFCQFGIKSMGLDKKENK

SEQ ID NO: 2582025 - protein, 20 aa, Entamoeba histolytica
HLLFSIPVGIILVFTTYNYY

SEQ ID NO: 2582026 - protein, 24 aa, Entamoeba histolytica
HLLICGCMAFLYFHHRSKVSYKTL

SEQ ID NO: 2582027 - protein, 29 aa, Entamoeba histolytica
HLLLFCGCFILKIAIYFVQPFLKSYLFWT

SEQ ID NO: 2582028 - protein, 27 aa, Entamoeba histolytica
HLLNLDCSFNRIFSFPPILSLTSLNII

SEQ ID NO: 2582029 - protein, 25 aa, Entamoeba histolytica
HLLPGMVAYCIRWYSDLDIPKELNF

SEQ ID NO: 2582030 - protein, 19 aa, Entamoeba histolytica
HLPAFPKIQAVTINNFLYD

SEQ ID NO: 2582031 - protein, 27 aa, Entamoeba histolytica
HLPYGQRISNWFKMLFTSIAHPCSTYY

SEQ ID NO: 2582032 - protein, 26 aa, Entamoeba histolytica
HLPYKMVCSIICALLAILPAFSNMIV

SEQ ID NO: 2582033 - protein, 18 aa, Entamoeba histolytica
HLQKLIYFHGRQALRRNT

SEQ ID NO: 2582034 - protein, 23 aa, Entamoeba histolytica
HLQPYKGTILFFVIFTILLHYLY

SEQ ID NO: 2582035 - protein, 18 aa, Entamoeba histolytica
HLQQLILLQYLFKKNEIE

SEQ ID NO: 2582036 - protein, 19 aa, Entamoeba histolytica
HLRYHKARINDMFEKNVIF

SEQ ID NO: 2582037 - protein, 25 aa, Entamoeba histolytica
HLSELKEYYSIYILFIHLFISHINM

SEQ ID NO: 2582038 - protein, 18 aa, Entamoeba histolytica
HLSFAKESQYIFVYSNND

SEQ ID NO: 2582039 - protein, 22 aa, Entamoeba histolytica
HLSIPAQLLLQLCIIMTDSLDM

SEQ ID NO: 2582040 - protein, 18 aa, Entamoeba histolytica
HLTYLSGIVLFALIVIPL

SEQ ID NO: 2582041 - protein, 18 aa, Entamoeba histolytica
HLVGTFLALFGLFVAFFG

SEQ ID NO: 2582042 - protein, 17 aa, Entamoeba histolytica
HLYCIDFLFKTHYFLIS

SEQ ID NO: 2582043 - protein, 19 aa, Entamoeba histolytica
HLYDLADFFLVDVDQRVIT

SEQ ID NO: 2582044 - protein, 18 aa, Entamoeba histolytica
HNACLKLHAQLLVFTPTC

SEQ ID NO: 2582045 - protein, 25 aa, Entamoeba histolytica
HNFLFDLALEFGFFFDSKLSRKSTK

SEQ ID NO: 2582046 - protein, 20 aa, Entamoeba histolytica
HNIRKFPCEEFKQRRINKLE

SEQ ID NO: 2582047 - protein, 18 aa, Entamoeba histolytica
HNLLDMMCNMFQKHVFYR

SEQ ID NO: 2582048 - protein, 22 aa, Entamoeba histolytica
HNLNGVSCISIILSVIFTFIFF

SEQ ID NO: 2582049 - protein, 22 aa, Entamoeba histolytica
HNLNGVSCISLILYVIFTFIFF

SEQ ID NO: 2582050 - protein, 19 aa, Entamoeba histolytica
HNLSYYLSLSFDFPKSTIQ

SEQ ID NO: 2582051 - protein, 22 aa, Entamoeba histolytica
HNNPILLAHISFYYHLISNYAG

SEQ ID NO: 2582052 - protein, 26 aa, Entamoeba histolytica
HNPISPIRWALYQGISLKYNHSLFPS

SEQ ID NO: 2582053 - protein, 23 aa, Entamoeba histolytica
HNRGRKLVFIFSMQGIGNILAPL

SEQ ID NO: 2582054 - protein, 25 aa, Entamoeba histolytica
HNRKRVGECLIHLSKDQKHQAQQLE

SEQ ID NO: 2582055 - protein, 24 aa, Entamoeba histolytica
HNTLTFILCFLLGVCYNFHGNITA

SEQ ID NO: 2582056 - protein, 18 aa, Entamoeba histolytica
HNVMFKSLQIILFYEQRC

SEQ ID NO: 2582057 - protein, 18 aa, Entamoeba histolytica
HPELFWKMTEEIHKITAY

SEQ ID NO: 2582058 - protein, 17 aa, Entamoeba histolytica
HPHFNPIFSKKIPPLSY

SEQ ID NO: 2582059 - protein, 28 aa, Entamoeba histolytica
HPHICIGEGYGALILYHFLTSHKYDGNS

SEQ ID NO: 2582060 - protein, 25 aa, Entamoeba histolytica
HPHPMFWKFIQGVGLCYLMLICFLL

SEQ ID NO: 2582061 - protein, 24 aa, Entamoeba histolytica
HPILRIKAAKCYYDIWKKEEKDVL

SEQ ID NO: 2582062 - protein, 19 aa, Entamoeba histolytica
HPQCICLNDGFSGNDNIFK

SEQ ID NO: 2582063 - protein, 18 aa, Entamoeba histolytica
HPQFFVINKDFVKPRTSS

SEQ ID NO: 2582064 - protein, 23 aa, Entamoeba histolytica
HPRVTYEVLVFANRVLKSYPSLR

SEQ ID NO: 2582065 - protein, 20 aa, Entamoeba histolytica
HPSFARFALECSEYKCVGST

SEQ ID NO: 2582066 - protein, 19 aa, Entamoeba histolytica
HPSLFLTIFKKEWYHFLFS

SEQ ID NO: 2582067 - protein, 24 aa, Entamoeba histolytica
HPSSPLKIYAGFIVPSVNDRSFLL

SEQ ID NO: 2582068 - protein, 18 aa, Entamoeba histolytica
HPVQCILVSLNLFSLCNV

SEQ ID NO: 2582069 - protein, 20 aa, Entamoeba histolytica
HPYCDLLRKPNQLLNDLGSE

SEQ ID NO: 2582070 - protein, 22 aa, Entamoeba histolytica
HQFDCLFPILSNAPNLFFQIKP

SEQ ID NO: 2582071 - protein, 23 aa, Entamoeba histolytica
HQHAPMCLIWTALILIQLLTGYV

SEQ ID NO: 2582072 - protein, 17 aa, Entamoeba histolytica
HQMIFKSNLQFQILNDL

SEQ ID NO: 2582073 - protein, 25 aa, Entamoeba histolytica
HQNIKIIQLFCDFIYASWKLIQQKG

SEQ ID NO: 2582074 - protein, 23 aa, Entamoeba histolytica
HQNKEGWLKWNINESNHCLFNQL

SEQ ID NO: 2582075 - protein, 22 aa, Entamoeba histolytica
HQRIKTILSILLNFIENHYLNV

SEQ ID NO: 2582076 - protein, 17 aa, Entamoeba histolytica
HQVDIQAVFPFDSNRKR

SEQ ID NO: 2582077 - protein, 20 aa, Entamoeba histolytica
HRCSPCKIDSCFECTSNRCN

SEQ ID NO: 2582078 - protein, 18 aa, Entamoeba histolytica
HRFEITFEVMLFYTNSNE

SEQ ID NO: 2582079 - protein, 19 aa, Entamoeba histolytica
HRIQLLEFVCQIGIEAEKL

SEQ ID NO: 2582080 - protein, 20 aa, Entamoeba histolytica
HRKVNSCPFMPSTQVYINST

SEQ ID NO: 2582081 - protein, 25 aa, Entamoeba histolytica
HRLEYRRFTFHSSKISKEFSFVHIS

SEQ ID NO: 2582082 - protein, 17 aa, Entamoeba histolytica
HRLSSRLKRTLDSYEQE

SEQ ID NO: 2582083 - protein, 17 aa, Entamoeba histolytica
HRSTVNITRGFVVGTKH

SEQ ID NO: 2582084 - protein, 28 aa, Entamoeba histolytica
HRVLLKYFNLICGIIIMLLAVNRKDIIS

SEQ ID NO: 2582085 - protein, 18 aa, Entamoeba histolytica
HSCGDGYYMEGFMKCILL

SEQ ID NO: 2582086 - protein, 19 aa, Entamoeba histolytica
HSCNFKTHYAKGFLECQTN

SEQ ID NO: 2582087 - protein, 22 aa, Entamoeba histolytica
HSDRLTSLFTFHLILLSIFSIT

SEQ ID NO: 2582088 - protein, 24 aa, Entamoeba histolytica
HSDVCGKLTDFGTCRNISERNRLN

SEQ ID NO: 2582089 - protein, 24 aa, Entamoeba histolytica
HSFAIALCYFIIPYFSANHDFRKL

SEQ ID NO: 2582090 - protein, 23 aa, Entamoeba histolytica
HSFCANHILAPFIWEPLLKNVIP

SEQ ID NO: 2582091 - protein, 24 aa, Entamoeba histolytica
HSIFEDWLLHASFIRYADSEESGY

SEQ ID NO: 2582092 - protein, 19 aa, Entamoeba histolytica
HSKIPPIIHRDLKSSNLLV

SEQ ID NO: 2582093 - protein, 31 aa, Entamoeba histolytica
HSLVSLTPILPCFICDGGLLILSRIPLKDRD

SEQ ID NO: 2582094 - protein, 25 aa, Entamoeba histolytica
HSRVFKRVILYYIIIILFFVFAFIM

SEQ ID NO: 2582095 - protein, 18 aa, Entamoeba histolytica
HSSIPPAPVVTGNESSPL

SEQ ID NO: 2582096 - protein, 24 aa, Entamoeba histolytica
HSSNCIYFREDIFRFENEQICSQW

SEQ ID NO: 2582097 - protein, 23 aa, Entamoeba histolytica
HSTKLKIGISLSDAYSGNTIKRT

SEQ ID NO: 2582098 - protein, 36 aa, Entamoeba histolytica
HSVELCFTRTKGCSVVEKYGYIFVFVLFFILLLPFL

SEQ ID NO: 2582099 - protein, 27 aa, Entamoeba histolytica
HSYPFCWRSDTPLIYRAIPSWFVNVES

SEQ ID NO: 2582100 - protein, 18 aa, Entamoeba histolytica
HTCNKCDNNVETICPMIT

SEQ ID NO: 2582101 - protein, 19 aa, Entamoeba histolytica
HTFVWPFYISMILSILLFF

SEQ ID NO: 2582102 - protein, 32 aa, Entamoeba histolytica; identical to SEQ ID NO: 2383677

SEQ ID NO: 2582103 - protein, 18 aa, Entamoeba histolytica
HTLGKLLVLTRWLGRNPV

SEQ ID NO: 2582104 - protein, 23 aa, Entamoeba histolytica
HTLQTIMCSLGFGVYSSPLILLA

SEQ ID NO: 2582105 - protein, 19 aa, Entamoeba histolytica
HTLSPEIIRNVMKCVNVII

SEQ ID NO: 2582106 - protein, 18 aa, Entamoeba histolytica
HTNQFINIHIFKSTVQPE

SEQ ID NO: 2582107 - protein, 18 aa, Entamoeba histolytica
HTPLTVFRYISGSVSFSY

SEQ ID NO: 2582108 - protein, 20 aa, Entamoeba histolytica
HTSIKMTIGPVIGLFVQIII

SEQ ID NO: 2582109 - protein, 29 aa, Entamoeba histolytica
HTVKIDLPKPILATWQFYVVLFTIIGVMT

SEQ ID NO: 2582110 - protein, 19 aa, Entamoeba histolytica
HTVQYPWNVINILKTSTLT

SEQ ID NO: 2582111 - protein, 19 aa, Entamoeba histolytica
HVFIPPSLYYDIDTPLEMM

SEQ ID NO: 2582112 - protein, 19 aa, Entamoeba histolytica
HVIHALAYYSTENNEIINP

SEQ ID NO: 2582113 - protein, 24 aa, Entamoeba histolytica
HVIIQWKSGILVYLEVSNEQNYIM

SEQ ID NO: 2582114 - protein, 18 aa, Entamoeba histolytica
HVLAGYRLPFPDFISPKM

SEQ ID NO: 2582115 - protein, 17 aa, Entamoeba histolytica
HVLKTGFAVNLYDPKTC

SEQ ID NO: 2582116 - protein, 17 aa, Entamoeba histolytica
HVLKTGFAVNLYDSKTC

SEQ ID NO: 2582117 - protein, 29 aa, Entamoeba histolytica
HVLSSAICAISFLVTRVQKLFTRYASSFL

SEQ ID NO: 2582118 - protein, 21 aa, Entamoeba histolytica
HVPLYINICVIIMCIIVFDII

SEQ ID NO: 2582119 - protein, 18 aa, Entamoeba histolytica
HVPYLFVIIYGLSFFFQN

SEQ ID NO: 2582120 - protein, 25 aa, Entamoeba histolytica
HVYESIEIVCKAALSLPPSDERQIQ

SEQ ID NO: 2582121 - protein, 17 aa, Entamoeba histolytica
HWGEKTIFVTSSHLFEN

SEQ ID NO: 2582122 - protein, 17 aa, Entamoeba histolytica
HYEHFYENFVEEVNLMK

SEQ ID NO: 2582123 - protein, 26 aa, Entamoeba histolytica
HYGTCNGHNGMFCAIDNSFGICSSNE

SEQ ID NO: 2582124 - protein, 19 aa, Entamoeba histolytica
HYHHFKFTGFFITGVISIL

SEQ ID NO: 2582125 - protein, 25 aa, Entamoeba histolytica
HYIRAESVLKLYALYNALGMLNSLL

SEQ ID NO: 2582126 - protein, 24 aa, Entamoeba histolytica
HYLAQNLTNIWAFSNEKKYDFVDS

SEQ ID NO: 2582127 - protein, 18 aa, Entamoeba histolytica
HYLICKKLIVIGLNSELP

SEQ ID NO: 2582128 - protein, 24 aa, Entamoeba histolytica
HYLPKDFDKGLGMKDGTAYLLSNK

SEQ ID NO: 2582129 - protein, 19 aa, Entamoeba histolytica
HYLPKDFDKGLSMTDGTAY

SEQ ID NO: 2582130 - protein, 23 aa, Entamoeba histolytica
HYMIVFSVLICYAVQDKKEVEVF

SEQ ID NO: 2582131 - protein, 18 aa, Entamoeba histolytica
HYTEYLIESGLCISMLLD

SEQ ID NO: 2582132 - protein, 22 aa, Entamoeba histolytica
HYTKNGKCFQCNEGYYIDKEKN

SEQ ID NO: 2582133 - protein, 17 aa, Entamoeba histolytica
HYVFTMYEILGRVVRLM

SEQ ID NO: 2582134 - protein, 25 aa, Entamoeba histolytica
HYYLKRFDSALQRILISTLFCCLIN

SEQ ID NO: 2582135 - protein, 18 aa, Entamoeba histolytica
HYYYDFMYAVLPFIPDIV

SEQ ID NO: 2582136 - protein, 17 aa, Entamoeba histolytica
IAANLSIQFRKDVLEQI

SEQ ID NO: 2582137 - protein, 30 aa, Entamoeba histolytica; identical to SEQ ID NO: 2383704

SEQ ID NO: 2582138 - protein, 19 aa, Entamoeba histolytica
IAAYFIRWVYNYHDVKDGF

SEQ ID NO: 2582139 - protein, 20 aa, Entamoeba histolytica
IACLCILSFIVVIFSKTRGS

SEQ ID NO: 2582140 - protein, 23 aa, Entamoeba histolytica
IADFLHKFHINFNLTFVQNLNIM

SEQ ID NO: 2582141 - protein, 17 aa, Entamoeba histolytica
IADICRIGFVLQAISGI

SEQ ID NO: 2582142 - protein, 19 aa, Entamoeba histolytica
IAEDCGFTYQELEEQPQEP

SEQ ID NO: 2582143 - protein, 18 aa, Entamoeba histolytica
IAESMVIPIVARLTSCLL

SEQ ID NO: 2582144 - protein, 17 aa, Entamoeba histolytica
IAFFIGMILFVVLEKLI

SEQ ID NO: 2582145 - protein, 19 aa, Entamoeba histolytica
IAFLLQILTGYFIYIIISK

SEQ ID NO: 2582146 - protein, 18 aa, Entamoeba histolytica
IAFSGLFLSAILMLNQFA

SEQ ID NO: 2582147 - protein, 17 aa, Entamoeba histolytica
IAGIAIYLFLFILVIIQ

SEQ ID NO: 2582148 - protein, 25 aa, Entamoeba histolytica
IAGLSRFSLTKVFCDIRPDYIIKSN

SEQ ID NO: 2582149 - protein, 19 aa, Entamoeba histolytica
IAGVPILVTINGYRYPRNE

SEQ ID NO: 2582150 - protein, 24 aa, Entamoeba histolytica
IAGVSVGMVFIRNGWVLCAFAVVI

SEQ ID NO: 2582151 - protein, 24 aa, Entamoeba histolytica
IAHDGRPKFDIILLNNLGLMTSVS

SEQ ID NO: 2582152 - protein, 25 aa, Entamoeba histolytica
IAIFVVICTCSYYLIIVVVLVLIAF

SEQ ID NO: 2582153 - protein, 27 aa, Entamoeba histolytica
IAIICVSVIVGILLILAIVLLAFIIYR

SEQ ID NO: 2582154 - protein, 24 aa, Entamoeba histolytica
IAIIIVFCIWFFKKPVEDKPQTYR

SEQ ID NO: 2582155 - protein, 17 aa, Entamoeba histolytica
IAIILSHLFVLMKRGFV

SEQ ID NO: 2582156 - protein, 24 aa, Entamoeba histolytica
IAIILSVICFYNFNFYNKSEKLII

SEQ ID NO: 2582157 - protein, 24 aa, Entamoeba histolytica
IAIIPRLIFDITMFIPIVAQTIMI

SEQ ID NO: 2582158 - protein, 19 aa, Entamoeba histolytica
IAIQPKWYIIGLLSPLFFS

SEQ ID NO: 2582159 - protein, 31 aa, Entamoeba histolytica
IAISNILFGFSFNYYFVVAMRLLNGMLNGTV

SEQ ID NO: 2582160 - protein, 19 aa, Entamoeba histolytica
IAIVICIAVTLTFISVIIS

SEQ ID NO: 2582161 - protein, 29 aa, Entamoeba histolytica
IAKHLNFFLKIIIKSLLFWMQKEDLFEKE

SEQ ID NO: 2582162 - protein, 26 aa, Entamoeba histolytica
IALCIMLPIIICMKDFKWTMDPTQCF

SEQ ID NO: 2582163 - protein, 27 aa, Entamoeba histolytica
IALDFCAILTWIFKRYRDTFIGLIEQE

SEQ ID NO: 2582164 - protein, 19 aa, Entamoeba histolytica
IALILLVAFILYAKLVLLK

SEQ ID NO: 2582165 - protein, 20 aa, Entamoeba histolytica
IALILLVAFILYAKLVLLKN

SEQ ID NO: 2582166 - protein, 25 aa, Entamoeba histolytica
IALLNKFGSFILERPIKRSKVTFQT

SEQ ID NO: 2582167 - protein, 17 aa, Entamoeba histolytica
IALMLRFFQVFWECSVT

SEQ ID NO: 2582168 - protein, 17 aa, Entamoeba histolytica
IALSRIIDVFGILLILI

SEQ ID NO: 2582169 - protein, 18 aa, Entamoeba histolytica
IALTFDFIVILASTVCYF

SEQ ID NO: 2582170 - protein, 19 aa, Entamoeba histolytica
IAMLICIGLCILSVVGTLI

SEQ ID NO: 2582171 - protein, 28 aa, Entamoeba histolytica
IAMNSFVKRMRWFPSFFFGYDQALMNVL

SEQ ID NO: 2582172 - protein, 30 aa, Entamoeba histolytica
IAPKYAYNFWICCLHFIGTPLISNNASVVE

SEQ ID NO: 2582173 - protein, 22 aa, Entamoeba histolytica
IAPTHFKGTFYLKNLATTSDVI

SEQ ID NO: 2582174 - protein, 18 aa, Entamoeba histolytica
IASIPKYIIVVFNSSQIL

SEQ ID NO: 2582175 - protein, 17 aa, Entamoeba histolytica
IASLSFLDRGSSYGKDS

SEQ ID NO: 2582176 - protein, 19 aa, Entamoeba histolytica
IASPLLKPSIDQLKSLEKD

SEQ ID NO: 2582177 - protein, 27 aa, Entamoeba histolytica
IATRTNKYLKSEIVSTLEDIKPPIPKA

SEQ ID NO: 2582178 - protein, 17 aa, Entamoeba histolytica
IAVVIASLFPNDFKMQQ

SEQ ID NO: 2582179 - protein, 18 aa, Entamoeba histolytica
IAVVLCFSLIKIQPSLEC

SEQ ID NO: 2582180 - protein, 24 aa, Entamoeba histolytica
IAYGGSLIFYFGWGFVYGLITWIP

SEQ ID NO: 2582181 - protein, 18 aa, Entamoeba histolytica
IAYIIVILFFNFAGTAVI

SEQ ID NO: 2582182 - protein, 24 aa, Entamoeba histolytica
IAYRCKRQDLIYGQQAQSMIGNQL

SEQ ID NO: 2582183 - protein, 20 aa, Entamoeba histolytica
IAYSCYGIYSTIYPPTNGYK

SEQ ID NO: 2582184 - protein, 21 aa, Entamoeba histolytica
IAYSDSYSFCSLLNKVMTNDD

SEQ ID NO: 2582185 - protein, 20 aa, Entamoeba histolytica
ICAATLRDGLNYQRVIIGAA

SEQ ID NO: 2582186 - protein, 18 aa, Entamoeba histolytica
ICAFKCSCKQSISKLGKL

SEQ ID NO: 2582187 - protein, 21 aa, Entamoeba histolytica
ICAIVLIVIVGIILLLTQYYS

SEQ ID NO: 2582188 - protein, 20 aa, Entamoeba histolytica
ICAKCSSLTCPADTTYRTYT

SEQ ID NO: 2582189 - protein, 20 aa, Entamoeba histolytica
ICESVKLVLRIASKKRESKY

SEQ ID NO: 2582190 - protein, 18 aa, Entamoeba histolytica
ICFALIILVSTGYPCNDF

SEQ ID NO: 2582191 - protein, 22 aa, Entamoeba histolytica
ICFVESRLLITLPKYLKNVRQI

SEQ ID NO: 2582192 - protein, 20 aa, Entamoeba histolytica
ICGKYPTSIDVEWYGTDTLG

SEQ ID NO: 2582193 - protein, 24 aa, Entamoeba histolytica
ICHCFKEFIENGLYVTDKPEDKTN

SEQ ID NO: 2582194 - protein, 24 aa, Entamoeba histolytica
ICHSELRTICNILKNTFGEDEEDI

SEQ ID NO: 2582195 - protein, 18 aa, Entamoeba histolytica
ICIDEWIRCHSFCPLCKV

SEQ ID NO: 2582196 - protein, 21 aa, Entamoeba histolytica
ICIFSLILMFYFYKHDILLSL

SEQ ID NO: 2582197 - protein, 21 aa, Entamoeba histolytica
ICIGIHFTLWWYNIIPSDPMY

SEQ ID NO: 2582198 - protein, 17 aa, Entamoeba histolytica
ICINCYNGFGISKDLKT

SEQ ID NO: 2582199 - protein, 24 aa, Entamoeba histolytica
ICKTMKHSFLIQGISLIQQENKYK

SEQ ID NO: 2582200 - protein, 20 aa, Entamoeba histolytica
ICLEPLGILVDYMGEGTLQN

SEQ ID NO: 2582201 - protein, 23 aa, Entamoeba histolytica
ICLLLHCFINYSFILLALTIAFF

SEQ ID NO: 2582202 - protein, 26 aa, Entamoeba histolytica
ICMKCATHFITPIPFFKIMAKDEYNP

SEQ ID NO: 2582203 - protein, 18 aa, Entamoeba histolytica
ICNCSLFNPTPSISAMLM

SEQ ID NO: 2582204 - protein, 17 aa, Entamoeba histolytica
ICNFLLSNVIVFKTLNY

SEQ ID NO: 2582205 - protein, 17 aa, Entamoeba histolytica
ICNFLSPHFDSHLTDLL

SEQ ID NO: 2582206 - protein, 20 aa, Entamoeba histolytica
ICQTCCLCLYAYSTTQGCVI

SEQ ID NO: 2582207 - protein, 21 aa, Entamoeba histolytica
ICRTKAIVIGAIYPSVRDPTL

SEQ ID NO: 2582208 - protein, 18 aa, Entamoeba histolytica
ICSFIVLTYFNWLETKQF

SEQ ID NO: 2582209 - protein, 27 aa, Entamoeba histolytica
ICSHHKRIIRELCRYVSPSLDNQKRRQ

SEQ ID NO: 2582210 - protein, 22 aa, Entamoeba histolytica
ICSLCLSAMIFCSVLPLLKNSA

SEQ ID NO: 2582211 - protein, 20 aa, Entamoeba histolytica
ICSLVDFLNSLSVCLGYISL

SEQ ID NO: 2582212 - protein, 28 aa, Entamoeba histolytica
ICSSLLVMLPICLITAELSSCLPSNGGL

SEQ ID NO: 2582213 - protein, 22 aa, Entamoeba histolytica
ICTGYLIGASMNFKSDETFIDF

SEQ ID NO: 2582214 - protein, 17 aa, Entamoeba histolytica
ICTIGYSTPTGMKCKKC

SEQ ID NO: 2582215 - protein, 18 aa, Entamoeba histolytica
ICVVIAVLIRLYSVLRYE

SEQ ID NO: 2582216 - protein, 25 aa, Entamoeba histolytica
ICWGLKLYFAYGFLMSIFIQITILL

SEQ ID NO: 2582217 - protein, 18 aa, Entamoeba histolytica
ICYLYYSYSFIKPDITPV

SEQ ID NO: 2582218 - protein, 17 aa, Entamoeba histolytica
ICYPVCIPNIIMKVILF

SEQ ID NO: 2582219 - protein, 24 aa, Entamoeba histolytica
ICYSNKEQIIFIGICNGSLIRLKE

SEQ ID NO: 2582220 - protein, 19 aa, Entamoeba histolytica
IDAFSRMKHCEGVKQSLAF

SEQ ID NO: 2582221 - protein, 21 aa, Entamoeba histolytica
IDAVASCHRAGITVRMVTGDN

SEQ ID NO: 2582222 - protein, 20 aa, Entamoeba histolytica
IDCLYFNAMKLIKSFATSSS

SEQ ID NO: 2582223 - protein, 17 aa, Entamoeba histolytica
IDCPCFGSDCSINTSVK

SEQ ID NO: 2582224 - protein, 26 aa, Entamoeba histolytica
IDCQPKEKFTPCGTMLFQILIQSENG

SEQ ID NO: 2582225 - protein, 21 aa, Entamoeba histolytica
IDCTVFRPWHISTEMIGKMPP

SEQ ID NO: 2582226 - protein, 17 aa, Entamoeba histolytica
IDDIKMRALQIIMSSTL

SEQ ID NO: 2582227 - protein, 17 aa, Entamoeba histolytica
IDECIKMAELFINRGIK

SEQ ID NO: 2582228 - protein, 24 aa, Entamoeba histolytica
IDEIKIQLPFPLTDKHHLLFHIKD

SEQ ID NO: 2582229 - protein, 23 aa, Entamoeba histolytica
IDEPYFRGCYPCDPGTYRDEQLI

SEQ ID NO: 2582230 - protein, 23 aa, Entamoeba histolytica
IDESCSFKEIYVGIINITKENNI

SEQ ID NO: 2582231 - protein, 17 aa, Entamoeba histolytica
IDFCRRVNRLLFPEFII

SEQ ID NO: 2582232 - protein, 21 aa, Entamoeba histolytica
IDFEIKKGVTYYILVKLVNPD

SEQ ID NO: 2582233 - protein, 24 aa, Entamoeba histolytica
IDFEPFRWLFTLPLSGVTTTLSPF

SEQ ID NO: 2582234 - protein, 17 aa, Entamoeba histolytica
IDFIRDLHQFVYFYEIN

SEQ ID NO: 2582235 - protein, 19 aa, Entamoeba histolytica
IDFQVKWLIVIACFVGAHA

SEQ ID NO: 2582236 - protein, 17 aa, Entamoeba histolytica
IDFSVPTLSSFVVLPNE

SEQ ID NO: 2582237 - protein, 17 aa, Entamoeba histolytica
IDFYCGECNKLLTQIDN

SEQ ID NO: 2582238 - protein, 18 aa, Entamoeba histolytica
IDGDWKYYLDPSLSVIVA

SEQ ID NO: 2582239 - protein, 31 aa, Entamoeba histolytica; identical to SEQ ID NO: 2383817

SEQ ID NO: 2582240 - protein, 18 aa, Entamoeba histolytica
IDGYILNDRVCTLCGNGK

SEQ ID NO: 2582241 - protein, 23 aa, Entamoeba histolytica
IDHIPRLDAPIVDNAYIKDNVQF

SEQ ID NO: 2582242 - protein, 23 aa, Entamoeba histolytica
IDHRCIYCVSKNLPIQVHTEKDY

SEQ ID NO: 2582243 - protein, 17 aa, Entamoeba histolytica
IDHYSWISNFLTKSEAF

SEQ ID NO: 2582244 - protein, 24 aa, Entamoeba histolytica
IDIDRVVRFLVHIFDLIDIPVSLI

SEQ ID NO: 2582245 - protein, 23 aa, Entamoeba histolytica
IDIKYKEFYVFATSYTIYMPAQY

SEQ ID NO: 2582246 - protein, 20 aa, Entamoeba histolytica
IDILKVCAMCNNSSTKVNEK

SEQ ID NO: 2582247 - protein, 17 aa, Entamoeba histolytica
IDIPPFYLGISATNGGS

SEQ ID NO: 2582248 - protein, 24 aa, Entamoeba histolytica
IDIPRLAPKVQVFKDSLLVVSGPK

SEQ ID NO: 2582249 - protein, 17 aa, Entamoeba histolytica
IDIPRLVSKLTVIEENN

SEQ ID NO: 2582250 - protein, 20 aa, Entamoeba histolytica
IDISLCHDIKFEVQYLNFWV

SEQ ID NO: 2582251 - protein, 20 aa, Entamoeba histolytica
IDKIKGCFNIFTANDCVFGI

SEQ ID NO: 2582252 - protein, 20 aa, Entamoeba histolytica
IDKKRLSNIFSEVLEHKEEL

SEQ ID NO: 2582253 - protein, 24 aa, Entamoeba histolytica
IDKQIYLPFILKRIRELANTYLAL

SEQ ID NO: 2582254 - protein, 18 aa, Entamoeba histolytica
IDKYCCKKKGSGYNDFNV

SEQ ID NO: 2582255 - protein, 31 aa, Entamoeba histolytica
IDLFHAIKMIRLDIIFILLALMFGWFAFQPF

SEQ ID NO: 2582256 - protein, 19 aa, Entamoeba histolytica
IDLLWSMKNIIHIQYNKQK

SEQ ID NO: 2582257 - protein, 24 aa, Entamoeba histolytica
IDLRAQKGIKMQLERRWDNNSFCR

SEQ ID NO: 2582258 - protein, 26 aa, Entamoeba histolytica
IDLSELIVNWERFRVKKEGLKPLSEA

SEQ ID NO: 2582259 - protein, 25 aa, Entamoeba histolytica
IDMGGLRKEWLRVIATSMFNADYLL

SEQ ID NO: 2582260 - protein, 18 aa, Entamoeba histolytica
IDMVMDWYAFGGKMDIIG

SEQ ID NO: 2582261 - protein, 24 aa, Entamoeba histolytica
IDNITCLNFKLDSVLVQSDINSIN

SEQ ID NO: 2582262 - protein, 23 aa, Entamoeba histolytica
IDNKTRLRYWLTMANPEQYTIKN

SEQ ID NO: 2582263 - protein, 20 aa, Entamoeba histolytica
IDNLPILPIQSFSEACNEIC

SEQ ID NO: 2582264 - protein, 17 aa, Entamoeba histolytica
IDNNKRYCIKYYSDSKC

SEQ ID NO: 2582265 - protein, 24 aa, Entamoeba histolytica
IDNYEFPAILLIVFSYSLMNKKLQ

SEQ ID NO: 2582266 - protein, 18 aa, Entamoeba histolytica
IDPIKFLLSFAKKYGSYI

SEQ ID NO: 2582267 - protein, 20 aa, Entamoeba histolytica
IDPKCAYCNVLSNSSLNHCF

SEQ ID NO: 2582268 - protein, 23 aa, Entamoeba histolytica
IDPSGKFAVVFCIKTQYFHFIDL

SEQ ID NO: 2582269 - protein, 19 aa, Entamoeba histolytica
IDQAIPIQPFQVIRTNNIL

SEQ ID NO: 2582270 - protein, 21 aa, Entamoeba histolytica
IDQKNNFYVRRCCGGNTKMML

SEQ ID NO: 2582271 - protein, 17 aa, Entamoeba histolytica
IDRPERDNLVILSDEKV

SEQ ID NO: 2582272 - protein, 24 aa, Entamoeba histolytica
IDRQELYPRIILNEGNGTSEDGMK

SEQ ID NO: 2582273 - protein, 18 aa, Entamoeba histolytica
IDSAIEWLFNSCDIPKPE

SEQ ID NO: 2582274 - protein, 18 aa, Entamoeba histolytica
IDSCNIIDCIAKECNADK

SEQ ID NO: 2582275 - protein, 19 aa, Entamoeba histolytica
IDSQLIMFCCGHKYHRDCI

SEQ ID NO: 2582276 - protein, 19 aa, Entamoeba histolytica
IDSVISYILSISWSSVLYL

SEQ ID NO: 2582277 - protein, 18 aa, Entamoeba histolytica
IDSYGGYFTKTISNSQLG

SEQ ID NO: 2582278 - protein, 19 aa, Entamoeba histolytica
IDVLLCWVSYFKKVDSLRV

SEQ ID NO: 2582279 - protein, 19 aa, Entamoeba histolytica
IDVSDEFTSQLGLMDRSWV

SEQ ID NO: 2582280 - protein, 28 aa, Entamoeba histolytica
IDYYEEAARLFVLISIRIPDLYESILET

SEQ ID NO: 2582281 - protein, 31 aa, Entamoeba histolytica
IDYYRYTSNLAFDFVYLLPFTINIDNDKKMY

SEQ ID NO: 2582282 - protein, 18 aa, Entamoeba histolytica
IEAILKILIENSSMSTDI

SEQ ID NO: 2582283 - protein, 18 aa, Entamoeba histolytica
IECECQPGWYSKHSSDCR

SEQ ID NO: 2582284 - protein, 17 aa, Entamoeba histolytica
IECSLSGCTTCKKGNYL

SEQ ID NO: 2582285 - protein, 18 aa, Entamoeba histolytica
IECTISGCIQCKSNNILS

SEQ ID NO: 2582286 - protein, 23 aa, Entamoeba histolytica
IEDCIYDYLRIMRYMTLSTRSAS

SEQ ID NO: 2582287 - protein, 17 aa, Entamoeba histolytica
IEDTEWIIGVTVYIGNE

SEQ ID NO: 2582288 - protein, 24 aa, Entamoeba histolytica
IEECPRLTDVVSFIEGRPSFSSIA

SEQ ID NO: 2582289 - protein, 18 aa, Entamoeba histolytica
IEECVEMCWKNAKENRPS

SEQ ID NO: 2582290 - protein, 23 aa, Entamoeba histolytica
IEEVKKLEIEMMKLYDTKIQDIQ

SEQ ID NO: 2582291 - protein, 19 aa, Entamoeba histolytica
IEEYEFFKKWHSINLETLE

SEQ ID NO: 2582292 - protein, 22 aa, Entamoeba histolytica
IEEYKYPLTYGSVVFIASIPKY

SEQ ID NO: 2582293 - protein, 17 aa, Entamoeba histolytica
IEFEIDKLLGIHTTEEV

SEQ ID NO: 2582294 - protein, 24 aa, Entamoeba histolytica
IEFIPDLFNIPDFVDLTSKQVQSI

SEQ ID NO: 2582295 - protein, 21 aa, Entamoeba histolytica
IEFSNGCMLIECESLQQGEAH

SEQ ID NO: 2582296 - protein, 20 aa, Entamoeba histolytica
IEFTKCWDLALVVLATVPFS

SEQ ID NO: 2582297 - protein, 23 aa, Entamoeba histolytica
IEFYCRPWFNSCMMVNVLYFIFF

SEQ ID NO: 2582298 - protein, 24 aa, Entamoeba histolytica
IEGCKRMRGRLLASYIKAAGQVIS

SEQ ID NO: 2582299 - protein, 25 aa, Entamoeba histolytica
IEGCKRMRGRLLASYIKAAGQVISV

SEQ ID NO: 2582300 - protein, 20 aa, Entamoeba histolytica
IEGCSSCIFNSISDIKCAAC

SEQ ID NO: 2582301 - protein, 24 aa, Entamoeba histolytica
IEGFDKLSQCVRVMKNYCISERVI

SEQ ID NO: 2582302 - protein, 22 aa, Entamoeba histolytica
IEGKCPKEYIPTVFENSTKTLK

SEQ ID NO: 2582303 - protein, 18 aa, Entamoeba histolytica
IEGLPGIVAKKILIVVKY

SEQ ID NO: 2582304 - protein, 24 aa, Entamoeba histolytica
IEHLPKWNKMILGIVLAIIAGIMY

SEQ ID NO: 2582305 - protein, 21 aa, Entamoeba histolytica
IEICSCIWYIASYIPYAQTCL

SEQ ID NO: 2582306 - protein, 23 aa, Entamoeba histolytica
IEIDGSGILSFLSPFKNFITTGI

SEQ ID NO: 2582307 - protein, 20 aa, Entamoeba histolytica
IEIEGIIGIHELEKSNCLIV

SEQ ID NO: 2582308 - protein, 21 aa, Entamoeba histolytica
IEIIKAMYFKNDFFEDHFFEN

SEQ ID NO: 2582309 - protein, 22 aa, Entamoeba histolytica
IEILKKAGIVISMLTGDMKETA

SEQ ID NO: 2582310 - protein, 24 aa, Entamoeba histolytica
IEIPQLIEIVTMYFIQIRKLIPSD

SEQ ID NO: 2582311 - protein, 21 aa, Entamoeba histolytica
IEISSLFATLVAIFKKYITFI

SEQ ID NO: 2582312 - protein, 20 aa, Entamoeba histolytica
IEIYDRYGIELFEESIGKNN

SEQ ID NO: 2582313 - protein, 17 aa, Entamoeba histolytica
IEKEYAYVVTVLITLCV

SEQ ID NO: 2582314 - protein, 20 aa, Entamoeba histolytica
IEKMNCKWYVVIKIIITKVL

SEQ ID NO: 2582315 - protein, 20 aa, Entamoeba histolytica
IEKPKLVETCFSFFQRTKND

SEQ ID NO: 2582316 - protein, 20 aa, Entamoeba histolytica
IEKQIKWIKKGFYSLIDEST

SEQ ID NO: 2582317 - protein, 32 aa, Entamoeba histolytica
IEKSSCIVRFLFNIAFQFKKKFYVDYQLRPRY

SEQ ID NO: 2582318 - protein, 18 aa, Entamoeba histolytica
IELAKICPVSIVCYEETQ

SEQ ID NO: 2582319 - protein, 19 aa, Entamoeba histolytica
IELFIKLVNQIIALYATLQ

SEQ ID NO: 2582320 - protein, 24 aa, Entamoeba histolytica
IELIPEFFFLPQFLINFNTIDFGK

SEQ ID NO: 2582321 - protein, 17 aa, Entamoeba histolytica
IELLGKWAKEDFASKKR

SEQ ID NO: 2582322 - protein, 25 aa, Entamoeba histolytica
IELLKETLAFDVIEKFVQLLSPEMT

SEQ ID NO: 2582323 - protein, 17 aa, Entamoeba histolytica
IELLLKNKTIETWTQNN

SEQ ID NO: 2582324 - protein, 17 aa, Entamoeba histolytica
IELLSVFFSGLEQTHLS

SEQ ID NO: 2582325 - protein, 18 aa, Entamoeba histolytica
IELNGEIKYGDWKLIKVM

SEQ ID NO: 2582326 - protein, 20 aa, Entamoeba histolytica
IEMVHLYLVIEIIRTINGWT

SEQ ID NO: 2582327 - protein, 18 aa, Entamoeba histolytica
IENCIKRNPHNTLIDEGN

SEQ ID NO: 2582328 - protein, 17 aa, Entamoeba histolytica
IENGGSYLLDIASSCSG

SEQ ID NO: 2582329 - protein, 19 aa, Entamoeba histolytica
IENIYKLWEGNGMGYMIMK

SEQ ID NO: 2582330 - protein, 25 aa, Entamoeba histolytica
IENLLRFIVHLYFPITKKYMNDILF

SEQ ID NO: 2582331 - protein, 17 aa, Entamoeba histolytica
IENLRKGKLENIEYISA

SEQ ID NO: 2582332 - protein, 19 aa, Entamoeba histolytica
IEPLKGCLDKILKLTGKSF

SEQ ID NO: 2582333 - protein, 25 aa, Entamoeba histolytica
IEPLQRRLFIVILMNVALIGMLIYL

SEQ ID NO: 2582334 - protein, 23 aa, Entamoeba histolytica
IEQKKIFISFLFDGIRSQSISQF

SEQ ID NO: 2582335 - protein, 18 aa, Entamoeba histolytica
IEQSPTIMVVDLFDYFAV

SEQ ID NO: 2582336 - protein, 26 aa, Entamoeba histolytica
IEQYPLKWLDWLLILIAVLVHFVICE

SEQ ID NO: 2582337 - protein, 17 aa, Entamoeba histolytica
IERKYTRFLMTFMIQLH

SEQ ID NO: 2582338 - protein, 21 aa, Entamoeba histolytica
IERLIEWAKELELIDEKEINK

SEQ ID NO: 2582339 - protein, 19 aa, Entamoeba histolytica
IERLIEWGREITPINIDTS

SEQ ID NO: 2582340 - protein, 29 aa, Entamoeba histolytica
IERRARKVVFCAAHSLPITYRILDSFFED

SEQ ID NO: 2582341 - protein, 19 aa, Entamoeba histolytica
IESCTPPALNSAIVVNIVY

SEQ ID NO: 2582342 - protein, 21 aa, Entamoeba histolytica
IESIPFTKMVALPFEIENYCS

SEQ ID NO: 2582343 - protein, 25 aa, Entamoeba histolytica
IESISRRLLLMIFERINFDELFFEC

SEQ ID NO: 2582344 - protein, 22 aa, Entamoeba histolytica
IESLIEWAKELELIDEKEINKL

SEQ ID NO: 2582345 - protein, 20 aa, Entamoeba histolytica
IESLTFINYVMKEVINEKGK

SEQ ID NO: 2582346 - protein, 21 aa, Entamoeba histolytica
IESLYVIFFFILKNLRETTIQ

SEQ ID NO: 2582347 - protein, 32 aa, Entamoeba histolytica
IESNEFLMILLLRLSPLFPFPISNYVLGPFCS

SEQ ID NO: 2582348 - protein, 22 aa, Entamoeba histolytica
IESPNCMRIFKGITIATASLCA

SEQ ID NO: 2582349 - protein, 17 aa, Entamoeba histolytica
IESSFQCAYSLIDIKHQ

SEQ ID NO: 2582350 - protein, 19 aa, Entamoeba histolytica
IESVLRYYIKINNGLISLF

SEQ ID NO: 2582351 - protein, 26 aa, Entamoeba histolytica
IETKEFPMYMIAVIVVFVLVLVVVAV

SEQ ID NO: 2582352 - protein, 24 aa, Entamoeba histolytica
IETMKMIAKRGIQIEEHFHIKGIE

SEQ ID NO: 2582353 - protein, 20 aa, Entamoeba histolytica
IEVDVSYVFQHRSLHSQEPQ

SEQ ID NO: 2582354 - protein, 17 aa, Entamoeba histolytica
IEVFKQYIYFISIPTFP

SEQ ID NO: 2582355 - protein, 30 aa, Entamoeba histolytica
IEVFKYSCAKFIDFWGLFICCVVIAIAAFY

SEQ ID NO: 2582356 - protein, 19 aa, Entamoeba histolytica
IEVFPKMKLMKHPRNPTEI

SEQ ID NO: 2582357 - protein, 20 aa, Entamoeba histolytica
IEVIQFFTIEALNIIDYYPV

SEQ ID NO: 2582358 - protein, 20 aa, Entamoeba histolytica
IEVKDCDAFLSFAGRKEVLI

SEQ ID NO: 2582359 - protein, 26 aa, Entamoeba histolytica
IEVPSLFKDQCDILRLDIVSEEGHQL

SEQ ID NO: 2582360 - protein, 27 aa, Entamoeba histolytica
IEVSNCFSCILAAVTINMIIRISSERT

SEQ ID NO: 2582361 - protein, 17 aa, Entamoeba histolytica
IEVYNPLTLDKINEITI

SEQ ID NO: 2582362 - protein, 21 aa, Entamoeba histolytica
IEYERYIIFIIFSLSKQCSEF

SEQ ID NO: 2582363 - protein, 26 aa, Entamoeba histolytica
IEYFILRPLFHSVLPFSLPKLRRREK

SEQ ID NO: 2582364 - protein, 17 aa, Entamoeba histolytica
IEYGDWKIIKVMSNEKQ

SEQ ID NO: 2582365 - protein, 17 aa, Entamoeba histolytica
IFALCVCDDTFPMRESF

SEQ ID NO: 2582366 - protein, 17 aa, Entamoeba histolytica
IFDTRFEKITIKNYSNN

SEQ ID NO: 2582367 - protein, 18 aa, Entamoeba histolytica
IFEDVCKGLEFLYQNKQI

SEQ ID NO: 2582368 - protein, 27 aa, Entamoeba histolytica
IFEECIKMGIEIIGIIYNITRSTKDRD

SEQ ID NO: 2582369 - protein, 17 aa, Entamoeba histolytica
IFEFCYPENIVGKQKER

SEQ ID NO: 2582370 - protein, 24 aa, Entamoeba histolytica
IFEVLKRLLVNYIQQSEINDNNPK

SEQ ID NO: 2582371 - protein, 23 aa, Entamoeba histolytica
IFFFSACFSLLFFYCKNRFGWFV

SEQ ID NO: 2582372 - protein, 18 aa, Entamoeba histolytica
IFGILFLVFHILEFSYVA

SEQ ID NO: 2582373 - protein, 17 aa, Entamoeba histolytica
IFGLRISPLPKQENTNP

SEQ ID NO: 2582374 - protein, 23 aa, Entamoeba histolytica
IFICFLMFYVLIMFDALRKPIRQ

SEQ ID NO: 2582375 - protein, 19 aa, Entamoeba histolytica
IFIETFKRKLIINFNNKMI

SEQ ID NO: 2582376 - protein, 19 aa, Entamoeba histolytica
IFIIGVWIWYLRRPYPVYL

SEQ ID NO: 2582377 - protein, 24 aa, Entamoeba histolytica
IFIKSCLKSILAINRYTVCNWLVL

SEQ ID NO: 2582378 - protein, 36 aa, Entamoeba histolytica
IFILPKLPGVWFYCWGITCALWFSTFQNKNELKYTM

SEQ ID NO: 2582379 - protein, 18 aa, Entamoeba histolytica
IFILYWIFLIITGLFIGL

SEQ ID NO: 2582380 - protein, 25 aa, Entamoeba histolytica
IFISVIVFCCLLALIIGLAVGLSKN

SEQ ID NO: 2582381 - protein, 22 aa, Entamoeba histolytica
IFKEGRCLLYPLFEKSNKLKES

SEQ ID NO: 2582382 - protein, 18 aa, Entamoeba histolytica
IFKSCPLLSPTTEIKSTC

SEQ ID NO: 2582383 - protein, 17 aa, Entamoeba histolytica
IFLCFLSYIHPIHSPLC

SEQ ID NO: 2582384 - protein, 20 aa, Entamoeba histolytica
IFLCYNIPIIIFVFYFWIIN

SEQ ID NO: 2582385 - protein, 34 aa, Entamoeba histolytica
IFLEKSSRVFGFFPLEFFGPPIVVLFMAISFTIF

SEQ ID NO: 2582386 - protein, 18 aa, Entamoeba histolytica
IFLHLCFDVLTLKATDSK

SEQ ID NO: 2582387 - protein, 25 aa, Entamoeba histolytica
IFLHMINCIMYSYPTIFEFTPYLLS

SEQ ID NO: 2582388 - protein, 19 aa, Entamoeba histolytica
IFLLMAVYVGVYFSGYMVS

SEQ ID NO: 2582389 - protein, 26 aa, Entamoeba histolytica
IFLRFRYSHELEIWYAFSQKSMKIPF

SEQ ID NO: 2582390 - protein, 22 aa, Entamoeba histolytica
IFLVIRNVFGINIFEVHQVVLP

SEQ ID NO: 2582391 - protein, 24 aa, Entamoeba histolytica
IFMMSCIVTIPWIIFYFIIEKQYE

SEQ ID NO: 2582392 - protein, 18 aa, Entamoeba histolytica
IFNLIPFSLIYDVINIVL

SEQ ID NO: 2582393 - protein, 21 aa, Entamoeba histolytica
IFNRIEIMAQLVIPEMVIQMC

SEQ ID NO: 2582394 - protein, 20 aa, Entamoeba histolytica
IFNSILKFFGVRDHNKLTTA

SEQ ID NO: 2582395 - protein, 18 aa, Entamoeba histolytica
IFNSLDLFKERRANKLIV

SEQ ID NO: 2582396 - protein, 26 aa, Entamoeba histolytica
IFPHKYCWREGDDLYINIKGCEFFTH

SEQ ID NO: 2582397 - protein, 24 aa, Entamoeba histolytica
IFPKLIKHWLFWYIFSMIIFVFSV

SEQ ID NO: 2582398 - protein, 26 aa, Entamoeba histolytica
IFPSHDFLKHICIVWNKCYYYISDRQ

SEQ ID NO: 2582399 - protein, 27 aa, Entamoeba histolytica
IFPSHDFLKHICIVWNKCYYYISDRQL

SEQ ID NO: 2582400 - protein, 25 aa, Entamoeba histolytica
IFQAICIAVIILCTVYQPFYEGKNF

SEQ ID NO: 2582401 - protein, 28 aa, Entamoeba histolytica
IFQILNYFRRLCVHPMLVLDDQHPMKQK

SEQ ID NO: 2582402 - protein, 20 aa, Entamoeba histolytica
IFQNCPYNGMRVSLEQLGGN

SEQ ID NO: 2582403 - protein, 18 aa, Entamoeba histolytica
IFREILWAVSNFAGDELV

SEQ ID NO: 2582404 - protein, 24 aa, Entamoeba histolytica
IFRIFTPKVCFDAAITVVVDVIVF

SEQ ID NO: 2582405 - protein, 27 aa, Entamoeba histolytica
IFRIFTPKVCFDISFCIVTDIMIVIGY

SEQ ID NO: 2582406 - protein, 23 aa, Entamoeba histolytica
IFRYSSFYISFMVNKRCFIVGVI

SEQ ID NO: 2582407 - protein, 20 aa, Entamoeba histolytica
IFSFSILMYETFKWDRPYPE

SEQ ID NO: 2582408 - protein, 30 aa, Entamoeba histolytica
IFSFSIVLYEIWKWDKAYPVEEFKFPWKIA

SEQ ID NO: 2582409 - protein, 18 aa, Entamoeba histolytica
IFSIAIYFISFFVLKSYF

SEQ ID NO: 2582410 - protein, 24 aa, Entamoeba histolytica
IFSIRYSNIHFYKFNNYSPLVFDK

SEQ ID NO: 2582411 - protein, 17 aa, Entamoeba histolytica
IFSKSVIKQQTFVRKRL

SEQ ID NO: 2582412 - protein, 31 aa, Entamoeba histolytica; identical to SEQ ID NO: 2384038

SEQ ID NO: 2582413 - protein, 24 aa, Entamoeba histolytica
IFSNIFCRNMLLLLSRSTKTAKYA

SEQ ID NO: 2582414 - protein, 19 aa, Entamoeba histolytica
IFSNPRCTLYGNGMTITFF

SEQ ID NO: 2582415 - protein, 23 aa, Entamoeba histolytica
IFSSLCLIGIIPFLFIKMNVLPE

SEQ ID NO: 2582416 - protein, 31 aa, Entamoeba histolytica
IFTARADILPFNWISELPLNMKNLEIPTEYI

SEQ ID NO: 2582417 - protein, 26 aa, Entamoeba histolytica
IFTHEDLDVILSFCLCINATIDQNIK

SEQ ID NO: 2582418 - protein, 21 aa, Entamoeba histolytica
IFTLGCLFYYIATRKHPYGNS

SEQ ID NO: 2582419 - protein, 19 aa, Entamoeba histolytica
IFTSIPLCSLQTFFPPMLP

SEQ ID NO: 2582420 - protein, 24 aa, Entamoeba histolytica
IFTSNGYGAIRWDGSPVEANYYNQ

SEQ ID NO: 2582421 - protein, 22 aa, Entamoeba histolytica
IFTSNIFYDFGILYGPTGLFWS

SEQ ID NO: 2582422 - protein, 18 aa, Entamoeba histolytica
IFVLGLLGVIGYIFYFSL

SEQ ID NO: 2582423 - protein, 17 aa, Entamoeba histolytica
IFVVSKGLEPIEVATEE

SEQ ID NO: 2582424 - protein, 25 aa, Entamoeba histolytica
IFYKGCSGSLIPKIEQCEITKSTSI

SEQ ID NO: 2582425 - protein, 18 aa, Entamoeba histolytica
IFYVLGLLLQFIMILIDR

SEQ ID NO: 2582426 - protein, 23 aa, Entamoeba histolytica
IGACVYLFIYIVGFIICLLLFFR

SEQ ID NO: 2582427 - protein, 36 aa, Entamoeba histolytica; identical to SEQ ID NO: 2384059

SEQ ID NO: 2582428 - protein, 25 aa, Entamoeba histolytica
IGASACLICPIGTYSKGEKNTYCKQ

SEQ ID NO: 2582429 - protein, 26 aa, Entamoeba histolytica
IGASIPCFIAKYFLQNTIKSYLHDHS

SEQ ID NO: 2582430 - protein, 22 aa, Entamoeba histolytica
IGCARSLLLNKCENIEFEIYGD

SEQ ID NO: 2582431 - protein, 24 aa, Entamoeba histolytica
IGCIRISPEGSFVFERESKLGLIV

SEQ ID NO: 2582432 - protein, 18 aa, Entamoeba histolytica
IGCKNGLYNRIVLNESQI

SEQ ID NO: 2582433 - protein, 23 aa, Entamoeba histolytica
IGCNWLVCCAVYFSASAKDLLSK

SEQ ID NO: 2582434 - protein, 19 aa, Entamoeba histolytica
IGCSKCLDGYYVYDSYCFN

SEQ ID NO: 2582435 - protein, 18 aa, Entamoeba histolytica
IGEGERWYDIELRKKESL

SEQ ID NO: 2582436 - protein, 25 aa, Entamoeba histolytica
IGEKLRIVISVIFFFISCFFDIPRI

SEQ ID NO: 2582437 - protein, 18 aa, Entamoeba histolytica
IGETKVAMNWGRALLSGI

SEQ ID NO: 2582438 - protein, 23 aa, Entamoeba histolytica
IGFFIVGLIFQLLAETSMFVDAI

SEQ ID NO: 2582439 - protein, 25 aa, Entamoeba histolytica
IGFNELRMKVGLREEGEQLPLIMPI

SEQ ID NO: 2582440 - protein, 21 aa, Entamoeba histolytica
IGFTKCWDLALVVLATVPFSS

SEQ ID NO: 2582441 - protein, 24 aa, Entamoeba histolytica
IGFVAWCLATIVYFVITWNYFNRA

SEQ ID NO: 2582442 - protein, 17 aa, Entamoeba histolytica
IGFWLWAYYLSYLRYAF

SEQ ID NO: 2582443 - protein, 21 aa, Entamoeba histolytica
IGGAICAFGLFAHQNPWITKK

SEQ ID NO: 2582444 - protein, 26 aa, Entamoeba histolytica
IGGCSLCKDGYFLNEFDCIKCPIECK

SEQ ID NO: 2582445 - protein, 25 aa, Entamoeba histolytica
IGGCVLSSLIIGFGIYGYTFIDTKV

SEQ ID NO: 2582446 - protein, 25 aa, Entamoeba histolytica
IGGCVLSSLIIGFGIYGYTFLGNIK

SEQ ID NO: 2582447 - protein, 24 aa, Entamoeba histolytica
IGGICYVYSFFLFKRKDWDYTGKH

SEQ ID NO: 2582448 - protein, 18 aa, Entamoeba histolytica
IGGVCSSKFQECLCEKNF

SEQ ID NO: 2582449 - protein, 19 aa, Entamoeba histolytica
IGHWKSILNAYKFDGRSCV

SEQ ID NO: 2582450 - protein, 19 aa, Entamoeba histolytica
IGIAAACKVGFENESQQEK

SEQ ID NO: 2582451 - protein, 24 aa, Entamoeba histolytica
IGIDYRKVFNFVVGLLNYIFSCVD

SEQ ID NO: 2582452 - protein, 25 aa, Entamoeba histolytica
IGIDYRKVFNFVVGLLNYIFSCVDG

SEQ ID NO: 2582453 - protein, 20 aa, Entamoeba histolytica
IGIFLFCYGSDLLAKFHINK

SEQ ID NO: 2582454 - protein, 20 aa, Entamoeba histolytica
IGIIILIWALYYLRKQRTIP

SEQ ID NO: 2582455 - protein, 20 aa, Entamoeba histolytica
IGIKCPSSLNPEWEDISHTI

SEQ ID NO: 2582456 - protein, 19 aa, Entamoeba histolytica
IGILLAWIFRVNKIEKDDI

SEQ ID NO: 2582457 - protein, 22 aa, Entamoeba histolytica
IGIRLISVGFSFIVTGIIGVIS

SEQ ID NO: 2582458 - protein, 19 aa, Entamoeba histolytica
IGISLNFCIESIFMLINIY

SEQ ID NO: 2582459 - protein, 17 aa, Entamoeba histolytica
IGKEFKCISDESLSDNS

SEQ ID NO: 2582460 - protein, 17 aa, Entamoeba histolytica
IGKELHAALTIECESCN

SEQ ID NO: 2582461 - protein, 22 aa, Entamoeba histolytica
IGKKGISQSINWIASAFKTVNI

SEQ ID NO: 2582462 - protein, 19 aa, Entamoeba histolytica
IGKYFKVITEYSLENGEFI

SEQ ID NO: 2582463 - protein, 23 aa, Entamoeba histolytica
IGLGVMCAFSFGVYFAVTYGSFV

SEQ ID NO: 2582464 - protein, 31 aa, Entamoeba histolytica
IGLIGKIMCNLCGIESLCLPIFMNLYNNIME

SEQ ID NO: 2582465 - protein, 20 aa, Entamoeba histolytica
IGLKCPHAQFTLAKSTESDY

SEQ ID NO: 2582466 - protein, 21 aa, Entamoeba histolytica
IGLNGWEVIELCNYLRVLHDV

SEQ ID NO: 2582467 - protein, 17 aa, Entamoeba histolytica
IGLNQTIKGFFNSLIID

SEQ ID NO: 2582468 - protein, 25 aa, Entamoeba histolytica
IGLRSAMVTMMICANSCFFLPFGYQ

SEQ ID NO: 2582469 - protein, 17 aa, Entamoeba histolytica
IGLSLAVSVIPEGLVAV

SEQ ID NO: 2582470 - protein, 24 aa, Entamoeba histolytica
IGLTRYAFCFSKLRIQRDETNPLV

SEQ ID NO: 2582471 - protein, 17 aa, Entamoeba histolytica
IGLYWCVPVITFPIIIG

SEQ ID NO: 2582472 - protein, 19 aa, Entamoeba histolytica
IGMVFFILVIGFIFIMFRP

SEQ ID NO: 2582473 - protein, 18 aa, Entamoeba histolytica
IGNIFPSLIPLLSTTERE

SEQ ID NO: 2582474 - protein, 20 aa, Entamoeba histolytica
IGNLTLWDPSLIKIYGKSVK

SEQ ID NO: 2582475 - protein, 22 aa, Entamoeba histolytica
IGNTKFKIGIIGDVTEYENNAK

SEQ ID NO: 2582476 - protein, 20 aa, Entamoeba histolytica
IGPTMSFAMFLTMVLTEQEF

SEQ ID NO: 2582477 - protein, 24 aa, Entamoeba histolytica
IGQFKFNKCVIFKYNNKNNDTRYM

SEQ ID NO: 2582478 - protein, 22 aa, Entamoeba histolytica
IGRILIPYWIFLILIGCISGIV

SEQ ID NO: 2582479 - protein, 19 aa, Entamoeba histolytica
IGRIRRRFYYSIMHQNVSW

SEQ ID NO: 2582480 - protein, 29 aa, Entamoeba histolytica
IGRMKFRPSRPHFVELISFEDQNISADIC

SEQ ID NO: 2582481 - protein, 24 aa, Entamoeba histolytica
IGRNTEYYDWFLINIILHPQNVYE

SEQ ID NO: 2582482 - protein, 19 aa, Entamoeba histolytica
IGRVKLDLAQYIDMNDKII

SEQ ID NO: 2582483 - protein, 24 aa, Entamoeba histolytica
IGSCAIGLFVSYFSAFIFNKMKGI

SEQ ID NO: 2582484 - protein, 19 aa, Entamoeba histolytica
IGSCSDWFNSRWGKRRPFL

SEQ ID NO: 2582485 - protein, 22 aa, Entamoeba histolytica
IGSMICCFDALIKCNAEYFFDT

SEQ ID NO: 2582486 - protein, 19 aa, Entamoeba histolytica
IGTCCSGVKSDVDFAQVFL

SEQ ID NO: 2582487 - protein, 23 aa, Entamoeba histolytica
IGTICGLLKSILMEMNPRFINGE

SEQ ID NO: 2582488 - protein, 19 aa, Entamoeba histolytica
IGVALRFITNGLLLIILIS

SEQ ID NO: 2582489 - protein, 20 aa, Entamoeba histolytica
IGVEKVCIMESGFEGYHECA

SEQ ID NO: 2582490 - protein, 17 aa, Entamoeba histolytica
IGVIISLVICYFINKAS

SEQ ID NO: 2582491 - protein, 19 aa, Entamoeba histolytica
IGVIVGAIFNYFKTKQLST

SEQ ID NO: 2582492 - protein, 20 aa, Entamoeba histolytica
IGVLVLWLALLITFSLTSKI

SEQ ID NO: 2582493 - protein, 25 aa, Entamoeba histolytica
IGWADIPLIIGLKFLPSFLIILMMN

SEQ ID NO: 2582494 - protein, 18 aa, Entamoeba histolytica
IGYDVEYLVKWGLTICVI

SEQ ID NO: 2582495 - protein, 22 aa, Entamoeba histolytica
IHCKQEKGDVLVFLPGSEEIEK

SEQ ID NO: 2582496 - protein, 17 aa, Entamoeba histolytica
IHDEYGYWYTFKGDGNQ

SEQ ID NO: 2582497 - protein, 25 aa, Entamoeba histolytica
IHFLQDLLLDYGYFFTLATEKGKKS

SEQ ID NO: 2582498 - protein, 18 aa, Entamoeba histolytica
IHFVSGLERCEKYIEMYK

SEQ ID NO: 2582499 - protein, 23 aa, Entamoeba histolytica
IHICSCIAAQLAHLPFFHFIREN

SEQ ID NO: 2582500 - protein, 17 aa, Entamoeba histolytica
IHIMCHSLGSKFFMQSY

SEQ ID NO: 2582501 - protein, 21 aa, Entamoeba histolytica
IHIQSLFFNRIVIIITSPITF

SEQ ID NO: 2582502 - protein, 22 aa, Entamoeba histolytica
IHIRKELQIFTGIDTLHTDINT

SEQ ID NO: 2582503 - protein, 17 aa, Entamoeba histolytica
IHKCSKCGGKGVVKENL

SEQ ID NO: 2582504 - protein, 17 aa, Entamoeba histolytica
IHLFIPFVLFAGCILSY

SEQ ID NO: 2582505 - protein, 24 aa, Entamoeba histolytica
IHLIAETLSEPALANSQSASQASG

SEQ ID NO: 2582506 - protein, 19 aa, Entamoeba histolytica
IHLKKEWNKKEIINEGVLF

SEQ ID NO: 2582507 - protein, 22 aa, Entamoeba histolytica
IHLRYHKARINDMFEKNVIFPP

SEQ ID NO: 2582508 - protein, 20 aa, Entamoeba histolytica
IHLVTLILIESCVIVSSNKV

SEQ ID NO: 2582509 - protein, 17 aa, Entamoeba histolytica
IHLYKILHTGVVYNLSF

SEQ ID NO: 2582510 - protein, 25 aa, Entamoeba histolytica
IHLYLRNRCSPLAYHFLDAQFDHTS

SEQ ID NO: 2582511 - protein, 17 aa, Entamoeba histolytica
IHMEEILSYGIILISKN

SEQ ID NO: 2582512 - protein, 24 aa, Entamoeba histolytica
IHNPNLVNFCMLRVNKTDITQQKE

SEQ ID NO: 2582513 - protein, 21 aa, Entamoeba histolytica
IHPKLFPTPLILPTTPNSILR

SEQ ID NO: 2582514 - protein, 19 aa, Entamoeba histolytica
IHPLFRLTSIQTFAILLKK

SEQ ID NO: 2582515 - protein, 25 aa, Entamoeba histolytica
IHQIMRFLLMISYVYPSLVFTDGPF

SEQ ID NO: 2582516 - protein, 24 aa, Entamoeba histolytica
IHSCKRFIEEGSKQTEVMFEKHKD

SEQ ID NO: 2582517 - protein, 21 aa, Entamoeba histolytica
IHSCVYIGFSQCFPVLVSWTQ

SEQ ID NO: 2582518 - protein, 26 aa, Entamoeba histolytica
IHSEDIPIGWGFKGNIYNEIMNKDNR

SEQ ID NO: 2582519 - protein, 17 aa, Entamoeba histolytica
IHSFLFYIYIQCTNAFV

SEQ ID NO: 2582520 - protein, 26 aa, Entamoeba histolytica
IHSKCYRCQSCFKVIVGDRESIDHRC

SEQ ID NO: 2582521 - protein, 17 aa, Entamoeba histolytica
IHSKVLFDYSISKNLEV

SEQ ID NO: 2582522 - protein, 23 aa, Entamoeba histolytica
IHSLGSIPTIYGVSLFQPKLYST

SEQ ID NO: 2582523 - protein, 18 aa, Entamoeba histolytica
IHSLIPVTVIGPRKSGKS

SEQ ID NO: 2582524 - protein, 18 aa, Entamoeba histolytica
IHSPRLSLLLNENIPQYL

SEQ ID NO: 2582525 - protein, 17 aa, Entamoeba histolytica
IHSYSFSVGELMIINGT

SEQ ID NO: 2582526 - protein, 18 aa, Entamoeba histolytica
IIALSGWMYLSYFPVYKK

SEQ ID NO: 2582527 - protein, 22 aa, Entamoeba histolytica
IIAVICIFILILIIALISVLYK

SEQ ID NO: 2582528 - protein, 19 aa, Entamoeba histolytica
IIDKKYCIIFNRFSTITTY

SEQ ID NO: 2582529 - protein, 20 aa, Entamoeba histolytica
IIDLGSACFSNYTLYSYIQS

SEQ ID NO: 2582530 - protein, 21 aa, Entamoeba histolytica
IIDVVYSFKLFNTIRYNSDSS

SEQ ID NO: 2582531 - protein, 17 aa, Entamoeba histolytica
IIDVYKAKVCVVNKRSL

SEQ ID NO: 2582532 - protein, 18 aa, Entamoeba histolytica
IIEFPKPVYHLHLTTPTQ

SEQ ID NO: 2582533 - protein, 30 aa, Entamoeba histolytica
IIEIYGAIVCFVYFPFSQIASFLIIDNTKR

SEQ ID NO: 2582534 - protein, 18 aa, Entamoeba histolytica
IIERLLLYLFYFWDTAGL

SEQ ID NO: 2582535 - protein, 26 aa, Entamoeba histolytica
IIFFSRSKLPLTIEILKHSTFTLLHN

SEQ ID NO: 2582536 - protein, 23 aa, Entamoeba histolytica
IIFLHYSCHIFLIVFFSFIFFLF

SEQ ID NO: 2582537 - protein, 34 aa, Entamoeba histolytica
IIFSCTRCCCGPCCAARHGICFPKDEKAYSTMGW

SEQ ID NO: 2582538 - protein, 17 aa, Entamoeba histolytica
IIGCSVGGVLILLLLII

SEQ ID NO: 2582539 - protein, 23 aa, Entamoeba histolytica
IIGCVLCLLWAFYKSKKEAYRQK

SEQ ID NO: 2582540 - protein, 17 aa, Entamoeba histolytica
IIGCVLGGLKLSSASYK

SEQ ID NO: 2582541 - protein, 24 aa, Entamoeba histolytica
IIGGVICGILLLLLIIIGVAIIVF

SEQ ID NO: 2582542 - protein, 20 aa, Entamoeba histolytica
IIGIGYCVFVTIILDVPLNF

SEQ ID NO: 2582543 - protein, 24 aa, Entamoeba histolytica
IIGIICCFCASIYCIVIMSEMSKT

SEQ ID NO: 2582544 - protein, 18 aa, Entamoeba histolytica
IIGMCVAFITAIISKCCD

SEQ ID NO: 2582545 - protein, 17 aa, Entamoeba histolytica
IIHEFDPYFNFRATKYL

SEQ ID NO: 2582546 - protein, 17 aa, Entamoeba histolytica
IIHSLLLSNHSIQTMSY

SEQ ID NO: 2582547 - protein, 18 aa, Entamoeba histolytica
IIHSPLLLLKCFILGFSV

SEQ ID NO: 2582548 - protein, 19 aa, Entamoeba histolytica
IIICIVLLFIFTRKRKNDF

SEQ ID NO: 2582549 - protein, 20 aa, Entamoeba histolytica
IIIFNTIHAVEFILGCISNT

SEQ ID NO: 2582550 - protein, 19 aa, Entamoeba histolytica
IIIIIGIVWWRRKKTAKDE

SEQ ID NO: 2582551 - protein, 18 aa, Entamoeba histolytica
IIIIILLCIISFITNIII

SEQ ID NO: 2582552 - protein, 19 aa, Entamoeba histolytica
IIIILSCIFSLSYSFEQNY

SEQ ID NO: 2582553 - protein, 18 aa, Entamoeba histolytica
IIIKEDFILPSITFILQT

SEQ ID NO: 2582554 - protein, 28 aa, Entamoeba histolytica
IIILCLVSLCILFILGTLAFWFNTKYKL

SEQ ID NO: 2582555 - protein, 18 aa, Entamoeba histolytica
IIILIIIGWCSRTYYRYK

SEQ ID NO: 2582556 - protein, 18 aa, Entamoeba histolytica
IIILILLILRFKYQKKRT

SEQ ID NO: 2582557 - protein, 23 aa, Entamoeba histolytica
IIILSRTSYFWGEKYKKKKSLVL

SEQ ID NO: 2582558 - protein, 26 aa, Entamoeba histolytica
IIINIITRWYIIISIGLIAFSMTFLM

SEQ ID NO: 2582559 - protein, 23 aa, Entamoeba histolytica
IIIPGLITYYAMKWKKSLHAAFF

SEQ ID NO: 2582560 - protein, 22 aa, Entamoeba histolytica
IIIPKPPCPIYILATPSTNQLK

SEQ ID NO: 2582561 - protein, 17 aa, Entamoeba histolytica
IIISFFIGWHMVMAIGG

SEQ ID NO: 2582562 - protein, 19 aa, Entamoeba histolytica
IIISHWKKPCLTKHITKTQ

SEQ ID NO: 2582563 - protein, 18 aa, Entamoeba histolytica
IIITPSLSGAIRMLAEEK

SEQ ID NO: 2582564 - protein, 20 aa, Entamoeba histolytica
IIKKIVKACAGYNVNYSSIS

SEQ ID NO: 2582565 - protein, 20 aa, Entamoeba histolytica
IIKLLLLSLFNQFNSIEELF

SEQ ID NO: 2582566 - protein, 17 aa, Entamoeba histolytica
IIKNPSFSNKQCSHAAD

SEQ ID NO: 2582567 - protein, 19 aa, Entamoeba histolytica
IIKRFSFSSSNQITINALI

SEQ ID NO: 2582568 - protein, 17 aa, Entamoeba histolytica
IIKSIKKAFLVGFPDNV

SEQ ID NO: 2582569 - protein, 25 aa, Entamoeba histolytica
IILAVIRFILGLGIGGEYPLSSSIA

SEQ ID NO: 2582570 - protein, 24 aa, Entamoeba histolytica
IILCAIAIIVLVVKWRFGKNHEES

SEQ ID NO: 2582571 - protein, 18 aa, Entamoeba histolytica
IILIYSIFTRLSFNSLSE

SEQ ID NO: 2582572 - protein, 17 aa, Entamoeba histolytica
IILKTTHVFLVILNQTA

SEQ ID NO: 2582573 - protein, 18 aa, Entamoeba histolytica
IILLFYKSLEEWYIHNDI

SEQ ID NO: 2582574 - protein, 25 aa, Entamoeba histolytica
IILLGCGIMFLLSCWVDKKEKKKRF

SEQ ID NO: 2582575 - protein, 25 aa, Entamoeba histolytica
IILPCATIIGCLKLKSQDRREKLWA

SEQ ID NO: 2582576 - protein, 24 aa, Entamoeba histolytica
IILQEFVYHIGYFINNKRQAKRAD

SEQ ID NO: 2582577 - protein, 19 aa, Entamoeba histolytica
IILRLKSFVIEKITRKETI

SEQ ID NO: 2582578 - protein, 18 aa, Entamoeba histolytica
IILTFIDIFHQYRSIRQS

SEQ ID NO: 2582579 - protein, 25 aa, Entamoeba histolytica
IILTINWPWLCICMVLLNATNPGFF

SEQ ID NO: 2582580 - protein, 17 aa, Entamoeba histolytica
IILYRKIKRIDIRIFKL

SEQ ID NO: 2582581 - protein, 19 aa, Entamoeba histolytica
IIMAVAFSGLFLAGVIVLD

SEQ ID NO: 2582582 - protein, 19 aa, Entamoeba histolytica
IIMCIIVFDIIYRLMYFIN

SEQ ID NO: 2582583 - protein, 25 aa, Entamoeba histolytica
IIMMCKRPNPSKVIWKIILWYCFIL

SEQ ID NO: 2582584 - protein, 18 aa, Entamoeba histolytica
IIMVLIIVCVLVIIGCSV

SEQ ID NO: 2582585 - protein, 31 aa, Entamoeba histolytica
IINAINFGCCFLLSWVCGFINNFLPGWLLAR

SEQ ID NO: 2582586 - protein, 30 aa, Entamoeba histolytica
IINDVFPIKDFWTHVCIVWTKCLYSLSRKQ

SEQ ID NO: 2582587 - protein, 30 aa, Entamoeba histolytica
IINECLKPTLPVSDLFKLRVFYQSYIIYKK

SEQ ID NO: 2582588 - protein, 17 aa, Entamoeba histolytica
IINGCLHNDFLVKHKVL

SEQ ID NO: 2582589 - protein, 20 aa, Entamoeba histolytica
IINHFICGVVSHWIAQLLSA

SEQ ID NO: 2582590 - protein, 18 aa, Entamoeba histolytica
IINKEERNTEVIHTQIET

SEQ ID NO: 2582591 - protein, 17 aa, Entamoeba histolytica
IIPECLFQNSTYGIIMA

SEQ ID NO: 2582592 - protein, 20 aa, Entamoeba histolytica
IIPELNELFTLVSFPSDDLK

SEQ ID NO: 2582593 - protein, 17 aa, Entamoeba histolytica
IIPHPKFPKFIVSTYGQ

SEQ ID NO: 2582594 - protein, 22 aa, Entamoeba histolytica
IIPLICIPFQYVLRKKQTIPLS

SEQ ID NO: 2582595 - protein, 25 aa, Entamoeba histolytica
IIPNMLRLFCLRFLVPGYYMVLQEI

SEQ ID NO: 2582596 - protein, 25 aa, Entamoeba histolytica
IIQCLCDGCGIGIAPKLAATAAGQA

SEQ ID NO: 2582597 - protein, 24 aa, Entamoeba histolytica
IIQFKEYIHICVKSTLFYISAINW

SEQ ID NO: 2582598 - protein, 26 aa, Entamoeba histolytica
IIQKYYRYAFKDMKGSQLVNEKRGEK

SEQ ID NO: 2582599 - protein, 18 aa, Entamoeba histolytica
IIQLIAIVYPKVFDNSLV

SEQ ID NO: 2582600 - protein, 25 aa, Entamoeba histolytica
IIRMMKKKKGFNFINALCLSRTNKP

SEQ ID NO: 2582601 - protein, 21 aa, Entamoeba histolytica
IIRYYCLLLKYNYINENCNII

SEQ ID NO: 2582602 - protein, 17 aa, Entamoeba histolytica
IISEPYLPNGLSFNTSQ

SEQ ID NO: 2582603 - protein, 21 aa, Entamoeba histolytica
IISFLPLFLYNQFKHVTNIYF

SEQ ID NO: 2582604 - protein, 23 aa, Entamoeba histolytica
IISIHYRFYWQIITVDLLFVAPY

SEQ ID NO: 2582605 - protein, 21 aa, Entamoeba histolytica
IISKICMLEITLPSPSIEDSL

SEQ ID NO: 2582606 - protein, 19 aa, Entamoeba histolytica
IISKKSGLIAWMAVQAGIA

SEQ ID NO: 2582607 - protein, 33 aa, Entamoeba histolytica
IISLDKSKCIEYRKGRALKIYNKEIDNNNKYYI

SEQ ID NO: 2582608 - protein, 20 aa, Entamoeba histolytica
IISLKPGKNYFIFLTTNNLQ

SEQ ID NO: 2582609 - protein, 17 aa, Entamoeba histolytica
IISLSFYKNYTWMDYLD

SEQ ID NO: 2582610 - protein, 27 aa, Entamoeba histolytica
IISLVEWNFSYRKRFSLFKEEEEGVWI

SEQ ID NO: 2582611 - protein, 26 aa, Entamoeba histolytica
IISMVFRFISALVCFFTDIFCNQGKR

SEQ ID NO: 2582612 - protein, 42 aa, Entamoeba histolytica
IISTICFAFGFALYYDWKLALCVIAVFPIHTLILFFDFKLNS

SEQ ID NO: 2582613 - protein, 24 aa, Entamoeba histolytica
IISTISFNLLLGIHFKKNAITYFS

SEQ ID NO: 2582614 - protein, 18 aa, Entamoeba histolytica
IISTVCWGLLINGIGLCF

SEQ ID NO: 2582615 - protein, 17 aa, Entamoeba histolytica
IITCLSIIYYIYITYLG

SEQ ID NO: 2582616 - protein, 22 aa, Entamoeba histolytica
IITDIFPLMKYWFINKQKKSYL

SEQ ID NO: 2582617 - protein, 25 aa, Entamoeba histolytica
IITEVIRFTTLIGIHYFTKKFDEIK

SEQ ID NO: 2582618 - protein, 17 aa, Entamoeba histolytica
IITGILISPSFGEINIS

SEQ ID NO: 2582619 - protein, 25 aa, Entamoeba histolytica
IITGLCAIIYYIPRSSFKNDVLQCF

SEQ ID NO: 2582620 - protein, 18 aa, Entamoeba histolytica
IITLCFSTFCNNVGCGQC

SEQ ID NO: 2582621 - protein, 25 aa, Entamoeba histolytica
IITSIFCVFVVFYVLVIFEALRKPI

SEQ ID NO: 2582622 - protein, 25 aa, Entamoeba histolytica
IITTFPRCVLVLYWFAFPYNFMNYR

SEQ ID NO: 2582623 - protein, 24 aa, Entamoeba histolytica
IIVCVGVLIAPLIIIVYFFFCYKT

SEQ ID NO: 2582624 - protein, 18 aa, Entamoeba histolytica
IIVFDIIYRLMYFINSRR

SEQ ID NO: 2582625 - protein, 24 aa, Entamoeba histolytica
IIVIPIIFRSFYFLISFFGTLTIV

SEQ ID NO: 2582626 - protein, 17 aa, Entamoeba histolytica
IIVSIMFGIIRVITLRR

SEQ ID NO: 2582627 - protein, 25 aa, Entamoeba histolytica
IIVTVCCFLLFFIIIAIIGVLLAYY

SEQ ID NO: 2582628 - protein, 19 aa, Entamoeba histolytica
IIYMGDLFTNYVLDINSIF

SEQ ID NO: 2582629 - protein, 28 aa, Entamoeba histolytica
IIYNCAICMTCGCLLCYKDKKHQDIIHS

SEQ ID NO: 2582630 - protein, 17 aa, Entamoeba histolytica
IIYQLLNSLSWKYITQL

SEQ ID NO: 2582631 - protein, 21 aa, Entamoeba histolytica
IKAAPCILSVLVAALDGLLKS

SEQ ID NO: 2582632 - protein, 27 aa, Entamoeba histolytica
IKAGMGFLSIFCLRVILYYCHIDTSNL

SEQ ID NO: 2582633 - protein, 28 aa, Entamoeba histolytica
IKAGMGFLSIFCLRVILYYCHIDTSNLF

SEQ ID NO: 2582634 - protein, 19 aa, Entamoeba histolytica
IKCAVPTCGNGKIDEFEEC

SEQ ID NO: 2582635 - protein, 19 aa, Entamoeba histolytica
IKCGTYIVANAFKDDVVCP

SEQ ID NO: 2582636 - protein, 18 aa, Entamoeba histolytica
IKCKNGYYLNSKHECQEN

SEQ ID NO: 2582637 - protein, 17 aa, Entamoeba histolytica
IKCKNGYYLNSNNECQE

SEQ ID NO: 2582638 - protein, 17 aa, Entamoeba histolytica
IKCKSGYSLNSNNKCQE

SEQ ID NO: 2582639 - protein, 17 aa, Entamoeba histolytica
IKCLPGYSYYMGECFQC

SEQ ID NO: 2582640 - protein, 17 aa, Entamoeba histolytica
IKCPKYCKTCERETLEC

SEQ ID NO: 2582641 - protein, 18 aa, Entamoeba histolytica
IKCSKGLYEYNRKCLPMC

SEQ ID NO: 2582642 - protein, 23 aa, Entamoeba histolytica
IKDEKKGGIIIEMRDVFGKCTFE

SEQ ID NO: 2582643 - protein, 23 aa, Entamoeba histolytica
IKDKLSCLDIEQLECDNGKHNQR

SEQ ID NO: 2582644 - protein, 19 aa, Entamoeba histolytica
IKDTVCRYAIQTGHRVDRK

SEQ ID NO: 2582645 - protein, 27 aa, Entamoeba histolytica
IKEFIGSQHFNVWWYRNKMNELCKVSV

SEQ ID NO: 2582646 - protein, 20 aa, Entamoeba histolytica
IKEGIEFYNDLVIDEIVHFI

SEQ ID NO: 2582647 - protein, 21 aa, Entamoeba histolytica
IKEGYVFDSYIKKVSSKKING

SEQ ID NO: 2582648 - protein, 23 aa, Entamoeba histolytica
IKEIELFSSILYNDFVKMTSLTK

SEQ ID NO: 2582649 - protein, 19 aa, Entamoeba histolytica
IKEIFKRYYQEIIQLPNFN

SEQ ID NO: 2582650 - protein, 20 aa, Entamoeba histolytica
IKEILGFKRGYQKGMTMDVS

SEQ ID NO: 2582651 - protein, 20 aa, Entamoeba histolytica
IKEIRRLLISSGDITSEQMM

SEQ ID NO: 2582652 - protein, 25 aa, Entamoeba histolytica
IKEKEWKKGEVISQEYMIMMLLIYN

SEQ ID NO: 2582653 - protein, 18 aa, Entamoeba histolytica
IKELKEVVVLMMQDNILK

SEQ ID NO: 2582654 - protein, 24 aa, Entamoeba histolytica
IKELSQRLTFYASHFKKYDGQKPR

SEQ ID NO: 2582655 - protein, 17 aa, Entamoeba histolytica
IKENRNIQMYSNKHKRL

SEQ ID NO: 2582656 - protein, 20 aa, Entamoeba histolytica
IKEVFCDGKISMNLMNSDKL

SEQ ID NO: 2582657 - protein, 20 aa, Entamoeba histolytica
IKEVIPLLLQQISYYSELLL

SEQ ID NO: 2582658 - protein, 20 aa, Entamoeba histolytica
IKFIPFINAYLFPLTTDIET

SEQ ID NO: 2582659 - protein, 21 aa, Entamoeba histolytica
IKFSIAFNCSSVDKLTIPSTT

SEQ ID NO: 2582660 - protein, 25 aa, Entamoeba histolytica
IKGEREKDAILALCSQFLLFGIKNE

SEQ ID NO: 2582661 - protein, 20 aa, Entamoeba histolytica
IKGICSSGMPIMTVNLVMII

SEQ ID NO: 2582662 - protein, 17 aa, Entamoeba histolytica
IKGILMKSLKTFDGKNY

SEQ ID NO: 2582663 - protein, 22 aa, Entamoeba histolytica
IKGRSVIESRISFIELLSGEKR

SEQ ID NO: 2582664 - protein, 25 aa, Entamoeba histolytica
IKGTAILFCELHFGYDINIQSKSIS

SEQ ID NO: 2582665 - protein, 17 aa, Entamoeba histolytica
IKHQKKFSSLAIKAESV

SEQ ID NO: 2582666 - protein, 17 aa, Entamoeba histolytica
IKHSYSLVIKKYPFLTL

SEQ ID NO: 2582667 - protein, 18 aa, Entamoeba histolytica
IKIDWNDIVCIIKRRYLL

SEQ ID NO: 2582668 - protein, 19 aa, Entamoeba histolytica
IKIDWNDIVCIIKRRYLLQ

SEQ ID NO: 2582669 - protein, 28 aa, Entamoeba histolytica
IKIEKELEGPIYLLRTSYQNFISRFGVK

SEQ ID NO: 2582670 - protein, 19 aa, Entamoeba histolytica
IKIEVWKLILERRLKETKK

SEQ ID NO: 2582671 - protein, 19 aa, Entamoeba histolytica
IKIINDFEPLITFCTSSLC

SEQ ID NO: 2582672 - protein, 19 aa, Entamoeba histolytica
IKIKFETYWSKWKSDNKKV

SEQ ID NO: 2582673 - protein, 19 aa, Entamoeba histolytica
IKIMEDIVVGLAFLHENNI

SEQ ID NO: 2582674 - protein, 22 aa, Entamoeba histolytica
IKISKTGCIKCEIGYYNKDGEC

SEQ ID NO: 2582675 - protein, 19 aa, Entamoeba histolytica
IKISTFIPSNKYVLLDNHP

SEQ ID NO: 2582676 - protein, 17 aa, Entamoeba histolytica
IKKALKFHKDIVGSAPT

SEQ ID NO: 2582677 - protein, 19 aa, Entamoeba histolytica
IKKDISLSFEETKTMNEQL

SEQ ID NO: 2582678 - protein, 17 aa, Entamoeba histolytica
IKKECTKQHIIHKYSSL

SEQ ID NO: 2582679 - protein, 25 aa, Entamoeba histolytica
IKKKGEGSFGIVYEGIFRGRKVAIK

SEQ ID NO: 2582680 - protein, 22 aa, Entamoeba histolytica
IKKMFWKIYIMLVGEEKNDRSG

SEQ ID NO: 2582681 - protein, 21 aa, Entamoeba histolytica
IKKPCYHLCNITSSTPSVRIL

SEQ ID NO: 2582682 - protein, 18 aa, Entamoeba histolytica
IKLCNETWMSWGFDISKT

SEQ ID NO: 2582683 - protein, 17 aa, Entamoeba histolytica
IKLENEYLLPISFACIA

SEQ ID NO: 2582684 - protein, 27 aa, Entamoeba histolytica
IKLFAGRPRPNFYAMIDAGNMKDAYKS

SEQ ID NO: 2582685 - protein, 26 aa, Entamoeba histolytica
IKLFGEVVFPAFFVKFIPIYNEETIQ

SEQ ID NO: 2582686 - protein, 19 aa, Entamoeba histolytica
IKLLLPLSSFISLIPSYAQ

SEQ ID NO: 2582687 - protein, 27 aa, Entamoeba histolytica
IKLLLSRIFDALCIFLINRLMYNYHEG

SEQ ID NO: 2582688 - protein, 18 aa, Entamoeba histolytica
IKLPRFINNIIITISSGN

SEQ ID NO: 2582689 - protein, 21 aa, Entamoeba histolytica
IKLQPGFGQSVIIKFELLCTT

SEQ ID NO: 2582690 - protein, 21 aa, Entamoeba histolytica
IKLRMPEGIDIVISKIIGALS

SEQ ID NO: 2582691 - protein, 20 aa, Entamoeba histolytica
IKLSDICLGFNLSLNDSIPW

SEQ ID NO: 2582692 - protein, 19 aa, Entamoeba histolytica
IKLTRRPLAVFPIVLFFTM

SEQ ID NO: 2582693 - protein, 26 aa, Entamoeba histolytica
IKLTSPEFFEFFSFIDNLLMNEAVAL

SEQ ID NO: 2582694 - protein, 19 aa, Entamoeba histolytica
IKMGMNFTITSHIKLIQEK

SEQ ID NO: 2582695 - protein, 37 aa, Entamoeba histolytica
IKMPTLHRIACFRDDIIFLIYLYQRWIYPVDKNRMDS

SEQ ID NO: 2582696 - protein, 18 aa, Entamoeba histolytica
IKNAVITCPAYFNDSQRQ

SEQ ID NO: 2582697 - protein, 22 aa, Entamoeba histolytica
IKNGLGCIICNDGYYKKDSICF

SEQ ID NO: 2582698 - protein, 19 aa, Entamoeba histolytica
IKNGLPLISSFTELFTEQS

SEQ ID NO: 2582699 - protein, 19 aa, Entamoeba histolytica
IKNKIKFVVIGGARDAEDL

SEQ ID NO: 2582700 - protein, 17 aa, Entamoeba histolytica
IKPDNMLVFSFAEQVGV

SEQ ID NO: 2582701 - protein, 23 aa, Entamoeba histolytica
IKPKELRFVFVGREFKREHTLIT

SEQ ID NO: 2582702 - protein, 19 aa, Entamoeba histolytica
IKPKIVSLFKDGDSYEDLS

SEQ ID NO: 2582703 - protein, 23 aa, Entamoeba histolytica
IKPNHIFRGGFFFNKGEEDIKKL

SEQ ID NO: 2582704 - protein, 25 aa, Entamoeba histolytica
IKPTIAREIMVMWFNLPDRLIWKQC

SEQ ID NO: 2582705 - protein, 24 aa, Entamoeba histolytica
IKQIRLCLPGAFDTFLQRLYFHMY

SEQ ID NO: 2582706 - protein, 20 aa, Entamoeba histolytica
IKQKVEGVCYYFIDYFKTIR

SEQ ID NO: 2582707 - protein, 25 aa, Entamoeba histolytica
IKQLLKSIWVYKFFVQLIQKLNTKN

SEQ ID NO: 2582708 - protein, 24 aa, Entamoeba histolytica
IKQRYNGFCKIPFPDRTCDVCDEG

SEQ ID NO: 2582709 - protein, 21 aa, Entamoeba histolytica
IKQSIGGIVFIQLSSPESYIQ

SEQ ID NO: 2582710 - protein, 21 aa, Entamoeba histolytica
IKRELPKGAFIQHLESPKSNA

SEQ ID NO: 2582711 - protein, 17 aa, Entamoeba histolytica
IKREVFDYTISFINELI

SEQ ID NO: 2582712 - protein, 17 aa, Entamoeba histolytica
IKRICLFQVFGYKGTLI

SEQ ID NO: 2582713 - protein, 17 aa, Entamoeba histolytica
IKRIFKTKLGFFDVTPL

SEQ ID NO: 2582714 - protein, 21 aa, Entamoeba histolytica
IKRKEINCLMILNNNIIIGEQ

SEQ ID NO: 2582715 - protein, 25 aa, Entamoeba histolytica
IKRLMKIRLSPYIVITSIVKETDQL

SEQ ID NO: 2582716 - protein, 20 aa, Entamoeba histolytica
IKRNEFLPELLRLTEIFTGA

SEQ ID NO: 2582717 - protein, 25 aa, Entamoeba histolytica
IKRREMICSFILIFSFFCRCVFNLL

SEQ ID NO: 2582718 - protein, 20 aa, Entamoeba histolytica
IKRRTIFNRILDLFVISIEE

SEQ ID NO: 2582719 - protein, 17 aa, Entamoeba histolytica
IKSDCYINEHLIRVNKT

SEQ ID NO: 2582720 - protein, 23 aa, Entamoeba histolytica
IKSFRYNFLYIFNEFITIIGDML

SEQ ID NO: 2582721 - protein, 18 aa, Entamoeba histolytica
IKSIGVRPSLIIISLVMI

SEQ ID NO: 2582722 - protein, 20 aa, Entamoeba histolytica
IKSKFEGIFDFFYDVITVVG

SEQ ID NO: 2582723 - protein, 17 aa, Entamoeba histolytica
IKSKSGVFFGIPPLGGW

SEQ ID NO: 2582724 - protein, 21 aa, Entamoeba histolytica
IKSLFSYKTLLLWVIEALIVS

SEQ ID NO: 2582725 - protein, 17 aa, Entamoeba histolytica
IKSYIIFNINNNFDKSV

SEQ ID NO: 2582726 - protein, 17 aa, Entamoeba histolytica
IKTAFSICLHNFPEGIA

SEQ ID NO: 2582727 - protein, 20 aa, Entamoeba histolytica
IKTHGMGIMNTCVNYVYQYL

SEQ ID NO: 2582728 - protein, 17 aa, Entamoeba histolytica
IKTLYLDKERALKSKEE

SEQ ID NO: 2582729 - protein, 19 aa, Entamoeba histolytica
IKTNGRFLLTNSIEEYQKN

SEQ ID NO: 2582730 - protein, 17 aa, Entamoeba histolytica
IKTRYQQDTSWKEDIEE

SEQ ID NO: 2582731 - protein, 22 aa, Entamoeba histolytica
IKTSLCMIGKLCSDNETKDICS

SEQ ID NO: 2582732 - protein, 24 aa, Entamoeba histolytica
IKTTVCGTLSWIAPEILARKPYCQ

SEQ ID NO: 2582733 - protein, 23 aa, Entamoeba histolytica
IKVAKKIEGGVIVIDINNNVYSI

SEQ ID NO: 2582734 - protein, 23 aa, Entamoeba histolytica
IKVCSGYYYKIKYNTIYISDKQN

SEQ ID NO: 2582735 - protein, 17 aa, Entamoeba histolytica
IKVFSLIFCCISSIITL

SEQ ID NO: 2582736 - protein, 17 aa, Entamoeba histolytica
IKVIFRIISAPWKKVYF

SEQ ID NO: 2582737 - protein, 20 aa, Entamoeba histolytica
IKVIMVIDALVFLYISEMLP

SEQ ID NO: 2582738 - protein, 24 aa, Entamoeba histolytica
IKVPTYYIFLNFGDWVMTNYIFIA

SEQ ID NO: 2582739 - protein, 17 aa, Entamoeba histolytica
IKYDPKCGDAYKRRGQT

SEQ ID NO: 2582740 - protein, 20 aa, Entamoeba histolytica
IKYEEFKTLLTFNETIINVI

SEQ ID NO: 2582741 - protein, 21 aa, Entamoeba histolytica
IKYHCGQTFLQKAYKVQRSEF

SEQ ID NO: 2582742 - protein, 17 aa, Entamoeba histolytica
IKYSLLIDRIKFELNQQ

SEQ ID NO: 2582743 - protein, 17 aa, Entamoeba histolytica
IKYTFTVEIKRVIGVKK

SEQ ID NO: 2582744 - protein, 19 aa, Entamoeba histolytica
ILACVCAFCIFFLIWWSFL

SEQ ID NO: 2582745 - protein, 21 aa, Entamoeba histolytica
ILANRYPYFLVRNKYIPLFLQ

SEQ ID NO: 2582746 - protein, 17 aa, Entamoeba histolytica
ILCCIISFFDTYEFRNQ

SEQ ID NO: 2582747 - protein, 20 aa, Entamoeba histolytica
ILCGYHSYCILRNNHSFKQF

SEQ ID NO: 2582748 - protein, 19 aa, Entamoeba histolytica
ILCNVQFMRFKVPFTYCEF

SEQ ID NO: 2582749 - protein, 17 aa, Entamoeba histolytica
ILCVAFLGYFISELLEM

SEQ ID NO: 2582750 - protein, 18 aa, Entamoeba histolytica
ILCVFSLPFFLFVVNLLC

SEQ ID NO: 2582751 - protein, 21 aa, Entamoeba histolytica
ILCYMCSTDALVSFVNQSKLL

SEQ ID NO: 2582752 - protein, 18 aa, Entamoeba histolytica
ILDNGFFGGWSYITVLLI

SEQ ID NO: 2582753 - protein, 18 aa, Entamoeba histolytica
ILDRCFDGYTPLIPNTSV

SEQ ID NO: 2582754 - protein, 18 aa, Entamoeba histolytica
ILEGWWFLVMACAVVVIS

SEQ ID NO: 2582755 - protein, 17 aa, Entamoeba histolytica
ILEKRAVSRDDSYFTSL

SEQ ID NO: 2582756 - protein, 24 aa, Entamoeba histolytica
ILELKSSVWKRMFPENVFQVLCAD

SEQ ID NO: 2582757 - protein, 18 aa, Entamoeba histolytica
ILELTRYWLDKCPETCNP

SEQ ID NO: 2582758 - protein, 18 aa, Entamoeba histolytica
ILENGVVCLVWFIVMSCL

SEQ ID NO: 2582759 - protein, 24 aa, Entamoeba histolytica
ILEPMRMISVWIVSVFIHYVISSS

SEQ ID NO: 2582760 - protein, 25 aa, Entamoeba histolytica
ILFDCGFLWQYYCVLTIFYCIIMFI

SEQ ID NO: 2582761 - protein, 26 aa, Entamoeba histolytica
ILFDMLIDILFEYGFIIFTSKMRNKG

SEQ ID NO: 2582762 - protein, 18 aa, Entamoeba histolytica
ILFEVEFDGDYSILIDTR

SEQ ID NO: 2582763 - protein, 20 aa, Entamoeba histolytica
ILFGHCFKYTNQLYLIEDLG

SEQ ID NO: 2582764 - protein, 19 aa, Entamoeba histolytica
ILFIIWQIVPRKLADSLGL

SEQ ID NO: 2582765 - protein, 20 aa, Entamoeba histolytica
ILFILCLFVLILIVFYCIIN

SEQ ID NO: 2582766 - protein, 30 aa, Entamoeba histolytica
ILFILGFFTCLTWVLNIIMFRDSTNDNTKR

SEQ ID NO: 2582767 - protein, 20 aa, Entamoeba histolytica
ILFKKVCYKIKSYIDPLFKE

SEQ ID NO: 2582768 - protein, 25 aa, Entamoeba histolytica
ILFLFSAICLFVFVSGLIPYTIDNY

SEQ ID NO: 2582769 - protein, 31 aa, Entamoeba histolytica
ILFLQLPYTFSFPWLNAIIIYVISIVVSITS

SEQ ID NO: 2582770 - protein, 18 aa, Entamoeba histolytica
ILFPKYLPLFSKIAYSVK

SEQ ID NO: 2582771 - protein, 20 aa, Entamoeba histolytica
ILFQKEFIGFDAFISSQTLL

SEQ ID NO: 2582772 - protein, 18 aa, Entamoeba histolytica
ILFRRWGDVFTLGHEGFN

SEQ ID NO: 2582773 - protein, 30 aa, Entamoeba histolytica
ILFVLGFFLPCIWIYNIVKYRNSGDLIEKR

SEQ ID NO: 2582774 - protein, 18 aa, Entamoeba histolytica
ILFYSRSSVYTWEHVLII

SEQ ID NO: 2582775 - protein, 25 aa, Entamoeba histolytica
ILGLFPPLFFGTSMSAFTKRYDYGL

SEQ ID NO: 2582776 - protein, 18 aa, Entamoeba histolytica
ILGLVALLIIFQAFVLIF

SEQ ID NO: 2582777 - protein, 27 aa, Entamoeba histolytica
ILGMVPALFLRRIYDIGMSKIDQYVFF

SEQ ID NO: 2582778 - protein, 20 aa, Entamoeba histolytica
ILHIMVWRQGGALLIPGSVI

SEQ ID NO: 2582779 - protein, 24 aa, Entamoeba histolytica
ILHWYYTRSVLFTLCLCNEATFVM

SEQ ID NO: 2582780 - protein, 26 aa, Entamoeba histolytica
ILHYVFSSSCSLCFESLENEESLSLI

SEQ ID NO: 2582781 - protein, 21 aa, Entamoeba histolytica
ILICMYFFQLGVIGFLDYSFF

SEQ ID NO: 2582782 - protein, 21 aa, Entamoeba histolytica
ILIDYTFDYCFEFIISSSTIS

SEQ ID NO: 2582783 - protein, 24 aa, Entamoeba histolytica
ILIGCTFLLGIAYFLTRNHHQAQY

SEQ ID NO: 2582784 - protein, 28 aa, Entamoeba histolytica
ILIGLILCRLCFPLLFNRGSNIIITLLL

SEQ ID NO: 2582785 - protein, 23 aa, Entamoeba histolytica
ILIKILLRNIEIIEISKNHYKQH

SEQ ID NO: 2582786 - protein, 18 aa, Entamoeba histolytica
ILILYSQGMGSNWYTPNM

SEQ ID NO: 2582787 - protein, 17 aa, Entamoeba histolytica
ILINYIILFAVSLGVPY

SEQ ID NO: 2582788 - protein, 24 aa, Entamoeba histolytica
ILIPQFFKMFLAFKKVGLDGNNEM

SEQ ID NO: 2582789 - protein, 18 aa, Entamoeba histolytica
ILIVIMLLCHILMLYCSK

SEQ ID NO: 2582790 - protein, 17 aa, Entamoeba histolytica
ILKEFYAVILTGFEAFK

SEQ ID NO: 2582791 - protein, 17 aa, Entamoeba histolytica
ILKEHIGNPVVYVNLEA

SEQ ID NO: 2582792 - protein, 22 aa, Entamoeba histolytica
ILKKNEGCIFTFKVKPMCSCTI

SEQ ID NO: 2582793 - protein, 22 aa, Entamoeba histolytica
ILKNSWFFYELIVKSLTLEMDS

SEQ ID NO: 2582794 - protein, 27 aa, Entamoeba histolytica
ILKRISQPMFREFLLRVHPQLYTHLLK

SEQ ID NO: 2582795 - protein, 18 aa, Entamoeba histolytica
ILKTILHFKIHHYTSQFP

SEQ ID NO: 2582796 - protein, 17 aa, Entamoeba histolytica
ILKYCTFVLNHFNNLEN

SEQ ID NO: 2582797 - protein, 24 aa, Entamoeba histolytica
ILKYKPEMYYQCSVANIQKDKDGA

SEQ ID NO: 2582798 - protein, 20 aa, Entamoeba histolytica
ILLECFTVLFTIVLIITSIR

SEQ ID NO: 2582799 - protein, 18 aa, Entamoeba histolytica
ILLFSWLYNYFVFALDDI

SEQ ID NO: 2582800 - protein, 19 aa, Entamoeba histolytica
ILLGIAIIFFSFVCFVPQI

SEQ ID NO: 2582801 - protein, 26 aa, Entamoeba histolytica
ILLIIASCLMNGFFINGGGIINVLFL

SEQ ID NO: 2582802 - protein, 22 aa, Entamoeba histolytica
ILLIVLLCWPETLVYWERNKCF

SEQ ID NO: 2582803 - protein, 18 aa, Entamoeba histolytica
ILLLCKLLSMIESLTLSI

SEQ ID NO: 2582804 - protein, 25 aa, Entamoeba histolytica
ILLLKSALWKEEWNSKKLTSLIIDI

SEQ ID NO: 2582805 - protein, 24 aa, Entamoeba histolytica
ILLPEILAAIFIGFTLLRFFVTPY

SEQ ID NO: 2582806 - protein, 19 aa, Entamoeba histolytica
ILLPIIILILLILRFKYQK

SEQ ID NO: 2582807 - protein, 21 aa, Entamoeba histolytica
ILLPTFIQILLLMFPNTAPEI

SEQ ID NO: 2582808 - protein, 17 aa, Entamoeba histolytica
ILLRKGDSISSLDKTTV

SEQ ID NO: 2582809 - protein, 27 aa, Entamoeba histolytica
ILLTGKFRFGYVFGFTIIGSLAEYFIL

SEQ ID NO: 2582810 - protein, 18 aa, Entamoeba histolytica
ILLTRCGYYYSIIFSISF

SEQ ID NO: 2582811 - protein, 24 aa, Entamoeba histolytica
ILLVLLWFVMHFMLAVQSIGPAVF

SEQ ID NO: 2582812 - protein, 18 aa, Entamoeba histolytica
ILLWAQTRMKNHLTTIEK

SEQ ID NO: 2582813 - protein, 17 aa, Entamoeba histolytica
ILMGCSVLPHLSALVAI

SEQ ID NO: 2582814 - protein, 18 aa, Entamoeba histolytica
ILMGCSVLPHLSALVAIV

SEQ ID NO: 2582815 - protein, 19 aa, Entamoeba histolytica
ILMLLKWVRDPLFIRTDWS

SEQ ID NO: 2582816 - protein, 19 aa, Entamoeba histolytica
ILMNGGLFLGGINKIIELL

SEQ ID NO: 2582817 - protein, 26 aa, Entamoeba histolytica
ILMTRISLLLPLLLEFIKQNKLNERY

SEQ ID NO: 2582818 - protein, 22 aa, Entamoeba histolytica
ILNCCRIVFLTSKFQIENTYHC

SEQ ID NO: 2582819 - protein, 21 aa, Entamoeba histolytica
ILNELFNQWIRNMNLVIMGDC

SEQ ID NO: 2582820 - protein, 17 aa, Entamoeba histolytica
ILNEVLNSIALKIINLF

SEQ ID NO: 2582821 - protein, 21 aa, Entamoeba histolytica
ILNGICCIFSLFTEKLALQYF

SEQ ID NO: 2582822 - protein, 18 aa, Entamoeba histolytica
ILNILASYCMFVIVQSFP

SEQ ID NO: 2582823 - protein, 24 aa, Entamoeba histolytica
ILNKFKGGEGFQLIDKKMKLSVPK

SEQ ID NO: 2582824 - protein, 19 aa, Entamoeba histolytica
ILNPRRLLGTKAPFEMTRE

SEQ ID NO: 2582825 - protein, 23 aa, Entamoeba histolytica
ILNTMYSLYCEFFFIHEEIEGRY

SEQ ID NO: 2582826 - protein, 26 aa, Entamoeba histolytica
ILQEFIRLVFHLSLEHCMLIRQVGET

SEQ ID NO: 2582827 - protein, 21 aa, Entamoeba histolytica
ILQSFCLFSFITFYYYYYQSV

SEQ ID NO: 2582828 - protein, 18 aa, Entamoeba histolytica
ILQYNFRLPFTDFAQLND

SEQ ID NO: 2582829 - protein, 41 aa, Entamoeba histolytica
ILSICSHCNKLLPACEMIQCALCGLPICSTSCLKIHSQQPH

SEQ ID NO: 2582830 - protein, 18 aa, Entamoeba histolytica
ILSIHIVFILLLLTKNYL

SEQ ID NO: 2582831 - protein, 23 aa, Entamoeba histolytica
ILSKEEYCIFINKLLQLLQIKKV

SEQ ID NO: 2582832 - protein, 27 aa, Entamoeba histolytica
ILSQTLWQYACCLTIVFAGRYIPFLEA

SEQ ID NO: 2582833 - protein, 19 aa, Entamoeba histolytica
ILSRLVYRKGIDLAVGIIP

SEQ ID NO: 2582834 - protein, 24 aa, Entamoeba histolytica
ILSRYGCCYGCFMFPNTCPNCHDC

SEQ ID NO: 2582835 - protein, 26 aa, Entamoeba histolytica
ILSSVIIKTPIIRRIIISTTESELFY

SEQ ID NO: 2582836 - protein, 19 aa, Entamoeba histolytica
ILSVLLLISHALKYIIGDS

SEQ ID NO: 2582837 - protein, 24 aa, Entamoeba histolytica
ILTELLRFLPVSDLAIREEVIVKI

SEQ ID NO: 2582838 - protein, 27 aa, Entamoeba histolytica
ILTGKSNEAFKCIKCKNGYYLNSNNKC

SEQ ID NO: 2582839 - protein, 19 aa, Entamoeba histolytica
ILTPYALNSCIAFGTVNLA

SEQ ID NO: 2582840 - protein, 31 aa, Entamoeba histolytica
ILTSFCFQLSIKWIFVLSLRLRNGLISMIYE

SEQ ID NO: 2582841 - protein, 38 aa, Entamoeba histolytica; identical to SEQ ID NO: 2384541

SEQ ID NO: 2582842 - protein, 26 aa, Entamoeba histolytica
ILVFKKRGIAVIPNYVFWLSLPMLIK

SEQ ID NO: 2582843 - protein, 19 aa, Entamoeba histolytica
ILVSLNLFSLCNVWSTECD

SEQ ID NO: 2582844 - protein, 25 aa, Entamoeba histolytica
ILYFVLRMMYNLFYFVMKQTSINPE

SEQ ID NO: 2582845 - protein, 23 aa, Entamoeba histolytica
ILYKGIYPFNSFQFDYLILSLND

SEQ ID NO: 2582846 - protein, 17 aa, Entamoeba histolytica
ILYLEFYVSVIVSQTKI

SEQ ID NO: 2582847 - protein, 17 aa, Entamoeba histolytica
ILYVCFIGYITKNKPLI

SEQ ID NO: 2582848 - protein, 19 aa, Entamoeba histolytica
IMAASFPLVHFAQRSLLDV

SEQ ID NO: 2582849 - protein, 18 aa, Entamoeba histolytica
IMAMGCFQVWYIKRQFKR

SEQ ID NO: 2582850 - protein, 18 aa, Entamoeba histolytica
IMESIRSQFIINFIGSVI

SEQ ID NO: 2582851 - protein, 25 aa, Entamoeba histolytica
IMFIKCPECMVALLIAPVLNANESF

SEQ ID NO: 2582852 - protein, 17 aa, Entamoeba histolytica
IMFKNLPNCLGLLQLCD

SEQ ID NO: 2582853 - protein, 19 aa, Entamoeba histolytica
IMIESSLFIPIFSFGIETQ

SEQ ID NO: 2582854 - protein, 17 aa, Entamoeba histolytica
IMIQCVMYLDSIKDSYL

SEQ ID NO: 2582855 - protein, 24 aa, Entamoeba histolytica
IMITEIFGFILLVVILYDLYLLYK

SEQ ID NO: 2582856 - protein, 17 aa, Entamoeba histolytica
IMLFVCFGESKSLSRQS

SEQ ID NO: 2582857 - protein, 17 aa, Entamoeba histolytica
IMNILFLGYLVFFVTAF

SEQ ID NO: 2582858 - protein, 18 aa, Entamoeba histolytica
IMNIRAAYFDIVYFTVVS

SEQ ID NO: 2582859 - protein, 17 aa, Entamoeba histolytica
IMNSRGSVFVHFQDVFK

SEQ ID NO: 2582860 - protein, 23 aa, Entamoeba histolytica
IMQLIYKYLRGVIVSIFMPCHCV

SEQ ID NO: 2582861 - protein, 18 aa, Entamoeba histolytica
IMQWKFDLYHSSIINFIL

SEQ ID NO: 2582862 - protein, 25 aa, Entamoeba histolytica
IMRNLRAVFMLVFVVFFTLNIRSEF

SEQ ID NO: 2582863 - protein, 25 aa, Entamoeba histolytica
IMRVIRFSIWYEGDFSIVVSTKHEN

SEQ ID NO: 2582864 - protein, 24 aa, Entamoeba histolytica
IMSIMLRYMFNLNVLPKEFNENFE

SEQ ID NO: 2582865 - protein, 17 aa, Entamoeba histolytica
IMSSIAILNGTNYSSGN

SEQ ID NO: 2582866 - protein, 22 aa, Entamoeba histolytica
IMVIIGIIWLRRRKSVKAESTA

SEQ ID NO: 2582867 - protein, 18 aa, Entamoeba histolytica
IMWEDAINNVKEREELII

SEQ ID NO: 2582868 - protein, 18 aa, Entamoeba histolytica
IMWVVSCFLVSYEVPITI

SEQ ID NO: 2582869 - protein, 23 aa, Entamoeba histolytica
INADIPGCFDLLLTTEINDEMKS

SEQ ID NO: 2582870 - protein, 23 aa, Entamoeba histolytica
INAGPKIKGVILGMSECVGELTC

SEQ ID NO: 2582871 - protein, 24 aa, Entamoeba histolytica
INAKSCLAYSWISDCPKVFFDRCS

SEQ ID NO: 2582872 - protein, 20 aa, Entamoeba histolytica
INALICWYSYFNKLPTLKFI

SEQ ID NO: 2582873 - protein, 25 aa, Entamoeba histolytica
INDEMKSLLVIYPFPRTLINTPIHI

SEQ ID NO: 2582874 - protein, 18 aa, Entamoeba histolytica
INDIEILSGALLHDTVED

SEQ ID NO: 2582875 - protein, 17 aa, Entamoeba histolytica
INDLVLKNRMKDIFETI

SEQ ID NO: 2582876 - protein, 18 aa, Entamoeba histolytica
INEAANASTLWFSIIIIV

SEQ ID NO: 2582877 - protein, 25 aa, Entamoeba histolytica
INEKGKRGKGLISLFIALMKLLYSN

SEQ ID NO: 2582878 - protein, 20 aa, Entamoeba histolytica
INELKLILESVLNPTIILSK

SEQ ID NO: 2582879 - protein, 19 aa, Entamoeba histolytica
INESICLKKLQLKLPLESQ

SEQ ID NO: 2582880 - protein, 26 aa, Entamoeba histolytica
INEVFLQLKLLWPSFNIINTTSDLFN

SEQ ID NO: 2582881 - protein, 19 aa, Entamoeba histolytica
INFAKCRKLSDIVVTINRI

SEQ ID NO: 2582882 - protein, 19 aa, Entamoeba histolytica
INFKWCYKVSPSVNEYGYP

SEQ ID NO: 2582883 - protein, 17 aa, Entamoeba histolytica
INFKYRINKWIQCNCDI

SEQ ID NO: 2582884 - protein, 23 aa, Entamoeba histolytica
INFPMNTCFELAEFKTLPQTIMI

SEQ ID NO: 2582885 - protein, 17 aa, Entamoeba histolytica
INFSVSIACPFGCNGHG

SEQ ID NO: 2582886 - protein, 20 aa, Entamoeba histolytica
INFVILCFAVRYAWKKQTII

SEQ ID NO: 2582887 - protein, 24 aa, Entamoeba histolytica
INGLKSYKWIRVVCTRILKHKDVF

SEQ ID NO: 2582888 - protein, 42 aa, Entamoeba histolytica; identical to SEQ ID NO: 2384598

SEQ ID NO: 2582889 - protein, 27 aa, Entamoeba histolytica
INHGIEVLRLVLGRKITMLMFGTNNGK

SEQ ID NO: 2582890 - protein, 17 aa, Entamoeba histolytica
INHIEYILPFFSLPILL

SEQ ID NO: 2582891 - protein, 33 aa, Entamoeba histolytica
INHLIVKGVSRWRGNCHFIKITVNGKFDYDGNF

SEQ ID NO: 2582892 - protein, 17 aa, Entamoeba histolytica
INHLKSAAYIFNEILKV

SEQ ID NO: 2582893 - protein, 18 aa, Entamoeba histolytica
INHSCSFIINSNEQENQE

SEQ ID NO: 2582894 - protein, 29 aa, Entamoeba histolytica
INIKGCEFFTHPSGRKFSVLMEMLNTDKY

SEQ ID NO: 2582895 - protein, 17 aa, Entamoeba histolytica
INILLEFLLRKIQPKTP

SEQ ID NO: 2582896 - protein, 24 aa, Entamoeba histolytica
INILRIGFVASLLARSGAIVVCAP

SEQ ID NO: 2582897 - protein, 17 aa, Entamoeba histolytica
INIPLKVLFTRGLQQTI

SEQ ID NO: 2582898 - protein, 24 aa, Entamoeba histolytica
INITFKTVCPFGCGEHGFCNNNGV

SEQ ID NO: 2582899 - protein, 31 aa, Entamoeba histolytica
INKCKEVKKNKCWKCSFWYGTNEEGNECNKE

SEQ ID NO: 2582900 - protein, 32 aa, Entamoeba histolytica
INKCKEVKNNKCWKCSFWYGTNEEGNECNKEV

SEQ ID NO: 2582901 - protein, 25 aa, Entamoeba histolytica
INKKCGAAIHSLKVNPWFTTEKDVN

SEQ ID NO: 2582902 - protein, 22 aa, Entamoeba histolytica
INKKCWDACQMMKINPMAIDKM

SEQ ID NO: 2582903 - protein, 23 aa, Entamoeba histolytica
INKKIGEQLLDWAKKSLSIDSCN

SEQ ID NO: 2582904 - protein, 18 aa, Entamoeba histolytica
INKKYKPVICKIKQPTQN

SEQ ID NO: 2582905 - protein, 17 aa, Entamoeba histolytica
INKRKETLVSMKMKIKF

SEQ ID NO: 2582906 - protein, 27 aa, Entamoeba histolytica
INKSCGEPMKFIFLIDVSKDSLTRVFD

SEQ ID NO: 2582907 - protein, 18 aa, Entamoeba histolytica
INKSRIELLTGITSLFHA

SEQ ID NO: 2582908 - protein, 19 aa, Entamoeba histolytica
INLLQYFLLHSCTGDDLKL

SEQ ID NO: 2582909 - protein, 25 aa, Entamoeba histolytica
INLNKGDMVLIDFSFFKRFLNIADS

SEQ ID NO: 2582910 - protein, 22 aa, Entamoeba histolytica
INLSSFPSYFKVEGSRQIQGVL

SEQ ID NO: 2582911 - protein, 17 aa, Entamoeba histolytica
INMNIVFAFVAGNQVNT

SEQ ID NO: 2582912 - protein, 17 aa, Entamoeba histolytica
INMYCLKSGSPEIETIQ

SEQ ID NO: 2582913 - protein, 19 aa, Entamoeba histolytica
INMYKWLIEIYYKEEKYNE

SEQ ID NO: 2582914 - protein, 24 aa, Entamoeba histolytica
INNDNKCKSLIITSDLIPSNINKA

SEQ ID NO: 2582915 - protein, 22 aa, Entamoeba histolytica
INNKCIKDICSNGVPISIINVS

SEQ ID NO: 2582916 - protein, 23 aa, Entamoeba histolytica
INNKCIKDICSNGVPISIINVSM

SEQ ID NO: 2582917 - protein, 25 aa, Entamoeba histolytica
INNLECYEGCILDYISITSLYIYHK

SEQ ID NO: 2582918 - protein, 21 aa, Entamoeba histolytica
INNLFCPIVVYLNTNGVDKLL

SEQ ID NO: 2582919 - protein, 18 aa, Entamoeba histolytica
INNVIAIFKSCNTQKDKD

SEQ ID NO: 2582920 - protein, 26 aa, Entamoeba histolytica
INNVIPRLVLNVGVTKSPLKSEGNIL

SEQ ID NO: 2582921 - protein, 18 aa, Entamoeba histolytica
INPIRKVIKEVFKTKIKT

SEQ ID NO: 2582922 - protein, 23 aa, Entamoeba histolytica
INPLCCTSCISICFVVVLVVANF

SEQ ID NO: 2582923 - protein, 18 aa, Entamoeba histolytica
INPLFPISVEEMKKMVKM

SEQ ID NO: 2582924 - protein, 20 aa, Entamoeba histolytica
INPLFSRGCFPRCGSCRNGL

SEQ ID NO: 2582925 - protein, 17 aa, Entamoeba histolytica
INQCFPKLIGDLDISSM

SEQ ID NO: 2582926 - protein, 20 aa, Entamoeba histolytica
INQIIHCLYGIKSIQFQFID

SEQ ID NO: 2582927 - protein, 36 aa, Entamoeba histolytica
INRISIAVNMLFDICLELGYFFTLKKSRKMSSTIRI

SEQ ID NO: 2582928 - protein, 22 aa, Entamoeba histolytica
INRKIRCLKIYKEWLTTPNSPS

SEQ ID NO: 2582929 - protein, 20 aa, Entamoeba histolytica
INRKRLIFLTSFTSIITSVC

SEQ ID NO: 2582930 - protein, 20 aa, Entamoeba histolytica
INSCGYCRSSKSSFCGICDD

SEQ ID NO: 2582931 - protein, 17 aa, Entamoeba histolytica
INSIFPILLLSLNGYKT

SEQ ID NO: 2582932 - protein, 26 aa, Entamoeba histolytica
INSLKRKGIFTLDGYRYCLVDYSIMD

SEQ ID NO: 2582933 - protein, 18 aa, Entamoeba histolytica
INSSMPVFILLLGIIFLF

SEQ ID NO: 2582934 - protein, 18 aa, Entamoeba histolytica
INTGISMMNSITKTQQTV

SEQ ID NO: 2582935 - protein, 23 aa, Entamoeba histolytica
INTPQYGSWFLIRGIEQSISIST

SEQ ID NO: 2582936 - protein, 19 aa, Entamoeba histolytica
INVCPTCVVNINGEYTESL

SEQ ID NO: 2582937 - protein, 21 aa, Entamoeba histolytica
INVEGRFLYDIIDAQDNALNS

SEQ ID NO: 2582938 - protein, 19 aa, Entamoeba histolytica
INVEGRFLYDIIDAQDNVL

SEQ ID NO: 2582939 - protein, 20 aa, Entamoeba histolytica
INVLVCAKCTTKVDDNIYIT

SEQ ID NO: 2582940 - protein, 22 aa, Entamoeba histolytica
INVPKLVLKSAIITANKDIKIP

SEQ ID NO: 2582941 - protein, 18 aa, Entamoeba histolytica
INVPYEYFRTIEINLVSN

SEQ ID NO: 2582942 - protein, 24 aa, Entamoeba histolytica
INYHSRESFTMYLTKFINFPMNTC

SEQ ID NO: 2582943 - protein, 24 aa, Entamoeba histolytica
INYLFKRLNQFFGQKLNFENIGII

SEQ ID NO: 2582944 - protein, 27 aa, Entamoeba histolytica
INYTVFGLTLLWFIVATSNFRKVLFGI

SEQ ID NO: 2582945 - protein, 20 aa, Entamoeba histolytica
IPAACIGIFIASRVEMVQMP

SEQ ID NO: 2582946 - protein, 21 aa, Entamoeba histolytica
IPAACIGIFIASRVEMVQMPQ

SEQ ID NO: 2582947 - protein, 21 aa, Entamoeba histolytica
IPADGLSCFCEQIWETIKDNK

SEQ ID NO: 2582948 - protein, 34 aa, Entamoeba histolytica; identical to SEQ ID NO: 2487370

SEQ ID NO: 2582949 - protein, 18 aa, Entamoeba histolytica
IPDAWPTQAGACLDEQEH

SEQ ID NO: 2582950 - protein, 23 aa, Entamoeba histolytica
IPDEMRYGYDIINGCKHNDILEN

SEQ ID NO: 2582951 - protein, 23 aa, Entamoeba histolytica
IPEEMRYGYDIINGCKHNDILEN

SEQ ID NO: 2582952 - protein, 23 aa, Entamoeba histolytica
IPEIVKYCVPFEVPVSINSIKKQ

SEQ ID NO: 2582953 - protein, 18 aa, Entamoeba histolytica
IPELSCVVSDTFRSNSFS

SEQ ID NO: 2582954 - protein, 22 aa, Entamoeba histolytica
IPFILQITISWGMKAALPITTA

SEQ ID NO: 2582955 - protein, 25 aa, Entamoeba histolytica
IPFLEAPCGFARTMNRSAGDDFSDV

SEQ ID NO: 2582956 - protein, 25 aa, Entamoeba histolytica
IPFLPWKYTFYFIRYLVNSLDEISL

SEQ ID NO: 2582957 - protein, 34 aa, Entamoeba histolytica
IPFNKKLFLFTIIFPCIGYYGIFHLNNSNRRERL

SEQ ID NO: 2582958 - protein, 19 aa, Entamoeba histolytica
IPFPYSLFIPKSYKEIAAF

SEQ ID NO: 2582959 - protein, 20 aa, Entamoeba histolytica
IPFVPILLRKGDSISSLDKT

SEQ ID NO: 2582960 - protein, 17 aa, Entamoeba histolytica
IPFWKIVIGVFVRMVLF

SEQ ID NO: 2582961 - protein, 25 aa, Entamoeba histolytica
IPHAKIVALLLWPSPTPLLYDDMKK

SEQ ID NO: 2582962 - protein, 17 aa, Entamoeba histolytica
IPHCKIYILQRSNYQGC

SEQ ID NO: 2582963 - protein, 23 aa, Entamoeba histolytica
IPHFISLNMLMRFHQVSHNCGEA

SEQ ID NO: 2582964 - protein, 22 aa, Entamoeba histolytica
IPHISVICAIIIAAYPIVDSTF

SEQ ID NO: 2582965 - protein, 22 aa, Entamoeba histolytica
IPHLCALSLLFYAPTTVHGELE

SEQ ID NO: 2582966 - protein, 20 aa, Entamoeba histolytica
IPHLTICLNHFSEPYYSNEI

SEQ ID NO: 2582967 - protein, 26 aa, Entamoeba histolytica
IPIATKFRIINEISKGLAYLHDLNPP

SEQ ID NO: 2582968 - protein, 22 aa, Entamoeba histolytica
IPICLKTLIEECWKQKPDERPK

SEQ ID NO: 2582969 - protein, 28 aa, Entamoeba histolytica
IPIHCFELLWKIFIVLKYGLLNKLILTN

SEQ ID NO: 2582970 - protein, 18 aa, Entamoeba histolytica
IPIINIFLSPFVFASLVV

SEQ ID NO: 2582971 - protein, 21 aa, Entamoeba histolytica
IPIIVKGLIGFKEDIIKDFYE

SEQ ID NO: 2582972 - protein, 19 aa, Entamoeba histolytica
IPIRCSDGYFLDSNNECIE

SEQ ID NO: 2582973 - protein, 25 aa, Entamoeba histolytica
IPISLRINLEISKVFYSLLINYDPN

SEQ ID NO: 2582974 - protein, 21 aa, Entamoeba histolytica
IPITLRYGQLGNILKDIKKEN

SEQ ID NO: 2582975 - protein, 17 aa, Entamoeba histolytica
IPIVARLTSCLLKTFPA

SEQ ID NO: 2582976 - protein, 17 aa, Entamoeba histolytica
IPKDVFKGVSVDVPQKI

SEQ ID NO: 2582977 - protein, 22 aa, Entamoeba histolytica
IPKLRRCALYSASIMIFTLNMI

SEQ ID NO: 2582978 - protein, 18 aa, Entamoeba histolytica
IPKNWRKVIQRIKNTAKQ

SEQ ID NO: 2582979 - protein, 24 aa, Entamoeba histolytica
IPKSSIPSFLGWYDVLKQLEKSSE

SEQ ID NO: 2582980 - protein, 17 aa, Entamoeba histolytica
IPLIFAWTKTSTQPASK

SEQ ID NO: 2582981 - protein, 28 aa, Entamoeba histolytica
IPLIKVFRGNGKWLKEFRVNEIDPGDTI

SEQ ID NO: 2582982 - protein, 18 aa, Entamoeba histolytica
IPLIQSWAKTSGHSANRL

SEQ ID NO: 2582983 - protein, 22 aa, Entamoeba histolytica
IPLLCLLIPCILEATKVTTLAI

SEQ ID NO: 2582984 - protein, 17 aa, Entamoeba histolytica
IPLLIHCISYFIQKDLS

SEQ ID NO: 2582985 - protein, 26 aa, Entamoeba histolytica
IPLLITGWFRLCGGIYNIVEIIPVGS

SEQ ID NO: 2582986 - protein, 23 aa, Entamoeba histolytica
IPLPPRAAVVLYYSYLGHSLEII

SEQ ID NO: 2582987 - protein, 18 aa, Entamoeba histolytica
IPLSLALLPEYIIGILSD

SEQ ID NO: 2582988 - protein, 18 aa, Entamoeba histolytica
IPLTCLIVLFWNIPKSKS

SEQ ID NO: 2582989 - protein, 18 aa, Entamoeba histolytica
IPLTIQWENGESVVVRYS

SEQ ID NO: 2582990 - protein, 19 aa, Entamoeba histolytica
IPLVILWIILIVIEIGIFA

SEQ ID NO: 2582991 - protein, 18 aa, Entamoeba histolytica
IPMYKLMIEDIINYMYDS

SEQ ID NO: 2582992 - protein, 31 aa, Entamoeba histolytica
IPNFLLCLDWLIVMVDFYFERQRSVFFGTFV

SEQ ID NO: 2582993 - protein, 23 aa, Entamoeba histolytica
IPNYVFWLSLPMLIKDGCKFIFC

SEQ ID NO: 2582994 - protein, 17 aa, Entamoeba histolytica
IPPMFRFLQCFRSARDS

SEQ ID NO: 2582995 - protein, 17 aa, Entamoeba histolytica
IPPSLIVSVEGWFGVLF

SEQ ID NO: 2582996 - protein, 20 aa, Entamoeba histolytica
IPQGEILSSVIIKTPIIRRI

SEQ ID NO: 2582997 - protein, 22 aa, Entamoeba histolytica
IPQLPEYIKYLYVQTRDSNIII

SEQ ID NO: 2582998 - protein, 19 aa, Entamoeba histolytica
IPQSLSFTNGFILPMFAYS

SEQ ID NO: 2582999 - protein, 18 aa, Entamoeba histolytica
IPSDCIIKTIQLCAKNKI

SEQ ID NO: 2583000 - protein, 25 aa, Entamoeba histolytica
IPSGHSKCTFAFLRINQPVDNVDVT

SEQ ID NO: 2583001 - protein, 18 aa, Entamoeba histolytica
IPSIGFLIVISFLREVLA

SEQ ID NO: 2583002 - protein, 24 aa, Entamoeba histolytica
IPSTEYKTSVVLLIQALSTILNQM

SEQ ID NO: 2583003 - protein, 21 aa, Entamoeba histolytica
IPTNGFRCVSEEVFEGQVVHG

SEQ ID NO: 2583004 - protein, 17 aa, Entamoeba histolytica
IPTRMVIDNTILQFTKE

SEQ ID NO: 2583005 - protein, 18 aa, Entamoeba histolytica
IPTSIKIICLNAFSNCNN

SEQ ID NO: 2583006 - protein, 26 aa, Entamoeba histolytica
IPTSMPFHYFMLFVRLLISLTNSIIL

SEQ ID NO: 2583007 - protein, 31 aa, Entamoeba histolytica
IPTTFGIKWLRLLFSREFPLDTVLQLWDGIF

SEQ ID NO: 2583008 - protein, 17 aa, Entamoeba histolytica
IPVGIILVFTTYNYYYF

SEQ ID NO: 2583009 - protein, 22 aa, Entamoeba histolytica
IPVIIAIGYILYVFIRQSNNTQ

SEQ ID NO: 2583010 - protein, 21 aa, Entamoeba histolytica
IPVLLCIVPAMIILSLIYSII

SEQ ID NO: 2583011 - protein, 24 aa, Entamoeba histolytica
IPVNRYTIPLIFYLTTSNNDFLQY

SEQ ID NO: 2583012 - protein, 17 aa, Entamoeba histolytica
IPWYGLVVASVVIPYYI

SEQ ID NO: 2583013 - protein, 18 aa, Entamoeba histolytica
IQAFPRNGLLLFVTTLRI

SEQ ID NO: 2583014 - protein, 22 aa, Entamoeba histolytica
IQAMVCLKCTTVINERVPVTIR

SEQ ID NO: 2583015 - protein, 17 aa, Entamoeba histolytica
IQAVFPFDSNRKRMSVL

SEQ ID NO: 2583016 - protein, 25 aa, Entamoeba histolytica
IQDGMSLKFGRLFQTFSSFITGYLI

SEQ ID NO: 2583017 - protein, 23 aa, Entamoeba histolytica
IQESFPIGILYPFHLLIESDVKT

SEQ ID NO: 2583018 - protein, 25 aa, Entamoeba histolytica
IQFFIIFKFIEFFLLDEALYTQFGF

SEQ ID NO: 2583019 - protein, 21 aa, Entamoeba histolytica
IQFGVCTSAKGFIEPLYGYFA

SEQ ID NO: 2583020 - protein, 25 aa, Entamoeba histolytica
IQFLSKRPTHYFLYYINDIILHLVI

SEQ ID NO: 2583021 - protein, 20 aa, Entamoeba histolytica
IQFPYSHIGLGRISNYIQVV

SEQ ID NO: 2583022 - protein, 26 aa, Entamoeba histolytica
IQFTRIKIYPGTCGVVLILTISDKIF

SEQ ID NO: 2583023 - protein, 19 aa, Entamoeba histolytica
IQFVSCPNIHIQGTVMVKN

SEQ ID NO: 2583024 - protein, 23 aa, Entamoeba histolytica
IQKHPLAACLIVVFIAYSCYGIY

SEQ ID NO: 2583025 - protein, 23 aa, Entamoeba histolytica
IQKLRFFVRLIPLFIPILLIGMY

SEQ ID NO: 2583026 - protein, 17 aa, Entamoeba histolytica
IQLFSLDFKQGVIVNED

SEQ ID NO: 2583027 - protein, 29 aa, Entamoeba histolytica
IQLFVFSCVLYIFICLMFLISTVYQLQIW

SEQ ID NO: 2583028 - protein, 21 aa, Entamoeba histolytica
IQLKFGIIVERILGSSWYFIM

SEQ ID NO: 2583029 - protein, 19 aa, Entamoeba histolytica
IQLYDTFLPFLIKALKRTD

SEQ ID NO: 2583030 - protein, 30 aa, Entamoeba histolytica
IQNIIFQFCEILYAWSCIDVFIVSVIAAVV

SEQ ID NO: 2583031 - protein, 25 aa, Entamoeba histolytica
IQNNCKYVKMILGHISLLFSPENRC

SEQ ID NO: 2583032 - protein, 27 aa, Entamoeba histolytica
IQNNCKYVKMILGHISLLFSPENRCCS

SEQ ID NO: 2583033 - protein, 24 aa, Entamoeba histolytica
IQNPRKRLGLVLQMQDEPYALELI

SEQ ID NO: 2583034 - protein, 22 aa, Entamoeba histolytica
IQPLKRLNHIICQRELTRTKFS

SEQ ID NO: 2583035 - protein, 29 aa, Entamoeba histolytica
IQQPRVLLRIKYEYPFEIIEKGISNEGGM

SEQ ID NO: 2583036 - protein, 24 aa, Entamoeba histolytica
IQREVPRHPVAFVIETLGGIIVDN

SEQ ID NO: 2583037 - protein, 20 aa, Entamoeba histolytica
IQSACKRLQFGEPGKSEIQF

SEQ ID NO: 2583038 - protein, 18 aa, Entamoeba histolytica
IQSIRIVKNHHRFCGFQN

SEQ ID NO: 2583039 - protein, 18 aa, Entamoeba histolytica
IQSSIGILQVFFVIVSLI

SEQ ID NO: 2583040 - protein, 23 aa, Entamoeba histolytica
IQSTVCCKLGHYWNISQMTGLPK

SEQ ID NO: 2583041 - protein, 21 aa, Entamoeba histolytica
IQTEIPEVLQIFKRYSKTPQQ

SEQ ID NO: 2583042 - protein, 18 aa, Entamoeba histolytica
IQTEISRTLEISRNHQCP

SEQ ID NO: 2583043 - protein, 19 aa, Entamoeba histolytica
IQTGHRVDRKFGWDTHGLP

SEQ ID NO: 2583044 - protein, 23 aa, Entamoeba histolytica
IQVYYKAGGSWGPLQNEMIVSID

SEQ ID NO: 2583045 - protein, 25 aa, Entamoeba histolytica
IQWKDIKVGDILLVKRKEAIPADIL

SEQ ID NO: 2583046 - protein, 19 aa, Entamoeba histolytica
IQYCDGRISISIRYNTSSV

SEQ ID NO: 2583047 - protein, 17 aa, Entamoeba histolytica
IQYQGYIPLQFETELST

SEQ ID NO: 2583048 - protein, 20 aa, Entamoeba histolytica
IRATMSISFIFTLLLIGVFI

SEQ ID NO: 2583049 - protein, 19 aa, Entamoeba histolytica
IRCLCVVLMFGCNGVGGFF

SEQ ID NO: 2583050 - protein, 17 aa, Entamoeba histolytica
IRDPVLFLFAHADDDAM

SEQ ID NO: 2583051 - protein, 24 aa, Entamoeba histolytica
IREETFKIVLNWIKLKGSTNQEEV

SEQ ID NO: 2583052 - protein, 25 aa, Entamoeba histolytica
IREFGKKYLGLKCPHAQFTKAKSAI

SEQ ID NO: 2583053 - protein, 23 aa, Entamoeba histolytica
IRELRKSELLNFIDSPPALSPFS

SEQ ID NO: 2583054 - protein, 19 aa, Entamoeba histolytica
IREPFKHKFVRSLILTIVE

SEQ ID NO: 2583055 - protein, 20 aa, Entamoeba histolytica
IRFNQWFLTFTFVLAFILWP

SEQ ID NO: 2583056 - protein, 21 aa, Entamoeba histolytica
IRFSIEYSGNFSIHISTTEEN

SEQ ID NO: 2583057 - protein, 19 aa, Entamoeba histolytica
IRFSNPFKSGNFIDAKNVM

SEQ ID NO: 2583058 - protein, 18 aa, Entamoeba histolytica
IRGIGCKFGPDIVNRFLS

SEQ ID NO: 2583059 - protein, 17 aa, Entamoeba histolytica
IRGIKNFIFFSCGTLVL

SEQ ID NO: 2583060 - protein, 21 aa, Entamoeba histolytica
IRGRCIEIIDKFLLNNNDFTL

SEQ ID NO: 2583061 - protein, 21 aa, Entamoeba histolytica
IRINGKMFIRNGFYMDKEIQT

SEQ ID NO: 2583062 - protein, 21 aa, Entamoeba histolytica
IRKFGKKYVGLKCPHAQFTEA

SEQ ID NO: 2583063 - protein, 23 aa, Entamoeba histolytica
IRKKDIDCLYSLIPVLSVILPLN

SEQ ID NO: 2583064 - protein, 20 aa, Entamoeba histolytica
IRLLISIPFSLNIPTLFYPI

SEQ ID NO: 2583065 - protein, 18 aa, Entamoeba histolytica
IRNIKFIKYNSWEESMKK

SEQ ID NO: 2583066 - protein, 24 aa, Entamoeba histolytica
IRNTERLLLFIVYCGFDTKLAKNS

SEQ ID NO: 2583067 - protein, 18 aa, Entamoeba histolytica
IRNYLCSFDEIISETSFG

SEQ ID NO: 2583068 - protein, 17 aa, Entamoeba histolytica
IRRIRRLYIKSLLDQEM

SEQ ID NO: 2583069 - protein, 19 aa, Entamoeba histolytica
IRRKKRVGEDIGIEMLEEG

SEQ ID NO: 2583070 - protein, 20 aa, Entamoeba histolytica
IRRSEERRGIQLSHNIRKFP

SEQ ID NO: 2583071 - protein, 18 aa, Entamoeba histolytica
IRSFIYFIKQFHKENKLI

SEQ ID NO: 2583072 - protein, 20 aa, Entamoeba histolytica
IRSHTPFLRKAIKERFYLFV

SEQ ID NO: 2583073 - protein, 23 aa, Entamoeba histolytica
IRSIIMKHFIYVVSYSKLQKIFL

SEQ ID NO: 2583074 - protein, 19 aa, Entamoeba histolytica
IRSQFIINFIGSVITPDKL

SEQ ID NO: 2583075 - protein, 23 aa, Entamoeba histolytica
IRSSEFFMYKKWFFETLGKMMRK

SEQ ID NO: 2583076 - protein, 22 aa, Entamoeba histolytica
IRTLCRSQIPSSLRSSIYKLFL

SEQ ID NO: 2583077 - protein, 25 aa, Entamoeba histolytica
IRVACINGPCDLTFYMEYTSTSKHD

SEQ ID NO: 2583078 - protein, 21 aa, Entamoeba histolytica
IRVGANLIKKGTVRITVYTIP

SEQ ID NO: 2583079 - protein, 18 aa, Entamoeba histolytica
IRVITLRRSYTCNSRYST

SEQ ID NO: 2583080 - protein, 19 aa, Entamoeba histolytica
IRVNLPLAAPNDMYLGLFF

SEQ ID NO: 2583081 - protein, 17 aa, Entamoeba histolytica
IRYAFNVEVDKKIQGSD

SEQ ID NO: 2583082 - protein, 19 aa, Entamoeba histolytica
IRYPSIYVLPTIQESIPYQ

SEQ ID NO: 2583083 - protein, 24 aa, Entamoeba histolytica
ISAISLQPFHCFELTHYNILKSIQ

SEQ ID NO: 2583084 - protein, 21 aa, Entamoeba histolytica
ISALCPPFFFYIQRIYSKSED

SEQ ID NO: 2583085 - protein, 18 aa, Entamoeba histolytica
ISANSLSELCHFNGQKTV

SEQ ID NO: 2583086 - protein, 18 aa, Entamoeba histolytica
ISAWEVFYQDEPYKDFKS

SEQ ID NO: 2583087 - protein, 19 aa, Entamoeba histolytica
ISCFLNFIWPKESIEKAYE

SEQ ID NO: 2583088 - protein, 19 aa, Entamoeba histolytica
ISCKSRKSIPSTFLPSHLS

SEQ ID NO: 2583089 - protein, 21 aa, Entamoeba histolytica
ISDEMILFVQLIRYISNLPKM

SEQ ID NO: 2583090 - protein, 22 aa, Entamoeba histolytica
ISDFWEHVCIVWTKCSCDTPEK

SEQ ID NO: 2583091 - protein, 23 aa, Entamoeba histolytica
ISDNRKNLLISFALSPLPICIVS

SEQ ID NO: 2583092 - protein, 21 aa, Entamoeba histolytica
ISDRRSVSIASTFSSSKFSVE

SEQ ID NO: 2583093 - protein, 22 aa, Entamoeba histolytica
ISELKELWILPVASIIHTSLQF

SEQ ID NO: 2583094 - protein, 20 aa, Entamoeba histolytica
ISELVCSIMIILNYIVLSYF

SEQ ID NO: 2583095 - protein, 20 aa, Entamoeba histolytica
ISERVISYFIQVYCETVDRF

SEQ ID NO: 2583096 - protein, 17 aa, Entamoeba histolytica
ISEYGFKQICERHKENH

SEQ ID NO: 2583097 - protein, 17 aa, Entamoeba histolytica
ISFFSLIFLVQSTTYEI

SEQ ID NO: 2583098 - protein, 23 aa, Entamoeba histolytica
ISFIFNCVSTIFLICQLVLLTLD

SEQ ID NO: 2583099 - protein, 17 aa, Entamoeba histolytica
ISFLMYVLCSLGYTFVV

SEQ ID NO: 2583100 - protein, 24 aa, Entamoeba histolytica
ISFPNLFNSIPFIYLYFSIDGINS

SEQ ID NO: 2583101 - protein, 18 aa, Entamoeba histolytica
ISGFSCGVTYLILGLGSV

SEQ ID NO: 2583102 - protein, 19 aa, Entamoeba histolytica
ISGLQIKSGYLILSSKRIL

SEQ ID NO: 2583103 - protein, 20 aa, Entamoeba histolytica
ISGLQIRAGYNILSSKRILM

SEQ ID NO: 2583104 - protein, 17 aa, Entamoeba histolytica
ISGLTFNGIEWPDVNGT

SEQ ID NO: 2583105 - protein, 21 aa, Entamoeba histolytica
ISGQMNCNWIGKMNKHYKLFI

SEQ ID NO: 2583106 - protein, 19 aa, Entamoeba histolytica
ISGRLLVGLRWWNKVNEDG

SEQ ID NO: 2583107 - protein, 18 aa, Entamoeba histolytica
ISGWRCLMYGPTTFLLFI

SEQ ID NO: 2583108 - protein, 20 aa, Entamoeba histolytica
ISIIFSWKKTSGIAVSKVVL

SEQ ID NO: 2583109 - protein, 17 aa, Entamoeba histolytica
ISIIVTFGGIDIVRKAA

SEQ ID NO: 2583110 - protein, 35 aa, Entamoeba histolytica
ISIKCKYTPFIIPMILEFVLFLSFVLNPIIGCQYI

SEQ ID NO: 2583111 - protein, 32 aa, Entamoeba histolytica
ISIKLPFGMNIKNYWFNPAFNNIFSFKENHAL

SEQ ID NO: 2583112 - protein, 22 aa, Entamoeba histolytica
ISILLPKFLTFSALPIESVNKC

SEQ ID NO: 2583113 - protein, 23 aa, Entamoeba histolytica
ISIPFKLYTTFIIREKYGMNNMS

SEQ ID NO: 2583114 - protein, 24 aa, Entamoeba histolytica
ISIPHPFWCKYIKIHQTSWYGKEY

SEQ ID NO: 2583115 - protein, 24 aa, Entamoeba histolytica
ISISEFIILILIIRISAVTGISED

SEQ ID NO: 2583116 - protein, 25 aa, Entamoeba histolytica
ISITSRIEGTFTFKKPVKLKNIHSP

SEQ ID NO: 2583117 - protein, 20 aa, Entamoeba histolytica
ISIYHQWLFGDHIPKAIQDN

SEQ ID NO: 2583118 - protein, 17 aa, Entamoeba histolytica
ISKAIEVLPEWAQLDAT

SEQ ID NO: 2583119 - protein, 24 aa, Entamoeba histolytica
ISKALNNFFFWGIGSIVYILYFIF

SEQ ID NO: 2583120 - protein, 22 aa, Entamoeba histolytica
ISKLCKESMKFEKEIKEMKKIN

SEQ ID NO: 2583121 - protein, 19 aa, Entamoeba histolytica
ISKNCYESFQMMHTNPNYS

SEQ ID NO: 2583122 - protein, 31 aa, Entamoeba histolytica
ISKNHYKQHFEVIKTIVLLPHQLSEMALITI

SEQ ID NO: 2583123 - protein, 17 aa, Entamoeba histolytica
ISKTHWLPSTGIKEINS

SEQ ID NO: 2583124 - protein, 25 aa, Entamoeba histolytica
ISKYLNKWISSTFMNFRKEKPRKIS

SEQ ID NO: 2583125 - protein, 17 aa, Entamoeba histolytica
ISLKDIMQFPVLYAEMQ

SEQ ID NO: 2583126 - protein, 24 aa, Entamoeba histolytica
ISLKELYTVDGLDEMKLVGLLLVY

SEQ ID NO: 2583127 - protein, 23 aa, Entamoeba histolytica
ISLKSAISLACQFQLLFFINVIL

SEQ ID NO: 2583128 - protein, 21 aa, Entamoeba histolytica
ISLLHLCYLYTLNIIKNQTTM

SEQ ID NO: 2583129 - protein, 23 aa, Entamoeba histolytica
ISLLSPFCGFSIKKPRKKTIVRH

SEQ ID NO: 2583130 - protein, 20 aa, Entamoeba histolytica
ISLPTSYKFNIQTNVNNMSI

SEQ ID NO: 2583131 - protein, 26 aa, Entamoeba histolytica
ISLRVFDFILMDGFCALMSVARTIMF

SEQ ID NO: 2583132 - protein, 25 aa, Entamoeba histolytica
ISLSDLRWIKSNLITASSFTSQLSQ

SEQ ID NO: 2583133 - protein, 19 aa, Entamoeba histolytica
ISLSLSFTIMNFLKYCRFN

SEQ ID NO: 2583134 - protein, 26 aa, Entamoeba histolytica
ISLVMCYKQRLSVIHYLYSLIPLATV

SEQ ID NO: 2583135 - protein, 25 aa, Entamoeba histolytica
ISLVVPHIFVFSTFVIFGCDFVFKS

SEQ ID NO: 2583136 - protein, 24 aa, Entamoeba histolytica
ISMPRSGSTFTHFCLVSDPHASSI

SEQ ID NO: 2583137 - protein, 25 aa, Entamoeba histolytica
ISNGECRTIIRPSNFDDVTNPKKIW

SEQ ID NO: 2583138 - protein, 20 aa, Entamoeba histolytica
ISNISFKWLTNEWLHLSELK

SEQ ID NO: 2583139 - protein, 17 aa, Entamoeba histolytica
ISNMVIGQYVFIFVGLY

SEQ ID NO: 2583140 - protein, 19 aa, Entamoeba histolytica
ISNNIIIMIQIMSKIFPSH

SEQ ID NO: 2583141 - protein, 20 aa, Entamoeba histolytica
ISNNIKIMIEIMSKIFSSQD

SEQ ID NO: 2583142 - protein, 24 aa, Entamoeba histolytica
ISNPLVPFHSCFALIQSSPENLDQ

SEQ ID NO: 2583143 - protein, 23 aa, Entamoeba histolytica
ISNRETPPLISLLALAEGLVFVV

SEQ ID NO: 2583144 - protein, 25 aa, Entamoeba histolytica
ISNVLRIGFYIGEPFEISLLIQSIF

SEQ ID NO: 2583145 - protein, 20 aa, Entamoeba histolytica
ISPDFSYIFNVIKKEVMKKW

SEQ ID NO: 2583146 - protein, 25 aa, Entamoeba histolytica
ISPEAPPLFLFFKCSDNIALDEARK

SEQ ID NO: 2583147 - protein, 22 aa, Entamoeba histolytica
ISPFRISYRLTSKCECSSKDKI

SEQ ID NO: 2583148 - protein, 17 aa, Entamoeba histolytica
ISPFVPINFNGTIRCSL

SEQ ID NO: 2583149 - protein, 20 aa, Entamoeba histolytica
ISPKMKNVIMKCWEQEPNQR

SEQ ID NO: 2583150 - protein, 17 aa, Entamoeba histolytica
ISPYRIAIGSLPFSRNQ

SEQ ID NO: 2583151 - protein, 21 aa, Entamoeba histolytica
ISQCKTGTCTDKWYKLTGNSV

SEQ ID NO: 2583152 - protein, 25 aa, Entamoeba histolytica
ISQFKDIEGFFGYYPVDEPLTTFID

SEQ ID NO: 2583153 - protein, 26 aa, Entamoeba histolytica
ISQVEPRLAVAVVLLFLYLGIFAGDI

SEQ ID NO: 2583154 - protein, 24 aa, Entamoeba histolytica
ISRCGQCLEIKGPVGDPLYCVVAG

SEQ ID NO: 2583155 - protein, 22 aa, Entamoeba histolytica
ISRDFLQWFVLYTINQSINIIF

SEQ ID NO: 2583156 - protein, 21 aa, Entamoeba histolytica
ISRIKKYFLLFVNNLTVGKGL

SEQ ID NO: 2583157 - protein, 18 aa, Entamoeba histolytica
ISRMGCLATILPNINISK

SEQ ID NO: 2583158 - protein, 17 aa, Entamoeba histolytica
ISRNRFWGTPIPIWTDD

SEQ ID NO: 2583159 - protein, 26 aa, Entamoeba histolytica
ISRPDIYTRGSICLIKNMLKNQPTLL

SEQ ID NO: 2583160 - protein, 23 aa, Entamoeba histolytica
ISRSTIRGTLLLRNVNICECSIH

SEQ ID NO: 2583161 - protein, 18 aa, Entamoeba histolytica
ISSAIWKGRDEEIVHCVI

SEQ ID NO: 2583162 - protein, 23 aa, Entamoeba histolytica
ISSCLRLASGAIYKNDRKNDYFL

SEQ ID NO: 2583163 - protein, 17 aa, Entamoeba histolytica
ISSCVIFPLSLTQMDIS

SEQ ID NO: 2583164 - protein, 17 aa, Entamoeba histolytica
ISSDFFTLMFKKSNTLE

SEQ ID NO: 2583165 - protein, 20 aa, Entamoeba histolytica
ISSFCNKLFPLLQQIMKLMT

SEQ ID NO: 2583166 - protein, 24 aa, Entamoeba histolytica
ISSFYRLGFKGTYEGDCFGFLFDE

SEQ ID NO: 2583167 - protein, 22 aa, Entamoeba histolytica
ISSIEIKFNYGIQLPDIITLTP

SEQ ID NO: 2583168 - protein, 17 aa, Entamoeba histolytica
ISSIITLILIYLLIQQK

SEQ ID NO: 2583169 - protein, 17 aa, Entamoeba histolytica
ISSKDTFIFVSKTKNGK

SEQ ID NO: 2583170 - protein, 26 aa, Entamoeba histolytica
ISSNNRINCKIKECYNSLECLTDEYN

SEQ ID NO: 2583171 - protein, 28 aa, Entamoeba histolytica
ISTATSCIFGFLALFYPFTWPGIFIPYI

SEQ ID NO: 2583172 - protein, 17 aa, Entamoeba histolytica
ISTISLYLYRVIQQNSA

SEQ ID NO: 2583173 - protein, 25 aa, Entamoeba histolytica
ISTLCSLFKLGRIPADSLFDSISQI

SEQ ID NO: 2583174 - protein, 18 aa, Entamoeba histolytica
ISTLIKAGMGFLSIFCLR

SEQ ID NO: 2583175 - protein, 21 aa, Entamoeba histolytica
ISTMRIRGVNQFKGSQAIKVD

SEQ ID NO: 2583176 - protein, 21 aa, Entamoeba histolytica
ISTRTAGFAFLDFSKISSGCY

SEQ ID NO: 2583177 - protein, 23 aa, Entamoeba histolytica
ISTTCLFSSIFIYFFEQANVYCR

SEQ ID NO: 2583178 - protein, 21 aa, Entamoeba histolytica
ISTVAGIPIDFAERSVELCKK

SEQ ID NO: 2583179 - protein, 25 aa, Entamoeba histolytica
ISTVPCPFKPYEVAQGYMVWGKKVC

SEQ ID NO: 2583180 - protein, 24 aa, Entamoeba histolytica
ISVKVPVGVWFHFALCCDEISTVY

SEQ ID NO: 2583181 - protein, 21 aa, Entamoeba histolytica
ISVVKRDGVVLAESSKYPIVT

SEQ ID NO: 2583182 - protein, 22 aa, Entamoeba histolytica
ISYCLIGYCLAQTKYICQVKQN

SEQ ID NO: 2583183 - protein, 18 aa, Entamoeba histolytica
ISYCNIVFMSLPYNNQIM

SEQ ID NO: 2583184 - protein, 25 aa, Entamoeba histolytica
ISYFEYFFELCFTRGVGCENLKEFL

SEQ ID NO: 2583185 - protein, 27 aa, Entamoeba histolytica
ISYIFVCLSCGGIYLLIVFNKANKKQN

SEQ ID NO: 2583186 - protein, 17 aa, Entamoeba histolytica
ITADLFLVFLKQLKEKS

SEQ ID NO: 2583187 - protein, 18 aa, Entamoeba histolytica
ITAGIAIAPGLILKTKIV

SEQ ID NO: 2583188 - protein, 18 aa, Entamoeba histolytica
ITAWELFYAEEPYKEFKS

SEQ ID NO: 2583189 - protein, 23 aa, Entamoeba histolytica
ITCHFQHYIAFGIYQVIIGVITF

SEQ ID NO: 2583190 - protein, 25 aa, Entamoeba histolytica
ITDAVECFLRLVLMLLLSILLKTRD

SEQ ID NO: 2583191 - protein, 26 aa, Entamoeba histolytica
ITDVLCCSTLEAVCGIFSLAPLSLGE

SEQ ID NO: 2583192 - protein, 21 aa, Entamoeba histolytica
ITEFIKCIYLNKNYSLKEDKI

SEQ ID NO: 2583193 - protein, 21 aa, Entamoeba histolytica
ITEGVNNHWSFNFQEDHSSLK

SEQ ID NO: 2583194 - protein, 19 aa, Entamoeba histolytica
ITFKPSFHLFQYSYKNQTS

SEQ ID NO: 2583195 - protein, 25 aa, Entamoeba histolytica
ITFPFPLKISHHYTVLFQQYTMDHP

SEQ ID NO: 2583196 - protein, 25 aa, Entamoeba histolytica
ITFSEFIIQMSLDFKNFEDIPVGYR

SEQ ID NO: 2583197 - protein, 24 aa, Entamoeba histolytica
ITFVSLRWIIPYILFDVIIPMIIG

SEQ ID NO: 2583198 - protein, 17 aa, Entamoeba histolytica
ITGNLSIPLGEFYTKPV

SEQ ID NO: 2583199 - protein, 19 aa, Entamoeba histolytica
ITHDPRILLLYTKTTSLPK

SEQ ID NO: 2583200 - protein, 17 aa, Entamoeba histolytica
ITHTLGIIIKRKHSDIV

SEQ ID NO: 2583201 - protein, 26 aa, Entamoeba histolytica
ITICRPRKQCSVALCCAKVQTIHVNS

SEQ ID NO: 2583202 - protein, 18 aa, Entamoeba histolytica
ITICYNRATLIVFYLVGG

SEQ ID NO: 2583203 - protein, 26 aa, Entamoeba histolytica
ITIFKRFPALLPQLSVASFGFIALIL

SEQ ID NO: 2583204 - protein, 20 aa, Entamoeba histolytica
ITINYSWKEIRCIGSESTLL

SEQ ID NO: 2583205 - protein, 27 aa, Entamoeba histolytica
ITIQRVIPILLHFGSLFKENLLVFNCE

SEQ ID NO: 2583206 - protein, 19 aa, Entamoeba histolytica
ITIRGSYNPIWKGSDSSFL

SEQ ID NO: 2583207 - protein, 17 aa, Entamoeba histolytica
ITIWLTGLFIHYVITNK

SEQ ID NO: 2583208 - protein, 22 aa, Entamoeba histolytica
ITKCVISIIGIVLTRKDVIIFS

SEQ ID NO: 2583209 - protein, 19 aa, Entamoeba histolytica
ITKFIKWAYKLPTMSFPID

SEQ ID NO: 2583210 - protein, 25 aa, Entamoeba histolytica
ITKGLKEWGGAILVGFDGDPDGKDE

SEQ ID NO: 2583211 - protein, 24 aa, Entamoeba histolytica
ITKHKLHAGMILGAVSKRIIDMKD

SEQ ID NO: 2583212 - protein, 26 aa, Entamoeba histolytica
ITKQKDCIRKGFKPITYHIINTENCP

SEQ ID NO: 2583213 - protein, 17 aa, Entamoeba histolytica
ITLICIIAFSSRLYSII

SEQ ID NO: 2583214 - protein, 17 aa, Entamoeba histolytica
ITLIFIFINECIEDKKC

SEQ ID NO: 2583215 - protein, 24 aa, Entamoeba histolytica
ITLLRVSPVFPFPIINYILPPVVD

SEQ ID NO: 2583216 - protein, 18 aa, Entamoeba histolytica
ITLMEHQVCLCFLLLLFS

SEQ ID NO: 2583217 - protein, 18 aa, Entamoeba histolytica
ITLRRMYLPWALVVLNFI

SEQ ID NO: 2583218 - protein, 31 aa, Entamoeba histolytica
ITLTMFVSEFTRLGGIGLILEKIMKYEGNVQ

SEQ ID NO: 2583219 - protein, 18 aa, Entamoeba histolytica
ITLWKLTRVFTLNFKEKG

SEQ ID NO: 2583220 - protein, 20 aa, Entamoeba histolytica
ITMYECFKWGEAYDKEKFVY

SEQ ID NO: 2583221 - protein, 21 aa, Entamoeba histolytica
ITMYETMKWGGAYDNWDGLFE

SEQ ID NO: 2583222 - protein, 18 aa, Entamoeba histolytica
ITNCRKETLSFILHGHEE

SEQ ID NO: 2583223 - protein, 18 aa, Entamoeba histolytica
ITNICFSNPPKFTEPTKT

SEQ ID NO: 2583224 - protein, 19 aa, Entamoeba histolytica
ITNKIFLIIMAIVFLIIIG

SEQ ID NO: 2583225 - protein, 19 aa, Entamoeba histolytica
ITNNEFWGFRGQNMNSDKK

SEQ ID NO: 2583226 - protein, 22 aa, Entamoeba histolytica
ITNVIKLLFGLMVKDIKVNEWC

SEQ ID NO: 2583227 - protein, 20 aa, Entamoeba histolytica
ITPPFWMEYVHCFTIPLLGF

SEQ ID NO: 2583228 - protein, 19 aa, Entamoeba histolytica
ITPTFKYEHCKIITSTSNI

SEQ ID NO: 2583229 - protein, 19 aa, Entamoeba histolytica
ITQKIAVILIFLVLMLQFG

SEQ ID NO: 2583230 - protein, 25 aa, Entamoeba histolytica
ITRMLTFIVHRLFEQKSKHCSKPQP

SEQ ID NO: 2583231 - protein, 24 aa, Entamoeba histolytica
ITSACLWVSFWRTRNEIHKNIKNV

SEQ ID NO: 2583232 - protein, 21 aa, Entamoeba histolytica
ITSESLLECEGSIDSFSFKII

SEQ ID NO: 2583233 - protein, 25 aa, Entamoeba histolytica
ITSFLCKISGIKLIDFYCGECNKLL

SEQ ID NO: 2583234 - protein, 24 aa, Entamoeba histolytica
ITSLPFKITIPMLNFVPEEQMCNN

SEQ ID NO: 2583235 - protein, 19 aa, Entamoeba histolytica
ITTCKTLGLYNRECKLTDS

SEQ ID NO: 2583236 - protein, 19 aa, Entamoeba histolytica
ITTCSSYTRMPVKIELFDN

SEQ ID NO: 2583237 - protein, 26 aa, Entamoeba histolytica
ITTEILRYSCKIIKSINSGEIKENLN

SEQ ID NO: 2583238 - protein, 24 aa, Entamoeba histolytica
ITTKEVPTWAIAVIVIVGVIIVIA

SEQ ID NO: 2583239 - protein, 19 aa, Entamoeba histolytica
ITTMRYNLFLYYKNSGLSY

SEQ ID NO: 2583240 - protein, 21 aa, Entamoeba histolytica
ITTTEGWAFGAFIAGHIPVPS

SEQ ID NO: 2583241 - protein, 20 aa, Entamoeba histolytica
ITVFGFRGSNKFSDWVYDFK

SEQ ID NO: 2583242 - protein, 23 aa, Entamoeba histolytica
ITVFPQIVSIYFQRRIKPTNTQL

SEQ ID NO: 2583243 - protein, 18 aa, Entamoeba histolytica
ITVSRLVLLIPFVSYDND

SEQ ID NO: 2583244 - protein, 18 aa, Entamoeba histolytica
ITVWDSFNKYCCNINKSC

SEQ ID NO: 2583245 - protein, 19 aa, Entamoeba histolytica
ITVYTRHWTIYTGLNTLLL

SEQ ID NO: 2583246 - protein, 31 aa, Entamoeba histolytica
ITWLYVFERCLGFVNFLSCFFKVLKTFFTQN

SEQ ID NO: 2583247 - protein, 23 aa, Entamoeba histolytica
ITYVLGLFLQFAMILADRIIYLC

SEQ ID NO: 2583248 - protein, 19 aa, Entamoeba histolytica
IVAFEGIFGLIETVFIACP

SEQ ID NO: 2583249 - protein, 23 aa, Entamoeba histolytica
IVCFCIIIPISLFKNLSALKYSS

SEQ ID NO: 2583250 - protein, 22 aa, Entamoeba histolytica
IVCLSLPIVKIIRVICKEKSPD

SEQ ID NO: 2583251 - protein, 22 aa, Entamoeba histolytica
IVDFLPYMKWWFTTENGELPST

SEQ ID NO: 2583252 - protein, 24 aa, Entamoeba histolytica
IVFIVLTLWWFYKAITFTGYVQPD

SEQ ID NO: 2583253 - protein, 24 aa, Entamoeba histolytica
IVFVLYCWYYSYSLILILLPLFIY

SEQ ID NO: 2583254 - protein, 18 aa, Entamoeba histolytica
IVGVCIFSLIILSHKKAC

SEQ ID NO: 2583255 - protein, 24 aa, Entamoeba histolytica
IVGVKIGRELLKCVTRALTQNLNL

SEQ ID NO: 2583256 - protein, 17 aa, Entamoeba histolytica
IVGVLAFILIKLYIKAR

SEQ ID NO: 2583257 - protein, 18 aa, Entamoeba histolytica
IVIDSSFFDKDFNDKTII

SEQ ID NO: 2583258 - protein, 17 aa, Entamoeba histolytica
IVIFFVKVVKGVIINEI

SEQ ID NO: 2583259 - protein, 18 aa, Entamoeba histolytica
IVIGCLLVIICFLIILVV

SEQ ID NO: 2583260 - protein, 29 aa, Entamoeba histolytica
IVIGLVKGWLKPSCSVTIWTINVDLQVLY

SEQ ID NO: 2583261 - protein, 23 aa, Entamoeba histolytica
IVIISVIAFFWFTRKPRSSHSQN

SEQ ID NO: 2583262 - protein, 20 aa, Entamoeba histolytica
IVISLTSLYLFQSILSFPMQ

SEQ ID NO: 2583263 - protein, 20 aa, Entamoeba histolytica
IVIYLFWLLFEVIRSFSERR

SEQ ID NO: 2583264 - protein, 19 aa, Entamoeba histolytica
IVKEEMKDGIPLVVTGHSL

SEQ ID NO: 2583265 - protein, 23 aa, Entamoeba histolytica
IVKKRIFSITLLVIVSILFIDAF

SEQ ID NO: 2583266 - protein, 17 aa, Entamoeba histolytica
IVLFWVFVLVWRKKKLI

SEQ ID NO: 2583267 - protein, 19 aa, Entamoeba histolytica
IVLIMFCLMLAFHISNYYK

SEQ ID NO: 2583268 - protein, 23 aa, Entamoeba histolytica
IVLLEIITAILILIIIVSIVCVV

SEQ ID NO: 2583269 - protein, 18 aa, Entamoeba histolytica
IVLLICVTLVFIIFHRNQ

SEQ ID NO: 2583270 - protein, 25 aa, Entamoeba histolytica
IVLNFCICVCCCKLIVHDRKSEKFT

SEQ ID NO: 2583271 - protein, 23 aa, Entamoeba histolytica
IVLVETIILWSVIIAQRKRINTL

SEQ ID NO: 2583272 - protein, 24 aa, Entamoeba histolytica
IVLYLLVLFFSWICERKLDKVILA

SEQ ID NO: 2583273 - protein, 17 aa, Entamoeba histolytica
IVMGLFTFVSRKYVYRN

SEQ ID NO: 2583274 - protein, 24 aa, Entamoeba histolytica
IVMIPFCVFIYRFEWTLDNNQVVP

SEQ ID NO: 2583275 - protein, 25 aa, Entamoeba histolytica
IVMIPLYFNDCFKLLSPSSILNIFI

SEQ ID NO: 2583276 - protein, 18 aa, Entamoeba histolytica
IVMSCLTFFMTGVFGLVT

SEQ ID NO: 2583277 - protein, 23 aa, Entamoeba histolytica
IVNAIYFKGEWETPFKIVQKKMK

SEQ ID NO: 2583278 - protein, 20 aa, Entamoeba histolytica
IVNKEERNREVIHTHKYANQ

SEQ ID NO: 2583279 - protein, 17 aa, Entamoeba histolytica
IVNRAYKNIQCQLDAEF

SEQ ID NO: 2583280 - protein, 34 aa, Entamoeba histolytica
IVQRPLCPRYMLLLNEIVRLSLLIEFDKQRILNS

SEQ ID NO: 2583281 - protein, 24 aa, Entamoeba histolytica
IVRHCMPRLKSLLFENEEIEVIKL

SEQ ID NO: 2583282 - protein, 18 aa, Entamoeba histolytica
IVRLRKLLYSALLRQNIS

SEQ ID NO: 2583283 - protein, 17 aa, Entamoeba histolytica
IVSCLANQCKCELVEED

SEQ ID NO: 2583284 - protein, 18 aa, Entamoeba histolytica
IVSICLDQGFLDKDENGN

SEQ ID NO: 2583285 - protein, 19 aa, Entamoeba histolytica
IVSLTLLRFRILKKNKLKY

SEQ ID NO: 2583286 - protein, 19 aa, Entamoeba histolytica
IVSPHRFGSNMLLPNDNGH

SEQ ID NO: 2583287 - protein, 19 aa, Entamoeba histolytica
IVSQLPLKYFIIPFILSIG

SEQ ID NO: 2583288 - protein, 29 aa, Entamoeba histolytica
IVSRFSFSNIFTLIPIILIYSIFTRLSFN

SEQ ID NO: 2583289 - protein, 25 aa, Entamoeba histolytica
IVSYKLLYLPIRFLSKRAQKALNLR

SEQ ID NO: 2583290 - protein, 19 aa, Entamoeba histolytica
IVTAVGLNSLWGKTKESLN

SEQ ID NO: 2583291 - protein, 18 aa, Entamoeba histolytica
IVTIKINGFDSFSLFLNT

SEQ ID NO: 2583292 - protein, 26 aa, Entamoeba histolytica
IVVFKSYSVLLKWFNTTSICGFYRVL

SEQ ID NO: 2583293 - protein, 20 aa, Entamoeba histolytica
IVVNYCYLWGYVATGSNTLM

SEQ ID NO: 2583294 - protein, 26 aa, Entamoeba histolytica
IVVSLPEIVRYLGLNMEDILPDLIGV

SEQ ID NO: 2583295 - protein, 21 aa, Entamoeba histolytica
IVVVKLIPWIKVSSINLTTKQ

SEQ ID NO: 2583296 - protein, 17 aa, Entamoeba histolytica
IVYASKIIEGIVHFSQN

SEQ ID NO: 2583297 - protein, 18 aa, Entamoeba histolytica
IVYFVVLMVFALRELMVS

SEQ ID NO: 2583298 - protein, 20 aa, Entamoeba histolytica
IVYKGLYKRHQVAIKKIKNI

SEQ ID NO: 2583299 - protein, 18 aa, Entamoeba histolytica
IVYLFFKKAYGLYTIKSN

SEQ ID NO: 2583300 - protein, 26 aa, Entamoeba histolytica
IVYYLEKDANCSFGLIQEDKTKENND

SEQ ID NO: 2583301 - protein, 18 aa, Entamoeba histolytica
IWCFTPGIFPLIRSGATD

SEQ ID NO: 2583302 - protein, 27 aa, Entamoeba histolytica
IWCTLISCLVCGGILIGLSVMSYHYTE

SEQ ID NO: 2583303 - protein, 19 aa, Entamoeba histolytica
IWFSVIMRIKIIGVMDDFV

SEQ ID NO: 2583304 - protein, 22 aa, Entamoeba histolytica
IWIKMMDRMNILMFNYFEEQSF

SEQ ID NO: 2583305 - protein, 25 aa, Entamoeba histolytica
IWILRATGLLAYFVFFLLYFILYYL

SEQ ID NO: 2583306 - protein, 18 aa, Entamoeba histolytica
IWMMCFDITLSIGATLGF

SEQ ID NO: 2583307 - protein, 24 aa, Entamoeba histolytica
IWNKPLRSYQIYKIINGMVSALHY

SEQ ID NO: 2583308 - protein, 25 aa, Entamoeba histolytica
IWPKQVAPLSAWRVVYYSVMCIALL

SEQ ID NO: 2583309 - protein, 23 aa, Entamoeba histolytica
IWQSLLLTFVFHFMLADVDVYSS

SEQ ID NO: 2583310 - protein, 19 aa, Entamoeba histolytica
IWTLICSIAAILFTLLAIV

SEQ ID NO: 2583311 - protein, 28 aa, Entamoeba histolytica
IWTMMICVACGQTPPFSAMMILWANLVV

SEQ ID NO: 2583312 - protein, 20 aa, Entamoeba histolytica
IWTPFSFKIGLLYYFVIMMT

SEQ ID NO: 2583313 - protein, 19 aa, Entamoeba histolytica
IWYVFSWGLTPAYIFMSVS

SEQ ID NO: 2583314 - protein, 18 aa, Entamoeba histolytica
IYADSIAGFWKYKHQPFI

SEQ ID NO: 2583315 - protein, 19 aa, Entamoeba histolytica
IYDKGCSHIVEMIDHFLYC

SEQ ID NO: 2583316 - protein, 23 aa, Entamoeba histolytica
IYDYANPIILPFSQFFRYSQTLV

SEQ ID NO: 2583317 - protein, 23 aa, Entamoeba histolytica
IYEFFKQCVHYTIMCNSDDEKQT

SEQ ID NO: 2583318 - protein, 18 aa, Entamoeba histolytica
IYEIIKRLMKIRLSPYIV

SEQ ID NO: 2583319 - protein, 18 aa, Entamoeba histolytica
IYENIQWEQPIFLKETKL

SEQ ID NO: 2583320 - protein, 17 aa, Entamoeba histolytica
IYFCLTWTYFNKAIYLT

SEQ ID NO: 2583321 - protein, 19 aa, Entamoeba histolytica
IYFDYLKGESTYDIELTSR

SEQ ID NO: 2583322 - protein, 17 aa, Entamoeba histolytica
IYFIQNMLLYIILQNTQ

SEQ ID NO: 2583323 - protein, 23 aa, Entamoeba histolytica
IYFTLSGIVSYYFILQNQIKPTI

SEQ ID NO: 2583324 - protein, 26 aa, Entamoeba histolytica
IYFTQFEICKTLRFTLAANKTNVKKR

SEQ ID NO: 2583325 - protein, 20 aa, Entamoeba histolytica
IYGCKRCSDGYYLTTNMKCS

SEQ ID NO: 2583326 - protein, 17 aa, Entamoeba histolytica
IYGEVRNNFRVIESKQG

SEQ ID NO: 2583327 - protein, 26 aa, Entamoeba histolytica
IYGKFYSLQLPTIWKGWNQQQQAKYR

SEQ ID NO: 2583328 - protein, 18 aa, Entamoeba histolytica
IYHFVGWWARCVICRDWK

SEQ ID NO: 2583329 - protein, 24 aa, Entamoeba histolytica
IYITFRYGKLHAILMDLNQKEQSG

SEQ ID NO: 2583330 - protein, 19 aa, Entamoeba histolytica
IYITNFRVWWVPNDEECFQ

SEQ ID NO: 2583331 - protein, 28 aa, Entamoeba histolytica
IYKNEHCLKCPKGTFSQDLQHCKEECDN

SEQ ID NO: 2583332 - protein, 34 aa, Entamoeba histolytica
IYLFIFRSFIFKTWIFEVKWTFVLLIILVIQNNP

SEQ ID NO: 2583333 - protein, 28 aa, Entamoeba histolytica
IYLGKLLYRLGYKGKEIYDLFTKAGEMG

SEQ ID NO: 2583334 - protein, 17 aa, Entamoeba histolytica
IYLHSVFGIIHRDIKLE

SEQ ID NO: 2583335 - protein, 17 aa, Entamoeba histolytica
IYLKFTNSYLRVIPNKC

SEQ ID NO: 2583336 - protein, 21 aa, Entamoeba histolytica
IYLLCWTLFTIYAWTAHEYEF

SEQ ID NO: 2583337 - protein, 22 aa, Entamoeba histolytica
IYLQHPICQIIHSIATQFHIHK

SEQ ID NO: 2583338 - protein, 19 aa, Entamoeba histolytica
IYLYFNMYLVWTLEFTTTH

SEQ ID NO: 2583339 - protein, 23 aa, Entamoeba histolytica
IYNIQFNGCKGIHTLNHSQAVAL

SEQ ID NO: 2583340 - protein, 25 aa, Entamoeba histolytica
IYNKEIPADGLALFTKQVWSAIKSN

SEQ ID NO: 2583341 - protein, 17 aa, Entamoeba histolytica
IYNSCFIIETLTNILRQ

SEQ ID NO: 2583342 - protein, 18 aa, Entamoeba histolytica
IYPFALICLSVFFTNSIN

SEQ ID NO: 2583343 - protein, 18 aa, Entamoeba histolytica
IYPLLPVTLKTISFNELN

SEQ ID NO: 2583344 - protein, 17 aa, Entamoeba histolytica
IYQFSIKKIHDIITLCI

SEQ ID NO: 2583345 - protein, 31 aa, Entamoeba histolytica
IYRISMNEPLRWRKQYHSWDLFFLSSSVIFV

SEQ ID NO: 2583346 - protein, 23 aa, Entamoeba histolytica
IYRKENIPLFGPLVTGSIVCFQE

SEQ ID NO: 2583347 - protein, 25 aa, Entamoeba histolytica
IYRMKEPYQRIEFTLTIGKSNEGTV

SEQ ID NO: 2583348 - protein, 26 aa, Entamoeba histolytica
IYRVDRELQHGFVLFECTSELMKNAF

SEQ ID NO: 2583349 - protein, 22 aa, Entamoeba histolytica
IYRVSKEEKFYCTLKSDIDSVS

SEQ ID NO: 2583350 - protein, 26 aa, Entamoeba histolytica
IYSFAITMYEVWNWKIVYQDKSRFRY

SEQ ID NO: 2583351 - protein, 22 aa, Entamoeba histolytica
IYSKTCYFTFLTMLQTINELSI

SEQ ID NO: 2583352 - protein, 22 aa, Entamoeba histolytica
IYSLGYRKGDKIAIFCETRYEW

SEQ ID NO: 2583353 - protein, 20 aa, Entamoeba histolytica
IYSNCIWDLFNVKTNERVCI

SEQ ID NO: 2583354 - protein, 25 aa, Entamoeba histolytica
IYSNQTHCLIPFFNDAGCVICEDGY

SEQ ID NO: 2583355 - protein, 25 aa, Entamoeba histolytica
IYSTLVCFLIFLGLSCGEIQKPLLF

SEQ ID NO: 2583356 - protein, 18 aa, Entamoeba histolytica
IYSVMTWEDPYPKQEFEY

SEQ ID NO: 2583357 - protein, 23 aa, Entamoeba histolytica
IYTIYLKEFIKIIISNNQQEFNE

SEQ ID NO: 2583358 - protein, 19 aa, Entamoeba histolytica
IYTTLTFFGIFAEFITALT

SEQ ID NO: 2583359 - protein, 24 aa, Entamoeba histolytica
IYVLEFLLLFILMFVCEKSNRLFK

SEQ ID NO: 2583360 - protein, 18 aa, Entamoeba histolytica
IYVPSFVIFPPLNQSLNY

SEQ ID NO: 2583361 - protein, 31 aa, Entamoeba histolytica
IYYATNVCQRWLGMRVELIGCVGLGAVVIFS

SEQ ID NO: 2583362 - protein, 18 aa, Entamoeba histolytica
IYYFRMYFMMLIFGASHG

SEQ ID NO: 2583363 - protein, 17 aa, Entamoeba histolytica
IYYFYKDVSILFCVPTI

SEQ ID NO: 2583364 - protein, 17 aa, Entamoeba histolytica
IYYGGRLIMNFNDFLER

SEQ ID NO: 2583365 - protein, 18 aa, Entamoeba histolytica
IYYGIIENCIKRNPHNTL

SEQ ID NO: 2583366 - protein, 24 aa, Entamoeba histolytica
KACLTIFYLFKVVYWIISGLQIRA

SEQ ID NO: 2583367 - protein, 25 aa, Entamoeba histolytica
KADHRKFAIALCNFIIPYFANNHEY

SEQ ID NO: 2583368 - protein, 19 aa, Entamoeba histolytica
KADTIPIKILVKGREVTLH

SEQ ID NO: 2583369 - protein, 27 aa, Entamoeba histolytica
KAEAVRLARRIAMEWEAYIKHTNALRK

SEQ ID NO: 2583370 - protein, 21 aa, Entamoeba histolytica
KAEFMFRQCCEVPIMKKTASN

SEQ ID NO: 2583371 - protein, 21 aa, Entamoeba histolytica
KAELKLTQFYTNLWDMASCSS

SEQ ID NO: 2583372 - protein, 17 aa, Entamoeba histolytica
KAHKCSDGILLLASMNN

SEQ ID NO: 2583373 - protein, 21 aa, Entamoeba histolytica
KAIDTEGTFRLNVYTLNPPSH

SEQ ID NO: 2583374 - protein, 20 aa, Entamoeba histolytica
KAIEKICLNNSITIDHQRLL

SEQ ID NO: 2583375 - protein, 21 aa, Entamoeba histolytica
KAIEVLPEWAQLDATAVSQNH

SEQ ID NO: 2583376 - protein, 20 aa, Entamoeba histolytica
KAKISLSIFIDFDIFNITQF

SEQ ID NO: 2583377 - protein, 20 aa, Entamoeba histolytica
KAKKECPATCVGLYECKDLE

SEQ ID NO: 2583378 - protein, 18 aa, Entamoeba histolytica
KAKKECPATCVGSYECKD

SEQ ID NO: 2583379 - protein, 18 aa, Entamoeba histolytica
KAKKECPATCVGSYECRD

SEQ ID NO: 2583380 - protein, 24 aa, Entamoeba histolytica
KAKKECQGCITVICGDKKKIISIT

SEQ ID NO: 2583381 - protein, 18 aa, Entamoeba histolytica
KAKVLTFIVPILIIMFSM

SEQ ID NO: 2583382 - protein, 27 aa, Entamoeba histolytica
KALCEGCILCDYRCEQCGLKSDSQRSE

SEQ ID NO: 2583383 - protein, 20 aa, Entamoeba histolytica
KALGDNALWVAIGCSGILLF

SEQ ID NO: 2583384 - protein, 22 aa, Entamoeba histolytica
KALLQLCKFKYTFIDKRLAEII

SEQ ID NO: 2583385 - protein, 23 aa, Entamoeba histolytica
KALNIFLTQAIDWEDPHEAAEAI

SEQ ID NO: 2583386 - protein, 22 aa, Entamoeba histolytica
KAMKLDLVLSWYLVETNLELKI

SEQ ID NO: 2583387 - protein, 32 aa, Entamoeba histolytica
KAMSWYTKFLWKFKWIILTVVILCCIVLCVGV

SEQ ID NO: 2583388 - protein, 22 aa, Entamoeba histolytica
KANLEGGCWLLFVAVIIYTVCS

SEQ ID NO: 2583389 - protein, 33 aa, Entamoeba histolytica
KAPAIVIAFLMYYQRLSFINAFNKVQGLYPLID

SEQ ID NO: 2583390 - protein, 19 aa, Entamoeba histolytica
KAQNYLSLFIKKASVIGLN

SEQ ID NO: 2583391 - protein, 19 aa, Entamoeba histolytica
KAQTCWMLFCFVYAIWNGA

SEQ ID NO: 2583392 - protein, 24 aa, Entamoeba histolytica
KAQTLICAYLMRIKLPKYLKHTLY

SEQ ID NO: 2583393 - protein, 19 aa, Entamoeba histolytica
KASDLASEWMVSMRDATAL

SEQ ID NO: 2583394 - protein, 27 aa, Entamoeba histolytica
KASESGEDFVLVFKYHTQIVVIVITVM

SEQ ID NO: 2583395 - protein, 25 aa, Entamoeba histolytica
KASWEMFKQTYFCFHLIALVLFIWL

SEQ ID NO: 2583396 - protein, 29 aa, Entamoeba histolytica
KATIKKPLLCFTRFFIVKLLMILLLCISC

SEQ ID NO: 2583397 - protein, 18 aa, Entamoeba histolytica
KATPPVLYDGFKIVFDGI

SEQ ID NO: 2583398 - protein, 28 aa, Entamoeba histolytica
KATQMSWALKIDRLREAFSNGKGGSAQR

SEQ ID NO: 2583399 - protein, 18 aa, Entamoeba histolytica
KAVICCRVTPLIKGEIIK

SEQ ID NO: 2583400 - protein, 17 aa, Entamoeba histolytica
KAVRALGRCAIKLENVA

SEQ ID NO: 2583401 - protein, 18 aa, Entamoeba histolytica
KCAPGYYKSSQWECSECA

SEQ ID NO: 2583402 - protein, 26 aa, Entamoeba histolytica
KCDDNCKICFGSAIYCMSCSSDKYLS

SEQ ID NO: 2583403 - protein, 17 aa, Entamoeba histolytica
KCDNGISGMLVLTIFTI

SEQ ID NO: 2583404 - protein, 19 aa, Entamoeba histolytica
KCDTCTEGIHYQCGAISTM

SEQ ID NO: 2583405 - protein, 24 aa, Entamoeba histolytica
KCDVSNRWHFDWKCNVTYFTSIAV

SEQ ID NO: 2583406 - protein, 20 aa, Entamoeba histolytica
KCENRRCLENILGKELPHDY

SEQ ID NO: 2583407 - protein, 18 aa, Entamoeba histolytica
KCFVDGRVSNDFVKCNTF

SEQ ID NO: 2583408 - protein, 18 aa, Entamoeba histolytica
KCGCGFRKVQVVCGATPE

SEQ ID NO: 2583409 - protein, 25 aa, Entamoeba histolytica
KCHKCSLPHCIKCYYGTNNEICSQC

SEQ ID NO: 2583410 - protein, 28 aa, Entamoeba histolytica
KCICVFVCFQFIYMLAFIFFTFMNIKKD

SEQ ID NO: 2583411 - protein, 19 aa, Entamoeba histolytica
KCIETPFIYDYPKSIPLKQ

SEQ ID NO: 2583412 - protein, 17 aa, Entamoeba histolytica
KCIKDICSNGVPISIIN

SEQ ID NO: 2583413 - protein, 21 aa, Entamoeba histolytica
KCITCADGYFMSWIGECKSID

SEQ ID NO: 2583414 - protein, 24 aa, Entamoeba histolytica
KCITLLKRIDLISATITINDHPMK

SEQ ID NO: 2583415 - protein, 26 aa, Entamoeba histolytica
KCLECGEGICTKCYNNLLFKNNKCQS

SEQ ID NO: 2583416 - protein, 19 aa, Entamoeba histolytica
KCLECKYSYGQYLYTTQTL

SEQ ID NO: 2583417 - protein, 28 aa, Entamoeba histolytica
KCLSDGLNIRGRETFAIPEHWKKQKKSM

SEQ ID NO: 2583418 - protein, 29 aa, Entamoeba histolytica
KCLSSLYGICYRCIQKYYPNGVKCEQCLE

SEQ ID NO: 2583419 - protein, 18 aa, Entamoeba histolytica
KCLTCKDNYYTSSYQCLE

SEQ ID NO: 2583420 - protein, 24 aa, Entamoeba histolytica
KCREIISLKGIWYLLDLSQPANVT

SEQ ID NO: 2583421 - protein, 20 aa, Entamoeba histolytica
KCRLTSYKFVFLISQSVNVI

SEQ ID NO: 2583422 - protein, 21 aa, Entamoeba histolytica
KCSACKANTTLDARGMCVGEW

SEQ ID NO: 2583423 - protein, 20 aa, Entamoeba histolytica
KCSEIGLGTKQCVIKSTDIK

SEQ ID NO: 2583424 - protein, 20 aa, Entamoeba histolytica
KCSIFEFCEYYILGHKEEST

SEQ ID NO: 2583425 - protein, 20 aa, Entamoeba histolytica
KCSLNSVFGAGRLYVGTHHL

SEQ ID NO: 2583426 - protein, 20 aa, Entamoeba histolytica
KCTDCGVLDTIVLGLGDFFI

SEQ ID NO: 2583427 - protein, 21 aa, Entamoeba histolytica
KCVDCSSFTLNIPKFTFDEEF

SEQ ID NO: 2583428 - protein, 22 aa, Entamoeba histolytica
KCVIRFQIYYCIIDKRKEDYYA

SEQ ID NO: 2583429 - protein, 19 aa, Entamoeba histolytica
KCVKCKNGYYRDGVSCINC

SEQ ID NO: 2583430 - protein, 17 aa, Entamoeba histolytica
KCVNFWKGENFGVLATR

SEQ ID NO: 2583431 - protein, 26 aa, Entamoeba histolytica
KCVNNCSILLLKVCKLLDSSINPTIL

SEQ ID NO: 2583432 - protein, 17 aa, Entamoeba histolytica
KCVTFHYTIKPLCSTHI

SEQ ID NO: 2583433 - protein, 19 aa, Entamoeba histolytica
KCYFNAMLQQSGFKKRFVK

SEQ ID NO: 2583434 - protein, 20 aa, Entamoeba histolytica
KCYKCNVGKNYYCNYNEENG

SEQ ID NO: 2583435 - protein, 25 aa, Entamoeba histolytica
KCYKILRIAAQYHREIVSHYIETSF

SEQ ID NO: 2583436 - protein, 20 aa, Entamoeba histolytica
KDAFSPPSFIVVKVNNKPVR

SEQ ID NO: 2583437 - protein, 19 aa, Entamoeba histolytica
KDCISKCNDTVIFSKKEKG

SEQ ID NO: 2583438 - protein, 20 aa, Entamoeba histolytica
KDCTECQPGYMWYGEGNCSK

SEQ ID NO: 2583439 - protein, 19 aa, Entamoeba histolytica
KDDCTEFLQYFQVVVDCEY

SEQ ID NO: 2583440 - protein, 21 aa, Entamoeba histolytica
KDDVPTWVIVILVIVGIIIVI

SEQ ID NO: 2583441 - protein, 20 aa, Entamoeba histolytica
KDECSNCFNVQAQHLNSDGI

SEQ ID NO: 2583442 - protein, 28 aa, Entamoeba histolytica
KDEKAYSTMGWLCWLIVSIAVFAIFLIP

SEQ ID NO: 2583443 - protein, 17 aa, Entamoeba histolytica
KDELVLKRMNDIRFRTN

SEQ ID NO: 2583444 - protein, 23 aa, Entamoeba histolytica
KDEMGCSIGLYNNGCKLNIRLSV

SEQ ID NO: 2583445 - protein, 17 aa, Entamoeba histolytica
KDFDWKDLMIELKEREI

SEQ ID NO: 2583446 - protein, 19 aa, Entamoeba histolytica
KDFKSLFQIKEFVKSGKRL

SEQ ID NO: 2583447 - protein, 19 aa, Entamoeba histolytica
KDFKWTMDPTQCFPSNAEA

SEQ ID NO: 2583448 - protein, 26 aa, Entamoeba histolytica
KDFLGLCEQIHFFLPFHFINIEDNFV

SEQ ID NO: 2583449 - protein, 17 aa, Entamoeba histolytica
KDFRSLFEIKVFVEKGK

SEQ ID NO: 2583450 - protein, 24 aa, Entamoeba histolytica
KDFSLKCSMNGIDFIPILNGTTTN

SEQ ID NO: 2583451 - protein, 33 aa, Entamoeba histolytica
KDGAVLRIKYLVNEKKLIIEIMVNHINMDCITI

SEQ ID NO: 2583452 - protein, 24 aa, Entamoeba histolytica
KDGIKRLAKFKGVHNDIQFCFYGM

SEQ ID NO: 2583453 - protein, 18 aa, Entamoeba histolytica
KDGKCIGIYKKIEVLNTT

SEQ ID NO: 2583454 - protein, 24 aa, Entamoeba histolytica
KDGKNTFITTEWIKIKTTPIKHTI

SEQ ID NO: 2583455 - protein, 25 aa, Entamoeba histolytica
KDGRTRRSLFRGRYAFFSNDKDVDK

SEQ ID NO: 2583456 - protein, 18 aa, Entamoeba histolytica
KDICLVCNVQRGWFYDEQ

SEQ ID NO: 2583457 - protein, 23 aa, Entamoeba histolytica
KDIDELLELLAIDAKQYVNAPML

SEQ ID NO: 2583458 - protein, 17 aa, Entamoeba histolytica
KDINILLEFLLRKIQPK

SEQ ID NO: 2583459 - protein, 28 aa, Entamoeba histolytica
KDIPKDSPWRYGTTLTTLFVEYFGCEII

SEQ ID NO: 2583460 - protein, 18 aa, Entamoeba histolytica
KDIYGFVADHWYTFSTLK

SEQ ID NO: 2583461 - protein, 21 aa, Entamoeba histolytica
KDKCQRCSSEFLLNNDKCITK

SEQ ID NO: 2583462 - protein, 24 aa, Entamoeba histolytica
KDKCTICADGYFMSWIGECKLIDE

SEQ ID NO: 2583463 - protein, 24 aa, Entamoeba histolytica
KDKEWITTVGMTFALNLSSFIANK

SEQ ID NO: 2583464 - protein, 20 aa, Entamoeba histolytica
KDKIEGFLMNFIQKEILGSF

SEQ ID NO: 2583465 - protein, 25 aa, Entamoeba histolytica
KDKLKFINKYFINYTVFGLTLLWFI

SEQ ID NO: 2583466 - protein, 27 aa, Entamoeba histolytica
KDKLLEYRRLLPILLNYGTGATPSIIK

SEQ ID NO: 2583467 - protein, 22 aa, Entamoeba histolytica
KDKYRIIIDHSKLNFGTEDNLA

SEQ ID NO: 2583468 - protein, 20 aa, Entamoeba histolytica
KDLKMQKGKIAAQCGHAAVG

SEQ ID NO: 2583469 - protein, 25 aa, Entamoeba histolytica
KDLNRTAISFSWLLQYAEQNGVSFG

SEQ ID NO: 2583470 - protein, 24 aa, Entamoeba histolytica
KDMPDWYFRIVSMGWDQQPLNRPK

SEQ ID NO: 2583471 - protein, 19 aa, Entamoeba histolytica
KDNEMSVAMELYNICEIKD

SEQ ID NO: 2583472 - protein, 33 aa, Entamoeba histolytica
KDNENFIRFPFKLKIKILFDTARGMQFLHENNI

SEQ ID NO: 2583473 - protein, 19 aa, Entamoeba histolytica
KDNHWCIFETVATNTYCTY

SEQ ID NO: 2583474 - protein, 18 aa, Entamoeba histolytica
KDNQCIECPESAICNSDG

SEQ ID NO: 2583475 - protein, 19 aa, Entamoeba histolytica
KDPLLSFAILQKNEISIRN

SEQ ID NO: 2583476 - protein, 18 aa, Entamoeba histolytica
KDQLFYLLMVEVCIGMWS

SEQ ID NO: 2583477 - protein, 17 aa, Entamoeba histolytica
KDRRLGFFGEIIRNIKF

SEQ ID NO: 2583478 - protein, 21 aa, Entamoeba histolytica
KDSFEIAYSPSINGIILIGNQ

SEQ ID NO: 2583479 - protein, 19 aa, Entamoeba histolytica
KDSFEVMLRDAYYDFGSVY

SEQ ID NO: 2583480 - protein, 17 aa, Entamoeba histolytica
KDSKGCNNVTCTCDVGF

SEQ ID NO: 2583481 - protein, 21 aa, Entamoeba histolytica
KDSLWYKFAVFLSNKKISFVS

SEQ ID NO: 2583482 - protein, 22 aa, Entamoeba histolytica
KDTELSGGFAVRSLYPTYKEFF

SEQ ID NO: 2583483 - protein, 22 aa, Entamoeba histolytica
KDTQKRLQIELMKRKEEEKRAR

SEQ ID NO: 2583484 - protein, 20 aa, Entamoeba histolytica
KDVNVYKLLFLLIVNLLFFL

SEQ ID NO: 2583485 - protein, 25 aa, Entamoeba histolytica
KDVPKVMIFYCMLFTGILIVTILTI

SEQ ID NO: 2583486 - protein, 17 aa, Entamoeba histolytica
KDWDLWGPMLVCYILSL

SEQ ID NO: 2583487 - protein, 19 aa, Entamoeba histolytica
KDWTVKEIIEEGSKFYDNI

SEQ ID NO: 2583488 - protein, 17 aa, Entamoeba histolytica
KDYFLYKMQCEAYEDLE

SEQ ID NO: 2583489 - protein, 24 aa, Entamoeba histolytica
KDYKFRYRRGLPLVLKGINASIED

SEQ ID NO: 2583490 - protein, 24 aa, Entamoeba histolytica
KEADKEAYCTYEITTRECKTCSLT

SEQ ID NO: 2583491 - protein, 22 aa, Entamoeba histolytica
KEAKITFLPTFKIKIGNGEYVD

SEQ ID NO: 2583492 - protein, 27 aa, Entamoeba histolytica
KEAKNNKCSKCSFWYGTNEEGNECNKE

SEQ ID NO: 2583493 - protein, 19 aa, Entamoeba histolytica
KEALKYAKGKIWIEPTGET

SEQ ID NO: 2583494 - protein, 17 aa, Entamoeba histolytica
KECPATCVGSYECKDLE

SEQ ID NO: 2583495 - protein, 17 aa, Entamoeba histolytica
KECPATCVGSYECRDLE

SEQ ID NO: 2583496 - protein, 25 aa, Entamoeba histolytica
KEDEPKKWLGFVYCGIILITQMIDS

SEQ ID NO: 2583497 - protein, 25 aa, Entamoeba histolytica
KEDIKRIIIPEGRIQLYHCNIKCTK

SEQ ID NO: 2583498 - protein, 19 aa, Entamoeba histolytica
KEDKCIKCSDSISNCTQCQ

SEQ ID NO: 2583499 - protein, 25 aa, Entamoeba histolytica
KEDVINIYCILDWFIENDQQKKKVI

SEQ ID NO: 2583500 - protein, 20 aa, Entamoeba histolytica
KEEDLKIKECQKEDHTEPTY

SEQ ID NO: 2583501 - protein, 19 aa, Entamoeba histolytica
KEEFWFISINRYEGKKNHK

SEQ ID NO: 2583502 - protein, 23 aa, Entamoeba histolytica
KEEPTLFYLLEYFKSDGLLKQMY

SEQ ID NO: 2583503 - protein, 26 aa, Entamoeba histolytica
KEEYVKLYFRYLDRYLFNYILHTSPS

SEQ ID NO: 2583504 - protein, 23 aa, Entamoeba histolytica
KEFAEVSTLFCMYNLLTNIRDWF

SEQ ID NO: 2583505 - protein, 17 aa, Entamoeba histolytica
KEFKRNVFVEHFSLFKF

SEQ ID NO: 2583506 - protein, 18 aa, Entamoeba histolytica
KEFKSLFEIKDYVESGKR

SEQ ID NO: 2583507 - protein, 19 aa, Entamoeba histolytica
KEFKSLFEIKDYVLQGKRL

SEQ ID NO: 2583508 - protein, 23 aa, Entamoeba histolytica
KEFNYKEIEGISSLLEEIQHIIM

SEQ ID NO: 2583509 - protein, 22 aa, Entamoeba histolytica
KEGFYSIIPFEMISCFYDTELE

SEQ ID NO: 2583510 - protein, 25 aa, Entamoeba histolytica
KEGKIIVNGIMKWFESITIEKAKSL

SEQ ID NO: 2583511 - protein, 18 aa, Entamoeba histolytica
KEGLICGTIIPFNKEGKR

SEQ ID NO: 2583512 - protein, 19 aa, Entamoeba histolytica
KEGMDCFGLDVYPVQNEEP

SEQ ID NO: 2583513 - protein, 21 aa, Entamoeba histolytica
KEGNPKLADFNAEVKQLEGEL

SEQ ID NO: 2583514 - protein, 21 aa, Entamoeba histolytica
KEGRTKLSFKYEEKIFEQKPL

SEQ ID NO: 2583515 - protein, 22 aa, Entamoeba histolytica
KEGSGICDLCPAGTYQEYEGGQ

SEQ ID NO: 2583516 - protein, 21 aa, Entamoeba histolytica
KEGYKRVIFCSTKVIIINIIV

SEQ ID NO: 2583517 - protein, 19 aa, Entamoeba histolytica
KEHCISCTGTPYSCHCENG

SEQ ID NO: 2583518 - protein, 25 aa, Entamoeba histolytica
KEHEIGRFILPLTFIITNQYIEKCI

SEQ ID NO: 2583519 - protein, 18 aa, Entamoeba histolytica
KEHGLKCVECNEGFYLTT

SEQ ID NO: 2583520 - protein, 21 aa, Entamoeba histolytica
KEHWGYNEIGDCYLVKERPDK

SEQ ID NO: 2583521 - protein, 23 aa, Entamoeba histolytica
KEHYVVLPLFALDLLFICLKEVV

SEQ ID NO: 2583522 - protein, 20 aa, Entamoeba histolytica
KEICVFMGPFFSGLTVLVGY

SEQ ID NO: 2583523 - protein, 21 aa, Entamoeba histolytica
KEIGVMLDSKFKIVNDKSKSD

SEQ ID NO: 2583524 - protein, 21 aa, Entamoeba histolytica
KEIKEILIFIMNTFPKIEPTC

SEQ ID NO: 2583525 - protein, 20 aa, Entamoeba histolytica
KEIKHICSYTTSTIGWQNII

SEQ ID NO: 2583526 - protein, 25 aa, Entamoeba histolytica
KEIKRNEFIPELLRRTEILTGAEET

SEQ ID NO: 2583527 - protein, 26 aa, Entamoeba histolytica
KEIPQGELLLRGPALFKEYFNRPEET

SEQ ID NO: 2583528 - protein, 20 aa, Entamoeba histolytica
KEIRHPCIIQYFGYSIEYPH

SEQ ID NO: 2583529 - protein, 26 aa, Entamoeba histolytica
KEIVERMCIFVQGFIAEGCKQTIIKE

SEQ ID NO: 2583530 - protein, 22 aa, Entamoeba histolytica
KEIYFNRLIEMCWKSNPDERPS

SEQ ID NO: 2583531 - protein, 23 aa, Entamoeba histolytica
KEKIRKATEWAVKKVNLIKEEQE

SEQ ID NO: 2583532 - protein, 22 aa, Entamoeba histolytica
KEKKKSGIILNVYLRDSDSLFD

SEQ ID NO: 2583533 - protein, 20 aa, Entamoeba histolytica
KEKKPIQSSGNWRQKSEEAK

SEQ ID NO: 2583534 - protein, 26 aa, Entamoeba histolytica
KEKNWRLGLYIICPLLGILLIGNVFV

SEQ ID NO: 2583535 - protein, 24 aa, Entamoeba histolytica
KEKRELLKTIALQIEGWKDVIDRE

SEQ ID NO: 2583536 - protein, 17 aa, Entamoeba histolytica
KEKRPTANMFMSTVEKK

SEQ ID NO: 2583537 - protein, 28 aa, Entamoeba histolytica
KEKVGGLKPSWEIAYCSWEESISYAISV

SEQ ID NO: 2583538 - protein, 20 aa, Entamoeba histolytica
KEKYHPIVWVQLFVSAIFSI

SEQ ID NO: 2583539 - protein, 21 aa, Entamoeba histolytica
KELHAALTIECESCNSIQLDY

SEQ ID NO: 2583540 - protein, 17 aa, Entamoeba histolytica
KELIGILPISLEKKEDL

SEQ ID NO: 2583541 - protein, 17 aa, Entamoeba histolytica
KELKNCCLINMMKNGLI

SEQ ID NO: 2583542 - protein, 23 aa, Entamoeba histolytica
KELKRIRIQDGLYKIYKAIAPMK

SEQ ID NO: 2583543 - protein, 22 aa, Entamoeba histolytica
KELLEFPVDLTVDLQKDLNDAF

SEQ ID NO: 2583544 - protein, 21 aa, Entamoeba histolytica
KELLNILQLVINGMKMKNGDI

SEQ ID NO: 2583545 - protein, 18 aa, Entamoeba histolytica
KELLPLKIRTSFSNYIIK

SEQ ID NO: 2583546 - protein, 22 aa, Entamoeba histolytica
KELLSQLVIDSCNIIDCIAKEC

SEQ ID NO: 2583547 - protein, 19 aa, Entamoeba histolytica
KELMFEVVLHSDKVPKTEF

SEQ ID NO: 2583548 - protein, 22 aa, Entamoeba histolytica
KELPKKRCGIVGYVGNDPCSKY

SEQ ID NO: 2583549 - protein, 17 aa, Entamoeba histolytica
KELTGYVFINKENDDQL

SEQ ID NO: 2583550 - protein, 17 aa, Entamoeba histolytica
KEMKAGGVQTIIMKCFD

SEQ ID NO: 2583551 - protein, 19 aa, Entamoeba histolytica
KEMLDICIVMDCREMTELI

SEQ ID NO: 2583552 - protein, 29 aa, Entamoeba histolytica
KENEDFFVIPYRLKLRVLFDTAKGMAFLH

SEQ ID NO: 2583553 - protein, 23 aa, Entamoeba histolytica
KENELAELFLIIERIMALSKEGL

SEQ ID NO: 2583554 - protein, 18 aa, Entamoeba histolytica
KENIWWVSIIIVGGCGII

SEQ ID NO: 2583555 - protein, 23 aa, Entamoeba histolytica
KENKCVECSLLFGNCEICTITHC

SEQ ID NO: 2583556 - protein, 19 aa, Entamoeba histolytica
KENLFRYELENEICNAYNY

SEQ ID NO: 2583557 - protein, 19 aa, Entamoeba histolytica
KENLLVFNCERILGHNLII

SEQ ID NO: 2583558 - protein, 25 aa, Entamoeba histolytica
KENMAMLVVQHFLLRSVLRTIMDCI

SEQ ID NO: 2583559 - protein, 22 aa, Entamoeba histolytica
KENNWWSILQFTIWSIIITIIM

SEQ ID NO: 2583560 - protein, 21 aa, Entamoeba histolytica
KENRKVVSFGKPGSNQMLEKA

SEQ ID NO: 2583561 - protein, 22 aa, Entamoeba histolytica
KENVFLSFIRRYFNKSYLGLII

SEQ ID NO: 2583562 - protein, 21 aa, Entamoeba histolytica
KEPINLLKFIVMIELFMQPHQ

SEQ ID NO: 2583563 - protein, 27 aa, Entamoeba histolytica
KEPKLLKGRILEKFSKKKLECVECSEF

SEQ ID NO: 2583564 - protein, 26 aa, Entamoeba histolytica
KEQCAPLVHSYCCRHVWGNDSKAFLY

SEQ ID NO: 2583565 - protein, 19 aa, Entamoeba histolytica
KEQGPIILLPFLVKYSKQR

SEQ ID NO: 2583566 - protein, 31 aa, Entamoeba histolytica
KEQKWIWPTAIRFVPLFACASVFLNNTPIVA

SEQ ID NO: 2583567 - protein, 18 aa, Entamoeba histolytica
KEQPNVILSIIMYTLIPL

SEQ ID NO: 2583568 - protein, 25 aa, Entamoeba histolytica
KEQRIAEKLHHFFPIQKIWNENKVI

SEQ ID NO: 2583569 - protein, 25 aa, Entamoeba histolytica
KEQRIAKKLHHFFPIQKIWNENGVI

SEQ ID NO: 2583570 - protein, 25 aa, Entamoeba histolytica
KEQRRAEKLHHFFPIQKIWNENGVI

SEQ ID NO: 2583571 - protein, 26 aa, Entamoeba histolytica
KEQRRAEKLHHFFPIQKIWNENKVII

SEQ ID NO: 2583572 - protein, 17 aa, Entamoeba histolytica
KERITIDEIVRMLDGIE

SEQ ID NO: 2583573 - protein, 17 aa, Entamoeba histolytica
KERITIDEIVRMLEKIQ

SEQ ID NO: 2583574 - protein, 25 aa, Entamoeba histolytica
KERMYHCKKCKRCIDMKDHHCSWVG

SEQ ID NO: 2583575 - protein, 23 aa, Entamoeba histolytica
KESCIPNVVWWIVLLEIITAILI

SEQ ID NO: 2583576 - protein, 17 aa, Entamoeba histolytica
KESIECMSDSLKMSVKV

SEQ ID NO: 2583577 - protein, 19 aa, Entamoeba histolytica
KESIVKMLWSLLVISETNM

SEQ ID NO: 2583578 - protein, 21 aa, Entamoeba histolytica
KESKEILKPVVIAMGDSPLEK

SEQ ID NO: 2583579 - protein, 22 aa, Entamoeba histolytica
KESNDIYHSFIFNQLFSNTNSI

SEQ ID NO: 2583580 - protein, 25 aa, Entamoeba histolytica
KESPKQLIWRCLLNAAQGIQYLHQR

SEQ ID NO: 2583581 - protein, 22 aa, Entamoeba histolytica
KESQCKSILALTQFSNRVVELF

SEQ ID NO: 2583582 - protein, 18 aa, Entamoeba histolytica
KESVFKKYIQSVGGLPSI

SEQ ID NO: 2583583 - protein, 18 aa, Entamoeba histolytica
KETHKLGIVYVGIGQFKE

SEQ ID NO: 2583584 - protein, 24 aa, Entamoeba histolytica
KETLPCALTVILAVTIDSNLLDVC

SEQ ID NO: 2583585 - protein, 27 aa, Entamoeba histolytica
KETLTGLSYKAGQYFFDTILMNLRVPF

SEQ ID NO: 2583586 - protein, 20 aa, Entamoeba histolytica
KETMGPTILDWFIPSQRRSN

SEQ ID NO: 2583587 - protein, 21 aa, Entamoeba histolytica
KETYGDGGYDFAITGYDALGI

SEQ ID NO: 2583588 - protein, 22 aa, Entamoeba histolytica
KEVEMLYKIRCDYIVHFYGALC

SEQ ID NO: 2583589 - protein, 25 aa, Entamoeba histolytica
KEVGCRVGSTVGYRVRFEEKMSKDT

SEQ ID NO: 2583590 - protein, 29 aa, Entamoeba histolytica
KEVRHILFVIAFRSCMNFIVWAIPPSVSF

SEQ ID NO: 2583591 - protein, 20 aa, Entamoeba histolytica
KEWERGRIYITNFRVWWVPN

SEQ ID NO: 2583592 - protein, 20 aa, Entamoeba histolytica
KEWFYKLIGLKTCYENNERT

SEQ ID NO: 2583593 - protein, 20 aa, Entamoeba histolytica
KEWIFEQILTFTLMYILLLF

SEQ ID NO: 2583594 - protein, 19 aa, Entamoeba histolytica
KEYEWKGTYCSDGVSNCVI

SEQ ID NO: 2583595 - protein, 18 aa, Entamoeba histolytica
KEYIANLCQVFVVLEVYK

SEQ ID NO: 2583596 - protein, 19 aa, Entamoeba histolytica
KEYLALALFYFQKSEFITS

SEQ ID NO: 2583597 - protein, 20 aa, Entamoeba histolytica
KEYQCTYPGCNEGLKTKYNC

SEQ ID NO: 2583598 - protein, 24 aa, Entamoeba histolytica
KEYYAELIEVPSLLKGKVPSKIFE

SEQ ID NO: 2583599 - protein, 21 aa, Entamoeba histolytica
KFANFQWSMFRGFPIMTVAFC

SEQ ID NO: 2583600 - protein, 18 aa, Entamoeba histolytica
KFCKTRNGAQMKLSEKYV

SEQ ID NO: 2583601 - protein, 26 aa, Entamoeba histolytica
KFDITKSFKSQICYGSYDEELISLFI

SEQ ID NO: 2583602 - protein, 26 aa, Entamoeba histolytica
KFFITESLFNILLFFSIPKLKHSSLF

SEQ ID NO: 2583603 - protein, 19 aa, Entamoeba histolytica
KFFSFCLLIGLLTIPQALR

SEQ ID NO: 2583604 - protein, 18 aa, Entamoeba histolytica
KFFVLYISVAIWPFCTAF

SEQ ID NO: 2583605 - protein, 24 aa, Entamoeba histolytica
KFIGECKECISIFINGSIEVINNS

SEQ ID NO: 2583606 - protein, 20 aa, Entamoeba histolytica
KFIKCSIDGYMFEETGNGII

SEQ ID NO: 2583607 - protein, 19 aa, Entamoeba histolytica
KFKKCAIKERVYDISKLQE

SEQ ID NO: 2583608 - protein, 22 aa, Entamoeba histolytica
KFKKITSWLRKSVNEHFFLIWY

SEQ ID NO: 2583609 - protein, 24 aa, Entamoeba histolytica
KFKKLCKSSKLFVYNSESIESISA

SEQ ID NO: 2583610 - protein, 25 aa, Entamoeba histolytica
KFKLETFGFVSFLFVFNEKTHEYTY

SEQ ID NO: 2583611 - protein, 20 aa, Entamoeba histolytica
KFLESYCIETNIPKGSFEQH

SEQ ID NO: 2583612 - protein, 19 aa, Entamoeba histolytica
KFLIEVIILVFNETINDLI

SEQ ID NO: 2583613 - protein, 25 aa, Entamoeba histolytica
KFNKPPPCFSQFYKINFNNLFVNIT

SEQ ID NO: 2583614 - protein, 16 aa, Entamoeba histolytica
KFNYVVVVIYILIQIN

SEQ ID NO: 2583615 - protein, 20 aa, Entamoeba histolytica
KFPSTCNINKMGIDHQVIIV

SEQ ID NO: 2583616 - protein, 17 aa, Entamoeba histolytica
KFTFGHDTLILGGDDFN

SEQ ID NO: 2583617 - protein, 20 aa, Entamoeba histolytica
KFTLKFGGGDTFEHLFFIGN

SEQ ID NO: 2583618 - protein, 18 aa, Entamoeba histolytica
KFTQRRARFQGVGDQMWH

SEQ ID NO: 2583619 - protein, 18 aa, Entamoeba histolytica
KFVQIGIIALLIIAILLV

SEQ ID NO: 2583620 - protein, 25 aa, Entamoeba histolytica
KFWYNEDIKWLFVMSQNTDIGNKES

SEQ ID NO: 2583621 - protein, 24 aa, Entamoeba histolytica
KFYSHYKYVFLLILGDFVGLMNDN

SEQ ID NO: 2583622 - protein, 24 aa, Entamoeba histolytica
KFYYSEILHIILLCTVIVSVLILQ

SEQ ID NO: 2583623 - protein, 23 aa, Entamoeba histolytica
KGAGEWTEFKILLTDLGITNNEF

SEQ ID NO: 2583624 - protein, 24 aa, Entamoeba histolytica
KGCSECIKSTFDLYATSVETIKKG

SEQ ID NO: 2583625 - protein, 18 aa, Entamoeba histolytica
KGDKIAIFCETRYEWMAF

SEQ ID NO: 2583626 - protein, 17 aa, Entamoeba histolytica
KGDSFISVRFQDFGIDE

SEQ ID NO: 2583627 - protein, 19 aa, Entamoeba histolytica
KGDTGLLVYSLKDWVFTSI

SEQ ID NO: 2583628 - protein, 22 aa, Entamoeba histolytica
KGECAKCKDFYYLNQSICERCS

SEQ ID NO: 2583629 - protein, 20 aa, Entamoeba histolytica
KGEVKITDFGLAKKIEDNAS

SEQ ID NO: 2583630 - protein, 18 aa, Entamoeba histolytica
KGFDLTCLLKLKDLKTNT

SEQ ID NO: 2583631 - protein, 23 aa, Entamoeba histolytica
KGIAPPCIYGICKSKQEKKLRKQ

SEQ ID NO: 2583632 - protein, 19 aa, Entamoeba histolytica
KGIDLAVGIIPYICSKYPK

SEQ ID NO: 2583633 - protein, 20 aa, Entamoeba histolytica
KGIIESCKYIGNTLSFLRRI

SEQ ID NO: 2583634 - protein, 25 aa, Entamoeba histolytica
KGIIFEPRFGITIIQIASSTKLYLT

SEQ ID NO: 2583635 - protein, 27 aa, Entamoeba histolytica
KGILKNCALIHLLRVILWAVREPLKSN

SEQ ID NO: 2583636 - protein, 20 aa, Entamoeba histolytica
KGIMRKPTCNEIVMIGVGAA

SEQ ID NO: 2583637 - protein, 26 aa, Entamoeba histolytica
KGIQELFEWQVECLKTKGVREGTENL

SEQ ID NO: 2583638 - protein, 17 aa, Entamoeba histolytica
KGIWYKVVNDYKYAFPL

SEQ ID NO: 2583639 - protein, 19 aa, Entamoeba histolytica
KGKCISCNNGTYSNNYQCL

SEQ ID NO: 2583640 - protein, 17 aa, Entamoeba histolytica
KGKCVTFHYTIKPLCST

SEQ ID NO: 2583641 - protein, 18 aa, Entamoeba histolytica
KGKFLRERIQWKILQVLN

SEQ ID NO: 2583642 - protein, 25 aa, Entamoeba histolytica
KGKKICCNKCKKIYCPKNCKEILDK

SEQ ID NO: 2583643 - protein, 18 aa, Entamoeba histolytica
KGKLENIEYISASLQYIP

SEQ ID NO: 2583644 - protein, 17 aa, Entamoeba histolytica
KGKSDDRIRACDAISRL

SEQ ID NO: 2583645 - protein, 23 aa, Entamoeba histolytica
KGLEIIPNYLFWVGLPSLLVDGV

SEQ ID NO: 2583646 - protein, 23 aa, Entamoeba histolytica
KGLKEWGSAILVGFDGDPNGKDD

SEQ ID NO: 2583647 - protein, 25 aa, Entamoeba histolytica
KGMIKLKRIIKLKCNIPVGKIKVKN

SEQ ID NO: 2583648 - protein, 17 aa, Entamoeba histolytica
KGNIKNCLRYNSLGNCD

SEQ ID NO: 2583649 - protein, 18 aa, Entamoeba histolytica
KGNKIRCNEMFSEVFNET

SEQ ID NO: 2583650 - protein, 18 aa, Entamoeba histolytica
KGNVTVKVVNNFPVESFK

SEQ ID NO: 2583651 - protein, 17 aa, Entamoeba histolytica
KGRFQVFVHGDFLPITL

SEQ ID NO: 2583652 - protein, 18 aa, Entamoeba histolytica
KGRFVVFVCVVFINSVTA

SEQ ID NO: 2583653 - protein, 28 aa, Entamoeba histolytica
KGRSSWFIRKIWKIISYFIFIVFTLIFC

SEQ ID NO: 2583654 - protein, 22 aa, Entamoeba histolytica
KGSDGYAIFHLLRWTQGNEANV

SEQ ID NO: 2583655 - protein, 26 aa, Entamoeba histolytica
KGSESCPKGRYILRQVFDKKKNLVEK

SEQ ID NO: 2583656 - protein, 23 aa, Entamoeba histolytica
KGTEGCIKYGYGSYLQNPENCQE

SEQ ID NO: 2583657 - protein, 20 aa, Entamoeba histolytica
KGTLLLPIFFILILQSFALA

SEQ ID NO: 2583658 - protein, 17 aa, Entamoeba histolytica
KGTLVYGCFLYMSFVAI

SEQ ID NO: 2583659 - protein, 18 aa, Entamoeba histolytica
KGVANGQGLWNIIQIFDW

SEQ ID NO: 2583660 - protein, 19 aa, Entamoeba histolytica
KGVFAGDVLMVFMSVLSAS

SEQ ID NO: 2583661 - protein, 19 aa, Entamoeba histolytica
KGVFAGDVLTVFMSVLSAS

SEQ ID NO: 2583662 - protein, 18 aa, Entamoeba histolytica
KGVFAVDVLMVFMSVLFA

SEQ ID NO: 2583663 - protein, 17 aa, Entamoeba histolytica
KGVSIKIVITMLIILII

SEQ ID NO: 2583664 - protein, 18 aa, Entamoeba histolytica
KGYCRNGEKVIVHTNEIL

SEQ ID NO: 2583665 - protein, 23 aa, Entamoeba histolytica
KGYKLIYLKVHFYEMKLLILGFV

SEQ ID NO: 2583666 - protein, 20 aa, Entamoeba histolytica
KGYVSIKYPMLINSITQKLN

SEQ ID NO: 2583667 - protein, 18 aa, Entamoeba histolytica
KHCEGVKQSLAFDAPINT

SEQ ID NO: 2583668 - protein, 37 aa, Entamoeba histolytica
KHCSAHAKSSILLLPEALKLVPIFVLGAMKTSAFMPF

SEQ ID NO: 2583669 - protein, 26 aa, Entamoeba histolytica
KHDGWKKLRLDPSFMNSKMLKMPIDI

SEQ ID NO: 2583670 - protein, 21 aa, Entamoeba histolytica
KHEYIFCTLGLIGGIGAGAAF

SEQ ID NO: 2583671 - protein, 18 aa, Entamoeba histolytica
KHIKKIVITPTFQGRASN

SEQ ID NO: 2583672 - protein, 18 aa, Entamoeba histolytica
KHIRKLTARKEFKTKEQL

SEQ ID NO: 2583673 - protein, 19 aa, Entamoeba histolytica
KHLGISIVNCYLLPSLLNG

SEQ ID NO: 2583674 - protein, 22 aa, Entamoeba histolytica
KHLRHPCVLQLFGSGTDMNYIL

SEQ ID NO: 2583675 - protein, 25 aa, Entamoeba histolytica
KHPCGNFSSYGYSYLMVRGGGDVEL

SEQ ID NO: 2583676 - protein, 20 aa, Entamoeba histolytica
KHPDVCGGYIARGTAYAMIG

SEQ ID NO: 2583677 - protein, 20 aa, Entamoeba histolytica
KHQRKIISLLWNKIPPLKSN

SEQ ID NO: 2583678 - protein, 17 aa, Entamoeba histolytica
KHSKLALNQPSLRTKFA

SEQ ID NO: 2583679 - protein, 23 aa, Entamoeba histolytica
KHSPSDLYSCEDYGYESNVEEIE

SEQ ID NO: 2583680 - protein, 21 aa, Entamoeba histolytica
KHSSGILIWTVWTVMTVLAVT

SEQ ID NO: 2583681 - protein, 20 aa, Entamoeba histolytica
KHSYRQGKWFKFDSTKINPS

SEQ ID NO: 2583682 - protein, 17 aa, Entamoeba histolytica
KIDDFMPLNLKELIEDC

SEQ ID NO: 2583683 - protein, 18 aa, Entamoeba histolytica
KIDECIRRIEAITLLNRI

SEQ ID NO: 2583684 - protein, 24 aa, Entamoeba histolytica
KIDIPVFWPILLVYFIVLFVVTMH

SEQ ID NO: 2583685 - protein, 31 aa, Entamoeba histolytica; identical to SEQ ID NO: 2385541

SEQ ID NO: 2583686 - protein, 18 aa, Entamoeba histolytica
KIDTIWKRIKEIIMINEI

SEQ ID NO: 2583687 - protein, 25 aa, Entamoeba histolytica
KIEALKHGFPYLCFSLLSFINILLL

SEQ ID NO: 2583688 - protein, 26 aa, Entamoeba histolytica
KIEKELEGPIYLLRTSYQNFISRFGV

SEQ ID NO: 2583689 - protein, 21 aa, Entamoeba histolytica
KIEKLEIIVALANKDNIKEIL

SEQ ID NO: 2583690 - protein, 18 aa, Entamoeba histolytica
KIELFKGPIMESYLNAKK

SEQ ID NO: 2583691 - protein, 22 aa, Entamoeba histolytica
KIERKCTRFLMTFMIQLHVMKR

SEQ ID NO: 2583692 - protein, 25 aa, Entamoeba histolytica
KIESSMKLFKLDGIELQEIEAVVPI

SEQ ID NO: 2583693 - protein, 24 aa, Entamoeba histolytica
KIFAGRPRPHFYARIDAKPNEIND

SEQ ID NO: 2583694 - protein, 17 aa, Entamoeba histolytica
KIFENIISYEIKKVTDK

SEQ ID NO: 2583695 - protein, 18 aa, Entamoeba histolytica
KIFFSLLIGSVFFNIQND

SEQ ID NO: 2583696 - protein, 22 aa, Entamoeba histolytica
KIFPCKCKKCQKLNEMKWKKPL

SEQ ID NO: 2583697 - protein, 24 aa, Entamoeba histolytica
KIGFKEKLMWTGITLLVFLVCSQI

SEQ ID NO: 2583698 - protein, 17 aa, Entamoeba histolytica
KIGGMIIISTFTSICGV

SEQ ID NO: 2583699 - protein, 18 aa, Entamoeba histolytica
KIGLPCCDDSFTRDVYFI

SEQ ID NO: 2583700 - protein, 20 aa, Entamoeba histolytica
KIGNPICDYYQLLLYNNTII

SEQ ID NO: 2583701 - protein, 19 aa, Entamoeba histolytica
KIGSPFGGMIYLRSDTTFT

SEQ ID NO: 2583702 - protein, 17 aa, Entamoeba histolytica
KIHFAFKGFFDLIENHQ

SEQ ID NO: 2583703 - protein, 19 aa, Entamoeba histolytica
KIHIKVVSLSEGFIESIVA

SEQ ID NO: 2583704 - protein, 23 aa, Entamoeba histolytica
KIHKITKYEAMFMKIIEERNEII

SEQ ID NO: 2583705 - protein, 23 aa, Entamoeba histolytica
KIICISLGVIGCFILIICTIVLI

SEQ ID NO: 2583706 - protein, 24 aa, Entamoeba histolytica
KIIEEFFKALIICQTVEVKQDDEE

SEQ ID NO: 2583707 - protein, 26 aa, Entamoeba histolytica
KIIEMLRRILQIYSIIHVDRGYFQGL

SEQ ID NO: 2583708 - protein, 23 aa, Entamoeba histolytica
KIIFEKEVILFSSLNNRETITVV

SEQ ID NO: 2583709 - protein, 18 aa, Entamoeba histolytica
KIILWYCFILVFIRMLLE

SEQ ID NO: 2583710 - protein, 22 aa, Entamoeba histolytica
KIIPLNCEMNYFGIGLREYETV

SEQ ID NO: 2583711 - protein, 20 aa, Entamoeba histolytica
KIIVEDCGFSLNEIELNDME

SEQ ID NO: 2583712 - protein, 22 aa, Entamoeba histolytica
KIKIGGITASYGFLISAYIDEL

SEQ ID NO: 2583713 - protein, 23 aa, Entamoeba histolytica
KIKKICLFQVFGFKGTLIHVVAL

SEQ ID NO: 2583714 - protein, 36 aa, Entamoeba histolytica
KIKLNEDFWMRHSLIALFSWYVIILLDEQNPTHIEN

SEQ ID NO: 2583715 - protein, 30 aa, Entamoeba histolytica
KIKRSEIKFGYNPWFCFFIPGLVVIVVVYF

SEQ ID NO: 2583716 - protein, 24 aa, Entamoeba histolytica
KIKSFVEWYLYGGLQSILFFVIFY

SEQ ID NO: 2583717 - protein, 21 aa, Entamoeba histolytica
KIKSSTIFSLRIDNDEKVSLT

SEQ ID NO: 2583718 - protein, 25 aa, Entamoeba histolytica
KILDIIKKYLLKVIMKMKDIQKAFI

SEQ ID NO: 2583719 - protein, 23 aa, Entamoeba histolytica
KILFCSLMGLSILMIMPDLIQHP

SEQ ID NO: 2583720 - protein, 20 aa, Entamoeba histolytica
KILIYIPIILVIGMIVFSPM

SEQ ID NO: 2583721 - protein, 26 aa, Entamoeba histolytica
KILLEIAYCYLNFCIAAKPNLLKTFK

SEQ ID NO: 2583722 - protein, 20 aa, Entamoeba histolytica
KILSCVLAMVALKYHVIIQW

SEQ ID NO: 2583723 - protein, 20 aa, Entamoeba histolytica
KILVAYPMALYFILFVLLVM

SEQ ID NO: 2583724 - protein, 21 aa, Entamoeba histolytica
KINCYLFILFILFTKSRLVNE

SEQ ID NO: 2583725 - protein, 18 aa, Entamoeba histolytica
KINELLKIKGIRNKVQQL

SEQ ID NO: 2583726 - protein, 18 aa, Entamoeba histolytica
KINSLFCNSQINFNVVYN

SEQ ID NO: 2583727 - protein, 23 aa, Entamoeba histolytica
KINTLIERRIWKYYYTNYNTIDC

SEQ ID NO: 2583728 - protein, 19 aa, Entamoeba histolytica
KIPLLLKEFENVVVTYYKN

SEQ ID NO: 2583729 - protein, 24 aa, Entamoeba histolytica
KIQARTCDFLSFFIDSASTALMKE

SEQ ID NO: 2583730 - protein, 18 aa, Entamoeba histolytica
KIQECIKSYCNEHSNEDS

SEQ ID NO: 2583731 - protein, 32 aa, Entamoeba histolytica
KIQFIKSDFDNFAFDIMEYWPQSIVLLQPNLF

SEQ ID NO: 2583732 - protein, 20 aa, Entamoeba histolytica
KIQHFFDKRLPALRDSARNK

SEQ ID NO: 2583733 - protein, 23 aa, Entamoeba histolytica
KIREFIKFLIFFQPYFNIKQQKL

SEQ ID NO: 2583734 - protein, 22 aa, Entamoeba histolytica
KIRKPSLIEITGFKTNLSLDNL

SEQ ID NO: 2583735 - protein, 28 aa, Entamoeba histolytica
KIRQCAVEILGNICGLYIKCNQKPTLID

SEQ ID NO: 2583736 - protein, 18 aa, Entamoeba histolytica
KIRREHPQFFVINKDFVK

SEQ ID NO: 2583737 - protein, 25 aa, Entamoeba histolytica
KISFFKIGGLLLVASVLVLYLYQVR

SEQ ID NO: 2583738 - protein, 19 aa, Entamoeba histolytica
KISLFSLSVCSVLMVNIWS

SEQ ID NO: 2583739 - protein, 18 aa, Entamoeba histolytica
KISLNFLLLNIVCFGALS

SEQ ID NO: 2583740 - protein, 26 aa, Entamoeba histolytica
KISTCYPHTNFPAIVRIFSSCNKILS

SEQ ID NO: 2583741 - protein, 21 aa, Entamoeba histolytica
KISYIYCEVMAKFYEVDVQEA

SEQ ID NO: 2583742 - protein, 23 aa, Entamoeba histolytica
KITKLCIKKSFGTQILNYYNQTS

SEQ ID NO: 2583743 - protein, 19 aa, Entamoeba histolytica
KITTEFISFRAFNISNERN

SEQ ID NO: 2583744 - protein, 17 aa, Entamoeba histolytica
KITTIVVFLIMACFISL

SEQ ID NO: 2583745 - protein, 18 aa, Entamoeba histolytica
KIWFEALQDKTLIILIIA

SEQ ID NO: 2583746 - protein, 24 aa, Entamoeba histolytica
KIYDRKFIRDYFGDWMQKVLKYFV

SEQ ID NO: 2583747 - protein, 19 aa, Entamoeba histolytica
KIYEYFGIEYSKEFDEALK

SEQ ID NO: 2583748 - protein, 23 aa, Entamoeba histolytica
KIYKKIGWDKMKWEKRVEEVKRQ

SEQ ID NO: 2583749 - protein, 18 aa, Entamoeba histolytica
KIYNGGYMTSLRWLCQIK

SEQ ID NO: 2583750 - protein, 28 aa, Entamoeba histolytica
KKAQLSLCSSCGKPIIGSVALEVKGKKY

SEQ ID NO: 2583751 - protein, 24 aa, Entamoeba histolytica
KKASKRLTYGFVRAEVVGALINGV

SEQ ID NO: 2583752 - protein, 22 aa, Entamoeba histolytica
KKCEHTLRLGVRLGSQFSEVVF

SEQ ID NO: 2583753 - protein, 24 aa, Entamoeba histolytica
KKDGECSKCPVLVNNSVIKSNKLK

SEQ ID NO: 2583754 - protein, 18 aa, Entamoeba histolytica
KKDLPEILFISVHTEEYT

SEQ ID NO: 2583755 - protein, 21 aa, Entamoeba histolytica
KKDPECLHRNGGLSEYVLSPR

SEQ ID NO: 2583756 - protein, 18 aa, Entamoeba histolytica
KKECIELDNILNKPIGGI

SEQ ID NO: 2583757 - protein, 22 aa, Entamoeba histolytica
KKECPQLASKCCINNQGCALYK

SEQ ID NO: 2583758 - protein, 19 aa, Entamoeba histolytica
KKEETIPCDGIVISSSNKN

SEQ ID NO: 2583759 - protein, 27 aa, Entamoeba histolytica
KKEFKKTMLKAFKKVQMNYIQNESNFV

SEQ ID NO: 2583760 - protein, 18 aa, Entamoeba histolytica
KKEILIFFIEKVPQINND

SEQ ID NO: 2583761 - protein, 27 aa, Entamoeba histolytica
KKEIQKERIFGCGKITTIVVFLIMACF

SEQ ID NO: 2583762 - protein, 20 aa, Entamoeba histolytica
KKEREQRLNIEMKKKEEENK

SEQ ID NO: 2583763 - protein, 21 aa, Entamoeba histolytica
KKERKGVICFCSTKKGCERKG

SEQ ID NO: 2583764 - protein, 18 aa, Entamoeba histolytica
KKEWIIIIIFIIAVIVIG

SEQ ID NO: 2583765 - protein, 18 aa, Entamoeba histolytica
KKFHKQCIFGWFRSTGRH

SEQ ID NO: 2583766 - protein, 17 aa, Entamoeba histolytica
KKFICDISFKEMIQNPI

SEQ ID NO: 2583767 - protein, 18 aa, Entamoeba histolytica
KKFNSAVVKIYLQDTQTI

SEQ ID NO: 2583768 - protein, 29 aa, Entamoeba histolytica
KKFPTGDGFFFQWVMSIGILIVGIFSLLF

SEQ ID NO: 2583769 - protein, 25 aa, Entamoeba histolytica
KKFPTGDGMFFQFTLTLGIFLTALF

SEQ ID NO: 2583770 - protein, 20 aa, Entamoeba histolytica
KKFYQMMYWIIGIPAVAVEY

SEQ ID NO: 2583771 - protein, 19 aa, Entamoeba histolytica
KKGEICTLCGNKVVDEEED

SEQ ID NO: 2583772 - protein, 18 aa, Entamoeba histolytica
KKGIKIRSNEMVSKVFNE

SEQ ID NO: 2583773 - protein, 22 aa, Entamoeba histolytica
KKGRQSFWVYAVDELQHVNLRT

SEQ ID NO: 2583774 - protein, 18 aa, Entamoeba histolytica
KKGSGIFIQKGNIETEVI

SEQ ID NO: 2583775 - protein, 18 aa, Entamoeba histolytica
KKHVIMAWNEMSDINKIN

SEQ ID NO: 2583776 - protein, 27 aa, Entamoeba histolytica
KKICLNCGCLVCNNCFTEHRIICTNGF

SEQ ID NO: 2583777 - protein, 25 aa, Entamoeba histolytica
KKIGFKEKLMWTGITLLVFLVCSQI

SEQ ID NO: 2583778 - protein, 19 aa, Entamoeba histolytica
KKIGGMIIISTFTSICGVV

SEQ ID NO: 2583779 - protein, 17 aa, Entamoeba histolytica
KKIISITQADDWIEEII

SEQ ID NO: 2583780 - protein, 25 aa, Entamoeba histolytica
KKIKYWLPRIIFFVFFFAAVELVFI

SEQ ID NO: 2583781 - protein, 27 aa, Entamoeba histolytica
KKITPEKIKGGLVFFHLFRSFMKHTRL

SEQ ID NO: 2583782 - protein, 21 aa, Entamoeba histolytica
KKKDCRYYIGKECGKIFLNIF

SEQ ID NO: 2583783 - protein, 19 aa, Entamoeba histolytica
KKKDCSYYTKKECGKIILQ

SEQ ID NO: 2583784 - protein, 17 aa, Entamoeba histolytica
KKKDFKDTIILSQPQLP

SEQ ID NO: 2583785 - protein, 17 aa, Entamoeba histolytica
KKKDIRVNLPLAAPNDM

SEQ ID NO: 2583786 - protein, 22 aa, Entamoeba histolytica
KKKEILPSLLCEKENKKKRIKS

SEQ ID NO: 2583787 - protein, 18 aa, Entamoeba histolytica
KKKGELFVIPKKLDASQK

SEQ ID NO: 2583788 - protein, 19 aa, Entamoeba histolytica
KKKIEGVDELKCQVVKIQK

SEQ ID NO: 2583789 - protein, 18 aa, Entamoeba histolytica
KKKKRIAIQNEINKMKME

SEQ ID NO: 2583790 - protein, 25 aa, Entamoeba histolytica
KKKRSVTLRGYWQIFGYVVVAILIV

SEQ ID NO: 2583791 - protein, 22 aa, Entamoeba histolytica
KKKSWLCVFPGCKESVKTHYNC

SEQ ID NO: 2583792 - protein, 20 aa, Entamoeba histolytica
KKKVIGLCEYCFSQNVSSSS

SEQ ID NO: 2583793 - protein, 20 aa, Entamoeba histolytica
KKKYRLLDPSGFDLKIGNSK

SEQ ID NO: 2583794 - protein, 26 aa, Entamoeba histolytica
KKKYRTGWKYPINIILHLFLFTVGGL

SEQ ID NO: 2583795 - protein, 23 aa, Entamoeba histolytica
KKLLKGAMGFLFSQSKLVYLPAL

SEQ ID NO: 2583796 - protein, 28 aa, Entamoeba histolytica
KKLLVIKVFDCLFIFLINRISFHFREGH

SEQ ID NO: 2583797 - protein, 19 aa, Entamoeba histolytica
KKLMLKFNLGVIFFYIIVY

SEQ ID NO: 2583798 - protein, 26 aa, Entamoeba histolytica
KKLPVKVVFCLIGICYLAVNALIIFV

SEQ ID NO: 2583799 - protein, 17 aa, Entamoeba histolytica
KKLSSKISTPTESKQPP

SEQ ID NO: 2583800 - protein, 18 aa, Entamoeba histolytica
KKMNIPMSYLKYYSDHVL

SEQ ID NO: 2583801 - protein, 23 aa, Entamoeba histolytica
KKMSESIVGIGIREVSQSAYDIL

SEQ ID NO: 2583802 - protein, 23 aa, Entamoeba histolytica
KKNFWSIYCSILYSIHGFGNTTF

SEQ ID NO: 2583803 - protein, 25 aa, Entamoeba histolytica
KKNIPVFVRPHFDDSIPFPLKNLIQ

SEQ ID NO: 2583804 - protein, 23 aa, Entamoeba histolytica
KKNKRYSQLMLFNYAIKTYGKEN

SEQ ID NO: 2583805 - protein, 23 aa, Entamoeba histolytica
KKNPKFIMRCVQAMALCHNVTPS

SEQ ID NO: 2583806 - protein, 20 aa, Entamoeba histolytica
KKNYDWMILILINKIISVFI

SEQ ID NO: 2583807 - protein, 17 aa, Entamoeba histolytica
KKPDLFSVFKTLGAEVL

SEQ ID NO: 2583808 - protein, 24 aa, Entamoeba histolytica
KKPESLSITFLVMWLGGDITNLLG

SEQ ID NO: 2583809 - protein, 23 aa, Entamoeba histolytica
KKPTKFIGNFTMKITESAEGLGR

SEQ ID NO: 2583810 - protein, 26 aa, Entamoeba histolytica
KKPYKNIFKWGLILALVNAITNLSNF

SEQ ID NO: 2583811 - protein, 19 aa, Entamoeba histolytica
KKQFHWLYLHILFKMVHHS

SEQ ID NO: 2583812 - protein, 21 aa, Entamoeba histolytica
KKQILSLSHWIVKKRIFSITL

SEQ ID NO: 2583813 - protein, 17 aa, Entamoeba histolytica
KKQLCGLVESLFERQAE

SEQ ID NO: 2583814 - protein, 17 aa, Entamoeba histolytica
KKQYISWVMALFELSSH

SEQ ID NO: 2583815 - protein, 18 aa, Entamoeba histolytica
KKRIASLCTSIISDTTST

SEQ ID NO: 2583816 - protein, 20 aa, Entamoeba histolytica
KKRIRYCPNVIFNKHVICTL

SEQ ID NO: 2583817 - protein, 19 aa, Entamoeba histolytica
KKRIYSICVGVFQIILIFF

SEQ ID NO: 2583818 - protein, 32 aa, Entamoeba histolytica
KKRRTSLPNALPFKINATPFIPKRKRIESTIN

SEQ ID NO: 2583819 - protein, 28 aa, Entamoeba histolytica
KKSFPIGKIIGFGCIILLVIFMLFMPEM

SEQ ID NO: 2583820 - protein, 23 aa, Entamoeba histolytica
KKSIDSRLSMSIMKTTFEKSFKK

SEQ ID NO: 2583821 - protein, 31 aa, Entamoeba histolytica
KKSLCKRIIQFPGWFFKQFFRTDPKGASMFL

SEQ ID NO: 2583822 - protein, 20 aa, Entamoeba histolytica
KKSSLFLLFSLLSLGLSASM

SEQ ID NO: 2583823 - protein, 20 aa, Entamoeba histolytica
KKSWLCIFPGCKEPVKTHYN

SEQ ID NO: 2583824 - protein, 21 aa, Entamoeba histolytica
KKTFFASLPFLEKGKLIDDKE

SEQ ID NO: 2583825 - protein, 18 aa, Entamoeba histolytica
KKTFKEKVWGVVKVLGFI

SEQ ID NO: 2583826 - protein, 18 aa, Entamoeba histolytica
KKTFWLDDVELIKDPNAP

SEQ ID NO: 2583827 - protein, 43 aa, Entamoeba histolytica
KKTIAIIVSSLFVSFLIVCAVILIIAVVIRKYLNVRSQKQNNE

SEQ ID NO: 2583828 - protein, 24 aa, Entamoeba histolytica
KKTIFRQCIHCGAFNKIQNVQIKD

SEQ ID NO: 2583829 - protein, 20 aa, Entamoeba histolytica
KKTLQCIELLLKNKTIETWT

SEQ ID NO: 2583830 - protein, 21 aa, Entamoeba histolytica
KKTYPRYILMDGDLNSDKGMK

SEQ ID NO: 2583831 - protein, 19 aa, Entamoeba histolytica
KKVGRPVGFYELIKRLIIS

SEQ ID NO: 2583832 - protein, 17 aa, Entamoeba histolytica
KKVNIIIKKFFMVNTQS

SEQ ID NO: 2583833 - protein, 24 aa, Entamoeba histolytica
KKWPENALIAIGGFLFLRFINPAI

SEQ ID NO: 2583834 - protein, 24 aa, Entamoeba histolytica
KKYAKARAGCILATCGNKQWDKGE

SEQ ID NO: 2583835 - protein, 24 aa, Entamoeba histolytica
KKYAKARAGCILATCGNRKWDEGE

SEQ ID NO: 2583836 - protein, 22 aa, Entamoeba histolytica
KKYCVSGICIIEPSTGKIISLT

SEQ ID NO: 2583837 - protein, 17 aa, Entamoeba histolytica
KKYEILNMFPFSSSTKR

SEQ ID NO: 2583838 - protein, 17 aa, Entamoeba histolytica
KKYHKQCFFCSRCKNVL

SEQ ID NO: 2583839 - protein, 19 aa, Entamoeba histolytica
KKYIPIQCIPNFIHRYNKY

SEQ ID NO: 2583840 - protein, 20 aa, Entamoeba histolytica
KKYKGEWSKKSIDSRLSMSI

SEQ ID NO: 2583841 - protein, 22 aa, Entamoeba histolytica
KKYNPSIIISYYIKQSIGGIVF

SEQ ID NO: 2583842 - protein, 20 aa, Entamoeba histolytica
KLANVYFLFISCLQLIPGLS

SEQ ID NO: 2583843 - protein, 17 aa, Entamoeba histolytica
KLAVPGTAGCKIIAHGG

SEQ ID NO: 2583844 - protein, 23 aa, Entamoeba histolytica
KLEERKRSGLVLFSIIIILPILT

SEQ ID NO: 2583845 - protein, 22 aa, Entamoeba histolytica
KLEKRVESWIDKYERIHKLLNI

SEQ ID NO: 2583846 - protein, 18 aa, Entamoeba histolytica
KLEMLKQYFEQWNEQANM

SEQ ID NO: 2583847 - protein, 17 aa, Entamoeba histolytica
KLFRIKRGTIFKPKPTD

SEQ ID NO: 2583848 - protein, 18 aa, Entamoeba histolytica
KLGCAVCNDGYYKKVSLC

SEQ ID NO: 2583849 - protein, 26 aa, Entamoeba histolytica
KLHNYDLLCCISFTFSKSAIHRLKCT

SEQ ID NO: 2583850 - protein, 25 aa, Entamoeba histolytica
KLIDGLLEFICQTFSLKQYTPALKA

SEQ ID NO: 2583851 - protein, 20 aa, Entamoeba histolytica
KLIDRKCWTIIYSHGNSQDL

SEQ ID NO: 2583852 - protein, 24 aa, Entamoeba histolytica
KLIIELHTPLLVFFDKLLQFIPEN

SEQ ID NO: 2583853 - protein, 20 aa, Entamoeba histolytica
KLIIEPRTQPLLIQSNEPII

SEQ ID NO: 2583854 - protein, 19 aa, Entamoeba histolytica
KLIPLRRLTIDSSQISTPN

SEQ ID NO: 2583855 - protein, 18 aa, Entamoeba histolytica
KLIVGWLLFSVILLLMLF

SEQ ID NO: 2583856 - protein, 18 aa, Entamoeba histolytica
KLKEEKIKKMMALRKSAQ

SEQ ID NO: 2583857 - protein, 19 aa, Entamoeba histolytica
KLKEIFRCYYLQTPNLSLL

SEQ ID NO: 2583858 - protein, 19 aa, Entamoeba histolytica
KLKGFSGIVNDDFSIGGDG

SEQ ID NO: 2583859 - protein, 23 aa, Entamoeba histolytica
KLKSGIQMTWWLGINLTLIYFFE

SEQ ID NO: 2583860 - protein, 18 aa, Entamoeba histolytica
KLLLKRGKNLILLVMMVL

SEQ ID NO: 2583861 - protein, 24 aa, Entamoeba histolytica
KLLMQFYGVWVASVFAKMEACGLI

SEQ ID NO: 2583862 - protein, 23 aa, Entamoeba histolytica
KLLNIKIQLSFSITSLLGDVRVR

SEQ ID NO: 2583863 - protein, 23 aa, Entamoeba histolytica
KLLPSLISYIGIEPIHEMLKSLL

SEQ ID NO: 2583864 - protein, 20 aa, Entamoeba histolytica
KLLYQLGIDRTFLFHILYNL

SEQ ID NO: 2583865 - protein, 19 aa, Entamoeba histolytica
KLMKHPRKPTEIVVYTDSY

SEQ ID NO: 2583866 - protein, 23 aa, Entamoeba histolytica
KLMLSCLKYNFLGTNMDETTEDI

SEQ ID NO: 2583867 - protein, 27 aa, Entamoeba histolytica
KLNLKVVSWLSHYSHLILIQRNTSSFI

SEQ ID NO: 2583868 - protein, 25 aa, Entamoeba histolytica
KLNPEKRYFFFFTFHDDNLLINFNI

SEQ ID NO: 2583869 - protein, 25 aa, Entamoeba histolytica
KLNSIPIEYFIGGNIFNNSVDYLIQ

SEQ ID NO: 2583870 - protein, 17 aa, Entamoeba histolytica
KLNVKFMKSTIWKNRIE

SEQ ID NO: 2583871 - protein, 22 aa, Entamoeba histolytica
KLPCDCPICLCLIEDSNDVLLT

SEQ ID NO: 2583872 - protein, 24 aa, Entamoeba histolytica
KLPDAHIPWYRYLLFTIAMACCVV

SEQ ID NO: 2583873 - protein, 23 aa, Entamoeba histolytica
KLPEEFSTLMGLVSAGLCCVESL

SEQ ID NO: 2583874 - protein, 22 aa, Entamoeba histolytica
KLPWNCWSDNLLVYGTLPTGIS

SEQ ID NO: 2583875 - protein, 20 aa, Entamoeba histolytica
KLQDLRLWLCSLVENSFYKV

SEQ ID NO: 2583876 - protein, 30 aa, Entamoeba histolytica
KLQFPSSLLIKRKLVLIAFQCLQSKVIKPE

SEQ ID NO: 2583877 - protein, 20 aa, Entamoeba histolytica
KLRHPCVLQFFGSGTDANFI

SEQ ID NO: 2583878 - protein, 18 aa, Entamoeba histolytica
KLRNEPRLLTSIQSGNKI

SEQ ID NO: 2583879 - protein, 29 aa, Entamoeba histolytica
KLRRVNGLKILICWSFLEVRICHILTNFR

SEQ ID NO: 2583880 - protein, 22 aa, Entamoeba histolytica
KLSDSTTFVPVRLAETSLSTQS

SEQ ID NO: 2583881 - protein, 18 aa, Entamoeba histolytica
KLSIPKHCYGYLNVIALT

SEQ ID NO: 2583882 - protein, 31 aa, Entamoeba histolytica
KLSISCLLCMAVSILIIYCVIIKKISSMCII

SEQ ID NO: 2583883 - protein, 23 aa, Entamoeba histolytica
KLSKCGFLLIFAMFVVIVTFCIS

SEQ ID NO: 2583884 - protein, 22 aa, Entamoeba histolytica
KLSKEVIETALLLSQKMGAKYI

SEQ ID NO: 2583885 - protein, 26 aa, Entamoeba histolytica
KLSMFALCWSLGKAIGFLLGGTLKVK

SEQ ID NO: 2583886 - protein, 20 aa, Entamoeba histolytica
KLSSIYQLWDWVLQSPKFAK

SEQ ID NO: 2583887 - protein, 20 aa, Entamoeba histolytica
KLSWWSLLELAGFVILFFAT

SEQ ID NO: 2583888 - protein, 19 aa, Entamoeba histolytica
KLTMSRLGFEVHDYHDKYN

SEQ ID NO: 2583889 - protein, 26 aa, Entamoeba histolytica
KLTRKSAPYFIQWIVNILQTYGTLKR

SEQ ID NO: 2583890 - protein, 22 aa, Entamoeba histolytica
KLTSLLLHYIYLLPIYKNNTLI

SEQ ID NO: 2583891 - protein, 25 aa, Entamoeba histolytica
KLVGCCLPLLFGCIVAISRVRDYFH

SEQ ID NO: 2583892 - protein, 25 aa, Entamoeba histolytica
KLYCSKMPKWSIYPLAFIPGVVLYL

SEQ ID NO: 2583893 - protein, 17 aa, Entamoeba histolytica
KMEEIFNSLDLFKERRA

SEQ ID NO: 2583894 - protein, 18 aa, Entamoeba histolytica
KMHLEILNEDTLKLIAGH

SEQ ID NO: 2583895 - protein, 23 aa, Entamoeba histolytica
KMHRRVSLLIGKYLKEHAENIVN

SEQ ID NO: 2583896 - protein, 19 aa, Entamoeba histolytica
KMHSGILKWIIRFHPDLVF

SEQ ID NO: 2583897 - protein, 20 aa, Entamoeba histolytica
KMIMIHSLGHSFSIHQHMGT

SEQ ID NO: 2583898 - protein, 20 aa, Entamoeba histolytica
KMISIVMFNLMGWDFVGNVS

SEQ ID NO: 2583899 - protein, 17 aa, Entamoeba histolytica
KMKGINVSSTFNLVLIL

SEQ ID NO: 2583900 - protein, 22 aa, Entamoeba histolytica
KMKRHHFVIIGITVFFLLIISI

SEQ ID NO: 2583901 - protein, 24 aa, Entamoeba histolytica
KMKSKGCLEYESYENLLQLIKTLV

SEQ ID NO: 2583902 - protein, 19 aa, Entamoeba histolytica
KMLDDCLLYYSYDMNITLC

SEQ ID NO: 2583903 - protein, 17 aa, Entamoeba histolytica
KMLKEFNYVVVVIYILI

SEQ ID NO: 2583904 - protein, 17 aa, Entamoeba histolytica
KMLKKFNYVVVVIYILI

SEQ ID NO: 2583905 - protein, 23 aa, Entamoeba histolytica
KMLKMPIDIQIFLSKLFDKEEVM

SEQ ID NO: 2583906 - protein, 28 aa, Entamoeba histolytica
KMLLEMLPKQFAAFMFFDCHNKFYQEIL

SEQ ID NO: 2583907 - protein, 17 aa, Entamoeba histolytica
KMLTKYRGFICGDDGKW

SEQ ID NO: 2583908 - protein, 29 aa, Entamoeba histolytica
KMLVIGLGLLHLCCGESASLVMDTVRALP

SEQ ID NO: 2583909 - protein, 19 aa, Entamoeba histolytica
KMMYIFISVDGFESFNAGI

SEQ ID NO: 2583910 - protein, 19 aa, Entamoeba histolytica
KMSKKNFMRVIGEYGPIYK

SEQ ID NO: 2583911 - protein, 25 aa, Entamoeba histolytica
KMSYCERIKLSPVFFNVSYPEEVIK

SEQ ID NO: 2583912 - protein, 25 aa, Entamoeba histolytica
KMVKKFFERNICPFILQEEVQKILS

SEQ ID NO: 2583913 - protein, 24 aa, Entamoeba histolytica
KMYFTELVDLIGFNSYSFIHPNSE

SEQ ID NO: 2583914 - protein, 25 aa, Entamoeba histolytica
KMYIPEIIYLLNLIGSVFTTIHFSS

SEQ ID NO: 2583915 - protein, 30 aa, Entamoeba histolytica
KMYNICIINSIPFPQFLPSIFHMYIQGDRE

SEQ ID NO: 2583916 - protein, 28 aa, Entamoeba histolytica
KMYYEMRTTISLPFYFYSVRFLGKIFKS

SEQ ID NO: 2583917 - protein, 17 aa, Entamoeba histolytica
KNARVCWNDDSIACTDN

SEQ ID NO: 2583918 - protein, 23 aa, Entamoeba histolytica
KNCNSLCYCIEGYVPSDDDPLSC

SEQ ID NO: 2583919 - protein, 17 aa, Entamoeba histolytica
KNCTYYWGFALAVSINV

SEQ ID NO: 2583920 - protein, 23 aa, Entamoeba histolytica
KNDGNIGWYWLIFIFSFISGFIP

SEQ ID NO: 2583921 - protein, 23 aa, Entamoeba histolytica
KNECMRLFMKIKRLLDSTQNILA

SEQ ID NO: 2583922 - protein, 18 aa, Entamoeba histolytica
KNEKEWKILQSIIKEYYN

SEQ ID NO: 2583923 - protein, 22 aa, Entamoeba histolytica
KNELLYKVMILIGLNDIVFTSL

SEQ ID NO: 2583924 - protein, 19 aa, Entamoeba histolytica
KNETILWLIGGVQQYLGAY

SEQ ID NO: 2583925 - protein, 17 aa, Entamoeba histolytica
KNFIFFSCGTLVLFFGL

SEQ ID NO: 2583926 - protein, 23 aa, Entamoeba histolytica
KNFRPQAFCNRDIIMVLNEGTFN

SEQ ID NO: 2583927 - protein, 25 aa, Entamoeba histolytica
KNFVKVWRYIRETNKVVVQYIKTNG

SEQ ID NO: 2583928 - protein, 17 aa, Entamoeba histolytica
KNGDIILNCSHFLNGLL

SEQ ID NO: 2583929 - protein, 17 aa, Entamoeba histolytica
KNGGGLVKLAQTIEKAL

SEQ ID NO: 2583930 - protein, 19 aa, Entamoeba histolytica
KNGGGYSIYSQWIEKILSP

SEQ ID NO: 2583931 - protein, 23 aa, Entamoeba histolytica
KNGIEVIHLFTGKPLLHVSLSST

SEQ ID NO: 2583932 - protein, 27 aa, Entamoeba histolytica
KNGILRISELCNIFRYFEIPKENDSKM

SEQ ID NO: 2583933 - protein, 19 aa, Entamoeba histolytica
KNGNGWIGVNMLDGQYFAV

SEQ ID NO: 2583934 - protein, 19 aa, Entamoeba histolytica
KNGVVYKEEQEVRMYKIYS

SEQ ID NO: 2583935 - protein, 17 aa, Entamoeba histolytica
KNHLRRIVVLGITTATI

SEQ ID NO: 2583936 - protein, 22 aa, Entamoeba histolytica
KNIDGASCLFIILGVIITLLFF

SEQ ID NO: 2583937 - protein, 22 aa, Entamoeba histolytica
KNIDGTSCVFVILSILIIFLLI

SEQ ID NO: 2583938 - protein, 28 aa, Entamoeba histolytica
KNIEQTCCQCINCNQYLHQNCISTFIET

SEQ ID NO: 2583939 - protein, 17 aa, Entamoeba histolytica
KNIIKILHLIGTLNEDY

SEQ ID NO: 2583940 - protein, 25 aa, Entamoeba histolytica
KNIKFIVQCLYRFVTHSTSLDIKQI

SEQ ID NO: 2583941 - protein, 29 aa, Entamoeba histolytica
KNIKRCPRCGGYVNPFCTFEEGGKKMKCN

SEQ ID NO: 2583942 - protein, 17 aa, Entamoeba histolytica
KNISGRLLVGLRWWNKV

SEQ ID NO: 2583943 - protein, 19 aa, Entamoeba histolytica
KNITDFFGHFVDIRIDSSL

SEQ ID NO: 2583944 - protein, 23 aa, Entamoeba histolytica
KNKEFKVIIGGSLILNFENYKDW

SEQ ID NO: 2583945 - protein, 37 aa, Entamoeba histolytica
KNKGRITVVSSFIFFSFIIPLAFGYAIWRPMTLLWTF

SEQ ID NO: 2583946 - protein, 23 aa, Entamoeba histolytica
KNKIESLVHLLKCSGIIGQKTKH

SEQ ID NO: 2583947 - protein, 18 aa, Entamoeba histolytica
KNKNSLLRSSELTISKMD

SEQ ID NO: 2583948 - protein, 17 aa, Entamoeba histolytica
KNKRLVKRDSICDNEIN

SEQ ID NO: 2583949 - protein, 24 aa, Entamoeba histolytica
KNKSEIKKLCEVYMVEIDPSLDIQ

SEQ ID NO: 2583950 - protein, 27 aa, Entamoeba histolytica
KNLHLKPRLKIKFMIDTAKGIQYLHSN

SEQ ID NO: 2583951 - protein, 24 aa, Entamoeba histolytica
KNLLRCIVEVLGIQMNSTQLAVQK

SEQ ID NO: 2583952 - protein, 20 aa, Entamoeba histolytica
KNLPNCLGLLQLCDDIIIAR

SEQ ID NO: 2583953 - protein, 28 aa, Entamoeba histolytica
KNLQLIGWIMVCVIIGILLIVIAGIYLF

SEQ ID NO: 2583954 - protein, 23 aa, Entamoeba histolytica
KNLSESLSTIFRLFDVQTTLVND

SEQ ID NO: 2583955 - protein, 21 aa, Entamoeba histolytica
KNMKLRYLFTYNKNDDVQSYE

SEQ ID NO: 2583956 - protein, 19 aa, Entamoeba histolytica
KNMNCKILFENIINLISND

SEQ ID NO: 2583957 - protein, 20 aa, Entamoeba histolytica
KNNFSVLFNYQFQENSTIDD

SEQ ID NO: 2583958 - protein, 21 aa, Entamoeba histolytica
KNNICLKCPQGKMIDSDHTGC

SEQ ID NO: 2583959 - protein, 24 aa, Entamoeba histolytica
KNNYPRWLMWGSVVNGNQTVDGIL

SEQ ID NO: 2583960 - protein, 17 aa, Entamoeba histolytica
KNPLLVKYGNLISGDFF

SEQ ID NO: 2583961 - protein, 19 aa, Entamoeba histolytica
KNQFGFVFDQVVKKKPEKQ

SEQ ID NO: 2583962 - protein, 21 aa, Entamoeba histolytica
KNQVPCYIGFFFLVISYARFR

SEQ ID NO: 2583963 - protein, 18 aa, Entamoeba histolytica
KNRCILSGAISFLTQAIK

SEQ ID NO: 2583964 - protein, 25 aa, Entamoeba histolytica
KNRMKDIFETIGFTITTLNSWVFSW

SEQ ID NO: 2583965 - protein, 22 aa, Entamoeba histolytica
KNVDGTLCVYVILSILITVLFF

SEQ ID NO: 2583966 - protein, 17 aa, Entamoeba histolytica
KNVIWLLEYDGTLTEIN

SEQ ID NO: 2583967 - protein, 17 aa, Entamoeba histolytica
KNVRRHCHYHITIKTDA

SEQ ID NO: 2583968 - protein, 19 aa, Entamoeba histolytica
KNVTRYCAVLFKRLKHWVL

SEQ ID NO: 2583969 - protein, 18 aa, Entamoeba histolytica
KNWKCIFPNCNEPAKTRF

SEQ ID NO: 2583970 - protein, 17 aa, Entamoeba histolytica
KNWKCVFPNCNEPVKTR

SEQ ID NO: 2583971 - protein, 32 aa, Entamoeba histolytica
KNYLKQYWPEILWRWYVKKGMYEEAIKCILKL

SEQ ID NO: 2583972 - protein, 20 aa, Entamoeba histolytica
KNYPSIIIMWIFLLVLMVVI

SEQ ID NO: 2583973 - protein, 30 aa, Entamoeba histolytica
KNYSKGCVPFCGTCKFGFSCNKAAKCVKTI

SEQ ID NO: 2583974 - protein, 24 aa, Entamoeba histolytica
KPDHPKCLWDCLPEKKLNICDVEN

SEQ ID NO: 2583975 - protein, 18 aa, Entamoeba histolytica
KPEERLGFERVCNYLVLI

SEQ ID NO: 2583976 - protein, 20 aa, Entamoeba histolytica
KPEIHRLIFTILKNLIKYHS

SEQ ID NO: 2583977 - protein, 22 aa, Entamoeba histolytica
KPEWLTLCRKSESSLSKQKKEE

SEQ ID NO: 2583978 - protein, 22 aa, Entamoeba histolytica
KPFEEWDLESFYPFFKEGFCKH

SEQ ID NO: 2583979 - protein, 29 aa, Entamoeba histolytica
KPFLQRLKSFPLWFCKQWLRTDEKGASLF

SEQ ID NO: 2583980 - protein, 26 aa, Entamoeba histolytica
KPFMTFRMLCSIAFFSLLIETISFGI

SEQ ID NO: 2583981 - protein, 26 aa, Entamoeba histolytica
KPFQIPYDCCGWKLTNITTLNNSTCQ

SEQ ID NO: 2583982 - protein, 23 aa, Entamoeba histolytica
KPGHKLRIKFMIDAAKGIEYLHS

SEQ ID NO: 2583983 - protein, 22 aa, Entamoeba histolytica
KPGLKIRLKFMTSVNVQDETLH

SEQ ID NO: 2583984 - protein, 24 aa, Entamoeba histolytica
KPGTTRAYMALTFYDNTKYYLFLQ

SEQ ID NO: 2583985 - protein, 24 aa, Entamoeba histolytica
KPIKKRNIEVPKIIDESPFKGSSK

SEQ ID NO: 2583986 - protein, 20 aa, Entamoeba histolytica
KPIMGNGVGIWFTDTQIYKG

SEQ ID NO: 2583987 - protein, 30 aa, Entamoeba histolytica
KPKKAEEVFKIIFRLAPNHCFAHYLRGVLF

SEQ ID NO: 2583988 - protein, 20 aa, Entamoeba histolytica
KPLFLNWAMFLGMTLCLILY

SEQ ID NO: 2583989 - protein, 18 aa, Entamoeba histolytica
KPLLSNRVNISKQWQDGE

SEQ ID NO: 2583990 - protein, 25 aa, Entamoeba histolytica
KPLMYCLLIVFGLTIILSFEIIPEL

SEQ ID NO: 2583991 - protein, 24 aa, Entamoeba histolytica
KPPECVRTEMGYCVECASGYFLSD

SEQ ID NO: 2583992 - protein, 18 aa, Entamoeba histolytica
KPPKHIGFHSLVQDDKNC

SEQ ID NO: 2583993 - protein, 23 aa, Entamoeba histolytica
KPQEMLNLLLGKIFFSEQQESCE

SEQ ID NO: 2583994 - protein, 24 aa, Entamoeba histolytica
KPTKEVFSLLKLFIDEHTLPIHLA

SEQ ID NO: 2583995 - protein, 19 aa, Entamoeba histolytica
KPTPFTIKIINDFEPLITF

SEQ ID NO: 2583996 - protein, 19 aa, Entamoeba histolytica
KPVAATMFCLGLIVMIPFC

SEQ ID NO: 2583997 - protein, 21 aa, Entamoeba histolytica
KPVKQKWLWSLYTILTVMSLI

SEQ ID NO: 2583998 - protein, 23 aa, Entamoeba histolytica
KPVWVLKMIINIQISMNNKNIKD

SEQ ID NO: 2583999 - protein, 23 aa, Entamoeba histolytica
KPWLESYWHIVAIIIIYIIVDGY

SEQ ID NO: 2584000 - protein, 31 aa, Entamoeba histolytica; identical to SEQ ID NO: 2385908

SEQ ID NO: 2584001 - protein, 18 aa, Entamoeba histolytica
KQALRPVLCVPTVYDTLP

SEQ ID NO: 2584002 - protein, 20 aa, Entamoeba histolytica
KQAQNGFGFIENIKEIIHSY

SEQ ID NO: 2584003 - protein, 18 aa, Entamoeba histolytica
KQASVFLILIPTTFDLIA

SEQ ID NO: 2584004 - protein, 25 aa, Entamoeba histolytica
KQCFFCSRCKNVLDEKSFVSIDDAN

SEQ ID NO: 2584005 - protein, 46 aa, Entamoeba histolytica
KQEQELECTCLLCKMKLVILQNRYVPWISLARIFYLSLMTLYPSKI

SEQ ID NO: 2584006 - protein, 22 aa, Entamoeba histolytica
KQFGFRSSRRMEWVESLNKMIV

SEQ ID NO: 2584007 - protein, 25 aa, Entamoeba histolytica
KQFIKFGVVSCVAFIIRSLLFKLGR

SEQ ID NO: 2584008 - protein, 21 aa, Entamoeba histolytica
KQFRTIWSYFFGYWKDPNTEN

SEQ ID NO: 2584009 - protein, 19 aa, Entamoeba histolytica
KQFSCLGLLKQIFTVSEEF

SEQ ID NO: 2584010 - protein, 19 aa, Entamoeba histolytica
KQGLVCFFTGLSGSGKSVV

SEQ ID NO: 2584011 - protein, 20 aa, Entamoeba histolytica
KQIKEFKRLSGTVQAEGKNN

SEQ ID NO: 2584012 - protein, 23 aa, Entamoeba histolytica
KQIKFLGMLPAEMLINGTKTENY

SEQ ID NO: 2584013 - protein, 22 aa, Entamoeba histolytica
KQIKFLGMLPAEMLNSGTKTEN

SEQ ID NO: 2584014 - protein, 25 aa, Entamoeba histolytica
KQILNRMVSGLIYFFVTPFIDIQIH

SEQ ID NO: 2584015 - protein, 17 aa, Entamoeba histolytica
KQIPWKTTLVVLIMSSI

SEQ ID NO: 2584016 - protein, 24 aa, Entamoeba histolytica
KQIQYRGSYWIKIDLSSKQSSGSH

SEQ ID NO: 2584017 - protein, 22 aa, Entamoeba histolytica
KQIVNKCWKCGKDKIDLNKCNC

SEQ ID NO: 2584018 - protein, 24 aa, Entamoeba histolytica
KQKLRGTVPLDFASVKSCEIENHP

SEQ ID NO: 2584019 - protein, 17 aa, Entamoeba histolytica
KQKQYVFHFTGVGLIII

SEQ ID NO: 2584020 - protein, 20 aa, Entamoeba histolytica
KQLFPVQRLFVLPEPIDDHY

SEQ ID NO: 2584021 - protein, 24 aa, Entamoeba histolytica
KQLISDPFGSIFIQPYKGFISVCI

SEQ ID NO: 2584022 - protein, 19 aa, Entamoeba histolytica
KQLKIRDPVLFLFAHADDD

SEQ ID NO: 2584023 - protein, 19 aa, Entamoeba histolytica
KQLLMTTFWQYRTPPVNSI

SEQ ID NO: 2584024 - protein, 17 aa, Entamoeba histolytica
KQLRNVVPYVYDITLGY

SEQ ID NO: 2584025 - protein, 17 aa, Entamoeba histolytica
KQLWYLVLIPIFCILIL

SEQ ID NO: 2584026 - protein, 25 aa, Entamoeba histolytica
KQMLEGMKLFGMMHPINGAITSASN

SEQ ID NO: 2584027 - protein, 19 aa, Entamoeba histolytica
KQNCIKCLYQIKSTLSNQR

SEQ ID NO: 2584028 - protein, 24 aa, Entamoeba histolytica
KQNCKRIAEKMLFGIKDLTENVLQ

SEQ ID NO: 2584029 - protein, 20 aa, Entamoeba histolytica
KQNNLSFEWQIPKQVILGQL

SEQ ID NO: 2584030 - protein, 24 aa, Entamoeba histolytica
KQPLRLLCAIVFLCCLTMTILGLF

SEQ ID NO: 2584031 - protein, 18 aa, Entamoeba histolytica
KQQFKLFLIHLLQSDSPP

SEQ ID NO: 2584032 - protein, 17 aa, Entamoeba histolytica
KQQIESFSYETILSNIM

SEQ ID NO: 2584033 - protein, 22 aa, Entamoeba histolytica
KQQYKILLIMLLFLETVIQTNP

SEQ ID NO: 2584034 - protein, 20 aa, Entamoeba histolytica
KQRINEVVPVSFDWSILSTR

SEQ ID NO: 2584035 - protein, 23 aa, Entamoeba histolytica
KQRLSLSSLIAWVSLSILQAVII

SEQ ID NO: 2584036 - protein, 18 aa, Entamoeba histolytica
KQSIFCVDEPFKSALISS

SEQ ID NO: 2584037 - protein, 20 aa, Entamoeba histolytica
KQTINIFVLKTFYPETEVDN

SEQ ID NO: 2584038 - protein, 29 aa, Entamoeba histolytica
KQTPFGPKWKKGDVVSICVDFDQRRIKIL

SEQ ID NO: 2584039 - protein, 24 aa, Entamoeba histolytica
KQVCGKLIGWELPYHLFPPSLHPC

SEQ ID NO: 2584040 - protein, 18 aa, Entamoeba histolytica
KQYFSRQHMDSLWMIIIA

SEQ ID NO: 2584041 - protein, 19 aa, Entamoeba histolytica
KQYFSVLSIHNENRIMFHF

SEQ ID NO: 2584042 - protein, 20 aa, Entamoeba histolytica
KQYLGIGFVDFNELVNGKIK

SEQ ID NO: 2584043 - protein, 32 aa, Entamoeba histolytica
KRADCSRIPLIIRKVLYLIIGFITYIILYCIL

SEQ ID NO: 2584044 - protein, 17 aa, Entamoeba histolytica
KRCVITHCIVWSICFFT

SEQ ID NO: 2584045 - protein, 17 aa, Entamoeba histolytica
KRDLLVYSFGFFTKRIY

SEQ ID NO: 2584046 - protein, 24 aa, Entamoeba histolytica
KREELRLSTLQVLLKGILSAEVNG

SEQ ID NO: 2584047 - protein, 20 aa, Entamoeba histolytica
KRELGVISLLAMMYVSCIGG

SEQ ID NO: 2584048 - protein, 26 aa, Entamoeba histolytica
KRELMKYKVLMKFLLFTLLTFLVSAD

SEQ ID NO: 2584049 - protein, 21 aa, Entamoeba histolytica
KRELRFLTYFTQIINADIPGC

SEQ ID NO: 2584050 - protein, 20 aa, Entamoeba histolytica
KRESDQIFSIPIVHQKHLST

SEQ ID NO: 2584051 - protein, 25 aa, Entamoeba histolytica
KREVPWVVFSCVTQVLKHLQSIMLI

SEQ ID NO: 2584052 - protein, 19 aa, Entamoeba histolytica
KRFEKKVPIHIAVNEKCPT

SEQ ID NO: 2584053 - protein, 21 aa, Entamoeba histolytica
KRFTYCVLDEGHIIKNPKTKL

SEQ ID NO: 2584054 - protein, 18 aa, Entamoeba histolytica
KRGNSINARKEREFKNQL

SEQ ID NO: 2584055 - protein, 20 aa, Entamoeba histolytica
KRHPNVRYKPLISYPTALMV

SEQ ID NO: 2584056 - protein, 23 aa, Entamoeba histolytica
KRHSRRGFYISVHRNNIFQESYS

SEQ ID NO: 2584057 - protein, 19 aa, Entamoeba histolytica
KRIFPRANIQIVRGTFQQA

SEQ ID NO: 2584058 - protein, 19 aa, Entamoeba histolytica
KRIGELVETYYILIMKLMT

SEQ ID NO: 2584059 - protein, 23 aa, Entamoeba histolytica
KRIISRLNPFGSIEAIESDVIGS

SEQ ID NO: 2584060 - protein, 19 aa, Entamoeba histolytica
KRIKALLFNTHFILPICPS

SEQ ID NO: 2584061 - protein, 21 aa, Entamoeba histolytica
KRIYIPTFLIYPIQRLPRYLL

SEQ ID NO: 2584062 - protein, 26 aa, Entamoeba histolytica
KRIYNLYKTHLKSEEPEKVTSTVPQP

SEQ ID NO: 2584063 - protein, 20 aa, Entamoeba histolytica
KRKEAIPADILLLSSSEPNG

SEQ ID NO: 2584064 - protein, 22 aa, Entamoeba histolytica
KRKETLVSMKMKIKFMIDAAKG

SEQ ID NO: 2584065 - protein, 18 aa, Entamoeba histolytica
KRKIDIIITFIVFVLSKL

SEQ ID NO: 2584066 - protein, 31 aa, Entamoeba histolytica
KRKILLIRYGFCCLIGAITLFFVGMFIVIGI

SEQ ID NO: 2584067 - protein, 20 aa, Entamoeba histolytica
KRKLANLGKWLVLLAGILCF

SEQ ID NO: 2584068 - protein, 26 aa, Entamoeba histolytica
KRKRRKIRIGFNGEIEYGDWKIIKVM

SEQ ID NO: 2584069 - protein, 26 aa, Entamoeba histolytica
KRKRRKIRIGFNGEIKYGDWKLIKVM

SEQ ID NO: 2584070 - protein, 23 aa, Entamoeba histolytica
KRKTRGLENISFRSLDDILENEL

SEQ ID NO: 2584071 - protein, 24 aa, Entamoeba histolytica
KRLDSAGVAIQWDKELSPIILQSI

SEQ ID NO: 2584072 - protein, 25 aa, Entamoeba histolytica
KRLEIPNGCLFSEAIERCWQQDPRD

SEQ ID NO: 2584073 - protein, 17 aa, Entamoeba histolytica
KRLILSINCLMKVGSII

SEQ ID NO: 2584074 - protein, 29 aa, Entamoeba histolytica
KRLKERRTLWYVWALWWFIYAVVCVATFT

SEQ ID NO: 2584075 - protein, 19 aa, Entamoeba histolytica
KRLLGSSIRSGLRASKEIV

SEQ ID NO: 2584076 - protein, 20 aa, Entamoeba histolytica
KRLRNPYIIGYIGSVTYIPE

SEQ ID NO: 2584077 - protein, 24 aa, Entamoeba histolytica
KRMLRFLHKSSIYNIQFNGCKGIH

SEQ ID NO: 2584078 - protein, 20 aa, Entamoeba histolytica
KRMSVLVERDGLYILYCKGA

SEQ ID NO: 2584079 - protein, 17 aa, Entamoeba histolytica
KRMTWDQFKTHPFVVDC

SEQ ID NO: 2584080 - protein, 17 aa, Entamoeba histolytica
KRNEFLPELLRLTEIFT

SEQ ID NO: 2584081 - protein, 25 aa, Entamoeba histolytica
KRNEFLPELLRRTEINGTNENIEIP

SEQ ID NO: 2584082 - protein, 23 aa, Entamoeba histolytica
KRNVKRLIKFIHLISFVNKVIDK

SEQ ID NO: 2584083 - protein, 27 aa, Entamoeba histolytica
KRPKKVKVKSLLPFLHIQKILAPNGEI

SEQ ID NO: 2584084 - protein, 18 aa, Entamoeba histolytica
KRQFLVHLFQLVLTGAVM

SEQ ID NO: 2584085 - protein, 19 aa, Entamoeba histolytica
KRQSFIGAEVEEIFSESKS

SEQ ID NO: 2584086 - protein, 19 aa, Entamoeba histolytica
KRSDEWLHSIGINPQMMKA

SEQ ID NO: 2584087 - protein, 17 aa, Entamoeba histolytica
KRVDEMIADGKTPRVDL

SEQ ID NO: 2584088 - protein, 21 aa, Entamoeba histolytica
KRVEEAIGIIEVIRKYLTNNK

SEQ ID NO: 2584089 - protein, 19 aa, Entamoeba histolytica
KRVGEDIGIEMLEEGQENS

SEQ ID NO: 2584090 - protein, 17 aa, Entamoeba histolytica
KRVKGEFTIIRNEYALL

SEQ ID NO: 2584091 - protein, 19 aa, Entamoeba histolytica
KRVLKGEGDIENIIEIMEE

SEQ ID NO: 2584092 - protein, 20 aa, Entamoeba histolytica
KRVLSICILQVLTIIFVLLL

SEQ ID NO: 2584093 - protein, 22 aa, Entamoeba histolytica
KRVYCSICNKDSLLGAQLKYMK

SEQ ID NO: 2584094 - protein, 25 aa, Entamoeba histolytica
KRYCIKYYSDSKCFKEEEQQDNDAV

SEQ ID NO: 2584095 - protein, 25 aa, Entamoeba histolytica
KRYIKCPKSKFIENDCSCFIKSTVS

SEQ ID NO: 2584096 - protein, 19 aa, Entamoeba histolytica
KRYLESYVYKDILKNPPNQ

SEQ ID NO: 2584097 - protein, 17 aa, Entamoeba histolytica
KRYRVIAIFDYILYILA

SEQ ID NO: 2584098 - protein, 17 aa, Entamoeba histolytica
KSAGSVVKILTSILTTV

SEQ ID NO: 2584099 - protein, 18 aa, Entamoeba histolytica
KSAITYGLLGEIPLTKEY

SEQ ID NO: 2584100 - protein, 18 aa, Entamoeba histolytica
KSCFSLLLVFVKDYIGKL

SEQ ID NO: 2584101 - protein, 20 aa, Entamoeba histolytica
KSCKSDFLLKFKADYHFYYF

SEQ ID NO: 2584102 - protein, 18 aa, Entamoeba histolytica
KSDEHLILLLTNYPTVVA

SEQ ID NO: 2584103 - protein, 21 aa, Entamoeba histolytica
KSDGIGKGFALWLTTKPIVSG

SEQ ID NO: 2584104 - protein, 17 aa, Entamoeba histolytica
KSDIGLYLILIIINNLV

SEQ ID NO: 2584105 - protein, 24 aa, Entamoeba histolytica
KSDNFEVHFNFSIFSSKPIMGNGV

SEQ ID NO: 2584106 - protein, 25 aa, Entamoeba histolytica
KSDSRWKVLVGISIFTYLMELLFCS

SEQ ID NO: 2584107 - protein, 29 aa, Entamoeba histolytica
KSDVFSFAICCTEIWLGRDPYDPEKFPDS

SEQ ID NO: 2584108 - protein, 29 aa, Entamoeba histolytica
KSDVFSFAICMLEIWLGKEPYDPMKFPDS

SEQ ID NO: 2584109 - protein, 20 aa, Entamoeba histolytica
KSDVFSFAICMLEVYLRKSP

SEQ ID NO: 2584110 - protein, 18 aa, Entamoeba histolytica
KSDVYSFGMVLWEMSTKK

SEQ ID NO: 2584111 - protein, 20 aa, Entamoeba histolytica
KSECKYCATLNIYDKEEGIS

SEQ ID NO: 2584112 - protein, 20 aa, Entamoeba histolytica
KSECQYYKLFGGYSGISFDI

SEQ ID NO: 2584113 - protein, 22 aa, Entamoeba histolytica
KSEELKKRITVLNKIAEMIGVL

SEQ ID NO: 2584114 - protein, 17 aa, Entamoeba histolytica
KSEIYGINISDDCYVYS

SEQ ID NO: 2584115 - protein, 18 aa, Entamoeba histolytica
KSELRNVISPEINQKNVK

SEQ ID NO: 2584116 - protein, 21 aa, Entamoeba histolytica
KSESALIIAHFNSGFPLPTHL

SEQ ID NO: 2584117 - protein, 25 aa, Entamoeba histolytica
KSFELRLNYHKSILQLASDRRNDQP

SEQ ID NO: 2584118 - protein, 20 aa, Entamoeba histolytica
KSFFIRSLSLVNCFLQTRET

SEQ ID NO: 2584119 - protein, 20 aa, Entamoeba histolytica
KSGIATKVYVPLSYEDEKNT

SEQ ID NO: 2584120 - protein, 23 aa, Entamoeba histolytica
KSHLKCVLMVYKIAESDQQTARD

SEQ ID NO: 2584121 - protein, 18 aa, Entamoeba histolytica
KSHYRIIVYYYYAKTNNG

SEQ ID NO: 2584122 - protein, 23 aa, Entamoeba histolytica
KSIDCPGYLVCYSTCSFVSTASS

SEQ ID NO: 2584123 - protein, 22 aa, Entamoeba histolytica
KSIDGTSCVFVILSILITFLLI

SEQ ID NO: 2584124 - protein, 19 aa, Entamoeba histolytica
KSIGLPLLFLEPTSNELLI

SEQ ID NO: 2584125 - protein, 25 aa, Entamoeba histolytica
KSIKKCTCIPLDLPPMPLYPDQMKE

SEQ ID NO: 2584126 - protein, 27 aa, Entamoeba histolytica
KSILNAYKFDGRSCVDLKDKWRNIENS

SEQ ID NO: 2584127 - protein, 18 aa, Entamoeba histolytica
KSINVIVIHSFYYDVSNK

SEQ ID NO: 2584128 - protein, 21 aa, Entamoeba histolytica
KSIPTPFLVKWGWIITISFVV

SEQ ID NO: 2584129 - protein, 23 aa, Entamoeba histolytica
KSIRDLLQLILIFWILLNEFFSF

SEQ ID NO: 2584130 - protein, 17 aa, Entamoeba histolytica
KSIYEIVGILIVGILII

SEQ ID NO: 2584131 - protein, 20 aa, Entamoeba histolytica
KSIYLTWKRRLKMLHDAASG

SEQ ID NO: 2584132 - protein, 27 aa, Entamoeba histolytica
KSIYNILRFWGMYSLYPSFIPSSFECV

SEQ ID NO: 2584133 - protein, 28 aa, Entamoeba histolytica
KSKFIQWKIRMMHIFGPISFLIFSCLFS

SEQ ID NO: 2584134 - protein, 20 aa, Entamoeba histolytica
KSKHIPVIVCCETYKMTDEI

SEQ ID NO: 2584135 - protein, 24 aa, Entamoeba histolytica
KSKKKIDGLFGFDFEYSTLLLIIL

SEQ ID NO: 2584136 - protein, 19 aa, Entamoeba histolytica
KSKLLRLAKIINEDLYEEV

SEQ ID NO: 2584137 - protein, 19 aa, Entamoeba histolytica
KSKTLFNLISFSLIILLII

SEQ ID NO: 2584138 - protein, 23 aa, Entamoeba histolytica
KSKYIEILGCLISSNSLMVKLEV

SEQ ID NO: 2584139 - protein, 17 aa, Entamoeba histolytica
KSLEVFYPILPGRPFDK

SEQ ID NO: 2584140 - protein, 19 aa, Entamoeba histolytica
KSLHIVWMLFCFFWAVWNG

SEQ ID NO: 2584141 - protein, 17 aa, Entamoeba histolytica
KSLKIAASMFQETEEVG

SEQ ID NO: 2584142 - protein, 19 aa, Entamoeba histolytica
KSLLKDEINDWGRVPLESG

SEQ ID NO: 2584143 - protein, 19 aa, Entamoeba histolytica
KSLPHRRGKKIVWVLVTIL

SEQ ID NO: 2584144 - protein, 19 aa, Entamoeba histolytica
KSLPINWERRLRMLKDAAS

SEQ ID NO: 2584145 - protein, 17 aa, Entamoeba histolytica
KSLYGKIHFLKHYIHIH

SEQ ID NO: 2584146 - protein, 19 aa, Entamoeba histolytica
KSMGPRLIIQNVTQFGLIV

SEQ ID NO: 2584147 - protein, 26 aa, Entamoeba histolytica
KSMNGSSKWWYSVVIYEHTLGIKSVE

SEQ ID NO: 2584148 - protein, 25 aa, Entamoeba histolytica
KSNELPMTMVLRFAKNINNALDVLH

SEQ ID NO: 2584149 - protein, 21 aa, Entamoeba histolytica
KSNELWYYIKVDNTFTSIPIN

SEQ ID NO: 2584150 - protein, 17 aa, Entamoeba histolytica
KSNIVIKKVELILISRR

SEQ ID NO: 2584151 - protein, 17 aa, Entamoeba histolytica
KSPHGRFTYALESFNFG

SEQ ID NO: 2584152 - protein, 17 aa, Entamoeba histolytica
KSQDFVIQNRFYSYNFK

SEQ ID NO: 2584153 - protein, 20 aa, Entamoeba histolytica
KSQIAALMFPLISYAIEEKS

SEQ ID NO: 2584154 - protein, 24 aa, Entamoeba histolytica
KSQRGRISICYSLEQLAHQTWLIE

SEQ ID NO: 2584155 - protein, 20 aa, Entamoeba histolytica
KSQRRLGVSPVKETKIVITN

SEQ ID NO: 2584156 - protein, 19 aa, Entamoeba histolytica
KSRSEAVTQPTAKDQTVQS

SEQ ID NO: 2584157 - protein, 22 aa, Entamoeba histolytica
KSRSSGGCGIYSRYSFSVEADK

SEQ ID NO: 2584158 - protein, 29 aa, Entamoeba histolytica
KSSFYAALLERFYTFFISYFFQLTTKTDI

SEQ ID NO: 2584159 - protein, 17 aa, Entamoeba histolytica
KSSKFLFYSLFCLILCI

SEQ ID NO: 2584160 - protein, 26 aa, Entamoeba histolytica
KSSKKLKIILLVSVIIVLALILIIGI

SEQ ID NO: 2584161 - protein, 21 aa, Entamoeba histolytica
KSSNNELYFYNSLKMKMSILI

SEQ ID NO: 2584162 - protein, 17 aa, Entamoeba histolytica
KSSQLLPGDCILLKQGQ

SEQ ID NO: 2584163 - protein, 38 aa, Entamoeba histolytica
KSSTLYLPPRYPLLGGWKTSFEVIYNYPLDVSVQQIKE

SEQ ID NO: 2584164 - protein, 29 aa, Entamoeba histolytica
KSSTLYLPPRYPLLGGWKTSFEVNYNYPL

SEQ ID NO: 2584165 - protein, 17 aa, Entamoeba histolytica
KSSVGVLNFIKRYTDAI

SEQ ID NO: 2584166 - protein, 18 aa, Entamoeba histolytica
KSTFKFNYMLAGIIITVL

SEQ ID NO: 2584167 - protein, 19 aa, Entamoeba histolytica
KSTFKFNYMLAGIIVMIVS

SEQ ID NO: 2584168 - protein, 25 aa, Entamoeba histolytica
KSTKLKKILIDVCASIYNTNPTYIR

SEQ ID NO: 2584169 - protein, 17 aa, Entamoeba histolytica
KSTLLAIARRDDNNQYY

SEQ ID NO: 2584170 - protein, 18 aa, Entamoeba histolytica
KSTLNLKQYRFVIFTEEV

SEQ ID NO: 2584171 - protein, 18 aa, Entamoeba histolytica
KSTMMAGLFRIEEPAGGS

SEQ ID NO: 2584172 - protein, 19 aa, Entamoeba histolytica
KSTMMAGLFRIEEPAGGSI

SEQ ID NO: 2584173 - protein, 21 aa, Entamoeba histolytica
KSVEASKKWYGNGINEGIRRN

SEQ ID NO: 2584174 - protein, 26 aa, Entamoeba histolytica
KSVILLGELLYLAGLLLPQRHLSLQK

SEQ ID NO: 2584175 - protein, 18 aa, Entamoeba histolytica
KSWYSYILSLLVGVVYTF

SEQ ID NO: 2584176 - protein, 18 aa, Entamoeba histolytica
KSYALPLVISEKVSIERR

SEQ ID NO: 2584177 - protein, 34 aa, Entamoeba histolytica
KSYFDLSFVFSWQFWWKLVVIILLTSIPFIAKFF

SEQ ID NO: 2584178 - protein, 29 aa, Entamoeba histolytica
KSYFKKGFSKLFLPLGFSGILSIIFIVMY

SEQ ID NO: 2584179 - protein, 18 aa, Entamoeba histolytica
KSYLGLIIVITFLILITV

SEQ ID NO: 2584180 - protein, 27 aa, Entamoeba histolytica
KTCENIHPVLSVYALFFSKCYPNLPSN

SEQ ID NO: 2584181 - protein, 22 aa, Entamoeba histolytica
KTDPGLWYKFVHTKSITDEKYT

SEQ ID NO: 2584182 - protein, 18 aa, Entamoeba histolytica
KTELPVRYVRELQKVLLS

SEQ ID NO: 2584183 - protein, 23 aa, Entamoeba histolytica
KTEMKSEEFVLGEWTFEYYMGDY

SEQ ID NO: 2584184 - protein, 18 aa, Entamoeba histolytica
KTEVYWNEIIIRNGKIGG

SEQ ID NO: 2584185 - protein, 17 aa, Entamoeba histolytica
KTEYSIEAKAKIVEIRS

SEQ ID NO: 2584186 - protein, 24 aa, Entamoeba histolytica
KTFFTSPIICCFIFMILCGLLNGL

SEQ ID NO: 2584187 - protein, 18 aa, Entamoeba histolytica
KTFYYSSIVVHLFLYGVI

SEQ ID NO: 2584188 - protein, 18 aa, Entamoeba histolytica
KTGCKNLQLIGWIMVCVI

SEQ ID NO: 2584189 - protein, 27 aa, Entamoeba histolytica
KTGIPPEVWRYYLLINRPEQSDTVFLW

SEQ ID NO: 2584190 - protein, 25 aa, Entamoeba histolytica
KTGKLKKMIIEWSINIKVFDKKNDK

SEQ ID NO: 2584191 - protein, 21 aa, Entamoeba histolytica
KTGMWRLNQIIAPWEDDKLSS

SEQ ID NO: 2584192 - protein, 25 aa, Entamoeba histolytica
KTGRVYIECFGKWIMYKLSSDSYVN

SEQ ID NO: 2584193 - protein, 22 aa, Entamoeba histolytica
KTIKRISIKHVIKEQKNQVSHF

SEQ ID NO: 2584194 - protein, 17 aa, Entamoeba histolytica
KTILKLVNKYSIEKCCN

SEQ ID NO: 2584195 - protein, 18 aa, Entamoeba histolytica
KTIPEFTFYISDMNHACS

SEQ ID NO: 2584196 - protein, 23 aa, Entamoeba histolytica
KTKEIIKDILIQGSESTVLIESS

SEQ ID NO: 2584197 - protein, 17 aa, Entamoeba histolytica
KTKLGFFDVTPLGRIVN

SEQ ID NO: 2584198 - protein, 26 aa, Entamoeba histolytica
KTKRKLRLFGVLTMISMMLFFMMLAL

SEQ ID NO: 2584199 - protein, 25 aa, Entamoeba histolytica
KTKSVIWMVSWKGVKFVLKDQMIDN

SEQ ID NO: 2584200 - protein, 18 aa, Entamoeba histolytica
KTKYNCLSHIWDMHIRTL

SEQ ID NO: 2584201 - protein, 19 aa, Entamoeba histolytica
KTLHAKLKLTTSIITSVNE

SEQ ID NO: 2584202 - protein, 21 aa, Entamoeba histolytica
KTLHKTICLIALINALKQTDI

SEQ ID NO: 2584203 - protein, 29 aa, Entamoeba histolytica
KTLKGMLRRAICNKIFLIILAIVFLIIIG

SEQ ID NO: 2584204 - protein, 24 aa, Entamoeba histolytica
KTLLKFVDVHSCVMRRVIGIATEK

SEQ ID NO: 2584205 - protein, 24 aa, Entamoeba histolytica
KTLNQFCILSIQYLFYQKSKQENK

SEQ ID NO: 2584206 - protein, 17 aa, Entamoeba histolytica
KTLRAQNIIEHTDEWVL

SEQ ID NO: 2584207 - protein, 20 aa, Entamoeba histolytica
KTLTCIRQTIEILKKSDEHF

SEQ ID NO: 2584208 - protein, 19 aa, Entamoeba histolytica
KTLVCSECKEGTTMDSRGM

SEQ ID NO: 2584209 - protein, 17 aa, Entamoeba histolytica
KTLWEFEDYQKKMIEIF

SEQ ID NO: 2584210 - protein, 18 aa, Entamoeba histolytica
KTMLFFSFYSKLNIPSIP

SEQ ID NO: 2584211 - protein, 21 aa, Entamoeba histolytica
KTMSFFSRWLDTIGKKKFPME

SEQ ID NO: 2584212 - protein, 19 aa, Entamoeba histolytica
KTMWLPDIFLYCNIDTQII

SEQ ID NO: 2584213 - protein, 20 aa, Entamoeba histolytica
KTNKFKGIDLTSATNVNTIK

SEQ ID NO: 2584214 - protein, 24 aa, Entamoeba histolytica
KTQEELRTSYGFTEVEKLGVYNQE

SEQ ID NO: 2584215 - protein, 18 aa, Entamoeba histolytica
KTQFKWMRREIGIGNNGE

SEQ ID NO: 2584216 - protein, 22 aa, Entamoeba histolytica
KTQGRQTYPFAFTETIAPLIGV

SEQ ID NO: 2584217 - protein, 24 aa, Entamoeba histolytica
KTRESSIFFSFHDETIFRLGNTDN

SEQ ID NO: 2584218 - protein, 22 aa, Entamoeba histolytica
KTRIAITSSIGFFIVGLIFQLL

SEQ ID NO: 2584219 - protein, 25 aa, Entamoeba histolytica
KTSCNNAESWICKKGIQWYVCKGNT

SEQ ID NO: 2584220 - protein, 19 aa, Entamoeba histolytica
KTSEIIQFISSLPFVKIIR

SEQ ID NO: 2584221 - protein, 18 aa, Entamoeba histolytica
KTSFYVFITGATENDVGV

SEQ ID NO: 2584222 - protein, 26 aa, Entamoeba histolytica
KTSGLLKIYGLEFDCCSLHFKSVPIG

SEQ ID NO: 2584223 - protein, 18 aa, Entamoeba histolytica
KTSILLLAVIWLYNIIVQ

SEQ ID NO: 2584224 - protein, 19 aa, Entamoeba histolytica
KTSLFSLSVCSVLMVNLWS

SEQ ID NO: 2584225 - protein, 17 aa, Entamoeba histolytica
KTSLGCSQCEKGYYVDN

SEQ ID NO: 2584226 - protein, 19 aa, Entamoeba histolytica
KTSLKIAFEAYVYHDILKN

SEQ ID NO: 2584227 - protein, 20 aa, Entamoeba histolytica
KTSNCLPDIYNYILDTYLFV

SEQ ID NO: 2584228 - protein, 26 aa, Entamoeba histolytica
KTSSKYYAPEKMKLVCEQTFVFDSSN

SEQ ID NO: 2584229 - protein, 18 aa, Entamoeba histolytica
KTTFFVFITGSDVNDVGI

SEQ ID NO: 2584230 - protein, 25 aa, Entamoeba histolytica
KTTVVKRKKFEFILSKPKVQEMKHI

SEQ ID NO: 2584231 - protein, 24 aa, Entamoeba histolytica
KTTWSQNSVKDFILFGLNSIPHKK

SEQ ID NO: 2584232 - protein, 27 aa, Entamoeba histolytica
KTVIRGDVFFQFGFEEFNKTLAFGNVI

SEQ ID NO: 2584233 - protein, 21 aa, Entamoeba histolytica
KTVISAYLWDGLYISLDKVTM

SEQ ID NO: 2584234 - protein, 18 aa, Entamoeba histolytica
KTVISICDVIISFYFDGQ

SEQ ID NO: 2584235 - protein, 27 aa, Entamoeba histolytica
KTVWKYFSKEWCFYHNTTIKSNTSEYC

SEQ ID NO: 2584236 - protein, 17 aa, Entamoeba histolytica
KTWNWILVIGHIISIIF

SEQ ID NO: 2584237 - protein, 18 aa, Entamoeba histolytica
KTYEGSLIKESRSESPLF

SEQ ID NO: 2584238 - protein, 19 aa, Entamoeba histolytica
KTYRRCIKITNDGKEIESE

SEQ ID NO: 2584239 - protein, 18 aa, Entamoeba histolytica
KVAMNWGRALLSGIGCNW

SEQ ID NO: 2584240 - protein, 19 aa, Entamoeba histolytica
KVCKDTCSLNLKNSIETLK

SEQ ID NO: 2584241 - protein, 27 aa, Entamoeba histolytica
KVDIYNLGCLFFFIARKEHPFGPLIDR

SEQ ID NO: 2584242 - protein, 26 aa, Entamoeba histolytica
KVFTSLSCFILKLPECTSAYSDEILL

SEQ ID NO: 2584243 - protein, 17 aa, Entamoeba histolytica
KVGPSIHICSCIAAQLA

SEQ ID NO: 2584244 - protein, 18 aa, Entamoeba histolytica
KVGYLFQHVVPLVFVLTV

SEQ ID NO: 2584245 - protein, 17 aa, Entamoeba histolytica
KVIIKLKEKLRMDISDE

SEQ ID NO: 2584246 - protein, 19 aa, Entamoeba histolytica
KVIQKPTLRKSVLTLCVII

SEQ ID NO: 2584247 - protein, 17 aa, Entamoeba histolytica
KVKGMLISNTLFRMGGA

SEQ ID NO: 2584248 - protein, 22 aa, Entamoeba histolytica
KVKVEGKVLFLIDGLTIEPIPL

SEQ ID NO: 2584249 - protein, 26 aa, Entamoeba histolytica
KVLDMFGCSLPVLARGYQCLKDELVV

SEQ ID NO: 2584250 - protein, 20 aa, Entamoeba histolytica
KVLLNSGCSPILIYRRNNGG

SEQ ID NO: 2584251 - protein, 22 aa, Entamoeba histolytica
KVNGCALKLIKSALGKREVTDE

SEQ ID NO: 2584252 - protein, 18 aa, Entamoeba histolytica
KVQECYIIASKLPVSLCN

SEQ ID NO: 2584253 - protein, 17 aa, Entamoeba histolytica
KVQMAILMFYKNYISSY

SEQ ID NO: 2584254 - protein, 24 aa, Entamoeba histolytica
KVRLRASDKVSILIVGVLLVALVI

SEQ ID NO: 2584255 - protein, 30 aa, Entamoeba histolytica
KVSCFKAAVFKMDIGQYFGISASNGDLSDS

SEQ ID NO: 2584256 - protein, 18 aa, Entamoeba histolytica
KVSCFSFKLEENVYSLKQ

SEQ ID NO: 2584257 - protein, 25 aa, Entamoeba histolytica
KVSFSSKCLAAFPPLLLAMIKADLS

SEQ ID NO: 2584258 - protein, 18 aa, Entamoeba histolytica
KVSMRYKDAIKLMLNDKY

SEQ ID NO: 2584259 - protein, 19 aa, Entamoeba histolytica
KVSVIKLFKCSDWTDMILI

SEQ ID NO: 2584260 - protein, 17 aa, Entamoeba histolytica
KVSWTKQQVELIKNEPG

SEQ ID NO: 2584261 - protein, 25 aa, Entamoeba histolytica
KVTLKIKQIRAFKKHIRKLTARKEF

SEQ ID NO: 2584262 - protein, 21 aa, Entamoeba histolytica
KVVGLKACRQRLWYQKGEEKV

SEQ ID NO: 2584263 - protein, 20 aa, Entamoeba histolytica
KVVNNYKYAFPLFIQTNVLL

SEQ ID NO: 2584264 - protein, 24 aa, Entamoeba histolytica
KVVRIKFGSGWYVRAFTTLAIGIK

SEQ ID NO: 2584265 - protein, 17 aa, Entamoeba histolytica
KVYLKVNIRLVSTIYPE

SEQ ID NO: 2584266 - protein, 19 aa, Entamoeba histolytica
KVYSLCGGLVISDLPEDQV

SEQ ID NO: 2584267 - protein, 20 aa, Entamoeba histolytica
KWEALRMVIWRVSRGFVVTR

SEQ ID NO: 2584268 - protein, 27 aa, Entamoeba histolytica
KWISWGLRIIHWVTIALSFVVLILFIV

SEQ ID NO: 2584269 - protein, 19 aa, Entamoeba histolytica
KWKESLVSYTSYLTPTKLL

SEQ ID NO: 2584270 - protein, 20 aa, Entamoeba histolytica
KWKKMIEIWKETVPHKLSER

SEQ ID NO: 2584271 - protein, 22 aa, Entamoeba histolytica
KWTKKCVASYCDDGFKFDYENQ

SEQ ID NO: 2584272 - protein, 17 aa, Entamoeba histolytica
KWTTLSTQRIVFYTNNS

SEQ ID NO: 2584273 - protein, 24 aa, Entamoeba histolytica
KWTYKRTLFLIAMAVFTLFLILLT

SEQ ID NO: 2584274 - protein, 20 aa, Entamoeba histolytica
KWVKGELSNYEFLYEVNRYA

SEQ ID NO: 2584275 - protein, 26 aa, Entamoeba histolytica
KWVMISEFFLVLSIVFLVIVVIVIIV

SEQ ID NO: 2584276 - protein, 17 aa, Entamoeba histolytica
KWYCVLFVLCFIAFSLV

SEQ ID NO: 2584277 - protein, 28 aa, Entamoeba histolytica
KWYFPSIKNHIYISIGFTFVALFFQSFR

SEQ ID NO: 2584278 - protein, 17 aa, Entamoeba histolytica
KWYRLKVNKGEERIITT

SEQ ID NO: 2584279 - protein, 19 aa, Entamoeba histolytica
KWYVTFFVFLGWGMSFAIP

SEQ ID NO: 2584280 - protein, 25 aa, Entamoeba histolytica
KYCAKKNLWYVWVIIVVVIILIISF

SEQ ID NO: 2584281 - protein, 18 aa, Entamoeba histolytica
KYCDINAFSCNKTQCSGT

SEQ ID NO: 2584282 - protein, 22 aa, Entamoeba histolytica
KYCNSQECFQCEAGYTLVNNGA

SEQ ID NO: 2584283 - protein, 20 aa, Entamoeba histolytica
KYCNSTKCFVCDKDAEGKQL

SEQ ID NO: 2584284 - protein, 26 aa, Entamoeba histolytica
KYCVNNKCVECFSGYILNSLGQCINK

SEQ ID NO: 2584285 - protein, 22 aa, Entamoeba histolytica
KYDDFLYFIKVLYGVSPKITVT

SEQ ID NO: 2584286 - protein, 24 aa, Entamoeba histolytica
KYECSLCLPQYILIEAECIYFKNL

SEQ ID NO: 2584287 - protein, 28 aa, Entamoeba histolytica
KYEINKLICLSGECSLVVAADTVITSSL

SEQ ID NO: 2584288 - protein, 25 aa, Entamoeba histolytica
KYELTQVCRIYVALVPKGYTITECP

SEQ ID NO: 2584289 - protein, 21 aa, Entamoeba histolytica
KYEVHGYPTLKSFPKGENKKP

SEQ ID NO: 2584290 - protein, 19 aa, Entamoeba histolytica
KYFIIPFILSIGIILIIHF

SEQ ID NO: 2584291 - protein, 17 aa, Entamoeba histolytica
KYFIKYVGNCLRMEEDM

SEQ ID NO: 2584292 - protein, 18 aa, Entamoeba histolytica
KYFINLFFLIVAILSCIP

SEQ ID NO: 2584293 - protein, 18 aa, Entamoeba histolytica
KYGEWLKQVLEYFLSLKS

SEQ ID NO: 2584294 - protein, 18 aa, Entamoeba histolytica
KYGEWLKQVLEYFWSLKS

SEQ ID NO: 2584295 - protein, 25 aa, Entamoeba histolytica
KYGGEKDVDCYKQRGICYQMIRNYE

SEQ ID NO: 2584296 - protein, 25 aa, Entamoeba histolytica
KYGHCSACSATACIICEDTNLVLAA

SEQ ID NO: 2584297 - protein, 24 aa, Entamoeba histolytica
KYGIRSEPQLAFIKPGNAVEFNLF

SEQ ID NO: 2584298 - protein, 18 aa, Entamoeba histolytica
KYGTYGCDSYCHCDDSDY

SEQ ID NO: 2584299 - protein, 23 aa, Entamoeba histolytica
KYGVEFSENIFIVCSFTKRRNSE

SEQ ID NO: 2584300 - protein, 19 aa, Entamoeba histolytica
KYHCGQTFLEKAYKVQRNE

SEQ ID NO: 2584301 - protein, 19 aa, Entamoeba histolytica
KYHFKGMNKIIIYGLIGSL

SEQ ID NO: 2584302 - protein, 21 aa, Entamoeba histolytica
KYIELAKCIIFMIAGDEVKKT

SEQ ID NO: 2584303 - protein, 20 aa, Entamoeba histolytica
KYIESAKCIIFMIAGDEVKK

SEQ ID NO: 2584304 - protein, 19 aa, Entamoeba histolytica
KYIFRGECIRCLSQNLLLS

SEQ ID NO: 2584305 - protein, 18 aa, Entamoeba histolytica
KYIGLKCPHAQFTHSKAS

SEQ ID NO: 2584306 - protein, 26 aa, Entamoeba histolytica
KYIPFLDAPCGFVKTVGHSGGEDFSK

SEQ ID NO: 2584307 - protein, 18 aa, Entamoeba histolytica
KYIPFLNSPCGFVKTVGH

SEQ ID NO: 2584308 - protein, 17 aa, Entamoeba histolytica
KYIQSVGGLPSIIIYLC

SEQ ID NO: 2584309 - protein, 24 aa, Entamoeba histolytica
KYIQVFNFISLIFFPITFVVNTFG

SEQ ID NO: 2584310 - protein, 25 aa, Entamoeba histolytica
KYIRMNPRFKREVIGVLIEYEGVTA

SEQ ID NO: 2584311 - protein, 21 aa, Entamoeba histolytica
KYKCDIIKGYYCKYEEDDNVM

SEQ ID NO: 2584312 - protein, 22 aa, Entamoeba histolytica
KYKFRIVECDTVLKKIKAYFHI

SEQ ID NO: 2584313 - protein, 23 aa, Entamoeba histolytica
KYKGTFPSAHWVLYAILELIISN

SEQ ID NO: 2584314 - protein, 23 aa, Entamoeba histolytica
KYKLLENFGGLLINTQKLIFDQF

SEQ ID NO: 2584315 - protein, 18 aa, Entamoeba histolytica
KYKPVICKIKQPTQNCNE

SEQ ID NO: 2584316 - protein, 19 aa, Entamoeba histolytica
KYLLVGLVVSVLFLVAGIY

SEQ ID NO: 2584317 - protein, 21 aa, Entamoeba histolytica
KYLNTWIDLIFGCLQQSVNHY

SEQ ID NO: 2584318 - protein, 24 aa, Entamoeba histolytica
KYLRHPSYFGWFYWSIFTQFVLIN

SEQ ID NO: 2584319 - protein, 23 aa, Entamoeba histolytica
KYNCIPCSEGTYSILSSSICLVC

SEQ ID NO: 2584320 - protein, 21 aa, Entamoeba histolytica
KYNELHNILSIMRTKQLLVKD

SEQ ID NO: 2584321 - protein, 19 aa, Entamoeba histolytica
KYNGVFQLGLDMLKRLEKH

SEQ ID NO: 2584322 - protein, 25 aa, Entamoeba histolytica
KYNWFRPASFFPLGYMYEILDKYNY

SEQ ID NO: 2584323 - protein, 27 aa, Entamoeba histolytica
KYPGKRECKRCEIEYGKYVNENRTMCF

SEQ ID NO: 2584324 - protein, 27 aa, Entamoeba histolytica
KYPNVICKYIEWGRIEIIKEILENQKL

SEQ ID NO: 2584325 - protein, 19 aa, Entamoeba histolytica
KYPNVVGAFLGRGTAFAML

SEQ ID NO: 2584326 - protein, 22 aa, Entamoeba histolytica
KYPYFDGSFHFTRKSLFLVLLK

SEQ ID NO: 2584327 - protein, 19 aa, Entamoeba histolytica
KYPYFSFSCISLIGQYVLT

SEQ ID NO: 2584328 - protein, 18 aa, Entamoeba histolytica
KYRFLAVSFTTLIFFTTI

SEQ ID NO: 2584329 - protein, 17 aa, Entamoeba histolytica
KYRGFICGDDGKWSNIC

SEQ ID NO: 2584330 - protein, 21 aa, Entamoeba histolytica
KYSHELCSLVAKDIQVLENMR

SEQ ID NO: 2584331 - protein, 19 aa, Entamoeba histolytica
KYSLTPKILIQFATQIAEG

SEQ ID NO: 2584332 - protein, 24 aa, Entamoeba histolytica
KYSYGMICWEMITRLITGEHVIPY

SEQ ID NO: 2584333 - protein, 26 aa, Entamoeba histolytica
KYTFIDKRLAEIISRGMNCEETAQEC

SEQ ID NO: 2584334 - protein, 18 aa, Entamoeba histolytica
KYTLRCNPEQITLKKGEA

SEQ ID NO: 2584335 - protein, 25 aa, Entamoeba histolytica
KYTWARRISLILGITYGLGIMVIPK

SEQ ID NO: 2584336 - protein, 18 aa, Entamoeba histolytica
KYVGLKCPHAQFTEAKSA

SEQ ID NO: 2584337 - protein, 19 aa, Entamoeba histolytica
KYVKMILGHISLLFSPENR

SEQ ID NO: 2584338 - protein, 19 aa, Entamoeba histolytica
KYYFDSFYAVLPFSIDIIN

SEQ ID NO: 2584339 - protein, 22 aa, Entamoeba histolytica
LAASVFRLFVITTLTSLISQGG

SEQ ID NO: 2584340 - protein, 18 aa, Entamoeba histolytica
LACACRGIIVVTVYATLG

SEQ ID NO: 2584341 - protein, 21 aa, Entamoeba histolytica
LACVGCGISYYINEKGEEKFC

SEQ ID NO: 2584342 - protein, 24 aa, Entamoeba histolytica
LADFFTLSCFGRGLGFLCGGSVML

SEQ ID NO: 2584343 - protein, 18 aa, Entamoeba histolytica
LAELKKVDAGYWFTEDGK

SEQ ID NO: 2584344 - protein, 24 aa, Entamoeba histolytica
LAEVSSLRTFICRNRTTSTFPQQL

SEQ ID NO: 2584345 - protein, 21 aa, Entamoeba histolytica
LAFNGLFGRENWLMQNLTNII

SEQ ID NO: 2584346 - protein, 25 aa, Entamoeba histolytica
LAFTLPCLFIFMSLYRFNGFTLFTI

SEQ ID NO: 2584347 - protein, 18 aa, Entamoeba histolytica
LAGLCLLSQIIQPFIQNL

SEQ ID NO: 2584348 - protein, 17 aa, Entamoeba histolytica
LAHCLKCSSSEECTECE

SEQ ID NO: 2584349 - protein, 17 aa, Entamoeba histolytica
LAHKVFVALGLRNDVVN

SEQ ID NO: 2584350 - protein, 26 aa, Entamoeba histolytica
LAIAYPMLNLRSGFVNFLCMWGALVL

SEQ ID NO: 2584351 - protein, 29 aa, Entamoeba histolytica
LAIGGFIIFRFIFKSEVPWIQRLGGCLGC

SEQ ID NO: 2584352 - protein, 23 aa, Entamoeba histolytica
LAIIRWVFILNFFISIIYAFVYN

SEQ ID NO: 2584353 - protein, 17 aa, Entamoeba histolytica
LAISYAMNVTRSLVFLI

SEQ ID NO: 2584354 - protein, 26 aa, Entamoeba histolytica
LAKVFARISLVFSILYVLFVCGFIGI

SEQ ID NO: 2584355 - protein, 25 aa, Entamoeba histolytica
LALAEGLVFVVPRWVYVSRKAGVIK

SEQ ID NO: 2584356 - protein, 19 aa, Entamoeba histolytica
LALYHCFLQLGTFSQIYFD

SEQ ID NO: 2584357 - protein, 19 aa, Entamoeba histolytica
LALYLWFGIMTLNIIISLI

SEQ ID NO: 2584358 - protein, 19 aa, Entamoeba histolytica
LAMVALKYHVIIQWKSGIL

SEQ ID NO: 2584359 - protein, 24 aa, Entamoeba histolytica
LANECLLCSCHATELTHFSLDETN

SEQ ID NO: 2584360 - protein, 17 aa, Entamoeba histolytica
LANIYFLIISIFQVIPG

SEQ ID NO: 2584361 - protein, 18 aa, Entamoeba histolytica
LANLSFLVLNIIYLLDCA

SEQ ID NO: 2584362 - protein, 26 aa, Entamoeba histolytica
LANLSIAFFERFHRYFLTHYPSIQTA

SEQ ID NO: 2584363 - protein, 20 aa, Entamoeba histolytica
LAPPLLHLAANLSFLSQSFS

SEQ ID NO: 2584364 - protein, 20 aa, Entamoeba histolytica
LAREGLRTLVFGSRKMSQEE

SEQ ID NO: 2584365 - protein, 26 aa, Entamoeba histolytica
LASLPLILPSFRQWKLKDMMEMIDAK

SEQ ID NO: 2584366 - protein, 17 aa, Entamoeba histolytica
LASYCMFVIVQSFPNVV

SEQ ID NO: 2584367 - protein, 25 aa, Entamoeba histolytica
LATKYYLQKSCDFFISTYWPSYILN

SEQ ID NO: 2584368 - protein, 29 aa, Entamoeba histolytica
LATRFLSNHMCKSCYGYCQLNGNDTTELT

SEQ ID NO: 2584369 - protein, 26 aa, Entamoeba histolytica
LAVFIEQKWLRFITIIIYVLLGLTAL

SEQ ID NO: 2584370 - protein, 31 aa, Entamoeba histolytica
LAVLIMVFSGIWPYTKLVILLFTWFMPSTLV

SEQ ID NO: 2584371 - protein, 26 aa, Entamoeba histolytica
LAVPYPLLWCRYSFFIVLYPMGVSGE

SEQ ID NO: 2584372 - protein, 18 aa, Entamoeba histolytica
LAVVKCILVIRLSFKLAT

SEQ ID NO: 2584373 - protein, 19 aa, Entamoeba histolytica
LAYVVGLIDMVMDWYAFGG

SEQ ID NO: 2584374 - protein, 17 aa, Entamoeba histolytica
LCACFVTNIGVIFSVAS

SEQ ID NO: 2584375 - protein, 26 aa, Entamoeba histolytica
LCADILELFELFSFVILLSLSNFGYY

SEQ ID NO: 2584376 - protein, 20 aa, Entamoeba histolytica
LCAIPILLLICNIYMMIYFQ

SEQ ID NO: 2584377 - protein, 19 aa, Entamoeba histolytica
LCCVCCIKCCCPSTRRHRT

SEQ ID NO: 2584378 - protein, 19 aa, Entamoeba histolytica
LCEHARLLNITTEGDQFTQ

SEQ ID NO: 2584379 - protein, 18 aa, Entamoeba histolytica
LCELACILQALSCIFTAI

SEQ ID NO: 2584380 - protein, 25 aa, Entamoeba histolytica
LCETKGKEIGVCWFECGSNTVGLCQ

SEQ ID NO: 2584381 - protein, 18 aa, Entamoeba histolytica
LCEVAIVYYLFKSLYGDN

SEQ ID NO: 2584382 - protein, 17 aa, Entamoeba histolytica
LCGNGKLDYGEDCDFSV

SEQ ID NO: 2584383 - protein, 20 aa, Entamoeba histolytica
LCIHLFKVTFHFKTTLPEII

SEQ ID NO: 2584384 - protein, 19 aa, Entamoeba histolytica
LCISASIFSILFIIMVYFI

SEQ ID NO: 2584385 - protein, 19 aa, Entamoeba histolytica
LCITFPKAIGIIIKTLFGT

SEQ ID NO: 2584386 - protein, 17 aa, Entamoeba histolytica
LCITLSLAFTMEIPTNG

SEQ ID NO: 2584387 - protein, 20 aa, Entamoeba histolytica
LCIVGIPIVVFKSYSVLLKW

SEQ ID NO: 2584388 - protein, 19 aa, Entamoeba histolytica
LCKHVYRPPQEYATIDGAH

SEQ ID NO: 2584389 - protein, 18 aa, Entamoeba histolytica
LCKLLSMIESLTLSIRVI

SEQ ID NO: 2584390 - protein, 25 aa, Entamoeba histolytica
LCLCVNRLIIWLLYLIAISLCSLHA

SEQ ID NO: 2584391 - protein, 20 aa, Entamoeba histolytica
LCLIPCYLTHECIIKSQLQD

SEQ ID NO: 2584392 - protein, 22 aa, Entamoeba histolytica
LCLVKYYGFSGMQLKGIPNQVR

SEQ ID NO: 2584393 - protein, 24 aa, Entamoeba histolytica
LCLYRMCPIIPFTISNYILSPFVD

SEQ ID NO: 2584394 - protein, 18 aa, Entamoeba histolytica
LCPCHYSDPKGEQDLIGS

SEQ ID NO: 2584395 - protein, 27 aa, Entamoeba histolytica
LCSAAEEFMFRFSFFKPTKEVLSLAPS

SEQ ID NO: 2584396 - protein, 18 aa, Entamoeba histolytica
LCSFISNIMSFDYLTLNN

SEQ ID NO: 2584397 - protein, 19 aa, Entamoeba histolytica
LCSKICSFFNSLITNDPML

SEQ ID NO: 2584398 - protein, 17 aa, Entamoeba histolytica
LCSQFLLFGIKNENIRI

SEQ ID NO: 2584399 - protein, 18 aa, Entamoeba histolytica
LCSTEYPNICSIINKKDL

SEQ ID NO: 2584400 - protein, 20 aa, Entamoeba histolytica
LCSVSVPHCKTCSSNGSCLS

SEQ ID NO: 2584401 - protein, 20 aa, Entamoeba histolytica
LCSVVFCHSCFIWYEPFYST

SEQ ID NO: 2584402 - protein, 24 aa, Entamoeba histolytica
LCTKRCYCKSLIIPESPCISSCLD

SEQ ID NO: 2584403 - protein, 20 aa, Entamoeba histolytica
LCVGVFKIVFITDSLGLWVP

SEQ ID NO: 2584404 - protein, 26 aa, Entamoeba histolytica
LCVLMCVIDLIGIMYLWGVELNAVSC

SEQ ID NO: 2584405 - protein, 17 aa, Entamoeba histolytica
LCVVLIFSGIKEIYEDL

SEQ ID NO: 2584406 - protein, 19 aa, Entamoeba histolytica
LCYPMFALFLVFYKNKKEK

SEQ ID NO: 2584407 - protein, 18 aa, Entamoeba histolytica
LDAIEIEHCRALSSIDKR

SEQ ID NO: 2584408 - protein, 23 aa, Entamoeba histolytica
LDCLLSEALVYFWVGENQKLFHI

SEQ ID NO: 2584409 - protein, 27 aa, Entamoeba histolytica
LDCLPIRKRYACSLIYFNSDSKMSLFN

SEQ ID NO: 2584410 - protein, 25 aa, Entamoeba histolytica
LDDSCPRLSKAVDIFTLGCLFYYIA

SEQ ID NO: 2584411 - protein, 17 aa, Entamoeba histolytica
LDEMFIEFMNNYRRCLK

SEQ ID NO: 2584412 - protein, 18 aa, Entamoeba histolytica
LDFVCVIVGLMASNLFCF

SEQ ID NO: 2584413 - protein, 26 aa, Entamoeba histolytica
LDGLSGLPSMCILSLMIFANQPLAIV

SEQ ID NO: 2584414 - protein, 23 aa, Entamoeba histolytica
LDGSFGKCPACYLNQMNLWCGFA

SEQ ID NO: 2584415 - protein, 40 aa, Entamoeba histolytica
LDGTSSVFMFFAFVIQKYSSNYCVFLFSFRILLYLLFICL

SEQ ID NO: 2584416 - protein, 17 aa, Entamoeba histolytica
LDGTYMYNGECYLCSDN

SEQ ID NO: 2584417 - protein, 22 aa, Entamoeba histolytica
LDIAKMVYAFFINRDKDIAGAE

SEQ ID NO: 2584418 - protein, 18 aa, Entamoeba histolytica
LDIIIKYILPLISNIPDI

SEQ ID NO: 2584419 - protein, 23 aa, Entamoeba histolytica
LDIIKNFFGFQFKEEVKKKPEKD

SEQ ID NO: 2584420 - protein, 26 aa, Entamoeba histolytica
LDIVIYRYLLNAVFVYPTEQNIESED

SEQ ID NO: 2584421 - protein, 18 aa, Entamoeba histolytica
LDKFRCEYIVQFYGACFI

SEQ ID NO: 2584422 - protein, 29 aa, Entamoeba histolytica
LDKIFQESKFRVVVFTTLQGMFSVLYRFI

SEQ ID NO: 2584423 - protein, 23 aa, Entamoeba histolytica
LDKNGMCTRECPDDCLTCDKALE

SEQ ID NO: 2584424 - protein, 17 aa, Entamoeba histolytica
LDKTIKTGCIKRMHYQF

SEQ ID NO: 2584425 - protein, 19 aa, Entamoeba histolytica
LDKYLKFGLAFVLFILMSL

SEQ ID NO: 2584426 - protein, 18 aa, Entamoeba histolytica
LDLLNSLRDLAMAKTKEG

SEQ ID NO: 2584427 - protein, 18 aa, Entamoeba histolytica
LDLPMKVLDMFGCSLPVL

SEQ ID NO: 2584428 - protein, 21 aa, Entamoeba histolytica
LDLSLTFIILFNYMRYTIMMI

SEQ ID NO: 2584429 - protein, 25 aa, Entamoeba histolytica
LDLSRYDFYDALSISLNGFILPNDN

SEQ ID NO: 2584430 - protein, 19 aa, Entamoeba histolytica
LDMKYSLLSQSICRQDKIQ

SEQ ID NO: 2584431 - protein, 21 aa, Entamoeba histolytica
LDMLSMISARGLLFGEVQVLQ

SEQ ID NO: 2584432 - protein, 22 aa, Entamoeba histolytica
LDNCKEGLAIHKGQMKAEAAGL

SEQ ID NO: 2584433 - protein, 24 aa, Entamoeba histolytica
LDNFRHEWFLSTFGFIGGIGGGAI

SEQ ID NO: 2584434 - protein, 23 aa, Entamoeba histolytica
LDNIKFGLKIVVYILSFICPLFG

SEQ ID NO: 2584435 - protein, 19 aa, Entamoeba histolytica
LDPSKLIALSILFAKQPNE

SEQ ID NO: 2584436 - protein, 18 aa, Entamoeba histolytica
LDRKGLIIIGVIFSVLAV

SEQ ID NO: 2584437 - protein, 20 aa, Entamoeba histolytica
LDRRTVIHLFGLTMLHTKKD

SEQ ID NO: 2584438 - protein, 20 aa, Entamoeba histolytica
LDSLCQILLHFNLIYANSSK

SEQ ID NO: 2584439 - protein, 19 aa, Entamoeba histolytica
LDSLSMKSIIPAISSKSIR

SEQ ID NO: 2584440 - protein, 17 aa, Entamoeba histolytica
LDSLYLHYSEFEITSTS

SEQ ID NO: 2584441 - protein, 18 aa, Entamoeba histolytica
LDTTFKSVMVYVYHSSFN

SEQ ID NO: 2584442 - protein, 17 aa, Entamoeba histolytica
LDTTGLYNSLHRLYETE

SEQ ID NO: 2584443 - protein, 28 aa, Entamoeba histolytica
LDVFITFVLECINVLNGLLDFTINAEPT

SEQ ID NO: 2584444 - protein, 17 aa, Entamoeba histolytica
LDVFITFVYDYINILNR

SEQ ID NO: 2584445 - protein, 17 aa, Entamoeba histolytica
LDVLPLPITPSWGRILE

SEQ ID NO: 2584446 - protein, 17 aa, Entamoeba histolytica
LDVSYVSSMSWYILIFA

SEQ ID NO: 2584447 - protein, 22 aa, Entamoeba histolytica
LDVYNIYAIFVILWNQETSKKI

SEQ ID NO: 2584448 - protein, 17 aa, Entamoeba histolytica
LDYSERFLISIVLLLSS

SEQ ID NO: 2584449 - protein, 19 aa, Entamoeba histolytica
LEACARRIISIVSPSLSYD

SEQ ID NO: 2584450 - protein, 25 aa, Entamoeba histolytica
LEAFIKCSRIILNSRIASGRYKGDF

SEQ ID NO: 2584451 - protein, 21 aa, Entamoeba histolytica
LEAMIKGVPVIACNNGGPLET

SEQ ID NO: 2584452 - protein, 21 aa, Entamoeba histolytica
LEAVLSFLLFHELNNVFHAST

SEQ ID NO: 2584453 - protein, 18 aa, Entamoeba histolytica
LECPIKEKFHLTSDFHFD

SEQ ID NO: 2584454 - protein, 22 aa, Entamoeba histolytica
LECQEYILSHCVDWLQVINSNH

SEQ ID NO: 2584455 - protein, 19 aa, Entamoeba histolytica
LECSYLSRLDKNGMCTREC

SEQ ID NO: 2584456 - protein, 20 aa, Entamoeba histolytica
LECVDRIAAEQAPIPITILI

SEQ ID NO: 2584457 - protein, 21 aa, Entamoeba histolytica
LEECVECSFGYLYNSTSRICT

SEQ ID NO: 2584458 - protein, 21 aa, Entamoeba histolytica
LEEMKRYGVKVIQRANSSQEV

SEQ ID NO: 2584459 - protein, 24 aa, Entamoeba histolytica
LEEQWCYRKARRIACGIDSDIPRF

SEQ ID NO: 2584460 - protein, 35 aa, Entamoeba histolytica
LEESSWTGANAFECYKRSDKVTSYSLAFSKESTGQ

SEQ ID NO: 2584461 - protein, 23 aa, Entamoeba histolytica
LEEVCKIKLSLEGKKNIEKEFEE

SEQ ID NO: 2584462 - protein, 17 aa, Entamoeba histolytica
LEEWYRKPTTIKYGNVK

SEQ ID NO: 2584463 - protein, 22 aa, Entamoeba histolytica
LEFFIPLIIGYILRISTLDNRV

SEQ ID NO: 2584464 - protein, 27 aa, Entamoeba histolytica
LEFIHKYSLKYNDWLSIDSHITVRYLF

SEQ ID NO: 2584465 - protein, 19 aa, Entamoeba histolytica
LEFVCQIGIEAEKLHNYDL

SEQ ID NO: 2584466 - protein, 17 aa, Entamoeba histolytica
LEGPFIYGVVISLITML

SEQ ID NO: 2584467 - protein, 19 aa, Entamoeba histolytica
LEGYSPRGFLKCSKDPDII

SEQ ID NO: 2584468 - protein, 20 aa, Entamoeba histolytica
LEIAKTLQSLFMKWDSEFKY

SEQ ID NO: 2584469 - protein, 32 aa, Entamoeba histolytica
LEIRTKRNLKRFCYAYLFIICCFAAVECLFIP

SEQ ID NO: 2584470 - protein, 19 aa, Entamoeba histolytica
LEKCCSLFYRLYLNYIPLI

SEQ ID NO: 2584471 - protein, 17 aa, Entamoeba histolytica
LEKGFGVTLTIEVIMLC

SEQ ID NO: 2584472 - protein, 18 aa, Entamoeba histolytica
LEKIPLWLDVSPPTDECA

SEQ ID NO: 2584473 - protein, 17 aa, Entamoeba histolytica
LEKLFFQCCAAVVSEAN

SEQ ID NO: 2584474 - protein, 23 aa, Entamoeba histolytica
LEKLRSSCIVSFIGYCADEETVC

SEQ ID NO: 2584475 - protein, 25 aa, Entamoeba histolytica
LEKNRKLILGFYIIIIVIVFPVSVW

SEQ ID NO: 2584476 - protein, 25 aa, Entamoeba histolytica
LEKQGGEVTRMFRLVIGCVQDVCGC

SEQ ID NO: 2584477 - protein, 17 aa, Entamoeba histolytica
LELKKKYVFQLFVGNKS

SEQ ID NO: 2584478 - protein, 17 aa, Entamoeba histolytica
LELLGNVYSLCLPIVWV

SEQ ID NO: 2584479 - protein, 22 aa, Entamoeba histolytica
LELLSRRAQLFALKSELQNSGN

SEQ ID NO: 2584480 - protein, 20 aa, Entamoeba histolytica
LELPFLHILHYVFSSSCSLC

SEQ ID NO: 2584481 - protein, 19 aa, Entamoeba histolytica
LELSLRTSSLVRVTSLLSL

SEQ ID NO: 2584482 - protein, 21 aa, Entamoeba histolytica
LELSPFMAFVLYLVYIQIDYH

SEQ ID NO: 2584483 - protein, 21 aa, Entamoeba histolytica
LELTYFYYFLPFVINIERNKK

SEQ ID NO: 2584484 - protein, 19 aa, Entamoeba histolytica
LEMIKKKIIDFMVIVLQCP

SEQ ID NO: 2584485 - protein, 17 aa, Entamoeba histolytica
LEMSGILTIFVTGAIMS

SEQ ID NO: 2584486 - protein, 22 aa, Entamoeba histolytica
LENEYLLPISFACIAPQNNCLI

SEQ ID NO: 2584487 - protein, 20 aa, Entamoeba histolytica
LENFACLFFFVGTLVSYLII

SEQ ID NO: 2584488 - protein, 26 aa, Entamoeba histolytica
LENYTCLKYLVALLYELSKNAKSKMT

SEQ ID NO: 2584489 - protein, 20 aa, Entamoeba histolytica
LEPEEFVEYCFLFFGQQNHI

SEQ ID NO: 2584490 - protein, 22 aa, Entamoeba histolytica
LEPFSMIGGLLWATGNLTSVPI

SEQ ID NO: 2584491 - protein, 22 aa, Entamoeba histolytica
LEPIARLNCCKVLMRTLEYLLI

SEQ ID NO: 2584492 - protein, 19 aa, Entamoeba histolytica
LEPYCSGNNCAFRSNCTDD

SEQ ID NO: 2584493 - protein, 31 aa, Entamoeba histolytica
LESFYPFFKEGFCKHLIPAALHRYEEQPPFE

SEQ ID NO: 2584494 - protein, 17 aa, Entamoeba histolytica
LESIWVMMTQGRKKMVN

SEQ ID NO: 2584495 - protein, 23 aa, Entamoeba histolytica
LETKKRPSIVISLENQFKYMCDS

SEQ ID NO: 2584496 - protein, 25 aa, Entamoeba histolytica
LEVIFNFAGIFGFFLLFIIPGVLQI

SEQ ID NO: 2584497 - protein, 21 aa, Entamoeba histolytica
LEVLPLIKLKIFMLETSDNFF

SEQ ID NO: 2584498 - protein, 25 aa, Entamoeba histolytica
LEYCSKKGIVAHLFSAFSALYQARP

SEQ ID NO: 2584499 - protein, 19 aa, Entamoeba histolytica
LEYFIYILLFYTISFKLIG

SEQ ID NO: 2584500 - protein, 17 aa, Entamoeba histolytica
LEYLTFMLQLFVTHPLT

SEQ ID NO: 2584501 - protein, 24 aa, Entamoeba histolytica
LEYNLKINQIFSFIISHTPVVFPS

SEQ ID NO: 2584502 - protein, 22 aa, Entamoeba histolytica
LEYPELYLTSTRSFICPFTRNF

SEQ ID NO: 2584503 - protein, 26 aa, Entamoeba histolytica
LFAKRKEIIINGGLFFGGIDKVIELL

SEQ ID NO: 2584504 - protein, 18 aa, Entamoeba histolytica
LFCIARTSFELVRLFYDC

SEQ ID NO: 2584505 - protein, 20 aa, Entamoeba histolytica
LFCLVLFKKFGVSLIPTLLM

SEQ ID NO: 2584506 - protein, 25 aa, Entamoeba histolytica
LFCTIEIGWYIYIFIHQKVSFSSFI

SEQ ID NO: 2584507 - protein, 22 aa, Entamoeba histolytica
LFCVSLGQGIECDKELSFKDTE

SEQ ID NO: 2584508 - protein, 17 aa, Entamoeba histolytica
LFCYPRTTNLSNINPLL

SEQ ID NO: 2584509 - protein, 24 aa, Entamoeba histolytica
LFDLHDLHMYFGLESSKDYCYWID

SEQ ID NO: 2584510 - protein, 18 aa, Entamoeba histolytica
LFDLICLIKKEFNQHQQG

SEQ ID NO: 2584511 - protein, 18 aa, Entamoeba histolytica
LFDNKFLEDIKVFIQRLK

SEQ ID NO: 2584512 - protein, 18 aa, Entamoeba histolytica
LFDYFILNDSFRIWCIWC

SEQ ID NO: 2584513 - protein, 28 aa, Entamoeba histolytica
LFDYFPFFRRLLSLLLLSQVFIKFYIII

SEQ ID NO: 2584514 - protein, 18 aa, Entamoeba histolytica
LFEAIPLAQQLTGINQKG

SEQ ID NO: 2584515 - protein, 21 aa, Entamoeba histolytica
LFEIIEWKEAYPADDPKFKYQ

SEQ ID NO: 2584516 - protein, 26 aa, Entamoeba histolytica
LFEKLPIGNLLLHYVNWMTNLCYLTD

SEQ ID NO: 2584517 - protein, 19 aa, Entamoeba histolytica
LFEQILLSIHYCLEYLQLG

SEQ ID NO: 2584518 - protein, 18 aa, Entamoeba histolytica
LFEYPWQIAEFVVSGKRL

SEQ ID NO: 2584519 - protein, 24 aa, Entamoeba histolytica
LFFCYRIVALVLMFTTLIIFFSVT

SEQ ID NO: 2584520 - protein, 20 aa, Entamoeba histolytica
LFFEWKNSWQTTKLALQALI

SEQ ID NO: 2584521 - protein, 25 aa, Entamoeba histolytica
LFFIRFLFILLLTFHCSFTVFLGSR

SEQ ID NO: 2584522 - protein, 17 aa, Entamoeba histolytica
LFFKKAYGLYTIKSKDN

SEQ ID NO: 2584523 - protein, 19 aa, Entamoeba histolytica
LFFLCELITGIVIHSLALL

SEQ ID NO: 2584524 - protein, 24 aa, Entamoeba histolytica
LFFSIPKLKHSSLFQLKPTILSII

SEQ ID NO: 2584525 - protein, 25 aa, Entamoeba histolytica
LFFVCKEYGKSMVMITVGNKVGKTH

SEQ ID NO: 2584526 - protein, 24 aa, Entamoeba histolytica
LFFVICFWIMFVITIAVIIVLAVI

SEQ ID NO: 2584527 - protein, 17 aa, Entamoeba histolytica
LFGTIGFILPNIIMKSV

SEQ ID NO: 2584528 - protein, 18 aa, Entamoeba histolytica
LFGYLSCKELHLKSTTRI

SEQ ID NO: 2584529 - protein, 17 aa, Entamoeba histolytica
LFHAIGIFLFCYGSDLL

SEQ ID NO: 2584530 - protein, 18 aa, Entamoeba histolytica
LFHSTCGDGIVLELNEEC

SEQ ID NO: 2584531 - protein, 20 aa, Entamoeba histolytica
LFHYIAELVIKFSEYALEQQ

SEQ ID NO: 2584532 - protein, 18 aa, Entamoeba histolytica
LFICCVVIAIAAFYEDIN

SEQ ID NO: 2584533 - protein, 19 aa, Entamoeba histolytica
LFICVPITLVIASYQRKMR

SEQ ID NO: 2584534 - protein, 17 aa, Entamoeba histolytica
LFIFIIFPRKPRYKNDE

SEQ ID NO: 2584535 - protein, 17 aa, Entamoeba histolytica
LFIHQWKENNQTIKINQ

SEQ ID NO: 2584536 - protein, 21 aa, Entamoeba histolytica
LFIIHICFFDYGYINNYVDEI

SEQ ID NO: 2584537 - protein, 17 aa, Entamoeba histolytica
LFIIIPTHNDFLFISLL

SEQ ID NO: 2584538 - protein, 25 aa, Entamoeba histolytica
LFIIMQLCVFNFINGTLFYYFLMDN

SEQ ID NO: 2584539 - protein, 25 aa, Entamoeba histolytica
LFIQHEVYKVYSLVLVHQQSLSKFD

SEQ ID NO: 2584540 - protein, 25 aa, Entamoeba histolytica
LFIQKGKRALAWTSLIHDDFEYFPC

SEQ ID NO: 2584541 - protein, 18 aa, Entamoeba histolytica
LFISCLQLIPGLSPTGRY

SEQ ID NO: 2584542 - protein, 28 aa, Entamoeba histolytica
LFISFPLDFIGEYLLMFNSFPDKHSFIF

SEQ ID NO: 2584543 - protein, 18 aa, Entamoeba histolytica
LFISRSMTYDGLREKGTT

SEQ ID NO: 2584544 - protein, 22 aa, Entamoeba histolytica
LFKEAAEAFGRAVSIKQDFVDG

SEQ ID NO: 2584545 - protein, 19 aa, Entamoeba histolytica
LFKETILLYLGYIKGIPGT

SEQ ID NO: 2584546 - protein, 21 aa, Entamoeba histolytica
LFKYSDWIDMILLVVGLISSI

SEQ ID NO: 2584547 - protein, 21 aa, Entamoeba histolytica
LFLEHPFVSIILLTVTLILIG

SEQ ID NO: 2584548 - protein, 18 aa, Entamoeba histolytica
LFLIPTFFTVFIFFVSCC

SEQ ID NO: 2584549 - protein, 18 aa, Entamoeba histolytica
LFLLFIKEYISLFSSMNW

SEQ ID NO: 2584550 - protein, 26 aa, Entamoeba histolytica
LFLLFTIFCDAFCLQEAMIGVINDKD

SEQ ID NO: 2584551 - protein, 19 aa, Entamoeba histolytica
LFLLLICFVYGGITEEVYN

SEQ ID NO: 2584552 - protein, 21 aa, Entamoeba histolytica
LFLLLYIRLTRKIKQEIDDEN

SEQ ID NO: 2584553 - protein, 18 aa, Entamoeba histolytica
LFLLPIILVNCCSVVIGM

SEQ ID NO: 2584554 - protein, 21 aa, Entamoeba histolytica
LFLMYCIWTIYVLYDHVYYCF

SEQ ID NO: 2584555 - protein, 22 aa, Entamoeba histolytica
LFLVSLPMKGHILKQQFIDGLT

SEQ ID NO: 2584556 - protein, 18 aa, Entamoeba histolytica
LFMICYSLGLLLISLATF

SEQ ID NO: 2584557 - protein, 17 aa, Entamoeba histolytica
LFMKEIPGLSGVEAGKI

SEQ ID NO: 2584558 - protein, 18 aa, Entamoeba histolytica
LFMRFLSIYLPHISIICA

SEQ ID NO: 2584559 - protein, 23 aa, Entamoeba histolytica
LFMTSILGLIGFITCSTIALIQG

SEQ ID NO: 2584560 - protein, 17 aa, Entamoeba histolytica
LFNCCLLNILSVFVGPL

SEQ ID NO: 2584561 - protein, 18 aa, Entamoeba histolytica
LFNDCSFFSSINGITACL

SEQ ID NO: 2584562 - protein, 22 aa, Entamoeba histolytica
LFNDPFVALGFYANYISIEYVD

SEQ ID NO: 2584563 - protein, 22 aa, Entamoeba histolytica
LFNFASYFYWLVVPLKCVDMGG

SEQ ID NO: 2584564 - protein, 17 aa, Entamoeba histolytica
LFNLISFSLIILLIIES

SEQ ID NO: 2584565 - protein, 19 aa, Entamoeba histolytica
LFNTLFCHWNHYVRMFFQE

SEQ ID NO: 2584566 - protein, 19 aa, Entamoeba histolytica
LFNTNGFIFPNTVIQQIYP

SEQ ID NO: 2584567 - protein, 20 aa, Entamoeba histolytica
LFQCIPLIYTFSISRPLYEN

SEQ ID NO: 2584568 - protein, 23 aa, Entamoeba histolytica
LFRAEPYMKMHIQLFDGHFDTDR

SEQ ID NO: 2584569 - protein, 19 aa, Entamoeba histolytica
LFRDIFFHTAFWMRTSGEV

SEQ ID NO: 2584570 - protein, 20 aa, Entamoeba histolytica
LFRYEDWMPSALFGKGKQDL

SEQ ID NO: 2584571 - protein, 18 aa, Entamoeba histolytica
LFSFHVISLLLLPIVLYL

SEQ ID NO: 2584572 - protein, 24 aa, Entamoeba histolytica
LFSGICLYLVIGVIINILVFKKRG

SEQ ID NO: 2584573 - protein, 21 aa, Entamoeba histolytica
LFSKEFVGILCCFSYSIISVG

SEQ ID NO: 2584574 - protein, 23 aa, Entamoeba histolytica
LFSTCLDCAVYPTLFVSYVSQKF

SEQ ID NO: 2584575 - protein, 26 aa, Entamoeba histolytica
LFSTHYLNRFDVILQHYCEVADDPII

SEQ ID NO: 2584576 - protein, 27 aa, Entamoeba histolytica
LFTCNTCKDGSCLNCIKNEVNFKEIYL

SEQ ID NO: 2584577 - protein, 18 aa, Entamoeba histolytica
LFTDLRSVIITSKECETV

SEQ ID NO: 2584578 - protein, 18 aa, Entamoeba histolytica
LFTFLPLVLLEQFRKLAN

SEQ ID NO: 2584579 - protein, 18 aa, Entamoeba histolytica
LFTLCLCVNRLIIWLLYL

SEQ ID NO: 2584580 - protein, 18 aa, Entamoeba histolytica
LFTLIPLLVITIFLFVNR

SEQ ID NO: 2584581 - protein, 25 aa, Entamoeba histolytica
LFTSELFRKIKLVEFFKSTSNTTKN

SEQ ID NO: 2584582 - protein, 17 aa, Entamoeba histolytica
LFVAYSMVYLRLLSKGI

SEQ ID NO: 2584583 - protein, 17 aa, Entamoeba histolytica
LFVCTIFLFINPYFALL

SEQ ID NO: 2584584 - protein, 17 aa, Entamoeba histolytica
LFVLIASSQTCDEFKNY

SEQ ID NO: 2584585 - protein, 21 aa, Entamoeba histolytica
LFVYDLIRIFRNCYIPFYDGQ

SEQ ID NO: 2584586 - protein, 17 aa, Entamoeba histolytica
LFYGIHAFSDLKTTYDI

SEQ ID NO: 2584587 - protein, 19 aa, Entamoeba histolytica
LFYPFTWPGIFIPYIPDEL

SEQ ID NO: 2584588 - protein, 19 aa, Entamoeba histolytica
LFYYFLINLAFMFVEVAYG

SEQ ID NO: 2584589 - protein, 22 aa, Entamoeba histolytica
LFYYRCMKLIVGWLLFSVILLL

SEQ ID NO: 2584590 - protein, 17 aa, Entamoeba histolytica
LGCCLASVWTPFQKKSS

SEQ ID NO: 2584591 - protein, 21 aa, Entamoeba histolytica
LGELLSLIFGNFFAIIVDICN

SEQ ID NO: 2584592 - protein, 18 aa, Entamoeba histolytica
LGFLLNWKNFLFSPIPPV

SEQ ID NO: 2584593 - protein, 25 aa, Entamoeba histolytica
LGFNSTFLSKVEWSIVISQFNNELK

SEQ ID NO: 2584594 - protein, 19 aa, Entamoeba histolytica
LGGFVPRLFGDYDDEWYSD

SEQ ID NO: 2584595 - protein, 17 aa, Entamoeba histolytica
LGGIHGLCELLNVDEKK

SEQ ID NO: 2584596 - protein, 25 aa, Entamoeba histolytica
LGGYMRISFFETFEWNYNYNETIPR

SEQ ID NO: 2584597 - protein, 38 aa, Entamoeba histolytica
LGHFPKHIIPFVFSWPSCSNPFLYCCAANVSSDNAVHR

SEQ ID NO: 2584598 - protein, 17 aa, Entamoeba histolytica
LGIDFSLITKRIISRLN

SEQ ID NO: 2584599 - protein, 23 aa, Entamoeba histolytica
LGIDSEHPADCTISAEELMILLE

SEQ ID NO: 2584600 - protein, 31 aa, Entamoeba histolytica
LGIFPNFFSKRGFIPCIKRCRVWAENKEKSY

SEQ ID NO: 2584601 - protein, 22 aa, Entamoeba histolytica
LGKFNAVEPFYGFMQMMVDWKN

SEQ ID NO: 2584602 - protein, 17 aa, Entamoeba histolytica
LGKVLEPSNCFEIQEKS

SEQ ID NO: 2584603 - protein, 22 aa, Entamoeba histolytica
LGLICIGGIFIIISIIDYVCKL

SEQ ID NO: 2584604 - protein, 17 aa, Entamoeba histolytica
LGMGCAIVVFTILCIYW

SEQ ID NO: 2584605 - protein, 23 aa, Entamoeba histolytica
LGPKKIIWWVAIIFTILSIIEVI

SEQ ID NO: 2584606 - protein, 26 aa, Entamoeba histolytica
LGPPIYVAGCGLLFGTLAIIIALNGN

SEQ ID NO: 2584607 - protein, 17 aa, Entamoeba histolytica
LGPSLLVPIGLIILTFL

SEQ ID NO: 2584608 - protein, 25 aa, Entamoeba histolytica
LGPTEFVFPIAIFFTIISGILSFDG

SEQ ID NO: 2584609 - protein, 28 aa, Entamoeba histolytica
LGPVSLRLKYYGGFTICVIILYLCLLIA

SEQ ID NO: 2584610 - protein, 19 aa, Entamoeba histolytica
LGQTILKPGTTRAYMALTF

SEQ ID NO: 2584611 - protein, 31 aa, Entamoeba histolytica
LGRIYCTLYILAFFFIFPMRLGQIITALNQR

SEQ ID NO: 2584612 - protein, 27 aa, Entamoeba histolytica
LGSIPWIELLPLFFPLSFVYSIPQKLF

SEQ ID NO: 2584613 - protein, 30 aa, Entamoeba histolytica
LGSNHCWLEILPFQFCVFIFTLGDYLILPL

SEQ ID NO: 2584614 - protein, 21 aa, Entamoeba histolytica
LGSSVGLLFIMGLFILLFFVL

SEQ ID NO: 2584615 - protein, 19 aa, Entamoeba histolytica
LGSVFLEYVFYTLLEFNNF

SEQ ID NO: 2584616 - protein, 27 aa, Entamoeba histolytica
LGSVLCCPGCFTLLRLEAIYEDNLRNK

SEQ ID NO: 2584617 - protein, 18 aa, Entamoeba histolytica
LGTSGCDKHCKCKEGYSY

SEQ ID NO: 2584618 - protein, 18 aa, Entamoeba histolytica
LGTVPLLEFTDGECGDIT

SEQ ID NO: 2584619 - protein, 27 aa, Entamoeba histolytica
LGTVVVICICCILLLVVHPHRDTSDQE

SEQ ID NO: 2584620 - protein, 22 aa, Entamoeba histolytica
LGVICGLFAVLFVMSVSTIFKT

SEQ ID NO: 2584621 - protein, 18 aa, Entamoeba histolytica
LHALEFIHKYSLKYNDWL

SEQ ID NO: 2584622 - protein, 17 aa, Entamoeba histolytica
LHCDSTHCYECGKTTDG

SEQ ID NO: 2584623 - protein, 19 aa, Entamoeba histolytica
LHDLFLFEGGIKLRDCLSH

SEQ ID NO: 2584624 - protein, 17 aa, Entamoeba histolytica
LHERDLFFQTSWHLPQN

SEQ ID NO: 2584625 - protein, 17 aa, Entamoeba histolytica
LHFGVLAKICLGETFSI

SEQ ID NO: 2584626 - protein, 18 aa, Entamoeba histolytica
LHFVSVLVLFFFSFLYCL

SEQ ID NO: 2584627 - protein, 24 aa, Entamoeba histolytica
LHFYLDACFIFSLLNNASNDSSPI

SEQ ID NO: 2584628 - protein, 19 aa, Entamoeba histolytica
LHGSFNWSIITLIVPSAVG

SEQ ID NO: 2584629 - protein, 20 aa, Entamoeba histolytica
LHHCKPPILHRDLKTNNLLV

SEQ ID NO: 2584630 - protein, 23 aa, Entamoeba histolytica
LHIECRLISLGFLFGNISILFEF

SEQ ID NO: 2584631 - protein, 30 aa, Entamoeba histolytica
LHIILTIICLVSFIFCIKIFNTPLTPNSYQ

SEQ ID NO: 2584632 - protein, 17 aa, Entamoeba histolytica
LHILRNRMCILPQEATM

SEQ ID NO: 2584633 - protein, 25 aa, Entamoeba histolytica
LHIPKDCYFYLTGHFQFEVLKGDVY

SEQ ID NO: 2584634 - protein, 22 aa, Entamoeba histolytica
LHISFTISLILGYGGIIVSSIY

SEQ ID NO: 2584635 - protein, 29 aa, Entamoeba histolytica
LHISPKLHWKFTFTVSLFILSFILTIICS

SEQ ID NO: 2584636 - protein, 23 aa, Entamoeba histolytica
LHKELKGHLWVLVVGIIEGIVFL

SEQ ID NO: 2584637 - protein, 18 aa, Entamoeba histolytica
LHKILKSKEICFKLLSQS

SEQ ID NO: 2584638 - protein, 17 aa, Entamoeba histolytica
LHLLKIQPVVPHLQINQ

SEQ ID NO: 2584639 - protein, 17 aa, Entamoeba histolytica
LHLNKLKLLQLIKKELV

SEQ ID NO: 2584640 - protein, 20 aa, Entamoeba histolytica
LHLVINCIYVLMNIYIDFKE

SEQ ID NO: 2584641 - protein, 24 aa, Entamoeba histolytica
LHNIPCDKQPFGLVGSKTLGGYPM

SEQ ID NO: 2584642 - protein, 22 aa, Entamoeba histolytica
LHPEFKYYQGFHDIVSYLLFTS

SEQ ID NO: 2584643 - protein, 18 aa, Entamoeba histolytica
LHPGLGLGVSGRRSLLLK

SEQ ID NO: 2584644 - protein, 21 aa, Entamoeba histolytica
LHQSIMQFADWVRIINDETEI

SEQ ID NO: 2584645 - protein, 17 aa, Entamoeba histolytica
LHRYLAFPHPIEWDKFF

SEQ ID NO: 2584646 - protein, 18 aa, Entamoeba histolytica
LHSPFNIYRISMNEPLRW

SEQ ID NO: 2584647 - protein, 17 aa, Entamoeba histolytica
LHSSVFFETPLKTIAIE

SEQ ID NO: 2584648 - protein, 19 aa, Entamoeba histolytica
LHVAGEVFAENGFLQRSDR

SEQ ID NO: 2584649 - protein, 26 aa, Entamoeba histolytica
LHVVDSCLFQNCLLNSFQKTSSIILE

SEQ ID NO: 2584650 - protein, 17 aa, Entamoeba histolytica
LHYFLKFLAQNIEYKHY

SEQ ID NO: 2584651 - protein, 17 aa, Entamoeba histolytica
LHYSLSLTFKIIVLLYV

SEQ ID NO: 2584652 - protein, 26 aa, Entamoeba histolytica
LIALAFPLMLQYVIKWINNPQGTLKR

SEQ ID NO: 2584653 - protein, 24 aa, Entamoeba histolytica
LIALFCYDIFWVFGSEVMLTVATH

SEQ ID NO: 2584654 - protein, 35 aa, Entamoeba histolytica
LIALPRYPLLTGWKTEFMIGYSLPNKVVISKGKAI

SEQ ID NO: 2584655 - protein, 18 aa, Entamoeba histolytica
LICCCITHTLGIIIKRKH

SEQ ID NO: 2584656 - protein, 19 aa, Entamoeba histolytica
LIDCFFFKQGNTRVHKIYF

SEQ ID NO: 2584657 - protein, 19 aa, Entamoeba histolytica
LIDLKGFYYTLAMQQFGTV

SEQ ID NO: 2584658 - protein, 24 aa, Entamoeba histolytica
LIDRIKFGVCNDIVNIIQIDGITK

SEQ ID NO: 2584659 - protein, 17 aa, Entamoeba histolytica
LIDTVFFVAPYVLYIDI

SEQ ID NO: 2584660 - protein, 18 aa, Entamoeba histolytica
LIEGVSLLVRSVRTGMRY

SEQ ID NO: 2584661 - protein, 18 aa, Entamoeba histolytica
LIEKFPMWLAPNMITLAG

SEQ ID NO: 2584662 - protein, 24 aa, Entamoeba histolytica
LIEKRWAYWSMIALLCVTMFYAVL

SEQ ID NO: 2584663 - protein, 27 aa, Entamoeba histolytica
LIERKKKLQSFSVWLVCILPHSLKVHQ

SEQ ID NO: 2584664 - protein, 17 aa, Entamoeba histolytica
LIEWGRGITPINIDTSN

SEQ ID NO: 2584665 - protein, 18 aa, Entamoeba histolytica
LIEYRLSLKTVEDEIETM

SEQ ID NO: 2584666 - protein, 22 aa, Entamoeba histolytica
LIFCFAGWYYLVHHQRVSDLEL

SEQ ID NO: 2584667 - protein, 17 aa, Entamoeba histolytica
LIFEIAFIYTIITSFSK

SEQ ID NO: 2584668 - protein, 27 aa, Entamoeba histolytica
LIFFPTHLKMVFKYIFSLEITSELELP

SEQ ID NO: 2584669 - protein, 19 aa, Entamoeba histolytica
LIFFVCLFLIMGTGSTIIS

SEQ ID NO: 2584670 - protein, 23 aa, Entamoeba histolytica
LIFISCILWIFVIINNSEVKELI

SEQ ID NO: 2584671 - protein, 25 aa, Entamoeba histolytica
LIFKEKRKTCLYLEFVMKTNEAEEN

SEQ ID NO: 2584672 - protein, 20 aa, Entamoeba histolytica
LIFNPCALLIRYYLKLLSNK

SEQ ID NO: 2584673 - protein, 23 aa, Entamoeba histolytica
LIFNSILKFFGVRDHNKLTTAQK

SEQ ID NO: 2584674 - protein, 17 aa, Entamoeba histolytica
LIGLIAIVIEQDQSLNT

SEQ ID NO: 2584675 - protein, 19 aa, Entamoeba histolytica
LIHCCLDCILRLIEDILQY

SEQ ID NO: 2584676 - protein, 19 aa, Entamoeba histolytica
LIHCTYCSIVDGMSGGGLI

SEQ ID NO: 2584677 - protein, 31 aa, Entamoeba histolytica; identical to SEQ ID NO: 2386679

SEQ ID NO: 2584678 - protein, 17 aa, Entamoeba histolytica
LIHLCKWGWSNWSIHGV

SEQ ID NO: 2584679 - protein, 20 aa, Entamoeba histolytica
LIHLLLMIEFVFINPTKTQE

SEQ ID NO: 2584680 - protein, 23 aa, Entamoeba histolytica
LIHSFKPIFVLISFSVFGDNSYV

SEQ ID NO: 2584681 - protein, 17 aa, Entamoeba histolytica
LIICLVMILGRHRGFPT

SEQ ID NO: 2584682 - protein, 19 aa, Entamoeba histolytica
LIIEPLEFANYVLTVIINV

SEQ ID NO: 2584683 - protein, 18 aa, Entamoeba histolytica
LIIFFYFAWSYAFTQNFK

SEQ ID NO: 2584684 - protein, 18 aa, Entamoeba histolytica
LIIGCCFVYYTNQINPTE

SEQ ID NO: 2584685 - protein, 25 aa, Entamoeba histolytica
LIIITRTSFFWGRIYKKKERLTLFR

SEQ ID NO: 2584686 - protein, 24 aa, Entamoeba histolytica
LIIKSEELSQCILKSLLKMANSSE

SEQ ID NO: 2584687 - protein, 28 aa, Entamoeba histolytica
LIIMTFLTWFFVSRCWKNKYTESEIPND

SEQ ID NO: 2584688 - protein, 17 aa, Entamoeba histolytica
LIIPLVIVGIILIIVII

SEQ ID NO: 2584689 - protein, 32 aa, Entamoeba histolytica
LIIRKGVACPFKICIIPKCSCFIEEDLIIIVH

SEQ ID NO: 2584690 - protein, 25 aa, Entamoeba histolytica
LIISISLPITVIFLFAKKRNSTYYF

SEQ ID NO: 2584691 - protein, 20 aa, Entamoeba histolytica
LIITEVIPFLVLAIGVDNIF

SEQ ID NO: 2584692 - protein, 25 aa, Entamoeba histolytica
LIITFLLTFFLYRRSFKVTEVSEID

SEQ ID NO: 2584693 - protein, 17 aa, Entamoeba histolytica
LIIVCRMLMIIVVVISY

SEQ ID NO: 2584694 - protein, 24 aa, Entamoeba histolytica
LIKMFNCFLLTLGLAFNFISTTEM

SEQ ID NO: 2584695 - protein, 24 aa, Entamoeba histolytica
LIKTLPKYLTFVIKRFERNTFQGE

SEQ ID NO: 2584696 - protein, 25 aa, Entamoeba histolytica
LIKVLKEVFPLILGDDMIFNDDEFK

SEQ ID NO: 2584697 - protein, 22 aa, Entamoeba histolytica
LILCFVGWYFLTKTQSISSLEL

SEQ ID NO: 2584698 - protein, 22 aa, Entamoeba histolytica
LILECYIVFYMNHFIVYFEGKL

SEQ ID NO: 2584699 - protein, 18 aa, Entamoeba histolytica
LILESVLNPTIILSKNTM

SEQ ID NO: 2584700 - protein, 19 aa, Entamoeba histolytica
LILFCLYFTKYIDGFVLLI

SEQ ID NO: 2584701 - protein, 18 aa, Entamoeba histolytica
LILHSAMFLSEFLLEHDV

SEQ ID NO: 2584702 - protein, 32 aa, Entamoeba histolytica
LILIEIGSLCLMIFCYCYIKPFRKVIKIEPTS

SEQ ID NO: 2584703 - protein, 17 aa, Entamoeba histolytica
LILKALFAMAICHNVTP

SEQ ID NO: 2584704 - protein, 18 aa, Entamoeba histolytica
LILKTKIVYWIYYLLMIL

SEQ ID NO: 2584705 - protein, 17 aa, Entamoeba histolytica
LILKYLLFYWNFFTISP

SEQ ID NO: 2584706 - protein, 23 aa, Entamoeba histolytica
LILLIIGLYCDMVLPRKYGTPES

SEQ ID NO: 2584707 - protein, 24 aa, Entamoeba histolytica
LILLWSSLILFEFLLIVLSIISFF

SEQ ID NO: 2584708 - protein, 22 aa, Entamoeba histolytica
LILSFLLCGIILAPAYVLIYQN

SEQ ID NO: 2584709 - protein, 19 aa, Entamoeba histolytica
LILTPSFYLLILLPPLLLG

SEQ ID NO: 2584710 - protein, 18 aa, Entamoeba histolytica
LILVGAISLLFSIALGPF

SEQ ID NO: 2584711 - protein, 27 aa, Entamoeba histolytica
LILVTIICVLCLIKKKSKYTSIGEETY

SEQ ID NO: 2584712 - protein, 23 aa, Entamoeba histolytica
LILYCGSVELGAWKEIKKYSDII

SEQ ID NO: 2584713 - protein, 19 aa, Entamoeba histolytica
LILYICILILYSQGMGSNW

SEQ ID NO: 2584714 - protein, 23 aa, Entamoeba histolytica
LIMIPSVICIILIIIVIVLLTIY

SEQ ID NO: 2584715 - protein, 18 aa, Entamoeba histolytica
LINILSSFHCCQNQQLDL

SEQ ID NO: 2584716 - protein, 23 aa, Entamoeba histolytica
LIPEGYKGSVYFMTCATGTEIPT

SEQ ID NO: 2584717 - protein, 25 aa, Entamoeba histolytica
LIPIFKVGMTFTYFAPLVFVVCLAI

SEQ ID NO: 2584718 - protein, 26 aa, Entamoeba histolytica
LIPIILDVCGFYKIIQFSFLSVAALV

SEQ ID NO: 2584719 - protein, 27 aa, Entamoeba histolytica
LIPLLYKHIERYLSLRLLSTSSKEQID

SEQ ID NO: 2584720 - protein, 17 aa, Entamoeba histolytica
LIPTLLMFFAISKLLGF

SEQ ID NO: 2584721 - protein, 19 aa, Entamoeba histolytica
LIQHPNWFILVSLTRFMIL

SEQ ID NO: 2584722 - protein, 24 aa, Entamoeba histolytica
LIQINSVVKQYCMLLLPKDFDSYE

SEQ ID NO: 2584723 - protein, 18 aa, Entamoeba histolytica
LIQRCWADEPNKRMTVEE

SEQ ID NO: 2584724 - protein, 24 aa, Entamoeba histolytica
LIQRLELYNSVLINKNLTSFINDV

SEQ ID NO: 2584725 - protein, 25 aa, Entamoeba histolytica
LIRDRITSFCFMIGLCVVWVGGVAM

SEQ ID NO: 2584726 - protein, 19 aa, Entamoeba histolytica
LISCLLSSLDIEYYQQYTR

SEQ ID NO: 2584727 - protein, 23 aa, Entamoeba histolytica
LISDIPKLIAFVIYLVSIALVLF

SEQ ID NO: 2584728 - protein, 18 aa, Entamoeba histolytica
LISEKKDEGYYCSNRKNK

SEQ ID NO: 2584729 - protein, 22 aa, Entamoeba histolytica
LISFVCVVRGIKIYSLPPNTHV

SEQ ID NO: 2584730 - protein, 18 aa, Entamoeba histolytica
LISLFIKKYEIFVQYSVD

SEQ ID NO: 2584731 - protein, 22 aa, Entamoeba histolytica
LISMICLTGFLFINNGYILCTF

SEQ ID NO: 2584732 - protein, 22 aa, Entamoeba histolytica
LISMLCAFLPSLSPVKNEWSIF

SEQ ID NO: 2584733 - protein, 18 aa, Entamoeba histolytica
LISPMCSPEHWLFSQKNV

SEQ ID NO: 2584734 - protein, 17 aa, Entamoeba histolytica
LISRPELYLTVNSIYTL

SEQ ID NO: 2584735 - protein, 21 aa, Entamoeba histolytica
LITKEFYAVFIAFTLFCLISV

SEQ ID NO: 2584736 - protein, 18 aa, Entamoeba histolytica
LITLCLKGFMMSYWVGYS

SEQ ID NO: 2584737 - protein, 19 aa, Entamoeba histolytica
LITWVCVFAVFATIGVFLL

SEQ ID NO: 2584738 - protein, 24 aa, Entamoeba histolytica
LIVFIKDFIKSFILETILNLIIIT

SEQ ID NO: 2584739 - protein, 24 aa, Entamoeba histolytica
LIVFPFCYFIYYLFSITNDASEGG

SEQ ID NO: 2584740 - protein, 17 aa, Entamoeba histolytica
LIVYGGLIGIIIIIVLL

SEQ ID NO: 2584741 - protein, 29 aa, Entamoeba histolytica
LIWYFKKYSFKLGVLLVFFFFGIHFFFLS

SEQ ID NO: 2584742 - protein, 20 aa, Entamoeba histolytica
LIYCVSRWAIVPLVTTANLY

SEQ ID NO: 2584743 - protein, 18 aa, Entamoeba histolytica
LIYLFWLMFAIIRSFSEA

SEQ ID NO: 2584744 - protein, 23 aa, Entamoeba histolytica
LIYPIQRLPRYLLLLETLSKNVP

SEQ ID NO: 2584745 - protein, 17 aa, Entamoeba histolytica
LIYTLPIKAQTELSPKL

SEQ ID NO: 2584746 - protein, 17 aa, Entamoeba histolytica
LKANIVFNNENDNAIAY

SEQ ID NO: 2584747 - protein, 19 aa, Entamoeba histolytica
LKANYDRVICKKDLEFETD

SEQ ID NO: 2584748 - protein, 27 aa, Entamoeba histolytica
LKCFSNWRLVLLFPLALLFGFSRSFYY

SEQ ID NO: 2584749 - protein, 18 aa, Entamoeba histolytica
LKCHECPNYSLNQINDIE

SEQ ID NO: 2584750 - protein, 19 aa, Entamoeba histolytica
LKCLNGYKIENNTCVKDEE

SEQ ID NO: 2584751 - protein, 19 aa, Entamoeba histolytica
LKCLNGYKIENNTCVKDKE

SEQ ID NO: 2584752 - protein, 24 aa, Entamoeba histolytica
LKDELKIIINNCLKNVEERWSLDE

SEQ ID NO: 2584753 - protein, 28 aa, Entamoeba histolytica
LKDKKARLLWFRNYFIGVLISIITNVDL

SEQ ID NO: 2584754 - protein, 21 aa, Entamoeba histolytica
LKDKWRLIYTFFDEKKHEFYD

SEQ ID NO: 2584755 - protein, 18 aa, Entamoeba histolytica
LKDMMEMIDAKFKEYKTK

SEQ ID NO: 2584756 - protein, 18 aa, Entamoeba histolytica
LKDSFIQRLLEAEETELV

SEQ ID NO: 2584757 - protein, 29 aa, Entamoeba histolytica
LKDSKCVFVNSSICLKFTNNHCSYCSFGG

SEQ ID NO: 2584758 - protein, 22 aa, Entamoeba histolytica
LKDTSMPFIENWVGDETIITDS

SEQ ID NO: 2584759 - protein, 20 aa, Entamoeba histolytica
LKDWPFTSFQSWAVDRMAAS

SEQ ID NO: 2584760 - protein, 23 aa, Entamoeba histolytica
LKDYRMIEGLQKLFVEMKESKLQ

SEQ ID NO: 2584761 - protein, 22 aa, Entamoeba histolytica
LKEADVGLAMGIRGTDVAKQAS

SEQ ID NO: 2584762 - protein, 19 aa, Entamoeba histolytica
LKEHCEYVSPFEFYMTINV

SEQ ID NO: 2584763 - protein, 17 aa, Entamoeba histolytica
LKELILQHCELRKIPEN

SEQ ID NO: 2584764 - protein, 24 aa, Entamoeba histolytica
LKELISTIFLPWFNTLRYLKQSFK

SEQ ID NO: 2584765 - protein, 25 aa, Entamoeba histolytica
LKELVPELFKFFSLSITTIQNHSIT

SEQ ID NO: 2584766 - protein, 19 aa, Entamoeba histolytica
LKENYPIFKKWESYSNYIS

SEQ ID NO: 2584767 - protein, 19 aa, Entamoeba histolytica
LKERGSAIITGFGGDPNGN

SEQ ID NO: 2584768 - protein, 26 aa, Entamoeba histolytica
LKERYLLSENIDFLWTENKKEYVFLV

SEQ ID NO: 2584769 - protein, 19 aa, Entamoeba histolytica
LKETKLFFEKTFIKDSPLT

SEQ ID NO: 2584770 - protein, 18 aa, Entamoeba histolytica
LKETTLFVSNHVIHALAY

SEQ ID NO: 2584771 - protein, 18 aa, Entamoeba histolytica
LKEWGRAILVGFDGDPYG

SEQ ID NO: 2584772 - protein, 21 aa, Entamoeba histolytica
LKFIREYVWCLPRVKREILAC

SEQ ID NO: 2584773 - protein, 20 aa, Entamoeba histolytica
LKFTSIISIICIFYTMITII

SEQ ID NO: 2584774 - protein, 24 aa, Entamoeba histolytica
LKGCKQCYIGYVFDTEKKLCVSDE

SEQ ID NO: 2584775 - protein, 18 aa, Entamoeba histolytica
LKGFLILFQKEFIGFDAF

SEQ ID NO: 2584776 - protein, 18 aa, Entamoeba histolytica
LKGFLPNILVIAVCAIES

SEQ ID NO: 2584777 - protein, 19 aa, Entamoeba histolytica
LKGIHKFHVYLNLQVESAL

SEQ ID NO: 2584778 - protein, 20 aa, Entamoeba histolytica
LKGRLKVKFVGEQGIDMGGL

SEQ ID NO: 2584779 - protein, 19 aa, Entamoeba histolytica
LKGSSRCIPKSCGNKKIDT

SEQ ID NO: 2584780 - protein, 17 aa, Entamoeba histolytica
LKHLAFLSPYYLSAISG

SEQ ID NO: 2584781 - protein, 17 aa, Entamoeba histolytica
LKHSIDLIVRLLARLTL

SEQ ID NO: 2584782 - protein, 25 aa, Entamoeba histolytica
LKHSNRFVLFRVIWNNYKHEYIFCT

SEQ ID NO: 2584783 - protein, 17 aa, Entamoeba histolytica
LKIATAVVNSINNSNDQ

SEQ ID NO: 2584784 - protein, 18 aa, Entamoeba histolytica
  misc_feature (15)..(18): Xaa can be any naturally occurring amino acid
LKIIIKLLTRMLLSXXXX

SEQ ID NO: 2584785 - protein, 17 aa, Entamoeba histolytica
LKILISTTIKSNKNVTK

SEQ ID NO: 2584786 - protein, 19 aa, Entamoeba histolytica
LKIPYIVLFHLKQKLTSLL

SEQ ID NO: 2584787 - protein, 18 aa, Entamoeba histolytica
LKIRTSFSNYIIKAKQVI

SEQ ID NO: 2584788 - protein, 18 aa, Entamoeba histolytica
LKISIHFIVFLLSILSFS

SEQ ID NO: 2584789 - protein, 28 aa, Entamoeba histolytica
LKISKYPVLARWCSRKLQFVGFTDNLEE

SEQ ID NO: 2584790 - protein, 17 aa, Entamoeba histolytica
LKKFIVILLSINIVLIA

SEQ ID NO: 2584791 - protein, 19 aa, Entamoeba histolytica
LKKGEAFEAEIYITPLCTC

SEQ ID NO: 2584792 - protein, 21 aa, Entamoeba histolytica
LKKIAPPLGTLMSASKAYEIQ

SEQ ID NO: 2584793 - protein, 21 aa, Entamoeba histolytica
LKKKDIRLFARAVIPDRDPVA

SEQ ID NO: 2584794 - protein, 19 aa, Entamoeba histolytica
LKKKYVFQLFVGNKSLNIC

SEQ ID NO: 2584795 - protein, 19 aa, Entamoeba histolytica
LKKPLGPFYSKPVVDEFEN

SEQ ID NO: 2584796 - protein, 27 aa, Entamoeba histolytica
LKKPYKSIFKWGLILALVNAITNLSNF

SEQ ID NO: 2584797 - protein, 27 aa, Entamoeba histolytica
LKKRRFSWSDGHSFNFSFFKKKKKCSS

SEQ ID NO: 2584798 - protein, 35 aa, Entamoeba histolytica
LKKSSLMKAIFVCYFPRLLMTVPYFIIMIGTETIL

SEQ ID NO: 2584799 - protein, 20 aa, Entamoeba histolytica
LKKTLCYKHGLNGETLSKHN

SEQ ID NO: 2584800 - protein, 20 aa, Entamoeba histolytica
LKLAKQITVSRDFKYNYAPE

SEQ ID NO: 2584801 - protein, 22 aa, Entamoeba histolytica
LKLDPNGGWGDQWNQMKIDNKG

SEQ ID NO: 2584802 - protein, 22 aa, Entamoeba histolytica
LKLHPRSVIGIYLNELPPDINN

SEQ ID NO: 2584803 - protein, 20 aa, Entamoeba histolytica
LKLILQESFALVLEEPQLLF

SEQ ID NO: 2584804 - protein, 21 aa, Entamoeba histolytica
LKLKASETILDMERYHLSTSK

SEQ ID NO: 2584805 - protein, 20 aa, Entamoeba histolytica
LKLKESFETTSLLFESTSIE

SEQ ID NO: 2584806 - protein, 19 aa, Entamoeba histolytica
LKLKRNFIQKKYENVIKQL

SEQ ID NO: 2584807 - protein, 19 aa, Entamoeba histolytica
LKLLPHYKLKIPLRSFFVV

SEQ ID NO: 2584808 - protein, 26 aa, Entamoeba histolytica
LKLNEFKKSTSFSLTGAKKFKYINCD

SEQ ID NO: 2584809 - protein, 25 aa, Entamoeba histolytica
LKLPFKLKIKIMKDIAKGVQFLHYN

SEQ ID NO: 2584810 - protein, 26 aa, Entamoeba histolytica
LKLQRMLNKKAKEFAVQRNELKKEFK

SEQ ID NO: 2584811 - protein, 19 aa, Entamoeba histolytica
LKLRIKLLIDASKGIKYLH

SEQ ID NO: 2584812 - protein, 20 aa, Entamoeba histolytica
LKLVLFILFLVCLIFATVHS

SEQ ID NO: 2584813 - protein, 17 aa, Entamoeba histolytica
LKLYSLRNNELTGNELQ

SEQ ID NO: 2584814 - protein, 32 aa, Entamoeba histolytica; identical to SEQ ID NO: 2386823

SEQ ID NO: 2584815 - protein, 20 aa, Entamoeba histolytica
LKMRCILEKRAVSRDDSYFT

SEQ ID NO: 2584816 - protein, 28 aa, Entamoeba histolytica
LKNCGKIFWNFPRACLTGFLFNFANYFY

SEQ ID NO: 2584817 - protein, 22 aa, Entamoeba histolytica
LKNQQCVACPAGYFQSQNECVE

SEQ ID NO: 2584818 - protein, 19 aa, Entamoeba histolytica
LKNSLRFIGLNSVQAGVQF

SEQ ID NO: 2584819 - protein, 25 aa, Entamoeba histolytica
LKNSYFQKKFCIFPSVSKEITTFFD

SEQ ID NO: 2584820 - protein, 18 aa, Entamoeba histolytica
LKNYWKLYVKGKRLSKGT

SEQ ID NO: 2584821 - protein, 21 aa, Entamoeba histolytica
LKPDNLLLFSFSPKVQFAAKI

SEQ ID NO: 2584822 - protein, 17 aa, Entamoeba histolytica
LKPGTAIQVTFKIKILC

SEQ ID NO: 2584823 - protein, 17 aa, Entamoeba histolytica
LKPGTAIQVTFKIKMLC

SEQ ID NO: 2584824 - protein, 21 aa, Entamoeba histolytica
LKPVWWVCILITIYVIIVALS

SEQ ID NO: 2584825 - protein, 28 aa, Entamoeba histolytica
LKQFSSRLSEWPTYCVLLKDNKNIETHD

SEQ ID NO: 2584826 - protein, 17 aa, Entamoeba histolytica
LKQRLGLSNGLGKEVCV

SEQ ID NO: 2584827 - protein, 23 aa, Entamoeba histolytica
LKQTCTFALLGVKLLGSDAIPSM

SEQ ID NO: 2584828 - protein, 19 aa, Entamoeba histolytica
LKQVLEYFLSLKSNLFVIS

SEQ ID NO: 2584829 - protein, 23 aa, Entamoeba histolytica
LKQVLEYFWSLKSHLFVISPTTL

SEQ ID NO: 2584830 - protein, 21 aa, Entamoeba histolytica
LKRIRELANTYLALQFQYSTI

SEQ ID NO: 2584831 - protein, 20 aa, Entamoeba histolytica
LKRMLYRAITNKIFLIIMAI

SEQ ID NO: 2584832 - protein, 17 aa, Entamoeba histolytica
LKRRDGSGLSPSFLLIL

SEQ ID NO: 2584833 - protein, 25 aa, Entamoeba histolytica
LKRRIVELLYGFSLIGRPTPISVIG

SEQ ID NO: 2584834 - protein, 20 aa, Entamoeba histolytica
LKSAAYIFNEILKVISGNEK

SEQ ID NO: 2584835 - protein, 18 aa, Entamoeba histolytica
LKSAENILTPRLIIHLQP

SEQ ID NO: 2584836 - protein, 17 aa, Entamoeba histolytica
LKSAISLACQFQLLFFI

SEQ ID NO: 2584837 - protein, 17 aa, Entamoeba histolytica
LKSAISLACQFQLLFFT

SEQ ID NO: 2584838 - protein, 17 aa, Entamoeba histolytica
LKSAISVMRESVDREKK

SEQ ID NO: 2584839 - protein, 20 aa, Entamoeba histolytica
LKSLEVESTYTIYVDQNIDN

SEQ ID NO: 2584840 - protein, 19 aa, Entamoeba histolytica
LKSLEVFEKGISVLIKNKE

SEQ ID NO: 2584841 - protein, 20 aa, Entamoeba histolytica
LKSNHGRFTYAIESMSNQKL

SEQ ID NO: 2584842 - protein, 19 aa, Entamoeba histolytica
LKSPHARFTYTRQTIGLFM

SEQ ID NO: 2584843 - protein, 20 aa, Entamoeba histolytica
LKSSMSLPEGFDVIICSFVS

SEQ ID NO: 2584844 - protein, 24 aa, Entamoeba histolytica
LKSVLCVLGSLKFYHPKLVTIKDK

SEQ ID NO: 2584845 - protein, 25 aa, Entamoeba histolytica
LKSVLGVSFSQVFVSNGLYLVGISN

SEQ ID NO: 2584846 - protein, 29 aa, Entamoeba histolytica
LKTGKAFGASNKWKGISVIFDTFQNGKIE

SEQ ID NO: 2584847 - protein, 23 aa, Entamoeba histolytica
LKTKPRYIVDMDSLYPFTKFVTS

SEQ ID NO: 2584848 - protein, 21 aa, Entamoeba histolytica
LKTKYNCLSHIWDIHLRHLSN

SEQ ID NO: 2584849 - protein, 20 aa, Entamoeba histolytica
LKTLKMSYCNKTRIPNLIST

SEQ ID NO: 2584850 - protein, 25 aa, Entamoeba histolytica
LKTQCPSYEAILFPQILNSKQLPNS

SEQ ID NO: 2584851 - protein, 19 aa, Entamoeba histolytica
LKTRIKFMCLRLPSERVWL

SEQ ID NO: 2584852 - protein, 19 aa, Entamoeba histolytica
LKTSIGIPLIDDGCYDGAL

SEQ ID NO: 2584853 - protein, 21 aa, Entamoeba histolytica
LKTTFLRTAQALSYEFSRTMM

SEQ ID NO: 2584854 - protein, 22 aa, Entamoeba histolytica
LKTVPSLIGIVGMISVFHMFAR

SEQ ID NO: 2584855 - protein, 20 aa, Entamoeba histolytica
LKVRLAYFKFLTKLLEGYDE

SEQ ID NO: 2584856 - protein, 23 aa, Entamoeba histolytica
LKWIIRFHPDLVFSRKNPDIENM

SEQ ID NO: 2584857 - protein, 17 aa, Entamoeba histolytica
LKYDLLRSSKPVHLNYT

SEQ ID NO: 2584858 - protein, 19 aa, Entamoeba histolytica
LKYGEQIARTMIVINDLES

SEQ ID NO: 2584859 - protein, 23 aa, Entamoeba histolytica
LKYLCCDPLNCFALFVLTTYTLG

SEQ ID NO: 2584860 - protein, 19 aa, Entamoeba histolytica
LKYVIKRYHHFFIIKTDAA

SEQ ID NO: 2584861 - protein, 20 aa, Entamoeba histolytica
LKYWGTLVIVYWIFFFILLL

SEQ ID NO: 2584862 - protein, 19 aa, Entamoeba histolytica
LKYYLNAYVFKDILKNPPQ

SEQ ID NO: 2584863 - protein, 19 aa, Entamoeba histolytica
LLACVVVGFVYFRRNKQES

SEQ ID NO: 2584864 - protein, 22 aa, Entamoeba histolytica
LLAKRIKHLFLMESLIKLVIKN

SEQ ID NO: 2584865 - protein, 18 aa, Entamoeba histolytica
LLAYSILGLFFEWKIPLK

SEQ ID NO: 2584866 - protein, 18 aa, Entamoeba histolytica
LLCACFSIIAFVLNTLSF

SEQ ID NO: 2584867 - protein, 23 aa, Entamoeba histolytica
LLCCFKYGNVEFDKVLNYIKKIG

SEQ ID NO: 2584868 - protein, 24 aa, Entamoeba histolytica
LLCCIKLHPMIRFIFFIISFLIGL

SEQ ID NO: 2584869 - protein, 23 aa, Entamoeba histolytica
LLCSCKWNWFFYDDCLYVCHCFF

SEQ ID NO: 2584870 - protein, 17 aa, Entamoeba histolytica
LLDPSGFDLKIGNSKSI

SEQ ID NO: 2584871 - protein, 20 aa, Entamoeba histolytica
LLECQNWCYTTLKLILLNPN

SEQ ID NO: 2584872 - protein, 18 aa, Entamoeba histolytica
LLECSDLLSFIATQTNFG

SEQ ID NO: 2584873 - protein, 24 aa, Entamoeba histolytica
LLEEAPTEFSFRIFSKQAIEYAEN

SEQ ID NO: 2584874 - protein, 23 aa, Entamoeba histolytica
LLEKIRCPYIINFIGSVTSSDTL

SEQ ID NO: 2584875 - protein, 24 aa, Entamoeba histolytica
LLELAGKTKNGWGAVINAIELSPK

SEQ ID NO: 2584876 - protein, 18 aa, Entamoeba histolytica
LLELPGFCLTSTRYENYD

SEQ ID NO: 2584877 - protein, 18 aa, Entamoeba histolytica
LLEMSGILTIFVTGAVMS

SEQ ID NO: 2584878 - protein, 17 aa, Entamoeba histolytica
LLENFRSDYIVYFYGSV

SEQ ID NO: 2584879 - protein, 24 aa, Entamoeba histolytica
LLERIDPELGMGHCLLLHFNNDYL

SEQ ID NO: 2584880 - protein, 18 aa, Entamoeba histolytica
LLERKFNNMFRFDNKGLP

SEQ ID NO: 2584881 - protein, 29 aa, Entamoeba histolytica
LLESRVNCFSFTKRYICHNSSLSYNDSKC

SEQ ID NO: 2584882 - protein, 22 aa, Entamoeba histolytica
LLETFTFNGFFCFPFVDYSFLS

SEQ ID NO: 2584883 - protein, 24 aa, Entamoeba histolytica
LLFELVSPCLSKLVKKFWLWCKPY

SEQ ID NO: 2584884 - protein, 19 aa, Entamoeba histolytica
LLFFICFQLGHIIHSIIFQ

SEQ ID NO: 2584885 - protein, 23 aa, Entamoeba histolytica
LLFGFSFNYWWAVISRSINGLVN

SEQ ID NO: 2584886 - protein, 18 aa, Entamoeba histolytica
LLFHCPSLAIKLESKRIN

SEQ ID NO: 2584887 - protein, 25 aa, Entamoeba histolytica
LLFHHRGNVFFRQFIPFYSNTSESI

SEQ ID NO: 2584888 - protein, 19 aa, Entamoeba histolytica
LLFIFKFTLTFVTFSLAHL

SEQ ID NO: 2584889 - protein, 18 aa, Entamoeba histolytica
LLFIIIGFFFPLVWIINY

SEQ ID NO: 2584890 - protein, 24 aa, Entamoeba histolytica
LLFKCSGIIPLFVCQHQGDGKHRE

SEQ ID NO: 2584891 - protein, 17 aa, Entamoeba histolytica
LLFLLIVNLLFFLCELI

SEQ ID NO: 2584892 - protein, 23 aa, Entamoeba histolytica
LLFLSLFLYFYFKKSNIHLNSLS

SEQ ID NO: 2584893 - protein, 18 aa, Entamoeba histolytica
LLFPSLEKCCSLFYRLYL

SEQ ID NO: 2584894 - protein, 18 aa, Entamoeba histolytica
LLGCFSVILSAIFLSHQN

SEQ ID NO: 2584895 - protein, 21 aa, Entamoeba histolytica
LLGIILCCFFPIQFYFNLLDP

SEQ ID NO: 2584896 - protein, 18 aa, Entamoeba histolytica
LLGIPLWYVHVSNVYNIP

SEQ ID NO: 2584897 - protein, 18 aa, Entamoeba histolytica
LLGSVIVGLVLGVLYFVN

SEQ ID NO: 2584898 - protein, 22 aa, Entamoeba histolytica
LLGYCLKQNIDYEARYTKLSSI

SEQ ID NO: 2584899 - protein, 23 aa, Entamoeba histolytica
LLHAAGALGEFWIDDVSMEAVNP

SEQ ID NO: 2584900 - protein, 22 aa, Entamoeba histolytica
LLHLFGELNWWPRKYPVKFNTY

SEQ ID NO: 2584901 - protein, 17 aa, Entamoeba histolytica
LLHSLLFYSKIYPTINT

SEQ ID NO: 2584902 - protein, 24 aa, Entamoeba histolytica
LLHWEYIDKILFLMYCIWTIYVLY

SEQ ID NO: 2584903 - protein, 25 aa, Entamoeba histolytica
LLHYLCLKKIITIHFTFDRQHSSRM

SEQ ID NO: 2584904 - protein, 18 aa, Entamoeba histolytica
LLIADSFINENIIVNEAN

SEQ ID NO: 2584905 - protein, 17 aa, Entamoeba histolytica
LLIEMAKTIGFPKDKRE

SEQ ID NO: 2584906 - protein, 18 aa, Entamoeba histolytica
LLIICLLVGSILLIINII

SEQ ID NO: 2584907 - protein, 18 aa, Entamoeba histolytica
LLIIKCITLLKRIDLISA

SEQ ID NO: 2584908 - protein, 18 aa, Entamoeba histolytica
LLILCLYLLLSNIVICIN

SEQ ID NO: 2584909 - protein, 19 aa, Entamoeba histolytica
LLILGFVIFCICGILECFW

SEQ ID NO: 2584910 - protein, 23 aa, Entamoeba histolytica
LLILKCYPIIQVFVIAFLGIFLI

SEQ ID NO: 2584911 - protein, 19 aa, Entamoeba histolytica
LLINDIKLLLPLSSFISLI

SEQ ID NO: 2584912 - protein, 21 aa, Entamoeba histolytica
LLKAFCIGFVISGTGYFIHLG

SEQ ID NO: 2584913 - protein, 17 aa, Entamoeba histolytica
LLKDSPFNLIIGPGGMT

SEQ ID NO: 2584914 - protein, 24 aa, Entamoeba histolytica
LLKEINPFIKWRLSAIENCKEQTG

SEQ ID NO: 2584915 - protein, 18 aa, Entamoeba histolytica
LLKKALGDNALWVAIGCS

SEQ ID NO: 2584916 - protein, 26 aa, Entamoeba histolytica
LLKKEIKTNILAIGYEYFHFYYSPYF

SEQ ID NO: 2584917 - protein, 25 aa, Entamoeba histolytica
LLKPSEIFVAAAIGIQCVNGDDDWI

SEQ ID NO: 2584918 - protein, 20 aa, Entamoeba histolytica
LLKREIIKAILSVGILIIVW

SEQ ID NO: 2584919 - protein, 32 aa, Entamoeba histolytica
LLKSEIMKPSFKRLLIKGSVVKTAMAQILLKV

SEQ ID NO: 2584920 - protein, 29 aa, Entamoeba histolytica
LLKSQLGGIFSFDAWRYYFNVNTSFVLKK

SEQ ID NO: 2584921 - protein, 19 aa, Entamoeba histolytica
LLKVCCKIESLSDVNKMNE

SEQ ID NO: 2584922 - protein, 19 aa, Entamoeba histolytica
LLLASLKCFSNWRLVLLFP

SEQ ID NO: 2584923 - protein, 23 aa, Entamoeba histolytica
LLLELFPQFPPKVLHSREISDWC

SEQ ID NO: 2584924 - protein, 17 aa, Entamoeba histolytica
LLLELTVGTELQNPKYS

SEQ ID NO: 2584925 - protein, 19 aa, Entamoeba histolytica
LLLHPDWNRSLFKIDTEIQ

SEQ ID NO: 2584926 - protein, 32 aa, Entamoeba histolytica
LLLIFPRFFRIKGLIPCNKWCVKYSNNVGSLF

SEQ ID NO: 2584927 - protein, 19 aa, Entamoeba histolytica
LLLLKCFILGFSVSGIGYF

SEQ ID NO: 2584928 - protein, 18 aa, Entamoeba histolytica
LLLPDVINLITLLILTTN

SEQ ID NO: 2584929 - protein, 17 aa, Entamoeba histolytica
LLLRLLLILWTLCVIFP

SEQ ID NO: 2584930 - protein, 23 aa, Entamoeba histolytica
LLLTLISYCFGETLCQKETDNNA

SEQ ID NO: 2584931 - protein, 17 aa, Entamoeba histolytica
LLLTYPIIFHQFLTELS

SEQ ID NO: 2584932 - protein, 17 aa, Entamoeba histolytica
LLMGMIICSEVCYIIGC

SEQ ID NO: 2584933 - protein, 19 aa, Entamoeba histolytica
LLMKIMFNLTFPFVILKAL

SEQ ID NO: 2584934 - protein, 23 aa, Entamoeba histolytica
LLNEMKYYYSFICHTQIFERIEI

SEQ ID NO: 2584935 - protein, 26 aa, Entamoeba histolytica
LLNGKLRFGNIYGFSIIASFVEYLVM

SEQ ID NO: 2584936 - protein, 25 aa, Entamoeba histolytica
LLNKKFKISFSIIFTTLILFFICVC

SEQ ID NO: 2584937 - protein, 24 aa, Entamoeba histolytica
LLNNFRHEWLLSFLGLIGGIGAGA

SEQ ID NO: 2584938 - protein, 29 aa, Entamoeba histolytica
LLNNICTIQNAFVLLKLFFLFLPSPIIPF

SEQ ID NO: 2584939 - protein, 19 aa, Entamoeba histolytica
LLNNWFNLLFLHWSSDVRK

SEQ ID NO: 2584940 - protein, 32 aa, Entamoeba histolytica
LLNPLNFYFYPEFEISDSKPFIFAPHGEGTFV

SEQ ID NO: 2584941 - protein, 19 aa, Entamoeba histolytica
LLNPSCKDYLYVDLNDGSA

SEQ ID NO: 2584942 - protein, 18 aa, Entamoeba histolytica
LLNSLSWKYITQLLNNVI

SEQ ID NO: 2584943 - protein, 20 aa, Entamoeba histolytica
LLPSCCGVAITMETIFVNQK

SEQ ID NO: 2584944 - protein, 17 aa, Entamoeba histolytica
LLPSEFIEGFICCLFMV

SEQ ID NO: 2584945 - protein, 23 aa, Entamoeba histolytica
LLQLLRSSFLINVDKTIREKPIK

SEQ ID NO: 2584946 - protein, 17 aa, Entamoeba histolytica
LLQQFGICYILTKQFAA

SEQ ID NO: 2584947 - protein, 23 aa, Entamoeba histolytica
LLQSRINVLLLLKSINGENRDVD

SEQ ID NO: 2584948 - protein, 18 aa, Entamoeba histolytica
LLQWKRLVQQEIGDGIIS

SEQ ID NO: 2584949 - protein, 18 aa, Entamoeba histolytica
LLRCPKCGKVADKYIEYD

SEQ ID NO: 2584950 - protein, 21 aa, Entamoeba histolytica
LLRNFKTPQYFIGKTGTEVEK

SEQ ID NO: 2584951 - protein, 17 aa, Entamoeba histolytica
LLRRRKIKQEKEMEEDE

SEQ ID NO: 2584952 - protein, 18 aa, Entamoeba histolytica
LLRVCPKGSINTAVECEM

SEQ ID NO: 2584953 - protein, 17 aa, Entamoeba histolytica
LLSHYCISHYLDIIPAK

SEQ ID NO: 2584954 - protein, 17 aa, Entamoeba histolytica
LLSKIIHSCWEHEEYRS

SEQ ID NO: 2584955 - protein, 17 aa, Entamoeba histolytica
LLSKLRNPFVVNYVGSV

SEQ ID NO: 2584956 - protein, 18 aa, Entamoeba histolytica
LLSLCLIFSVPFELEIAC

SEQ ID NO: 2584957 - protein, 25 aa, Entamoeba histolytica
LLSLCNRFSLQITFLESLLDLDYSN

SEQ ID NO: 2584958 - protein, 23 aa, Entamoeba histolytica
LLSLHSLCFTRYTPCYWRSVLGF

SEQ ID NO: 2584959 - protein, 18 aa, Entamoeba histolytica
LLSQYPIYPWVISTFSED

SEQ ID NO: 2584960 - protein, 26 aa, Entamoeba histolytica
LLSSCGEAPCLTRCVSHLIPRVNRLC

SEQ ID NO: 2584961 - protein, 24 aa, Entamoeba histolytica
LLSTESFIPCIFILEKQWKKLNKK

SEQ ID NO: 2584962 - protein, 21 aa, Entamoeba histolytica
LLSTYCYIGIFASSAEYLIGS

SEQ ID NO: 2584963 - protein, 17 aa, Entamoeba histolytica
LLTALLKVCCKIESLSD

SEQ ID NO: 2584964 - protein, 19 aa, Entamoeba histolytica
LLTEIKKDISLSFEETKTM

SEQ ID NO: 2584965 - protein, 23 aa, Entamoeba histolytica
LLTHIRKALLLFSRYPNTFIPNT

SEQ ID NO: 2584966 - protein, 27 aa, Entamoeba histolytica
LLTHIRKALLLFSRYPYGFIPNSAAIY

SEQ ID NO: 2584967 - protein, 19 aa, Entamoeba histolytica
LLTQLKVLYLNKIIKSVDV

SEQ ID NO: 2584968 - protein, 19 aa, Entamoeba histolytica
LLTTRVGGLGLNLTAADIV

SEQ ID NO: 2584969 - protein, 18 aa, Entamoeba histolytica
LLVISFVVALLLIITYFT

SEQ ID NO: 2584970 - protein, 28 aa, Entamoeba histolytica
LLVLRLDRVFMFPGIIPFLFFSVSIITK

SEQ ID NO: 2584971 - protein, 17 aa, Entamoeba histolytica
LLVRLLIHFISVMDDKQ

SEQ ID NO: 2584972 - protein, 24 aa, Entamoeba histolytica
LLVRSVRTGMRYVQEYDLIKDPTT

SEQ ID NO: 2584973 - protein, 18 aa, Entamoeba histolytica
LLWAGCGITFSRCIPDRE

SEQ ID NO: 2584974 - protein, 26 aa, Entamoeba histolytica
LLYDSEFQLPMGFPLFQPVTYGYAHK

SEQ ID NO: 2584975 - protein, 21 aa, Entamoeba histolytica
LLYIHCGYIVIGDIGMGEPVY

SEQ ID NO: 2584976 - protein, 22 aa, Entamoeba histolytica
LLYKEVKGALKNSIKHSGNSQF

SEQ ID NO: 2584977 - protein, 21 aa, Entamoeba histolytica
LLYNLIVLCLKYFGILLSPSL

SEQ ID NO: 2584978 - protein, 20 aa, Entamoeba histolytica
LLYPFIWQGVLIPFVPVQLQ

SEQ ID NO: 2584979 - protein, 26 aa, Entamoeba histolytica
LLYPSVSCKAVIMLILYSYSKQFDRT

SEQ ID NO: 2584980 - protein, 17 aa, Entamoeba histolytica
LLYWRNYPPSIIGMMVM

SEQ ID NO: 2584981 - protein, 24 aa, Entamoeba histolytica
LMAFPGFIVSFLLVDRIGRKPLQL

SEQ ID NO: 2584982 - protein, 23 aa, Entamoeba histolytica
LMCSAYGSLWAYVATCVSTLSTL

SEQ ID NO: 2584983 - protein, 23 aa, Entamoeba histolytica
LMDEWKNSTSIIYHQNTINELLP

SEQ ID NO: 2584984 - protein, 18 aa, Entamoeba histolytica
LMDLKATYYGLVKRQSME

SEQ ID NO: 2584985 - protein, 18 aa, Entamoeba histolytica
LMESWRRSIIFSEKLKQI

SEQ ID NO: 2584986 - protein, 20 aa, Entamoeba histolytica
LMFPLCGWMGLIFAIIFWLS

SEQ ID NO: 2584987 - protein, 21 aa, Entamoeba histolytica
LMFPLMLQFIVAWVKEDEPKK

SEQ ID NO: 2584988 - protein, 23 aa, Entamoeba histolytica
LMFTQCVLVVFIAPIAIYMQLTN

SEQ ID NO: 2584989 - protein, 22 aa, Entamoeba histolytica
LMILSFLSFILLILFSLVVLLQ

SEQ ID NO: 2584990 - protein, 19 aa, Entamoeba histolytica
LMIMLMLNFNGIGMESIEI

SEQ ID NO: 2584991 - protein, 18 aa, Entamoeba histolytica
LMKHPRKPTEIVVYTDSY

SEQ ID NO: 2584992 - protein, 21 aa, Entamoeba histolytica
LMKKVCPTIMLGIPRIYEKII

SEQ ID NO: 2584993 - protein, 17 aa, Entamoeba histolytica
LMKRLRNPYIIGYIGSV

SEQ ID NO: 2584994 - protein, 25 aa, Entamoeba histolytica
LMKSLRHPCILQFFGSGMDNNFMLI

SEQ ID NO: 2584995 - protein, 23 aa, Entamoeba histolytica
LMKVRICQDIAIGMGYLHQNDII

SEQ ID NO: 2584996 - protein, 19 aa, Entamoeba histolytica
LMLCIKEGLHIYYYIHYNM

SEQ ID NO: 2584997 - protein, 15 aa, Entamoeba histolytica
LMMQNILHLFSFLII

SEQ ID NO: 2584998 - protein, 20 aa, Entamoeba histolytica
LMNGCISYFASFLFAIIIFK

SEQ ID NO: 2584999 - protein, 18 aa, Entamoeba histolytica
LMNLRVPFLKDASMESYG

SEQ ID NO: 2585000 - protein, 18 aa, Entamoeba histolytica
LMNMSTYFFWLVVPLLMQ

SEQ ID NO: 2585001 - protein, 17 aa, Entamoeba histolytica
LMNQLSILRANNELLYY

SEQ ID NO: 2585002 - protein, 24 aa, Entamoeba histolytica
LMPREMYVKLLAYVSIYYKMIVVW

SEQ ID NO: 2585003 - protein, 17 aa, Entamoeba histolytica
LMQCIMLTLFAIPLDKI

SEQ ID NO: 2585004 - protein, 20 aa, Entamoeba histolytica
LMQFRGIIMPQLYNQAKEVN

SEQ ID NO: 2585005 - protein, 28 aa, Entamoeba histolytica
LMQYKSLFNRYSRRSIEHGIAIIQDGVE

SEQ ID NO: 2585006 - protein, 17 aa, Entamoeba histolytica
LMSCVYGSCDLNCIKCE

SEQ ID NO: 2585007 - protein, 18 aa, Entamoeba histolytica
LMSITFFVLCCITAFWML

SEQ ID NO: 2585008 - protein, 18 aa, Entamoeba histolytica
LMSKALIKINAYEQMKRM

SEQ ID NO: 2585009 - protein, 17 aa, Entamoeba histolytica
LMSQEFEKEMSIGLLWF

SEQ ID NO: 2585010 - protein, 25 aa, Entamoeba histolytica
LMTIQKIPVVWARAIVEASEAIDSR

SEQ ID NO: 2585011 - protein, 17 aa, Entamoeba histolytica
LMVCIPGIIVYELMLII

SEQ ID NO: 2585012 - protein, 23 aa, Entamoeba histolytica
LMVKLEVASIFPLITGNAHVVTQ

SEQ ID NO: 2585013 - protein, 20 aa, Entamoeba histolytica
LMYETFKWDRPYPENVFKYP

SEQ ID NO: 2585014 - protein, 26 aa, Entamoeba histolytica
LMYLLKEIFNFIVIVFAFMGGLLIYS

SEQ ID NO: 2585015 - protein, 18 aa, Entamoeba histolytica
LMYMFGVLCDRKPGVAKG

SEQ ID NO: 2585016 - protein, 19 aa, Entamoeba histolytica
LNAACKLESDLFKLTSTIL

SEQ ID NO: 2585017 - protein, 17 aa, Entamoeba histolytica
LNAILILPVQHGASQGE

SEQ ID NO: 2585018 - protein, 36 aa, Entamoeba histolytica
LNALWKLWDYLLLSEDPCFFVFILTALFLLKEHTLG

SEQ ID NO: 2585019 - protein, 18 aa, Entamoeba histolytica
LNCQLSTKSSDNSAKQTI

SEQ ID NO: 2585020 - protein, 25 aa, Entamoeba histolytica
LNCVKIPKMHNGFILLNIANYLHYI

SEQ ID NO: 2585021 - protein, 18 aa, Entamoeba histolytica
LNDMNGIIISNSYKGCLI

SEQ ID NO: 2585022 - protein, 29 aa, Entamoeba histolytica
LNDSFRIWCIWCIVVFFSPFIIIQLYFTV

SEQ ID NO: 2585023 - protein, 19 aa, Entamoeba histolytica
LNDSIPWKAPEVLTGNKPT

SEQ ID NO: 2585024 - protein, 23 aa, Entamoeba histolytica
LNDSRFSFNREFIGCATSGWFDH

SEQ ID NO: 2585025 - protein, 22 aa, Entamoeba histolytica
LNDYFPPCEKVIEIGNNESIWN

SEQ ID NO: 2585026 - protein, 27 aa, Entamoeba histolytica
LNEEWYKHPWCIITSLFCHSSISQIIY

SEQ ID NO: 2585027 - protein, 23 aa, Entamoeba histolytica
LNEIILRILVERSFGEYRQVGAL

SEQ ID NO: 2585028 - protein, 18 aa, Entamoeba histolytica
LNELIKFDFIDSPDNEIS

SEQ ID NO: 2585029 - protein, 19 aa, Entamoeba histolytica
LNEMEWYCAVFVFQQKNNE

SEQ ID NO: 2585030 - protein, 25 aa, Entamoeba histolytica
LNEMKWKKPLTIKRFITVLITIVLL

SEQ ID NO: 2585031 - protein, 25 aa, Entamoeba histolytica
LNENRRAVGYLSLLNSMGYTIILKR

SEQ ID NO: 2585032 - protein, 19 aa, Entamoeba histolytica
LNEYPQLTNIMQWKFDLYH

SEQ ID NO: 2585033 - protein, 26 aa, Entamoeba histolytica
LNEYPYPWSISKFVCVGRRLPQPSDM

SEQ ID NO: 2585034 - protein, 26 aa, Entamoeba histolytica
LNFILPVNCYSSWINLALLIILKSPF

SEQ ID NO: 2585035 - protein, 25 aa, Entamoeba histolytica
LNFKEGKISLSFSIVNLINIVSTSS

SEQ ID NO: 2585036 - protein, 19 aa, Entamoeba histolytica
LNFKESDCQGFTDLTDYTL

SEQ ID NO: 2585037 - protein, 17 aa, Entamoeba histolytica
LNGDKWKGVLEAIIQLE

SEQ ID NO: 2585038 - protein, 17 aa, Entamoeba histolytica
LNGECWIIANSILLEGS

SEQ ID NO: 2585039 - protein, 25 aa, Entamoeba histolytica
LNGGPDVWKGISILINTNENNKQNN

SEQ ID NO: 2585040 - protein, 18 aa, Entamoeba histolytica
LNGLKYLHSNGVVHGNVS

SEQ ID NO: 2585041 - protein, 21 aa, Entamoeba histolytica
LNHKECFTLNGILLEPPFVSF

SEQ ID NO: 2585042 - protein, 17 aa, Entamoeba histolytica
LNHNVFLMVLKKFVNTE

SEQ ID NO: 2585043 - protein, 38 aa, Entamoeba histolytica
LNIIPWELLEPFKNCVRYFSFSGIERINSSKISPEAPP

SEQ ID NO: 2585044 - protein, 17 aa, Entamoeba histolytica
LNIKWLRNQIGIVGQEP

SEQ ID NO: 2585045 - protein, 17 aa, Entamoeba histolytica
LNIKWLRNQIGLVGQEP

SEQ ID NO: 2585046 - protein, 18 aa, Entamoeba histolytica
LNIKWLRNQIGLVGQEPV

SEQ ID NO: 2585047 - protein, 17 aa, Entamoeba histolytica
LNIKWLRNQIGLVGQES

SEQ ID NO: 2585048 - protein, 23 aa, Entamoeba histolytica
LNIVTFPFLFGIMFSDAGHGIFI

SEQ ID NO: 2585049 - protein, 18 aa, Entamoeba histolytica
LNIYDNLPLINSRIDQAI

SEQ ID NO: 2585050 - protein, 20 aa, Entamoeba histolytica
LNKFSVPWFDLRGNHDVDGV

SEQ ID NO: 2585051 - protein, 18 aa, Entamoeba histolytica
LNKKRLIYTLPIKAQTEL

SEQ ID NO: 2585052 - protein, 17 aa, Entamoeba histolytica
LNLEYSFQPFNDIKLVS

SEQ ID NO: 2585053 - protein, 20 aa, Entamoeba histolytica
LNLFPYKSLYEENSNPQSQQ

SEQ ID NO: 2585054 - protein, 17 aa, Entamoeba histolytica
LNLKWLRNQIGLVGQEP

SEQ ID NO: 2585055 - protein, 17 aa, Entamoeba histolytica
LNLLRYYIGGFLMNMST

SEQ ID NO: 2585056 - protein, 18 aa, Entamoeba histolytica
LNLYKEGFDTVGMDDYPV

SEQ ID NO: 2585057 - protein, 26 aa, Entamoeba histolytica
LNNKCLKCKYGTYPLGKECFQCNTIT

SEQ ID NO: 2585058 - protein, 25 aa, Entamoeba histolytica
LNQLMPVVMSWKDVFLYLIDMVQHK

SEQ ID NO: 2585059 - protein, 17 aa, Entamoeba histolytica
LNSCIAFGTVNLASPHD

SEQ ID NO: 2585060 - protein, 26 aa, Entamoeba histolytica
LNSNDWKQRLAFLTALNAAINSKKSS

SEQ ID NO: 2585061 - protein, 19 aa, Entamoeba histolytica
LNSPCGFVKTVGHSGGEDF

SEQ ID NO: 2585062 - protein, 18 aa, Entamoeba histolytica
LNTYKNRYVNGFSGDECT

SEQ ID NO: 2585063 - protein, 19 aa, Entamoeba histolytica
LNVFPKIEFNIIPKELIQI

SEQ ID NO: 2585064 - protein, 25 aa, Entamoeba histolytica
LNVPLQFVCCGVFQLICDGILVSQI

SEQ ID NO: 2585065 - protein, 17 aa, Entamoeba histolytica
LNVYYCWALGYHFHSLV

SEQ ID NO: 2585066 - protein, 30 aa, Entamoeba histolytica
LNYYLMHFLFFTALCFVGAIIMILIDSNIN

SEQ ID NO: 2585067 - protein, 18 aa, Entamoeba histolytica
LPCQFCGMNAISIDNGTK

SEQ ID NO: 2585068 - protein, 18 aa, Entamoeba histolytica
LPDAYIPIWRYIVYGIAM

SEQ ID NO: 2585069 - protein, 19 aa, Entamoeba histolytica
LPDYFLKEGNCYTCYKCKS

SEQ ID NO: 2585070 - protein, 24 aa, Entamoeba histolytica
LPELCIGILGLIFMKYYSTSSSLI

SEQ ID NO: 2585071 - protein, 17 aa, Entamoeba histolytica
LPELKWNRIILKPDHPK

SEQ ID NO: 2585072 - protein, 20 aa, Entamoeba histolytica
LPESRPLFDEIIDILTDLIE

SEQ ID NO: 2585073 - protein, 19 aa, Entamoeba histolytica
LPFFVQFPMCLFTAEMSLS

SEQ ID NO: 2585074 - protein, 19 aa, Entamoeba histolytica
LPFIDEFHINNDIFDKLCL

SEQ ID NO: 2585075 - protein, 26 aa, Entamoeba histolytica
LPFILPYCYFSFIIVLVETIILWSVI

SEQ ID NO: 2585076 - protein, 17 aa, Entamoeba histolytica
LPFSALQDVIDYERLLI

SEQ ID NO: 2585077 - protein, 21 aa, Entamoeba histolytica
LPFSRSFDIPDVWPTGKPSCI

SEQ ID NO: 2585078 - protein, 22 aa, Entamoeba histolytica
LPFTYRYQYIIWGYFIVTTLCV

SEQ ID NO: 2585079 - protein, 24 aa, Entamoeba histolytica
LPGGKCAICKVGYYNLNSDCYECS

SEQ ID NO: 2585080 - protein, 19 aa, Entamoeba histolytica
LPGNVPLLILLGIICLLFA

SEQ ID NO: 2585081 - protein, 22 aa, Entamoeba histolytica
LPHFLWCWGCMTFVKNDMVNEN

SEQ ID NO: 2585082 - protein, 19 aa, Entamoeba histolytica
LPICVWTFCHFAKETAFMS

SEQ ID NO: 2585083 - protein, 23 aa, Entamoeba histolytica
LPKRSECGILCGFWVNERGVFDE

SEQ ID NO: 2585084 - protein, 21 aa, Entamoeba histolytica
LPKTEYYAFVSIEDLTTFDIT

SEQ ID NO: 2585085 - protein, 24 aa, Entamoeba histolytica
LPKTLCDFSYCIVYLLTSFYPVLL

SEQ ID NO: 2585086 - protein, 17 aa, Entamoeba histolytica
LPKTWKRYLPVLFGVFW

SEQ ID NO: 2585087 - protein, 17 aa, Entamoeba histolytica
LPLAVTVSLAYSMKQMM

SEQ ID NO: 2585088 - protein, 19 aa, Entamoeba histolytica
LPLCCSLLIPFILQITISW

SEQ ID NO: 2585089 - protein, 18 aa, Entamoeba histolytica
LPLDDSIPLLFKELIQEC

SEQ ID NO: 2585090 - protein, 17 aa, Entamoeba histolytica
LPLFIFIIFPRKPRYKN

SEQ ID NO: 2585091 - protein, 23 aa, Entamoeba histolytica
LPLFKILPIQSFAILLQVISTII

SEQ ID NO: 2585092 - protein, 23 aa, Entamoeba histolytica
LPLICLPIVIIISIICLGTVPLL

SEQ ID NO: 2585093 - protein, 24 aa, Entamoeba histolytica
LPLLKFAVFCIEWVIKHRVPSLTK

SEQ ID NO: 2585094 - protein, 20 aa, Entamoeba histolytica
LPLNVFYSCLLLYKHFYIIQ

SEQ ID NO: 2585095 - protein, 19 aa, Entamoeba histolytica
LPLSEHIDELIPIFNIFAN

SEQ ID NO: 2585096 - protein, 17 aa, Entamoeba histolytica
LPMKFAKLFTVGNILIL

SEQ ID NO: 2585097 - protein, 25 aa, Entamoeba histolytica
LPMLIKDGCKFIFCCKKPSPEPFYE

SEQ ID NO: 2585098 - protein, 17 aa, Entamoeba histolytica
LPNELKLTCNLMGVSSQ

SEQ ID NO: 2585099 - protein, 25 aa, Entamoeba histolytica
LPNKDFRFSTEFEYGGSKSDKKVLN

SEQ ID NO: 2585100 - protein, 21 aa, Entamoeba histolytica
LPNKKGYHLFSYDEEGNSPNA

SEQ ID NO: 2585101 - protein, 24 aa, Entamoeba histolytica
LPNQIESIFLYIINSCCEKEFIMN

SEQ ID NO: 2585102 - protein, 22 aa, Entamoeba histolytica
LPNRDLKKGFKSLLQMNSDKVF

SEQ ID NO: 2585103 - protein, 17 aa, Entamoeba histolytica
LPNTFILELPNIPIIAT

SEQ ID NO: 2585104 - protein, 22 aa, Entamoeba histolytica
LPNVDYHVFFGFSSKFEAGTLP

SEQ ID NO: 2585105 - protein, 20 aa, Entamoeba histolytica
LPNYYCEQALEIQSIPYSDI

SEQ ID NO: 2585106 - protein, 17 aa, Entamoeba histolytica
LPPEIYPTPTIVKQSNT

SEQ ID NO: 2585107 - protein, 20 aa, Entamoeba histolytica
LPPFRIKIHFHYQINVWYLI

SEQ ID NO: 2585108 - protein, 18 aa, Entamoeba histolytica
LPPKIKEINETTSNKFFE

SEQ ID NO: 2585109 - protein, 18 aa, Entamoeba histolytica
LPPLKIVAFEGIFGLIET

SEQ ID NO: 2585110 - protein, 24 aa, Entamoeba histolytica
LPPSSLRLDAEWLLNNIASHQMDN

SEQ ID NO: 2585111 - protein, 18 aa, Entamoeba histolytica
LPQHPEMGKALYDIITNS

SEQ ID NO: 2585112 - protein, 21 aa, Entamoeba histolytica
LPQIFCLIAIGFRYCKKDIIF

SEQ ID NO: 2585113 - protein, 20 aa, Entamoeba histolytica
LPRHLLVAFLYDASCFFYWI

SEQ ID NO: 2585114 - protein, 17 aa, Entamoeba histolytica
LPSAQWVMYALLMDIIK

SEQ ID NO: 2585115 - protein, 21 aa, Entamoeba histolytica
LPSCSYFSPLFGEIPFVAITP

SEQ ID NO: 2585116 - protein, 28 aa, Entamoeba histolytica
LPSHLKFEQGVCCAMETLLKIFISTCEY

SEQ ID NO: 2585117 - protein, 17 aa, Entamoeba histolytica
LPSIAFLIIYSEVPVTV

SEQ ID NO: 2585118 - protein, 20 aa, Entamoeba histolytica
LPSIFIRMILQAILISLYPK

SEQ ID NO: 2585119 - protein, 26 aa, Entamoeba histolytica
LPSLFKKRLPGIEVLYPNLMVTMERY

SEQ ID NO: 2585120 - protein, 22 aa, Entamoeba histolytica
LPSLSQRMVCFFLFILSCYPFS

SEQ ID NO: 2585121 - protein, 22 aa, Entamoeba histolytica
LPSLSQRMVCFFLFILSCYSFS

SEQ ID NO: 2585122 - protein, 23 aa, Entamoeba histolytica
LPTFLKECMAYAISILTNSIPIT

SEQ ID NO: 2585123 - protein, 17 aa, Entamoeba histolytica
LPTLQWTMIITYSLDFS

SEQ ID NO: 2585124 - protein, 18 aa, Entamoeba histolytica
LPTQCPNGDLVIDPSQDD

SEQ ID NO: 2585125 - protein, 20 aa, Entamoeba histolytica
LPTSNIILFEIISKICMLEI

SEQ ID NO: 2585126 - protein, 28 aa, Entamoeba histolytica
LPTTRLYVIGKIHFKSVLFPQTNVIHWF

SEQ ID NO: 2585127 - protein, 26 aa, Entamoeba histolytica
LPVIPDYLICPSLPTLQWTMIITYSL

SEQ ID NO: 2585128 - protein, 23 aa, Entamoeba histolytica
LPVKLLKDIIFKCQLRVESPLTL

SEQ ID NO: 2585129 - protein, 26 aa, Entamoeba histolytica
LPVKSSEILPQFECLSNKGVISKNNK

SEQ ID NO: 2585130 - protein, 20 aa, Entamoeba histolytica
LPWRVFIYKFLNTIVDDLFA

SEQ ID NO: 2585131 - protein, 20 aa, Entamoeba histolytica
LPYFRTVTVFGLFPASYIIW

SEQ ID NO: 2585132 - protein, 24 aa, Entamoeba histolytica
LPYKLKIKMLFDTARGMQFLHENR

SEQ ID NO: 2585133 - protein, 29 aa, Entamoeba histolytica
LPYKLKLKIMRDVECGLHYLHESKLLHNN

SEQ ID NO: 2585134 - protein, 17 aa, Entamoeba histolytica
LPYLFVVLFAIGMTLAV

SEQ ID NO: 2585135 - protein, 23 aa, Entamoeba histolytica
LPYLLRFDFLNILRDFDYLYEKD

SEQ ID NO: 2585136 - protein, 26 aa, Entamoeba histolytica
LPYSIPRLSCLDNRCGNGIIDETEEC

SEQ ID NO: 2585137 - protein, 25 aa, Entamoeba histolytica
LQCHKKCSIKYLFNVPIYAKGIEFN

SEQ ID NO: 2585138 - protein, 19 aa, Entamoeba histolytica
LQDKGMMIINAFLLTLFFI

SEQ ID NO: 2585139 - protein, 23 aa, Entamoeba histolytica
LQECFYNILPYNVYFDYYSHSSN

SEQ ID NO: 2585140 - protein, 25 aa, Entamoeba histolytica
LQEVCKTWDGLYCVECKEGYYIEQM

SEQ ID NO: 2585141 - protein, 19 aa, Entamoeba histolytica
LQFGLCYLIFPIVQTYSIV

SEQ ID NO: 2585142 - protein, 22 aa, Entamoeba histolytica
LQGSPIFGCTECEKGYYFGLDY

SEQ ID NO: 2585143 - protein, 18 aa, Entamoeba histolytica
LQILPKIDLEIMYFTINN

SEQ ID NO: 2585144 - protein, 24 aa, Entamoeba histolytica
LQIPKEFVSLMVILIFVVSGRIKN

SEQ ID NO: 2585145 - protein, 18 aa, Entamoeba histolytica
LQKCIELSLDEGVRRNKS

SEQ ID NO: 2585146 - protein, 18 aa, Entamoeba histolytica
LQKCIELSLNEGVRRNKS

SEQ ID NO: 2585147 - protein, 18 aa, Entamoeba histolytica
LQKKGRFNGLQLMNGLLV

SEQ ID NO: 2585148 - protein, 24 aa, Entamoeba histolytica
LQKKLREKARMEVMKEIKAKEAKT

SEQ ID NO: 2585149 - protein, 17 aa, Entamoeba histolytica
LQKRPVYRHLLFNHDES

SEQ ID NO: 2585150 - protein, 23 aa, Entamoeba histolytica
LQLFSCIYMPIIILTIVGLPLTT

SEQ ID NO: 2585151 - protein, 26 aa, Entamoeba histolytica
LQLLMFSAALIKFKPKYDPFKLVKPV

SEQ ID NO: 2585152 - protein, 18 aa, Entamoeba histolytica
LQLSLDYLKSVKCNDLRF

SEQ ID NO: 2585153 - protein, 18 aa, Entamoeba histolytica
LQLYLGVYVSLMLLLWGC

SEQ ID NO: 2585154 - protein, 19 aa, Entamoeba histolytica
LQNSLKLYYQRAFEAKKLK

SEQ ID NO: 2585155 - protein, 24 aa, Entamoeba histolytica
LQPGCLRGNSKECFKCVNNKKIEG

SEQ ID NO: 2585156 - protein, 19 aa, Entamoeba histolytica
LQPQICLRCNKNCKKCNSH

SEQ ID NO: 2585157 - protein, 18 aa, Entamoeba histolytica
LQPYSLKELDIFFDKEDI

SEQ ID NO: 2585158 - protein, 23 aa, Entamoeba histolytica
LQQAYSWSSYLFVLQAILILGMS

SEQ ID NO: 2585159 - protein, 17 aa, Entamoeba histolytica
LQQSAALAFFWSPCESL

SEQ ID NO: 2585160 - protein, 24 aa, Entamoeba histolytica
LQQSGFKKRFVKYFNGITENEQFI

SEQ ID NO: 2585161 - protein, 18 aa, Entamoeba histolytica
LQQVMKHPFVKAALDNTK

SEQ ID NO: 2585162 - protein, 27 aa, Entamoeba histolytica
LQRRCVIRMKNIHWEKINGVKEVDYDH

SEQ ID NO: 2585163 - protein, 28 aa, Entamoeba histolytica
LQRRCVIRMKNIHWEKINGVKEVDYDHQ

SEQ ID NO: 2585164 - protein, 24 aa, Entamoeba histolytica
LQSEAFKAFVHFTITIANDHCVPL

SEQ ID NO: 2585165 - protein, 22 aa, Entamoeba histolytica
LQSFSFDFLGLAGWALDLLGYS

SEQ ID NO: 2585166 - protein, 18 aa, Entamoeba histolytica
LQSHCVQCGESISKYTLV

SEQ ID NO: 2585167 - protein, 17 aa, Entamoeba histolytica
LQSISFIMNCFSERVVP

SEQ ID NO: 2585168 - protein, 23 aa, Entamoeba histolytica
LQSKEFLQPFLIAKPINIFIPRP

SEQ ID NO: 2585169 - protein, 17 aa, Entamoeba histolytica
LQSLKIVLFSNSQNYTF

SEQ ID NO: 2585170 - protein, 23 aa, Entamoeba histolytica
LQSLPINIVIAVMKLCASFMAVG

SEQ ID NO: 2585171 - protein, 27 aa, Entamoeba histolytica
LQVGYRFTYTMPLAFVVILAMAKDAYD

SEQ ID NO: 2585172 - protein, 17 aa, Entamoeba histolytica
LQVPIHFDRMDSSKSNK

SEQ ID NO: 2585173 - protein, 17 aa, Entamoeba histolytica
LQWSRGDDIIFLFMGNE

SEQ ID NO: 2585174 - protein, 25 aa, Entamoeba histolytica
LQYDLPRMIGIGLFTDVSTSQAMRN

SEQ ID NO: 2585175 - protein, 19 aa, Entamoeba histolytica
LQYVCVGFADFKFSNDGKL

SEQ ID NO: 2585176 - protein, 19 aa, Entamoeba histolytica
LRATNIWFNTHVIIDNLYA

SEQ ID NO: 2585177 - protein, 18 aa, Entamoeba histolytica
LREKVWAILLKRKPLNTD

SEQ ID NO: 2585178 - protein, 21 aa, Entamoeba histolytica
LREPYKFPADIFAFGMVIFET

SEQ ID NO: 2585179 - protein, 25 aa, Entamoeba histolytica
LRETEFKITLEINIYRRCIKIKNNG

SEQ ID NO: 2585180 - protein, 21 aa, Entamoeba histolytica
LRETRPDIARALRGETPTNTP

SEQ ID NO: 2585181 - protein, 19 aa, Entamoeba histolytica
LRFDFAFSTDYPPLFENIT

SEQ ID NO: 2585182 - protein, 20 aa, Entamoeba histolytica
LRFTPKQALAHPFITNGSLK

SEQ ID NO: 2585183 - protein, 20 aa, Entamoeba histolytica
LRGDVTLEIVRRIAQTVKKQ

SEQ ID NO: 2585184 - protein, 17 aa, Entamoeba histolytica
LRGLVKVILELFSQWLL

SEQ ID NO: 2585185 - protein, 19 aa, Entamoeba histolytica
LRGSEGCLANCQCQQDVGW

SEQ ID NO: 2585186 - protein, 19 aa, Entamoeba histolytica
LRGVGLMRKLMVLFIDENT

SEQ ID NO: 2585187 - protein, 20 aa, Entamoeba histolytica
LRHICVVELIGAVYTEGEIA

SEQ ID NO: 2585188 - protein, 17 aa, Entamoeba histolytica
LRHKCVVEFIGAVYTEG

SEQ ID NO: 2585189 - protein, 24 aa, Entamoeba histolytica
LRIDESYCPLYILNGKEVLDMKNT

SEQ ID NO: 2585190 - protein, 17 aa, Entamoeba histolytica
LRIGLNQTIKGFFNSLI

SEQ ID NO: 2585191 - protein, 20 aa, Entamoeba histolytica
LRIVNKESIVYASKIIEGIV

SEQ ID NO: 2585192 - protein, 24 aa, Entamoeba histolytica
LRKEKEIYQMFGFSSLKKRMNTLV

SEQ ID NO: 2585193 - protein, 29 aa, Entamoeba histolytica
LRKKLETQMCWLLTVMNAMLNRTYSNGND

SEQ ID NO: 2585194 - protein, 20 aa, Entamoeba histolytica
LRKMMKIVLYPIYITIPMIR

SEQ ID NO: 2585195 - protein, 24 aa, Entamoeba histolytica
LRKNESVNMIKEWIDFIREKIETT

SEQ ID NO: 2585196 - protein, 19 aa, Entamoeba histolytica
LRKTLKVNTLLTVQTISSQ

SEQ ID NO: 2585197 - protein, 17 aa, Entamoeba histolytica
LRLIAEAMSLGMIIGIQ

SEQ ID NO: 2585198 - protein, 28 aa, Entamoeba histolytica
LRLKHFKCWRVMTLIAGFMLMLVGGSIF

SEQ ID NO: 2585199 - protein, 18 aa, Entamoeba histolytica
LRLNRFALSSSLRFLSKH

SEQ ID NO: 2585200 - protein, 17 aa, Entamoeba histolytica
LRLNRLQVASLFALSFL

SEQ ID NO: 2585201 - protein, 25 aa, Entamoeba histolytica
LRMDVKAVCPMGCGENGICSTASGG

SEQ ID NO: 2585202 - protein, 19 aa, Entamoeba histolytica
LRMKFPYRDVPNGWRVDID

SEQ ID NO: 2585203 - protein, 17 aa, Entamoeba histolytica
LRMKIDMIHPLEYLTFM

SEQ ID NO: 2585204 - protein, 23 aa, Entamoeba histolytica
LRMTRFWTYFGMWSCGVYFFINF

SEQ ID NO: 2585205 - protein, 25 aa, Entamoeba histolytica
LRNGWVLCVLAIPIGIISGYDLQSN

SEQ ID NO: 2585206 - protein, 17 aa, Entamoeba histolytica
LRNPFVVNYVGSVTYIP

SEQ ID NO: 2585207 - protein, 24 aa, Entamoeba histolytica
LRNVLCVIFPMIILDVKSYIDKTF

SEQ ID NO: 2585208 - protein, 17 aa, Entamoeba histolytica
LRNVLVSIVGIFVIISL

SEQ ID NO: 2585209 - protein, 24 aa, Entamoeba histolytica
LRPRGFKTITCFMTLFCTTKIKDM

SEQ ID NO: 2585210 - protein, 20 aa, Entamoeba histolytica
LRQFLVPHPFQLVDIRAIVK

SEQ ID NO: 2585211 - protein, 21 aa, Entamoeba histolytica
LRQGELQSMIPIILIYPNPFM

SEQ ID NO: 2585212 - protein, 17 aa, Entamoeba histolytica
LRQNILFNYQKILINEN

SEQ ID NO: 2585213 - protein, 24 aa, Entamoeba histolytica
LRQYTTLELINWIKPNAPKEFCEY

SEQ ID NO: 2585214 - protein, 22 aa, Entamoeba histolytica
LRRAELIPILYLMLLIPLVIAR

SEQ ID NO: 2585215 - protein, 23 aa, Entamoeba histolytica
LRRAELIPILYLMLLIPLVIARF

SEQ ID NO: 2585216 - protein, 33 aa, Entamoeba histolytica
LRRIGERWCLIIGGLCIIPFLLVNIFQKSYLLI

SEQ ID NO: 2585217 - protein, 22 aa, Entamoeba histolytica
LRSEFWIQIYYLIITFGVIITP

SEQ ID NO: 2585218 - protein, 18 aa, Entamoeba histolytica
LRSFHKILNYSGIMTDCG

SEQ ID NO: 2585219 - protein, 21 aa, Entamoeba histolytica
LRSGYCYKYLNNINCISINSN

SEQ ID NO: 2585220 - protein, 20 aa, Entamoeba histolytica
LRSHSKFELTHLVRVNRAFD

SEQ ID NO: 2585221 - protein, 23 aa, Entamoeba histolytica
LRSIHLRPKILLTDQLTKENYDV

SEQ ID NO: 2585222 - protein, 20 aa, Entamoeba histolytica
LRSIIWMICEYCSHYDEVIS

SEQ ID NO: 2585223 - protein, 17 aa, Entamoeba histolytica
LRSTIIGNFIANIHKLL

SEQ ID NO: 2585224 - protein, 18 aa, Entamoeba histolytica
LRTACIWIVQLIIGLFVA

SEQ ID NO: 2585225 - protein, 30 aa, Entamoeba histolytica
LRTGLMYIHCFMRRDFLCKREVPWVVFSCV

SEQ ID NO: 2585226 - protein, 22 aa, Entamoeba histolytica
LRTIIYPNFLNYYLMHFLFFTA

SEQ ID NO: 2585227 - protein, 21 aa, Entamoeba histolytica
LRTIPFFTPLIDKVWPKDDNN

SEQ ID NO: 2585228 - protein, 28 aa, Entamoeba histolytica
LRTLFRMEWGHFLICFIAIMISQLSTLV

SEQ ID NO: 2585229 - protein, 19 aa, Entamoeba histolytica
LRTPLLFEPIVKFIDSLIF

SEQ ID NO: 2585230 - protein, 17 aa, Entamoeba histolytica
LRTRSQIIGKKEIRLLV

SEQ ID NO: 2585231 - protein, 19 aa, Entamoeba histolytica
LRTSSLVRVTSLLSLGILN

SEQ ID NO: 2585232 - protein, 21 aa, Entamoeba histolytica
LRTYLAESFVVIFSASLMGMI

SEQ ID NO: 2585233 - protein, 19 aa, Entamoeba histolytica
LRVGDDWEILAEKRNILVE

SEQ ID NO: 2585234 - protein, 23 aa, Entamoeba histolytica
LRVGGKICCFCPCIEQIQKSCQE

SEQ ID NO: 2585235 - protein, 25 aa, Entamoeba histolytica
LRVIFDVTGSFSFVLCFSLPCIFHY

SEQ ID NO: 2585236 - protein, 19 aa, Entamoeba histolytica
LRVLFDTAKGMAFLHENRI

SEQ ID NO: 2585237 - protein, 28 aa, Entamoeba histolytica
LRVSKAFKSHTIFSLSLTIILVFISTIT

SEQ ID NO: 2585238 - protein, 17 aa, Entamoeba histolytica
LRYSHDPSFKYTASTCG

SEQ ID NO: 2585239 - protein, 28 aa, Entamoeba histolytica
LRYYFVWEFGELLSILMGFGYSGMKDGE

SEQ ID NO: 2585240 - protein, 26 aa, Entamoeba histolytica
LSAFAKLHATFPCLRDQIKSLFIKYS

SEQ ID NO: 2585241 - protein, 28 aa, Entamoeba histolytica
LSAISLRIPLILKDIFESVGSKQVPICR

SEQ ID NO: 2585242 - protein, 27 aa, Entamoeba histolytica
LSALWCSLSFCYLCISKIVKSFDILED

SEQ ID NO: 2585243 - protein, 19 aa, Entamoeba histolytica
LSASISFEAIVFTPITSSS

SEQ ID NO: 2585244 - protein, 25 aa, Entamoeba histolytica
LSASKFSLYSDFEVVGSLSATPILE

SEQ ID NO: 2585245 - protein, 20 aa, Entamoeba histolytica
LSATWSRTGNPDWSRTKYVK

SEQ ID NO: 2585246 - protein, 17 aa, Entamoeba histolytica
LSCAEGYYRHNESEKLC

SEQ ID NO: 2585247 - protein, 22 aa, Entamoeba histolytica
LSCKFKVYFIHWHLDTISQSKL

SEQ ID NO: 2585248 - protein, 17 aa, Entamoeba histolytica
LSCSWKMNEAMKKLYDR

SEQ ID NO: 2585249 - protein, 17 aa, Entamoeba histolytica
LSCTVRLSLNDGTISVN

SEQ ID NO: 2585250 - protein, 22 aa, Entamoeba histolytica
LSDASFWKNLSFDQYASLININ

SEQ ID NO: 2585251 - protein, 22 aa, Entamoeba histolytica
LSDCAKGMRFLHANSIIHRDLK

SEQ ID NO: 2585252 - protein, 24 aa, Entamoeba histolytica
LSDCFDITIFRVEWFESFQEIIQT

SEQ ID NO: 2585253 - protein, 22 aa, Entamoeba histolytica
LSEEIKVTIGFSHFKKLMNNYQ

SEQ ID NO: 2585254 - protein, 19 aa, Entamoeba histolytica
LSEEMIKFIFTARADILPF

SEQ ID NO: 2585255 - protein, 18 aa, Entamoeba histolytica
LSEKEVIPQSALVFDAGD

SEQ ID NO: 2585256 - protein, 17 aa, Entamoeba histolytica
LSELCHFNGQKTVFTED

SEQ ID NO: 2585257 - protein, 19 aa, Entamoeba histolytica
LSELVWYNKKLYGFDDKTG

SEQ ID NO: 2585258 - protein, 24 aa, Entamoeba histolytica
LSEQSLVTWVFKGIDSFQQANLHS

SEQ ID NO: 2585259 - protein, 19 aa, Entamoeba histolytica
LSFAGRKEVLITMKNINIM

SEQ ID NO: 2585260 - protein, 22 aa, Entamoeba histolytica
LSFFCIGALWAYSSIFSSTTTL

SEQ ID NO: 2585261 - protein, 25 aa, Entamoeba histolytica
LSFFSILLCLYYWKTPSLKEIKSKT

SEQ ID NO: 2585262 - protein, 20 aa, Entamoeba histolytica
LSFHSIFLLNGELRITEPII

SEQ ID NO: 2585263 - protein, 18 aa, Entamoeba histolytica
LSFKHTIFTFIGLGASVT

SEQ ID NO: 2585264 - protein, 18 aa, Entamoeba histolytica
LSFNRFLLDYVTREFEII

SEQ ID NO: 2585265 - protein, 25 aa, Entamoeba histolytica
LSGRLRWMIELFAYWNQLQFSPSPS

SEQ ID NO: 2585266 - protein, 31 aa, Entamoeba histolytica
LSHLLNRNPPCLVELSLFLYQCDQIDIHLRN

SEQ ID NO: 2585267 - protein, 19 aa, Entamoeba histolytica
LSHMGCFIPAKAASIRPLT

SEQ ID NO: 2585268 - protein, 23 aa, Entamoeba histolytica
LSIKGCSPSVIQISIFSECKSGV

SEQ ID NO: 2585269 - protein, 26 aa, Entamoeba histolytica
LSIKSWNIFLVLGFFVSFILSLVCIL

SEQ ID NO: 2585270 - protein, 17 aa, Entamoeba histolytica
LSILIPFLAVIKGSLTL

SEQ ID NO: 2585271 - protein, 19 aa, Entamoeba histolytica
LSIPSFYFSYTYDLTRSYQ

SEQ ID NO: 2585272 - protein, 19 aa, Entamoeba histolytica
LSIRNSWGNKYQKIVERRD

SEQ ID NO: 2585273 - protein, 23 aa, Entamoeba histolytica
LSIRPLESIKILISRLSIEVRSN

SEQ ID NO: 2585274 - protein, 17 aa, Entamoeba histolytica
LSISILCNVQFMRFKVP

SEQ ID NO: 2585275 - protein, 23 aa, Entamoeba histolytica
LSIVFCLWIVLLIVKLELNTEWS

SEQ ID NO: 2585276 - protein, 18 aa, Entamoeba histolytica
LSKCPICRAQITTIVKTY

SEQ ID NO: 2585277 - protein, 20 aa, Entamoeba histolytica
LSKDRLDKIITIATHMFECG

SEQ ID NO: 2585278 - protein, 19 aa, Entamoeba histolytica
LSKEVIETALLLSQKMGAK

SEQ ID NO: 2585279 - protein, 23 aa, Entamoeba histolytica
LSKKKCDYYRAYKNGHSESEKCD

SEQ ID NO: 2585280 - protein, 17 aa, Entamoeba histolytica
LSKLRLASKNGDAKLYK

SEQ ID NO: 2585281 - protein, 26 aa, Entamoeba histolytica
LSKSDIKGHIAWRRSIGKNGKKVTAS

SEQ ID NO: 2585282 - protein, 21 aa, Entamoeba histolytica
LSKYFLKDVVDSFLHIIQTIK

SEQ ID NO: 2585283 - protein, 20 aa, Entamoeba histolytica
LSLEHCMLIRQVGETFDSKR

SEQ ID NO: 2585284 - protein, 27 aa, Entamoeba histolytica
LSLFCAKQLRSLICERIKLNDESVSCL

SEQ ID NO: 2585285 - protein, 22 aa, Entamoeba histolytica
LSLFIICWFFLFLIRIYLIYYI

SEQ ID NO: 2585286 - protein, 17 aa, Entamoeba histolytica
LSLFTFFFIISLSLTVI

SEQ ID NO: 2585287 - protein, 19 aa, Entamoeba histolytica
LSLGFPAFLLLYVNTLPLL

SEQ ID NO: 2585288 - protein, 19 aa, Entamoeba histolytica
LSLGFSFNYPWAVVSRLLL

SEQ ID NO: 2585289 - protein, 24 aa, Entamoeba histolytica
LSLINVIAPFTFYLDKLPIITIND

SEQ ID NO: 2585290 - protein, 24 aa, Entamoeba histolytica
LSLLELLQALTIPFFILAKIPQIY

SEQ ID NO: 2585291 - protein, 19 aa, Entamoeba histolytica
LSLPIVMIPLYFNDCFKLL

SEQ ID NO: 2585292 - protein, 27 aa, Entamoeba histolytica
LSLPNLRRLEIRAGRNGLTENLPIRSM

SEQ ID NO: 2585293 - protein, 25 aa, Entamoeba histolytica
LSLQRSGLLTGKWKNLVISTFNDKN

SEQ ID NO: 2585294 - protein, 21 aa, Entamoeba histolytica
LSLQSKRSFSIVIICSFILVF

SEQ ID NO: 2585295 - protein, 19 aa, Entamoeba histolytica
LSLVINVFIVFSKVLRLHP

SEQ ID NO: 2585296 - protein, 19 aa, Entamoeba histolytica
LSLYCKLGQAIGQNSKVKL

SEQ ID NO: 2585297 - protein, 17 aa, Entamoeba histolytica
LSLYPYWNPYDPQHNTI

SEQ ID NO: 2585298 - protein, 17 aa, Entamoeba histolytica
LSMPKCNPPLYSFERIR

SEQ ID NO: 2585299 - protein, 23 aa, Entamoeba histolytica
LSMRTAELYALFATPGLAEATFR

SEQ ID NO: 2585300 - protein, 25 aa, Entamoeba histolytica
LSNGECFPCSGMKGCQICSSGTVCT

SEQ ID NO: 2585301 - protein, 20 aa, Entamoeba histolytica
LSNQTMRLFLSSIFTSFLPQ

SEQ ID NO: 2585302 - protein, 19 aa, Entamoeba histolytica
LSNVLAFLSSCIWSININS

SEQ ID NO: 2585303 - protein, 19 aa, Entamoeba histolytica
LSPAPFAHWCIKEITEQPI

SEQ ID NO: 2585304 - protein, 19 aa, Entamoeba histolytica
LSQCGWKINDLMIHIVLLV

SEQ ID NO: 2585305 - protein, 19 aa, Entamoeba histolytica
LSQCTFPSSINFESISFEL

SEQ ID NO: 2585306 - protein, 17 aa, Entamoeba histolytica
LSQFASFMVEPYCAAKI

SEQ ID NO: 2585307 - protein, 17 aa, Entamoeba histolytica
LSQFASFMVEPYCSAVM

SEQ ID NO: 2585308 - protein, 24 aa, Entamoeba histolytica
LSQREVVKRIALISEEWNSENGML

SEQ ID NO: 2585309 - protein, 20 aa, Entamoeba histolytica
LSQRTFKFFYFPRFLIVLLI

SEQ ID NO: 2585310 - protein, 24 aa, Entamoeba histolytica
LSQTCYKMGVIGFVAWCLATIVYF

SEQ ID NO: 2585311 - protein, 22 aa, Entamoeba histolytica
LSQVFIKFYIIIAVNQKKNFVI

SEQ ID NO: 2585312 - protein, 20 aa, Entamoeba histolytica
LSQYAWYLLICRKKYHKEDY

SEQ ID NO: 2585313 - protein, 18 aa, Entamoeba histolytica
LSQYLSVQLKQMKLMRKP

SEQ ID NO: 2585314 - protein, 22 aa, Entamoeba histolytica
LSRKRPSHWQKFASENKDIIQL

SEQ ID NO: 2585315 - protein, 25 aa, Entamoeba histolytica
LSRNKRFAISKCCGVIQINSELKQY

SEQ ID NO: 2585316 - protein, 19 aa, Entamoeba histolytica
LSSFCHKRQYLVIYDSEKK

SEQ ID NO: 2585317 - protein, 24 aa, Entamoeba histolytica
LSSFMLPCAVVMLFIQIFADCGVN

SEQ ID NO: 2585318 - protein, 19 aa, Entamoeba histolytica
LSSICFYSSIRIELLNSSN

SEQ ID NO: 2585319 - protein, 17 aa, Entamoeba histolytica
LSSIDFESECIRWLGAF

SEQ ID NO: 2585320 - protein, 19 aa, Entamoeba histolytica
LSSKLIKLMKEYRDIQELN

SEQ ID NO: 2585321 - protein, 17 aa, Entamoeba histolytica
LSSQIVSMFLCDLSNHI

SEQ ID NO: 2585322 - protein, 17 aa, Entamoeba histolytica
LSSRLKRTLDSYEQEKD

SEQ ID NO: 2585323 - protein, 18 aa, Entamoeba histolytica
LSSVSHCLRVSNSSCASC

SEQ ID NO: 2585324 - protein, 21 aa, Entamoeba histolytica
LSSYSGRGDYIFNYPHCPCDD

SEQ ID NO: 2585325 - protein, 17 aa, Entamoeba histolytica
LSTCLFVSHFPELNNLE

SEQ ID NO: 2585326 - protein, 17 aa, Entamoeba histolytica
LSTEIIPFYSLWATIFG

SEQ ID NO: 2585327 - protein, 19 aa, Entamoeba histolytica
LSTGMKIFIGIFIIVAVIT

SEQ ID NO: 2585328 - protein, 19 aa, Entamoeba histolytica
LSTHSVEILNQLSLQANYN

SEQ ID NO: 2585329 - protein, 22 aa, Entamoeba histolytica
LSTKSANEWTYFKISLKDLNVT

SEQ ID NO: 2585330 - protein, 17 aa, Entamoeba histolytica
LSVCSVLMVNIWSHDVG

SEQ ID NO: 2585331 - protein, 17 aa, Entamoeba histolytica
LSVDWQFSDIMNDEYIN

SEQ ID NO: 2585332 - protein, 23 aa, Entamoeba histolytica
LSVGKEIREILCIANSTKETIKV

SEQ ID NO: 2585333 - protein, 34 aa, Entamoeba histolytica
LSVIRDANLFFAEFIRDLAIMWRHDEMAKLVDTH

SEQ ID NO: 2585334 - protein, 23 aa, Entamoeba histolytica
LSVKEFFSYFTLSSYLIPIACAV

SEQ ID NO: 2585335 - protein, 26 aa, Entamoeba histolytica
LSVLIYKSTFIFRNFQRVINVYFTAP

SEQ ID NO: 2585336 - protein, 26 aa, Entamoeba histolytica
LSVMDRRMIDCLKKIDGEKKLVEYIK

SEQ ID NO: 2585337 - protein, 30 aa, Entamoeba histolytica; identical to SEQ ID NO: 2387409

SEQ ID NO: 2585338 - protein, 25 aa, Entamoeba histolytica
LSVVCTVCPPSLLYKYIPSVDLLKK

SEQ ID NO: 2585339 - protein, 25 aa, Entamoeba histolytica
LSWNRRGCPCDGSQCTLKINDQIKP

SEQ ID NO: 2585340 - protein, 23 aa, Entamoeba histolytica
LSYRVKCIMRNGGTSKYVRVPRI

SEQ ID NO: 2585341 - protein, 18 aa, Entamoeba histolytica
LTAFAFSVANSFKKELTP

SEQ ID NO: 2585342 - protein, 17 aa, Entamoeba histolytica
LTAFKLTSNPLFPVTSQ

SEQ ID NO: 2585343 - protein, 17 aa, Entamoeba histolytica
LTAGFTIENFWPSKYHK

SEQ ID NO: 2585344 - protein, 20 aa, Entamoeba histolytica
LTALFSINFDKCVTLKIWDM

SEQ ID NO: 2585345 - protein, 23 aa, Entamoeba histolytica
LTCDLKIFIVLKEMVHDIASHEK

SEQ ID NO: 2585346 - protein, 21 aa, Entamoeba histolytica
LTCEGESKSGIKGFFRVFKKM

SEQ ID NO: 2585347 - protein, 18 aa, Entamoeba histolytica
LTCKICYSLPEGRCKKIF

SEQ ID NO: 2585348 - protein, 25 aa, Entamoeba histolytica
LTDGCLDVWVGRKWNDWLADGEELG

SEQ ID NO: 2585349 - protein, 24 aa, Entamoeba histolytica
LTECWKNIVRLVLTRKGKKGEEEA

SEQ ID NO: 2585350 - protein, 28 aa, Entamoeba histolytica
LTEGIFSFIKKLFVKRIYSKIYVDTIRH

SEQ ID NO: 2585351 - protein, 20 aa, Entamoeba histolytica
LTFEEICWSLVKMIDDAPNH

SEQ ID NO: 2585352 - protein, 20 aa, Entamoeba histolytica
LTFHCSFTVFLGSRRLTTKF

SEQ ID NO: 2585353 - protein, 24 aa, Entamoeba histolytica
LTFMRMNVLIKFYGETLACLIYAL

SEQ ID NO: 2585354 - protein, 23 aa, Entamoeba histolytica
LTFNRRFCNELKRCDELERKIRY

SEQ ID NO: 2585355 - protein, 17 aa, Entamoeba histolytica
LTFSGFFMVFFTLCTQV

SEQ ID NO: 2585356 - protein, 19 aa, Entamoeba histolytica
LTGAKKFKYINCDSDSFCI

SEQ ID NO: 2585357 - protein, 18 aa, Entamoeba histolytica
LTGNRNGILYSFTTDNTP

SEQ ID NO: 2585358 - protein, 18 aa, Entamoeba histolytica
LTHECIIKSQLQDIDLSS

SEQ ID NO: 2585359 - protein, 21 aa, Entamoeba histolytica
LTHRLEAKKQCELYMTEVNNY

SEQ ID NO: 2585360 - protein, 25 aa, Entamoeba histolytica
LTICLYPNQPILCFVNGNFINESKS

SEQ ID NO: 2585361 - protein, 25 aa, Entamoeba histolytica
LTIFKKEWYHFLFSYILVSIYELFS

SEQ ID NO: 2585362 - protein, 17 aa, Entamoeba histolytica
LTIFLVKNILLLCKLLS

SEQ ID NO: 2585363 - protein, 19 aa, Entamoeba histolytica
LTIICIFIYQIADNVDGRQ

SEQ ID NO: 2585364 - protein, 20 aa, Entamoeba histolytica
LTIIRIFRYSSFYISFMVNK

SEQ ID NO: 2585365 - protein, 17 aa, Entamoeba histolytica
LTIRELLNQSSIYYNAP

SEQ ID NO: 2585366 - protein, 27 aa, Entamoeba histolytica
LTITEVVHLLGCLGDLTIKQQKDIQQT

SEQ ID NO: 2585367 - protein, 26 aa, Entamoeba histolytica
LTITLCCVCPAPLLSIIYSVEYNVTR

SEQ ID NO: 2585368 - protein, 21 aa, Entamoeba histolytica
LTKEEFVHFPVKARGIHDYSY

SEQ ID NO: 2585369 - protein, 17 aa, Entamoeba histolytica
LTKELTGYVFINKENDD

SEQ ID NO: 2585370 - protein, 18 aa, Entamoeba histolytica
LTKLDAFNELNFVTRNPT

SEQ ID NO: 2585371 - protein, 17 aa, Entamoeba histolytica
LTLCVIIFLLSGTLTIT

SEQ ID NO: 2585372 - protein, 23 aa, Entamoeba histolytica
LTLDCLPEEGGMLVVSQSGETKD

SEQ ID NO: 2585373 - protein, 23 aa, Entamoeba histolytica
LTLDLWNPIFIPYVILLCFISRA

SEQ ID NO: 2585374 - protein, 19 aa, Entamoeba histolytica
LTLFCTIKLHGMKIPSTVY

SEQ ID NO: 2585375 - protein, 18 aa, Entamoeba histolytica
LTLFDFLSKCLTYKPEDR

SEQ ID NO: 2585376 - protein, 20 aa, Entamoeba histolytica
LTLFSYFLPFTINIDNDKKM

SEQ ID NO: 2585377 - protein, 23 aa, Entamoeba histolytica
LTLLEAVGLFLLIAPVTCLFAFC

SEQ ID NO: 2585378 - protein, 17 aa, Entamoeba histolytica
LTLPDFIVKQLISEKVM

SEQ ID NO: 2585379 - protein, 18 aa, Entamoeba histolytica
LTLPYSLHYFLKFLAQNI

SEQ ID NO: 2585380 - protein, 23 aa, Entamoeba histolytica
LTLSCIPSFIGMYIIVLIMWMIW

SEQ ID NO: 2585381 - protein, 23 aa, Entamoeba histolytica
LTLSCSQWFISLGKYGILMGIFL

SEQ ID NO: 2585382 - protein, 18 aa, Entamoeba histolytica
LTLSNAWGLILAIGLMGN

SEQ ID NO: 2585383 - protein, 32 aa, Entamoeba histolytica
LTMDIITAVLFAFCILCVLLYAAYLTYAKKYR

SEQ ID NO: 2585384 - protein, 23 aa, Entamoeba histolytica
LTMQLRLGMIIERRWNSFRFLIV

SEQ ID NO: 2585385 - protein, 31 aa, Entamoeba histolytica
LTMTPALFLCFPRFFKLQSCIPCYKKCVKFT

SEQ ID NO: 2585386 - protein, 24 aa, Entamoeba histolytica
LTMYRFAAIFLMIFTSFISLLYRS

SEQ ID NO: 2585387 - protein, 25 aa, Entamoeba histolytica
LTNCKEFRNKGCIYCDNDTYLDGIR

SEQ ID NO: 2585388 - protein, 27 aa, Entamoeba histolytica
LTNLPPVYTYFYLCVIVSSEGFVKFVI

SEQ ID NO: 2585389 - protein, 19 aa, Entamoeba histolytica
LTNNWKYPMHFTFHSGDYT

SEQ ID NO: 2585390 - protein, 20 aa, Entamoeba histolytica
LTNTIQYIHNNIHLIAETTT

SEQ ID NO: 2585391 - protein, 17 aa, Entamoeba histolytica
LTPKFSLFFGGICYVFY

SEQ ID NO: 2585392 - protein, 24 aa, Entamoeba histolytica
LTPLGRIGILFGIGIPTMVLTQVL

SEQ ID NO: 2585393 - protein, 18 aa, Entamoeba histolytica
LTPNLSMNLIQIGNNVPY

SEQ ID NO: 2585394 - protein, 19 aa, Entamoeba histolytica
LTPSDFVDYAFRYFGQQNH

SEQ ID NO: 2585395 - protein, 23 aa, Entamoeba histolytica
LTPYRSCVIRRYFFLQGTIFLIR

SEQ ID NO: 2585396 - protein, 22 aa, Entamoeba histolytica
LTQERYLVFTSRFITNTKSECK

SEQ ID NO: 2585397 - protein, 30 aa, Entamoeba histolytica
LTQFRLLNIMYKRIIYIQALGQCTLSDYKE

SEQ ID NO: 2585398 - protein, 17 aa, Entamoeba histolytica
LTRSFKKLLNAVKEETE

SEQ ID NO: 2585399 - protein, 17 aa, Entamoeba histolytica
LTRVFTLNFKEKGSFIQ

SEQ ID NO: 2585400 - protein, 21 aa, Entamoeba histolytica
LTRYFNIRFSNPFKSGNFIDA

SEQ ID NO: 2585401 - protein, 22 aa, Entamoeba histolytica
LTSCNLFFLLFADICNKNIPNF

SEQ ID NO: 2585402 - protein, 30 aa, Entamoeba histolytica; identical to SEQ ID NO: 2379754

SEQ ID NO: 2585403 - protein, 18 aa, Entamoeba histolytica
LTSIFLNYFFDTTIVHMA

SEQ ID NO: 2585404 - protein, 17 aa, Entamoeba histolytica
LTSIQTFAILLKKITHT

SEQ ID NO: 2585405 - protein, 21 aa, Entamoeba histolytica
LTTEWCIYSSMIFVLIGLIGC

SEQ ID NO: 2585406 - protein, 18 aa, Entamoeba histolytica
LTTFDITISLGFTDDYIN

SEQ ID NO: 2585407 - protein, 30 aa, Entamoeba histolytica
LTTTCLYCMMVCLSPPYGFEFLNNIPYWIF

SEQ ID NO: 2585408 - protein, 17 aa, Entamoeba histolytica
LTVGVLIVNDIEDISNK

SEQ ID NO: 2585409 - protein, 19 aa, Entamoeba histolytica
LTVHASFAAALFFEICFFF

SEQ ID NO: 2585410 - protein, 23 aa, Entamoeba histolytica
LTVYRFVSFLIMFITCAVQLGKN

SEQ ID NO: 2585411 - protein, 19 aa, Entamoeba histolytica
LTYIFRTTPVLSFILSVTS

SEQ ID NO: 2585412 - protein, 24 aa, Entamoeba histolytica
LTYMGYCYLLIGLICIGVIFFIIS

SEQ ID NO: 2585413 - protein, 24 aa, Entamoeba histolytica
LTYPITWAAVPGFVEITNVYLSEF

SEQ ID NO: 2585414 - protein, 27 aa, Entamoeba histolytica
LVAVCLNFPLIIPKSVKFLNRISTLTV

SEQ ID NO: 2585415 - protein, 27 aa, Entamoeba histolytica
LVAVCLNLPLIIPKSVKFLSKISVLTL

SEQ ID NO: 2585416 - protein, 17 aa, Entamoeba histolytica
LVDDCFSSMLTINQNWK

SEQ ID NO: 2585417 - protein, 23 aa, Entamoeba histolytica
LVDSFYFILPFDIVILNDKSVKF

SEQ ID NO: 2585418 - protein, 21 aa, Entamoeba histolytica
LVEDLWCFTPGLFPLIRSGAT

SEQ ID NO: 2585419 - protein, 20 aa, Entamoeba histolytica
LVFASICYWASNQFAPNGTF

SEQ ID NO: 2585420 - protein, 17 aa, Entamoeba histolytica
LVGIVVHTGNAHGGHYF

SEQ ID NO: 2585421 - protein, 29 aa, Entamoeba histolytica
LVGLCTYCISPIIAGCLMNSFGSEWCPYT

SEQ ID NO: 2585422 - protein, 34 aa, Entamoeba histolytica
LVHANIYFAEFMRSMLYLWRLGKIAEVIEKYLNV

SEQ ID NO: 2585423 - protein, 19 aa, Entamoeba histolytica
LVHGRYCYRQIGITLFYLI

SEQ ID NO: 2585424 - protein, 24 aa, Entamoeba histolytica
LVHGRYSFNRIGIFTSHTLYRSIL

SEQ ID NO: 2585425 - protein, 17 aa, Entamoeba histolytica
LVIAYYLFISYQQFNYR

SEQ ID NO: 2585426 - protein, 18 aa, Entamoeba histolytica
LVIGAGIVFVWSIQSEFA

SEQ ID NO: 2585427 - protein, 23 aa, Entamoeba histolytica
LVIICFLIILVVIFILLRKKIIT

SEQ ID NO: 2585428 - protein, 19 aa, Entamoeba histolytica
LVIIGSRIAHLGLIVQKAK

SEQ ID NO: 2585429 - protein, 19 aa, Entamoeba histolytica
LVIKRILFIKGCIVSCLFP

SEQ ID NO: 2585430 - protein, 18 aa, Entamoeba histolytica
LVILKCWFNVDTGMASVA

SEQ ID NO: 2585431 - protein, 18 aa, Entamoeba histolytica
LVKKDGKCIGIYKKIEVL

SEQ ID NO: 2585432 - protein, 21 aa, Entamoeba histolytica
LVKKDGKCIGIYKKIEVLNTT

SEQ ID NO: 2585433 - protein, 25 aa, Entamoeba histolytica
LVLAKKSFLRFILKSKSKMVSKNLK

SEQ ID NO: 2585434 - protein, 31 aa, Entamoeba histolytica
LVLEEPQLLFVIRWFFSFLLDPVNSVTLSKL

SEQ ID NO: 2585435 - protein, 21 aa, Entamoeba histolytica
LVLNDPLYHWLFNSAVSPDNT

SEQ ID NO: 2585436 - protein, 23 aa, Entamoeba histolytica
LVLPIEGFFSVSSLRVNKIIVSA

SEQ ID NO: 2585437 - protein, 17 aa, Entamoeba histolytica
LVLRCIQHYFYFTNDEC

SEQ ID NO: 2585438 - protein, 21 aa, Entamoeba histolytica
LVLSCLLHPFYFITFALDNPI

SEQ ID NO: 2585439 - protein, 25 aa, Entamoeba histolytica
LVLYLKRKKLLVLVALGPSLLVPIG

SEQ ID NO: 2585440 - protein, 20 aa, Entamoeba histolytica
LVMTITEWVILLFSVSCLSE

SEQ ID NO: 2585441 - protein, 18 aa, Entamoeba histolytica
LVMVCFKANVDKVKELLE

SEQ ID NO: 2585442 - protein, 22 aa, Entamoeba histolytica
LVMVICLIVLVLQQIIFKKLKW

SEQ ID NO: 2585443 - protein, 19 aa, Entamoeba histolytica
LVNGFGVLRQREGKLYVND

SEQ ID NO: 2585444 - protein, 19 aa, Entamoeba histolytica
LVNKYSIEKCCNCHETDGD

SEQ ID NO: 2585445 - protein, 20 aa, Entamoeba histolytica
LVPLLARFVSISAKIGLKYA

SEQ ID NO: 2585446 - protein, 19 aa, Entamoeba histolytica
LVREMYRFTEGFKKKEIVK

SEQ ID NO: 2585447 - protein, 23 aa, Entamoeba histolytica
LVRHKINELFALELTPNLSMNLI

SEQ ID NO: 2585448 - protein, 18 aa, Entamoeba histolytica
LVRVEPFTTMFIRMNENH

SEQ ID NO: 2585449 - protein, 19 aa, Entamoeba histolytica
LVSEPSLFIIHFTDLIEYF

SEQ ID NO: 2585450 - protein, 24 aa, Entamoeba histolytica
LVSFKSIEIELVFQMLEKLLNTYH

SEQ ID NO: 2585451 - protein, 25 aa, Entamoeba histolytica
LVSGLCLIIIPLASLTKFTFFGISS

SEQ ID NO: 2585452 - protein, 21 aa, Entamoeba histolytica
LVSICSSYIYPGILNNFSVTT

SEQ ID NO: 2585453 - protein, 23 aa, Entamoeba histolytica
LVSIYELIKYFIFNIKNVTRYCA

SEQ ID NO: 2585454 - protein, 18 aa, Entamoeba histolytica
LVSTCYFSADGVKKSSKL

SEQ ID NO: 2585455 - protein, 17 aa, Entamoeba histolytica
LVSTLWGIFVFGEIRGI

SEQ ID NO: 2585456 - protein, 18 aa, Entamoeba histolytica
LVTRFELSSFIILIISGI

SEQ ID NO: 2585457 - protein, 24 aa, Entamoeba histolytica
LVTSRSDFEIHWKTFINLKDITFD

SEQ ID NO: 2585458 - protein, 25 aa, Entamoeba histolytica
LVVECGMILVLLSFFLPMVATRDID

SEQ ID NO: 2585459 - protein, 19 aa, Entamoeba histolytica
LVVEIKQPVGYEFAIKTPC

SEQ ID NO: 2585460 - protein, 34 aa, Entamoeba histolytica
LVVFYKFGTKFVMKRLFLNWELRENKNIYYGKMK

SEQ ID NO: 2585461 - protein, 18 aa, Entamoeba histolytica
LVVGTLYLNKDIDVGKYC

SEQ ID NO: 2585462 - protein, 26 aa, Entamoeba histolytica
LVVIAFRNVGSFDRLKLNDQIIKNYF

SEQ ID NO: 2585463 - protein, 18 aa, Entamoeba histolytica
LVVSVLFLVAGIYIPYFN

SEQ ID NO: 2585464 - protein, 35 aa, Entamoeba histolytica
LVVYVFPAFFAFRVATGLLKWVSLGVMIIGFILGG

SEQ ID NO: 2585465 - protein, 17 aa, Entamoeba histolytica
LVYRMNKWHYFLLDFCY

SEQ ID NO: 2585466 - protein, 18 aa, Entamoeba histolytica
LWCGFACDPNSARWTEID

SEQ ID NO: 2585467 - protein, 20 aa, Entamoeba histolytica
LWELYCWSHPFPDVKNLSVV

SEQ ID NO: 2585468 - protein, 19 aa, Entamoeba histolytica
LWFNVREYIFTFSLLIFIV

SEQ ID NO: 2585469 - protein, 22 aa, Entamoeba histolytica
LWGPMLVCYILSLLLSINIMIR

SEQ ID NO: 2585470 - protein, 17 aa, Entamoeba histolytica
LWIKISIWIICPIICLA

SEQ ID NO: 2585471 - protein, 21 aa, Entamoeba histolytica
LWIQFLSCVDFKLIKTPKTLL

SEQ ID NO: 2585472 - protein, 18 aa, Entamoeba histolytica
LWKITGIIMKEHYPQMFD

SEQ ID NO: 2585473 - protein, 20 aa, Entamoeba histolytica
LWTLWIILWSFQFLVFAVVV

SEQ ID NO: 2585474 - protein, 18 aa, Entamoeba histolytica
LWVDLYYDEIVIRSDKTA

SEQ ID NO: 2585475 - protein, 27 aa, Entamoeba histolytica
LWWFIYAVVCVATFTVLKLFIKTDDLL

SEQ ID NO: 2585476 - protein, 28 aa, Entamoeba histolytica
LWYLVLIPIFCILILFMISILVCVYKIY

SEQ ID NO: 2585477 - protein, 18 aa, Entamoeba histolytica
LYAISFKGKIITKLDFYA

SEQ ID NO: 2585478 - protein, 22 aa, Entamoeba histolytica
LYAKARAGIIKGFTGIDDPYEA

SEQ ID NO: 2585479 - protein, 21 aa, Entamoeba histolytica
LYCCMICGKFYQGRDVGSPAY

SEQ ID NO: 2585480 - protein, 18 aa, Entamoeba histolytica
LYCLYRMVLDNKQAISNA

SEQ ID NO: 2585481 - protein, 18 aa, Entamoeba histolytica
LYCSCIKTHATPSKTTLY

SEQ ID NO: 2585482 - protein, 17 aa, Entamoeba histolytica
LYDGYGFIEDLEKIIEE

SEQ ID NO: 2585483 - protein, 32 aa, Entamoeba histolytica
LYDHVYYCFWRYFRFEIVRIINFYLFNKIENV

SEQ ID NO: 2585484 - protein, 23 aa, Entamoeba histolytica
LYDIESLYVIFFFILKNLKEETV

SEQ ID NO: 2585485 - protein, 19 aa, Entamoeba histolytica
LYDPIQFLTLWSKSISFIP

SEQ ID NO: 2585486 - protein, 18 aa, Entamoeba histolytica
LYDSLAPGDKQAACCLQM

SEQ ID NO: 2585487 - protein, 22 aa, Entamoeba histolytica
LYECKDLEGCVVTKYNASCEPK

SEQ ID NO: 2585488 - protein, 23 aa, Entamoeba histolytica
LYEKDCPKPLVFKETAELPDIME

SEQ ID NO: 2585489 - protein, 22 aa, Entamoeba histolytica
LYFICYAICFRNKPFMYRETTF

SEQ ID NO: 2585490 - protein, 18 aa, Entamoeba histolytica
LYFLKLHPLLLLVMMLLF

SEQ ID NO: 2585491 - protein, 34 aa, Entamoeba histolytica
LYFNGELNAIGYGNCIYSKFEYLINCEEKGITSE

SEQ ID NO: 2585492 - protein, 18 aa, Entamoeba histolytica
LYFRGCILAITGVLLSFI

SEQ ID NO: 2585493 - protein, 20 aa, Entamoeba histolytica
LYFSFCLFISVAFFITKLWY

SEQ ID NO: 2585494 - protein, 25 aa, Entamoeba histolytica
LYFVGIMVCGILSPLATIIISLIGT

SEQ ID NO: 2585495 - protein, 18 aa, Entamoeba histolytica
LYFYHVHFALNSGMKEDN

SEQ ID NO: 2585496 - protein, 17 aa, Entamoeba histolytica
LYGFEINDTLLISLLNI

SEQ ID NO: 2585497 - protein, 24 aa, Entamoeba histolytica
LYHPLSSPLLYLLNKHNKRFKLAL

SEQ ID NO: 2585498 - protein, 24 aa, Entamoeba histolytica
LYHPRCLLQLLFAGSFKQVEIILS

SEQ ID NO: 2585499 - protein, 17 aa, Entamoeba histolytica
LYICIGLVLINMIVYPF

SEQ ID NO: 2585500 - protein, 18 aa, Entamoeba histolytica
LYILICYGKLIQVNLEKG

SEQ ID NO: 2585501 - protein, 25 aa, Entamoeba histolytica
LYIPASDGLVSWIYYHHKLHNPYFP

SEQ ID NO: 2585502 - protein, 19 aa, Entamoeba histolytica
LYIRGISTWAISILCSNKK

SEQ ID NO: 2585503 - protein, 19 aa, Entamoeba histolytica
LYISCDLSSIGLKANSNEL

SEQ ID NO: 2585504 - protein, 23 aa, Entamoeba histolytica
LYITNECQLIFSVFPNISNVIME

SEQ ID NO: 2585505 - protein, 19 aa, Entamoeba histolytica
LYIVCWIVPFFNRLLPLFK

SEQ ID NO: 2585506 - protein, 17 aa, Entamoeba histolytica
LYKNCTYYYGFAIAVAI

SEQ ID NO: 2585507 - protein, 17 aa, Entamoeba histolytica
LYLDYPIYIIEISIINE

SEQ ID NO: 2585508 - protein, 24 aa, Entamoeba histolytica
LYLFKILLAIALRYLAFTEVTQHT

SEQ ID NO: 2585509 - protein, 18 aa, Entamoeba histolytica
LYLIAGAILLIFLLVLLW

SEQ ID NO: 2585510 - protein, 18 aa, Entamoeba histolytica
LYMFILFVWIFFHVDHLK

SEQ ID NO: 2585511 - protein, 17 aa, Entamoeba histolytica
LYPHPWLIADTITTGKR

SEQ ID NO: 2585512 - protein, 18 aa, Entamoeba histolytica
LYPIGWKQTTTYNLGLCY

SEQ ID NO: 2585513 - protein, 18 aa, Entamoeba histolytica
LYPIKKIRYIYALIFLIG

SEQ ID NO: 2585514 - protein, 25 aa, Entamoeba histolytica
LYPSLPFIWGYFALLSVGLWYSSRS

SEQ ID NO: 2585515 - protein, 17 aa, Entamoeba histolytica
LYSLIPVLSVILPLNML

SEQ ID NO: 2585516 - protein, 17 aa, Entamoeba histolytica
LYSPLFFYTQTLFSKND

SEQ ID NO: 2585517 - protein, 17 aa, Entamoeba histolytica
LYSPPSFLQIKINNNQK

SEQ ID NO: 2585518 - protein, 18 aa, Entamoeba histolytica
LYTFLIIALMLRFFQVFW

SEQ ID NO: 2585519 - protein, 17 aa, Entamoeba histolytica
LYTIKIFSNPRCTLYGN

SEQ ID NO: 2585520 - protein, 17 aa, Entamoeba histolytica
LYTKLLLHIMKYQTSDA

SEQ ID NO: 2585521 - protein, 19 aa, Entamoeba histolytica
LYTSCSIQTGIFINPSLSI

SEQ ID NO: 2585522 - protein, 24 aa, Entamoeba histolytica
LYVACGLCLFTIVRIHYTSDVFVG

SEQ ID NO: 2585523 - protein, 18 aa, Entamoeba histolytica
LYVFPMYIIRAGLIAINY

SEQ ID NO: 2585524 - protein, 24 aa, Entamoeba histolytica
LYVFPRYIIYAAIQAYPFIPQNAT

SEQ ID NO: 2585525 - protein, 26 aa, Entamoeba histolytica
LYVSCLCKMIGCLINEFNERAQTCAY

SEQ ID NO: 2585526 - protein, 17 aa, Entamoeba histolytica
LYYHPRDTLTILNPLSH

SEQ ID NO: 2585527 - protein, 19 aa, Entamoeba histolytica
LYYIKGTLLLPIFFILILQ

SEQ ID NO: 2585528 - protein, 17 aa, Entamoeba histolytica
LYYKYKSLHIVWMLFCF

SEQ ID NO: 2585529 - protein, 17 aa, Entamoeba histolytica
LYYLNELVIHFTVYGTV

SEQ ID NO: 2585530 - protein, 25 aa, Entamoeba histolytica
LYYTLNYIFCRTMLSILFSIIKAFL

SEQ ID NO: 2585531 - protein, 25 aa, Entamoeba histolytica
MACVKGKRTPIKLSYTIFDSAEDIN

SEQ ID NO: 2585532 - protein, 17 aa, Entamoeba histolytica
MAFNWKATQVDLMNQLI

SEQ ID NO: 2585533 - protein, 34 aa, Entamoeba histolytica
MAFYTCKMAKLWYLQRMDWIGAFIIVITTTVICI

SEQ ID NO: 2585534 - protein, 17 aa, Entamoeba histolytica
MAGFASWKYKNVIQDEG

SEQ ID NO: 2585535 - protein, 20 aa, Entamoeba histolytica
MAKLLLRLLAYFHEHVSETD

SEQ ID NO: 2585536 - protein, 22 aa, Entamoeba histolytica
MALDILQPLLLLISSSKMISTC

SEQ ID NO: 2585537 - protein, 24 aa, Entamoeba histolytica
MALNNFRVTMCEVRVPETRSQTRG

SEQ ID NO: 2585538 - protein, 17 aa, Entamoeba histolytica
MANYQGGIFKFPSTCNI

SEQ ID NO: 2585539 - protein, 20 aa, Entamoeba histolytica
MAPTCLSFFSSILRSFYSIL

SEQ ID NO: 2585540 - protein, 21 aa, Entamoeba histolytica
MAQILLKVLCDLLKRNWHFNF

SEQ ID NO: 2585541 - protein, 17 aa, Entamoeba histolytica
MATGSFCHVCRKNYLPQ

SEQ ID NO: 2585542 - protein, 23 aa, Entamoeba histolytica
MATYFCWLIIPLLMKENGASSFL

SEQ ID NO: 2585543 - protein, 26 aa, Entamoeba histolytica
MCFLSCIPLKISPTVFCGWRSIIIFG

SEQ ID NO: 2585544 - protein, 20 aa, Entamoeba histolytica
MCGLVMTLVLLLSFIYYGGS

SEQ ID NO: 2585545 - protein, 19 aa, Entamoeba histolytica
MCHKKGGDYIALMRSYFTG

SEQ ID NO: 2585546 - protein, 17 aa, Entamoeba histolytica
MCIVTEFAKYGSLRDLM

SEQ ID NO: 2585547 - protein, 19 aa, Entamoeba histolytica
MCLRLPSERVWLGCEDEPE

SEQ ID NO: 2585548 - protein, 23 aa, Entamoeba histolytica
MCSQVHLLWSCSLEVIISIVWLF

SEQ ID NO: 2585549 - protein, 19 aa, Entamoeba histolytica
MCYNYIPPKKIDEGKKEKE

SEQ ID NO: 2585550 - protein, 20 aa, Entamoeba histolytica
MCYQCPIGCSLCSGPDSCIT

SEQ ID NO: 2585551 - protein, 21 aa, Entamoeba histolytica
MDHARLTVMEAFFLGVSTSTD

SEQ ID NO: 2585552 - protein, 25 aa, Entamoeba histolytica
MDHHCPWLGTCVGFKNHKFFILFLC

SEQ ID NO: 2585553 - protein, 24 aa, Entamoeba histolytica
MDISCIPIAILVLLWVLKSLSLMI

SEQ ID NO: 2585554 - protein, 21 aa, Entamoeba histolytica
MDPFNIWALEMYPESFIHDST

SEQ ID NO: 2585555 - protein, 19 aa, Entamoeba histolytica
MDRWLRLRILGSKIPTQII

SEQ ID NO: 2585556 - protein, 32 aa, Entamoeba histolytica
MDVICLPLYFIYRPIYQWIFQRVTEVYMMYFP

SEQ ID NO: 2585557 - protein, 20 aa, Entamoeba histolytica
MECKICPIGSISNREGSKEC

SEQ ID NO: 2585558 - protein, 17 aa, Entamoeba histolytica
MECKVEVPISYRISYCA

SEQ ID NO: 2585559 - protein, 26 aa, Entamoeba histolytica
MEFIMYRVGGSIGFMSSTHLKVVEDI

SEQ ID NO: 2585560 - protein, 22 aa, Entamoeba histolytica
MEFTCSEPSVLMLTTQEVYESD

SEQ ID NO: 2585561 - protein, 19 aa, Entamoeba histolytica
MEFTLPFIDEFHINNDIFD

SEQ ID NO: 2585562 - protein, 18 aa, Entamoeba histolytica
MEGALPFFETTIIPFNKE

SEQ ID NO: 2585563 - protein, 20 aa, Entamoeba histolytica
MEHSFFYRWGYLMVAHYTNM

SEQ ID NO: 2585564 - protein, 18 aa, Entamoeba histolytica
MEKWKEKKDIIWKMKNLN

SEQ ID NO: 2585565 - protein, 17 aa, Entamoeba histolytica
MELEIGRVYEFSLMPRE

SEQ ID NO: 2585566 - protein, 19 aa, Entamoeba histolytica
MELKFKIKMLCTASVSDEI

SEQ ID NO: 2585567 - protein, 20 aa, Entamoeba histolytica
MEMLKLLPYSLKIHFVSGLE

SEQ ID NO: 2585568 - protein, 17 aa, Entamoeba histolytica
MEPSQVILFTFQKKYKP

SEQ ID NO: 2585569 - protein, 23 aa, Entamoeba histolytica
MERGTCWDFALIGFLEDSYRQNG

SEQ ID NO: 2585570 - protein, 19 aa, Entamoeba histolytica
MEYVHCFTIPLLGFVNCLY

SEQ ID NO: 2585571 - protein, 25 aa, Entamoeba histolytica
MFCCGHKYHRDCIINELNLHKTSFA

SEQ ID NO: 2585572 - protein, 23 aa, Entamoeba histolytica
MFDFSVYFYWLVLPVLLKKLQAG

SEQ ID NO: 2585573 - protein, 23 aa, Entamoeba histolytica
MFECGKERVELVTVSLINEIVSL

SEQ ID NO: 2585574 - protein, 19 aa, Entamoeba histolytica
MFEIPTLKKKGELFVIPKK

SEQ ID NO: 2585575 - protein, 20 aa, Entamoeba histolytica
MFEISSAFGTVGMSLGSSKD

SEQ ID NO: 2585576 - protein, 19 aa, Entamoeba histolytica
MFETMKWGPAYPKEQFKYP

SEQ ID NO: 2585577 - protein, 18 aa, Entamoeba histolytica
MFFARLLGIRVFLTEHSL

SEQ ID NO: 2585578 - protein, 25 aa, Entamoeba histolytica
MFFETEFKGDFSLLLDSTKSNRYVF

SEQ ID NO: 2585579 - protein, 22 aa, Entamoeba histolytica
MFGKEFYYGYEFLDDSRKTCSH

SEQ ID NO: 2585580 - protein, 18 aa, Entamoeba histolytica
MFHRCFSLILSALQQLFI

SEQ ID NO: 2585581 - protein, 24 aa, Entamoeba histolytica
MFIAFDFGLCYYIDETESVEFERD

SEQ ID NO: 2585582 - protein, 21 aa, Entamoeba histolytica
MFIEFMNNYRRCLKESRKQQE

SEQ ID NO: 2585583 - protein, 22 aa, Entamoeba histolytica
MFIILRQYFQLILNPDKTISTM

SEQ ID NO: 2585584 - protein, 23 aa, Entamoeba histolytica
MFIILRQYFQLILTHDKTISKMA

SEQ ID NO: 2585585 - protein, 19 aa, Entamoeba histolytica
MFINLLWQKSSGIMIDGVD

SEQ ID NO: 2585586 - protein, 25 aa, Entamoeba histolytica
MFISSVSLKELWVSSKVEKILLNGN

SEQ ID NO: 2585587 - protein, 24 aa, Entamoeba histolytica
MFKTPRIGFMGMITPYIPPKNENN

SEQ ID NO: 2585588 - protein, 20 aa, Entamoeba histolytica
MFLEIPRKQILNFLQILISK

SEQ ID NO: 2585589 - protein, 19 aa, Entamoeba histolytica
MFLNCCRFNAFTIDTKKEL

SEQ ID NO: 2585590 - protein, 18 aa, Entamoeba histolytica
MFNFASYFYWLVVPLKCV

SEQ ID NO: 2585591 - protein, 22 aa, Entamoeba histolytica
MFNLRMESIGTKIGNVIEEMRV

SEQ ID NO: 2585592 - protein, 23 aa, Entamoeba histolytica
MFYKLKYTYNLSFLSSFDTVNTS

SEQ ID NO: 2585593 - protein, 22 aa, Entamoeba histolytica
MGAFSLGSWYASVVLRGKGGKK

SEQ ID NO: 2585594 - protein, 22 aa, Entamoeba histolytica
MGCAIVVFTILCIYWVIDAINY

SEQ ID NO: 2585595 - protein, 21 aa, Entamoeba histolytica
MGCGALVFIVLTIYYIVSQFT

SEQ ID NO: 2585596 - protein, 20 aa, Entamoeba histolytica
MGCVPCTQNTWSNEGADECI

SEQ ID NO: 2585597 - protein, 18 aa, Entamoeba histolytica
MGDEAYLVKWKLFRSLAL

SEQ ID NO: 2585598 - protein, 28 aa, Entamoeba histolytica
MGDELRYRFNHVWKEFLETYFVPYKVEG

SEQ ID NO: 2585599 - protein, 17 aa, Entamoeba histolytica
MGDNFYRYSNIEINDQC

SEQ ID NO: 2585600 - protein, 21 aa, Entamoeba histolytica
MGFCSSNFWKRLTPIKTSLQV

SEQ ID NO: 2585601 - protein, 18 aa, Entamoeba histolytica
MGIERNGWAHEYIKIGTK

SEQ ID NO: 2585602 - protein, 17 aa, Entamoeba histolytica
MGIWISFQILRIGFVSI

SEQ ID NO: 2585603 - protein, 20 aa, Entamoeba histolytica
MGLFSIYCGALYNEFFGIAI

SEQ ID NO: 2585604 - protein, 24 aa, Entamoeba histolytica
MGLMAIYCGIVFNEFFGFSIDIFG

SEQ ID NO: 2585605 - protein, 18 aa, Entamoeba histolytica
MGLYKFLRFEKHFPNGLK

SEQ ID NO: 2585606 - protein, 17 aa, Entamoeba histolytica
MGNKGYVSIKYPMLINS

SEQ ID NO: 2585607 - protein, 30 aa, Entamoeba histolytica
MGSALQIFLGIYICVMLFVWGGSQNIKASF

SEQ ID NO: 2585608 - protein, 18 aa, Entamoeba histolytica
MGSFKFLFSQNACTKARR

SEQ ID NO: 2585609 - protein, 26 aa, Entamoeba histolytica
MGSLALGSWYGSLVIRGKGASKDCSA

SEQ ID NO: 2585610 - protein, 18 aa, Entamoeba histolytica
MGYISYWSGDYLLAKYCW

SEQ ID NO: 2585611 - protein, 32 aa, Entamoeba histolytica
MHKMIEGFKEWKIIFVDGFIRSTKFEYGINYV

SEQ ID NO: 2585612 - protein, 22 aa, Entamoeba histolytica
MICANSCFFLPFGYQTNLMVMK

SEQ ID NO: 2585613 - protein, 25 aa, Entamoeba histolytica
MICHMFCCSPLQFGISVSGLLVQDI

SEQ ID NO: 2585614 - protein, 20 aa, Entamoeba histolytica
MIDDLLLKRVEKINYSYILS

SEQ ID NO: 2585615 - protein, 19 aa, Entamoeba histolytica
MIDHFLYCGHLCIVQELLG

SEQ ID NO: 2585616 - protein, 28 aa, Entamoeba histolytica
MIDSFGYEFCCKWIFTLSMRVRNGLIGL

SEQ ID NO: 2585617 - protein, 19 aa, Entamoeba histolytica
MIDTVRIGYMNSKKSIIAL

SEQ ID NO: 2585618 - protein, 17 aa, Entamoeba histolytica
MIECAKVANAYEFVSKL

SEQ ID NO: 2585619 - protein, 28 aa, Entamoeba histolytica
MIGILSLTIYVCFSWRGYNDVIESNMAI

SEQ ID NO: 2585620 - protein, 19 aa, Entamoeba histolytica
MIGVLDMIICFVTYSSTNS

SEQ ID NO: 2585621 - protein, 22 aa, Entamoeba histolytica
MIHAIKFIKQVFDNICPNKNVS

SEQ ID NO: 2585622 - protein, 19 aa, Entamoeba histolytica
MIIGICILFIILIFVVIIA

SEQ ID NO: 2585623 - protein, 18 aa, Entamoeba histolytica
MIIIPLVVVGAIFIGTIL

SEQ ID NO: 2585624 - protein, 25 aa, Entamoeba histolytica
MIIIQCVICLILAILSGHSHSIIND

SEQ ID NO: 2585625 - protein, 17 aa, Entamoeba histolytica
MIIITGIICSGIISIII

SEQ ID NO: 2585626 - protein, 23 aa, Entamoeba histolytica
MIIMPYPFLGTWERKYVIGEDQS

SEQ ID NO: 2585627 - protein, 18 aa, Entamoeba histolytica
MIISICFVFIPPYYSKKM

SEQ ID NO: 2585628 - protein, 26 aa, Entamoeba histolytica
MIKADLSKIFGFTGIFGFVLILILPS

SEQ ID NO: 2585629 - protein, 20 aa, Entamoeba histolytica
MIKSNLCYNDPMSVAQFLKN

SEQ ID NO: 2585630 - protein, 19 aa, Entamoeba histolytica
MILCPSYLYPQPMSSDKIL

SEQ ID NO: 2585631 - protein, 23 aa, Entamoeba histolytica
MILHVRLNFLTQFMVQDETVYKL

SEQ ID NO: 2585632 - protein, 26 aa, Entamoeba histolytica
MILLLCISCGLVIVGMFLQSFSFDFL

SEQ ID NO: 2585633 - protein, 23 aa, Entamoeba histolytica
MINECPFSKILKSLIEENINGKF

SEQ ID NO: 2585634 - protein, 26 aa, Entamoeba histolytica
MIPTIPRRSSIQFSYHNLIEKTRSVL

SEQ ID NO: 2585635 - protein, 22 aa, Entamoeba histolytica
MIRNYMMLIIRGGMLQRLGVFG

SEQ ID NO: 2585636 - protein, 23 aa, Entamoeba histolytica
MISGCYLCFIFTRTFAKGYFKTG

SEQ ID NO: 2585637 - protein, 27 aa, Entamoeba histolytica
MITASCMPEFFVGLIGYALLGDMIFPA

SEQ ID NO: 2585638 - protein, 21 aa, Entamoeba histolytica
MITFDILCHLKYLNISNRPLS

SEQ ID NO: 2585639 - protein, 24 aa, Entamoeba histolytica
MITKGLKEWGGAILVGFDDPYCKD

SEQ ID NO: 2585640 - protein, 18 aa, Entamoeba histolytica
MIYFIPGIVSFVYGGKIK

SEQ ID NO: 2585641 - protein, 20 aa, Entamoeba histolytica
MKALTCAMFDFIFLTTNENI

SEQ ID NO: 2585642 - protein, 23 aa, Entamoeba histolytica
MKCSPIIRKGIFFSVKTVPYHTL

SEQ ID NO: 2585643 - protein, 18 aa, Entamoeba histolytica
MKDGIPLVVTGHSLGGGI

SEQ ID NO: 2585644 - protein, 24 aa, Entamoeba histolytica
MKEISKLYCVDSIFNIIGNVIFKE

SEQ ID NO: 2585645 - protein, 18 aa, Entamoeba histolytica
MKEMNYRDYVNIPKVEPR

SEQ ID NO: 2585646 - protein, 18 aa, Entamoeba histolytica
MKERGNAIIVGYLGDPEG

SEQ ID NO: 2585647 - protein, 19 aa, Entamoeba histolytica
MKETISLFLKYKEEKNQIV

SEQ ID NO: 2585648 - protein, 17 aa, Entamoeba histolytica
MKEYRDIQELNKAENEN

SEQ ID NO: 2585649 - protein, 29 aa, Entamoeba histolytica
MKFIPIILLRPLFRIPLKQNDLVIGVITL

SEQ ID NO: 2585650 - protein, 17 aa, Entamoeba histolytica
MKGKFLRKEDCDNGTNC

SEQ ID NO: 2585651 - protein, 18 aa, Entamoeba histolytica
MKGPIIVFENYVQITPNG

SEQ ID NO: 2585652 - protein, 26 aa, Entamoeba histolytica
MKGRIIQALMCFVPFYGQLKYINEIL

SEQ ID NO: 2585653 - protein, 21 aa, Entamoeba histolytica
MKGVAYFDLLVYYHKKIQKKL

SEQ ID NO: 2585654 - protein, 25 aa, Entamoeba histolytica
MKGYLAVVICGFVFVDQECAKRVQL

SEQ ID NO: 2585655 - protein, 19 aa, Entamoeba histolytica
MKIFIGIFIIVAVITIIAG

SEQ ID NO: 2585656 - protein, 22 aa, Entamoeba histolytica
MKKDKCIDCSIFTNDCIQCNNQ

SEQ ID NO: 2585657 - protein, 22 aa, Entamoeba histolytica
MKKIMSCFFDIIPRFKQGYSFC

SEQ ID NO: 2585658 - protein, 24 aa, Entamoeba histolytica
MKKLSKEYFGFIGSICDMKEAHIA

SEQ ID NO: 2585659 - protein, 22 aa, Entamoeba histolytica
MKKNFLFNGDCLISIHVDMHSI

SEQ ID NO: 2585660 - protein, 17 aa, Entamoeba histolytica
MKKTWNFDSIGDRFYMR

SEQ ID NO: 2585661 - protein, 19 aa, Entamoeba histolytica
MKLFHPIFIAVMTRIQIVS

SEQ ID NO: 2585662 - protein, 20 aa, Entamoeba histolytica
MKLFREIEHLLSTLSNRFDI

SEQ ID NO: 2585663 - protein, 17 aa, Entamoeba histolytica
MKLKRKNLYNFFKDDID

SEQ ID NO: 2585664 - protein, 20 aa, Entamoeba histolytica
MKLMKHPRKPTEIVVYTDSF

SEQ ID NO: 2585665 - protein, 20 aa, Entamoeba histolytica
MKLMKHPRKPTEIVVYTDSY

SEQ ID NO: 2585666 - protein, 20 aa, Entamoeba histolytica
MKLNNEIKSLLFVVDTLNPT

SEQ ID NO: 2585667 - protein, 17 aa, Entamoeba histolytica
MKLPFLKQVKDLVDHFP

SEQ ID NO: 2585668 - protein, 24 aa, Entamoeba histolytica
MKLSDPSFSCFSRMSQFLLNSSHF

SEQ ID NO: 2585669 - protein, 25 aa, Entamoeba histolytica
MKMFYKRIGLGITFYMLVWAISIFE

SEQ ID NO: 2585670 - protein, 20 aa, Entamoeba histolytica
MKNKESFVAKGFEYLNDAPK

SEQ ID NO: 2585671 - protein, 36 aa, Entamoeba histolytica
MKNKIIKIQILLIFHMIKLMLVLMIFLIIIITLMEH

SEQ ID NO: 2585672 - protein, 18 aa, Entamoeba histolytica
MKNNHRFTSILSEKLNKQ

SEQ ID NO: 2585673 - protein, 20 aa, Entamoeba histolytica
MKNQSLIVYFDLFMKYLQFI

SEQ ID NO: 2585674 - protein, 24 aa, Entamoeba histolytica
MKQHFCLAFIKMMINEYINISIFT

SEQ ID NO: 2585675 - protein, 17 aa, Entamoeba histolytica
MKQMKIDNCFGTIQRVV

SEQ ID NO: 2585676 - protein, 19 aa, Entamoeba histolytica
MKQTCKNWHLGGMGCSAGV

SEQ ID NO: 2585677 - protein, 28 aa, Entamoeba histolytica
MKRGEVDACFSLGCKYCPPHTFRRNHKC

SEQ ID NO: 2585678 - protein, 18 aa, Entamoeba histolytica
MKRIIKKRASYRKYSKEQ

SEQ ID NO: 2585679 - protein, 25 aa, Entamoeba histolytica
MKRWKREIKQTVGIGNYIKKSDDFS

SEQ ID NO: 2585680 - protein, 24 aa, Entamoeba histolytica
MKSIIPAISSKSIRTWIACNDSNL

SEQ ID NO: 2585681 - protein, 17 aa, Entamoeba histolytica
MKSLMIMYQEILTEQEM

SEQ ID NO: 2585682 - protein, 20 aa, Entamoeba histolytica
MKSSQNMRIVPMVSKGIIKQ

SEQ ID NO: 2585683 - protein, 17 aa, Entamoeba histolytica
MKTQAVIRLVLDSPSES

SEQ ID NO: 2585684 - protein, 20 aa, Entamoeba histolytica
MKTSTGIITFIWIIEQFIEK

SEQ ID NO: 2585685 - protein, 18 aa, Entamoeba histolytica
MKVTLLGNHFPNFLTMRT

SEQ ID NO: 2585686 - protein, 22 aa, Entamoeba histolytica
MKYLERENILILSKETLESYLI

SEQ ID NO: 2585687 - protein, 21 aa, Entamoeba histolytica
MKYRGCFLLLTGISLSYYSIF

SEQ ID NO: 2585688 - protein, 19 aa, Entamoeba histolytica
MLASSLLIRLIPFLRIFEL

SEQ ID NO: 2585689 - protein, 17 aa, Entamoeba histolytica
MLDEFLEDIELTFKMIC

SEQ ID NO: 2585690 - protein, 19 aa, Entamoeba histolytica
MLDKFRCEYIVHFYGAVFI

SEQ ID NO: 2585691 - protein, 19 aa, Entamoeba histolytica
MLDKFRNEYIIQFYGAVFI

SEQ ID NO: 2585692 - protein, 18 aa, Entamoeba histolytica
MLEKCIETPFIYDYPKSI

SEQ ID NO: 2585693 - protein, 23 aa, Entamoeba histolytica
MLERIRSPYIINFIGSVITVDTL

SEQ ID NO: 2585694 - protein, 25 aa, Entamoeba histolytica
MLFAYKYGKVYAFCISVIIHTLSEI

SEQ ID NO: 2585695 - protein, 18 aa, Entamoeba histolytica
MLFTSIAHPCSTYYKQLN

SEQ ID NO: 2585696 - protein, 17 aa, Entamoeba histolytica
MLGDLLSRFAVYIPIPW

SEQ ID NO: 2585697 - protein, 23 aa, Entamoeba histolytica
MLGDSRLKFIIQLLASSLTGREM

SEQ ID NO: 2585698 - protein, 24 aa, Entamoeba histolytica
MLGIKCSFIPIILYLMVALLSINS

SEQ ID NO: 2585699 - protein, 20 aa, Entamoeba histolytica
MLHKISGWLFGIFAIIHSCC

SEQ ID NO: 2585700 - protein, 22 aa, Entamoeba histolytica
MLICDTHLWYIWKMYYSNDNFP

SEQ ID NO: 2585701 - protein, 20 aa, Entamoeba histolytica
MLIHCLGIFCSKQENGGFKL

SEQ ID NO: 2585702 - protein, 19 aa, Entamoeba histolytica
MLIKIAIQVTYQLGILLTI

SEQ ID NO: 2585703 - protein, 18 aa, Entamoeba histolytica
MLIRKQWNSTIIKSVISP

SEQ ID NO: 2585704 - protein, 19 aa, Entamoeba histolytica
MLKHLKNVILQLGKPKDQM

SEQ ID NO: 2585705 - protein, 17 aa, Entamoeba histolytica
MLKQANVRVWMLTGDKV

SEQ ID NO: 2585706 - protein, 24 aa, Entamoeba histolytica
MLPCKHSACRSCIERHMEHHNECF

SEQ ID NO: 2585707 - protein, 25 aa, Entamoeba histolytica
MLPLLKEYFYPFITKFLPFLLQRCK

SEQ ID NO: 2585708 - protein, 19 aa, Entamoeba histolytica
MLQRRILALIITLDGKSIE

SEQ ID NO: 2585709 - protein, 18 aa, Entamoeba histolytica
MLSSLFNIVVIFPFVLCF

SEQ ID NO: 2585710 - protein, 33 aa, Entamoeba histolytica
MLTSGITTILSWRGSILYFKSIVVPDSFNSVEN

SEQ ID NO: 2585711 - protein, 25 aa, Entamoeba histolytica
MLVIDPLAFRSWDDYVLNNLKHSEQ

SEQ ID NO: 2585712 - protein, 29 aa, Entamoeba histolytica
MMCNMFQKHVFYRGFTLPTFLKECMAYAI

SEQ ID NO: 2585713 - protein, 25 aa, Entamoeba histolytica
MMHPEVPRRLVLPDFFFKVLPYFKQ

SEQ ID NO: 2585714 - protein, 19 aa, Entamoeba histolytica
MMKHPDIILPNGQRVDPTT

SEQ ID NO: 2585715 - protein, 26 aa, Entamoeba histolytica
MMKMLGMKMTPYWVLHIVYFFCIFLI

SEQ ID NO: 2585716 - protein, 21 aa, Entamoeba histolytica
MMLLFYCFYKYLFYEETPKQS

SEQ ID NO: 2585717 - protein, 24 aa, Entamoeba histolytica
MMPSENDYSIGLRIKYGNFIYATS

SEQ ID NO: 2585718 - protein, 25 aa, Entamoeba histolytica
MMTYKEFYSLAAIERCRIKDSLHNH

SEQ ID NO: 2585719 - protein, 28 aa, Entamoeba histolytica
MMVRLSKCPFCLIMGLFLFVSLEETPIV

SEQ ID NO: 2585720 - protein, 17 aa, Entamoeba histolytica
MNDCLNAACKLESDLFK

SEQ ID NO: 2585721 - protein, 26 aa, Entamoeba histolytica
MNDLLKIRFCQDISRGMEYLHQNDIV

SEQ ID NO: 2585722 - protein, 17 aa, Entamoeba histolytica
MNEAMKKLYDRGLFSYL

SEQ ID NO: 2585723 - protein, 23 aa, Entamoeba histolytica
MNECVKCGKGYYSNKGDSFCHLC

SEQ ID NO: 2585724 - protein, 23 aa, Entamoeba histolytica
MNGIEVIHLFTGKPLLHVTLLTS

SEQ ID NO: 2585725 - protein, 17 aa, Entamoeba histolytica
MNITLCFQEMKKQNKKI

SEQ ID NO: 2585726 - protein, 17 aa, Entamoeba histolytica
MNIVFAFVAGNQVNTKM

SEQ ID NO: 2585727 - protein, 23 aa, Entamoeba histolytica
MNKMCIEEGVIPSGFDLVQSIYS

SEQ ID NO: 2585728 - protein, 17 aa, Entamoeba histolytica
MNLDFDFFLSVLEFATH

SEQ ID NO: 2585729 - protein, 19 aa, Entamoeba histolytica
MNLLECFPVFHPSLELLKI

SEQ ID NO: 2585730 - protein, 18 aa, Entamoeba histolytica
MNNFCEYLVKFIFHCLPQ

SEQ ID NO: 2585731 - protein, 22 aa, Entamoeba histolytica
MNNGVFCIIGILSTNEVFKLDK

SEQ ID NO: 2585732 - protein, 22 aa, Entamoeba histolytica
MNNNIIKWVCQRSERDGIKIIY

SEQ ID NO: 2585733 - protein, 25 aa, Entamoeba histolytica
MNQFVFGIFCFKIVIVIVATIAGSL

SEQ ID NO: 2585734 - protein, 19 aa, Entamoeba histolytica
MNQNIVMLWRLLKRESTIR

SEQ ID NO: 2585735 - protein, 17 aa, Entamoeba histolytica
MNWFEILLGIAIIFFSF

SEQ ID NO: 2585736 - protein, 20 aa, Entamoeba histolytica
MNWSLLISVLFWNINGVDGC

SEQ ID NO: 2585737 - protein, 22 aa, Entamoeba histolytica
MPAQYGYFLFWALKSKENIGKY

SEQ ID NO: 2585738 - protein, 24 aa, Entamoeba histolytica
MPKAKEFICFSSGWHNVIKRFRLL

SEQ ID NO: 2585739 - protein, 23 aa, Entamoeba histolytica
MPKCNPPLYSFERIRLEEYKSII

SEQ ID NO: 2585740 - protein, 19 aa, Entamoeba histolytica
MPLLLKIMIESCWKQNPQD

SEQ ID NO: 2585741 - protein, 17 aa, Entamoeba histolytica
MPMSASFTKSQSMFIKR

SEQ ID NO: 2585742 - protein, 20 aa, Entamoeba histolytica
MPSFSFKLNLEYSFQPFNDI

SEQ ID NO: 2585743 - protein, 24 aa, Entamoeba histolytica
MPSICKKTEMGYCVQCDDKYFLQG

SEQ ID NO: 2585744 - protein, 23 aa, Entamoeba histolytica
MPTLHRIACFRDDIIFLIYLYQR

SEQ ID NO: 2585745 - protein, 19 aa, Entamoeba histolytica
MPVFLQRIVGVVLALIAGI

SEQ ID NO: 2585746 - protein, 17 aa, Entamoeba histolytica
MQGTPSAYRNVTMTSEH

SEQ ID NO: 2585747 - protein, 18 aa, Entamoeba histolytica
MQLARVITTIALFNSIRI

SEQ ID NO: 2585748 - protein, 17 aa, Entamoeba histolytica
MQLERRWDNNSFCRGYY

SEQ ID NO: 2585749 - protein, 33 aa, Entamoeba histolytica
MQLLYCSIFNFAPLPLYIGWYMIFFTTMFNQLP

SEQ ID NO: 2585750 - protein, 26 aa, Entamoeba histolytica
MQNLLIDILLEFGFFFDSKMARHSQK

SEQ ID NO: 2585751 - protein, 24 aa, Entamoeba histolytica
MREVDCGFSTYPSLYVHSVSNSMA

SEQ ID NO: 2585752 - protein, 17 aa, Entamoeba histolytica
MRFKKCFIDGNEFTTSF

SEQ ID NO: 2585753 - protein, 19 aa, Entamoeba histolytica
MRFKVPFTYCEFGTHISLL

SEQ ID NO: 2585754 - protein, 18 aa, Entamoeba histolytica
MRKECLSLVHIIIDSIKK

SEQ ID NO: 2585755 - protein, 25 aa, Entamoeba histolytica
MRLLDCPPLVLSVLQSLKIVLFSNS

SEQ ID NO: 2585756 - protein, 18 aa, Entamoeba histolytica
MRMAFKPIMAKLFGNDNV

SEQ ID NO: 2585757 - protein, 18 aa, Entamoeba histolytica
MRRLSEKKFWVRSFGVVF

SEQ ID NO: 2585758 - protein, 20 aa, Entamoeba histolytica
MRSAFGYSFSLYFSALIVMI

SEQ ID NO: 2585759 - protein, 17 aa, Entamoeba histolytica
MRVRNGLIGLIFEKALK

SEQ ID NO: 2585760 - protein, 26 aa, Entamoeba histolytica
MSAFTKRYDYGLTWSDMLEKVPNSNV

SEQ ID NO: 2585761 - protein, 19 aa, Entamoeba histolytica
MSCRVCSSGYFLNETKGCS

SEQ ID NO: 2585762 - protein, 31 aa, Entamoeba histolytica; identical to SEQ ID NO: 2387843

SEQ ID NO: 2585763 - protein, 25 aa, Entamoeba histolytica
MSEFLKVRFCQDIARGMEYLHENDI

SEQ ID NO: 2585764 - protein, 24 aa, Entamoeba histolytica
MSFPIDFKPLFMFDIESIKPTKEV

SEQ ID NO: 2585765 - protein, 18 aa, Entamoeba histolytica
MSGLFSFNMNGERDKFLF

SEQ ID NO: 2585766 - protein, 17 aa, Entamoeba histolytica
MSHIIVRLIPWLHILSE

SEQ ID NO: 2585767 - protein, 24 aa, Entamoeba histolytica
MSIMMLWPRMEKLGDPNFRKLSVI

SEQ ID NO: 2585768 - protein, 24 aa, Entamoeba histolytica
MSKQRAVELLSLFIQSVIDKEIGL

SEQ ID NO: 2585769 - protein, 34 aa, Entamoeba histolytica
MSMFPICVIGATIFLKCCLYLYCRTVNNPAAGAL

SEQ ID NO: 2585770 - protein, 18 aa, Entamoeba histolytica
MSPKHVLAIRYIINICKE

SEQ ID NO: 2585771 - protein, 25 aa, Entamoeba histolytica
MSSEGRQAYPACLPGTIMRVIRFSI

SEQ ID NO: 2585772 - protein, 18 aa, Entamoeba histolytica
MSSLRKSNDIVIFSDGLC

SEQ ID NO: 2585773 - protein, 20 aa, Entamoeba histolytica
MSTGRKVAWFIFAIGIVPLL

SEQ ID NO: 2585774 - protein, 23 aa, Entamoeba histolytica
MSTYFCWLIIPLLMKENGATPFD

SEQ ID NO: 2585775 - protein, 24 aa, Entamoeba histolytica
MSVELKLRFCHDIASGMDYLHQND

SEQ ID NO: 2585776 - protein, 21 aa, Entamoeba histolytica
MSVFIPLFFQVLFESFNQYNE

SEQ ID NO: 2585777 - protein, 17 aa, Entamoeba histolytica
MSYCNKTRIPNLISTMT

SEQ ID NO: 2585778 - protein, 27 aa, Entamoeba histolytica
MTASFIIKIIWFRGIVRESSGLLMKIM

SEQ ID NO: 2585779 - protein, 27 aa, Entamoeba histolytica
MTELIIKTMCEWCVYYDFNSCKSCNIQ

SEQ ID NO: 2585780 - protein, 23 aa, Entamoeba histolytica
MTELWKKGELSNFNYLMYLNTKA

SEQ ID NO: 2585781 - protein, 24 aa, Entamoeba histolytica
MTELWKKGELSNFNYLMYLNTKAG

SEQ ID NO: 2585782 - protein, 17 aa, Entamoeba histolytica
MTFLICVSTIWNRYHYL

SEQ ID NO: 2585783 - protein, 27 aa, Entamoeba histolytica
MTGINYEFVKNLFIKNGNDLKTYTSVL

SEQ ID NO: 2585784 - protein, 18 aa, Entamoeba histolytica
MTIAEYKAVVEIQRKISK

SEQ ID NO: 2585785 - protein, 27 aa, Entamoeba histolytica
MTIAFIIKIIWYRGVIRENSGLLMKVV

SEQ ID NO: 2585786 - protein, 19 aa, Entamoeba histolytica
MTLAVCIFYSMYLFVHEEP

SEQ ID NO: 2585787 - protein, 21 aa, Entamoeba histolytica
MTLSTFCWGFFNSKFTERITL

SEQ ID NO: 2585788 - protein, 20 aa, Entamoeba histolytica
MTMYIVFKGKFLRERIQWKI

SEQ ID NO: 2585789 - protein, 20 aa, Entamoeba histolytica
MTRIEGMFLYEVKQYKYDDF

SEQ ID NO: 2585790 - protein, 24 aa, Entamoeba histolytica
MTRLRGPYIVGFIGACYLEKKMCI

SEQ ID NO: 2585791 - protein, 17 aa, Entamoeba histolytica
MTWDQFKTHPFVVDCLK

SEQ ID NO: 2585792 - protein, 20 aa, Entamoeba histolytica
MTWIFFNVMTGFSFFGIAFS

SEQ ID NO: 2585793 - protein, 23 aa, Entamoeba histolytica
MVCLIQFFLGVFLCFFALKTNSL

SEQ ID NO: 2585794 - protein, 21 aa, Entamoeba histolytica
MVKESHFNYSFVIPQLGTVRQ

SEQ ID NO: 2585795 - protein, 23 aa, Entamoeba histolytica
MVLSSPPWNCFSPQIQSDIPLPQ

SEQ ID NO: 2585796 - protein, 17 aa, Entamoeba histolytica
MVNGWSSGTGFAGVAGS

SEQ ID NO: 2585797 - protein, 17 aa, Entamoeba histolytica
MVSPIIVERGIDGALKE

SEQ ID NO: 2585798 - protein, 22 aa, Entamoeba histolytica
MVVDLFDYFAVNSIEEMNFVIT

SEQ ID NO: 2585799 - protein, 22 aa, Entamoeba histolytica
MVVELEHLLRIAFITFNDIDIR

SEQ ID NO: 2585800 - protein, 20 aa, Entamoeba histolytica
MVYYIQSWVVLSSESNDTPP

SEQ ID NO: 2585801 - protein, 18 aa, Entamoeba histolytica
MWERGSAIIVGYEGDPEG

SEQ ID NO: 2585802 - protein, 19 aa, Entamoeba histolytica
MWYGSLSFQQLVKFKTTPS

SEQ ID NO: 2585803 - protein, 21 aa, Entamoeba histolytica
MYAKRGWCDDCLKTLEDVHLF

SEQ ID NO: 2585804 - protein, 25 aa, Entamoeba histolytica
MYEEAIKCILKLCVEDIYLTKIKVE

SEQ ID NO: 2585805 - protein, 24 aa, Entamoeba histolytica
MYEILGRVVRLMILFGKNTINANF

SEQ ID NO: 2585806 - protein, 20 aa, Entamoeba histolytica
MYEILNWKTPYDTPQFEYSW

SEQ ID NO: 2585807 - protein, 17 aa, Entamoeba histolytica
MYFICFFIVPPILHKWG

SEQ ID NO: 2585808 - protein, 17 aa, Entamoeba histolytica
MYHPALMIYQFLSELGF

SEQ ID NO: 2585809 - protein, 18 aa, Entamoeba histolytica
MYKIYSSKTKRMYNTYHV

SEQ ID NO: 2585810 - protein, 17 aa, Entamoeba histolytica
MYLFEIIGVIIIVVSLA

SEQ ID NO: 2585811 - protein, 18 aa, Entamoeba histolytica
MYLFLMMHLLHFLQMTYY

SEQ ID NO: 2585812 - protein, 22 aa, Entamoeba histolytica
MYLIGCGESIYYYKDKKSDCLC

SEQ ID NO: 2585813 - protein, 24 aa, Entamoeba histolytica
MYLKSGNCSLSYFLTISSSPYELT

SEQ ID NO: 2585814 - protein, 18 aa, Entamoeba histolytica
MYLPWALVVLNFILGAPI

SEQ ID NO: 2585815 - protein, 19 aa, Entamoeba histolytica
MYLYFMVNWTTTVNGKHKQ

SEQ ID NO: 2585816 - protein, 22 aa, Entamoeba histolytica
MYMLAGCYYLITKGWSFLISKE

SEQ ID NO: 2585817 - protein, 24 aa, Entamoeba histolytica
MYPEYRYLCCFDEECNPMLPTKDE

SEQ ID NO: 2585818 - protein, 18 aa, Entamoeba histolytica
MYPTRTGMVGGITGVMYD

SEQ ID NO: 2585819 - protein, 17 aa, Entamoeba histolytica
MYPTTAFKKTQNKTPMK

SEQ ID NO: 2585820 - protein, 32 aa, Entamoeba histolytica
MYQMRRSLYEWAHLRTYFIIERIKKVMKIFIH

SEQ ID NO: 2585821 - protein, 18 aa, Entamoeba histolytica
MYQTWSWKNPYDKDEGSR

SEQ ID NO: 2585822 - protein, 19 aa, Entamoeba histolytica
MYVTEAFNLYVLDKSSPDP

SEQ ID NO: 2585823 - protein, 24 aa, Entamoeba histolytica
NAAGFWVMICISTFNGLPTPINSS

SEQ ID NO: 2585824 - protein, 18 aa, Entamoeba histolytica
NACIKPKIVSLFKDGDSY

SEQ ID NO: 2585825 - protein, 26 aa, Entamoeba histolytica
NACLRHIPARFIVGIIVLVIVLLISV

SEQ ID NO: 2585826 - protein, 19 aa, Entamoeba histolytica
NADVWKFEDISGIKAKGKS

SEQ ID NO: 2585827 - protein, 21 aa, Entamoeba histolytica
NAFCFNGILLVLIAFGVNQFS

SEQ ID NO: 2585828 - protein, 19 aa, Entamoeba histolytica
NAFEFLKPMVDMLLTVTET

SEQ ID NO: 2585829 - protein, 25 aa, Entamoeba histolytica
NAGGKYLCDKECFTSVIGIQKELSL

SEQ ID NO: 2585830 - protein, 23 aa, Entamoeba histolytica
NAIECIQCKSGYYLNSMKECQNG

SEQ ID NO: 2585831 - protein, 19 aa, Entamoeba histolytica
NAITYFSIVSNILYQSQRF

SEQ ID NO: 2585832 - protein, 21 aa, Entamoeba histolytica
NAKCTVLRLGDSMTTHSYLND

SEQ ID NO: 2585833 - protein, 19 aa, Entamoeba histolytica
NAKVGASIAYELSLLTNSP

SEQ ID NO: 2585834 - protein, 21 aa, Entamoeba histolytica
NALFFDFYYSLPFKVAISNTK

SEQ ID NO: 2585835 - protein, 22 aa, Entamoeba histolytica
NALKRQQLKIAYSTENCLLQTI

SEQ ID NO: 2585836 - protein, 20 aa, Entamoeba histolytica
NALYYVRTALNFGDILCSFG

SEQ ID NO: 2585837 - protein, 19 aa, Entamoeba histolytica
NAMSQFVSWLLADEDNILD

SEQ ID NO: 2585838 - protein, 22 aa, Entamoeba histolytica
NAPDNECYILWTQVQPVYDNGD

SEQ ID NO: 2585839 - protein, 20 aa, Entamoeba histolytica
NASVICGFVALLLMVNGIYM

SEQ ID NO: 2585840 - protein, 18 aa, Entamoeba histolytica
NAVFKIGPLKMLEYPFSD

SEQ ID NO: 2585841 - protein, 19 aa, Entamoeba histolytica
NAVFTYRGTNELNISTLTI

SEQ ID NO: 2585842 - protein, 26 aa, Entamoeba histolytica
NAVGKEWRIDLTLKLLSVISLDRFGD

SEQ ID NO: 2585843 - protein, 24 aa, Entamoeba histolytica
NAVLFVPMLVVSVFFDVKGTKEKQ

SEQ ID NO: 2585844 - protein, 18 aa, Entamoeba histolytica
NAVLYLLSFWNKVITSTQ

SEQ ID NO: 2585845 - protein, 24 aa, Entamoeba histolytica
NAYGYYLGICFMKKTINYQQDVPN

SEQ ID NO: 2585846 - protein, 25 aa, Entamoeba histolytica
NCEAKCCVCSGVIKNTEESFKCSNC

SEQ ID NO: 2585847 - protein, 18 aa, Entamoeba histolytica
NCEELKRLIQKICSDALR

SEQ ID NO: 2585848 - protein, 24 aa, Entamoeba histolytica
NCEICTITHCLKCKNNNVLDIDGK

SEQ ID NO: 2585849 - protein, 25 aa, Entamoeba histolytica
NCIDNRTRYCWICEKHLNSQKGCIG

SEQ ID NO: 2585850 - protein, 19 aa, Entamoeba histolytica
NCINSKVLVNKGVIRLGGS

SEQ ID NO: 2585851 - protein, 21 aa, Entamoeba histolytica
NCKDIPLCILELEQNPSESLK

SEQ ID NO: 2585852 - protein, 19 aa, Entamoeba histolytica
NCKIKLKIFLDAAKGIQYL

SEQ ID NO: 2585853 - protein, 18 aa, Entamoeba histolytica
NCKNCIWYSDLEAPGCKE

SEQ ID NO: 2585854 - protein, 20 aa, Entamoeba histolytica
NCKTCFSSAIYYMSCSSDKY

SEQ ID NO: 2585855 - protein, 20 aa, Entamoeba histolytica
NCLIIPIGAFFAGVSAAYLG

SEQ ID NO: 2585856 - protein, 17 aa, Entamoeba histolytica
NCLPDYFLKEGNCYTCY

SEQ ID NO: 2585857 - protein, 23 aa, Entamoeba histolytica
NCLPNCVCDKGYVVTSDHRCKIM

SEQ ID NO: 2585858 - protein, 23 aa, Entamoeba histolytica
NCNKCSIDSNGIKNCSLCSSNYE

SEQ ID NO: 2585859 - protein, 20 aa, Entamoeba histolytica
NCNSFCQCLDGHIPDPNDPM

SEQ ID NO: 2585860 - protein, 22 aa, Entamoeba histolytica
NCNWLLCILSYIAGLSSGFANQ

SEQ ID NO: 2585861 - protein, 23 aa, Entamoeba histolytica
NCPCTGVNCHLIYASTSEIINET

SEQ ID NO: 2585862 - protein, 28 aa, Entamoeba histolytica
NCPEPSFPWFYKLWRVQGYYNLLILKCY

SEQ ID NO: 2585863 - protein, 20 aa, Entamoeba histolytica
NCQVSERFIASGLRSFSVIG

SEQ ID NO: 2585864 - protein, 24 aa, Entamoeba histolytica
NCRKYKNGVCVKCFGPYKPVNGTC

SEQ ID NO: 2585865 - protein, 21 aa, Entamoeba histolytica
NCSPIRLFCMSIHLMEISHMN

SEQ ID NO: 2585866 - protein, 17 aa, Entamoeba histolytica
NCSSCLNENYCFRCGPN

SEQ ID NO: 2585867 - protein, 23 aa, Entamoeba histolytica
NCSSRIWLEDTFRTVDGKKQKPY

SEQ ID NO: 2585868 - protein, 24 aa, Entamoeba histolytica
NCTELDGPVCVRCDDGFYVDKDGT

SEQ ID NO: 2585869 - protein, 21 aa, Entamoeba histolytica
NCTGIKGWIGELIKIGTSLQK

SEQ ID NO: 2585870 - protein, 33 aa, Entamoeba histolytica
NCTNVCLPLCEIQGCISGCRFPDDCSLCDITKG

SEQ ID NO: 2585871 - protein, 17 aa, Entamoeba histolytica
NCVTSPIGNNGCLLRIR

SEQ ID NO: 2585872 - protein, 19 aa, Entamoeba histolytica
NDAECKSVDSVVDTLTSVL

SEQ ID NO: 2585873 - protein, 25 aa, Entamoeba histolytica
NDCILKEIIEWAWSHVPSERPSFKE

SEQ ID NO: 2585874 - protein, 29 aa, Entamoeba histolytica
NDDSWKKRIDMEWKRKISQKFQTNEHEEI

SEQ ID NO: 2585875 - protein, 24 aa, Entamoeba histolytica
NDFLPEYRRAYATVAFHGTYLPKH

SEQ ID NO: 2585876 - protein, 27 aa, Entamoeba histolytica
NDGYVLKDETCSLCGNGKLDEGEECDL

SEQ ID NO: 2585877 - protein, 24 aa, Entamoeba histolytica
NDGYYKKDSICFGCEDPMETCITK

SEQ ID NO: 2585878 - protein, 27 aa, Entamoeba histolytica
NDGYYKKVSLCFSCPNSMKTCLGPNQA

SEQ ID NO: 2585879 - protein, 24 aa, Entamoeba histolytica
NDHTLRLRCLFNRSIKTYANIISF

SEQ ID NO: 2585880 - protein, 25 aa, Entamoeba histolytica
NDIKMKKAECVRIMTDYDIELKFLN

SEQ ID NO: 2585881 - protein, 19 aa, Entamoeba histolytica
NDILFRSGTYYIPDIIEYT

SEQ ID NO: 2585882 - protein, 21 aa, Entamoeba histolytica
NDINICKQLFIGQLFGKSNTI

SEQ ID NO: 2585883 - protein, 27 aa, Entamoeba histolytica
NDIQLEWWIYIIICNGIILLFIMFIII

SEQ ID NO: 2585884 - protein, 20 aa, Entamoeba histolytica
NDIWQWAFGRMFGKHKPFTF

SEQ ID NO: 2585885 - protein, 22 aa, Entamoeba histolytica
NDKLSYFWIFFTFIILYNNLVP

SEQ ID NO: 2585886 - protein, 23 aa, Entamoeba histolytica
NDLKEAAHAYVFTDINNSSIKEH

SEQ ID NO: 2585887 - protein, 25 aa, Entamoeba histolytica
NDLLKILGVIVFCVVMYFINGFNKN

SEQ ID NO: 2585888 - protein, 21 aa, Entamoeba histolytica
NDLTSYFGLIEFYEKYLETHR

SEQ ID NO: 2585889 - protein, 22 aa, Entamoeba histolytica
NDLYLNEIVKFIKCIINNETNK

SEQ ID NO: 2585890 - protein, 19 aa, Entamoeba histolytica
NDMKNVFDVIVNIINQTIN

SEQ ID NO: 2585891 - protein, 17 aa, Entamoeba histolytica
NDNCVKITLPMYTPDAE

SEQ ID NO: 2585892 - protein, 22 aa, Entamoeba histolytica
NDNLPFSMYWSGHYHQKNLHVY

SEQ ID NO: 2585893 - protein, 22 aa, Entamoeba histolytica
NDNVPLFEGWRCNNLQLDKKMF

SEQ ID NO: 2585894 - protein, 18 aa, Entamoeba histolytica
NDNWCVKVSDFGLSTPLL

SEQ ID NO: 2585895 - protein, 21 aa, Entamoeba histolytica
NDSFGSLSLEAVTPDTTFDGA

SEQ ID NO: 2585896 - protein, 23 aa, Entamoeba histolytica
NDSLKWKIVHLNFYTPNETVASD

SEQ ID NO: 2585897 - protein, 17 aa, Entamoeba histolytica
NDSRFSLKAQFDHCDYQ

SEQ ID NO: 2585898 - protein, 17 aa, Entamoeba histolytica
NDTFKIGSPFGGMIYLR

SEQ ID NO: 2585899 - protein, 23 aa, Entamoeba histolytica
NDTQIKFIVCQRIISTDLIGILS

SEQ ID NO: 2585900 - protein, 24 aa, Entamoeba histolytica
NDVKIRLNKDLGISYMNIGNINKA

SEQ ID NO: 2585901 - protein, 21 aa, Entamoeba histolytica
NDVPVVLSLLFFFLVNNVTIE

SEQ ID NO: 2585902 - protein, 23 aa, Entamoeba histolytica
NDWSCLFVLWLSIAIQFKINNNH

SEQ ID NO: 2585903 - protein, 20 aa, Entamoeba histolytica
NDYSISLRIQYGEFVYFTGG

SEQ ID NO: 2585904 - protein, 23 aa, Entamoeba histolytica
NECDNWYALAYDRKGCVRYTSGW

SEQ ID NO: 2585905 - protein, 30 aa, Entamoeba histolytica
NECIDMPCLYPMAVALTFSREVFQKISNNK

SEQ ID NO: 2585906 - protein, 26 aa, Entamoeba histolytica
NECLYFKGEFPSILLERCKTFEERLI

SEQ ID NO: 2585907 - protein, 19 aa, Entamoeba histolytica
NECLYRRLENSVVNFCTEM

SEQ ID NO: 2585908 - protein, 18 aa, Entamoeba histolytica
NECNILWTQVQPVYDKGN

SEQ ID NO: 2585909 - protein, 18 aa, Entamoeba histolytica
NECTRCIEPEYQWDCHSC

SEQ ID NO: 2585910 - protein, 19 aa, Entamoeba histolytica
NEDWVPAVLFGNGKQDISL

SEQ ID NO: 2585911 - protein, 20 aa, Entamoeba histolytica
NEEFKCIKCKNGYSLNSNNK

SEQ ID NO: 2585912 - protein, 21 aa, Entamoeba histolytica
NEEFKCIKCKNGYYLNSKHEC

SEQ ID NO: 2585913 - protein, 20 aa, Entamoeba histolytica
NEEFKCIKCKNGYYLNSNNE

SEQ ID NO: 2585914 - protein, 21 aa, Entamoeba histolytica
NEEFKCIKCKNGYYLNSNNEC

SEQ ID NO: 2585915 - protein, 25 aa, Entamoeba histolytica
NEEFKEVVKAIGYFIGIHRNELPGS

SEQ ID NO: 2585916 - protein, 17 aa, Entamoeba histolytica
NEEICCLTTSNKVNTLI

SEQ ID NO: 2585917 - protein, 23 aa, Entamoeba histolytica
NEEYLRASITFNEIMKTKDILMT

SEQ ID NO: 2585918 - protein, 17 aa, Entamoeba histolytica
NEFPISVILVKNGGGYV

SEQ ID NO: 2585919 - protein, 23 aa, Entamoeba histolytica
NEFPLCVIRNIHIIIITSLLILI

SEQ ID NO: 2585920 - protein, 23 aa, Entamoeba histolytica
NEFTQKLSHCFSLKPFNSPIYLC

SEQ ID NO: 2585921 - protein, 17 aa, Entamoeba histolytica
NEFWGFWGQNYGSLPHT

SEQ ID NO: 2585922 - protein, 18 aa, Entamoeba histolytica
NEGCAVCMKGYYRSSSLC

SEQ ID NO: 2585923 - protein, 18 aa, Entamoeba histolytica
NEGFCISAIDAHCRGYGY

SEQ ID NO: 2585924 - protein, 17 aa, Entamoeba histolytica
NEGKYSYLVTGLLSILI

SEQ ID NO: 2585925 - protein, 19 aa, Entamoeba histolytica
NEIELKMTLEDRIDEIIEL

SEQ ID NO: 2585926 - protein, 20 aa, Entamoeba histolytica
NEIERLIEWGRGKELIDEEE

SEQ ID NO: 2585927 - protein, 19 aa, Entamoeba histolytica
NEIESLLNWARKLSPIDVN

SEQ ID NO: 2585928 - protein, 22 aa, Entamoeba histolytica
NEIGDIPHLLLFKNINILIKDY

SEQ ID NO: 2585929 - protein, 25 aa, Entamoeba histolytica
NEIGECVQCSFGFVLDSNNPIACIE

SEQ ID NO: 2585930 - protein, 26 aa, Entamoeba histolytica
NEILFKRLPMIKTIINFVLFIISIIL

SEQ ID NO: 2585931 - protein, 19 aa, Entamoeba histolytica
NEINLLYFIVLPVSQLEGC

SEQ ID NO: 2585932 - protein, 17 aa, Entamoeba histolytica
NEIPLSLALLPEYIIGI

SEQ ID NO: 2585933 - protein, 23 aa, Entamoeba histolytica
NEIRFLHIFPLNILFACYNGYLT

SEQ ID NO: 2585934 - protein, 19 aa, Entamoeba histolytica
NEISDKVIIRYGDSTNGSS

SEQ ID NO: 2585935 - protein, 17 aa, Entamoeba histolytica
NEISKMFNYMKEHQKLI

SEQ ID NO: 2585936 - protein, 30 aa, Entamoeba histolytica
NEKEGEGSLCFKAKVTKFGLYGYRKTTSGK

SEQ ID NO: 2585937 - protein, 22 aa, Entamoeba histolytica
NEKETWTHQSILFNLDHYLNPK

SEQ ID NO: 2585938 - protein, 22 aa, Entamoeba histolytica
NEKHRILPFNSYYGIINSLITN

SEQ ID NO: 2585939 - protein, 21 aa, Entamoeba histolytica
NEKLWEYARTLGYESAKTEFT

SEQ ID NO: 2585940 - protein, 25 aa, Entamoeba histolytica
NEKQTDCVFCPVGTHFIDEPYFRGC

SEQ ID NO: 2585941 - protein, 23 aa, Entamoeba histolytica
NEKYLAEVLLHFEQLIKKELWHI

SEQ ID NO: 2585942 - protein, 22 aa, Entamoeba histolytica
NELCFSMNLFYCAETNGVNCTT

SEQ ID NO: 2585943 - protein, 17 aa, Entamoeba histolytica
NELEYPEATILAKPNPI

SEQ ID NO: 2585944 - protein, 18 aa, Entamoeba histolytica
NELIKFFPTKEEKETVLP

SEQ ID NO: 2585945 - protein, 21 aa, Entamoeba histolytica
NELKLTCNLMGVSSQTFNESW

SEQ ID NO: 2585946 - protein, 22 aa, Entamoeba histolytica
NELKPSIISILIKILLRNIEII

SEQ ID NO: 2585947 - protein, 23 aa, Entamoeba histolytica
NELNTFYCCIAFLSKQSIHYSNK

SEQ ID NO: 2585948 - protein, 20 aa, Entamoeba histolytica
NELTESLFLIGDQKLIFDIV

SEQ ID NO: 2585949 - protein, 20 aa, Entamoeba histolytica
NELYRKPMIEAAKNGQLNEK

SEQ ID NO: 2585950 - protein, 20 aa, Entamoeba histolytica
NEMILNLLLLVFSFIDGFSI

SEQ ID NO: 2585951 - protein, 29 aa, Entamoeba histolytica
NEMSLDFKLRCMYDIAHGMFYLHQNDIIH

SEQ ID NO: 2585952 - protein, 23 aa, Entamoeba histolytica
NENKLWEEWKIKYGKTYNNINEI

SEQ ID NO: 2585953 - protein, 20 aa, Entamoeba histolytica
NENLCPLIQCTINSNKNELL

SEQ ID NO: 2585954 - protein, 23 aa, Entamoeba histolytica
NENRICPCDGSFEIISSGMNDLG

SEQ ID NO: 2585955 - protein, 31 aa, Entamoeba histolytica
NEPCNYFKGDICYKCPLGYYSINGNCTQCQE

SEQ ID NO: 2585956 - protein, 25 aa, Entamoeba histolytica
NEPIRFIFHGGDYLKYTISFVPAIL

SEQ ID NO: 2585957 - protein, 24 aa, Entamoeba histolytica
NEPYKTCDVIGCGYIHELNCLFYT

SEQ ID NO: 2585958 - protein, 21 aa, Entamoeba histolytica
NEQRKQIKFFIGSLNSEHRNT

SEQ ID NO: 2585959 - protein, 21 aa, Entamoeba histolytica
NERFSTVYIILVKEMFQNIYN

SEQ ID NO: 2585960 - protein, 21 aa, Entamoeba histolytica
NERIFPAFVQYIISDTNLILE

SEQ ID NO: 2585961 - protein, 25 aa, Entamoeba histolytica
NESILRAKIFKRIAFVIYCGEKEVF

SEQ ID NO: 2585962 - protein, 20 aa, Entamoeba histolytica
NETIRRMIIITGIICSGIIS

SEQ ID NO: 2585963 - protein, 28 aa, Entamoeba histolytica
NETVWYSGRCIYYSKIPYCIKAENSRCT

SEQ ID NO: 2585964 - protein, 21 aa, Entamoeba histolytica
NEVTCLVCDGIILNGTCVNYE

SEQ ID NO: 2585965 - protein, 21 aa, Entamoeba histolytica
NEVYISLVFPYPVKVSKHYSY

SEQ ID NO: 2585966 - protein, 17 aa, Entamoeba histolytica
NEWKWGNFGILFTHISV

SEQ ID NO: 2585967 - protein, 29 aa, Entamoeba histolytica
NEYPHCALSSFKNGIKMYLSDHEELYKGN

SEQ ID NO: 2585968 - protein, 24 aa, Entamoeba histolytica
NFFIKNFYEVLAFCYQLGVFISRS

SEQ ID NO: 2585969 - protein, 31 aa, Entamoeba histolytica; identical to SEQ ID NO: 2388078

SEQ ID NO: 2585970 - protein, 25 aa, Entamoeba histolytica
NFFQSLKMKIFFQIHQHAPMCLIWT

SEQ ID NO: 2585971 - protein, 19 aa, Entamoeba histolytica
NFFRYCLTGFLYNYSVFFY

SEQ ID NO: 2585972 - protein, 22 aa, Entamoeba histolytica
NFFSYDGFLLGCVFSFNLFGCS

SEQ ID NO: 2585973 - protein, 17 aa, Entamoeba histolytica
NFIDAKNVMALMCKKPT

SEQ ID NO: 2585974 - protein, 19 aa, Entamoeba histolytica
NFIHRYNKYFSFNNLEITV

SEQ ID NO: 2585975 - protein, 19 aa, Entamoeba histolytica
NFIKIPKKVFISLIGKGFN

SEQ ID NO: 2585976 - protein, 22 aa, Entamoeba histolytica
NFILKEMYIDFNVNRTQINQIV

SEQ ID NO: 2585977 - protein, 25 aa, Entamoeba histolytica
NFIQKEILGSFVLPSMKSFEIPDIT

SEQ ID NO: 2585978 - protein, 37 aa, Entamoeba histolytica
NFKECHDILRPSLQWYFSILFWRDIKTLKSTFKQTTL

SEQ ID NO: 2585979 - protein, 23 aa, Entamoeba histolytica
NFKGIDVDGVILFFIELLKETPK

SEQ ID NO: 2585980 - protein, 19 aa, Entamoeba histolytica
NFLLCAPAAIISLVSTVVY

SEQ ID NO: 2585981 - protein, 27 aa, Entamoeba histolytica
NFLNPKKLKCFINHKTVPCHSVLPHKA

SEQ ID NO: 2585982 - protein, 21 aa, Entamoeba histolytica
NFMKEGKMFSVWIKDEKKGGI

SEQ ID NO: 2585983 - protein, 18 aa, Entamoeba histolytica
NFMRVIGEYGPIYKNSDI

SEQ ID NO: 2585984 - protein, 27 aa, Entamoeba histolytica
NFNDFKGCFKFNGENIITLDSKNLLLQ

SEQ ID NO: 2585985 - protein, 35 aa, Entamoeba histolytica
NFNIIKMTKFMGWKRFVFREYPVALAAYLFIWIPG

SEQ ID NO: 2585986 - protein, 18 aa, Entamoeba histolytica
NFPLTALTNVTFDYYDVL

SEQ ID NO: 2585987 - protein, 24 aa, Entamoeba histolytica
NFPQHILPLVFNWPSSQNAACYYC

SEQ ID NO: 2585988 - protein, 27 aa, Entamoeba histolytica
NFRKWCCIGCGITIILAMAIHPTTVSI

SEQ ID NO: 2585989 - protein, 25 aa, Entamoeba histolytica
NFTCTYRKDIICGRVEIIEQKVYRK

SEQ ID NO: 2585990 - protein, 22 aa, Entamoeba histolytica
NFVEECSFILGLTASVCEDIDT

SEQ ID NO: 2585991 - protein, 18 aa, Entamoeba histolytica
NFVICIILIVTLTLLLIP

SEQ ID NO: 2585992 - protein, 18 aa, Entamoeba histolytica
NFVSFNFFIMYFAQTIMF

SEQ ID NO: 2585993 - protein, 27 aa, Entamoeba histolytica
NFYFDSFKAILPFKFIIDQSTVKTQIV

SEQ ID NO: 2585994 - protein, 24 aa, Entamoeba histolytica
NFYLRPKLVPVLIGYMLSIIPIFI

SEQ ID NO: 2585995 - protein, 19 aa, Entamoeba histolytica
NFYRLCITGLLFNFSAYFL

SEQ ID NO: 2585996 - protein, 19 aa, Entamoeba histolytica
NGADKFIIEKGLSVNTSKV

SEQ ID NO: 2585997 - protein, 17 aa, Entamoeba histolytica
NGAECIKCKIGEDQNGN

SEQ ID NO: 2585998 - protein, 18 aa, Entamoeba histolytica
NGAFSLLSTFFVAILLLS

SEQ ID NO: 2585999 - protein, 18 aa, Entamoeba histolytica
NGAKRFGYNGGDKNEVKE

SEQ ID NO: 2586000 - protein, 18 aa, Entamoeba histolytica
NGCKYCNSTKCFVCDKDA

SEQ ID NO: 2586001 - protein, 28 aa, Entamoeba histolytica
NGDCGTFFKRLLPIVFTENSLCLAVMKT

SEQ ID NO: 2586002 - protein, 19 aa, Entamoeba histolytica
NGDCIKCPLYCYEDSCLDE

SEQ ID NO: 2586003 - protein, 27 aa, Entamoeba histolytica
NGEMRISFIETFAWDYSFNQTIPREFL

SEQ ID NO: 2586004 - protein, 18 aa, Entamoeba histolytica
NGESFEVEDFIIKRCNEI

SEQ ID NO: 2586005 - protein, 22 aa, Entamoeba histolytica
NGEVPAWAIAVIVIVGVIIVIA

SEQ ID NO: 2586006 - protein, 26 aa, Entamoeba histolytica
NGEYCLKADMNGWGLIQLNAYHPAQA

SEQ ID NO: 2586007 - protein, 25 aa, Entamoeba histolytica
NGFFIKIFFWFIIIRIIYSSNDNIN

SEQ ID NO: 2586008 - protein, 17 aa, Entamoeba histolytica
NGFYICFESETFDSVQF

SEQ ID NO: 2586009 - protein, 22 aa, Entamoeba histolytica
NGGLLKECYSLLVKELSNGIED

SEQ ID NO: 2586010 - protein, 22 aa, Entamoeba histolytica
NGHYDFNIGIILSIISNKINYG

SEQ ID NO: 2586011 - protein, 20 aa, Entamoeba histolytica
NGICVFNRDCIFEKAKQLNI

SEQ ID NO: 2586012 - protein, 25 aa, Entamoeba histolytica
NGIGFSMMIVCMFVTVSLSKNRVYI

SEQ ID NO: 2586013 - protein, 20 aa, Entamoeba histolytica
NGIGLCFFSDIIFVREASST

SEQ ID NO: 2586014 - protein, 25 aa, Entamoeba histolytica
NGIKGQCLGLGFSIIIFFIIVSYVL

SEQ ID NO: 2586015 - protein, 25 aa, Entamoeba histolytica
NGIKGQCLGLGFSVITFFMIASYAL

SEQ ID NO: 2586016 - protein, 25 aa, Entamoeba histolytica
NGIKKRIAPIIFHNTFWLIKDYYTP

SEQ ID NO: 2586017 - protein, 17 aa, Entamoeba histolytica
NGIVILPIVDFLYMIII

SEQ ID NO: 2586018 - protein, 18 aa, Entamoeba histolytica
NGKCAPCNELKHCATCSG

SEQ ID NO: 2586019 - protein, 20 aa, Entamoeba histolytica
NGKCLTCKPGYGININDGTC

SEQ ID NO: 2586020 - protein, 21 aa, Entamoeba histolytica
NGKIIIKGDITFINFDVFNNL

SEQ ID NO: 2586021 - protein, 18 aa, Entamoeba histolytica
NGKLMWNIWMEKDDNGDI

SEQ ID NO: 2586022 - protein, 19 aa, Entamoeba histolytica
NGKSSLGNFILKKNIFEVG

SEQ ID NO: 2586023 - protein, 24 aa, Entamoeba histolytica
NGKYCLRCNTGFYIENGNCLPCGQ

SEQ ID NO: 2586024 - protein, 18 aa, Entamoeba histolytica
NGLLKVSLLSAQSLIDGN

SEQ ID NO: 2586025 - protein, 17 aa, Entamoeba histolytica
NGLNIGEKMFKYMDSHP

SEQ ID NO: 2586026 - protein, 23 aa, Entamoeba histolytica
NGMYWFECLFNAKKYHNIIELLR

SEQ ID NO: 2586027 - protein, 23 aa, Entamoeba histolytica
NGNICTQCPVGSHVGKDGKCSCG

SEQ ID NO: 2586028 - protein, 18 aa, Entamoeba histolytica
NGRCSLCETKYYLDDSMK

SEQ ID NO: 2586029 - protein, 24 aa, Entamoeba histolytica
NGSCSDASSLHCLQGSPIFGCTEC

SEQ ID NO: 2586030 - protein, 17 aa, Entamoeba histolytica
NGSDPVFHKALEENGQR

SEQ ID NO: 2586031 - protein, 22 aa, Entamoeba histolytica
NGSSILLTLGIFFILFSFCNEA

SEQ ID NO: 2586032 - protein, 17 aa, Entamoeba histolytica
NGSSSYTYFGYVTSTSG

SEQ ID NO: 2586033 - protein, 23 aa, Entamoeba histolytica
NGTCVACAYGYWLDPEYGKCVEN

SEQ ID NO: 2586034 - protein, 21 aa, Entamoeba histolytica
NGVERNGLCFSIKRIEIDKQK

SEQ ID NO: 2586035 - protein, 22 aa, Entamoeba histolytica
NGVMFHIDFGYILGKECKPFPP

SEQ ID NO: 2586036 - protein, 22 aa, Entamoeba histolytica
NGYECKPCILGTLHCQNCSING

SEQ ID NO: 2586037 - protein, 23 aa, Entamoeba histolytica
NHIGHALLTLGILDLIKKSQSPR

SEQ ID NO: 2586038 - protein, 20 aa, Entamoeba histolytica
NHIYESFELFGGILNEYKQS

SEQ ID NO: 2586039 - protein, 24 aa, Entamoeba histolytica
NHKNIDSALCTFIMLGIAVTFLFF

SEQ ID NO: 2586040 - protein, 21 aa, Entamoeba histolytica
NHLFRMVLIVVVLLGYLNIVP

SEQ ID NO: 2586041 - protein, 25 aa, Entamoeba histolytica
NHLLVGRGKIFGDLVTFNSVKEVLT

SEQ ID NO: 2586042 - protein, 23 aa, Entamoeba histolytica
NHNLNGVSCISIILSFIFTFIFF

SEQ ID NO: 2586043 - protein, 28 aa, Entamoeba histolytica
NHSHVYSLCFFRVLYLDCLLSEALVYFW

SEQ ID NO: 2586044 - protein, 18 aa, Entamoeba histolytica
NHTLKWIIHVELMQFNLL

SEQ ID NO: 2586045 - protein, 17 aa, Entamoeba histolytica
NHYQCIDALSLTESYTD

SEQ ID NO: 2586046 - protein, 19 aa, Entamoeba histolytica
NIAAYPRYRKVFSNLLQEY

SEQ ID NO: 2586047 - protein, 24 aa, Entamoeba histolytica
NIALCYVCNPQIKKMEKIASVVEE

SEQ ID NO: 2586048 - protein, 28 aa, Entamoeba histolytica
NIAQCKKLWGVTHFRISKDSGIINGLNL

SEQ ID NO: 2586049 - protein, 25 aa, Entamoeba histolytica
NICKERLKYSWVIYSLLIKSIIGYL

SEQ ID NO: 2586050 - protein, 21 aa, Entamoeba histolytica
NICNFELKYSKAFDDNKCTTG

SEQ ID NO: 2586051 - protein, 21 aa, Entamoeba histolytica
NIDGTSLVFMFLTFVIHLFFF

SEQ ID NO: 2586052 - protein, 21 aa, Entamoeba histolytica
NIDQGCPCRHDISESADSCDV

SEQ ID NO: 2586053 - protein, 18 aa, Entamoeba histolytica
NIDYKLSIELKDEKSEIN

SEQ ID NO: 2586054 - protein, 23 aa, Entamoeba histolytica
NIECEPRIAILGPHSSINVYFTI

SEQ ID NO: 2586055 - protein, 17 aa, Entamoeba histolytica
NIEVLLFIHGLDHTLYD

SEQ ID NO: 2586056 - protein, 19 aa, Entamoeba histolytica
NIFHTLSLICYIIHVGTYY

SEQ ID NO: 2586057 - protein, 19 aa, Entamoeba histolytica
NIFKREIKSFLMIDYSHPS

SEQ ID NO: 2586058 - protein, 22 aa, Entamoeba histolytica
NIFQIKLCMGMKLISKQIAVLN

SEQ ID NO: 2586059 - protein, 19 aa, Entamoeba histolytica
NIFSISWENPVSLDLSLPP

SEQ ID NO: 2586060 - protein, 27 aa, Entamoeba histolytica
NIFTMICFFCFGLNFLIYYNAVVNMGD

SEQ ID NO: 2586061 - protein, 21 aa, Entamoeba histolytica
NIGDCRSYLYSNSTLRTIYNY

SEQ ID NO: 2586062 - protein, 23 aa, Entamoeba histolytica
NIIKQEFELILPLINKSIKKALS

SEQ ID NO: 2586063 - protein, 25 aa, Entamoeba histolytica
NIIPKDYFVEGGLSYLPLTKEYLNT

SEQ ID NO: 2586064 - protein, 27 aa, Entamoeba histolytica
NIIQKELFYLITQCNGLIYLLIYFSEK

SEQ ID NO: 2586065 - protein, 20 aa, Entamoeba histolytica
NIIRKCIKTKYNGDEIEGKH

SEQ ID NO: 2586066 - protein, 20 aa, Entamoeba histolytica
NIIRPHFSSLLSRLSEKAVS

SEQ ID NO: 2586067 - protein, 20 aa, Entamoeba histolytica
NIIRSIRLVRTSYCNYCIGC

SEQ ID NO: 2586068 - protein, 19 aa, Entamoeba histolytica
NIKCFKYPISNISIDPSGK

SEQ ID NO: 2586069 - protein, 23 aa, Entamoeba histolytica
NIKEFGCGIVSEMIIETEDSSSI

SEQ ID NO: 2586070 - protein, 21 aa, Entamoeba histolytica
NIKKYLDGIGWKTITFYEKKK

SEQ ID NO: 2586071 - protein, 20 aa, Entamoeba histolytica
NIKNEFKIISPLFVNQKKAF

SEQ ID NO: 2586072 - protein, 18 aa, Entamoeba histolytica
NIKNVLDYIYIVTVDNMV

SEQ ID NO: 2586073 - protein, 25 aa, Entamoeba histolytica
NIKRLCIAGELFSEAGFFQRSDQRN

SEQ ID NO: 2586074 - protein, 21 aa, Entamoeba histolytica
NILFKNPIIFSSISIPLLPLL

SEQ ID NO: 2586075 - protein, 18 aa, Entamoeba histolytica
NILFKYSGSLIIEKGIGD

SEQ ID NO: 2586076 - protein, 24 aa, Entamoeba histolytica
NILKGICIKTECSFDNLYQSEFIA

SEQ ID NO: 2586077 - protein, 24 aa, Entamoeba histolytica
NILKVMILILFFSYLMNFFFKHRK

SEQ ID NO: 2586078 - protein, 29 aa, Entamoeba histolytica
NILTPRLIIHLQPSIPIYVFIHSPYGKTI

SEQ ID NO: 2586079 - protein, 24 aa, Entamoeba histolytica
NILYDLCLEMGYFFDARLSRKTEK

SEQ ID NO: 2586080 - protein, 19 aa, Entamoeba histolytica
NIMRLPLIRFPKLLNDTMQ

SEQ ID NO: 2586081 - protein, 17 aa, Entamoeba histolytica
NINIKGGSYYIRSDSKN

SEQ ID NO: 2586082 - protein, 19 aa, Entamoeba histolytica
NINKWIDLIFGYKSCGEEA

SEQ ID NO: 2586083 - protein, 23 aa, Entamoeba histolytica
NINLNLPEQFVFSDDQVLILKNS

SEQ ID NO: 2586084 - protein, 31 aa, Entamoeba histolytica
NIPDSFPPEMAKLISDCWAEDPNLRPKFAEI

SEQ ID NO: 2586085 - protein, 18 aa, Entamoeba histolytica
NIPIPVCMVKLMNTYFVI

SEQ ID NO: 2586086 - protein, 24 aa, Entamoeba histolytica
NIPNGIECLSMLIYSNFFESPLFI

SEQ ID NO: 2586087 - protein, 25 aa, Entamoeba histolytica
NIPWSHLCVYFWKAKVLTFIVPILI

SEQ ID NO: 2586088 - protein, 21 aa, Entamoeba histolytica
NIQKLLSLKGIERIENNEEDN

SEQ ID NO: 2586089 - protein, 20 aa, Entamoeba histolytica
NIQRVCVALQQFGEIVYNFV

SEQ ID NO: 2586090 - protein, 24 aa, Entamoeba histolytica
NIRMMKILTARGLRMFASNWNLGI

SEQ ID NO: 2586091 - protein, 22 aa, Entamoeba histolytica
NIRRLGAQCFSVVLRYLPLHVT

SEQ ID NO: 2586092 - protein, 22 aa, Entamoeba histolytica
NISCYILALLFVYFICTTGSVS

SEQ ID NO: 2586093 - protein, 18 aa, Entamoeba histolytica
NISKCGACMTLIGPSNTP

SEQ ID NO: 2586094 - protein, 26 aa, Entamoeba histolytica
NISLSENWIRFTVYTSIIIQILISSI

SEQ ID NO: 2586095 - protein, 19 aa, Entamoeba histolytica
NISRRCSHNTFIRYLQNSI

SEQ ID NO: 2586096 - protein, 34 aa, Entamoeba histolytica
NISSMCLTMRFFIMLRIYLSKHIKELPIFDTEGN

SEQ ID NO: 2586097 - protein, 21 aa, Entamoeba histolytica
NISTCFELTLKEFEYGNKDRL

SEQ ID NO: 2586098 - protein, 24 aa, Entamoeba histolytica
NITIKELIIENGLTIIKTSGFIEN

SEQ ID NO: 2586099 - protein, 22 aa, Entamoeba histolytica
NITTLKIWGLFITFSIISFVFY

SEQ ID NO: 2586100 - protein, 22 aa, Entamoeba histolytica
NIVSDFVYFFAYKNEAWGFTKI

SEQ ID NO: 2586101 - protein, 19 aa, Entamoeba histolytica
NIVYWIKFEFALRRYQFNI

SEQ ID NO: 2586102 - protein, 18 aa, Entamoeba histolytica
NIYFLNSCGIDYYNKKST

SEQ ID NO: 2586103 - protein, 27 aa, Entamoeba histolytica
NKAQFIIKNWIYIKSILTIICFFVSIT

SEQ ID NO: 2586104 - protein, 27 aa, Entamoeba histolytica
NKASYRFGLPYQYSFIVLVIFQAICIA

SEQ ID NO: 2586105 - protein, 17 aa, Entamoeba histolytica
NKCDICGKKHKTKDHGK

SEQ ID NO: 2586106 - protein, 17 aa, Entamoeba histolytica
NKCKEVKNNKCWKCSFW

SEQ ID NO: 2586107 - protein, 22 aa, Entamoeba histolytica
NKCKSISWNKCITCDNNEDFNN

SEQ ID NO: 2586108 - protein, 22 aa, Entamoeba histolytica
NKCSECDMNYGYCIGCEKDFIL

SEQ ID NO: 2586109 - protein, 18 aa, Entamoeba histolytica
NKDIIGYFITNEENVKPD

SEQ ID NO: 2586110 - protein, 23 aa, Entamoeba histolytica
NKDIIQLLLKWIKSEVNEIVLPA

SEQ ID NO: 2586111 - protein, 17 aa, Entamoeba histolytica
NKDKLIYHYILKSIPSF

SEQ ID NO: 2586112 - protein, 25 aa, Entamoeba histolytica
NKDYCYRSSQIIGFIINSHKSEQNI

SEQ ID NO: 2586113 - protein, 22 aa, Entamoeba histolytica
NKDYRYALSMEWFNVTFKRGVC

SEQ ID NO: 2586114 - protein, 18 aa, Entamoeba histolytica
NKEIIINIITRWYIIISI

SEQ ID NO: 2586115 - protein, 27 aa, Entamoeba histolytica
NKENGFRFVMCIIISMQIIRNIFFYIA

SEQ ID NO: 2586116 - protein, 28 aa, Entamoeba histolytica
NKERVRLMKECAIGVYYLHSLGIVHRDI

SEQ ID NO: 2586117 - protein, 25 aa, Entamoeba histolytica
NKGTADCGYSLMTYDVLRDYFEIHK

SEQ ID NO: 2586118 - protein, 23 aa, Entamoeba histolytica
NKHNIIMLFVLIVFSCICSAYTY

SEQ ID NO: 2586119 - protein, 27 aa, Entamoeba histolytica
NKIILSRLCMMLKYMIEHFKENGNEII

SEQ ID NO: 2586120 - protein, 21 aa, Entamoeba histolytica
NKIIYCIGMAGIDSYYDFYIN

SEQ ID NO: 2586121 - protein, 30 aa, Entamoeba histolytica
NKILLILSIPFRFIMEFTTPHISDNRKNLL

SEQ ID NO: 2586122 - protein, 22 aa, Entamoeba histolytica
NKIPPIDWKQFFIVFSQGIILL

SEQ ID NO: 2586123 - protein, 25 aa, Entamoeba histolytica
NKISDLYLKYCIIITIIRFLFTPLR

SEQ ID NO: 2586124 - protein, 24 aa, Entamoeba histolytica
NKKAKIIFRNGCNIQTINNSSIEF

SEQ ID NO: 2586125 - protein, 22 aa, Entamoeba histolytica
NKKCSDAFCKSCPNNKDKCEVC

SEQ ID NO: 2586126 - protein, 20 aa, Entamoeba histolytica
NKKGCAICKKGYYYDKKNYR

SEQ ID NO: 2586127 - protein, 22 aa, Entamoeba histolytica
NKKGCKPISCGNGVINDVYNGK

SEQ ID NO: 2586128 - protein, 21 aa, Entamoeba histolytica
NKKGEWVRIRAIPFKPTTNLK

SEQ ID NO: 2586129 - protein, 26 aa, Entamoeba histolytica
NKKIISWQLLCRSILYSLSVVNAPRV

SEQ ID NO: 2586130 - protein, 22 aa, Entamoeba histolytica
NKKIPITLEWGNWKIVRHSMED

SEQ ID NO: 2586131 - protein, 26 aa, Entamoeba histolytica
NKKKEFMVRTGISMGVTVIVTFTLAF

SEQ ID NO: 2586132 - protein, 19 aa, Entamoeba histolytica
NKKNGIVFFGELTVTTINT

SEQ ID NO: 2586133 - protein, 29 aa, Entamoeba histolytica
NKKSFPIGKIIGFGCIILLVIFMLFMPEM

SEQ ID NO: 2586134 - protein, 23 aa, Entamoeba histolytica
NKKTCLWMTPFLIILAYIHLIAC

SEQ ID NO: 2586135 - protein, 21 aa, Entamoeba histolytica
NKKYVWWNVFTIRKNSTRILL

SEQ ID NO: 2586136 - protein, 23 aa, Entamoeba histolytica
NKLCECLIELALNVFPKIEFNII

SEQ ID NO: 2586137 - protein, 25 aa, Entamoeba histolytica
NKLHGGWKYLFIVLSRFEQMNLIEH

SEQ ID NO: 2586138 - protein, 24 aa, Entamoeba histolytica
NKMLFFYKQIIIFYYFVKNQTNDE

SEQ ID NO: 2586139 - protein, 19 aa, Entamoeba histolytica
NKMPLLNGDKWKGVLEAII

SEQ ID NO: 2586140 - protein, 21 aa, Entamoeba histolytica
NKMTFFYACLNQICVCLIGLI

SEQ ID NO: 2586141 - protein, 19 aa, Entamoeba histolytica
NKNAIVFIAPFSVSVPEAI

SEQ ID NO: 2586142 - protein, 23 aa, Entamoeba histolytica
NKNIDGASCLFIILGVIITLLFF

SEQ ID NO: 2586143 - protein, 23 aa, Entamoeba histolytica
NKNIDGASCMFIILGVIITLLFF

SEQ ID NO: 2586144 - protein, 19 aa, Entamoeba histolytica
NKNTFKDIITRALNERLNG

SEQ ID NO: 2586145 - protein, 24 aa, Entamoeba histolytica
NKPEQFKSLLLVYGPFVSSIKLFN

SEQ ID NO: 2586146 - protein, 23 aa, Entamoeba histolytica
NKPVLLRKVVGWNKVMMSSNEFN

SEQ ID NO: 2586147 - protein, 19 aa, Entamoeba histolytica
NKPVRFGVINEDYLKCRSE

SEQ ID NO: 2586148 - protein, 22 aa, Entamoeba histolytica
NKQKFSEIVHCLNLSDKEKEIY

SEQ ID NO: 2586149 - protein, 26 aa, Entamoeba histolytica
NKRRRTRVIIYIEVFVFITSYIICYL

SEQ ID NO: 2586150 - protein, 25 aa, Entamoeba histolytica
NKSKYSERMTCLLIAIIFEIPDIDK

SEQ ID NO: 2586151 - protein, 18 aa, Entamoeba histolytica
NKSLPCIYQIEKRDPTLE

SEQ ID NO: 2586152 - protein, 24 aa, Entamoeba histolytica
NKSRILPNLGIVFWVICILVALGG

SEQ ID NO: 2586153 - protein, 25 aa, Entamoeba histolytica
NKTHLRYGQCLELTGSTKIPVRCTI

SEQ ID NO: 2586154 - protein, 26 aa, Entamoeba histolytica
NKTKELWKCGSCRNSTIYKCESKPNK

SEQ ID NO: 2586155 - protein, 18 aa, Entamoeba histolytica
NKTLKRMLYRAITNKIFL

SEQ ID NO: 2586156 - protein, 20 aa, Entamoeba histolytica
NKTSHFKSVIILPHQLGNLI

SEQ ID NO: 2586157 - protein, 25 aa, Entamoeba histolytica
NKTVRGRLSWFFYRTQDLMKYPLIV

SEQ ID NO: 2586158 - protein, 20 aa, Entamoeba histolytica
NKVFHYLEFILTLLKPFNSQ

SEQ ID NO: 2586159 - protein, 24 aa, Entamoeba histolytica
NKVGWKNKKGFGLNFTRPSTLKTQ

SEQ ID NO: 2586160 - protein, 22 aa, Entamoeba histolytica
NKVISCSEGFYSDGTQCMSCEE

SEQ ID NO: 2586161 - protein, 19 aa, Entamoeba histolytica
NKVQNIIMSYAFEQYYSCC

SEQ ID NO: 2586162 - protein, 22 aa, Entamoeba histolytica
NKWNDVFFYFLFNTAAICSVIL

SEQ ID NO: 2586163 - protein, 24 aa, Entamoeba histolytica
NKWNIDFVGCLSYNVFSDDKTLFI

SEQ ID NO: 2586164 - protein, 23 aa, Entamoeba histolytica
NKYFTCAFKFPTIAPEVLLNRNH

SEQ ID NO: 2586165 - protein, 24 aa, Entamoeba histolytica
NKYGCGKCEDKVKTICPGNTPSGD

SEQ ID NO: 2586166 - protein, 18 aa, Entamoeba histolytica
NKYNNLKNAVGIYGDGYM

SEQ ID NO: 2586167 - protein, 20 aa, Entamoeba histolytica
NKYRTWQWVGASDCKKTVDY

SEQ ID NO: 2586168 - protein, 20 aa, Entamoeba histolytica
NKYVGSSIEELVQFQQFSSC

SEQ ID NO: 2586169 - protein, 23 aa, Entamoeba histolytica
NLAKDGLRTLVFGKKVISKEDYE

SEQ ID NO: 2586170 - protein, 18 aa, Entamoeba histolytica
NLAPNIISILGLISCLLA

SEQ ID NO: 2586171 - protein, 24 aa, Entamoeba histolytica
NLCLCKQAIRSLRIISRCSEIIPN

SEQ ID NO: 2586172 - protein, 21 aa, Entamoeba histolytica
NLDGTSGMFMFLAFVIHLIFF

SEQ ID NO: 2586173 - protein, 21 aa, Entamoeba histolytica
NLDGTSSIFIILCVTIIFLFF

SEQ ID NO: 2586174 - protein, 24 aa, Entamoeba histolytica
NLDVLKRYWITCIITEKEHEIGRF

SEQ ID NO: 2586175 - protein, 24 aa, Entamoeba histolytica
NLELSRTIFLISLICVLIIGTLLV

SEQ ID NO: 2586176 - protein, 18 aa, Entamoeba histolytica
NLFICLSDGILQSPQGKN

SEQ ID NO: 2586177 - protein, 20 aa, Entamoeba histolytica
NLFIHFLHFYISFDYSQLIS

SEQ ID NO: 2586178 - protein, 25 aa, Entamoeba histolytica
NLFLSPCYLVSFIATEMNSIIQVQP

SEQ ID NO: 2586179 - protein, 17 aa, Entamoeba histolytica
NLHDFTIIYAIFATFTL

SEQ ID NO: 2586180 - protein, 31 aa, Entamoeba histolytica
NLIILFALSWCVFRVVDLMIAFFLFLFSDFE

SEQ ID NO: 2586181 - protein, 20 aa, Entamoeba histolytica
NLIKYKKIKSLLSTFIQPIT

SEQ ID NO: 2586182 - protein, 19 aa, Entamoeba histolytica
NLIPLHAFLLLVFGRFSNR

SEQ ID NO: 2586183 - protein, 19 aa, Entamoeba histolytica
NLKIIPIATKFRIINEISK

SEQ ID NO: 2586184 - protein, 21 aa, Entamoeba histolytica
NLLLILGVAFLGYFVSELLEM

SEQ ID NO: 2586185 - protein, 18 aa, Entamoeba histolytica
NLLMPRVISYKEMIKFII

SEQ ID NO: 2586186 - protein, 26 aa, Entamoeba histolytica
NLLPFTFPVKYFFVFYKQRKLFVPTI

SEQ ID NO: 2586187 - protein, 18 aa, Entamoeba histolytica
NLLWHGFMNDNEITNTHI

SEQ ID NO: 2586188 - protein, 17 aa, Entamoeba histolytica
NLMAFEYVWKCWSNFHF

SEQ ID NO: 2586189 - protein, 19 aa, Entamoeba histolytica
NLMGNGGKMPFTIQRISCS

SEQ ID NO: 2586190 - protein, 21 aa, Entamoeba histolytica
NLPRWLKWIYTISYYRITRNI

SEQ ID NO: 2586191 - protein, 24 aa, Entamoeba histolytica
NLQELSYFCFFLLVSHMVTVSFDL

SEQ ID NO: 2586192 - protein, 27 aa, Entamoeba histolytica
NLSNDFCCYCVIRPIYAVLQNTNKSIK

SEQ ID NO: 2586193 - protein, 19 aa, Entamoeba histolytica
NLSSAPRFLNLVYVTIPIQ

SEQ ID NO: 2586194 - protein, 24 aa, Entamoeba histolytica
NLSYWKQKILLLLTQMETPVGEYT

SEQ ID NO: 2586195 - protein, 29 aa, Entamoeba histolytica
NLTERIWGCKEWFEMQGTPSAYRNVTMTS

SEQ ID NO: 2586196 - protein, 27 aa, Entamoeba histolytica
NLTTSFDLKSLWIDDTLFVFQNMSIQC

SEQ ID NO: 2586197 - protein, 19 aa, Entamoeba histolytica
NLVDDCFSSMLTINQNWKT

SEQ ID NO: 2586198 - protein, 21 aa, Entamoeba histolytica
NLVLYYLRWKSSFPIPDHLTF

SEQ ID NO: 2586199 - protein, 17 aa, Entamoeba histolytica
NLVYFPLYDGMLNNYTS

SEQ ID NO: 2586200 - protein, 17 aa, Entamoeba histolytica
NLWQIDFGEEWRNKNHI

SEQ ID NO: 2586201 - protein, 19 aa, Entamoeba histolytica
NLYCFAMALLMVKNDKQEL

SEQ ID NO: 2586202 - protein, 19 aa, Entamoeba histolytica
NLYLPVYIGIAIVLFCTIL

SEQ ID NO: 2586203 - protein, 18 aa, Entamoeba histolytica
NMALPCIVLKALINQHSL

SEQ ID NO: 2586204 - protein, 21 aa, Entamoeba histolytica
NMEMLKWLNVKIIKKNKILDM

SEQ ID NO: 2586205 - protein, 25 aa, Entamoeba histolytica
NMFYYCLLFTISIISCFIHCIHQLR

SEQ ID NO: 2586206 - protein, 27 aa, Entamoeba histolytica
NMIQSSIKDICWIIMKIEKLAQLERIN

SEQ ID NO: 2586207 - protein, 29 aa, Entamoeba histolytica
NMISFCISEIIPWWLLCCHDSVKEISEAA

SEQ ID NO: 2586208 - protein, 21 aa, Entamoeba histolytica
NMPLPRKWNHIVLVGKGKKIT

SEQ ID NO: 2586209 - protein, 18 aa, Entamoeba histolytica
NMPLYCITGMMFDFSVYF

SEQ ID NO: 2586210 - protein, 23 aa, Entamoeba histolytica
NMTRAFLLFSLLQIYWGIDMYIY

SEQ ID NO: 2586211 - protein, 29 aa, Entamoeba histolytica
NMVCISNMLSFWMKYTLSMFRYPEKAQQW

SEQ ID NO: 2586212 - protein, 26 aa, Entamoeba histolytica
NMYRKNRMRFGALYIDSLEQINDQTI

SEQ ID NO: 2586213 - protein, 24 aa, Entamoeba histolytica
NNCELLKCITDCFEVSCLGDNVEC

SEQ ID NO: 2586214 - protein, 20 aa, Entamoeba histolytica
NNCEPSYCDYNYFLDSITLN

SEQ ID NO: 2586215 - protein, 18 aa, Entamoeba histolytica
NNCGRIGVLVLILHDIVD

SEQ ID NO: 2586216 - protein, 24 aa, Entamoeba histolytica
NNCISDGLFLFKGIQVPYVSGGQY

SEQ ID NO: 2586217 - protein, 34 aa, Entamoeba histolytica
NNCKESFEICYGCFLCGLIPIFISPKVSIIEINK

SEQ ID NO: 2586218 - protein, 25 aa, Entamoeba histolytica
NNDLSWPIMLRFAYQIASGMASLHK

SEQ ID NO: 2586219 - protein, 18 aa, Entamoeba histolytica
NNFISIYLFLLLAAIGIT

SEQ ID NO: 2586220 - protein, 28 aa, Entamoeba histolytica
NNGEFNKWISIYEGYSFDEVCSKIDSLS

SEQ ID NO: 2586221 - protein, 25 aa, Entamoeba histolytica
NNGEICPIPHSFLIFIRIISLFVMT

SEQ ID NO: 2586222 - protein, 27 aa, Entamoeba histolytica
NNGMNVIICFFLGFILFIPFLIAYIIG

SEQ ID NO: 2586223 - protein, 25 aa, Entamoeba histolytica
NNHKNIDGASCMFIILGVIITLLFF

SEQ ID NO: 2586224 - protein, 24 aa, Entamoeba histolytica
NNIEFKTKCPINKLTIIESKEVNI

SEQ ID NO: 2586225 - protein, 24 aa, Entamoeba histolytica
NNIEFKTKFPINKLTIIESKEVSI

SEQ ID NO: 2586226 - protein, 23 aa, Entamoeba histolytica
NNIKFKPSFIYQSYSKFPSNIRE

SEQ ID NO: 2586227 - protein, 17 aa, Entamoeba histolytica
NNIKRFIDVLKELKQTN

SEQ ID NO: 2586228 - protein, 29 aa, Entamoeba histolytica
NNINFKWRLSQYITWYIVFSLLMSMLMLS

SEQ ID NO: 2586229 - protein, 17 aa, Entamoeba histolytica
NNINICFLINNKQMKFI

SEQ ID NO: 2586230 - protein, 22 aa, Entamoeba histolytica
NNISTCFELTLKEFEYGNKDRL

SEQ ID NO: 2586231 - protein, 22 aa, Entamoeba histolytica
NNIYPTYLCYHVNDKLVCAQPI

SEQ ID NO: 2586232 - protein, 21 aa, Entamoeba histolytica
NNKCIKDICSNGVPISIINVS

SEQ ID NO: 2586233 - protein, 17 aa, Entamoeba histolytica
NNKECLISLDGFKENTT

SEQ ID NO: 2586234 - protein, 23 aa, Entamoeba histolytica
NNKIHCGGAYVFFDNYFDYGYEP

SEQ ID NO: 2586235 - protein, 17 aa, Entamoeba histolytica
NNKRDLLVYSFGFFTKR

SEQ ID NO: 2586236 - protein, 24 aa, Entamoeba histolytica
NNKSVKTAFAMKRWKREIKQTVGI

SEQ ID NO: 2586237 - protein, 18 aa, Entamoeba histolytica
NNLKYGYFKKQIFAEVGV

SEQ ID NO: 2586238 - protein, 23 aa, Entamoeba histolytica
NNLLNRLAVCIGKKEEIPNNYTG

SEQ ID NO: 2586239 - protein, 24 aa, Entamoeba histolytica
NNNYSISYLKAFKNILCHHPHLIN

SEQ ID NO: 2586240 - protein, 20 aa, Entamoeba histolytica
NNRIELFASSALSLYNKYQT

SEQ ID NO: 2586241 - protein, 19 aa, Entamoeba histolytica
NNSCLTCAKDYYLPRNYTG

SEQ ID NO: 2586242 - protein, 23 aa, Entamoeba histolytica
NNTACLWCLLFLTLLSVSVSLVM

SEQ ID NO: 2586243 - protein, 26 aa, Entamoeba histolytica
NNTIKRLTFGYVFVLCFDYLYISNST

SEQ ID NO: 2586244 - protein, 25 aa, Entamoeba histolytica
NNTKSSNCQWIFVVVITLISIILLV

SEQ ID NO: 2586245 - protein, 19 aa, Entamoeba histolytica
NNTRISLTNLFSIDSRHSS

SEQ ID NO: 2586246 - protein, 20 aa, Entamoeba histolytica
NNVGCGQCETEVCITCKIGY

SEQ ID NO: 2586247 - protein, 32 aa, Entamoeba histolytica
NNVLKIKDFWKHVCIVWTMCYNSLPPKKIEKD

SEQ ID NO: 2586248 - protein, 21 aa, Entamoeba histolytica
NNVNTHLAIIFGITDSTVIKS

SEQ ID NO: 2586249 - protein, 24 aa, Entamoeba histolytica
NNWQKFPLVIIVKTALWVKEKIQQ

SEQ ID NO: 2586250 - protein, 18 aa, Entamoeba histolytica
NNYEGWYNSELIKTYYSI

SEQ ID NO: 2586251 - protein, 20 aa, Entamoeba histolytica
NNYIKAFYLRNGGNPSEKYV

SEQ ID NO: 2586252 - protein, 24 aa, Entamoeba histolytica
NNYRGYLCILFVAFSHFVYVLDIL

SEQ ID NO: 2586253 - protein, 28 aa, Entamoeba histolytica
NPDIKCVHVHPGLVWSKFWRYMTPIMKF

SEQ ID NO: 2586254 - protein, 28 aa, Entamoeba histolytica
NPEAIPVYFRRENVCIFAGENVWFSVKK

SEQ ID NO: 2586255 - protein, 18 aa, Entamoeba histolytica
NPFIEGFLIMFGIHKTSY

SEQ ID NO: 2586256 - protein, 29 aa, Entamoeba histolytica
NPFIVIRIAMCFFVVAVALILIFPEKFFV

SEQ ID NO: 2586257 - protein, 24 aa, Entamoeba histolytica
NPFNWKWVTSYGYPLKITLTSLYV

SEQ ID NO: 2586258 - protein, 22 aa, Entamoeba histolytica
NPFYHCVFRLFDLVHCILGIYA

SEQ ID NO: 2586259 - protein, 18 aa, Entamoeba histolytica
NPHAPSYGYYIPIVIPPK

SEQ ID NO: 2586260 - protein, 28 aa, Entamoeba histolytica
NPHFVKLLCTCYGYFFADIFMLIPENSV

SEQ ID NO: 2586261 - protein, 20 aa, Entamoeba histolytica
NPIDPIDKVFVFKRTDTPDS

SEQ ID NO: 2586262 - protein, 18 aa, Entamoeba histolytica
NPKECNPELVLFEILHQS

SEQ ID NO: 2586263 - protein, 24 aa, Entamoeba histolytica
NPKLLDFLYCLSLCNSCTIEHSDS

SEQ ID NO: 2586264 - protein, 23 aa, Entamoeba histolytica
NPLLIKYKCEVIQYSDIIREVVI

SEQ ID NO: 2586265 - protein, 19 aa, Entamoeba histolytica
NPLMPQYVYDTLIILPEAL

SEQ ID NO: 2586266 - protein, 25 aa, Entamoeba histolytica
NPLPWKFFPTPSFMIFPFATVISDL

SEQ ID NO: 2586267 - protein, 39 aa, Entamoeba histolytica
NPNIGSAVLHCIGYFSLFICIIVTLKCRSVVSQLVKLHH

SEQ ID NO: 2586268 - protein, 17 aa, Entamoeba histolytica
NPNNYWFGIGLFYLTLV

SEQ ID NO: 2586269 - protein, 18 aa, Entamoeba histolytica
NPNNYWFGIGLFYLTLVY

SEQ ID NO: 2586270 - protein, 20 aa, Entamoeba histolytica
NPQCLTRFLLTTNESTGTMQ

SEQ ID NO: 2586271 - protein, 23 aa, Entamoeba histolytica
NPSHCLSCADGYYFSQDNSECIK

SEQ ID NO: 2586272 - protein, 25 aa, Entamoeba histolytica
NPSKEVMVAIGLLFHLHFLSLQRWL

SEQ ID NO: 2586273 - protein, 19 aa, Entamoeba histolytica
NPSLVWFFVILSLCLVWMI

SEQ ID NO: 2586274 - protein, 24 aa, Entamoeba histolytica
NPTCLTCFGGYYLINNGNECVNAT

SEQ ID NO: 2586275 - protein, 23 aa, Entamoeba histolytica
NPTEALCVLILYQITRTIFNLTP

SEQ ID NO: 2586276 - protein, 20 aa, Entamoeba histolytica
NPTKCPFKKINTMTLKHSKG

SEQ ID NO: 2586277 - protein, 27 aa, Entamoeba histolytica
NPYLECFKPICLCLRAMSECFKCNLVN

SEQ ID NO: 2586278 - protein, 25 aa, Entamoeba histolytica
NPYLLFRIADLFFIGCVVLTMVLNT

SEQ ID NO: 2586279 - protein, 17 aa, Entamoeba histolytica
NQENGHCLIPFNTMNYY

SEQ ID NO: 2586280 - protein, 18 aa, Entamoeba histolytica
NQFCRIFNPPTCNCNLLP

SEQ ID NO: 2586281 - protein, 17 aa, Entamoeba histolytica
NQFISGLITEFGGIVDR

SEQ ID NO: 2586282 - protein, 19 aa, Entamoeba histolytica
NQICVCLIGLIAIVIEQDQ

SEQ ID NO: 2586283 - protein, 17 aa, Entamoeba histolytica
NQIIGLILFTNTAKNTT

SEQ ID NO: 2586284 - protein, 31 aa, Entamoeba histolytica
NQIKEKNNIFGMMGVIFYWIITQKNYIIKEE

SEQ ID NO: 2586285 - protein, 25 aa, Entamoeba histolytica
NQIKEVFELSSFDEIEWRNKVKQEI

SEQ ID NO: 2586286 - protein, 20 aa, Entamoeba histolytica
NQKFPFNIHFAFFVVSLIAL

SEQ ID NO: 2586287 - protein, 18 aa, Entamoeba histolytica
NQLEYKFSCCGFDNATVQ

SEQ ID NO: 2586288 - protein, 24 aa, Entamoeba histolytica
NQLLTTMINICFSSKEVIEQFTLE

SEQ ID NO: 2586289 - protein, 20 aa, Entamoeba histolytica
NQLMRCIPLTFNNMSQLFNS

SEQ ID NO: 2586290 - protein, 21 aa, Entamoeba histolytica
NQMIFCLLCCSFVNQCVVLAT

SEQ ID NO: 2586291 - protein, 19 aa, Entamoeba histolytica
NQMNLWCGFACDPNSARWT

SEQ ID NO: 2586292 - protein, 25 aa, Entamoeba histolytica
NQNHCIECAYGYYLNSIQVCTKNPS

SEQ ID NO: 2586293 - protein, 17 aa, Entamoeba histolytica
NQPFKWSQFTIIEVHCS

SEQ ID NO: 2586294 - protein, 21 aa, Entamoeba histolytica
NQPKDCIEIIKLITNKESTKI

SEQ ID NO: 2586295 - protein, 20 aa, Entamoeba histolytica
NQPLCPFREECMQPFSDYVL

SEQ ID NO: 2586296 - protein, 18 aa, Entamoeba histolytica
NQRNCLFSNLLNSLNNAY

SEQ ID NO: 2586297 - protein, 25 aa, Entamoeba histolytica
NQTLTDFYLFFSIVAEQQPIDLSKV

SEQ ID NO: 2586298 - protein, 19 aa, Entamoeba histolytica
NQVKLRFNAKDGFGKAVQA

SEQ ID NO: 2586299 - protein, 26 aa, Entamoeba histolytica
NQVPVYCGFAFIAISFFQFRIFTLGY

SEQ ID NO: 2586300 - protein, 22 aa, Entamoeba histolytica
NQYICIGMFLVLYFYENLSYFF

SEQ ID NO: 2586301 - protein, 25 aa, Entamoeba histolytica
NQYPKFTCQWIELFSHRNVLYELSK

SEQ ID NO: 2586302 - protein, 17 aa, Entamoeba histolytica
NRCCLDVFNCSECTYTD

SEQ ID NO: 2586303 - protein, 17 aa, Entamoeba histolytica
NRDIIGFFMNGDEKVKV

SEQ ID NO: 2586304 - protein, 23 aa, Entamoeba histolytica
NRFIDCCFSCCCRKKCEHTLRLG

SEQ ID NO: 2586305 - protein, 27 aa, Entamoeba histolytica
NRFKKWSIVICICLIIVIFLVVVGSIL

SEQ ID NO: 2586306 - protein, 30 aa, Entamoeba histolytica
NRIMFHFFERFLLCNNLYLTTCFISLSYMF

SEQ ID NO: 2586307 - protein, 23 aa, Entamoeba histolytica
NRIPSWCDRVLYKTERRHGVIVE

SEQ ID NO: 2586308 - protein, 19 aa, Entamoeba histolytica
NRIRKHAKQPLLYSNITQD

SEQ ID NO: 2586309 - protein, 22 aa, Entamoeba histolytica
NRLIEALSCYLYPLHPFTKPPQ

SEQ ID NO: 2586310 - protein, 21 aa, Entamoeba histolytica
NRLKAATAICEMCVKYCKEHA

SEQ ID NO: 2586311 - protein, 19 aa, Entamoeba histolytica
NRMRALKCILNIIDNISTI

SEQ ID NO: 2586312 - protein, 21 aa, Entamoeba histolytica
NRMTVVNGWFGGIKMETRDQK

SEQ ID NO: 2586313 - protein, 23 aa, Entamoeba histolytica
NRNPCGRCSQRAFVELKGYDEEI

SEQ ID NO: 2586314 - protein, 23 aa, Entamoeba histolytica
NRNVGITVWEVYPIVNNQVIRQQ

SEQ ID NO: 2586315 - protein, 23 aa, Entamoeba histolytica
NRQLSLKFVDGVSFTVFDIDNNK

SEQ ID NO: 2586316 - protein, 31 aa, Entamoeba histolytica
NRRCPVSFNYKCPKMTFFIKYIRYLSYLNPY

SEQ ID NO: 2586317 - protein, 23 aa, Entamoeba histolytica
NRSINAIAYWIATTCSILIHIKY

SEQ ID NO: 2586318 - protein, 25 aa, Entamoeba histolytica
NRSREGLELFAIYITSFMLGLLLFA

SEQ ID NO: 2586319 - protein, 22 aa, Entamoeba histolytica
NRTRFGYLSSLGCTCQYTTSFI

SEQ ID NO: 2586320 - protein, 18 aa, Entamoeba histolytica
NRVREMMKMLGMKMTPYW

SEQ ID NO: 2586321 - protein, 18 aa, Entamoeba histolytica
NRYFPVEIINPITQQSIQ

SEQ ID NO: 2586322 - protein, 25 aa, Entamoeba histolytica
NRYICFWPQLLKFNADVWKFEDISG

SEQ ID NO: 2586323 - protein, 19 aa, Entamoeba histolytica
NRYVNGFSGDECTFGSNGF

SEQ ID NO: 2586324 - protein, 25 aa, Entamoeba histolytica
NSDACPICYSLFYLRTTTIPNVACK

SEQ ID NO: 2586325 - protein, 22 aa, Entamoeba histolytica
NSDLIWRLLLNITENEELDQKI

SEQ ID NO: 2586326 - protein, 23 aa, Entamoeba histolytica
NSDLKQSFVLSSLFTTKLILHSA

SEQ ID NO: 2586327 - protein, 22 aa, Entamoeba histolytica
NSDQAIIFWSRVCEKRNDKDDI

SEQ ID NO: 2586328 - protein, 26 aa, Entamoeba histolytica
NSEEFCFRGVFKFCSEHLYSTETASW

SEQ ID NO: 2586329 - protein, 25 aa, Entamoeba histolytica
NSEFRRFRYFLPFTINIDNDKKMYL

SEQ ID NO: 2586330 - protein, 21 aa, Entamoeba histolytica
NSEKKKAPGIDMNKVNLIKTR

SEQ ID NO: 2586331 - protein, 20 aa, Entamoeba histolytica
NSEKRPVFRGVISGDGENVI

SEQ ID NO: 2586332 - protein, 21 aa, Entamoeba histolytica
NSEPLLYQICVDPSYCNPSYV

SEQ ID NO: 2586333 - protein, 19 aa, Entamoeba histolytica
NSFINRFIDCCFSCCCRKK

SEQ ID NO: 2586334 - protein, 27 aa, Entamoeba histolytica
NSFPFIPLKISHDFTVEGFLSIQYSLQ

SEQ ID NO: 2586335 - protein, 27 aa, Entamoeba histolytica
NSFPSTYKWACLDSILILSTQTFNENL

SEQ ID NO: 2586336 - protein, 17 aa, Entamoeba histolytica
NSFVLLKKGKYIGFISE

SEQ ID NO: 2586337 - protein, 19 aa, Entamoeba histolytica
NSGKCILSLSLDKETSISL

SEQ ID NO: 2586338 - protein, 21 aa, Entamoeba histolytica
NSGKTPFVFDLIKFNEELTNK

SEQ ID NO: 2586339 - protein, 25 aa, Entamoeba histolytica
NSIASLLHRALCNFVDNFRELKLID

SEQ ID NO: 2586340 - protein, 21 aa, Entamoeba histolytica
NSIEMSIQWMISDVPSFVMVA

SEQ ID NO: 2586341 - protein, 17 aa, Entamoeba histolytica
NSIGAPVIGESIRLTLT

SEQ ID NO: 2586342 - protein, 26 aa, Entamoeba histolytica
NSIISLSCYYFKLLEDYSDIIKEIQK

SEQ ID NO: 2586343 - protein, 24 aa, Entamoeba histolytica
NSILRSCMIIICIGIITMISFFCY

SEQ ID NO: 2586344 - protein, 21 aa, Entamoeba histolytica
NSIPRIFTIFNNFLTGNFIPY

SEQ ID NO: 2586345 - protein, 24 aa, Entamoeba histolytica
NSKIPFRFIPFFKIHSITIQTIPT

SEQ ID NO: 2586346 - protein, 24 aa, Entamoeba histolytica
NSKSFRLLSGISIIFFNTSGILGY

SEQ ID NO: 2586347 - protein, 25 aa, Entamoeba histolytica
NSKTCLSCISGFMIQDNTCISAKQE

SEQ ID NO: 2586348 - protein, 25 aa, Entamoeba histolytica
NSKTYPWKMCIDPFKQFPFNMNINL

SEQ ID NO: 2586349 - protein, 24 aa, Entamoeba histolytica
NSLILRSLALVWLLFQECNYVIII

SEQ ID NO: 2586350 - protein, 27 aa, Entamoeba histolytica
NSLITRGVFCFIRKSGNIYALLNNEEV

SEQ ID NO: 2586351 - protein, 30 aa, Entamoeba histolytica
NSLLSIKIPHLFPYLSMVFNYLFEFIPTSI

SEQ ID NO: 2586352 - protein, 24 aa, Entamoeba histolytica
NSLMELPEKILLTIYPISLYYGLF

SEQ ID NO: 2586353 - protein, 25 aa, Entamoeba histolytica
NSLMYKLCYYRFGELMTDRNKPTGF

SEQ ID NO: 2586354 - protein, 17 aa, Entamoeba histolytica
NSLRVIFHRDFFPKEAS

SEQ ID NO: 2586355 - protein, 17 aa, Entamoeba histolytica
NSMFWLYGLSQMSLDNL

SEQ ID NO: 2586356 - protein, 21 aa, Entamoeba histolytica
NSNIFNWKKALIVLFQGMTMA

SEQ ID NO: 2586357 - protein, 26 aa, Entamoeba histolytica
NSNSRDICKIYSLFAETIISTMSHVN

SEQ ID NO: 2586358 - protein, 24 aa, Entamoeba histolytica
NSPCLQCMPGTYSGIGSAKCYQCP

SEQ ID NO: 2586359 - protein, 24 aa, Entamoeba histolytica
NSPHGIKYIIEFFKSNIGHPETSL

SEQ ID NO: 2586360 - protein, 22 aa, Entamoeba histolytica
NSPQLRLGFVAQEVKEVLPDLV

SEQ ID NO: 2586361 - protein, 23 aa, Entamoeba histolytica
NSQARMFAVLSMVFFIVSTVIIV

SEQ ID NO: 2586362 - protein, 18 aa, Entamoeba histolytica
NSQDLGMCLPFIENLAHQ

SEQ ID NO: 2586363 - protein, 22 aa, Entamoeba histolytica
NSQLPLSLGMQYIRNMTTLLRT

SEQ ID NO: 2586364 - protein, 21 aa, Entamoeba histolytica
NSRINKDFMIFGGVIDGFNAS

SEQ ID NO: 2586365 - protein, 24 aa, Entamoeba histolytica
NSSCAFPVMLNTTFIDYMSKNGNN

SEQ ID NO: 2586366 - protein, 17 aa, Entamoeba histolytica
NSSCIAYVCLTRLMEAY

SEQ ID NO: 2586367 - protein, 21 aa, Entamoeba histolytica
NSSLIIRKGLLHQIHDIHIQQ

SEQ ID NO: 2586368 - protein, 18 aa, Entamoeba histolytica
NSTIFVIGGLSYTPRIKE

SEQ ID NO: 2586369 - protein, 24 aa, Entamoeba histolytica
NSVTIKSGILYYINVIALNLILGN

SEQ ID NO: 2586370 - protein, 24 aa, Entamoeba histolytica
NSYMKTCLKQIGGVSSIIIAVICI

SEQ ID NO: 2586371 - protein, 21 aa, Entamoeba histolytica
NTCLPKCDIKGCLTGCTAPNQ

SEQ ID NO: 2586372 - protein, 27 aa, Entamoeba histolytica
NTDYRLLGSLFFKRGNVLRKILSNPVQ

SEQ ID NO: 2586373 - protein, 18 aa, Entamoeba histolytica
NTECFICNDGFYLTSDGT

SEQ ID NO: 2586374 - protein, 26 aa, Entamoeba histolytica
NTEDFKEVFVWKVFYTSLIWVLKNID

SEQ ID NO: 2586375 - protein, 17 aa, Entamoeba histolytica
NTFPLKDIEALIKYLPN

SEQ ID NO: 2586376 - protein, 24 aa, Entamoeba histolytica
NTFTIWIPLEESFLGTKKRIQLNH

SEQ ID NO: 2586377 - protein, 23 aa, Entamoeba histolytica
NTHLPDPFVFTFGVREMVWSNTF

SEQ ID NO: 2586378 - protein, 24 aa, Entamoeba histolytica
NTIPFKIEKKFVLENFKLLNDMFC

SEQ ID NO: 2586379 - protein, 17 aa, Entamoeba histolytica
NTKEYYLALSTLLQNVA

SEQ ID NO: 2586380 - protein, 19 aa, Entamoeba histolytica
NTKLNCFGYLGCLIGNNIF

SEQ ID NO: 2586381 - protein, 23 aa, Entamoeba histolytica
NTKSVLLEDIMKIWESVARPECF

SEQ ID NO: 2586382 - protein, 19 aa, Entamoeba histolytica
NTLGCKYCNFITPKCGDTQ

SEQ ID NO: 2586383 - protein, 19 aa, Entamoeba histolytica
NTLLIPGIILRYLPNDRLT

SEQ ID NO: 2586384 - protein, 25 aa, Entamoeba histolytica
NTLMTFERFVFIAGVTGILIFERGR

SEQ ID NO: 2586385 - protein, 24 aa, Entamoeba histolytica
NTLNLATNYVIEWIEYIRNKDSEL

SEQ ID NO: 2586386 - protein, 19 aa, Entamoeba histolytica
NTLPRSICLNTLSEEINPV

SEQ ID NO: 2586387 - protein, 26 aa, Entamoeba histolytica
NTLSLKWLRMCIIKNCFIQPSLEDYN

SEQ ID NO: 2586388 - protein, 20 aa, Entamoeba histolytica
NTMAICFVFILALVLFVYCI

SEQ ID NO: 2586389 - protein, 22 aa, Entamoeba histolytica
NTMEYRKTPLLNEHTIGLMKGC

SEQ ID NO: 2586390 - protein, 28 aa, Entamoeba histolytica
NTNNDYNVIFGMFKDFVEKVVTSTGTNK

SEQ ID NO: 2586391 - protein, 25 aa, Entamoeba histolytica
NTNPTFGSECIIVISNISQPIILNE

SEQ ID NO: 2586392 - protein, 17 aa, Entamoeba histolytica
NTNVCGEFGKYLQLHVS

SEQ ID NO: 2586393 - protein, 28 aa, Entamoeba histolytica
NTPCSSTSCSFCSFIINGQIKYDFYYIN

SEQ ID NO: 2586394 - protein, 21 aa, Entamoeba histolytica
NTPRGGKLFKLLTSSNYHAVN

SEQ ID NO: 2586395 - protein, 26 aa, Entamoeba histolytica
NTSEYCPFGKLIGKFKTLRQFCQIWN

SEQ ID NO: 2586396 - protein, 24 aa, Entamoeba histolytica
NTSIKLKGSFGYKDKMILNDINLE

SEQ ID NO: 2586397 - protein, 18 aa, Entamoeba histolytica
NTSLPYVVVYPIVTAGPG

SEQ ID NO: 2586398 - protein, 24 aa, Entamoeba histolytica
NTTGFRNTFRWKSIKNEAQITFQT

SEQ ID NO: 2586399 - protein, 24 aa, Entamoeba histolytica
NTTHCLDCDSIAYSLSNGKCINQN

SEQ ID NO: 2586400 - protein, 23 aa, Entamoeba histolytica
NTTSRPRPPLPKRNISKSPLSTT

SEQ ID NO: 2586401 - protein, 19 aa, Entamoeba histolytica
NTYIQLRISVGFAGPETKI

SEQ ID NO: 2586402 - protein, 20 aa, Entamoeba histolytica
NTYIQLRISVGFAGPETKIY

SEQ ID NO: 2586403 - protein, 24 aa, Entamoeba histolytica
NVDLSLYLKLLIDRIKFGVCNDIV

SEQ ID NO: 2586404 - protein, 17 aa, Entamoeba histolytica
NVEEIFNRIEIMAQLVI

SEQ ID NO: 2586405 - protein, 23 aa, Entamoeba histolytica
NVELCTSRRGCIIIDDKRKVRYI

SEQ ID NO: 2586406 - protein, 24 aa, Entamoeba histolytica
NVEYEILNVFPFSSSTKRMGIIVR

SEQ ID NO: 2586407 - protein, 19 aa, Entamoeba histolytica
NVFKIIWHEVDIVMDEILF

SEQ ID NO: 2586408 - protein, 33 aa, Entamoeba histolytica; identical to SEQ ID NO: 2554492

SEQ ID NO: 2586409 - protein, 20 aa, Entamoeba histolytica
NVHFKVWDLIAKKVVAQLYR

SEQ ID NO: 2586410 - protein, 18 aa, Entamoeba histolytica
NVIASGMKKFDIGVDTYI

SEQ ID NO: 2586411 - protein, 19 aa, Entamoeba histolytica
NVIECIQCKSGYYLNSNNK

SEQ ID NO: 2586412 - protein, 17 aa, Entamoeba histolytica
NVIFPPPEVFFICDNCT

SEQ ID NO: 2586413 - protein, 17 aa, Entamoeba histolytica
NVILLMCEFIYNMFCGN

SEQ ID NO: 2586414 - protein, 25 aa, Entamoeba histolytica
NVISLLLSVFVFRFTHKFYSLQTSH

SEQ ID NO: 2586415 - protein, 20 aa, Entamoeba histolytica
NVKLNLPVFEIYDYHYNSSE

SEQ ID NO: 2586416 - protein, 17 aa, Entamoeba histolytica
NVLEHFDIIFLQDVIGA

SEQ ID NO: 2586417 - protein, 24 aa, Entamoeba histolytica
NVLMEFYIFIVFIWIFFHVDHLRF

SEQ ID NO: 2586418 - protein, 20 aa, Entamoeba histolytica
NVLYFKNYFQYFPIQIENCT

SEQ ID NO: 2586419 - protein, 21 aa, Entamoeba histolytica
NVLYKLFFLFLFHCLKLFKTI

SEQ ID NO: 2586420 - protein, 18 aa, Entamoeba histolytica
NVMALMCKKPTPFTIKII

SEQ ID NO: 2586421 - protein, 24 aa, Entamoeba histolytica
NVNSICAVCPVWGISAVETPDLYA

SEQ ID NO: 2586422 - protein, 18 aa, Entamoeba histolytica
NVPSAWPLTPVISEGGAQ

SEQ ID NO: 2586423 - protein, 20 aa, Entamoeba histolytica
NVSKMEWKFRGIKEKDIPFI

SEQ ID NO: 2586424 - protein, 18 aa, Entamoeba histolytica
NVSYKLRMLKALHLYETI

SEQ ID NO: 2586425 - protein, 18 aa, Entamoeba histolytica
NVTPFGGYANNKVNGKYN

SEQ ID NO: 2586426 - protein, 20 aa, Entamoeba histolytica
NVVCECLKMFLKQLPNSLIN

SEQ ID NO: 2586427 - protein, 33 aa, Entamoeba histolytica
NVVSPYKVRLVWKEIRGVWQWIEGKTYEVKPEL

SEQ ID NO: 2586428 - protein, 24 aa, Entamoeba histolytica
NWFYLFGTAGCWFFFDIAFYGNSM

SEQ ID NO: 2586429 - protein, 17 aa, Entamoeba histolytica
NWLLLLFDASYYKIIIW

SEQ ID NO: 2586430 - protein, 25 aa, Entamoeba histolytica
NWNLFKCSFILLKFSLFAIPFTLRI

SEQ ID NO: 2586431 - protein, 31 aa, Entamoeba histolytica
NWYKRLTVTIVCVILLFSYIFTYVLLKTTPD

SEQ ID NO: 2586432 - protein, 18 aa, Entamoeba histolytica
NYDLVLINVLYFKNYFQY

SEQ ID NO: 2586433 - protein, 23 aa, Entamoeba histolytica
NYDQRSKREWKRVEEIRQNSIQL

SEQ ID NO: 2586434 - protein, 20 aa, Entamoeba histolytica
NYFCEIMTWIFFNVMTGFSF

SEQ ID NO: 2586435 - protein, 23 aa, Entamoeba histolytica
NYFVFLKRGKWGLLGNTPTIIFL

SEQ ID NO: 2586436 - protein, 24 aa, Entamoeba histolytica
NYGIFRRKIKILTSIVAAREGIHV

SEQ ID NO: 2586437 - protein, 17 aa, Entamoeba histolytica
NYHCYSVACMNNSFYKI

SEQ ID NO: 2586438 - protein, 17 aa, Entamoeba histolytica
NYIASFRIEERNQLYGL

SEQ ID NO: 2586439 - protein, 25 aa, Entamoeba histolytica
NYIDSRLFFFVGFGSLFTLSCFFVD

SEQ ID NO: 2586440 - protein, 26 aa, Entamoeba histolytica
NYIFILRFLWILIVHRRARGITTNDI

SEQ ID NO: 2586441 - protein, 25 aa, Entamoeba histolytica
NYKDNCLKDIFSLSLEVFNLLLQKR

SEQ ID NO: 2586442 - protein, 22 aa, Entamoeba histolytica
NYKYSRFVPLVAFLGYASLALY

SEQ ID NO: 2586443 - protein, 24 aa, Entamoeba histolytica
NYPLHKYLGFSLLKLHLPANKILL

SEQ ID NO: 2586444 - protein, 25 aa, Entamoeba histolytica
NYPYCYECESGFKLNKDGSCELISI

SEQ ID NO: 2586445 - protein, 17 aa, Entamoeba histolytica
NYQLWRLITPIFLHGGI

SEQ ID NO: 2586446 - protein, 24 aa, Entamoeba histolytica
NYRNKRVYDLFGYTIFEYQEIICQ

SEQ ID NO: 2586447 - protein, 26 aa, Entamoeba histolytica
NYSNVLPMFRWRMYYIDDKNTATSFP

SEQ ID NO: 2586448 - protein, 24 aa, Entamoeba histolytica
NYSSDFRIYLSYVSYVFVPVLMCT

SEQ ID NO: 2586449 - protein, 27 aa, Entamoeba histolytica
NYTSDFLKVRFCQDIARGMEYLHENDI

SEQ ID NO: 2586450 - protein, 25 aa, Entamoeba histolytica
NYVEAGICAVHFVSYIYKYLKDKIP

SEQ ID NO: 2586451 - protein, 18 aa, Entamoeba histolytica
NYVYPFGVDPIWKSSNNE

SEQ ID NO: 2586452 - protein, 19 aa, Entamoeba histolytica
NYYSIKLGSNVAVQSSTSS

SEQ ID NO: 2586453 - protein, 25 aa, Entamoeba histolytica
NYYWTCAFIPILIVLALIHGFAIVA

SEQ ID NO: 2586454 - protein, 24 aa, Entamoeba histolytica
PACSQLPILRFILSSNIYTMNVGY

SEQ ID NO: 2586455 - protein, 17 aa, Entamoeba histolytica
PADIYAFAITMYETMKW

SEQ ID NO: 2586456 - protein, 19 aa, Entamoeba histolytica
PAFSNSISHVGFRSTDGKE

SEQ ID NO: 2586457 - protein, 21 aa, Entamoeba histolytica
PAIKALNLFHPSSYEGGIDMK

SEQ ID NO: 2586458 - protein, 18 aa, Entamoeba histolytica
PALICITIAYVFSILAFN

SEQ ID NO: 2586459 - protein, 19 aa, Entamoeba histolytica
PANYYRFSLNKDIGVDVST

SEQ ID NO: 2586460 - protein, 19 aa, Entamoeba histolytica
PARTHHCGFCKRCITKYDH

SEQ ID NO: 2586461 - protein, 19 aa, Entamoeba histolytica
PATSIPAVVRELRWDSKAL

SEQ ID NO: 2586462 - protein, 25 aa, Entamoeba histolytica
PAVSWVCTFFMWKYDILPSNKVFYF

SEQ ID NO: 2586463 - protein, 20 aa, Entamoeba histolytica
PCGHKCMQICHGNKKCPPCS

SEQ ID NO: 2586464 - protein, 18 aa, Entamoeba histolytica
PCIVLKALINQHSLDSDA

SEQ ID NO: 2586465 - protein, 25 aa, Entamoeba histolytica
PCPKCTSLTEKTCYCGKNKVKIPCY

SEQ ID NO: 2586466 - protein, 17 aa, Entamoeba histolytica
PCPSSLGGDCVVLTFNP

SEQ ID NO: 2586467 - protein, 33 aa, Entamoeba histolytica
PCVEGRWYTLSCVPSYCDYGYKFDRTSQTCIED

SEQ ID NO: 2586468 - protein, 26 aa, Entamoeba histolytica
PCYSIPSCTSFQLWCSIFPLLSNLSN

SEQ ID NO: 2586469 - protein, 26 aa, Entamoeba histolytica
PCYVHVFCTKGFYSIFKKMIKMNKKS

SEQ ID NO: 2586470 - protein, 18 aa, Entamoeba histolytica
PDDAVECCTLWDDFSIIY

SEQ ID NO: 2586471 - protein, 18 aa, Entamoeba histolytica
PDDGENFIGYDTNISIRV

SEQ ID NO: 2586472 - protein, 22 aa, Entamoeba histolytica
PDEMRYGYDIINGCKHNDILEN

SEQ ID NO: 2586473 - protein, 17 aa, Entamoeba histolytica
PDFAPSFIVGPRDFLYG

SEQ ID NO: 2586474 - protein, 25 aa, Entamoeba histolytica
PDFREISLELKIITGMDVSKNAKLE

SEQ ID NO: 2586475 - protein, 18 aa, Entamoeba histolytica
PDGFYKYFHFKFPSLFTV

SEQ ID NO: 2586476 - protein, 23 aa, Entamoeba histolytica
PDHCKSVSPSALNFIFEDDIIEL

SEQ ID NO: 2586477 - protein, 17 aa, Entamoeba histolytica
PDHSGAINSCLWELTLL

SEQ ID NO: 2586478 - protein, 17 aa, Entamoeba histolytica
PDICDHCDTSLGYKEDC

SEQ ID NO: 2586479 - protein, 19 aa, Entamoeba histolytica
PDICERCNISKGYTSDCQG

SEQ ID NO: 2586480 - protein, 20 aa, Entamoeba histolytica
PDILTTLQVVSWRQEAYKDD

SEQ ID NO: 2586481 - protein, 25 aa, Entamoeba histolytica
PDIRVFVLHIVRWLNRVIRINPIRK

SEQ ID NO: 2586482 - protein, 20 aa, Entamoeba histolytica
PDISFPLSIRTIVATNSFET

SEQ ID NO: 2586483 - protein, 20 aa, Entamoeba histolytica
PDIYIRLLFGIDLVQIESMK

SEQ ID NO: 2586484 - protein, 25 aa, Entamoeba histolytica
PDLRDRGLFYWRLLAHDPELAKEMV

SEQ ID NO: 2586485 - protein, 25 aa, Entamoeba histolytica
PDLSKRISFDSVKSCSLLKDIDSHN

SEQ ID NO: 2586486 - protein, 20 aa, Entamoeba histolytica
PDMVETITILVLWSSDEMSW

SEQ ID NO: 2586487 - protein, 24 aa, Entamoeba histolytica
PDNCFYKLIIEECWKVNPDERPNF

SEQ ID NO: 2586488 - protein, 20 aa, Entamoeba histolytica
PDNILMFSMDFFEKVNAKLT

SEQ ID NO: 2586489 - protein, 17 aa, Entamoeba histolytica
PDNMLVFSFAEQVGVNL

SEQ ID NO: 2586490 - protein, 18 aa, Entamoeba histolytica
PDNNCVVTSLAQNTYEQE

SEQ ID NO: 2586491 - protein, 19 aa, Entamoeba histolytica
PDQYWTLVIPAGFVMGFFC

SEQ ID NO: 2586492 - protein, 19 aa, Entamoeba histolytica
PDSESILRFVGAGKRLCIS

SEQ ID NO: 2586493 - protein, 19 aa, Entamoeba histolytica
PDSESILRFVGAGKRLHVS

SEQ ID NO: 2586494 - protein, 21 aa, Entamoeba histolytica
PDVLDSLLLSFNRFLLDYVTR

SEQ ID NO: 2586495 - protein, 21 aa, Entamoeba histolytica
PDYYEGIAILVAVFAVSLIGA

SEQ ID NO: 2586496 - protein, 22 aa, Entamoeba histolytica
PEDIKSSLIINEFKRFKELRKR

SEQ ID NO: 2586497 - protein, 23 aa, Entamoeba histolytica
PEDMLKEHMNYYAFSTKDGQVIW

SEQ ID NO: 2586498 - protein, 20 aa, Entamoeba histolytica
PEELHFLSCLICAGHTEKEK

SEQ ID NO: 2586499 - protein, 21 aa, Entamoeba histolytica
PEFNIKKALSIYFVCTEDERK

SEQ ID NO: 2586500 - protein, 20 aa, Entamoeba histolytica
PEGAVVPSLICKPDDVPNCD

SEQ ID NO: 2586501 - protein, 17 aa, Entamoeba histolytica
PEGIELFAVGRKKHLNY

SEQ ID NO: 2586502 - protein, 18 aa, Entamoeba histolytica
PEKICGMYPILKQAIKQQ

SEQ ID NO: 2586503 - protein, 20 aa, Entamoeba histolytica
PELNRCSFVYSSTKEKMSYL

SEQ ID NO: 2586504 - protein, 29 aa, Entamoeba histolytica
PELPPQHNIIRIPWRRILFTPNPKKPTIW

SEQ ID NO: 2586505 - protein, 17 aa, Entamoeba histolytica
PEMKVTLLGNHFPNFLT

SEQ ID NO: 2586506 - protein, 18 aa, Entamoeba histolytica
PENQRPVLYVSVGTLAFV

SEQ ID NO: 2586507 - protein, 19 aa, Entamoeba histolytica
PENRCCSDIGMLKTGMLEG

SEQ ID NO: 2586508 - protein, 20 aa, Entamoeba histolytica
PENRCCSDIGMLKTGMLEGI

SEQ ID NO: 2586509 - protein, 18 aa, Entamoeba histolytica
PEQITLKKGEAFEAEIYI

SEQ ID NO: 2586510 - protein, 23 aa, Entamoeba histolytica
PERAKGFIPLIVRAIMAIIISCS

SEQ ID NO: 2586511 - protein, 19 aa, Entamoeba histolytica
PERNSGRVKAATKCVPALL

SEQ ID NO: 2586512 - protein, 25 aa, Entamoeba histolytica
PESILPPLLHLAANLSFLSSTFCSE

SEQ ID NO: 2586513 - protein, 26 aa, Entamoeba histolytica
PESIYGSAVGLRFEKSVIELVQTYLR

SEQ ID NO: 2586514 - protein, 20 aa, Entamoeba histolytica
PESLRSAAYRYLSVVCTVCP

SEQ ID NO: 2586515 - protein, 24 aa, Entamoeba histolytica
PESMGLVCGIVFMFITMLFSSLIS

SEQ ID NO: 2586516 - protein, 20 aa, Entamoeba histolytica
PESPLFFLKWLNRRRNDLGE

SEQ ID NO: 2586517 - protein, 22 aa, Entamoeba histolytica
PETCSIWWKLLTIWWTVSTIRL

SEQ ID NO: 2586518 - protein, 18 aa, Entamoeba histolytica
PEVFIVLCQNNGLTVFNE

SEQ ID NO: 2586519 - protein, 18 aa, Entamoeba histolytica
PEVIDAVASCHRAGITVR

SEQ ID NO: 2586520 - protein, 22 aa, Entamoeba histolytica
PEVKEYKPVIVASTISIAVVLS

SEQ ID NO: 2586521 - protein, 19 aa, Entamoeba histolytica
PEYHTYCGKYVVNNTRREP

SEQ ID NO: 2586522 - protein, 17 aa, Entamoeba histolytica
PEYIIGILSDFIHSESF

SEQ ID NO: 2586523 - protein, 20 aa, Entamoeba histolytica
PEYYLYSFGFCITGILFLYC

SEQ ID NO: 2586524 - protein, 25 aa, Entamoeba histolytica
PFCPCKSNECLLNFNDENITELNDI

SEQ ID NO: 2586525 - protein, 24 aa, Entamoeba histolytica
PFCSCEIDEIILFTAVNIKTNKII

SEQ ID NO: 2586526 - protein, 23 aa, Entamoeba histolytica
PFDLKMRILYDTSKGMVFLHENN

SEQ ID NO: 2586527 - protein, 21 aa, Entamoeba histolytica
PFEGTHYILGFVIEHHALETI

SEQ ID NO: 2586528 - protein, 20 aa, Entamoeba histolytica
PFEIRVGLDVNDTAFQDGSY

SEQ ID NO: 2586529 - protein, 18 aa, Entamoeba histolytica
PFELHWHLVVQDEYQIPS

SEQ ID NO: 2586530 - protein, 19 aa, Entamoeba histolytica
PFEQYGFFLVYIIGLLYSG

SEQ ID NO: 2586531 - protein, 24 aa, Entamoeba histolytica
PFFIFQVVCSILWMMDDMPIFAFM

SEQ ID NO: 2586532 - protein, 24 aa, Entamoeba histolytica
PFFILCLSVIYLLKEYWKIQEENE

SEQ ID NO: 2586533 - protein, 19 aa, Entamoeba histolytica
PFGKLGMLAALYIPTLLLT

SEQ ID NO: 2586534 - protein, 17 aa, Entamoeba histolytica
PFGRFDSLISFKMLRSI

SEQ ID NO: 2586535 - protein, 18 aa, Entamoeba histolytica
PFGTEMWDIEMINFCEMT

SEQ ID NO: 2586536 - protein, 17 aa, Entamoeba histolytica
PFHSFMFHLHLLLFCGC

SEQ ID NO: 2586537 - protein, 26 aa, Entamoeba histolytica
PFILFACLFSTFFIIVIPIIFRSFYF

SEQ ID NO: 2586538 - protein, 18 aa, Entamoeba histolytica
PFISFIIKLIGSHRSLYQ

SEQ ID NO: 2586539 - protein, 20 aa, Entamoeba histolytica
PFISLHWRPSLYKLGKISSL

SEQ ID NO: 2586540 - protein, 17 aa, Entamoeba histolytica
PFISRAQVHFIIQRGHH

SEQ ID NO: 2586541 - protein, 22 aa, Entamoeba histolytica
PFIVGVLFLNFVYLFLRMPFHS

SEQ ID NO: 2586542 - protein, 19 aa, Entamoeba histolytica
PFKEMNWSLLISVLFWNIN

SEQ ID NO: 2586543 - protein, 17 aa, Entamoeba histolytica
PFMCAFALSIIEYYVEK

SEQ ID NO: 2586544 - protein, 29 aa, Entamoeba histolytica
PFNCKECYKEKCALCFGNDIVISGVCYPM

SEQ ID NO: 2586545 - protein, 27 aa, Entamoeba histolytica
PFNSSPYGICWCSQMSMANNCIIGSDT

SEQ ID NO: 2586546 - protein, 24 aa, Entamoeba histolytica
PFPLKNLIQLCWKQIYTERPSFDF

SEQ ID NO: 2586547 - protein, 24 aa, Entamoeba histolytica
PFPSLFSFEINDFISPSFGILMNY

SEQ ID NO: 2586548 - protein, 28 aa, Entamoeba histolytica
PFQLILGLISLCWFGWNQLIGGIAIVSS

SEQ ID NO: 2586549 - protein, 26 aa, Entamoeba histolytica
PFTKTRWSLFIICLVWFMYRMVHYHK

SEQ ID NO: 2586550 - protein, 25 aa, Entamoeba histolytica
PFTSRLCPCFGTNCIIHSLTGLLYI

SEQ ID NO: 2586551 - protein, 26 aa, Entamoeba histolytica
PFTTIKMACFLFCFCFYSLMCISYYK

SEQ ID NO: 2586552 - protein, 18 aa, Entamoeba histolytica
PFVALSFLDATLMISSEF

SEQ ID NO: 2586553 - protein, 25 aa, Entamoeba histolytica
PFVYEIRTILDWCLSKTSMFYKQWL

SEQ ID NO: 2586554 - protein, 25 aa, Entamoeba histolytica
PFVYEIRTILDWTFAKTSMFYKLWL

SEQ ID NO: 2586555 - protein, 17 aa, Entamoeba histolytica
PFYKCQDALDVQLPYTA

SEQ ID NO: 2586556 - protein, 20 aa, Entamoeba histolytica
PFYLERSVLIGLLISWDTFS

SEQ ID NO: 2586557 - protein, 24 aa, Entamoeba histolytica
PGDKQAACCLQMIADYALPRLFVG

SEQ ID NO: 2586558 - protein, 29 aa, Entamoeba histolytica
PGEVQAPCYAKLYFPYNGFIIMTLILGAL

SEQ ID NO: 2586559 - protein, 22 aa, Entamoeba histolytica
PGGFKFNINFNYFLSSLSLFFL

SEQ ID NO: 2586560 - protein, 20 aa, Entamoeba histolytica
PGIIVYELMLIILLIIFLIQ

SEQ ID NO: 2586561 - protein, 19 aa, Entamoeba histolytica
PGNDIFLSFYSHLVDSLYF

SEQ ID NO: 2586562 - protein, 17 aa, Entamoeba histolytica
PGQACEFEIFIKPLCSC

SEQ ID NO: 2586563 - protein, 17 aa, Entamoeba histolytica
PGQRFSSFYTVASKSPI

SEQ ID NO: 2586564 - protein, 25 aa, Entamoeba histolytica
PGTCVPVCICCWFLNLFQSKKTRII

SEQ ID NO: 2586565 - protein, 24 aa, Entamoeba histolytica
PGVFRIGEWMIINGLKTKSEIKAM

SEQ ID NO: 2586566 - protein, 17 aa, Entamoeba histolytica
PGYDCFINSPSTTNFEL

SEQ ID NO: 2586567 - protein, 21 aa, Entamoeba histolytica
PHDSVLCKVSDFGTSRCFVES

SEQ ID NO: 2586568 - protein, 24 aa, Entamoeba histolytica
PHEELLRHSIPIIIRLYQNKLLPN

SEQ ID NO: 2586569 - protein, 17 aa, Entamoeba histolytica
PHGRFTYALESFNFGSL

SEQ ID NO: 2586570 - protein, 27 aa, Entamoeba histolytica
PHIGSLASLLHKPPEVFVSSLKAQAGG

SEQ ID NO: 2586571 - protein, 28 aa, Entamoeba histolytica
PHLQFLGTLIFYCLAIKTPPGYIKKSNL

SEQ ID NO: 2586572 - protein, 18 aa, Entamoeba histolytica
PHPFQLVDIRAIVKASHS

SEQ ID NO: 2586573 - protein, 22 aa, Entamoeba histolytica
PHPWDIADTITIGKRPNIIQEV

SEQ ID NO: 2586574 - protein, 19 aa, Entamoeba histolytica
PHWYDPIINSIKFVWNFII

SEQ ID NO: 2586575 - protein, 18 aa, Entamoeba histolytica
PHYHFIVMVLWQRIDAMV

SEQ ID NO: 2586576 - protein, 20 aa, Entamoeba histolytica
PIACAVCLEIAKTLQSLFMK

SEQ ID NO: 2586577 - protein, 22 aa, Entamoeba histolytica
PIAYKLLLNYFISNYKEKIKSS

SEQ ID NO: 2586578 - protein, 18 aa, Entamoeba histolytica
PICCLITFIDICSHWTHM

SEQ ID NO: 2586579 - protein, 24 aa, Entamoeba histolytica
PICPSKCLISGKGMEEIKTIKMTK

SEQ ID NO: 2586580 - protein, 24 aa, Entamoeba histolytica
PIDTLKFFCYYVLRQIKELYNYII

SEQ ID NO: 2586581 - protein, 17 aa, Entamoeba histolytica
PIEMKWYVKTPAKRNKN

SEQ ID NO: 2586582 - protein, 18 aa, Entamoeba histolytica
PIFIAFSGKKAYSYQGKF

SEQ ID NO: 2586583 - protein, 24 aa, Entamoeba histolytica
PIGFRCKKELTPCCVVPVVHSVPR

SEQ ID NO: 2586584 - protein, 20 aa, Entamoeba histolytica
PIHIILMIIERICVVRESVK

SEQ ID NO: 2586585 - protein, 17 aa, Entamoeba histolytica
PIIKYNKINGVPDVLTS

SEQ ID NO: 2586586 - protein, 19 aa, Entamoeba histolytica
PIILLKCVCAMLYRSSQVK

SEQ ID NO: 2586587 - protein, 26 aa, Entamoeba histolytica
PIINSIKFVWNFIIKIWDIFTSFVSK

SEQ ID NO: 2586588 - protein, 19 aa, Entamoeba histolytica
PIIPICPGENVQQCNQTEI

SEQ ID NO: 2586589 - protein, 26 aa, Entamoeba histolytica
PIIYIICGLSMLFRRSYTFTKQIILP

SEQ ID NO: 2586590 - protein, 18 aa, Entamoeba histolytica
PILHLISLISTKTISKEE

SEQ ID NO: 2586591 - protein, 25 aa, Entamoeba histolytica
PILHMISLFVLWFAPLQRRFQSFLY

SEQ ID NO: 2586592 - protein, 23 aa, Entamoeba histolytica
PILPSDGSVVWAIIIKIIIMLLP

SEQ ID NO: 2586593 - protein, 19 aa, Entamoeba histolytica
PILQLLRCYILFPEHWSTF

SEQ ID NO: 2586594 - protein, 18 aa, Entamoeba histolytica
PINCIKYVLMIGSIKTIS

SEQ ID NO: 2586595 - protein, 27 aa, Entamoeba histolytica
PINEFPYPWSISKFVCIGRRLPQHPEM

SEQ ID NO: 2586596 - protein, 23 aa, Entamoeba histolytica
PINLPKFRSNFKVSKSIEKIVNA

SEQ ID NO: 2586597 - protein, 20 aa, Entamoeba histolytica
PIPICLMKLVNTFVVLIMCV

SEQ ID NO: 2586598 - protein, 23 aa, Entamoeba histolytica
PIQPKLPCDLIEITPTFPSKKEN

SEQ ID NO: 2586599 - protein, 26 aa, Entamoeba histolytica
PIQRFPFSSLLKRMSVVVAIKDFNTN

SEQ ID NO: 2586600 - protein, 36 aa, Entamoeba histolytica
PISDCYIIILSFDRWRSVLSHWKYYLQRVLPNDESI

SEQ ID NO: 2586601 - protein, 22 aa, Entamoeba histolytica
PISIRVNLDISKLIYSMFISTD

SEQ ID NO: 2586602 - protein, 21 aa, Entamoeba histolytica
PISMRVNLDIAKMVYAFFINR

SEQ ID NO: 2586603 - protein, 26 aa, Entamoeba histolytica
PISYAIVKKRVRSFNELLDIYIKNKF

SEQ ID NO: 2586604 - protein, 21 aa, Entamoeba histolytica
PITELVFCYLLSNWNYLVCQF

SEQ ID NO: 2586605 - protein, 17 aa, Entamoeba histolytica
PITITWKNGANVTISYS

SEQ ID NO: 2586606 - protein, 17 aa, Entamoeba histolytica
PITLCLNHLPSTLQPLT

SEQ ID NO: 2586607 - protein, 21 aa, Entamoeba histolytica
PIVSSCLEFIFNCHIEDVILT

SEQ ID NO: 2586608 - protein, 23 aa, Entamoeba histolytica
PIYYPEYLGIFTFVNNDLRVANK

SEQ ID NO: 2586609 - protein, 24 aa, Entamoeba histolytica
PKEFISQIIVICWNHDPRIKAIDT

SEQ ID NO: 2586610 - protein, 19 aa, Entamoeba histolytica
PKEKFGCWVGEAHPHETRV

SEQ ID NO: 2586611 - protein, 25 aa, Entamoeba histolytica
PKEKHIWNAIFGRFVDDIQRNAPPD

SEQ ID NO: 2586612 - protein, 17 aa, Entamoeba histolytica
PKESVVLTISFMAKCTT

SEQ ID NO: 2586613 - protein, 18 aa, Entamoeba histolytica
PKFGMIFQIISMVITGYV

SEQ ID NO: 2586614 - protein, 27 aa, Entamoeba histolytica
PKFSLFFGGICYVFYIATNVYLIRSLY

SEQ ID NO: 2586615 - protein, 19 aa, Entamoeba histolytica
PKFSTAISIGMFSTASFWF

SEQ ID NO: 2586616 - protein, 19 aa, Entamoeba histolytica
PKFVDILTIIESWGEDIRY

SEQ ID NO: 2586617 - protein, 19 aa, Entamoeba histolytica
PKGFPKKKLIPLLLLSFLE

SEQ ID NO: 2586618 - protein, 17 aa, Entamoeba histolytica
PKGKNCYNTMAGYCEIC

SEQ ID NO: 2586619 - protein, 19 aa, Entamoeba histolytica
PKGLPTKAIDQFISTTTIQ

SEQ ID NO: 2586620 - protein, 18 aa, Entamoeba histolytica
PKGNEPPAKVEGNSLQSK

SEQ ID NO: 2586621 - protein, 20 aa, Entamoeba histolytica
PKGPLRILVNLAQERKEPIP

SEQ ID NO: 2586622 - protein, 20 aa, Entamoeba histolytica
PKILSLPSTLVFNSSMHLVI

SEQ ID NO: 2586623 - protein, 19 aa, Entamoeba histolytica
PKIMDFCSIFSFIEYFLPP

SEQ ID NO: 2586624 - protein, 20 aa, Entamoeba histolytica
PKIYSLGFLLNWKNFLFSPI

SEQ ID NO: 2586625 - protein, 19 aa, Entamoeba histolytica
PKKALLRYLIKTPTQKISK

SEQ ID NO: 2586626 - protein, 20 aa, Entamoeba histolytica
PKKILGICCTVIVGVSYGAF

SEQ ID NO: 2586627 - protein, 21 aa, Entamoeba histolytica
PKKILKWVISNWKCMIFFVIF

SEQ ID NO: 2586628 - protein, 23 aa, Entamoeba histolytica
PKKPLPFGLLVLRFDKPDIQIYL

SEQ ID NO: 2586629 - protein, 20 aa, Entamoeba histolytica
PKLFVGMLICLIFSEALALY

SEQ ID NO: 2586630 - protein, 29 aa, Entamoeba histolytica
PKLMDFPPLEFAKQITLFTSELFRKIKLV

SEQ ID NO: 2586631 - protein, 17 aa, Entamoeba histolytica
PKLSDLVTLNENTEEID

SEQ ID NO: 2586632 - protein, 19 aa, Entamoeba histolytica
PKLYLLEDVSYPFVASTAM

SEQ ID NO: 2586633 - protein, 25 aa, Entamoeba histolytica
PKNCKRILECIVHHIGIIVLVVGVI

SEQ ID NO: 2586634 - protein, 19 aa, Entamoeba histolytica
PKNICKFGNEPHCYQCKEG

SEQ ID NO: 2586635 - protein, 18 aa, Entamoeba histolytica
PKNKRLVKRDSICDKEIN

SEQ ID NO: 2586636 - protein, 19 aa, Entamoeba histolytica
PKNKRLVKRDSICDNEINI

SEQ ID NO: 2586637 - protein, 23 aa, Entamoeba histolytica
PKNKRLVKRDSICDNEINIEHGH

SEQ ID NO: 2586638 - protein, 18 aa, Entamoeba histolytica
PKNKRLVKRDSRCDKEIN

SEQ ID NO: 2586639 - protein, 22 aa, Entamoeba histolytica
PKNRAYHPNWFTGKSQYGTLNY

SEQ ID NO: 2586640 - protein, 20 aa, Entamoeba histolytica
PKPLLSYLWNGMISLVIIYF

SEQ ID NO: 2586641 - protein, 17 aa, Entamoeba histolytica
PKPQAWRGILSISSGSI

SEQ ID NO: 2586642 - protein, 19 aa, Entamoeba histolytica
PKPVMPSLMKLLDSPDENI

SEQ ID NO: 2586643 - protein, 23 aa, Entamoeba histolytica
PKPWSTNEISSWKCAGDDAQFNQ

SEQ ID NO: 2586644 - protein, 17 aa, Entamoeba histolytica
PKQEKPAVVQQTQNGDA

SEQ ID NO: 2586645 - protein, 22 aa, Entamoeba histolytica
PKQFFLTSFVMFNLLGINLSGI

SEQ ID NO: 2586646 - protein, 33 aa, Entamoeba histolytica
PKQHKRIYNEYKVHLKGEGEVIEPLQEAKETGN

SEQ ID NO: 2586647 - protein, 30 aa, Entamoeba histolytica
PKRIKERRTLWILWAFWWFVYALVCVMAFG

SEQ ID NO: 2586648 - protein, 25 aa, Entamoeba histolytica
PKSEFKFPWKIAEFISTGKRPNIIQ

SEQ ID NO: 2586649 - protein, 27 aa, Entamoeba histolytica
PKSEFKFPWKIAEFISTGKRPNIIQEV

SEQ ID NO: 2586650 - protein, 27 aa, Entamoeba histolytica
PKSEFKFPWKIAEFISTGKRPVIIQEV

SEQ ID NO: 2586651 - protein, 24 aa, Entamoeba histolytica
PKSFSPGICELIKKCWAHDPKQRP

SEQ ID NO: 2586652 - protein, 18 aa, Entamoeba histolytica
PKSVLTLYVREVSIRELY

SEQ ID NO: 2586653 - protein, 23 aa, Entamoeba histolytica
PKTGYCQGMSFLAGQILLVTQNP

SEQ ID NO: 2586654 - protein, 23 aa, Entamoeba histolytica
PKTLKEQFLEFLMVHETVSDYLQ

SEQ ID NO: 2586655 - protein, 19 aa, Entamoeba histolytica
PKTRVVCRYDNGWKNDNCP

SEQ ID NO: 2586656 - protein, 18 aa, Entamoeba histolytica
PKTRYNCYSHVWDAHLRH

SEQ ID NO: 2586657 - protein, 25 aa, Entamoeba histolytica
PKVFLRLYGLFSMFVALWVLLFFFR

SEQ ID NO: 2586658 - protein, 18 aa, Entamoeba histolytica
PKVKCMVPYCDDDNNLKE

SEQ ID NO: 2586659 - protein, 18 aa, Entamoeba histolytica
PKVKCMVPYCDNDKNLTE

SEQ ID NO: 2586660 - protein, 19 aa, Entamoeba histolytica
PKYCELCKKVISILRVLSK

SEQ ID NO: 2586661 - protein, 18 aa, Entamoeba histolytica
PLAIYAFFYPLRNPFYHC

SEQ ID NO: 2586662 - protein, 18 aa, Entamoeba histolytica
PLCIGACLILIVIILIII

SEQ ID NO: 2586663 - protein, 23 aa, Entamoeba histolytica
PLCYKQAYPTLWYKIKGDGRYLV

SEQ ID NO: 2586664 - protein, 22 aa, Entamoeba histolytica
PLDGPMPTEWKHLITSCWNQKP

SEQ ID NO: 2586665 - protein, 18 aa, Entamoeba histolytica
PLELILTIVIVIPLIYKK

SEQ ID NO: 2586666 - protein, 19 aa, Entamoeba histolytica
PLEPLFQRHIVALGNAFAF

SEQ ID NO: 2586667 - protein, 18 aa, Entamoeba histolytica
PLFSWLYCSCIKTHATPS

SEQ ID NO: 2586668 - protein, 18 aa, Entamoeba histolytica
PLGDVTLPNWAFKHNLLD

SEQ ID NO: 2586669 - protein, 27 aa, Entamoeba histolytica
PLGFFCCGCSFLFIFFFDRVVVTHGGH

SEQ ID NO: 2586670 - protein, 17 aa, Entamoeba histolytica
PLGILLFRYEDWMPSAL

SEQ ID NO: 2586671 - protein, 18 aa, Entamoeba histolytica
PLHILRNRMCILPQEATM

SEQ ID NO: 2586672 - protein, 17 aa, Entamoeba histolytica
PLIAWSFTQKFPFNAHF

SEQ ID NO: 2586673 - protein, 22 aa, Entamoeba histolytica
PLICAGPGLLSALWGIIVFGEI

SEQ ID NO: 2586674 - protein, 32 aa, Entamoeba histolytica
PLICAGPGLLSALWGIVVFKEIRGWKNFIYFG

SEQ ID NO: 2586675 - protein, 19 aa, Entamoeba histolytica
PLICLPIVIIISIICLGTV

SEQ ID NO: 2586676 - protein, 21 aa, Entamoeba histolytica
PLIFICSIFIINICLFSVIHI

SEQ ID NO: 2586677 - protein, 24 aa, Entamoeba histolytica
PLKTERWELDFGLPSTKAIVDTEY

SEQ ID NO: 2586678 - protein, 19 aa, Entamoeba histolytica
PLLHHIMLLILWVVPITRK

SEQ ID NO: 2586679 - protein, 25 aa, Entamoeba histolytica
PLLLFIWRFIIRRIIHPNPIQKYHA

SEQ ID NO: 2586680 - protein, 24 aa, Entamoeba histolytica
PLMKGAKKGIDFGFFEGETFGNMG

SEQ ID NO: 2586681 - protein, 23 aa, Entamoeba histolytica
PLNEFPYSISVDVPKEIINNQKV

SEQ ID NO: 2586682 - protein, 25 aa, Entamoeba histolytica
PLNSISTSCVVVWNESELALDTSLF

SEQ ID NO: 2586683 - protein, 20 aa, Entamoeba histolytica
PLPICIVSQLPLKYFIIPFI

SEQ ID NO: 2586684 - protein, 20 aa, Entamoeba histolytica
PLPIKRGIKNLCTPPTIATL

SEQ ID NO: 2586685 - protein, 25 aa, Entamoeba histolytica
PLQIQRKVGEIGIVLSEESVRNNDL

SEQ ID NO: 2586686 - protein, 19 aa, Entamoeba histolytica
PLQSVWCTLTYFNDSKQSK

SEQ ID NO: 2586687 - protein, 19 aa, Entamoeba histolytica
PLSDHIKCTTLFNLKSIQS

SEQ ID NO: 2586688 - protein, 25 aa, Entamoeba histolytica
PLSLSCSTLTFGRSGTEPVPVDEEL

SEQ ID NO: 2586689 - protein, 19 aa, Entamoeba histolytica
PLTQCFQGQIQIEEDGKKS

SEQ ID NO: 2586690 - protein, 23 aa, Entamoeba histolytica
PLVKKDGKCIGIFNKIEVLNTTG

SEQ ID NO: 2586691 - protein, 24 aa, Entamoeba histolytica
PLVKKGGKCIGIYKKIEVLNTTGT

SEQ ID NO: 2586692 - protein, 20 aa, Entamoeba histolytica
PLVNSFKYDTCVGNEIFKNA

SEQ ID NO: 2586693 - protein, 19 aa, Entamoeba histolytica
PMCSIKGCDGECASPNECT

SEQ ID NO: 2586694 - protein, 18 aa, Entamoeba histolytica
PMKFKRKVISPILKIHLD

SEQ ID NO: 2586695 - protein, 25 aa, Entamoeba histolytica
PMKVLCKIHRGLTCCIDGRIYEEYS

SEQ ID NO: 2586696 - protein, 31 aa, Entamoeba histolytica; identical to SEQ ID NO: 2388859

SEQ ID NO: 2586697 - protein, 22 aa, Entamoeba histolytica
PMLSSFLDYFGYFVGGWKSNMD

SEQ ID NO: 2586698 - protein, 27 aa, Entamoeba histolytica
PMSDLLKIRFCQDIARGMEYLHENDIL

SEQ ID NO: 2586699 - protein, 26 aa, Entamoeba histolytica
PMSDLLKVRFCQDIARGMEYLHQNDI

SEQ ID NO: 2586700 - protein, 24 aa, Entamoeba histolytica
PMVLSSPPWNCFSPQIQSDIPLPQ

SEQ ID NO: 2586701 - protein, 20 aa, Entamoeba histolytica
PMYIIRAGLIAINYVPDTIK

SEQ ID NO: 2586702 - protein, 22 aa, Entamoeba histolytica
PNAKFLICCEPIFVDYIQILIV

SEQ ID NO: 2586703 - protein, 23 aa, Entamoeba histolytica
PNAPKEFCEYILTKKINGNTIRK

SEQ ID NO: 2586704 - protein, 22 aa, Entamoeba histolytica
PNCDSCIPSSISTICLICSSGY

SEQ ID NO: 2586705 - protein, 30 aa, Entamoeba histolytica
PNCHDCLGCGLAACMCCDWCTDCCYVSPYH

SEQ ID NO: 2586706 - protein, 17 aa, Entamoeba histolytica
PNCLTFVRMFDGHVLDM

SEQ ID NO: 2586707 - protein, 18 aa, Entamoeba histolytica
PNCSEYNEEICCLTTSNK

SEQ ID NO: 2586708 - protein, 20 aa, Entamoeba histolytica
PNCVECFLPYFSYNGDCQIN

SEQ ID NO: 2586709 - protein, 19 aa, Entamoeba histolytica
PNDELRVLCDMFLQKTVHS

SEQ ID NO: 2586710 - protein, 18 aa, Entamoeba histolytica
PNDLYSIYQMSLNVLGGR

SEQ ID NO: 2586711 - protein, 24 aa, Entamoeba histolytica
PNEEVVNILAVFPFSSERARSSVL

SEQ ID NO: 2586712 - protein, 20 aa, Entamoeba histolytica
PNEHAIALSSSVSFIETTLT

SEQ ID NO: 2586713 - protein, 20 aa, Entamoeba histolytica
PNENFLCFLNSLKTVIMTEI

SEQ ID NO: 2586714 - protein, 18 aa, Entamoeba histolytica
PNFFKGNLLIPSVSLSRI

SEQ ID NO: 2586715 - protein, 25 aa, Entamoeba histolytica
PNGKYCLRCNTGFYIENGNCLPCGQ

SEQ ID NO: 2586716 - protein, 20 aa, Entamoeba histolytica
PNGLKQLGFYMWLAVCMIPT

SEQ ID NO: 2586717 - protein, 17 aa, Entamoeba histolytica
PNIAFFIGMILFVVLEK

SEQ ID NO: 2586718 - protein, 18 aa, Entamoeba histolytica
PNIFKSIRIIFASNSGGK

SEQ ID NO: 2586719 - protein, 38 aa, Entamoeba histolytica
PNISKLIFLQCVSNLLGIPREVPVIIPPSELIDLIQHY

SEQ ID NO: 2586720 - protein, 21 aa, Entamoeba histolytica
PNIYSKLVLCEAIHWFSQIIT

SEQ ID NO: 2586721 - protein, 19 aa, Entamoeba histolytica
PNKCCYINLLFMPYCSFNI

SEQ ID NO: 2586722 - protein, 17 aa, Entamoeba histolytica
PNKRGMFIVTFDIESSF

SEQ ID NO: 2586723 - protein, 19 aa, Entamoeba histolytica
PNKYFRREYIFVRDFITGL

SEQ ID NO: 2586724 - protein, 20 aa, Entamoeba histolytica
PNLDGIFAYYEKTELLLTLS

SEQ ID NO: 2586725 - protein, 22 aa, Entamoeba histolytica
PNLEISDPLFGYIETSFTRLAD

SEQ ID NO: 2586726 - protein, 17 aa, Entamoeba histolytica
PNLLIILADNFLYRSYT

SEQ ID NO: 2586727 - protein, 20 aa, Entamoeba histolytica
PNLLKTFKSIDMFLDKYKEM

SEQ ID NO: 2586728 - protein, 17 aa, Entamoeba histolytica
PNLPFGGNCQSGIGCYH

SEQ ID NO: 2586729 - protein, 17 aa, Entamoeba histolytica
PNLWVKGIIVPYINETL

SEQ ID NO: 2586730 - protein, 24 aa, Entamoeba histolytica
PNNKYRLSQWVAINMSSFQINKII

SEQ ID NO: 2586731 - protein, 17 aa, Entamoeba histolytica
PNNLLLFIITTLMIYLK

SEQ ID NO: 2586732 - protein, 18 aa, Entamoeba histolytica
PNPFLPFFPGGVGGNIAT

SEQ ID NO: 2586733 - protein, 29 aa, Entamoeba histolytica
PNPFMFIVWFIPQWIKSLKMIGVVKEKVI

SEQ ID NO: 2586734 - protein, 18 aa, Entamoeba histolytica
PNSIKVFAFEVVICCIIK

SEQ ID NO: 2586735 - protein, 17 aa, Entamoeba histolytica
PNSPRVEKIVCDNKPGY

SEQ ID NO: 2586736 - protein, 20 aa, Entamoeba histolytica
PNTLVSYLFELSHVIASAFS

SEQ ID NO: 2586737 - protein, 25 aa, Entamoeba histolytica
PNVLGECNCQIAVIIQPHLKGIYKI

SEQ ID NO: 2586738 - protein, 20 aa, Entamoeba histolytica
PNWWLTNIIAICIAISIQTL

SEQ ID NO: 2586739 - protein, 28 aa, Entamoeba histolytica
PNYEMADALSWGRGLGCSFLEDCSKWPK

SEQ ID NO: 2586740 - protein, 30 aa, Entamoeba histolytica
PNYLRLPYKLKIRMLFDTARGMEFLHENRI

SEQ ID NO: 2586741 - protein, 19 aa, Entamoeba histolytica
PPCGILRTIRRGATYEQVT

SEQ ID NO: 2586742 - protein, 23 aa, Entamoeba histolytica
PPEEEKGFFAKYWVWILIGVVAL

SEQ ID NO: 2586743 - protein, 28 aa, Entamoeba histolytica
PPFNELKLPRLDAFSSDAQTCLNQNIQY

SEQ ID NO: 2586744 - protein, 17 aa, Entamoeba histolytica
PPILHRDLKTNNLLVND

SEQ ID NO: 2586745 - protein, 19 aa, Entamoeba histolytica
PPITRAFVSFLPKIMDFCS

SEQ ID NO: 2586746 - protein, 21 aa, Entamoeba histolytica
PPKTRYNCYAHVWDSHIKQFL

SEQ ID NO: 2586747 - protein, 24 aa, Entamoeba histolytica
PPKTVGGLAWYFVKLIEINHSTLF

SEQ ID NO: 2586748 - protein, 23 aa, Entamoeba histolytica
PPLTYQVICHLFATMLTFILSIV

SEQ ID NO: 2586749 - protein, 17 aa, Entamoeba histolytica
PPPLMQGKGPINVEGKH

SEQ ID NO: 2586750 - protein, 18 aa, Entamoeba histolytica
PPPSFKISFKPIQTEFDE

SEQ ID NO: 2586751 - protein, 19 aa, Entamoeba histolytica
PPQSDFRSILELWILPEYV

SEQ ID NO: 2586752 - protein, 24 aa, Entamoeba histolytica
PPSGCKSFLKEAGFETEDNVADAL

SEQ ID NO: 2586753 - protein, 21 aa, Entamoeba histolytica
PPSNGYIRFYGFTKYDNYDNY

SEQ ID NO: 2586754 - protein, 25 aa, Entamoeba histolytica
PPYSCTIHYPFLLLKAFCIGFVISG

SEQ ID NO: 2586755 - protein, 34 aa, Entamoeba histolytica
PQAKLLFVLGFIFCCLWPINACLYRHSTNKQIQQ

SEQ ID NO: 2586756 - protein, 17 aa, Entamoeba histolytica
PQCKVCHSVPVRRSSEH

SEQ ID NO: 2586757 - protein, 22 aa, Entamoeba histolytica
PQEVPIYLNVHLNKITSLFFDN

SEQ ID NO: 2586758 - protein, 19 aa, Entamoeba histolytica
PQFEYSWSIAEFITNGKRL

SEQ ID NO: 2586759 - protein, 17 aa, Entamoeba histolytica
PQFKPNDLYSIYQMSLN

SEQ ID NO: 2586760 - protein, 18 aa, Entamoeba histolytica
PQFPYNRLLAQPKVFDIE

SEQ ID NO: 2586761 - protein, 18 aa, Entamoeba histolytica
PQHIDSFIDYYFEILPLF

SEQ ID NO: 2586762 - protein, 19 aa, Entamoeba histolytica
PQIFCLIAIGFRYCKKDII

SEQ ID NO: 2586763 - protein, 17 aa, Entamoeba histolytica
PQIKNLIVRSWEQDTRK

SEQ ID NO: 2586764 - protein, 17 aa, Entamoeba histolytica
PQIPKTSQLQEGDNVPT

SEQ ID NO: 2586765 - protein, 18 aa, Entamoeba histolytica
PQIWRTFRTKNCGSLSLT

SEQ ID NO: 2586766 - protein, 29 aa, Entamoeba histolytica
PQKYIWPSAIRLFPFVMAVSLFLNNTPVV

SEQ ID NO: 2586767 - protein, 20 aa, Entamoeba histolytica
PQLQEIYQFFTSLKEQIIQQ

SEQ ID NO: 2586768 - protein, 28 aa, Entamoeba histolytica
PQSYNIWLLICTAIFGALIIITATSSII

SEQ ID NO: 2586769 - protein, 25 aa, Entamoeba histolytica
PQVFNLSVEFLRGFPYMTCAFTAHY

SEQ ID NO: 2586770 - protein, 17 aa, Entamoeba histolytica
PQVHILRSHSIKVCTCF

SEQ ID NO: 2586771 - protein, 19 aa, Entamoeba histolytica
PQYIYPWKIIGELSAILSY

SEQ ID NO: 2586772 - protein, 19 aa, Entamoeba histolytica
PRDSLYCKSFLHLYSSKQI

SEQ ID NO: 2586773 - protein, 18 aa, Entamoeba histolytica
PRFDSFRAVVKVNEDKIG

SEQ ID NO: 2586774 - protein, 23 aa, Entamoeba histolytica
PRFKPIQFKWSKFIKKLDPDNEA

SEQ ID NO: 2586775 - protein, 20 aa, Entamoeba histolytica
PRGNDGFKPKQLVLSIYVVK

SEQ ID NO: 2586776 - protein, 21 aa, Entamoeba histolytica
PRGRIRFLLRPSGAVGCNTVN

SEQ ID NO: 2586777 - protein, 18 aa, Entamoeba histolytica
PRGRNCYKAVGIGLKSLG

SEQ ID NO: 2586778 - protein, 18 aa, Entamoeba histolytica
PRIGFWQLGTYGHWGEWH

SEQ ID NO: 2586779 - protein, 18 aa, Entamoeba histolytica
PRIKEVIEQTVGNYSIRL

SEQ ID NO: 2586780 - protein, 19 aa, Entamoeba histolytica
PRLSLLLNENIPQYLFLHS

SEQ ID NO: 2586781 - protein, 30 aa, Entamoeba histolytica
PRNLPQRIVYVFNWPLLVILAYTIPDVKIK

SEQ ID NO: 2586782 - protein, 21 aa, Entamoeba histolytica
PRRLYFKSLLRQDAILYDFQE

SEQ ID NO: 2586783 - protein, 19 aa, Entamoeba histolytica
PRRVAAITLAERVSKEVGC

SEQ ID NO: 2586784 - protein, 26 aa, Entamoeba histolytica
PRSPVCAKLTDFGTCRNISERNLSAK

SEQ ID NO: 2586785 - protein, 23 aa, Entamoeba histolytica
PRSSTKLSFLIPSFMRKRSNSSS

SEQ ID NO: 2586786 - protein, 21 aa, Entamoeba histolytica
PRTSELYVHRSGRTARAGRSG

SEQ ID NO: 2586787 - protein, 20 aa, Entamoeba histolytica
PRVYFSLLIIFMALYSIFIG

SEQ ID NO: 2586788 - protein, 20 aa, Entamoeba histolytica
PRWLAPNILTTIGFISMTVA

SEQ ID NO: 2586789 - protein, 19 aa, Entamoeba histolytica
PRYLFPEKIQYVPTIIQRL

SEQ ID NO: 2586790 - protein, 17 aa, Entamoeba histolytica
PRYYCNKAALLPFSPSD

SEQ ID NO: 2586791 - protein, 21 aa, Entamoeba histolytica
PSAGGLCLLYGISDVTVDAEV

SEQ ID NO: 2586792 - protein, 33 aa, Entamoeba histolytica
PSCCKSYGIIFVRRAQCKCCQRYFCSNCIDNRT

SEQ ID NO: 2586793 - protein, 24 aa, Entamoeba histolytica
PSEGCAICKDGYYWKDKNCYLCQE

SEQ ID NO: 2586794 - protein, 24 aa, Entamoeba histolytica
PSELKIQECFNLTGNVAKIIQLNL

SEQ ID NO: 2586795 - protein, 18 aa, Entamoeba histolytica
PSELKRNILLPFNILYVT

SEQ ID NO: 2586796 - protein, 17 aa, Entamoeba histolytica
PSFIIAAFVKFITGCTV

SEQ ID NO: 2586797 - protein, 23 aa, Entamoeba histolytica
PSFPELLPALKSMFTFPSPQHRS

SEQ ID NO: 2586798 - protein, 32 aa, Entamoeba histolytica
PSFSTQIIQHFPKLILLFCVYSWTTFVLSYFT

SEQ ID NO: 2586799 - protein, 29 aa, Entamoeba histolytica
PSILMKLLVCPRLTLYALQSIQFILFCNP

SEQ ID NO: 2586800 - protein, 18 aa, Entamoeba histolytica
PSKLRGVASEAMILAATS

SEQ ID NO: 2586801 - protein, 18 aa, Entamoeba histolytica
PSLLRVINVCLKKPQIEI

SEQ ID NO: 2586802 - protein, 24 aa, Entamoeba histolytica
PSLLTKILCCGFCNKKDVKSSSSE

SEQ ID NO: 2586803 - protein, 21 aa, Entamoeba histolytica
PSLNPAKLIPLRRLTIDSSQI

SEQ ID NO: 2586804 - protein, 20 aa, Entamoeba histolytica
PSLRLVILNIIRNLAVDEGL

SEQ ID NO: 2586805 - protein, 26 aa, Entamoeba histolytica
PSLVSCLSVAPCQRLNEGVKIQPPQS

SEQ ID NO: 2586806 - protein, 32 aa, Entamoeba histolytica
PSNINKAKCIEYKKGKSLKIYNKEIDNNKRYC

SEQ ID NO: 2586807 - protein, 25 aa, Entamoeba histolytica
PSPYQIPKYPFKEEFTFDANSKHPG

SEQ ID NO: 2586808 - protein, 24 aa, Entamoeba histolytica
PSQMFCPHCNKLITTEVTYESGSL

SEQ ID NO: 2586809 - protein, 18 aa, Entamoeba histolytica
PSQNPVVCMIAGSVSVTI

SEQ ID NO: 2586810 - protein, 19 aa, Entamoeba histolytica
PSQNSSWIILLWVVVGCII

SEQ ID NO: 2586811 - protein, 18 aa, Entamoeba histolytica
PSQVILFTFQKKYKPLIH

SEQ ID NO: 2586812 - protein, 23 aa, Entamoeba histolytica
PSRLKMIDCFLIYQLITAALVLV

SEQ ID NO: 2586813 - protein, 23 aa, Entamoeba histolytica
PSSCKRAEMGYCTECEDGYFIYT

SEQ ID NO: 2586814 - protein, 20 aa, Entamoeba histolytica
PSSDGYCWSYTCDETTGFCK

SEQ ID NO: 2586815 - protein, 29 aa, Entamoeba histolytica
PSSFFTIHSSRRWKIDISTCETSTNMNYD

SEQ ID NO: 2586816 - protein, 18 aa, Entamoeba histolytica
PSSIIKPSVRGIILNVLD

SEQ ID NO: 2586817 - protein, 31 aa, Entamoeba histolytica
PSSKFPSSLFIKIMHSVCLFETSRIIKSSTS

SEQ ID NO: 2586818 - protein, 25 aa, Entamoeba histolytica
PSSLLFPKEIEEIGLLMKRVTDKVY

SEQ ID NO: 2586819 - protein, 25 aa, Entamoeba histolytica
PSSYFQKDLRCIFYSSASSEITEDI

SEQ ID NO: 2586820 - protein, 18 aa, Entamoeba histolytica
PSSYNFLFEKVLFNTNLK

SEQ ID NO: 2586821 - protein, 23 aa, Entamoeba histolytica
PSTEYKTSVVLLIQAISNVISQN

SEQ ID NO: 2586822 - protein, 24 aa, Entamoeba histolytica
PSTLPLIISDILTFTTMDITTTNS

SEQ ID NO: 2586823 - protein, 27 aa, Entamoeba histolytica
PSTNFLKLRFCQDIARGMLYLHENDII

SEQ ID NO: 2586824 - protein, 20 aa, Entamoeba histolytica
PSVILGGAAPLMFILVYIAL

SEQ ID NO: 2586825 - protein, 19 aa, Entamoeba histolytica
PSVKVFAEECIKFYKSCNV

SEQ ID NO: 2586826 - protein, 27 aa, Entamoeba histolytica
PSVMKLTEIFKVFVLYFKFNSKENILI

SEQ ID NO: 2586827 - protein, 17 aa, Entamoeba histolytica
PSYDIGALKNWQSIMGT

SEQ ID NO: 2586828 - protein, 22 aa, Entamoeba histolytica
PSYQRIALSLVLLVMTSSSVFK

SEQ ID NO: 2586829 - protein, 24 aa, Entamoeba histolytica
PSYSMLMCIFAPFKQKINEPSESP

SEQ ID NO: 2586830 - protein, 20 aa, Entamoeba histolytica
PSYYLFRWLTLLGASELPMD

SEQ ID NO: 2586831 - protein, 21 aa, Entamoeba histolytica
PTERVFDFLDDIYVTFVKTFN

SEQ ID NO: 2586832 - protein, 25 aa, Entamoeba histolytica
PTGFEKYGGFLFYLVVIFQLGYFIY

SEQ ID NO: 2586833 - protein, 19 aa, Entamoeba histolytica
PTILNELITIFNLPFDKGS

SEQ ID NO: 2586834 - protein, 20 aa, Entamoeba histolytica
PTIPQPFKFISLPSTYQQLI

SEQ ID NO: 2586835 - protein, 24 aa, Entamoeba histolytica
PTLSLRLMLERVISSFIVDPDEVV

SEQ ID NO: 2586836 - protein, 18 aa, Entamoeba histolytica
PTLYTSVGTLAFVSETLT

SEQ ID NO: 2586837 - protein, 18 aa, Entamoeba histolytica
PTNCNALFYSMRASSNRF

SEQ ID NO: 2586838 - protein, 19 aa, Entamoeba histolytica
PTNKVCVKKFFKSKAGIIL

SEQ ID NO: 2586839 - protein, 20 aa, Entamoeba histolytica
PTQRPFVCMIAGTFKTKPNH

SEQ ID NO: 2586840 - protein, 23 aa, Entamoeba histolytica
PTRKPRASFSIGSKRMSLRTLPL

SEQ ID NO: 2586841 - protein, 24 aa, Entamoeba histolytica
PTTNECTYVLFAIGDHINPKEGYN

SEQ ID NO: 2586842 - protein, 21 aa, Entamoeba histolytica
PTVFCGWRSIIIFGTVWGLVP

SEQ ID NO: 2586843 - protein, 19 aa, Entamoeba histolytica
PTVLGGMRFICLDVKPEQI

SEQ ID NO: 2586844 - protein, 28 aa, Entamoeba histolytica
PTVLLLLSISCSIGYTCLDVMNNFKDVV

SEQ ID NO: 2586845 - protein, 23 aa, Entamoeba histolytica
PTWRITFFYCWELGYHFHSLVHH

SEQ ID NO: 2586846 - protein, 20 aa, Entamoeba histolytica
PTYICSLLVIFGLGPIIEIL

SEQ ID NO: 2586847 - protein, 33 aa, Entamoeba histolytica
PTYMAAVFICLAIVFQLIVCFSQEFGKKWIFVS

SEQ ID NO: 2586848 - protein, 17 aa, Entamoeba histolytica
PVALAAYLFIWIPGMIF

SEQ ID NO: 2586849 - protein, 20 aa, Entamoeba histolytica
PVAMKARIPDALPQMNTVSL

SEQ ID NO: 2586850 - protein, 22 aa, Entamoeba histolytica
PVDGEGIVNISLYNILKQKLTE

SEQ ID NO: 2586851 - protein, 23 aa, Entamoeba histolytica
PVGFTRIDFSYSYDKEGSNKLWN

SEQ ID NO: 2586852 - protein, 19 aa, Entamoeba histolytica
PVGFYELIKRLIISDYRDP

SEQ ID NO: 2586853 - protein, 18 aa, Entamoeba histolytica
PVIVDLFGLLLVSIILTS

SEQ ID NO: 2586854 - protein, 23 aa, Entamoeba histolytica
PVKARGIHDYSYCAQCRLMKFLL

SEQ ID NO: 2586855 - protein, 18 aa, Entamoeba histolytica
PVKDTSVFIDIPRLAPKV

SEQ ID NO: 2586856 - protein, 19 aa, Entamoeba histolytica
PVLFTRVLVKYVNNYKEPM

SEQ ID NO: 2586857 - protein, 30 aa, Entamoeba histolytica
PVPCKELLLSCWKINTERLISIDEIVMKVE

SEQ ID NO: 2586858 - protein, 24 aa, Entamoeba histolytica
PVRIASFVKRILIMMLNCDSSIAL

SEQ ID NO: 2586859 - protein, 24 aa, Entamoeba histolytica
PVSLIICSFMLYDLVGTAALYGII

SEQ ID NO: 2586860 - protein, 17 aa, Entamoeba histolytica
PVTHNWLGFTGCNGGFG

SEQ ID NO: 2586861 - protein, 17 aa, Entamoeba histolytica
PVVFAAVPRVLQLIYGG

SEQ ID NO: 2586862 - protein, 19 aa, Entamoeba histolytica
PVYLLKYFSSFVLSLPMTY

SEQ ID NO: 2586863 - protein, 24 aa, Entamoeba histolytica
PWKEFDLSNIIAMILSLIIEQPVN

SEQ ID NO: 2586864 - protein, 22 aa, Entamoeba histolytica
PWPESYWHIVAIIIIYIIVDGY

SEQ ID NO: 2586865 - protein, 21 aa, Entamoeba histolytica
PWYISCGLCDDGYYLSGNTCV

SEQ ID NO: 2586866 - protein, 19 aa, Entamoeba histolytica
PYDTPQFEYSWSIAEFITN

SEQ ID NO: 2586867 - protein, 21 aa, Entamoeba histolytica
PYFHLKWYNTIYMKQKELENY

SEQ ID NO: 2586868 - protein, 21 aa, Entamoeba histolytica
PYHSGKSFLLNALTNITDIFP

SEQ ID NO: 2586869 - protein, 26 aa, Entamoeba histolytica
PYIGARKCLPPLLSYFQMMSLVVLEF

SEQ ID NO: 2586870 - protein, 21 aa, Entamoeba histolytica
PYIRCLAIFSPLCIFVAYLIN

SEQ ID NO: 2586871 - protein, 17 aa, Entamoeba histolytica
PYKEFKSLFEIKDYVLQ

SEQ ID NO: 2586872 - protein, 23 aa, Entamoeba histolytica
PYKKYCFIQNYIIGVNGKDGIVY

SEQ ID NO: 2586873 - protein, 26 aa, Entamoeba histolytica
PYKYKGRIYMLFWGLCFYFGQQTEVL

SEQ ID NO: 2586874 - protein, 17 aa, Entamoeba histolytica
PYLLKSNNLHVCLEMVR

SEQ ID NO: 2586875 - protein, 20 aa, Entamoeba histolytica
PYMPCCIICSELLFNFNWNI

SEQ ID NO: 2586876 - protein, 18 aa, Entamoeba histolytica
PYNESLICAFKCSCKQSI

SEQ ID NO: 2586877 - protein, 17 aa, Entamoeba histolytica
PYPDIPRFHLIEKVGEI

SEQ ID NO: 2586878 - protein, 24 aa, Entamoeba histolytica
PYPENVFKYPWNIAEYVMQGNRLE

SEQ ID NO: 2586879 - protein, 21 aa, Entamoeba histolytica
PYRRATYRYTPLLAEILTLDI

SEQ ID NO: 2586880 - protein, 19 aa, Entamoeba histolytica
PYSECKSVFDIKNIVINGG

SEQ ID NO: 2586881 - protein, 20 aa, Entamoeba histolytica
PYTGILMVCLIQFFLGVFLC

SEQ ID NO: 2586882 - protein, 25 aa, Entamoeba histolytica
PYVRFKKILGHGIGLISVYKSSNIV

SEQ ID NO: 2586883 - protein, 26 aa, Entamoeba histolytica
PYYSATCLNGQCVVQAVGDVSNVGCG

SEQ ID NO: 2586884 - protein, 22 aa, Entamoeba histolytica
QAAEICTVLTTFCGSDGIEEAA

SEQ ID NO: 2586885 - protein, 20 aa, Entamoeba histolytica
QADSFSQLISMLKNEGKLVE

SEQ ID NO: 2586886 - protein, 19 aa, Entamoeba histolytica
QAFETIQCLFSIYNSPNDI

SEQ ID NO: 2586887 - protein, 18 aa, Entamoeba histolytica
QAGEILRAKIEEFDELIQ

SEQ ID NO: 2586888 - protein, 20 aa, Entamoeba histolytica
QAIALRLAKKGVHLSIASRS

SEQ ID NO: 2586889 - protein, 24 aa, Entamoeba histolytica
QAIKDYLLALAICNEARPKKEGDK

SEQ ID NO: 2586890 - protein, 32 aa, Entamoeba histolytica
QAKNMLAWDVVCFYSFYFLICCCEQDALRKDY

SEQ ID NO: 2586891 - protein, 25 aa, Entamoeba histolytica
QALLKISYILSFFGSKAFPKSDYDL

SEQ ID NO: 2586892 - protein, 18 aa, Entamoeba histolytica
QALSCSDKIIGIVKSEAP

SEQ ID NO: 2586893 - protein, 20 aa, Entamoeba histolytica
QAYCAAHLFQTLLPNTFSLK

SEQ ID NO: 2586894 - protein, 19 aa, Entamoeba histolytica
QAYGKLIFEYCQKHKEIPI

SEQ ID NO: 2586895 - protein, 28 aa, Entamoeba histolytica
QCAPMLPTMIPIILKRVNLNIVSQYEYY

SEQ ID NO: 2586896 - protein, 19 aa, Entamoeba histolytica
QCECQSGWYPHGAISCRKI

SEQ ID NO: 2586897 - protein, 20 aa, Entamoeba histolytica
QCFQCSPGYFLTENYLCSQC

SEQ ID NO: 2586898 - protein, 22 aa, Entamoeba histolytica
QCGLYCGVCRVGYSCSELGKCV

SEQ ID NO: 2586899 - protein, 21 aa, Entamoeba histolytica
QCGYSVFNIILTFLFEIISVV

SEQ ID NO: 2586900 - protein, 26 aa, Entamoeba histolytica
QCIPRCPKCGGLLKLDVVLFGEKLDR

SEQ ID NO: 2586901 - protein, 21 aa, Entamoeba histolytica
QCKPNPISNCIEYNKGKCISC

SEQ ID NO: 2586902 - protein, 18 aa, Entamoeba histolytica
QCKVNVGVMQIDFKDNYL

SEQ ID NO: 2586903 - protein, 21 aa, Entamoeba histolytica
QCLPCHVTCLNCVLNSKTCLS

SEQ ID NO: 2586904 - protein, 18 aa, Entamoeba histolytica
QCLSCKNKLLLNGVCTVS

SEQ ID NO: 2586905 - protein, 19 aa, Entamoeba histolytica
QCLSCKNKLLLNGVCTVSS

SEQ ID NO: 2586906 - protein, 20 aa, Entamoeba histolytica
QCPLKPLSGHLLTVYTSQTD

SEQ ID NO: 2586907 - protein, 30 aa, Entamoeba histolytica
QCRLMKFLLFRMNFKGDYSILLDSTAADKV

SEQ ID NO: 2586908 - protein, 28 aa, Entamoeba histolytica
QCSHLRFPNLHSFPAIILKYEQPEDTTY

SEQ ID NO: 2586909 - protein, 18 aa, Entamoeba histolytica
QCSIKEVFCDGKISMNLM

SEQ ID NO: 2586910 - protein, 21 aa, Entamoeba histolytica
QCSRLGAVLDMITDRAGTTIL

SEQ ID NO: 2586911 - protein, 19 aa, Entamoeba histolytica
QCTIACACRYGTQPMEIDG

SEQ ID NO: 2586912 - protein, 18 aa, Entamoeba histolytica
QCTICSVGSYSIGGKGSC

SEQ ID NO: 2586913 - protein, 26 aa, Entamoeba histolytica
QCYDECPYCLWGLCHACTKGCNYGSW

SEQ ID NO: 2586914 - protein, 26 aa, Entamoeba histolytica
QCYDECPYCLWGLCHACTKGCSYGSW

SEQ ID NO: 2586915 - protein, 24 aa, Entamoeba histolytica
QDDLKIGQILLWLSLGVYLFYILA

SEQ ID NO: 2586916 - protein, 17 aa, Entamoeba histolytica
QDGIGPKFGMIFQIISM

SEQ ID NO: 2586917 - protein, 25 aa, Entamoeba histolytica
QDIWLRNLIYRRYPEISSINSEKTI

SEQ ID NO: 2586918 - protein, 27 aa, Entamoeba histolytica
QDIYDCPNDVFAYAITAWELFYAEEPY

SEQ ID NO: 2586919 - protein, 22 aa, Entamoeba histolytica
QDLLLQRRVSIISMLQDKTSNC

SEQ ID NO: 2586920 - protein, 17 aa, Entamoeba histolytica
QDNILKKSVDWFCKEMR

SEQ ID NO: 2586921 - protein, 24 aa, Entamoeba histolytica
QDPTYRTLIVWDLMKVIVDIMETD

SEQ ID NO: 2586922 - protein, 18 aa, Entamoeba histolytica
QDSCSLCGNGKKDEGEEC

SEQ ID NO: 2586923 - protein, 31 aa, Entamoeba histolytica
QDSRLSRTQLRWSEMTSILGLSKTVMDLIHS

SEQ ID NO: 2586924 - protein, 22 aa, Entamoeba histolytica
QDYCYECNDGFFIENDHCVSSK

SEQ ID NO: 2586925 - protein, 20 aa, Entamoeba histolytica
QEARKALLRDAKRNPRLFCG

SEQ ID NO: 2586926 - protein, 25 aa, Entamoeba histolytica
QECKACTTNCKYCNSQECFQCEAGY

SEQ ID NO: 2586927 - protein, 26 aa, Entamoeba histolytica
QEELMKRFAIITTLFTPLTFLSTSFG

SEQ ID NO: 2586928 - protein, 19 aa, Entamoeba histolytica
QEFEYPWVIATFVASGHRR

SEQ ID NO: 2586929 - protein, 24 aa, Entamoeba histolytica
QEFGKKWIFVSALRIRNGLTGLIY

SEQ ID NO: 2586930 - protein, 26 aa, Entamoeba histolytica
QEFGKKWLFVLGVRIRNGLIGLIYDK

SEQ ID NO: 2586931 - protein, 23 aa, Entamoeba histolytica
QEFIVKMLWSLLVISEAGLYEDV

SEQ ID NO: 2586932 - protein, 22 aa, Entamoeba histolytica
QEFLDRLMVFKEYIAIELNVEE

SEQ ID NO: 2586933 - protein, 17 aa, Entamoeba histolytica
QEFPELQLPANLKGFEL

SEQ ID NO: 2586934 - protein, 19 aa, Entamoeba histolytica
QEGYMLRKGKCYKFESDNC

SEQ ID NO: 2586935 - protein, 21 aa, Entamoeba histolytica
QEIKDIIKIIISIEKQCVGII

SEQ ID NO: 2586936 - protein, 21 aa, Entamoeba histolytica
QEITDIISIISCYQTFITKSS

SEQ ID NO: 2586937 - protein, 25 aa, Entamoeba histolytica
QEKHMYRSHFLRMIEESIDFIPSTE

SEQ ID NO: 2586938 - protein, 18 aa, Entamoeba histolytica
QEKLKVIFEYKMKMIEEV

SEQ ID NO: 2586939 - protein, 17 aa, Entamoeba histolytica
QEKPAVVQQTQNGDAQP

SEQ ID NO: 2586940 - protein, 26 aa, Entamoeba histolytica
QELRKRKKLPLGFKFLQVIQEKDFEK

SEQ ID NO: 2586941 - protein, 23 aa, Entamoeba histolytica
QELYCAATRCLAIMSKPERIVKS

SEQ ID NO: 2586942 - protein, 22 aa, Entamoeba histolytica
QENGEHSLKQTVEKEQEQQDLT

SEQ ID NO: 2586943 - protein, 26 aa, Entamoeba histolytica
QENIRKGIYFCLGSFLVIGLEFFMLL

SEQ ID NO: 2586944 - protein, 17 aa, Entamoeba histolytica
QENVEVIILPPLLVPNQ

SEQ ID NO: 2586945 - protein, 18 aa, Entamoeba histolytica
QEPDQRITFEQITRLLLK

SEQ ID NO: 2586946 - protein, 18 aa, Entamoeba histolytica
QERAFDFIDEVVINFSKL

SEQ ID NO: 2586947 - protein, 25 aa, Entamoeba histolytica
QERIKRSIVITGIFNLKTDRIEFTR

SEQ ID NO: 2586948 - protein, 20 aa, Entamoeba histolytica
QESFIPFFLLGELANDISDT

SEQ ID NO: 2586949 - protein, 20 aa, Entamoeba histolytica
QEVIKGVGISARQFCSTINF

SEQ ID NO: 2586950 - protein, 22 aa, Entamoeba histolytica
QEWKMPHGFLFEYITCANYFCE

SEQ ID NO: 2586951 - protein, 20 aa, Entamoeba histolytica
QEYMIMMLLIYNSFKEENKK

SEQ ID NO: 2586952 - protein, 21 aa, Entamoeba histolytica
QEYVFRYFLFNELLQSLHPLF

SEQ ID NO: 2586953 - protein, 23 aa, Entamoeba histolytica
QFAKEHPDIIAVHVHPGLVYSNL

SEQ ID NO: 2586954 - protein, 19 aa, Entamoeba histolytica
QFCNLRITIELGSHWLKTL

SEQ ID NO: 2586955 - protein, 29 aa, Entamoeba histolytica
QFDSIYEIAWRFGGNSLRTFTKVVQLIYN

SEQ ID NO: 2586956 - protein, 17 aa, Entamoeba histolytica
QFEELKELFGNVVDVCF

SEQ ID NO: 2586957 - protein, 21 aa, Entamoeba histolytica
QFEKACSTFVFAILEEIPLTK

SEQ ID NO: 2586958 - protein, 22 aa, Entamoeba histolytica
QFEKACSTFVFAILEEIPLTKE

SEQ ID NO: 2586959 - protein, 26 aa, Entamoeba histolytica
QFIGMYSIVVLIVWTIGQFYGDCLKI

SEQ ID NO: 2586960 - protein, 25 aa, Entamoeba histolytica
QFILYCLLGVLFGVTFILDVNWGLL

SEQ ID NO: 2586961 - protein, 24 aa, Entamoeba histolytica
QFIPHLFIPSSFDFPSTTSAFDTF

SEQ ID NO: 2586962 - protein, 21 aa, Entamoeba histolytica
QFKQRFEPRITLEEIKSENEM

SEQ ID NO: 2586963 - protein, 17 aa, Entamoeba histolytica
QFKRGDTPLITYAENAE

SEQ ID NO: 2586964 - protein, 17 aa, Entamoeba histolytica
QFLLEVLSDVDFIKNSK

SEQ ID NO: 2586965 - protein, 18 aa, Entamoeba histolytica
QFLPFLFICNYLIDIFLL

SEQ ID NO: 2586966 - protein, 25 aa, Entamoeba histolytica
QFMPERWILEHIKLKKDWTVKEIIE

SEQ ID NO: 2586967 - protein, 19 aa, Entamoeba histolytica
QFNCLRKKIIQCDSGYYYE

SEQ ID NO: 2586968 - protein, 22 aa, Entamoeba histolytica
QFRKICILKGVSPRLPSKGLNT

SEQ ID NO: 2586969 - protein, 19 aa, Entamoeba histolytica
QFVTGLLMLFTIPLLSELL

SEQ ID NO: 2586970 - protein, 23 aa, Entamoeba histolytica
QFVTQCGWGMVGLFEVILDVIIF

SEQ ID NO: 2586971 - protein, 23 aa, Entamoeba histolytica
QFYPFAMLGGMIWATGNLLTVPV

SEQ ID NO: 2586972 - protein, 30 aa, Entamoeba histolytica
QGATILFILGFFICLTWIACYCIYKNSSDS

SEQ ID NO: 2586973 - protein, 17 aa, Entamoeba histolytica
QGCLECNEGFYLSEGSQ

SEQ ID NO: 2586974 - protein, 18 aa, Entamoeba histolytica
QGEKEIREKTGIEAEIVK

SEQ ID NO: 2586975 - protein, 19 aa, Entamoeba histolytica
QGFLKYWRVKEIPNFLLCA

SEQ ID NO: 2586976 - protein, 21 aa, Entamoeba histolytica
QGFTVFVLYFIIKKKKRTQVN

SEQ ID NO: 2586977 - protein, 23 aa, Entamoeba histolytica
QGGKLSFYTNFEIKDSSSITFNY

SEQ ID NO: 2586978 - protein, 18 aa, Entamoeba histolytica
QGIHSVCAVFLSLSFNEA

SEQ ID NO: 2586979 - protein, 20 aa, Entamoeba histolytica
QGKCIHYSFISHCKMASNSI

SEQ ID NO: 2586980 - protein, 23 aa, Entamoeba histolytica
QGKQEIPSVIALNDQGDIQFGEN

SEQ ID NO: 2586981 - protein, 18 aa, Entamoeba histolytica
QGLSGWNYVSDGYSTIYK

SEQ ID NO: 2586982 - protein, 18 aa, Entamoeba histolytica
QGMLEITALLLLNKFYDT

SEQ ID NO: 2586983 - protein, 22 aa, Entamoeba histolytica
QGRNPYIAWDFFQLNSDLSVVV

SEQ ID NO: 2586984 - protein, 17 aa, Entamoeba histolytica
QGWKNLQTIFSKKKLCF

SEQ ID NO: 2586985 - protein, 19 aa, Entamoeba histolytica
QGYEYKSLNAIILLIRIFQ

SEQ ID NO: 2586986 - protein, 17 aa, Entamoeba histolytica
QHEKKLFLSDDEIKELM

SEQ ID NO: 2586987 - protein, 17 aa, Entamoeba histolytica
QHFIELDKSMKINHYSY

SEQ ID NO: 2586988 - protein, 23 aa, Entamoeba histolytica
QHHGISGWGVWGILLYAVYFVII

SEQ ID NO: 2586989 - protein, 23 aa, Entamoeba histolytica
QHHTRWFKIKNYENVPLLVNISY

SEQ ID NO: 2586990 - protein, 18 aa, Entamoeba histolytica
QHLNEILIMIVMTISITL

SEQ ID NO: 2586991 - protein, 17 aa, Entamoeba histolytica
QHMKRFNSTIVKNIIQS

SEQ ID NO: 2586992 - protein, 22 aa, Entamoeba histolytica
QHPNQCGIVFCLSKKDCESLSK

SEQ ID NO: 2586993 - protein, 24 aa, Entamoeba histolytica
QHRLKEQYIEAGLCEVHLVLFIHH

SEQ ID NO: 2586994 - protein, 20 aa, Entamoeba histolytica
QHWRNNCVEKLFNFLYKILS

SEQ ID NO: 2586995 - protein, 17 aa, Entamoeba histolytica
QICTKCSFFYHLKNNNC

SEQ ID NO: 2586996 - protein, 27 aa, Entamoeba histolytica
QIEDECYKCPPGTYSDKYNCIPCSEGT

SEQ ID NO: 2586997 - protein, 19 aa, Entamoeba histolytica
QIESLHFLCKLLAIHEIPT

SEQ ID NO: 2586998 - protein, 23 aa, Entamoeba histolytica
QIEYATLFLPVFEMISKVMNPKV

SEQ ID NO: 2586999 - protein, 18 aa, Entamoeba histolytica
QIFAKIFFSLLIGSVFFN

SEQ ID NO: 2587000 - protein, 25 aa, Entamoeba histolytica
QIFIENGLSFALRMKIDMIHPLEYL

SEQ ID NO: 2587001 - protein, 19 aa, Entamoeba histolytica
QIFLFKRHNKFIVEYLLEA

SEQ ID NO: 2587002 - protein, 17 aa, Entamoeba histolytica
QIGCIPSTCGNNLLDKE

SEQ ID NO: 2587003 - protein, 24 aa, Entamoeba histolytica
QIGNAVLFIPMLVVSVFSDVKGNK

SEQ ID NO: 2587004 - protein, 22 aa, Entamoeba histolytica
QIHCLSCDSLPGCSDCSQTEKA

SEQ ID NO: 2587005 - protein, 28 aa, Entamoeba histolytica
QIHRLPKFIFEYIVAISICLSLFGTIGF

SEQ ID NO: 2587006 - protein, 17 aa, Entamoeba histolytica
QIIPCLSSPQGPFQEIF

SEQ ID NO: 2587007 - protein, 21 aa, Entamoeba histolytica
QIKDIPSWVYSAVAFCEASYR

SEQ ID NO: 2587008 - protein, 17 aa, Entamoeba histolytica
QIKSFRLSPSGEYLFGI

SEQ ID NO: 2587009 - protein, 20 aa, Entamoeba histolytica
QILYLLFFWVFKNLSHQTLS

SEQ ID NO: 2587010 - protein, 33 aa, Entamoeba histolytica
QIMSKIFPSHDFWRHVCIVWNKCYYSISDRQLT

SEQ ID NO: 2587011 - protein, 17 aa, Entamoeba histolytica
QIMTVISVFCFILSLIA

SEQ ID NO: 2587012 - protein, 18 aa, Entamoeba histolytica
QINLTREVELCQFITEGK

SEQ ID NO: 2587013 - protein, 18 aa, Entamoeba histolytica
QINRRAALEVIKSYSDDL

SEQ ID NO: 2587014 - protein, 22 aa, Entamoeba histolytica
QISKRVRPVVAFKDGSNEDDEQ

SEQ ID NO: 2587015 - protein, 18 aa, Entamoeba histolytica
QITMEGVGSLLFIPQINE

SEQ ID NO: 2587016 - protein, 23 aa, Entamoeba histolytica
QIYCPNSLFIIRALVVAPIIEET

SEQ ID NO: 2587017 - protein, 28 aa, Entamoeba histolytica
QIYMSVCFALICANMFTRWVVPSKEHLV

SEQ ID NO: 2587018 - protein, 22 aa, Entamoeba histolytica
QIYQFLLHIALKQHKYSDAIRL

SEQ ID NO: 2587019 - protein, 18 aa, Entamoeba histolytica
QIYSKFIIRRKWGSKTYV

SEQ ID NO: 2587020 - protein, 38 aa, Entamoeba histolytica
QIYSKQHKRLFNLHNIHLKGETGVDEKLTTDKGAEEPT

SEQ ID NO: 2587021 - protein, 21 aa, Entamoeba histolytica
QKCHFCHLNSFIPHTSIDSIQ

SEQ ID NO: 2587022 - protein, 21 aa, Entamoeba histolytica
QKCSHPSYIYTLFYVPVYFNF

SEQ ID NO: 2587023 - protein, 22 aa, Entamoeba histolytica
QKEEFSLYPTVSFSTDTEQYDC

SEQ ID NO: 2587024 - protein, 21 aa, Entamoeba histolytica
QKFSAHFLVFGRVFRLNLKEI

SEQ ID NO: 2587025 - protein, 31 aa, Entamoeba histolytica
QKFSLSFFISMKFIPFMWIIYIIGSYFAVPL

SEQ ID NO: 2587026 - protein, 18 aa, Entamoeba histolytica
QKGWKKPLLELSSFIATS

SEQ ID NO: 2587027 - protein, 26 aa, Entamoeba histolytica
QKHFKLSGLLPICYFLEKNDCTQEEL

SEQ ID NO: 2587028 - protein, 23 aa, Entamoeba histolytica
QKIKARIINAIKYWVENTWQMSI

SEQ ID NO: 2587029 - protein, 25 aa, Entamoeba histolytica
QKILSWKETDDFILRLQLDGKAVTV

SEQ ID NO: 2587030 - protein, 32 aa, Entamoeba histolytica
QKKASKKLWIILCVAGGIVIVLGAIVTLVCIL

SEQ ID NO: 2587031 - protein, 24 aa, Entamoeba histolytica
QKKIVIRVGEEFRDSKGEAEIYID

SEQ ID NO: 2587032 - protein, 22 aa, Entamoeba histolytica
QKKLWGYFCGVLEHPQADVLNE

SEQ ID NO: 2587033 - protein, 20 aa, Entamoeba histolytica
QKLLISFAFVFLSIFFFVFY

SEQ ID NO: 2587034 - protein, 24 aa, Entamoeba histolytica
QKMLCLISYFFVMILYPEKNEKVH

SEQ ID NO: 2587035 - protein, 23 aa, Entamoeba histolytica
QKNFANNLIFIFAKTNFIVTGNT

SEQ ID NO: 2587036 - protein, 23 aa, Entamoeba histolytica
QKNFSNNLIFIFAKTNFIVTGNT

SEQ ID NO: 2587037 - protein, 18 aa, Entamoeba histolytica
QKNHIFQILNYFRRLCVH

SEQ ID NO: 2587038 - protein, 23 aa, Entamoeba histolytica
QKNIDGTSCVFVILSILIIFLLI

SEQ ID NO: 2587039 - protein, 24 aa, Entamoeba histolytica
QKNPRVALVLGIIFNFFEDSKTSE

SEQ ID NO: 2587040 - protein, 23 aa, Entamoeba histolytica
QKNTFRILYIQTFVISVLILSVL

SEQ ID NO: 2587041 - protein, 25 aa, Entamoeba histolytica
QKNYIPWISLVRIFYLSLMSLYPYK

SEQ ID NO: 2587042 - protein, 17 aa, Entamoeba histolytica
QKPKYSILLPGIESKEQ

SEQ ID NO: 2587043 - protein, 18 aa, Entamoeba histolytica
QKQDFSFDDFFSKSTDSN

SEQ ID NO: 2587044 - protein, 27 aa, Entamoeba histolytica
QKRLLSQFKRSLCSSKYSYSVCCLILL

SEQ ID NO: 2587045 - protein, 23 aa, Entamoeba histolytica
QKSMACIWFLIMGSLIITILLFC

SEQ ID NO: 2587046 - protein, 20 aa, Entamoeba histolytica
QKSRSEAVTQPTAKDQPVQS

SEQ ID NO: 2587047 - protein, 25 aa, Entamoeba histolytica
QKWSKLKCWGSAILFSINETTLAFL

SEQ ID NO: 2587048 - protein, 17 aa, Entamoeba histolytica
QKYCLEHKLPIYNNVLN

SEQ ID NO: 2587049 - protein, 22 aa, Entamoeba histolytica
QKYTLGESLSFKSLTESSSTIE

SEQ ID NO: 2587050 - protein, 25 aa, Entamoeba histolytica
QLAELWKGIDEMRIKLSANEQLITE

SEQ ID NO: 2587051 - protein, 18 aa, Entamoeba histolytica
QLCFICCSNPADTIMLPC

SEQ ID NO: 2587052 - protein, 18 aa, Entamoeba histolytica
QLEKSFIYPCVNIKRKDF

SEQ ID NO: 2587053 - protein, 27 aa, Entamoeba histolytica
QLEQTWKSGVVMLIIFIVLFTALSIWN

SEQ ID NO: 2587054 - protein, 22 aa, Entamoeba histolytica
QLESEFGYKILIQGIIVDGVDC

SEQ ID NO: 2587055 - protein, 25 aa, Entamoeba histolytica
QLFHPRFIMIACFCFGKKLEEFRFE

SEQ ID NO: 2587056 - protein, 22 aa, Entamoeba histolytica
QLFRANGGFTHLMSSFMKKEGK

SEQ ID NO: 2587057 - protein, 22 aa, Entamoeba histolytica
QLHYNFKIRYCGGQKELFNVLH

SEQ ID NO: 2587058 - protein, 25 aa, Entamoeba histolytica
QLIHSFPLLMKLMLQLFNNEISNVE

SEQ ID NO: 2587059 - protein, 18 aa, Entamoeba histolytica
QLINPCIDKQVIFIIIDI

SEQ ID NO: 2587060 - protein, 19 aa, Entamoeba histolytica
QLISCSNLHINLVANKLKN

SEQ ID NO: 2587061 - protein, 24 aa, Entamoeba histolytica
QLITFPLFLFFAFIHFHSIPYHNV

SEQ ID NO: 2587062 - protein, 23 aa, Entamoeba histolytica
QLKKIPVYIIFPLIGITYVLIMT

SEQ ID NO: 2587063 - protein, 32 aa, Entamoeba histolytica
QLKNYIIKKSMKFLIFMIIFVVSKGLEPIEVA

SEQ ID NO: 2587064 - protein, 21 aa, Entamoeba histolytica
QLKQRFEPRITLEEIKSENEM

SEQ ID NO: 2587065 - protein, 23 aa, Entamoeba histolytica
QLLADSRLLWWIKNNNKTITLWN

SEQ ID NO: 2587066 - protein, 18 aa, Entamoeba histolytica
QLLEDFLFEKGYRYTYSL

SEQ ID NO: 2587067 - protein, 34 aa, Entamoeba histolytica
QLLEKDFHKMGGWFKVCIAILISILVLTVGVIIF

SEQ ID NO: 2587068 - protein, 19 aa, Entamoeba histolytica
QLLFKDIRLDTGDDQTDTY

SEQ ID NO: 2587069 - protein, 26 aa, Entamoeba histolytica
QLLRCLALFLEYAWMKGIDGFNNEVN

SEQ ID NO: 2587070 - protein, 24 aa, Entamoeba histolytica
QLPEEYRIEAVMNYYQEHNIPRIR

SEQ ID NO: 2587071 - protein, 32 aa, Entamoeba histolytica
QLQEARAYSCASRKWLIIGIVVGILVVVVIIA

SEQ ID NO: 2587072 - protein, 20 aa, Entamoeba histolytica
QLQMMKLKTVELIQFDSKID

SEQ ID NO: 2587073 - protein, 18 aa, Entamoeba histolytica
QLQSRVKLLGAIQHCETR

SEQ ID NO: 2587074 - protein, 18 aa, Entamoeba histolytica
QLREILFSCFKRDPNQRA

SEQ ID NO: 2587075 - protein, 18 aa, Entamoeba histolytica
QLSGSSVFFFFKNEASII

SEQ ID NO: 2587076 - protein, 21 aa, Entamoeba histolytica
QLSILCFFLSLILFSLVIIFV

SEQ ID NO: 2587077 - protein, 24 aa, Entamoeba histolytica
QLTFEIFPVISFIVYSCYSLKTHD

SEQ ID NO: 2587078 - protein, 17 aa, Entamoeba histolytica
QLVCIADVNDTRGCNGG

SEQ ID NO: 2587079 - protein, 18 aa, Entamoeba histolytica
QLVPVLYKLEFVALVIQN

SEQ ID NO: 2587080 - protein, 21 aa, Entamoeba histolytica
QLYCKECPVGSYSSMKGSDRC

SEQ ID NO: 2587081 - protein, 20 aa, Entamoeba histolytica
QLYMVLCVLLLINLVDVLHV

SEQ ID NO: 2587082 - protein, 25 aa, Entamoeba histolytica
QLYQAFCKFALIYIRANSKNESRSE

SEQ ID NO: 2587083 - protein, 20 aa, Entamoeba histolytica
QMACYLRFLKERKMYKKELD

SEQ ID NO: 2587084 - protein, 20 aa, Entamoeba histolytica
QMAKKFLKRLFNNENSLAIE

SEQ ID NO: 2587085 - protein, 26 aa, Entamoeba histolytica
QMIYRRGHWLFIDFNKINTITKVIMF

SEQ ID NO: 2587086 - protein, 24 aa, Entamoeba histolytica
QMMDKMRCPYIINFIGAVDTPGYY

SEQ ID NO: 2587087 - protein, 17 aa, Entamoeba histolytica
QMMWKGWTIPKLVENLV

SEQ ID NO: 2587088 - protein, 24 aa, Entamoeba histolytica
QMNKRKCICFVLPQNLKYLSILSF

SEQ ID NO: 2587089 - protein, 19 aa, Entamoeba histolytica
QMRCKAITLLNMFINLLWQ

SEQ ID NO: 2587090 - protein, 20 aa, Entamoeba histolytica
QNAYPLCPSADIKLHKNLTS

SEQ ID NO: 2587091 - protein, 24 aa, Entamoeba histolytica
QNDPRFKYNWDISEFIMLGKRLEK

SEQ ID NO: 2587092 - protein, 22 aa, Entamoeba histolytica
QNECFVHIGGLPRLEQYRCNAF

SEQ ID NO: 2587093 - protein, 18 aa, Entamoeba histolytica
QNFMLAIDRCLGNSGDPQ

SEQ ID NO: 2587094 - protein, 19 aa, Entamoeba histolytica
QNFSSKFTYGFTRAEVTGA

SEQ ID NO: 2587095 - protein, 25 aa, Entamoeba histolytica
QNGLECSYTLLPYETLLRMNLLIRP

SEQ ID NO: 2587096 - protein, 18 aa, Entamoeba histolytica
QNICYPLFAVSQETTDIM

SEQ ID NO: 2587097 - protein, 21 aa, Entamoeba histolytica
QNIDICLIKSLTQEFPELQLP

SEQ ID NO: 2587098 - protein, 23 aa, Entamoeba histolytica
QNIIKTIIVPRVVKSCSHETLMK

SEQ ID NO: 2587099 - protein, 21 aa, Entamoeba histolytica
QNIKASFVNFFIVSFALSCIA

SEQ ID NO: 2587100 - protein, 23 aa, Entamoeba histolytica
QNIKSPLLIPMPFINSSEYPHYN

SEQ ID NO: 2587101 - protein, 24 aa, Entamoeba histolytica
QNILTCWRFFCFGVMALTCIIHII

SEQ ID NO: 2587102 - protein, 18 aa, Entamoeba histolytica
QNKKRLVYNELVVMNIIN

SEQ ID NO: 2587103 - protein, 28 aa, Entamoeba histolytica
QNKMMDILYKIHLKSEGIKEERTDEVKV

SEQ ID NO: 2587104 - protein, 24 aa, Entamoeba histolytica
QNKRPNILLKYLISNPRFIANFCN

SEQ ID NO: 2587105 - protein, 26 aa, Entamoeba histolytica
QNKSILWLSLCMLFIPLISAFVRQRN

SEQ ID NO: 2587106 - protein, 18 aa, Entamoeba histolytica
QNLEGGSYIVLFKGKYGI

SEQ ID NO: 2587107 - protein, 23 aa, Entamoeba histolytica
QNLILRGTVHFRKNESEISETTG

SEQ ID NO: 2587108 - protein, 22 aa, Entamoeba histolytica
QNLLPCDLIQLGATCQTFHRSI

SEQ ID NO: 2587109 - protein, 17 aa, Entamoeba histolytica
QNLPCTRIPTYTINSFD

SEQ ID NO: 2587110 - protein, 17 aa, Entamoeba histolytica
QNNCKYVKMILGHISLL

SEQ ID NO: 2587111 - protein, 24 aa, Entamoeba histolytica
QNNNFCFINHLGIYIRETIIALYK

SEQ ID NO: 2587112 - protein, 24 aa, Entamoeba histolytica
QNNVLELWSLFDFLMPGFLGTEKE

SEQ ID NO: 2587113 - protein, 22 aa, Entamoeba histolytica
QNQYRPAKWLKLDTTEMTKQVV

SEQ ID NO: 2587114 - protein, 26 aa, Entamoeba histolytica
QNSFLRIYFPTVLNWMIGGVVGQNKF

SEQ ID NO: 2587115 - protein, 30 aa, Entamoeba histolytica
QNTCLTNKCGWCSITKKCGYCEDINNLCNN

SEQ ID NO: 2587116 - protein, 17 aa, Entamoeba histolytica
QNTCQKEQCSIPYISQT

SEQ ID NO: 2587117 - protein, 30 aa, Entamoeba histolytica
QNVMWYDCYYCFSKYRFIWDSISLKNLFIH

SEQ ID NO: 2587118 - protein, 27 aa, Entamoeba histolytica
QNYKINNCWFCLSNSKSELKLIISCGY

SEQ ID NO: 2587119 - protein, 23 aa, Entamoeba histolytica
QNYLPVKICFALYGLLTKYQTKQ

SEQ ID NO: 2587120 - protein, 18 aa, Entamoeba histolytica
QNYPDMYPTTAFKKTQNK

SEQ ID NO: 2587121 - protein, 23 aa, Entamoeba histolytica
QPHSPRNSSGCFVMNCKNQIIGL

SEQ ID NO: 2587122 - protein, 21 aa, Entamoeba histolytica
QPKFDQFRGSITIGNDKISIN

SEQ ID NO: 2587123 - protein, 24 aa, Entamoeba histolytica
QPLCGRIISGFEFDIQPMVAGPTK

SEQ ID NO: 2587124 - protein, 26 aa, Entamoeba histolytica
QPSSCDRNGWKWGTWNELEPTYESYG

SEQ ID NO: 2587125 - protein, 24 aa, Entamoeba histolytica
QPTTCPFKVFPKIYVKKQTDSYEI

SEQ ID NO: 2587126 - protein, 17 aa, Entamoeba histolytica
  misc_feature (17)..(17): Xaa can be any naturally occurring amino acid
QPTYGRPGTYKDNVVEX

SEQ ID NO: 2587127 - protein, 27 aa, Entamoeba histolytica
QPYKGFISVCIEWGVIIIIGCVLCLLW

SEQ ID NO: 2587128 - protein, 22 aa, Entamoeba histolytica
QQCAMIKEFELFITVSKLLQKI

SEQ ID NO: 2587129 - protein, 17 aa, Entamoeba histolytica
QQFGICYILTKQFAAIV

SEQ ID NO: 2587130 - protein, 17 aa, Entamoeba histolytica
QQFKLICQIEFTSSRKR

SEQ ID NO: 2587131 - protein, 17 aa, Entamoeba histolytica
QQFKNAFLRGSILQSSL

SEQ ID NO: 2587132 - protein, 24 aa, Entamoeba histolytica
QQFKRFYIKCIMTSIITGILIITV

SEQ ID NO: 2587133 - protein, 20 aa, Entamoeba histolytica
QQFMKLLHIIGSFDQQFVNH

SEQ ID NO: 2587134 - protein, 17 aa, Entamoeba histolytica
QQFYLFLPEIKMIQKFL

SEQ ID NO: 2587135 - protein, 24 aa, Entamoeba histolytica
QQHIECLEMNYANSSIEFLSVNNL

SEQ ID NO: 2587136 - protein, 17 aa, Entamoeba histolytica
QQIKRIIHDTGIEDRVF

SEQ ID NO: 2587137 - protein, 18 aa, Entamoeba histolytica
QQLISRPDIYTRGSICLI

SEQ ID NO: 2587138 - protein, 23 aa, Entamoeba histolytica
QQSLEMLRHAGIRTWMLTGDKVE

SEQ ID NO: 2587139 - protein, 24 aa, Entamoeba histolytica
QQSQLKWYFSIFTKILEKVSECII

SEQ ID NO: 2587140 - protein, 19 aa, Entamoeba histolytica
QQTKFVFLLLFYKVLLCSL

SEQ ID NO: 2587141 - protein, 20 aa, Entamoeba histolytica
QQTVKLSWCKNLLENTECPL

SEQ ID NO: 2587142 - protein, 35 aa, Entamoeba histolytica
QQYKFDELMGFITLPNCVVCIGIKGIKCVEINRQV

SEQ ID NO: 2587143 - protein, 19 aa, Entamoeba histolytica
QQYLLRRQWSNIIIENYRR

SEQ ID NO: 2587144 - protein, 19 aa, Entamoeba histolytica
QQYLLRRQWSNLIIENYRR

SEQ ID NO: 2587145 - protein, 25 aa, Entamoeba histolytica
QRDCYLLPKYQELYFSLVTSSYKSI

SEQ ID NO: 2587146 - protein, 21 aa, Entamoeba histolytica
QRDVLPLLYLFIGNGNASSVL

SEQ ID NO: 2587147 - protein, 21 aa, Entamoeba histolytica
QRFMLPISLSILIITFIPLVY

SEQ ID NO: 2587148 - protein, 23 aa, Entamoeba histolytica
QRGIKMVWEQQGFVEQIISIGER

SEQ ID NO: 2587149 - protein, 28 aa, Entamoeba histolytica
QRGSIVNGIGSFWLNCRNLIERISETTV

SEQ ID NO: 2587150 - protein, 22 aa, Entamoeba histolytica
QRHKELFHKLIIAQENKDKIHS

SEQ ID NO: 2587151 - protein, 18 aa, Entamoeba histolytica
QRHNLPVYWNRRNPTELH

SEQ ID NO: 2587152 - protein, 17 aa, Entamoeba histolytica
QRIKMYGTFTIIAIFIF

SEQ ID NO: 2587153 - protein, 21 aa, Entamoeba histolytica
QRIKSKYSRVVCANFMTQTID

SEQ ID NO: 2587154 - protein, 19 aa, Entamoeba histolytica
QRILCGLSRKNATYQTLEI

SEQ ID NO: 2587155 - protein, 24 aa, Entamoeba histolytica
QRILNMIIDKCIEKNIDMEHIQYI

SEQ ID NO: 2587156 - protein, 18 aa, Entamoeba histolytica
QRINELFEQILLSIHYCL

SEQ ID NO: 2587157 - protein, 17 aa, Entamoeba histolytica
QRISMASGVFFILCITT

SEQ ID NO: 2587158 - protein, 21 aa, Entamoeba histolytica
QRIVLDASKGIAILHAKNYLH

SEQ ID NO: 2587159 - protein, 17 aa, Entamoeba histolytica
QRKCVLDGVDIEKVRKL

SEQ ID NO: 2587160 - protein, 40 aa, Entamoeba histolytica
QRKQLKDFFVFRIMKLRWLKSQFFVWFSILTLIHVSLLIS

SEQ ID NO: 2587161 - protein, 21 aa, Entamoeba histolytica
QRLEMSIQVILEINDRADVKV

SEQ ID NO: 2587162 - protein, 23 aa, Entamoeba histolytica
QRLIWRVSRGLVLIKSMDLTEGS

SEQ ID NO: 2587163 - protein, 25 aa, Entamoeba histolytica
QRNNLCVYPSCLTGKLGPKDECSQG

SEQ ID NO: 2587164 - protein, 25 aa, Entamoeba histolytica
QRPFVWKVLCGYLPENVSLHSSKQK

SEQ ID NO: 2587165 - protein, 20 aa, Entamoeba histolytica
QRPIKHSFLNPDLSKKHNTL

SEQ ID NO: 2587166 - protein, 23 aa, Entamoeba histolytica
QRSERYFERFIGWVQLICVIQNI

SEQ ID NO: 2587167 - protein, 24 aa, Entamoeba histolytica
QRSFLTRDVRMMYYHAVYKMLSTG

SEQ ID NO: 2587168 - protein, 26 aa, Entamoeba histolytica
QRTYHLKKKLIIKIIIFTIFIMIILV

SEQ ID NO: 2587169 - protein, 21 aa, Entamoeba histolytica
QRVEVPLAISARGELSNINIE

SEQ ID NO: 2587170 - protein, 20 aa, Entamoeba histolytica
QSAALAFFWSPCESLITTES

SEQ ID NO: 2587171 - protein, 27 aa, Entamoeba histolytica
QSCGSCYCVSNALALQLKWANLTYLRD

SEQ ID NO: 2587172 - protein, 19 aa, Entamoeba histolytica
QSCSDLSKYPGCKKTDSCN

SEQ ID NO: 2587173 - protein, 19 aa, Entamoeba histolytica
QSCSDLSKYPGCKTTDTCN

SEQ ID NO: 2587174 - protein, 18 aa, Entamoeba histolytica
QSDLKGVLYTGSVKERFV

SEQ ID NO: 2587175 - protein, 26 aa, Entamoeba histolytica
QSDSFSFSIICWELFYQQKYFNKNFN

SEQ ID NO: 2587176 - protein, 19 aa, Entamoeba histolytica
QSDSVLFQRIFKTIEASKT

SEQ ID NO: 2587177 - protein, 26 aa, Entamoeba histolytica
QSESFSLLCFTGLYIPASDGLVSWIY

SEQ ID NO: 2587178 - protein, 19 aa, Entamoeba histolytica
QSFGLPLIITRGNNVFGPH

SEQ ID NO: 2587179 - protein, 29 aa, Entamoeba histolytica
QSFKSHKDLECLYNFFDGCHDLRSVEIAK

SEQ ID NO: 2587180 - protein, 18 aa, Entamoeba histolytica
QSGCLKCVDGFYQDNQNN

SEQ ID NO: 2587181 - protein, 22 aa, Entamoeba histolytica
QSGSFKFIFSLFELLSIHPEQL

SEQ ID NO: 2587182 - protein, 34 aa, Entamoeba histolytica; identical to SEQ ID NO: 2389368

SEQ ID NO: 2587183 - protein, 34 aa, Entamoeba histolytica; identical to SEQ ID NO: 2389370

SEQ ID NO: 2587184 - protein, 21 aa, Entamoeba histolytica
QSIAEMFFCVVLYLVEQEKMP

SEQ ID NO: 2587185 - protein, 17 aa, Entamoeba histolytica
QSIAFVYQHLMIPKPIF

SEQ ID NO: 2587186 - protein, 19 aa, Entamoeba histolytica
QSIKESRNIQMYSNKHKRL

SEQ ID NO: 2587187 - protein, 28 aa, Entamoeba histolytica
QSIQGSVLFYSWCFDIVVVIVHAKMKII

SEQ ID NO: 2587188 - protein, 25 aa, Entamoeba histolytica
QSITSRKGLSFNFIETLYYTHGIHS

SEQ ID NO: 2587189 - protein, 25 aa, Entamoeba histolytica
QSKGAFLLYKGRDAVVTTCNSMVTS

SEQ ID NO: 2587190 - protein, 34 aa, Entamoeba histolytica
QSKQHKIMYNLYKAELKGEVTTQITDEVPKSSQP

SEQ ID NO: 2587191 - protein, 22 aa, Entamoeba histolytica
QSKRWYGFIVPLIFVLFLGVIF

SEQ ID NO: 2587192 - protein, 21 aa, Entamoeba histolytica
QSLESFGWLDLLKIVGEFLFI

SEQ ID NO: 2587193 - protein, 23 aa, Entamoeba histolytica
QSLRKCFIIYSFIVSYRSTQLLT

SEQ ID NO: 2587194 - protein, 17 aa, Entamoeba histolytica
QSMKVMPMSASFTKSQS

SEQ ID NO: 2587195 - protein, 25 aa, Entamoeba histolytica
QSNLIIRSSISWNYNLLTLLFNRYS

SEQ ID NO: 2587196 - protein, 24 aa, Entamoeba histolytica
QSNQSFWFVVIIIFLLTVILFLIA

SEQ ID NO: 2587197 - protein, 19 aa, Entamoeba histolytica
QSRIILIDVSDEFTSQLGL

SEQ ID NO: 2587198 - protein, 23 aa, Entamoeba histolytica
QSSIGVCVECLFNYHLEEGQCIQ

SEQ ID NO: 2587199 - protein, 17 aa, Entamoeba histolytica
QSVAVKLIPTRMVIDNT

SEQ ID NO: 2587200 - protein, 18 aa, Entamoeba histolytica
QSVFSFSIAIFVTFNQIV

SEQ ID NO: 2587201 - protein, 30 aa, Entamoeba histolytica
QSVGKRRCVLRGLEYLKEIWTENSKVLNQI

SEQ ID NO: 2587202 - protein, 18 aa, Entamoeba histolytica
QSYFPLHYRFTSITEKQH

SEQ ID NO: 2587203 - protein, 27 aa, Entamoeba histolytica
QTDIELTMSFGCYFIVTSQTTFKSISG

SEQ ID NO: 2587204 - protein, 18 aa, Entamoeba histolytica
QTFVFSATMILASEMMAK

SEQ ID NO: 2587205 - protein, 29 aa, Entamoeba histolytica
QTFVGISMFNVLPAFSFSGEKVKVVMTFN

SEQ ID NO: 2587206 - protein, 32 aa, Entamoeba histolytica
QTKGTFCPKSRRLLFKCIMIIISQAKDLTEYQ

SEQ ID NO: 2587207 - protein, 18 aa, Entamoeba histolytica
QTLFDFLSGCFQYDPKLR

SEQ ID NO: 2587208 - protein, 23 aa, Entamoeba histolytica
QTLHPTSSIDLMFSATDKNNKPT

SEQ ID NO: 2587209 - protein, 25 aa, Entamoeba histolytica
QTLLCLRFVPWYVVIVNLISQAIYF

SEQ ID NO: 2587210 - protein, 25 aa, Entamoeba histolytica
QTLSRISYGLSFFGTKAFEKDEPTL

SEQ ID NO: 2587211 - protein, 26 aa, Entamoeba histolytica
QTNPRLIKLFLSFFLINSTRFAYLAK

SEQ ID NO: 2587212 - protein, 25 aa, Entamoeba histolytica
QTPKLLFFTCVALYASFVASLFKNA

SEQ ID NO: 2587213 - protein, 21 aa, Entamoeba histolytica
QTRVWPSLLLMVITVATLSIF

SEQ ID NO: 2587214 - protein, 28 aa, Entamoeba histolytica
QTTTRNCRRWKGSIIEYIPKGNKPINAL

SEQ ID NO: 2587215 - protein, 23 aa, Entamoeba histolytica
QTWLPKLKTVAVIGTIIIGTIAI

SEQ ID NO: 2587216 - protein, 20 aa, Entamoeba histolytica
QTYNRLTNTIQYIHNNIHLI

SEQ ID NO: 2587217 - protein, 17 aa, Entamoeba histolytica
QVAPVIGFSNSFTFSHT

SEQ ID NO: 2587218 - protein, 18 aa, Entamoeba histolytica
QVFIKIILLTSLLVIITL

SEQ ID NO: 2587219 - protein, 20 aa, Entamoeba histolytica
QVFLSLILLEFISKYKQSNN

SEQ ID NO: 2587220 - protein, 20 aa, Entamoeba histolytica
QVICEFFKSLPYAHVIGTSV

SEQ ID NO: 2587221 - protein, 17 aa, Entamoeba histolytica
QVILEIFENIPFEKVKE

SEQ ID NO: 2587222 - protein, 23 aa, Entamoeba histolytica
QVISQLPWNCWSSSFEFSDKLPQ

SEQ ID NO: 2587223 - protein, 18 aa, Entamoeba histolytica
QVKFKFLCTCFVNEIVDV

SEQ ID NO: 2587224 - protein, 20 aa, Entamoeba histolytica
QVLELFSLLFERIGQNRIMA

SEQ ID NO: 2587225 - protein, 24 aa, Entamoeba histolytica
QVPNELIIFLTRVWINRITNKKEG

SEQ ID NO: 2587226 - protein, 21 aa, Entamoeba histolytica
QVSLFIVHALSIYPHFINLLV

SEQ ID NO: 2587227 - protein, 18 aa, Entamoeba histolytica
QVVNCPYKTIPSAVVKSI

SEQ ID NO: 2587228 - protein, 20 aa, Entamoeba histolytica
QWCKARGFKDGILINTKVSK

SEQ ID NO: 2587229 - protein, 25 aa, Entamoeba histolytica
QWFACGLVSFLMCHICNIICYSLTL

SEQ ID NO: 2587230 - protein, 24 aa, Entamoeba histolytica
QWIFDCVNENFILPCGEYTIGQKL

SEQ ID NO: 2587231 - protein, 17 aa, Entamoeba histolytica
QWKIYFDYLKGESTYDI

SEQ ID NO: 2587232 - protein, 17 aa, Entamoeba histolytica
QWLNWKSSKEVFDTTPA

SEQ ID NO: 2587233 - protein, 23 aa, Entamoeba histolytica
QWLYKNLFFTVGIIIFLIFLVLL

SEQ ID NO: 2587234 - protein, 18 aa, Entamoeba histolytica
QWSTLRAYVIMKKVMLRD

SEQ ID NO: 2587235 - protein, 20 aa, Entamoeba histolytica
QWTVKNCLIIPIGAFFAGVS

SEQ ID NO: 2587236 - protein, 23 aa, Entamoeba histolytica
QYCGSCMPGFHCTSSGFCEISTS

SEQ ID NO: 2587237 - protein, 18 aa, Entamoeba histolytica
QYCKPKYLLVPLILMFGL

SEQ ID NO: 2587238 - protein, 24 aa, Entamoeba histolytica
QYECKTCGIGYYPQRMTCSRCEYH

SEQ ID NO: 2587239 - protein, 25 aa, Entamoeba histolytica
QYEFLAPFLPLISWQLAHVDLSWSL

SEQ ID NO: 2587240 - protein, 19 aa, Entamoeba histolytica
QYFKLLAINGSEIGQIESL

SEQ ID NO: 2587241 - protein, 21 aa, Entamoeba histolytica
QYGDCSTAFGITQFPFYMNFN

SEQ ID NO: 2587242 - protein, 25 aa, Entamoeba histolytica
QYKQKYRFGKWFKINLNQVTNAVFV

SEQ ID NO: 2587243 - protein, 23 aa, Entamoeba histolytica
QYMVDSSCFTRRFEYWNFHYNIG

SEQ ID NO: 2587244 - protein, 19 aa, Entamoeba histolytica
QYNCVGRFEKLRLLSHYCI

SEQ ID NO: 2587245 - protein, 35 aa, Entamoeba histolytica
QYPSEVLYSCGFLLLRVMLLKCSFNKLKKKMPTIL

SEQ ID NO: 2587246 - protein, 22 aa, Entamoeba histolytica
QYVKNGECAPCNELKHCVACSG

SEQ ID NO: 2587247 - protein, 19 aa, Entamoeba histolytica
QYVNAPMLFLTWVEQSAEI

SEQ ID NO: 2587248 - protein, 19 aa, Entamoeba histolytica
QYYIHQHHDPFFLDFLQVS

SEQ ID NO: 2587249 - protein, 20 aa, Entamoeba histolytica
QYYSIEWIIILIILTITIII

SEQ ID NO: 2587250 - protein, 24 aa, Entamoeba histolytica
RAGDEIYYALNILYFVSLVLDPYI

SEQ ID NO: 2587251 - protein, 26 aa, Entamoeba histolytica
RAGDIICIYGKLTPLRECAVKENFTL

SEQ ID NO: 2587252 - protein, 26 aa, Entamoeba histolytica
RAISTKECIICQPGFVLLNGQCYKSI

SEQ ID NO: 2587253 - protein, 21 aa, Entamoeba histolytica
RAKDNLGFEMPIFYNDSIGGR

SEQ ID NO: 2587254 - protein, 18 aa, Entamoeba histolytica
RAKIEEFDELIQTTKAVS

SEQ ID NO: 2587255 - protein, 23 aa, Entamoeba histolytica
RAKIWKLLLRYYRAEQKTWVSSE

SEQ ID NO: 2587256 - protein, 30 aa, Entamoeba histolytica
RAKLGIDVLWCFFIGISVFYSFTISISIFF

SEQ ID NO: 2587257 - protein, 18 aa, Entamoeba histolytica
RAMWNIVQIFDWTVYNDS

SEQ ID NO: 2587258 - protein, 19 aa, Entamoeba histolytica
RAQVHFIIQRGHHKCKHNI

SEQ ID NO: 2587259 - protein, 21 aa, Entamoeba histolytica
RAQVLKFFQRLFLNYQKCFKE

SEQ ID NO: 2587260 - protein, 21 aa, Entamoeba histolytica
RARAAKCYYDIWKKEEKDVLQ

SEQ ID NO: 2587261 - protein, 26 aa, Entamoeba histolytica
RASLFARLSLSMFALGIIFCALLICF

SEQ ID NO: 2587262 - protein, 20 aa, Entamoeba histolytica
RAVVILHYFESIKYFKYTNI

SEQ ID NO: 2587263 - protein, 17 aa, Entamoeba histolytica
RAWLLSYSFAIVIVTML

SEQ ID NO: 2587264 - protein, 20 aa, Entamoeba histolytica
RCDIALELNNPGVFSEAAVI

SEQ ID NO: 2587265 - protein, 17 aa, Entamoeba histolytica
RCEDKQCKICLKGENGC

SEQ ID NO: 2587266 - protein, 29 aa, Entamoeba histolytica
RCEEGYYLYSNICVSPFHLIEKCMDSRKE

SEQ ID NO: 2587267 - protein, 19 aa, Entamoeba histolytica
RCEQCGLKSDSQRSERYKK

SEQ ID NO: 2587268 - protein, 17 aa, Entamoeba histolytica
RCGHDFHVSCLKGWLAR

SEQ ID NO: 2587269 - protein, 24 aa, Entamoeba histolytica
RCKYWKRKSIVIILLVVLVLGIIG

SEQ ID NO: 2587270 - protein, 20 aa, Entamoeba histolytica
RCTLYGNGMTITFFNTSDTV

SEQ ID NO: 2587271 - protein, 19 aa, Entamoeba histolytica
RCVYFYFERKDFFELENFI

SEQ ID NO: 2587272 - protein, 17 aa, Entamoeba histolytica
RDCVFKSQNKESGVVLA

SEQ ID NO: 2587273 - protein, 20 aa, Entamoeba histolytica
RDDGMFVIDMWRNATVPVSV

SEQ ID NO: 2587274 - protein, 24 aa, Entamoeba histolytica
RDDSVCKYALMVLAEQIIKMDTYR

SEQ ID NO: 2587275 - protein, 22 aa, Entamoeba histolytica
RDHLKKTLDFVIKGLSRMTFDI

SEQ ID NO: 2587276 - protein, 27 aa, Entamoeba histolytica
RDIEKMKPCGEWSFKYRGTRPEIVHID

SEQ ID NO: 2587277 - protein, 18 aa, Entamoeba histolytica
RDIEVITFGCGKKNYYRE

SEQ ID NO: 2587278 - protein, 25 aa, Entamoeba histolytica
RDLMFKKQLRRMLLKRKKDYDKYSR

SEQ ID NO: 2587279 - protein, 25 aa, Entamoeba histolytica
RDLTKRYLCAASFNALIQKVEKSAF

SEQ ID NO: 2587280 - protein, 21 aa, Entamoeba histolytica
RDRSLVILKIRNFGTLNIGNP

SEQ ID NO: 2587281 - protein, 24 aa, Entamoeba histolytica
RDTRYLCSLFKYDIQSNVSEAIKN

SEQ ID NO: 2587282 - protein, 24 aa, Entamoeba histolytica
RDVKGENLLVFSLNPHSPVCAKLT

SEQ ID NO: 2587283 - protein, 23 aa, Entamoeba histolytica
RDVKGENLLVFSLNPRSPVCAKL

SEQ ID NO: 2587284 - protein, 23 aa, Entamoeba histolytica
RDYPEVKDKEFILVCKDNYLGVY

SEQ ID NO: 2587285 - protein, 22 aa, Entamoeba histolytica
REECAIVMKNCCDQLFAQTGID

SEQ ID NO: 2587286 - protein, 24 aa, Entamoeba histolytica
REEIYEMFRVFRIIDLTKENKTDD

SEQ ID NO: 2587287 - protein, 18 aa, Entamoeba histolytica
REFGKKYIGLKCPHAQFT

SEQ ID NO: 2587288 - protein, 18 aa, Entamoeba histolytica
REFGKKYSALKCPHAQFT

SEQ ID NO: 2587289 - protein, 19 aa, Entamoeba histolytica
REFGKKYSALKCPHAQFTE

SEQ ID NO: 2587290 - protein, 23 aa, Entamoeba histolytica
REFIGCATSGWFDHYKKCERLVI

SEQ ID NO: 2587291 - protein, 19 aa, Entamoeba histolytica
REFIKGRSNERVALYDYND

SEQ ID NO: 2587292 - protein, 18 aa, Entamoeba histolytica
REGCSICDISDGYVLSSD

SEQ ID NO: 2587293 - protein, 17 aa, Entamoeba histolytica
REGLPLVLKGVDAVIND

SEQ ID NO: 2587294 - protein, 23 aa, Entamoeba histolytica
REIKELGFDFIIKSSKKKEKKGS

SEQ ID NO: 2587295 - protein, 23 aa, Entamoeba histolytica
REINDFIVYWIVKLNKKYYKVTI

SEQ ID NO: 2587296 - protein, 23 aa, Entamoeba histolytica
REINLKFACCGWKSYNANSCSFT

SEQ ID NO: 2587297 - protein, 25 aa, Entamoeba histolytica
REKSDLSIKVFYQWLTTSIYEGTMI

SEQ ID NO: 2587298 - protein, 24 aa, Entamoeba histolytica
RELFGNGLNEIWYDKRFTKEDSPY

SEQ ID NO: 2587299 - protein, 27 aa, Entamoeba histolytica
RELKKNIFTLIPFLANSVFNVFYNIPV

SEQ ID NO: 2587300 - protein, 24 aa, Entamoeba histolytica
REMGDGLIVYLARWVEGKMKETIT

SEQ ID NO: 2587301 - protein, 20 aa, Entamoeba histolytica
REMKQLDMVYLMKVALHVKD

SEQ ID NO: 2587302 - protein, 18 aa, Entamoeba histolytica
RENVAFSALDNVQFIVNA

SEQ ID NO: 2587303 - protein, 18 aa, Entamoeba histolytica
REPNILIDMSHNRRYTFN

SEQ ID NO: 2587304 - protein, 20 aa, Entamoeba histolytica
RERQVYFTLNMFYVDEGHSH

SEQ ID NO: 2587305 - protein, 20 aa, Entamoeba histolytica
RESFNIITCFRGNGKKKITK

SEQ ID NO: 2587306 - protein, 22 aa, Entamoeba histolytica
RESNFPSEWFFLIDSLKNVEIP

SEQ ID NO: 2587307 - protein, 21 aa, Entamoeba histolytica
RFAINTKICLSITSFHPETWT

SEQ ID NO: 2587308 - protein, 18 aa, Entamoeba histolytica
RFDFAFSTDYPPLFENIT

SEQ ID NO: 2587309 - protein, 19 aa, Entamoeba histolytica
RFEKLRLLSHYCISHYLDI

SEQ ID NO: 2587310 - protein, 29 aa, Entamoeba histolytica
RFEWMAMALACARQGITLVTVYATLGEES

SEQ ID NO: 2587311 - protein, 19 aa, Entamoeba histolytica
RFGASLLHHSLITLMADDE

SEQ ID NO: 2587312 - protein, 19 aa, Entamoeba histolytica
RFGGILFFLICMIPFIMRT

SEQ ID NO: 2587313 - protein, 20 aa, Entamoeba histolytica
RFINEYKSDIGLYLILIIIN

SEQ ID NO: 2587314 - protein, 22 aa, Entamoeba histolytica
RFKHLGKLILYHGRMSLYRNTS

SEQ ID NO: 2587315 - protein, 20 aa, Entamoeba histolytica
RFLLDYVTREFEIITIDDNS

SEQ ID NO: 2587316 - protein, 19 aa, Entamoeba histolytica
RFLLLRTYLAESFVVIFSA

SEQ ID NO: 2587317 - protein, 19 aa, Entamoeba histolytica
RFLSKRAQKALNLRRQRKV

SEQ ID NO: 2587318 - protein, 20 aa, Entamoeba histolytica
RFNCYAHVWDAHLRQYYTQN

SEQ ID NO: 2587319 - protein, 23 aa, Entamoeba histolytica
RFQQQCYPFYLAFFGMLISTILF

SEQ ID NO: 2587320 - protein, 18 aa, Entamoeba histolytica
RFSAELIEGVSLLVRSVR

SEQ ID NO: 2587321 - protein, 21 aa, Entamoeba histolytica
RFTSVCWFGVLILSSLIVKFT

SEQ ID NO: 2587322 - protein, 18 aa, Entamoeba histolytica
RFVEVMKISGNYEYQYFG

SEQ ID NO: 2587323 - protein, 17 aa, Entamoeba histolytica
RFVLPSLLTRQVVESEE

SEQ ID NO: 2587324 - protein, 25 aa, Entamoeba histolytica
RFVPKGSFFMCQCIFDGSNYIDSTL

SEQ ID NO: 2587325 - protein, 23 aa, Entamoeba histolytica
RFYSRMHLVLSCLGTVSSPLILY

SEQ ID NO: 2587326 - protein, 20 aa, Entamoeba histolytica
RFYSYNFKFLEGFEKRILNI

SEQ ID NO: 2587327 - protein, 20 aa, Entamoeba histolytica
RGCGVAAKLMHKLDSSYDYF

SEQ ID NO: 2587328 - protein, 26 aa, Entamoeba histolytica
RGDEWWSSVCLSMLTRACDFISKNPG

SEQ ID NO: 2587329 - protein, 25 aa, Entamoeba histolytica
RGEVTDEVYLVYGPKGSILNVPQIK

SEQ ID NO: 2587330 - protein, 21 aa, Entamoeba histolytica
RGFSSFRLLTIKTFDDETQYL

SEQ ID NO: 2587331 - protein, 27 aa, Entamoeba histolytica
RGFYGCLCCIIVLTLYYFMPFLPASIR

SEQ ID NO: 2587332 - protein, 18 aa, Entamoeba histolytica
RGGSFGMTVITLNGRGHC

SEQ ID NO: 2587333 - protein, 18 aa, Entamoeba histolytica
RGKNCPIHGSGEEKRSFI

SEQ ID NO: 2587334 - protein, 19 aa, Entamoeba histolytica
RGLNCLITIVISSIVLGII

SEQ ID NO: 2587335 - protein, 18 aa, Entamoeba histolytica
RGRFITEFIGAIFQLNKL

SEQ ID NO: 2587336 - protein, 21 aa, Entamoeba histolytica
RGRIIESISIIGFYLNSSELT

SEQ ID NO: 2587337 - protein, 19 aa, Entamoeba histolytica
RGRIKMSVNTALYKPKEKN

SEQ ID NO: 2587338 - protein, 18 aa, Entamoeba histolytica
RGRYKKEMIEGFMRMIRR

SEQ ID NO: 2587339 - protein, 17 aa, Entamoeba histolytica
RGSESFSVEYAIRSIKA

SEQ ID NO: 2587340 - protein, 26 aa, Entamoeba histolytica
RGSLIKHLFKYVATFLSYYPVKIIGL

SEQ ID NO: 2587341 - protein, 18 aa, Entamoeba histolytica
RGSVFVHFQDVFKKTMFS

SEQ ID NO: 2587342 - protein, 20 aa, Entamoeba histolytica
RGVMYKCVCVISMGLKNEKL

SEQ ID NO: 2587343 - protein, 20 aa, Entamoeba histolytica
RGVNQFKGSQAIKVDIVDIF

SEQ ID NO: 2587344 - protein, 21 aa, Entamoeba histolytica
RGYGKIGIIIKICIEETTRIS

SEQ ID NO: 2587345 - protein, 19 aa, Entamoeba histolytica
RHANMWRSSMKELNKKRAE

SEQ ID NO: 2587346 - protein, 20 aa, Entamoeba histolytica
RHDLGFRRILFILSLTNGGV

SEQ ID NO: 2587347 - protein, 19 aa, Entamoeba histolytica
RHHFQEFINTLNLATNYVI

SEQ ID NO: 2587348 - protein, 17 aa, Entamoeba histolytica
RHNAKICTFIADRRYTI

SEQ ID NO: 2587349 - protein, 18 aa, Entamoeba histolytica
RHSIKNAKNLIVFMSSCT

SEQ ID NO: 2587350 - protein, 20 aa, Entamoeba histolytica
RIAEISTLMLMDISLISTPS

SEQ ID NO: 2587351 - protein, 17 aa, Entamoeba histolytica
RICVVRESVKAADLLII

SEQ ID NO: 2587352 - protein, 27 aa, Entamoeba histolytica
RIEAITLLNRIICWVLMISHNFTTPDD

SEQ ID NO: 2587353 - protein, 23 aa, Entamoeba histolytica
RIEECDWRKVFMPSNARFIEKWA

SEQ ID NO: 2587354 - protein, 23 aa, Entamoeba histolytica
RIEEKSRFIGLHLGETVLNKPPN

SEQ ID NO: 2587355 - protein, 17 aa, Entamoeba histolytica
RIFQIYMSVCFALICAN

SEQ ID NO: 2587356 - protein, 19 aa, Entamoeba histolytica
RIGFNGEIKYGDWKLIKVM

SEQ ID NO: 2587357 - protein, 24 aa, Entamoeba histolytica
RIGHWLELNLLEFPDSVNYMQVQL

SEQ ID NO: 2587358 - protein, 32 aa, Entamoeba histolytica
RIIANTFPIIGFWKHVCVVWTKCMCFYPQAVL

SEQ ID NO: 2587359 - protein, 19 aa, Entamoeba histolytica
RIIFSASLFISMSLIGIVT

SEQ ID NO: 2587360 - protein, 19 aa, Entamoeba histolytica
RIIHDTGIEDRVFCNKTIR

SEQ ID NO: 2587361 - protein, 27 aa, Entamoeba histolytica
RIIQSCPFFPLILKLILQESFALVLEE

SEQ ID NO: 2587362 - protein, 19 aa, Entamoeba histolytica
RIITTICDIILLRNNQTIE

SEQ ID NO: 2587363 - protein, 19 aa, Entamoeba histolytica
RIKAIDTVRAFHLSMGYMV

SEQ ID NO: 2587364 - protein, 17 aa, Entamoeba histolytica
RIKEIIMINEINEELKN

SEQ ID NO: 2587365 - protein, 18 aa, Entamoeba histolytica
RIKEMKTQAVIRLVLDSP

SEQ ID NO: 2587366 - protein, 18 aa, Entamoeba histolytica
RIKICMDAARGIEYLHQN

SEQ ID NO: 2587367 - protein, 27 aa, Entamoeba histolytica
RILFIKGCIVSCLFPIFNNIIDDFTKS

SEQ ID NO: 2587368 - protein, 18 aa, Entamoeba histolytica
RILKCGYGSLLNEKGSCV

SEQ ID NO: 2587369 - protein, 25 aa, Entamoeba histolytica
RILSNEVFKQWKIKTQNRMKKFIEN

SEQ ID NO: 2587370 - protein, 20 aa, Entamoeba histolytica
RIMEGLKIGAKIGGYDSKII

SEQ ID NO: 2587371 - protein, 28 aa, Entamoeba histolytica
RIMIQILLYCWLCYNSKNEKEWKILQSI

SEQ ID NO: 2587372 - protein, 27 aa, Entamoeba histolytica
RINENLKRLHVMGEIMAENGFLQRSDI

SEQ ID NO: 2587373 - protein, 20 aa, Entamoeba histolytica
RIPFAGIVDICAFDKTGTLT

SEQ ID NO: 2587374 - protein, 21 aa, Entamoeba histolytica
RIPSRLRRLFLSTKASLLEIK

SEQ ID NO: 2587375 - protein, 17 aa, Entamoeba histolytica
RIQLYHCNIKCTKEVIR

SEQ ID NO: 2587376 - protein, 18 aa, Entamoeba histolytica
RIQYGEFVYFTGGDLDGS

SEQ ID NO: 2587377 - protein, 19 aa, Entamoeba histolytica
RIRPSCFVDTLEIEGSREW

SEQ ID NO: 2587378 - protein, 24 aa, Entamoeba histolytica
RISIICILVLFGVISLFLSFTFIL

SEQ ID NO: 2587379 - protein, 21 aa, Entamoeba histolytica
RISPFIVVRMSMVFLTIGEAI

SEQ ID NO: 2587380 - protein, 18 aa, Entamoeba histolytica
RITESLVLVSFVILVAVA

SEQ ID NO: 2587381 - protein, 19 aa, Entamoeba histolytica
RITKEVTCYMTLHCTTKIN

SEQ ID NO: 2587382 - protein, 19 aa, Entamoeba histolytica
RIWGSMCCILYLFVFLIFG

SEQ ID NO: 2587383 - protein, 19 aa, Entamoeba histolytica
RKAFQGFCIHAGGRGVIDA

SEQ ID NO: 2587384 - protein, 19 aa, Entamoeba histolytica
RKCSTCLLMKPSRSHHCNI

SEQ ID NO: 2587385 - protein, 22 aa, Entamoeba histolytica
RKCWMCVFPGCTEPPKTRYNCY

SEQ ID NO: 2587386 - protein, 19 aa, Entamoeba histolytica
RKDAMKLCEMYVVYVDDSR

SEQ ID NO: 2587387 - protein, 18 aa, Entamoeba histolytica
RKDIPYYLFIHSKYASKT

SEQ ID NO: 2587388 - protein, 23 aa, Entamoeba histolytica
RKDLAAAVVRKSSPIQVHKNVLF

SEQ ID NO: 2587389 - protein, 18 aa, Entamoeba histolytica
RKDLKVVVMSATLDSQLF

SEQ ID NO: 2587390 - protein, 19 aa, Entamoeba histolytica
RKDYFNFAMFIKSIEETVL

SEQ ID NO: 2587391 - protein, 22 aa, Entamoeba histolytica
RKEEVLIFREEWHTVGKEKKPK

SEQ ID NO: 2587392 - protein, 29 aa, Entamoeba histolytica
RKEIDLLSKFKCRYIIQFLGAVINKNNVS

SEQ ID NO: 2587393 - protein, 17 aa, Entamoeba histolytica
RKELKTLINSFSKDEEI

SEQ ID NO: 2587394 - protein, 21 aa, Entamoeba histolytica
RKELPDVLKDISFNIHHGEKI

SEQ ID NO: 2587395 - protein, 26 aa, Entamoeba histolytica
RKEVGCVADCVCMWYNVADDSVKCLS

SEQ ID NO: 2587396 - protein, 18 aa, Entamoeba histolytica
RKFIERWGYSQPLNTPTR

SEQ ID NO: 2587397 - protein, 25 aa, Entamoeba histolytica
RKFKKEFWISLVLCLLFWVPGIIYA

SEQ ID NO: 2587398 - protein, 21 aa, Entamoeba histolytica
RKFNRFVAIALTFDFIVILAS

SEQ ID NO: 2587399 - protein, 26 aa, Entamoeba histolytica
RKHVTYGLAIGYPFAVLCLAAVNLGL

SEQ ID NO: 2587400 - protein, 17 aa, Entamoeba histolytica
RKIKILSLIPFSSERKR

SEQ ID NO: 2587401 - protein, 17 aa, Entamoeba histolytica
RKIPIKIEVWKLILERR

SEQ ID NO: 2587402 - protein, 20 aa, Entamoeba histolytica
RKIRCLKIYKEWLTTPNSPS

SEQ ID NO: 2587403 - protein, 19 aa, Entamoeba histolytica
RKISFLFIFSLGGYLLGLV

SEQ ID NO: 2587404 - protein, 18 aa, Entamoeba histolytica
RKISQKFQTNEHEEIKKD

SEQ ID NO: 2587405 - protein, 21 aa, Entamoeba histolytica
RKISSSGIFLWKMWNINENSI

SEQ ID NO: 2587406 - protein, 18 aa, Entamoeba histolytica
RKKKDCCYYTKKEGGKII

SEQ ID NO: 2587407 - protein, 42 aa, Entamoeba histolytica
RKKTLYYKWIYPIAIAIDITLRFGWTINIILLYFNWFDENKI

SEQ ID NO: 2587408 - protein, 18 aa, Entamoeba histolytica
RKLIRSIKRNVIFYGTLI

SEQ ID NO: 2587409 - protein, 19 aa, Entamoeba histolytica
RKLLYSALLRQNISYYDRK

SEQ ID NO: 2587410 - protein, 18 aa, Entamoeba histolytica
RKLPSLLSRSHVISKFTN

SEQ ID NO: 2587411 - protein, 20 aa, Entamoeba histolytica
RKLSSLSFLPLGHVFAIVME

SEQ ID NO: 2587412 - protein, 22 aa, Entamoeba histolytica
RKMLQECFKTLWEFEDYQKKMI

SEQ ID NO: 2587413 - protein, 25 aa, Entamoeba histolytica
RKMLTEIVTAISMLHSFHFIYRQLN

SEQ ID NO: 2587414 - protein, 21 aa, Entamoeba histolytica
RKMPLSYLLLFIGILLYIHCG

SEQ ID NO: 2587415 - protein, 30 aa, Entamoeba histolytica
RKNNLPPRLKFNAHRRFTSKKGDSIDLPSI

SEQ ID NO: 2587416 - protein, 29 aa, Entamoeba histolytica
RKPLNIRKSFRFILPRALLLLTLFMLVFT

SEQ ID NO: 2587417 - protein, 18 aa, Entamoeba histolytica
RKPLQTILGRDVEIKKKQ

SEQ ID NO: 2587418 - protein, 17 aa, Entamoeba histolytica
RKQILNFLQILISKIIS

SEQ ID NO: 2587419 - protein, 19 aa, Entamoeba histolytica
RKRIPEISIALQVLLEATY

SEQ ID NO: 2587420 - protein, 17 aa, Entamoeba histolytica
RKRMSVLVRMWDGTLVL

SEQ ID NO: 2587421 - protein, 20 aa, Entamoeba histolytica
RKRRYCSVLNNTGGFDSNCI

SEQ ID NO: 2587422 - protein, 19 aa, Entamoeba histolytica
RKSMFKSFMNILVKLNAVS

SEQ ID NO: 2587423 - protein, 20 aa, Entamoeba histolytica
RKSMWWISLIVIPIFILIIV

SEQ ID NO: 2587424 - protein, 19 aa, Entamoeba histolytica
RKSNALFYCILIHHQSNTI

SEQ ID NO: 2587425 - protein, 19 aa, Entamoeba histolytica
RKSSALKPVLATLLNIGNF

SEQ ID NO: 2587426 - protein, 28 aa, Entamoeba histolytica
RKSVMIKFLPIYVVVLLIILGGIKLILE

SEQ ID NO: 2587427 - protein, 25 aa, Entamoeba histolytica
RKTAAMCVAKLYFLNQEECVRQGFV

SEQ ID NO: 2587428 - protein, 21 aa, Entamoeba histolytica
RKTEMKETLIAVLNDINAVGF

SEQ ID NO: 2587429 - protein, 18 aa, Entamoeba histolytica
RKTFPSVQTILFTATATE

SEQ ID NO: 2587430 - protein, 17 aa, Entamoeba histolytica
RKVALDLGIKRIYIPTF

SEQ ID NO: 2587431 - protein, 18 aa, Entamoeba histolytica
RKVLYPIQLIWRGLYFIN

SEQ ID NO: 2587432 - protein, 18 aa, Entamoeba histolytica
RKYAYWLIFPHFEEAELS

SEQ ID NO: 2587433 - protein, 25 aa, Entamoeba histolytica
RKYILKMLYIYILGYDVDFGIPIIT

SEQ ID NO: 2587434 - protein, 18 aa, Entamoeba histolytica
RKYIPELFKILKGKDSII

SEQ ID NO: 2587435 - protein, 29 aa, Entamoeba histolytica
RKYSKEQFKAFSQLCEWREKTARNQNISV

SEQ ID NO: 2587436 - protein, 18 aa, Entamoeba histolytica
RKYYSILGKILFQDESCD

SEQ ID NO: 2587437 - protein, 18 aa, Entamoeba histolytica
RLACSCIQYHYNYIKNAQ

SEQ ID NO: 2587438 - protein, 18 aa, Entamoeba histolytica
RLANFGCGGYEKDGNELP

SEQ ID NO: 2587439 - protein, 29 aa, Entamoeba histolytica
RLCEDGKNWREIYKSLLVLDNILKNGSEE

SEQ ID NO: 2587440 - protein, 21 aa, Entamoeba histolytica
RLCFIISLIIVIGYIALIIFI

SEQ ID NO: 2587441 - protein, 18 aa, Entamoeba histolytica
RLDCLPSSCGNKKLDEGE

SEQ ID NO: 2587442 - protein, 18 aa, Entamoeba histolytica
RLDDSVMSDVLWSLSFIA

SEQ ID NO: 2587443 - protein, 18 aa, Entamoeba histolytica
RLDFPKSFSPGICELIKK

SEQ ID NO: 2587444 - protein, 20 aa, Entamoeba histolytica
RLDMVYRSPLYNTFQETLLG

SEQ ID NO: 2587445 - protein, 18 aa, Entamoeba histolytica
RLEFISVLAESDRLYQIN

SEQ ID NO: 2587446 - protein, 17 aa, Entamoeba histolytica
RLEHTLDLMCTLFTKIF

SEQ ID NO: 2587447 - protein, 26 aa, Entamoeba histolytica
RLEIASGMPEWYFLIIQNCWKQNPSE

SEQ ID NO: 2587448 - protein, 19 aa, Entamoeba histolytica
RLERIEKIFYGGRLIMDIN

SEQ ID NO: 2587449 - protein, 25 aa, Entamoeba histolytica
RLFTNWYFLVICGGICICQIIIVQF

SEQ ID NO: 2587450 - protein, 19 aa, Entamoeba histolytica
RLGQLLALGHFPKHIIPFV

SEQ ID NO: 2587451 - protein, 20 aa, Entamoeba histolytica
RLHIPKKCLYHDMIKKCWKG

SEQ ID NO: 2587452 - protein, 17 aa, Entamoeba histolytica
RLHWIEFQNKFYIGDGI

SEQ ID NO: 2587453 - protein, 25 aa, Entamoeba histolytica
RLIDIICSICILFPLIKTLNLLKKN

SEQ ID NO: 2587454 - protein, 21 aa, Entamoeba histolytica
RLIDKCLKKNIQVLHEKELNQ

SEQ ID NO: 2587455 - protein, 18 aa, Entamoeba histolytica
RLIEWGRGITPINIDTSN

SEQ ID NO: 2587456 - protein, 26 aa, Entamoeba histolytica
RLIILRRYFTLMGVLFAIRLVCVYLT

SEQ ID NO: 2587457 - protein, 18 aa, Entamoeba histolytica
RLILLIMCINIVNSTDNS

SEQ ID NO: 2587458 - protein, 17 aa, Entamoeba histolytica
RLINADIEILLPQDNAF

SEQ ID NO: 2587459 - protein, 19 aa, Entamoeba histolytica
RLINCIKTTLIKIALITIE

SEQ ID NO: 2587460 - protein, 30 aa, Entamoeba histolytica
RLIPFLRIFELFMIDILYAFYAFNLKLQLR

SEQ ID NO: 2587461 - protein, 21 aa, Entamoeba histolytica
RLKDTSIPFVENWENESTKSE

SEQ ID NO: 2587462 - protein, 18 aa, Entamoeba histolytica
RLLARLTLIYPLISMTTY

SEQ ID NO: 2587463 - protein, 20 aa, Entamoeba histolytica
RLLLGPILVEAIRIIKNYKE

SEQ ID NO: 2587464 - protein, 17 aa, Entamoeba histolytica
RLLWFNSHGFLHLVMKC

SEQ ID NO: 2587465 - protein, 26 aa, Entamoeba histolytica
RLLYSSPIIPMFILCSIFITHRNELF

SEQ ID NO: 2587466 - protein, 25 aa, Entamoeba histolytica
RLNLKEIPWMILGFIGSMIYGALFP

SEQ ID NO: 2587467 - protein, 17 aa, Entamoeba histolytica
RLPTCSFTTEMCKTCKN

SEQ ID NO: 2587468 - protein, 17 aa, Entamoeba histolytica
RLQREYAAFLKSPPPDM

SEQ ID NO: 2587469 - protein, 20 aa, Entamoeba histolytica
RLSDCVYLDKTLLEMIKKKI

SEQ ID NO: 2587470 - protein, 17 aa, Entamoeba histolytica
RLSHHVLKGLDLEIKKG

SEQ ID NO: 2587471 - protein, 25 aa, Entamoeba histolytica
RLSKAMKNFLFWGIGACVYLFIYIV

SEQ ID NO: 2587472 - protein, 18 aa, Entamoeba histolytica
RLSKAQCMDALSSQNNLA

SEQ ID NO: 2587473 - protein, 19 aa, Entamoeba histolytica
RLSKAQCMDALSSQNNLAG

SEQ ID NO: 2587474 - protein, 20 aa, Entamoeba histolytica
RLSKLPLSFIDLKTPLKLIT

SEQ ID NO: 2587475 - protein, 21 aa, Entamoeba histolytica
RLSNACVIGLFVVLGNSVTVK

SEQ ID NO: 2587476 - protein, 20 aa, Entamoeba histolytica
RLSTISVAICKTKTAKEYLE

SEQ ID NO: 2587477 - protein, 19 aa, Entamoeba histolytica
RLTLNIDIFIITFIATLFV

SEQ ID NO: 2587478 - protein, 25 aa, Entamoeba histolytica
RLVDALKLKGYRIIENSNIIAQYLS

SEQ ID NO: 2587479 - protein, 19 aa, Entamoeba histolytica
RLVKCNLEKKGWKIKICEK

SEQ ID NO: 2587480 - protein, 24 aa, Entamoeba histolytica
RLVNSICLYSPFPYGYESETLYGM

SEQ ID NO: 2587481 - protein, 40 aa, Entamoeba histolytica; identical to SEQ ID NO: 2389694

SEQ ID NO: 2587482 - protein, 19 aa, Entamoeba histolytica
RLVVKRICKEPISMMDNIF

SEQ ID NO: 2587483 - protein, 19 aa, Entamoeba histolytica
RLVVPVTYFINPKPSVDRS

SEQ ID NO: 2587484 - protein, 21 aa, Entamoeba histolytica
RLYPHVVRQFHMEVALNDHGL

SEQ ID NO: 2587485 - protein, 19 aa, Entamoeba histolytica
RLYTPIVNFMAKFFCNVPS

SEQ ID NO: 2587486 - protein, 17 aa, Entamoeba histolytica
RMIRFMIINDIPFIEIL

SEQ ID NO: 2587487 - protein, 21 aa, Entamoeba histolytica
RMKDLWRKDDFEEFRKEIDLL

SEQ ID NO: 2587488 - protein, 18 aa, Entamoeba histolytica
RMKLSYYTKDLYRMTSRS

SEQ ID NO: 2587489 - protein, 24 aa, Entamoeba histolytica
RMSEFPPSLCLMTKLNKISLQRNE

SEQ ID NO: 2587490 - protein, 24 aa, Entamoeba histolytica
RMSIIPICEIRDVFGNVVFNENLL

SEQ ID NO: 2587491 - protein, 20 aa, Entamoeba histolytica
RMTVVNGWFGGIKMETRDQK

SEQ ID NO: 2587492 - protein, 21 aa, Entamoeba histolytica
RMVIWRVSRGFVVTRSAPIDN

SEQ ID NO: 2587493 - protein, 19 aa, Entamoeba histolytica
RMVLFTAAVSLIFTSPFTY

SEQ ID NO: 2587494 - protein, 19 aa, Entamoeba histolytica
RNAYVNWFLAFVGGLAGGF

SEQ ID NO: 2587495 - protein, 23 aa, Entamoeba histolytica
RNDCAYSFIPYQVLTNYMKLNPE

SEQ ID NO: 2587496 - protein, 18 aa, Entamoeba histolytica
RNFFKNIIPILSYAIGGC

SEQ ID NO: 2587497 - protein, 18 aa, Entamoeba histolytica
RNGICVIVNQTLHPLTLS

SEQ ID NO: 2587498 - protein, 18 aa, Entamoeba histolytica
RNGLIGLIFEKALKLNSA

SEQ ID NO: 2587499 - protein, 17 aa, Entamoeba histolytica
RNGLLLFVTTLRIGALT

SEQ ID NO: 2587500 - protein, 20 aa, Entamoeba histolytica
RNILDPCRMISIWFLSVLMY

SEQ ID NO: 2587501 - protein, 17 aa, Entamoeba histolytica
RNILLPFNILYVTKNSS

SEQ ID NO: 2587502 - protein, 19 aa, Entamoeba histolytica
RNISPKPVMPSLMKLLDSP

SEQ ID NO: 2587503 - protein, 21 aa, Entamoeba histolytica
RNLPYPQIISLKFDDEEINVQ

SEQ ID NO: 2587504 - protein, 25 aa, Entamoeba histolytica
RNNHSFKQFIVHLLFSIPVGIILVF

SEQ ID NO: 2587505 - protein, 20 aa, Entamoeba histolytica
RNQSYLMMLMFSFIGVSGLL

SEQ ID NO: 2587506 - protein, 20 aa, Entamoeba histolytica
RNRIITFFLIFSIAIFFWLV

SEQ ID NO: 2587507 - protein, 24 aa, Entamoeba histolytica
RNSEIIKICFYKNASFFLILLWYS

SEQ ID NO: 2587508 - protein, 24 aa, Entamoeba histolytica
RNSEKICAFKMKYSNLHFSSINEK

SEQ ID NO: 2587509 - protein, 24 aa, Entamoeba histolytica
RNSELYYRSIEFLKQLPDIDKIIT

SEQ ID NO: 2587510 - protein, 24 aa, Entamoeba histolytica
RNSKRFSMRKTLLLEKVHFDVKIT

SEQ ID NO: 2587511 - protein, 27 aa, Entamoeba histolytica
RNTELIRLVSFGMFKGALITLMVEIGP

SEQ ID NO: 2587512 - protein, 18 aa, Entamoeba histolytica
RNTINGRHSIMCQPISQM

SEQ ID NO: 2587513 - protein, 24 aa, Entamoeba histolytica
RNTLKTLFTYGILLSDSWNVLMIK

SEQ ID NO: 2587514 - protein, 17 aa, Entamoeba histolytica
RNVQCPVCNGSGAAHSH

SEQ ID NO: 2587515 - protein, 30 aa, Entamoeba histolytica; identical to SEQ ID NO: 2389739

SEQ ID NO: 2587516 - protein, 24 aa, Entamoeba histolytica
RNWITDCFFLFITLVAGTGIYAAV

SEQ ID NO: 2587517 - protein, 17 aa, Entamoeba histolytica
RNYCLKCLNGYKIENNK

SEQ ID NO: 2587518 - protein, 18 aa, Entamoeba histolytica
RNYCLKCSNGYKIENNTC

SEQ ID NO: 2587519 - protein, 27 aa, Entamoeba histolytica
RPELWRMIPVIIPMFLAGIIVLTRTRD

SEQ ID NO: 2587520 - protein, 18 aa, Entamoeba histolytica
RPFMIIGLGVWLFGAIII

SEQ ID NO: 2587521 - protein, 19 aa, Entamoeba histolytica
RPFVRAVGEYVLIGNAESL

SEQ ID NO: 2587522 - protein, 19 aa, Entamoeba histolytica
RPHQYGIVIEIYRKENIPL

SEQ ID NO: 2587523 - protein, 22 aa, Entamoeba histolytica
RPKIEKEFREQLIIEQERLKQK

SEQ ID NO: 2587524 - protein, 17 aa, Entamoeba histolytica
RPPPEEEKGFFAKYWVW

SEQ ID NO: 2587525 - protein, 19 aa, Entamoeba histolytica
RPQIVDMRETIWLLHDQEL

SEQ ID NO: 2587526 - protein, 17 aa, Entamoeba histolytica
RPSHHVLKGIDIEIKKG

SEQ ID NO: 2587527 - protein, 18 aa, Entamoeba histolytica
RPSHHVLKGIDLEIKKGE

SEQ ID NO: 2587528 - protein, 18 aa, Entamoeba histolytica
RPSLYKLGKISSLLFSVG

SEQ ID NO: 2587529 - protein, 20 aa, Entamoeba histolytica
RPVLYVSVGTLAFVGETLTF

SEQ ID NO: 2587530 - protein, 23 aa, Entamoeba histolytica
RQADGSGLQHCLIDGASKIVQSG

SEQ ID NO: 2587531 - protein, 17 aa, Entamoeba histolytica
RQCCEVPIMKKTASNFG

SEQ ID NO: 2587532 - protein, 29 aa, Entamoeba histolytica
RQENIRKGIYFCLGSFLVIGLEFFMLLMS

SEQ ID NO: 2587533 - protein, 26 aa, Entamoeba histolytica
RQFERSNFLFVLGIFFPLLQWINWMC

SEQ ID NO: 2587534 - protein, 18 aa, Entamoeba histolytica
RQGGALLIPGSVIVKNLK

SEQ ID NO: 2587535 - protein, 17 aa, Entamoeba histolytica
RQHFLRMIDDCVSYIPS

SEQ ID NO: 2587536 - protein, 26 aa, Entamoeba histolytica
RQHSSRMKPLLTFFLSLYPYWNPYDP

SEQ ID NO: 2587537 - protein, 27 aa, Entamoeba histolytica
RQKYLNCMLEHLSLIFTQRSCSTNQTN

SEQ ID NO: 2587538 - protein, 23 aa, Entamoeba histolytica
RQLICLARGLLSRSKVIVLDEAT

SEQ ID NO: 2587539 - protein, 17 aa, Entamoeba histolytica
RQLKYWGTLVIVYWIFF

SEQ ID NO: 2587540 - protein, 19 aa, Entamoeba histolytica
RQMCYEVIEKKDIISSDMV

SEQ ID NO: 2587541 - protein, 18 aa, Entamoeba histolytica
RQPQPGTWFFLKGADETI

SEQ ID NO: 2587542 - protein, 27 aa, Entamoeba histolytica
RQRTSIRFYLPRGLLCGLLFSLILASF

SEQ ID NO: 2587543 - protein, 21 aa, Entamoeba histolytica
RQTFSPIPWNCMKYEVKSSQK

SEQ ID NO: 2587544 - protein, 21 aa, Entamoeba histolytica
RQVRARVSVLLKDAAEQRNEH

SEQ ID NO: 2587545 - protein, 21 aa, Entamoeba histolytica
RRERLWGVSMLIYAILMMIVV

SEQ ID NO: 2587546 - protein, 26 aa, Entamoeba histolytica
RRFKHLTKLILFYGRNGKYQITTLIK

SEQ ID NO: 2587547 - protein, 32 aa, Entamoeba histolytica
RRFQSFLYHCCEVLYAWSCIDVFVVSVIAAIV

SEQ ID NO: 2587548 - protein, 19 aa, Entamoeba histolytica
RRFVTLMGVMFLMRIICVY

SEQ ID NO: 2587549 - protein, 17 aa, Entamoeba histolytica
RRGCDLCDANECFSCQP

SEQ ID NO: 2587550 - protein, 31 aa, Entamoeba histolytica
RRGKQIYSIFCSLRILLLDVLTQILKSIPEE

SEQ ID NO: 2587551 - protein, 17 aa, Entamoeba histolytica
RRICHFGIFCYVLCQIN

SEQ ID NO: 2587552 - protein, 24 aa, Entamoeba histolytica
RRIEHLRILYDMTMNQFTKENCQI

SEQ ID NO: 2587553 - protein, 17 aa, Entamoeba histolytica
RRKEIIQNQIIKKDDAK

SEQ ID NO: 2587554 - protein, 21 aa, Entamoeba histolytica
RRLHVFGEIFAENGFLQRSDQ

SEQ ID NO: 2587555 - protein, 19 aa, Entamoeba histolytica
RRLYFKSLLRQDAIWYDFQ

SEQ ID NO: 2587556 - protein, 17 aa, Entamoeba histolytica
RRMYLPWALVVLNFILG

SEQ ID NO: 2587557 - protein, 22 aa, Entamoeba histolytica
RRNTLIVKLSFYKNVAFILMQF

SEQ ID NO: 2587558 - protein, 21 aa, Entamoeba histolytica
RRPLAVFPIVLFFTMLSWLTL

SEQ ID NO: 2587559 - protein, 17 aa, Entamoeba histolytica
RRQVLLVDFAVAWPDDN

SEQ ID NO: 2587560 - protein, 17 aa, Entamoeba histolytica
RRRGKLFKTQKEYYERI

SEQ ID NO: 2587561 - protein, 17 aa, Entamoeba histolytica
RRRMYRSLSCIYENNGN

SEQ ID NO: 2587562 - protein, 21 aa, Entamoeba histolytica
RRRPIMILGLGIWFVGSFGTL

SEQ ID NO: 2587563 - protein, 19 aa, Entamoeba histolytica
RRSESPRPILSDAEDEDIA

SEQ ID NO: 2587564 - protein, 19 aa, Entamoeba histolytica
RRSTAPISIEDFVTYKKSD

SEQ ID NO: 2587565 - protein, 21 aa, Entamoeba histolytica
RRTEFLFSYLQSIGYDLYNYK

SEQ ID NO: 2587566 - protein, 19 aa, Entamoeba histolytica
RRVIESIHLKKEWNKKEII

SEQ ID NO: 2587567 - protein, 19 aa, Entamoeba histolytica
RRWILSMFIFSLIGLSSSF

SEQ ID NO: 2587568 - protein, 21 aa, Entamoeba histolytica
RRWSTRIFLQRHILINVISLL

SEQ ID NO: 2587569 - protein, 27 aa, Entamoeba histolytica
RRYCFWKFHATFCIASLFMLQNMTDWS

SEQ ID NO: 2587570 - protein, 18 aa, Entamoeba histolytica
RRYVICKGQTEPQPDSSC

SEQ ID NO: 2587571 - protein, 22 aa, Entamoeba histolytica
RSACSRMLYLRLPTLLLQTPST

SEQ ID NO: 2587572 - protein, 20 aa, Entamoeba histolytica
RSAFYKFTLKQNMPIEISTC

SEQ ID NO: 2587573 - protein, 21 aa, Entamoeba histolytica
RSCIAEMYFSYVNYVCIEYKR

SEQ ID NO: 2587574 - protein, 21 aa, Entamoeba histolytica
RSEEWKKTQKLLGKTNQLIGT

SEQ ID NO: 2587575 - protein, 19 aa, Entamoeba histolytica
RSEGRIIVLACYIGKETKS

SEQ ID NO: 2587576 - protein, 22 aa, Entamoeba histolytica
RSENYRFILSLNILCDLLSEFG

SEQ ID NO: 2587577 - protein, 24 aa, Entamoeba histolytica
RSFGSKRVVLFVDIILFIVTFILF

SEQ ID NO: 2587578 - protein, 25 aa, Entamoeba histolytica
RSGAIVVCAPIAPYREIRDEVRKMV

SEQ ID NO: 2587579 - protein, 21 aa, Entamoeba histolytica
RSGSKSRLGIVYKNPSLKHSA

SEQ ID NO: 2587580 - protein, 26 aa, Entamoeba histolytica
RSHSIKVCTCFMTLHCTTKIFGLKIH

SEQ ID NO: 2587581 - protein, 17 aa, Entamoeba histolytica
RSIIFPLRMSKGGKMPI

SEQ ID NO: 2587582 - protein, 17 aa, Entamoeba histolytica
RSIKTSGKRMVITEIDA

SEQ ID NO: 2587583 - protein, 22 aa, Entamoeba histolytica
RSILELWILPEYVMTTKKMLND

SEQ ID NO: 2587584 - protein, 19 aa, Entamoeba histolytica
RSIPVAIKMFKWENLTEEQ

SEQ ID NO: 2587585 - protein, 28 aa, Entamoeba histolytica
RSKCGVVADGLKGKWFVYTPKETEKVLI

SEQ ID NO: 2587586 - protein, 20 aa, Entamoeba histolytica
RSKHLISILFCEATAIYGVI

SEQ ID NO: 2587587 - protein, 22 aa, Entamoeba histolytica
RSLCIPYLRYVPNADGIRKRKP

SEQ ID NO: 2587588 - protein, 18 aa, Entamoeba histolytica
RSLCSSLVNYNWLSEQLM

SEQ ID NO: 2587589 - protein, 17 aa, Entamoeba histolytica
RSLIKKNWFYLFGTAGC

SEQ ID NO: 2587590 - protein, 17 aa, Entamoeba histolytica
RSNCSHHLICLNHYKRF

SEQ ID NO: 2587591 - protein, 20 aa, Entamoeba histolytica
RSNNPLSMELRMKIMLDAAK

SEQ ID NO: 2587592 - protein, 27 aa, Entamoeba histolytica
RSPFRGEVLFALIGPALCDFLGGYLMN

SEQ ID NO: 2587593 - protein, 20 aa, Entamoeba histolytica
RSQILFFIVWVTRYLDIFYN

SEQ ID NO: 2587594 - protein, 22 aa, Entamoeba histolytica
RSQLKRVLFSFLRSGEEYCQGI

SEQ ID NO: 2587595 - protein, 17 aa, Entamoeba histolytica
RSSDIICSMKKEGIQSG

SEQ ID NO: 2587596 - protein, 24 aa, Entamoeba histolytica
RSSVRIILCSVGFLLYIIFSYLCM

SEQ ID NO: 2587597 - protein, 18 aa, Entamoeba histolytica
RSSVYTWEHVLIIIPPIF

SEQ ID NO: 2587598 - protein, 22 aa, Entamoeba histolytica
RSTMKGTILLRNEIVKQGFEYY

SEQ ID NO: 2587599 - protein, 23 aa, Entamoeba histolytica
RSTNEYCVILLKALQGLIPDIIM

SEQ ID NO: 2587600 - protein, 18 aa, Entamoeba histolytica
RSVCYLCNKHIFNDFVLY

SEQ ID NO: 2587601 - protein, 24 aa, Entamoeba histolytica
RSVTELWEKIDFFGERDDNLHNET

SEQ ID NO: 2587602 - protein, 19 aa, Entamoeba histolytica
RSVYNFAPYIKNYYIVTMG

SEQ ID NO: 2587603 - protein, 17 aa, Entamoeba histolytica
RTDEVKVKTQITEDANT

SEQ ID NO: 2587604 - protein, 26 aa, Entamoeba histolytica
RTEQCLPCPKGSYFVNNKCLLCEEGT

SEQ ID NO: 2587605 - protein, 39 aa, Entamoeba histolytica
RTFLKPFKLFKCKEFGDVIARIAVVWSFEHADILFFQGL

SEQ ID NO: 2587606 - protein, 21 aa, Entamoeba histolytica
RTFYRSCLYDSLAPGDKQAAC

SEQ ID NO: 2587607 - protein, 20 aa, Entamoeba histolytica
RTGKILPIEYILVSLKHQNL

SEQ ID NO: 2587608 - protein, 19 aa, Entamoeba histolytica
RTHHCSVCNQCVVRYDHHC

SEQ ID NO: 2587609 - protein, 25 aa, Entamoeba histolytica
RTHKFRLGNDLAIPFLHGAYSVESN

SEQ ID NO: 2587610 - protein, 18 aa, Entamoeba histolytica
RTIIRTRFVLPSLLTRQV

SEQ ID NO: 2587611 - protein, 27 aa, Entamoeba histolytica
RTIKKLKLSNSCPLIIETEIKVEEVDT

SEQ ID NO: 2587612 - protein, 27 aa, Entamoeba histolytica
RTIKTLKLSKSCPLIIETEIKVEKVES

SEQ ID NO: 2587613 - protein, 17 aa, Entamoeba histolytica
RTIPFISANSIYLNCSN

SEQ ID NO: 2587614 - protein, 27 aa, Entamoeba histolytica
RTLFRMEWGHFLICFIAIMISQLSTLV

SEQ ID NO: 2587615 - protein, 26 aa, Entamoeba histolytica
RTMGIRLRFSYCETYKLNYQFNETIP

SEQ ID NO: 2587616 - protein, 17 aa, Entamoeba histolytica
RTMIITYKEFIFKRPNN

SEQ ID NO: 2587617 - protein, 19 aa, Entamoeba histolytica
RTNILSLENFFFKNFENTN

SEQ ID NO: 2587618 - protein, 17 aa, Entamoeba histolytica
RTPRLICNNRKKVRKSR

SEQ ID NO: 2587619 - protein, 25 aa, Entamoeba histolytica
RTQSSFYSLVSWCMGTTEHLDYFDT

SEQ ID NO: 2587620 - protein, 31 aa, Entamoeba histolytica
RTSTFYGYYMKYRLLCHNKLIRFFIGELIGS

SEQ ID NO: 2587621 - protein, 28 aa, Entamoeba histolytica
RTSYQNFISRFGVKFTITSNNHLKGEPT

SEQ ID NO: 2587622 - protein, 28 aa, Entamoeba histolytica
RTSYQNFISRFGVKFTITSNNHLKGKPT

SEQ ID NO: 2587623 - protein, 19 aa, Entamoeba histolytica
RTTTLPQFYVPNSNIHIPS

SEQ ID NO: 2587624 - protein, 21 aa, Entamoeba histolytica
RTTYEGNHLWKGEYRSKLEEL

SEQ ID NO: 2587625 - protein, 20 aa, Entamoeba histolytica
RVCDLLFHLTNAIRFTSLIT

SEQ ID NO: 2587626 - protein, 26 aa, Entamoeba histolytica
RVCVILCCLCPAPSVNIIYCVEYNVA

SEQ ID NO: 2587627 - protein, 23 aa, Entamoeba histolytica
RVDYPLWFLCLYDAAGRASKALE

SEQ ID NO: 2587628 - protein, 18 aa, Entamoeba histolytica
RVELKCENGISFTCGNVE

SEQ ID NO: 2587629 - protein, 23 aa, Entamoeba histolytica
RVGMRKTRMGLYAKENESLRASE

SEQ ID NO: 2587630 - protein, 20 aa, Entamoeba histolytica
RVIFTTALTLAWVFGISTVI

SEQ ID NO: 2587631 - protein, 18 aa, Entamoeba histolytica
RVIMPFLILLNIALFITS

SEQ ID NO: 2587632 - protein, 30 aa, Entamoeba histolytica; identical to SEQ ID NO: 2389844

SEQ ID NO: 2587633 - protein, 23 aa, Entamoeba histolytica
RVKRIITRLLGFREISSISRSLT

SEQ ID NO: 2587634 - protein, 26 aa, Entamoeba histolytica
RVLSRICFLCGLFGGIKSNQLDNIKK

SEQ ID NO: 2587635 - protein, 17 aa, Entamoeba histolytica
RVLTWGQLPITSHWGTI

SEQ ID NO: 2587636 - protein, 24 aa, Entamoeba histolytica
RVNSIRCNLHLSSGPFIINSLSGS

SEQ ID NO: 2587637 - protein, 23 aa, Entamoeba histolytica
RVQDVLSLLTLIGIIYDNETLTS

SEQ ID NO: 2587638 - protein, 24 aa, Entamoeba histolytica
RVQRFSVCFFKMLYFFITAPLGVG

SEQ ID NO: 2587639 - protein, 18 aa, Entamoeba histolytica
RVSGKIRLFIVSRYQSNY

SEQ ID NO: 2587640 - protein, 21 aa, Entamoeba histolytica
RVTIRQKYCEIWKIKKRQMMI

SEQ ID NO: 2587641 - protein, 23 aa, Entamoeba histolytica
RVTLKMPSMDVVWLKSDEYKENI

SEQ ID NO: 2587642 - protein, 25 aa, Entamoeba histolytica
RVVFDLLLEQYFRYFFMHWCDSVQF

SEQ ID NO: 2587643 - protein, 21 aa, Entamoeba histolytica
RVVWEWKTYHFLTLSLFTFFF

SEQ ID NO: 2587644 - protein, 35 aa, Entamoeba histolytica
RVYFSLKKDIYWWIVDHWYCFGSLQQCLLKTSPSK

SEQ ID NO: 2587645 - protein, 27 aa, Entamoeba histolytica
RWILDSLKILIGFVIILLCCVLIWKSH

SEQ ID NO: 2587646 - protein, 20 aa, Entamoeba histolytica
RWRIFLERIYEYSGIIPISV

SEQ ID NO: 2587647 - protein, 26 aa, Entamoeba histolytica
RWVILACSIARCVFYVPLFIYYYNVY

SEQ ID NO: 2587648 - protein, 17 aa, Entamoeba histolytica
RWYCGRYLLDPTSNGSS

SEQ ID NO: 2587649 - protein, 25 aa, Entamoeba histolytica
RWYVVLCSFVGWYLAFLSPLLMPLD

SEQ ID NO: 2587650 - protein, 26 aa, Entamoeba histolytica
RWYVVLCSFVGWYLAFLSPLLMPLDI

SEQ ID NO: 2587651 - protein, 29 aa, Entamoeba histolytica
RYCAVLFKRLKHWVLGVGSFVLGLLFYLV

SEQ ID NO: 2587652 - protein, 20 aa, Entamoeba histolytica
RYCRMRGYNTLYVCGTDEYG

SEQ ID NO: 2587653 - protein, 21 aa, Entamoeba histolytica
RYCYRQIGITLFYLIYKNVIL

SEQ ID NO: 2587654 - protein, 17 aa, Entamoeba histolytica
RYEKVIGTLCENLDSLD

SEQ ID NO: 2587655 - protein, 24 aa, Entamoeba histolytica
RYFDEVFKGLILLHFLCQNGNCII

SEQ ID NO: 2587656 - protein, 22 aa, Entamoeba histolytica
RYFESKLAVGMFIHQFAKEHPD

SEQ ID NO: 2587657 - protein, 25 aa, Entamoeba histolytica
RYGNIGRAFSFPVIVRVYSIAGTYV

SEQ ID NO: 2587658 - protein, 18 aa, Entamoeba histolytica
RYIEVVLMICHMFCCSPL

SEQ ID NO: 2587659 - protein, 23 aa, Entamoeba histolytica
RYIKKPEIICIGVAKDNHSDPKA

SEQ ID NO: 2587660 - protein, 26 aa, Entamoeba histolytica
RYIPKKWKIVQLWNGRVIILMIRTTI

SEQ ID NO: 2587661 - protein, 19 aa, Entamoeba histolytica
RYITLPSAIIITILSVILS

SEQ ID NO: 2587662 - protein, 20 aa, Entamoeba histolytica
RYKEYKCTFPGCNEPAKTKY

SEQ ID NO: 2587663 - protein, 18 aa, Entamoeba histolytica
RYKLCLNIFAFEVCCLVI

SEQ ID NO: 2587664 - protein, 22 aa, Entamoeba histolytica
RYKRSVWYKVFVPRRGTISVNT

SEQ ID NO: 2587665 - protein, 20 aa, Entamoeba histolytica
RYLPSNPRLKHFVYSIIGVI

SEQ ID NO: 2587666 - protein, 17 aa, Entamoeba histolytica
RYLPVLFGVFWMALCGY

SEQ ID NO: 2587667 - protein, 28 aa, Entamoeba histolytica
RYNKIVQYILRYPRRCSTHIYPRKATIW

SEQ ID NO: 2587668 - protein, 21 aa, Entamoeba histolytica
RYNSYLSKRMRVILSTEKDII

SEQ ID NO: 2587669 - protein, 20 aa, Entamoeba histolytica
RYSYESFYRYIKSIFNKTIQ

SEQ ID NO: 2587670 - protein, 19 aa, Entamoeba histolytica
RYTGGELFYYPNYSTKNQI

SEQ ID NO: 2587671 - protein, 18 aa, Entamoeba histolytica
RYVDDDCTVNNPVFISYK

SEQ ID NO: 2587672 - protein, 20 aa, Entamoeba histolytica
RYVQCFWSKGQFTDCTCKPE

SEQ ID NO: 2587673 - protein, 17 aa, Entamoeba histolytica
RYWDPRGAEELIKNKEV

SEQ ID NO: 2587674 - protein, 24 aa, Entamoeba histolytica
SAAFWAFSALTFWPAAVGTIGKEA

SEQ ID NO: 2587675 - protein, 25 aa, Entamoeba histolytica
SAAFWALSAFTFWPAAVGTVGKEAG

SEQ ID NO: 2587676 - protein, 17 aa, Entamoeba histolytica
SACNCVYGSEPVNINGI

SEQ ID NO: 2587677 - protein, 29 aa, Entamoeba histolytica
SACSCVTKGLKECRGAILVGFDGDPYGKD

SEQ ID NO: 2587678 - protein, 30 aa, Entamoeba histolytica
SACSILTKGLKEWGSAILVGFNGDPNGKDE

SEQ ID NO: 2587679 - protein, 19 aa, Entamoeba histolytica
SADVYARYCRMRGYNTLYV

SEQ ID NO: 2587680 - protein, 17 aa, Entamoeba histolytica
SAFLHTLRLHWVEFQNK

SEQ ID NO: 2587681 - protein, 20 aa, Entamoeba histolytica
SAIFCGILALLLFLKQSHSK

SEQ ID NO: 2587682 - protein, 19 aa, Entamoeba histolytica
SAIGEINPLFPISVEEMKK

SEQ ID NO: 2587683 - protein, 17 aa, Entamoeba histolytica
SAISLACQFQLLFFINV

SEQ ID NO: 2587684 - protein, 24 aa, Entamoeba histolytica
SAKCIKYGNKYMKVYTQSVKPSTD

SEQ ID NO: 2587685 - protein, 20 aa, Entamoeba histolytica
SAKLRCWDTVYVQRTTSIDT

SEQ ID NO: 2587686 - protein, 22 aa, Entamoeba histolytica
SAKSFPGVWFKFTSTKNGYYSI

SEQ ID NO: 2587687 - protein, 20 aa, Entamoeba histolytica
SALAFEWIGIFVFILVFIYW

SEQ ID NO: 2587688 - protein, 17 aa, Entamoeba histolytica
SALECLEQVVGCTDYVY

SEQ ID NO: 2587689 - protein, 18 aa, Entamoeba histolytica
SALFISILIPFVLGSISS

SEQ ID NO: 2587690 - protein, 18 aa, Entamoeba histolytica
SALFRCALLLISSLSSSN

SEQ ID NO: 2587691 - protein, 18 aa, Entamoeba histolytica
SALIKGFTMTSGIINLQN

SEQ ID NO: 2587692 - protein, 22 aa, Entamoeba histolytica
SALPRATKLLLLLGDAPTPTFK

SEQ ID NO: 2587693 - protein, 20 aa, Entamoeba histolytica
SALSCFAFSGIIFCILSIVL

SEQ ID NO: 2587694 - protein, 18 aa, Entamoeba histolytica
SAMGCLSVLISEAHKLLL

SEQ ID NO: 2587695 - protein, 17 aa, Entamoeba histolytica
SAMKGWKNPAFGEWCIQ

SEQ ID NO: 2587696 - protein, 20 aa, Entamoeba histolytica
SANNWKYIWHIKLLNNTTVL

SEQ ID NO: 2587697 - protein, 23 aa, Entamoeba histolytica
SANRLLMSVSFCAILGGMNSILG

SEQ ID NO: 2587698 - protein, 26 aa, Entamoeba histolytica
SAQCCLKVHLIIALVICILAMIYKVN

SEQ ID NO: 2587699 - protein, 32 aa, Entamoeba histolytica
SASILIHVVDPFSSLCAGRCRNVIDMAVHSTT

SEQ ID NO: 2587700 - protein, 17 aa, Entamoeba histolytica
SASIPLLLIDGKWTISG

SEQ ID NO: 2587701 - protein, 28 aa, Entamoeba histolytica
SATTFIFCIICVFIFGICFSIYHYFKSR

SEQ ID NO: 2587702 - protein, 19 aa, Entamoeba histolytica
SAVGLCIIGSVFVGEAPLN

SEQ ID NO: 2587703 - protein, 26 aa, Entamoeba histolytica
SAVILWKALCIFFFTEAPIVVILSGS

SEQ ID NO: 2587704 - protein, 18 aa, Entamoeba histolytica
SAVSIPIKIQIPSLSTLN

SEQ ID NO: 2587705 - protein, 20 aa, Entamoeba histolytica
SAYSRTVYNIAVAQKERTAR

SEQ ID NO: 2587706 - protein, 20 aa, Entamoeba histolytica
SAYWIAHFIQNMIISFFLCW

SEQ ID NO: 2587707 - protein, 17 aa, Entamoeba histolytica
SCADKYLNCLVCSEEGC

SEQ ID NO: 2587708 - protein, 23 aa, Entamoeba histolytica
SCELKYKLIYNLDAYEVFCPFPQ

SEQ ID NO: 2587709 - protein, 18 aa, Entamoeba histolytica
SCEYQCFGKGIKVNKQNN

SEQ ID NO: 2587710 - protein, 22 aa, Entamoeba histolytica
SCFATPCKFGLTPSSTELFDCL

SEQ ID NO: 2587711 - protein, 24 aa, Entamoeba histolytica
SCGFNIKFSFALLILMVSLIVAII

SEQ ID NO: 2587712 - protein, 24 aa, Entamoeba histolytica
SCGTCSTGYVCTKSGMCVEEPNMN

SEQ ID NO: 2587713 - protein, 18 aa, Entamoeba histolytica
SCHSCFDKSSGISKVTCT

SEQ ID NO: 2587714 - protein, 18 aa, Entamoeba histolytica
SCHSRFYLNDGECLPCPT

SEQ ID NO: 2587715 - protein, 17 aa, Entamoeba histolytica
SCICSAYTYDENDLLSF

SEQ ID NO: 2587716 - protein, 17 aa, Entamoeba histolytica
SCIKCQPGYSINKDKTT

SEQ ID NO: 2587717 - protein, 21 aa, Entamoeba histolytica
SCILLIASCFFAFFESRRQGN

SEQ ID NO: 2587718 - protein, 23 aa, Entamoeba histolytica
SCISSLLRMLSIPSIRKDVLQLV

SEQ ID NO: 2587719 - protein, 23 aa, Entamoeba histolytica
SCLGPRMVFRIGNYYTILDGLLM

SEQ ID NO: 2587720 - protein, 20 aa, Entamoeba histolytica
SCLLLYKHFYIIQSPQLFHP

SEQ ID NO: 2587721 - protein, 20 aa, Entamoeba histolytica
SCLVSLEFSKMFQMLFMSFD

SEQ ID NO: 2587722 - protein, 22 aa, Entamoeba histolytica
SCNRCIKCKPSYGVVNGTCAQP

SEQ ID NO: 2587723 - protein, 22 aa, Entamoeba histolytica
SCPSAYCSSCNSQGCTECIDNY

SEQ ID NO: 2587724 - protein, 17 aa, Entamoeba histolytica
SCQHCLWIDPYKNSNKA

SEQ ID NO: 2587725 - protein, 24 aa, Entamoeba histolytica
SCRKIPVWLYWVLYVLTIFILYWI

SEQ ID NO: 2587726 - protein, 20 aa, Entamoeba histolytica
SCRSLEIGLFLKIETSSGVC

SEQ ID NO: 2587727 - protein, 22 aa, Entamoeba histolytica
SCSQSKFIASLPFTQQLMQNHA

SEQ ID NO: 2587728 - protein, 21 aa, Entamoeba histolytica
SCTFGYLCFLILIKWMFFIED

SEQ ID NO: 2587729 - protein, 26 aa, Entamoeba histolytica
SCVPLYRPLTVILFFLITGIIFIPIG

SEQ ID NO: 2587730 - protein, 19 aa, Entamoeba histolytica
SCVVSDTFRSNSFSETASD

SEQ ID NO: 2587731 - protein, 23 aa, Entamoeba histolytica
SCYDRIIKPLGIFFFLSSGVYLF

SEQ ID NO: 2587732 - protein, 19 aa, Entamoeba histolytica
SDASPVYLTFYYLVNILIN

SEQ ID NO: 2587733 - protein, 20 aa, Entamoeba histolytica
SDCHKKCWYNNQWTIGNGEG

SEQ ID NO: 2587734 - protein, 17 aa, Entamoeba histolytica
SDCSFYLNELCILCEEG

SEQ ID NO: 2587735 - protein, 17 aa, Entamoeba histolytica
SDCYINEHLIRVNKTSN

SEQ ID NO: 2587736 - protein, 26 aa, Entamoeba histolytica
SDDYFQCFIPFISILIGNIFPSLIPL

SEQ ID NO: 2587737 - protein, 22 aa, Entamoeba histolytica
SDEEMKRVLKLVNSVNELDDVV

SEQ ID NO: 2587738 - protein, 19 aa, Entamoeba histolytica
SDEHFPLLNVIDGDDPVVL

SEQ ID NO: 2587739 - protein, 18 aa, Entamoeba histolytica
SDEMCALVIYTGNDTRLA

SEQ ID NO: 2587740 - protein, 27 aa, Entamoeba histolytica
SDERYFKVARDWFLFLMSHDATLFISI

SEQ ID NO: 2587741 - protein, 29 aa, Entamoeba histolytica
SDETIKLFIDCVLPMYWSIRSSRNTHLFF

SEQ ID NO: 2587742 - protein, 20 aa, Entamoeba histolytica
SDFFIIFDILHICKSSLMTN

SEQ ID NO: 2587743 - protein, 22 aa, Entamoeba histolytica
SDFILHNALEFLLEYCSKKGIV

SEQ ID NO: 2587744 - protein, 20 aa, Entamoeba histolytica
SDHCLSCSTNYYFVKGKTTC

SEQ ID NO: 2587745 - protein, 18 aa, Entamoeba histolytica
SDHIFVFVIGGISLGEIS

SEQ ID NO: 2587746 - protein, 25 aa, Entamoeba histolytica
SDIFHCIYNIYSIPFQFKCITPNCF

SEQ ID NO: 2587747 - protein, 20 aa, Entamoeba histolytica
SDIFIPFLLIQGTNDESVTM

SEQ ID NO: 2587748 - protein, 22 aa, Entamoeba histolytica
SDIFRRVALVFALILFILKFII

SEQ ID NO: 2587749 - protein, 17 aa, Entamoeba histolytica
SDIGMLKTGMLEGIEVM

SEQ ID NO: 2587750 - protein, 17 aa, Entamoeba histolytica
SDINFAREIYCDDTKRE

SEQ ID NO: 2587751 - protein, 26 aa, Entamoeba histolytica
SDIPMFVACCSFCIVMTTSFPLVHHA

SEQ ID NO: 2587752 - protein, 33 aa, Entamoeba histolytica
SDISWDRWFCAFRLKNCFIDLMYAVLSYTSQHS

SEQ ID NO: 2587753 - protein, 28 aa, Entamoeba histolytica
SDIVQIRFRYAYELEYWDKLLDELCELA

SEQ ID NO: 2587754 - protein, 20 aa, Entamoeba histolytica
SDKSKLMFFTLFRSGGAAIL

SEQ ID NO: 2587755 - protein, 19 aa, Entamoeba histolytica
SDLIMRFLAIYIPHISVIC

SEQ ID NO: 2587756 - protein, 21 aa, Entamoeba histolytica
SDPELLASMTSIRKMIIKGIA

SEQ ID NO: 2587757 - protein, 20 aa, Entamoeba histolytica
SDPISTCFLYTTPLRLNQDF

SEQ ID NO: 2587758 - protein, 34 aa, Entamoeba histolytica
SDQMRYFLSFFIELPLCYILRYLPSNPRLKHFVY

SEQ ID NO: 2587759 - protein, 26 aa, Entamoeba histolytica
SDRLLCKKVRLGLIISLIVIGLLFIV

SEQ ID NO: 2587760 - protein, 23 aa, Entamoeba histolytica
SDSCLIKTIIEQCWAQKPNERPT

SEQ ID NO: 2587761 - protein, 29 aa, Entamoeba histolytica
SDSLTILRWCFEYHKKIKKDFLNQIVNTE

SEQ ID NO: 2587762 - protein, 18 aa, Entamoeba histolytica
SDSLVCVEKMMRVMVNRG

SEQ ID NO: 2587763 - protein, 19 aa, Entamoeba histolytica
SDSLWKKEQGPIILLPFLV

SEQ ID NO: 2587764 - protein, 20 aa, Entamoeba histolytica
SDSWKFFVNTYFCIDIIGLL

SEQ ID NO: 2587765 - protein, 17 aa, Entamoeba histolytica
SDSYWYSINYKPGDGQF

SEQ ID NO: 2587766 - protein, 29 aa, Entamoeba histolytica
SDTKILIYCGVNFAKIGVYGSHFLTHGYA

SEQ ID NO: 2587767 - protein, 21 aa, Entamoeba histolytica
SDTLRKWVRDRWSATQLNKKR

SEQ ID NO: 2587768 - protein, 22 aa, Entamoeba histolytica
SDVARFWVMIIIVIIGGTPCQV

SEQ ID NO: 2587769 - protein, 27 aa, Entamoeba histolytica
SDVFSFAICMLEIWLTHDPYPIIEFHD

SEQ ID NO: 2587770 - protein, 27 aa, Entamoeba histolytica
SDVFSFAVCMLEIWLGKPPYSSDEFPN

SEQ ID NO: 2587771 - protein, 23 aa, Entamoeba histolytica
SDVMISFYLYCGWMDQLTEKLAD

SEQ ID NO: 2587772 - protein, 28 aa, Entamoeba histolytica
SDVYSFAICMLEIWLGRDPYDPAKFPDS

SEQ ID NO: 2587773 - protein, 29 aa, Entamoeba histolytica
SDVYSFAICMLEIWLGRDPYNPMKFPDSE

SEQ ID NO: 2587774 - protein, 26 aa, Entamoeba histolytica
SDVYSFAICMLEIWNNGSLYDEQHFP

SEQ ID NO: 2587775 - protein, 17 aa, Entamoeba histolytica
SDYKDQFPISGIFEVHQ

SEQ ID NO: 2587776 - protein, 18 aa, Entamoeba histolytica
SDYLPIFYVLGLLLQFIM

SEQ ID NO: 2587777 - protein, 25 aa, Entamoeba histolytica
SDYPSIRCADGFQIDLLIKLRETRL

SEQ ID NO: 2587778 - protein, 19 aa, Entamoeba histolytica
SEAKRFMTIYHQPVLLTFD

SEQ ID NO: 2587779 - protein, 24 aa, Entamoeba histolytica
SEAVLSVENCFDRLESKTPYSYGF

SEQ ID NO: 2587780 - protein, 23 aa, Entamoeba histolytica
SECFKCNLVNFAIFQIYQDNSVV

SEQ ID NO: 2587781 - protein, 18 aa, Entamoeba histolytica
SECQQCMKYLSSFIRNSK

SEQ ID NO: 2587782 - protein, 29 aa, Entamoeba histolytica
SECVGELTCCLCPLFAGLIATQTDDRKWA

SEQ ID NO: 2587783 - protein, 22 aa, Entamoeba histolytica
SEDLIKHIVRFITPLNGQCQLI

SEQ ID NO: 2587784 - protein, 19 aa, Entamoeba histolytica
SEDTLGIYLCKSLNQTVEV

SEQ ID NO: 2587785 - protein, 22 aa, Entamoeba histolytica
SEDYGVCSPGFAISSPSYYISK

SEQ ID NO: 2587786 - protein, 33 aa, Entamoeba histolytica; identical to SEQ ID NO: 2389997

SEQ ID NO: 2587787 - protein, 25 aa, Entamoeba histolytica
SEELCKSAPVIILWTTLFLVQILLA

SEQ ID NO: 2587788 - protein, 27 aa, Entamoeba histolytica
SEELDWRYSRSAGMLFGVLVTIIAVIS

SEQ ID NO: 2587789 - protein, 31 aa, Entamoeba histolytica
SEEVLINFYHFLKRYLKVISPLIVSSYVIDF

SEQ ID NO: 2587790 - protein, 18 aa, Entamoeba histolytica
SEFFKFSLDKTYLMEAYD

SEQ ID NO: 2587791 - protein, 27 aa, Entamoeba histolytica
SEFIEGFICCLFMVVAGILLLIRKLIQ

SEQ ID NO: 2587792 - protein, 22 aa, Entamoeba histolytica
SEFRFKLDGVISSRMDKVHSAF

SEQ ID NO: 2587793 - protein, 25 aa, Entamoeba histolytica
SEGCSALVCASGVYNGFDDLTIKTV

SEQ ID NO: 2587794 - protein, 22 aa, Entamoeba histolytica
SEGFDIHSWCIQFGNGNIKLHY

SEQ ID NO: 2587795 - protein, 26 aa, Entamoeba histolytica
SEGFKSFKNALSWEFKSVSFEKGIEY

SEQ ID NO: 2587796 - protein, 28 aa, Entamoeba histolytica
SEGYFGYPVCMPHIFGKMIDLEYEFNIS

SEQ ID NO: 2587797 - protein, 17 aa, Entamoeba histolytica
SEIPIIITVKGNTLKTG

SEQ ID NO: 2587798 - protein, 25 aa, Entamoeba histolytica
SEISMKLRIRFMLDSIKGIEYLHSN

SEQ ID NO: 2587799 - protein, 20 aa, Entamoeba histolytica
SEKFLGIPPISTFILNKASA

SEQ ID NO: 2587800 - protein, 25 aa, Entamoeba histolytica
SEKLIITTWWRWLIFSINGIMVVIM

SEQ ID NO: 2587801 - protein, 20 aa, Entamoeba histolytica
SELHSGCGICNTNKREGCSI

SEQ ID NO: 2587802 - protein, 20 aa, Entamoeba histolytica
SELIKFPSFSFLTKLEYLDI

SEQ ID NO: 2587803 - protein, 17 aa, Entamoeba histolytica
SELKRLMGDIVLGNGDI

SEQ ID NO: 2587804 - protein, 19 aa, Entamoeba histolytica
SELQKGDFLRIYNISKTLH

SEQ ID NO: 2587805 - protein, 22 aa, Entamoeba histolytica
SELRCISLIKLINFLSTNLKDK

SEQ ID NO: 2587806 - protein, 18 aa, Entamoeba histolytica
SELSRLRKNFSIEKQEDV

SEQ ID NO: 2587807 - protein, 17 aa, Entamoeba histolytica
SELVNIFQLSRREFSEK

SEQ ID NO: 2587808 - protein, 17 aa, Entamoeba histolytica
SEMIVGIIIQLLKRYSG

SEQ ID NO: 2587809 - protein, 20 aa, Entamoeba histolytica
SEMLPMNSIIQFIQNCLLRI

SEQ ID NO: 2587810 - protein, 25 aa, Entamoeba histolytica
SENEIKRLIEWGRGLELIDEEEIKK

SEQ ID NO: 2587811 - protein, 21 aa, Entamoeba histolytica
SENSAIVFIELIISILSVKRN

SEQ ID NO: 2587812 - protein, 24 aa, Entamoeba histolytica
SENYSSIHLLYLITSYRPELFSRQ

SEQ ID NO: 2587813 - protein, 26 aa, Entamoeba histolytica
SEPFPKQSFKFAWDVAEFIESGKHLP

SEQ ID NO: 2587814 - protein, 25 aa, Entamoeba histolytica
SERNYCLKCLNGYKIENNKCVKDKE

SEQ ID NO: 2587815 - protein, 25 aa, Entamoeba histolytica
SERNYCLKCLNGYKIENNTCVKDEE

SEQ ID NO: 2587816 - protein, 25 aa, Entamoeba histolytica
SERNYCLKCLNGYKIENNTCVKDKE

SEQ ID NO: 2587817 - protein, 19 aa, Entamoeba histolytica
SERNYCLKCSNGHKLENNT

SEQ ID NO: 2587818 - protein, 22 aa, Entamoeba histolytica
SESENGWLFEVFGYKTLKQLAK

SEQ ID NO: 2587819 - protein, 25 aa, Entamoeba histolytica
SESKKFFGEVAFDIISFLQKSIGDY

SEQ ID NO: 2587820 - protein, 23 aa, Entamoeba histolytica
SESLRGGGLMSKLMYLFIDESTE

SEQ ID NO: 2587821 - protein, 23 aa, Entamoeba histolytica
SESLTNLSAHCFADTGLISINFP

SEQ ID NO: 2587822 - protein, 21 aa, Entamoeba histolytica
SESNYPFAFLSEYQFNNQFIT

SEQ ID NO: 2587823 - protein, 24 aa, Entamoeba histolytica
SESSIPKLICKESKSIPNCTELDG

SEQ ID NO: 2587824 - protein, 18 aa, Entamoeba histolytica
SETLRIIKKHSIALSTES

SEQ ID NO: 2587825 - protein, 18 aa, Entamoeba histolytica
SETRFVFCRFLDRLKTNH

SEQ ID NO: 2587826 - protein, 24 aa, Entamoeba histolytica
SEVGETYHAYFVCNKYIAFGRTLP

SEQ ID NO: 2587827 - protein, 25 aa, Entamoeba histolytica
SEVITCPPDVLGFTFVALFLSIRHI

SEQ ID NO: 2587828 - protein, 25 aa, Entamoeba histolytica
SEVKCGKYGVSDYCYVISRDITNPK

SEQ ID NO: 2587829 - protein, 21 aa, Entamoeba histolytica
SEWKFDVMEFIQSIESNIGQD

SEQ ID NO: 2587830 - protein, 17 aa, Entamoeba histolytica
SEYKYTYVLHYTASSSS

SEQ ID NO: 2587831 - protein, 21 aa, Entamoeba histolytica
SEYPMFHPLSFFKRNYQESIT

SEQ ID NO: 2587832 - protein, 19 aa, Entamoeba histolytica
SEYRWCSEMQRQLNIKLLE

SEQ ID NO: 2587833 - protein, 19 aa, Entamoeba histolytica
SFALAFFWSICEYLLSNEI

SEQ ID NO: 2587834 - protein, 17 aa, Entamoeba histolytica
SFASLFMMTFPKYVNSV

SEQ ID NO: 2587835 - protein, 18 aa, Entamoeba histolytica
SFCFWVLGQFSYWQYKQT

SEQ ID NO: 2587836 - protein, 19 aa, Entamoeba histolytica
SFCLCLKDTFTLLRQFPTM

SEQ ID NO: 2587837 - protein, 17 aa, Entamoeba histolytica
SFCNKELYEFNKLRCPL

SEQ ID NO: 2587838 - protein, 20 aa, Entamoeba histolytica
SFCSSCYSGFIGKDSKCFTC

SEQ ID NO: 2587839 - protein, 20 aa, Entamoeba histolytica
SFCSSSWCPIIPECGIYDYH

SEQ ID NO: 2587840 - protein, 17 aa, Entamoeba histolytica
SFETTSLLFESTSIEKV

SEQ ID NO: 2587841 - protein, 25 aa, Entamoeba histolytica
SFFREYICLVDKFSLNLLYPSVSCK

SEQ ID NO: 2587842 - protein, 25 aa, Entamoeba histolytica
SFFTRKRAALFVVVVFIGALIMLDN

SEQ ID NO: 2587843 - protein, 21 aa, Entamoeba histolytica
SFGIIMWEFLTRDIPYKNIPL

SEQ ID NO: 2587844 - protein, 19 aa, Entamoeba histolytica
SFGKIKFVFYIGNSPTKIT

SEQ ID NO: 2587845 - protein, 18 aa, Entamoeba histolytica
SFGLALWGGYIGVALIAS

SEQ ID NO: 2587846 - protein, 18 aa, Entamoeba histolytica
SFHFIAALIYTIGIRSNA

SEQ ID NO: 2587847 - protein, 19 aa, Entamoeba histolytica
SFHRARTLLITKVLELNKK

SEQ ID NO: 2587848 - protein, 20 aa, Entamoeba histolytica
SFIFICIGVWLFFKIKALQP

SEQ ID NO: 2587849 - protein, 20 aa, Entamoeba histolytica
SFIGCLVFEYIIFRQIWILN

SEQ ID NO: 2587850 - protein, 30 aa, Entamoeba histolytica
SFIHLCFIVFPILYLCIFKKIVKSHLDDNT

SEQ ID NO: 2587851 - protein, 22 aa, Entamoeba histolytica
SFIPNKNCVYDIIGRGSIHLTK

SEQ ID NO: 2587852 - protein, 25 aa, Entamoeba histolytica
SFIRELTKIIGLIIGCCFVYYTNQI

SEQ ID NO: 2587853 - protein, 32 aa, Entamoeba histolytica
SFITSQCPISFNYKSSSIVLWFCPQSIINEAQ

SEQ ID NO: 2587854 - protein, 26 aa, Entamoeba histolytica
SFKLCGELFIGFSHLYYIIAKDPQEL

SEQ ID NO: 2587855 - protein, 17 aa, Entamoeba histolytica
SFLARVVLLCLVIVTII

SEQ ID NO: 2587856 - protein, 24 aa, Entamoeba histolytica
SFLCVFEMVIALCMYFFTKDDFIE

SEQ ID NO: 2587857 - protein, 20 aa, Entamoeba histolytica
SFLIFIRIISLFVMTIPSAF

SEQ ID NO: 2587858 - protein, 27 aa, Entamoeba histolytica
SFLNQEIWSSICGRNNIMIIIKDWNGN

SEQ ID NO: 2587859 - protein, 17 aa, Entamoeba histolytica
SFLPTKISFFLNQPYHF

SEQ ID NO: 2587860 - protein, 18 aa, Entamoeba histolytica
SFMFHLHLLLFCGCFILK

SEQ ID NO: 2587861 - protein, 18 aa, Entamoeba histolytica
SFNKLKKKMPTILNELIT

SEQ ID NO: 2587862 - protein, 18 aa, Entamoeba histolytica
SFNTEFYTTVDIDERLKN

SEQ ID NO: 2587863 - protein, 31 aa, Entamoeba histolytica
SFPDGFYLYFYKRFPGLLILVYNVVKKHYPN

SEQ ID NO: 2587864 - protein, 22 aa, Entamoeba histolytica
SFPRFRIYFLGWYLIPAAGGCI

SEQ ID NO: 2587865 - protein, 19 aa, Entamoeba histolytica
SFPTRRLTLDTSQINTLSS

SEQ ID NO: 2587866 - protein, 19 aa, Entamoeba histolytica
SFPYCFTRTKLSNESASIS

SEQ ID NO: 2587867 - protein, 18 aa, Entamoeba histolytica
SFSLDMLSMISARGLLFG

SEQ ID NO: 2587868 - protein, 21 aa, Entamoeba histolytica
SFSSKFWPYFSNVTLFSIFVP

SEQ ID NO: 2587869 - protein, 18 aa, Entamoeba histolytica
SFTCMYPLFFQVIAHLAV

SEQ ID NO: 2587870 - protein, 20 aa, Entamoeba histolytica
SFTLNFRGNYSIQIYTKDQN

SEQ ID NO: 2587871 - protein, 25 aa, Entamoeba histolytica
SFVIEVITWIIPWFVGGILGVSLSL

SEQ ID NO: 2587872 - protein, 19 aa, Entamoeba histolytica
SFVKVFKGSSLIIKGCEET

SEQ ID NO: 2587873 - protein, 27 aa, Entamoeba histolytica
SFVLCFSLPCIFHYLSRRKVIAKFNKT

SEQ ID NO: 2587874 - protein, 19 aa, Entamoeba histolytica
SFVMTRLLLGPILVEAIRI

SEQ ID NO: 2587875 - protein, 24 aa, Entamoeba histolytica
SFVQIRGTIPLIWKTNEEDTFRPK

SEQ ID NO: 2587876 - protein, 23 aa, Entamoeba histolytica
SFVSFPPLFWVVRDYALDERTES

SEQ ID NO: 2587877 - protein, 19 aa, Entamoeba histolytica
SFVVILFLLVFALIAAGYV

SEQ ID NO: 2587878 - protein, 18 aa, Entamoeba histolytica
SFYAICRQDIGWFDKKEN

SEQ ID NO: 2587879 - protein, 19 aa, Entamoeba histolytica
SFYHLFKILTTIFMIAVVL

SEQ ID NO: 2587880 - protein, 25 aa, Entamoeba histolytica
SFYILRQSWYLSLFLTPLGIKVCIK

SEQ ID NO: 2587881 - protein, 20 aa, Entamoeba histolytica
SFYVAEWISIIMFFFALSQR

SEQ ID NO: 2587882 - protein, 21 aa, Entamoeba histolytica
SGAINSCLWELTLLQLHHSPQ

SEQ ID NO: 2587883 - protein, 18 aa, Entamoeba histolytica
SGCDGCYAFAAKEIAFIS

SEQ ID NO: 2587884 - protein, 17 aa, Entamoeba histolytica
SGCDRTGMVFALASSLC

SEQ ID NO: 2587885 - protein, 19 aa, Entamoeba histolytica
SGCDWQIRVNLYGMCNLEQ

SEQ ID NO: 2587886 - protein, 25 aa, Entamoeba histolytica
SGCELNCSCAFGWKRDNKGGCVPSS

SEQ ID NO: 2587887 - protein, 21 aa, Entamoeba histolytica
SGDKKRLIILLILVIVVTFLI

SEQ ID NO: 2587888 - protein, 19 aa, Entamoeba histolytica
SGEIWRLVTPFLVYSDRFS

SEQ ID NO: 2587889 - protein, 24 aa, Entamoeba histolytica
SGEYKCEMGYEVYDYSSMAQMWGG

SEQ ID NO: 2587890 - protein, 17 aa, Entamoeba histolytica
SGFDYFRSTALSIRLQN

SEQ ID NO: 2587891 - protein, 23 aa, Entamoeba histolytica
SGGEIFGIIVAVLFLVVILLVIG

SEQ ID NO: 2587892 - protein, 22 aa, Entamoeba histolytica
SGGEINWFYSFPGLYNQILPDS

SEQ ID NO: 2587893 - protein, 24 aa, Entamoeba histolytica
SGGMKRRLSVAIACIAKPKCVILD

SEQ ID NO: 2587894 - protein, 39 aa, Entamoeba histolytica
SGGVYVFLLLLFICSSSNYCVSFFFFSFHILLYLLFICL

SEQ ID NO: 2587895 - protein, 24 aa, Entamoeba histolytica
SGIIPISVIITIEIARSLQKRNIE

SEQ ID NO: 2587896 - protein, 21 aa, Entamoeba histolytica
SGIIQCLPGYYLSETSTCSSC

SEQ ID NO: 2587897 - protein, 20 aa, Entamoeba histolytica
SGIIQCLPGYYLSETSTCTS

SEQ ID NO: 2587898 - protein, 21 aa, Entamoeba histolytica
SGIISIFVFWFVKDKTIKKLS

SEQ ID NO: 2587899 - protein, 22 aa, Entamoeba histolytica
SGILCCLNYWTLFGGLIELCGG

SEQ ID NO: 2587900 - protein, 19 aa, Entamoeba histolytica
SGITDHCKSCLQKGNTTTC

SEQ ID NO: 2587901 - protein, 23 aa, Entamoeba histolytica
SGKRLGFDTSIPMLLKGLIQDCW

SEQ ID NO: 2587902 - protein, 24 aa, Entamoeba histolytica
SGKRLPFDDTIPICLKTLIEECWK

SEQ ID NO: 2587903 - protein, 21 aa, Entamoeba histolytica
SGLFSGMVFYIQREVPRHPVA

SEQ ID NO: 2587904 - protein, 17 aa, Entamoeba histolytica
SGLTEGVFLEFPDMAKV

SEQ ID NO: 2587905 - protein, 18 aa, Entamoeba histolytica
SGMFSFFREYICLVDKFS

SEQ ID NO: 2587906 - protein, 26 aa, Entamoeba histolytica
SGMPLLYSCIRIVMQVVPKRFDLEKI

SEQ ID NO: 2587907 - protein, 18 aa, Entamoeba histolytica
SGMVRYFYENNIIIHDIT

SEQ ID NO: 2587908 - protein, 18 aa, Entamoeba histolytica
SGNCGKFGTILKVEVNGV

SEQ ID NO: 2587909 - protein, 20 aa, Entamoeba histolytica
SGNCKPCPSNCLVCDNNTCI

SEQ ID NO: 2587910 - protein, 21 aa, Entamoeba histolytica
SGNGFEYWIRFITSHPGEYVI

SEQ ID NO: 2587911 - protein, 29 aa, Entamoeba histolytica
SGQKCDLVPVWWNFVVVIIIIDIIIKICV

SEQ ID NO: 2587912 - protein, 21 aa, Entamoeba histolytica
SGRCECYNGYTLIDETCTKCG

SEQ ID NO: 2587913 - protein, 25 aa, Entamoeba histolytica
SGSLTLLVLIQWSGLFQIRHSLHTK

SEQ ID NO: 2587914 - protein, 39 aa, Entamoeba histolytica
SGSLVFILCCVLCCFGLLCFSCIPCCLDGLKDAHHKWFV

SEQ ID NO: 2587915 - protein, 26 aa, Entamoeba histolytica
SGSPIKAALCALAYYYMALSWGAYVF

SEQ ID NO: 2587916 - protein, 25 aa, Entamoeba histolytica
SGTFGIVYRAEWRGVDVAVKLMKTD

SEQ ID NO: 2587917 - protein, 25 aa, Entamoeba histolytica
SGTFGIVYRAEWRGVDVAVKVMKTD

SEQ ID NO: 2587918 - protein, 20 aa, Entamoeba histolytica
SGTFLEYIKEQGFDNVFREW

SEQ ID NO: 2587919 - protein, 23 aa, Entamoeba histolytica
SGTWDILMDWGLMRKKYNFLRKK

SEQ ID NO: 2587920 - protein, 22 aa, Entamoeba histolytica
SGYKFCYLYVIVYGSLLFLKLI

SEQ ID NO: 2587921 - protein, 19 aa, Entamoeba histolytica
SGYSPRFELLESYEGKAVG

SEQ ID NO: 2587922 - protein, 23 aa, Entamoeba histolytica
SGYVSTPPVCFVVSGTCTQDNLL

SEQ ID NO: 2587923 - protein, 24 aa, Entamoeba histolytica
SHESWRMLIVLLPFIIAGTVAISR

SEQ ID NO: 2587924 - protein, 23 aa, Entamoeba histolytica
SHFFDIFFDFLFTHMNITKSQHI

SEQ ID NO: 2587925 - protein, 24 aa, Entamoeba histolytica
SHGFLHLVMKCISITQAIYIVLYI

SEQ ID NO: 2587926 - protein, 17 aa, Entamoeba histolytica
SHGFLYIIMEYMESGSL

SEQ ID NO: 2587927 - protein, 21 aa, Entamoeba histolytica
SHGYWIVACFFLISIFLLIFF

SEQ ID NO: 2587928 - protein, 17 aa, Entamoeba histolytica
SHHLICLNHYKRFNNKQ

SEQ ID NO: 2587929 - protein, 21 aa, Entamoeba histolytica
SHHPLELILTIVIVIPLIYKK

SEQ ID NO: 2587930 - protein, 29 aa, Entamoeba histolytica
SHIFWISFCCCWILFNIKVFEELIYSRKL

SEQ ID NO: 2587931 - protein, 19 aa, Entamoeba histolytica
SHILHKGFIIIGLFIGVFV

SEQ ID NO: 2587932 - protein, 17 aa, Entamoeba histolytica
SHITAVWIAARLFVQIS

SEQ ID NO: 2587933 - protein, 22 aa, Entamoeba histolytica
SHITRLLLWHGRNSYIRSSDLA

SEQ ID NO: 2587934 - protein, 18 aa, Entamoeba histolytica
SHKKACGVYQSMNKFWMI

SEQ ID NO: 2587935 - protein, 22 aa, Entamoeba histolytica
SHKLSCIVLEYYPLGTIDHFLD

SEQ ID NO: 2587936 - protein, 17 aa, Entamoeba histolytica
SHNTFIRYLQNSISSFY

SEQ ID NO: 2587937 - protein, 25 aa, Entamoeba histolytica
SHNYIMKINHSFFSWNSLIELNLRD

SEQ ID NO: 2587938 - protein, 24 aa, Entamoeba histolytica
SHPSVYAFMSFIFLAVRFLTLGWD

SEQ ID NO: 2587939 - protein, 22 aa, Entamoeba histolytica
SHQHVSHFFTFFFASQIIGLTR

SEQ ID NO: 2587940 - protein, 20 aa, Entamoeba histolytica
SHSRKSFDLSSRSLVSANLK

SEQ ID NO: 2587941 - protein, 22 aa, Entamoeba histolytica
SHYKLYCLLYHWYKSYTTKPFI

SEQ ID NO: 2587942 - protein, 19 aa, Entamoeba histolytica
SIAIMKITKRCLAKRLPTE

SEQ ID NO: 2587943 - protein, 17 aa, Entamoeba histolytica
SIASVVFSLHFTLHVAV

SEQ ID NO: 2587944 - protein, 18 aa, Entamoeba histolytica
SICDFLGTYMMNFGLLYI

SEQ ID NO: 2587945 - protein, 23 aa, Entamoeba histolytica
SICIVGYCVFPIFVGAITTTIAT

SEQ ID NO: 2587946 - protein, 20 aa, Entamoeba histolytica
SICSKDLIKGFWFRIKGAEQ

SEQ ID NO: 2587947 - protein, 25 aa, Entamoeba histolytica
SICTGEICFHYTFIISAGMVVCSFI

SEQ ID NO: 2587948 - protein, 20 aa, Entamoeba histolytica
SICTPSLNKGFWFKIEGTEQ

SEQ ID NO: 2587949 - protein, 17 aa, Entamoeba histolytica
SIEDCLDLILSTLTPPF

SEQ ID NO: 2587950 - protein, 32 aa, Entamoeba histolytica; identical to SEQ ID NO: 2390190

SEQ ID NO: 2587951 - protein, 20 aa, Entamoeba histolytica
SIEPIKYVRCQNLISLCRTT

SEQ ID NO: 2587952 - protein, 20 aa, Entamoeba histolytica
SIEVFPKMKLMKHQRNPTEI

SEQ ID NO: 2587953 - protein, 22 aa, Entamoeba histolytica
SIFKCSLFFIKIQTPFLNLFVI

SEQ ID NO: 2587954 - protein, 17 aa, Entamoeba histolytica
SIFKELLLEFLSYCCFI

SEQ ID NO: 2587955 - protein, 18 aa, Entamoeba histolytica
SIFKILLFTMQFSGNYSI

SEQ ID NO: 2587956 - protein, 17 aa, Entamoeba histolytica
SIFKYGYSLSLSFLESF

SEQ ID NO: 2587957 - protein, 20 aa, Entamoeba histolytica
SIFLVILMVLNLLKIKIIMY

SEQ ID NO: 2587958 - protein, 29 aa, Entamoeba histolytica
SIFPICVIGVTIFFKCCLYLYCRTVNNPS

SEQ ID NO: 2587959 - protein, 20 aa, Entamoeba histolytica
SIGLISFIIFKFIIKNDIAW

SEQ ID NO: 2587960 - protein, 18 aa, Entamoeba histolytica
SIHINEPIELIFNSETYY

SEQ ID NO: 2587961 - protein, 19 aa, Entamoeba histolytica
SIHIPTVLLLLSISCSIGY

SEQ ID NO: 2587962 - protein, 19 aa, Entamoeba histolytica
SIHPSRYYPLDVECIKRGN

SEQ ID NO: 2587963 - protein, 25 aa, Entamoeba histolytica
SIHSELKTLFALPSLPLVIPYLTLL

SEQ ID NO: 2587964 - protein, 17 aa, Entamoeba histolytica
SIIDWIGGITWLIFYIV

SEQ ID NO: 2587965 - protein, 22 aa, Entamoeba histolytica
SIIIKLCDFGVALKATKDMEYG

SEQ ID NO: 2587966 - protein, 17 aa, Entamoeba histolytica
SIIKMLFHRSNISELDI

SEQ ID NO: 2587967 - protein, 19 aa, Entamoeba histolytica
SIIKTESKVSWDVRTVIAI

SEQ ID NO: 2587968 - protein, 21 aa, Entamoeba histolytica
SIILNNTWSYGGIKFLHQVEF

SEQ ID NO: 2587969 - protein, 23 aa, Entamoeba histolytica
SIIPDRDIIALLGINGGSQITLP

SEQ ID NO: 2587970 - protein, 31 aa, Entamoeba histolytica
SIIQFIQNCLLRIILFVCGIYSIQITDKSTN

SEQ ID NO: 2587971 - protein, 18 aa, Entamoeba histolytica
SIIQLILFINFVNRINGF

SEQ ID NO: 2587972 - protein, 25 aa, Entamoeba histolytica
SIITLSIVCVGLFFILGIAGMLLNK

SEQ ID NO: 2587973 - protein, 23 aa, Entamoeba histolytica
SIIVGGIILLLAIIIILCSILIL

SEQ ID NO: 2587974 - protein, 39 aa, Entamoeba histolytica
SIIVLRPTFEPSFVFSLGFWWRVAVITLINSFPFILKFI

SEQ ID NO: 2587975 - protein, 25 aa, Entamoeba histolytica
SIKASIPFIVLTGFFFLSLIVNFVS

SEQ ID NO: 2587976 - protein, 17 aa, Entamoeba histolytica
SIKCLHSPFNIYRISMN

SEQ ID NO: 2587977 - protein, 18 aa, Entamoeba histolytica
SIKFCSFNGYNIFINGSL

SEQ ID NO: 2587978 - protein, 17 aa, Entamoeba histolytica
SILALNLSTMFTIFSLL

SEQ ID NO: 2587979 - protein, 18 aa, Entamoeba histolytica
SILFDIYSLWQGHRLPFK

SEQ ID NO: 2587980 - protein, 17 aa, Entamoeba histolytica
SILHLLQSLYFYGDELK

SEQ ID NO: 2587981 - protein, 22 aa, Entamoeba histolytica
SILIPNFINSFFISYYLNNEEI

SEQ ID NO: 2587982 - protein, 21 aa, Entamoeba histolytica
SILKLKKMMSSVMENTAPLIN

SEQ ID NO: 2587983 - protein, 17 aa, Entamoeba histolytica
SILLPAIVNLLGELNWF

SEQ ID NO: 2587984 - protein, 17 aa, Entamoeba histolytica
SILSRGILYSKIQPNES

SEQ ID NO: 2587985 - protein, 23 aa, Entamoeba histolytica
SILTELKVSFGQYNVDSIQHICY

SEQ ID NO: 2587986 - protein, 21 aa, Entamoeba histolytica
SILTIICFFVSITSLTLAIEG

SEQ ID NO: 2587987 - protein, 20 aa, Entamoeba histolytica
SILVCVYKIYQRRIQRRLRI

SEQ ID NO: 2587988 - protein, 20 aa, Entamoeba histolytica
SIMLCSLLLYVLVVMDALRK

SEQ ID NO: 2587989 - protein, 19 aa, Entamoeba histolytica
SINGMYLYFMVNWTTTVNG

SEQ ID NO: 2587990 - protein, 22 aa, Entamoeba histolytica
SIPKHFRFNRYIPYKTFDLTTT

SEQ ID NO: 2587991 - protein, 18 aa, Entamoeba histolytica
SIPLRTIVWILFYAPLKF

SEQ ID NO: 2587992 - protein, 22 aa, Entamoeba histolytica
SIQKCYYFYVIIIEILCFIILI

SEQ ID NO: 2587993 - protein, 18 aa, Entamoeba histolytica
SIREGEQIFNLIVNALAV

SEQ ID NO: 2587994 - protein, 19 aa, Entamoeba histolytica
SISDLAVQILIQLIIRHGS

SEQ ID NO: 2587995 - protein, 22 aa, Entamoeba histolytica
SISEKISIGWIAKSLPWLMFIG

SEQ ID NO: 2587996 - protein, 17 aa, Entamoeba histolytica
SISETIVSLSLLKNPTS

SEQ ID NO: 2587997 - protein, 24 aa, Entamoeba histolytica
SISKLGKLYVFNRYICFWPQLLKF

SEQ ID NO: 2587998 - protein, 25 aa, Entamoeba histolytica
SISSICALVYHLIRPYPTSFLGIIL

SEQ ID NO: 2587999 - protein, 23 aa, Entamoeba histolytica
SISSLFMQWDYWILPETKIEFIG

SEQ ID NO: 2588000 - protein, 28 aa, Entamoeba histolytica
SITPRHAYRLLSVFLLKAVSIMNKQPSA

SEQ ID NO: 2588001 - protein, 20 aa, Entamoeba histolytica
SIVFPLIVVFLMFFLGIETL

SEQ ID NO: 2588002 - protein, 26 aa, Entamoeba histolytica
SIVGIECGTPWYWVLTAIGGPLMLAV

SEQ ID NO: 2588003 - protein, 23 aa, Entamoeba histolytica
SIVIPFFVPYLFFTLGVLVVVTI

SEQ ID NO: 2588004 - protein, 19 aa, Entamoeba histolytica
SIVLLPSLMSQEFEKEMSI

SEQ ID NO: 2588005 - protein, 30 aa, Entamoeba histolytica
SIVVAGLVFRRASYSFGLFIFGGITAILFI

SEQ ID NO: 2588006 - protein, 23 aa, Entamoeba histolytica
SIYERWSLVMFNILFSILLPMVV

SEQ ID NO: 2588007 - protein, 20 aa, Entamoeba histolytica
SIYNFTGYDVVRFGKVNTNI

SEQ ID NO: 2588008 - protein, 24 aa, Entamoeba histolytica
SIYPEKYPLVYLYFSMIGAIFLNI

SEQ ID NO: 2588009 - protein, 18 aa, Entamoeba histolytica
SKAGITVHSFSMKTSISE

SEQ ID NO: 2588010 - protein, 17 aa, Entamoeba histolytica
SKAKEGNAFFSGLFGKR

SEQ ID NO: 2588011 - protein, 18 aa, Entamoeba histolytica
SKAKRFYVTLTLEAQSSL

SEQ ID NO: 2588012 - protein, 32 aa, Entamoeba histolytica
SKAPKITWRLQIMLWYAGLRGAIAVILALQMN

SEQ ID NO: 2588013 - protein, 21 aa, Entamoeba histolytica
SKAYDALNCPCGFTEVQSKYS

SEQ ID NO: 2588014 - protein, 23 aa, Entamoeba histolytica
SKCICSLSIDQFIYWFCSENYSS

SEQ ID NO: 2588015 - protein, 17 aa, Entamoeba histolytica
SKCKIAHCGQCPDIEKC

SEQ ID NO: 2588016 - protein, 18 aa, Entamoeba histolytica
SKCLDVLDYKLIIGTTFD

SEQ ID NO: 2588017 - protein, 23 aa, Entamoeba histolytica
SKCQKCTFWYRPSDDGTYCSSYI

SEQ ID NO: 2588018 - protein, 19 aa, Entamoeba histolytica
SKCYFKKSTSSLGVIQYRL

SEQ ID NO: 2588019 - protein, 17 aa, Entamoeba histolytica
SKDLICIGNLDKRKLKI

SEQ ID NO: 2588020 - protein, 17 aa, Entamoeba histolytica
SKDTFIFVSKTKNGKWN

SEQ ID NO: 2588021 - protein, 23 aa, Entamoeba histolytica
SKEELSTVLSIEWSNGETCDVSY

SEQ ID NO: 2588022 - protein, 24 aa, Entamoeba histolytica
SKEIAQNIIFTRRNINSFERKVKE

SEQ ID NO: 2588023 - protein, 20 aa, Entamoeba histolytica
SKEVYSYDIIHIIGVEETEI

SEQ ID NO: 2588024 - protein, 19 aa, Entamoeba histolytica
SKEYLRIPLTIQWENGESV

SEQ ID NO: 2588025 - protein, 20 aa, Entamoeba histolytica
SKFDDFFVNIVFTFTPDCVD

SEQ ID NO: 2588026 - protein, 20 aa, Entamoeba histolytica
SKFIIRRKWGSKTYVTSFSG

SEQ ID NO: 2588027 - protein, 32 aa, Entamoeba histolytica
SKGIKLLATISVLCFAVYFFALIGAITVTLIL

SEQ ID NO: 2588028 - protein, 19 aa, Entamoeba histolytica
SKGRTTIIVGHRLSTIQNA

SEQ ID NO: 2588029 - protein, 23 aa, Entamoeba histolytica
SKGYHPFNFCIFLHMINCIMYSY

SEQ ID NO: 2588030 - protein, 34 aa, Entamoeba histolytica
SKHVFVKFFAPWCGHCKKLAPEYIKLADAYKDKQ

SEQ ID NO: 2588031 - protein, 17 aa, Entamoeba histolytica
SKIAIYFSAAFWALSAF

SEQ ID NO: 2588032 - protein, 17 aa, Entamoeba histolytica
SKIGFFLLFIVFAVLVV

SEQ ID NO: 2588033 - protein, 18 aa, Entamoeba histolytica
SKIGFYFSAAFWAFSALT

SEQ ID NO: 2588034 - protein, 17 aa, Entamoeba histolytica
SKIIWLLYGFLFITFFL

SEQ ID NO: 2588035 - protein, 17 aa, Entamoeba histolytica
SKILSAISLRIPLILKD

SEQ ID NO: 2588036 - protein, 21 aa, Entamoeba histolytica
SKIRGELQCHGPLHLHSIIQS

SEQ ID NO: 2588037 - protein, 20 aa, Entamoeba histolytica
SKIRICLSLLISLTIIFVYL

SEQ ID NO: 2588038 - protein, 23 aa, Entamoeba histolytica
SKISSGCYVMMIGFMYLSSYPIT

SEQ ID NO: 2588039 - protein, 19 aa, Entamoeba histolytica
SKKCFLLVQSIVKFITSAL

SEQ ID NO: 2588040 - protein, 25 aa, Entamoeba histolytica
SKKGELKAVIILGLIHNEEIIIPKP

SEQ ID NO: 2588041 - protein, 17 aa, Entamoeba histolytica
SKKKWLMIIFHTPNNPK

SEQ ID NO: 2588042 - protein, 17 aa, Entamoeba histolytica
SKKSFLIYIFALLLLII

SEQ ID NO: 2588043 - protein, 25 aa, Entamoeba histolytica
SKKSIEIIKLPPFNELKLPRLDAFS

SEQ ID NO: 2588044 - protein, 22 aa, Entamoeba histolytica
SKKWRQTWKNNNLVLFEDFIID

SEQ ID NO: 2588045 - protein, 24 aa, Entamoeba histolytica
SKLFECIKALALCHNVTPSISNEG

SEQ ID NO: 2588046 - protein, 24 aa, Entamoeba histolytica
SKLFRGDQFLNFILQREKVDDGTV

SEQ ID NO: 2588047 - protein, 21 aa, Entamoeba histolytica
SKLKRVCVRSISFSCKPPNVE

SEQ ID NO: 2588048 - protein, 20 aa, Entamoeba histolytica
SKLLRDLDQEYARLRSENQH

SEQ ID NO: 2588049 - protein, 25 aa, Entamoeba histolytica
SKLNKKWRSSMIIGTIFKQGNTYEF

SEQ ID NO: 2588050 - protein, 20 aa, Entamoeba histolytica
SKLRNPFIVNFIGSVNYTKD

SEQ ID NO: 2588051 - protein, 23 aa, Entamoeba histolytica
SKLSRRHKPFFARGSNSRATESS

SEQ ID NO: 2588052 - protein, 20 aa, Entamoeba histolytica
SKLVEPSLMTLKFKEQTFTL

SEQ ID NO: 2588053 - protein, 23 aa, Entamoeba histolytica
SKMQPELIRFIFASMKTENIHII

SEQ ID NO: 2588054 - protein, 26 aa, Entamoeba histolytica
SKMSTLICELEEGVAIINNLSQDEMD

SEQ ID NO: 2588055 - protein, 25 aa, Entamoeba histolytica
SKMTTTIPFVFSIIIDKTILNIKDL

SEQ ID NO: 2588056 - protein, 26 aa, Entamoeba histolytica
SKNCGLKSRLAYNVVVGNKYFVFVGF

SEQ ID NO: 2588057 - protein, 24 aa, Entamoeba histolytica
SKNCKDESYGLVIADFIGRILIPY

SEQ ID NO: 2588058 - protein, 20 aa, Entamoeba histolytica
SKNKYGRACMDICYDNVTKE

SEQ ID NO: 2588059 - protein, 23 aa, Entamoeba histolytica
SKNLKMKRIILIVFGATFVVAIC

SEQ ID NO: 2588060 - protein, 27 aa, Entamoeba histolytica
SKNRKEICFNFGLTLDFIGKNARTIPN

SEQ ID NO: 2588061 - protein, 22 aa, Entamoeba histolytica
SKNTMNKICFVMKQNINPYLDV

SEQ ID NO: 2588062 - protein, 23 aa, Entamoeba histolytica
SKPFSWPTTDFISIKEIQTAMNL

SEQ ID NO: 2588063 - protein, 19 aa, Entamoeba histolytica
SKPLAIGISSSFTPLNNGP

SEQ ID NO: 2588064 - protein, 20 aa, Entamoeba histolytica
SKPQGNWCGPVICVIPVGDD

SEQ ID NO: 2588065 - protein, 22 aa, Entamoeba histolytica
SKRGIPGYSLFKISFVTFLVIL

SEQ ID NO: 2588066 - protein, 23 aa, Entamoeba histolytica
SKRKWNVVKGFLIGQTISIINAS

SEQ ID NO: 2588067 - protein, 21 aa, Entamoeba histolytica
SKRPCCSQIKKVLQKVSKNLP

SEQ ID NO: 2588068 - protein, 24 aa, Entamoeba histolytica
SKRRGIRGGIRIEDFEEGNERKRI

SEQ ID NO: 2588069 - protein, 17 aa, Entamoeba histolytica
SKSEKFLGIPPISTFIL

SEQ ID NO: 2588070 - protein, 19 aa, Entamoeba histolytica
SKSGIKGFFRVFKKMFINL

SEQ ID NO: 2588071 - protein, 17 aa, Entamoeba histolytica
SKSGVFFGIPPLGGWIL

SEQ ID NO: 2588072 - protein, 22 aa, Entamoeba histolytica
SKSLYKRFGMFDESTLYVHSPP

SEQ ID NO: 2588073 - protein, 22 aa, Entamoeba histolytica
SKSVYCPLCHTISNVFIEEHQP

SEQ ID NO: 2588074 - protein, 24 aa, Entamoeba histolytica
SKSYKKPADIFAFAITMYEILNWK

SEQ ID NO: 2588075 - protein, 28 aa, Entamoeba histolytica
SKTAGVFCKWHYIILYLVAVCLNFPLII

SEQ ID NO: 2588076 - protein, 23 aa, Entamoeba histolytica
SKTCLSCKIGYYFDGDNCKKVAD

SEQ ID NO: 2588077 - protein, 23 aa, Entamoeba histolytica
SKTNWALIIPLVIVAVIIIVILL

SEQ ID NO: 2588078 - protein, 20 aa, Entamoeba histolytica
SKTNWALIIPLVIVGIILII

SEQ ID NO: 2588079 - protein, 22 aa, Entamoeba histolytica
SKTPMWLILLIAFLSFDNIVYV

SEQ ID NO: 2588080 - protein, 20 aa, Entamoeba histolytica
SKTPYSYGFWFEINAKEEGF

SEQ ID NO: 2588081 - protein, 26 aa, Entamoeba histolytica
SKTQKRISLIYAFVISIIFSGFIPLL

SEQ ID NO: 2588082 - protein, 22 aa, Entamoeba histolytica
SKTSMFYKQWLKVEDIHAELYM

SEQ ID NO: 2588083 - protein, 26 aa, Entamoeba histolytica
SKVIIKRTYSFIVIFVYFALVISSII

SEQ ID NO: 2588084 - protein, 21 aa, Entamoeba histolytica
SKVKLTLCKLIGKIDDYPMLS

SEQ ID NO: 2588085 - protein, 24 aa, Entamoeba histolytica
SKVSDCVVGLTFKEKMMATQNILL

SEQ ID NO: 2588086 - protein, 19 aa, Entamoeba histolytica
SKVSWDVRTVIAIFDNLIE

SEQ ID NO: 2588087 - protein, 23 aa, Entamoeba histolytica
SKVWDVVIGISFITSAMFLQALQ

SEQ ID NO: 2588088 - protein, 17 aa, Entamoeba histolytica
SKWKKSLLDALSHSSFF

SEQ ID NO: 2588089 - protein, 26 aa, Entamoeba histolytica
SKYFPLCICWSTIPILSWLVPCLGHT

SEQ ID NO: 2588090 - protein, 23 aa, Entamoeba histolytica
SKYLEYPFIFSILPYNNIFFSSF

SEQ ID NO: 2588091 - protein, 23 aa, Entamoeba histolytica
SLAEFDFQLNIGKTMSIPLTNLY

SEQ ID NO: 2588092 - protein, 23 aa, Entamoeba histolytica
SLAIRLCSLMFYHYFSCSQECSL

SEQ ID NO: 2588093 - protein, 17 aa, Entamoeba histolytica
SLANGFLSFYIYRKSLI

SEQ ID NO: 2588094 - protein, 21 aa, Entamoeba histolytica
SLATFIYKLVNFETGTFSTNS

SEQ ID NO: 2588095 - protein, 25 aa, Entamoeba histolytica
SLCCRAEGKYSLFSLKKEDDELPKT

SEQ ID NO: 2588096 - protein, 22 aa, Entamoeba histolytica
SLCGVGCFNCLYDGYCESCMKG

SEQ ID NO: 2588097 - protein, 22 aa, Entamoeba histolytica
SLCKRCEVGYSFGMKTESNKCI

SEQ ID NO: 2588098 - protein, 17 aa, Entamoeba histolytica
SLCLECSDSYYLTTMGK

SEQ ID NO: 2588099 - protein, 22 aa, Entamoeba histolytica
SLCLIMEYFPLGSIRKFYTEHE

SEQ ID NO: 2588100 - protein, 25 aa, Entamoeba histolytica
SLCLNCMSCCSIPLLIIIVGLFDVW

SEQ ID NO: 2588101 - protein, 20 aa, Entamoeba histolytica
SLCLPIVWVAQSAKLCLVKY

SEQ ID NO: 2588102 - protein, 21 aa, Entamoeba histolytica
SLCPTNCRRCINNKCILCDDY

SEQ ID NO: 2588103 - protein, 18 aa, Entamoeba histolytica
SLCVPKCDIEGCINGCIS

SEQ ID NO: 2588104 - protein, 31 aa, Entamoeba histolytica
SLDIPESIKSNAIWNICRLEDYHVVSSIIRT

SEQ ID NO: 2588105 - protein, 17 aa, Entamoeba histolytica
SLDKTYLMEAYDYLFSS

SEQ ID NO: 2588106 - protein, 20 aa, Entamoeba histolytica
SLDMDFTFLLIFYSLKSRKP

SEQ ID NO: 2588107 - protein, 25 aa, Entamoeba histolytica
SLDQLCVIDEPLFLEVFVKLLKQIE

SEQ ID NO: 2588108 - protein, 21 aa, Entamoeba histolytica
SLDRIFEIYLILSKELNRPIT

SEQ ID NO: 2588109 - protein, 18 aa, Entamoeba histolytica
SLEIEGIYFTTQLVQCQI

SEQ ID NO: 2588110 - protein, 21 aa, Entamoeba histolytica
SLELYVPFLFVFVHLITSPNG

SEQ ID NO: 2588111 - protein, 24 aa, Entamoeba histolytica
SLENKRILFNFAFESLTSDEEERF

SEQ ID NO: 2588112 - protein, 23 aa, Entamoeba histolytica
SLESALRITICLLSQLDYQVTKT

SEQ ID NO: 2588113 - protein, 22 aa, Entamoeba histolytica
SLETFSFFLEVAKFCIALNDFN

SEQ ID NO: 2588114 - protein, 19 aa, Entamoeba histolytica
SLEWECQATYYGSILFYAL

SEQ ID NO: 2588115 - protein, 24 aa, Entamoeba histolytica
SLEYVRIECLDFMNLLKELIKTNK

SEQ ID NO: 2588116 - protein, 23 aa, Entamoeba histolytica
SLFARLIIHITFLIIESIDYTSG

SEQ ID NO: 2588117 - protein, 17 aa, Entamoeba histolytica
SLFEIKVFVEKGKRLEI

SEQ ID NO: 2588118 - protein, 21 aa, Entamoeba histolytica
SLFICGILLIIASCLMNGFFI

SEQ ID NO: 2588119 - protein, 21 aa, Entamoeba histolytica
SLFLICYPEYISQQTFVDDNN

SEQ ID NO: 2588120 - protein, 19 aa, Entamoeba histolytica
SLFLKSEWILEGINDNNSL

SEQ ID NO: 2588121 - protein, 20 aa, Entamoeba histolytica
SLFLLFQFLYLMFLITLGLS

SEQ ID NO: 2588122 - protein, 17 aa, Entamoeba histolytica
SLFVYKTHQGILKWLGL

SEQ ID NO: 2588123 - protein, 25 aa, Entamoeba histolytica
SLGETAIKCSWSISNENIVSDFVYF

SEQ ID NO: 2588124 - protein, 23 aa, Entamoeba histolytica
SLHNKRSLAFVIQFLECVEPPCC

SEQ ID NO: 2588125 - protein, 23 aa, Entamoeba histolytica
SLICKPDDVPNCDFQDENICVQC

SEQ ID NO: 2588126 - protein, 21 aa, Entamoeba histolytica
SLIFCCISSIITLILIYLLIQ

SEQ ID NO: 2588127 - protein, 26 aa, Entamoeba histolytica
SLIGWKIQHYVVWFILFSLFLDCAIS

SEQ ID NO: 2588128 - protein, 18 aa, Entamoeba histolytica
SLIHLWESIIQCFKVRKN

SEQ ID NO: 2588129 - protein, 18 aa, Entamoeba histolytica
SLILAFAVPNSVDKCLAK

SEQ ID NO: 2588130 - protein, 18 aa, Entamoeba histolytica
SLILKNESIVNWVVVDSI

SEQ ID NO: 2588131 - protein, 21 aa, Entamoeba histolytica
SLILPMYGIITLKGTFVNKKR

SEQ ID NO: 2588132 - protein, 18 aa, Entamoeba histolytica
SLIQNWRDAFLVRKDLSL

SEQ ID NO: 2588133 - protein, 28 aa, Entamoeba histolytica
SLIRAVIKREWWPFLLSFIAITISQIAM

SEQ ID NO: 2588134 - protein, 20 aa, Entamoeba histolytica
SLIYRLSEFYNINGVIDTLS

SEQ ID NO: 2588135 - protein, 21 aa, Entamoeba histolytica
SLKEITCLHLSSIQSINQQYY

SEQ ID NO: 2588136 - protein, 17 aa, Entamoeba histolytica
SLKKCIIEFPKPVYHLH

SEQ ID NO: 2588137 - protein, 19 aa, Entamoeba histolytica
SLKMKRLTLNIDIFIITFI

SEQ ID NO: 2588138 - protein, 28 aa, Entamoeba histolytica
SLKQIYRLKLMWCEIEPFTCFFEGNQIP

SEQ ID NO: 2588139 - protein, 18 aa, Entamoeba histolytica
SLLDLSLISCKSRKSIPS

SEQ ID NO: 2588140 - protein, 24 aa, Entamoeba histolytica
SLLGCMKIGLTIYYSIKQTDKLAS

SEQ ID NO: 2588141 - protein, 29 aa, Entamoeba histolytica
SLLKCSNIFCGWSCTYERGIDNFYNGVFF

SEQ ID NO: 2588142 - protein, 26 aa, Entamoeba histolytica
SLLKHFPTLLCWDEFDQKLKPMELEI

SEQ ID NO: 2588143 - protein, 22 aa, Entamoeba histolytica
SLLKIREFFFISAMTGSVIMLV

SEQ ID NO: 2588144 - protein, 17 aa, Entamoeba histolytica
SLLKNIRSPYVVSTIGY

SEQ ID NO: 2588145 - protein, 24 aa, Entamoeba histolytica
SLLLCGGLTILAYVLFPTLPQKNH

SEQ ID NO: 2588146 - protein, 20 aa, Entamoeba histolytica
SLLLLFQFFYLMFLITLGLS

SEQ ID NO: 2588147 - protein, 18 aa, Entamoeba histolytica
SLLNWARKLSPIDVNKVE

SEQ ID NO: 2588148 - protein, 26 aa, Entamoeba histolytica
SLLQMKLDILFICFLLVLLSFLAGLC

SEQ ID NO: 2588149 - protein, 27 aa, Entamoeba histolytica
SLLSTCRLSIILLWSILFVLSLLFFYT

SEQ ID NO: 2588150 - protein, 26 aa, Entamoeba histolytica
SLLVDAYSLWKGHRLEYRRFTFHSSK

SEQ ID NO: 2588151 - protein, 23 aa, Entamoeba histolytica
SLMQKKFQSIISMVVQYDTKDVH

SEQ ID NO: 2588152 - protein, 19 aa, Entamoeba histolytica
SLMSLYPYKTFFSVKSDIP

SEQ ID NO: 2588153 - protein, 18 aa, Entamoeba histolytica
SLNGRTTVYLGVDQTPGD

SEQ ID NO: 2588154 - protein, 25 aa, Entamoeba histolytica
SLNTKSQRASECIDSKVINNTNEAK

SEQ ID NO: 2588155 - protein, 24 aa, Entamoeba histolytica
SLPEGRCKKIFFGCYDNELEEFTD

SEQ ID NO: 2588156 - protein, 26 aa, Entamoeba histolytica
SLPEMMRLPIIQGFIGRSECAVEPEV

SEQ ID NO: 2588157 - protein, 18 aa, Entamoeba histolytica
SLPIASSIICLKKAPESL

SEQ ID NO: 2588158 - protein, 20 aa, Entamoeba histolytica
SLPILLCLVFIHPILLLVPL

SEQ ID NO: 2588159 - protein, 19 aa, Entamoeba histolytica
SLPLFKIKPVWILTIIQCV

SEQ ID NO: 2588160 - protein, 17 aa, Entamoeba histolytica
SLPSLFVCTIFLFINPY

SEQ ID NO: 2588161 - protein, 21 aa, Entamoeba histolytica
SLQRAMCRKKVNIIFYTVLIV

SEQ ID NO: 2588162 - protein, 27 aa, Entamoeba histolytica
SLQRIPTCMGMALTCRSNLQRIAHKLI

SEQ ID NO: 2588163 - protein, 25 aa, Entamoeba histolytica
SLQTFFPPMLPFLFRSLTQPKQPLP

SEQ ID NO: 2588164 - protein, 18 aa, Entamoeba histolytica
SLQTGYLYFLFVGVNEEY

SEQ ID NO: 2588165 - protein, 25 aa, Entamoeba histolytica
SLRGCAKPTKISLCCRAEGKYSLFS

SEQ ID NO: 2588166 - protein, 21 aa, Entamoeba histolytica
SLRLKRFYISQIRRETGSIRK

SEQ ID NO: 2588167 - protein, 19 aa, Entamoeba histolytica
SLSEGLIFIIVYTLMSICL

SEQ ID NO: 2588168 - protein, 20 aa, Entamoeba histolytica
SLSGCTTCKKGNYLNSTCYP

SEQ ID NO: 2588169 - protein, 17 aa, Entamoeba histolytica
SLSKMWGKREVSYDLKI

SEQ ID NO: 2588170 - protein, 24 aa, Entamoeba histolytica
SLSLFPLFNLDFFISPKLHYLMFS

SEQ ID NO: 2588171 - protein, 24 aa, Entamoeba histolytica
SLSVKISVALPANFREMLSQIECL

SEQ ID NO: 2588172 - protein, 24 aa, Entamoeba histolytica
SLTGEWKNKMLVGPFESILIGQRS

SEQ ID NO: 2588173 - protein, 25 aa, Entamoeba histolytica
SLTNEFIELFVPLQIQRKVGEIGIV

SEQ ID NO: 2588174 - protein, 23 aa, Entamoeba histolytica
SLTNGRLAILGSIDMLNNTYFEK

SEQ ID NO: 2588175 - protein, 20 aa, Entamoeba histolytica
SLTTFELLKNYSLKKLLQLG

SEQ ID NO: 2588176 - protein, 23 aa, Entamoeba histolytica
SLTWCAQGSLLTRCSKPEKRGRN

SEQ ID NO: 2588177 - protein, 18 aa, Entamoeba histolytica
SLVFKTRKIWGFCILTIS

SEQ ID NO: 2588178 - protein, 19 aa, Entamoeba histolytica
SLVIIRLFIHFVLSSDDYF

SEQ ID NO: 2588179 - protein, 23 aa, Entamoeba histolytica
SLVLNCYAGLWAYVATCIKTFTT

SEQ ID NO: 2588180 - protein, 29 aa, Entamoeba histolytica
SLVTYCAAPMPFVIGCLRTLYPEIQNECG

SEQ ID NO: 2588181 - protein, 17 aa, Entamoeba histolytica
SLWEIVPLTALVILFWN

SEQ ID NO: 2588182 - protein, 19 aa, Entamoeba histolytica
SLYLFIGGIIFQLCSGIIS

SEQ ID NO: 2588183 - protein, 17 aa, Entamoeba histolytica
SLYQLRLNISFASLPSL

SEQ ID NO: 2588184 - protein, 21 aa, Entamoeba histolytica
SLYQVCWSVGKAFGFLFGGML

SEQ ID NO: 2588185 - protein, 24 aa, Entamoeba histolytica
SLYSRFSFQNGRLITPYIPIHQNG

SEQ ID NO: 2588186 - protein, 23 aa, Entamoeba histolytica
SLYVCLEIIKLIQAFFIENDEDI

SEQ ID NO: 2588187 - protein, 26 aa, Entamoeba histolytica
SMAILPICISIVFSKCCRQSLAQLRI

SEQ ID NO: 2588188 - protein, 18 aa, Entamoeba histolytica
SMECLAVLCETYRTLGDA

SEQ ID NO: 2588189 - protein, 25 aa, Entamoeba histolytica
SMFIFPRYLSIFSIAVYLSTIIIRQ

SEQ ID NO: 2588190 - protein, 18 aa, Entamoeba histolytica
SMFKGILIMALRGLTDND

SEQ ID NO: 2588191 - protein, 27 aa, Entamoeba histolytica
SMFLLLLCFLSDLFLCEAQKQEWPLFH

SEQ ID NO: 2588192 - protein, 17 aa, Entamoeba histolytica
SMFLLVIMTVLTYIIPC

SEQ ID NO: 2588193 - protein, 17 aa, Entamoeba histolytica
SMHFIPSGIKWILSFSI

SEQ ID NO: 2588194 - protein, 17 aa, Entamoeba histolytica
SMHLVIFFSTLLPSLQD

SEQ ID NO: 2588195 - protein, 17 aa, Entamoeba histolytica
SMIACGFSIPKVSLASL

SEQ ID NO: 2588196 - protein, 21 aa, Entamoeba histolytica
SMLDKFRCDYIINFFGACCLK

SEQ ID NO: 2588197 - protein, 17 aa, Entamoeba histolytica
SMSCSKTNLGLIIPLIV

SEQ ID NO: 2588198 - protein, 24 aa, Entamoeba histolytica
SMSLCFFIEKLIELFKRRSNKEAA

SEQ ID NO: 2588199 - protein, 23 aa, Entamoeba histolytica
SMTFKSPILRTFKPIPQTHNLIN

SEQ ID NO: 2588200 - protein, 23 aa, Entamoeba histolytica
SMTKLSNFLSFFGSKALPNNPFY

SEQ ID NO: 2588201 - protein, 24 aa, Entamoeba histolytica
SMVCVFVGILFYYSFCNEFTTTNY

SEQ ID NO: 2588202 - protein, 18 aa, Entamoeba histolytica
SMYVRAGALLGIGTCCSG

SEQ ID NO: 2588203 - protein, 17 aa, Entamoeba histolytica
SNAFKNSLITMIEFPNS

SEQ ID NO: 2588204 - protein, 18 aa, Entamoeba histolytica
SNAFTFGGIRIVNKSLAN

SEQ ID NO: 2588205 - protein, 23 aa, Entamoeba histolytica
SNAKKPRASEVVKQKKEQKKALI

SEQ ID NO: 2588206 - protein, 20 aa, Entamoeba histolytica
SNAKTCCSRVGMAAYSNDGI

SEQ ID NO: 2588207 - protein, 25 aa, Entamoeba histolytica
SNALIPLSTCLEGTSTYYTSYTENG

SEQ ID NO: 2588208 - protein, 24 aa, Entamoeba histolytica
SNCLAHILCIVAMLAVDTQFFVSA

SEQ ID NO: 2588209 - protein, 22 aa, Entamoeba histolytica
SNCLMKDCKAIFSSELGYGLML

SEQ ID NO: 2588210 - protein, 26 aa, Entamoeba histolytica
SNDYLTWNWDEIFKLLTSLSQNMRYV

SEQ ID NO: 2588211 - protein, 27 aa, Entamoeba histolytica
SNFPTFKGKWWPSGVMDFFTMAPFITA

SEQ ID NO: 2588212 - protein, 20 aa, Entamoeba histolytica
SNGCGKDCVCKKGYTPDKKG

SEQ ID NO: 2588213 - protein, 17 aa, Entamoeba histolytica
SNHGICFNYIDKINQEQ

SEQ ID NO: 2588214 - protein, 27 aa, Entamoeba histolytica
SNIAPALVCCRLFFRLTKQSKIYLSSS

SEQ ID NO: 2588215 - protein, 24 aa, Entamoeba histolytica
SNICIPSSITKEFVSYPGVCSETT

SEQ ID NO: 2588216 - protein, 30 aa, Entamoeba histolytica
SNIHKRMYKKYKKHIKCEVSEEVSKGTTEE

SEQ ID NO: 2588217 - protein, 20 aa, Entamoeba histolytica
SNIIFPFVIQYNHYVQQAGY

SEQ ID NO: 2588218 - protein, 25 aa, Entamoeba histolytica
SNIIKEIKGWFGIDESKEIESLFKP

SEQ ID NO: 2588219 - protein, 19 aa, Entamoeba histolytica
SNIKMNEFYGVICSNIDEI

SEQ ID NO: 2588220 - protein, 20 aa, Entamoeba histolytica
SNILELIFCVIMLYMKGNKK

SEQ ID NO: 2588221 - protein, 23 aa, Entamoeba histolytica
SNIPTACVYVCNLRNVIGTLSNV

SEQ ID NO: 2588222 - protein, 24 aa, Entamoeba histolytica
SNKCIYRYDHYCGFIGNSLGFHNY

SEQ ID NO: 2588223 - protein, 25 aa, Entamoeba histolytica
SNKHKRLYNVYNVHLKGEAIHEVSD

SEQ ID NO: 2588224 - protein, 22 aa, Entamoeba histolytica
SNKKAWKYALISILSIVDMDLC

SEQ ID NO: 2588225 - protein, 19 aa, Entamoeba histolytica
SNKRGLLISRIFQTKIKII

SEQ ID NO: 2588226 - protein, 26 aa, Entamoeba histolytica
SNLEVPKSIPFLYSLTNKWNQMDFIY

SEQ ID NO: 2588227 - protein, 24 aa, Entamoeba histolytica
SNLLDVCRGFSLADRLRNCVEHLN

SEQ ID NO: 2588228 - protein, 22 aa, Entamoeba histolytica
SNLLEEFCQEFGHLGDTKEDKI

SEQ ID NO: 2588229 - protein, 19 aa, Entamoeba histolytica
SNLMKRGALQVSQILITHS

SEQ ID NO: 2588230 - protein, 20 aa, Entamoeba histolytica
SNLPIFYGHENTIEGTTLYY

SEQ ID NO: 2588231 - protein, 22 aa, Entamoeba histolytica
SNLPRHLLVAFLYNTSCYFYWI

SEQ ID NO: 2588232 - protein, 26 aa, Entamoeba histolytica
SNLPYIEDILPFGLYIKIDDQQIELF

SEQ ID NO: 2588233 - protein, 18 aa, Entamoeba histolytica
SNLSTAICQCFLPPKQSV

SEQ ID NO: 2588234 - protein, 18 aa, Entamoeba histolytica
SNLSTAICQCFLPQKDNV

SEQ ID NO: 2588235 - protein, 25 aa, Entamoeba histolytica
SNNFELFTSFILKWRYNKINEDYKN

SEQ ID NO: 2588236 - protein, 22 aa, Entamoeba histolytica
SNPLKTVIVIGAIVITIGAIGA

SEQ ID NO: 2588237 - protein, 24 aa, Entamoeba histolytica
SNQKRPKILVSYIDYYFEKPNKGS

SEQ ID NO: 2588238 - protein, 21 aa, Entamoeba histolytica
SNQLLPLFIDKFFNQFNKGTV

SEQ ID NO: 2588239 - protein, 30 aa, Entamoeba histolytica; identical to SEQ ID NO: 2390492

SEQ ID NO: 2588240 - protein, 22 aa, Entamoeba histolytica
SNRFEFGFKDELVFDGIKQLLK

SEQ ID NO: 2588241 - protein, 22 aa, Entamoeba histolytica
SNRFKQFLINGLLETLPGFTQI

SEQ ID NO: 2588242 - protein, 21 aa, Entamoeba histolytica
SNSFEPILWISFDNILNDFDI

SEQ ID NO: 2588243 - protein, 17 aa, Entamoeba histolytica
SNSFSETASDVWSSPTC

SEQ ID NO: 2588244 - protein, 20 aa, Entamoeba histolytica
SNSICLSCAEGYYRHNESEK

SEQ ID NO: 2588245 - protein, 24 aa, Entamoeba histolytica
SNSNTCKLCFDGFVLNGLKCVSYK

SEQ ID NO: 2588246 - protein, 18 aa, Entamoeba histolytica
SNSSKPSSFFTIHSSRRW

SEQ ID NO: 2588247 - protein, 23 aa, Entamoeba histolytica
SNSVCGTLAWTAPEMLKGKPVST

SEQ ID NO: 2588248 - protein, 21 aa, Entamoeba histolytica
SNTLLSIERIHLVNPKSVLTL

SEQ ID NO: 2588249 - protein, 19 aa, Entamoeba histolytica
SNTLMTMYWLFKNQPQMCD

SEQ ID NO: 2588250 - protein, 20 aa, Entamoeba histolytica
SNTYLPWSVTFSINASGPGL

SEQ ID NO: 2588251 - protein, 22 aa, Entamoeba histolytica
SNVLETILFCFSNALNDPLLVQ

SEQ ID NO: 2588252 - protein, 17 aa, Entamoeba histolytica
SNWKINIIVIILLLNFF

SEQ ID NO: 2588253 - protein, 19 aa, Entamoeba histolytica
SNWYSYLFYFVIGITPLIQ

SEQ ID NO: 2588254 - protein, 24 aa, Entamoeba histolytica
SNYFKAIVCGIIIFFVKLWTIQEN

SEQ ID NO: 2588255 - protein, 22 aa, Entamoeba histolytica
SNYRVGTDIECKCKLTTSGSIE

SEQ ID NO: 2588256 - protein, 17 aa, Entamoeba histolytica
SPAIPFVCKTNADIQFK

SEQ ID NO: 2588257 - protein, 17 aa, Entamoeba histolytica
SPECANNLYLRGMAFTV

SEQ ID NO: 2588258 - protein, 21 aa, Entamoeba histolytica
SPEHCLSCNFEKGFYLAESNE

SEQ ID NO: 2588259 - protein, 31 aa, Entamoeba histolytica; identical to SEQ ID NO: 2390515

SEQ ID NO: 2588260 - protein, 17 aa, Entamoeba histolytica
SPEQALRSLLFCDTPSL

SEQ ID NO: 2588261 - protein, 18 aa, Entamoeba histolytica
SPETWNFLVLNKDNKKHY

SEQ ID NO: 2588262 - protein, 17 aa, Entamoeba histolytica
SPFILKFKELNENISNI

SEQ ID NO: 2588263 - protein, 26 aa, Entamoeba histolytica
SPFYCKEVLLGIGFTCLKSLSKEQLL

SEQ ID NO: 2588264 - protein, 26 aa, Entamoeba histolytica
SPGLLRISSFIKMGSILKRFIQKLEE

SEQ ID NO: 2588265 - protein, 17 aa, Entamoeba histolytica
SPHQIVIFTDGYCRGTC

SEQ ID NO: 2588266 - protein, 17 aa, Entamoeba histolytica
SPHSKPLLSNRVNISKQ

SEQ ID NO: 2588267 - protein, 19 aa, Entamoeba histolytica
SPILTKRYFALLTNELDID

SEQ ID NO: 2588268 - protein, 20 aa, Entamoeba histolytica
SPKGNEPPAKVEGNSLQSKQ

SEQ ID NO: 2588269 - protein, 19 aa, Entamoeba histolytica
SPKITWRHQIMLWYAGLRG

SEQ ID NO: 2588270 - protein, 23 aa, Entamoeba histolytica
SPKKSFLRFILKSKSNMVSKNLK

SEQ ID NO: 2588271 - protein, 18 aa, Entamoeba histolytica
SPKLSYNDWYFVFYKIFF

SEQ ID NO: 2588272 - protein, 18 aa, Entamoeba histolytica
SPLKRISIKEVICSLQKI

SEQ ID NO: 2588273 - protein, 20 aa, Entamoeba histolytica
SPNECSTCQQPAYQWDCHSC

SEQ ID NO: 2588274 - protein, 23 aa, Entamoeba histolytica
SPNFHCLDIPTLILTEPKTPMHN

SEQ ID NO: 2588275 - protein, 19 aa, Entamoeba histolytica
SPNGFRGSYNLENAVISRN

SEQ ID NO: 2588276 - protein, 19 aa, Entamoeba histolytica
SPQHLSFFIPIEYPSNTSL

SEQ ID NO: 2588277 - protein, 20 aa, Entamoeba histolytica
SPRIYCLSNKCGNNILDKGE

SEQ ID NO: 2588278 - protein, 18 aa, Entamoeba histolytica
SPSCCFFPGEGITIHMNI

SEQ ID NO: 2588279 - protein, 17 aa, Entamoeba histolytica
SPTLLALTLIIIGIIYS

SEQ ID NO: 2588280 - protein, 24 aa, Entamoeba histolytica
SPVCAKLTDFGTCRNISERSLSAK

SEQ ID NO: 2588281 - protein, 24 aa, Entamoeba histolytica
SPVCAKLTDFGTCRNISERSLSVK

SEQ ID NO: 2588282 - protein, 20 aa, Entamoeba histolytica
SPVIQWFWEIFNEMEQRQKV

SEQ ID NO: 2588283 - protein, 23 aa, Entamoeba histolytica
SPWNCLDPELGFIFENNEIVWLG

SEQ ID NO: 2588284 - protein, 18 aa, Entamoeba histolytica
SPYVFDLLDVMVKSAVEQ

SEQ ID NO: 2588285 - protein, 17 aa, Entamoeba histolytica
SQCLQCEIGYFVNNGKC

SEQ ID NO: 2588286 - protein, 18 aa, Entamoeba histolytica
SQDPILRPPFSEIVDKLS

SEQ ID NO: 2588287 - protein, 17 aa, Entamoeba histolytica
SQECGKWGETQEIEMKE

SEQ ID NO: 2588288 - protein, 24 aa, Entamoeba histolytica
SQEECKYLNLYNNMVLRVTSDSYP

SEQ ID NO: 2588289 - protein, 25 aa, Entamoeba histolytica
SQESINSFLMLLPFQSFSNKSLIDT

SEQ ID NO: 2588290 - protein, 18 aa, Entamoeba histolytica
SQFFKDLFKGYLKCTTNL

SEQ ID NO: 2588291 - protein, 21 aa, Entamoeba histolytica
SQFYPLRLVRDYIATLIDESH

SEQ ID NO: 2588292 - protein, 20 aa, Entamoeba histolytica
SQGQYGLSWQGWVLSLLLSC

SEQ ID NO: 2588293 - protein, 21 aa, Entamoeba histolytica
SQHKYILSIAFFLIGGAITEA

SEQ ID NO: 2588294 - protein, 18 aa, Entamoeba histolytica
SQIAKLCYDDVPEKNRNV

SEQ ID NO: 2588295 - protein, 25 aa, Entamoeba histolytica
SQIKLLSLILYYCIVSSMGSITFNL

SEQ ID NO: 2588296 - protein, 17 aa, Entamoeba histolytica
SQIMFIGIMIYKENVIE

SEQ ID NO: 2588297 - protein, 18 aa, Entamoeba histolytica
SQIYREIIFMKIIRNSYI

SEQ ID NO: 2588298 - protein, 19 aa, Entamoeba histolytica
SQKERRSTAPISIEDFVTY

SEQ ID NO: 2588299 - protein, 24 aa, Entamoeba histolytica
SQKLFCLSHPFLMGIPHGDIVDSV

SEQ ID NO: 2588300 - protein, 18 aa, Entamoeba histolytica
SQKMNWKAIINILNLAAV

SEQ ID NO: 2588301 - protein, 25 aa, Entamoeba histolytica
SQLPYEFVVETGKTRIFFVSVPETT

SEQ ID NO: 2588302 - protein, 25 aa, Entamoeba histolytica
SQLTRLPIFRFLRNSNELFMQMLST

SEQ ID NO: 2588303 - protein, 23 aa, Entamoeba histolytica
SQMIDLRYDLSFMSKVLVAILRM

SEQ ID NO: 2588304 - protein, 26 aa, Entamoeba histolytica
SQNQMKEYIQLFLPIILLMGKTALPQ

SEQ ID NO: 2588305 - protein, 19 aa, Entamoeba histolytica
SQPFTRVIGTISIILFLIS

SEQ ID NO: 2588306 - protein, 18 aa, Entamoeba histolytica
SQQCAICNDGYYRDGKGC

SEQ ID NO: 2588307 - protein, 22 aa, Entamoeba histolytica
SQRRLESCVIFDGTDYRFLGFK

SEQ ID NO: 2588308 - protein, 23 aa, Entamoeba histolytica
SQSKFFFDDFVSVLGVDNDGIDA

SEQ ID NO: 2588309 - protein, 22 aa, Entamoeba histolytica
SQSKLVYLPALRFFGNLSSKDS

SEQ ID NO: 2588310 - protein, 30 aa, Entamoeba histolytica
SQSKRPSLFLVIFKLEWKMFLLCYITMVIY

SEQ ID NO: 2588311 - protein, 23 aa, Entamoeba histolytica
SQSPRIIVMSSLSAADWHQKEIP

SEQ ID NO: 2588312 - protein, 18 aa, Entamoeba histolytica
SQSTCIQESDVVCGNHAY

SEQ ID NO: 2588313 - protein, 25 aa, Entamoeba histolytica
SQTCSCLNGFIPLKGSSRCIPKSCG

SEQ ID NO: 2588314 - protein, 23 aa, Entamoeba histolytica
SQVCGKLTDFGTCRNISERALQL

SEQ ID NO: 2588315 - protein, 19 aa, Entamoeba histolytica
SQVLKVFYPPTFKESLQNE

SEQ ID NO: 2588316 - protein, 29 aa, Entamoeba histolytica
SQVVLREENRWFIPIAIVGVILIVSIVLF

SEQ ID NO: 2588317 - protein, 29 aa, Entamoeba histolytica
SQYIKFFEWFFFDYYENVLFAGVDANGSL

SEQ ID NO: 2588318 - protein, 20 aa, Entamoeba histolytica
SQYSCCGWFSINTMTCKSLA

SEQ ID NO: 2588319 - protein, 28 aa, Entamoeba histolytica
SQYTPCYWRSVVGFGFVFMNYVMEVFER

SEQ ID NO: 2588320 - protein, 22 aa, Entamoeba histolytica
SRAKAKLIRLLTSVAEHFFNTA

SEQ ID NO: 2588321 - protein, 19 aa, Entamoeba histolytica
SRCGQCLEITGPTQRPFVC

SEQ ID NO: 2588322 - protein, 20 aa, Entamoeba histolytica
SRCGRCVLKMDHHCPFVGSC

SEQ ID NO: 2588323 - protein, 26 aa, Entamoeba histolytica
SRCSRNKIWFGKLIEIERNLCNLNNQ

SEQ ID NO: 2588324 - protein, 19 aa, Entamoeba histolytica
SRFSLKAQFDHCDYQVFYK

SEQ ID NO: 2588325 - protein, 28 aa, Entamoeba histolytica
SRGFSYITFIFLFLCFIAYTLIATLVLD

SEQ ID NO: 2588326 - protein, 17 aa, Entamoeba histolytica
SRGMCLDNSYPSIPEDA

SEQ ID NO: 2588327 - protein, 21 aa, Entamoeba histolytica
SRIELLTGITSLFHAIGIFLF

SEQ ID NO: 2588328 - protein, 23 aa, Entamoeba histolytica
SRIGGEILIILGLTENSQLYENY

SEQ ID NO: 2588329 - protein, 18 aa, Entamoeba histolytica
SRIIPLNGQVYFPKDILR

SEQ ID NO: 2588330 - protein, 17 aa, Entamoeba histolytica
SRIKCYLFVKNLLRCIV

SEQ ID NO: 2588331 - protein, 19 aa, Entamoeba histolytica
SRLEIEIHPDLTLNIHVGF

SEQ ID NO: 2588332 - protein, 21 aa, Entamoeba histolytica
SRLRYGYGNTFEFKDLKSSGI

SEQ ID NO: 2588333 - protein, 21 aa, Entamoeba histolytica
SRMDRSEISGFLYSNGQKQNK

SEQ ID NO: 2588334 - protein, 18 aa, Entamoeba histolytica
SRQLTLKGYSLFSKVKVN

SEQ ID NO: 2588335 - protein, 25 aa, Entamoeba histolytica
SRRDCSRTGLRFSSRGGDINGNVSN

SEQ ID NO: 2588336 - protein, 21 aa, Entamoeba histolytica
SRRVIGFSVFNIVIVFIFIIV

SEQ ID NO: 2588337 - protein, 17 aa, Entamoeba histolytica
SRSFVLESFEAMVDELL

SEQ ID NO: 2588338 - protein, 23 aa, Entamoeba histolytica
SRTWKSLVTQSIFDISGKYKLKA

SEQ ID NO: 2588339 - protein, 18 aa, Entamoeba histolytica
SRWGKRRPFLLLGNLIVI

SEQ ID NO: 2588340 - protein, 17 aa, Entamoeba histolytica
SRYLYKIIKDIYFPNKE

SEQ ID NO: 2588341 - protein, 24 aa, Entamoeba histolytica
SSALRLLVPSTWYSKDFINDALII

SEQ ID NO: 2588342 - protein, 30 aa, Entamoeba histolytica
SSATRLKRAMWWKNIKLYLIAGAILLIFLL

SEQ ID NO: 2588343 - protein, 17 aa, Entamoeba histolytica
SSCIKLFSFHVISLLLL

SEQ ID NO: 2588344 - protein, 25 aa, Entamoeba histolytica
SSCKANFCTENDWSFEGEIVGFADY

SEQ ID NO: 2588345 - protein, 19 aa, Entamoeba histolytica
SSCKTCPKNQVANLQKTSN

SEQ ID NO: 2588346 - protein, 21 aa, Entamoeba histolytica
SSCNSYRPLIMNDDSEICGNT

SEQ ID NO: 2588347 - protein, 23 aa, Entamoeba histolytica
SSDCKRKLIQVVIKLVTFNDSGI

SEQ ID NO: 2588348 - protein, 17 aa, Entamoeba histolytica
SSDFAFVDEMNWFEILL

SEQ ID NO: 2588349 - protein, 18 aa, Entamoeba histolytica
SSEFPLFSTYVALFRCGQ

SEQ ID NO: 2588350 - protein, 18 aa, Entamoeba histolytica
SSENIWLDRQIYGEGQGL

SEQ ID NO: 2588351 - protein, 26 aa, Entamoeba histolytica
SSEQFKMPWDIAKFVIAGKRLERKDT

SEQ ID NO: 2588352 - protein, 19 aa, Entamoeba histolytica
SSERARSSVLVKIGERIVL

SEQ ID NO: 2588353 - protein, 17 aa, Entamoeba histolytica
SSFEAPLAFMSMSLLHF

SEQ ID NO: 2588354 - protein, 30 aa, Entamoeba histolytica
SSFFIASFILCCVACFGVFIFQPTFSCDVS

SEQ ID NO: 2588355 - protein, 17 aa, Entamoeba histolytica
SSFIFNVLIELFLSICW

SEQ ID NO: 2588356 - protein, 28 aa, Entamoeba histolytica
SSFKNDVLQCFVSFLPLISSGLCYCQLT

SEQ ID NO: 2588357 - protein, 19 aa, Entamoeba histolytica
SSFLSRIFIGKKIRYGQLI

SEQ ID NO: 2588358 - protein, 23 aa, Entamoeba histolytica
SSFQCAYSLIDIKHQYPIRSEKS

SEQ ID NO: 2588359 - protein, 27 aa, Entamoeba histolytica
SSFYILRFIAPMPFYLVTGSSLQLAIF

SEQ ID NO: 2588360 - protein, 18 aa, Entamoeba histolytica
SSGSIVFCIEGYYTNGLQ

SEQ ID NO: 2588361 - protein, 38 aa, Entamoeba histolytica; identical to SEQ ID NO: 2390656

SEQ ID NO: 2588362 - protein, 17 aa, Entamoeba histolytica
SSHFFRDTIPIIASLAA

SEQ ID NO: 2588363 - protein, 22 aa, Entamoeba histolytica
SSHKCKKCEVGSFFNRETKKCE

SEQ ID NO: 2588364 - protein, 19 aa, Entamoeba histolytica
SSIEIINGIVLIGSNENKS

SEQ ID NO: 2588365 - protein, 19 aa, Entamoeba histolytica
SSIFIGFLMAVSFVMIMTM

SEQ ID NO: 2588366 - protein, 25 aa, Entamoeba histolytica
SSIKIHSCDFLFPMNFPQSLQSLDL

SEQ ID NO: 2588367 - protein, 23 aa, Entamoeba histolytica
SSIPIYISSGFGYVKVIGSDGLA

SEQ ID NO: 2588368 - protein, 21 aa, Entamoeba histolytica
SSIPMALKMIRLHLKGKVKQG

SEQ ID NO: 2588369 - protein, 29 aa, Entamoeba histolytica
SSISKAAIDLCRLVFPLSRDKNPRVRNQV

SEQ ID NO: 2588370 - protein, 20 aa, Entamoeba histolytica
SSKCFLDLSSVILVKLTNTI

SEQ ID NO: 2588371 - protein, 20 aa, Entamoeba histolytica
SSKDQRLWISPILLSESISV

SEQ ID NO: 2588372 - protein, 25 aa, Entamoeba histolytica
SSKDYCYWIDLIGIVLPFTVSVKQT

SEQ ID NO: 2588373 - protein, 17 aa, Entamoeba histolytica
SSKEKFIKWRNYQTCQE

SEQ ID NO: 2588374 - protein, 21 aa, Entamoeba histolytica
SSKQFPLMLFIGSSDNSNKII

SEQ ID NO: 2588375 - protein, 26 aa, Entamoeba histolytica
SSKYSYSVCCLILLLIFKKKTRTNIF

SEQ ID NO: 2588376 - protein, 20 aa, Entamoeba histolytica
SSLCRDKFKHLYDFNLIEAV

SEQ ID NO: 2588377 - protein, 24 aa, Entamoeba histolytica
SSLFWNFPRACLAGFMFNFASYFY

SEQ ID NO: 2588378 - protein, 17 aa, Entamoeba histolytica
SSLICLYKNGGHSKYVN

SEQ ID NO: 2588379 - protein, 20 aa, Entamoeba histolytica
SSLLKLLRFQIVQLQVATDS

SEQ ID NO: 2588380 - protein, 25 aa, Entamoeba histolytica
SSLNHCFPCTSLANQLCQKDNGTSS

SEQ ID NO: 2588381 - protein, 17 aa, Entamoeba histolytica
SSLPSFVEAVNCTEFQM

SEQ ID NO: 2588382 - protein, 18 aa, Entamoeba histolytica
SSLPWLVFIYLIKPVMSI

SEQ ID NO: 2588383 - protein, 19 aa, Entamoeba histolytica
SSLPWLVFIYLIKPVMSIS

SEQ ID NO: 2588384 - protein, 17 aa, Entamoeba histolytica
SSLRGLVKVILELFSQW

SEQ ID NO: 2588385 - protein, 40 aa, Entamoeba histolytica
SSLSLFFLHFWRSCLIFIVLPSFYIFKIITFASLITGITG

SEQ ID NO: 2588386 - protein, 17 aa, Entamoeba histolytica
SSLYCKVMNVAKTTKIK

SEQ ID NO: 2588387 - protein, 28 aa, Entamoeba histolytica
SSLYMFRWLTLLCCMEFTLFETFMYWDF

SEQ ID NO: 2588388 - protein, 28 aa, Entamoeba histolytica
SSMKLYPSQFVWFRHIYLAFSTYTKLNQ

SEQ ID NO: 2588389 - protein, 21 aa, Entamoeba histolytica
SSMSPRIAYSLIQSLKTKILP

SEQ ID NO: 2588390 - protein, 24 aa, Entamoeba histolytica
SSNHPNGWFKLGIIKQYIDKDNKY

SEQ ID NO: 2588391 - protein, 19 aa, Entamoeba histolytica
SSNITFIIRLCETTQVLHF

SEQ ID NO: 2588392 - protein, 18 aa, Entamoeba histolytica
SSNNELYYANSLKMKLSI

SEQ ID NO: 2588393 - protein, 19 aa, Entamoeba histolytica
SSNSMSSCYFCDTKNSYFI

SEQ ID NO: 2588394 - protein, 17 aa, Entamoeba histolytica
SSQCFYCPEGTYYEQGH

SEQ ID NO: 2588395 - protein, 25 aa, Entamoeba histolytica
SSQDFLKHICIVWNKCYYYISDRQL

SEQ ID NO: 2588396 - protein, 18 aa, Entamoeba histolytica
SSQGDKSLSQPVEGNSSP

SEQ ID NO: 2588397 - protein, 20 aa, Entamoeba histolytica
SSQINWKVISVIGPYHSGKS

SEQ ID NO: 2588398 - protein, 20 aa, Entamoeba histolytica
SSQTFPIVFAPSSNVRFRDV

SEQ ID NO: 2588399 - protein, 21 aa, Entamoeba histolytica
SSRCLQCKEGITMINNYCIYV

SEQ ID NO: 2588400 - protein, 27 aa, Entamoeba histolytica
SSRLPPPCPYTGIDWGVMDTLLVGSMD

SEQ ID NO: 2588401 - protein, 22 aa, Entamoeba histolytica
SSRNTHLFFLKPLIPIQLTEIF

SEQ ID NO: 2588402 - protein, 24 aa, Entamoeba histolytica
SSRSFKELINIILVTGNYLNSDYP

SEQ ID NO: 2588403 - protein, 23 aa, Entamoeba histolytica
SSSDSRFDLTILKFTNVPKYLTF

SEQ ID NO: 2588404 - protein, 24 aa, Entamoeba histolytica
SSSFLIDRLEVWTPTLPVSVPTSL

SEQ ID NO: 2588405 - protein, 26 aa, Entamoeba histolytica
SSSICLVCGNGMWSYISSSGCYSCKS

SEQ ID NO: 2588406 - protein, 19 aa, Entamoeba histolytica
SSSLIRWNPDHYADCINSP

SEQ ID NO: 2588407 - protein, 22 aa, Entamoeba histolytica
SSSSLWMRIPLYLLQDYPRQSR

SEQ ID NO: 2588408 - protein, 21 aa, Entamoeba histolytica
SSSYSGRGDYIFNYPHCPCDD

SEQ ID NO: 2588409 - protein, 18 aa, Entamoeba histolytica
SSTMEYLRTIPFFTPLID

SEQ ID NO: 2588410 - protein, 23 aa, Entamoeba histolytica
SSTPKKRGMFIVAFETENTIVPQ

SEQ ID NO: 2588411 - protein, 22 aa, Entamoeba histolytica
SSTPRKPIFLPLFTSSLSKQMT

SEQ ID NO: 2588412 - protein, 18 aa, Entamoeba histolytica
SSTSFTISWNSIISPNGF

SEQ ID NO: 2588413 - protein, 22 aa, Entamoeba histolytica
SSTYLIWYEYDYIKPNYESNKH

SEQ ID NO: 2588414 - protein, 23 aa, Entamoeba histolytica
SSVCGKLTDFGTCRNVSERSLAN

SEQ ID NO: 2588415 - protein, 23 aa, Entamoeba histolytica
SSVCIRCKAGYRLNGNLCDKCRE

SEQ ID NO: 2588416 - protein, 25 aa, Entamoeba histolytica
SSVFFFFKNEASIILGTSKGQTIKS

SEQ ID NO: 2588417 - protein, 32 aa, Entamoeba histolytica
SSVFKNKIGNFFELRKSVLVEGFKEEEKELRE

SEQ ID NO: 2588418 - protein, 17 aa, Entamoeba histolytica
SSVGFGVGIAFYYDWKV

SEQ ID NO: 2588419 - protein, 18 aa, Entamoeba histolytica
SSVIAKFMVFIGIVDILF

SEQ ID NO: 2588420 - protein, 23 aa, Entamoeba histolytica
SSVSFATCSLTYFRGFADSKHKS

SEQ ID NO: 2588421 - protein, 22 aa, Entamoeba histolytica
SSYHAWRYIALTGNASLIPAID

SEQ ID NO: 2588422 - protein, 20 aa, Entamoeba histolytica
SSYIEWWLIILMILFILCLF

SEQ ID NO: 2588423 - protein, 25 aa, Entamoeba histolytica
SSYIFSIVFICFWLGSIVISLNTKF

SEQ ID NO: 2588424 - protein, 19 aa, Entamoeba histolytica
SSYSGRGDYIFNYPHCPCD

SEQ ID NO: 2588425 - protein, 27 aa, Entamoeba histolytica
SSYWMKEIHEILKLLTPHALEDMMNEM

SEQ ID NO: 2588426 - protein, 19 aa, Entamoeba histolytica
STAICLGQTILKPGTTRAY

SEQ ID NO: 2588427 - protein, 19 aa, Entamoeba histolytica
STCQCIEGYSLKDHYCIST

SEQ ID NO: 2588428 - protein, 17 aa, Entamoeba histolytica
STECVASYCEPGYKFDR

SEQ ID NO: 2588429 - protein, 19 aa, Entamoeba histolytica
STFIETRCKGHFKIIHEII

SEQ ID NO: 2588430 - protein, 17 aa, Entamoeba histolytica
STFKMSFVQVVSTLIAL

SEQ ID NO: 2588431 - protein, 23 aa, Entamoeba histolytica
STFPLSCDKRVILLGAEDNENTC

SEQ ID NO: 2588432 - protein, 28 aa, Entamoeba histolytica
STGSKWEAFKWALISGVCEPFGALTVGA

SEQ ID NO: 2588433 - protein, 20 aa, Entamoeba histolytica
STGTEINNVIAIFKSCNTQK

SEQ ID NO: 2588434 - protein, 33 aa, Entamoeba histolytica
STHCKRLSKWMYIGLAIGCFFVTDIVLYLLVLF

SEQ ID NO: 2588435 - protein, 25 aa, Entamoeba histolytica
STHIYPRKATIWLVIVFLMITFSEF

SEQ ID NO: 2588436 - protein, 29 aa, Entamoeba histolytica
STHLKVVEDIGVLKPVVFAAVPRVLQLIY

SEQ ID NO: 2588437 - protein, 23 aa, Entamoeba histolytica
STICLICSSGYYKTNDGLCKKAQ

SEQ ID NO: 2588438 - protein, 24 aa, Entamoeba histolytica
STIDEIRNSYLLIYTYHDQGWKNL

SEQ ID NO: 2588439 - protein, 20 aa, Entamoeba histolytica
STIDLCIFNLIPFSLIYDVI

SEQ ID NO: 2588440 - protein, 18 aa, Entamoeba histolytica
STIFKLPFYLSTIISVFI

SEQ ID NO: 2588441 - protein, 24 aa, Entamoeba histolytica
STIKELECVKGDFFDSTIMNLIIS

SEQ ID NO: 2588442 - protein, 23 aa, Entamoeba histolytica
STILCVILVFGFIAIGIMYVIQP

SEQ ID NO: 2588443 - protein, 25 aa, Entamoeba histolytica
STILNEWRHSVVIITKCLELFTVIS

SEQ ID NO: 2588444 - protein, 17 aa, Entamoeba histolytica
STIQLVILLYQLINKNN

SEQ ID NO: 2588445 - protein, 19 aa, Entamoeba histolytica
STITTVLWIYGFASFVFCN

SEQ ID NO: 2588446 - protein, 24 aa, Entamoeba histolytica
STKDRFKLIYSLVSNSSYDYMGYS

SEQ ID NO: 2588447 - protein, 18 aa, Entamoeba histolytica
STKIKLRMPEGIDIVISK

SEQ ID NO: 2588448 - protein, 22 aa, Entamoeba histolytica
STLEGIPVTWSIDSVNGTKGNG

SEQ ID NO: 2588449 - protein, 19 aa, Entamoeba histolytica
STLELRKGNTSALIIGCDN

SEQ ID NO: 2588450 - protein, 23 aa, Entamoeba histolytica
STLKSSELWRLYNTKLIVTSILI

SEQ ID NO: 2588451 - protein, 19 aa, Entamoeba histolytica
STLLFPFITKKFFIEEYNL

SEQ ID NO: 2588452 - protein, 18 aa, Entamoeba histolytica
STLLILLVDFSRWYLNDH

SEQ ID NO: 2588453 - protein, 21 aa, Entamoeba histolytica
STLNLKRIEVVMDVVNEEPIF

SEQ ID NO: 2588454 - protein, 21 aa, Entamoeba histolytica
STLPLIISDTLTFTTMNITNT

SEQ ID NO: 2588455 - protein, 19 aa, Entamoeba histolytica
STNGIDWSSNILAFIGLSF

SEQ ID NO: 2588456 - protein, 24 aa, Entamoeba histolytica
STQLRRYPSDFDRSVSLSTNSLYN

SEQ ID NO: 2588457 - protein, 20 aa, Entamoeba histolytica
STSAFCLLAALVTKRDTRYL

SEQ ID NO: 2588458 - protein, 23 aa, Entamoeba histolytica
STSEKYIGYGLFVFDHIMLTINY

SEQ ID NO: 2588459 - protein, 23 aa, Entamoeba histolytica
STSLFFYCFYIKMNWIQSHPFLL

SEQ ID NO: 2588460 - protein, 26 aa, Entamoeba histolytica
STSLLKMWLHFIHFCGNVANITNPDV

SEQ ID NO: 2588461 - protein, 23 aa, Entamoeba histolytica
STSNPYCYARGFLISTNESTSLQ

SEQ ID NO: 2588462 - protein, 19 aa, Entamoeba histolytica
STSSGIRWGISIIPRIILC

SEQ ID NO: 2588463 - protein, 19 aa, Entamoeba histolytica
STSVVKGRGVGVVVATGKV

SEQ ID NO: 2588464 - protein, 17 aa, Entamoeba histolytica
STSYVLVSLLSLLLALL

SEQ ID NO: 2588465 - protein, 18 aa, Entamoeba histolytica
STTCLICDDNYYLNTEGS

SEQ ID NO: 2588466 - protein, 20 aa, Entamoeba histolytica
STTIQFFKFINSIMKVNVIT

SEQ ID NO: 2588467 - protein, 17 aa, Entamoeba histolytica
STTTPVVQTNTVSPGSD

SEQ ID NO: 2588468 - protein, 45 aa, Entamoeba histolytica
STVFEIYWRICLAFGNCVLLCLFFWFLRLYSVFNWALEQHLTALL

SEQ ID NO: 2588469 - protein, 21 aa, Entamoeba histolytica
STVGFSIVKYPSWGFFGMNYA

SEQ ID NO: 2588470 - protein, 18 aa, Entamoeba histolytica
STVKCLEPYCSGNNCAFR

SEQ ID NO: 2588471 - protein, 23 aa, Entamoeba histolytica
STYCMSCPSGGYVLSENTCYLGN

SEQ ID NO: 2588472 - protein, 23 aa, Entamoeba histolytica
SVAHCTNCLCDTGYYSAGNNTCL

SEQ ID NO: 2588473 - protein, 25 aa, Entamoeba histolytica
SVAIWPFCTAFFWPVTTGTVGFEAP

SEQ ID NO: 2588474 - protein, 24 aa, Entamoeba histolytica
SVAIWPFCTAFYWPVTTGTVGFEA

SEQ ID NO: 2588475 - protein, 25 aa, Entamoeba histolytica
SVAKEIFKLLILKFPTLPPIEIPSV

SEQ ID NO: 2588476 - protein, 24 aa, Entamoeba histolytica
SVCGIPFVMILSYFILKRRFNLIQ

SEQ ID NO: 2588477 - protein, 19 aa, Entamoeba histolytica
SVDCITWRQEAYIEPFEIR

SEQ ID NO: 2588478 - protein, 24 aa, Entamoeba histolytica
SVEEYLLRVGEFIHEVYSIQFQPN

SEQ ID NO: 2588479 - protein, 20 aa, Entamoeba histolytica
SVEIKKPPKHIGFHSLVQDD

SEQ ID NO: 2588480 - protein, 18 aa, Entamoeba histolytica
SVEIPHLQQLILLQYLFK

SEQ ID NO: 2588481 - protein, 29 aa, Entamoeba histolytica
SVFDFYSAQLWKLYFPMNLKLKASGEHDK

SEQ ID NO: 2588482 - protein, 18 aa, Entamoeba histolytica
SVFDIKNIVINGGRLEID

SEQ ID NO: 2588483 - protein, 24 aa, Entamoeba histolytica
SVFFCGLPSFLAIIIAVTRTRDHY

SEQ ID NO: 2588484 - protein, 17 aa, Entamoeba histolytica
SVFIISALIYGVLLLLN

SEQ ID NO: 2588485 - protein, 23 aa, Entamoeba histolytica
SVFRDILMRFVVYFSTRAETKSE

SEQ ID NO: 2588486 - protein, 19 aa, Entamoeba histolytica
SVGGVAWSTYWHYFRAGGF

SEQ ID NO: 2588487 - protein, 17 aa, Entamoeba histolytica
SVGGVLILLLLIIVVVS

SEQ ID NO: 2588488 - protein, 18 aa, Entamoeba histolytica
SVGLNCRLFISGQKMIYF

SEQ ID NO: 2588489 - protein, 27 aa, Entamoeba histolytica
SVGSIQRGGAVSVYFDNYLVSTKDRFK

SEQ ID NO: 2588490 - protein, 18 aa, Entamoeba histolytica
SVIFYWFYPHEFKLHENL

SEQ ID NO: 2588491 - protein, 20 aa, Entamoeba histolytica
SVIIKFELLCTTKVNDIIDV

SEQ ID NO: 2588492 - protein, 21 aa, Entamoeba histolytica
SVIKMTIGPIIGFFLQPIIGA

SEQ ID NO: 2588493 - protein, 19 aa, Entamoeba histolytica
SVILCIRNVLKTDISMKKA

SEQ ID NO: 2588494 - protein, 18 aa, Entamoeba histolytica
SVILPEFDHPVKIQRNEK

SEQ ID NO: 2588495 - protein, 18 aa, Entamoeba histolytica
SVILRINQKITYGIIILI

SEQ ID NO: 2588496 - protein, 18 aa, Entamoeba histolytica
SVIPLTLIVVDNYLSLLK

SEQ ID NO: 2588497 - protein, 23 aa, Entamoeba histolytica
SVISCILCHAVANYLGFPDFTTM

SEQ ID NO: 2588498 - protein, 27 aa, Entamoeba histolytica
SVITDQFFFEWSLKLIIDRSSKEISEI

SEQ ID NO: 2588499 - protein, 19 aa, Entamoeba histolytica
SVIYLCYLYNVFIDDPVFV

SEQ ID NO: 2588500 - protein, 18 aa, Entamoeba histolytica
SVKEDWCSLVDSKNGYTP

SEQ ID NO: 2588501 - protein, 21 aa, Entamoeba histolytica
SVLCLLPLLIVILLIVLPSLI

SEQ ID NO: 2588502 - protein, 18 aa, Entamoeba histolytica
SVLFPQTNVIHWFTDISY

SEQ ID NO: 2588503 - protein, 19 aa, Entamoeba histolytica
SVLKRSLCELLDGVCINGL

SEQ ID NO: 2588504 - protein, 17 aa, Entamoeba histolytica
SVLLRKSLLTEYITNFQ

SEQ ID NO: 2588505 - protein, 18 aa, Entamoeba histolytica
SVLMYLISIIVLRPTFEP

SEQ ID NO: 2588506 - protein, 19 aa, Entamoeba histolytica
SVMLCGMGVILISENISTA

SEQ ID NO: 2588507 - protein, 18 aa, Entamoeba histolytica
SVNHKLVLAMYYAMGYIS

SEQ ID NO: 2588508 - protein, 20 aa, Entamoeba histolytica
SVNRLSCRGGVLSQSLNSTV

SEQ ID NO: 2588509 - protein, 20 aa, Entamoeba histolytica
SVNYKIYRRRAFVSNSNEKL

SEQ ID NO: 2588510 - protein, 24 aa, Entamoeba histolytica
SVNYSAAEPLTWGKGMKKDFFKCS

SEQ ID NO: 2588511 - protein, 17 aa, Entamoeba histolytica
SVPDFKRVLPTVRSIIE

SEQ ID NO: 2588512 - protein, 17 aa, Entamoeba histolytica
SVPSFDNYYCHKIGDKI

SEQ ID NO: 2588513 - protein, 17 aa, Entamoeba histolytica
SVPVAVKMFRWENLTEE

SEQ ID NO: 2588514 - protein, 22 aa, Entamoeba histolytica
SVQRKFKIGVLPIPGSKLPKLP

SEQ ID NO: 2588515 - protein, 18 aa, Entamoeba histolytica
SVSCKMLVIGLGLLHLCC

SEQ ID NO: 2588516 - protein, 23 aa, Entamoeba histolytica
SVSDHLTAVFAFQSPIQQFDHFS

SEQ ID NO: 2588517 - protein, 24 aa, Entamoeba histolytica
SVSGGFRPICKLFICCVMMFGKHR

SEQ ID NO: 2588518 - protein, 36 aa, Entamoeba histolytica
SVSSLLCFISIFSLFMKYHFPIYFSIEPSSISLLLH

SEQ ID NO: 2588519 - protein, 26 aa, Entamoeba histolytica
SVTHPEILTTLALDFKIARSCPNGIE

SEQ ID NO: 2588520 - protein, 19 aa, Entamoeba histolytica
SVTILSYLFLFIATQGCGA

SEQ ID NO: 2588521 - protein, 38 aa, Entamoeba histolytica; identical to SEQ ID NO: 2390815

SEQ ID NO: 2588522 - protein, 27 aa, Entamoeba histolytica
SVVPLEVIKYPIIEASDIEYVYVGDFQ

SEQ ID NO: 2588523 - protein, 32 aa, Entamoeba histolytica; identical to SEQ ID NO: 2390823

SEQ ID NO: 2588524 - protein, 24 aa, Entamoeba histolytica
SWCSLCTTIRCSSCQVGTYLSNGL

SEQ ID NO: 2588525 - protein, 19 aa, Entamoeba histolytica
SWIILLWVVVGCIICAGLV

SEQ ID NO: 2588526 - protein, 33 aa, Entamoeba histolytica
SWLFIFRIVPMVVIFMICLARAVIPLCYGLMNS

SEQ ID NO: 2588527 - protein, 20 aa, Entamoeba histolytica
SWLMFISYIFVCLSCGGIYL

SEQ ID NO: 2588528 - protein, 19 aa, Entamoeba histolytica
SWPELARHALTYIVNAFWH

SEQ ID NO: 2588529 - protein, 22 aa, Entamoeba histolytica
SWQSCLVLLFSEFIGFALGFLT

SEQ ID NO: 2588530 - protein, 20 aa, Entamoeba histolytica
SWSLECISLSLSQTTGPQKN

SEQ ID NO: 2588531 - protein, 19 aa, Entamoeba histolytica
SYALGSWYGSLVIRGKGGS

SEQ ID NO: 2588532 - protein, 24 aa, Entamoeba histolytica
SYALGSWYGSLVIRGKGGSKGVSA

SEQ ID NO: 2588533 - protein, 18 aa, Entamoeba histolytica
SYCFLVFYFFLYVPNIVL

SEQ ID NO: 2588534 - protein, 18 aa, Entamoeba histolytica
SYCTRKLEEWYRKPTTIK

SEQ ID NO: 2588535 - protein, 26 aa, Entamoeba histolytica
SYDELKYPYCWDLIKDFLVIFFLIII

SEQ ID NO: 2588536 - protein, 24 aa, Entamoeba histolytica
SYEGGPLPWYLNKGLYFTNITLRN

SEQ ID NO: 2588537 - protein, 25 aa, Entamoeba histolytica
SYFAFQWLGVAVFFLYLSSLILYVP

SEQ ID NO: 2588538 - protein, 19 aa, Entamoeba histolytica
SYFCDIIFLILLVLRLDRV

SEQ ID NO: 2588539 - protein, 25 aa, Entamoeba histolytica
SYFILKRRFNLIQVFSAIIALSGFI

SEQ ID NO: 2588540 - protein, 17 aa, Entamoeba histolytica
SYFKRYSQNQMKEYIQL

SEQ ID NO: 2588541 - protein, 18 aa, Entamoeba histolytica
SYGGKWRKYAIISCAVFP

SEQ ID NO: 2588542 - protein, 19 aa, Entamoeba histolytica
SYGPRLFRQKENVFVESEE

SEQ ID NO: 2588543 - protein, 19 aa, Entamoeba histolytica
SYHFKRDFTYSLKETMECE

SEQ ID NO: 2588544 - protein, 20 aa, Entamoeba histolytica
SYILKLLSIFGRYYRNRSHS

SEQ ID NO: 2588545 - protein, 18 aa, Entamoeba histolytica
SYILSLFGSKAFPISGYD

SEQ ID NO: 2588546 - protein, 25 aa, Entamoeba histolytica
SYLFKNEINEIIKFFKTNSVMNYEK

SEQ ID NO: 2588547 - protein, 23 aa, Entamoeba histolytica
SYLGIKDMLPFVVTQYQISSVER

SEQ ID NO: 2588548 - protein, 20 aa, Entamoeba histolytica
SYLIIKNWWNGWGEDNKGYM

SEQ ID NO: 2588549 - protein, 27 aa, Entamoeba histolytica
SYLRIKALCGFSPFVISSYTQRGGHCI

SEQ ID NO: 2588550 - protein, 18 aa, Entamoeba histolytica
SYNEALCPCHYSDPKGEQ

SEQ ID NO: 2588551 - protein, 25 aa, Entamoeba histolytica
SYNKYIICLFIYVILILKFLIEVII

SEQ ID NO: 2588552 - protein, 19 aa, Entamoeba histolytica
SYNLCMRAPLVSNEGDDFK

SEQ ID NO: 2588553 - protein, 25 aa, Entamoeba histolytica
SYNPIWKGSDSSFLIQRNNQIQSRN

SEQ ID NO: 2588554 - protein, 22 aa, Entamoeba histolytica
SYQCISCSPTTVFLKGYCIIPE

SEQ ID NO: 2588555 - protein, 19 aa, Entamoeba histolytica
SYQCTSCIDGILKNYQCLP

SEQ ID NO: 2588556 - protein, 20 aa, Entamoeba histolytica
SYQLKVKILDDMAVALSYLH

SEQ ID NO: 2588557 - protein, 17 aa, Entamoeba histolytica
SYRAYGLRHNLLNSTEY

SEQ ID NO: 2588558 - protein, 18 aa, Entamoeba histolytica
SYRIKCMNKNIKFIVQCL

SEQ ID NO: 2588559 - protein, 26 aa, Entamoeba histolytica
SYSSIKLYLVIGICIVISLTSLYLFQ

SEQ ID NO: 2588560 - protein, 29 aa, Entamoeba histolytica
SYSVFEMFWRMAFILFSSFCCMLYLSSIR

SEQ ID NO: 2588561 - protein, 19 aa, Entamoeba histolytica
SYTAIKIFKIEKGIINKTR

SEQ ID NO: 2588562 - protein, 19 aa, Entamoeba histolytica
SYTSFILKHGICSGDIVIV

SEQ ID NO: 2588563 - protein, 42 aa, Entamoeba histolytica
SYVICIIVSLYGSILYSDCGWRCGFIPQRTGKILPIEYILVS

SEQ ID NO: 2588564 - protein, 18 aa, Entamoeba histolytica
SYVQEYLREMSFIGFSSN

SEQ ID NO: 2588565 - protein, 24 aa, Entamoeba histolytica
SYVQIRGSIPLLWSQIPNIKYKPK

SEQ ID NO: 2588566 - protein, 29 aa, Entamoeba histolytica
SYVRLRCGVITMKVCDGRDKISCEDNQCN

SEQ ID NO: 2588567 - protein, 21 aa, Entamoeba histolytica
SYWYIYMIIGICILFIILIFV

SEQ ID NO: 2588568 - protein, 22 aa, Entamoeba histolytica
SYYDFYINMYIFKDYKNLNNII

SEQ ID NO: 2588569 - protein, 21 aa, Entamoeba histolytica
SYYLMNIMLRLIKILQEPSEW

SEQ ID NO: 2588570 - protein, 25 aa, Entamoeba histolytica
SYYTCRYCTKMIKRFDQWQDEDIIF

SEQ ID NO: 2588571 - protein, 28 aa, Entamoeba histolytica
TAEKHFPRLFSWRSFHNYIKELSIDEQE

SEQ ID NO: 2588572 - protein, 18 aa, Entamoeba histolytica
TAETRNGNWFSLDGTDHS

SEQ ID NO: 2588573 - protein, 25 aa, Entamoeba histolytica
TAFIISLFLFFFLIFFITFISVMGN

SEQ ID NO: 2588574 - protein, 26 aa, Entamoeba histolytica
TAGIACGWHYIILYLVAVCLNLPLII

SEQ ID NO: 2588575 - protein, 26 aa, Entamoeba histolytica
TAGIACGWHYILLILVAVCLNFPFII

SEQ ID NO: 2588576 - protein, 18 aa, Entamoeba histolytica
TAIINPKVPYYVFIHSRY

SEQ ID NO: 2588577 - protein, 28 aa, Entamoeba histolytica
TAIKVLKKSFGFKEVLTIITSYNHQLNL

SEQ ID NO: 2588578 - protein, 21 aa, Entamoeba histolytica
TAIRWFLPLLSLSMKLSSIYQ

SEQ ID NO: 2588579 - protein, 31 aa, Entamoeba histolytica
TAISIWTIFALPKLPGIWVLLFITSACLWVS

SEQ ID NO: 2588580 - protein, 19 aa, Entamoeba histolytica
TAPLPWHKVITLQRGADTT

SEQ ID NO: 2588581 - protein, 19 aa, Entamoeba histolytica
TAQALSYEFSRTMMISRGT

SEQ ID NO: 2588582 - protein, 17 aa, Entamoeba histolytica
TAQECLEHPFLHLLDVE

SEQ ID NO: 2588583 - protein, 28 aa, Entamoeba histolytica
TAQFKSEHVFLILQLCGSIIFYHSSGET

SEQ ID NO: 2588584 - protein, 18 aa, Entamoeba histolytica
TAQRWIDQKNNFYVRRCC

SEQ ID NO: 2588585 - protein, 22 aa, Entamoeba histolytica
TARIWGSMCCILYAIVFLIFGM

SEQ ID NO: 2588586 - protein, 18 aa, Entamoeba histolytica
TARYLVYRMNKWHYFLLD

SEQ ID NO: 2588587 - protein, 18 aa, Entamoeba histolytica
TASFVRSHTPLTVFRYIS

SEQ ID NO: 2588588 - protein, 17 aa, Entamoeba histolytica
TASTCGTESNLLTNITL

SEQ ID NO: 2588589 - protein, 18 aa, Entamoeba histolytica
TATKCLSCSDSYIINSIG

SEQ ID NO: 2588590 - protein, 18 aa, Entamoeba histolytica
TATQWRSLATLVLAVITV

SEQ ID NO: 2588591 - protein, 19 aa, Entamoeba histolytica
TAVIRHLICLIDISKNVPE

SEQ ID NO: 2588592 - protein, 20 aa, Entamoeba histolytica
TCAACCSVDLMPFLNKANGE

SEQ ID NO: 2588593 - protein, 18 aa, Entamoeba histolytica
TCADPLKVGSKCDGCKTG

SEQ ID NO: 2588594 - protein, 19 aa, Entamoeba histolytica
TCAGILRYIPKKWKIYQLW

SEQ ID NO: 2588595 - protein, 27 aa, Entamoeba histolytica
TCAGILRYIPKQWKFMTIWNGRLSVLV

SEQ ID NO: 2588596 - protein, 23 aa, Entamoeba histolytica
TCAKTNILQGFGMTELCGASSCM

SEQ ID NO: 2588597 - protein, 23 aa, Entamoeba histolytica
TCCLCPLFAGLIATQTDDRKWAL

SEQ ID NO: 2588598 - protein, 21 aa, Entamoeba histolytica
TCFGCSMFTDICCVFHTLLNK

SEQ ID NO: 2588599 - protein, 42 aa, Entamoeba histolytica
TCFLIAGIFYYHFWLLCILFCIARTSFELVRLFYDCQIPYIM

SEQ ID NO: 2588600 - protein, 27 aa, Entamoeba histolytica
TCIISSMWLFFRFFKKYKEELTNGKKI

SEQ ID NO: 2588601 - protein, 25 aa, Entamoeba histolytica
TCIKISGPSLKPTICTIVGATVMNV

SEQ ID NO: 2588602 - protein, 21 aa, Entamoeba histolytica
TCIYCVPCFGLVFTLLIFHIY

SEQ ID NO: 2588603 - protein, 18 aa, Entamoeba histolytica
TCKFSDLFIEDDYLTKCI

SEQ ID NO: 2588604 - protein, 22 aa, Entamoeba histolytica
TCKSLKSAPRNTGIYIVYNGEL

SEQ ID NO: 2588605 - protein, 24 aa, Entamoeba histolytica
TCKTALEFNAPFTLVEYKPNTGKT

SEQ ID NO: 2588606 - protein, 24 aa, Entamoeba histolytica
TCKTALEFNAPFTLVEYKPNTGRT

SEQ ID NO: 2588607 - protein, 20 aa, Entamoeba histolytica
TCLFILFDCIIQYTELFDAD

SEQ ID NO: 2588608 - protein, 19 aa, Entamoeba histolytica
TCLIIKPLRCSHCRICNNC

SEQ ID NO: 2588609 - protein, 33 aa, Entamoeba histolytica
TCLNNKCGWCSSTKKCGFCEHGGEFCDNDDTHG

SEQ ID NO: 2588610 - protein, 30 aa, Entamoeba histolytica
TCLTCSEGKVKYCCRCFDFSYHRNHVTKEV

SEQ ID NO: 2588611 - protein, 17 aa, Entamoeba histolytica
TCNKCDNNVETICPMIT

SEQ ID NO: 2588612 - protein, 18 aa, Entamoeba histolytica
TCPDSTPLLGERYYQGNG

SEQ ID NO: 2588613 - protein, 22 aa, Entamoeba histolytica
TCQCLKPFRCHHCQICDCCIYR

SEQ ID NO: 2588614 - protein, 21 aa, Entamoeba histolytica
TCQKEQCSIPYISQTSFDCSN

SEQ ID NO: 2588615 - protein, 18 aa, Entamoeba histolytica
TCQQPAYQWDCHSCGDGY

SEQ ID NO: 2588616 - protein, 22 aa, Entamoeba histolytica
TCSECSHGFSLINGSCVGCSDI

SEQ ID NO: 2588617 - protein, 23 aa, Entamoeba histolytica
TCSEKDTKCKFVEFDCTNSKLVE

SEQ ID NO: 2588618 - protein, 19 aa, Entamoeba histolytica
TCSFLQAIIIILSSLIQIL

SEQ ID NO: 2588619 - protein, 22 aa, Entamoeba histolytica
TCSSCKVFGECIQCSFSGCTNC

SEQ ID NO: 2588620 - protein, 18 aa, Entamoeba histolytica
TCVPLYALVFGYICGLSH

SEQ ID NO: 2588621 - protein, 17 aa, Entamoeba histolytica
TCVYVCNLRNVIGTLSN

SEQ ID NO: 2588622 - protein, 18 aa, Entamoeba histolytica
TCWYCDRTTNLVLRVGDD

SEQ ID NO: 2588623 - protein, 19 aa, Entamoeba histolytica
TCYIPGYSTYDISWNGFTY

SEQ ID NO: 2588624 - protein, 19 aa, Entamoeba histolytica
TDCILKGIIEKAWNHKPSD

SEQ ID NO: 2588625 - protein, 31 aa, Entamoeba histolytica
TDDALGEVCQMLNWTSFSFDEYMEGLIAPIP

SEQ ID NO: 2588626 - protein, 18 aa, Entamoeba histolytica
TDDMRWDVLISVLLCLFI

SEQ ID NO: 2588627 - protein, 19 aa, Entamoeba histolytica
TDFAEGIYHGKFVFPYDYP

SEQ ID NO: 2588628 - protein, 24 aa, Entamoeba histolytica
TDGYCRGTCSFFIKNLAESGSAII

SEQ ID NO: 2588629 - protein, 20 aa, Entamoeba histolytica
TDHTCWWIKTTVDIANGLLD

SEQ ID NO: 2588630 - protein, 17 aa, Entamoeba histolytica
TDILKQMLFLFIWIICL

SEQ ID NO: 2588631 - protein, 23 aa, Entamoeba histolytica
TDIPKKYIEIMGKVYGEMAKYPI

SEQ ID NO: 2588632 - protein, 17 aa, Entamoeba histolytica
TDIPLKCFGEGDRSGVV

SEQ ID NO: 2588633 - protein, 19 aa, Entamoeba histolytica
TDIYWSGCDGCYAFAAKEI

SEQ ID NO: 2588634 - protein, 24 aa, Entamoeba histolytica
TDKDVFISCIEWIDKERIAITTRN

SEQ ID NO: 2588635 - protein, 22 aa, Entamoeba histolytica
TDKEIKIKGLATIYIMSIMLRY

SEQ ID NO: 2588636 - protein, 23 aa, Entamoeba histolytica
TDKNPFCLAHFFLRGISYNNRVK

SEQ ID NO: 2588637 - protein, 27 aa, Entamoeba histolytica
TDKWTYHRSLCLLAQAIFLVFSLLLVV

SEQ ID NO: 2588638 - protein, 18 aa, Entamoeba histolytica
TDLDCSVKEFYEKFVRNE

SEQ ID NO: 2588639 - protein, 18 aa, Entamoeba histolytica
TDLISWIYIIRIILFSLT

SEQ ID NO: 2588640 - protein, 17 aa, Entamoeba histolytica
TDLKILISTTIKSNKNV

SEQ ID NO: 2588641 - protein, 32 aa, Entamoeba histolytica
TDLLRVLLIKMCNRINPTLAMYEAYATHALSL

SEQ ID NO: 2588642 - protein, 20 aa, Entamoeba histolytica
TDLPEYAHRWIFSVIKDHSN

SEQ ID NO: 2588643 - protein, 18 aa, Entamoeba histolytica
TDLTCYSLAYLIPANLMF

SEQ ID NO: 2588644 - protein, 29 aa, Entamoeba histolytica
TDLVCPCQSLTGYECELEFTGSTNPITFP

SEQ ID NO: 2588645 - protein, 24 aa, Entamoeba histolytica
TDNLEWSQWVGLIWGGIATVGCLI

SEQ ID NO: 2588646 - protein, 20 aa, Entamoeba histolytica
TDPALMCRISFILQATCSLT

SEQ ID NO: 2588647 - protein, 24 aa, Entamoeba histolytica
TDSISLRMFYDMYLFTYVVILKST

SEQ ID NO: 2588648 - protein, 24 aa, Entamoeba histolytica
TDSQSVCLYSMFAKKIDLICKGCI

SEQ ID NO: 2588649 - protein, 20 aa, Entamoeba histolytica
TDTPDSFCGMILLLVIVVGI

SEQ ID NO: 2588650 - protein, 18 aa, Entamoeba histolytica
TDVLCGIGQKIGDFYIPL

SEQ ID NO: 2588651 - protein, 23 aa, Entamoeba histolytica
TDVPKETISLVQLSHENKESTLI

SEQ ID NO: 2588652 - protein, 21 aa, Entamoeba histolytica
TDWIEGLAIFVAVIVVSVGSS

SEQ ID NO: 2588653 - protein, 26 aa, Entamoeba histolytica
TDYFPLNSCISFTDYAAYFFYNNNTH

SEQ ID NO: 2588654 - protein, 28 aa, Entamoeba histolytica
TDYFPLNSCISFTDYAAYFFYNNNTHMN

SEQ ID NO: 2588655 - protein, 23 aa, Entamoeba histolytica
TDYKNLINLCWKQNANECPSFDQ

SEQ ID NO: 2588656 - protein, 21 aa, Entamoeba histolytica
TEAKSAITYGLLGRLPLTKEY

SEQ ID NO: 2588657 - protein, 17 aa, Entamoeba histolytica
TEALLCVTDYPTILNQY

SEQ ID NO: 2588658 - protein, 21 aa, Entamoeba histolytica
TECIYHLNLFIIIGIPIIIIF

SEQ ID NO: 2588659 - protein, 18 aa, Entamoeba histolytica
TECTPCFTNFTDKKRPVP

SEQ ID NO: 2588660 - protein, 25 aa, Entamoeba histolytica
TEDFLKFYLEMVSTILNEWRHSVVI

SEQ ID NO: 2588661 - protein, 22 aa, Entamoeba histolytica
TEEGIKLLIKYCDNADYEEIKE

SEQ ID NO: 2588662 - protein, 23 aa, Entamoeba histolytica
TEELPLYCSYILLEATCIATTHN

SEQ ID NO: 2588663 - protein, 25 aa, Entamoeba histolytica
TEEVDLKFSFCFTESETERVRYYIS

SEQ ID NO: 2588664 - protein, 19 aa, Entamoeba histolytica
TEFKQWLCTIWKHKDELVG

SEQ ID NO: 2588665 - protein, 22 aa, Entamoeba histolytica
TEGCGSFARLYYDKFIVGEEYY

SEQ ID NO: 2588666 - protein, 18 aa, Entamoeba histolytica
TEHKRPLLFTKLANSIHT

SEQ ID NO: 2588667 - protein, 19 aa, Entamoeba histolytica
TEICWTFSIFLEAVAILPQ

SEQ ID NO: 2588668 - protein, 22 aa, Entamoeba histolytica
TEIEDFFIIFIWILKNINKNML

SEQ ID NO: 2588669 - protein, 18 aa, Entamoeba histolytica
TEIIHQLFLILLISVLLI

SEQ ID NO: 2588670 - protein, 22 aa, Entamoeba histolytica
TEIIPFYSLWATIFGGFSDIIL

SEQ ID NO: 2588671 - protein, 24 aa, Entamoeba histolytica
TEIMCFLVGISFNYLSEVLYSTTN

SEQ ID NO: 2588672 - protein, 17 aa, Entamoeba histolytica
TEIQCIGIILALNHNIP

SEQ ID NO: 2588673 - protein, 17 aa, Entamoeba histolytica
TEKELLNILQLVINGMK

SEQ ID NO: 2588674 - protein, 19 aa, Entamoeba histolytica
TELEVVKILETWGNEVKIE

SEQ ID NO: 2588675 - protein, 18 aa, Entamoeba histolytica
TELKREICIMNLIESPYI

SEQ ID NO: 2588676 - protein, 22 aa, Entamoeba histolytica
TELQLLCVVGLFIIAINPNIIY

SEQ ID NO: 2588677 - protein, 20 aa, Entamoeba histolytica
TELYDRLIVQIALSCPDVFG

SEQ ID NO: 2588678 - protein, 21 aa, Entamoeba histolytica
TEMGYRLGSYPLKFFANLSLV

SEQ ID NO: 2588679 - protein, 17 aa, Entamoeba histolytica
TEMKDVLVLGWGSSMLT

SEQ ID NO: 2588680 - protein, 20 aa, Entamoeba histolytica
TEMKEPVGYDFAIKTPCKKS

SEQ ID NO: 2588681 - protein, 26 aa, Entamoeba histolytica
TEMTSCIGCGLALNQCYWNVKTHQCI

SEQ ID NO: 2588682 - protein, 24 aa, Entamoeba histolytica
TENCALEYIVFFFIFVICAFSNQY

SEQ ID NO: 2588683 - protein, 23 aa, Entamoeba histolytica
TENCLKFGYASLFADPTNCSVRF

SEQ ID NO: 2588684 - protein, 25 aa, Entamoeba histolytica
TENRMTVVRGWFGGEVMERDKSLDL

SEQ ID NO: 2588685 - protein, 32 aa, Entamoeba histolytica
TENRSSMVYQCCKLFVHLLEIRDCNTVMSNVL

SEQ ID NO: 2588686 - protein, 22 aa, Entamoeba histolytica
TESRELFCIGNLTKKTIKIFLN

SEQ ID NO: 2588687 - protein, 31 aa, Entamoeba histolytica
TETNLRYLALDAMCSMCAVGCDKEVQKYLSR

SEQ ID NO: 2588688 - protein, 21 aa, Entamoeba histolytica
TEVEALFYLPFHPILLTLFVL

SEQ ID NO: 2588689 - protein, 25 aa, Entamoeba histolytica
TEYFPLNSCISFTDYAAYFFYNNNT

SEQ ID NO: 2588690 - protein, 19 aa, Entamoeba histolytica
TEYPNICSIINKKDLMNQV

SEQ ID NO: 2588691 - protein, 18 aa, Entamoeba histolytica
TFCIPFVISSGIDACDTE

SEQ ID NO: 2588692 - protein, 25 aa, Entamoeba histolytica
TFCQSHLRFGGYFVQLILNVITLIK

SEQ ID NO: 2588693 - protein, 25 aa, Entamoeba histolytica
TFCTLWMILSMITFVLFGIVLTCCM

SEQ ID NO: 2588694 - protein, 18 aa, Entamoeba histolytica
TFDCKKNLTLSWNDSNQD

SEQ ID NO: 2588695 - protein, 19 aa, Entamoeba histolytica
TFDGCCSFIFFSFIGCLVF

SEQ ID NO: 2588696 - protein, 19 aa, Entamoeba histolytica
TFEELCFAQQTILSLMIRN

SEQ ID NO: 2588697 - protein, 24 aa, Entamoeba histolytica
TFESSCVRGVFRFSNENFYSTVTA

SEQ ID NO: 2588698 - protein, 17 aa, Entamoeba histolytica
TFFFFLFIFYYKSILVF

SEQ ID NO: 2588699 - protein, 27 aa, Entamoeba histolytica
TFFLFGFCFIFFWLASFVISRKSSQPF

SEQ ID NO: 2588700 - protein, 19 aa, Entamoeba histolytica
TFFPYLAIIGLRYIYGPFF

SEQ ID NO: 2588701 - protein, 17 aa, Entamoeba histolytica
TFFRYFGLLSYLIPISC

SEQ ID NO: 2588702 - protein, 26 aa, Entamoeba histolytica
TFFVLCCITAFWMLESLARTCGLHSL

SEQ ID NO: 2588703 - protein, 28 aa, Entamoeba histolytica
TFGINILLLCWKKMIRLIESEVQINQLT

SEQ ID NO: 2588704 - protein, 24 aa, Entamoeba histolytica
TFHACETLRYDIMFKPVTGTVKSG

SEQ ID NO: 2588705 - protein, 22 aa, Entamoeba histolytica
TFHILDFKATFVNNGDSKYIKV

SEQ ID NO: 2588706 - protein, 17 aa, Entamoeba histolytica
TFIDFIWKIQNVFSHYE

SEQ ID NO: 2588707 - protein, 21 aa, Entamoeba histolytica
TFILDVNWGLLLGVFAGYGLC

SEQ ID NO: 2588708 - protein, 18 aa, Entamoeba histolytica
TFISKLLFRIINLKYQNI

SEQ ID NO: 2588709 - protein, 17 aa, Entamoeba histolytica
TFKELMNQLSILRANNE

SEQ ID NO: 2588710 - protein, 22 aa, Entamoeba histolytica
TFKFPWKIAEFVISGERLPRLD

SEQ ID NO: 2588711 - protein, 22 aa, Entamoeba histolytica
TFKNLRMGVYFLMKTLNENETS

SEQ ID NO: 2588712 - protein, 18 aa, Entamoeba histolytica
TFKYDWNLGVIKITKHAR

SEQ ID NO: 2588713 - protein, 22 aa, Entamoeba histolytica
TFLKFFKFIGWILLEKWYCVLF

SEQ ID NO: 2588714 - protein, 20 aa, Entamoeba histolytica
TFLPGIVSGIIWEIAQICFM

SEQ ID NO: 2588715 - protein, 23 aa, Entamoeba histolytica
TFLYQLFILIPFKFQSLLNSLFL

SEQ ID NO: 2588716 - protein, 21 aa, Entamoeba histolytica
TFNFNKINSFIPMCTESLRGC

SEQ ID NO: 2588717 - protein, 20 aa, Entamoeba histolytica
TFNMGRRRPFMIIGLGVWLF

SEQ ID NO: 2588718 - protein, 31 aa, Entamoeba histolytica
TFSCLKLTWSQRILFCLGFCGFGMLCIFMSL

SEQ ID NO: 2588719 - protein, 21 aa, Entamoeba histolytica
TFSKLCERSEIMLKEFKEEQK

SEQ ID NO: 2588720 - protein, 23 aa, Entamoeba histolytica
TFSSVIAAFTFRAIFNTYSHSPS

SEQ ID NO: 2588721 - protein, 22 aa, Entamoeba histolytica
TFTGECFYLAVFEIHNNLAMTL

SEQ ID NO: 2588722 - protein, 18 aa, Entamoeba histolytica
TFTIRIFPHKYCWREGDD

SEQ ID NO: 2588723 - protein, 20 aa, Entamoeba histolytica
TFTSTNAYRFIVPNRAQECV

SEQ ID NO: 2588724 - protein, 37 aa, Entamoeba histolytica
TFTTRRCGSCLGLSGPSMKSYQCMISGFFKINNATDD

SEQ ID NO: 2588725 - protein, 17 aa, Entamoeba histolytica
TFTYPLLIADSFINENI

SEQ ID NO: 2588726 - protein, 18 aa, Entamoeba histolytica
TFVKKWAEDHAFLKSPHG

SEQ ID NO: 2588727 - protein, 17 aa, Entamoeba histolytica
TGAPSRFTVNDVQRLIN

SEQ ID NO: 2588728 - protein, 18 aa, Entamoeba histolytica
TGCIARMVLKKVIRAKEI

SEQ ID NO: 2588729 - protein, 20 aa, Entamoeba histolytica
TGCIKRMHYQFTIATDASSS

SEQ ID NO: 2588730 - protein, 26 aa, Entamoeba histolytica
TGCVIEFKKMLGFCISCVSNCSIFIL

SEQ ID NO: 2588731 - protein, 18 aa, Entamoeba histolytica
TGFIYATECSDGFSGRSP

SEQ ID NO: 2588732 - protein, 17 aa, Entamoeba histolytica
TGGLMHCAKTIEFIPDL

SEQ ID NO: 2588733 - protein, 19 aa, Entamoeba histolytica
TGGYGCFSILISITSTLTI

SEQ ID NO: 2588734 - protein, 20 aa, Entamoeba histolytica
TGHNFILFVAYPAIGYILSM

SEQ ID NO: 2588735 - protein, 26 aa, Entamoeba histolytica
TGICVFGILCLIPYLFLQEHSTKPPI

SEQ ID NO: 2588736 - protein, 21 aa, Entamoeba histolytica
TGKDYKLLVGKNVSDEIKTNL

SEQ ID NO: 2588737 - protein, 25 aa, Entamoeba histolytica
TGLVYKIIGGIGMFALVVVALVELL

SEQ ID NO: 2588738 - protein, 17 aa, Entamoeba histolytica
TGNIPSSLLFPKEIEEI

SEQ ID NO: 2588739 - protein, 19 aa, Entamoeba histolytica
TGREHLRFYGSLKGLKRYT

SEQ ID NO: 2588740 - protein, 19 aa, Entamoeba histolytica
TGSLIYISVILPEFDHPVK

SEQ ID NO: 2588741 - protein, 18 aa, Entamoeba histolytica
TGSRWRKSMLDAINHSRF

SEQ ID NO: 2588742 - protein, 18 aa, Entamoeba histolytica
TGVGFIFSLLWVITRHWI

SEQ ID NO: 2588743 - protein, 20 aa, Entamoeba histolytica
TGVLKAFAFLFEYIGEKSKD

SEQ ID NO: 2588744 - protein, 19 aa, Entamoeba histolytica
TGVNKAPAIVIAFLMYYQR

SEQ ID NO: 2588745 - protein, 17 aa, Entamoeba histolytica
THGGCLCNGVSCETCGN

SEQ ID NO: 2588746 - protein, 18 aa, Entamoeba histolytica
THLIEFITATILFVVGMI

SEQ ID NO: 2588747 - protein, 18 aa, Entamoeba histolytica
THLKSKFGTGYVLTLNAD

SEQ ID NO: 2588748 - protein, 17 aa, Entamoeba histolytica
THLNWINLHLKGIVVNK

SEQ ID NO: 2588749 - protein, 32 aa, Entamoeba histolytica
THMKNAMWWKNFKLWLIIGTVVAIIILVIIII

SEQ ID NO: 2588750 - protein, 28 aa, Entamoeba histolytica
THMYSNKHKIMYNKYNIHLKSEQHQVNK

SEQ ID NO: 2588751 - protein, 18 aa, Entamoeba histolytica
THPCIERAIEIDLIDVID

SEQ ID NO: 2588752 - protein, 22 aa, Entamoeba histolytica
THPSFCLYVISALIVSYHSELL

SEQ ID NO: 2588753 - protein, 22 aa, Entamoeba histolytica
THPSPIFALHWSNPITLTLTQN

SEQ ID NO: 2588754 - protein, 22 aa, Entamoeba histolytica
THQGILKWLGLSIMILGVILSI

SEQ ID NO: 2588755 - protein, 17 aa, Entamoeba histolytica
TIACLYSVAAIYGISIH

SEQ ID NO: 2588756 - protein, 25 aa, Entamoeba histolytica
TIAKERLKYVWIIFALIIKSMVGYY

SEQ ID NO: 2588757 - protein, 18 aa, Entamoeba histolytica
TICGVFGLAAMFLQTSSQ

SEQ ID NO: 2588758 - protein, 19 aa, Entamoeba histolytica
TIDLDVDFTPSFNWNTKMI

SEQ ID NO: 2588759 - protein, 20 aa, Entamoeba histolytica
TIDRACLMYCRYERFFQRFI

SEQ ID NO: 2588760 - protein, 19 aa, Entamoeba histolytica
TIENFWPSKYHKMELEIGR

SEQ ID NO: 2588761 - protein, 23 aa, Entamoeba histolytica
TIFAFIIGFIIYRKKRSNNGYHD

SEQ ID NO: 2588762 - protein, 23 aa, Entamoeba histolytica
TIFCLIILCSILFDIYSLWQGHR

SEQ ID NO: 2588763 - protein, 19 aa, Entamoeba histolytica
TIFLFICSLVDFLNSLSVC

SEQ ID NO: 2588764 - protein, 20 aa, Entamoeba histolytica
TIFLPCIIFNAGFTMKKRNF

SEQ ID NO: 2588765 - protein, 22 aa, Entamoeba histolytica
TIFSREHLDLFVSFLKHISVKL

SEQ ID NO: 2588766 - protein, 24 aa, Entamoeba histolytica
TIGFFKWNWEFELWYLNDDGTNDK

SEQ ID NO: 2588767 - protein, 26 aa, Entamoeba histolytica
TIGLICITCLFLIGSFVAFSFGVPRH

SEQ ID NO: 2588768 - protein, 21 aa, Entamoeba histolytica
TIGSCTKLTLTGKRTIKKLKL

SEQ ID NO: 2588769 - protein, 25 aa, Entamoeba histolytica
TIGSCTKLTLTGTRTIKTLKLSKSC

SEQ ID NO: 2588770 - protein, 18 aa, Entamoeba histolytica
TIHQDFTSLLALQMDNLF

SEQ ID NO: 2588771 - protein, 25 aa, Entamoeba histolytica
TIHQPRPLIFQKFDKIIMLNRGHMM

SEQ ID NO: 2588772 - protein, 28 aa, Entamoeba histolytica
TIIFAMLLAIFWRKQKQYVFHFTGVGLI

SEQ ID NO: 2588773 - protein, 27 aa, Entamoeba histolytica
TIINNCWRFGKGLKMKGFENKSCLGPR

SEQ ID NO: 2588774 - protein, 20 aa, Entamoeba histolytica
TIINSLSFHSIFLLNGELRI

SEQ ID NO: 2588775 - protein, 19 aa, Entamoeba histolytica
TILALFMVFSVWQLSILDT

SEQ ID NO: 2588776 - protein, 18 aa, Entamoeba histolytica
TILLLAFELIEKCDNELL

SEQ ID NO: 2588777 - protein, 18 aa, Entamoeba histolytica
TILVWKLIEDKIHHIFVL

SEQ ID NO: 2588778 - protein, 24 aa, Entamoeba histolytica
TILYCGVLKRLVMNCMSAFDKFIT

SEQ ID NO: 2588779 - protein, 17 aa, Entamoeba histolytica
TINSGKTPFVFDLIKFN

SEQ ID NO: 2588780 - protein, 21 aa, Entamoeba histolytica
TINVCPTCVVNINGEYTESLK

SEQ ID NO: 2588781 - protein, 20 aa, Entamoeba histolytica
TIPGMRFVIDTGLVKEKEYQ

SEQ ID NO: 2588782 - protein, 25 aa, Entamoeba histolytica
TIPQCISCSNILFLEANSRKIVGVE

SEQ ID NO: 2588783 - protein, 26 aa, Entamoeba histolytica
TIQFIRWLRKSYVTGIVIVVDILMNL

SEQ ID NO: 2588784 - protein, 19 aa, Entamoeba histolytica
TIQGIKISTFIPSNKYVLL

SEQ ID NO: 2588785 - protein, 25 aa, Entamoeba histolytica
TIQLKRLMKKNCQFSYSMLLMKLSL

SEQ ID NO: 2588786 - protein, 24 aa, Entamoeba histolytica
TIQYWAKYCIIGFASLADIYYVYS

SEQ ID NO: 2588787 - protein, 38 aa, Entamoeba histolytica
TISRCGQCIEIIGPSLMPYKCMISGWFTYNGSDTNDNI

SEQ ID NO: 2588788 - protein, 17 aa, Entamoeba histolytica
TITECPKDPCGTNEAGI

SEQ ID NO: 2588789 - protein, 26 aa, Entamoeba histolytica
TITLDYRFNEIFVLLRESFNIITCFR

SEQ ID NO: 2588790 - protein, 25 aa, Entamoeba histolytica
TITPCGHAFCYQCIKEWLSRVPNCP

SEQ ID NO: 2588791 - protein, 21 aa, Entamoeba histolytica
TITVQSKPEWLTLCRKSESSL

SEQ ID NO: 2588792 - protein, 21 aa, Entamoeba histolytica
TIVLVTMAFLWTKFISPTANG

SEQ ID NO: 2588793 - protein, 29 aa, Entamoeba histolytica
TIVLWFAVALNWKDIKVFLKEGKSFIPSL

SEQ ID NO: 2588794 - protein, 24 aa, Entamoeba histolytica
TIVSLCIEEWIAAGMLIIVIVSNV

SEQ ID NO: 2588795 - protein, 17 aa, Entamoeba histolytica
TIVSLSLLKNPTSIIDA

SEQ ID NO: 2588796 - protein, 18 aa, Entamoeba histolytica
TIVWILFYAPLKFFYLAI

SEQ ID NO: 2588797 - protein, 34 aa, Entamoeba histolytica
TIWNGRLSVLVIRICLLCLTTLAASFITNIGVIF

SEQ ID NO: 2588798 - protein, 18 aa, Entamoeba histolytica
TIYPFMIILLLALFIMMK

SEQ ID NO: 2588799 - protein, 22 aa, Entamoeba histolytica
TKCDWLARNFLLVFLEDTTSIG

SEQ ID NO: 2588800 - protein, 18 aa, Entamoeba histolytica
TKCGNGVLDDGEECELNQ

SEQ ID NO: 2588801 - protein, 17 aa, Entamoeba histolytica
TKCNLGYWLRKYSSEVS

SEQ ID NO: 2588802 - protein, 17 aa, Entamoeba histolytica
TKCNLGYWLRKYSSKVS

SEQ ID NO: 2588803 - protein, 23 aa, Entamoeba histolytica
TKDCSFVNLWKKFAPSLTHDKFT

SEQ ID NO: 2588804 - protein, 24 aa, Entamoeba histolytica
TKDFKPNHIIVLFGSQHKGHLPTK

SEQ ID NO: 2588805 - protein, 25 aa, Entamoeba histolytica
TKDSIYRKTFCFSFQHESDIIEWTN

SEQ ID NO: 2588806 - protein, 23 aa, Entamoeba histolytica
TKEIARKLIVFGFNDISKIAHAS

SEQ ID NO: 2588807 - protein, 23 aa, Entamoeba histolytica
TKETRFGFLPLFEHGHLIQNDVY

SEQ ID NO: 2588808 - protein, 23 aa, Entamoeba histolytica
TKEVIPLISCDSINTKVTNVKEA

SEQ ID NO: 2588809 - protein, 21 aa, Entamoeba histolytica
TKFFWNFLSLYNVCLILIRLF

SEQ ID NO: 2588810 - protein, 17 aa, Entamoeba histolytica
TKFPGISKFVLRRKKTL

SEQ ID NO: 2588811 - protein, 20 aa, Entamoeba histolytica
TKFRIGNFAYEFTPIDNFPL

SEQ ID NO: 2588812 - protein, 26 aa, Entamoeba histolytica
TKGLKEWGGAILLGFDGDPYGKDEEF

SEQ ID NO: 2588813 - protein, 25 aa, Entamoeba histolytica
TKGLKEWGGAILVGFDVYDIFDVTS

SEQ ID NO: 2588814 - protein, 19 aa, Entamoeba histolytica
TKGRFQVFVHGDFLPITLF

SEQ ID NO: 2588815 - protein, 17 aa, Entamoeba histolytica
TKHVLKTGFAVNLYDSK

SEQ ID NO: 2588816 - protein, 24 aa, Entamoeba histolytica
TKICYECIDGYELIDGICKPLLNC

SEQ ID NO: 2588817 - protein, 17 aa, Entamoeba histolytica
TKIMPPIPCGTQPPQCN

SEQ ID NO: 2588818 - protein, 21 aa, Entamoeba histolytica
TKIPVRCTIIGTFTGTNPLMP

SEQ ID NO: 2588819 - protein, 23 aa, Entamoeba histolytica
TKIYLECFKDIFNGISTTGSTLV

SEQ ID NO: 2588820 - protein, 19 aa, Entamoeba histolytica
TKLKLFTEFCNIMKLLHAE

SEQ ID NO: 2588821 - protein, 17 aa, Entamoeba histolytica
TKLMKGAFFTVDFEGSY

SEQ ID NO: 2588822 - protein, 20 aa, Entamoeba histolytica
TKLNECIIIDNGVYIIGYVD

SEQ ID NO: 2588823 - protein, 27 aa, Entamoeba histolytica
TKLRLIYNSMDFCCRHYVNLFEESEQI

SEQ ID NO: 2588824 - protein, 23 aa, Entamoeba histolytica
TKLSLKISNLIFGPNIKSIYINK

SEQ ID NO: 2588825 - protein, 17 aa, Entamoeba histolytica
TKMANAHEFVSKLPEGY

SEQ ID NO: 2588826 - protein, 22 aa, Entamoeba histolytica
TKMKYLFLFPIQSLRVYYSIQY

SEQ ID NO: 2588827 - protein, 24 aa, Entamoeba histolytica
TKNAIHFIGSFKFGSFTLGSSDDS

SEQ ID NO: 2588828 - protein, 19 aa, Entamoeba histolytica
TKNGMVLCVDMNRKRSEIE

SEQ ID NO: 2588829 - protein, 17 aa, Entamoeba histolytica
TKNYFIFVSIDENNIGI

SEQ ID NO: 2588830 - protein, 20 aa, Entamoeba histolytica
TKPIRKYWLLTDVFLHEHGC

SEQ ID NO: 2588831 - protein, 18 aa, Entamoeba histolytica
TKQNFSFDDFFSNTNNNE

SEQ ID NO: 2588832 - protein, 23 aa, Entamoeba histolytica
TKQNIPEGCCRIVKLTDNKYSVN

SEQ ID NO: 2588833 - protein, 19 aa, Entamoeba histolytica
TKQTNFCWVCNPRFGCGVD

SEQ ID NO: 2588834 - protein, 18 aa, Entamoeba histolytica
TKRETIVFMDYLVDIDAI

SEQ ID NO: 2588835 - protein, 22 aa, Entamoeba histolytica
TKRSIMLLRLLKSGMNKEMIIK

SEQ ID NO: 2588836 - protein, 22 aa, Entamoeba histolytica
TKRWVKLSKILLIPYTILVVGL

SEQ ID NO: 2588837 - protein, 23 aa, Entamoeba histolytica
TKSICLQTLLLVLFRTNNPCGIT

SEQ ID NO: 2588838 - protein, 21 aa, Entamoeba histolytica
TKSVIYFDVVGRISVSNIEVD

SEQ ID NO: 2588839 - protein, 22 aa, Entamoeba histolytica
TKTFLFMFTFDVMLTLLLAEVM

SEQ ID NO: 2588840 - protein, 18 aa, Entamoeba histolytica
TKTKCIRSRTDGCGENSK

SEQ ID NO: 2588841 - protein, 29 aa, Entamoeba histolytica
TKTPGVYSFCFDNTMSLYTSKLVEFKLQL

SEQ ID NO: 2588842 - protein, 28 aa, Entamoeba histolytica
TKTPHRVSVFNWFWNRQSYIPNEPYSTQ

SEQ ID NO: 2588843 - protein, 29 aa, Entamoeba histolytica
TKTRLSSICLTIFYVFKVVYWTISGLQIK

SEQ ID NO: 2588844 - protein, 25 aa, Entamoeba histolytica
TKTRREIFQAIGIFIGFVICVSIII

SEQ ID NO: 2588845 - protein, 18 aa, Entamoeba histolytica
TKVGEFFVNSGFNVFMLD

SEQ ID NO: 2588846 - protein, 18 aa, Entamoeba histolytica
TKVNLALILPLCIGACLI

SEQ ID NO: 2588847 - protein, 26 aa, Entamoeba histolytica
TKWFYPCGKFGILLGIFLPTLILAQP

SEQ ID NO: 2588848 - protein, 17 aa, Entamoeba histolytica
TKYMTELHLFKFSPEII

SEQ ID NO: 2588849 - protein, 24 aa, Entamoeba histolytica
TKYPYWRCGLTFTNEEKQNIVNEN

SEQ ID NO: 2588850 - protein, 31 aa, Entamoeba histolytica
TKYYWWSFIPVFLFNQFKYFINLFFLIVAIL

SEQ ID NO: 2588851 - protein, 18 aa, Entamoeba histolytica
TLAFISLSVIQLFHSFIS

SEQ ID NO: 2588852 - protein, 25 aa, Entamoeba histolytica
TLAIIFCIIIPFSSVVLNDKQMVIN

SEQ ID NO: 2588853 - protein, 17 aa, Entamoeba histolytica
TLCLSVFERNKELVYNI

SEQ ID NO: 2588854 - protein, 18 aa, Entamoeba histolytica
TLCSTAIPNCDICSPSEL

SEQ ID NO: 2588855 - protein, 23 aa, Entamoeba histolytica
TLDKFSFVCGVLILLLTQHILSA

SEQ ID NO: 2588856 - protein, 25 aa, Entamoeba histolytica
TLEDIKPPIPKAEESPSEPGKVTTP

SEQ ID NO: 2588857 - protein, 20 aa, Entamoeba histolytica
TLFCIGLFFSFLGDLLLLMD

SEQ ID NO: 2588858 - protein, 26 aa, Entamoeba histolytica
TLFELCWKFVFIFYSCIIVVIYLFIF

SEQ ID NO: 2588859 - protein, 23 aa, Entamoeba histolytica
TLFETFMYWDFFFIDLHEFVLLK

SEQ ID NO: 2588860 - protein, 24 aa, Entamoeba histolytica
TLFRVVSLLIGWLILHVLGDFTES

SEQ ID NO: 2588861 - protein, 23 aa, Entamoeba histolytica
TLFRYTIALILIRFFISLITVVI

SEQ ID NO: 2588862 - protein, 21 aa, Entamoeba histolytica
TLFYFCVLMVYQVIATQYLFG

SEQ ID NO: 2588863 - protein, 27 aa, Entamoeba histolytica
TLGEMWGGQFLRWFNFACLVLYLYGSL

SEQ ID NO: 2588864 - protein, 18 aa, Entamoeba histolytica
TLICSIYPLLPVTLKTIS

SEQ ID NO: 2588865 - protein, 19 aa, Entamoeba histolytica
TLIILSLMIFFAFSSFINI

SEQ ID NO: 2588866 - protein, 18 aa, Entamoeba histolytica
TLIKIIPLNCEMNYFGIG

SEQ ID NO: 2588867 - protein, 25 aa, Entamoeba histolytica
TLIMKPHLYKSIKSLFSYKTLLLWV

SEQ ID NO: 2588868 - protein, 20 aa, Entamoeba histolytica
TLKEVVSLLIKKLDGKEFSE

SEQ ID NO: 2588869 - protein, 20 aa, Entamoeba histolytica
TLKFTTVIILIFSVIATLFY

SEQ ID NO: 2588870 - protein, 17 aa, Entamoeba histolytica
TLLFYRILPTIITYLNL

SEQ ID NO: 2588871 - protein, 24 aa, Entamoeba histolytica
TLLLCLIVSIIFYFIPIIIGYNSF

SEQ ID NO: 2588872 - protein, 19 aa, Entamoeba histolytica
TLLLRSEDKVRWSLICCLC

SEQ ID NO: 2588873 - protein, 17 aa, Entamoeba histolytica
TLLMMTHICIPKMEGRK

SEQ ID NO: 2588874 - protein, 19 aa, Entamoeba histolytica
TLLNILWDCYPKFNTNSTL

SEQ ID NO: 2588875 - protein, 19 aa, Entamoeba histolytica
TLLRFRILKKNKLKYTLEN

SEQ ID NO: 2588876 - protein, 20 aa, Entamoeba histolytica
TLLSEFLFDDQIKGILMKSL

SEQ ID NO: 2588877 - protein, 18 aa, Entamoeba histolytica
TLLSKVFTSLSCFILKLP

SEQ ID NO: 2588878 - protein, 23 aa, Entamoeba histolytica
TLLTICVLLNWTFKPPITRAFVS

SEQ ID NO: 2588879 - protein, 25 aa, Entamoeba histolytica
TLLTILKEHVCKFDILSKLISPDFS

SEQ ID NO: 2588880 - protein, 18 aa, Entamoeba histolytica
TLNMTKRETIVFMDYLVD

SEQ ID NO: 2588881 - protein, 24 aa, Entamoeba histolytica
TLPFKIHYLFICVYIVVSLIVVYG

SEQ ID NO: 2588882 - protein, 19 aa, Entamoeba histolytica
TLPNRSWAYLSIPFTIINQ

SEQ ID NO: 2588883 - protein, 25 aa, Entamoeba histolytica
TLPSLCPNNNLPLVLTTNSDDKINV

SEQ ID NO: 2588884 - protein, 25 aa, Entamoeba histolytica
TLPSLCPNNNLPLVLTTSSDDKINV

SEQ ID NO: 2588885 - protein, 24 aa, Entamoeba histolytica
TLQCFGEKVIPFPINERTINDIKE

SEQ ID NO: 2588886 - protein, 20 aa, Entamoeba histolytica
TLQSGHSMGYFMGNHSLFNE

SEQ ID NO: 2588887 - protein, 29 aa, Entamoeba histolytica
TLRSSIKSSSSWHPLRFSYDLIGLTDQSY

SEQ ID NO: 2588888 - protein, 20 aa, Entamoeba histolytica
TLRVIECDIVRTFPEGAEYL

SEQ ID NO: 2588889 - protein, 25 aa, Entamoeba histolytica
TLSERLFVGSCCDLLRRDLTKRYLC

SEQ ID NO: 2588890 - protein, 31 aa, Entamoeba histolytica
TLSLHILRPFIVVLMFELYWFTIFFFLLEAY

SEQ ID NO: 2588891 - protein, 23 aa, Entamoeba histolytica
TLSPEIRDWVLIPLLIVTVCSNY

SEQ ID NO: 2588892 - protein, 18 aa, Entamoeba histolytica
TLSSRLVVLIGYLFFILS

SEQ ID NO: 2588893 - protein, 20 aa, Entamoeba histolytica
TLTCGQQCAMIKEFELFITV

SEQ ID NO: 2588894 - protein, 23 aa, Entamoeba histolytica
TLTEPKFLYFTPLYQQYTLRSLD

SEQ ID NO: 2588895 - protein, 25 aa, Entamoeba histolytica
TLTFKRLTGSISLLNYVPKTIGSGE

SEQ ID NO: 2588896 - protein, 25 aa, Entamoeba histolytica
TLTHYKISYASFYVKSDITASEGCS

SEQ ID NO: 2588897 - protein, 20 aa, Entamoeba histolytica
TLTNNWKYPMHFTFHSGDYT

SEQ ID NO: 2588898 - protein, 20 aa, Entamoeba histolytica
TLVELSMVFLFSSNEEFNYP

SEQ ID NO: 2588899 - protein, 18 aa, Entamoeba histolytica
TLVLKCLIDRKIKVDIVK

SEQ ID NO: 2588900 - protein, 18 aa, Entamoeba histolytica
TLWCLCCVVEYFLHQLIC

SEQ ID NO: 2588901 - protein, 27 aa, Entamoeba histolytica
TLYAIFVCIGMVLKIRPEVLLCNGPGT

SEQ ID NO: 2588902 - protein, 22 aa, Entamoeba histolytica
TLYEIWDSCLLIALEIETDATL

SEQ ID NO: 2588903 - protein, 19 aa, Entamoeba histolytica
TLYLKDFRLTVGHCNSAFN

SEQ ID NO: 2588904 - protein, 19 aa, Entamoeba histolytica
TLYPHPWLIADTITTGNRP

SEQ ID NO: 2588905 - protein, 26 aa, Entamoeba histolytica
TMHSCTVIGWKLCLPPLLSYFQICEL

SEQ ID NO: 2588906 - protein, 26 aa, Entamoeba histolytica
TMIVCGCALGFIGYGYGGPVYAGLGG

SEQ ID NO: 2588907 - protein, 17 aa, Entamoeba histolytica
TMLQCFTWEDPFPKTQF

SEQ ID NO: 2588908 - protein, 17 aa, Entamoeba histolytica
TMNRWHFIILTVITILI

SEQ ID NO: 2588909 - protein, 23 aa, Entamoeba histolytica
TMSHEYCDGLLFIAHHNEELSKS

SEQ ID NO: 2588910 - protein, 23 aa, Entamoeba histolytica
TMTEIRQGPNLYSFKTINGQFKI

SEQ ID NO: 2588911 - protein, 19 aa, Entamoeba histolytica
TNANTFKKCIVSISQQISS

SEQ ID NO: 2588912 - protein, 17 aa, Entamoeba histolytica
TNCIIHSLTGLLYIGNS

SEQ ID NO: 2588913 - protein, 18 aa, Entamoeba histolytica
TNCLKYINSGHCVECKEG

SEQ ID NO: 2588914 - protein, 22 aa, Entamoeba histolytica
TNCLLYKYGRCVACENHFSFDS

SEQ ID NO: 2588915 - protein, 26 aa, Entamoeba histolytica
TNESSKMVKCWIEFIESKAMNISETF

SEQ ID NO: 2588916 - protein, 22 aa, Entamoeba histolytica
TNFKELFKMIGEEESNILKGII

SEQ ID NO: 2588917 - protein, 19 aa, Entamoeba histolytica
TNFLFWGIGSIIYIIFYIL

SEQ ID NO: 2588918 - protein, 26 aa, Entamoeba histolytica
TNFVLRQRFGLGIALYFDFLYYVLVS

SEQ ID NO: 2588919 - protein, 25 aa, Entamoeba histolytica
TNGEWYCIYPPFAFVQALERMNSDL

SEQ ID NO: 2588920 - protein, 21 aa, Entamoeba histolytica
TNHRLNILKLYSLRNNELTGN

SEQ ID NO: 2588921 - protein, 21 aa, Entamoeba histolytica
TNIFDTRFENIVIKNHSKKKW

SEQ ID NO: 2588922 - protein, 28 aa, Entamoeba histolytica
TNIKSRLRVSLLYTWCVILILNNVRIQD

SEQ ID NO: 2588923 - protein, 18 aa, Entamoeba histolytica
TNITFGLLSSDYKIQSLP

SEQ ID NO: 2588924 - protein, 25 aa, Entamoeba histolytica
TNKVECPYWLAPECIINKKACLKSD

SEQ ID NO: 2588925 - protein, 18 aa, Entamoeba histolytica
TNLKTEIALLLNSIVFFY

SEQ ID NO: 2588926 - protein, 27 aa, Entamoeba histolytica
TNLLDPRTVSIIFTCLLVISFVVALLL

SEQ ID NO: 2588927 - protein, 22 aa, Entamoeba histolytica
TNLNGISCTFIILSIGITFILF

SEQ ID NO: 2588928 - protein, 23 aa, Entamoeba histolytica
TNLPEWTTWTLLIGMACYDLVAV

SEQ ID NO: 2588929 - protein, 22 aa, Entamoeba histolytica
TNLRRFECIGMKEAFNAIGGIE

SEQ ID NO: 2588930 - protein, 22 aa, Entamoeba histolytica
TNLSREALLVWLIAETIAVTFV

SEQ ID NO: 2588931 - protein, 21 aa, Entamoeba histolytica
TNLVCPIDFSGKFTAEVPDYQ

SEQ ID NO: 2588932 - protein, 18 aa, Entamoeba histolytica
TNNCARIGVLVLILHDIV

SEQ ID NO: 2588933 - protein, 18 aa, Entamoeba histolytica
TNNDGTCVECLFSESAEK

SEQ ID NO: 2588934 - protein, 26 aa, Entamoeba histolytica
TNNDYNVIFGMFKDFVEKVVTSTGTN

SEQ ID NO: 2588935 - protein, 18 aa, Entamoeba histolytica
TNNWKYPMHFTFHSGDYT

SEQ ID NO: 2588936 - protein, 24 aa, Entamoeba histolytica
TNQIKRLHVFGEILAENGYLVRSD

SEQ ID NO: 2588937 - protein, 18 aa, Entamoeba histolytica
TNQIPTFVSDWFNNAPLN

SEQ ID NO: 2588938 - protein, 18 aa, Entamoeba histolytica
TNSLLRRLPGGTCKSICN

SEQ ID NO: 2588939 - protein, 19 aa, Entamoeba histolytica
TNSTMGIWIKSCEQHIIHS

SEQ ID NO: 2588940 - protein, 17 aa, Entamoeba histolytica
TNTIKCYQNTFSTLSGA

SEQ ID NO: 2588941 - protein, 24 aa, Entamoeba histolytica
TNTIQNIYINIHLIAETLSESVPA

SEQ ID NO: 2588942 - protein, 19 aa, Entamoeba histolytica
TNTKCLECLFHSYINQEEC

SEQ ID NO: 2588943 - protein, 24 aa, Entamoeba histolytica
TNVFLEMFQNFGIVTEPNHMFWGQ

SEQ ID NO: 2588944 - protein, 24 aa, Entamoeba histolytica
TNVSLCSEFICYCSDLDIVELSVI

SEQ ID NO: 2588945 - protein, 25 aa, Entamoeba histolytica
TNYKCLKCGLGCLFCEDDSGDCLSC

SEQ ID NO: 2588946 - protein, 25 aa, Entamoeba histolytica
TPAPHLPPSFPLSVTVPDNYSNPIQ

SEQ ID NO: 2588947 - protein, 24 aa, Entamoeba histolytica
TPDPKECRSCYGAETPEKKCCFTC

SEQ ID NO: 2588948 - protein, 25 aa, Entamoeba histolytica
TPDPVLIPFWKIWFDALKDKTLIIL

SEQ ID NO: 2588949 - protein, 23 aa, Entamoeba histolytica
TPEAPASQHGPTPVEGGSVTTGG

SEQ ID NO: 2588950 - protein, 24 aa, Entamoeba histolytica
TPERDFNKYFILYLACVLMLIQTN

SEQ ID NO: 2588951 - protein, 21 aa, Entamoeba histolytica
TPESLSLVFQKERMIPQTKIE

SEQ ID NO: 2588952 - protein, 21 aa, Entamoeba histolytica
TPFIYKNFYVVQSRFLDFLLS

SEQ ID NO: 2588953 - protein, 20 aa, Entamoeba histolytica
TPFMLITVLFLGFFATKFTA

SEQ ID NO: 2588954 - protein, 24 aa, Entamoeba histolytica
TPFSGPWSRIEVTGAVFIISLLLF

SEQ ID NO: 2588955 - protein, 20 aa, Entamoeba histolytica
TPGSIYMRTRVLGSDHKGFV

SEQ ID NO: 2588956 - protein, 17 aa, Entamoeba histolytica
TPINMNIVFAFVAGNQV

SEQ ID NO: 2588957 - protein, 18 aa, Entamoeba histolytica
TPITIIWENGERLTVNYK

SEQ ID NO: 2588958 - protein, 18 aa, Entamoeba histolytica
TPITIIWENGERLTVNYN

SEQ ID NO: 2588959 - protein, 19 aa, Entamoeba histolytica
TPKLITWVDELMKYKNFII

SEQ ID NO: 2588960 - protein, 17 aa, Entamoeba histolytica
TPKVWLLGYDEDHKPLT

SEQ ID NO: 2588961 - protein, 20 aa, Entamoeba histolytica
TPLSNFEAGMAYRDVPDPAV

SEQ ID NO: 2588962 - protein, 19 aa, Entamoeba histolytica
TPMKSLCEKYMIQLVEKPN

SEQ ID NO: 2588963 - protein, 31 aa, Entamoeba histolytica
TPRMVKVCDITEPFVPLAPKNFFKPISEVIE

SEQ ID NO: 2588964 - protein, 22 aa, Entamoeba histolytica
TPSEIKQLIFINGSYTNSLDLT

SEQ ID NO: 2588965 - protein, 28 aa, Entamoeba histolytica
TPSFYGRRVRTCFVKIILQLSLPLTIII

SEQ ID NO: 2588966 - protein, 24 aa, Entamoeba histolytica
TPYNWKYFPTPAFYAYVASNFIAD

SEQ ID NO: 2588967 - protein, 25 aa, Entamoeba histolytica
TQCGHTFCWKCIKDKVPGYCPFCGN

SEQ ID NO: 2588968 - protein, 19 aa, Entamoeba histolytica
TQEIYYWSIILIKLLMFIL

SEQ ID NO: 2588969 - protein, 25 aa, Entamoeba histolytica
TQFKWMRREIGIGFNGEIKYGDWEI

SEQ ID NO: 2588970 - protein, 19 aa, Entamoeba histolytica
TQIGKELHSQPVVPTVQHE

SEQ ID NO: 2588971 - protein, 18 aa, Entamoeba histolytica
TQIPFSLKMKSNDKLLHS

SEQ ID NO: 2588972 - protein, 24 aa, Entamoeba histolytica
TQIPMYCAFSFLVIAGGKTVLLTN

SEQ ID NO: 2588973 - protein, 22 aa, Entamoeba histolytica
TQKFPFNAHFTFFVLAVIPFIN

SEQ ID NO: 2588974 - protein, 17 aa, Entamoeba histolytica
TQKSSAVSIPIKIQIPS

SEQ ID NO: 2588975 - protein, 18 aa, Entamoeba histolytica
TQLDFSWSQSDDIPLEIL

SEQ ID NO: 2588976 - protein, 32 aa, Entamoeba histolytica
TQLPFGRDPQQAFCPRCNMTVTTVVKYEAGGM

SEQ ID NO: 2588977 - protein, 25 aa, Entamoeba histolytica
TQQELKKGITLIGFRLSDFNNDITQ

SEQ ID NO: 2588978 - protein, 23 aa, Entamoeba histolytica
TQRMCSNPSKYSFQMKKVLLNSG

SEQ ID NO: 2588979 - protein, 20 aa, Entamoeba histolytica
TQRSCFYGKHILKLKNKSVI

SEQ ID NO: 2588980 - protein, 21 aa, Entamoeba histolytica
TQWCKARGFKDGILINTKVSK

SEQ ID NO: 2588981 - protein, 21 aa, Entamoeba histolytica
TQWGVCILLGLVSLPLGLLNG

SEQ ID NO: 2588982 - protein, 25 aa, Entamoeba histolytica
TQWTYRRSVILLGFIVTVILYLVMA

SEQ ID NO: 2588983 - protein, 18 aa, Entamoeba histolytica
TQYAICTKAKALGEEILN

SEQ ID NO: 2588984 - protein, 17 aa, Entamoeba histolytica
TQYSDAIDIFFKVIQTW

SEQ ID NO: 2588985 - protein, 17 aa, Entamoeba histolytica
TQYVYGIYFDVPVQNSS

SEQ ID NO: 2588986 - protein, 17 aa, Entamoeba histolytica
TRALLYFSSLCREKDEL

SEQ ID NO: 2588987 - protein, 21 aa, Entamoeba histolytica
TRATGIFPLKHCNIELQTYPI

SEQ ID NO: 2588988 - protein, 18 aa, Entamoeba histolytica
TRCILKIQISVHIFFLVA

SEQ ID NO: 2588989 - protein, 25 aa, Entamoeba histolytica
TRCTITNLYHCIKIISHFSGTEKSN

SEQ ID NO: 2588990 - protein, 20 aa, Entamoeba histolytica
TRDCTGCQPGYMWFGEGNCS

SEQ ID NO: 2588991 - protein, 20 aa, Entamoeba histolytica
TRECKTCSLTETKEKVEEID

SEQ ID NO: 2588992 - protein, 25 aa, Entamoeba histolytica
TRELAVQINEHFKKLIKYLPQFTSL

SEQ ID NO: 2588993 - protein, 25 aa, Entamoeba histolytica
TRELDASGIGIRWQQSLDPGLVDSL

SEQ ID NO: 2588994 - protein, 17 aa, Entamoeba histolytica
TRFAMTFTFGNILIFIG

SEQ ID NO: 2588995 - protein, 18 aa, Entamoeba histolytica
TRFNCYAHVWDIHLREYY

SEQ ID NO: 2588996 - protein, 24 aa, Entamoeba histolytica
TRFYCGAITFKTCSSRTTEDDCIR

SEQ ID NO: 2588997 - protein, 22 aa, Entamoeba histolytica
TRIKRIIVNIIIDNSMLDILKN

SEQ ID NO: 2588998 - protein, 17 aa, Entamoeba histolytica
TRIWKKDNSDYILIVNN

SEQ ID NO: 2588999 - protein, 21 aa, Entamoeba histolytica
TRKIWGFCILTISFILNNIGF

SEQ ID NO: 2589000 - protein, 24 aa, Entamoeba histolytica
TRKLAIPLMVDLCTKRCYCKSLII

SEQ ID NO: 2589001 - protein, 28 aa, Entamoeba histolytica
TRKVKCPASRGLDCKAIPLASQIYLTHP

SEQ ID NO: 2589002 - protein, 22 aa, Entamoeba histolytica
TRLCSKSKIKLHEIPQLPEYIK

SEQ ID NO: 2589003 - protein, 25 aa, Entamoeba histolytica
TRLVKAYFLMCEIIEFNETKENEEG

SEQ ID NO: 2589004 - protein, 26 aa, Entamoeba histolytica
TRNCKLCDVNSCFSCLENSYLSKGIC

SEQ ID NO: 2589005 - protein, 17 aa, Entamoeba histolytica
TRNICLCIFFDGVDLLC

SEQ ID NO: 2589006 - protein, 23 aa, Entamoeba histolytica
TRQETCPICKSKVTVDSVIPIYN

SEQ ID NO: 2589007 - protein, 22 aa, Entamoeba histolytica
TRSDGSASFVVRGMENVKGDIE

SEQ ID NO: 2589008 - protein, 18 aa, Entamoeba histolytica
TRSFICPFTRNFNFPQMY

SEQ ID NO: 2589009 - protein, 17 aa, Entamoeba histolytica
TRSGKYILYSFSDLIGL

SEQ ID NO: 2589010 - protein, 19 aa, Entamoeba histolytica
TRTAGFSIINVRDLSPPVI

SEQ ID NO: 2589011 - protein, 25 aa, Entamoeba histolytica
TRTFLYKQKMRIHRVELELEVFKGH

SEQ ID NO: 2589012 - protein, 17 aa, Entamoeba histolytica
TRVEPVVQFMLTPQQSV

SEQ ID NO: 2589013 - protein, 24 aa, Entamoeba histolytica
TRYEIFGILACSFFGIERSKICHT

SEQ ID NO: 2589014 - protein, 19 aa, Entamoeba histolytica
TSAFQKYPLFLLAVISLIG

SEQ ID NO: 2589015 - protein, 26 aa, Entamoeba histolytica
TSAYCSGCSYDSPDVCFYCIDQYILE

SEQ ID NO: 2589016 - protein, 37 aa, Entamoeba histolytica
TSCKVCPDGFFPYPDRSRCFTCQAGMELAASGCKDCQ

SEQ ID NO: 2589017 - protein, 21 aa, Entamoeba histolytica
TSCLFNLIIPKSFTSGTLKLY

SEQ ID NO: 2589018 - protein, 20 aa, Entamoeba histolytica
TSCLYCKWTDVTDDINEAFI

SEQ ID NO: 2589019 - protein, 18 aa, Entamoeba histolytica
TSCNLCGSGMTIDNGICQ

SEQ ID NO: 2589020 - protein, 22 aa, Entamoeba histolytica
TSCVLCSPGYWFNGNSCVKCNE

SEQ ID NO: 2589021 - protein, 25 aa, Entamoeba histolytica
TSCYFPIPLFYQFFQRREFPRCGTC

SEQ ID NO: 2589022 - protein, 23 aa, Entamoeba histolytica
TSDEEMKRVLKLVNSVNELDDVV

SEQ ID NO: 2589023 - protein, 23 aa, Entamoeba histolytica
TSDFHLALFVLRLLLSKRNELKD

SEQ ID NO: 2589024 - protein, 18 aa, Entamoeba histolytica
TSDNFFVYFSYIMMLFNN

SEQ ID NO: 2589025 - protein, 24 aa, Entamoeba histolytica
TSELKRLQIGFAKNNMYVLNNGNV

SEQ ID NO: 2589026 - protein, 25 aa, Entamoeba histolytica
TSERIESIISFDFVNKVFNYSEISV

SEQ ID NO: 2589027 - protein, 18 aa, Entamoeba histolytica
TSFELVRLFYDCQIPYIM

SEQ ID NO: 2589028 - protein, 24 aa, Entamoeba histolytica
TSFHPETWTPVWSISSMLEAIRAF

SEQ ID NO: 2589029 - protein, 18 aa, Entamoeba histolytica
TSFKRPNLFQQYIREDNE

SEQ ID NO: 2589030 - protein, 21 aa, Entamoeba histolytica
TSFYEYFEWNLDYNKESNPRE

SEQ ID NO: 2589031 - protein, 17 aa, Entamoeba histolytica
TSFYSLWVYVFEIEQQV

SEQ ID NO: 2589032 - protein, 18 aa, Entamoeba histolytica
TSGCGKDCLCKKGYTANG

SEQ ID NO: 2589033 - protein, 19 aa, Entamoeba histolytica
TSGCSRCSIGFYLNKGKCL

SEQ ID NO: 2589034 - protein, 26 aa, Entamoeba histolytica
TSGKPEVPEPSVASGKNSEKPPQPTS

SEQ ID NO: 2589035 - protein, 22 aa, Entamoeba histolytica
TSHIPQTFILNGKLTFSKTTSA

SEQ ID NO: 2589036 - protein, 22 aa, Entamoeba histolytica
TSIILCILNWVAMVMLSQRQHN

SEQ ID NO: 2589037 - protein, 22 aa, Entamoeba histolytica
TSIKANTPWPSKVNFLNTLSSL

SEQ ID NO: 2589038 - protein, 27 aa, Entamoeba histolytica
TSILHLWLMVSIPKFDITKSFKSQICY

SEQ ID NO: 2589039 - protein, 18 aa, Entamoeba histolytica
TSIMPPFISFIIKLIGSH

SEQ ID NO: 2589040 - protein, 25 aa, Entamoeba histolytica
TSKNCSSCSFGYYFNDEGICEYIGE

SEQ ID NO: 2589041 - protein, 18 aa, Entamoeba histolytica
TSKSYPLLLPDVINLITL

SEQ ID NO: 2589042 - protein, 18 aa, Entamoeba histolytica
TSLEVIKVLSAHEIAESM

SEQ ID NO: 2589043 - protein, 27 aa, Entamoeba histolytica
TSLHLEDACDFTWKIMQGELDSIKCLH

SEQ ID NO: 2589044 - protein, 21 aa, Entamoeba histolytica
TSLKNKTGFILLNRNLPFVVI

SEQ ID NO: 2589045 - protein, 17 aa, Entamoeba histolytica
TSLLVILDRCFDGYTPL

SEQ ID NO: 2589046 - protein, 17 aa, Entamoeba histolytica
TSLQVPIHFDRMDSSKS

SEQ ID NO: 2589047 - protein, 24 aa, Entamoeba histolytica
TSLSKKELQGFCDLLNGKENNFTL

SEQ ID NO: 2589048 - protein, 19 aa, Entamoeba histolytica
TSNEEFKYHLVITEENMQN

SEQ ID NO: 2589049 - protein, 17 aa, Entamoeba histolytica
TSPNLDGIFAYYEKTEL

SEQ ID NO: 2589050 - protein, 21 aa, Entamoeba histolytica
TSQWKELWVDLYYDEIVIRSD

SEQ ID NO: 2589051 - protein, 22 aa, Entamoeba histolytica
TSSNLGGLVAQWSSHHVTKLKK

SEQ ID NO: 2589052 - protein, 19 aa, Entamoeba histolytica
TSSTKCAVPTCGNGKIDVY

SEQ ID NO: 2589053 - protein, 19 aa, Entamoeba histolytica
TSTRYENYDALSFTTDAIQ

SEQ ID NO: 2589054 - protein, 19 aa, Entamoeba histolytica
TSVFNKGLILFLQYYIHQH

SEQ ID NO: 2589055 - protein, 26 aa, Entamoeba histolytica
TSVHLKLRFCQDISRGMLYLHENNII

SEQ ID NO: 2589056 - protein, 19 aa, Entamoeba histolytica
TSVIQRSFVYEIFLGSLPL

SEQ ID NO: 2589057 - protein, 18 aa, Entamoeba histolytica
TSVSGAAVAPVDWEIKEV

SEQ ID NO: 2589058 - protein, 21 aa, Entamoeba histolytica
TSYKYSFKYFSLQQRINFTIL

SEQ ID NO: 2589059 - protein, 17 aa, Entamoeba histolytica
TSYTCASHCLAGYEQDN

SEQ ID NO: 2589060 - protein, 18 aa, Entamoeba histolytica
TTCFSSATYCMGCSSDKY

SEQ ID NO: 2589061 - protein, 18 aa, Entamoeba histolytica
TTCGIPFCVYCPEYYNDK

SEQ ID NO: 2589062 - protein, 18 aa, Entamoeba histolytica
TTCPYDCLNGVCSVSKGG

SEQ ID NO: 2589063 - protein, 20 aa, Entamoeba histolytica
TTDSDSFCLFGISKNNQNIC

SEQ ID NO: 2589064 - protein, 19 aa, Entamoeba histolytica
TTFWQYRTPPVNSIHEVLT

SEQ ID NO: 2589065 - protein, 25 aa, Entamoeba histolytica
TTGCAFTYPFAWLAGAKIMTYTHYP

SEQ ID NO: 2589066 - protein, 17 aa, Entamoeba histolytica
TTILCWTAIPFLQSYCS

SEQ ID NO: 2589067 - protein, 17 aa, Entamoeba histolytica
TTIWDRWRPTTFTDDII

SEQ ID NO: 2589068 - protein, 19 aa, Entamoeba histolytica
TTKGSIGWQAPEMLDDSCP

SEQ ID NO: 2589069 - protein, 24 aa, Entamoeba histolytica
TTKQWLLSFCCKLLSNKLSENDTI

SEQ ID NO: 2589070 - protein, 23 aa, Entamoeba histolytica
TTKTPRFEQVLTLNATTNTFNGN

SEQ ID NO: 2589071 - protein, 23 aa, Entamoeba histolytica
TTLFLEEFIRIVFIGHPDRTTSF

SEQ ID NO: 2589072 - protein, 24 aa, Entamoeba histolytica
TTLIGYPFFIVYIIAAGLGIFIEG

SEQ ID NO: 2589073 - protein, 25 aa, Entamoeba histolytica
TTLILFFICVCIIIGILFIIQPDYA

SEQ ID NO: 2589074 - protein, 17 aa, Entamoeba histolytica
TTLLTQVMNPYGFYIGT

SEQ ID NO: 2589075 - protein, 17 aa, Entamoeba histolytica
TTLPNICINKKPYSPFE

SEQ ID NO: 2589076 - protein, 25 aa, Entamoeba histolytica
TTLQSILKNMCELYKLLYTIPQFQK

SEQ ID NO: 2589077 - protein, 17 aa, Entamoeba histolytica
TTLSFPAAYFTFKGTGT

SEQ ID NO: 2589078 - protein, 23 aa, Entamoeba histolytica
TTLYIPYLFLFGWNIVSIEDHYN

SEQ ID NO: 2589079 - protein, 18 aa, Entamoeba histolytica
TTMCGVYVNAGRENSVAS

SEQ ID NO: 2589080 - protein, 19 aa, Entamoeba histolytica
TTMIGWNCFLQVGSNMLIT

SEQ ID NO: 2589081 - protein, 25 aa, Entamoeba histolytica
TTMPEKKLNMFIKFCDIIKTLHTKL

SEQ ID NO: 2589082 - protein, 23 aa, Entamoeba histolytica
TTNLCGTLAWIAPEILQNKPFGI

SEQ ID NO: 2589083 - protein, 17 aa, Entamoeba histolytica
TTPLFKKTALYLVDALR

SEQ ID NO: 2589084 - protein, 18 aa, Entamoeba histolytica
TTPVLSFILSVTSLLIAN

SEQ ID NO: 2589085 - protein, 29 aa, Entamoeba histolytica
TTQLKLGAGVYRLSLLVHESLKISKEFFS

SEQ ID NO: 2589086 - protein, 25 aa, Entamoeba histolytica
TTQLKRLHVFGEIFAENGYLVRSDA

SEQ ID NO: 2589087 - protein, 24 aa, Entamoeba histolytica
TTQLKVRICQDIARGMNYLHQNNI

SEQ ID NO: 2589088 - protein, 21 aa, Entamoeba histolytica
TTSESFLCYLIPQNVDEMQEI

SEQ ID NO: 2589089 - protein, 17 aa, Entamoeba histolytica
TTSMFIILCATIILLFF

SEQ ID NO: 2589090 - protein, 30 aa, Entamoeba histolytica; identical to SEQ ID NO: 2391413

SEQ ID NO: 2589091 - protein, 25 aa, Entamoeba histolytica
TTTHLKRLFLLWGFSLSILLMIYGI

SEQ ID NO: 2589092 - protein, 26 aa, Entamoeba histolytica
TTTLWFKFIGVRVIFVGIIFITLCCF

SEQ ID NO: 2589093 - protein, 20 aa, Entamoeba histolytica
TTTRCSFIPLFNPKEYSDQK

SEQ ID NO: 2589094 - protein, 26 aa, Entamoeba histolytica
TTTSSLYFKFIDQFPDAPICEFGEVF

SEQ ID NO: 2589095 - protein, 19 aa, Entamoeba histolytica
TTVDPFIALLGRMIPSPHL

SEQ ID NO: 2589096 - protein, 19 aa, Entamoeba histolytica
TTVGMFLMHFCFFVLSERQ

SEQ ID NO: 2589097 - protein, 19 aa, Entamoeba histolytica
TTYLLKLLPLFIFTLFIQL

SEQ ID NO: 2589098 - protein, 35 aa, Entamoeba histolytica
TTYSNSLVDRWLCLRVDCIGAFVMFGSVIAASLGG

SEQ ID NO: 2589099 - protein, 19 aa, Entamoeba histolytica
TVCPYNCLNGVCSVSKGGC

SEQ ID NO: 2589100 - protein, 21 aa, Entamoeba histolytica
TVCVILPFVILFFIATPKLDL

SEQ ID NO: 2589101 - protein, 24 aa, Entamoeba histolytica
TVEIEYSIIMSILYIEDVLENIRV

SEQ ID NO: 2589102 - protein, 25 aa, Entamoeba histolytica
TVFPGLMFTSAFIFKFLAYFNLIID

SEQ ID NO: 2589103 - protein, 18 aa, Entamoeba histolytica
TVFTDVWLPNDIDTNTDF

SEQ ID NO: 2589104 - protein, 19 aa, Entamoeba histolytica
TVFTTRYAKYVLKSSNQTA

SEQ ID NO: 2589105 - protein, 17 aa, Entamoeba histolytica
TVGHAALALGLIFQGTM

SEQ ID NO: 2589106 - protein, 23 aa, Entamoeba histolytica
TVGNKGAYVLLSFDENTKPITKI

SEQ ID NO: 2589107 - protein, 29 aa, Entamoeba histolytica
TVHIPKYFVKDSFLGWKYVDFNNSKFNPD

SEQ ID NO: 2589108 - protein, 28 aa, Entamoeba histolytica
TVHRPECAIPFKYSLPIESLAKEMTLIN

SEQ ID NO: 2589109 - protein, 19 aa, Entamoeba histolytica
TVHSNLCLCKQAIRSLRII

SEQ ID NO: 2589110 - protein, 23 aa, Entamoeba histolytica
TVHTAFCLFSIIIYYAGKMYAHR

SEQ ID NO: 2589111 - protein, 23 aa, Entamoeba histolytica
TVIKRFIGCLIIYIPIPDNSINT

SEQ ID NO: 2589112 - protein, 19 aa, Entamoeba histolytica
TVIPGIIFLWKVIIKPLLF

SEQ ID NO: 2589113 - protein, 21 aa, Entamoeba histolytica
TVISVFCFILSLIAFIYQFVF

SEQ ID NO: 2589114 - protein, 19 aa, Entamoeba histolytica
TVKEHWKYGINITSTLPIT

SEQ ID NO: 2589115 - protein, 24 aa, Entamoeba histolytica
TVKQADCNFHYPPFLYTLKKNETS

SEQ ID NO: 2589116 - protein, 24 aa, Entamoeba histolytica
TVKQCRNSTCPACYQICKNGAIST

SEQ ID NO: 2589117 - protein, 25 aa, Entamoeba histolytica
TVLLTCPIFYYFRFCKELFVSDLTP

SEQ ID NO: 2589118 - protein, 21 aa, Entamoeba histolytica
TVLSLRLPILTVVSHDDNYAE

SEQ ID NO: 2589119 - protein, 17 aa, Entamoeba histolytica
TVMKACCDKLFEQTKID

SEQ ID NO: 2589120 - protein, 17 aa, Entamoeba histolytica
TVPESYLITGYETMGDG

SEQ ID NO: 2589121 - protein, 25 aa, Entamoeba histolytica
TVSFKEKYGRMALLKMTELKEPKRG

SEQ ID NO: 2589122 - protein, 20 aa, Entamoeba histolytica
TVSTIRLKYYGTWKLTESLG

SEQ ID NO: 2589123 - protein, 18 aa, Entamoeba histolytica
TVSWKRYVDDDCTVNNPV

SEQ ID NO: 2589124 - protein, 23 aa, Entamoeba histolytica
TVSYKIIRIHTGFNTVDLILCCC

SEQ ID NO: 2589125 - protein, 20 aa, Entamoeba histolytica
TVTCIKEWIEEYGRIKKEEE

SEQ ID NO: 2589126 - protein, 31 aa, Entamoeba histolytica
TVTLPSFMVICFYVCLSFIIDRHIVIVINNI

SEQ ID NO: 2589127 - protein, 23 aa, Entamoeba histolytica
TVTLRLILIIVFHLVSIKCSIFE

SEQ ID NO: 2589128 - protein, 25 aa, Entamoeba histolytica
TVVKALKRRGEVVAMTGDGVNDAPA

SEQ ID NO: 2589129 - protein, 20 aa, Entamoeba histolytica
TVVLKFKVILIVILQKQGYN

SEQ ID NO: 2589130 - protein, 22 aa, Entamoeba histolytica
TVVVDCLFVVWIYWNKSNIEEW

SEQ ID NO: 2589131 - protein, 17 aa, Entamoeba histolytica
TWACIIIGYIPPVLTIL

SEQ ID NO: 2589132 - protein, 17 aa, Entamoeba histolytica
TWARRISLILGITYGLG

SEQ ID NO: 2589133 - protein, 19 aa, Entamoeba histolytica
TWVKWETGWSLGYKAEQWE

SEQ ID NO: 2589134 - protein, 26 aa, Entamoeba histolytica
TYCGCAVGGSWNCAIMRELAKVYCSE

SEQ ID NO: 2589135 - protein, 22 aa, Entamoeba histolytica
TYCMSCKGNAILSNHTCFNDYK

SEQ ID NO: 2589136 - protein, 22 aa, Entamoeba histolytica
TYDIKSSIIAGKRPELKLPMPQ

SEQ ID NO: 2589137 - protein, 24 aa, Entamoeba histolytica
TYEKHVWPSLLFMVLITFLLSVVI

SEQ ID NO: 2589138 - protein, 25 aa, Entamoeba histolytica
TYFEFRGVNVLTEYSQEITIVNTGK

SEQ ID NO: 2589139 - protein, 20 aa, Entamoeba histolytica
TYGCLQCMRGYFFNSNLECE

SEQ ID NO: 2589140 - protein, 26 aa, Entamoeba histolytica
TYGFQRVEPLLGFINGFFLVLFSAFT

SEQ ID NO: 2589141 - protein, 31 aa, Entamoeba histolytica
TYHYQECREIMDFLYKRLCEDGKNWREIYKS

SEQ ID NO: 2589142 - protein, 18 aa, Entamoeba histolytica
TYIILSILLFIISFNQMR

SEQ ID NO: 2589143 - protein, 25 aa, Entamoeba histolytica
TYILYRPIYQWIFQRVTEVYMMYFP

SEQ ID NO: 2589144 - protein, 19 aa, Entamoeba histolytica
TYISWEMEDRPYLYLYQNV

SEQ ID NO: 2589145 - protein, 20 aa, Entamoeba histolytica
TYLPPLFIQRNYSIKCIVSE

SEQ ID NO: 2589146 - protein, 18 aa, Entamoeba histolytica
TYRMCGIECIDRFKDSTP

SEQ ID NO: 2589147 - protein, 18 aa, Entamoeba histolytica
TYRRCIKVTNDGKEIESE

SEQ ID NO: 2589148 - protein, 18 aa, Entamoeba histolytica
TYSCLKCENRRCLENILG

SEQ ID NO: 2589149 - protein, 23 aa, Entamoeba histolytica
TYSKLCWFDSIKIGSLSNTKLSV

SEQ ID NO: 2589150 - protein, 37 aa, Entamoeba histolytica
TYSLIKRLMLIGILFFPFHLVVCYLFRNSNDKRIQRI

SEQ ID NO: 2589151 - protein, 29 aa, Entamoeba histolytica
TYTPSWKSIVIPLLIGFIVPLISNIIPIK

SEQ ID NO: 2589152 - protein, 25 aa, Entamoeba histolytica
TYTRCGLCLEITGPSLLTTTCTVVG

SEQ ID NO: 2589153 - protein, 19 aa, Entamoeba histolytica
TYYTLPFVYEIRTILDWCL

SEQ ID NO: 2589154 - protein, 23 aa, Entamoeba histolytica
VADSKRIKYKWNQFQLKNKTYIY

SEQ ID NO: 2589155 - protein, 22 aa, Entamoeba histolytica
VAEALCSLSNIIVKMKVGVDDF

SEQ ID NO: 2589156 - protein, 24 aa, Entamoeba histolytica
VAFCSNCKCEYGYSYDKEKNACNP

SEQ ID NO: 2589157 - protein, 19 aa, Entamoeba histolytica
VAFITAIISKCCDFLNAPT

SEQ ID NO: 2589158 - protein, 19 aa, Entamoeba histolytica
VAFSGLFLAGVIVLDLFAF

SEQ ID NO: 2589159 - protein, 28 aa, Entamoeba histolytica
VAIKGTFPFIWIFLVFASICYWASNQFA

SEQ ID NO: 2589160 - protein, 17 aa, Entamoeba histolytica
VAKKKIIMCASGLSSVN

SEQ ID NO: 2589161 - protein, 22 aa, Entamoeba histolytica
VAKTDAGLWYLLKRSSDIVNEK

SEQ ID NO: 2589162 - protein, 19 aa, Entamoeba histolytica
VALDLGIKRIYIPTFLIYP

SEQ ID NO: 2589163 - protein, 22 aa, Entamoeba histolytica
VALFCLCFYWAGLFFVICFWIM

SEQ ID NO: 2589164 - protein, 20 aa, Entamoeba histolytica
VALFGVCVYAFGYIPFQYIK

SEQ ID NO: 2589165 - protein, 24 aa, Entamoeba histolytica
VALGMVYCVFGFLKHTSMVVSPPK

SEQ ID NO: 2589166 - protein, 18 aa, Entamoeba histolytica
VALMFRFFQAFWDCNKKT

SEQ ID NO: 2589167 - protein, 18 aa, Entamoeba histolytica
VAMSIPLIFAWTKTSTQP

SEQ ID NO: 2589168 - protein, 27 aa, Entamoeba histolytica
VAPCNIIPFRAKHCGAQVAFINCSKTP

SEQ ID NO: 2589169 - protein, 17 aa, Entamoeba histolytica
VAQVCWFIANSNLPYVV

SEQ ID NO: 2589170 - protein, 21 aa, Entamoeba histolytica
VARFHFKLAKRTTAVKTLKLK

SEQ ID NO: 2589171 - protein, 27 aa, Entamoeba histolytica
VARLTSCLLKTFPAVVISNIIKNSPTK

SEQ ID NO: 2589172 - protein, 28 aa, Entamoeba histolytica
VASIVPVCIMLGFSCIRELLDEFRKFRA

SEQ ID NO: 2589173 - protein, 25 aa, Entamoeba histolytica
VASTFGCPIGGLLFSVEVTATYYPV

SEQ ID NO: 2589174 - protein, 18 aa, Entamoeba histolytica
VASYCEPGYKFDRFNNKC

SEQ ID NO: 2589175 - protein, 24 aa, Entamoeba histolytica
VATSNFRKVLFGILFLLHYLCLKK

SEQ ID NO: 2589176 - protein, 23 aa, Entamoeba histolytica
VAVFAVSLIGAWNDYSKQSKFIE

SEQ ID NO: 2589177 - protein, 19 aa, Entamoeba histolytica
VAVKRLVKEFYSIAQHEVE

SEQ ID NO: 2589178 - protein, 24 aa, Entamoeba histolytica
VAVMFPVVWSAYWGKDPYGAERGK

SEQ ID NO: 2589179 - protein, 32 aa, Entamoeba histolytica
VAVSHILLCISLFKIQIQPAINHLKSAAYIFN

SEQ ID NO: 2589180 - protein, 25 aa, Entamoeba histolytica
VAYSEDFFAILFFPIEHKIACLLPL

SEQ ID NO: 2589181 - protein, 21 aa, Entamoeba histolytica
VAYSIQWIGVFALSKASYSVF

SEQ ID NO: 2589182 - protein, 17 aa, Entamoeba histolytica
VCAVFLSLSFNEAICSE

SEQ ID NO: 2589183 - protein, 18 aa, Entamoeba histolytica
VCGCKWSNEELVFISPVA

SEQ ID NO: 2589184 - protein, 19 aa, Entamoeba histolytica
VCGEFGKYLQLHVSSSESI

SEQ ID NO: 2589185 - protein, 23 aa, Entamoeba histolytica
VCIAYAGAMISMFIVVIFLILSI

SEQ ID NO: 2589186 - protein, 17 aa, Entamoeba histolytica
VCIFYSMYLFVHEEPTR

SEQ ID NO: 2589187 - protein, 23 aa, Entamoeba histolytica
VCIGYRYNCAIDMWSFGCMVAEM

SEQ ID NO: 2589188 - protein, 24 aa, Entamoeba histolytica
VCIGYRYNCAIDMWSFGCMVAEMF

SEQ ID NO: 2589189 - protein, 27 aa, Entamoeba histolytica
VCIINISLTLFFLWKVILMAIFFILQV

SEQ ID NO: 2589190 - protein, 29 aa, Entamoeba histolytica
VCLALNFIKNGWVCLIFAIPTGFISGLDL

SEQ ID NO: 2589191 - protein, 17 aa, Entamoeba histolytica
VCLIGLIAIVIEQDQSL

SEQ ID NO: 2589192 - protein, 18 aa, Entamoeba histolytica
VCNLKPSKLRGVASEAMI

SEQ ID NO: 2589193 - protein, 24 aa, Entamoeba histolytica
VCNSGMKCALKFVMNKPVNCSGIK

SEQ ID NO: 2589194 - protein, 18 aa, Entamoeba histolytica
VCPLCKQPILQSKTNYGK

SEQ ID NO: 2589195 - protein, 23 aa, Entamoeba histolytica
VCSEEGCELCQSPFILNDKKECI

SEQ ID NO: 2589196 - protein, 27 aa, Entamoeba histolytica
VCSFSKNNICLKCPQGKMIDSDHTGCS

SEQ ID NO: 2589197 - protein, 19 aa, Entamoeba histolytica
VCSIPYCEKCNKNGYCQEC

SEQ ID NO: 2589198 - protein, 20 aa, Entamoeba histolytica
VCSKAGGPILYYPDPNKISS

SEQ ID NO: 2589199 - protein, 22 aa, Entamoeba histolytica
VCSQCKGFCSLTHGGCLCNGVS

SEQ ID NO: 2589200 - protein, 21 aa, Entamoeba histolytica
VCSQFALGLVLRGSSISVTYG

SEQ ID NO: 2589201 - protein, 20 aa, Entamoeba histolytica
VCSSIYPILFINCIDSSSEN

SEQ ID NO: 2589202 - protein, 25 aa, Entamoeba histolytica
VCSVICSFLGALAWWYPKPWPESYW

SEQ ID NO: 2589203 - protein, 18 aa, Entamoeba histolytica
VCTTCSGLATAIGGIVVY

SEQ ID NO: 2589204 - protein, 30 aa, Entamoeba histolytica
VCVKKFFKSKAGIILGCVIGVVLLLIIIAI

SEQ ID NO: 2589205 - protein, 17 aa, Entamoeba histolytica
VCVSLTFIAFILSVIFL

SEQ ID NO: 2589206 - protein, 17 aa, Entamoeba histolytica
VCVVILFIICGTLSITL

SEQ ID NO: 2589207 - protein, 30 aa, Entamoeba histolytica
VCYFTYSYIYRKGEKWYLPDTDNVWKQTVL

SEQ ID NO: 2589208 - protein, 19 aa, Entamoeba histolytica
VCYFVCVIGGFIPFFIKLL

SEQ ID NO: 2589209 - protein, 22 aa, Entamoeba histolytica
VDAGAAVAYVGRWFTQNPSDWA

SEQ ID NO: 2589210 - protein, 24 aa, Entamoeba histolytica
VDALKELYCIKAIDENGHITQLGI

SEQ ID NO: 2589211 - protein, 21 aa, Entamoeba histolytica
VDALYKIIFELSKEMIKKYQT

SEQ ID NO: 2589212 - protein, 21 aa, Entamoeba histolytica
VDAYSLWKGHRLEYRHFTFHS

SEQ ID NO: 2589213 - protein, 28 aa, Entamoeba histolytica
VDCIWRFLETPFKFRMEKTVSVDNDLPM

SEQ ID NO: 2589214 - protein, 18 aa, Entamoeba histolytica
VDEPFKSALISSLAALEV

SEQ ID NO: 2589215 - protein, 17 aa, Entamoeba histolytica
VDFLNVFRDSSILFRAN

SEQ ID NO: 2589216 - protein, 17 aa, Entamoeba histolytica
VDFLYMIIILHFPLIIK

SEQ ID NO: 2589217 - protein, 17 aa, Entamoeba histolytica
VDFSRWYLNDHFVYQIV

SEQ ID NO: 2589218 - protein, 20 aa, Entamoeba histolytica
VDGTYWRVLGEFRLPNQKIL

SEQ ID NO: 2589219 - protein, 18 aa, Entamoeba histolytica
VDHLRFLAIKEKYPILQW

SEQ ID NO: 2589220 - protein, 18 aa, Entamoeba histolytica
VDIICFMLYLSLSLMNTE

SEQ ID NO: 2589221 - protein, 22 aa, Entamoeba histolytica
VDIKISSGLLKKSRSHFMTFPA

SEQ ID NO: 2589222 - protein, 21 aa, Entamoeba histolytica
VDIMFPMVWHLYYGDSDSAEH

SEQ ID NO: 2589223 - protein, 17 aa, Entamoeba histolytica
VDIQAVFPFDSNRKRMS

SEQ ID NO: 2589224 - protein, 17 aa, Entamoeba histolytica
VDISDSIVICFKYFPII

SEQ ID NO: 2589225 - protein, 17 aa, Entamoeba histolytica
VDITKYYLNLSLKQQLN

SEQ ID NO: 2589226 - protein, 18 aa, Entamoeba histolytica
VDKLSLFRKMVEKEFEIL

SEQ ID NO: 2589227 - protein, 19 aa, Entamoeba histolytica
VDLAAQMLVIDPLAFRSWD

SEQ ID NO: 2589228 - protein, 25 aa, Entamoeba histolytica
VDLMYSSLMARCWNEQPSNRPDFKE

SEQ ID NO: 2589229 - protein, 17 aa, Entamoeba histolytica
VDLSISFMAKCTALLNE

SEQ ID NO: 2589230 - protein, 17 aa, Entamoeba histolytica
VDLSISFMAKCTTILNE

SEQ ID NO: 2589231 - protein, 26 aa, Entamoeba histolytica
VDLYIKLGKYLPECETLPEITYKIQE

SEQ ID NO: 2589232 - protein, 23 aa, Entamoeba histolytica
VDNPRWVAPEVLINKPFTLAADV

SEQ ID NO: 2589233 - protein, 17 aa, Entamoeba histolytica
VDPRSPYAYTDERKTEV

SEQ ID NO: 2589234 - protein, 19 aa, Entamoeba histolytica
VDPYFSWKLYVHSQSNYKE

SEQ ID NO: 2589235 - protein, 17 aa, Entamoeba histolytica
VDQSCILSCEETESKEC

SEQ ID NO: 2589236 - protein, 25 aa, Entamoeba histolytica
VDRMKTCGYWEFLFKPSKKEDVHYD

SEQ ID NO: 2589237 - protein, 24 aa, Entamoeba histolytica
VDSKLDILHFFPSILQKCLEDATS

SEQ ID NO: 2589238 - protein, 17 aa, Entamoeba histolytica
VDSRTGFIYATECSDGF

SEQ ID NO: 2589239 - protein, 24 aa, Entamoeba histolytica
VDSRYRIAVDVSFDNRIRFIQEVD

SEQ ID NO: 2589240 - protein, 24 aa, Entamoeba histolytica
VDSSFIIPCITRLSTIDNELNVDL

SEQ ID NO: 2589241 - protein, 17 aa, Entamoeba histolytica
VDVLMVFMSVLFASQTL

SEQ ID NO: 2589242 - protein, 21 aa, Entamoeba histolytica
VDVSTCFPKTIIDTGVEITTG

SEQ ID NO: 2589243 - protein, 17 aa, Entamoeba histolytica
VDYAFRYFGQQNHINPY

SEQ ID NO: 2589244 - protein, 22 aa, Entamoeba histolytica
VECICKCGGISVLLSIIEKSTT

SEQ ID NO: 2589245 - protein, 24 aa, Entamoeba histolytica
VECVSELPQRILVANELMKQFTSI

SEQ ID NO: 2589246 - protein, 24 aa, Entamoeba histolytica
VEFIECVKELIPIMNTLYYYNELI

SEQ ID NO: 2589247 - protein, 19 aa, Entamoeba histolytica
VEGLQGIILTMEFANCKFT

SEQ ID NO: 2589248 - protein, 29 aa, Entamoeba histolytica
VEIIFALRFFLYFEHRWGIILFFVTYIIS

SEQ ID NO: 2589249 - protein, 19 aa, Entamoeba histolytica
VEIKKAPKHIGFKGEGDND

SEQ ID NO: 2589250 - protein, 17 aa, Entamoeba histolytica
VEIKRAPRHNGFQSIIL

SEQ ID NO: 2589251 - protein, 17 aa, Entamoeba histolytica
VEIRGYCDLNEIKKITI

SEQ ID NO: 2589252 - protein, 19 aa, Entamoeba histolytica
VEIRKGRKLTLIREELKCV

SEQ ID NO: 2589253 - protein, 19 aa, Entamoeba histolytica
VEITQRLVFNLNDPVPIEQ

SEQ ID NO: 2589254 - protein, 24 aa, Entamoeba histolytica
VELKEIPDYIGYFGLDEDDNKCSH

SEQ ID NO: 2589255 - protein, 21 aa, Entamoeba histolytica
VELKFKIKMICTAVVNDEIGI

SEQ ID NO: 2589256 - protein, 18 aa, Entamoeba histolytica
VELMPVFYAFIVIPLVTA

SEQ ID NO: 2589257 - protein, 17 aa, Entamoeba histolytica
VELQKKFIERKMNIKKW

SEQ ID NO: 2589258 - protein, 23 aa, Entamoeba histolytica
VELRNGWDKIIEEWRNFDEENTN

SEQ ID NO: 2589259 - protein, 20 aa, Entamoeba histolytica
VEMIDRMNLLMFDNITEDSF

SEQ ID NO: 2589260 - protein, 23 aa, Entamoeba histolytica
VEMYIGIIFFCYFIAQTLVMAIM

SEQ ID NO: 2589261 - protein, 23 aa, Entamoeba histolytica
VEMYIGILFFCYFIAQTLVMSVM

SEQ ID NO: 2589262 - protein, 22 aa, Entamoeba histolytica
VENKLTFLLLFVLILFNNPFFT

SEQ ID NO: 2589263 - protein, 17 aa, Entamoeba histolytica
VEPLTKLFVDKWKEEEK

SEQ ID NO: 2589264 - protein, 17 aa, Entamoeba histolytica
VEQCLSSVIPLIGLKAY

SEQ ID NO: 2589265 - protein, 17 aa, Entamoeba histolytica
VEQPFGFPEYVAKNKLK

SEQ ID NO: 2589266 - protein, 17 aa, Entamoeba histolytica
VEQVKSYALPLVISEKV

SEQ ID NO: 2589267 - protein, 20 aa, Entamoeba histolytica
VERRKLQLTLCSRFVDPTRP

SEQ ID NO: 2589268 - protein, 20 aa, Entamoeba histolytica
VESDIYSLGMLYIIIHMQFI

SEQ ID NO: 2589269 - protein, 24 aa, Entamoeba histolytica
VESLRPALFEGWGKKQGGSVKTWK

SEQ ID NO: 2589270 - protein, 19 aa, Entamoeba histolytica
VESSYYWYDKTHVCVYESA

SEQ ID NO: 2589271 - protein, 22 aa, Entamoeba histolytica
VETLFSPSYFEWNDVCLSASED

SEQ ID NO: 2589272 - protein, 23 aa, Entamoeba histolytica
VEVLHPIFLRIVFALDDLLTYQT

SEQ ID NO: 2589273 - protein, 20 aa, Entamoeba histolytica
VEVSGRMGINATLLVSEAKR

SEQ ID NO: 2589274 - protein, 23 aa, Entamoeba histolytica
VEYIKRGALHISYYDLNVYNSNE

SEQ ID NO: 2589275 - protein, 22 aa, Entamoeba histolytica
VEYLVKWGLTICVIILVVLISH

SEQ ID NO: 2589276 - protein, 24 aa, Entamoeba histolytica
VFALSIYWFFYVFNWYMTYAKQLL

SEQ ID NO: 2589277 - protein, 25 aa, Entamoeba histolytica
VFEMTMRVLFHLYKPITGHYMNDIL

SEQ ID NO: 2589278 - protein, 20 aa, Entamoeba histolytica
VFFEHTFKTISFATVLSEVK

SEQ ID NO: 2589279 - protein, 27 aa, Entamoeba histolytica
VFFKIKDIWKHVCIVWNKCYNYTPKEI

SEQ ID NO: 2589280 - protein, 22 aa, Entamoeba histolytica
VFFLRRGQTFWQTLVSIVAQFL

SEQ ID NO: 2589281 - protein, 24 aa, Entamoeba histolytica
VFFVVCFWIMFVIAILVIIVLVVL

SEQ ID NO: 2589282 - protein, 17 aa, Entamoeba histolytica
VFGCNALGIWLGSKTLQ

SEQ ID NO: 2589283 - protein, 19 aa, Entamoeba histolytica
VFGCQRCNLGYFLYDGQCI

SEQ ID NO: 2589284 - protein, 19 aa, Entamoeba histolytica
VFGNVKYKKVDIITNEFCP

SEQ ID NO: 2589285 - protein, 18 aa, Entamoeba histolytica
VFIACLDKDLSYQVIKDN

SEQ ID NO: 2589286 - protein, 26 aa, Entamoeba histolytica
VFIAPCVFHLLSIRLFQKCSLFSYHP

SEQ ID NO: 2589287 - protein, 17 aa, Entamoeba histolytica
VFICFSQTTCNNAIDIN

SEQ ID NO: 2589288 - protein, 25 aa, Entamoeba histolytica
VFIFICSIVIIFLLIRFTKGHKIDL

SEQ ID NO: 2589289 - protein, 20 aa, Entamoeba histolytica
VFILICLVIAYYLFISYQQF

SEQ ID NO: 2589290 - protein, 25 aa, Entamoeba histolytica
VFISPVAGVLIRFFYEMWVEHSNED

SEQ ID NO: 2589291 - protein, 25 aa, Entamoeba histolytica
VFKESLRVALPVLEMRCSRCDSVIG

SEQ ID NO: 2589292 - protein, 37 aa, Entamoeba histolytica
VFLCVYSAIMVILWGARKWLDVSFSSFFIASFILCCV

SEQ ID NO: 2589293 - protein, 26 aa, Entamoeba histolytica
VFLLFYVLITFEFYRYGKGTKKIKYW

SEQ ID NO: 2589294 - protein, 27 aa, Entamoeba histolytica
VFMICSFGYLCFLIIFKWCNPDKDPAP

SEQ ID NO: 2589295 - protein, 17 aa, Entamoeba histolytica
VFNECFKCGNHCKKCKN

SEQ ID NO: 2589296 - protein, 27 aa, Entamoeba histolytica
VFNEILKFLICLVMLKFVHKKENLLQH

SEQ ID NO: 2589297 - protein, 20 aa, Entamoeba histolytica
VFNTSIYPLFSIFNVSGMTT

SEQ ID NO: 2589298 - protein, 19 aa, Entamoeba histolytica
VFNWPVDWISFAFLLFNFG

SEQ ID NO: 2589299 - protein, 24 aa, Entamoeba histolytica
VFPSALRFLPFVMILSLFLNNTPV

SEQ ID NO: 2589300 - protein, 22 aa, Entamoeba histolytica
VFPTLKRLLPFIKEKELEKKYI

SEQ ID NO: 2589301 - protein, 23 aa, Entamoeba histolytica
VFSCANFTCLPVYKRAPCSFTKV

SEQ ID NO: 2589302 - protein, 27 aa, Entamoeba histolytica
VFSFGMVMAFVLLRKPLQTILGRDVEI

SEQ ID NO: 2589303 - protein, 22 aa, Entamoeba histolytica
VFSGIWPYTKLVMLLVVWMIPS

SEQ ID NO: 2589304 - protein, 22 aa, Entamoeba histolytica
VFSLSMPQWLYIVVDDKCNRVR

SEQ ID NO: 2589305 - protein, 17 aa, Entamoeba histolytica
VFTARLWIHRISYTNII

SEQ ID NO: 2589306 - protein, 24 aa, Entamoeba histolytica
VFTKCSIGGKIYGKKEYEESEEEE

SEQ ID NO: 2589307 - protein, 27 aa, Entamoeba histolytica
VFTTLFFLRYLFLPLISYPSLLKTLQK

SEQ ID NO: 2589308 - protein, 21 aa, Entamoeba histolytica
VFVLCFGWLLNSGFIAFCYMY

SEQ ID NO: 2589309 - protein, 22 aa, Entamoeba histolytica
VFVSLYGWPLILLIIGLYCDMV

SEQ ID NO: 2589310 - protein, 19 aa, Entamoeba histolytica
VFVTIILDVPLNFNIPVLS

SEQ ID NO: 2589311 - protein, 24 aa, Entamoeba histolytica
VFYKIFFRVLEPIGYYHLKSENIF

SEQ ID NO: 2589312 - protein, 25 aa, Entamoeba histolytica
VGAFLGRGTAFAMLSNFEKAIQDFT

SEQ ID NO: 2589313 - protein, 32 aa, Entamoeba histolytica
VGAHAICCFVLSLRFSLRLIVGIYPSSSLSID

SEQ ID NO: 2589314 - protein, 17 aa, Entamoeba histolytica
VGASDCKKTVDYLPADK

SEQ ID NO: 2589315 - protein, 18 aa, Entamoeba histolytica
VGCAICNDGYYRKGTSCP

SEQ ID NO: 2589316 - protein, 23 aa, Entamoeba histolytica
VGCDCKGDCVIDYSDVTNDIIYA

SEQ ID NO: 2589317 - protein, 26 aa, Entamoeba histolytica
VGELLKRKIIKGVIYIHIIRIIINQL

SEQ ID NO: 2589318 - protein, 17 aa, Entamoeba histolytica
VGFFRCSFFTLTVEIGS

SEQ ID NO: 2589319 - protein, 37 aa, Entamoeba histolytica
VGFGFGIGLYFSWKLSLCILAVFPIISFFMFINGQLN

SEQ ID NO: 2589320 - protein, 32 aa, Entamoeba histolytica
VGFGVGIAFYYDWKVALCVMAIAPVLIVIVFL

SEQ ID NO: 2589321 - protein, 22 aa, Entamoeba histolytica
VGFINFCIFGILFLVFHILEFS

SEQ ID NO: 2589322 - protein, 25 aa, Entamoeba histolytica
VGFLYCAFCSFLVPKTEIEEPPKNH

SEQ ID NO: 2589323 - protein, 18 aa, Entamoeba histolytica
VGGLCYYLTAPNSLFELV

SEQ ID NO: 2589324 - protein, 20 aa, Entamoeba histolytica
VGGYFFLQAFETIQCLFSIY

SEQ ID NO: 2589325 - protein, 18 aa, Entamoeba histolytica
VGILFGEVLQCVATPNID

SEQ ID NO: 2589326 - protein, 19 aa, Entamoeba histolytica
VGILIRRSSHNTGVDIVRI

SEQ ID NO: 2589327 - protein, 23 aa, Entamoeba histolytica
VGKQCAELMFSTGLNELNTTTSF

SEQ ID NO: 2589328 - protein, 23 aa, Entamoeba histolytica
VGLCISFSCGISLLILLLVQTIF

SEQ ID NO: 2589329 - protein, 18 aa, Entamoeba histolytica
VGLNSLWGKTKESLNQDK

SEQ ID NO: 2589330 - protein, 23 aa, Entamoeba histolytica
VGLTNKCGWNIHQNDVIEMKTIK

SEQ ID NO: 2589331 - protein, 19 aa, Entamoeba histolytica
VGMYDSAYWIAHFIQNMII

SEQ ID NO: 2589332 - protein, 28 aa, Entamoeba histolytica
VGPMCIMMLWPRIEKFGDPNFRKLSIID

SEQ ID NO: 2589333 - protein, 18 aa, Entamoeba histolytica
VGRVLTLMSLNFKILSCV

SEQ ID NO: 2589334 - protein, 23 aa, Entamoeba histolytica
VGSRPVRFFIHCYERMTIHYQSE

SEQ ID NO: 2589335 - protein, 23 aa, Entamoeba histolytica
VGTICGLLKSLLMEMNPRFINGE

SEQ ID NO: 2589336 - protein, 21 aa, Entamoeba histolytica
VGTTFSLKRAYLIRSKANSNQ

SEQ ID NO: 2589337 - protein, 24 aa, Entamoeba histolytica
VGVFTVFVSVCFLYILQNVVELVP

SEQ ID NO: 2589338 - protein, 19 aa, Entamoeba histolytica
VGVMKPEFIVRSVAPVVFA

SEQ ID NO: 2589339 - protein, 18 aa, Entamoeba histolytica
VGVSVLVVIAGMVMYVYQ

SEQ ID NO: 2589340 - protein, 17 aa, Entamoeba histolytica
VGYICIFSLILMFYFYK

SEQ ID NO: 2589341 - protein, 21 aa, Entamoeba histolytica
VGYYYFWWLDAVGGIVLSFYI

SEQ ID NO: 2589342 - protein, 22 aa, Entamoeba histolytica
VHDTCIIPAFIEKLNYSDALAS

SEQ ID NO: 2589343 - protein, 17 aa, Entamoeba histolytica
VHESLKISKEFFSRPIY

SEQ ID NO: 2589344 - protein, 28 aa, Entamoeba histolytica
VHIPKYFVKDSFLGWKYVDFNNSKFNPD

SEQ ID NO: 2589345 - protein, 18 aa, Entamoeba histolytica
VHLYYFFHYCYLSELQFF

SEQ ID NO: 2589346 - protein, 25 aa, Entamoeba histolytica
VHRIHAIELLPLYSSNGLSVGETMK

SEQ ID NO: 2589347 - protein, 21 aa, Entamoeba histolytica
VHSVPRLKSAPGTFLSKAISL

SEQ ID NO: 2589348 - protein, 27 aa, Entamoeba histolytica
VHWYSIYICSALCLFLLTVLVFASYKR

SEQ ID NO: 2589349 - protein, 25 aa, Entamoeba histolytica
VHYHASWILSNWFFGRTQDWIQTHS

SEQ ID NO: 2589350 - protein, 34 aa, Entamoeba histolytica
VHYPCPIPDLYIYLIIACCGLVIFILGLILIAII

SEQ ID NO: 2589351 - protein, 18 aa, Entamoeba histolytica
VIAGRGVKFFGFPLLGTW

SEQ ID NO: 2589352 - protein, 25 aa, Entamoeba histolytica
VIAIFPFDIVRYIGIGCTISVTITL

SEQ ID NO: 2589353 - protein, 25 aa, Entamoeba histolytica
VIAIVMCFFMTFLFSITVSRLVLLI

SEQ ID NO: 2589354 - protein, 18 aa, Entamoeba histolytica
VIAPAGLYYCFKKFDFNM

SEQ ID NO: 2589355 - protein, 20 aa, Entamoeba histolytica
VICRDWKLTWFNSILFEFME

SEQ ID NO: 2589356 - protein, 17 aa, Entamoeba histolytica
VICSYTFNGKVLTPVTL

SEQ ID NO: 2589357 - protein, 18 aa, Entamoeba histolytica
VIEFFSIETKHMFLDQFK

SEQ ID NO: 2589358 - protein, 18 aa, Entamoeba histolytica
VIEKVPFKTVKTMVQGKE

SEQ ID NO: 2589359 - protein, 17 aa, Entamoeba histolytica
VIETALLLSQKMGAKYI

SEQ ID NO: 2589360 - protein, 36 aa, Entamoeba histolytica
VIFEALRKPISWRKNINFWIGRILFFCAFILVILIT

SEQ ID NO: 2589361 - protein, 17 aa, Entamoeba histolytica
VIFKQAILSNGFTVSAP

SEQ ID NO: 2589362 - protein, 17 aa, Entamoeba histolytica
VIGASLFILYSLISFLN

SEQ ID NO: 2589363 - protein, 22 aa, Entamoeba histolytica
VIGFTKCWDLALVVLATVPFSS

SEQ ID NO: 2589364 - protein, 22 aa, Entamoeba histolytica
VIGFTKCWDLALVVLATVPLSS

SEQ ID NO: 2589365 - protein, 19 aa, Entamoeba histolytica
VIGGEGVISFLKKMNLIDT

SEQ ID NO: 2589366 - protein, 18 aa, Entamoeba histolytica
VIGGFIPFFIKLLPNRKL

SEQ ID NO: 2589367 - protein, 24 aa, Entamoeba histolytica
VIGIGAACGFRLMTKANLFCLFIV

SEQ ID NO: 2589368 - protein, 18 aa, Entamoeba histolytica
VIGTISIILFLISFIWWI

SEQ ID NO: 2589369 - protein, 18 aa, Entamoeba histolytica
VIHMLKYIRMNPRFKREV

SEQ ID NO: 2589370 - protein, 22 aa, Entamoeba histolytica
VIIGFACSFCFGDATRTPVTHN

SEQ ID NO: 2589371 - protein, 20 aa, Entamoeba histolytica
VIIQPHLKGIYKIQIYTKKY

SEQ ID NO: 2589372 - protein, 17 aa, Entamoeba histolytica
VIISLVICYFINKASYR

SEQ ID NO: 2589373 - protein, 18 aa, Entamoeba histolytica
VIITPFVGFIFKKVKFGN

SEQ ID NO: 2589374 - protein, 22 aa, Entamoeba histolytica
VIKLFKYSDWIDVILVLVGLIS

SEQ ID NO: 2589375 - protein, 19 aa, Entamoeba histolytica
VIKRNDIVGQFFCYIQLKE

SEQ ID NO: 2589376 - protein, 19 aa, Entamoeba histolytica
VILAKMYAKRGWCDDCLKT

SEQ ID NO: 2589377 - protein, 24 aa, Entamoeba histolytica
VILFPSTTMPLSFEDFEKYSTKPK

SEQ ID NO: 2589378 - protein, 17 aa, Entamoeba histolytica
VILGIPIKIETNVQYKL

SEQ ID NO: 2589379 - protein, 20 aa, Entamoeba histolytica
VILILKFLIEVIILVFNETI

SEQ ID NO: 2589380 - protein, 27 aa, Entamoeba histolytica
VILIVFGSWCLVNFFIGKRGIAVLPLY

SEQ ID NO: 2589381 - protein, 26 aa, Entamoeba histolytica
VILLSILCFIIYIPTYFVYGQSEPEV

SEQ ID NO: 2589382 - protein, 23 aa, Entamoeba histolytica
VILPGGVFYFMFVVMVHSLWYEW

SEQ ID NO: 2589383 - protein, 27 aa, Entamoeba histolytica
VILVCDIRFPPKLAFATMKNIYSFFYS

SEQ ID NO: 2589384 - protein, 18 aa, Entamoeba histolytica
VINALWLYIILKYKHSTD

SEQ ID NO: 2589385 - protein, 20 aa, Entamoeba histolytica
VINCPILSSFSLVNTQNPIT

SEQ ID NO: 2589386 - protein, 19 aa, Entamoeba histolytica
VINVCLKKPQIEIICEIAS

SEQ ID NO: 2589387 - protein, 21 aa, Entamoeba histolytica
VIPIKLRIKFMIDAANGIQYL

SEQ ID NO: 2589388 - protein, 28 aa, Entamoeba histolytica
VIPILPCELRKKVIFNFVLSHKLFNTLF

SEQ ID NO: 2589389 - protein, 25 aa, Entamoeba histolytica
VIPKLRRCALYSASIMIFTLNMIPF

SEQ ID NO: 2589390 - protein, 19 aa, Entamoeba histolytica
VIPSHYYLFSLIGWIANQL

SEQ ID NO: 2589391 - protein, 17 aa, Entamoeba histolytica
VIPTILLLKSALWKEEW

SEQ ID NO: 2589392 - protein, 19 aa, Entamoeba histolytica
VIQLIKMGMNFTITSHIKL

SEQ ID NO: 2589393 - protein, 18 aa, Entamoeba histolytica
VIQQLIFHLHINHVKFNK

SEQ ID NO: 2589394 - protein, 18 aa, Entamoeba histolytica
VIQRCCIKTMSLLEKGVE

SEQ ID NO: 2589395 - protein, 19 aa, Entamoeba histolytica
VIRMKVWKLLLGYYTPRKR

SEQ ID NO: 2589396 - protein, 19 aa, Entamoeba histolytica
VISAFTFRAVTNIYKGRDG

SEQ ID NO: 2589397 - protein, 22 aa, Entamoeba histolytica
VISELPWNCWSSSFEFSSQLPP

SEQ ID NO: 2589398 - protein, 18 aa, Entamoeba histolytica
VISLRYIIITTFPRCVLV

SEQ ID NO: 2589399 - protein, 23 aa, Entamoeba histolytica
VISNWKCMIFFVIFTICLCLLYF

SEQ ID NO: 2589400 - protein, 25 aa, Entamoeba histolytica
VISRFACSWSLGKAIGFCVSGPMKT

SEQ ID NO: 2589401 - protein, 25 aa, Entamoeba histolytica
VISSFPLHQCFELIQIVNEPILYFN

SEQ ID NO: 2589402 - protein, 23 aa, Entamoeba histolytica
VISYKEMIKFIIFFIKQKLGKID

SEQ ID NO: 2589403 - protein, 24 aa, Entamoeba histolytica
VISYRDMFRFVIFFIKQKLGKIDA

SEQ ID NO: 2589404 - protein, 20 aa, Entamoeba histolytica
VITFGCGKKNYYRECYANPT

SEQ ID NO: 2589405 - protein, 18 aa, Entamoeba histolytica
VIVGGTLNFTALARDTDG

SEQ ID NO: 2589406 - protein, 25 aa, Entamoeba histolytica
VIVGLMASNLFCFISGIRYVVYNFI

SEQ ID NO: 2589407 - protein, 24 aa, Entamoeba histolytica
VIVKICLIAEKFAKTPQWYVDIML

SEQ ID NO: 2589408 - protein, 23 aa, Entamoeba histolytica
VIVLTMSVLYLTWLCVLSNKLDE

SEQ ID NO: 2589409 - protein, 17 aa, Entamoeba histolytica
VIVRNIGCFELGIEEKK

SEQ ID NO: 2589410 - protein, 19 aa, Entamoeba histolytica
VIVTFCISISMTIPNPWFS

SEQ ID NO: 2589411 - protein, 17 aa, Entamoeba histolytica
VIVTLIVLVIGLVVFCV

SEQ ID NO: 2589412 - protein, 21 aa, Entamoeba histolytica
VIYKVCTKLNISIPINLPQEF

SEQ ID NO: 2589413 - protein, 25 aa, Entamoeba histolytica
VIYPYCFLHHYGLKKWSMIGLLFHV

SEQ ID NO: 2589414 - protein, 28 aa, Entamoeba histolytica
VIYWIEVVASLILSFSMLFKQDNRFINP

SEQ ID NO: 2589415 - protein, 19 aa, Entamoeba histolytica
VKASSDWLYYHSGIYSHSC

SEQ ID NO: 2589416 - protein, 18 aa, Entamoeba histolytica
VKAYLVIFYALLIYFPQL

SEQ ID NO: 2589417 - protein, 21 aa, Entamoeba histolytica
VKCILVIRLSFKLATKSIWVV

SEQ ID NO: 2589418 - protein, 23 aa, Entamoeba histolytica
VKCLSQSMPAKWYHMKGTGKYYL

SEQ ID NO: 2589419 - protein, 25 aa, Entamoeba histolytica
VKCTCVLRCKIPVTLRYGQAKDVIK

SEQ ID NO: 2589420 - protein, 25 aa, Entamoeba histolytica
VKDSIEWYFRVFICQTKIEGIINSI

SEQ ID NO: 2589421 - protein, 22 aa, Entamoeba histolytica
VKECYDLIELCLKDKLEETEEK

SEQ ID NO: 2589422 - protein, 25 aa, Entamoeba histolytica
VKEDFKVMVPFSMKSKTTKIDVIKT

SEQ ID NO: 2589423 - protein, 17 aa, Entamoeba histolytica
VKEKLLKFLIETNQPNE

SEQ ID NO: 2589424 - protein, 18 aa, Entamoeba histolytica
VKELPKLLRVFELGSEGK

SEQ ID NO: 2589425 - protein, 27 aa, Entamoeba histolytica
VKFFALAYFRFPSFRIKLTQYYTNLFQ

SEQ ID NO: 2589426 - protein, 23 aa, Entamoeba histolytica
VKFFDERPVFSFRNSVVGMKRVL

SEQ ID NO: 2589427 - protein, 19 aa, Entamoeba histolytica
VKFFGFPLLGTWILHQTQP

SEQ ID NO: 2589428 - protein, 18 aa, Entamoeba histolytica
VKFFGPKIQECIKSYCNE

SEQ ID NO: 2589429 - protein, 17 aa, Entamoeba histolytica
VKFGIQFISYLLTFIGS

SEQ ID NO: 2589430 - protein, 21 aa, Entamoeba histolytica
VKGEIIWPIVDTIITRYTIAP

SEQ ID NO: 2589431 - protein, 27 aa, Entamoeba histolytica
VKGFSIGCAIVLTTICSIFIFGTQVDT

SEQ ID NO: 2589432 - protein, 20 aa, Entamoeba histolytica
VKGKAGSIVTLIGDYFSHMK

SEQ ID NO: 2589433 - protein, 19 aa, Entamoeba histolytica
VKGTLNIRTGSTFEATNIK

SEQ ID NO: 2589434 - protein, 20 aa, Entamoeba histolytica
VKHYPQCIIINVDKLDYCSS

SEQ ID NO: 2589435 - protein, 20 aa, Entamoeba histolytica
VKIFYCKYNDPLYIKIEKLE

SEQ ID NO: 2589436 - protein, 21 aa, Entamoeba histolytica
VKIGRDLLKCVTRALVQNLNQ

SEQ ID NO: 2589437 - protein, 19 aa, Entamoeba histolytica
VKILDDMAVALSYLHQNSI

SEQ ID NO: 2589438 - protein, 18 aa, Entamoeba histolytica
VKILIPFTSNFKMPNKKI

SEQ ID NO: 2589439 - protein, 18 aa, Entamoeba histolytica
VKITLPMYTPDAEFDRHE

SEQ ID NO: 2589440 - protein, 23 aa, Entamoeba histolytica
VKKDSRYFIAFRWFMAQLLINAK

SEQ ID NO: 2589441 - protein, 30 aa, Entamoeba histolytica; identical to SEQ ID NO: 2391789

SEQ ID NO: 2589442 - protein, 24 aa, Entamoeba histolytica
VKKKEILPSLLCEKENKKKRIKST

SEQ ID NO: 2589443 - protein, 25 aa, Entamoeba histolytica
VKKSVRYLLKRAFEINSNETNKILS

SEQ ID NO: 2589444 - protein, 22 aa, Entamoeba histolytica
VKLICFIILYFVLRMMYNLFYF

SEQ ID NO: 2589445 - protein, 24 aa, Entamoeba histolytica
VKLKEGLKIAMAISSVGNKYLQDT

SEQ ID NO: 2589446 - protein, 27 aa, Entamoeba histolytica
VKLLIKLVLLISIIVSIMFGIIRVITL

SEQ ID NO: 2589447 - protein, 20 aa, Entamoeba histolytica
VKMTEYIHRFGLPYNESLIC

SEQ ID NO: 2589448 - protein, 17 aa, Entamoeba histolytica
VKNDILLSMGLEEAIVF

SEQ ID NO: 2589449 - protein, 23 aa, Entamoeba histolytica
VKPECYLSILLFDTMAYNECIII

SEQ ID NO: 2589450 - protein, 22 aa, Entamoeba histolytica
VKQYRVVIFSLEIPKESVCDSA

SEQ ID NO: 2589451 - protein, 20 aa, Entamoeba histolytica
VKRALDEKAIKEGKKPKFNT

SEQ ID NO: 2589452 - protein, 18 aa, Entamoeba histolytica
VKSILLIFTIADHHILQQ

SEQ ID NO: 2589453 - protein, 21 aa, Entamoeba histolytica
VKSKFLFVGPIYGNYIVHLFE

SEQ ID NO: 2589454 - protein, 19 aa, Entamoeba histolytica
VKSLFFSHIIWFYTATLIV

SEQ ID NO: 2589455 - protein, 18 aa, Entamoeba histolytica
VKTALAIAKECGIVGECQ

SEQ ID NO: 2589456 - protein, 21 aa, Entamoeba histolytica
VKTLECGFVTFSNYIQYWVLG

SEQ ID NO: 2589457 - protein, 24 aa, Entamoeba histolytica
VKTWNLWTLASFIISLVLFFIFML

SEQ ID NO: 2589458 - protein, 22 aa, Entamoeba histolytica
VKTWNWYLLFSYVLSFILIFSV

SEQ ID NO: 2589459 - protein, 26 aa, Entamoeba histolytica
VKVEPCKKSNCSISLDVEEYERQRLQ

SEQ ID NO: 2589460 - protein, 17 aa, Entamoeba histolytica
VKVIAFKGTNSFGDGLY

SEQ ID NO: 2589461 - protein, 23 aa, Entamoeba histolytica
VKVILELFSQWLLPNPSKIDHIL

SEQ ID NO: 2589462 - protein, 18 aa, Entamoeba histolytica
VKVPFALKSLAIIVDENT

SEQ ID NO: 2589463 - protein, 19 aa, Entamoeba histolytica
VKYVNCIFEYNGSLANCQI

SEQ ID NO: 2589464 - protein, 17 aa, Entamoeba histolytica
VLCDLLKRNWHFNFHIT

SEQ ID NO: 2589465 - protein, 19 aa, Entamoeba histolytica
VLCEAIHWFSQIITIPEYC

SEQ ID NO: 2589466 - protein, 20 aa, Entamoeba histolytica
VLCIYLTFAQCYKDGTVTIK

SEQ ID NO: 2589467 - protein, 23 aa, Entamoeba histolytica
VLCSPILRIIWDFSTIYNQFLTS

SEQ ID NO: 2589468 - protein, 24 aa, Entamoeba histolytica
VLDQELFLRQSIIYISKSLIIENA

SEQ ID NO: 2589469 - protein, 20 aa, Entamoeba histolytica
VLDRWKTFSFGGEEDPTQQS

SEQ ID NO: 2589470 - protein, 27 aa, Entamoeba histolytica
VLEGWRFSYKSGYYFGLLNIIFVSVSF

SEQ ID NO: 2589471 - protein, 32 aa, Entamoeba histolytica; identical to SEQ ID NO: 2391825

SEQ ID NO: 2589472 - protein, 21 aa, Entamoeba histolytica
VLEMRCSRCDSVIGIVQQKPM

SEQ ID NO: 2589473 - protein, 18 aa, Entamoeba histolytica
VLFAIRLVCVYLTILPDP

SEQ ID NO: 2589474 - protein, 31 aa, Entamoeba histolytica
VLFGIVLTCCMFLSTRLEGFTTKIIDNCEET

SEQ ID NO: 2589475 - protein, 22 aa, Entamoeba histolytica
VLFVCGFIGIYIVLVVSIFSTI

SEQ ID NO: 2589476 - protein, 23 aa, Entamoeba histolytica
VLGEKKYGLHLFENYLIGQTTVE

SEQ ID NO: 2589477 - protein, 36 aa, Entamoeba histolytica
VLGIFFEWHIPLKYLWPSVRVVLYRTIYGLIYGLTI

SEQ ID NO: 2589478 - protein, 21 aa, Entamoeba histolytica
VLGKPCYLMYMQLIGYLLLIG

SEQ ID NO: 2589479 - protein, 24 aa, Entamoeba histolytica
VLHDVCPLEIILLLREILQSQLTI

SEQ ID NO: 2589480 - protein, 23 aa, Entamoeba histolytica
VLICAMLSFELCYRKNETSTLCT

SEQ ID NO: 2589481 - protein, 17 aa, Entamoeba histolytica
VLICFLGTVVVICICCI

SEQ ID NO: 2589482 - protein, 19 aa, Entamoeba histolytica
VLIDPEIFTDFSLNSPKEN

SEQ ID NO: 2589483 - protein, 22 aa, Entamoeba histolytica
VLIGIIWWRRSRSVKAETAAIK

SEQ ID NO: 2589484 - protein, 19 aa, Entamoeba histolytica
VLIITSLFVAFLADCRHKK

SEQ ID NO: 2589485 - protein, 25 aa, Entamoeba histolytica
VLIMWMIWIPLHFISSIKFDIFPIT

SEQ ID NO: 2589486 - protein, 20 aa, Entamoeba histolytica
VLIVFSCICSAYTYDENDLL

SEQ ID NO: 2589487 - protein, 27 aa, Entamoeba histolytica
VLKKCITSLFKHHYIATLIFFLIMLTS

SEQ ID NO: 2589488 - protein, 17 aa, Entamoeba histolytica
VLKQFGVVLSFAVLLDT

SEQ ID NO: 2589489 - protein, 27 aa, Entamoeba histolytica
VLKTFYPEVEFDNFFEVFNKCIKTIDE

SEQ ID NO: 2589490 - protein, 25 aa, Entamoeba histolytica
VLLCCGGILLYFLLRTTKFDINIYL

SEQ ID NO: 2589491 - protein, 22 aa, Entamoeba histolytica
VLLEAPKKYLLILPGETSTSFC

SEQ ID NO: 2589492 - protein, 19 aa, Entamoeba histolytica
VLLEILKFIDIVNINPLID

SEQ ID NO: 2589493 - protein, 24 aa, Entamoeba histolytica
VLLIFRYILLFVILLSFIFNSFIK

SEQ ID NO: 2589494 - protein, 18 aa, Entamoeba histolytica
VLMACFVGSMKKIQVQEL

SEQ ID NO: 2589495 - protein, 17 aa, Entamoeba histolytica
VLMCCFLSCCFYGVTII

SEQ ID NO: 2589496 - protein, 31 aa, Entamoeba histolytica
VLMLQFGIMLYFRFAPFIKENEIVSTFEKSV

SEQ ID NO: 2589497 - protein, 25 aa, Entamoeba histolytica
VLMMDKMRCPYIINFVGAVDTLDHY

SEQ ID NO: 2589498 - protein, 20 aa, Entamoeba histolytica
VLMTFGSFIFFCINPSMCSL

SEQ ID NO: 2589499 - protein, 17 aa, Entamoeba histolytica
VLMYLPLSLVHSIHLPS

SEQ ID NO: 2589500 - protein, 20 aa, Entamoeba histolytica
VLNKFMLFIHQWKENNQTIK

SEQ ID NO: 2589501 - protein, 24 aa, Entamoeba histolytica
VLPFELPDIVYLCIGICSMILLII

SEQ ID NO: 2589502 - protein, 19 aa, Entamoeba histolytica
VLPNMYINIDMSFPKMNCD

SEQ ID NO: 2589503 - protein, 27 aa, Entamoeba histolytica
VLPYKLKMRMLLDCAKGMVFLHENKIV

SEQ ID NO: 2589504 - protein, 18 aa, Entamoeba histolytica
VLRNKFPSSVSLGIDINN

SEQ ID NO: 2589505 - protein, 18 aa, Entamoeba histolytica
VLSIACILFGPRLQMKYR

SEQ ID NO: 2589506 - protein, 25 aa, Entamoeba histolytica
VLSSCPHKIHLECYLKDYEDSGNEE

SEQ ID NO: 2589507 - protein, 19 aa, Entamoeba histolytica
VLSSLKANIVFNNENDNAI

SEQ ID NO: 2589508 - protein, 27 aa, Entamoeba histolytica
VLTGKSNEAFKCIKCKSGYSLNSNNKC

SEQ ID NO: 2589509 - protein, 26 aa, Entamoeba histolytica
VLTGKSNEAFKCINCKNGYYLNSKHE

SEQ ID NO: 2589510 - protein, 18 aa, Entamoeba histolytica
VLTGWLQLGPGFYKILEI

SEQ ID NO: 2589511 - protein, 19 aa, Entamoeba histolytica
VLTPEEFVNAGDFLVNKYR

SEQ ID NO: 2589512 - protein, 21 aa, Entamoeba histolytica
VLTPSCIHLLLLALKDKNVNE

SEQ ID NO: 2589513 - protein, 26 aa, Entamoeba histolytica
VLTYMGYCYLLIGLICIGVIFFIISI

SEQ ID NO: 2589514 - protein, 20 aa, Entamoeba histolytica
VLVVKWRFGKNHEESSVTTT

SEQ ID NO: 2589515 - protein, 19 aa, Entamoeba histolytica
VLYDGFKIVFDGIQNEPEK

SEQ ID NO: 2589516 - protein, 20 aa, Entamoeba histolytica
VLYIIPFCLIKPLFDNYSIL

SEQ ID NO: 2589517 - protein, 25 aa, Entamoeba histolytica
VLYKKWSRKHAKSFTIDGQSYPFTP

SEQ ID NO: 2589518 - protein, 18 aa, Entamoeba histolytica
VLYYLIYLQFPFKINSLN

SEQ ID NO: 2589519 - protein, 18 aa, Entamoeba histolytica
VLYYLRWKSSFPIPDHLT

SEQ ID NO: 2589520 - protein, 18 aa, Entamoeba histolytica
VMCIALLYSSYITTRIVL

SEQ ID NO: 2589521 - protein, 24 aa, Entamoeba histolytica
VMIHFKKRIIMIINICVQIIVVGM

SEQ ID NO: 2589522 - protein, 23 aa, Entamoeba histolytica
VMKEVMEEIRLLKKLKHKHIVRY

SEQ ID NO: 2589523 - protein, 24 aa, Entamoeba histolytica
VMKNGVCRVCPDGYYSNRITCDKC

SEQ ID NO: 2589524 - protein, 18 aa, Entamoeba histolytica
VMLSLCVYLSRCQKFVPY

SEQ ID NO: 2589525 - protein, 18 aa, Entamoeba histolytica
VMNCKNQIIGLILFTNTA

SEQ ID NO: 2589526 - protein, 19 aa, Entamoeba histolytica
VMPCKDMIDTVRIGYMNSK

SEQ ID NO: 2589527 - protein, 18 aa, Entamoeba histolytica
VMPILAFTLMTILYPDYS

SEQ ID NO: 2589528 - protein, 31 aa, Entamoeba histolytica
VMRYSEEWKKVVWRCGRWIDMDHPYKTMDID

SEQ ID NO: 2589529 - protein, 20 aa, Entamoeba histolytica
VMSFSTFWVYLRSLFLLFQF

SEQ ID NO: 2589530 - protein, 17 aa, Entamoeba histolytica
VMSRLVLILAPAICLLS

SEQ ID NO: 2589531 - protein, 17 aa, Entamoeba histolytica
VMVKILINYLKTQQTID

SEQ ID NO: 2589532 - protein, 19 aa, Entamoeba histolytica
VNASCSISFKINVINKFLL

SEQ ID NO: 2589533 - protein, 18 aa, Entamoeba histolytica
VNAWKVRMYAVIALLRSL

SEQ ID NO: 2589534 - protein, 21 aa, Entamoeba histolytica
VNCYLLISWMYECIVNLHIQR

SEQ ID NO: 2589535 - protein, 24 aa, Entamoeba histolytica
VNDLPDYGAFLFYASYGIETRGSS

SEQ ID NO: 2589536 - protein, 28 aa, Entamoeba histolytica
VNEGEGMYRISIDFYVRRFESSCEEPTN

SEQ ID NO: 2589537 - protein, 19 aa, Entamoeba histolytica
VNGGPGAICKTFLNKEGLD

SEQ ID NO: 2589538 - protein, 17 aa, Entamoeba histolytica
VNIALGRVVEVKTLQSF

SEQ ID NO: 2589539 - protein, 17 aa, Entamoeba histolytica
VNIKRKDFSHIYHSSEK

SEQ ID NO: 2589540 - protein, 25 aa, Entamoeba histolytica
VNILTRYPNMLSISMQRSFLTRDVR

SEQ ID NO: 2589541 - protein, 23 aa, Entamoeba histolytica
VNINTSCLYDFLVDIQKIIISTG

SEQ ID NO: 2589542 - protein, 19 aa, Entamoeba histolytica
VNIVMKLACDQLFAQTGID

SEQ ID NO: 2589543 - protein, 18 aa, Entamoeba histolytica
VNKFILPLEVNKYSNHEL

SEQ ID NO: 2589544 - protein, 21 aa, Entamoeba histolytica
VNLCLCIVKIVAAIVSGSLTV

SEQ ID NO: 2589545 - protein, 23 aa, Entamoeba histolytica
VNLDRVAPIIATFVNGRVDFILT

SEQ ID NO: 2589546 - protein, 19 aa, Entamoeba histolytica
VNLVMSIGITIEFCVHIAH

SEQ ID NO: 2589547 - protein, 17 aa, Entamoeba histolytica
VNMLQRRILALIITLDG

SEQ ID NO: 2589548 - protein, 23 aa, Entamoeba histolytica
VNNFTNDLDICFANTQKNYFYID

SEQ ID NO: 2589549 - protein, 22 aa, Entamoeba histolytica
VNNLLFKVIMIFDNLHNSCEDI

SEQ ID NO: 2589550 - protein, 18 aa, Entamoeba histolytica
VNPFLFRIGFTSVSSNAR

SEQ ID NO: 2589551 - protein, 18 aa, Entamoeba histolytica
VNQFCRIFNPPTCNCNLL

SEQ ID NO: 2589552 - protein, 24 aa, Entamoeba histolytica
VNQMKSSYCNLIIKGEIETSLIID

SEQ ID NO: 2589553 - protein, 22 aa, Entamoeba histolytica
VNRCVQCSFGYLNTSFKCQECN

SEQ ID NO: 2589554 - protein, 17 aa, Entamoeba histolytica
VNRMYAMMVDKNCDGIV

SEQ ID NO: 2589555 - protein, 18 aa, Entamoeba histolytica
VNTLKFIKKPSIDNLNNL

SEQ ID NO: 2589556 - protein, 23 aa, Entamoeba histolytica
VNTMLCQVCLIFFQATKEIQHKF

SEQ ID NO: 2589557 - protein, 22 aa, Entamoeba histolytica
VNVFSIIAMCYVNAEQYHRAMS

SEQ ID NO: 2589558 - protein, 22 aa, Entamoeba histolytica
VNYKTVICLISLGVMMTLILSE

SEQ ID NO: 2589559 - protein, 18 aa, Entamoeba histolytica
VNYTFEFSENVTFNNLYV

SEQ ID NO: 2589560 - protein, 23 aa, Entamoeba histolytica
VPAKLLLVICENGICKMNVNQRL

SEQ ID NO: 2589561 - protein, 22 aa, Entamoeba histolytica
VPDKLSVITCIGVLQQYLDTTP

SEQ ID NO: 2589562 - protein, 26 aa, Entamoeba histolytica
VPFELEIACGFFIFLFSNIFIWTYDR

SEQ ID NO: 2589563 - protein, 17 aa, Entamoeba histolytica
VPGCTAPAINMKSDGTL

SEQ ID NO: 2589564 - protein, 20 aa, Entamoeba histolytica
VPGENEPSCYQVFHDEIYMA

SEQ ID NO: 2589565 - protein, 19 aa, Entamoeba histolytica
VPGIPKYVFISMAFSDIFT

SEQ ID NO: 2589566 - protein, 26 aa, Entamoeba histolytica
VPGMSVRNISYWGWLFTLKQPLFYLM

SEQ ID NO: 2589567 - protein, 19 aa, Entamoeba histolytica
VPHCIKYNYEACIECETNY

SEQ ID NO: 2589568 - protein, 20 aa, Entamoeba histolytica
VPIAGCLAVIIIIVLVVIFL

SEQ ID NO: 2589569 - protein, 18 aa, Entamoeba histolytica
VPIAIGFVSYHPFYEIMR

SEQ ID NO: 2589570 - protein, 23 aa, Entamoeba histolytica
VPILPIRICCVLFGLIGLPIFSY

SEQ ID NO: 2589571 - protein, 17 aa, Entamoeba histolytica
VPISYRISYCAKPQYID

SEQ ID NO: 2589572 - protein, 20 aa, Entamoeba histolytica
VPITLRYGQLGNILKDIKRE

SEQ ID NO: 2589573 - protein, 20 aa, Entamoeba histolytica
VPLLILLGIICLLFAGFTTL

SEQ ID NO: 2589574 - protein, 17 aa, Entamoeba histolytica
VPLLLLLICESFTNNSI

SEQ ID NO: 2589575 - protein, 25 aa, Entamoeba histolytica
VPNCPVCKSRVLLNQIIRVNKNKNH

SEQ ID NO: 2589576 - protein, 20 aa, Entamoeba histolytica
VPNKEYYVFVGPENFAEEGF

SEQ ID NO: 2589577 - protein, 17 aa, Entamoeba histolytica
VPPEGIELFAVGRKKHL

SEQ ID NO: 2589578 - protein, 18 aa, Entamoeba histolytica
VPPELWKRIEDVAFEPNV

SEQ ID NO: 2589579 - protein, 20 aa, Entamoeba histolytica
VPQTISWLFIFRIVPMVVIF

SEQ ID NO: 2589580 - protein, 22 aa, Entamoeba histolytica
VPQVRFVDRGLLLKSKVPASKP

SEQ ID NO: 2589581 - protein, 38 aa, Entamoeba histolytica
VPRTNNCLLRAFFYWSGCYFLRLNLMKKAEFMFRQCCE

SEQ ID NO: 2589582 - protein, 24 aa, Entamoeba histolytica
VPSPWLQVRILRTLRYITPKKGAE

SEQ ID NO: 2589583 - protein, 18 aa, Entamoeba histolytica
VPSQHKIQIITLNVNGSY

SEQ ID NO: 2589584 - protein, 25 aa, Entamoeba histolytica
VPSTIEFKSSLTYIIVNSAYSSSDK

SEQ ID NO: 2589585 - protein, 18 aa, Entamoeba histolytica
VPTDFFTYEEKFWDEFAD

SEQ ID NO: 2589586 - protein, 18 aa, Entamoeba histolytica
VPTLSSFVVLPNELKLTC

SEQ ID NO: 2589587 - protein, 25 aa, Entamoeba histolytica
VPVMCTDVLVGLCLDYDIFLFSRVL

SEQ ID NO: 2589588 - protein, 19 aa, Entamoeba histolytica
VPVSFDWSILSTRIGELQL

SEQ ID NO: 2589589 - protein, 17 aa, Entamoeba histolytica
VPVSVVLHVDFSDVEYG

SEQ ID NO: 2589590 - protein, 19 aa, Entamoeba histolytica
VPVTIRYGKFKQIMQELLE

SEQ ID NO: 2589591 - protein, 23 aa, Entamoeba histolytica
VPVTLRYGKLKSILKEIEKNNPE

SEQ ID NO: 2589592 - protein, 17 aa, Entamoeba histolytica
VPYNLSDVYGCYKMLTD

SEQ ID NO: 2589593 - protein, 18 aa, Entamoeba histolytica
VQALKWFVDACDTGVGEK

SEQ ID NO: 2589594 - protein, 24 aa, Entamoeba histolytica
VQAVAVLPFRAGIVAKPGNLKIKT

SEQ ID NO: 2589595 - protein, 18 aa, Entamoeba histolytica
VQCKCYYDNLLPDCEINP

SEQ ID NO: 2589596 - protein, 25 aa, Entamoeba histolytica
VQEHMPVFYGLWIVYGIILLYLKIF

SEQ ID NO: 2589597 - protein, 31 aa, Entamoeba histolytica
VQFNPMVIVKYSWFFFELIIRSLVYYLNDEI

SEQ ID NO: 2589598 - protein, 23 aa, Entamoeba histolytica
VQFPRTYRTIAFSKLFENVYLCS

SEQ ID NO: 2589599 - protein, 21 aa, Entamoeba histolytica
VQGCGSAARLIFNDKRKTSFY

SEQ ID NO: 2589600 - protein, 24 aa, Entamoeba histolytica
VQIIKGRGGIFLPNNCAISMLRCF

SEQ ID NO: 2589601 - protein, 17 aa, Entamoeba histolytica
VQKARLSWDNTEECDTF

SEQ ID NO: 2589602 - protein, 22 aa, Entamoeba histolytica
VQKDWMCLLSYIVIGLGVMCAF

SEQ ID NO: 2589603 - protein, 26 aa, Entamoeba histolytica
VQKKRLDLVLLLLKFGARIYIANNAG

SEQ ID NO: 2589604 - protein, 26 aa, Entamoeba histolytica
VQLHSILRCGRLIMSSKTRIVGYNGS

SEQ ID NO: 2589605 - protein, 25 aa, Entamoeba histolytica
VQMPSRISPELAYVGFFQMFPTIIK

SEQ ID NO: 2589606 - protein, 19 aa, Entamoeba histolytica
VQQYFKLVVGTLYLNKDID

SEQ ID NO: 2589607 - protein, 20 aa, Entamoeba histolytica
VQQYFKLVVGTLYLNKDIDV

SEQ ID NO: 2589608 - protein, 23 aa, Entamoeba histolytica
VQRLIKKYFRVHKGTLATLKSSI

SEQ ID NO: 2589609 - protein, 17 aa, Entamoeba histolytica
VQSFSLYAGLAIFIDFI

SEQ ID NO: 2589610 - protein, 25 aa, Entamoeba histolytica
VQSRFLDFLLSWKIFGLLYVFSMAV

SEQ ID NO: 2589611 - protein, 25 aa, Entamoeba histolytica
VQYSVDLKLLIALTIHLCKNNQTNT

SEQ ID NO: 2589612 - protein, 19 aa, Entamoeba histolytica
VRALGRCAIKLENVANQCI

SEQ ID NO: 2589613 - protein, 19 aa, Entamoeba histolytica
VRENICFLSPYKKEHYDES

SEQ ID NO: 2589614 - protein, 17 aa, Entamoeba histolytica
VRFSISITPEVVILKRN

SEQ ID NO: 2589615 - protein, 26 aa, Entamoeba histolytica
VRGDGRRYAIHTCFTQSSGSDHTSLE

SEQ ID NO: 2589616 - protein, 21 aa, Entamoeba histolytica
VRGEFIPLTFPVHTYTTDNTV

SEQ ID NO: 2589617 - protein, 22 aa, Entamoeba histolytica
VRGPDQLCCTITILFVIFGVVS

SEQ ID NO: 2589618 - protein, 26 aa, Entamoeba histolytica
VRILKIPSSTLWFSFHELPKIGISYY

SEQ ID NO: 2589619 - protein, 17 aa, Entamoeba histolytica
VRLEAYVFKDILKNPPQ

SEQ ID NO: 2589620 - protein, 24 aa, Entamoeba histolytica
VRLSTCVRLSVHIIKNQKYNYVQG

SEQ ID NO: 2589621 - protein, 23 aa, Entamoeba histolytica
VRNKCIWILLFGLAVFVTTYMYL

SEQ ID NO: 2589622 - protein, 21 aa, Entamoeba histolytica
VRNQVLIFSNRIFKLYPNTQE

SEQ ID NO: 2589623 - protein, 25 aa, Entamoeba histolytica
VRNSVKRICKIFAIEHPDVGYQQGI

SEQ ID NO: 2589624 - protein, 36 aa, Entamoeba histolytica
VRQQSYRWFVCLFCREFHFHLTLALWDNFMLDNGFR

SEQ ID NO: 2589625 - protein, 23 aa, Entamoeba histolytica
VRQTLKAGFGIEVTFKIKMLCTA

SEQ ID NO: 2589626 - protein, 17 aa, Entamoeba histolytica
VRRCCGGNTKMMLLTQP

SEQ ID NO: 2589627 - protein, 17 aa, Entamoeba histolytica
VRSKCPTTNFIINSPTF

SEQ ID NO: 2589628 - protein, 18 aa, Entamoeba histolytica
VRSNLSLNSKRLYETSQI

SEQ ID NO: 2589629 - protein, 30 aa, Entamoeba histolytica
VRSRLVGSLKYWIESCLFDNKFLEDIKVFI

SEQ ID NO: 2589630 - protein, 19 aa, Entamoeba histolytica
VRTALNFGDILCSFGDRMK

SEQ ID NO: 2589631 - protein, 28 aa, Entamoeba histolytica
VRTSYCNYCIGCCSVSVVFVITCTLLSI

SEQ ID NO: 2589632 - protein, 20 aa, Entamoeba histolytica
VRVGEELDLIGYVKPSVTGM

SEQ ID NO: 2589633 - protein, 24 aa, Entamoeba histolytica
VRWRNYFRSWGMCFTCIGDEEELI

SEQ ID NO: 2589634 - protein, 26 aa, Entamoeba histolytica
VRYHRLYHAYFRFLSRYAAENPNLVG

SEQ ID NO: 2589635 - protein, 17 aa, Entamoeba histolytica
VRYKPLISYPTALMVEP

SEQ ID NO: 2589636 - protein, 21 aa, Entamoeba histolytica
VSAVVLCIIGSVFVGESPLNA

SEQ ID NO: 2589637 - protein, 20 aa, Entamoeba histolytica
VSCVYPKYWTAYRGGILRGL

SEQ ID NO: 2589638 - protein, 24 aa, Entamoeba histolytica
VSDAFECIESVKINNTFTQYVQKT

SEQ ID NO: 2589639 - protein, 17 aa, Entamoeba histolytica
VSDISFASIVFGDLQKV

SEQ ID NO: 2589640 - protein, 23 aa, Entamoeba histolytica
VSEFLLNYGFAFFSICIAEVGCF

SEQ ID NO: 2589641 - protein, 23 aa, Entamoeba histolytica
VSEIKHYFCTGMYSNSFTVSVIE

SEQ ID NO: 2589642 - protein, 22 aa, Entamoeba histolytica
VSELLEILFWKYLKEEPGTSAE

SEQ ID NO: 2589643 - protein, 17 aa, Entamoeba histolytica
VSEQFSHEFKCSLNSVF

SEQ ID NO: 2589644 - protein, 21 aa, Entamoeba histolytica
VSFEKGIEYYGTWRDEIIFNS

SEQ ID NO: 2589645 - protein, 17 aa, Entamoeba histolytica
VSFIPVIISLLLSYHAP

SEQ ID NO: 2589646 - protein, 23 aa, Entamoeba histolytica
VSFIRLTISFIINMYVLCSPILR

SEQ ID NO: 2589647 - protein, 25 aa, Entamoeba histolytica
VSFSCGHKFHYSCVIPWLQHNSVCP

SEQ ID NO: 2589648 - protein, 17 aa, Entamoeba histolytica
VSGKIWLYAITLEVAVT

SEQ ID NO: 2589649 - protein, 21 aa, Entamoeba histolytica
VSGKLKIGIGYTQSKELLTLL

SEQ ID NO: 2589650 - protein, 19 aa, Entamoeba histolytica
VSGNSFIDIIINFIVTIAL

SEQ ID NO: 2589651 - protein, 26 aa, Entamoeba histolytica
VSHYLKIKFCLDAAKAIEYLHSNGIL

SEQ ID NO: 2589652 - protein, 24 aa, Entamoeba histolytica
VSIGKKNVLEWWVPSTIANIRTYN

SEQ ID NO: 2589653 - protein, 18 aa, Entamoeba histolytica
VSIIKIGLSLAVSVIPEG

SEQ ID NO: 2589654 - protein, 25 aa, Entamoeba histolytica
VSIKWQAAEIISIIVTFGGIDIVRK

SEQ ID NO: 2589655 - protein, 17 aa, Entamoeba histolytica
VSISFASQECGKWEETQ

SEQ ID NO: 2589656 - protein, 17 aa, Entamoeba histolytica
VSISFASQECGKWGETQ

SEQ ID NO: 2589657 - protein, 17 aa, Entamoeba histolytica
VSISLPFTRAQNVPSAW

SEQ ID NO: 2589658 - protein, 17 aa, Entamoeba histolytica
VSISWAVSEEIILKSLS

SEQ ID NO: 2589659 - protein, 17 aa, Entamoeba histolytica
VSITTCIALIISLYIFF

SEQ ID NO: 2589660 - protein, 22 aa, Entamoeba histolytica
VSKEIDRFIGLKYDMPNKVEAI

SEQ ID NO: 2589661 - protein, 26 aa, Entamoeba histolytica
VSKKLKWYYHLVILIAGVVGVMLIII

SEQ ID NO: 2589662 - protein, 21 aa, Entamoeba histolytica
VSKSNCIYPIFDGNQYHIIYN

SEQ ID NO: 2589663 - protein, 19 aa, Entamoeba histolytica
VSLEVAKFIQTMLMECDTD

SEQ ID NO: 2589664 - protein, 19 aa, Entamoeba histolytica
VSLFIELLSSFMLPCAVVM

SEQ ID NO: 2589665 - protein, 17 aa, Entamoeba histolytica
VSLIGAWNDYSKQSKFI

SEQ ID NO: 2589666 - protein, 19 aa, Entamoeba histolytica
VSLLRCFLASLPEPLIPES

SEQ ID NO: 2589667 - protein, 23 aa, Entamoeba histolytica
VSLVCGLLFVFGYPQFHFTTLKI

SEQ ID NO: 2589668 - protein, 25 aa, Entamoeba histolytica
VSLYSCYLLPFLFFLGFVYSLGSLY

SEQ ID NO: 2589669 - protein, 19 aa, Entamoeba histolytica
VSNICFFVCYTFVEVRRCC

SEQ ID NO: 2589670 - protein, 19 aa, Entamoeba histolytica
VSNIQGFRRYVICKGQTEP

SEQ ID NO: 2589671 - protein, 26 aa, Entamoeba histolytica
VSNPSRLSKWLPIISLVYSQHLDQVW

SEQ ID NO: 2589672 - protein, 17 aa, Entamoeba histolytica
VSPKQEKPAVVQQTQNG

SEQ ID NO: 2589673 - protein, 26 aa, Entamoeba histolytica
VSPSLKQLHIFGAVFAENGFFQRSDS

SEQ ID NO: 2589674 - protein, 25 aa, Entamoeba histolytica
VSQHLNEWIDLIFGFKQTGEPAIKA

SEQ ID NO: 2589675 - protein, 25 aa, Entamoeba histolytica
VSQHLNEWIDLIFGYKQRGKNAEEA

SEQ ID NO: 2589676 - protein, 30 aa, Entamoeba histolytica
VSSETGKICRICFETGKCITFRSYGALSEH

SEQ ID NO: 2589677 - protein, 30 aa, Entamoeba histolytica
VSSLCAVLICLLLSIFKKSFILTFLLIIVT

SEQ ID NO: 2589678 - protein, 17 aa, Entamoeba histolytica
VSSLCIIQIESEETSAI

SEQ ID NO: 2589679 - protein, 24 aa, Entamoeba histolytica
VSSTLCSFVVYLLIGLFGYFSLTP

SEQ ID NO: 2589680 - protein, 22 aa, Entamoeba histolytica
VSSYDIPSGWGKYTNEYTYLVT

SEQ ID NO: 2589681 - protein, 18 aa, Entamoeba histolytica
VSTCFPKTLVNTAVEITK

SEQ ID NO: 2589682 - protein, 21 aa, Entamoeba histolytica
VSTPRRRLLSLVSPRKTESPQ

SEQ ID NO: 2589683 - protein, 26 aa, Entamoeba histolytica
VSVCIWPFCTGFFWPVTTGTIGLEAP

SEQ ID NO: 2589684 - protein, 17 aa, Entamoeba histolytica
VSVILRKDIPYYLFIHS

SEQ ID NO: 2589685 - protein, 22 aa, Entamoeba histolytica
VSVLCLLPLLIVILLIVLPSLI

SEQ ID NO: 2589686 - protein, 21 aa, Entamoeba histolytica
VSWWKGHKMDIAYIYNCFSGD

SEQ ID NO: 2589687 - protein, 17 aa, Entamoeba histolytica
VSYRLSGTESRDFNQDG

SEQ ID NO: 2589688 - protein, 22 aa, Entamoeba histolytica
VSYVSSMSWYILIFAGGRYIIR

SEQ ID NO: 2589689 - protein, 18 aa, Entamoeba histolytica
VTDQYGCLECYYDQINLE

SEQ ID NO: 2589690 - protein, 24 aa, Entamoeba histolytica
VTECIDLMPLKLISLYVRGTLVNV

SEQ ID NO: 2589691 - protein, 25 aa, Entamoeba histolytica
VTEEGRCRCNPGFGGDDCHKLCYYN

SEQ ID NO: 2589692 - protein, 18 aa, Entamoeba histolytica
VTELCPVYSPFFGSMGIT

SEQ ID NO: 2589693 - protein, 18 aa, Entamoeba histolytica
VTELLGCSLYELMKLNKK

SEQ ID NO: 2589694 - protein, 17 aa, Entamoeba histolytica
VTFHFKTTLPEIISLFP

SEQ ID NO: 2589695 - protein, 25 aa, Entamoeba histolytica
VTFKCLKSSILLGFISCLWYAQYIR

SEQ ID NO: 2589696 - protein, 34 aa, Entamoeba histolytica
VTFLNIWTRKLWRSACSLLDYIKGIMRKPTCNEI

SEQ ID NO: 2589697 - protein, 17 aa, Entamoeba histolytica
VTFTIYLIYAYRKTVHH

SEQ ID NO: 2589698 - protein, 17 aa, Entamoeba histolytica
VTGYPWVFVSSYDQNHP

SEQ ID NO: 2589699 - protein, 24 aa, Entamoeba histolytica
VTHPEILTTLVLDFDLLSSCPNGI

SEQ ID NO: 2589700 - protein, 17 aa, Entamoeba histolytica
VTIALYVGLICWVICVI

SEQ ID NO: 2589701 - protein, 17 aa, Entamoeba histolytica
VTICHSFSILSTLRGYI

SEQ ID NO: 2589702 - protein, 23 aa, Entamoeba histolytica
VTIIPGLILLWKLFVKPKLFKSS

SEQ ID NO: 2589703 - protein, 24 aa, Entamoeba histolytica
VTIPKFKIETSFSMNQQLKQLGLI

SEQ ID NO: 2589704 - protein, 25 aa, Entamoeba histolytica
VTIQPRYPLLGGWSTSFSINYHYKF

SEQ ID NO: 2589705 - protein, 26 aa, Entamoeba histolytica
VTKAGFKGGFILKNSWNDTIYGNYPG

SEQ ID NO: 2589706 - protein, 25 aa, Entamoeba histolytica
VTKGLKEWGGAIIVGFDGDPYGKDE

SEQ ID NO: 2589707 - protein, 25 aa, Entamoeba histolytica
VTKGLKEWGGAILVGFDVDPYGKDE

SEQ ID NO: 2589708 - protein, 22 aa, Entamoeba histolytica
VTLILIGLIMMWWSSDYDDESF

SEQ ID NO: 2589709 - protein, 26 aa, Entamoeba histolytica
VTLLGNRIPNLLTFKTLIAKVIGLVF

SEQ ID NO: 2589710 - protein, 32 aa, Entamoeba histolytica
VTLYYCRTCFFKKPPRAIHCRICNNCIEHFDH

SEQ ID NO: 2589711 - protein, 22 aa, Entamoeba histolytica
VTNDIIPIISFVFDDSSISTMI

SEQ ID NO: 2589712 - protein, 23 aa, Entamoeba histolytica
VTPPTRLPWHIRMLKKASESGED

SEQ ID NO: 2589713 - protein, 22 aa, Entamoeba histolytica
VTQVLKHLQSIMLIKVDDLTLD

SEQ ID NO: 2589714 - protein, 22 aa, Entamoeba histolytica
VTRNPTSFLFWFITLGVQGFTV

SEQ ID NO: 2589715 - protein, 23 aa, Entamoeba histolytica
VTSSFKYPYIVAVVKNKLYSTLL

SEQ ID NO: 2589716 - protein, 19 aa, Entamoeba histolytica
VTSWGCAVGEYYYNFFRGC

SEQ ID NO: 2589717 - protein, 18 aa, Entamoeba histolytica
VTYFNGGMQFLYPQPCAT

SEQ ID NO: 2589718 - protein, 24 aa, Entamoeba histolytica
VVAVCGLLLIFGMIIVKFAKRNNN

SEQ ID NO: 2589719 - protein, 25 aa, Entamoeba histolytica
VVCFIICCIVAYKFCDKTEKPTRVN

SEQ ID NO: 2589720 - protein, 18 aa, Entamoeba histolytica
VVCLVWFIVMSCLTFFMT

SEQ ID NO: 2589721 - protein, 24 aa, Entamoeba histolytica
VVEFLNEFLNIFIVPSQTVQIKEQ

SEQ ID NO: 2589722 - protein, 17 aa, Entamoeba histolytica
VVEFWKYWMDSTPQSDA

SEQ ID NO: 2589723 - protein, 24 aa, Entamoeba histolytica
VVFIPICVSFNIATRPHSYTCSAS

SEQ ID NO: 2589724 - protein, 19 aa, Entamoeba histolytica
VVGIFLWWRQRGEEVEGEV

SEQ ID NO: 2589725 - protein, 31 aa, Entamoeba histolytica
VVGIICGSLSFLFGCSVQFIGMYSIVVLIVW

SEQ ID NO: 2589726 - protein, 20 aa, Entamoeba histolytica
VVGILAFRTHPIFTLITEHK

SEQ ID NO: 2589727 - protein, 17 aa, Entamoeba histolytica
VVGKAQIDRSVKVPFAL

SEQ ID NO: 2589728 - protein, 19 aa, Entamoeba histolytica
VVGKSRILSISKPYTITKI

SEQ ID NO: 2589729 - protein, 30 aa, Entamoeba histolytica
VVGMFLISFSFDFLGLAGWALAILGQSPRR

SEQ ID NO: 2589730 - protein, 17 aa, Entamoeba histolytica
VVGTLYLNKDIDVGKYC

SEQ ID NO: 2589731 - protein, 17 aa, Entamoeba histolytica
VVIASLFPNDFKMQQRA

SEQ ID NO: 2589732 - protein, 23 aa, Entamoeba histolytica
VVIDLNKVSAFFCIENVQEPTSY

SEQ ID NO: 2589733 - protein, 29 aa, Entamoeba histolytica
VVIFPFVLCFYPDCIRIYNFFTGQLDDTI

SEQ ID NO: 2589734 - protein, 24 aa, Entamoeba histolytica
VVKELWKREFGVFQSRHTLPPNAL

SEQ ID NO: 2589735 - protein, 17 aa, Entamoeba histolytica
VVKGLIIESECYIHESL

SEQ ID NO: 2589736 - protein, 28 aa, Entamoeba histolytica
VVKQGHIIWNWYNRWLVLTKEQLYYYDE

SEQ ID NO: 2589737 - protein, 19 aa, Entamoeba histolytica
VVLCIPYLIGQMGVEIDNI

SEQ ID NO: 2589738 - protein, 19 aa, Entamoeba histolytica
VVLKFKVILIVILQKTVRI

SEQ ID NO: 2589739 - protein, 20 aa, Entamoeba histolytica
VVLLLWLLLWVFSGCFVCDH

SEQ ID NO: 2589740 - protein, 18 aa, Entamoeba histolytica
VVLSSLISLIGIFPAIVM

SEQ ID NO: 2589741 - protein, 26 aa, Entamoeba histolytica
VVLYLVCIMFNFNLVKEFNFIDKKDI

SEQ ID NO: 2589742 - protein, 21 aa, Entamoeba histolytica
VVMKERIECSAVFTEKYTSVS

SEQ ID NO: 2589743 - protein, 25 aa, Entamoeba histolytica
VVNLKPKKMCKIKVYIFPFCTLEEE

SEQ ID NO: 2589744 - protein, 22 aa, Entamoeba histolytica
VVNRIVPFLNNFGIEKESVITT

SEQ ID NO: 2589745 - protein, 22 aa, Entamoeba histolytica
VVPEDRFGAFIGLANCAVVFAQ

SEQ ID NO: 2589746 - protein, 19 aa, Entamoeba histolytica
VVPPELWKRIEDVAFEPNV

SEQ ID NO: 2589747 - protein, 18 aa, Entamoeba histolytica
VVRYYCQYQRAFEIVKKL

SEQ ID NO: 2589748 - protein, 18 aa, Entamoeba histolytica
VVSCRETYLLISQLLEKT

SEQ ID NO: 2589749 - protein, 19 aa, Entamoeba histolytica
VVSLSEGFIESIVASGGIK

SEQ ID NO: 2589750 - protein, 19 aa, Entamoeba histolytica
VVVFEWYHSYILTSCTRKN

SEQ ID NO: 2589751 - protein, 17 aa, Entamoeba histolytica
VVVGFVYFRRNKQESQY

SEQ ID NO: 2589752 - protein, 20 aa, Entamoeba histolytica
VVVISFLWYLARPCLGGVRG

SEQ ID NO: 2589753 - protein, 25 aa, Entamoeba histolytica
VVVYSGLKYLMWMIGIGGGIIGVVI

SEQ ID NO: 2589754 - protein, 21 aa, Entamoeba histolytica
VVYLIACCGILGIAVYKFSKM

SEQ ID NO: 2589755 - protein, 25 aa, Entamoeba histolytica
VVYSGWKYLMWMIGIGGGIIGVVIV

SEQ ID NO: 2589756 - protein, 31 aa, Entamoeba histolytica; identical to SEQ ID NO: 2392092

SEQ ID NO: 2589757 - protein, 25 aa, Entamoeba histolytica
VVYVGFRFALGFVFYPFEVSNTYMN

SEQ ID NO: 2589758 - protein, 17 aa, Entamoeba histolytica
VWCTLTYFNDSKQSKKL

SEQ ID NO: 2589759 - protein, 17 aa, Entamoeba histolytica
VWIITIIIAIIIYLVYH

SEQ ID NO: 2589760 - protein, 20 aa, Entamoeba histolytica
VWLFCVVQWSAFAGLVIMFL

SEQ ID NO: 2589761 - protein, 17 aa, Entamoeba histolytica
VWLVCILPHSLKVHQGM

SEQ ID NO: 2589762 - protein, 20 aa, Entamoeba histolytica
VWMLFCFFWAVWNGANFYFE

SEQ ID NO: 2589763 - protein, 23 aa, Entamoeba histolytica
VWSICFFTSIPIYTHSCALEFAI

SEQ ID NO: 2589764 - protein, 32 aa, Entamoeba histolytica
VWVVMSCIIVSFFVILLFNIVFFVIKNCFLNE

SEQ ID NO: 2589765 - protein, 18 aa, Entamoeba histolytica
VWYEFKFIERIHTLQKGD

SEQ ID NO: 2589766 - protein, 23 aa, Entamoeba histolytica
VYADLLWKNVFETFYLNDNIVID

SEQ ID NO: 2589767 - protein, 22 aa, Entamoeba histolytica
VYAFKTGVLFCFAPASVFLTSV

SEQ ID NO: 2589768 - protein, 23 aa, Entamoeba histolytica
VYCIPSMLLFIIKVWQIGITDMI

SEQ ID NO: 2589769 - protein, 18 aa, Entamoeba histolytica
VYCPCYSSNCVVQILPSI

SEQ ID NO: 2589770 - protein, 19 aa, Entamoeba histolytica
VYEGLYLVTFNRDYAKASE

SEQ ID NO: 2589771 - protein, 26 aa, Entamoeba histolytica
VYESASFRSEICKIFSSYENVNVQIN

SEQ ID NO: 2589772 - protein, 22 aa, Entamoeba histolytica
VYFSLLSGFLFDNFGPRGTLIF

SEQ ID NO: 2589773 - protein, 23 aa, Entamoeba histolytica
VYGSLFLLTFIYYFILFSIEYLS

SEQ ID NO: 2589774 - protein, 18 aa, Entamoeba histolytica
VYIGFVFSLFLFKLYHNY

SEQ ID NO: 2589775 - protein, 23 aa, Entamoeba histolytica
VYIKVILDKSCTAFSNVFSLKFK

SEQ ID NO: 2589776 - protein, 17 aa, Entamoeba histolytica
VYIPLIVFVVFNIINFG

SEQ ID NO: 2589777 - protein, 18 aa, Entamoeba histolytica
VYISLAVIVSVIIILFIA

SEQ ID NO: 2589778 - protein, 19 aa, Entamoeba histolytica
VYKEPKLSDLVTLNENTEE

SEQ ID NO: 2589779 - protein, 17 aa, Entamoeba histolytica
VYKGEFKGNSVAIKRMK

SEQ ID NO: 2589780 - protein, 18 aa, Entamoeba histolytica
VYKGIFRNNIVAIKNLKN

SEQ ID NO: 2589781 - protein, 21 aa, Entamoeba histolytica
VYKKNGFEVFGNVKYKKVDII

SEQ ID NO: 2589782 - protein, 21 aa, Entamoeba histolytica
VYKNLKMGKSILHDFDTIQWH

SEQ ID NO: 2589783 - protein, 18 aa, Entamoeba histolytica
VYKSIKYLAMITETEGLF

SEQ ID NO: 2589784 - protein, 20 aa, Entamoeba histolytica
VYLIACCGILGIAVYKFSKM

SEQ ID NO: 2589785 - protein, 17 aa, Entamoeba histolytica
VYLSFFIFLMIIVLFIR

SEQ ID NO: 2589786 - protein, 23 aa, Entamoeba histolytica
VYNLSMVVGWTFILVTYFLKALE

SEQ ID NO: 2589787 - protein, 18 aa, Entamoeba histolytica
VYNPLTLDKINEITIKID

SEQ ID NO: 2589788 - protein, 18 aa, Entamoeba histolytica
VYQNEFVMTLAILTRIDP

SEQ ID NO: 2589789 - protein, 19 aa, Entamoeba histolytica
VYSCGELLHVMLYGNHHYF

SEQ ID NO: 2589790 - protein, 17 aa, Entamoeba histolytica
VYSCGLTGGSFCAFATL

SEQ ID NO: 2589791 - protein, 24 aa, Entamoeba histolytica
VYSDRFSIWFLFELLFISQALSQI

SEQ ID NO: 2589792 - protein, 34 aa, Entamoeba histolytica
VYSLPKLPGMWVYCWTITIVMWTSCWRQRNELSE

SEQ ID NO: 2589793 - protein, 34 aa, Entamoeba histolytica
VYVDDCNVCYSGGYRKCGINSYIVMKLEKNHHYY

SEQ ID NO: 2589794 - protein, 23 aa, Entamoeba histolytica
VYVREKWYYYGLVDNNRTNNLKI

SEQ ID NO: 2589795 - protein, 17 aa, Entamoeba histolytica
VYYCWALGYHFHSLVFH

SEQ ID NO: 2589796 - protein, 17 aa, Entamoeba histolytica
VYYHSTLIADEKEISLQ

SEQ ID NO: 2589797 - protein, 17 aa, Entamoeba histolytica
VYYPSADHKIEKRKCTT

SEQ ID NO: 2589798 - protein, 24 aa, Entamoeba histolytica
WAIANLILGIGFVFIAVVVVVLYL

SEQ ID NO: 2589799 - protein, 26 aa, Entamoeba histolytica
WAKSNLKTSIVFSSQLLRSIECLESF

SEQ ID NO: 2589800 - protein, 18 aa, Entamoeba histolytica
WANKGCRTLALSYKDIAP

SEQ ID NO: 2589801 - protein, 22 aa, Entamoeba histolytica
WANRILPILLYFSLLTLTILAI

SEQ ID NO: 2589802 - protein, 30 aa, Entamoeba histolytica
WAWSPPKFECWWLTRIIPYIFLIFVSLFLC

SEQ ID NO: 2589803 - protein, 21 aa, Entamoeba histolytica
WCDDCLKTLEDVHLFEFELVN

SEQ ID NO: 2589804 - protein, 18 aa, Entamoeba histolytica
WCLPRVKREILACLVSCV

SEQ ID NO: 2589805 - protein, 22 aa, Entamoeba histolytica
WDCLLYSPYLCLIINSESIYEG

SEQ ID NO: 2589806 - protein, 24 aa, Entamoeba histolytica
WDDLKLLRPEMNEVENERILLEKE

SEQ ID NO: 2589807 - protein, 20 aa, Entamoeba histolytica
WDEKRKCVVRKSGDNVIRIS

SEQ ID NO: 2589808 - protein, 19 aa, Entamoeba histolytica
WDIADTITIGKRPNIIQEV

SEQ ID NO: 2589809 - protein, 17 aa, Entamoeba histolytica
WDKDVLVLLDCVRDINL

SEQ ID NO: 2589810 - protein, 17 aa, Entamoeba histolytica
WDLALVVLATVPLSSFS

SEQ ID NO: 2589811 - protein, 17 aa, Entamoeba histolytica
WDLFNFICVVPFFLLLI

SEQ ID NO: 2589812 - protein, 18 aa, Entamoeba histolytica
WDLHSFKIIRSFEHHACI

SEQ ID NO: 2589813 - protein, 19 aa, Entamoeba histolytica
WDLTLVIIIAIARALIRNP

SEQ ID NO: 2589814 - protein, 17 aa, Entamoeba histolytica
WDLWGPMLVCYILSLLL

SEQ ID NO: 2589815 - protein, 18 aa, Entamoeba histolytica
WDNNSFCRGYYCNGGESV

SEQ ID NO: 2589816 - protein, 28 aa, Entamoeba histolytica
WDVLISVLLCLFISFLIMKFTKMNFCKS

SEQ ID NO: 2589817 - protein, 17 aa, Entamoeba histolytica
WDYTGKHIFIFGGSAGV

SEQ ID NO: 2589818 - protein, 26 aa, Entamoeba histolytica
WEADRLEVRYGLFGRVFGQRAVAWAF

SEQ ID NO: 2589819 - protein, 21 aa, Entamoeba histolytica
WEESISYAISVVEWLAQLIEN

SEQ ID NO: 2589820 - protein, 17 aa, Entamoeba histolytica
WEGNGMGYMIMKEISNI

SEQ ID NO: 2589821 - protein, 26 aa, Entamoeba histolytica
WEIPLTVYMLFNWLWLLGTLIYLNCV

SEQ ID NO: 2589822 - protein, 22 aa, Entamoeba histolytica
WEIRHGAAICLREVLRAQSNAV

SEQ ID NO: 2589823 - protein, 21 aa, Entamoeba histolytica
WEIVPLTALVILFWNIPSNKS

SEQ ID NO: 2589824 - protein, 23 aa, Entamoeba histolytica
WEIWKKWDWDIDYSLRKYTLLMP

SEQ ID NO: 2589825 - protein, 22 aa, Entamoeba histolytica
WEKKEETGRCLIEKVDILYESN

SEQ ID NO: 2589826 - protein, 24 aa, Entamoeba histolytica
WEKMKLKLIMPKGIWEEDVEEYMI

SEQ ID NO: 2589827 - protein, 20 aa, Entamoeba histolytica
WERNKCFAMQSSLGISSIDR

SEQ ID NO: 2589828 - protein, 17 aa, Entamoeba histolytica
WESVLKKGLELSCIIEA

SEQ ID NO: 2589829 - protein, 20 aa, Entamoeba histolytica
WEVKHGALLVLKYTVAIVDK

SEQ ID NO: 2589830 - protein, 24 aa, Entamoeba histolytica
WFDPDSWYPLGRNIGTTVFPGLMF

SEQ ID NO: 2589831 - protein, 18 aa, Entamoeba histolytica
WFFLFLIRIYLIYYILFI

SEQ ID NO: 2589832 - protein, 19 aa, Entamoeba histolytica
WFFVLKLAKQITVSRDFKY

SEQ ID NO: 2589833 - protein, 19 aa, Entamoeba histolytica
WFGVLILSSLIVKFTPKKV

SEQ ID NO: 2589834 - protein, 17 aa, Entamoeba histolytica
WFHYIFYWVSVIGASLF

SEQ ID NO: 2589835 - protein, 19 aa, Entamoeba histolytica
WFIEKELRLNRFALSSSLR

SEQ ID NO: 2589836 - protein, 19 aa, Entamoeba histolytica
WFNLPDRLIWKQCQEEYSV

SEQ ID NO: 2589837 - protein, 19 aa, Entamoeba histolytica
WFNTTSICGFYRVLQNKNQ

SEQ ID NO: 2589838 - protein, 17 aa, Entamoeba histolytica
WFVVHGFVCLFMTGVFG

SEQ ID NO: 2589839 - protein, 20 aa, Entamoeba histolytica
WFYPHEFKLHENLIVHMKGT

SEQ ID NO: 2589840 - protein, 20 aa, Entamoeba histolytica
WGAPYPKETFPFPWNIAEFI

SEQ ID NO: 2589841 - protein, 25 aa, Entamoeba histolytica
WGECSKITYAVGFCFGVGSTVTTLI

SEQ ID NO: 2589842 - protein, 25 aa, Entamoeba histolytica
WGEGKELWFAYIIKYLILFFPVFNL

SEQ ID NO: 2589843 - protein, 22 aa, Entamoeba histolytica
WGFKFCYINILIIIVFVFPLWF

SEQ ID NO: 2589844 - protein, 18 aa, Entamoeba histolytica
WGIKFDDLNGLKWNNMRI

SEQ ID NO: 2589845 - protein, 20 aa, Entamoeba histolytica
WGKKVCEAFRGINGVLDSQF

SEQ ID NO: 2589846 - protein, 22 aa, Entamoeba histolytica
WGKRKHPFVGVAGVECIISGNY

SEQ ID NO: 2589847 - protein, 17 aa, Entamoeba histolytica
WGLLINGIGLCFFSDII

SEQ ID NO: 2589848 - protein, 17 aa, Entamoeba histolytica
WGNAGHSMAYWMQNISE

SEQ ID NO: 2589849 - protein, 17 aa, Entamoeba histolytica
WGPAYPKEQFKYPWQIA

SEQ ID NO: 2589850 - protein, 17 aa, Entamoeba histolytica
WGRSIRPKLGLPQGNRE

SEQ ID NO: 2589851 - protein, 24 aa, Entamoeba histolytica
WGRVPLESGVTFLANVSNCYEILL

SEQ ID NO: 2589852 - protein, 17 aa, Entamoeba histolytica
WGTFFFDLHIVCFFIPL

SEQ ID NO: 2589853 - protein, 19 aa, Entamoeba histolytica
WGTSIVFFAKQWRMRIELI

SEQ ID NO: 2589854 - protein, 23 aa, Entamoeba histolytica
WHQKIPILWTYKPFYEPRTIHLP

SEQ ID NO: 2589855 - protein, 22 aa, Entamoeba histolytica
WHYAKLSMLGSYVMVLIIVAFF

SEQ ID NO: 2589856 - protein, 18 aa, Entamoeba histolytica
WICERKLDKVILAERETV

SEQ ID NO: 2589857 - protein, 17 aa, Entamoeba histolytica
WIGVFALSKASYSVFNV

SEQ ID NO: 2589858 - protein, 19 aa, Entamoeba histolytica
WIICLRIGAVVLIRLHLFL

SEQ ID NO: 2589859 - protein, 17 aa, Entamoeba histolytica
WIIIIIFIIAVIVIGII

SEQ ID NO: 2589860 - protein, 23 aa, Entamoeba histolytica
WIKINTIALEWVKIAQYIQSKYL

SEQ ID NO: 2589861 - protein, 17 aa, Entamoeba histolytica
WILCPSGDSISVTGYGG

SEQ ID NO: 2589862 - protein, 18 aa, Entamoeba histolytica
WILLEKWYCVLFVLCFIA

SEQ ID NO: 2589863 - protein, 18 aa, Entamoeba histolytica
WIPLSGRCQILVNKRLAN

SEQ ID NO: 2589864 - protein, 21 aa, Entamoeba histolytica
WIRCHSFCPLCKVSFHLNPLK

SEQ ID NO: 2589865 - protein, 25 aa, Entamoeba histolytica
WIRCHSFCPLCKVSFHLNPLKKNKQ

SEQ ID NO: 2589866 - protein, 40 aa, Entamoeba histolytica
WISDCPKVFFDRCSWLLSLPEDWFEFGLILSKTPMFCQYL

SEQ ID NO: 2589867 - protein, 18 aa, Entamoeba histolytica
WISGELFSYVHYNILIVS

SEQ ID NO: 2589868 - protein, 18 aa, Entamoeba histolytica
WISKKLCSNGKWDNISIS

SEQ ID NO: 2589869 - protein, 19 aa, Entamoeba histolytica
WIVFGVLVYVLFAGILAGC

SEQ ID NO: 2589870 - protein, 17 aa, Entamoeba histolytica
WIVFIFQPTFKPTVSTL

SEQ ID NO: 2589871 - protein, 19 aa, Entamoeba histolytica
WIWYLRRPYPVYLVSFATS

SEQ ID NO: 2589872 - protein, 22 aa, Entamoeba histolytica
WKDAFIKISSYILGEYGSLVVK

SEQ ID NO: 2589873 - protein, 18 aa, Entamoeba histolytica
WKDVFLYLIDMVQHKLNM

SEQ ID NO: 2589874 - protein, 20 aa, Entamoeba histolytica
WKDVICKSVNRNGGNEYDES

SEQ ID NO: 2589875 - protein, 19 aa, Entamoeba histolytica
WKEIRCIGSESTLLLKSKS

SEQ ID NO: 2589876 - protein, 21 aa, Entamoeba histolytica
WKGHVETLVPLLARFVSISAK

SEQ ID NO: 2589877 - protein, 18 aa, Entamoeba histolytica
WKGVKFVLKDQMIDNSNE

SEQ ID NO: 2589878 - protein, 24 aa, Entamoeba histolytica
WKIIGELSAILSYELEYFECTCEG

SEQ ID NO: 2589879 - protein, 20 aa, Entamoeba histolytica
WKIIQLLKIDFIRDLHQFVY

SEQ ID NO: 2589880 - protein, 20 aa, Entamoeba histolytica
WKINIIVIILLLNFFHILSL

SEQ ID NO: 2589881 - protein, 19 aa, Entamoeba histolytica
WKIPGRAPPSVIAERGMTL

SEQ ID NO: 2589882 - protein, 17 aa, Entamoeba histolytica
WKIYQLWNGRVIIFIIR

SEQ ID NO: 2589883 - protein, 19 aa, Entamoeba histolytica
WKKALIVLFQGMTMAIISI

SEQ ID NO: 2589884 - protein, 22 aa, Entamoeba histolytica
WKKGGYIGLVFDKIMHLFEVII

SEQ ID NO: 2589885 - protein, 18 aa, Entamoeba histolytica
WKKPLLELSSFIATSLVA

SEQ ID NO: 2589886 - protein, 31 aa, Entamoeba histolytica
WKKQKKSMKWIYSIIVIPVIIAIGYILYVFI

SEQ ID NO: 2589887 - protein, 21 aa, Entamoeba histolytica
WKLILERRLKETKKEIYEEPN

SEQ ID NO: 2589888 - protein, 17 aa, Entamoeba histolytica
WKLTRVFTLNFKEKGSF

SEQ ID NO: 2589889 - protein, 19 aa, Entamoeba histolytica
WKLTWFNSILFEFMELSFQ

SEQ ID NO: 2589890 - protein, 18 aa, Entamoeba histolytica
WKMTEEIHKITAYPNHVH

SEQ ID NO: 2589891 - protein, 21 aa, Entamoeba histolytica
WKNLQTIFSKKKLCFPDNGRW

SEQ ID NO: 2589892 - protein, 22 aa, Entamoeba histolytica
WKNNKLLLAQGLRDLYIENPSL

SEQ ID NO: 2589893 - protein, 17 aa, Entamoeba histolytica
WKNPAFGEWCIQKIIGT

SEQ ID NO: 2589894 - protein, 21 aa, Entamoeba histolytica
WKPKCIKSDVNEFFLPSSYQR

SEQ ID NO: 2589895 - protein, 19 aa, Entamoeba histolytica
WKRLRCFHFSLKEMRINDF

SEQ ID NO: 2589896 - protein, 19 aa, Entamoeba histolytica
WKRSGFCSEHGNQFKGNVV

SEQ ID NO: 2589897 - protein, 18 aa, Entamoeba histolytica
WKSSKEVFDTTPALPQIN

SEQ ID NO: 2589898 - protein, 17 aa, Entamoeba histolytica
WKTLKLYGCGSSIDSQE

SEQ ID NO: 2589899 - protein, 19 aa, Entamoeba histolytica
WKTSVCMKCVDGYQFDVSS

SEQ ID NO: 2589900 - protein, 19 aa, Entamoeba histolytica
WKVSLAVMAVSPVLIVVVF

SEQ ID NO: 2589901 - protein, 17 aa, Entamoeba histolytica
WKYPMHFTFHSGDYTKY

SEQ ID NO: 2589902 - protein, 20 aa, Entamoeba histolytica
WKYPMHFTFHSGDYTKYEIM

SEQ ID NO: 2589903 - protein, 20 aa, Entamoeba histolytica
WKYYERFGYQNSEENFLHKM

SEQ ID NO: 2589904 - protein, 17 aa, Entamoeba histolytica
WKYYLQRVLPNDESIKM

SEQ ID NO: 2589905 - protein, 24 aa, Entamoeba histolytica
WLGFAICFGCVILISYFFVVYYSL

SEQ ID NO: 2589906 - protein, 17 aa, Entamoeba histolytica
WLIFSINGIMVVIMNIK

SEQ ID NO: 2589907 - protein, 18 aa, Entamoeba histolytica
WLIVIACFVGAHAICCFV

SEQ ID NO: 2589908 - protein, 19 aa, Entamoeba histolytica
WLMFIGGLISSLGYLLTLL

SEQ ID NO: 2589909 - protein, 20 aa, Entamoeba histolytica
WLNIFFNWIPEMVFMICSFG

SEQ ID NO: 2589910 - protein, 17 aa, Entamoeba histolytica
WLPDNRNSIHINEPIEL

SEQ ID NO: 2589911 - protein, 17 aa, Entamoeba histolytica
WLVLLAGILCFIVVGLL

SEQ ID NO: 2589912 - protein, 17 aa, Entamoeba histolytica
WMCELSHKLKIAELNIE

SEQ ID NO: 2589913 - protein, 17 aa, Entamoeba histolytica
WMGLIFAIIFWLSLLLI

SEQ ID NO: 2589914 - protein, 24 aa, Entamoeba histolytica
WMTICKCTKYLKEVEFIECVKELI

SEQ ID NO: 2589915 - protein, 19 aa, Entamoeba histolytica
WMYECIVNLHIQRFMLPIS

SEQ ID NO: 2589916 - protein, 20 aa, Entamoeba histolytica
WNCFLQVGSNMLITFINSFL

SEQ ID NO: 2589917 - protein, 24 aa, Entamoeba histolytica
WNDNICILVGGLTRILKYILPSVS

SEQ ID NO: 2589918 - protein, 26 aa, Entamoeba histolytica
WNDVRFELVSDIPWNCFNPHLDVKGK

SEQ ID NO: 2589919 - protein, 19 aa, Entamoeba histolytica
WNEYCEKYSFDWSSLTVLI

SEQ ID NO: 2589920 - protein, 17 aa, Entamoeba histolytica
WNFIPLAYLRQFKYTYN

SEQ ID NO: 2589921 - protein, 19 aa, Entamoeba histolytica
WNGNVSFERVITFETTPSL

SEQ ID NO: 2589922 - protein, 17 aa, Entamoeba histolytica
WNGYVSFERLIKFETTP

SEQ ID NO: 2589923 - protein, 17 aa, Entamoeba histolytica
WNKGVSFERLITFETTP

SEQ ID NO: 2589924 - protein, 24 aa, Entamoeba histolytica
WNKMKLKLIMPKGIWEEDVEEYMI

SEQ ID NO: 2589925 - protein, 17 aa, Entamoeba histolytica
WNKNAIKVSKKFSKLFQ

SEQ ID NO: 2589926 - protein, 17 aa, Entamoeba histolytica
WNQDPSARWTFQQIDEF

SEQ ID NO: 2589927 - protein, 18 aa, Entamoeba histolytica
WNQITDFIVMILIVGTIV

SEQ ID NO: 2589928 - protein, 19 aa, Entamoeba histolytica
WNTKMIFVWVKASFTNKNV

SEQ ID NO: 2589929 - protein, 28 aa, Entamoeba histolytica
WNVITQCWDHIPSKRPAFKDVAVMLQDE

SEQ ID NO: 2589930 - protein, 22 aa, Entamoeba histolytica
WNWILVIGHIISIIFIFIIYGL

SEQ ID NO: 2589931 - protein, 19 aa, Entamoeba histolytica
WPFELFCEKMMQNIFDPKW

SEQ ID NO: 2589932 - protein, 17 aa, Entamoeba histolytica
WQIFGYVVVAILIVLIL

SEQ ID NO: 2589933 - protein, 20 aa, Entamoeba histolytica
WQLAHVDLSWSLTQPQNNYQ

SEQ ID NO: 2589934 - protein, 24 aa, Entamoeba histolytica
WQPSLIRRAVICLIFTSFAGMLSA

SEQ ID NO: 2589935 - protein, 18 aa, Entamoeba histolytica
WQYPIKLFVHLINIQTDR

SEQ ID NO: 2589936 - protein, 17 aa, Entamoeba histolytica
WRCNGYDYILIVNVRAV

SEQ ID NO: 2589937 - protein, 20 aa, Entamoeba histolytica
WRGKCWKCNDGYYMNSESVP

SEQ ID NO: 2589938 - protein, 26 aa, Entamoeba histolytica
WRHQIMLWYAGLRGAIAVLLSLQMAS

SEQ ID NO: 2589939 - protein, 19 aa, Entamoeba histolytica
WRKKAKFELLTTVRIHHGK

SEQ ID NO: 2589940 - protein, 19 aa, Entamoeba histolytica
WRLVTPFLVYSDRFSIWFL

SEQ ID NO: 2589941 - protein, 18 aa, Entamoeba histolytica
WRMFNIIMLGVGFLIIYI

SEQ ID NO: 2589942 - protein, 23 aa, Entamoeba histolytica
WRTSSWKSNEWRDITYIMCEDAM

SEQ ID NO: 2589943 - protein, 17 aa, Entamoeba histolytica
WRVFIYKFLNTIVDDLF

SEQ ID NO: 2589944 - protein, 20 aa, Entamoeba histolytica
WRVKEIPNFLLCAPAAIISL

SEQ ID NO: 2589945 - protein, 17 aa, Entamoeba histolytica
WRYCACSLLYNYAAFLF

SEQ ID NO: 2589946 - protein, 17 aa, Entamoeba histolytica
WRYDKKSGKEEIKDIDE

SEQ ID NO: 2589947 - protein, 21 aa, Entamoeba histolytica
WRYYFNVNTSFVLKKILMIIM

SEQ ID NO: 2589948 - protein, 24 aa, Entamoeba histolytica
WSKSISFIPMKAFIYHRRSNFLEI

SEQ ID NO: 2589949 - protein, 17 aa, Entamoeba histolytica
WSMFRGFPIMTVAFCGH

SEQ ID NO: 2589950 - protein, 19 aa, Entamoeba histolytica
WSNEELVFISPVAGVLIRF

SEQ ID NO: 2589951 - protein, 23 aa, Entamoeba histolytica
WSSPTCPCTGNGCIIDTTKPSVA

SEQ ID NO: 2589952 - protein, 19 aa, Entamoeba histolytica
WSVGKAFGFLFGGMLKSAL

SEQ ID NO: 2589953 - protein, 27 aa, Entamoeba histolytica
WSWSSWLIGGSCGILLGLSDNMIYNLK

SEQ ID NO: 2589954 - protein, 18 aa, Entamoeba histolytica
WSYWQYKQRFNLLALCTM

SEQ ID NO: 2589955 - protein, 20 aa, Entamoeba histolytica
WTCFSPDTESTCGFGSTIQL

SEQ ID NO: 2589956 - protein, 26 aa, Entamoeba histolytica
WTFTFSLTCFAYFLATLMSKTRIAIT

SEQ ID NO: 2589957 - protein, 17 aa, Entamoeba histolytica
WTIMAFSSVCFLFVSLL

SEQ ID NO: 2589958 - protein, 20 aa, Entamoeba histolytica
WTKCMCFYPQAVLEESIHIK

SEQ ID NO: 2589959 - protein, 25 aa, Entamoeba histolytica
WTLHFAARLPFSYYYFVSFLEDLLL

SEQ ID NO: 2589960 - protein, 18 aa, Entamoeba histolytica
WTRILLKTGSKTPILNIY

SEQ ID NO: 2589961 - protein, 18 aa, Entamoeba histolytica
WTTPLFKKTALYLVDALR

SEQ ID NO: 2589962 - protein, 20 aa, Entamoeba histolytica
WVEMSMFLKSLKIDERSEYL

SEQ ID NO: 2589963 - protein, 19 aa, Entamoeba histolytica
WVFLLRKKISLNFLLLNIV

SEQ ID NO: 2589964 - protein, 17 aa, Entamoeba histolytica
WVFPRYVISAAYNAKNF

SEQ ID NO: 2589965 - protein, 17 aa, Entamoeba histolytica
WVGFGSMFTHVAFALAC

SEQ ID NO: 2589966 - protein, 19 aa, Entamoeba histolytica
WVGNCIGRRNYRIFYQFLI

SEQ ID NO: 2589967 - protein, 17 aa, Entamoeba histolytica
WVGVLVSIFIRKLSPDN

SEQ ID NO: 2589968 - protein, 23 aa, Entamoeba histolytica
WVLQSPKFAKFMFFLLAYILSCE

SEQ ID NO: 2589969 - protein, 17 aa, Entamoeba histolytica
WVRDRWSATQLNKKRQH

SEQ ID NO: 2589970 - protein, 18 aa, Entamoeba histolytica
WVVLRRYFFLQGIIYFIR

SEQ ID NO: 2589971 - protein, 24 aa, Entamoeba histolytica
WVVVGCIICAGLVMVIVIVVIIIR

SEQ ID NO: 2589972 - protein, 24 aa, Entamoeba histolytica
WWLSLCKIGYMLSVSFFSFINCNT

SEQ ID NO: 2589973 - protein, 18 aa, Entamoeba histolytica
WYEFMFLERCELLQKNDR

SEQ ID NO: 2589974 - protein, 17 aa, Entamoeba histolytica
WYFIPFFFFTQVILLSL

SEQ ID NO: 2589975 - protein, 18 aa, Entamoeba histolytica
WYGSLVIRGKGGSKGVFA

SEQ ID NO: 2589976 - protein, 18 aa, Entamoeba histolytica
WYIVFSLLMSMLMLSIII

SEQ ID NO: 2589977 - protein, 19 aa, Entamoeba histolytica
WYLARPCLGGVRGTQGCFC

SEQ ID NO: 2589978 - protein, 18 aa, Entamoeba histolytica
WYNSPKITYYGTVEHKRT

SEQ ID NO: 2589979 - protein, 17 aa, Entamoeba histolytica
WYNTIYMKQKELENYME

SEQ ID NO: 2589980 - protein, 17 aa, Entamoeba histolytica
WYPLGRNIGTTVFPGLM

SEQ ID NO: 2589981 - protein, 23 aa, Entamoeba histolytica
WYQLCGIVLFVFVHKHIKSQIKM

SEQ ID NO: 2589982 - protein, 18 aa, Entamoeba histolytica
WYVFYGFVGGFKFISMGE

SEQ ID NO: 2589983 - protein, 17 aa, Entamoeba histolytica
YACEFELFITIKCTTKI

SEQ ID NO: 2589984 - protein, 20 aa, Entamoeba histolytica
YADVIVKGFAVSVAIVCTTT

SEQ ID NO: 2589985 - protein, 23 aa, Entamoeba histolytica
YAGLGGAIGIFIGMIVDTLLVII

SEQ ID NO: 2589986 - protein, 17 aa, Entamoeba histolytica
YAGRPRPNMYALVAQGK

SEQ ID NO: 2589987 - protein, 24 aa, Entamoeba histolytica
YAIGTLIGLIPCNFVVVYFSASMT

SEQ ID NO: 2589988 - protein, 20 aa, Entamoeba histolytica
YAIKRTLAFLTTYQGNEEQM

SEQ ID NO: 2589989 - protein, 26 aa, Entamoeba histolytica
YAKEIKTLKLLSSKVLKNLKNEDEEQ

SEQ ID NO: 2589990 - protein, 17 aa, Entamoeba histolytica
YAKGKIWIEPTGETSLK

SEQ ID NO: 2589991 - protein, 20 aa, Entamoeba histolytica
YALESMSFVSLRSNLLSQEF

SEQ ID NO: 2589992 - protein, 18 aa, Entamoeba histolytica
YALIAVICSYTFNGKVLT

SEQ ID NO: 2589993 - protein, 25 aa, Entamoeba histolytica
YALPGKIQFTFVILLQFINNTIESV

SEQ ID NO: 2589994 - protein, 18 aa, Entamoeba histolytica
YALSPEIYEEIKPETMLN

SEQ ID NO: 2589995 - protein, 20 aa, Entamoeba histolytica
YALSRKELKQVYDYHDPTDE

SEQ ID NO: 2589996 - protein, 17 aa, Entamoeba histolytica
YALTYSGIRSFDIDYQL

SEQ ID NO: 2589997 - protein, 19 aa, Entamoeba histolytica
YANQLKRIYNLYKTHLKSE

SEQ ID NO: 2589998 - protein, 17 aa, Entamoeba histolytica
YANSSICYCSYDPYVDQ

SEQ ID NO: 2589999 - protein, 24 aa, Entamoeba histolytica
YAPECPTACRLFHYIAELVIKFSE

SEQ ID NO: 2590000 - protein, 17 aa, Entamoeba histolytica
YAQFKVYVFNVGQADSQ

SEQ ID NO: 2590001 - protein, 19 aa, Entamoeba histolytica
YAREFFKTTLFPPPFNKQN

SEQ ID NO: 2590002 - protein, 24 aa, Entamoeba histolytica
YASSILPDISIYFSQLVHICSSVY

SEQ ID NO: 2590003 - protein, 22 aa, Entamoeba histolytica
YASWKLIQQKGIYETIIYEVIV

SEQ ID NO: 2590004 - protein, 27 aa, Entamoeba histolytica
YAVTMYECFKWGNAFASNIKPWCICDM

SEQ ID NO: 2590005 - protein, 19 aa, Entamoeba histolytica
YCAVPTCGNGKINDYEECD

SEQ ID NO: 2590006 - protein, 19 aa, Entamoeba histolytica
YCCTEYKGITKYKLVGIVV

SEQ ID NO: 2590007 - protein, 17 aa, Entamoeba histolytica
YCEIWKIKKRQMMIDIN

SEQ ID NO: 2590008 - protein, 30 aa, Entamoeba histolytica; identical to SEQ ID NO: 2392345

SEQ ID NO: 2590009 - protein, 19 aa, Entamoeba histolytica
YCGLKTYSLKGAVSCIECD

SEQ ID NO: 2590010 - protein, 20 aa, Entamoeba histolytica
YCHSACSLVTKGLKEWGRAI

SEQ ID NO: 2590011 - protein, 19 aa, Entamoeba histolytica
YCILFIVVLYLHIGITKKI

SEQ ID NO: 2590012 - protein, 17 aa, Entamoeba histolytica
YCISERVISYFIQVYCE

SEQ ID NO: 2590013 - protein, 20 aa, Entamoeba histolytica
YCIYEPRGVYSIIDTTKDII

SEQ ID NO: 2590014 - protein, 18 aa, Entamoeba histolytica
YCLSCKEGYFIDDHQCRD

SEQ ID NO: 2590015 - protein, 22 aa, Entamoeba histolytica
YCLYLFLLVALMFRFFQAFWDC

SEQ ID NO: 2590016 - protein, 19 aa, Entamoeba histolytica
YCNDISFYHLFKILTTIFM

SEQ ID NO: 2590017 - protein, 18 aa, Entamoeba histolytica
YCNHLCIVTELLGCSLYE

SEQ ID NO: 2590018 - protein, 18 aa, Entamoeba histolytica
YCNHLCIVTELLGSSLYE

SEQ ID NO: 2590019 - protein, 18 aa, Entamoeba histolytica
YCPCSGSACSIKIPNTIS

SEQ ID NO: 2590020 - protein, 28 aa, Entamoeba histolytica
YCPNTRLERWWFIITDVRNQFVLNATHG

SEQ ID NO: 2590021 - protein, 19 aa, Entamoeba histolytica
YCQECIRNISFLSIVQLII

SEQ ID NO: 2590022 - protein, 18 aa, Entamoeba histolytica
YCRMSFYDKDYIKLTSNF

SEQ ID NO: 2590023 - protein, 18 aa, Entamoeba histolytica
YCRMSLYDKNYIKLTSDF

SEQ ID NO: 2590024 - protein, 20 aa, Entamoeba histolytica
YCRSSKSSFCGICDDYFTKQ

SEQ ID NO: 2590025 - protein, 17 aa, Entamoeba histolytica
YCSCLPAVALIFPDTKK

SEQ ID NO: 2590026 - protein, 21 aa, Entamoeba histolytica
YCSNADEGIVCYWKENNTFVH

SEQ ID NO: 2590027 - protein, 18 aa, Entamoeba histolytica
YCTCKVDDPILIVSSDVK

SEQ ID NO: 2590028 - protein, 19 aa, Entamoeba histolytica
YCTCKVDDPILIVSSDVKK

SEQ ID NO: 2590029 - protein, 19 aa, Entamoeba histolytica
YCTECACGYELSTTNHTCV

SEQ ID NO: 2590030 - protein, 22 aa, Entamoeba histolytica
YCVFPCLIPPFISNRRIEKYIR

SEQ ID NO: 2590031 - protein, 20 aa, Entamoeba histolytica
YCYLCIGCTIICGIYFVWVI

SEQ ID NO: 2590032 - protein, 19 aa, Entamoeba histolytica
YCYSACSCVTKGLKEWGGA

SEQ ID NO: 2590033 - protein, 21 aa, Entamoeba histolytica
YDDFNSFDWKMIVETYKENSA

SEQ ID NO: 2590034 - protein, 23 aa, Entamoeba histolytica
YDEVLHQIILLKPSEIFVAAAIG

SEQ ID NO: 2590035 - protein, 21 aa, Entamoeba histolytica
YDEVPQCMKLVEGQSNSVTFD

SEQ ID NO: 2590036 - protein, 23 aa, Entamoeba histolytica
YDFFLHLPLSISSFHFYDSSGNI

SEQ ID NO: 2590037 - protein, 24 aa, Entamoeba histolytica
YDFYSEIYKLLVLTRDSHLSFTID

SEQ ID NO: 2590038 - protein, 28 aa, Entamoeba histolytica
YDGCDSYGYCPSGWSYFNHKCYENEGKL

SEQ ID NO: 2590039 - protein, 22 aa, Entamoeba histolytica
YDHLYLLLQLYQVFIIPKNQSF

SEQ ID NO: 2590040 - protein, 20 aa, Entamoeba histolytica
YDICYELGVNFISKLSKQSN

SEQ ID NO: 2590041 - protein, 19 aa, Entamoeba histolytica
YDIEYKFTLNLEIGIEAID

SEQ ID NO: 2590042 - protein, 19 aa, Entamoeba histolytica
YDIFIGVFFCTIYFMYTVG

SEQ ID NO: 2590043 - protein, 21 aa, Entamoeba histolytica
YDILVDYCFPEGVLHTRKEAK

SEQ ID NO: 2590044 - protein, 27 aa, Entamoeba histolytica
YDLFLKTHFISFLFKILPFKSTPTDEK

SEQ ID NO: 2590045 - protein, 24 aa, Entamoeba histolytica
YDLLYRFVQTLGMLPFSLLSTGNK

SEQ ID NO: 2590046 - protein, 21 aa, Entamoeba histolytica
YDLTFALYVNDVFKTNNVILK

SEQ ID NO: 2590047 - protein, 24 aa, Entamoeba histolytica
YDMFLFLKLFKTFNIKRGNETKQI

SEQ ID NO: 2590048 - protein, 23 aa, Entamoeba histolytica
YDPKELLCIFQQYGDVKTIYYST

SEQ ID NO: 2590049 - protein, 27 aa, Entamoeba histolytica
YDRKGCVRYTSGWSVALIIIGITLFIG

SEQ ID NO: 2590050 - protein, 25 aa, Entamoeba histolytica
YDVFYYLAMQPWRHFVWTTCETTKG

SEQ ID NO: 2590051 - protein, 25 aa, Entamoeba histolytica
YDVFYYLAMQPWRHFVWTTCTTTDG

SEQ ID NO: 2590052 - protein, 23 aa, Entamoeba histolytica
YDYDLFFSFSELKKNICPPFICV

SEQ ID NO: 2590053 - protein, 19 aa, Entamoeba histolytica
YDYLLFVGITEEYEANVRV

SEQ ID NO: 2590054 - protein, 17 aa, Entamoeba histolytica
YDYNETIPREFLLDPIN

SEQ ID NO: 2590055 - protein, 22 aa, Entamoeba histolytica
YDYTPFFGIEENDTFVLNIDCV

SEQ ID NO: 2590056 - protein, 22 aa, Entamoeba histolytica
YEALDRIILLLFDRRIDSELES

SEQ ID NO: 2590057 - protein, 19 aa, Entamoeba histolytica
YECECQAGWFEAHSVGCQR

SEQ ID NO: 2590058 - protein, 25 aa, Entamoeba histolytica
YECSKYKPNCLVCSNSSPNCLVCKN

SEQ ID NO: 2590059 - protein, 24 aa, Entamoeba histolytica
YECVCSCCSILLSIILLLQQCLFG

SEQ ID NO: 2590060 - protein, 17 aa, Entamoeba histolytica
YEDLLMASFRVEMTDDP

SEQ ID NO: 2590061 - protein, 17 aa, Entamoeba histolytica
YEEICCLTTSNKVNTLI

SEQ ID NO: 2590062 - protein, 33 aa, Entamoeba histolytica
YEEYQRKFFPYRKAHKRVRGWVNNAPRSKYRPK

SEQ ID NO: 2590063 - protein, 19 aa, Entamoeba histolytica
YEFCMKATNLFLIQTNCVA

SEQ ID NO: 2590064 - protein, 25 aa, Entamoeba histolytica
YEFDRCYACGSTVIIGVSDGSLDIK

SEQ ID NO: 2590065 - protein, 22 aa, Entamoeba histolytica
YEFLSKRIGSLSSQTINIAIKT

SEQ ID NO: 2590066 - protein, 28 aa, Entamoeba histolytica
YEFRNQECFRRSFDIFINDQFVTQCGWG

SEQ ID NO: 2590067 - protein, 27 aa, Entamoeba histolytica
YEHQEKIFSAWGFIISYVVYKGGCVTI

SEQ ID NO: 2590068 - protein, 22 aa, Entamoeba histolytica
YEIESPILFFGDDTKQVWQYQF

SEQ ID NO: 2590069 - protein, 23 aa, Entamoeba histolytica
YEIFCGQFIRLLRCPKCGKVADK

SEQ ID NO: 2590070 - protein, 29 aa, Entamoeba histolytica
YEIFCGQFIRLLRCPKCGKVADKYIEYDN

SEQ ID NO: 2590071 - protein, 20 aa, Entamoeba histolytica
YEILNMFPFSSSTKRMGVIV

SEQ ID NO: 2590072 - protein, 25 aa, Entamoeba histolytica
YEINGTYWLGGEVQRFDTLKFNGYA

SEQ ID NO: 2590073 - protein, 18 aa, Entamoeba histolytica
YEINWSCFEKKVEEIEDI

SEQ ID NO: 2590074 - protein, 23 aa, Entamoeba histolytica
YEIPESYIGKDLYIDVILISNVV

SEQ ID NO: 2590075 - protein, 19 aa, Entamoeba histolytica
YEIPRKCYRNGLISETGEE

SEQ ID NO: 2590076 - protein, 19 aa, Entamoeba histolytica
YEKEEIGGICYSNKEQIIF

SEQ ID NO: 2590077 - protein, 20 aa, Entamoeba histolytica
YEKWKIMWEDAINNVKEREE

SEQ ID NO: 2590078 - protein, 25 aa, Entamoeba histolytica
YELIYKLVIFEGYQPYYLEEFPPER

SEQ ID NO: 2590079 - protein, 23 aa, Entamoeba histolytica
YELLLPLYFDYHFTVTKAMKEFL

SEQ ID NO: 2590080 - protein, 24 aa, Entamoeba histolytica
YELTQVCRIYVALVPKGYTITECP

SEQ ID NO: 2590081 - protein, 26 aa, Entamoeba histolytica
YENYLWCGIMFIGSLILYFIGFIFLK

SEQ ID NO: 2590082 - protein, 17 aa, Entamoeba histolytica
YEPCGLVAASFFNDSFE

SEQ ID NO: 2590083 - protein, 20 aa, Entamoeba histolytica
YEREFKKKFDLPDMLSSYKF

SEQ ID NO: 2590084 - protein, 18 aa, Entamoeba histolytica
YEVSIWRNPFPKEQFKYP

SEQ ID NO: 2590085 - protein, 21 aa, Entamoeba histolytica
YEVTVPYSGIFGIGTQLPVQC

SEQ ID NO: 2590086 - protein, 20 aa, Entamoeba histolytica
YEWATTIMLVYTALFCTILM

SEQ ID NO: 2590087 - protein, 26 aa, Entamoeba histolytica
YEYVFASSLFVFWKIIITSIFCVFVV

SEQ ID NO: 2590088 - protein, 19 aa, Entamoeba histolytica
YFALLSVGLWYSSRSSNVS

SEQ ID NO: 2590089 - protein, 19 aa, Entamoeba histolytica
YFATKGCDNVCNLMNIPRA

SEQ ID NO: 2590090 - protein, 17 aa, Entamoeba histolytica
YFCRPRVNKALDVGSTD

SEQ ID NO: 2590091 - protein, 19 aa, Entamoeba histolytica
YFDFQMFNLRMESIGTKIG

SEQ ID NO: 2590092 - protein, 18 aa, Entamoeba histolytica
YFEDCRFGILGISNDDKN

SEQ ID NO: 2590093 - protein, 24 aa, Entamoeba histolytica
YFFPLPDYVASYSFLIEPTQETTN

SEQ ID NO: 2590094 - protein, 18 aa, Entamoeba histolytica
YFGCLRMMKEIKILLDSN

SEQ ID NO: 2590095 - protein, 17 aa, Entamoeba histolytica
YFGMAGGALVFIALTIY

SEQ ID NO: 2590096 - protein, 25 aa, Entamoeba histolytica
YFGVAIPDILVYLGVTRETLSEIMG

SEQ ID NO: 2590097 - protein, 18 aa, Entamoeba histolytica
YFGYSGLVEFIWIELNNK

SEQ ID NO: 2590098 - protein, 31 aa, Entamoeba histolytica
YFIIPRFSPTCWVKLPYKRSFYMTYSQKSYE

SEQ ID NO: 2590099 - protein, 21 aa, Entamoeba histolytica
YFILSCLTFFITGVLGLVVGT

SEQ ID NO: 2590100 - protein, 25 aa, Entamoeba histolytica
YFINLLKAKWYCVVFVIVFIAFSMI

SEQ ID NO: 2590101 - protein, 35 aa, Entamoeba histolytica
YFINPIVILLCCFLIGTIILFFIKSRRKQNEVELE

SEQ ID NO: 2590102 - protein, 21 aa, Entamoeba histolytica
YFIRGLCVFTTILPDPSGRPS

SEQ ID NO: 2590103 - protein, 26 aa, Entamoeba histolytica
YFIRYFLVICIFFILACIGIICAVFT

SEQ ID NO: 2590104 - protein, 24 aa, Entamoeba histolytica
YFISACIFLVFSIILILTCLKLWG

SEQ ID NO: 2590105 - protein, 17 aa, Entamoeba histolytica
YFISFKLDCLLNKICGR

SEQ ID NO: 2590106 - protein, 21 aa, Entamoeba histolytica
YFIVFCLLLFIWIQPLQITIS

SEQ ID NO: 2590107 - protein, 22 aa, Entamoeba histolytica
YFIVFCLLLFIWIQPLQITISA

SEQ ID NO: 2590108 - protein, 17 aa, Entamoeba histolytica
YFIYKAIIEPSGIILKE

SEQ ID NO: 2590109 - protein, 21 aa, Entamoeba histolytica
YFKEELIDYIINCIAPGLDPI

SEQ ID NO: 2590110 - protein, 25 aa, Entamoeba histolytica
YFKLYGYSCCPCFIPPPCSPANSHR

SEQ ID NO: 2590111 - protein, 22 aa, Entamoeba histolytica
YFLCNACSQLIPIFKVGMTFTY

SEQ ID NO: 2590112 - protein, 25 aa, Entamoeba histolytica
YFLYKRKIWLCSLFFGLSIHMKIYP

SEQ ID NO: 2590113 - protein, 19 aa, Entamoeba histolytica
YFMLCKDVPYISYKSPIFF

SEQ ID NO: 2590114 - protein, 23 aa, Entamoeba histolytica
YFNCFGGSISFEITLLQIVVNLK

SEQ ID NO: 2590115 - protein, 17 aa, Entamoeba histolytica
YFNEIVFISLLYSIALL

SEQ ID NO: 2590116 - protein, 23 aa, Entamoeba histolytica
YFNSLWMIMCLLPPPQSFIDQFK

SEQ ID NO: 2590117 - protein, 23 aa, Entamoeba histolytica
YFNVSGLDTWYGLQFFEPLRDTP

SEQ ID NO: 2590118 - protein, 19 aa, Entamoeba histolytica
YFRFCKELFVSDLTPNLGL

SEQ ID NO: 2590119 - protein, 25 aa, Entamoeba histolytica
YFRKWKYRSHFTILEVVFLLGCIIF

SEQ ID NO: 2590120 - protein, 17 aa, Entamoeba histolytica
YFRYFFMHWCDSVQFAF

SEQ ID NO: 2590121 - protein, 19 aa, Entamoeba histolytica
YFSAFIFNKMKGINVSSTF

SEQ ID NO: 2590122 - protein, 23 aa, Entamoeba histolytica
YFSCFGKILICGETVVREDQSIT

SEQ ID NO: 2590123 - protein, 24 aa, Entamoeba histolytica
YFSIITCSLFYLLIAVCGDLSFDK

SEQ ID NO: 2590124 - protein, 18 aa, Entamoeba histolytica
YFSSFTSLFVFTSSLLNH

SEQ ID NO: 2590125 - protein, 22 aa, Entamoeba histolytica
YFTELINALGLKEVKTPEQICT

SEQ ID NO: 2590126 - protein, 17 aa, Entamoeba histolytica
YFTRRFVELQILNEQSI

SEQ ID NO: 2590127 - protein, 18 aa, Entamoeba histolytica
YFVITMIGIIVFIINYTI

SEQ ID NO: 2590128 - protein, 18 aa, Entamoeba histolytica
YFVIVMCFCFYQIKNDLA

SEQ ID NO: 2590129 - protein, 24 aa, Entamoeba histolytica
YFYNSLKMKMSILIGVTHMTIGIW

SEQ ID NO: 2590130 - protein, 20 aa, Entamoeba histolytica
YGADALRLSLINSPAVRAET

SEQ ID NO: 2590131 - protein, 19 aa, Entamoeba histolytica
YGCAICKNGYFVSNLTCFH

SEQ ID NO: 2590132 - protein, 19 aa, Entamoeba histolytica
YGCKRCLDGYYLTTNMKCS

SEQ ID NO: 2590133 - protein, 17 aa, Entamoeba histolytica
YGCQRCVDGYFLNSDLM

SEQ ID NO: 2590134 - protein, 17 aa, Entamoeba histolytica
YGDACSSGCILPDICER

SEQ ID NO: 2590135 - protein, 26 aa, Entamoeba histolytica
YGDCLKIFNMFIVISIIFSGIMFILS

SEQ ID NO: 2590136 - protein, 23 aa, Entamoeba histolytica
YGEPSVKRYVPFALALTSIGKPK

SEQ ID NO: 2590137 - protein, 17 aa, Entamoeba histolytica
YGFEMIKKRGGIKSIQK

SEQ ID NO: 2590138 - protein, 21 aa, Entamoeba histolytica
YGFHCYQCSSTHYLENGICKE

SEQ ID NO: 2590139 - protein, 17 aa, Entamoeba histolytica
YGGESCILKCWHNNTWQ

SEQ ID NO: 2590140 - protein, 17 aa, Entamoeba histolytica
YGGFILYFYIIFQCGYD

SEQ ID NO: 2590141 - protein, 25 aa, Entamoeba histolytica
YGGIMSVYCIYKLMNCIIHVIGLTH

SEQ ID NO: 2590142 - protein, 18 aa, Entamoeba histolytica
YGGPCFNLLIGLGGGVLA

SEQ ID NO: 2590143 - protein, 23 aa, Entamoeba histolytica
YGIRSEPQLAFIKPGNAVEFNLF

SEQ ID NO: 2590144 - protein, 18 aa, Entamoeba histolytica
YGKHILKLKNKSVIYSDT

SEQ ID NO: 2590145 - protein, 26 aa, Entamoeba histolytica
YGKIHFLKHYIHIHRILQIQSQQVND

SEQ ID NO: 2590146 - protein, 18 aa, Entamoeba histolytica
YGLIGAVCSVTFGETVQT

SEQ ID NO: 2590147 - protein, 17 aa, Entamoeba histolytica
YGLNGLIVISSNTRECS

SEQ ID NO: 2590148 - protein, 21 aa, Entamoeba histolytica
YGMTYSLLWINYLVDQFFFRV

SEQ ID NO: 2590149 - protein, 24 aa, Entamoeba histolytica
YGNEGFLLMILYYLGCYITLSKLQ

SEQ ID NO: 2590150 - protein, 25 aa, Entamoeba histolytica
YGNLISGDFFILWKLVDVSHSSNFE

SEQ ID NO: 2590151 - protein, 19 aa, Entamoeba histolytica
YGSCLRCKDGYYASNGICK

SEQ ID NO: 2590152 - protein, 17 aa, Entamoeba histolytica
YGSFSCIDIEIYKKVIT

SEQ ID NO: 2590153 - protein, 19 aa, Entamoeba histolytica
YGVSLSFFETFRFNYNYTE

SEQ ID NO: 2590154 - protein, 19 aa, Entamoeba histolytica
YGYDLGISILESYRYNYNY

SEQ ID NO: 2590155 - protein, 19 aa, Entamoeba histolytica
YGYSLSLSFLESFRYNYNY

SEQ ID NO: 2590156 - protein, 17 aa, Entamoeba histolytica
YHCKKCGYCIEKRDHHC

SEQ ID NO: 2590157 - protein, 25 aa, Entamoeba histolytica
YHCYSKRFIEFLPFQVYGLASVYSY

SEQ ID NO: 2590158 - protein, 19 aa, Entamoeba histolytica
YHFLTLSLFTFFFIISLSL

SEQ ID NO: 2590159 - protein, 26 aa, Entamoeba histolytica
YHFNYKTVFVKSRILLGILGIVIVLF

SEQ ID NO: 2590160 - protein, 18 aa, Entamoeba histolytica
YHFQCGYSVFNIILTFLF

SEQ ID NO: 2590161 - protein, 25 aa, Entamoeba histolytica
YHNELVCRVVLLLLSYVIKEEYNEI

SEQ ID NO: 2590162 - protein, 25 aa, Entamoeba histolytica
YHPFYEIMRRMLLSIYELCPTLSNQ

SEQ ID NO: 2590163 - protein, 17 aa, Entamoeba histolytica
YHPGNDIFLSFYSHLVD

SEQ ID NO: 2590164 - protein, 22 aa, Entamoeba histolytica
YHSIILKNHFKSIDQYTSQFII

SEQ ID NO: 2590165 - protein, 24 aa, Entamoeba histolytica
YHVPSARTSWEFSNQAMKILETAG

SEQ ID NO: 2590166 - protein, 17 aa, Entamoeba histolytica
YIALTGNASLIPAIDTF

SEQ ID NO: 2590167 - protein, 24 aa, Entamoeba histolytica
YIANCKRFIGSVCIKCNDGYFIQS

SEQ ID NO: 2590168 - protein, 17 aa, Entamoeba histolytica
YIDLCVLRNKFPSSVSL

SEQ ID NO: 2590169 - protein, 22 aa, Entamoeba histolytica
YIDLKRMDLVFNKDPSITSGLE

SEQ ID NO: 2590170 - protein, 24 aa, Entamoeba histolytica
YIEARSILTYNILQYLNVALNNYF

SEQ ID NO: 2590171 - protein, 20 aa, Entamoeba histolytica
YIEDIIIDVVYSFKLFNTIR

SEQ ID NO: 2590172 - protein, 24 aa, Entamoeba histolytica
YIEMKRDFVAMLRKNESVNMIKEW

SEQ ID NO: 2590173 - protein, 24 aa, Entamoeba histolytica
YIFGGCGFLLFYFICSVIVDLVIE

SEQ ID NO: 2590174 - protein, 17 aa, Entamoeba histolytica
YIFTFSLLIFIVLSMIY

SEQ ID NO: 2590175 - protein, 18 aa, Entamoeba histolytica
YIFYLLFNCCLLNILSVF

SEQ ID NO: 2590176 - protein, 22 aa, Entamoeba histolytica
YIFYYFALVFAFFFPSFTVHYI

SEQ ID NO: 2590177 - protein, 17 aa, Entamoeba histolytica
YIGIAIVLFCTILCELV

SEQ ID NO: 2590178 - protein, 22 aa, Entamoeba histolytica
YIHIICLLLVFLLSISILCNVQ

SEQ ID NO: 2590179 - protein, 24 aa, Entamoeba histolytica
YIHKYSYCCGNVLVSNCHEIELLN

SEQ ID NO: 2590180 - protein, 20 aa, Entamoeba histolytica
YIHNNIHLIAETTTSSQGAK

SEQ ID NO: 2590181 - protein, 17 aa, Entamoeba histolytica
YIHQVLDGLAFIHDQGI

SEQ ID NO: 2590182 - protein, 24 aa, Entamoeba histolytica
YIHSCVYIGFSQCFPVLVSWTQIM

SEQ ID NO: 2590183 - protein, 18 aa, Entamoeba histolytica
YIIASKLPVSLCNHKEIM

SEQ ID NO: 2590184 - protein, 17 aa, Entamoeba histolytica
YIICVPLVKPTFLRCLE

SEQ ID NO: 2590185 - protein, 27 aa, Entamoeba histolytica
YIIKKGRYGIIGIWIIIALCCSYFALN

SEQ ID NO: 2590186 - protein, 22 aa, Entamoeba histolytica
YIITFPFLFGVMFGDIGHGIIV

SEQ ID NO: 2590187 - protein, 18 aa, Entamoeba histolytica
YIIYSIYLMIAFRPKKII

SEQ ID NO: 2590188 - protein, 19 aa, Entamoeba histolytica
YIKHFFTKMHFDFITIGCL

SEQ ID NO: 2590189 - protein, 18 aa, Entamoeba histolytica
YIKSLKLSVKESVLDYAK

SEQ ID NO: 2590190 - protein, 25 aa, Entamoeba histolytica
YIKYGGWVYFTLVMLFFFISSFLLI

SEQ ID NO: 2590191 - protein, 19 aa, Entamoeba histolytica
YIKYISIVFNNVFSLFVKV

SEQ ID NO: 2590192 - protein, 22 aa, Entamoeba histolytica
YILCTFGIIFGFIAGFDLEENM

SEQ ID NO: 2590193 - protein, 18 aa, Entamoeba histolytica
YILPYSICPYQHQRGINE

SEQ ID NO: 2590194 - protein, 25 aa, Entamoeba histolytica
YILQFGLCYLIFPIVQTYSIVGDFT

SEQ ID NO: 2590195 - protein, 19 aa, Entamoeba histolytica
YILSISWSSVLYLIQDLGL

SEQ ID NO: 2590196 - protein, 23 aa, Entamoeba histolytica
YILSMIACGFSIPKVSLASLAKE

SEQ ID NO: 2590197 - protein, 19 aa, Entamoeba histolytica
YILSPRITSVIYPKTPYYL

SEQ ID NO: 2590198 - protein, 43 aa, Entamoeba histolytica
YILSTICFAFGFALYYDWKLALCVIAVFPIHTLILFFDFKLNS

SEQ ID NO: 2590199 - protein, 19 aa, Entamoeba histolytica
YINGFKAKMGDEFKKILKE

SEQ ID NO: 2590200 - protein, 28 aa, Entamoeba histolytica
YINLLFMPYCSFNIQIPFQIIIVEDNIK

SEQ ID NO: 2590201 - protein, 25 aa, Entamoeba histolytica
YINMVRLNLFSGFYEYYVLVFLFSF

SEQ ID NO: 2590202 - protein, 18 aa, Entamoeba histolytica
YINSGHCVECKEGYYLVI

SEQ ID NO: 2590203 - protein, 19 aa, Entamoeba histolytica
YINSVECPQAIMTTNTIIE

SEQ ID NO: 2590204 - protein, 19 aa, Entamoeba histolytica
YIPESKAGITVHSFSMKTS

SEQ ID NO: 2590205 - protein, 20 aa, Entamoeba histolytica
YIPICVIAIISIYQKNIEKG

SEQ ID NO: 2590206 - protein, 20 aa, Entamoeba histolytica
YIPKKWKIYQLWNGRVIIFI

SEQ ID NO: 2590207 - protein, 17 aa, Entamoeba histolytica
YIQEYFVSVITFIICGI

SEQ ID NO: 2590208 - protein, 22 aa, Entamoeba histolytica
YIREDNEIFLLMIELLSMNLHN

SEQ ID NO: 2590209 - protein, 18 aa, Entamoeba histolytica
YIRYETVPPSSLPDSTEI

SEQ ID NO: 2590210 - protein, 28 aa, Entamoeba histolytica
YISCWRYPRIEMFFKFLCCTETRDHPLR

SEQ ID NO: 2590211 - protein, 17 aa, Entamoeba histolytica
YISETKIPLWKDEKDKR

SEQ ID NO: 2590212 - protein, 18 aa, Entamoeba histolytica
YITGTTMPLMYIIFLTCN

SEQ ID NO: 2590213 - protein, 32 aa, Entamoeba histolytica
YITLAPMQVKFLWLCLCNIPSSSSLLEIIPLI

SEQ ID NO: 2590214 - protein, 24 aa, Entamoeba histolytica
YITSDIFYVIGFVVWTIGINMIQL

SEQ ID NO: 2590215 - protein, 17 aa, Entamoeba histolytica
YIVCSGLIKVSYGKVTL

SEQ ID NO: 2590216 - protein, 26 aa, Entamoeba histolytica
YIVGFIICLLLFFRLTKKIKQEIEDE

SEQ ID NO: 2590217 - protein, 19 aa, Entamoeba histolytica
YIVGMMLFSFIVLINIVYM

SEQ ID NO: 2590218 - protein, 32 aa, Entamoeba histolytica
YIVRLCPFTMSFIRSRIQSVKVILTVGLIMTL

SEQ ID NO: 2590219 - protein, 21 aa, Entamoeba histolytica
YIVSCFRRLACHHIHVSGKIW

SEQ ID NO: 2590220 - protein, 17 aa, Entamoeba histolytica
YIVYGIAMLICIGLCIL

SEQ ID NO: 2590221 - protein, 33 aa, Entamoeba histolytica
YIYFFKGRLWFTLEFISFIGMFYSFITLHFILV

SEQ ID NO: 2590222 - protein, 25 aa, Entamoeba histolytica
YIYGKWFKLNMNFSGYISIETVFHY

SEQ ID NO: 2590223 - protein, 25 aa, Entamoeba histolytica
YKCDEVFKTPKKCTFKTGETDIDFN

SEQ ID NO: 2590224 - protein, 20 aa, Entamoeba histolytica
YKDQFPISGIFEVHQHVEIN

SEQ ID NO: 2590225 - protein, 19 aa, Entamoeba histolytica
YKERKEFGEHVLIQVICEN

SEQ ID NO: 2590226 - protein, 29 aa, Entamoeba histolytica
YKEVIMPNFLFLIKICLRIKDIYKVLDYE

SEQ ID NO: 2590227 - protein, 19 aa, Entamoeba histolytica
YKFPLNFEDSYSCGSENYK

SEQ ID NO: 2590228 - protein, 17 aa, Entamoeba histolytica
YKFTLNLEIGIEAIDYE

SEQ ID NO: 2590229 - protein, 17 aa, Entamoeba histolytica
YKIEKEYAYVVTVLITL

SEQ ID NO: 2590230 - protein, 24 aa, Entamoeba histolytica
YKIIPDSVFIEWMIKYDNAKSLIV

SEQ ID NO: 2590231 - protein, 17 aa, Entamoeba histolytica
YKIKDFIIFGIPLMILS

SEQ ID NO: 2590232 - protein, 19 aa, Entamoeba histolytica
YKILKKLDVDYVLVIFGGV

SEQ ID NO: 2590233 - protein, 19 aa, Entamoeba histolytica
YKITLNGGIKIISNEPGYT

SEQ ID NO: 2590234 - protein, 25 aa, Entamoeba histolytica
YKKETSSCLFEWRGKCWKCNDGYYM

SEQ ID NO: 2590235 - protein, 27 aa, Entamoeba histolytica
YKKLPETLVFHLKRFGYNEQFQIVKYN

SEQ ID NO: 2590236 - protein, 27 aa, Entamoeba histolytica
YKLDLRIIRALYDLGFINPTEIQQLSI

SEQ ID NO: 2590237 - protein, 25 aa, Entamoeba histolytica
YKLGLTVRETCRFNYNYNETIPREF

SEQ ID NO: 2590238 - protein, 18 aa, Entamoeba histolytica
YKLGRIPYLYLVIVALFT

SEQ ID NO: 2590239 - protein, 22 aa, Entamoeba histolytica
YKLKIKMLFDTARGMEFLHENN

SEQ ID NO: 2590240 - protein, 25 aa, Entamoeba histolytica
YKLKKLRAKRNIKEFPSSFNPINLP

SEQ ID NO: 2590241 - protein, 17 aa, Entamoeba histolytica
YKLLFLLIVNLLFFLCE

SEQ ID NO: 2590242 - protein, 19 aa, Entamoeba histolytica
YKLLHIIPFDSDRKRMSVI

SEQ ID NO: 2590243 - protein, 21 aa, Entamoeba histolytica
YKLMNCIIHVIGLTHSDGSSW

SEQ ID NO: 2590244 - protein, 22 aa, Entamoeba histolytica
YKLRMLKALHLYETIFLGKNNN

SEQ ID NO: 2590245 - protein, 20 aa, Entamoeba histolytica
YKMVLLVRKDLKMQKGKIAA

SEQ ID NO: 2590246 - protein, 27 aa, Entamoeba histolytica
YKNASFFLILLWYSFISNFTCQVVFDD

SEQ ID NO: 2590247 - protein, 25 aa, Entamoeba histolytica
YKNCDANPTALAFDMCTLRSDITSI

SEQ ID NO: 2590248 - protein, 21 aa, Entamoeba histolytica
YKNEVIGLLLLGFIYTVHCFF

SEQ ID NO: 2590249 - protein, 28 aa, Entamoeba histolytica
YKNKDYISSISFCWWLLNGILSSITIFF

SEQ ID NO: 2590250 - protein, 23 aa, Entamoeba histolytica
YKNVAFILMQFWFGIQNAFSGQS

SEQ ID NO: 2590251 - protein, 25 aa, Entamoeba histolytica
YKPTELGDYCEFHLNVLIVILPIIG

SEQ ID NO: 2590252 - protein, 23 aa, Entamoeba histolytica
YKQYQMYIGITGFIIITTILLLI

SEQ ID NO: 2590253 - protein, 17 aa, Entamoeba histolytica
YKSIKLISCDPLEDTTI

SEQ ID NO: 2590254 - protein, 19 aa, Entamoeba histolytica
YKSLEEWYIHNDIPNNKQQ

SEQ ID NO: 2590255 - protein, 20 aa, Entamoeba histolytica
YKSLNAIILLIRIFQQIGDF

SEQ ID NO: 2590256 - protein, 18 aa, Entamoeba histolytica
YKSMKCSVIVIPKTSKEV

SEQ ID NO: 2590257 - protein, 19 aa, Entamoeba histolytica
YKTLLLWVIEALIVSTMVF

SEQ ID NO: 2590258 - protein, 23 aa, Entamoeba histolytica
YKTTFSIHGSFIFYHELLPQIFI

SEQ ID NO: 2590259 - protein, 21 aa, Entamoeba histolytica
YKVVNDYKYAFPLFIQANVLL

SEQ ID NO: 2590260 - protein, 18 aa, Entamoeba histolytica
YKYAFPLFIQANVLLASS

SEQ ID NO: 2590261 - protein, 19 aa, Entamoeba histolytica
YKYAFPLFIQTNVLLASST

SEQ ID NO: 2590262 - protein, 17 aa, Entamoeba histolytica
YKYIKNWWIHRKDEKQP

SEQ ID NO: 2590263 - protein, 24 aa, Entamoeba histolytica
YKYKSRLYMLLWGIWFYCSEQTEV

SEQ ID NO: 2590264 - protein, 17 aa, Entamoeba histolytica
YKYRSLLPMIGNTKIGA

SEQ ID NO: 2590265 - protein, 17 aa, Entamoeba histolytica
YKYTYVLHYTASSSSGN

SEQ ID NO: 2590266 - protein, 23 aa, Entamoeba histolytica
YLCECLFNLSLILKEHIGNPVVY

SEQ ID NO: 2590267 - protein, 18 aa, Entamoeba histolytica
YLCSSGICVLDYSKSNQT

SEQ ID NO: 2590268 - protein, 17 aa, Entamoeba histolytica
YLDDSMKCVNCPDNCTS

SEQ ID NO: 2590269 - protein, 26 aa, Entamoeba histolytica
YLDGFGYRYTEHWVLDNSKPTFSYSI

SEQ ID NO: 2590270 - protein, 20 aa, Entamoeba histolytica
YLDKAIESFSQFNTLNKTTL

SEQ ID NO: 2590271 - protein, 24 aa, Entamoeba histolytica
YLDLFRMLITFIGNSIGFVRMIRT

SEQ ID NO: 2590272 - protein, 18 aa, Entamoeba histolytica
YLDNALRPYVVKCGESNY

SEQ ID NO: 2590273 - protein, 17 aa, Entamoeba histolytica
YLDQSIVARDWMDIYSP

SEQ ID NO: 2590274 - protein, 32 aa, Entamoeba histolytica; identical to SEQ ID NO: 2392628

SEQ ID NO: 2590275 - protein, 18 aa, Entamoeba histolytica
YLEKQAQNGFGFIENIKE

SEQ ID NO: 2590276 - protein, 20 aa, Entamoeba histolytica
YLELLYCYNSYWIVLVCMVI

SEQ ID NO: 2590277 - protein, 25 aa, Entamoeba histolytica
YLFDILLRFLHFVFPAKIISKEVTK

SEQ ID NO: 2590278 - protein, 38 aa, Entamoeba histolytica
YLGFLVVVMVFRFFLCKGRLIVLRRFVTLMGVMFLMRI

SEQ ID NO: 2590279 - protein, 17 aa, Entamoeba histolytica
YLGRKGHELRQKNINLY

SEQ ID NO: 2590280 - protein, 23 aa, Entamoeba histolytica
YLHCEWAYPIKFTVIPRPVRKNN

SEQ ID NO: 2590281 - protein, 17 aa, Entamoeba histolytica
YLHCPMVDYWIPENRAL

SEQ ID NO: 2590282 - protein, 18 aa, Entamoeba histolytica
YLHILFKMVHHSLLSEIQ

SEQ ID NO: 2590283 - protein, 25 aa, Entamoeba histolytica
YLIFLVKPYVNWSRMYLEINELIDG

SEQ ID NO: 2590284 - protein, 23 aa, Entamoeba histolytica
YLILCLIIKLVMIASAIIFSKSE

SEQ ID NO: 2590285 - protein, 26 aa, Entamoeba histolytica
YLINKRFSYFFFHWSDLIRTAFFHII

SEQ ID NO: 2590286 - protein, 18 aa, Entamoeba histolytica
YLIVISIEDINHVFNTTD

SEQ ID NO: 2590287 - protein, 21 aa, Entamoeba histolytica
YLIVSCCFVLFALGLVGSLYI

SEQ ID NO: 2590288 - protein, 29 aa, Entamoeba histolytica
YLKECTKIKWKQCISFDNCHRILPTLSLR

SEQ ID NO: 2590289 - protein, 20 aa, Entamoeba histolytica
YLKHFSVIVKFILINKKCWD

SEQ ID NO: 2590290 - protein, 19 aa, Entamoeba histolytica
YLLAKYCWEKVYASKNNQL

SEQ ID NO: 2590291 - protein, 28 aa, Entamoeba histolytica
YLLCCIKLHPMIRFIFFIISFLIGLTAL

SEQ ID NO: 2590292 - protein, 21 aa, Entamoeba histolytica
YLLESLGFAFVLPMESSQTIG

SEQ ID NO: 2590293 - protein, 23 aa, Entamoeba histolytica
YLLFALQVSFRFSSVTILSYLFL

SEQ ID NO: 2590294 - protein, 18 aa, Entamoeba histolytica
YLLFTIAMACCVVLCILS

SEQ ID NO: 2590295 - protein, 20 aa, Entamoeba histolytica
YLLMEMNIFITIFVGFAVWA

SEQ ID NO: 2590296 - protein, 26 aa, Entamoeba histolytica
YLLPSCTFFLGFSFIFGNYMKRVWES

SEQ ID NO: 2590297 - protein, 23 aa, Entamoeba histolytica
YLLSKWLLKYLKVRDIEKQLNIF

SEQ ID NO: 2590298 - protein, 18 aa, Entamoeba histolytica
YLLVPLILMFGLCFLYVS

SEQ ID NO: 2590299 - protein, 18 aa, Entamoeba histolytica
YLMIAFRPKKIISSSDEP

SEQ ID NO: 2590300 - protein, 28 aa, Entamoeba histolytica
YLMNKKIVWRDIINRMILDKESLLAKNQ

SEQ ID NO: 2590301 - protein, 17 aa, Entamoeba histolytica
YLMTCIFVAFNKVYTMQ

SEQ ID NO: 2590302 - protein, 18 aa, Entamoeba histolytica
YLMTCIFVAFNKVYTMQY

SEQ ID NO: 2590303 - protein, 25 aa, Entamoeba histolytica
YLNGFKMKFEIKVHVFFGTITLNAE

SEQ ID NO: 2590304 - protein, 23 aa, Entamoeba histolytica
YLNNCGRCGCLILILHDIVDAIM

SEQ ID NO: 2590305 - protein, 29 aa, Entamoeba histolytica
YLNTLPSWRWYYKFHYAPFALDFALYLNE

SEQ ID NO: 2590306 - protein, 25 aa, Entamoeba histolytica
YLPHISIICAIVFAAYPTIYTTPEI

SEQ ID NO: 2590307 - protein, 25 aa, Entamoeba histolytica
YLPKDFDKGLSMRFGKAYLLSNKKL

SEQ ID NO: 2590308 - protein, 18 aa, Entamoeba histolytica
YLPKDFDKGLSMTDGTAY

SEQ ID NO: 2590309 - protein, 17 aa, Entamoeba histolytica
YLPLAHIFELCLEFCIL

SEQ ID NO: 2590310 - protein, 20 aa, Entamoeba histolytica
YLPLRKHYTLGYTVLAIILP

SEQ ID NO: 2590311 - protein, 24 aa, Entamoeba histolytica
YLPRPFHEYPFKTTMALSREECAI

SEQ ID NO: 2590312 - protein, 24 aa, Entamoeba histolytica
  misc_feature (22)..(24): Xaa can be any naturally occurring amino acid
YLPRPFHEYPFKTTMALSREEXXX

SEQ ID NO: 2590313 - protein, 23 aa, Entamoeba histolytica
YLPRRISNQLLLKEGDELYVSIS

SEQ ID NO: 2590314 - protein, 18 aa, Entamoeba histolytica
YLQISLLSLYCKLGQAIG

SEQ ID NO: 2590315 - protein, 24 aa, Entamoeba histolytica
YLQLPRTFGELGVNEIRQRIDPQY

SEQ ID NO: 2590316 - protein, 22 aa, Entamoeba histolytica
YLRHPSYFGWFWWSVTTQIVML

SEQ ID NO: 2590317 - protein, 23 aa, Entamoeba histolytica
YLRIKFVLDCAKGIQYLHTNGIM

SEQ ID NO: 2590318 - protein, 20 aa, Entamoeba histolytica
YLRQLMKLKNGFERIKANLF

SEQ ID NO: 2590319 - protein, 19 aa, Entamoeba histolytica
YLSAPRCILFFTGNPSLLA

SEQ ID NO: 2590320 - protein, 25 aa, Entamoeba histolytica
YLSDECKYCKTPCGSGCCTKISSSM

SEQ ID NO: 2590321 - protein, 24 aa, Entamoeba histolytica
YLSDLRLGMHYPLGSVVMLTNTAD

SEQ ID NO: 2590322 - protein, 18 aa, Entamoeba histolytica
YLSLPALLLTYIDFIIAA

SEQ ID NO: 2590323 - protein, 17 aa, Entamoeba histolytica
YLSMVVFVILNLIGLII

SEQ ID NO: 2590324 - protein, 18 aa, Entamoeba histolytica
YLSSPSLVCRSLVRLQPY

SEQ ID NO: 2590325 - protein, 19 aa, Entamoeba histolytica
YLSSTAFKFEAVRMYGNSF

SEQ ID NO: 2590326 - protein, 17 aa, Entamoeba histolytica
YLTFMLQLFVTHPLTED

SEQ ID NO: 2590327 - protein, 18 aa, Entamoeba histolytica
YLTLEYKGIQNFLMTNIA

SEQ ID NO: 2590328 - protein, 26 aa, Entamoeba histolytica
YLTNKLTIWYKIRCINIDIDKATTIM

SEQ ID NO: 2590329 - protein, 21 aa, Entamoeba histolytica
YLVIAVLCFIQSLRIVKNHHK

SEQ ID NO: 2590330 - protein, 26 aa, Entamoeba histolytica
YLVICWSCTFSLIFLINIIVPGKSPR

SEQ ID NO: 2590331 - protein, 19 aa, Entamoeba histolytica
YLVKWKLFRSLALEDLKKT

SEQ ID NO: 2590332 - protein, 18 aa, Entamoeba histolytica
YLVWCMFLVLLVSLYGLH

SEQ ID NO: 2590333 - protein, 22 aa, Entamoeba histolytica
YLVYKNPLLLNAINHFIPTKTS

SEQ ID NO: 2590334 - protein, 24 aa, Entamoeba histolytica
YLYYFCKAGNMGICENEKELIKKV

SEQ ID NO: 2590335 - protein, 18 aa, Entamoeba histolytica
YMAMGTCVYYCTIPTKLN

SEQ ID NO: 2590336 - protein, 17 aa, Entamoeba histolytica
YMDKLGLMNYLSLKTIK

SEQ ID NO: 2590337 - protein, 21 aa, Entamoeba histolytica
YMFIVCPAFLLSGISSLLFIF

SEQ ID NO: 2590338 - protein, 23 aa, Entamoeba histolytica
YMIPIPWNRWVILACSIARCVFY

SEQ ID NO: 2590339 - protein, 19 aa, Entamoeba histolytica
YMLHYHFQIDLGEIPLTSD

SEQ ID NO: 2590340 - protein, 20 aa, Entamoeba histolytica
YMRLKCPHAQFTLAKDEFVE

SEQ ID NO: 2590341 - protein, 21 aa, Entamoeba histolytica
YMRLKCPHAQFTLAKDEFVEG

SEQ ID NO: 2590342 - protein, 20 aa, Entamoeba histolytica
YMRLKCPHAQFTLAKDYLVG

SEQ ID NO: 2590343 - protein, 17 aa, Entamoeba histolytica
YMSVNSLCVPKCDIEGC

SEQ ID NO: 2590344 - protein, 18 aa, Entamoeba histolytica
YMVWGKKVCEAFRGINGV

SEQ ID NO: 2590345 - protein, 20 aa, Entamoeba histolytica
YMYMYFCIPLTKELYSQSNQ

SEQ ID NO: 2590346 - protein, 24 aa, Entamoeba histolytica
YNCSKFCKYCFDDLMKLISKTPKG

SEQ ID NO: 2590347 - protein, 21 aa, Entamoeba histolytica
YNDPFDLILHFNKVEFDQADV

SEQ ID NO: 2590348 - protein, 31 aa, Entamoeba histolytica; identical to SEQ ID NO: 2392693

SEQ ID NO: 2590349 - protein, 19 aa, Entamoeba histolytica
YNFMNYRVDGVLVITLFSL

SEQ ID NO: 2590350 - protein, 17 aa, Entamoeba histolytica
YNFRFLYVMLCGICVFI

SEQ ID NO: 2590351 - protein, 23 aa, Entamoeba histolytica
YNKDGECLSCNSIKPNCAVCNIT

SEQ ID NO: 2590352 - protein, 24 aa, Entamoeba histolytica
YNKKLIIFFLWFTFFFFLFIFYYK

SEQ ID NO: 2590353 - protein, 27 aa, Entamoeba histolytica
YNKYNWIKQNWLVLILVTGVFLLILMA

SEQ ID NO: 2590354 - protein, 19 aa, Entamoeba histolytica
YNLFPMIFFGLILFVLNSF

SEQ ID NO: 2590355 - protein, 17 aa, Entamoeba histolytica
YNLGISVGETYRYNYNY

SEQ ID NO: 2590356 - protein, 25 aa, Entamoeba histolytica
YNLIGRYPLLGNWKESFSISYEQLI

SEQ ID NO: 2590357 - protein, 17 aa, Entamoeba histolytica
YNLIPLQTFLGGTIIGK

SEQ ID NO: 2590358 - protein, 25 aa, Entamoeba histolytica
YNLKLRMLYDTARGMSFLHENNILH

SEQ ID NO: 2590359 - protein, 17 aa, Entamoeba histolytica
YNLRIGLNQTIKGFFNS

SEQ ID NO: 2590360 - protein, 24 aa, Entamoeba histolytica
YNLTSRCPGCFITFSSYFIDPFWE

SEQ ID NO: 2590361 - protein, 22 aa, Entamoeba histolytica
YNNRVKIPITFYSKNKEKMMYI

SEQ ID NO: 2590362 - protein, 21 aa, Entamoeba histolytica
YNPKLSEIDLLYSANLTNAKC

SEQ ID NO: 2590363 - protein, 19 aa, Entamoeba histolytica
YNQIPVCGDSVWNQYYEQC

SEQ ID NO: 2590364 - protein, 19 aa, Entamoeba histolytica
YNSEFFYPNEVCPYTVRRG

SEQ ID NO: 2590365 - protein, 17 aa, Entamoeba histolytica
YNSLPFVPKKILGICCT

SEQ ID NO: 2590366 - protein, 18 aa, Entamoeba histolytica
YNVLKGLTVGLGLGAVMF

SEQ ID NO: 2590367 - protein, 23 aa, Entamoeba histolytica
YNVRKTFYTNWPYKSKNDIHAVR

SEQ ID NO: 2590368 - protein, 25 aa, Entamoeba histolytica
YNYRRLSYVILYSFYKNIVMYLTQF

SEQ ID NO: 2590369 - protein, 19 aa, Entamoeba histolytica
YNYTRMSAIFFGKGGKMTS

SEQ ID NO: 2590370 - protein, 20 aa, Entamoeba histolytica
YPAIFGKITIFKRFPALLPQ

SEQ ID NO: 2590371 - protein, 27 aa, Entamoeba histolytica
YPARYCIYCSHFLPPRAYHCVICNKCT

SEQ ID NO: 2590372 - protein, 17 aa, Entamoeba histolytica
YPDCHYLSYLFDLSLNI

SEQ ID NO: 2590373 - protein, 20 aa, Entamoeba histolytica
YPDFDRLGGTISYIQKTFPL

SEQ ID NO: 2590374 - protein, 20 aa, Entamoeba histolytica
YPECKSYTTSIIIISVIGGI

SEQ ID NO: 2590375 - protein, 24 aa, Entamoeba histolytica
YPEKEFPYIWNIASFIADGKRRPK

SEQ ID NO: 2590376 - protein, 26 aa, Entamoeba histolytica
YPEMKSLCPHTPFFLIATQSEKRNKC

SEQ ID NO: 2590377 - protein, 25 aa, Entamoeba histolytica
YPFKENRPLDFIYFTDVGVYKFYCM

SEQ ID NO: 2590378 - protein, 17 aa, Entamoeba histolytica
YPFYRKLNKLLFDLHDL

SEQ ID NO: 2590379 - protein, 19 aa, Entamoeba histolytica
YPHPWDIADTITIGKRPNI

SEQ ID NO: 2590380 - protein, 17 aa, Entamoeba histolytica
YPIECTKDLDGYYKYIQ

SEQ ID NO: 2590381 - protein, 25 aa, Entamoeba histolytica
YPIFLNWYNFFIAFGLVLMATFMKR

SEQ ID NO: 2590382 - protein, 20 aa, Entamoeba histolytica
YPIQLIWRGLYFINTYSYFR

SEQ ID NO: 2590383 - protein, 20 aa, Entamoeba histolytica
YPIREYQLDWSRIPSDTSKL

SEQ ID NO: 2590384 - protein, 27 aa, Entamoeba histolytica
YPKGVKSCSAILFWCYMFAILNIIFGV

SEQ ID NO: 2590385 - protein, 28 aa, Entamoeba histolytica
YPKSWELLKEYIIILFIIILSRTSYFWG

SEQ ID NO: 2590386 - protein, 20 aa, Entamoeba histolytica
YPLCLQCSWTTTSTSCVLCS

SEQ ID NO: 2590387 - protein, 17 aa, Entamoeba histolytica
YPLLSGISGSIGGLFSK

SEQ ID NO: 2590388 - protein, 18 aa, Entamoeba histolytica
YPLLSLFIAFILAIICIV

SEQ ID NO: 2590389 - protein, 17 aa, Entamoeba histolytica
YPLLYKLVSSLLKSRFS

SEQ ID NO: 2590390 - protein, 26 aa, Entamoeba histolytica
YPLNSCIDFSDYAAYFFYNNNTHMNF

SEQ ID NO: 2590391 - protein, 23 aa, Entamoeba histolytica
YPLRFTITKAIGWIVCIGGILLF

SEQ ID NO: 2590392 - protein, 21 aa, Entamoeba histolytica
YPSIIEFYGFIFFYPGLFSGP

SEQ ID NO: 2590393 - protein, 25 aa, Entamoeba histolytica
YPTFSGKLWPTGAMDFFTMAPFITA

SEQ ID NO: 2590394 - protein, 22 aa, Entamoeba histolytica
YPTRLSHRVLKGFNLEIKKGET

SEQ ID NO: 2590395 - protein, 26 aa, Entamoeba histolytica
YPVCIPNIIMKVILFEVEFDGDYSIL

SEQ ID NO: 2590396 - protein, 26 aa, Entamoeba histolytica
YPVEEFKFPWKIADFVCDGKRLLQPE

SEQ ID NO: 2590397 - protein, 17 aa, Entamoeba histolytica
YPVGDGFYFTFMMGLGI

SEQ ID NO: 2590398 - protein, 21 aa, Entamoeba histolytica
YPVHRYIASRFIWDIFCLFAI

SEQ ID NO: 2590399 - protein, 18 aa, Entamoeba histolytica
YPVILGMVYIISKLLLYN

SEQ ID NO: 2590400 - protein, 19 aa, Entamoeba histolytica
YPWEIADFISEGKRPRKED

SEQ ID NO: 2590401 - protein, 17 aa, Entamoeba histolytica
YQCFTVQDGINFKMKND

SEQ ID NO: 2590402 - protein, 26 aa, Entamoeba histolytica
YQELMKTIGISPVFICYMESMKKVKL

SEQ ID NO: 2590403 - protein, 17 aa, Entamoeba histolytica
YQFPFVIFNHLLEVPQT

SEQ ID NO: 2590404 - protein, 21 aa, Entamoeba histolytica
YQGHTLFIKWWRGSKSKSGVL

SEQ ID NO: 2590405 - protein, 23 aa, Entamoeba histolytica
YQGSFPSAHWVLYAILELIISNY

SEQ ID NO: 2590406 - protein, 17 aa, Entamoeba histolytica
YQGYIPLQFETELSTRL

SEQ ID NO: 2590407 - protein, 17 aa, Entamoeba histolytica
YQILRMKLSYYTKDLYR

SEQ ID NO: 2590408 - protein, 26 aa, Entamoeba histolytica
YQKKEFRIPISIFIDQQFLALMKLYH

SEQ ID NO: 2590409 - protein, 19 aa, Entamoeba histolytica
YQKNEFSDLLAYKMLNDVA

SEQ ID NO: 2590410 - protein, 21 aa, Entamoeba histolytica
YQKYPFCGRIIAGLELDVESS

SEQ ID NO: 2590411 - protein, 17 aa, Entamoeba histolytica
YQLIADMFICKGKVHVD

SEQ ID NO: 2590412 - protein, 20 aa, Entamoeba histolytica
YQLIGRVNWKVEVSVDGKLE

SEQ ID NO: 2590413 - protein, 25 aa, Entamoeba histolytica
YQLLKGLFLIYAFIIHYYRFSVIFI

SEQ ID NO: 2590414 - protein, 26 aa, Entamoeba histolytica
YQLNLWKNYLMYFPANMEIDLGLNKE

SEQ ID NO: 2590415 - protein, 26 aa, Entamoeba histolytica
YQLRPRYLFIPFIKLFDSLVFKKIKE

SEQ ID NO: 2590416 - protein, 17 aa, Entamoeba histolytica
YQLWNGRVIIFIIRCSI

SEQ ID NO: 2590417 - protein, 24 aa, Entamoeba histolytica
YQMASGLSIFGWLLAAVFIIAAAV

SEQ ID NO: 2590418 - protein, 17 aa, Entamoeba histolytica
YQPNGLGECIIQCLYGD

SEQ ID NO: 2590419 - protein, 22 aa, Entamoeba histolytica
YQRFSRCYSILLTIAYVKILLA

SEQ ID NO: 2590420 - protein, 23 aa, Entamoeba histolytica
YQRYVLKIFMLFSSQRSACSRML

SEQ ID NO: 2590421 - protein, 24 aa, Entamoeba histolytica
YQYMTICKLFESFSDILLTLLITF

SEQ ID NO: 2590422 - protein, 17 aa, Entamoeba histolytica
YRALYIINWIYRYATEQ

SEQ ID NO: 2590423 - protein, 17 aa, Entamoeba histolytica
YRCPGCTQGSYCPGNDI

SEQ ID NO: 2590424 - protein, 22 aa, Entamoeba histolytica
YREKMKLFGIFVAINVIFIVFV

SEQ ID NO: 2590425 - protein, 21 aa, Entamoeba histolytica
YRFKLDVIIVIIAFIGYIAYE

SEQ ID NO: 2590426 - protein, 25 aa, Entamoeba histolytica
YRFTEGFKKKEIVKLNSFDYYKGIT

SEQ ID NO: 2590427 - protein, 24 aa, Entamoeba histolytica
YRIKSQLSMKVARCYAQINNIVVH

SEQ ID NO: 2590428 - protein, 26 aa, Entamoeba histolytica
YRIPLYLEFYSMFSAGHFIIGLGDII

SEQ ID NO: 2590429 - protein, 27 aa, Entamoeba histolytica
YRKAPCGNGGYVQGFWVKFDSKAMEND

SEQ ID NO: 2590430 - protein, 19 aa, Entamoeba histolytica
YRKEIRLFWVSGQPIPQFI

SEQ ID NO: 2590431 - protein, 25 aa, Entamoeba histolytica
YRKKEPYQRIEFILTIGKSNEGTVT

SEQ ID NO: 2590432 - protein, 24 aa, Entamoeba histolytica
YRKKEPYQRIEFTLTIGKSNEGTV

SEQ ID NO: 2590433 - protein, 19 aa, Entamoeba histolytica
YRLPFPDFISPKMKNVIMK

SEQ ID NO: 2590434 - protein, 18 aa, Entamoeba histolytica
YRLSQGLCIGCPTERGEG

SEQ ID NO: 2590435 - protein, 21 aa, Entamoeba histolytica
YRNVLRLGFGILEFTLAISIG

SEQ ID NO: 2590436 - protein, 18 aa, Entamoeba histolytica
YRPMGIQVQQEFEGFSYS

SEQ ID NO: 2590437 - protein, 19 aa, Entamoeba histolytica
YRQKVLRSKGFGTVSPTTT

SEQ ID NO: 2590438 - protein, 24 aa, Entamoeba histolytica
YRQRLTRIWVFFIFPVVVNAYRCN

SEQ ID NO: 2590439 - protein, 19 aa, Entamoeba histolytica
YRRATYRYTPLLAEILIPD

SEQ ID NO: 2590440 - protein, 20 aa, Entamoeba histolytica
YRSDCLGCAEGYIPQGYLKC

SEQ ID NO: 2590441 - protein, 26 aa, Entamoeba histolytica
YRSWLHCLWVIFIGCSGILVLSFTFH

SEQ ID NO: 2590442 - protein, 22 aa, Entamoeba histolytica
YRTLGTILFNCRLSLYLPLFLK

SEQ ID NO: 2590443 - protein, 26 aa, Entamoeba histolytica
YRVGRKMIKQKGKWYRIHTNGLGNNI

SEQ ID NO: 2590444 - protein, 18 aa, Entamoeba histolytica
YRVIAIFDYILYILAEPT

SEQ ID NO: 2590445 - protein, 17 aa, Entamoeba histolytica
YSACALLTKGMWERGSA

SEQ ID NO: 2590446 - protein, 21 aa, Entamoeba histolytica
YSACDYVFHFLVRVEPFTTMF

SEQ ID NO: 2590447 - protein, 17 aa, Entamoeba histolytica
YSALKCPHAQFTEAKGY

SEQ ID NO: 2590448 - protein, 18 aa, Entamoeba histolytica
YSDFTIDLDVDFTPSFNW

SEQ ID NO: 2590449 - protein, 24 aa, Entamoeba histolytica
YSDRGCGINSRLIHQLSSDYDYFI

SEQ ID NO: 2590450 - protein, 25 aa, Entamoeba histolytica
YSEKARFDKLLLYASSCAAYYPEPQ

SEQ ID NO: 2590451 - protein, 27 aa, Entamoeba histolytica
YSFAILMYECINWCYAYPISMKTWNIA

SEQ ID NO: 2590452 - protein, 26 aa, Entamoeba histolytica
YSFFLKIPFIYRSVVNFILYTSCYFI

SEQ ID NO: 2590453 - protein, 17 aa, Entamoeba histolytica
YSFGISAWEVFYQDEPY

SEQ ID NO: 2590454 - protein, 25 aa, Entamoeba histolytica
YSFHTICIFILFVALVYRHTITLNW

SEQ ID NO: 2590455 - protein, 23 aa, Entamoeba histolytica
YSFPDNCRKVLSITKSWKETQSL

SEQ ID NO: 2590456 - protein, 18 aa, Entamoeba histolytica
YSFPFKFMLEQLMRFSNI

SEQ ID NO: 2590457 - protein, 28 aa, Entamoeba histolytica
YSGIKFVLRLSFIQSCLKSNQIIKKICD

SEQ ID NO: 2590458 - protein, 17 aa, Entamoeba histolytica
YSGSLIIEKGIGDYFNM

SEQ ID NO: 2590459 - protein, 18 aa, Entamoeba histolytica
YSHDPSFKYTASTCGTES

SEQ ID NO: 2590460 - protein, 20 aa, Entamoeba histolytica
YSHSQLRICVINNCKISIYQ

SEQ ID NO: 2590461 - protein, 27 aa, Entamoeba histolytica
YSIEYPHLYLLMEFMPKHSLFNVLHSN

SEQ ID NO: 2590462 - protein, 17 aa, Entamoeba histolytica
YSIKLSDICLGFNLSLN

SEQ ID NO: 2590463 - protein, 25 aa, Entamoeba histolytica
YSIPEFRFLVKLILVHGRYCYRQIG

SEQ ID NO: 2590464 - protein, 17 aa, Entamoeba histolytica
YSISIAIIFLVYLMLQI

SEQ ID NO: 2590465 - protein, 34 aa, Entamoeba histolytica
YSIVFRYFATWKMAECMGILFGFGYSGVKENKPT

SEQ ID NO: 2590466 - protein, 18 aa, Entamoeba histolytica
YSIYCFKQYINYNKKEMY

SEQ ID NO: 2590467 - protein, 20 aa, Entamoeba histolytica
YSKRECSKLILIDESEKGGR

SEQ ID NO: 2590468 - protein, 18 aa, Entamoeba histolytica
YSLAYLIPANLMFYIFRS

SEQ ID NO: 2590469 - protein, 17 aa, Entamoeba histolytica
YSLGIVLYYLIYLQFPF

SEQ ID NO: 2590470 - protein, 17 aa, Entamoeba histolytica
YSLMWKQKQIFIKTFTK

SEQ ID NO: 2590471 - protein, 26 aa, Entamoeba histolytica
YSMLLMFCIGIFWIIVGTLILISSES

SEQ ID NO: 2590472 - protein, 19 aa, Entamoeba histolytica
YSMMYKMCYHNFYKASNGY

SEQ ID NO: 2590473 - protein, 19 aa, Entamoeba histolytica
YSNAMIRNILEPMRMISVW

SEQ ID NO: 2590474 - protein, 22 aa, Entamoeba histolytica
YSNETKKVFNIFGTNQLVFDNN

SEQ ID NO: 2590475 - protein, 18 aa, Entamoeba histolytica
YSNHELKGVLTIYKNAEA

SEQ ID NO: 2590476 - protein, 26 aa, Entamoeba histolytica
YSNKHKRLYNVYNVHLKGEAIHEVSD

SEQ ID NO: 2590477 - protein, 22 aa, Entamoeba histolytica
YSQFKNCFTVPVLCNDKSQCTQ

SEQ ID NO: 2590478 - protein, 26 aa, Entamoeba histolytica
YSQMLDLFNYFGLRTGLMYIHCFMRR

SEQ ID NO: 2590479 - protein, 21 aa, Entamoeba histolytica
YSTETRLLLNLSKNNESILTI

SEQ ID NO: 2590480 - protein, 24 aa, Entamoeba histolytica
YSTLKRWVNESSFIGINAMSNDIA

SEQ ID NO: 2590481 - protein, 24 aa, Entamoeba histolytica
YSTTCLNGKCVVQAVGDVSNVGCG

SEQ ID NO: 2590482 - protein, 24 aa, Entamoeba histolytica
YSTTCLNGQCVVQAVGDVSNVGCG

SEQ ID NO: 2590483 - protein, 25 aa, Entamoeba histolytica
YSVFYYLTMQPWRNLEWTTIDSNFP

SEQ ID NO: 2590484 - protein, 30 aa, Entamoeba histolytica; identical to SEQ ID NO: 2392859

SEQ ID NO: 2590485 - protein, 20 aa, Entamoeba histolytica
YSVNCGIQLISGGTTLATKY

SEQ ID NO: 2590486 - protein, 26 aa, Entamoeba histolytica
YSYAIVMWEFLARADPYPDIPRFHLI

SEQ ID NO: 2590487 - protein, 17 aa, Entamoeba histolytica
YSYAVTMYECFKWGNAF

SEQ ID NO: 2590488 - protein, 19 aa, Entamoeba histolytica
YSYFFKTLIKFSLTNEKAV

SEQ ID NO: 2590489 - protein, 19 aa, Entamoeba histolytica
YTAGICYKTSTISSVQITK

SEQ ID NO: 2590490 - protein, 43 aa, Entamoeba histolytica
YTCFLIAGIFYYHFWLLCILFCIARTSFELVRLFYDCQIPYIM

SEQ ID NO: 2590491 - protein, 28 aa, Entamoeba histolytica
YTCKMAKYWYLQRMDWIGAAISIITVIV

SEQ ID NO: 2590492 - protein, 20 aa, Entamoeba histolytica
YTCPICGANHQELKKVFMLE

SEQ ID NO: 2590493 - protein, 30 aa, Entamoeba histolytica
YTEHEINDLLKIRICDNIAQAMDYLHNKQI

SEQ ID NO: 2590494 - protein, 20 aa, Entamoeba histolytica
YTGKHIFIFGGSAGVGQAIA

SEQ ID NO: 2590495 - protein, 21 aa, Entamoeba histolytica
YTHLKEIIHSLLLSNHSIQTM

SEQ ID NO: 2590496 - protein, 18 aa, Entamoeba histolytica
YTHNCFYDGLDVTSYIFG

SEQ ID NO: 2590497 - protein, 19 aa, Entamoeba histolytica
YTHYAKWIGPFIKDEYFST

SEQ ID NO: 2590498 - protein, 23 aa, Entamoeba histolytica
YTIFELFWRLIFILFSCLCTCIY

SEQ ID NO: 2590499 - protein, 23 aa, Entamoeba histolytica
YTISFKLIGFIVILITCYTSNET

SEQ ID NO: 2590500 - protein, 24 aa, Entamoeba histolytica
YTKESLQIIWLWEIINEMENSLKG

SEQ ID NO: 2590501 - protein, 19 aa, Entamoeba histolytica
YTKLSSIIYQQFAFSSARK

SEQ ID NO: 2590502 - protein, 17 aa, Entamoeba histolytica
YTKLVMLLVVWMIPSSI

SEQ ID NO: 2590503 - protein, 24 aa, Entamoeba histolytica
YTLACIFLSFFFVLFFGLFPLSLL

SEQ ID NO: 2590504 - protein, 18 aa, Entamoeba histolytica
YTLEQEVENLLDLVSLTK

SEQ ID NO: 2590505 - protein, 18 aa, Entamoeba histolytica
YTLFHWVKDFTEREVRVI

SEQ ID NO: 2590506 - protein, 20 aa, Entamoeba histolytica
YTLGESLSFKSLTESSSNIA

SEQ ID NO: 2590507 - protein, 19 aa, Entamoeba histolytica
YTLKSGEAMELKFKIKMLC

SEQ ID NO: 2590508 - protein, 18 aa, Entamoeba histolytica
YTLLKNKLLILFGNTMEN

SEQ ID NO: 2590509 - protein, 22 aa, Entamoeba histolytica
YTLQMAKSWYSQRLDWLGVGLA

SEQ ID NO: 2590510 - protein, 20 aa, Entamoeba histolytica
YTMHTCFSFLNFTRYQTAGL

SEQ ID NO: 2590511 - protein, 19 aa, Entamoeba histolytica
YTPDECGYCDEKGYRSDCL

SEQ ID NO: 2590512 - protein, 23 aa, Entamoeba histolytica
YTPLKLDYVWRTALALGAVPCIL

SEQ ID NO: 2590513 - protein, 18 aa, Entamoeba histolytica
YTQINILYSLIVFSISVI

SEQ ID NO: 2590514 - protein, 20 aa, Entamoeba histolytica
YTRGNKMYCGKRDNEGNAGY

SEQ ID NO: 2590515 - protein, 19 aa, Entamoeba histolytica
YTRIVEHFIVLKNICEDHL

SEQ ID NO: 2590516 - protein, 19 aa, Entamoeba histolytica
YTRLIELFIIYMFGVTDPL

SEQ ID NO: 2590517 - protein, 21 aa, Entamoeba histolytica
YTRLKCPHAQFTLAKDYLVGG

SEQ ID NO: 2590518 - protein, 20 aa, Entamoeba histolytica
YTSQFPFNAFMHIKTSSSHV

SEQ ID NO: 2590519 - protein, 25 aa, Entamoeba histolytica
YTTIRFFNDYGLEWNGIYFEKRTNP

SEQ ID NO: 2590520 - protein, 21 aa, Entamoeba histolytica
YTTLFPLCVVLIFSGIKEIYE

SEQ ID NO: 2590521 - protein, 17 aa, Entamoeba histolytica
YTTLKLILLNPNKKVFS

SEQ ID NO: 2590522 - protein, 17 aa, Entamoeba histolytica
YTVCNWLVLLFGWMSFV

SEQ ID NO: 2590523 - protein, 17 aa, Entamoeba histolytica
YTVGDVLDISELRYSNN

SEQ ID NO: 2590524 - protein, 21 aa, Entamoeba histolytica
YTVHCFFTIYCFFISIISTKS

SEQ ID NO: 2590525 - protein, 26 aa, Entamoeba histolytica
YTVQIPNDWKNFFEDITFVQQLFNVY

SEQ ID NO: 2590526 - protein, 22 aa, Entamoeba histolytica
YVACVCCGFVNASMNVTIRRFI

SEQ ID NO: 2590527 - protein, 33 aa, Entamoeba histolytica
YVASIIARACCPRYHLTIGKEYYERVEFTNKTE

SEQ ID NO: 2590528 - protein, 30 aa, Entamoeba histolytica
YVEMSFIITCCLICISLYYLKKPKLYFRGC

SEQ ID NO: 2590529 - protein, 19 aa, Entamoeba histolytica
YVFHFMPQVHILRSHSIKV

SEQ ID NO: 2590530 - protein, 17 aa, Entamoeba histolytica
YVFPLLFRLINFIEHSV

SEQ ID NO: 2590531 - protein, 30 aa, Entamoeba histolytica
YVFYISLSFTTAIFLRWVNRVDELMVNNKF

SEQ ID NO: 2590532 - protein, 21 aa, Entamoeba histolytica
YVGTHHLCFSYLKIIKKKHVI

SEQ ID NO: 2590533 - protein, 26 aa, Entamoeba histolytica
YVHHRRPEDSWGYFEMFVKSPETGEM

SEQ ID NO: 2590534 - protein, 24 aa, Entamoeba histolytica
YVIDFLITFLVDYQRYVLKIFMLF

SEQ ID NO: 2590535 - protein, 22 aa, Entamoeba histolytica
YVIKKKIDYINGFKAKMGDEFK

SEQ ID NO: 2590536 - protein, 24 aa, Entamoeba histolytica
YVILLCFISRAFNIFPITFIMNLR

SEQ ID NO: 2590537 - protein, 26 aa, Entamoeba histolytica
YVKLPYKLKVRMLFDTARGMQFLHEN

SEQ ID NO: 2590538 - protein, 20 aa, Entamoeba histolytica
YVKVMKRIIERGADYVEKEK

SEQ ID NO: 2590539 - protein, 17 aa, Entamoeba histolytica
YVLKFKVLWSTNSGEIE

SEQ ID NO: 2590540 - protein, 20 aa, Entamoeba histolytica
YVLSPRVSVILRKDIPYYLF

SEQ ID NO: 2590541 - protein, 19 aa, Entamoeba histolytica
YVLYKRIIFSASLFISMSL

SEQ ID NO: 2590542 - protein, 23 aa, Entamoeba histolytica
YVNEDRTRFGFIAQELKEVIPEA

SEQ ID NO: 2590543 - protein, 22 aa, Entamoeba histolytica
YVNPCGRLLYNYTVNSTIPSPD

SEQ ID NO: 2590544 - protein, 17 aa, Entamoeba histolytica
YVRRTIQEFSEKRNVTI

SEQ ID NO: 2590545 - protein, 24 aa, Entamoeba histolytica
YVSIYYKMIVVWKRGIICSERVDS

SEQ ID NO: 2590546 - protein, 19 aa, Entamoeba histolytica
YVVGTCLKTGESSSKKVFK

SEQ ID NO: 2590547 - protein, 18 aa, Entamoeba histolytica
YVVIPWFVVHGFVCLFMT

SEQ ID NO: 2590548 - protein, 22 aa, Entamoeba histolytica
YVYCFKCSPGCINSCIADYTCD

SEQ ID NO: 2590549 - protein, 24 aa, Entamoeba histolytica
YVYLERRRNLKVFSEGEEVEESKE

SEQ ID NO: 2590550 - protein, 23 aa, Entamoeba histolytica
YVYRSTLRIKEFQELLIKMHPQG

SEQ ID NO: 2590551 - protein, 20 aa, Entamoeba histolytica
YWHYFRAGGFIGLILCLIPF

SEQ ID NO: 2590552 - protein, 19 aa, Entamoeba histolytica
YWILPETKIEFIGERRAWA

SEQ ID NO: 2590553 - protein, 17 aa, Entamoeba histolytica
YWINVWYVYIFYYFALV

SEQ ID NO: 2590554 - protein, 19 aa, Entamoeba histolytica
YWNKLKLLLRSIQLFDYMS

SEQ ID NO: 2590555 - protein, 18 aa, Entamoeba histolytica
YWTAYRGGILRGLKCEKG

SEQ ID NO: 2590556 - protein, 17 aa, Entamoeba histolytica
YWVENTWQMSIDKSMPI

SEQ ID NO: 2590557 - protein, 27 aa, Entamoeba histolytica
YYANSLKMKLSILIGVFHMTFGVILSL

SEQ ID NO: 2590558 - protein, 20 aa, Entamoeba histolytica
YYERYCDTLCPCEGDDCEMD

SEQ ID NO: 2590559 - protein, 19 aa, Entamoeba histolytica
YYFAYCFVASVFLQITVLL

SEQ ID NO: 2590560 - protein, 20 aa, Entamoeba histolytica
YYFFHYCYLSELQFFHSRSL

SEQ ID NO: 2590561 - protein, 17 aa, Entamoeba histolytica
YYICVAVFMVLTVPLAY

SEQ ID NO: 2590562 - protein, 17 aa, Entamoeba histolytica
YYIGKECGKIFLNIFSG

SEQ ID NO: 2590563 - protein, 24 aa, Entamoeba histolytica
YYIRATCAISDCAITLKVDKTDAS

SEQ ID NO: 2590564 - protein, 17 aa, Entamoeba histolytica
YYISNFFSVFGPLIVLI

SEQ ID NO: 2590565 - protein, 21 aa, Entamoeba histolytica
YYKLLSELFLRYKKNGGNSEL

SEQ ID NO: 2590566 - protein, 19 aa, Entamoeba histolytica
YYKTLKFTTRYDLDDLDDI

SEQ ID NO: 2590567 - protein, 25 aa, Entamoeba histolytica
YYLSYLRYAFELVMLNQFDNIPLFC

SEQ ID NO: 2590568 - protein, 26 aa, Entamoeba histolytica
YYLTTEECILCLDIICKKKLGFNSTF

SEQ ID NO: 2590569 - protein, 18 aa, Entamoeba histolytica
YYLVTKGWSFLISKEQRR

SEQ ID NO: 2590570 - protein, 20 aa, Entamoeba histolytica
YYNFFRGCWDCSDESFCPGD

SEQ ID NO: 2590571 - protein, 17 aa, Entamoeba histolytica
YYNGVTWIGRVISISEL

SEQ ID NO: 2590572 - protein, 23 aa, Entamoeba histolytica
YYNKKSTCKFTRFSEKGKNSEMF

SEQ ID NO: 2590573 - protein, 19 aa, Entamoeba histolytica
YYPLFLSYIRFIIREKTEF

SEQ ID NO: 2590574 - protein, 19 aa, Entamoeba histolytica
YYPYWTCFSPDTESTCGFG

SEQ ID NO: 2590575 - protein, 18 aa, Entamoeba histolytica
YYQDASCQHCLWIDPYKN

SEQ ID NO: 2590576 - protein, 24 aa, Entamoeba histolytica
YYSHSSLFFKPSTEELLTPLNSLK

SEQ ID NO: 2590577 - protein, 24 aa, Entamoeba histolytica
YYSKKMWPLVIVFIILQIITEIIV

SEQ ID NO: 2590578 - protein, 25 aa, Entamoeba histolytica
YYSTTCLNGKCVVQAVGDVSNVGCG

SEQ ID NO: 2590579 - protein, 25 aa, Entamoeba histolytica
YYTKKECGKIILQICSGLISLKSAI

SEQ ID NO: 2590580 - protein, 29 aa, Entamoeba histolytica
YYTLQMAKIWYSQRLEWMGFTISTLTVLI

SEQ ID NO: 2590581 - protein, 27 aa, Entamoeba histolytica
YYTYCLLHFFLYIGMMFCNYNYFNECF

SEQ ID NO: 2590582 - protein, 18 aa, Entamoeba histolytica
YYVPYLFCCVLFGLFSLF

SEQ ID NO: 2590583 - protein, 22 aa, Entamoeba histolytica
YYYDIELWYSLLARSKVPFLTF

SEQ ID NO: 2590584 - protein, 23 aa, Entamoeba histolytica
VKNNKCWKCSFWYGTNEEGNECN

SEQ ID NO: 2590585 - protein, 24 aa, Entamoeba histolytica
DNGEWSSKCVLAYCDEGYKFDYIN

SEQ ID NO: 2590586 - protein, 24 aa, Entamoeba histolytica
DNGEWSSKCVLAYCDSGYKFDYIN

SEQ ID NO: 2590587 - protein, 25 aa, Entamoeba histolytica
VYSFAICMLEIWLGRDPYDPMKFPD

SEQ ID NO: 2590588 - protein, 25 aa, Entamoeba histolytica
DNGEWSTKCVLAYCDSGYKFDYINN

SEQ ID NO: 2590589 - protein, 24 aa, Entamoeba histolytica
DNGEWSTKCVLSYCDSGYKFDYIN

SEQ ID NO: 2590590 - protein, 22 aa, Entamoeba histolytica
GIKGQCLGLGFSVITFFMIASY

SEQ ID NO: 2590591 - protein, 19 aa, Entamoeba histolytica
QRRAEKLHHFFPIQKIWNE

SEQ ID NO: 2590592 - protein, 17 aa, Entamoeba histolytica
AASSPFIVLFAIIVVIL

SEQ ID NO: 2590593 - protein, 25 aa, Entamoeba histolytica
ALYYDWKLALCVIAVFPIHTLILFF

SEQ ID NO: 2590594 - protein, 19 aa, Entamoeba histolytica
CYECTIIGCEWCNNQCSLT

SEQ ID NO: 2590595 - protein, 24 aa, Entamoeba histolytica
DNGEWSTKCVLAYCDEGYKFDYIN

SEQ ID NO: 2590596 - protein, 24 aa, Entamoeba histolytica
DNGEWSTKCVLAYCDSGYKFDYIN

SEQ ID NO: 2590597 - protein, 17 aa, Entamoeba histolytica
FAFGFALYYDWKLALCV

SEQ ID NO: 2590598 - protein, 20 aa, Entamoeba histolytica
FGIVYRAEWRGVDVAVKVMK

SEQ ID NO: 2590599 - protein, 19 aa, Entamoeba histolytica
GEFFSYFGMCITGYVIGFV

SEQ ID NO: 2590600 - protein, 17 aa, Entamoeba histolytica
GFTKCWDLALVVLATVP

SEQ ID NO: 2590601 - protein, 18 aa, Entamoeba histolytica
GKKWKQQYIYSISKDGEL

SEQ ID NO: 2590602 - protein, 19 aa, Entamoeba histolytica
HPPELCWTTPLFKKTALYL

SEQ ID NO: 2590603 - protein, 17 aa, Entamoeba histolytica
IAVFPIHTLILFFDFKL

SEQ ID NO: 2590604 - protein, 18 aa, Entamoeba histolytica
IFNSFSILWFWIADSCDG

SEQ ID NO: 2590605 - protein, 21 aa, Entamoeba histolytica
KNNKCWKCSFWYGTNEEGNEC

SEQ ID NO: 2590606 - protein, 20 aa, Entamoeba histolytica
KSRDCIFMFISWCCTLSALS

SEQ ID NO: 2590607 - protein, 19 aa, Entamoeba histolytica
LIECGGIVLQECKTDTTTY

SEQ ID NO: 2590608 - protein, 20 aa, Entamoeba histolytica
LLKVRFCQDIARGMEYLHQN

SEQ ID NO: 2590609 - protein, 17 aa, Entamoeba histolytica
LNSCISFTDYAAYFFYN

SEQ ID NO: 2590610 - protein, 23 aa, Entamoeba histolytica
LPTGCYCTYSLISKQECIFDCEN

SEQ ID NO: 2590611 - protein, 17 aa, Entamoeba histolytica
LVVSFLSVGFFAEYLTK

SEQ ID NO: 2590612 - protein, 19 aa, Entamoeba histolytica
LYLPPRYPLLGGWKTSFEV

SEQ ID NO: 2590613 - protein, 19 aa, Entamoeba histolytica
MITFVLFIVLATSTETFLS

SEQ ID NO: 2590614 - protein, 19 aa, Entamoeba histolytica
NSFTRRIEVTGGQIEVNNK

SEQ ID NO: 2590615 - protein, 20 aa, Entamoeba histolytica
QRIAEKLHHFFPIQKIWNEN

SEQ ID NO: 2590616 - protein, 20 aa, Entamoeba histolytica
RLRYNLPIIMCLISTIIEFA

SEQ ID NO: 2590617 - protein, 23 aa, Entamoeba histolytica
SDLLKIRFCQDIARGMEYLHQND

SEQ ID NO: 2590618 - protein, 18 aa, Entamoeba histolytica
SIFFDWSVVLVTFIIMII

SEQ ID NO: 2590619 - protein, 23 aa, Entamoeba histolytica
TCPCSGDKCIIDFSATTSVIYKL

SEQ ID NO: 2590620 - protein, 21 aa, Entamoeba histolytica
TDKEILPFLLINKIQIYGEDP

SEQ ID NO: 2590621 - protein, 21 aa, Entamoeba histolytica
TEFPKWTIGVMVIFVIALIVI

SEQ ID NO: 2590622 - protein, 21 aa, Entamoeba histolytica
TFPMCIFCIMVLSALFIGIDY

SEQ ID NO: 2590623 - protein, 22 aa, Entamoeba histolytica
VLPHLSALVAIVFPRLNDIEAN

SEQ ID NO: 2590624 - protein, 24 aa, Entamoeba histolytica
VSWIWRIIVIIAFEFLEMSVFLIP

SEQ ID NO: 2590625 - protein, 18 aa, Entamoeba histolytica
YFVKDSFLGWKYVDFNNS

SEQ ID NO: 2590626 - protein, 18 aa, Entamoeba histolytica
YSDFSFLFGLILIVTSLL

SEQ ID NO: 2590627 - protein, 19 aa, Entamoeba histolytica
AAIDLCRLVFPLSRDKNPR

SEQ ID NO: 2590628 - protein, 20 aa, Entamoeba histolytica
AAYLCRLCAPLALNILHMIK

SEQ ID NO: 2590629 - protein, 17 aa, Entamoeba histolytica
ACIPLCIGYAIYSLYNN

SEQ ID NO: 2590630 - protein, 19 aa, Entamoeba histolytica
ADGLKGKWFVYTPKETEKV

SEQ ID NO: 2590631 - protein, 20 aa, Entamoeba histolytica
ADILELFELFSFVILLSLSN

SEQ ID NO: 2590632 - protein, 25 aa, Entamoeba histolytica
AEKHFPRLFSWRSFHNYIKELSIDE

SEQ ID NO: 2590633 - protein, 19 aa, Entamoeba histolytica
AFDFCFKWINKLKWIIVVF

SEQ ID NO: 2590634 - protein, 18 aa, Entamoeba histolytica
AFFAFRVATGLLKWVSLG

SEQ ID NO: 2590635 - protein, 18 aa, Entamoeba histolytica
AFTKRYDYGLTWSDMLEK

SEQ ID NO: 2590636 - protein, 22 aa, Entamoeba histolytica
AFTLPCLFIFMSLYRFNGFTLF

SEQ ID NO: 2590637 - protein, 19 aa, Entamoeba histolytica
AFYYDWKVALCVMAIAPVL

SEQ ID NO: 2590638 - protein, 17 aa, Entamoeba histolytica
AFYYDWKVSLAVMAVSP

SEQ ID NO: 2590639 - protein, 18 aa, Entamoeba histolytica
AGDGFFLQWMMSIGILII

SEQ ID NO: 2590640 - protein, 17 aa, Entamoeba histolytica
AGFLTERIEVIINTLSQ

SEQ ID NO: 2590641 - protein, 20 aa, Entamoeba histolytica
AGICAVHFVSYIYKYLKDKI

SEQ ID NO: 2590642 - protein, 21 aa, Entamoeba histolytica
AGVFCKWHYIILYLVAVCLNF

SEQ ID NO: 2590643 - protein, 20 aa, Entamoeba histolytica
AICILEIWICESVYPEDEFH

SEQ ID NO: 2590644 - protein, 17 aa, Entamoeba histolytica
AICLFVFVSGLIPYTID

SEQ ID NO: 2590645 - protein, 19 aa, Entamoeba histolytica
AICLLEIWLGRSPYNPVKF

SEQ ID NO: 2590646 - protein, 19 aa, Entamoeba histolytica
AICMLEIWNNGSLYDEQHF

SEQ ID NO: 2590647 - protein, 19 aa, Entamoeba histolytica
AIESRLLITVPRYLKEVEE

SEQ ID NO: 2590648 - protein, 18 aa, Entamoeba histolytica
AIFVCIGMVLKIRPEVLL

SEQ ID NO: 2590649 - protein, 18 aa, Entamoeba histolytica
AIIFCIIIPFSSVVLNDK

SEQ ID NO: 2590650 - protein, 22 aa, Entamoeba histolytica
AILPICISIVFSKCCRQSLAQL

SEQ ID NO: 2590651 - protein, 18 aa, Entamoeba histolytica
AISLRIPLILKDIFESVG

SEQ ID NO: 2590652 - protein, 17 aa, Entamoeba histolytica
AIWPFCTAFFWPVTTGT

SEQ ID NO: 2590653 - protein, 21 aa, Entamoeba histolytica
ALCILLRFCMCFTHVVQYFNE

SEQ ID NO: 2590654 - protein, 24 aa, Entamoeba histolytica
ALGGQEQWKGLAIFVDTFQNSYAS

SEQ ID NO: 2590655 - protein, 18 aa, Entamoeba histolytica
ALLLCFFVMLLSFTSNVY

SEQ ID NO: 2590656 - protein, 19 aa, Entamoeba histolytica
ALSHCYKIIFAFWKELNKA

SEQ ID NO: 2590657 - protein, 19 aa, Entamoeba histolytica
AMFAFPWYITWFLHSVENI

SEQ ID NO: 2590658 - protein, 19 aa, Entamoeba histolytica
AMFDFTFYWYNFMPLSRGT

SEQ ID NO: 2590659 - protein, 26 aa, Entamoeba histolytica
ANLFFAEFIRDLAIMWRHDEMAKLVD

SEQ ID NO: 2590660 - protein, 20 aa, Entamoeba histolytica
ANLFFAEFIRDLSLLWRHDE

SEQ ID NO: 2590661 - protein, 29 aa, Entamoeba histolytica
ANLFLANFIRDLMRFWKLAYVVGLIDMVM

SEQ ID NO: 2590662 - protein, 23 aa, Entamoeba histolytica
AQCCLKVHLIIALVICILAMIYK

SEQ ID NO: 2590663 - protein, 18 aa, Entamoeba histolytica
AQKGIKMQLERRWDNNSF

SEQ ID NO: 2590664 - protein, 20 aa, Entamoeba histolytica
ARLLWFRNYFIGVLISIITN

SEQ ID NO: 2590665 - protein, 23 aa, Entamoeba histolytica
ARNSGLFAVCWSFGKAIGYAAGG

SEQ ID NO: 2590666 - protein, 20 aa, Entamoeba histolytica
ARSGFAVEYIRCWGEYIRKE

SEQ ID NO: 2590667 - protein, 17 aa, Entamoeba histolytica
ASIKHLFVRPAWGKGKY

SEQ ID NO: 2590668 - protein, 23 aa, Entamoeba histolytica
ASKKLWIILCVAGGIVIVLGAIV

SEQ ID NO: 2590669 - protein, 24 aa, Entamoeba histolytica
ASLFLHPRVNIVIRVIMPFLILLN

SEQ ID NO: 2590670 - protein, 23 aa, Entamoeba histolytica
ASSRISIYILFGIILIVSLFSIF

SEQ ID NO: 2590671 - protein, 21 aa, Entamoeba histolytica
ASTLVPSVCRWYRLKQIIKQQ

SEQ ID NO: 2590672 - protein, 24 aa, Entamoeba histolytica
ATIKKPLLCFTRFFIVKLLMILLL

SEQ ID NO: 2590673 - protein, 21 aa, Entamoeba histolytica
ATLDDGCWCLFAGVIVYTVTT

SEQ ID NO: 2590674 - protein, 20 aa, Entamoeba histolytica
AVECFLRLVLMLLLSILLKT

SEQ ID NO: 2590675 - protein, 19 aa, Entamoeba histolytica
AVGKEWRIDLTLKLLSVIS

SEQ ID NO: 2590676 - protein, 20 aa, Entamoeba histolytica
AVIKREWWPFLLSFIAITIS

SEQ ID NO: 2590677 - protein, 18 aa, Entamoeba histolytica
AVSLCIIFGFSLLAIKRF

SEQ ID NO: 2590678 - protein, 19 aa, Entamoeba histolytica
AYLCRLCAPLALNILHMIK

SEQ ID NO: 2590679 - protein, 19 aa, Entamoeba histolytica
AYSTMGWLCWLIVSIAVFA

SEQ ID NO: 2590680 - protein, 23 aa, Entamoeba histolytica
CAICMTCGCLLCYKDKKHQDIIH

SEQ ID NO: 2590681 - protein, 18 aa, Entamoeba histolytica
CALSSFKNGIKMYLSDHE

SEQ ID NO: 2590682 - protein, 19 aa, Entamoeba histolytica
CASRKWLIIGIVVGILVVV

SEQ ID NO: 2590683 - protein, 20 aa, Entamoeba histolytica
CATIIGCLKLKSQDRREKLW

SEQ ID NO: 2590684 - protein, 20 aa, Entamoeba histolytica
CAVGGSWNCAIMRELAKVYC

SEQ ID NO: 2590685 - protein, 20 aa, Entamoeba histolytica
CCAARHGICFPKDEKAYSTM

SEQ ID NO: 2590686 - protein, 17 aa, Entamoeba histolytica
CCCGGLLLLIFIAYIAL

SEQ ID NO: 2590687 - protein, 17 aa, Entamoeba histolytica
CDFQDLFSIKSHVLAGY

SEQ ID NO: 2590688 - protein, 17 aa, Entamoeba histolytica
CDFTWKIMQGELDSIKC

SEQ ID NO: 2590689 - protein, 17 aa, Entamoeba histolytica
CDVSNRWHFDWKCNVTY

SEQ ID NO: 2590690 - protein, 18 aa, Entamoeba histolytica
CECKPGFVFKDEGCTECG

SEQ ID NO: 2590691 - protein, 26 aa, Entamoeba histolytica
CEMIQCALCGLPICSTSCLKIHSQQP

SEQ ID NO: 2590692 - protein, 17 aa, Entamoeba histolytica
CFFPLDVIITLGMGAAI

SEQ ID NO: 2590693 - protein, 20 aa, Entamoeba histolytica
CFISIFSLFMKYHFPIYFSI

SEQ ID NO: 2590694 - protein, 18 aa, Entamoeba histolytica
CFSNWRLVLLFPLALLFG

SEQ ID NO: 2590695 - protein, 20 aa, Entamoeba histolytica
CGEPMKFIFLIDVSKDSLTR

SEQ ID NO: 2590696 - protein, 18 aa, Entamoeba histolytica
CGHCKALAPKYIEVSKMY

SEQ ID NO: 2590697 - protein, 19 aa, Entamoeba histolytica
CGLKSRLAYNVVVGNKYFV

SEQ ID NO: 2590698 - protein, 18 aa, Entamoeba histolytica
CGTFFKRLLPIVFTENSL

SEQ ID NO: 2590699 - protein, 17 aa, Entamoeba histolytica
CHKKCSIKYLFNVPIYA

SEQ ID NO: 2590700 - protein, 18 aa, Entamoeba histolytica
CIAGELFSEAGFFQRSDQ

SEQ ID NO: 2590701 - protein, 20 aa, Entamoeba histolytica
CIMMLWPRIEKFGDPNFRKL

SEQ ID NO: 2590702 - protein, 23 aa, Entamoeba histolytica
CISCSVKHCIICTAEVCYNCQEG

SEQ ID NO: 2590703 - protein, 20 aa, Entamoeba histolytica
CKAMAILAFCNFFSVCEQDQ

SEQ ID NO: 2590704 - protein, 24 aa, Entamoeba histolytica
CKECYKEKCALCFGNDIVISGVCY

SEQ ID NO: 2590705 - protein, 22 aa, Entamoeba histolytica
CKERLKYSWVIYSLLIKSIIGY

SEQ ID NO: 2590706 - protein, 24 aa, Entamoeba histolytica
CKHYHIFKLLGIQSIQFFIIFKFI

SEQ ID NO: 2590707 - protein, 29 aa, Entamoeba histolytica
CKKICCCKNCKRILECIVHHIGITVLFFD

SEQ ID NO: 2590708 - protein, 20 aa, Entamoeba histolytica
CKRILECIVHHIGIIVLVVG

SEQ ID NO: 2590709 - protein, 17 aa, Entamoeba histolytica
CLDCFPRSFFLFCDVSK

SEQ ID NO: 2590710 - protein, 18 aa, Entamoeba histolytica
CLICPIGTYSKGEKNTYC

SEQ ID NO: 2590711 - protein, 20 aa, Entamoeba histolytica
CLKPTLPVSDLFKLRVFYQS

SEQ ID NO: 2590712 - protein, 19 aa, Entamoeba histolytica
CLKYLVALLYELSKNAKSK

SEQ ID NO: 2590713 - protein, 18 aa, Entamoeba histolytica
CNVCYSGGYRKCGINSYI

SEQ ID NO: 2590714 - protein, 21 aa, Entamoeba histolytica
CPCQSLTGYECELEFTGSTNP

SEQ ID NO: 2590715 - protein, 19 aa, Entamoeba histolytica
CPICYSLFYLRTTTIPNVA

SEQ ID NO: 2590716 - protein, 18 aa, Entamoeba histolytica
CPIDRTALIFSYTRRPFS

SEQ ID NO: 2590717 - protein, 17 aa, Entamoeba histolytica
CPIFYYFRFCKELFVSD

SEQ ID NO: 2590718 - protein, 26 aa, Entamoeba histolytica
CPMPFFIFEWHYLWYVHAFNFEISLR

SEQ ID NO: 2590719 - protein, 19 aa, Entamoeba histolytica
CPSYEAILFPQILNSKQLP

SEQ ID NO: 2590720 - protein, 20 aa, Entamoeba histolytica
CQSHLRFGGYFVQLILNVIT

SEQ ID NO: 2590721 - protein, 17 aa, Entamoeba histolytica
CSKCSESNCIVCKDNDG

SEQ ID NO: 2590722 - protein, 20 aa, Entamoeba histolytica
CSRNKIWFGKLIEIERNLCN

SEQ ID NO: 2590723 - protein, 23 aa, Entamoeba histolytica
CSTCSSQECYSCFNSSEIVTTSK

SEQ ID NO: 2590724 - protein, 18 aa, Entamoeba histolytica
CSYKSWSLILLWSSLILF

SEQ ID NO: 2590725 - protein, 19 aa, Entamoeba histolytica
CTFKFGRRRIFLVVGAIID

SEQ ID NO: 2590726 - protein, 18 aa, Entamoeba histolytica
CTLWMILSMITFVLFGIV

SEQ ID NO: 2590727 - protein, 19 aa, Entamoeba histolytica
CVHVHPGLVWSKFWRYMTP

SEQ ID NO: 2590728 - protein, 17 aa, Entamoeba histolytica
CVIEFKKMLGFCISCVS

SEQ ID NO: 2590729 - protein, 18 aa, Entamoeba histolytica
CVILCCLCPAPSVNIIYC

SEQ ID NO: 2590730 - protein, 19 aa, Entamoeba histolytica
CVPFCGTCKFGFSCNKAAK

SEQ ID NO: 2590731 - protein, 18 aa, Entamoeba histolytica
CVTSFILFLGVLIMVVPE

SEQ ID NO: 2590732 - protein, 24 aa, Entamoeba histolytica
CWCLFRISDLMIRFFLILFTHQPD

SEQ ID NO: 2590733 - protein, 19 aa, Entamoeba histolytica
CWGLKLYFAYGFLMSIFIQ

SEQ ID NO: 2590734 - protein, 24 aa, Entamoeba histolytica
CYDECPYCLWGLCHACTKGCNYGS

SEQ ID NO: 2590735 - protein, 23 aa, Entamoeba histolytica
CYDECPYCLWGLCHACTKGCSYG

SEQ ID NO: 2590736 - protein, 23 aa, Entamoeba histolytica
CYGCFLCGLIPIFISPKVSIIEI

SEQ ID NO: 2590737 - protein, 19 aa, Entamoeba histolytica
CYKQRLSVIHYLYSLIPLA

SEQ ID NO: 2590738 - protein, 18 aa, Entamoeba histolytica
DAASSPFIVLFAIIVVIL

SEQ ID NO: 2590739 - protein, 24 aa, Entamoeba histolytica
DAICSKELYLFWLFNVGNRKTKEE

SEQ ID NO: 2590740 - protein, 22 aa, Entamoeba histolytica
DALKELYCIKAIDENGHITQLG

SEQ ID NO: 2590741 - protein, 22 aa, Entamoeba histolytica
DCLGCGLAACMCCDWCTDCCYV

SEQ ID NO: 2590742 - protein, 18 aa, Entamoeba histolytica
DDIIFLIYLYQRWIYPVD

SEQ ID NO: 2590743 - protein, 23 aa, Entamoeba histolytica
DEEVRPSLKWYFMIFFGPNVETM

SEQ ID NO: 2590744 - protein, 24 aa, Entamoeba histolytica
DELRYRFNHVWKEFLETYFVPYKV

SEQ ID NO: 2590745 - protein, 17 aa, Entamoeba histolytica
DEMKLVGLLLVYGIVHN

SEQ ID NO: 2590746 - protein, 20 aa, Entamoeba histolytica
DEMKSLLVIYPFPRTLINTP

SEQ ID NO: 2590747 - protein, 20 aa, Entamoeba histolytica
DFLKVRFCQDIARGMEYLHE

SEQ ID NO: 2590748 - protein, 19 aa, Entamoeba histolytica
DFYSEIYKLLVLTRDSHLS

SEQ ID NO: 2590749 - protein, 27 aa, Entamoeba histolytica
DGFYLYFYKRFPGLLILVYNVVKKHYP

SEQ ID NO: 2590750 - protein, 23 aa, Entamoeba histolytica
DGKPSDCIIYFSMKDIARVEWLK

SEQ ID NO: 2590751 - protein, 19 aa, Entamoeba histolytica
DGNIGWYWLIFIFSFISGF

SEQ ID NO: 2590752 - protein, 21 aa, Entamoeba histolytica
DIELTMSFGCYFIVTSQTTFK

SEQ ID NO: 2590753 - protein, 18 aa, Entamoeba histolytica
DIFHCIYNIYSIPFQFKC

SEQ ID NO: 2590754 - protein, 23 aa, Entamoeba histolytica
DIIPRFKQGYSFCFIGKEDQTES

SEQ ID NO: 2590755 - protein, 17 aa, Entamoeba histolytica
DILPFNWISELPLNMKN

SEQ ID NO: 2590756 - protein, 17 aa, Entamoeba histolytica
DKACGKYVSVGYDYLAV

SEQ ID NO: 2590757 - protein, 19 aa, Entamoeba histolytica
DKAIWRIIFIISPIALILL

SEQ ID NO: 2590758 - protein, 24 aa, Entamoeba histolytica
DLFFKSGLLFYVLVILYIIVSRTI

SEQ ID NO: 2590759 - protein, 20 aa, Entamoeba histolytica
DLFKRYGIHVTFFIIGERVK

SEQ ID NO: 2590760 - protein, 17 aa, Entamoeba histolytica
DLFWGFSVDYEFKYKEL

SEQ ID NO: 2590761 - protein, 22 aa, Entamoeba histolytica
DLLKIRFCQDISRGMEYLHQND

SEQ ID NO: 2590762 - protein, 18 aa, Entamoeba histolytica
DLNLMFWIAISMTIALII

SEQ ID NO: 2590763 - protein, 23 aa, Entamoeba histolytica
DNGEWSSKCVLAYCDEGYMFDYI

SEQ ID NO: 2590764 - protein, 25 aa, Entamoeba histolytica
DNGEWSSKCVLAYCDSGYKFDYINN

SEQ ID NO: 2590765 - protein, 24 aa, Entamoeba histolytica
DNGEWSTKCVLAYCDSGYKFDYIK

SEQ ID NO: 2590766 - protein, 23 aa, Entamoeba histolytica
DNGEWSTKCVLSYCDSGYKFDYI

SEQ ID NO: 2590767 - protein, 21 aa, Entamoeba histolytica
DPIPFRCLLKFSKKENNSHCI

SEQ ID NO: 2590768 - protein, 18 aa, Entamoeba histolytica
DQFFFEWSLKLIIDRSSK

SEQ ID NO: 2590769 - protein, 23 aa, Entamoeba histolytica
DRMKTCGYWEFLFKPSKKEDVHY

SEQ ID NO: 2590770 - protein, 21 aa, Entamoeba histolytica
DRRMIDCLKKIDGEKKLVEYI

SEQ ID NO: 2590771 - protein, 17 aa, Entamoeba histolytica
DRSRCFTCQAGMELAAS

SEQ ID NO: 2590772 - protein, 18 aa, Entamoeba histolytica
DRTRFGFIAQELKEVIPE

SEQ ID NO: 2590773 - protein, 23 aa, Entamoeba histolytica
DSFRIWCIWCIVVFFSPFIIIQL

SEQ ID NO: 2590774 - protein, 20 aa, Entamoeba histolytica
DSIYRKTFCFSFQHESDIIE

SEQ ID NO: 2590775 - protein, 24 aa, Entamoeba histolytica
DSLTILRWCFEYHKKIKKDFLNQI

SEQ ID NO: 2590776 - protein, 25 aa, Entamoeba histolytica
DSWKKRIDMEWKRKISQKFQTNEHE

SEQ ID NO: 2590777 - protein, 17 aa, Entamoeba histolytica
DTFKYVIEKGVVTKYTF

SEQ ID NO: 2590778 - protein, 17 aa, Entamoeba histolytica
DTLKFFCYYVLRQIKEL

SEQ ID NO: 2590779 - protein, 26 aa, Entamoeba histolytica
DVFSFAICCTEIWLGRDPYDPEKFPD

SEQ ID NO: 2590780 - protein, 25 aa, Entamoeba histolytica
DVFSFAVCMLEIWLGKPPYSSDEFP

SEQ ID NO: 2590781 - protein, 18 aa, Entamoeba histolytica
DVFSFSICLLEIWLTHQP

SEQ ID NO: 2590782 - protein, 23 aa, Entamoeba histolytica
DVNYASAMALVFMGKYEDALKVV

SEQ ID NO: 2590783 - protein, 18 aa, Entamoeba histolytica
DWRYSRSAGMLFGVLVTI

SEQ ID NO: 2590784 - protein, 18 aa, Entamoeba histolytica
DYCYRSSQIIGFIINSHK

SEQ ID NO: 2590785 - protein, 19 aa, Entamoeba histolytica
DYLICPSLPTLQWTMIITY

SEQ ID NO: 2590786 - protein, 21 aa, Entamoeba histolytica
DYRLLGSLFFKRGNVLRKILS

SEQ ID NO: 2590787 - protein, 24 aa, Entamoeba histolytica
EADRLEVRYGLFGRVFGQRAVAWA

SEQ ID NO: 2590788 - protein, 37 aa, Entamoeba histolytica
EAGGMACLMCCIFTLLGFCCCGLIFCCMRNFKNAVHF

SEQ ID NO: 2590789 - protein, 21 aa, Entamoeba histolytica
EANNSKCLKCFGWNKPNKQGN

SEQ ID NO: 2590790 - protein, 24 aa, Entamoeba histolytica
EAVRLARRIAMEWEAYIKHTNALR

SEQ ID NO: 2590791 - protein, 18 aa, Entamoeba histolytica
ECAIPFKYSLPIESLAKE

SEQ ID NO: 2590792 - protein, 18 aa, Entamoeba histolytica
ECEFPCYAAASGEYIRDD

SEQ ID NO: 2590793 - protein, 30 aa, Entamoeba histolytica
ECHDILRPSLQWYFSILFWRDIKTLKSTFK

SEQ ID NO: 2590794 - protein, 19 aa, Entamoeba histolytica
ECKSGVESVCFAKNESDAE

SEQ ID NO: 2590795 - protein, 17 aa, Entamoeba histolytica
ECKYCKTPCGSGCCTKI

SEQ ID NO: 2590796 - protein, 18 aa, Entamoeba histolytica
ECQIDSYGIKKCLTCISD

SEQ ID NO: 2590797 - protein, 20 aa, Entamoeba histolytica
ECTCLLCKMKLVILQNRYVP

SEQ ID NO: 2590798 - protein, 22 aa, Entamoeba histolytica
ECTKIKWKQCISFDNCHRILPT

SEQ ID NO: 2590799 - protein, 17 aa, Entamoeba histolytica
EDFKEVFVWKVFYTSLI

SEQ ID NO: 2590800 - protein, 18 aa, Entamoeba histolytica
EENAKCVLYGDGKTIKVY

SEQ ID NO: 2590801 - protein, 22 aa, Entamoeba histolytica
EEVDLKFSFCFTESETERVRYY

SEQ ID NO: 2590802 - protein, 19 aa, Entamoeba histolytica
EEWHFWRLLLINIYTLWTV

SEQ ID NO: 2590803 - protein, 22 aa, Entamoeba histolytica
EEWYKHPWCIITSLFCHSSISQ

SEQ ID NO: 2590804 - protein, 17 aa, Entamoeba histolytica
EFIRLVFHLSLEHCMLI

SEQ ID NO: 2590805 - protein, 19 aa, Entamoeba histolytica
EFISQIIVICWNHDPRIKA

SEQ ID NO: 2590806 - protein, 20 aa, Entamoeba histolytica
EFISSLLFLWCICIFPKFYF

SEQ ID NO: 2590807 - protein, 20 aa, Entamoeba histolytica
EFKFPWKIAEFISTGKRPNI

SEQ ID NO: 2590808 - protein, 20 aa, Entamoeba histolytica
EFKFPWKIAEFISTGKRPVI

SEQ ID NO: 2590809 - protein, 21 aa, Entamoeba histolytica
EFLRLPVWMLFLGIDVNLAYK

SEQ ID NO: 2590810 - protein, 22 aa, Entamoeba histolytica
EGEGSLCFKAKVTKFGLYGYRK

SEQ ID NO: 2590811 - protein, 24 aa, Entamoeba histolytica
EGFKSFKNALSWEFKSVSFEKGIE

SEQ ID NO: 2590812 - protein, 22 aa, Entamoeba histolytica
EGGRKCLWISILIDSITVVLLL

SEQ ID NO: 2590813 - protein, 17 aa, Entamoeba histolytica
EGKCYRCEDSFDGILEN

SEQ ID NO: 2590814 - protein, 21 aa, Entamoeba histolytica
EGMYRISIDFYVRRFESSCEE

SEQ ID NO: 2590815 - protein, 21 aa, Entamoeba histolytica
EGTSGVVFKGRFREHIVAIKD

SEQ ID NO: 2590816 - protein, 19 aa, Entamoeba histolytica
EGYPWCDIDKKMSWCDIND

SEQ ID NO: 2590817 - protein, 22 aa, Entamoeba histolytica
EHKIACLLPLFGPVLLLLIKSL

SEQ ID NO: 2590818 - protein, 17 aa, Entamoeba histolytica
EHMPVFYGLWIVYGIIL

SEQ ID NO: 2590819 - protein, 19 aa, Entamoeba histolytica
EIFSKWGIQNIIGFNDNDN

SEQ ID NO: 2590820 - protein, 19 aa, Entamoeba histolytica
EILGSFVLPSMKSFEIPDI

SEQ ID NO: 2590821 - protein, 21 aa, Entamoeba histolytica
EILRYSCKIIKSINSGEIKEN

SEQ ID NO: 2590822 - protein, 25 aa, Entamoeba histolytica
EINDLLKIRICDNIAQAMDYLHNKQ

SEQ ID NO: 2590823 - protein, 21 aa, Entamoeba histolytica
EIYDVLIKWGYFIQMPSVSPF

SEQ ID NO: 2590824 - protein, 29 aa, Entamoeba histolytica
EKDFHKMGGWFKVCIAILISILVLTVGVI

SEQ ID NO: 2590825 - protein, 17 aa, Entamoeba histolytica
EKHIWNAIFGRFVDDIQ

SEQ ID NO: 2590826 - protein, 20 aa, Entamoeba histolytica
EKIKGGLVFFHLFRSFMKHT

SEQ ID NO: 2590827 - protein, 23 aa, Entamoeba histolytica
EKKKRIINMIGIIMYQMRRSLYE

SEQ ID NO: 2590828 - protein, 17 aa, Entamoeba histolytica
ELDASGIGIRWQQSLDP

SEQ ID NO: 2590829 - protein, 24 aa, Entamoeba histolytica
ELKRKDWYGVLAFSGIEPINEINE

SEQ ID NO: 2590830 - protein, 18 aa, Entamoeba histolytica
ELKSLIIYREYYLEESRK

SEQ ID NO: 2590831 - protein, 19 aa, Entamoeba histolytica
ELLLSCWKINTERLISIDE

SEQ ID NO: 2590832 - protein, 19 aa, Entamoeba histolytica
ELMKRFAIITTLFTPLTFL

SEQ ID NO: 2590833 - protein, 20 aa, Entamoeba histolytica
ELMKTIGISPVFICYMESMK

SEQ ID NO: 2590834 - protein, 17 aa, Entamoeba histolytica
ELMKYKVLMKFLLFTLL

SEQ ID NO: 2590835 - protein, 22 aa, Entamoeba histolytica
ELVPELFKFFSLSITTIQNHSI

SEQ ID NO: 2590836 - protein, 19 aa, Entamoeba histolytica
ELYTVDGLDEMKLVGLLLV

SEQ ID NO: 2590837 - protein, 21 aa, Entamoeba histolytica
EMKSLCPHTPFFLIATQSEKR

SEQ ID NO: 2590838 - protein, 18 aa, Entamoeba histolytica
EMTSCIGCGLALNQCYWN

SEQ ID NO: 2590839 - protein, 23 aa, Entamoeba histolytica
ENEIKRLIEWGRGLELIDEEEIK

SEQ ID NO: 2590840 - protein, 18 aa, Entamoeba histolytica
ENILFRFYLKFIGSPIAT

SEQ ID NO: 2590841 - protein, 17 aa, Entamoeba histolytica
EPLRWRKQYHSWDLFFL

SEQ ID NO: 2590842 - protein, 22 aa, Entamoeba histolytica
EPSFPWFYKLWRVQGYYNLLIL

SEQ ID NO: 2590843 - protein, 23 aa, Entamoeba histolytica
EQFKMPWDIAKFVIAGKRLERKD

SEQ ID NO: 2590844 - protein, 17 aa, Entamoeba histolytica
EQFKSLLLVYGPFVSSI

SEQ ID NO: 2590845 - protein, 21 aa, Entamoeba histolytica
EQWFAHQMCCFLLPYYDCSSN

SEQ ID NO: 2590846 - protein, 18 aa, Entamoeba histolytica
ERIMTFYIALLFRFHIFI

SEQ ID NO: 2590847 - protein, 16 aa, Entamoeba histolytica
ERKCTRFLMTFMIQLH

SEQ ID NO: 2590848 - protein, 20 aa, Entamoeba histolytica
ERLFVGSCCDLLRRDLTKRY

SEQ ID NO: 2590849 - protein, 19 aa, Entamoeba histolytica
ERNIRLVGLSVILSTIFTY

SEQ ID NO: 2590850 - protein, 19 aa, Entamoeba histolytica
ESDMKLYLLVGGKVKDKVV

SEQ ID NO: 2590851 - protein, 17 aa, Entamoeba histolytica
ESIISFDFVNKVFNYSE

SEQ ID NO: 2590852 - protein, 19 aa, Entamoeba histolytica
ESIKSNAIWNICRLEDYHV

SEQ ID NO: 2590853 - protein, 17 aa, Entamoeba histolytica
ESLSITFLVMWLGGDIT

SEQ ID NO: 2590854 - protein, 17 aa, Entamoeba histolytica
ESMTWKGFLLMLIPAFC

SEQ ID NO: 2590855 - protein, 21 aa, Entamoeba histolytica
ETGKICRICFETGKCITFRSY

SEQ ID NO: 2590856 - protein, 19 aa, Entamoeba histolytica
ETWKGVVYLLVIAFMQILT

SEQ ID NO: 2590857 - protein, 19 aa, Entamoeba histolytica
EVFELSSFDEIEWRNKVKQ

SEQ ID NO: 2590858 - protein, 20 aa, Entamoeba histolytica
EVLYSCGFLLLRVMLLKCSF

SEQ ID NO: 2590859 - protein, 18 aa, Entamoeba histolytica
EVVKAIGYFIGIHRNELP

SEQ ID NO: 2590860 - protein, 18 aa, Entamoeba histolytica
EWEMWMWFGIITAVIVIF

SEQ ID NO: 2590861 - protein, 19 aa, Entamoeba histolytica
EWKIPLKYIKVVLQVAIFK

SEQ ID NO: 2590862 - protein, 17 aa, Entamoeba histolytica
EYLRASITFNEIMKTKD

SEQ ID NO: 2590863 - protein, 17 aa, Entamoeba histolytica
EYVWKCWSNFHFYFYVI

SEQ ID NO: 2590864 - protein, 20 aa, Entamoeba histolytica
FAGRPRPHFYARLSEHPEQV

SEQ ID NO: 2590865 - protein, 20 aa, Entamoeba histolytica
FAICMLEVWISKDPYDSIKF

SEQ ID NO: 2590866 - protein, 23 aa, Entamoeba histolytica
FATWKMAECMGILFGFGYSGVKE

SEQ ID NO: 2590867 - protein, 22 aa, Entamoeba histolytica
FCAKQLRSLICERIKLNDESVS

SEQ ID NO: 2590868 - protein, 18 aa, Entamoeba histolytica
FCCMRNFKNAVHFCPNCK

SEQ ID NO: 2590869 - protein, 17 aa, Entamoeba histolytica
FCCYCVIRPIYAVLQNT

SEQ ID NO: 2590870 - protein, 24 aa, Entamoeba histolytica
FCPCKSNECLLNFNDENITELNDI

SEQ ID NO: 2590871 - protein, 17 aa, Entamoeba histolytica
FCSNCKCEYGYSYDKEK

SEQ ID NO: 2590872 - protein, 19 aa, Entamoeba histolytica
FDRCYACGSTVIIGVSDGS

SEQ ID NO: 2590873 - protein, 18 aa, Entamoeba histolytica
FDSFKAILPFKFIIDQST

SEQ ID NO: 2590874 - protein, 25 aa, Entamoeba histolytica
FDVGCSPLKIILCPKKFLNNYACEG

SEQ ID NO: 2590875 - protein, 24 aa, Entamoeba histolytica
FEECIKMGIEIIGIIYNITRSTKD

SEQ ID NO: 2590876 - protein, 22 aa, Entamoeba histolytica
FELEIACGFFIFLFSNIFIWTY

SEQ ID NO: 2590877 - protein, 20 aa, Entamoeba histolytica
FELFTSFILKWRYNKINEDY

SEQ ID NO: 2590878 - protein, 19 aa, Entamoeba histolytica
FELLWKIFIVLKYGLLNKL

SEQ ID NO: 2590879 - protein, 17 aa, Entamoeba histolytica
FEQGVCCAMETLLKIFI

SEQ ID NO: 2590880 - protein, 17 aa, Entamoeba histolytica
FERSNFLFVLGIFFPLL

SEQ ID NO: 2590881 - protein, 17 aa, Entamoeba histolytica
FETEFKGDFSLLLDSTK

SEQ ID NO: 2590882 - protein, 24 aa, Entamoeba histolytica
FEVFWRITLLTSMCCCTLFFMYVL

SEQ ID NO: 2590883 - protein, 20 aa, Entamoeba histolytica
FEVLKRLLVNYIQQSEINDN

SEQ ID NO: 2590884 - protein, 17 aa, Entamoeba histolytica
FFAILFFPIEHKIACLL

SEQ ID NO: 2590885 - protein, 17 aa, Entamoeba histolytica
FFCYRIVALVLMFTTLI

SEQ ID NO: 2590886 - protein, 22 aa, Entamoeba histolytica
FFFCFLKFIPCYSILGCICSII

SEQ ID NO: 2590887 - protein, 18 aa, Entamoeba histolytica
FFIPLIIGYILRISTLDN

SEQ ID NO: 2590888 - protein, 23 aa, Entamoeba histolytica
FFYFPRFLIVLLIGSFLVNLYLY

SEQ ID NO: 2590889 - protein, 18 aa, Entamoeba histolytica
FGELLSILMGFGYSGMKD

SEQ ID NO: 2590890 - protein, 19 aa, Entamoeba histolytica
FGILCLIPYLFLQEHSTKP

SEQ ID NO: 2590891 - protein, 20 aa, Entamoeba histolytica
FGIVYRAEWRGVDVAVKLMK

SEQ ID NO: 2590892 - protein, 22 aa, Entamoeba histolytica
FGMEILPLLKFIGSSQTYAEFL

SEQ ID NO: 2590893 - protein, 20 aa, Entamoeba histolytica
FGSWCLVNFFIGKRGIAVLP

SEQ ID NO: 2590894 - protein, 20 aa, Entamoeba histolytica
FGTKFVMKRLFLNWELRENK

SEQ ID NO: 2590895 - protein, 17 aa, Entamoeba histolytica
FGYLCFLIIFKWCNPDK

SEQ ID NO: 2590896 - protein, 18 aa, Entamoeba histolytica
FHATFCIASLFMLQNMTD

SEQ ID NO: 2590897 - protein, 17 aa, Entamoeba histolytica
FHFHLTLALWDNFMLDN

SEQ ID NO: 2590898 - protein, 18 aa, Entamoeba histolytica
FHTICIFILFVALVYRHT

SEQ ID NO: 2590899 - protein, 17 aa, Entamoeba histolytica
FHYFMLFVRLLISLTNS

SEQ ID NO: 2590900 - protein, 21 aa, Entamoeba histolytica
FIDKRLAEIISRGMNCEETAQ

SEQ ID NO: 2590901 - protein, 17 aa, Entamoeba histolytica
FIFEYIVAISICLSLFG

SEQ ID NO: 2590902 - protein, 18 aa, Entamoeba histolytica
FIFPRYLSIFSIAVYLST

SEQ ID NO: 2590903 - protein, 17 aa, Entamoeba histolytica
FIIFKFIEFFLLDEALY

SEQ ID NO: 2590904 - protein, 21 aa, Entamoeba histolytica
FIIFRFIFKSEVPWIQRLGGC

SEQ ID NO: 2590905 - protein, 22 aa, Entamoeba histolytica
FIKCPECMVALLIAPVLNANES

SEQ ID NO: 2590906 - protein, 18 aa, Entamoeba histolytica
FILCCVACFGVFIFQPTF

SEQ ID NO: 2590907 - protein, 21 aa, Entamoeba histolytica
FILKRRFNLIQVFSAIIALSG

SEQ ID NO: 2590908 - protein, 22 aa, Entamoeba histolytica
FILPYCYFSFIIVLVETIILWS

SEQ ID NO: 2590909 - protein, 17 aa, Entamoeba histolytica
FIMYRVGGSIGFMSSTH

SEQ ID NO: 2590910 - protein, 18 aa, Entamoeba histolytica
FINAFFIIKQYFSVLSIH

SEQ ID NO: 2590911 - protein, 17 aa, Entamoeba histolytica
FINFCIFGILFLVFHIL

SEQ ID NO: 2590912 - protein, 23 aa, Entamoeba histolytica
FIQWKIRMMHIFGPISFLIFSCL

SEQ ID NO: 2590913 - protein, 17 aa, Entamoeba histolytica
FISRFGVKFTITSNNHL

SEQ ID NO: 2590914 - protein, 17 aa, Entamoeba histolytica
FITALTLAARVEERRQK

SEQ ID NO: 2590915 - protein, 20 aa, Entamoeba histolytica
FKEVFVWKVFYTSLIWVLKN

SEQ ID NO: 2590916 - protein, 18 aa, Entamoeba histolytica
FKFPWKIAEFISTGKRPN

SEQ ID NO: 2590917 - protein, 20 aa, Entamoeba histolytica
FKGDICYKCPLGYYSINGNC

SEQ ID NO: 2590918 - protein, 21 aa, Entamoeba histolytica
FKHLTKLILFYGRNGKYQITT

SEQ ID NO: 2590919 - protein, 23 aa, Entamoeba histolytica
FKIKDIWKHVCIVWNKCYNSLFQ

SEQ ID NO: 2590920 - protein, 23 aa, Entamoeba histolytica
FKIKDIWKHVCIVWNKCYNYTPK

SEQ ID NO: 2590921 - protein, 25 aa, Entamoeba histolytica
FKIKDIWKHVCIVWTMCYNYIPPKK

SEQ ID NO: 2590922 - protein, 18 aa, Entamoeba histolytica
FKNEINEIIKFFKTNSVM

SEQ ID NO: 2590923 - protein, 18 aa, Entamoeba histolytica
FKNQLAFQHCLLIGVLNQ

SEQ ID NO: 2590924 - protein, 22 aa, Entamoeba histolytica
FKSEHVFLILQLCGSIIFYHSS

SEQ ID NO: 2590925 - protein, 17 aa, Entamoeba histolytica
FKSHTIFSLSLTIILVF

SEQ ID NO: 2590926 - protein, 21 aa, Entamoeba histolytica
FLCFPRFFKLQSCIPCYKKCV

SEQ ID NO: 2590927 - protein, 17 aa, Entamoeba histolytica
FLCKGRLIVLRRFVTLM

SEQ ID NO: 2590928 - protein, 24 aa, Entamoeba histolytica
FLFGFCFIFFWLASFVISRKSSQP

SEQ ID NO: 2590929 - protein, 17 aa, Entamoeba histolytica
FLFSAICLFVFVSGLIP

SEQ ID NO: 2590930 - protein, 21 aa, Entamoeba histolytica
FLMILLLRLSPLFPFPISNYV

SEQ ID NO: 2590931 - protein, 23 aa, Entamoeba histolytica
FLMYYQRLSFINAFNKVQGLYPL

SEQ ID NO: 2590932 - protein, 19 aa, Entamoeba histolytica
FLNQEIWSSICGRNNIMII

SEQ ID NO: 2590933 - protein, 21 aa, Entamoeba histolytica
FLRIYFPTVLNWMIGGVVGQN

SEQ ID NO: 2590934 - protein, 17 aa, Entamoeba histolytica
FLSFKFFFIESVINIIL

SEQ ID NO: 2590935 - protein, 21 aa, Entamoeba histolytica
FLSNHMCKSCYGYCQLNGNDT

SEQ ID NO: 2590936 - protein, 19 aa, Entamoeba histolytica
FLWCICIFPKFYFILEYIS

SEQ ID NO: 2590937 - protein, 23 aa, Entamoeba histolytica
FMFIVWFIPQWIKSLKMIGVVKE

SEQ ID NO: 2590938 - protein, 25 aa, Entamoeba histolytica
FNEILKFLICLVMLKFVHKKENLLQ

SEQ ID NO: 2590939 - protein, 18 aa, Entamoeba histolytica
FNQPEIWTTMELTNGCPC

SEQ ID NO: 2590940 - protein, 22 aa, Entamoeba histolytica
FNYEIVNEIAFWYYQQLFEEKC

SEQ ID NO: 2590941 - protein, 20 aa, Entamoeba histolytica
FPDKHSFIFRSFKQEFIVKM

SEQ ID NO: 2590942 - protein, 18 aa, Entamoeba histolytica
FPFFRRLLSLLLLSQVFI

SEQ ID NO: 2590943 - protein, 23 aa, Entamoeba histolytica
FPFIPLKISHDFTVEGFLSIQYS

SEQ ID NO: 2590944 - protein, 20 aa, Entamoeba histolytica
FPIIGFWKHVCVVWTKCMCF

SEQ ID NO: 2590945 - protein, 19 aa, Entamoeba histolytica
FPLHQCFELIQIVNEPILY

SEQ ID NO: 2590946 - protein, 18 aa, Entamoeba histolytica
FPMYMIAVIVVFVLVLVV

SEQ ID NO: 2590947 - protein, 19 aa, Entamoeba histolytica
FPNLHSFPAIILKYEQPED

SEQ ID NO: 2590948 - protein, 17 aa, Entamoeba histolytica
FPSLFTVLYSFVKEFYS

SEQ ID NO: 2590949 - protein, 19 aa, Entamoeba histolytica
FPSSLFIKIMHSVCLFETS

SEQ ID NO: 2590950 - protein, 23 aa, Entamoeba histolytica
FPSTYKWACLDSILILSTQTFNE

SEQ ID NO: 2590951 - protein, 17 aa, Entamoeba histolytica
FPSWGIALIIILSIIVM

SEQ ID NO: 2590952 - protein, 24 aa, Entamoeba histolytica
FPTFKGKWWPSGVMDFFTMAPFIT

SEQ ID NO: 2590953 - protein, 22 aa, Entamoeba histolytica
FPTHLKMVFKYIFSLEITSELE

SEQ ID NO: 2590954 - protein, 17 aa, Entamoeba histolytica
FPVKYFFVFYKQRKLFV

SEQ ID NO: 2590955 - protein, 22 aa, Entamoeba histolytica
FPYRKAHKRVRGWVNNAPRSKY

SEQ ID NO: 2590956 - protein, 18 aa, Entamoeba histolytica
FQLILGLISLCWFGWNQL

SEQ ID NO: 2590957 - protein, 19 aa, Entamoeba histolytica
FQLPMGFPLFQPVTYGYAH

SEQ ID NO: 2590958 - protein, 17 aa, Entamoeba histolytica
FQNKFYLGDGIKFVPFK

SEQ ID NO: 2590959 - protein, 24 aa, Entamoeba histolytica
FQSFLYHCCEVLYAWSCIDVFVVS

SEQ ID NO: 2590960 - protein, 19 aa, Entamoeba histolytica
FREYICLVDKFSLNLLYPS

SEQ ID NO: 2590961 - protein, 19 aa, Entamoeba histolytica
FRFSTEFEYGGSKSDKKVL

SEQ ID NO: 2590962 - protein, 17 aa, Entamoeba histolytica
FRFVMCIIISMQIIRNI

SEQ ID NO: 2590963 - protein, 18 aa, Entamoeba histolytica
FRIGEWMIINGLKTKSEI

SEQ ID NO: 2590964 - protein, 24 aa, Entamoeba histolytica
FRNQECFRRSFDIFINDQFVTQCG

SEQ ID NO: 2590965 - protein, 18 aa, Entamoeba histolytica
FRPASFFPLGYMYEILDK

SEQ ID NO: 2590966 - protein, 21 aa, Entamoeba histolytica
FRPREFFNITVLLRLSKALDI

SEQ ID NO: 2590967 - protein, 24 aa, Entamoeba histolytica
FRVLDRIYLIIGIIIFALILKYFI

SEQ ID NO: 2590968 - protein, 19 aa, Entamoeba histolytica
FRYIHKLRFVIVIFWILAV

SEQ ID NO: 2590969 - protein, 21 aa, Entamoeba histolytica
FRYSHELEIWYAFSQKSMKIP

SEQ ID NO: 2590970 - protein, 18 aa, Entamoeba histolytica
FSAWGFIISYVVYKGGCV

SEQ ID NO: 2590971 - protein, 19 aa, Entamoeba histolytica
FSCFGKILICGETVVREDQ

SEQ ID NO: 2590972 - protein, 17 aa, Entamoeba histolytica
FSFSSRFSFKFLSYKMS

SEQ ID NO: 2590973 - protein, 18 aa, Entamoeba histolytica
FSILLSFLYFMIFSVYDV

SEQ ID NO: 2590974 - protein, 19 aa, Entamoeba histolytica
FSKEWCFYHNTTIKSNTSE

SEQ ID NO: 2590975 - protein, 20 aa, Entamoeba histolytica
FSLLCFTGLYIPASDGLVSW

SEQ ID NO: 2590976 - protein, 17 aa, Entamoeba histolytica
FSLLPSFSQMRFSQVEQ

SEQ ID NO: 2590977 - protein, 17 aa, Entamoeba histolytica
FSPEIIYQLSIDSISGS

SEQ ID NO: 2590978 - protein, 27 aa, Entamoeba histolytica
FSRPIYAVICMFLRIVVSEVQLQISSH

SEQ ID NO: 2590979 - protein, 24 aa, Entamoeba histolytica
FSSRLSEWPTYCVLLKDNKNIETH

SEQ ID NO: 2590980 - protein, 18 aa, Entamoeba histolytica
FSVCFFKMLYFFITAPLG

SEQ ID NO: 2590981 - protein, 17 aa, Entamoeba histolytica
FSYITFIFLFLCFIAYT

SEQ ID NO: 2590982 - protein, 21 aa, Entamoeba histolytica
FTCLTWVLNIIMFRDSTNDNT

SEQ ID NO: 2590983 - protein, 22 aa, Entamoeba histolytica
FTFSLTCFAYFLATLMSKTRIA

SEQ ID NO: 2590984 - protein, 17 aa, Entamoeba histolytica
FTIPRWFVLGIICVVSI

SEQ ID NO: 2590985 - protein, 20 aa, Entamoeba histolytica
FTTAIFLRWVNRVDELMVNN

SEQ ID NO: 2590986 - protein, 23 aa, Entamoeba histolytica
FTVTELFWRIAFVCVGSIQLMTF

SEQ ID NO: 2590987 - protein, 17 aa, Entamoeba histolytica
FVFPIAIFFTIISGILS

SEQ ID NO: 2590988 - protein, 18 aa, Entamoeba histolytica
FVLCCITAFWMLESLART

SEQ ID NO: 2590989 - protein, 24 aa, Entamoeba histolytica
FVLCFSLPCIFHYLSRRKVIAKFN

SEQ ID NO: 2590990 - protein, 18 aa, Entamoeba histolytica
FVYFLKFGIAIGIHLSIL

SEQ ID NO: 2590991 - protein, 18 aa, Entamoeba histolytica
FWKHVCVVWTKCMCFYPQ

SEQ ID NO: 2590992 - protein, 17 aa, Entamoeba histolytica
FWLIIPILMRDIGASPF

SEQ ID NO: 2590993 - protein, 20 aa, Entamoeba histolytica
FWSKRCVPTYCDYGYLFDFD

SEQ ID NO: 2590994 - protein, 18 aa, Entamoeba histolytica
FWTFCVFAGIFLGIPYDE

SEQ ID NO: 2590995 - protein, 22 aa, Entamoeba histolytica
FYCKEVLLGIGFTCLKSLSKEQ

SEQ ID NO: 2590996 - protein, 23 aa, Entamoeba histolytica
FYHFLKRYLKVISPLIVSSYVID

SEQ ID NO: 2590997 - protein, 17 aa, Entamoeba histolytica
FYIMINWFFTLMEYLSI

SEQ ID NO: 2590998 - protein, 18 aa, Entamoeba histolytica
FYYHWKIHYGLVDPITFE

SEQ ID NO: 2590999 - protein, 18 aa, Entamoeba histolytica
GASNKWKGISVIFDTFQN

SEQ ID NO: 2591000 - protein, 24 aa, Entamoeba histolytica
GCCEMCLNELFAPFSTINLLRKQE

SEQ ID NO: 2591001 - protein, 23 aa, Entamoeba histolytica
GCELNCSCAFGWKRDNKGGCVPS

SEQ ID NO: 2591002 - protein, 21 aa, Entamoeba histolytica
GDKIFNFLFRYIHKLRFVIVI

SEQ ID NO: 2591003 - protein, 18 aa, Entamoeba histolytica
GECSKCPVLVNNSVIKSN

SEQ ID NO: 2591004 - protein, 18 aa, Entamoeba histolytica
GESLFVFATTILREGSGN

SEQ ID NO: 2591005 - protein, 21 aa, Entamoeba histolytica
GETAIKCSWSISNENIVSDFV

SEQ ID NO: 2591006 - protein, 18 aa, Entamoeba histolytica
GEVTRMFRLVIGCVQDVC

SEQ ID NO: 2591007 - protein, 19 aa, Entamoeba histolytica
GEVVFPAFFVKFIPIYNEE

SEQ ID NO: 2591008 - protein, 17 aa, Entamoeba histolytica
GFAKDWDLTLVIIIAIA

SEQ ID NO: 2591009 - protein, 24 aa, Entamoeba histolytica
GFFCCGCSFLFIFFFDRVVVTHGG

SEQ ID NO: 2591010 - protein, 20 aa, Entamoeba histolytica
GFFLPCIWIYNIVKYRNSGD

SEQ ID NO: 2591011 - protein, 24 aa, Entamoeba histolytica
GFIFCCLWPINACLYRHSTNKQIQ

SEQ ID NO: 2591012 - protein, 19 aa, Entamoeba histolytica
GFLLLRVMLLKCSFNKLKK

SEQ ID NO: 2591013 - protein, 22 aa, Entamoeba histolytica
GFLYCAFCSFLVPKTEIEEPPK

SEQ ID NO: 2591014 - protein, 17 aa, Entamoeba histolytica
GFSKCWDLTLVIMAVTP

SEQ ID NO: 2591015 - protein, 17 aa, Entamoeba histolytica
GGMLGFFAMDNLNAITS

SEQ ID NO: 2591016 - protein, 18 aa, Entamoeba histolytica
GHCKKLAPEYIKLADAYK

SEQ ID NO: 2591017 - protein, 19 aa, Entamoeba histolytica
GHIIWNWYNRWLVLTKEQL

SEQ ID NO: 2591018 - protein, 18 aa, Entamoeba histolytica
GHNGMFCAIDNSFGICSS

SEQ ID NO: 2591019 - protein, 25 aa, Entamoeba histolytica
GIARILLSLSLCFIGLFIGLSQLFI

SEQ ID NO: 2591020 - protein, 17 aa, Entamoeba histolytica
GIFCFKIVIVIVATIAG

SEQ ID NO: 2591021 - protein, 22 aa, Entamoeba histolytica
GIKGQCLGLGFSIITFFMIASY

SEQ ID NO: 2591022 - protein, 25 aa, Entamoeba histolytica
GILSLTIYVCFSWRGYNDVIESNMA

SEQ ID NO: 2591023 - protein, 19 aa, Entamoeba histolytica
GINYEFVKNLFIKNGNDLK

SEQ ID NO: 2591024 - protein, 24 aa, Entamoeba histolytica
GIPPEVWRYYLLINRPEQSDTVFL

SEQ ID NO: 2591025 - protein, 19 aa, Entamoeba histolytica
GIVYRAEWRKVDVAVKVMK

SEQ ID NO: 2591026 - protein, 17 aa, Entamoeba histolytica
GIYFCLGSFLVIGLEFF

SEQ ID NO: 2591027 - protein, 18 aa, Entamoeba histolytica
GKIFWNFPRACLTGFLFN

SEQ ID NO: 2591028 - protein, 19 aa, Entamoeba histolytica
GKKRLWELFFVFLVGFFRC

SEQ ID NO: 2591029 - protein, 23 aa, Entamoeba histolytica
GKNWREIYKSLLVLDNILKNGSE

SEQ ID NO: 2591030 - protein, 26 aa, Entamoeba histolytica
GKQIYSIFCSLRILLLDVLTQILKSI

SEQ ID NO: 2591031 - protein, 22 aa, Entamoeba histolytica
GLICITCLFLIGSFVAFSFGVP

SEQ ID NO: 2591032 - protein, 21 aa, Entamoeba histolytica
GLILCRLCFPLLFNRGSNIII

SEQ ID NO: 2591033 - protein, 23 aa, Entamoeba histolytica
GLKEWGGAILLGFDGDPYGKDEE

SEQ ID NO: 2591034 - protein, 19 aa, Entamoeba histolytica
GLMKGCARGVYYLHKLGIV

SEQ ID NO: 2591035 - protein, 17 aa, Entamoeba histolytica
GLVKGWLKPSCSVTIWT

SEQ ID NO: 2591036 - protein, 17 aa, Entamoeba histolytica
GLVSWIYYHHKLHNPYF

SEQ ID NO: 2591037 - protein, 28 aa, Entamoeba histolytica
GLYFSWKLSLCILAVFPIISFFMFINGQ

SEQ ID NO: 2591038 - protein, 21 aa, Entamoeba histolytica
GNFPFIWGFFMLCSLSYWVSF

SEQ ID NO: 2591039 - protein, 18 aa, Entamoeba histolytica
GRPRPHFYARIDAKPNEI

SEQ ID NO: 2591040 - protein, 23 aa, Entamoeba histolytica
GSIQRGGAVSVYFDNYLVSTKDR

SEQ ID NO: 2591041 - protein, 22 aa, Entamoeba histolytica
GTFGIVYRAEWRGVDVAIKLMK

SEQ ID NO: 2591042 - protein, 19 aa, Entamoeba histolytica
GTFGVVFKGEWRKIDVAVK

SEQ ID NO: 2591043 - protein, 17 aa, Entamoeba histolytica
GTLIFSFIFGTIGYLLF

SEQ ID NO: 2591044 - protein, 17 aa, Entamoeba histolytica
GTVLTVFMSVLLATQSL

SEQ ID NO: 2591045 - protein, 25 aa, Entamoeba histolytica
GVACPFKICIIPKCSCFIEEDLIII

SEQ ID NO: 2591046 - protein, 17 aa, Entamoeba histolytica
GVIKLNFFGTENIEQNE

SEQ ID NO: 2591047 - protein, 18 aa, Entamoeba histolytica
GVLAEIYISIGLYDSAFQ

SEQ ID NO: 2591048 - protein, 19 aa, Entamoeba histolytica
GVYSFCFDNTMSLYTSKLV

SEQ ID NO: 2591049 - protein, 18 aa, Entamoeba histolytica
GWVLCVLAIPIGIISGYD

SEQ ID NO: 2591050 - protein, 24 aa, Entamoeba histolytica
GYFGYPVCMPHIFGKMIDLEYEFN

SEQ ID NO: 2591051 - protein, 17 aa, Entamoeba histolytica
HAFCYQCIKEWLSRVPN

SEQ ID NO: 2591052 - protein, 24 aa, Entamoeba histolytica
HCATTCKCYFGFIPITINGTTKCS

SEQ ID NO: 2591053 - protein, 17 aa, Entamoeba histolytica
HCKYCTSSDCLLCNDNY

SEQ ID NO: 2591054 - protein, 18 aa, Entamoeba histolytica
HCSYCSFGGVTNGQCSKC

SEQ ID NO: 2591055 - protein, 22 aa, Entamoeba histolytica
HDFVQYWVCFSIQLYLMYINTI

SEQ ID NO: 2591056 - protein, 17 aa, Entamoeba histolytica
HEVYKVYSLVLVHQQSL

SEQ ID NO: 2591057 - protein, 17 aa, Entamoeba histolytica
HFFERFLLCNNLYLTTC

SEQ ID NO: 2591058 - protein, 19 aa, Entamoeba histolytica
HFIRKRLNKVINWDQDTHQ

SEQ ID NO: 2591059 - protein, 22 aa, Entamoeba histolytica
HFKCWRVMTLIAGFMLMLVGGS

SEQ ID NO: 2591060 - protein, 22 aa, Entamoeba histolytica
HFKLSGLLPICYFLEKNDCTQE

SEQ ID NO: 2591061 - protein, 20 aa, Entamoeba histolytica
HGVIIGCLFFDYFKSKKALR

SEQ ID NO: 2591062 - protein, 17 aa, Entamoeba histolytica
HHCPWLGTCVGFKNHKF

SEQ ID NO: 2591063 - protein, 17 aa, Entamoeba histolytica
HKIHLECYLKDYEDSGN

SEQ ID NO: 2591064 - protein, 17 aa, Entamoeba histolytica
HLFVRPAWGKGKYTQFN

SEQ ID NO: 2591065 - protein, 19 aa, Entamoeba histolytica
HLMFWSIFEGIVFLLWIIS

SEQ ID NO: 2591066 - protein, 19 aa, Entamoeba histolytica
HPMFWKFIQGVGLCYLMLI

SEQ ID NO: 2591067 - protein, 21 aa, Entamoeba histolytica
HPYSRIVLINVIILGGFYTIS

SEQ ID NO: 2591068 - protein, 17 aa, Entamoeba histolytica
HQEKIFSAWGFIISYVV

SEQ ID NO: 2591069 - protein, 28 aa, Entamoeba histolytica
HQMKKAMCWRKWKLWIIIGVIAAIIIAV

SEQ ID NO: 2591070 - protein, 23 aa, Entamoeba histolytica
HSEDIPIGWGFKGNIYNEIMNKD

SEQ ID NO: 2591071 - protein, 18 aa, Entamoeba histolytica
HVFICLLAPLAPRFISYF

SEQ ID NO: 2591072 - protein, 19 aa, Entamoeba histolytica
HVSCLKGWLARASDCPICR

SEQ ID NO: 2591073 - protein, 17 aa, Entamoeba histolytica
HVVPICFNWPVGKHSLH

SEQ ID NO: 2591074 - protein, 19 aa, Entamoeba histolytica
HWLELSVMLSWVFIIVFAA

SEQ ID NO: 2591075 - protein, 17 aa, Entamoeba histolytica
HWSLSQFFLWIIVFLLL

SEQ ID NO: 2591076 - protein, 17 aa, Entamoeba histolytica
HYLNRFDVILQHYCEVA

SEQ ID NO: 2591077 - protein, 23 aa, Entamoeba histolytica
IAESCLRLPLPADKLVSFMFISL

SEQ ID NO: 2591078 - protein, 21 aa, Entamoeba histolytica
IAFIIKIIWYRGVIRENSGLL

SEQ ID NO: 2591079 - protein, 33 aa, Entamoeba histolytica
IALPRYPLLTGWKTEFMIGYSLPNKVVISKGKA

SEQ ID NO: 2591080 - protein, 22 aa, Entamoeba histolytica
IAPALVCCRLFFRLTKQSKIYL

SEQ ID NO: 2591081 - protein, 21 aa, Entamoeba histolytica
ICGSLSFLFGCSVQFIGMYSI

SEQ ID NO: 2591082 - protein, 17 aa, Entamoeba histolytica
ICIFPKFYFILEYISYK

SEQ ID NO: 2591083 - protein, 23 aa, Entamoeba histolytica
ICIGEGYGALILYHFLTSHKYDG

SEQ ID NO: 2591084 - protein, 18 aa, Entamoeba histolytica
ICLKTLIEECWKQKPDER

SEQ ID NO: 2591085 - protein, 18 aa, Entamoeba histolytica
ICSMILLIICSRIKRTGI

SEQ ID NO: 2591086 - protein, 20 aa, Entamoeba histolytica
IDITLRFGWTINIILLYFNW

SEQ ID NO: 2591087 - protein, 24 aa, Entamoeba histolytica
IDMPCLYPMAVALTFSREVFQKIS

SEQ ID NO: 2591088 - protein, 18 aa, Entamoeba histolytica
IDRLEVWTPTLPVSVPTS

SEQ ID NO: 2591089 - protein, 19 aa, Entamoeba histolytica
IDVLWCFFIGISVFYSFTI

SEQ ID NO: 2591090 - protein, 23 aa, Entamoeba histolytica
IEDECYKCPPGTYSDKYNCIPCS

SEQ ID NO: 2591091 - protein, 20 aa, Entamoeba histolytica
IEDILPFGLYIKIDDQQIEL

SEQ ID NO: 2591092 - protein, 18 aa, Entamoeba histolytica
IEGFFGYYPVDEPLTTFI

SEQ ID NO: 2591093 - protein, 27 aa, Entamoeba histolytica
IEGFKEWKIIFVDGFIRSTKFEYGINY

SEQ ID NO: 2591094 - protein, 17 aa, Entamoeba histolytica
IEGTFTFKKPVKLKNIH

SEQ ID NO: 2591095 - protein, 18 aa, Entamoeba histolytica
IEIIKLPPFNELKLPRLD

SEQ ID NO: 2591096 - protein, 17 aa, Entamoeba histolytica
IEVITWIIPWFVGGILG

SEQ ID NO: 2591097 - protein, 17 aa, Entamoeba histolytica
IEVLRLVLGRKITMLMF

SEQ ID NO: 2591098 - protein, 23 aa, Entamoeba histolytica
IFILRFLWILIVHRRARGITTND

SEQ ID NO: 2591099 - protein, 17 aa, Entamoeba histolytica
IFISFLFDGIRSQSISQ

SEQ ID NO: 2591100 - protein, 17 aa, Entamoeba histolytica
IFLICWCLFRISDLMIR

SEQ ID NO: 2591101 - protein, 20 aa, Entamoeba histolytica
IFPWKKRSKLVFCVPGAFII

SEQ ID NO: 2591102 - protein, 17 aa, Entamoeba histolytica
IFYKGCSGLLIPKIEQC

SEQ ID NO: 2591103 - protein, 17 aa, Entamoeba histolytica
IGCGLALNQCYWNVKTH

SEQ ID NO: 2591104 - protein, 26 aa, Entamoeba histolytica
IGFIKCWDLTLVVLCMFPFIMVSMMG

SEQ ID NO: 2591105 - protein, 18 aa, Entamoeba histolytica
IGIIIGVCFQFIPRSNNS

SEQ ID NO: 2591106 - protein, 17 aa, Entamoeba histolytica
IGIIQWITCLVLSSLSL

SEQ ID NO: 2591107 - protein, 17 aa, Entamoeba histolytica
IGIYKWAPLLSIFMCLT

SEQ ID NO: 2591108 - protein, 18 aa, Entamoeba histolytica
IGNLLLHYVNWMTNLCYL

SEQ ID NO: 2591109 - protein, 18 aa, Entamoeba histolytica
IGRAFSFPVIVRVYSIAG

SEQ ID NO: 2591110 - protein, 22 aa, Entamoeba histolytica
IGSLCLMIFCYCYIKPFRKVIK

SEQ ID NO: 2591111 - protein, 17 aa, Entamoeba histolytica
IGVLNWVGCTIIIHKRK

SEQ ID NO: 2591112 - protein, 19 aa, Entamoeba histolytica
IHSSRRWKIDISTCETSTN

SEQ ID NO: 2591113 - protein, 18 aa, Entamoeba histolytica
IIDCPMPFFIFEWHYLWY

SEQ ID NO: 2591114 - protein, 18 aa, Entamoeba histolytica
IIFEPRFGITIIQIASST

SEQ ID NO: 2591115 - protein, 18 aa, Entamoeba histolytica
IIGGIGMFALVVVALVEL

SEQ ID NO: 2591116 - protein, 22 aa, Entamoeba histolytica
IIITRTSFFWGRIYKKKERLTL

SEQ ID NO: 2591117 - protein, 20 aa, Entamoeba histolytica
IIIVFCIWFFKKPVEDKPQT

SEQ ID NO: 2591118 - protein, 20 aa, Entamoeba histolytica
IIKTLCYWRNEKIIHQHHLL

SEQ ID NO: 2591119 - protein, 18 aa, Entamoeba histolytica
IILDVCGFYKIIQFSFLS

SEQ ID NO: 2591120 - protein, 20 aa, Entamoeba histolytica
IIPDSVFIEWMIKYDNAKSL

SEQ ID NO: 2591121 - protein, 18 aa, Entamoeba histolytica
IIPFYSLWATIFGGFSDI

SEQ ID NO: 2591122 - protein, 17 aa, Entamoeba histolytica
IIQHFPKLILLFCVYSW

SEQ ID NO: 2591123 - protein, 18 aa, Entamoeba histolytica
IITLCIGIAFFLFSLHVT

SEQ ID NO: 2591124 - protein, 17 aa, Entamoeba histolytica
IIVFSVFYPSLKYPLDS

SEQ ID NO: 2591125 - protein, 18 aa, Entamoeba histolytica
IKCGVCSPILVPLDKDKQ

SEQ ID NO: 2591126 - protein, 20 aa, Entamoeba histolytica
IKCSFIPIILYLMVALLSIN

SEQ ID NO: 2591127 - protein, 17 aa, Entamoeba histolytica
IKDEFTQLLAIKVLSDC

SEQ ID NO: 2591128 - protein, 21 aa, Entamoeba histolytica
IKDFWTHVCIVWTKCLYSLSR

SEQ ID NO: 2591129 - protein, 17 aa, Entamoeba histolytica
IKELECVKGDFFDSTIM

SEQ ID NO: 2591130 - protein, 25 aa, Entamoeba histolytica
IKERRTLWILWAFWWFVYALVCVMA

SEQ ID NO: 2591131 - protein, 21 aa, Entamoeba histolytica
IKGQCLGLGFSIIIFFIIVSY

SEQ ID NO: 2591132 - protein, 20 aa, Entamoeba histolytica
IKGQCLGLGFSVITFFMIAS

SEQ ID NO: 2591133 - protein, 17 aa, Entamoeba histolytica
IKHLFKYVATFLSYYPV

SEQ ID NO: 2591134 - protein, 25 aa, Entamoeba histolytica
IKIQILLIFHMIKLMLVLMIFLIII

SEQ ID NO: 2591135 - protein, 17 aa, Entamoeba histolytica
IKLCMGMKLISKQIAVL

SEQ ID NO: 2591136 - protein, 19 aa, Entamoeba histolytica
IKLLATISVLCFAVYFFAL

SEQ ID NO: 2591137 - protein, 22 aa, Entamoeba histolytica
IKMCNRINPTLAMYEAYATHAL

SEQ ID NO: 2591138 - protein, 21 aa, Entamoeba histolytica
IKMEFANLILLNSDYEVETFV

SEQ ID NO: 2591139 - protein, 21 aa, Entamoeba histolytica
IKMKRMNGIFALRHCTVTMMN

SEQ ID NO: 2591140 - protein, 17 aa, Entamoeba histolytica
IKNHIYISIGFTFVALF

SEQ ID NO: 2591141 - protein, 18 aa, Entamoeba histolytica
IKPPIPKAEESPSEPGKV

SEQ ID NO: 2591142 - protein, 18 aa, Entamoeba histolytica
IKQIRAFKKHIRKLTARK

SEQ ID NO: 2591143 - protein, 19 aa, Entamoeba histolytica
IKSSSSWHPLRFSYDLIGL

SEQ ID NO: 2591144 - protein, 19 aa, Entamoeba histolytica
IKSWNIFLVLGFFVSFILS

SEQ ID NO: 2591145 - protein, 20 aa, Entamoeba histolytica
IKVITFRGSQSFSDFVYDIQ

SEQ ID NO: 2591146 - protein, 20 aa, Entamoeba histolytica
ILCHTLRLRFSLNSVNISTI

SEQ ID NO: 2591147 - protein, 24 aa, Entamoeba histolytica
ILDSLKILIGFVIILLCCVLIWKS

SEQ ID NO: 2591148 - protein, 17 aa, Entamoeba histolytica
ILFEIIELAPFVEFPEN

SEQ ID NO: 2591149 - protein, 18 aa, Entamoeba histolytica
ILFFLLLVYYKFEPNQLV

SEQ ID NO: 2591150 - protein, 23 aa, Entamoeba histolytica
ILFFPFHLVVCYLFRNSNDKRIQ

SEQ ID NO: 2591151 - protein, 19 aa, Entamoeba histolytica
ILFGFSFNYYFVVAMRLLN

SEQ ID NO: 2591152 - protein, 17 aa, Entamoeba histolytica
ILFNFAFESLTSDEEER

SEQ ID NO: 2591153 - protein, 17 aa, Entamoeba histolytica
ILLGELLYLAGLLLPQR

SEQ ID NO: 2591154 - protein, 17 aa, Entamoeba histolytica
ILLYCWLCYNSKNEKEW

SEQ ID NO: 2591155 - protein, 32 aa, Entamoeba histolytica
ILPKLPGVWFYCWGITCALWFSTFQNKNELKY

SEQ ID NO: 2591156 - protein, 21 aa, Entamoeba histolytica
ILQNRYVPWISLARIFYLSLM

SEQ ID NO: 2591157 - protein, 18 aa, Entamoeba histolytica
ILRLYAMIHLARFDPKRK

SEQ ID NO: 2591158 - protein, 19 aa, Entamoeba histolytica
ILSFDRWRSVLSHWKYYLQ

SEQ ID NO: 2591159 - protein, 17 aa, Entamoeba histolytica
ILVIGHIISIIFIFIIY

SEQ ID NO: 2591160 - protein, 17 aa, Entamoeba histolytica
IMLRYMFNLNVLPKEFN

SEQ ID NO: 2591161 - protein, 19 aa, Entamoeba histolytica
IMLYFRFAPFIKENEIVST

SEQ ID NO: 2591162 - protein, 18 aa, Entamoeba histolytica
IMPNFLFLIKICLRIKDI

SEQ ID NO: 2591163 - protein, 18 aa, Entamoeba histolytica
IMQLCVFNFINGTLFYYF

SEQ ID NO: 2591164 - protein, 17 aa, Entamoeba histolytica
IMRRMLLSIYELCPTLS

SEQ ID NO: 2591165 - protein, 19 aa, Entamoeba histolytica
INIITRWYIIISIGLIAFS

SEQ ID NO: 2591166 - protein, 23 aa, Entamoeba histolytica
INILLLCWKKMIRLIESEVQINQ

SEQ ID NO: 2591167 - protein, 21 aa, Entamoeba histolytica
INNCWRFGKGLKMKGFENKSC

SEQ ID NO: 2591168 - protein, 23 aa, Entamoeba histolytica
INPPFKMSWRIAATFLVSLFDAI

SEQ ID NO: 2591169 - protein, 26 aa, Entamoeba histolytica
INTLFKYPHLKSHWSLSQFFLWIIVF

SEQ ID NO: 2591170 - protein, 21 aa, Entamoeba histolytica
IPMILEFVLFLSFVLNPIIGC

SEQ ID NO: 2591171 - protein, 18 aa, Entamoeba histolytica
IPQFFKMFLAFKKVGLDG

SEQ ID NO: 2591172 - protein, 24 aa, Entamoeba histolytica
IPSLCLWTFIFLCVIGFIIVLLYQ

SEQ ID NO: 2591173 - protein, 18 aa, Entamoeba histolytica
IPSSTLWFSFHELPKIGI

SEQ ID NO: 2591174 - protein, 17 aa, Entamoeba histolytica
IQHEVYKVYSLVLVHQQ

SEQ ID NO: 2591175 - protein, 17 aa, Entamoeba histolytica
IQKEILGSFVLPSMKSF

SEQ ID NO: 2591176 - protein, 17 aa, Entamoeba histolytica
IRDANLFFAEFIRDLSL

SEQ ID NO: 2591177 - protein, 18 aa, Entamoeba histolytica
IRKSFRFILPRALLLLTL

SEQ ID NO: 2591178 - protein, 17 aa, Entamoeba histolytica
IRLNAMITQACGENDDF

SEQ ID NO: 2591179 - protein, 19 aa, Entamoeba histolytica
IRLRFSYCETYKLNYQFNE

SEQ ID NO: 2591180 - protein, 17 aa, Entamoeba histolytica
IRVALLLWKHFFLSLPN

SEQ ID NO: 2591181 - protein, 18 aa, Entamoeba histolytica
IRYCPPELLNELDLDETT

SEQ ID NO: 2591182 - protein, 18 aa, Entamoeba histolytica
ISFCCCWILFNIKVFEEL

SEQ ID NO: 2591183 - protein, 18 aa, Entamoeba histolytica
ISFFLCWFVIGIGAACGF

SEQ ID NO: 2591184 - protein, 19 aa, Entamoeba histolytica
ISFIETFAWDYSFNQTIPR

SEQ ID NO: 2591185 - protein, 17 aa, Entamoeba histolytica
ISFKELIIKSALIKGFT

SEQ ID NO: 2591186 - protein, 18 aa, Entamoeba histolytica
ISFSFDFLGLAGWALAIL

SEQ ID NO: 2591187 - protein, 19 aa, Entamoeba histolytica
ISLELKIITGMDVSKNAKL

SEQ ID NO: 2591188 - protein, 17 aa, Entamoeba histolytica
ISLLLPLLLEFIKQNKL

SEQ ID NO: 2591189 - protein, 19 aa, Entamoeba histolytica
ISLLLSVFVFRFTHKFYSL

SEQ ID NO: 2591190 - protein, 17 aa, Entamoeba histolytica
ISLVFSILYVLFVCGFI

SEQ ID NO: 2591191 - protein, 17 aa, Entamoeba histolytica
ISPELAYVGFFQMFPTI

SEQ ID NO: 2591192 - protein, 20 aa, Entamoeba histolytica
ISPIRWALYQGISLKYNHSL

SEQ ID NO: 2591193 - protein, 20 aa, Entamoeba histolytica
ISRRLLLMIFERINFDELFF

SEQ ID NO: 2591194 - protein, 17 aa, Entamoeba histolytica
ISSFSFFFSNEFSSHLG

SEQ ID NO: 2591195 - protein, 17 aa, Entamoeba histolytica
ISSMWLFFRFFKKYKEE

SEQ ID NO: 2591196 - protein, 17 aa, Entamoeba histolytica
ISTIFLPWFNTLRYLKQ

SEQ ID NO: 2591197 - protein, 20 aa, Entamoeba histolytica
ISTSCVVVWNESELALDTSL

SEQ ID NO: 2591198 - protein, 19 aa, Entamoeba histolytica
ISYGLSFFGTKAFEKDEPT

SEQ ID NO: 2591199 - protein, 18 aa, Entamoeba histolytica
ITDCFFLFITLVAGTGIY

SEQ ID NO: 2591200 - protein, 22 aa, Entamoeba histolytica
ITLCCVCPAPLLSIIYSVEYNV

SEQ ID NO: 2591201 - protein, 17 aa, Entamoeba histolytica
ITLEINIYRRCIKIKNN

SEQ ID NO: 2591202 - protein, 18 aa, Entamoeba histolytica
ITVVYSWKTPDNSEIFLT

SEQ ID NO: 2591203 - protein, 17 aa, Entamoeba histolytica
ITYRFIHQYGFDLNSGM

SEQ ID NO: 2591204 - protein, 18 aa, Entamoeba histolytica
IVAVLLKYWLKTRNLNCP

SEQ ID NO: 2591205 - protein, 20 aa, Entamoeba histolytica
IVCGCALGFIGYGYGGPVYA

SEQ ID NO: 2591206 - protein, 19 aa, Entamoeba histolytica
IVEVMYRFFACSIESTKCK

SEQ ID NO: 2591207 - protein, 22 aa, Entamoeba histolytica
IVIYRYLLNAVFVYPTEQNIES

SEQ ID NO: 2591208 - protein, 17 aa, Entamoeba histolytica
IVLTCCMFLSTRLEGFT

SEQ ID NO: 2591209 - protein, 22 aa, Entamoeba histolytica
IVPVCIMLGFSCIRELLDEFRK

SEQ ID NO: 2591210 - protein, 19 aa, Entamoeba histolytica
IVQCLYRFVTHSTSLDIKQ

SEQ ID NO: 2591211 - protein, 24 aa, Entamoeba histolytica
IVSFSFCCLACWVVFMFQPTFSCS

SEQ ID NO: 2591212 - protein, 19 aa, Entamoeba histolytica
IVYRAKWRKIEIAVKVLKT

SEQ ID NO: 2591213 - protein, 18 aa, Entamoeba histolytica
IWLLICTAIFGALIIITA

SEQ ID NO: 2591214 - protein, 20 aa, Entamoeba histolytica
IWTRKLWRSACSLLDYIKGI

SEQ ID NO: 2591215 - protein, 20 aa, Entamoeba histolytica
IYGSCLIRFFGFYLATLLLF

SEQ ID NO: 2591216 - protein, 22 aa, Entamoeba histolytica
IYHEMVRLLGIIAVRQPSLSHN

SEQ ID NO: 2591217 - protein, 19 aa, Entamoeba histolytica
IYLQHPICQIIHSIATQFH

SEQ ID NO: 2591218 - protein, 20 aa, Entamoeba histolytica
KAAVFKMDIGQYFGISASNG

SEQ ID NO: 2591219 - protein, 21 aa, Entamoeba histolytica
KAEEVFKIIFRLAPNHCFAHY

SEQ ID NO: 2591220 - protein, 21 aa, Entamoeba histolytica
KAIEIFFRFCELDLFKESKEI

SEQ ID NO: 2591221 - protein, 26 aa, Entamoeba histolytica
KAKCIEYKKGKSLKIYNKEIDNNKRY

SEQ ID NO: 2591222 - protein, 19 aa, Entamoeba histolytica
KCKIEYGLKIGRHGCMKCF

SEQ ID NO: 2591223 - protein, 19 aa, Entamoeba histolytica
KCLKCGLGCLFCEDDSGDC

SEQ ID NO: 2591224 - protein, 21 aa, Entamoeba histolytica
KCLLYGSMCDLMIRKIPKTSS

SEQ ID NO: 2591225 - protein, 17 aa, Entamoeba histolytica
KDFIKSFILETILNLII

SEQ ID NO: 2591226 - protein, 17 aa, Entamoeba histolytica
KDNLGFEMPIFYNDSIG

SEQ ID NO: 2591227 - protein, 19 aa, Entamoeba histolytica
KDNSLWAILFVYRNADAKQ

SEQ ID NO: 2591228 - protein, 18 aa, Entamoeba histolytica
KDTKCKFVEFDCTNSKLV

SEQ ID NO: 2591229 - protein, 23 aa, Entamoeba histolytica
KEDFKVMVPFSMKSKTTKIDVIK

SEQ ID NO: 2591230 - protein, 18 aa, Entamoeba histolytica
KEEYCIFINKLLQLLQIK

SEQ ID NO: 2591231 - protein, 20 aa, Entamoeba histolytica
KEFMVRTGISMGVTVIVTFT

SEQ ID NO: 2591232 - protein, 21 aa, Entamoeba histolytica
KEFRIPISIFIDQQFLALMKL

SEQ ID NO: 2591233 - protein, 17 aa, Entamoeba histolytica
KEICFNFGLTLDFIGKN

SEQ ID NO: 2591234 - protein, 20 aa, Entamoeba histolytica
KEIFKLLILKFPTLPPIEIP

SEQ ID NO: 2591235 - protein, 19 aa, Entamoeba histolytica
KEIYKEGCWYAFNTNGQQK

SEQ ID NO: 2591236 - protein, 19 aa, Entamoeba histolytica
KEIYQMFGFSSLKKRMNTL

SEQ ID NO: 2591237 - protein, 19 aa, Entamoeba histolytica
KELIIKSALIKGFTMTSGI

SEQ ID NO: 2591238 - protein, 18 aa, Entamoeba histolytica
KENCWKYLIEFISDVFPV

SEQ ID NO: 2591239 - protein, 17 aa, Entamoeba histolytica
KEQFKAFSQLCEWREKT

SEQ ID NO: 2591240 - protein, 20 aa, Entamoeba histolytica
KERIFGCGKITTIVVFLIMA

SEQ ID NO: 2591241 - protein, 17 aa, Entamoeba histolytica
KESRASTLLTFDIFGPP

SEQ ID NO: 2591242 - protein, 19 aa, Entamoeba histolytica
KETLAFDVIEKFVQLLSPE

SEQ ID NO: 2591243 - protein, 17 aa, Entamoeba histolytica
KEVPTWAIAVIVIVGVI

SEQ ID NO: 2591244 - protein, 19 aa, Entamoeba histolytica
KEYFIAIGIFLQIYEIKKR

SEQ ID NO: 2591245 - protein, 18 aa, Entamoeba histolytica
KEYISLFSSMNWIIHDSI

SEQ ID NO: 2591246 - protein, 23 aa, Entamoeba histolytica
KFFKSKAGIILGCVIGVVLLLII

SEQ ID NO: 2591247 - protein, 17 aa, Entamoeba histolytica
KFFPLGCYMNWYDDFDI

SEQ ID NO: 2591248 - protein, 17 aa, Entamoeba histolytica
KGLSFNFIETLYYTHGI

SEQ ID NO: 2591249 - protein, 18 aa, Entamoeba histolytica
KGTFPFIWIFLVFASICY

SEQ ID NO: 2591250 - protein, 17 aa, Entamoeba histolytica
KHFRIVAVLLKYWLKTR

SEQ ID NO: 2591251 - protein, 18 aa, Entamoeba histolytica
KHVWPSLLFMVLITFLLS

SEQ ID NO: 2591252 - protein, 17 aa, Entamoeba histolytica
KICFGSAIYCMSCSSDK

SEQ ID NO: 2591253 - protein, 17 aa, Entamoeba histolytica
KIEKEFREQLIIEQERL

SEQ ID NO: 2591254 - protein, 17 aa, Entamoeba histolytica
KIHSCDFLFPMNFPQSL

SEQ ID NO: 2591255 - protein, 21 aa, Entamoeba histolytica
KIVDFWGIFICCFVIAFAAFF

SEQ ID NO: 2591256 - protein, 20 aa, Entamoeba histolytica
KKDGYKWFAIQKVMNKKQIS

SEQ ID NO: 2591257 - protein, 23 aa, Entamoeba histolytica
KKGELKAVIILGLIHNEEIIIPK

SEQ ID NO: 2591258 - protein, 18 aa, Entamoeba histolytica
KKLNMFIKFCDIIKTLHT

SEQ ID NO: 2591259 - protein, 18 aa, Entamoeba histolytica
KKMNCCISNVNNFLQSFG

SEQ ID NO: 2591260 - protein, 20 aa, Entamoeba histolytica
KKNKCSKCSFWYGTNEEGNE

SEQ ID NO: 2591261 - protein, 19 aa, Entamoeba histolytica
KKRIWWLRIIEEIWLILVG

SEQ ID NO: 2591262 - protein, 19 aa, Entamoeba histolytica
KKRLPGIEVLYPNLMVTME

SEQ ID NO: 2591263 - protein, 23 aa, Entamoeba histolytica
KKVMKIFIHFIIKYMEENIKNKE

SEQ ID NO: 2591264 - protein, 24 aa, Entamoeba histolytica
KKYARLTITFAILGIFMSPLFILS

SEQ ID NO: 2591265 - protein, 17 aa, Entamoeba histolytica
KLCYYRFGELMTDRNKP

SEQ ID NO: 2591266 - protein, 17 aa, Entamoeba histolytica
KLDYVWRTALALGAVPC

SEQ ID NO: 2591267 - protein, 17 aa, Entamoeba histolytica
KLFAGRPRPHFYARLSE

SEQ ID NO: 2591268 - protein, 17 aa, Entamoeba histolytica
KLFECIKALALCHNVTP

SEQ ID NO: 2591269 - protein, 19 aa, Entamoeba histolytica
KLKIKILFDTARGMQFLHE

SEQ ID NO: 2591270 - protein, 20 aa, Entamoeba histolytica
KLKKMIIEWSINIKVFDKKN

SEQ ID NO: 2591271 - protein, 20 aa, Entamoeba histolytica
KLLCTCYGYFFADIFMLIPE

SEQ ID NO: 2591272 - protein, 20 aa, Entamoeba histolytica
KLLVCPRLTLYALQSIQFIL

SEQ ID NO: 2591273 - protein, 24 aa, Entamoeba histolytica
KLNWEIICGIAIDIAEGLVCLKEN

SEQ ID NO: 2591274 - protein, 18 aa, Entamoeba histolytica
KLRRCALYSASIMIFTLN

SEQ ID NO: 2591275 - protein, 24 aa, Entamoeba histolytica
KLTKLKMLLLFIAIMAFASIFIIF

SEQ ID NO: 2591276 - protein, 18 aa, Entamoeba histolytica
KLWGYFCGVLEHPQADVL

SEQ ID NO: 2591277 - protein, 18 aa, Entamoeba histolytica
KMKCNLCEYLSDVDDNYF

SEQ ID NO: 2591278 - protein, 21 aa, Entamoeba histolytica
KMKRVCVIPIWLSHEDYPYLL

SEQ ID NO: 2591279 - protein, 22 aa, Entamoeba histolytica
KMMDILYKIHLKSEGIKEERTD

SEQ ID NO: 2591280 - protein, 19 aa, Entamoeba histolytica
KMPFPLSYRFKLITQQGLG

SEQ ID NO: 2591281 - protein, 17 aa, Entamoeba histolytica
KNAVHFCPNCKKRLGSK

SEQ ID NO: 2591282 - protein, 17 aa, Entamoeba histolytica
KNCSSCSFGYYFNDEGI

SEQ ID NO: 2591283 - protein, 24 aa, Entamoeba histolytica
KNEHCLKCPKGTFSQDLQHCKEEC

SEQ ID NO: 2591284 - protein, 18 aa, Entamoeba histolytica
KNGKCFKCQDGCNVCYED

SEQ ID NO: 2591285 - protein, 18 aa, Entamoeba histolytica
KNIFKWGLILALVNAITN

SEQ ID NO: 2591286 - protein, 27 aa, Entamoeba histolytica
KNMLAWDVVCFYSFYFLICCCEQDALR

SEQ ID NO: 2591287 - protein, 19 aa, Entamoeba histolytica
KNNIFGMMGVIFYWIITQK

SEQ ID NO: 2591288 - protein, 19 aa, Entamoeba histolytica
KNNKCSKCSFWYGTNEEGN

SEQ ID NO: 2591289 - protein, 20 aa, Entamoeba histolytica
KNNKCSKCSFWYGTNEEGNE

SEQ ID NO: 2591290 - protein, 17 aa, Entamoeba histolytica
KNVLEWWVPSTIANIRT

SEQ ID NO: 2591291 - protein, 17 aa, Entamoeba histolytica
KNYIIKKSMKFLIFMII

SEQ ID NO: 2591292 - protein, 17 aa, Entamoeba histolytica
KPISWRKNINFWIGRIL

SEQ ID NO: 2591293 - protein, 17 aa, Entamoeba histolytica
KPNHIIVLFGSQHKGHL

SEQ ID NO: 2591294 - protein, 17 aa, Entamoeba histolytica
KPSEIFVAAAIGIQCVN

SEQ ID NO: 2591295 - protein, 18 aa, Entamoeba histolytica
KQKYRFGKWFKINLNQVT

SEQ ID NO: 2591296 - protein, 32 aa, Entamoeba histolytica
KQLKDFFVFRIMKLRWLKSQFFVWFSILTLIH

SEQ ID NO: 2591297 - protein, 18 aa, Entamoeba histolytica
KRAMWWKNIKLYLIAGAI

SEQ ID NO: 2591298 - protein, 19 aa, Entamoeba histolytica
KRGIIKWGPLLSITNAITN

SEQ ID NO: 2591299 - protein, 19 aa, Entamoeba histolytica
KRIAPIIFHNTFWLIKDYY

SEQ ID NO: 2591300 - protein, 19 aa, Entamoeba histolytica
KRIISYNCLPSFLTTLLHT

SEQ ID NO: 2591301 - protein, 22 aa, Entamoeba histolytica
KRISQPMFREFLLRVHPQLYTH

SEQ ID NO: 2591302 - protein, 21 aa, Entamoeba histolytica
KRKKLPLGFKFLQVIQEKDFE

SEQ ID NO: 2591303 - protein, 20 aa, Entamoeba histolytica
KRLDLVLLLLKFGARIYIAN

SEQ ID NO: 2591304 - protein, 18 aa, Entamoeba histolytica
KRLNFPRMRGILGTTELK

SEQ ID NO: 2591305 - protein, 19 aa, Entamoeba histolytica
KRLPHFFQILSLTPIGRGI

SEQ ID NO: 2591306 - protein, 20 aa, Entamoeba histolytica
KRPKILVSYIDYYFEKPNKG

SEQ ID NO: 2591307 - protein, 21 aa, Entamoeba histolytica
KRRIVELLYGFSLIGRPTPIS

SEQ ID NO: 2591308 - protein, 23 aa, Entamoeba histolytica
KRRTSLPNALPFKINATPFIPKR

SEQ ID NO: 2591309 - protein, 21 aa, Entamoeba histolytica
KRSKLVFCVPGAFIISNPQGV

SEQ ID NO: 2591310 - protein, 24 aa, Entamoeba histolytica
KRTMWWKNMKLWLIIGGVVAVIVI

SEQ ID NO: 2591311 - protein, 17 aa, Entamoeba histolytica
KRYFFFFTFHDDNLLIN

SEQ ID NO: 2591312 - protein, 17 aa, Entamoeba histolytica
KSGGMLGFFAMDNLNAI

SEQ ID NO: 2591313 - protein, 19 aa, Entamoeba histolytica
KSGNCSLSYFLTISSSPYE

SEQ ID NO: 2591314 - protein, 24 aa, Entamoeba histolytica
KSHKDLECLYNFFDGCHDLRSVEI

SEQ ID NO: 2591315 - protein, 20 aa, Entamoeba histolytica
KSIVIPLLIGFIVPLISNII

SEQ ID NO: 2591316 - protein, 17 aa, Entamoeba histolytica
KSKGCLEYESYENLLQL

SEQ ID NO: 2591317 - protein, 29 aa, Entamoeba histolytica
KSLCKRIIQFPGWFFKQFFRTDPKGASMF

SEQ ID NO: 2591318 - protein, 18 aa, Entamoeba histolytica
KSQLSMKVARCYAQINNI

SEQ ID NO: 2591319 - protein, 18 aa, Entamoeba histolytica
KSSLKMKVIRKMKIYNPS

SEQ ID NO: 2591320 - protein, 24 aa, Entamoeba histolytica
KSSNWKIGLVIGVLVVVLIIIIIL

SEQ ID NO: 2591321 - protein, 21 aa, Entamoeba histolytica
KSVKWYYCLGITFCDISATFC

SEQ ID NO: 2591322 - protein, 23 aa, Entamoeba histolytica
KTFKPSIVSFKFTYGKNETDPFI

SEQ ID NO: 2591323 - protein, 17 aa, Entamoeba histolytica
KTKCPINKLTIIESKEV

SEQ ID NO: 2591324 - protein, 22 aa, Entamoeba histolytica
KTLYYKWIYPIAIAIDITLRFG

SEQ ID NO: 2591325 - protein, 20 aa, Entamoeba histolytica
KTPCKKSRWILYDKELEACW

SEQ ID NO: 2591326 - protein, 24 aa, Entamoeba histolytica
KTQKRISLIYAFVISIIFSGFIPL

SEQ ID NO: 2591327 - protein, 18 aa, Entamoeba histolytica
KTSFEVIYNYPLDVSVQQ

SEQ ID NO: 2591328 - protein, 19 aa, Entamoeba histolytica
KTVGGLAWYFVKLIEINHS

SEQ ID NO: 2591329 - protein, 17 aa, Entamoeba histolytica
KVFPSWGIALIIILSII

SEQ ID NO: 2591330 - protein, 21 aa, Entamoeba histolytica
KVGGLKPSWEIAYCSWEESIS

SEQ ID NO: 2591331 - protein, 25 aa, Entamoeba histolytica
KVNIKELFRYAGVFEIILLIIGIIG

SEQ ID NO: 2591332 - protein, 26 aa, Entamoeba histolytica
KVRLVWKEIRGVWQWIEGKTYEVKPE

SEQ ID NO: 2591333 - protein, 18 aa, Entamoeba histolytica
KVVFCAAHSLPITYRILD

SEQ ID NO: 2591334 - protein, 18 aa, Entamoeba histolytica
KWEAFKWALISGVCEPFG

SEQ ID NO: 2591335 - protein, 18 aa, Entamoeba histolytica
KWMYIGLAIGCFFVTDIV

SEQ ID NO: 2591336 - protein, 21 aa, Entamoeba histolytica
KYFNLICGIIIMLLAVNRKDI

SEQ ID NO: 2591337 - protein, 18 aa, Entamoeba histolytica
KYGRMALLKMTELKEPKR

SEQ ID NO: 2591338 - protein, 21 aa, Entamoeba histolytica
LAFPLMLQYVIKWINNPQGTL

SEQ ID NO: 2591339 - protein, 18 aa, Entamoeba histolytica
LAIFWRKQKQYVFHFTGV

SEQ ID NO: 2591340 - protein, 17 aa, Entamoeba histolytica
LAIGCFFVTDIVLYLLV

SEQ ID NO: 2591341 - protein, 17 aa, Entamoeba histolytica
LAIVFQLIVCFSQEFGK

SEQ ID NO: 2591342 - protein, 17 aa, Entamoeba histolytica
LALDAMCSMCAVGCDKE

SEQ ID NO: 2591343 - protein, 17 aa, Entamoeba histolytica
LALIYLRNGWVLCVLAI

SEQ ID NO: 2591344 - protein, 18 aa, Entamoeba histolytica
LAVIRFILGLGIGGEYPL

SEQ ID NO: 2591345 - protein, 26 aa, Entamoeba histolytica
LCDHFKFTVPFLKYWTFDNIIFHYKN

SEQ ID NO: 2591346 - protein, 17 aa, Entamoeba histolytica
LCFCPFCQFGIKSMGLD

SEQ ID NO: 2591347 - protein, 17 aa, Entamoeba histolytica
LCICWSTIPILSWLVPC

SEQ ID NO: 2591348 - protein, 17 aa, Entamoeba histolytica
LCMMLKYMIEHFKENGN

SEQ ID NO: 2591349 - protein, 17 aa, Entamoeba histolytica
LCMWGALVLTTFTSQGM

SEQ ID NO: 2591350 - protein, 17 aa, Entamoeba histolytica
LCPCFGTNCIIHSLTGL

SEQ ID NO: 2591351 - protein, 17 aa, Entamoeba histolytica
LCPKKFLNNYACEGRID

SEQ ID NO: 2591352 - protein, 18 aa, Entamoeba histolytica
LCVYFWKAKVLTFIVPIL

SEQ ID NO: 2591353 - protein, 17 aa, Entamoeba histolytica
LDFIGEYLLMFNSFPDK

SEQ ID NO: 2591354 - protein, 20 aa, Entamoeba histolytica
LDGFGYRYTEHWVLDNSKPT

SEQ ID NO: 2591355 - protein, 24 aa, Entamoeba histolytica
LDIRWRYKLILSFCSSALIVIIYP

SEQ ID NO: 2591356 - protein, 29 aa, Entamoeba histolytica
LDKSKCIEYRKGRALKIYNKEIDNNNKYY

SEQ ID NO: 2591357 - protein, 18 aa, Entamoeba histolytica
LDWLIVMVDFYFERQRSV

SEQ ID NO: 2591358 - protein, 17 aa, Entamoeba histolytica
LEACWKKLALLILTRKG

SEQ ID NO: 2591359 - protein, 20 aa, Entamoeba histolytica
LEAPCGFARTMNRSAGDDFS

SEQ ID NO: 2591360 - protein, 24 aa, Entamoeba histolytica
LEGWRFSYKSGYYFGLLNIIFVSV

SEQ ID NO: 2591361 - protein, 22 aa, Entamoeba histolytica
LEKSSRVFGFFPLEFFGPPIVV

SEQ ID NO: 2591362 - protein, 18 aa, Entamoeba histolytica
LELLIAIVRSCWKLNVFE

SEQ ID NO: 2591363 - protein, 22 aa, Entamoeba histolytica
LEMKFCYEREEFGKTIIDDLIP

SEQ ID NO: 2591364 - protein, 25 aa, Entamoeba histolytica
LEQTWKSGVVMLIIFIVLFTALSIW

SEQ ID NO: 2591365 - protein, 17 aa, Entamoeba histolytica
LETFGFVSFLFVFNEKT

SEQ ID NO: 2591366 - protein, 18 aa, Entamoeba histolytica
LETPFKFRMEKTVSVDND

SEQ ID NO: 2591367 - protein, 21 aa, Entamoeba histolytica
LEYRRLLPILLNYGTGATPSI

SEQ ID NO: 2591368 - protein, 22 aa, Entamoeba histolytica
LFAGRPRPNFYAMIDAGNMKDA

SEQ ID NO: 2591369 - protein, 27 aa, Entamoeba histolytica
LFALGFLCCCVWCYGWCQYRHSTNSQA

SEQ ID NO: 2591370 - protein, 24 aa, Entamoeba histolytica
LFCGCFILKIAIYFVQPFLKSYLF

SEQ ID NO: 2591371 - protein, 17 aa, Entamoeba histolytica
LFELFSFVILLSLSNFG

SEQ ID NO: 2591372 - protein, 18 aa, Entamoeba histolytica
LFFCLSNFYPSKSFFTKE

SEQ ID NO: 2591373 - protein, 17 aa, Entamoeba histolytica
LFFLRYLFLPLISYPSL

SEQ ID NO: 2591374 - protein, 18 aa, Entamoeba histolytica
LFIICWFFLFLIRIYLIY

SEQ ID NO: 2591375 - protein, 18 aa, Entamoeba histolytica
LFILGFFICLTWIACYCI

SEQ ID NO: 2591376 - protein, 17 aa, Entamoeba histolytica
LFIPFLIAYIIGKKSES

SEQ ID NO: 2591377 - protein, 20 aa, Entamoeba histolytica
LFKKNCANIRKWNAERTNER

SEQ ID NO: 2591378 - protein, 17 aa, Entamoeba histolytica
LFKKRLPGIEVLYPNLM

SEQ ID NO: 2591379 - protein, 17 aa, Entamoeba histolytica
LFLEYAWMKGIDGFNNE

SEQ ID NO: 2591380 - protein, 17 aa, Entamoeba histolytica
LFLIYAFIIHYYRFSVI

SEQ ID NO: 2591381 - protein, 18 aa, Entamoeba histolytica
LFLLFTIFCDAFCLQEAM

SEQ ID NO: 2591382 - protein, 20 aa, Entamoeba histolytica
LFMKYHFPIYFSIEPSSISL

SEQ ID NO: 2591383 - protein, 17 aa, Entamoeba histolytica
LFVIAFRSCMNFIVWAI

SEQ ID NO: 2591384 - protein, 19 aa, Entamoeba histolytica
LFVSFLIVCAVILIIAVVI

SEQ ID NO: 2591385 - protein, 17 aa, Entamoeba histolytica
LFWNFPRACLAGFMFNF

SEQ ID NO: 2591386 - protein, 22 aa, Entamoeba histolytica
LGEMWGGQFLRWFNFACLVLYL

SEQ ID NO: 2591387 - protein, 17 aa, Entamoeba histolytica
LGFLVVVMVFRFFLCKG

SEQ ID NO: 2591388 - protein, 19 aa, Entamoeba histolytica
LGMRVELIGCVGLGAVVIF

SEQ ID NO: 2591389 - protein, 18 aa, Entamoeba histolytica
LGRWSWDVEPIWVESSLK

SEQ ID NO: 2591390 - protein, 21 aa, Entamoeba histolytica
LHGGWKYLFIVLSRFEQMNLI

SEQ ID NO: 2591391 - protein, 23 aa, Entamoeba histolytica
LHIVCFFIPLGIYFMLKNITDEN

SEQ ID NO: 2591392 - protein, 22 aa, Entamoeba histolytica
LHLPKHLPIILGFIPYDFKNKE

SEQ ID NO: 2591393 - protein, 18 aa, Entamoeba histolytica
LHRIACFRDDIIFLIYLY

SEQ ID NO: 2591394 - protein, 20 aa, Entamoeba histolytica
LHSILRCGRLIMSSKTRIVG

SEQ ID NO: 2591395 - protein, 21 aa, Entamoeba histolytica
LHWRDVMKIAVKWRQISEPND

SEQ ID NO: 2591396 - protein, 25 aa, Entamoeba histolytica
LHYVFSSSCSLCFESLENEESLSLI

SEQ ID NO: 2591397 - protein, 20 aa, Entamoeba histolytica
LIFLQCVSNLLGIPREVPVI

SEQ ID NO: 2591398 - protein, 17 aa, Entamoeba histolytica
LIIACIFFLFIIYWSLM

SEQ ID NO: 2591399 - protein, 17 aa, Entamoeba histolytica
LIIFIGIWSYCGIRFQR

SEQ ID NO: 2591400 - protein, 19 aa, Entamoeba histolytica
LIIHLQPSIPIYVFIHSPY

SEQ ID NO: 2591401 - protein, 17 aa, Entamoeba histolytica
LIKVFRGNGKWLKEFRV

SEQ ID NO: 2591402 - protein, 17 aa, Entamoeba histolytica
LILCFVGWYFLTKTQSI

SEQ ID NO: 2591403 - protein, 22 aa, Entamoeba histolytica
LILCPTCLILGVDKCSAIPLKE

SEQ ID NO: 2591404 - protein, 18 aa, Entamoeba histolytica
LILMNSLLFIFKFTLTFV

SEQ ID NO: 2591405 - protein, 20 aa, Entamoeba histolytica
LIRKSWPYLPLIFKESYCTR

SEQ ID NO: 2591406 - protein, 24 aa, Entamoeba histolytica
LITWKDGKKFFPLGLYFDEIVDSD

SEQ ID NO: 2591407 - protein, 17 aa, Entamoeba histolytica
LKCISYFLPFISDKNIL

SEQ ID NO: 2591408 - protein, 20 aa, Entamoeba histolytica
LKELFGNVVDVCFAYEAITE

SEQ ID NO: 2591409 - protein, 17 aa, Entamoeba histolytica
LKGETGVDEKLTTDKGA

SEQ ID NO: 2591410 - protein, 23 aa, Entamoeba histolytica
LKGMLRRAICNKIFLIILAIVFL

SEQ ID NO: 2591411 - protein, 17 aa, Entamoeba histolytica
LKGWLARASDCPICRNP

SEQ ID NO: 2591412 - protein, 27 aa, Entamoeba histolytica
LKIKDFWKHVCIVWTMCYNSLPPKKIE

SEQ ID NO: 2591413 - protein, 19 aa, Entamoeba histolytica
LKKGITLIGFRLSDFNNDI

SEQ ID NO: 2591414 - protein, 20 aa, Entamoeba histolytica
LKLGAGVYRLSLLVHESLKI

SEQ ID NO: 2591415 - protein, 20 aa, Entamoeba histolytica
LKLPRLDAFSSDAQTCLNQN

SEQ ID NO: 2591416 - protein, 25 aa, Entamoeba histolytica
LKLTWSQRILFCLGFCGFGMLCIFM

SEQ ID NO: 2591417 - protein, 17 aa, Entamoeba histolytica
LKPFLKEEMVIAEIERK

SEQ ID NO: 2591418 - protein, 17 aa, Entamoeba histolytica
LKPRLKIKFMIDTAKGI

SEQ ID NO: 2591419 - protein, 19 aa, Entamoeba histolytica
LKSIWVYKFFVQLIQKLNT

SEQ ID NO: 2591420 - protein, 17 aa, Entamoeba histolytica
LKVRFCQDIARGMEYLH

SEQ ID NO: 2591421 - protein, 17 aa, Entamoeba histolytica
LKWYFSIFTKILEKVSE

SEQ ID NO: 2591422 - protein, 18 aa, Entamoeba histolytica
LLCCISFTFSKSAIHRLK

SEQ ID NO: 2591423 - protein, 18 aa, Entamoeba histolytica
LLDFCYYTNFLLLVTIIL

SEQ ID NO: 2591424 - protein, 19 aa, Entamoeba histolytica
LLEIAYCYLNFCIAAKPNL

SEQ ID NO: 2591425 - protein, 19 aa, Entamoeba histolytica
LLFIWRFIIRRIIHPNPIQ

SEQ ID NO: 2591426 - protein, 19 aa, Entamoeba histolytica
LLHRALCNFVDNFRELKLI

SEQ ID NO: 2591427 - protein, 21 aa, Entamoeba histolytica
LLIDILLEFGFFFDSKMARHS

SEQ ID NO: 2591428 - protein, 22 aa, Entamoeba histolytica
LLLCISCGLVIVGMFLQSFSFD

SEQ ID NO: 2591429 - protein, 27 aa, Entamoeba histolytica
LLLFKAWMLRWWKIMYLRLLDLQKWKV

SEQ ID NO: 2591430 - protein, 23 aa, Entamoeba histolytica
LLLLCFLSDLFLCEAQKQEWPLF

SEQ ID NO: 2591431 - protein, 21 aa, Entamoeba histolytica
LLMFCIGIFWIIVGTLILISS

SEQ ID NO: 2591432 - protein, 17 aa, Entamoeba histolytica
LLMTVPYFIIMIGTETI

SEQ ID NO: 2591433 - protein, 21 aa, Entamoeba histolytica
LLNGTVCIANFFATERQVDCL

SEQ ID NO: 2591434 - protein, 18 aa, Entamoeba histolytica
LLNRIICWVLMISHNFTT

SEQ ID NO: 2591435 - protein, 17 aa, Entamoeba histolytica
LLNRLAVCIGKKEEIPN

SEQ ID NO: 2591436 - protein, 17 aa, Entamoeba histolytica
LLRCIVEVLGIQMNSTQ

SEQ ID NO: 2591437 - protein, 24 aa, Entamoeba histolytica
LLRSIECLESFLIHHDILNIFKAA

SEQ ID NO: 2591438 - protein, 18 aa, Entamoeba histolytica
LLRWNRLIVEVCLNNCSI

SEQ ID NO: 2591439 - protein, 24 aa, Entamoeba histolytica
LLSRFAVYIPIPWNKWPILGLSVV

SEQ ID NO: 2591440 - protein, 23 aa, Entamoeba histolytica
LLSYGVWCLIGFFVYSIYKFLTS

SEQ ID NO: 2591441 - protein, 25 aa, Entamoeba histolytica
LLTGKFRFGYVFGFTIIGSLAEYFI

SEQ ID NO: 2591442 - protein, 24 aa, Entamoeba histolytica
LLWVGVCFLCFLGIRINYLGLAII

SEQ ID NO: 2591443 - protein, 17 aa, Entamoeba histolytica
LLYRFVQTLGMLPFSLL

SEQ ID NO: 2591444 - protein, 17 aa, Entamoeba histolytica
LMYCLLIVFGLTIILSF

SEQ ID NO: 2591445 - protein, 18 aa, Entamoeba histolytica
LMYIHCFMRRDFLCKREV

SEQ ID NO: 2591446 - protein, 18 aa, Entamoeba histolytica
LNCGCLVCNNCFTEHRII

SEQ ID NO: 2591447 - protein, 23 aa, Entamoeba histolytica
LNEDFWMRHSLIALFSWYVIILL

SEQ ID NO: 2591448 - protein, 25 aa, Entamoeba histolytica
LNGKLRFGNIYGFSIIASFVEYLVM

SEQ ID NO: 2591449 - protein, 17 aa, Entamoeba histolytica
LNQLLSLVSDWPLQESI

SEQ ID NO: 2591450 - protein, 19 aa, Entamoeba histolytica
LNRYTKLCVYTFSIVLPII

SEQ ID NO: 2591451 - protein, 18 aa, Entamoeba histolytica
LNSCISFTDYAAYFFYNN

SEQ ID NO: 2591452 - protein, 18 aa, Entamoeba histolytica
LNSIALKIINLFSTQTEL

SEQ ID NO: 2591453 - protein, 18 aa, Entamoeba histolytica
LPETLVFHLKRFGYNEQF

SEQ ID NO: 2591454 - protein, 19 aa, Entamoeba histolytica
LPFTFPVKYFFVFYKQRKL

SEQ ID NO: 2591455 - protein, 20 aa, Entamoeba histolytica
LPLCCLKKGLISPIDITNKY

SEQ ID NO: 2591456 - protein, 17 aa, Entamoeba histolytica
LPLCLQKWINWGFNVSE

SEQ ID NO: 2591457 - protein, 20 aa, Entamoeba histolytica
LPLFFCLSNFYPSKSFFTKE

SEQ ID NO: 2591458 - protein, 20 aa, Entamoeba histolytica
LPMTMVLRFAKNINNALDVL

SEQ ID NO: 2591459 - protein, 21 aa, Entamoeba histolytica
LPNLRRLEIRAGRNGLTENLP

SEQ ID NO: 2591460 - protein, 17 aa, Entamoeba histolytica
LPRMIGIGLFTDVSTSQ

SEQ ID NO: 2591461 - protein, 18 aa, Entamoeba histolytica
LPVKVVFCLIGICYLAVN

SEQ ID NO: 2591462 - protein, 20 aa, Entamoeba histolytica
LPYTFSFPWLNAIIIYVISI

SEQ ID NO: 2591463 - protein, 17 aa, Entamoeba histolytica
LQLFSLDSFDTWIMVII

SEQ ID NO: 2591464 - protein, 17 aa, Entamoeba histolytica
LQLPYTFSFPWLNAIII

SEQ ID NO: 2591465 - protein, 17 aa, Entamoeba histolytica
LQRRLFIVILMNVALIG

SEQ ID NO: 2591466 - protein, 18 aa, Entamoeba histolytica
LQTSRVFCKYAFPDNLAR

SEQ ID NO: 2591467 - protein, 27 aa, Entamoeba histolytica
LQWILRSCVLIAYFFCFILYFFMNILH

SEQ ID NO: 2591468 - protein, 21 aa, Entamoeba histolytica
LRAMFSFTFFWYNFMPLTRGT

SEQ ID NO: 2591469 - protein, 17 aa, Entamoeba histolytica
LRCLALFLEYAWMKGID

SEQ ID NO: 2591470 - protein, 21 aa, Entamoeba histolytica
LRFIAPMPFYLVTGSSLQLAI

SEQ ID NO: 2591471 - protein, 18 aa, Entamoeba histolytica
LRIITPFISKWNEAEIKS

SEQ ID NO: 2591472 - protein, 21 aa, Entamoeba histolytica
LRIPLILKDIFESVGSKQVPI

SEQ ID NO: 2591473 - protein, 19 aa, Entamoeba histolytica
LRIVISVIFFFISCFFDIP

SEQ ID NO: 2591474 - protein, 17 aa, Entamoeba histolytica
LRLDAEWLLNNIASHQM

SEQ ID NO: 2591475 - protein, 17 aa, Entamoeba histolytica
LRLFGVLTMISMMLFFM

SEQ ID NO: 2591476 - protein, 20 aa, Entamoeba histolytica
LRLLVPSTWYSKDFINDALI

SEQ ID NO: 2591477 - protein, 17 aa, Entamoeba histolytica
LRLSTLQVLLKGILSAE

SEQ ID NO: 2591478 - protein, 21 aa, Entamoeba histolytica
LRRKANFIFGNAFYYKSYSSQ

SEQ ID NO: 2591479 - protein, 17 aa, Entamoeba histolytica
LRWFSLFTTDVFMKTTL

SEQ ID NO: 2591480 - protein, 19 aa, Entamoeba histolytica
LSEDPCFFVFILTALFLLK

SEQ ID NO: 2591481 - protein, 24 aa, Entamoeba histolytica
LSFDGRFPFIWTYSTLVASCYWIS

SEQ ID NO: 2591482 - protein, 17 aa, Entamoeba histolytica
LSFYIMINWFFTLMEYL

SEQ ID NO: 2591483 - protein, 19 aa, Entamoeba histolytica
LSIAFFERFHRYFLTHYPS

SEQ ID NO: 2591484 - protein, 26 aa, Entamoeba histolytica
LSIKIPHLFPYLSMVFNYLFEFIPTS

SEQ ID NO: 2591485 - protein, 20 aa, Entamoeba histolytica
LSILCFIIYIPTYFVYGQSE

SEQ ID NO: 2591486 - protein, 20 aa, Entamoeba histolytica
LSISCSIGYTCLDVMNNFKD

SEQ ID NO: 2591487 - protein, 19 aa, Entamoeba histolytica
LSLCNRFSLQITFLESLLD

SEQ ID NO: 2591488 - protein, 25 aa, Entamoeba histolytica
LSLFFLHFWRSCLIFIVLPSFYIFK

SEQ ID NO: 2591489 - protein, 20 aa, Entamoeba histolytica
LSLPEDWFEFGLILSKTPMF

SEQ ID NO: 2591490 - protein, 18 aa, Entamoeba histolytica
LSPLFPFPISNYVLGPFC

SEQ ID NO: 2591491 - protein, 17 aa, Entamoeba histolytica
LSQFKRSLCSSKYSYSV

SEQ ID NO: 2591492 - protein, 17 aa, Entamoeba histolytica
LSQLVIDSCNIIDCIAK

SEQ ID NO: 2591493 - protein, 18 aa, Entamoeba histolytica
LSRYDFYDALSISLNGFI

SEQ ID NO: 2591494 - protein, 20 aa, Entamoeba histolytica
LSTICFAFGFALYYDWKLAL

SEQ ID NO: 2591495 - protein, 17 aa, Entamoeba histolytica
LTGSISLLNYVPKTIGS

SEQ ID NO: 2591496 - protein, 18 aa, Entamoeba histolytica
LTKIIGLIIGCCFVYYTN

SEQ ID NO: 2591497 - protein, 20 aa, Entamoeba histolytica
LTLLVLIQWSGLFQIRHSLH

SEQ ID NO: 2591498 - protein, 19 aa, Entamoeba histolytica
LTNKCGWCSITKKCGYCED

SEQ ID NO: 2591499 - protein, 25 aa, Entamoeba histolytica
LTPILPCFICDGGLLILSRIPLKDR

SEQ ID NO: 2591500 - protein, 17 aa, Entamoeba histolytica
LTSCLLKTFPAVVISNI

SEQ ID NO: 2591501 - protein, 23 aa, Entamoeba histolytica
LTSPEFFEFFSFIDNLLMNEAVA

SEQ ID NO: 2591502 - protein, 19 aa, Entamoeba histolytica
LTVTIVCVILLFSYIFTYV

SEQ ID NO: 2591503 - protein, 23 aa, Entamoeba histolytica
LVCDIRFPPKLAFATMKNIYSFF

SEQ ID NO: 2591504 - protein, 33 aa, Entamoeba histolytica
LVFILCCVLCCFGLLCFSCIPCCLDGLKDAHHK

SEQ ID NO: 2591505 - protein, 17 aa, Entamoeba histolytica
LVGLLLVYGIVHNKKAI

SEQ ID NO: 2591506 - protein, 19 aa, Entamoeba histolytica
LVKAYFLMCEIIEFNETKE

SEQ ID NO: 2591507 - protein, 19 aa, Entamoeba histolytica
LVLLISIIVSIMFGIIRVI

SEQ ID NO: 2591508 - protein, 17 aa, Entamoeba histolytica
LVLLWFVMHFMLAVQSI

SEQ ID NO: 2591509 - protein, 17 aa, Entamoeba histolytica
LVMCYKQRLSVIHYLYS

SEQ ID NO: 2591510 - protein, 19 aa, Entamoeba histolytica
LVNSICLYSPFPYGYESET

SEQ ID NO: 2591511 - protein, 19 aa, Entamoeba histolytica
LVPVWWNFVVVIIIIDIII

SEQ ID NO: 2591512 - protein, 18 aa, Entamoeba histolytica
LVRSVRTGMRYVQEYDLI

SEQ ID NO: 2591513 - protein, 18 aa, Entamoeba histolytica
LVTYSIYWLPYVNLAQDY

SEQ ID NO: 2591514 - protein, 17 aa, Entamoeba histolytica
LWFKFIGVRVIFVGIIF

SEQ ID NO: 2591515 - protein, 19 aa, Entamoeba histolytica
LWFTLEFISFIGMFYSFIT

SEQ ID NO: 2591516 - protein, 19 aa, Entamoeba histolytica
LWLCLCNIPSSSSLLEIIP

SEQ ID NO: 2591517 - protein, 17 aa, Entamoeba histolytica
LYFAYGFLMSIFIQITI

SEQ ID NO: 2591518 - protein, 20 aa, Entamoeba histolytica
LYKHIERYLSLRLLSTSSKE

SEQ ID NO: 2591519 - protein, 17 aa, Entamoeba histolytica
LYLKYCIIITIIRFLFT

SEQ ID NO: 2591520 - protein, 23 aa, Entamoeba histolytica
LYLVCIMFNFNLVKEFNFIDKKD

SEQ ID NO: 2591521 - protein, 17 aa, Entamoeba histolytica
LYPRIILNEGNGTSEDG

SEQ ID NO: 2591522 - protein, 19 aa, Entamoeba histolytica
MADALSWGRGLGCSFLEDC

SEQ ID NO: 2591523 - protein, 21 aa, Entamoeba histolytica
MAKIWYSQRLEWMGFTISTLT

SEQ ID NO: 2591524 - protein, 24 aa, Entamoeba histolytica
MAKLWYLQRMDWIGAFIIVITTTV

SEQ ID NO: 2591525 - protein, 19 aa, Entamoeba histolytica
MALACARQGITLVTVYATL

SEQ ID NO: 2591526 - protein, 22 aa, Entamoeba histolytica
MAPEIYRYFKVILITMQIILLS

SEQ ID NO: 2591527 - protein, 18 aa, Entamoeba histolytica
MCCSELKEFCAIINEHEE

SEQ ID NO: 2591528 - protein, 19 aa, Entamoeba histolytica
MCLTMRFFIMLRIYLSKHI

SEQ ID NO: 2591529 - protein, 17 aa, Entamoeba histolytica
MFLLIDLMRNWFLSSND

SEQ ID NO: 2591530 - protein, 17 aa, Entamoeba histolytica
MFNCFLLTLGLAFNFIS

SEQ ID NO: 2591531 - protein, 18 aa, Entamoeba histolytica
MFYKRIGLGITFYMLVWA

SEQ ID NO: 2591532 - protein, 24 aa, Entamoeba histolytica
MGFITLPNCVVCIGIKGIKCVEIN

SEQ ID NO: 2591533 - protein, 20 aa, Entamoeba histolytica
MGGLKPSWEVAYCSWEESIN

SEQ ID NO: 2591534 - protein, 19 aa, Entamoeba histolytica
MILLIICSRIKRTGIIQTM

SEQ ID NO: 2591535 - protein, 17 aa, Entamoeba histolytica
MIMIHSLGHSFSIHQHM

SEQ ID NO: 2591536 - protein, 17 aa, Entamoeba histolytica
MKLFGMMHPINGAITSA

SEQ ID NO: 2591537 - protein, 17 aa, Entamoeba histolytica
MKLKLIMPKGIWEEDVE

SEQ ID NO: 2591538 - protein, 22 aa, Entamoeba histolytica
MKLTEIFKVFVLYFKFNSKENI

SEQ ID NO: 2591539 - protein, 17 aa, Entamoeba histolytica
MKLVGLLLVYGIVHNKK

SEQ ID NO: 2591540 - protein, 25 aa, Entamoeba histolytica
MKNAMWWKNFKLWLIIGTVVAIIIL

SEQ ID NO: 2591541 - protein, 21 aa, Entamoeba histolytica
MKPSFKRLLIKGSVVKTAMAQ

SEQ ID NO: 2591542 - protein, 23 aa, Entamoeba histolytica
MKRVLKYLVYWLLNGTVCIANFF

SEQ ID NO: 2591543 - protein, 17 aa, Entamoeba histolytica
MKSYQCMISGFFKINNA

SEQ ID NO: 2591544 - protein, 19 aa, Entamoeba histolytica
MKVLCKIHRGLTCCIDGRI

SEQ ID NO: 2591545 - protein, 17 aa, Entamoeba histolytica
MKYKVLMKFLLFTLLTF

SEQ ID NO: 2591546 - protein, 24 aa, Entamoeba histolytica
MLIATVITICFSRFFTVCVYDKIA

SEQ ID NO: 2591547 - protein, 17 aa, Entamoeba histolytica
MLLKCSFTRLKKRMPTI

SEQ ID NO: 2591548 - protein, 18 aa, Entamoeba histolytica
MLNLRSGFVNFLCMWGAL

SEQ ID NO: 2591549 - protein, 18 aa, Entamoeba histolytica
MLPKQFAAFMFFDCHNKF

SEQ ID NO: 2591550 - protein, 18 aa, Entamoeba histolytica
MLYLWRLGKIAEVIEKYL

SEQ ID NO: 2591551 - protein, 19 aa, Entamoeba histolytica
MNFLKYCRFNGFFNKEDKL

SEQ ID NO: 2591552 - protein, 22 aa, Entamoeba histolytica
MNIKNYWFNPAFNNIFSFKENH

SEQ ID NO: 2591553 - protein, 17 aa, Entamoeba histolytica
MRILKDVAKGMSFLHEN

SEQ ID NO: 2591554 - protein, 17 aa, Entamoeba histolytica
MRRRLSIAIAMTGNPKV

SEQ ID NO: 2591555 - protein, 17 aa, Entamoeba histolytica
MRSMLYLWRLGKIAEVI

SEQ ID NO: 2591556 - protein, 19 aa, Entamoeba histolytica
MTFLTWFFVSRCWKNKYTE

SEQ ID NO: 2591557 - protein, 19 aa, Entamoeba histolytica
MTKFMGWKRFVFREYPVAL

SEQ ID NO: 2591558 - protein, 23 aa, Entamoeba histolytica
MTYKEFYSLAAIERCRIKDSLHN

SEQ ID NO: 2591559 - protein, 17 aa, Entamoeba histolytica
MVAYCIRWYSDLDIPKE

SEQ ID NO: 2591560 - protein, 18 aa, Entamoeba histolytica
MYIPEIIYLLNLIGSVFT

SEQ ID NO: 2591561 - protein, 24 aa, Entamoeba histolytica
MYLLKEIFNFIVIVFAFMGGLLIY

SEQ ID NO: 2591562 - protein, 22 aa, Entamoeba histolytica
MYNLYKAELKGEVTTQITDEVP

SEQ ID NO: 2591563 - protein, 24 aa, Entamoeba histolytica
MYSNKHKIMYNKYNIHLKSEQHQV

SEQ ID NO: 2591564 - protein, 23 aa, Entamoeba histolytica
NCHKDSNCAFIFEDQEQITLHIP

SEQ ID NO: 2591565 - protein, 19 aa, Entamoeba histolytica
NCIYSKFEYLINCEEKGIT

SEQ ID NO: 2591566 - protein, 20 aa, Entamoeba histolytica
NCKRIAEKMLFGIKDLTENV

SEQ ID NO: 2591567 - protein, 17 aa, Entamoeba histolytica
NCLYRFNLLLSSNITHL

SEQ ID NO: 2591568 - protein, 19 aa, Entamoeba histolytica
NCMLEHLSLIFTQRSCSTN

SEQ ID NO: 2591569 - protein, 21 aa, Entamoeba histolytica
NCRRWKGSIIEYIPKGNKPIN

SEQ ID NO: 2591570 - protein, 22 aa, Entamoeba histolytica
NELLKRILKIVALYPKSNQVLI

SEQ ID NO: 2591571 - protein, 18 aa, Entamoeba histolytica
NFGCCFLLSWVCGFINNF

SEQ ID NO: 2591572 - protein, 18 aa, Entamoeba histolytica
NFGPRGTLIFSFIFGTIG

SEQ ID NO: 2591573 - protein, 19 aa, Entamoeba histolytica
NFISRFGVKFTITSNNHLK

SEQ ID NO: 2591574 - protein, 17 aa, Entamoeba histolytica
NFPPRINVINEYAFSGC

SEQ ID NO: 2591575 - protein, 20 aa, Entamoeba histolytica
NFWICCLHFIGTPLISNNAS

SEQ ID NO: 2591576 - protein, 17 aa, Entamoeba histolytica
NFYEIGWRFVFIILSCI

SEQ ID NO: 2591577 - protein, 19 aa, Entamoeba histolytica
NGCKDCLCSPQYLPYSIPR

SEQ ID NO: 2591578 - protein, 21 aa, Entamoeba histolytica
NGEWSTKCIVSYCDDGYKFDY

SEQ ID NO: 2591579 - protein, 22 aa, Entamoeba histolytica
NGWKTSRVRIARSLDKEELNNT

SEQ ID NO: 2591580 - protein, 20 aa, Entamoeba histolytica
NGWVLCVLAIPIGIISGYDL

SEQ ID NO: 2591581 - protein, 17 aa, Entamoeba histolytica
NIGSAVLHCIGYFSLFI

SEQ ID NO: 2591582 - protein, 25 aa, Entamoeba histolytica
NIKSRLRVSLLYTWCVILILNNVRI

SEQ ID NO: 2591583 - protein, 18 aa, Entamoeba histolytica
NIMYKRIIYIQALGQCTL

SEQ ID NO: 2591584 - protein, 26 aa, Entamoeba histolytica
NINFKWRLSQYITWYIVFSLLMSMLM

SEQ ID NO: 2591585 - protein, 17 aa, Entamoeba histolytica
NINFWIGRILFFCAFIL

SEQ ID NO: 2591586 - protein, 23 aa, Entamoeba histolytica
NIYRLSFVMVMNFCYFLFELIIG

SEQ ID NO: 2591587 - protein, 18 aa, Entamoeba histolytica
NKDFRFSTEFEYGGSKSD

SEQ ID NO: 2591588 - protein, 24 aa, Entamoeba histolytica
NKDYISSISFCWWLLNGILSSITI

SEQ ID NO: 2591589 - protein, 20 aa, Entamoeba histolytica
NKLICLSGECSLVVAADTVI

SEQ ID NO: 2591590 - protein, 18 aa, Entamoeba histolytica
NKRFAISKCCGVIQINSE

SEQ ID NO: 2591591 - protein, 21 aa, Entamoeba histolytica
NKRFSYFFFHWSDLIRTAFFH

SEQ ID NO: 2591592 - protein, 17 aa, Entamoeba histolytica
NKRLLCRSLIYNPEPYY

SEQ ID NO: 2591593 - protein, 22 aa, Entamoeba histolytica
NKVECPYWLAPECIINKKACLK

SEQ ID NO: 2591594 - protein, 18 aa, Entamoeba histolytica
NKVGYFGVFYYKDENCTE

SEQ ID NO: 2591595 - protein, 18 aa, Entamoeba histolytica
NLDCSFNRIFSFPPILSL

SEQ ID NO: 2591596 - protein, 19 aa, Entamoeba histolytica
NLNGTSCIFVILSVVVTFL

SEQ ID NO: 2591597 - protein, 19 aa, Entamoeba histolytica
NMALLCFDILLLVFVFWIF

SEQ ID NO: 2591598 - protein, 19 aa, Entamoeba histolytica
NMLFDICLELGYFFTLKKS

SEQ ID NO: 2591599 - protein, 17 aa, Entamoeba histolytica
NNIIKTLCYWRNEKIIH

SEQ ID NO: 2591600 - protein, 18 aa, Entamoeba histolytica
NNKCSKCSFWYGTNEEGN

SEQ ID NO: 2591601 - protein, 17 aa, Entamoeba histolytica
NNNFCFINHLGIYIRET

SEQ ID NO: 2591602 - protein, 18 aa, Entamoeba histolytica
NNRINCKIKECYNSLECL

SEQ ID NO: 2591603 - protein, 20 aa, Entamoeba histolytica
NPMRYWRIGVLFGGTIYVII

SEQ ID NO: 2591604 - protein, 18 aa, Entamoeba histolytica
NPRLFCGIFEEFLGNGIE

SEQ ID NO: 2591605 - protein, 21 aa, Entamoeba histolytica
NPRVALVLGIIFNFFEDSKTS

SEQ ID NO: 2591606 - protein, 22 aa, Entamoeba histolytica
NPSRLSKWLPIISLVYSQHLDQ

SEQ ID NO: 2591607 - protein, 18 aa, Entamoeba histolytica
NQQCVACPAGYFQSQNEC

SEQ ID NO: 2591608 - protein, 17 aa, Entamoeba histolytica
NRKEICFNFGLTLDFIG

SEQ ID NO: 2591609 - protein, 22 aa, Entamoeba histolytica
NRKRVGECLIHLSKDQKHQAQQ

SEQ ID NO: 2591610 - protein, 18 aa, Entamoeba histolytica
NRMKDIFETIGFTITTLN

SEQ ID NO: 2591611 - protein, 17 aa, Entamoeba histolytica
NRRINLLVLQTFYPSPL

SEQ ID NO: 2591612 - protein, 18 aa, Entamoeba histolytica
NRVVELFSNFILSAKNLK

SEQ ID NO: 2591613 - protein, 17 aa, Entamoeba histolytica
NSISTSCVVVWNESELA

SEQ ID NO: 2591614 - protein, 17 aa, Entamoeba histolytica
NSNPLQITFKWSDTFKK

SEQ ID NO: 2591615 - protein, 19 aa, Entamoeba histolytica
NSRDICKIYSLFAETIIST

SEQ ID NO: 2591616 - protein, 20 aa, Entamoeba histolytica
NSSIYSVCWSFGKSLGYLFG

SEQ ID NO: 2591617 - protein, 19 aa, Entamoeba histolytica
NTCKLCFDGFVLNGLKCVS

SEQ ID NO: 2591618 - protein, 24 aa, Entamoeba histolytica
NTIKRLTFGYVFVLCFDYLYISNS

SEQ ID NO: 2591619 - protein, 19 aa, Entamoeba histolytica
NVCQRWLGMRVELIGCVGL

SEQ ID NO: 2591620 - protein, 19 aa, Entamoeba histolytica
NVIPRLVLNVGVTKSPLKS

SEQ ID NO: 2591621 - protein, 22 aa, Entamoeba histolytica
NVLRIGFYIGEPFEISLLIQSI

SEQ ID NO: 2591622 - protein, 19 aa, Entamoeba histolytica
NYFKAIVCGIIIFFVKLWT

SEQ ID NO: 2591623 - protein, 19 aa, Entamoeba histolytica
NYMKRVWESLVLVIFIRPF

SEQ ID NO: 2591624 - protein, 17 aa, Entamoeba histolytica
NYPRWLMWGSVVNGNQT

SEQ ID NO: 2591625 - protein, 17 aa, Entamoeba histolytica
PALFEGWGKKQGGSVKT

SEQ ID NO: 2591626 - protein, 20 aa, Entamoeba histolytica
PALFLRRIYDIGMSKIDQYV

SEQ ID NO: 2591627 - protein, 17 aa, Entamoeba histolytica
PCELRKKVIFNFVLSHK

SEQ ID NO: 2591628 - protein, 18 aa, Entamoeba histolytica
PCGEWSFKYRGTRPEIVH

SEQ ID NO: 2591629 - protein, 21 aa, Entamoeba histolytica
PCGNFSSYGYSYLMVRGGGDV

SEQ ID NO: 2591630 - protein, 17 aa, Entamoeba histolytica
PDVWKGISILINTNENN

SEQ ID NO: 2591631 - protein, 21 aa, Entamoeba histolytica
PEALKLVPIFVLGAMKTSAFM

SEQ ID NO: 2591632 - protein, 23 aa, Entamoeba histolytica
PEFPFMWGYCWFTTILSYLSLWN

SEQ ID NO: 2591633 - protein, 20 aa, Entamoeba histolytica
PEGWCSCIPQTILLLQRYGY

SEQ ID NO: 2591634 - protein, 19 aa, Entamoeba histolytica
PEHCLDCLNSEYCFKCENG

SEQ ID NO: 2591635 - protein, 20 aa, Entamoeba histolytica
PEILTTLALDFKIARSCPNG

SEQ ID NO: 2591636 - protein, 20 aa, Entamoeba histolytica
PEMMRLPIIQGFIGRSECAV

SEQ ID NO: 2591637 - protein, 21 aa, Entamoeba histolytica
PETWKGVVYLLVIAFMQILTS

SEQ ID NO: 2591638 - protein, 18 aa, Entamoeba histolytica
PEYRRAYATVAFHGTYLP

SEQ ID NO: 2591639 - protein, 17 aa, Entamoeba histolytica
PEYRYLCCFDEECNPML

SEQ ID NO: 2591640 - protein, 17 aa, Entamoeba histolytica
PFCDFQDLFSIKSHVLA

SEQ ID NO: 2591641 - protein, 18 aa, Entamoeba histolytica
PFFPLILKLILQESFALV

SEQ ID NO: 2591642 - protein, 25 aa, Entamoeba histolytica
PFGPKWKKGDVVSICVDFDQRRIKI

SEQ ID NO: 2591643 - protein, 17 aa, Entamoeba histolytica
PFLKRIKIISSIDASSQ

SEQ ID NO: 2591644 - protein, 17 aa, Entamoeba histolytica
PFPKTQFKFAWDIADLV

SEQ ID NO: 2591645 - protein, 20 aa, Entamoeba histolytica
PFTMSFIRSRIQSVKVILTV

SEQ ID NO: 2591646 - protein, 20 aa, Entamoeba histolytica
PGKRECKRCEIEYGKYVNEN

SEQ ID NO: 2591647 - protein, 18 aa, Entamoeba histolytica
PHKYCWREGDDLYINIKG

SEQ ID NO: 2591648 - protein, 18 aa, Entamoeba histolytica
PIECKTCFYEHCLTCADD

SEQ ID NO: 2591649 - protein, 18 aa, Entamoeba histolytica
PIFCCISILLYLITSIAA

SEQ ID NO: 2591650 - protein, 21 aa, Entamoeba histolytica
PIILLRPLFRIPLKQNDLVIG

SEQ ID NO: 2591651 - protein, 17 aa, Entamoeba histolytica
PIIPMFILCSIFITHRN

SEQ ID NO: 2591652 - protein, 20 aa, Entamoeba histolytica
PIIRRMVCIFDKLLEALNKS

SEQ ID NO: 2591653 - protein, 17 aa, Entamoeba histolytica
PIYVAGCGLLFGTLAII

SEQ ID NO: 2591654 - protein, 18 aa, Entamoeba histolytica
PKGRYILRQVFDKKKNLV

SEQ ID NO: 2591655 - protein, 20 aa, Entamoeba histolytica
PKHIIPFVFSWPSCSNPFLY

SEQ ID NO: 2591656 - protein, 22 aa, Entamoeba histolytica
PKKNILRWGPTLAFVSAANTFV

SEQ ID NO: 2591657 - protein, 18 aa, Entamoeba histolytica
PKPIYYRKYKRVVKQVKP

SEQ ID NO: 2591658 - protein, 21 aa, Entamoeba histolytica
PKTQFKFAWDIADLVANGKRT

SEQ ID NO: 2591659 - protein, 19 aa, Entamoeba histolytica
PKVFFDRCSWLLSLPEDWF

SEQ ID NO: 2591660 - protein, 18 aa, Entamoeba histolytica
PLFHSVLPFSLPKLRRRE

SEQ ID NO: 2591661 - protein, 18 aa, Entamoeba histolytica
PLFWDFNKKLNFIKSASD

SEQ ID NO: 2591662 - protein, 21 aa, Entamoeba histolytica
PLFYRLIKVILMPKTTVPQTI

SEQ ID NO: 2591663 - protein, 17 aa, Entamoeba histolytica
PLIYLTRFVPFTFIRKY

SEQ ID NO: 2591664 - protein, 20 aa, Entamoeba histolytica
PLKYLWPSVRVVLYRTIYGL

SEQ ID NO: 2591665 - protein, 18 aa, Entamoeba histolytica
PLQITFKWSDTFKKDNSS

SEQ ID NO: 2591666 - protein, 19 aa, Entamoeba histolytica
PLVHSYCCRHVWGNDSKAF

SEQ ID NO: 2591667 - protein, 17 aa, Entamoeba histolytica
PLYLEFYSMFSAGHFII

SEQ ID NO: 2591668 - protein, 17 aa, Entamoeba histolytica
PMLPTMIPIILKRVNLN

SEQ ID NO: 2591669 - protein, 19 aa, Entamoeba histolytica
PMYCAFSFLVIAGGKTVLL

SEQ ID NO: 2591670 - protein, 18 aa, Entamoeba histolytica
PNQCGIVFCLSKKDCESL

SEQ ID NO: 2591671 - protein, 18 aa, Entamoeba histolytica
PNVICKYIEWGRIEIIKE

SEQ ID NO: 2591672 - protein, 21 aa, Entamoeba histolytica
PPKFECWWLTRIIPYIFLIFV

SEQ ID NO: 2591673 - protein, 19 aa, Entamoeba histolytica
PPSSLRLDAEWLLNNIASH

SEQ ID NO: 2591674 - protein, 23 aa, Entamoeba histolytica
PQLLFVIRWFFSFLLDPVNSVTL

SEQ ID NO: 2591675 - protein, 19 aa, Entamoeba histolytica
PRKGLWYKVVNNYKYAFPL

SEQ ID NO: 2591676 - protein, 20 aa, Entamoeba histolytica
PRVDLYLMIFLKFLATVIPT

SEQ ID NO: 2591677 - protein, 21 aa, Entamoeba histolytica
PRWFVLGIICVVSIFILLLWM

SEQ ID NO: 2591678 - protein, 22 aa, Entamoeba histolytica
PSGHSKCTFAFLRINQPVDNVD

SEQ ID NO: 2591679 - protein, 18 aa, Entamoeba histolytica
PSGIKWILSFSICGSSVA

SEQ ID NO: 2591680 - protein, 24 aa, Entamoeba histolytica
PSHDFWRHVCIVWNKCYYSISDRQ

SEQ ID NO: 2591681 - protein, 21 aa, Entamoeba histolytica
PSLKQLHIFGAVFAENGFFQR

SEQ ID NO: 2591682 - protein, 24 aa, Entamoeba histolytica
PSLMPYKCMISGWFTYNGSDTNDN

SEQ ID NO: 2591683 - protein, 21 aa, Entamoeba histolytica
PSPIIPFCFLDFIKQQENCKL

SEQ ID NO: 2591684 - protein, 20 aa, Entamoeba histolytica
PSSHAQFWCCFIVLFYYYIN

SEQ ID NO: 2591685 - protein, 21 aa, Entamoeba histolytica
PSSHAQFWCCFIVLFYYYINQ

SEQ ID NO: 2591686 - protein, 25 aa, Entamoeba histolytica
PSSLLIKRKLVLIAFQCLQSKVIKP

SEQ ID NO: 2591687 - protein, 20 aa, Entamoeba histolytica
PTFEPSFVFSLGFWWRVAVI

SEQ ID NO: 2591688 - protein, 21 aa, Entamoeba histolytica
PTIPRRSSIQFSYHNLIEKTR

SEQ ID NO: 2591689 - protein, 20 aa, Entamoeba histolytica
PTSMPFHYFMLFVRLLISLT

SEQ ID NO: 2591690 - protein, 18 aa, Entamoeba histolytica
PVCICCWFLNLFQSKKTR

SEQ ID NO: 2591691 - protein, 20 aa, Entamoeba histolytica
PYDCCGWKLTNITTLNNSTC

SEQ ID NO: 2591692 - protein, 17 aa, Entamoeba histolytica
QAAEIISIIVTFGGIDI

SEQ ID NO: 2591693 - protein, 17 aa, Entamoeba histolytica
QCISCSNILFLEANSRK

SEQ ID NO: 2591694 - protein, 20 aa, Entamoeba histolytica
QCTKCRCSVCDKKEGCYIGC

SEQ ID NO: 2591695 - protein, 17 aa, Entamoeba histolytica
QCVICLILAILSGHSHS

SEQ ID NO: 2591696 - protein, 24 aa, Entamoeba histolytica
QECAKRVQLEWEELLGLLEEFAAF

SEQ ID NO: 2591697 - protein, 21 aa, Entamoeba histolytica
QECREIMDFLYKRLCEDGKNW

SEQ ID NO: 2591698 - protein, 17 aa, Entamoeba histolytica
QELKKGITLIGFRLSDF

SEQ ID NO: 2591699 - protein, 17 aa, Entamoeba histolytica
QEYILSHCVDWLQVINS

SEQ ID NO: 2591700 - protein, 24 aa, Entamoeba histolytica
QFNPMVIVKYSWFFFELIIRSLVY

SEQ ID NO: 2591701 - protein, 24 aa, Entamoeba histolytica
QFVFSLPIDVCFGIASNNDGYMIV

SEQ ID NO: 2591702 - protein, 17 aa, Entamoeba histolytica
QHKIMYNLYKAELKGEV

SEQ ID NO: 2591703 - protein, 22 aa, Entamoeba histolytica
QHLNEWIDLIFGFKQTGEPAIK

SEQ ID NO: 2591704 - protein, 21 aa, Entamoeba histolytica
QHLNEWIDLIFGYKQRGKNAE

SEQ ID NO: 2591705 - protein, 17 aa, Entamoeba histolytica
QINEHFKKLIKYLPQFT

SEQ ID NO: 2591706 - protein, 19 aa, Entamoeba histolytica
QKHVFYRGFTLPTFLKECM

SEQ ID NO: 2591707 - protein, 18 aa, Entamoeba histolytica
QKIPVVWARAIVEASEAI

SEQ ID NO: 2591708 - protein, 17 aa, Entamoeba histolytica
QKKFCIFPSVSKEITTF

SEQ ID NO: 2591709 - protein, 20 aa, Entamoeba histolytica
QKKSMKWIYSIIVIPVIIAI

SEQ ID NO: 2591710 - protein, 19 aa, Entamoeba histolytica
QLCLCPLCINGIPNYNDTK

SEQ ID NO: 2591711 - protein, 19 aa, Entamoeba histolytica
QNMIISFFLCWFVIGIGAA

SEQ ID NO: 2591712 - protein, 19 aa, Entamoeba histolytica
QQSSWKIVWIVLLISLILA

SEQ ID NO: 2591713 - protein, 22 aa, Entamoeba histolytica
QRPLCPRYMLLLNEIVRLSLLI

SEQ ID NO: 2591714 - protein, 20 aa, Entamoeba histolytica
QRVEPLLGFINGFFLVLFSA

SEQ ID NO: 2591715 - protein, 23 aa, Entamoeba histolytica
QTLTDFYLFFSIVAEQQPIDLSK

SEQ ID NO: 2591716 - protein, 18 aa, Entamoeba histolytica
QVFIKFYIIIAVNQKKNF

SEQ ID NO: 2591717 - protein, 19 aa, Entamoeba histolytica
QVKFLWLCLCNIPSSSSLL

SEQ ID NO: 2591718 - protein, 18 aa, Entamoeba histolytica
QWCYRKARRIACGIDSDI

SEQ ID NO: 2591719 - protein, 17 aa, Entamoeba histolytica
RAEKLHHFFPIQKIWNE

SEQ ID NO: 2591720 - protein, 21 aa, Entamoeba histolytica
RAFCYKFGWYLAALQLFDTFI

SEQ ID NO: 2591721 - protein, 19 aa, Entamoeba histolytica
RAPCSFTKVLYCTIPSCSI

SEQ ID NO: 2591722 - protein, 19 aa, Entamoeba histolytica
RATGLLAYFVFFLLYFILY

SEQ ID NO: 2591723 - protein, 17 aa, Entamoeba histolytica
RCNLHLSSGPFIINSLS

SEQ ID NO: 2591724 - protein, 19 aa, Entamoeba histolytica
RCPKCGGLLKLDVVLFGEK

SEQ ID NO: 2591725 - protein, 21 aa, Entamoeba histolytica
RCPRCGGYVNPFCTFEEGGKK

SEQ ID NO: 2591726 - protein, 20 aa, Entamoeba histolytica
REGLKGIVIILNFTNPRLSD

SEQ ID NO: 2591727 - protein, 25 aa, Entamoeba histolytica
REGRFRFGGFWGKKWAKLTINKNES

SEQ ID NO: 2591728 - protein, 20 aa, Entamoeba histolytica
REIFQAIGIFIGFVICVSII

SEQ ID NO: 2591729 - protein, 17 aa, Entamoeba histolytica
REKARMEVMKEIKAKEA

SEQ ID NO: 2591730 - protein, 17 aa, Entamoeba histolytica
REMICSFILIFSFFCRC

SEQ ID NO: 2591731 - protein, 18 aa, Entamoeba histolytica
RFRIGNFHFFKTILSEEM

SEQ ID NO: 2591732 - protein, 24 aa, Entamoeba histolytica
RFSPTCWVKLPYKRSFYMTYSQKS

SEQ ID NO: 2591733 - protein, 22 aa, Entamoeba histolytica
RHAYRLLSVFLLKAVSIMNKQP

SEQ ID NO: 2591734 - protein, 17 aa, Entamoeba histolytica
RHHFVIIGITVFFLLII

SEQ ID NO: 2591735 - protein, 17 aa, Entamoeba histolytica
RHIPARFIVGIIVLVIV

SEQ ID NO: 2591736 - protein, 18 aa, Entamoeba histolytica
RIAMCFFVVAVALILIFP

SEQ ID NO: 2591737 - protein, 19 aa, Entamoeba histolytica
RIFGLRLTYVMTIICTSMF

SEQ ID NO: 2591738 - protein, 18 aa, Entamoeba histolytica
RIGLGITFYMLVWAISIF

SEQ ID NO: 2591739 - protein, 18 aa, Entamoeba histolytica
RIGMPIPFYVLKKNIAAY

SEQ ID NO: 2591740 - protein, 21 aa, Entamoeba histolytica
RIKALCGFSPFVISSYTQRGG

SEQ ID NO: 2591741 - protein, 21 aa, Entamoeba histolytica
RIKRSIVITGIFNLKTDRIEF

SEQ ID NO: 2591742 - protein, 18 aa, Entamoeba histolytica
RILKSGGMLGFFAMDNLN

SEQ ID NO: 2591743 - protein, 18 aa, Entamoeba histolytica
RIPFDWLEEKSMGLSDSI

SEQ ID NO: 2591744 - protein, 20 aa, Entamoeba histolytica
RIYNEYKVHLKGEGEVIEPL

SEQ ID NO: 2591745 - protein, 21 aa, Entamoeba histolytica
RKCWMCVFPGCTEPPKTRYNC

SEQ ID NO: 2591746 - protein, 18 aa, Entamoeba histolytica
RKEKEIYQMFGFSSLKKR

SEQ ID NO: 2591747 - protein, 23 aa, Entamoeba histolytica
RKKEPYQRIEFILTIGKSNEGTV

SEQ ID NO: 2591748 - protein, 24 aa, Entamoeba histolytica
RKSKRKSIRVIGNMALLCFDILLL

SEQ ID NO: 2591749 - protein, 23 aa, Entamoeba histolytica
RKWCCIGCGITIILAMAIHPTTV

SEQ ID NO: 2591750 - protein, 20 aa, Entamoeba histolytica
RKYRYCFEIKTAAASSTHID

SEQ ID NO: 2591751 - protein, 19 aa, Entamoeba histolytica
RLCFIISLIIVIGYIALII

SEQ ID NO: 2591752 - protein, 17 aa, Entamoeba histolytica
RLFLNWELRENKNIYYG

SEQ ID NO: 2591753 - protein, 20 aa, Entamoeba histolytica
RLGGCLGCNIGLFLFPILEI

SEQ ID NO: 2591754 - protein, 18 aa, Entamoeba histolytica
RLIKLFLSFFLINSTRFA

SEQ ID NO: 2591755 - protein, 20 aa, Entamoeba histolytica
RLKSFPLWFCKQWLRTDEKG

SEQ ID NO: 2591756 - protein, 17 aa, Entamoeba histolytica
RLMKIRLSPYIVITSIV

SEQ ID NO: 2591757 - protein, 17 aa, Entamoeba histolytica
RMIGIGLFTDVSTSQAM

SEQ ID NO: 2591758 - protein, 18 aa, Entamoeba histolytica
RNISYWGWLFTLKQPLFY

SEQ ID NO: 2591759 - protein, 22 aa, Entamoeba histolytica
RNLRAVFMLVFVVFFTLNIRSE

SEQ ID NO: 2591760 - protein, 19 aa, Entamoeba histolytica
RRCGSCLGLSGPSMKSYQC

SEQ ID NO: 2591761 - protein, 22 aa, Entamoeba histolytica
RRFSWSDGHSFNFSFFKKKKKC

SEQ ID NO: 2591762 - protein, 21 aa, Entamoeba histolytica
RRPEDSWGYFEMFVKSPETGE

SEQ ID NO: 2591763 - protein, 22 aa, Entamoeba histolytica
RRTLWYVWALWWFIYAVVCVAT

SEQ ID NO: 2591764 - protein, 25 aa, Entamoeba histolytica
RRVNGLKILICWSFLEVRICHILTN

SEQ ID NO: 2591765 - protein, 19 aa, Entamoeba histolytica
RRVRTCFVKIILQLSLPLT

SEQ ID NO: 2591766 - protein, 17 aa, Entamoeba histolytica
RSACSLLDYIKGIMRKP

SEQ ID NO: 2591767 - protein, 21 aa, Entamoeba histolytica
RSEIDWVILICRALMTVVVCI

SEQ ID NO: 2591768 - protein, 25 aa, Entamoeba histolytica
RSFFKRYYLLFLVSFYLLAFIIPNY

SEQ ID NO: 2591769 - protein, 17 aa, Entamoeba histolytica
RSSMVYQCCKLFVHLLE

SEQ ID NO: 2591770 - protein, 19 aa, Entamoeba histolytica
RTAISFSWLLQYAEQNGVS

SEQ ID NO: 2591771 - protein, 22 aa, Entamoeba histolytica
RTKGCSVVEKYGYIFVFVLFFI

SEQ ID NO: 2591772 - protein, 20 aa, Entamoeba histolytica
RTNKYLKSEIVSTLEDIKPP

SEQ ID NO: 2591773 - protein, 19 aa, Entamoeba histolytica
RTSTFYGYYMKYRLLCHNK

SEQ ID NO: 2591774 - protein, 18 aa, Entamoeba histolytica
RTTISLPFYFYSVRFLGK

SEQ ID NO: 2591775 - protein, 19 aa, Entamoeba histolytica
RTTLGFGYPTVIKMYELFS

SEQ ID NO: 2591776 - protein, 20 aa, Entamoeba histolytica
RVDRELQHGFVLFECTSELM

SEQ ID NO: 2591777 - protein, 21 aa, Entamoeba histolytica
RVRTSDLPQCFPLNKNIINKQ

SEQ ID NO: 2591778 - protein, 19 aa, Entamoeba histolytica
RYCFWKFHATFCIASLFML

SEQ ID NO: 2591779 - protein, 19 aa, Entamoeba histolytica
RYDYGLTWSDMLEKVPNSN

SEQ ID NO: 2591780 - protein, 19 aa, Entamoeba histolytica
RYFKVARDWFLFLMSHDAT

SEQ ID NO: 2591781 - protein, 20 aa, Entamoeba histolytica
RYLIRNCGDRELFIWYCETN

SEQ ID NO: 2591782 - protein, 23 aa, Entamoeba histolytica
SAAEEFMFRFSFFKPTKEVLSLA

SEQ ID NO: 2591783 - protein, 23 aa, Entamoeba histolytica
SAKFFSGDCSFGFEENDNDWIYY

SEQ ID NO: 2591784 - protein, 17 aa, Entamoeba histolytica
SALRLLVPSTWYSKDFI

SEQ ID NO: 2591785 - protein, 25 aa, Entamoeba histolytica
SALWCSLSFCYLCISKIVKSFDILE

SEQ ID NO: 2591786 - protein, 19 aa, Entamoeba histolytica
SAWVSGLLYFFGRIPQIIH

SEQ ID NO: 2591787 - protein, 17 aa, Entamoeba histolytica
SCFFYWIVVPLLFNEQG

SEQ ID NO: 2591788 - protein, 20 aa, Entamoeba histolytica
SCIIVSFFVILLFNIVFFVI

SEQ ID NO: 2591789 - protein, 17 aa, Entamoeba histolytica
SCLLGMIRLEGFNETTK

SEQ ID NO: 2591790 - protein, 17 aa, Entamoeba histolytica
SCVLYIFICLMFLISTV

SEQ ID NO: 2591791 - protein, 17 aa, Entamoeba histolytica
SCVRGVFRFSNENFYST

SEQ ID NO: 2591792 - protein, 18 aa, Entamoeba histolytica
SDIFLEFHSGSTMQFWLD

SEQ ID NO: 2591793 - protein, 24 aa, Entamoeba histolytica
SDIHRSWCAFRCTQLLTLLDQIVS

SEQ ID NO: 2591794 - protein, 23 aa, Entamoeba histolytica
SDLLKIRFCQDIARGMEYLHEND

SEQ ID NO: 2591795 - protein, 22 aa, Entamoeba histolytica
SDLLKVRFCQDIARGMEYLHQN

SEQ ID NO: 2591796 - protein, 17 aa, Entamoeba histolytica
SDLRLGMHYPLGSVVML

SEQ ID NO: 2591797 - protein, 17 aa, Entamoeba histolytica
SDLSIKVFYQWLTTSIY

SEQ ID NO: 2591798 - protein, 24 aa, Entamoeba histolytica
SDPLRFSFNYSFFETFRHNYNYNE

SEQ ID NO: 2591799 - protein, 19 aa, Entamoeba histolytica
SDPSIQCISRFCSSSLVFC

SEQ ID NO: 2591800 - protein, 17 aa, Entamoeba histolytica
SDPYFQWTVHVHNPKNF

SEQ ID NO: 2591801 - protein, 22 aa, Entamoeba histolytica
SEELCKSAPVIILWTTLFLVQI

SEQ ID NO: 2591802 - protein, 25 aa, Entamoeba histolytica
SEEWKKVVWRCGRWIDMDHPYKTMD

SEQ ID NO: 2591803 - protein, 18 aa, Entamoeba histolytica
SEFWIQIYYLIITFGVII

SEQ ID NO: 2591804 - protein, 19 aa, Entamoeba histolytica
SEIIPWWLLCCHDSVKEIS

SEQ ID NO: 2591805 - protein, 21 aa, Entamoeba histolytica
SEIKFGYNPWFCFFIPGLVVI

SEQ ID NO: 2591806 - protein, 17 aa, Entamoeba histolytica
SFIFKTWIFEVKWTFVL

SEQ ID NO: 2591807 - protein, 19 aa, Entamoeba histolytica
SFMVICFYVCLSFIIDRHI

SEQ ID NO: 2591808 - protein, 20 aa, Entamoeba histolytica
SFNCSKCPVGSASAVRNAAQ

SEQ ID NO: 2591809 - protein, 21 aa, Entamoeba histolytica
SFSACCFWLIIPILMRDIGAS

SEQ ID NO: 2591810 - protein, 23 aa, Entamoeba histolytica
SFVFSLGFWWRVAVITLINSFPF

SEQ ID NO: 2591811 - protein, 22 aa, Entamoeba histolytica
SFVKRMRWFPSFFFGYDQALMN

SEQ ID NO: 2591812 - protein, 19 aa, Entamoeba histolytica
SGCKSFLKEAGFETEDNVA

SEQ ID NO: 2591813 - protein, 20 aa, Entamoeba histolytica
SGCLQLRLTSLQIINTILAK

SEQ ID NO: 2591814 - protein, 19 aa, Entamoeba histolytica
SGLLTGKWKNLVISTFNDK

SEQ ID NO: 2591815 - protein, 18 aa, Entamoeba histolytica
SGSTFTHFCLVSDPHASS

SEQ ID NO: 2591816 - protein, 29 aa, Entamoeba histolytica
SHEMKKAMCWRKWKLWIIIGVIAAIIIIV

SEQ ID NO: 2591817 - protein, 23 aa, Entamoeba histolytica
SHHKRIIRELCRYVSPSLDNQKR

SEQ ID NO: 2591818 - protein, 24 aa, Entamoeba histolytica
SICSHCNKLLPACEMIQCALCGLP

SEQ ID NO: 2591819 - protein, 19 aa, Entamoeba histolytica
SIECLSCSNNLFLKDNKCQ

SEQ ID NO: 2591820 - protein, 19 aa, Entamoeba histolytica
SIKDICWIIMKIEKLAQLE

SEQ ID NO: 2591821 - protein, 17 aa, Entamoeba histolytica
SILTYNILQYLNVALNN

SEQ ID NO: 2591822 - protein, 20 aa, Entamoeba histolytica
SIPFRFIMEFTTPHISDNRK

SEQ ID NO: 2591823 - protein, 20 aa, Entamoeba histolytica
SIPRLSCLDNRCGNGIIDET

SEQ ID NO: 2591824 - protein, 19 aa, Entamoeba histolytica
SITSRIEGTFTFKKPVKLK

SEQ ID NO: 2591825 - protein, 20 aa, Entamoeba histolytica
SIVNSVMWGRCVFDNIRKFL

SEQ ID NO: 2591826 - protein, 17 aa, Entamoeba histolytica
SKFRVVVFTTLQGMFSV

SEQ ID NO: 2591827 - protein, 17 aa, Entamoeba histolytica
SKLGFGWLLKAAQQGNV

SEQ ID NO: 2591828 - protein, 19 aa, Entamoeba histolytica
SKMPKWSIYPLAFIPGVVL

SEQ ID NO: 2591829 - protein, 24 aa, Entamoeba histolytica
SKQHKRLFNLHNIHLKGETGVDEK

SEQ ID NO: 2591830 - protein, 17 aa, Entamoeba histolytica
SKRISFDSVKSCSLLKD

SEQ ID NO: 2591831 - protein, 23 aa, Entamoeba histolytica
SKRPSLFLVIFKLEWKMFLLCYI

SEQ ID NO: 2591832 - protein, 23 aa, Entamoeba histolytica
SKSDIKGHIAWRRSIGKNGKKVT

SEQ ID NO: 2591833 - protein, 17 aa, Entamoeba histolytica
SLFKLGRIPADSLFDSI

SEQ ID NO: 2591834 - protein, 18 aa, Entamoeba histolytica
SLICCLCCVLIIVIFLAI

SEQ ID NO: 2591835 - protein, 17 aa, Entamoeba histolytica
SLIEWAKELELIDEKEI

SEQ ID NO: 2591836 - protein, 21 aa, Entamoeba histolytica
SLKKRITSLIQWYPKEMQCVE

SEQ ID NO: 2591837 - protein, 17 aa, Entamoeba histolytica
SLKRLYCQREQLPHCLN

SEQ ID NO: 2591838 - protein, 20 aa, Entamoeba histolytica
SLLKMWLHFIHFCGNVANIT

SEQ ID NO: 2591839 - protein, 23 aa, Entamoeba histolytica
SLNHCFPCTSLANQLCQKDNGTS

SEQ ID NO: 2591840 - protein, 23 aa, Entamoeba histolytica
SLPKLPGMWVYCWTITIVMWTSC

SEQ ID NO: 2591841 - protein, 17 aa, Entamoeba histolytica
SLPRFWIVLLYIICVPL

SEQ ID NO: 2591842 - protein, 22 aa, Entamoeba histolytica
SLSENWIRFTVYTSIIIQILIS

SEQ ID NO: 2591843 - protein, 17 aa, Entamoeba histolytica
SMFNVLPAFSFSGEKVK

SEQ ID NO: 2591844 - protein, 17 aa, Entamoeba histolytica
SMICCFDALIKCNAEYF

SEQ ID NO: 2591845 - protein, 17 aa, Entamoeba histolytica
SMLRCFYTLYVNCDIGE

SEQ ID NO: 2591846 - protein, 19 aa, Entamoeba histolytica
SMMIVCMFVTVSLSKNRVY

SEQ ID NO: 2591847 - protein, 18 aa, Entamoeba histolytica
SMVFRFISALVCFFTDIF

SEQ ID NO: 2591848 - protein, 20 aa, Entamoeba histolytica
SNCFSCILAAVTINMIIRIS

SEQ ID NO: 2591849 - protein, 18 aa, Entamoeba histolytica
SNCKCEYGYSYDKEKNAC

SEQ ID NO: 2591850 - protein, 18 aa, Entamoeba histolytica
SNCQWIFVVVITLISIIL

SEQ ID NO: 2591851 - protein, 22 aa, Entamoeba histolytica
SNDWKQRLAFLTALNAAINSKK

SEQ ID NO: 2591852 - protein, 20 aa, Entamoeba histolytica
SNIFCGWSCTYERGIDNFYN

SEQ ID NO: 2591853 - protein, 24 aa, Entamoeba histolytica
SNLWRYWCPWLMWFVSPFFKIFWK

SEQ ID NO: 2591854 - protein, 17 aa, Entamoeba histolytica
SNNELYFYNSLKMKMSI

SEQ ID NO: 2591855 - protein, 19 aa, Entamoeba histolytica
SPCIISFIGYCITKESICL

SEQ ID NO: 2591856 - protein, 19 aa, Entamoeba histolytica
SPHGIKYIIEFFKSNIGHP

SEQ ID NO: 2591857 - protein, 23 aa, Entamoeba histolytica
SPIKAALCALAYYYMALSWGAYV

SEQ ID NO: 2591858 - protein, 23 aa, Entamoeba histolytica
SPTRLCYWLSTILRLYAMIHLAR

SEQ ID NO: 2591859 - protein, 17 aa, Entamoeba histolytica
SPVFPFPIINYILPPVV

SEQ ID NO: 2591860 - protein, 21 aa, Entamoeba histolytica
SPYGICWCSQMSMANNCIIGS

SEQ ID NO: 2591861 - protein, 19 aa, Entamoeba histolytica
SQLGGIFSFDAWRYYFNVN

SEQ ID NO: 2591862 - protein, 23 aa, Entamoeba histolytica
SQVEPRLAVAVVLLFLYLGIFAG

SEQ ID NO: 2591863 - protein, 18 aa, Entamoeba histolytica
SRASTLLTFDIFGPPIVV

SEQ ID NO: 2591864 - protein, 23 aa, Entamoeba histolytica
SRDLLKHKWFITNGIKIEESKKP

SEQ ID NO: 2591865 - protein, 24 aa, Entamoeba histolytica
SRFIWDIFCLFAILIHLSCMRSRG

SEQ ID NO: 2591866 - protein, 17 aa, Entamoeba histolytica
SRIPLIIRKVLYLIIGF

SEQ ID NO: 2591867 - protein, 17 aa, Entamoeba histolytica
SRTGLRFSSRGGDINGN

SEQ ID NO: 2591868 - protein, 20 aa, Entamoeba histolytica
SRVFCKYAFPDNLARVLSRI

SEQ ID NO: 2591869 - protein, 21 aa, Entamoeba histolytica
SSAICAISFLVTRVQKLFTRY

SEQ ID NO: 2591870 - protein, 22 aa, Entamoeba histolytica
SSCDRNGWKWGTWNELEPTYES

SEQ ID NO: 2591871 - protein, 22 aa, Entamoeba histolytica
SSCGEAPCLTRCVSHLIPRVNR

SEQ ID NO: 2591872 - protein, 26 aa, Entamoeba histolytica
SSCIVRFLFNIAFQFKKKFYVDYQLR

SEQ ID NO: 2591873 - protein, 19 aa, Entamoeba histolytica
SSECILCYNGYQLQNKKCV

SEQ ID NO: 2591874 - protein, 20 aa, Entamoeba histolytica
SSFYSLVSWCMGTTEHLDYF

SEQ ID NO: 2591875 - protein, 20 aa, Entamoeba histolytica
SSICALVYHLIRPYPTSFLG

SEQ ID NO: 2591876 - protein, 23 aa, Entamoeba histolytica
SSICLVCGNGMWSYISSSGCYSC

SEQ ID NO: 2591877 - protein, 24 aa, Entamoeba histolytica
SSKKLKIILLVSVIIVLALILIIG

SEQ ID NO: 2591878 - protein, 22 aa, Entamoeba histolytica
SSKMVKCWIEFIESKAMNISET

SEQ ID NO: 2591879 - protein, 21 aa, Entamoeba histolytica
SSLAFRFSILLSFLYFMIFSV

SEQ ID NO: 2591880 - protein, 18 aa, Entamoeba histolytica
SSLLCFISIFSLFMKYHF

SEQ ID NO: 2591881 - protein, 17 aa, Entamoeba histolytica
SSMKLFKLDGIELQEIE

SEQ ID NO: 2591882 - protein, 17 aa, Entamoeba histolytica
SSTKLSFLIPSFMRKRS

SEQ ID NO: 2591883 - protein, 23 aa, Entamoeba histolytica
SSTSCSFCSFIINGQIKYDFYYI

SEQ ID NO: 2591884 - protein, 19 aa, Entamoeba histolytica
STICFAFGFALYYDWKLAL

SEQ ID NO: 2591885 - protein, 17 aa, Entamoeba histolytica
STIEFKSSLTYIIVNSA

SEQ ID NO: 2591886 - protein, 17 aa, Entamoeba histolytica
STKECIICQPGFVLLNG

SEQ ID NO: 2591887 - protein, 21 aa, Entamoeba histolytica
SVFEMFWRMAFILFSSFCCML

SEQ ID NO: 2591888 - protein, 19 aa, Entamoeba histolytica
SVFNWFWNRQSYIPNEPYS

SEQ ID NO: 2591889 - protein, 21 aa, Entamoeba histolytica
SVHLKLRFCQDISRGMLYLHE

SEQ ID NO: 2591890 - protein, 19 aa, Entamoeba histolytica
SVKTWKKRWFVLKDNRLWY

SEQ ID NO: 2591891 - protein, 24 aa, Entamoeba histolytica
SVSIKELYRYAGFIDYILLIGGII

SEQ ID NO: 2591892 - protein, 17 aa, Entamoeba histolytica
SWHPLRFSYDLIGLTDQ

SEQ ID NO: 2591893 - protein, 21 aa, Entamoeba histolytica
SWLHCLWVIFIGCSGILVLSF

SEQ ID NO: 2591894 - protein, 18 aa, Entamoeba histolytica
SYCERIKLSPVFFNVSYP

SEQ ID NO: 2591895 - protein, 17 aa, Entamoeba histolytica
SYCTSCFYGFCSSCEDG

SEQ ID NO: 2591896 - protein, 20 aa, Entamoeba histolytica
SYGYCPSGWSYFNHKCYENE

SEQ ID NO: 2591897 - protein, 18 aa, Entamoeba histolytica
SYNIWLLICTAIFGALII

SEQ ID NO: 2591898 - protein, 20 aa, Entamoeba histolytica
SYSVCCLILLLIFKKKTRTN

SEQ ID NO: 2591899 - protein, 24 aa, Entamoeba histolytica
TASFIIKIIWFRGIVRESSGLLMK

SEQ ID NO: 2591900 - protein, 23 aa, Entamoeba histolytica
TATSCIFGFLALFYPFTWPGIFI

SEQ ID NO: 2591901 - protein, 21 aa, Entamoeba histolytica
TCCLCPLFAGLIATQTDDRKW

SEQ ID NO: 2591902 - protein, 17 aa, Entamoeba histolytica
TCFFKKPPRAIHCRICN

SEQ ID NO: 2591903 - protein, 21 aa, Entamoeba histolytica
TCNTCKDGSCLNCIKNEVNFK

SEQ ID NO: 2591904 - protein, 17 aa, Entamoeba histolytica
TCPLLKFIVVGGLGTII

SEQ ID NO: 2591905 - protein, 19 aa, Entamoeba histolytica
TCRLSIILLWSILFVLSLL

SEQ ID NO: 2591906 - protein, 23 aa, Entamoeba histolytica
TCSEGKVKYCCRCFDFSYHRNHV

SEQ ID NO: 2591907 - protein, 18 aa, Entamoeba histolytica
TCTACAYGSYSKGETSVC

SEQ ID NO: 2591908 - protein, 17 aa, Entamoeba histolytica
TDYPSVFSIPSFFNNKQ

SEQ ID NO: 2591909 - protein, 19 aa, Entamoeba histolytica
TEECILCLDIICKKKLGFN

SEQ ID NO: 2591910 - protein, 17 aa, Entamoeba histolytica
TEFVFPIAIFFTIISGI

SEQ ID NO: 2591911 - protein, 21 aa, Entamoeba histolytica
TEVIRFTTLIGIHYFTKKFDE

SEQ ID NO: 2591912 - protein, 17 aa, Entamoeba histolytica
TEYYDWFLINIILHPQN

SEQ ID NO: 2591913 - protein, 17 aa, Entamoeba histolytica
TFGFVSFLFVFNEKTHE

SEQ ID NO: 2591914 - protein, 23 aa, Entamoeba histolytica
TFIFCIICVFIFGICFSIYHYFK

SEQ ID NO: 2591915 - protein, 19 aa, Entamoeba histolytica
TGDGFFFQWVMSIGILIVG

SEQ ID NO: 2591916 - protein, 19 aa, Entamoeba histolytica
TGDGFFYQWVMAIGVLLAG

SEQ ID NO: 2591917 - protein, 17 aa, Entamoeba histolytica
TGLLKWVSLGVMIIGFI

SEQ ID NO: 2591918 - protein, 17 aa, Entamoeba histolytica
THPEILTTLALDFKIAR

SEQ ID NO: 2591919 - protein, 26 aa, Entamoeba histolytica
THTFFWICFFLMQFCTVVLVLNLLKK

SEQ ID NO: 2591920 - protein, 20 aa, Entamoeba histolytica
TIEGIPLFVEHSFRFFELSS

SEQ ID NO: 2591921 - protein, 21 aa, Entamoeba histolytica
TIICLVSFIFCIKIFNTPLTP

SEQ ID NO: 2591922 - protein, 17 aa, Entamoeba histolytica
TIILGLICFITITFFLL

SEQ ID NO: 2591923 - protein, 19 aa, Entamoeba histolytica
TILSWRGSILYFKSIVVPD

SEQ ID NO: 2591924 - protein, 22 aa, Entamoeba histolytica
TIQRVIPILLHFGSLFKENLLV

SEQ ID NO: 2591925 - protein, 21 aa, Entamoeba histolytica
TKFLWKFKWIILTVVILCCIV

SEQ ID NO: 2591926 - protein, 21 aa, Entamoeba histolytica
TKKEGCIICRSCEDSENDPLG

SEQ ID NO: 2591927 - protein, 24 aa, Entamoeba histolytica
TKQKDCIRKGFKPITYHIINTENC

SEQ ID NO: 2591928 - protein, 20 aa, Entamoeba histolytica
TLILIGLIMMWWSSDYDDES

SEQ ID NO: 2591929 - protein, 20 aa, Entamoeba histolytica
TLISCLVCGGILIGLSVMSY

SEQ ID NO: 2591930 - protein, 17 aa, Entamoeba histolytica
TLLRLLISMGYNIVLKK

SEQ ID NO: 2591931 - protein, 17 aa, Entamoeba histolytica
TLSCVPSYCDYGYKFDR

SEQ ID NO: 2591932 - protein, 20 aa, Entamoeba histolytica
TLTGLSYKAGQYFFDTILMN

SEQ ID NO: 2591933 - protein, 17 aa, Entamoeba histolytica
TMCEWCVYYDFNSCKSC

SEQ ID NO: 2591934 - protein, 19 aa, Entamoeba histolytica
TMICFFCFGLNFLIYYNAV

SEQ ID NO: 2591935 - protein, 19 aa, Entamoeba histolytica
TMYECFKWGNAFASNIKPW

SEQ ID NO: 2591936 - protein, 24 aa, Entamoeba histolytica
TNFLKLRFCQDIARGMLYLHENDI

SEQ ID NO: 2591937 - protein, 24 aa, Entamoeba histolytica
TNIVKECLKHLGMAPEIYRYFKVI

SEQ ID NO: 2591938 - protein, 32 aa, Entamoeba histolytica
TNNCLLRAFFYWSGCYFLRLNLMKKAEFMFRQ

SEQ ID NO: 2591939 - protein, 21 aa, Entamoeba histolytica
TPCYWRSVLGFGYILLNFTME

SEQ ID NO: 2591940 - protein, 19 aa, Entamoeba histolytica
TPCYWRSVVGFGFVFMNYV

SEQ ID NO: 2591941 - protein, 19 aa, Entamoeba histolytica
TPHRVSVFNWFWNRQSYIP

SEQ ID NO: 2591942 - protein, 22 aa, Entamoeba histolytica
TQLRWSEMTSILGLSKTVMDLI

SEQ ID NO: 2591943 - protein, 18 aa, Entamoeba histolytica
TRFSWNHIETVDSAFECI

SEQ ID NO: 2591944 - protein, 17 aa, Entamoeba histolytica
TRIVPLYLAVHIFAESP

SEQ ID NO: 2591945 - protein, 17 aa, Entamoeba histolytica
TRREIFQAIGIFIGFVI

SEQ ID NO: 2591946 - protein, 17 aa, Entamoeba histolytica
TRSLPLYLSIFIFGESS

SEQ ID NO: 2591947 - protein, 18 aa, Entamoeba histolytica
TSCYFYWIVVPLLFNEQG

SEQ ID NO: 2591948 - protein, 17 aa, Entamoeba histolytica
TSLPLIFFFTLVFLSFT

SEQ ID NO: 2591949 - protein, 19 aa, Entamoeba histolytica
TSRCPGCFITFSSYFIDPF

SEQ ID NO: 2591950 - protein, 24 aa, Entamoeba histolytica
TSWKDGKAFCALVHHFKPELINFE

SEQ ID NO: 2591951 - protein, 17 aa, Entamoeba histolytica
TSWTHKFIRKWSNATTH

SEQ ID NO: 2591952 - protein, 23 aa, Entamoeba histolytica
TTHLKRLFLLWGFSLSILLMIYG

SEQ ID NO: 2591953 - protein, 17 aa, Entamoeba histolytica
TTIKMACFLFCFCFYSL

SEQ ID NO: 2591954 - protein, 19 aa, Entamoeba histolytica
TVCCFLLFFIIIAIIGVLL

SEQ ID NO: 2591955 - protein, 25 aa, Entamoeba histolytica
TVFEIYWRICLAFGNCVLLCLFFWF

SEQ ID NO: 2591956 - protein, 19 aa, Entamoeba histolytica
TVIGWKLCLPPLLSYFQIC

SEQ ID NO: 2591957 - protein, 23 aa, Entamoeba histolytica
TVPMCLYDFLIVHIFPLITPLIS

SEQ ID NO: 2591958 - protein, 21 aa, Entamoeba histolytica
TVVKRKKFEFILSKPKVQEMK

SEQ ID NO: 2591959 - protein, 21 aa, Entamoeba histolytica
TYCLLHFFLYIGMMFCNYNYF

SEQ ID NO: 2591960 - protein, 18 aa, Entamoeba histolytica
VACGQTPPFSAMMILWAN

SEQ ID NO: 2591961 - protein, 18 aa, Entamoeba histolytica
VAIPDILVYLGVTRETLS

SEQ ID NO: 2591962 - protein, 18 aa, Entamoeba histolytica
VARDWFLFLMSHDATLFI

SEQ ID NO: 2591963 - protein, 20 aa, Entamoeba histolytica
VCDITEPFVPLAPKNFFKPI

SEQ ID NO: 2591964 - protein, 18 aa, Entamoeba histolytica
VCIWPFCTGFFWPVTTGT

SEQ ID NO: 2591965 - protein, 20 aa, Entamoeba histolytica
VCLFCREFHFHLTLALWDNF

SEQ ID NO: 2591966 - protein, 20 aa, Entamoeba histolytica
VCLNFPFIIPKSVKFLNRIS

SEQ ID NO: 2591967 - protein, 23 aa, Entamoeba histolytica
VCPCQSLTGYECELEFTGSTNPI

SEQ ID NO: 2591968 - protein, 18 aa, Entamoeba histolytica
VCQMLNWTSFSFDEYMEG

SEQ ID NO: 2591969 - protein, 17 aa, Entamoeba histolytica
VCRVVLLLLSYVIKEEY

SEQ ID NO: 2591970 - protein, 21 aa, Entamoeba histolytica
VCYFPRLLMTVPYFIIMIGTE

SEQ ID NO: 2591971 - protein, 22 aa, Entamoeba histolytica
VDALKLKGYRIIENSNIIAQYL

SEQ ID NO: 2591972 - protein, 23 aa, Entamoeba histolytica
VEELKIHIGFRFKFLRNKDTLNI

SEQ ID NO: 2591973 - protein, 19 aa, Entamoeba histolytica
VELKLRFCHDIASGMDYLH

SEQ ID NO: 2591974 - protein, 22 aa, Entamoeba histolytica
VELRLLKIVLNWLIPEVFNECL

SEQ ID NO: 2591975 - protein, 17 aa, Entamoeba histolytica
VEPCKKSNCSISLDVEE

SEQ ID NO: 2591976 - protein, 18 aa, Entamoeba histolytica
VFCGYRLSEVITCPPDVL

SEQ ID NO: 2591977 - protein, 17 aa, Entamoeba histolytica
VFFKIGFLIVFFITFYY

SEQ ID NO: 2591978 - protein, 23 aa, Entamoeba histolytica
VFGFRGSYEFSDWVYDFKLFTES

SEQ ID NO: 2591979 - protein, 19 aa, Entamoeba histolytica
VFLPCVWAFVVGLTRFYDH

SEQ ID NO: 2591980 - protein, 18 aa, Entamoeba histolytica
VFLQLKLLWPSFNIINTT

SEQ ID NO: 2591981 - protein, 18 aa, Entamoeba histolytica
VFPFCYFIYYLFSITNDA

SEQ ID NO: 2591982 - protein, 24 aa, Entamoeba histolytica
VFSFAICMLEIWLGKEPYDPMKFP

SEQ ID NO: 2591983 - protein, 24 aa, Entamoeba histolytica
VFSFAICMLEIWLTHDPYPIIEFH

SEQ ID NO: 2591984 - protein, 17 aa, Entamoeba histolytica
VFVSVCFLYILQNVVEL

SEQ ID NO: 2591985 - protein, 17 aa, Entamoeba histolytica
VFYKFGTKFVMKRLFLN

SEQ ID NO: 2591986 - protein, 17 aa, Entamoeba histolytica
VGCCLPLLFGCIVAISR

SEQ ID NO: 2591987 - protein, 22 aa, Entamoeba histolytica
VGELTCCLCPLFAGLIATQTDD

SEQ ID NO: 2591988 - protein, 25 aa, Entamoeba histolytica
VGELTCCLCPLFAGLIATQTDDRKW

SEQ ID NO: 2591989 - protein, 18 aa, Entamoeba histolytica
VGGVKIFFDKYLTSTGSG

SEQ ID NO: 2591990 - protein, 17 aa, Entamoeba histolytica
VGSLKYWIESCLFDNKF

SEQ ID NO: 2591991 - protein, 25 aa, Entamoeba histolytica
VHCKWCNNKMCFVCADDYLLSTDGI

SEQ ID NO: 2591992 - protein, 19 aa, Entamoeba histolytica
VICTCSYYLIIVVVLVLIA

SEQ ID NO: 2591993 - protein, 18 aa, Entamoeba histolytica
VIFKLEWKMFLLCYITMV

SEQ ID NO: 2591994 - protein, 21 aa, Entamoeba histolytica
VILWKALCIFFFTEAPIVVIL

SEQ ID NO: 2591995 - protein, 18 aa, Entamoeba histolytica
VIQRKCRLWNGNIIEYLP

SEQ ID NO: 2591996 - protein, 21 aa, Entamoeba histolytica
VIRGDVFFQFGFEEFNKTLAF

SEQ ID NO: 2591997 - protein, 17 aa, Entamoeba histolytica
VITQCWDHIPSKRPAFK

SEQ ID NO: 2591998 - protein, 21 aa, Entamoeba histolytica
VKGWLKPSCSVTIWTINVDLQ

SEQ ID NO: 2591999 - protein, 23 aa, Entamoeba histolytica
VKKNKCWKCSFWYGTNEEGNECN

SEQ ID NO: 2592000 - protein, 22 aa, Entamoeba histolytica
VKNNKCWKCSFWYGTNEEGNEC

SEQ ID NO: 2592001 - protein, 18 aa, Entamoeba histolytica
VKVWRYIRETNKVVVQYI

SEQ ID NO: 2592002 - protein, 19 aa, Entamoeba histolytica
VLAKICLGETFSIFETFIN

SEQ ID NO: 2592003 - protein, 24 aa, Entamoeba histolytica
VLKPHRRLAIALAIEYLKKMNCCI

SEQ ID NO: 2592004 - protein, 23 aa, Entamoeba histolytica
VLLCLFFWFLRLYSVFNWALEQH

SEQ ID NO: 2592005 - protein, 17 aa, Entamoeba histolytica
VLLCLFISFLIMKFTKM

SEQ ID NO: 2592006 - protein, 19 aa, Entamoeba histolytica
VLLLLSISCSIGYTCLDVM

SEQ ID NO: 2592007 - protein, 17 aa, Entamoeba histolytica
VLPAFSFSGEKVKVVMT

SEQ ID NO: 2592008 - protein, 18 aa, Entamoeba histolytica
VLPMFRWRMYYIDDKNTA

SEQ ID NO: 2592009 - protein, 24 aa, Entamoeba histolytica
VLREENRWFIPIAIVGVILIVSIV

SEQ ID NO: 2592010 - protein, 24 aa, Entamoeba histolytica
VLSRICFLCGLFGGIKSNQLDNIK

SEQ ID NO: 2592011 - protein, 18 aa, Entamoeba histolytica
VLYEIWKWDKAYPVEEFK

SEQ ID NO: 2592012 - protein, 18 aa, Entamoeba histolytica
VMVAIGLLFHLHFLSLQR

SEQ ID NO: 2592013 - protein, 26 aa, Entamoeba histolytica
VMWYDCYYCFSKYRFIWDSISLKNLF

SEQ ID NO: 2592014 - protein, 23 aa, Entamoeba histolytica
VNNCSILLLKVCKLLDSSINPTI

SEQ ID NO: 2592015 - protein, 17 aa, Entamoeba histolytica
VPLESGVTFLANVSNCY

SEQ ID NO: 2592016 - protein, 23 aa, Entamoeba histolytica
VPLYRPLTVILFFLITGIIFIPI

SEQ ID NO: 2592017 - protein, 19 aa, Entamoeba histolytica
VPSYCDYGYKFDRTSQTCI

SEQ ID NO: 2592018 - protein, 22 aa, Entamoeba histolytica
VPYPLLWCRYSFFIVLYPMGVS

SEQ ID NO: 2592019 - protein, 24 aa, Entamoeba histolytica
VQIRFRYAYELEYWDKLLDELCEL

SEQ ID NO: 2592020 - protein, 22 aa, Entamoeba histolytica
VRLSKCPFCLIMGLFLFVSLEE

SEQ ID NO: 2592021 - protein, 19 aa, Entamoeba histolytica
VRSCWKLNVFEGYEGIVSL

SEQ ID NO: 2592022 - protein, 19 aa, Entamoeba histolytica
VRYLLKRAFEINSNETNKI

SEQ ID NO: 2592023 - protein, 23 aa, Entamoeba histolytica
VSFALSCIACWIVFIFQPTFKPT

SEQ ID NO: 2592024 - protein, 20 aa, Entamoeba histolytica
VSIRQPIEWEIEKSDSRWKV

SEQ ID NO: 2592025 - protein, 17 aa, Entamoeba histolytica
VSLKELWVSSKVEKILL

SEQ ID NO: 2592026 - protein, 18 aa, Entamoeba histolytica
VTIDYFWTFCVFAGIFLG

SEQ ID NO: 2592027 - protein, 17 aa, Entamoeba histolytica
VTLKIKQIRAFKKHIRK

SEQ ID NO: 2592028 - protein, 18 aa, Entamoeba histolytica
VVASLILSFSMLFKQDNR

SEQ ID NO: 2592029 - protein, 25 aa, Entamoeba histolytica
VVCCIIAGLLFRFKPLIYLTRFVPF

SEQ ID NO: 2592030 - protein, 18 aa, Entamoeba histolytica
VVCCSIILCLKKVLINKD

SEQ ID NO: 2592031 - protein, 17 aa, Entamoeba histolytica
VVKRIALISEEWNSENG

SEQ ID NO: 2592032 - protein, 17 aa, Entamoeba histolytica
VVLARFIVRQMRKLMII

SEQ ID NO: 2592033 - protein, 18 aa, Entamoeba histolytica
VVMVFRFFLCKGRLIVLR

SEQ ID NO: 2592034 - protein, 24 aa, Entamoeba histolytica
VVSLPEIVRYLGLNMEDILPDLIG

SEQ ID NO: 2592035 - protein, 18 aa, Entamoeba histolytica
VYCPFKYITTHEMKDDSF

SEQ ID NO: 2592036 - protein, 18 aa, Entamoeba histolytica
VYEIRTILDWTFAKTSMF

SEQ ID NO: 2592037 - protein, 18 aa, Entamoeba histolytica
VYMLFNWLWLLGTLIYLN

SEQ ID NO: 2592038 - protein, 24 aa, Entamoeba histolytica
VYSFAICMLEIWLGQDPYDSTEFP

SEQ ID NO: 2592039 - protein, 25 aa, Entamoeba histolytica
VYSFAICMLEIWLGRDPYDPAKFPD

SEQ ID NO: 2592040 - protein, 25 aa, Entamoeba histolytica
VYSFAICMLEIWLGRDPYNPMKFPD

SEQ ID NO: 2592041 - protein, 17 aa, Entamoeba histolytica
VYSFAICMLEIWNNGSL

SEQ ID NO: 2592042 - protein, 20 aa, Entamoeba histolytica
VYYCFWRYFRFEIVRIINFY

SEQ ID NO: 2592043 - protein, 19 aa, Entamoeba histolytica
WAKECYHISFGMVMGMSTR

SEQ ID NO: 2592044 - protein, 21 aa, Entamoeba histolytica
WECDKCSVGFMYQCGAVSTFI

SEQ ID NO: 2592045 - protein, 20 aa, Entamoeba histolytica
WFFKSVICRFKLYPWYLKPK

SEQ ID NO: 2592046 - protein, 22 aa, Entamoeba histolytica
WFYPCGKFGILLGIFLPTLILA

SEQ ID NO: 2592047 - protein, 17 aa, Entamoeba histolytica
WGPTLAFVSAANTFVTS

SEQ ID NO: 2592048 - protein, 18 aa, Entamoeba histolytica
WGVVKVLGFISLGVGVGV

SEQ ID NO: 2592049 - protein, 17 aa, Entamoeba histolytica
WIFEVKWTFVLLIILVI

SEQ ID NO: 2592050 - protein, 17 aa, Entamoeba histolytica
WILRATGLLAYFVFFLL

SEQ ID NO: 2592051 - protein, 19 aa, Entamoeba histolytica
WKLNVFEGYEGIVSLQVLK

SEQ ID NO: 2592052 - protein, 17 aa, Entamoeba histolytica
WKYLCPFVSFSMKQKNI

SEQ ID NO: 2592053 - protein, 19 aa, Entamoeba histolytica
WLEILPFQFCVFIFTLGDY

SEQ ID NO: 2592054 - protein, 20 aa, Entamoeba histolytica
WLRIIEEIWLILVGFVRSSF

SEQ ID NO: 2592055 - protein, 24 aa, Entamoeba histolytica
WMIRPYSKYVICWFGLDTLQLLNF

SEQ ID NO: 2592056 - protein, 17 aa, Entamoeba histolytica
WNKYCGKLDTKFESDGD

SEQ ID NO: 2592057 - protein, 19 aa, Entamoeba histolytica
WNLFKCSFILLKFSLFAIP

SEQ ID NO: 2592058 - protein, 23 aa, Entamoeba histolytica
WPSCSNPFLYCCAANVSSDNAVH

SEQ ID NO: 2592059 - protein, 24 aa, Entamoeba histolytica
WPTAIRFVPLFACASVFLNNTPIV

SEQ ID NO: 2592060 - protein, 19 aa, Entamoeba histolytica
WQFWWKLVVIILLTSIPFI

SEQ ID NO: 2592061 - protein, 19 aa, Entamoeba histolytica
WQYACCLTIVFAGRYIPFL

SEQ ID NO: 2592062 - protein, 17 aa, Entamoeba histolytica
WRGSILYFKSIVVPDSF

SEQ ID NO: 2592063 - protein, 17 aa, Entamoeba histolytica
WRIDLTLKLLSVISLDR

SEQ ID NO: 2592064 - protein, 18 aa, Entamoeba histolytica
WRLQIMLWYAGLRGAIAV

SEQ ID NO: 2592065 - protein, 20 aa, Entamoeba histolytica
WRLVLLFPLALLFGFSRSFY

SEQ ID NO: 2592066 - protein, 17 aa, Entamoeba histolytica
WRMIPVIIPMFLAGIIV

SEQ ID NO: 2592067 - protein, 17 aa, Entamoeba histolytica
WRSSMIIGTIFKQGNTY

SEQ ID NO: 2592068 - protein, 17 aa, Entamoeba histolytica
WRYPRIEMFFKFLCCTE
